United States Patent 7,901,882 (ANALYSIS OF METHYLATION USING NUCLEIC ACID ARRAYS) - sequence listing, part 8

SEQ ID NO: 275933 - DNA, 25 bp, Mus musculus
tgcgaccagaggagcgaagcagagc

SEQ ID NO: 275934 - DNA, 25 bp, Mus musculus
gccgccaccaatcgcgctctggctc

SEQ ID NO: 275935 - DNA, 25 bp, Mus musculus
ggtccggacacagctgagtctcccg

SEQ ID NO: 275936 - DNA, 25 bp, Mus musculus
gccggcagattccacctctagagta

SEQ ID NO: 275937 - DNA, 25 bp, Mus musculus
agattccacctctagagtaattccc

SEQ ID NO: 275938 - DNA, 25 bp, Mus musculus
ccgagcttttccctaggcggtcacg

SEQ ID NO: 275939 - DNA, 25 bp, Mus musculus
tggcagcaggctccggtccggacac

SEQ ID NO: 275940 - DNA, 25 bp, Mus musculus
tttgacagcgtatagcttacggggc

SEQ ID NO: 275941 - DNA, 25 bp, Mus musculus
cccactgcgttgaattctcgcgaga

SEQ ID NO: 275942 - DNA, 25 bp, Mus musculus
gctgagcaagaggtgagaagatccc

SEQ ID NO: 275943 - DNA, 25 bp, Mus musculus
ggctgcgaggggctaacgcatcaaa

SEQ ID NO: 275944 - DNA, 25 bp, Mus musculus
ctctcaaccagcgtagcgcggcgta

SEQ ID NO: 275945 - DNA, 25 bp, Mus musculus
gtgaaaagcgcctacaccggctctc

SEQ ID NO: 275946 - DNA, 25 bp, Mus musculus
gtcgctgccgttctctcctgagaca

SEQ ID NO: 275947 - DNA, 25 bp, Mus musculus
cagactaggcccgaagcctgcggtc

SEQ ID NO: 275948 - DNA, 25 bp, Mus musculus
acgcatcaaagactggacccgagga

SEQ ID NO: 275949 - DNA, 25 bp, Mus musculus
gacccgaggagttgggttctgctcc

SEQ ID NO: 275950 - DNA, 25 bp, Mus musculus
tattgcggagagaaagtggcctttg

SEQ ID NO: 275951 - DNA, 25 bp, Mus musculus
cacacacgtcgagccgagagagtta

SEQ ID NO: 275952 - DNA, 25 bp, Mus musculus
tttttccattgattgccgcgggccg

SEQ ID NO: 275953 - DNA, 25 bp, Mus musculus
attctggaacagttgcccgtgggca

SEQ ID NO: 275954 - DNA, 25 bp, Mus musculus
acggttcctgcagtggtacttctca

SEQ ID NO: 275955 - DNA, 25 bp, Mus musculus
tggttgaagaactcgcccacgaacg

SEQ ID NO: 275956 - DNA, 25 bp, Mus musculus
ctgcttgaggacatcacggtagacc

SEQ ID NO: 275957 - DNA, 25 bp, Mus musculus
ggctccagcacatacaggtcgcata

SEQ ID NO: 275958 - DNA, 25 bp, Mus musculus
cccggcggaacaggaactgagtcaa

SEQ ID NO: 275959 - DNA, 25 bp, Mus musculus
cttcttgacgaagggtgtgcacacc

SEQ ID NO: 275960 - DNA, 25 bp, Mus musculus
gaactccagctgacggatgcgcaca

SEQ ID NO: 275961 - DNA, 25 bp, Mus musculus
tcaactagcggctgcaggaactcca

SEQ ID NO: 275962 - DNA, 25 bp, Mus musculus
tcgcgcaccagctgaatgactcgta

SEQ ID NO: 275963 - DNA, 25 bp, Mus musculus
tacttgcccgcaaaggccactatgc

SEQ ID NO: 275964 - DNA, 25 bp, Mus musculus
atagcgcaccagcatgtaacgaccg

SEQ ID NO: 275965 - DNA, 25 bp, Mus musculus
agctgtacatctctcgggccttctg

SEQ ID NO: 275966 - DNA, 25 bp, Mus musculus
cgcctgcgtgttcttctggatccag

SEQ ID NO: 275967 - DNA, 25 bp, Mus musculus
tcctcgcagagtgaacggctggatc

SEQ ID NO: 275968 - DNA, 25 bp, Mus musculus
catttccgggaagctgtagtatctc

SEQ ID NO: 275969 - DNA, 25 bp, Mus musculus
tgctgcggctgctgaattgtccctt

SEQ ID NO: 275970 - DNA, 25 bp, Mus musculus
ttcggatgccgctgtctctttgccc

SEQ ID NO: 275971 - DNA, 25 bp, Mus musculus
tgtgacatctccaccttgcggagcc

SEQ ID NO: 275972 - DNA, 25 bp, Mus musculus
aagctgtagtatctcggcccagggt

SEQ ID NO: 275973 - DNA, 25 bp, Mus musculus
gtaagtcccggtccgatcctgacca

SEQ ID NO: 275974 - DNA, 25 bp, Mus musculus
ctctggctgtttgccggtaagtccc

SEQ ID NO: 275975 - DNA, 25 bp, Mus musculus
ggttctctctggctgtttgccggta

SEQ ID NO: 275976 - DNA, 25 bp, Mus musculus
gctgaccttcttcttggtgtcgggg

SEQ ID NO: 275977 - DNA, 25 bp, Mus musculus
accgacatgctgaccttcttcttgg

SEQ ID NO: 275978 - DNA, 25 bp, Mus musculus
tgggccggctcaccgacatgctgac

SEQ ID NO: 275979 - DNA, 25 bp, Mus musculus
tctctttgcccaggagtcccggcgc

SEQ ID NO: 275980 - DNA, 25 bp, Mus musculus
tcggcagttcggatgccgctgtctc

SEQ ID NO: 275981 - DNA, 25 bp, Mus musculus
gtgcgggtgtgacatctccaccttg

SEQ ID NO: 275982 - DNA, 25 bp, Mus musculus
gtgtgtcccggaaagctatcaaaga

SEQ ID NO: 275983 - DNA, 25 bp, Mus musculus
gctccgccggagtccaagtgaccgt

SEQ ID NO: 275984 - DNA, 25 bp, Mus musculus
aaagactgcaggaccacccctcttg

SEQ ID NO: 275985 - DNA, 25 bp, Mus musculus
ccgccggagtccaagtgaccgtcgg

SEQ ID NO: 275986 - DNA, 25 bp, Mus musculus
ccaagtgaccgtcggggaaggagca

SEQ ID NO: 275987 - DNA, 25 bp, Mus musculus
cgccgccagcagtgtacacagcaaa

SEQ ID NO: 275988 - DNA, 25 bp, Mus musculus
gtgtacacagcaaaatacccccgag

SEQ ID NO: 275989 - DNA, 25 bp, Mus musculus
cccgagccgctgcatgtttgttccg

SEQ ID NO: 275990 - DNA, 25 bp, Mus musculus
gagccgctgcatgtttgttccgcgc

SEQ ID NO: 275991 - DNA, 25 bp, Mus musculus
ccgcctgtgtgtcccggaaagctat

SEQ ID NO: 275992 - DNA, 25 bp, Mus musculus
gctatcaaagactgcaggaccaccc

SEQ ID NO: 275993 - DNA, 25 bp, Mus musculus
tgtcccggaaagctatcaaagactg

SEQ ID NO: 275994 - DNA, 25 bp, Mus musculus
cggaaagctatcaaagactgcagga

SEQ ID NO: 275995 - DNA, 25 bp, Mus musculus
ccgctgcatgtttgttccgcgctgg

SEQ ID NO: 275996 - DNA, 25 bp, Mus musculus
cgccgtgggctcttcaccaatcaaa

SEQ ID NO: 275997 - DNA, 25 bp, Mus musculus
ggttccgcgctgcatgaccattggt

SEQ ID NO: 275998 - DNA, 25 bp, Mus musculus
atagtaggcgcccttcagcagcagg

SEQ ID NO: 275999 - DNA, 25 bp, Mus musculus
aaacccaacacacgcgcatagtagg

SEQ ID NO: 276000 - DNA, 25 bp, Mus musculus
ctgtcatcgttcaggggaacgtccc

SEQ ID NO: 276001 - DNA, 25 bp, Mus musculus
cagcagggtcgcctgtcatcgttca

SEQ ID NO: 276002 - DNA, 25 bp, Mus musculus
atgaccattggtcgcgcgtctcaag

SEQ ID NO: 276003 - DNA, 25 bp, Mus musculus
cttcggaggccctgtcattggccga

SEQ ID NO: 276004 - DNA, 25 bp, Mus musculus
tcattggccgaacctcgatggaggc

SEQ ID NO: 276005 - DNA, 25 bp, Mus musculus
tttctgcgccctcagacagaggaca

SEQ ID NO: 276006 - DNA, 25 bp, Mus musculus
gactgtgccagtcccggctggactc

SEQ ID NO: 276007 - DNA, 25 bp, Mus musculus
agttccgtccgggatctcagaccca

SEQ ID NO: 276008 - DNA, 25 bp, Mus musculus
atctcagacccacctgcggggtgcg

SEQ ID NO: 276009 - DNA, 25 bp, Mus musculus
tttgctctgtgcgatctaggctccc

SEQ ID NO: 276010 - DNA, 25 bp, Mus musculus
gcgcccgaggactggcatttgccaa

SEQ ID NO: 276011 - DNA, 25 bp, Mus musculus
cctggaataattccgcttccgtttg

SEQ ID NO: 276012 - DNA, 25 bp, Mus musculus
tcagccttcattggtctgttgcgcc

SEQ ID NO: 276013 - DNA, 25 bp, Mus musculus
cgagctgcctcaaatgcctggaata

SEQ ID NO: 276014 - DNA, 25 bp, Mus musculus
ggcatttgccaagtttctgctggaa

SEQ ID NO: 276015 - DNA, 25 bp, Mus musculus
caggctttgggtggctgttgtccca

SEQ ID NO: 276016 - DNA, 25 bp, Mus musculus
gtgtcatctctggtccacaggcgga

SEQ ID NO: 276017 - DNA, 25 bp, Mus musculus
gccctaaccgggtcggtgtcatctc

SEQ ID NO: 276018 - DNA, 25 bp, Mus musculus
caaagaaggtaggaacagccgaggc

SEQ ID NO: 276019 - DNA, 25 bp, Mus musculus
tgactcgttcttggggaaactcgga

SEQ ID NO: 276020 - DNA, 25 bp, Mus musculus
gtcccgcaagaaggatgactcgttc

SEQ ID NO: 276021 - DNA, 25 bp, Mus musculus
aagtcgcctccgtcccgcaagaagg

SEQ ID NO: 276022 - DNA, 25 bp, Mus musculus
tccgtttggaaagccgcagcctcag

SEQ ID NO: 276023 - DNA, 25 bp, Mus musculus
tggaaagttttctcgggcgccgtca

SEQ ID NO: 276024 - DNA, 25 bp, Mus musculus
gagcgtcgttgcctgtgcaaaccag

SEQ ID NO: 276025 - DNA, 25 bp, Mus musculus
ctccttgcctgggaagcgccgagtt

SEQ ID NO: 276026 - DNA, 25 bp, Mus musculus
gttgggccgcaaccctgcgcggcaa

SEQ ID NO: 276027 - DNA, 25 bp, Mus musculus
atcggcgctttgtgtgcggctccaa

SEQ ID NO: 276028 - DNA, 25 bp, Mus musculus
ctgtctaggcgtcaccgcgatcggc

SEQ ID NO: 276029 - DNA, 25 bp, Mus musculus
ctggcgttcatttcattcctgtcct

SEQ ID NO: 276030 - DNA, 25 bp, Mus musculus
ttcggtcctggcgttcatttcattc

SEQ ID NO: 276031 - DNA, 25 bp, Mus musculus
ccctccggagcgagttcggtcctgg

SEQ ID NO: 276032 - DNA, 25 bp, Mus musculus
gacccggcggcatgacgtcaccgag

SEQ ID NO: 276033 - DNA, 25 bp, Mus musculus
tcgttgcctgtgcaaaccaggaggg

SEQ ID NO: 276034 - DNA, 25 bp, Mus musculus
tcccttccagcctgggagcgtcgtt

SEQ ID NO: 276035 - DNA, 25 bp, Mus musculus
gtttcctgaagagcaacctcccttc

SEQ ID NO: 276036 - DNA, 25 bp, Mus musculus
cctcagtttcctgaagagcaacctc

SEQ ID NO: 276037 - DNA, 25 bp, Mus musculus
ggagggcgcacacccggcattccta

SEQ ID NO: 276038 - DNA, 25 bp, Mus musculus
cgcaaactggccaagctcaaccgga

SEQ ID NO: 276039 - DNA, 25 bp, Mus musculus
ccgctacgaagccaaggtgcaccta

SEQ ID NO: 276040 - DNA, 25 bp, Mus musculus
gctgccctaattgcacctagccgga

SEQ ID NO: 276041 - DNA, 25 bp, Mus musculus
tgcgccatggatccttcggagaaga

SEQ ID NO: 276042 - DNA, 25 bp, Mus musculus
tgagcgcatcctgcccaacaagacg

SEQ ID NO: 276043 - DNA, 25 bp, Mus musculus
agacgcggatcttgcgcctctggac

SEQ ID NO: 276044 - DNA, 25 bp, Mus musculus
aatgtacgcttcgtgctggtgcgca

SEQ ID NO: 276045 - DNA, 25 bp, Mus musculus
ggtacgcaaggccttccgcaaactg

SEQ ID NO: 276046 - DNA, 25 bp, Mus musculus
cagcagccgtcgtcaccttgttcgt

SEQ ID NO: 276047 - DNA, 25 bp, Mus musculus
tgctgtcgcaggaccacacgattcg

SEQ ID NO: 276048 - DNA, 25 bp, Mus musculus
agctggaccgcgagatagaccgcta

SEQ ID NO: 276049 - DNA, 25 bp, Mus musculus
gtcaactacgtgcaggatacctatc

SEQ ID NO: 276050 - DNA, 25 bp, Mus musculus
ggcatcgacctggacggacaaactc

SEQ ID NO: 276051 - DNA, 25 bp, Mus musculus
cacacgattcgccagcaggtgcagc

SEQ ID NO: 276052 - DNA, 25 bp, Mus musculus
tccctagtgccacaaaatgactgga

SEQ ID NO: 276053 - DNA, 25 bp, Mus musculus
cagaacgatgctatgcggcgcttgc

SEQ ID NO: 276054 - DNA, 25 bp, Mus musculus
tggcagcaatgacccgaacctggga

SEQ ID NO: 276055 - DNA, 25 bp, Mus musculus
ctcgccggcctgtaaagggcccgtg

SEQ ID NO: 276056 - DNA, 25 bp, Mus musculus
aagtaggttagtggtgcgacattta

SEQ ID NO: 276057 - DNA, 25 bp, Mus musculus
ttgtccgccaagacaactccgttcg

SEQ ID NO: 276058 - DNA, 25 bp, Mus musculus
gtgacctttggttcaatccctagtg

SEQ ID NO: 276059 - DNA, 25 bp, Mus musculus
actccgttcgctctctctgattggc

SEQ ID NO: 276060 - DNA, 25 bp, Mus musculus
cctgcctagtatgggtgtgaccttt

SEQ ID NO: 276061 - DNA, 25 bp, Mus musculus
agctccctggtagatcacctgccta

SEQ ID NO: 276062 - DNA, 25 bp, Mus musculus
gaggtgcctgtttacccgcgccgga

SEQ ID NO: 276063 - DNA, 25 bp, Mus musculus
cgacatttagggaaggcagaaagta

SEQ ID NO: 276064 - DNA, 25 bp, Mus musculus
tctgattggctaacgggaagaggca

SEQ ID NO: 276065 - DNA, 25 bp, Mus musculus
cttaaagagacagcagtaccgggtg

SEQ ID NO: 276066 - DNA, 25 bp, Mus musculus
cgcttcctgtcaccgttaggcaaaa

SEQ ID NO: 276067 - DNA, 25 bp, Mus musculus
ctcgccaaagtagcactccggtgtc

SEQ ID NO: 276068 - DNA, 25 bp, Mus musculus
ccacctctgggacgcggagaatcag

SEQ ID NO: 276069 - DNA, 25 bp, Mus musculus
tgaaaccctctgttgttggcgggaa

SEQ ID NO: 276070 - DNA, 25 bp, Mus musculus
caacgctctgcttggtttgaaaccc

SEQ ID NO: 276071 - DNA, 25 bp, Mus musculus
cgtttctgtcagcagggcgaacgcc

SEQ ID NO: 276072 - DNA, 25 bp, Mus musculus
cttcttctaggagagcgtttctgtc

SEQ ID NO: 276073 - DNA, 25 bp, Mus musculus
agcctgagtagtgtctccgcggtct

SEQ ID NO: 276074 - DNA, 25 bp, Mus musculus
agctcctcccacagtaggcgtgtca

SEQ ID NO: 276075 - DNA, 25 bp, Mus musculus
tccttagctgcttctcgcgagactt

SEQ ID NO: 276076 - DNA, 25 bp, Mus musculus
ccctgagacgtccaccgagggtctt

SEQ ID NO: 276077 - DNA, 25 bp, Mus musculus
gagcccggttcacagcagctagcct

SEQ ID NO: 276078 - DNA, 25 bp, Mus musculus
aaagcagtgcctgggagtcttcttc

SEQ ID NO: 276079 - DNA, 25 bp, Mus musculus
gtctccgggccagtaaaagcagtgc

SEQ ID NO: 276080 - DNA, 25 bp, Mus musculus
caatcaggagcagacgtggaaaaga

SEQ ID NO: 276081 - DNA, 25 bp, Mus musculus
agcgaggcccgagcttccgcgtcga

SEQ ID NO: 276082 - DNA, 25 bp, Mus musculus
cacggcgtagccatcgctgaaggga

SEQ ID NO: 276083 - DNA, 25 bp, Mus musculus
cagtactcaagcacgccgcgatggc

SEQ ID NO: 276084 - DNA, 25 bp, Mus musculus
tgtcccgcaccttttgcgtgggctg

SEQ ID NO: 276085 - DNA, 25 bp, Mus musculus
agagcgcgaccacggcgtagccatc

SEQ ID NO: 276086 - DNA, 25 bp, Mus musculus
caagagccaatcaggagcagacgtg

SEQ ID NO: 276087 - DNA, 25 bp, Mus musculus
cggtcgggacccgtgacgccatagc

SEQ ID NO: 276088 - DNA, 25 bp, Mus musculus
cagggtgcacgttggcagtactcaa

SEQ ID NO: 276089 - DNA, 25 bp, Mus musculus
gacgccatagcgctctcagccaatg

SEQ ID NO: 276090 - DNA, 25 bp, Mus musculus
agccaatgggcgcaccgctgtcggt

SEQ ID NO: 276091 - DNA, 25 bp, Mus musculus
cacttggccgccgttttgcgggagt

SEQ ID NO: 276092 - DNA, 25 bp, Mus musculus
gtcggtccgctcttcagcagccggt

SEQ ID NO: 276093 - DNA, 25 bp, Mus musculus
ggaagagtgtgagcaagagccaatc

SEQ ID NO: 276094 - DNA, 25 bp, Mus musculus
ccgctaatcgccagctcagaaacaa

SEQ ID NO: 276095 - DNA, 25 bp, Mus musculus
tgacagggtctgcaacatccgcata

SEQ ID NO: 276096 - DNA, 25 bp, Mus musculus
tgtctcccgtgtccctgaggcttag

SEQ ID NO: 276097 - DNA, 25 bp, Mus musculus
gcagcgctagctttctcagatgaga

SEQ ID NO: 276098 - DNA, 25 bp, Mus musculus
agatgagaccctggacaaagtgacc

SEQ ID NO: 276099 - DNA, 25 bp, Mus musculus
caaagtgaccaagtcggagggctac

SEQ ID NO: 276100 - DNA, 25 bp, Mus musculus
agggctactgcagccgcatcttgcg

SEQ ID NO: 276101 - DNA, 25 bp, Mus musculus
cgtgagggatacacggagttcagcc

SEQ ID NO: 276102 - DNA, 25 bp, Mus musculus
tggaaggcgaccctgacttctataa

SEQ ID NO: 276103 - DNA, 25 bp, Mus musculus
tctataagccaggaagcagctaccg

SEQ ID NO: 276104 - DNA, 25 bp, Mus musculus
cctagggcactgacccgagcaaggc

SEQ ID NO: 276105 - DNA, 25 bp, Mus musculus
gagtgtaccacgtctgcgcatccca

SEQ ID NO: 276106 - DNA, 25 bp, Mus musculus
tcccgtcacttggagcaggagtgtc

SEQ ID NO: 276107 - DNA, 25 bp, Mus musculus
gggatccgggcgcaaatcagccctc

SEQ ID NO: 276108 - DNA, 25 bp, Mus musculus
accctgttccagaagctcttcagca

SEQ ID NO: 276109 - DNA, 25 bp, Mus musculus
gtgactaatttctgtcatatgactg

SEQ ID NO: 276110 - DNA, 25 bp, Mus musculus
tgccctcttcgctaggctgtttatg

SEQ ID NO: 276111 - DNA, 25 bp, Mus musculus
cagccctcgggtggctttgtgcaga

SEQ ID NO: 276112 - DNA, 25 bp, Mus musculus
gctcttcagcaagcggagcggatta

SEQ ID NO: 276113 - DNA, 25 bp, Mus musculus
agactgtcgcgcgttcggccaacct

SEQ ID NO: 276114 - DNA, 25 bp, Mus musculus
tgtcatatgactgaggcgcccatgg

SEQ ID NO: 276115 - DNA, 25 bp, Mus musculus
tgatacggctcgtcgccagccaatc

SEQ ID NO: 276116 - DNA, 25 bp, Mus musculus
ttgctgccacgtgatacggctcgtc

SEQ ID NO: 276117 - DNA, 25 bp, Mus musculus
ccgctcagtttgctgccacgtgata

SEQ ID NO: 276118 - DNA, 25 bp, Mus musculus
acccgtgagccagccaatggcaggc

SEQ ID NO: 276119 - DNA, 25 bp, Mus musculus
cgtgacggacccgtgagccagccaa

SEQ ID NO: 276120 - DNA, 25 bp, Mus musculus
cgcgacccggactgcgcgttcaggt

SEQ ID NO: 276121 - DNA, 25 bp, Mus musculus
ccgtggccgtttgaagtgactaatt

SEQ ID NO: 276122 - DNA, 25 bp, Mus musculus
cccgacccagggtgtgcaaagctgt

SEQ ID NO: 276123 - DNA, 25 bp, Mus musculus
cgtgtgacttcggacgacctgtaga

SEQ ID NO: 276124 - DNA, 25 bp, Mus musculus
ttcggacgacctgtagagctctccc

SEQ ID NO: 276125 - DNA, 25 bp, Mus musculus
ccgtgaactctagtgacaatcactc

SEQ ID NO: 276126 - DNA, 25 bp, Mus musculus
tgcaaagctgtggagtcgaggtcca

SEQ ID NO: 276127 - DNA, 25 bp, Mus musculus
tcgaggtccacaccacagtgacaac

SEQ ID NO: 276128 - DNA, 25 bp, Mus musculus
tctgtctatgcagggtcaggcctca

SEQ ID NO: 276129 - DNA, 25 bp, Mus musculus
cacggggccgtgattgccaacctaa

SEQ ID NO: 276130 - DNA, 25 bp, Mus musculus
tgccaacctaacacagtcggatctg

SEQ ID NO: 276131 - DNA, 25 bp, Mus musculus
gcccgcgagcgaagacgctgcagaa

SEQ ID NO: 276132 - DNA, 25 bp, Mus musculus
cgctgcagaaccttgggactcctcg

SEQ ID NO: 276133 - DNA, 25 bp, Mus musculus
ctcaccggcctctgtctatgcaggg

SEQ ID NO: 276134 - DNA, 25 bp, Mus musculus
agtgacaacccggagcaccacgtca

SEQ ID NO: 276135 - DNA, 25 bp, Mus musculus
cttctccttccgtgaactctagtga

SEQ ID NO: 276136 - DNA, 25 bp, Mus musculus
atctatccaaaagcccgggatcggc

SEQ ID NO: 276137 - DNA, 25 bp, Mus musculus
ggcgacgcaggaagtgcaatctatc

SEQ ID NO: 276138 - DNA, 25 bp, Mus musculus
cgtcaaagaagcctgcggagtcttg

SEQ ID NO: 276139 - DNA, 25 bp, Mus musculus
cccaactagggttcggtgatcgtca

SEQ ID NO: 276140 - DNA, 25 bp, Mus musculus
atagctccggcgcagcgacaacctg

SEQ ID NO: 276141 - DNA, 25 bp, Mus musculus
cccttcgaggactcggggctcaaca

SEQ ID NO: 276142 - DNA, 25 bp, Mus musculus
ctgtccgtgaggtaagctccctctc

SEQ ID NO: 276143 - DNA, 25 bp, Mus musculus
ggccaggccgcagatgctgaatcac

SEQ ID NO: 276144 - DNA, 25 bp, Mus musculus
caggttactgatcgtttcccgccgg

SEQ ID NO: 276145 - DNA, 25 bp, Mus musculus
acccagcagcggacacaggaacacg

SEQ ID NO: 276146 - DNA, 25 bp, Mus musculus
tgctgaatcactgtaggagactgtc

SEQ ID NO: 276147 - DNA, 25 bp, Mus musculus
ctgcgaaagctgagaacgtgggatt

SEQ ID NO: 276148 - DNA, 25 bp, Mus musculus
ggggctcaacacaccatagctccgg

SEQ ID NO: 276149 - DNA, 25 bp, Mus musculus
cccacgtaaggtggagaagctgagc

SEQ ID NO: 276150 - DNA, 25 bp, Mus musculus
gagagcctgcgcaacggctacgtga

SEQ ID NO: 276151 - DNA, 25 bp, Mus musculus
agccgtgaccgctctgcgaagctcg

SEQ ID NO: 276152 - DNA, 25 bp, Mus musculus
tgcgcaacggctacgtgaagagctg

SEQ ID NO: 276153 - DNA, 25 bp, Mus musculus
acgtgaagagctgcgtgagcccgct

SEQ ID NO: 276154 - DNA, 25 bp, Mus musculus
acctctgccgcttctgcaacgtgga

SEQ ID NO: 276155 - DNA, 25 bp, Mus musculus
tgccgcttctgcaacgtggagccgc

SEQ ID NO: 276156 - DNA, 25 bp, Mus musculus
ggacgctgctgagcgcctgctcgct

SEQ ID NO: 276157 - DNA, 25 bp, Mus musculus
aagaagcccttctcgccgctctcag

SEQ ID NO: 276158 - DNA, 25 bp, Mus musculus
ttcagcatcgcctgtgccttcttct

SEQ ID NO: 276159 - DNA, 25 bp, Mus musculus
tgtgccttcttcttcctcacctgtt

SEQ ID NO: 276160 - DNA, 25 bp, Mus musculus
ttcttcttcctcacctgtttcctga

SEQ ID NO: 276161 - DNA, 25 bp, Mus musculus
caggcctctgctgtcgtgcctggtc

SEQ ID NO: 276162 - DNA, 25 bp, Mus musculus
tcccgagccgcgcttgagggaaaag

SEQ ID NO: 276163 - DNA, 25 bp, Mus musculus
gtggtgggtgtccttctccggcctc

SEQ ID NO: 276164 - DNA, 25 bp, Mus musculus
gcttcctgtaggaggcgcggccctc

SEQ ID NO: 276165 - DNA, 25 bp, Mus musculus
gctacgaaccagtccggagcgagga

SEQ ID NO: 276166 - DNA, 25 bp, Mus musculus
tggcggaccaccagcacgaagagca

SEQ ID NO: 276167 - DNA, 25 bp, Mus musculus
atgttgccgacaaatggcagccgcg

SEQ ID NO: 276168 - DNA, 25 bp, Mus musculus
tcctcatgtagacgtggggaagatc

SEQ ID NO: 276169 - DNA, 25 bp, Mus musculus
acccggctctgcttcctcatgtaga

SEQ ID NO: 276170 - DNA, 25 bp, Mus musculus
gaaggtccgcgttgaggcctacctc

SEQ ID NO: 276171 - DNA, 25 bp, Mus musculus
tccttctgacgagaggaaggtccgc

SEQ ID NO: 276172 - DNA, 25 bp, Mus musculus
aagccggcttcgcttgagtggttcc

SEQ ID NO: 276173 - DNA, 25 bp, Mus musculus
aagccgaagcgcctctggcgtggta

SEQ ID NO: 276174 - DNA, 25 bp, Mus musculus
ctgtgggcgggaaactcaagccgaa

SEQ ID NO: 276175 - DNA, 25 bp, Mus musculus
gcgcagaagcacatgctgatctgtg

SEQ ID NO: 276176 - DNA, 25 bp, Mus musculus
gggctcccggtagctccaacatcgg

SEQ ID NO: 276177 - DNA, 25 bp, Mus musculus
gcttgagtggttccttctgacgaga

SEQ ID NO: 276178 - DNA, 25 bp, Mus musculus
gacccgcgcgggaaccgtcgacaga

SEQ ID NO: 276179 - DNA, 25 bp, Mus musculus
aaccgtcgacagagcgcgcctgggc

SEQ ID NO: 276180 - DNA, 25 bp, Mus musculus
aggccagtctactgggccgcgcgca

SEQ ID NO: 276181 - DNA, 25 bp, Mus musculus
caaagcggcgcgctcgcagtctgag

SEQ ID NO: 276182 - DNA, 25 bp, Mus musculus
ccgcctcgtgaaggcacagtacatc

SEQ ID NO: 276183 - DNA, 25 bp, Mus musculus
caagtggacgcgtaccgtgcggctc

SEQ ID NO: 276184 - DNA, 25 bp, Mus musculus
cagcccaaggccaagtggacgcgta

SEQ ID NO: 276185 - DNA, 25 bp, Mus musculus
acgcggtggctctgcgcagcccaag

SEQ ID NO: 276186 - DNA, 25 bp, Mus musculus
tagcccactgcacgcggtggctctg

SEQ ID NO: 276187 - DNA, 25 bp, Mus musculus
gagacctgctcatccgcggaacggc

SEQ ID NO: 276188 - DNA, 25 bp, Mus musculus
cagccggagctgagacctgctcatc

SEQ ID NO: 276189 - DNA, 25 bp, Mus musculus
gttgcagtgcctcgatccttctcag

SEQ ID NO: 276190 - DNA, 25 bp, Mus musculus
atccgccgcttacgcgaggtcgcag

SEQ ID NO: 276191 - DNA, 25 bp, Mus musculus
ttgacggctacatctcggcgctcct

SEQ ID NO: 276192 - DNA, 25 bp, Mus musculus
caggtggtgcgcgaatatgccagtc

SEQ ID NO: 276193 - DNA, 25 bp, Mus musculus
cgcgaatatgccagtcagtttgtcc

SEQ ID NO: 276194 - DNA, 25 bp, Mus musculus
gcgcgaatatgccagtcagtttgtc

SEQ ID NO: 276195 - DNA, 25 bp, Mus musculus
gtgcgcgaatatgccagtcagtttg

SEQ ID NO: 276196 - DNA, 25 bp, Mus musculus
ggtgcgcgaatatgccagtcagttt

SEQ ID NO: 276197 - DNA, 25 bp, Mus musculus
gtggtgcgcgaatatgccagtcagt

SEQ ID NO: 276198 - DNA, 25 bp, Mus musculus
tccttcccagtgtacaagcggagtc

SEQ ID NO: 276199 - DNA, 25 bp, Mus musculus
gaatatgccagtcagtttgtccagc

SEQ ID NO: 276200 - DNA, 25 bp, Mus musculus
gcgaatatgccagtcagtttgtcca

SEQ ID NO: 276201 - DNA, 25 bp, Mus musculus
ccttcccagtgtacaagcggagtcg

SEQ ID NO: 276202 - DNA, 25 bp, Mus musculus
aggtggtgcgcgaatatgccagtca

SEQ ID NO: 276203 - DNA, 25 bp, Mus musculus
cctgcaggtggtgcgcgaatatgcc

SEQ ID NO: 276204 - DNA, 25 bp, Mus musculus
actcctgcaggtggtgcgcgaatat

SEQ ID NO: 276205 - DNA, 25 bp, Mus musculus
gcactcctgcaggtggtgcgcgaat

SEQ ID NO: 276206 - DNA, 25 bp, Mus musculus
tgtacttggcctcctcgggcgtgat

SEQ ID NO: 276207 - DNA, 25 bp, Mus musculus
caggttgccggtatcaaacttgatg

SEQ ID NO: 276208 - DNA, 25 bp, Mus musculus
acttgatggcatcggtgatttttcc

SEQ ID NO: 276209 - DNA, 25 bp, Mus musculus
tcgaccttaatgagccgctgcatgc

SEQ ID NO: 276210 - DNA, 25 bp, Mus musculus
tgtcgttgaccttgatgagcgggtc

SEQ ID NO: 276211 - DNA, 25 bp, Mus musculus
gggatgcccttggtacccacgaaga

SEQ ID NO: 276212 - DNA, 25 bp, Mus musculus
acgaagactttcctcaccttgcaca

SEQ ID NO: 276213 - DNA, 25 bp, Mus musculus
tcaccttgcacagcttgtacttggc

SEQ ID NO: 276214 - DNA, 25 bp, Mus musculus
ctgttcctcaggaagatggcgagcg

SEQ ID NO: 276215 - DNA, 25 bp, Mus musculus
caggtgtttcttgggaccacgagcc

SEQ ID NO: 276216 - DNA, 25 bp, Mus musculus
ggccgccacacgcttcaggtgtttc

SEQ ID NO: 276217 - DNA, 25 bp, Mus musculus
tcagtttgtccagcatccagtggcg

SEQ ID NO: 276218 - DNA, 25 bp, Mus musculus
ccaggttggcgcctccggttaccat

SEQ ID NO: 276219 - DNA, 25 bp, Mus musculus
agccgctgcatgcagatcttcttca

SEQ ID NO: 276220 - DNA, 25 bp, Mus musculus
gctgagcaaaaaggaccaccgttgg

SEQ ID NO: 276221 - DNA, 25 bp, Mus musculus
gcctggctaacactgacgcctctta

SEQ ID NO: 276222 - DNA, 25 bp, Mus musculus
agccaacgatcccagtccgaaatgg

SEQ ID NO: 276223 - DNA, 25 bp, Mus musculus
agagctacgaagatcctggagtccc

SEQ ID NO: 276224 - DNA, 25 bp, Mus musculus
gaactggaactcgagcgtcccggga

SEQ ID NO: 276225 - DNA, 25 bp, Mus musculus
tgtgtactgctgagaggaccattaa

SEQ ID NO: 276226 - DNA, 25 bp, Mus musculus
ccttggagttcggtttgtgtactgc

SEQ ID NO: 276227 - DNA, 25 bp, Mus musculus
ccaccgttgggttgcaaactgcctt

SEQ ID NO: 276228 - DNA, 25 bp, Mus musculus
cgcctcttagaactgcggcggcgca

SEQ ID NO: 276229 - DNA, 25 bp, Mus musculus
ctgaagcgcagaggacctggaagcc

SEQ ID NO: 276230 - DNA, 25 bp, Mus musculus
tttaagggagaaagccgaaagcagc

SEQ ID NO: 276231 - DNA, 25 bp, Mus musculus
cggccgttcctttgcatttgcagca

SEQ ID NO: 276232 - DNA, 25 bp, Mus musculus
ttatcttaaagctgcgcggacccgg

SEQ ID NO: 276233 - DNA, 25 bp, Mus musculus
cgaccaccttttatctatccgaaca

SEQ ID NO: 276234 - DNA, 25 bp, Mus musculus
cgtacagagaaactaaccccagagg

SEQ ID NO: 276235 - DNA, 25 bp, Mus musculus
cgggctccaggatggtacctctcgg

SEQ ID NO: 276236 - DNA, 25 bp, Mus musculus
tccctcgctctcttaattcgctcgc

SEQ ID NO: 276237 - DNA, 25 bp, Mus musculus
tatgactgctgctctctcactcagc

SEQ ID NO: 276238 - DNA, 25 bp, Mus musculus
cccaacaggtagctatgactgctgc

SEQ ID NO: 276239 - DNA, 25 bp, Mus musculus
cagtgcccagcctaacgcggggctc

SEQ ID NO: 276240 - DNA, 25 bp, Mus musculus
ttctctacctcgactcgcccgcttg

SEQ ID NO: 276241 - DNA, 25 bp, Mus musculus
cggcgagcaccctcctcccagtccc

SEQ ID NO: 276242 - DNA, 25 bp, Mus musculus
cggctctgccaaaggctgcgctcga

SEQ ID NO: 276243 - DNA, 25 bp, Mus musculus
ctctgccaaaggctgcgctcgactg

SEQ ID NO: 276244 - DNA, 25 bp, Mus musculus
tacctctcgggagggttccttgtgc

SEQ ID NO: 276245 - DNA, 25 bp, Mus musculus
aaggctgcgctcgactgcctcgcgt

SEQ ID NO: 276246 - DNA, 25 bp, Mus musculus
taattcgctcgctccgtcccggtta

SEQ ID NO: 276247 - DNA, 25 bp, Mus musculus
cctcgcgtccctccgctgtcccacc

SEQ ID NO: 276248 - DNA, 25 bp, Mus musculus
gaactgcgagtgtgtttggcatatc

SEQ ID NO: 276249 - DNA, 25 bp, Mus musculus
ccgcacggggtgaaacgttcagcct

SEQ ID NO: 276250 - DNA, 25 bp, Mus musculus
ggaaagctccctctacacgccgaag

SEQ ID NO: 276251 - DNA, 25 bp, Mus musculus
gtcaggatcccagctacgatgagtg

SEQ ID NO: 276252 - DNA, 25 bp, Mus musculus
tacacgccgaagaaagcgtagcctc

SEQ ID NO: 276253 - DNA, 25 bp, Mus musculus
ctctgcgttctggagtggcgctgct

SEQ ID NO: 276254 - DNA, 25 bp, Mus musculus
cagcagtgacgactgtagcggtgaa

SEQ ID NO: 276255 - DNA, 25 bp, Mus musculus
caggccagtaaagagtgagtccaaa

SEQ ID NO: 276256 - DNA, 25 bp, Mus musculus
gacggcttagtcaggccagtaaaga

SEQ ID NO: 276257 - DNA, 25 bp, Mus musculus
ttaagtcactgaagacggcttagtc

SEQ ID NO: 276258 - DNA, 25 bp, Mus musculus
gggaaatgtagtttaagtcactgaa

SEQ ID NO: 276259 - DNA, 25 bp, Mus musculus
acgccgcgcgagatgcttcgctcgg

SEQ ID NO: 276260 - DNA, 25 bp, Mus musculus
aaagcgtagcctccgagggctctcc

SEQ ID NO: 276261 - DNA, 25 bp, Mus musculus
cagctacgatgagtgctgcccggga

SEQ ID NO: 276262 - DNA, 25 bp, Mus musculus
agctttgggccacggaacgtgcccg

SEQ ID NO: 276263 - DNA, 25 bp, Mus musculus
gccaccggtcaacagctttgggcca

SEQ ID NO: 276264 - DNA, 25 bp, Mus musculus
gtgcgtgcacacacctgcagactgc

SEQ ID NO: 276265 - DNA, 25 bp, Mus musculus
gcggagcatcgtgcgcccttctcgt

SEQ ID NO: 276266 - DNA, 25 bp, Mus musculus
ttacgaagagcccacacccacttga

SEQ ID NO: 276267 - DNA, 25 bp, Mus musculus
tggcacattcctttcctcgcagagg

SEQ ID NO: 276268 - DNA, 25 bp, Mus musculus
ttcctcgcagaggatgctgcaaact

SEQ ID NO: 276269 - DNA, 25 bp, Mus musculus
ccgacaaagttcgtgcgtgcacaca

SEQ ID NO: 276270 - DNA, 25 bp, Mus musculus
tcacagagtcctgcccgacaaagtt

SEQ ID NO: 276271 - DNA, 25 bp, Mus musculus
agaccgcagcccacgatcacagagt

SEQ ID NO: 276272 - DNA, 25 bp, Mus musculus
agattaaccagtggccggctgaatc

SEQ ID NO: 276273 - DNA, 25 bp, Mus musculus
cttaaccctactgggcagctaccgg

SEQ ID NO: 276274 - DNA, 25 bp, Mus musculus
cgggcagcgccaaggttccatgcgc

SEQ ID NO: 276275 - DNA, 25 bp, Mus musculus
cttcccaaggggagattaaccagtg

SEQ ID NO: 276276 - DNA, 25 bp, Mus musculus
atagtctatttttggcgacgccctc

SEQ ID NO: 276277 - DNA, 25 bp, Mus musculus
atctctctacgtcacggccaggcgg

SEQ ID NO: 276278 - DNA, 25 bp, Mus musculus
cccgcttgctgaatggcagcctcga

SEQ ID NO: 276279 - DNA, 25 bp, Mus musculus
ctgcggacatgaactcgcccgtgga

SEQ ID NO: 276280 - DNA, 25 bp, Mus musculus
acagttctcatttccctcccggtgg

SEQ ID NO: 276281 - DNA, 25 bp, Mus musculus
agtttggaccctgcgacagttctca

SEQ ID NO: 276282 - DNA, 25 bp, Mus musculus
gaacctcaaccggaagctgggtatg

SEQ ID NO: 276283 - DNA, 25 bp, Mus musculus
gcatgcgcatgcgttctcggccagt

SEQ ID NO: 276284 - DNA, 25 bp, Mus musculus
ctcgcgaagaaaagccaagccgctc

SEQ ID NO: 276285 - DNA, 25 bp, Mus musculus
tttccggactcgagcgctaaaccaa

SEQ ID NO: 276286 - DNA, 25 bp, Mus musculus
cgacgccctcgtagcatttccggaa

SEQ ID NO: 276287 - DNA, 25 bp, Mus musculus
gctgggtatgcggaaactacaatcc

SEQ ID NO: 276288 - DNA, 25 bp, Mus musculus
aatcctgtaaccgaggcggagtctc

SEQ ID NO: 276289 - DNA, 25 bp, Mus musculus
cgggcgttgcgaagacttgtttgct

SEQ ID NO: 276290 - DNA, 25 bp, Mus musculus
agagcagatcgtccgcgttcctcgg

SEQ ID NO: 276291 - DNA, 25 bp, Mus musculus
cactacgggagaggtgcacctgtta

SEQ ID NO: 276292 - DNA, 25 bp, Mus musculus
aggcggcaaagctcccgttctacta

SEQ ID NO: 276293 - DNA, 25 bp, Mus musculus
tactagcccgggcagagcagatcgt

SEQ ID NO: 276294 - DNA, 25 bp, Mus musculus
gcgcgggtagagttccaggaatatc

SEQ ID NO: 276295 - DNA, 25 bp, Mus musculus
cggtgcggattcacttactcgatga

SEQ ID NO: 276296 - DNA, 25 bp, Mus musculus
tcgatgaagaagctggcgccctcct

SEQ ID NO: 276297 - DNA, 25 bp, Mus musculus
ttggtcaaactagcgcagccgtggc

SEQ ID NO: 276298 - DNA, 25 bp, Mus musculus
cagccagcgcggctagagtagcgtc

SEQ ID NO: 276299 - DNA, 25 bp, Mus musculus
tcatgtgacccgagttgaccggttc

SEQ ID NO: 276300 - DNA, 25 bp, Mus musculus
cttgatgaagaagacgcggccgtcc

SEQ ID NO: 276301 - DNA, 25 bp, Mus musculus
ggccgtcccgacagacgccatagga

SEQ ID NO: 276302 - DNA, 25 bp, Mus musculus
acgccataggaccagtgctcaggta

SEQ ID NO: 276303 - DNA, 25 bp, Mus musculus
gcgcccacctgagcggatcatgtga

SEQ ID NO: 276304 - DNA, 25 bp, Mus musculus
acgtcaacttcagccactacagatg

SEQ ID NO: 276305 - DNA, 25 bp, Mus musculus
tctgcgcgccttttctacacaggtc

SEQ ID NO: 276306 - DNA, 25 bp, Mus musculus
gccggcgcttctctctagatcgtta

SEQ ID NO: 276307 - DNA, 25 bp, Mus musculus
tgggatgatcgcaaagcctaggtgc

SEQ ID NO: 276308 - DNA, 25 bp, Mus musculus
ataagctgcgggtttctcagggctc

SEQ ID NO: 276309 - DNA, 25 bp, Mus musculus
tctcttcggaagtcgcatctgaggg

SEQ ID NO: 276310 - DNA, 25 bp, Mus musculus
agtctgtctctaacatctcttcgga

SEQ ID NO: 276311 - DNA, 25 bp, Mus musculus
tcttagccagagcagcaagtctgtc

SEQ ID NO: 276312 - DNA, 25 bp, Mus musculus
gctacgccttgaactcttgtctcta

SEQ ID NO: 276313 - DNA, 25 bp, Mus musculus
gagactacgcgtcccagaaggcatg

SEQ ID NO: 276314 - DNA, 25 bp, Mus musculus
gtgacgccactcaccgacgtttgct

SEQ ID NO: 276315 - DNA, 25 bp, Mus musculus
gggacaggcccttcctgaaaacaga

SEQ ID NO: 276316 - DNA, 25 bp, Mus musculus
tcagcctctactcaccgtggggacg

SEQ ID NO: 276317 - DNA, 25 bp, Mus musculus
atcgttaattctaggcttccgagcc

SEQ ID NO: 276318 - DNA, 25 bp, Mus musculus
aaatctttcattccctccagcggtc

SEQ ID NO: 276319 - DNA, 25 bp, Mus musculus
ttctcgccttggtgtttgctgacag

SEQ ID NO: 276320 - DNA, 25 bp, Mus musculus
ctcacctcacgctgcgggagtcttg

SEQ ID NO: 276321 - DNA, 25 bp, Mus musculus
cggacgttcaggtgcttcgaagttt

SEQ ID NO: 276322 - DNA, 25 bp, Mus musculus
taataacagcgctcggccagacatc

SEQ ID NO: 276323 - DNA, 25 bp, Mus musculus
ggccgcccagagattagcttggttt

SEQ ID NO: 276324 - DNA, 25 bp, Mus musculus
gcctctgatctctggcttgcggttg

SEQ ID NO: 276325 - DNA, 25 bp, Mus musculus
ctcgagctccgaagcgccctttgtt

SEQ ID NO: 276326 - DNA, 25 bp, Mus musculus
gtacttgagcgccttgcgattggcc

SEQ ID NO: 276327 - DNA, 25 bp, Mus musculus
gagctctgcacgtcacttccgatgg

SEQ ID NO: 276328 - DNA, 25 bp, Mus musculus
cgctgaggagagcttcgactgactc

SEQ ID NO: 276329 - DNA, 25 bp, Mus musculus
gccctccaaggtccgagccatgttt

SEQ ID NO: 276330 - DNA, 25 bp, Mus musculus
gggagtcttggtcttcaccgcaacc

SEQ ID NO: 276331 - DNA, 25 bp, Mus musculus
tttgcattagctcgtcgtgtgggcc

SEQ ID NO: 276332 - DNA, 25 bp, Mus musculus
acgcattaggctgtggatcagagca

SEQ ID NO: 276333 - DNA, 25 bp, Mus musculus
cccactggtgaggtctctggaccta

SEQ ID NO: 276334 - DNA, 25 bp, Mus musculus
actcttctagctacagagcgcttga

SEQ ID NO: 276335 - DNA, 25 bp, Mus musculus
agcgcttgagcttttcttccgggtg

SEQ ID NO: 276336 - DNA, 25 bp, Mus musculus
accctgcagagaaggtcagtggcgc

SEQ ID NO: 276337 - DNA, 25 bp, Mus musculus
cgcggcttcctcacgcttcggagag

SEQ ID NO: 276338 - DNA, 25 bp, Mus musculus
gagagcgccacgtccctcttggcta

SEQ ID NO: 276339 - DNA, 25 bp, Mus musculus
gttcttccagaagcgccttcgcgta

SEQ ID NO: 276340 - DNA, 25 bp, Mus musculus
gtccctggaccagttcaccaatagg

SEQ ID NO: 276341 - DNA, 25 bp, Mus musculus
tctcccagctgaagccggaggcgtc

SEQ ID NO: 276342 - DNA, 25 bp, Mus musculus
gcgatccggagctggaccaattagc

SEQ ID NO: 276343 - DNA, 25 bp, Mus musculus
gcagagtaggtgctggacccagact

SEQ ID NO: 276344 - DNA, 25 bp, Mus musculus
agcagggtgtagatcccagcctcga

SEQ ID NO: 276345 - DNA, 25 bp, Mus musculus
tggacctatcgattcccggctgatg

SEQ ID NO: 276346 - DNA, 25 bp, Mus musculus
cctgccagccgcggggcactagcct

SEQ ID NO: 276347 - DNA, 25 bp, Mus musculus
gtccctgcccgtctgaaaactccgc

SEQ ID NO: 276348 - DNA, 25 bp, Mus musculus
tggtggtgtggaatttcagcagcct

SEQ ID NO: 276349 - DNA, 25 bp, Mus musculus
tgcccgtctgaaaactccgcgccgc

SEQ ID NO: 276350 - DNA, 25 bp, Mus musculus
ctgaaaactccgcgccgcggcggtg

SEQ ID NO: 276351 - DNA, 25 bp, Mus musculus
gatagagcgcgcaccggggtgtccc

SEQ ID NO: 276352 - DNA, 25 bp, Mus musculus
ggccgccgcggaagatggtggcggc

SEQ ID NO: 276353 - DNA, 25 bp, Mus musculus
ttgggaaggggatctcgagccccgc

SEQ ID NO: 276354 - DNA, 25 bp, Mus musculus
ctggtggtgtggaatttcagcagcc

SEQ ID NO: 276355 - DNA, 25 bp, Mus musculus
gcactagcctcccgggcgagggtaa

SEQ ID NO: 276356 - DNA, 25 bp, Mus musculus
agcccgcggaggacctggaggccga

SEQ ID NO: 276357 - DNA, 25 bp, Mus musculus
gagcccgcgcacagcagcctgccag

SEQ ID NO: 276358 - DNA, 25 bp, Mus musculus
cccgcgcacagcagcctgccagccg

SEQ ID NO: 276359 - DNA, 25 bp, Mus musculus
cgcggcgctcgcactcggcgctgct

SEQ ID NO: 276360 - DNA, 25 bp, Mus musculus
ttggctttctgcgaaacgcacgcta

SEQ ID NO: 276361 - DNA, 25 bp, Mus musculus
gggtcaactgcatctctatccctca

SEQ ID NO: 276362 - DNA, 25 bp, Mus musculus
agctagggcgggtcaactgcatctc

SEQ ID NO: 276363 - DNA, 25 bp, Mus musculus
ccagtcgaggcgtggtcaggaaaca

SEQ ID NO: 276364 - DNA, 25 bp, Mus musculus
gggcgggtcaactgcatctctatcc

SEQ ID NO: 276365 - DNA, 25 bp, Mus musculus
tcacctgcaggtgtcgcaggcagca

SEQ ID NO: 276366 - DNA, 25 bp, Mus musculus
ccgagcttttggctttctgcgaaac

SEQ ID NO: 276367 - DNA, 25 bp, Mus musculus
tctgcgaaacgcacgctaaggatga

SEQ ID NO: 276368 - DNA, 25 bp, Mus musculus
aacgcacgctaaggatgacccactg

SEQ ID NO: 276369 - DNA, 25 bp, Mus musculus
cgctaaggatgacccactggtgact

SEQ ID NO: 276370 - DNA, 25 bp, Mus musculus
ccgagaatcccttccgcgacaagcg

SEQ ID NO: 276371 - DNA, 25 bp, Mus musculus
gatgacccactggtgactcctgtcc

SEQ ID NO: 276372 - DNA, 25 bp, Mus musculus
atctctatccctcacctgcaggtgt

SEQ ID NO: 276373 - DNA, 25 bp, Mus musculus
ggcagcagccgagcttttggctttc

SEQ ID NO: 276374 - DNA, 25 bp, Mus musculus
gcccacgggactccgaaagcgaaca

SEQ ID NO: 276375 - DNA, 25 bp, Mus musculus
acgtggttccctaactcggcagtga

SEQ ID NO: 276376 - DNA, 25 bp, Mus musculus
gcagtgagtggctgagcctaactcc

SEQ ID NO: 276377 - DNA, 25 bp, Mus musculus
cgcgccaagagtaaaccacgacgtg

SEQ ID NO: 276378 - DNA, 25 bp, Mus musculus
ccctgcagggatctataggcccacg

SEQ ID NO: 276379 - DNA, 25 bp, Mus musculus
agggatggcacagataccacacgga

SEQ ID NO: 276380 - DNA, 25 bp, Mus musculus
accacacggatgaacacggagtttc

SEQ ID NO: 276381 - DNA, 25 bp, Mus musculus
cacggagtttcacaaacactcactc

SEQ ID NO: 276382 - DNA, 25 bp, Mus musculus
aacactcactcaccggcgagggaag

SEQ ID NO: 276383 - DNA, 25 bp, Mus musculus
ctcctcaggacgctgccaaggcgta

SEQ ID NO: 276384 - DNA, 25 bp, Mus musculus
ccaaggcgtattttacgcgccaaga

SEQ ID NO: 276385 - DNA, 25 bp, Mus musculus
gccgggcaaacgcacggaattatgg

SEQ ID NO: 276386 - DNA, 25 bp, Mus musculus
ttatgggaagcggaagcgctatcgc

SEQ ID NO: 276387 - DNA, 25 bp, Mus musculus
gagctcccgcagacaccggaggctg

SEQ ID NO: 276388 - DNA, 25 bp, Mus musculus
caggaggcccatccggaaactccgg

SEQ ID NO: 276389 - DNA, 25 bp, Mus musculus
cgaaactgaaagactctgaccaatc

SEQ ID NO: 276390 - DNA, 25 bp, Mus musculus
tccaggtcaaaggagagcgaaactg

SEQ ID NO: 276391 - DNA, 25 bp, Mus musculus
cgaaactcgctcctcattgggtaga

SEQ ID NO: 276392 - DNA, 25 bp, Mus musculus
ggcagctagcgcatgacttgaaatc

SEQ ID NO: 276393 - DNA, 25 bp, Mus musculus
cccgcagtctgcttatataggctag

SEQ ID NO: 276394 - DNA, 25 bp, Mus musculus
cgcggttatcaacgagcgaacacac

SEQ ID NO: 276395 - DNA, 25 bp, Mus musculus
cgccatcgttccagactcgcggtta

SEQ ID NO: 276396 - DNA, 25 bp, Mus musculus
gggacagactgaccaccgcaactca

SEQ ID NO: 276397 - DNA, 25 bp, Mus musculus
tgtccctggtagtccaccgaggcca

SEQ ID NO: 276398 - DNA, 25 bp, Mus musculus
ctccaccgtggagataaggcctggc

SEQ ID NO: 276399 - DNA, 25 bp, Mus musculus
cccaagccttatggtgcaggattcc

SEQ ID NO: 276400 - DNA, 25 bp, Mus musculus
gtagaccgcactccggcttctggga

SEQ ID NO: 276401 - DNA, 25 bp, Mus musculus
agcaggttgctgctgcggttatccc

SEQ ID NO: 276402 - DNA, 25 bp, Mus musculus
cttatgacaggggtagggtcaccta

SEQ ID NO: 276403 - DNA, 25 bp, Mus musculus
tcacccacctgggttgccagtcatt

SEQ ID NO: 276404 - DNA, 25 bp, Mus musculus
agtcattccagctccgcgggtactt

SEQ ID NO: 276405 - DNA, 25 bp, Mus musculus
ggggctctgcggctcattaccttcc

SEQ ID NO: 276406 - DNA, 25 bp, Mus musculus
gaggcgacgtctcttccagggcagc

SEQ ID NO: 276407 - DNA, 25 bp, Mus musculus
tcacagaatatggactagaggcggg

SEQ ID NO: 276408 - DNA, 25 bp, Mus musculus
tcaaaaggcgggacctgctcgagag

SEQ ID NO: 276409 - DNA, 25 bp, Mus musculus
ctggagttctgagagcctagacttc

SEQ ID NO: 276410 - DNA, 25 bp, Mus musculus
cctagacttcaaggcgaggtccgcg

SEQ ID NO: 276411 - DNA, 25 bp, Mus musculus
gaggtccgcgttcgcgtagctaaaa

SEQ ID NO: 276412 - DNA, 25 bp, Mus musculus
gaactactggagagcagggacccga

SEQ ID NO: 276413 - DNA, 25 bp, Mus musculus
ctcctgagcagcagctctgtctgcg

SEQ ID NO: 276414 - DNA, 25 bp, Mus musculus
tagagagcaatgtggactcgtcgcg

SEQ ID NO: 276415 - DNA, 25 bp, Mus musculus
gcggggctattggtcacagaatatg

SEQ ID NO: 276416 - DNA, 25 bp, Mus musculus
gaggttgcaagtcccacgtagggcc

SEQ ID NO: 276417 - DNA, 25 bp, Mus musculus
ctgctctgggacacccgttgttttg

SEQ ID NO: 276418 - DNA, 25 bp, Mus musculus
tggggtgctccctggttgcaaaaaa

SEQ ID NO: 276419 - DNA, 25 bp, Mus musculus
agccaccgtcctacctggatgtacg

SEQ ID NO: 276420 - DNA, 25 bp, Mus musculus
acagccagccggcaagatatcagtg

SEQ ID NO: 276421 - DNA, 25 bp, Mus musculus
cagaacctggatgcccgaggtcctc

SEQ ID NO: 276422 - DNA, 25 bp, Mus musculus
aggtcctccgcttcggtttctggtg

SEQ ID NO: 276423 - DNA, 25 bp, Mus musculus
ctggttgcaaaaaagctggagcgcc

SEQ ID NO: 276424 - DNA, 25 bp, Mus musculus
ctgcctgatcgacagcagggctttc

SEQ ID NO: 276425 - DNA, 25 bp, Mus musculus
acactgcgctgctagctgtgggtct

SEQ ID NO: 276426 - DNA, 25 bp, Mus musculus
tggggtgtcttctccatcctgccct

SEQ ID NO: 276427 - DNA, 25 bp, Mus musculus
agttttataccagccgcacccgatg

SEQ ID NO: 276428 - DNA, 25 bp, Mus musculus
ctagaacccggctgtggagtgtata

SEQ ID NO: 276429 - DNA, 25 bp, Mus musculus
ctagctccagaacacgcacaggtgc

SEQ ID NO: 276430 - DNA, 25 bp, Mus musculus
caggctacggtgaaagctggcctca

SEQ ID NO: 276431 - DNA, 25 bp, Mus musculus
ctacctaccacacccgttagtaatg

SEQ ID NO: 276432 - DNA, 25 bp, Mus musculus
gctgctcctcagctcgaaatgcgga

SEQ ID NO: 276433 - DNA, 25 bp, Mus musculus
gcggacgtcagcgagccgctaccta

SEQ ID NO: 276434 - DNA, 25 bp, Mus musculus
acctaggggatgctaggcgcgcaaa

SEQ ID NO: 276435 - DNA, 25 bp, Mus musculus
cgttagtaatgctcaccaccgtggc

SEQ ID NO: 276436 - DNA, 25 bp, Mus musculus
gagctcccggtgcaacaacctgtaa

SEQ ID NO: 276437 - DNA, 25 bp, Mus musculus
ctaggcgcgcaaagagtgaccgctg

SEQ ID NO: 276438 - DNA, 25 bp, Mus musculus
cttccgagtggcgaccctacacttg

SEQ ID NO: 276439 - DNA, 25 bp, Mus musculus
cagactggaaaatggagccgccgca

SEQ ID NO: 276440 - DNA, 25 bp, Mus musculus
tgaagagaaccatacgccggtcctc

SEQ ID NO: 276441 - DNA, 25 bp, Mus musculus
ctggcctcacggagaatgaagagaa

SEQ ID NO: 276442 - DNA, 25 bp, Mus musculus
caacctgtaagagtcgccgcagcga

SEQ ID NO: 276443 - DNA, 25 bp, Mus musculus
cggatccagccgtagacgtgcccgg

SEQ ID NO: 276444 - DNA, 25 bp, Mus musculus
gcagcagccatagtccgtgcggcaa

SEQ ID NO: 276445 - DNA, 25 bp, Mus musculus
atggccaccttgagcaacgggaaac

SEQ ID NO: 276446 - DNA, 25 bp, Mus musculus
tctggctgagaagttggcatgacca

SEQ ID NO: 276447 - DNA, 25 bp, Mus musculus
ctggctcttgcaaggatctggctga

SEQ ID NO: 276448 - DNA, 25 bp, Mus musculus
ctctccagtaagatgctcaggcctg

SEQ ID NO: 276449 - DNA, 25 bp, Mus musculus
gcgcacttcgtgctcatagtaactc

SEQ ID NO: 276450 - DNA, 25 bp, Mus musculus
tgacctagcacatgcggcgacaggc

SEQ ID NO: 276451 - DNA, 25 bp, Mus musculus
acatgtgccttgctgtgacctagca

SEQ ID NO: 276452 - DNA, 25 bp, Mus musculus
gcgctgcccacctggatgaagtctc

SEQ ID NO: 276453 - DNA, 25 bp, Mus musculus
gtcggcggattttatgctgttcata

SEQ ID NO: 276454 - DNA, 25 bp, Mus musculus
gtggcaccaacacgtcgaagctgtc

SEQ ID NO: 276455 - DNA, 25 bp, Mus musculus
ctggaaccagcgcagtaccagggta

SEQ ID NO: 276456 - DNA, 25 bp, Mus musculus
aagacccgcaggttgagcgtgtacc

SEQ ID NO: 276457 - DNA, 25 bp, Mus musculus
accctccaagctgtagcgcacagtg

SEQ ID NO: 276458 - DNA, 25 bp, Mus musculus
gacaatgcagctatggtccaaacgc

SEQ ID NO: 276459 - DNA, 25 bp, Mus musculus
tccgtgacctccactgcaaatagtc

SEQ ID NO: 276460 - DNA, 25 bp, Mus musculus
tgcaaatagtcaccggcgaagagcc

SEQ ID NO: 276461 - DNA, 25 bp, Mus musculus
ctgagaagggcctccggacaccagt

SEQ ID NO: 276462 - DNA, 25 bp, Mus musculus
tcccacggaagcagccgctatggct

SEQ ID NO: 276463 - DNA, 25 bp, Mus musculus
ggcgctcatcgctgcggacaatgca

SEQ ID NO: 276464 - DNA, 25 bp, Mus musculus
ctcagggtgatgacgcatagatgcc

SEQ ID NO: 276465 - DNA, 25 bp, Mus musculus
taggccctggattacacccgattgg

SEQ ID NO: 276466 - DNA, 25 bp, Mus musculus
cgattggttagaaatgaccgattca

SEQ ID NO: 276467 - DNA, 25 bp, Mus musculus
tgaccgattcacgtactctattggg

SEQ ID NO: 276468 - DNA, 25 bp, Mus musculus
ccctgtcgatcattgtaacgtcgtg

SEQ ID NO: 276469 - DNA, 25 bp, Mus musculus
attgtaacgtcgtgaaggcgcccgg

SEQ ID NO: 276470 - DNA, 25 bp, Mus musculus
cgcgcgcttgtgacgtatagacgtc

SEQ ID NO: 276471 - DNA, 25 bp, Mus musculus
ccaatcgtgctctcgactcagggtg

SEQ ID NO: 276472 - DNA, 25 bp, Mus musculus
tgtcgggttccagatgacgtcacag

SEQ ID NO: 276473 - DNA, 25 bp, Mus musculus
tggaaagtggggactgcctctccag

SEQ ID NO: 276474 - DNA, 25 bp, Mus musculus
ctctccagctcggtaggcaaggcaa

SEQ ID NO: 276475 - DNA, 25 bp, Mus musculus
gcaaggcaaggcgagcctcctagcc

SEQ ID NO: 276476 - DNA, 25 bp, Mus musculus
ggcgagcctcctagccgggcatatc

SEQ ID NO: 276477 - DNA, 25 bp, Mus musculus
gggcatatccgctgcccaccgcttt

SEQ ID NO: 276478 - DNA, 25 bp, Mus musculus
ggaggaccaggacggccaccctgcc

SEQ ID NO: 276479 - DNA, 25 bp, Mus musculus
cgccgcgacctacctgggtgtacgg

SEQ ID NO: 276480 - DNA, 25 bp, Mus musculus
tccgtgaatcgtcgcgtggaaagtg

SEQ ID NO: 276481 - DNA, 25 bp, Mus musculus
gcccgcgctgccctcgctcatcacg

SEQ ID NO: 276482 - DNA, 25 bp, Mus musculus
ctcatcacggctcggcgaggaccct

SEQ ID NO: 276483 - DNA, 25 bp, Mus musculus
ccttgtcgggttccagatgacgtca

SEQ ID NO: 276484 - DNA, 25 bp, Mus musculus
ggccctgccttgtcgggttccagat

SEQ ID NO: 276485 - DNA, 25 bp, Mus musculus
acctacctgggtgtacggcccgctg

SEQ ID NO: 276486 - DNA, 25 bp, Mus musculus
ccggatggccgccagcgtgttctcg

SEQ ID NO: 276487 - DNA, 25 bp, Mus musculus
atcagagtcccggagcttcggcgtt

SEQ ID NO: 276488 - DNA, 25 bp, Mus musculus
tccagccaatcagagtcccggagct

SEQ ID NO: 276489 - DNA, 25 bp, Mus musculus
ggacccatctcgagaaagagcccgc

SEQ ID NO: 276490 - DNA, 25 bp, Mus musculus
gccgacggacccatctcgagaaaga

SEQ ID NO: 276491 - DNA, 25 bp, Mus musculus
agcgctgcacaatggcgccgacgga

SEQ ID NO: 276492 - DNA, 25 bp, Mus musculus
agccggaaccctccgctgggagcag

SEQ ID NO: 276493 - DNA, 25 bp, Mus musculus
aggtactggccacagccggaaccct

SEQ ID NO: 276494 - DNA, 25 bp, Mus musculus
cgtagacgccgaggtactggccaca

SEQ ID NO: 276495 - DNA, 25 bp, Mus musculus
caccagcacgaaggagaaggggccc

SEQ ID NO: 276496 - DNA, 25 bp, Mus musculus
aaggggctgcgtgtcaccaccagca

SEQ ID NO: 276497 - DNA, 25 bp, Mus musculus
accgcagcaggatgtagaggctgcc

SEQ ID NO: 276498 - DNA, 25 bp, Mus musculus
cggtcacggggcttgagcacctgca

SEQ ID NO: 276499 - DNA, 25 bp, Mus musculus
cggcaccggctcgaagctgaagaac

SEQ ID NO: 276500 - DNA, 25 bp, Mus musculus
cgtaaagctcatgtaagcgcttgct

SEQ ID NO: 276501 - DNA, 25 bp, Mus musculus
cggtcacgagcccttgaaggcatcg

SEQ ID NO: 276502 - DNA, 25 bp, Mus musculus
tgagacccggcattggtgtcccgag

SEQ ID NO: 276503 - DNA, 25 bp, Mus musculus
tttcctacgggtctaggctgaggtg

SEQ ID NO: 276504 - DNA, 25 bp, Mus musculus
ctttgcttacagaggaggctggtcc

SEQ ID NO: 276505 - DNA, 25 bp, Mus musculus
ctaaaccgactgaggcctttgctta

SEQ ID NO: 276506 - DNA, 25 bp, Mus musculus
ggaggacctagatgcgctctgtcta

SEQ ID NO: 276507 - DNA, 25 bp, Mus musculus
cgtgcatctcgattgcgtaaagctc

SEQ ID NO: 276508 - DNA, 25 bp, Mus musculus
ccgcctgagggacccgtaatatggc

SEQ ID NO: 276509 - DNA, 25 bp, Mus musculus
atggaggcccaaccgcttcaactgc

SEQ ID NO: 276510 - DNA, 25 bp, Mus musculus
aattgtagtctatggaggcccaacc

SEQ ID NO: 276511 - DNA, 25 bp, Mus musculus
accgcagtgcactttgggaattgta

SEQ ID NO: 276512 - DNA, 25 bp, Mus musculus
gtttggcttccctcggtcacgagcc

SEQ ID NO: 276513 - DNA, 25 bp, Mus musculus
agcgcttgctgatgaccgcagtgca

SEQ ID NO: 276514 - DNA, 25 bp, Mus musculus
acaatcatggcggatgacggagccc

SEQ ID NO: 276515 - DNA, 25 bp, Mus musculus
agcttgggttttgccgggccattgc

SEQ ID NO: 276516 - DNA, 25 bp, Mus musculus
cccgggatcttcagagcggaagctg

SEQ ID NO: 276517 - DNA, 25 bp, Mus musculus
cttcacaatcatggcgtctggggcg

SEQ ID NO: 276518 - DNA, 25 bp, Mus musculus
aggaagttgcccctcacaatcatgg

SEQ ID NO: 276519 - DNA, 25 bp, Mus musculus
gatcggaatccggaggaagttgccc

SEQ ID NO: 276520 - DNA, 25 bp, Mus musculus
ttccctggatgtgagaaaaggggct

SEQ ID NO: 276521 - DNA, 25 bp, Mus musculus
ggccgagcttccctggatgtgagaa

SEQ ID NO: 276522 - DNA, 25 bp, Mus musculus
tacaactgcggaggatcggaatccg

SEQ ID NO: 276523 - DNA, 25 bp, Mus musculus
ttgcccgatacaactgcggaggatc

SEQ ID NO: 276524 - DNA, 25 bp, Mus musculus
ggccattgcccgatacaactgcgga

SEQ ID NO: 276525 - DNA, 25 bp, Mus musculus
agctgcccttcacaatcatggcgtc

SEQ ID NO: 276526 - DNA, 25 bp, Mus musculus
ttttgccgggccattgcccgataca

SEQ ID NO: 276527 - DNA, 25 bp, Mus musculus
gcggaagctgcccttcacaatcatg

SEQ ID NO: 276528 - DNA, 25 bp, Mus musculus
tgggacgatgctgtgtgacactttc

SEQ ID NO: 276529 - DNA, 25 bp, Mus musculus
catcctctttgccatggctgtggag

SEQ ID NO: 276530 - DNA, 25 bp, Mus musculus
acgctcatcctctttgccatggctg

SEQ ID NO: 276531 - DNA, 25 bp, Mus musculus
gccatgacgttcttcggcctggcct

SEQ ID NO: 276532 - DNA, 25 bp, Mus musculus
tttcgccttcgccatgacgttcttc

SEQ ID NO: 276533 - DNA, 25 bp, Mus musculus
atgctgtgtgacactttcgccttcg

SEQ ID NO: 276534 - DNA, 25 bp, Mus musculus
tcgaaacagctctctgctgggcctg

SEQ ID NO: 276535 - DNA, 25 bp, Mus musculus
ttgtggcctatgctcgaaacagctc

SEQ ID NO: 276536 - DNA, 25 bp, Mus musculus
gccctgcagtgtttgtggcctatgc

SEQ ID NO: 276537 - DNA, 25 bp, Mus musculus
cgtgcttcttgagccctgcagtgtt

SEQ ID NO: 276538 - DNA, 25 bp, Mus musculus
atctgctgggcacgtgcttcttgag

SEQ ID NO: 276539 - DNA, 25 bp, Mus musculus
cctttgcggtgttggtcactgggct

SEQ ID NO: 276540 - DNA, 25 bp, Mus musculus
acggaggtcacacccatcggccttt

SEQ ID NO: 276541 - DNA, 25 bp, Mus musculus
cacccatcggcctttgcggtgttgg

SEQ ID NO: 276542 - DNA, 25 bp, Mus musculus
ttgctgtagaaaccgcgtccatggc

SEQ ID NO: 276543 - DNA, 25 bp, Mus musculus
gtgtgaagcttcagggtagagaccc

SEQ ID NO: 276544 - DNA, 25 bp, Mus musculus
aacccggtcagagagttgcgtagtg

SEQ ID NO: 276545 - DNA, 25 bp, Mus musculus
aggctcgcagaaggaaacccggtca

SEQ ID NO: 276546 - DNA, 25 bp, Mus musculus
cgacctcaggcaacaggctcgcaga

SEQ ID NO: 276547 - DNA, 25 bp, Mus musculus
atgtcttggattccggtgcgacctc

SEQ ID NO: 276548 - DNA, 25 bp, Mus musculus
tcacctggttcgctagcaggccaag

SEQ ID NO: 276549 - DNA, 25 bp, Mus musculus
agccttaggcccacacgcggagaaa

SEQ ID NO: 276550 - DNA, 25 bp, Mus musculus
gcgttccaagcctctgtgcgccagg

SEQ ID NO: 276551 - DNA, 25 bp, Mus musculus
aagagcctatgggatcagatctgcg

SEQ ID NO: 276552 - DNA, 25 bp, Mus musculus
gggtctcccgaagtgctcgtgtcac

SEQ ID NO: 276553 - DNA, 25 bp, Mus musculus
gcggattcgccgatcactacgcgca

SEQ ID NO: 276554 - DNA, 25 bp, Mus musculus
tccggaagtcagcttcgactttctg

SEQ ID NO: 276555 - DNA, 25 bp, Mus musculus
cgagacttgtatccagccgcagcgt

SEQ ID NO: 276556 - DNA, 25 bp, Mus musculus
ggacccgcttccactactggctggt

SEQ ID NO: 276557 - DNA, 25 bp, Mus musculus
gccgcaagccgagctattcgcagcg

SEQ ID NO: 276558 - DNA, 25 bp, Mus musculus
gtgcgtgtgctccatgagcgcgccc

SEQ ID NO: 276559 - DNA, 25 bp, Mus musculus
gcagccctagggaggatcgccgcac

SEQ ID NO: 276560 - DNA, 25 bp, Mus musculus
ttccactactggctggtgtcctcgg

SEQ ID NO: 276561 - DNA, 25 bp, Mus musculus
ggctccgcacctgccctcctagata

SEQ ID NO: 276562 - DNA, 25 bp, Mus musculus
ctcctagataggcagctcggttctc

SEQ ID NO: 276563 - DNA, 25 bp, Mus musculus
ggctcctgaagccagagtgtgcacc

SEQ ID NO: 276564 - DNA, 25 bp, Mus musculus
tgaagccagagtgtgcacctccctc

SEQ ID NO: 276565 - DNA, 25 bp, Mus musculus
cctccctcctaggaccgctcagctc

SEQ ID NO: 276566 - DNA, 25 bp, Mus musculus
agccaatcagcagcttcctggatgg

SEQ ID NO: 276567 - DNA, 25 bp, Mus musculus
tcagcagcttcctggatggtgtgtg

SEQ ID NO: 276568 - DNA, 25 bp, Mus musculus
gcctaagccgcaagccgagctattc

SEQ ID NO: 276569 - DNA, 25 bp, Mus musculus
gtgtcctcgggtggctccgcacctg

SEQ ID NO: 276570 - DNA, 25 bp, Mus musculus
ggcccgtacatgtcgtcgccgtact

SEQ ID NO: 276571 - DNA, 25 bp, Mus musculus
gcactgacgcgagaggtacacatcc

SEQ ID NO: 276572 - DNA, 25 bp, Mus musculus
catccgaacgggttttagcacactc

SEQ ID NO: 276573 - DNA, 25 bp, Mus musculus
tccctggtccacagaaggcaatcga

SEQ ID NO: 276574 - DNA, 25 bp, Mus musculus
caatcgagacgtgggagtcactgtc

SEQ ID NO: 276575 - DNA, 25 bp, Mus musculus
caccaggcacatgaccgcaatagta

SEQ ID NO: 276576 - DNA, 25 bp, Mus musculus
gtactggcgctttgaagcaactgcc

SEQ ID NO: 276577 - DNA, 25 bp, Mus musculus
cgccgtactcgttgagcaggctgta

SEQ ID NO: 276578 - DNA, 25 bp, Mus musculus
gcgctcgttcatgttgcaggtgatg

SEQ ID NO: 276579 - DNA, 25 bp, Mus musculus
actgggatttgcctttgcgctttcc

SEQ ID NO: 276580 - DNA, 25 bp, Mus musculus
ggtggtcgccatgcttcctactatc

SEQ ID NO: 276581 - DNA, 25 bp, Mus musculus
acgttccttggcgtcttcgtctgcg

SEQ ID NO: 276582 - DNA, 25 bp, Mus musculus
cacgtacgcgacagtttgcccaagc

SEQ ID NO: 276583 - DNA, 25 bp, Mus musculus
gcggggtcattcaagcactgtactg

SEQ ID NO: 276584 - DNA, 25 bp, Mus musculus
taagtataaaaacgcgagaagccgc

SEQ ID NO: 276585 - DNA, 25 bp, Mus musculus
cgctccgcatagcaaccaatcagaa

SEQ ID NO: 276586 - DNA, 25 bp, Mus musculus
agctggcgacgctccgcatagcaac

SEQ ID NO: 276587 - DNA, 25 bp, Mus musculus
cagaatgcaacatgtccttcctagc

SEQ ID NO: 276588 - DNA, 25 bp, Mus musculus
cccgcaggaggaagttcaggcgttt

SEQ ID NO: 276589 - DNA, 25 bp, Mus musculus
cgtttgctaagcagagctaagtata

SEQ ID NO: 276590 - DNA, 25 bp, Mus musculus
agaagccgcggtgccaaattacgga

SEQ ID NO: 276591 - DNA, 25 bp, Mus musculus
gccaaattacggacaggaggacgga

SEQ ID NO: 276592 - DNA, 25 bp, Mus musculus
cggaagtagctgagaagccatgttt

SEQ ID NO: 276593 - DNA, 25 bp, Mus musculus
tttgttaggggcagacttcactccg

SEQ ID NO: 276594 - DNA, 25 bp, Mus musculus
gtgccgctcgcgcacactgtttgtt

SEQ ID NO: 276595 - DNA, 25 bp, Mus musculus
ttatctcttgtttaagggcgtgggc

SEQ ID NO: 276596 - DNA, 25 bp, Mus musculus
ttggcaaccaatcagggccggggca

SEQ ID NO: 276597 - DNA, 25 bp, Mus musculus
acactgtttgttactgggtggcctc

SEQ ID NO: 276598 - DNA, 25 bp, Mus musculus
ctgtctcaccgcgtcccaggcctcc

SEQ ID NO: 276599 - DNA, 25 bp, Mus musculus
tgagctgcagcctccgcgaacgaac

SEQ ID NO: 276600 - DNA, 25 bp, Mus musculus
tgaggctgacaccagcgagcgtgtc

SEQ ID NO: 276601 - DNA, 25 bp, Mus musculus
cacctgaggctgacaccagcgagcg

SEQ ID NO: 276602 - DNA, 25 bp, Mus musculus
ggccacctgaggctgacaccagcga

SEQ ID NO: 276603 - DNA, 25 bp, Mus musculus
tggaggccacctgaggctgacacca

SEQ ID NO: 276604 - DNA, 25 bp, Mus musculus
cttgtggaggccacctgaggctgac

SEQ ID NO: 276605 - DNA, 25 bp, Mus musculus
gcttgctcagcagttccaggtcagc

SEQ ID NO: 276606 - DNA, 25 bp, Mus musculus
ccgcttgctcagcagttccaggtca

SEQ ID NO: 276607 - DNA, 25 bp, Mus musculus
cgccgcttgctcagcagttccaggt

SEQ ID NO: 276608 - DNA, 25 bp, Mus musculus
tgcgccgcttgctcagcagttccag

SEQ ID NO: 276609 - DNA, 25 bp, Mus musculus
gcttgcgcccgatttcgggtgttcc

SEQ ID NO: 276610 - DNA, 25 bp, Mus musculus
ggcttgcgcccgatttcgggtgttc

SEQ ID NO: 276611 - DNA, 25 bp, Mus musculus
aggctgacaccagcgagcgtgtccc

SEQ ID NO: 276612 - DNA, 25 bp, Mus musculus
ggtaaactggtttgagccgcttcaa

SEQ ID NO: 276613 - DNA, 25 bp, Mus musculus
cgacgcgcctcagggagcgctttaa

SEQ ID NO: 276614 - DNA, 25 bp, Mus musculus
tcctccaacttgtcgcgaatggcga

SEQ ID NO: 276615 - DNA, 25 bp, Mus musculus
gaccagggcccttttcagatccaga

SEQ ID NO: 276616 - DNA, 25 bp, Mus musculus
gaccaaacgactgcggatgaacacc

SEQ ID NO: 276617 - DNA, 25 bp, Mus musculus
aacgtaccgcgccagtctcttggtc

SEQ ID NO: 276618 - DNA, 25 bp, Mus musculus
ccctgggtttcgcagagttcaacgg

SEQ ID NO: 276619 - DNA, 25 bp, Mus musculus
gcgctttaaacttcgcgacggctta

SEQ ID NO: 276620 - DNA, 25 bp, Mus musculus
tcgcgacggcttaaattgaggaaag

SEQ ID NO: 276621 - DNA, 25 bp, Mus musculus
ttgcgagggccaagagtggtaaact

SEQ ID NO: 276622 - DNA, 25 bp, Mus musculus
gccgcttcaagagacaaaccaaccg

SEQ ID NO: 276623 - DNA, 25 bp, Mus musculus
accgtcactcctgtctagcgctttg

SEQ ID NO: 276624 - DNA, 25 bp, Mus musculus
tctagcgctttgctggagagaggcc

SEQ ID NO: 276625 - DNA, 25 bp, Mus musculus
aggcgtaggtctgtggccttttttg

SEQ ID NO: 276626 - DNA, 25 bp, Mus musculus
gaaaagcaggagtgacgctgagtga

SEQ ID NO: 276627 - DNA, 25 bp, Mus musculus
cgactggtgtcatcgctgctggcct

SEQ ID NO: 276628 - DNA, 25 bp, Mus musculus
tggcctactggacctgctggataca

SEQ ID NO: 276629 - DNA, 25 bp, Mus musculus
cctgctggatacagcccggtgtggc

SEQ ID NO: 276630 - DNA, 25 bp, Mus musculus
atacagcccggtgtggccaaggctc

SEQ ID NO: 276631 - DNA, 25 bp, Mus musculus
gtggccaaggctcggcagagctcct

SEQ ID NO: 276632 - DNA, 25 bp, Mus musculus
aaggctcggcagagctcctggcacc

SEQ ID NO: 276633 - DNA, 25 bp, Mus musculus
taaggatggagacgccggctccagt

SEQ ID NO: 276634 - DNA, 25 bp, Mus musculus
cttcccagggccagggatgagatgc

SEQ ID NO: 276635 - DNA, 25 bp, Mus musculus
atgagatgccggtgtggggttgcta

SEQ ID NO: 276636 - DNA, 25 bp, Mus musculus
gctaggagacgcgcctgtatgaccc

SEQ ID NO: 276637 - DNA, 25 bp, Mus musculus
cctcgcgagggcgactggtgtcatc

SEQ ID NO: 276638 - DNA, 25 bp, Mus musculus
tgtaaggatggagacgccggctcca

SEQ ID NO: 276639 - DNA, 25 bp, Mus musculus
ctgtatgaccccagcctcgcgaggg

SEQ ID NO: 276640 - DNA, 25 bp, Mus musculus
ttctgggttggtgatgaactttgtc

SEQ ID NO: 276641 - DNA, 25 bp, Mus musculus
actttgtcgcctggagttgctgggc

SEQ ID NO: 276642 - DNA, 25 bp, Mus musculus
tgttgttgccgtcggcttctgggtt

SEQ ID NO: 276643 - DNA, 25 bp, Mus musculus
actagcttccttcgcctgttgttgc

SEQ ID NO: 276644 - DNA, 25 bp, Mus musculus
gtcgcgggagaaaagcactagcttc

SEQ ID NO: 276645 - DNA, 25 bp, Mus musculus
tgaagcctcccagctcggcctggga

SEQ ID NO: 276646 - DNA, 25 bp, Mus musculus
ccagcaccaggtgagagcaaagatg

SEQ ID NO: 276647 - DNA, 25 bp, Mus musculus
aatcaggcctgcgtcccttcttgtc

SEQ ID NO: 276648 - DNA, 25 bp, Mus musculus
cggccttagaggaagagcgcttgct

SEQ ID NO: 276649 - DNA, 25 bp, Mus musculus
cagcgtcagagctcagcaaggaaga

SEQ ID NO: 276650 - DNA, 25 bp, Mus musculus
acccaagcctggacagatggtcagc

SEQ ID NO: 276651 - DNA, 25 bp, Mus musculus
ggatccttcccagtcgggctgggta

SEQ ID NO: 276652 - DNA, 25 bp, Mus musculus
cggctagccatctagataccggatc

SEQ ID NO: 276653 - DNA, 25 bp, Mus musculus
tgtcttccttccacttcgctttgcg

SEQ ID NO: 276654 - DNA, 25 bp, Mus musculus
tactatagttagaagccaggtctta

SEQ ID NO: 276655 - DNA, 25 bp, Mus musculus
gccttgaacagacaaatatggatga

SEQ ID NO: 276656 - DNA, 25 bp, Mus musculus
attatttactttgggaggtcgctcg

SEQ ID NO: 276657 - DNA, 25 bp, Mus musculus
gctttaaattaatagtgcacaaata

SEQ ID NO: 276658 - DNA, 25 bp, Mus musculus
cacacaaaatgatcttaagggtttt

SEQ ID NO: 276659 - DNA, 25 bp, Mus musculus
agagtttgctcctagcactgccctc

SEQ ID NO: 276660 - DNA, 25 bp, Mus musculus
tatgtgtaagagtttgctcctagca

SEQ ID NO: 276661 - DNA, 25 bp, Mus musculus
tgacaattccgttatgccttgaaca

SEQ ID NO: 276662 - DNA, 25 bp, Mus musculus
cgcagtggactcatcttgacaattc

SEQ ID NO: 276663 - DNA, 25 bp, Mus musculus
aggaaaggacagacgcagtggactc

SEQ ID NO: 276664 - DNA, 25 bp, Mus musculus
agctggccttcctttcaggaggaaa

SEQ ID NO: 276665 - DNA, 25 bp, Mus musculus
gtgatgttgcccattctgaagaaga

SEQ ID NO: 276666 - DNA, 25 bp, Mus musculus
gaggcctcggtgatgttgcccattc

SEQ ID NO: 276667 - DNA, 25 bp, Mus musculus
cattctgaagaagaagctggccttc

SEQ ID NO: 276668 - DNA, 25 bp, Mus musculus
cctttgttgtttgggggttctcatg

SEQ ID NO: 276669 - DNA, 25 bp, Mus musculus
cgagcagcctcacatcagcggcgtc

SEQ ID NO: 276670 - DNA, 25 bp, Mus musculus
aaaagctttggttcgatcgggagcg

SEQ ID NO: 276671 - DNA, 25 bp, Mus musculus
tggtactaaaagctttggttcgatc

SEQ ID NO: 276672 - DNA, 25 bp, Mus musculus
tagatgtagtacaatcctggtacta

SEQ ID NO: 276673 - DNA, 25 bp, Mus musculus
ctcaattagatgtagtacaatcctg

SEQ ID NO: 276674 - DNA, 25 bp, Mus musculus
gatccctttagccaacaactcaatt

SEQ ID NO: 276675 - DNA, 25 bp, Mus musculus
gggttctcatgggatccctttagcc

SEQ ID NO: 276676 - DNA, 25 bp, Mus musculus
ctgagagcagcctttgttgtttggg

SEQ ID NO: 276677 - DNA, 25 bp, Mus musculus
agttttctgagagcagcctttgttg

SEQ ID NO: 276678 - DNA, 25 bp, Mus musculus
gggccttgctgtcagttttctgaga

SEQ ID NO: 276679 - DNA, 25 bp, Mus musculus
acaaaggggccttgctgtcagtttt

SEQ ID NO: 276680 - DNA, 25 bp, Mus musculus
tttgtcttcaacaaaggggccttgc

SEQ ID NO: 276681 - DNA, 25 bp, Mus musculus
atgggatccctttagccaacaactc

SEQ ID NO: 276682 - DNA, 25 bp, Mus musculus
ctgcttatctcagtgccggcacctt

SEQ ID NO: 276683 - DNA, 25 bp, Mus musculus
tcacaaacgcggtgcgctgcttatc

SEQ ID NO: 276684 - DNA, 25 bp, Mus musculus
cccaatgcgtgcgagtttattaaat

SEQ ID NO: 276685 - DNA, 25 bp, Mus musculus
ctcgggagattcctgaaggtcactc

SEQ ID NO: 276686 - DNA, 25 bp, Mus musculus
gctcgcagtgcacaccgggaaactc

SEQ ID NO: 276687 - DNA, 25 bp, Mus musculus
tcccgcctaccggagcagtagagca

SEQ ID NO: 276688 - DNA, 25 bp, Mus musculus
gctgcaatctagtccgggagacctc

SEQ ID NO: 276689 - DNA, 25 bp, Mus musculus
actcccggacttgcgaggactcacg

SEQ ID NO: 276690 - DNA, 25 bp, Mus musculus
ccagtttctgtgaactcggtcacca

SEQ ID NO: 276691 - DNA, 25 bp, Mus musculus
acgagacattcgtcctgccagtttc

SEQ ID NO: 276692 - DNA, 25 bp, Mus musculus
cggcaaggagacctacaagtgtgtc

SEQ ID NO: 276693 - DNA, 25 bp, Mus musculus
gtccttgctggtgacgatctccttg

SEQ ID NO: 276694 - DNA, 25 bp, Mus musculus
gtcctgtgagcagccgagagctaac

SEQ ID NO: 276695 - DNA, 25 bp, Mus musculus
cggcaccttcgttcctgtcagtact

SEQ ID NO: 276696 - DNA, 25 bp, Mus musculus
actcaccatggcgaggcaccggtat

SEQ ID NO: 276697 - DNA, 25 bp, Mus musculus
agcacgacctgtgtggctctgtgga

SEQ ID NO: 276698 - DNA, 25 bp, Mus musculus
cctgcaatgcgtcaaactggggcga

SEQ ID NO: 276699 - DNA, 25 bp, Mus musculus
acgcaactccgattggtccggcctt

SEQ ID NO: 276700 - DNA, 25 bp, Mus musculus
gtggcggaaatgagaacgcaactcc

SEQ ID NO: 276701 - DNA, 25 bp, Mus musculus
ttggacccgcctcgtggcggaaatg

SEQ ID NO: 276702 - DNA, 25 bp, Mus musculus
gtctctgtgtgagccacgccgctat

SEQ ID NO: 276703 - DNA, 25 bp, Mus musculus
ggcaccggtttacggagagtgacac

SEQ ID NO: 276704 - DNA, 25 bp, Mus musculus
cgctttcctctctggcggaagggca

SEQ ID NO: 276705 - DNA, 25 bp, Mus musculus
ggactactttcgctctcggcgctct

SEQ ID NO: 276706 - DNA, 25 bp, Mus musculus
cagcgaatctgctgccgcacgggca

SEQ ID NO: 276707 - DNA, 25 bp, Mus musculus
ttccacagagcccagcgaatctgct

SEQ ID NO: 276708 - DNA, 25 bp, Mus musculus
gctgcactgcggcttcctacggatc

SEQ ID NO: 276709 - DNA, 25 bp, Mus musculus
tacggatcccttcgcgtcaggctcg

SEQ ID NO: 276710 - DNA, 25 bp, Mus musculus
tccaagacccaattcagaggcggcg

SEQ ID NO: 276711 - DNA, 25 bp, Mus musculus
ctgctgccacacaggtggtgcctgc

SEQ ID NO: 276712 - DNA, 25 bp, Mus musculus
ctgccacacaggtggtgcctgcctt

SEQ ID NO: 276713 - DNA, 25 bp, Mus musculus
aagacccaattcagaggcggcggct

SEQ ID NO: 276714 - DNA, 25 bp, Mus musculus
cagcatgctcgctcagcgctcagcg

SEQ ID NO: 276715 - DNA, 25 bp, Mus musculus
tgccctccaagacccaattcagagg

SEQ ID NO: 276716 - DNA, 25 bp, Mus musculus
agtgcagagcggaatgtggtggctg

SEQ ID NO: 276717 - DNA, 25 bp, Mus musculus
gagccaggtgagtgcagagcggaat

SEQ ID NO: 276718 - DNA, 25 bp, Mus musculus
cgcacgcatcgctgcgggagcccga

SEQ ID NO: 276719 - DNA, 25 bp, Mus musculus
aggcgctggacgcacgcatcgctgc

SEQ ID NO: 276720 - DNA, 25 bp, Mus musculus
caagaggcgctggacgcacgcatcg

SEQ ID NO: 276721 - DNA, 25 bp, Mus musculus
gcgcggagacccaagaggcgctgga

SEQ ID NO: 276722 - DNA, 25 bp, Mus musculus
ggtgcctgccttggcgcggagaccc

SEQ ID NO: 276723 - DNA, 25 bp, Mus musculus
ggctgcacgcagcatgctcgctcag

SEQ ID NO: 276724 - DNA, 25 bp, Mus musculus
gctgttgcatcgtgctgacgctcct

SEQ ID NO: 276725 - DNA, 25 bp, Mus musculus
tcgcccacgtagtagctcgctatct

SEQ ID NO: 276726 - DNA, 25 bp, Mus musculus
ggaaaggctctgagcccgaccacga

SEQ ID NO: 276727 - DNA, 25 bp, Mus musculus
acttcctagggctgcagcctttgca

SEQ ID NO: 276728 - DNA, 25 bp, Mus musculus
cggcctggccctgtacttcctaggg

SEQ ID NO: 276729 - DNA, 25 bp, Mus musculus
tgctgctactgttcgccctgctcgg

SEQ ID NO: 276730 - DNA, 25 bp, Mus musculus
gagcgatatgtgcaggccacgaccc

SEQ ID NO: 276731 - DNA, 25 bp, Mus musculus
ttcgccgacgcagtggagcgatatg

SEQ ID NO: 276732 - DNA, 25 bp, Mus musculus
cgccggacaagttcagcttcgccga

SEQ ID NO: 276733 - DNA, 25 bp, Mus musculus
aaggcccgcactcaacttggttatg

SEQ ID NO: 276734 - DNA, 25 bp, Mus musculus
ggccgtgacgcacactttccagatt

SEQ ID NO: 276735 - DNA, 25 bp, Mus musculus
ctcaacttggttatgcgccggacaa

SEQ ID NO: 276736 - DNA, 25 bp, Mus musculus
ctatctttctacctggcttgacctc

SEQ ID NO: 276737 - DNA, 25 bp, Mus musculus
actttccagattgccaaggcccgca

SEQ ID NO: 276738 - DNA, 25 bp, Mus musculus
gatcatcttcgaggacgaccgggta

SEQ ID NO: 276739 - DNA, 25 bp, Mus musculus
tccgcccatttcgttccctcgctcg

SEQ ID NO: 276740 - DNA, 25 bp, Mus musculus
ccgcgatggctgacgagattgccaa

SEQ ID NO: 276741 - DNA, 25 bp, Mus musculus
ggctgacgagattgccaaggctcaa

SEQ ID NO: 276742 - DNA, 25 bp, Mus musculus
ttgccaaggctcaagtggcccagcc

SEQ ID NO: 276743 - DNA, 25 bp, Mus musculus
ccggcggcgacacgatcttcggcaa

SEQ ID NO: 276744 - DNA, 25 bp, Mus musculus
ggcgacacgatcttcggcaagatca

SEQ ID NO: 276745 - DNA, 25 bp, Mus musculus
cccgccaagatcatcttcgaggacg

SEQ ID NO: 276746 - DNA, 25 bp, Mus musculus
atcttcgaggacgaccgggtaggct

SEQ ID NO: 276747 - DNA, 25 bp, Mus musculus
cgaccgggtaggcttgccgcttgcc

SEQ ID NO: 276748 - DNA, 25 bp, Mus musculus
taggcttgccgcttgcccggcgaca

SEQ ID NO: 276749 - DNA, 25 bp, Mus musculus
gcctgcgctcgggttacgcgttatc

SEQ ID NO: 276750 - DNA, 25 bp, Mus musculus
gttacgcgttatcggccgctcggcc

SEQ ID NO: 276751 - DNA, 25 bp, Mus musculus
cggcaagatcatccgcaaagaaatc

SEQ ID NO: 276752 - DNA, 25 bp, Mus musculus
ccaaggggctgagcattcgtatgca

SEQ ID NO: 276753 - DNA, 25 bp, Mus musculus
gatctgacttgggaattctccttgg

SEQ ID NO: 276754 - DNA, 25 bp, Mus musculus
gactgatcgcgtgcgtttcggaaga

SEQ ID NO: 276755 - DNA, 25 bp, Mus musculus
cagctgcgccctgtgtgtgactgat

SEQ ID NO: 276756 - DNA, 25 bp, Mus musculus
gattgcgggaaacctgcccagctgc

SEQ ID NO: 276757 - DNA, 25 bp, Mus musculus
ccctgggccaaaactagctagtgtc

SEQ ID NO: 276758 - DNA, 25 bp, Mus musculus
gagtatttctgcgtcctccgcgatg

SEQ ID NO: 276759 - DNA, 25 bp, Mus musculus
acgcccttgcagcattgttggttga

SEQ ID NO: 276760 - DNA, 25 bp, Mus musculus
acctcgaggtctgagctgcatacgc

SEQ ID NO: 276761 - DNA, 25 bp, Mus musculus
cgggcctcagttctcggaacctcga

SEQ ID NO: 276762 - DNA, 25 bp, Mus musculus
agcgcagttctggttgcaccaggca

SEQ ID NO: 276763 - DNA, 25 bp, Mus musculus
ccgaggctcagtgtttgcgtctgta

SEQ ID NO: 276764 - DNA, 25 bp, Mus musculus
ctttgccagctccttgggatccttg

SEQ ID NO: 276765 - DNA, 25 bp, Mus musculus
cgcgcctgccacactgtgggaggta

SEQ ID NO: 276766 - DNA, 25 bp, Mus musculus
cgctgctgactaggccagacaggcc

SEQ ID NO: 276767 - DNA, 25 bp, Mus musculus
gctgactcaggcttcggccgcgctg

SEQ ID NO: 276768 - DNA, 25 bp, Mus musculus
agagtggcgactgcttcgtggaccc

SEQ ID NO: 276769 - DNA, 25 bp, Mus musculus
ctgtgtttaagcagagtggcgactg

SEQ ID NO: 276770 - DNA, 25 bp, Mus musculus
cgcctcattcattgatctgtgttta

SEQ ID NO: 276771 - DNA, 25 bp, Mus musculus
ggcccgggacgcctcattcattgat

SEQ ID NO: 276772 - DNA, 25 bp, Mus musculus
tggtcaactctgcttagcccgagcg

SEQ ID NO: 276773 - DNA, 25 bp, Mus musculus
caggggtcgttgaacctggtcaact

SEQ ID NO: 276774 - DNA, 25 bp, Mus musculus
ggaacatggccgctgcctgatagaa

SEQ ID NO: 276775 - DNA, 25 bp, Mus musculus
ctgagcaccggcgacatggagaaag

SEQ ID NO: 276776 - DNA, 25 bp, Mus musculus
tgcctgatagaagacccggccgccg

SEQ ID NO: 276777 - DNA, 25 bp, Mus musculus
gcggagtttctccagcaggaacatg

SEQ ID NO: 276778 - DNA, 25 bp, Mus musculus
atgtgcgctctctgcaccacgagca

SEQ ID NO: 276779 - DNA, 25 bp, Mus musculus
tctaggttccttctgcgagcgcagc

SEQ ID NO: 276780 - DNA, 25 bp, Mus musculus
gactcatggtccgtcgggaagttaa

SEQ ID NO: 276781 - DNA, 25 bp, Mus musculus
ggtggtcgtaccacggctcatcctc

SEQ ID NO: 276782 - DNA, 25 bp, Mus musculus
ctccactaggttatctgccagcatg

SEQ ID NO: 276783 - DNA, 25 bp, Mus musculus
aacgtggcactttggcagaaccctc

SEQ ID NO: 276784 - DNA, 25 bp, Mus musculus
ggcaccttgaccaatcacgaatgag

SEQ ID NO: 276785 - DNA, 25 bp, Mus musculus
aatgagccgcctatagagtgacagc

SEQ ID NO: 276786 - DNA, 25 bp, Mus musculus
agtgacagcgacttcagccaataga

SEQ ID NO: 276787 - DNA, 25 bp, Mus musculus
gtccgaggaccatcagccaataata

SEQ ID NO: 276788 - DNA, 25 bp, Mus musculus
cgtcgcgtctcctcagttgagtgca

SEQ ID NO: 276789 - DNA, 25 bp, Mus musculus
ccgggtgccgaggactactaattct

SEQ ID NO: 276790 - DNA, 25 bp, Mus musculus
ctaattctgggcacgggtcatcatc

SEQ ID NO: 276791 - DNA, 25 bp, Mus musculus
ttaaagcaccgagcatcagcctgtg

SEQ ID NO: 276792 - DNA, 25 bp, Mus musculus
ggtcatcatcttcccacccgagggt

SEQ ID NO: 276793 - DNA, 25 bp, Mus musculus
acccggcaagcgctttcttaaagca

SEQ ID NO: 276794 - DNA, 25 bp, Mus musculus
cctcctgcgtttgtacgtgcaccgg

SEQ ID NO: 276795 - DNA, 25 bp, Mus musculus
cggatcttccgccattatgagtcca

SEQ ID NO: 276796 - DNA, 25 bp, Mus musculus
tttgtacgtgcaccgggtggaaaca

SEQ ID NO: 276797 - DNA, 25 bp, Mus musculus
caccgggtggaaacacgacctggag

SEQ ID NO: 276798 - DNA, 25 bp, Mus musculus
cacgacctggagtcgttggcgttcc

SEQ ID NO: 276799 - DNA, 25 bp, Mus musculus
acttggcggcgatggctcgagctcc

SEQ ID NO: 276800 - DNA, 25 bp, Mus musculus
tcccgctccctgtacgtgaacatga

SEQ ID NO: 276801 - DNA, 25 bp, Mus musculus
tgtacgtgaacatgactagcggccc

SEQ ID NO: 276802 - DNA, 25 bp, Mus musculus
gcgggaaggacacgcaccaggtact

SEQ ID NO: 276803 - DNA, 25 bp, Mus musculus
gacacgcaccaggtactgggccgca

SEQ ID NO: 276804 - DNA, 25 bp, Mus musculus
cacggcgccttttgttcggcggcgc

SEQ ID NO: 276805 - DNA, 25 bp, Mus musculus
gggacagcctttgctgcctggctcc

SEQ ID NO: 276806 - DNA, 25 bp, Mus musculus
cccggtctccgctcattgggcaggg

SEQ ID NO: 276807 - DNA, 25 bp, Mus musculus
gccattatgagtccaggcggcgcca

SEQ ID NO: 276808 - DNA, 25 bp, Mus musculus
tgtccagagccctcatcgcttaata

SEQ ID NO: 276809 - DNA, 25 bp, Mus musculus
ctgacgtcaggcgactccttaaata

SEQ ID NO: 276810 - DNA, 25 bp, Mus musculus
tccttaaatagagccggtagcgcgc

SEQ ID NO: 276811 - DNA, 25 bp, Mus musculus
atttcccgaggagccagaacgcggc

SEQ ID NO: 276812 - DNA, 25 bp, Mus musculus
acccgacgcgcgtgagaatcgaaga

SEQ ID NO: 276813 - DNA, 25 bp, Mus musculus
ctaggcaatcgcagagccacgcagc

SEQ ID NO: 276814 - DNA, 25 bp, Mus musculus
gcaggtgccacctcggaaaccatga

SEQ ID NO: 276815 - DNA, 25 bp, Mus musculus
cgggcccatggagctatggcctata

SEQ ID NO: 276816 - DNA, 25 bp, Mus musculus
tgtccttgtcctgcacttacctgtg

SEQ ID NO: 276817 - DNA, 25 bp, Mus musculus
aacttctggcgaagtcccgcccgtg

SEQ ID NO: 276818 - DNA, 25 bp, Mus musculus
agccctcattgtgggcgtcaagaaa

SEQ ID NO: 276819 - DNA, 25 bp, Mus musculus
tgctggagtttatccgcgtgcaccc

SEQ ID NO: 276820 - DNA, 25 bp, Mus musculus
taataccgggagatgctggcaatgc

SEQ ID NO: 276821 - DNA, 25 bp, Mus musculus
gagatgatatcccttacgcccaacg

SEQ ID NO: 276822 - DNA, 25 bp, Mus musculus
ccctcgacggatcttcaacatgtca

SEQ ID NO: 276823 - DNA, 25 bp, Mus musculus
agctatttcgtcactcaagaagccc

SEQ ID NO: 276824 - DNA, 25 bp, Mus musculus
cgcccagctatttcgtcactcaaga

SEQ ID NO: 276825 - DNA, 25 bp, Mus musculus
cggatcttcaacatgtcacgagaca

SEQ ID NO: 276826 - DNA, 25 bp, Mus musculus
gtcacgagacaccaagctgatagtg

SEQ ID NO: 276827 - DNA, 25 bp, Mus musculus
tgcggaacccagtgacccgagccat

SEQ ID NO: 276828 - DNA, 25 bp, Mus musculus
gtgacccgagccatctctgactaca

SEQ ID NO: 276829 - DNA, 25 bp, Mus musculus
cgcagactctttccaagaagccgga

SEQ ID NO: 276830 - DNA, 25 bp, Mus musculus
actctttccaagaagccggacatcc

SEQ ID NO: 276831 - DNA, 25 bp, Mus musculus
tgtccttccgcaaccgcagtctagg

SEQ ID NO: 276832 - DNA, 25 bp, Mus musculus
tccgcaaccgcagtctaggcctggt

SEQ ID NO: 276833 - DNA, 25 bp, Mus musculus
agtctaggcctggtggacgtgtctt

SEQ ID NO: 276834 - DNA, 25 bp, Mus musculus
tggacgtgtcttggaacgctatccg

SEQ ID NO: 276835 - DNA, 25 bp, Mus musculus
tctctgactacacgcagactctttc

SEQ ID NO: 276836 - DNA, 25 bp, Mus musculus
ctcaccttgaagtcgcggctgtgtt

SEQ ID NO: 276837 - DNA, 25 bp, Mus musculus
cttgctgaacgagcgcttctccttc

SEQ ID NO: 276838 - DNA, 25 bp, Mus musculus
gcggctcatgaaactgcccaccgag

SEQ ID NO: 276839 - DNA, 25 bp, Mus musculus
cagcgtcttgaggacgcggctcatg

SEQ ID NO: 276840 - DNA, 25 bp, Mus musculus
catgaagcacgtgttgccgtggttg

SEQ ID NO: 276841 - DNA, 25 bp, Mus musculus
ctgcagcgtggcgttcatgaagcac

SEQ ID NO: 276842 - DNA, 25 bp, Mus musculus
agctcggtgttactgaggcactgca

SEQ ID NO: 276843 - DNA, 25 bp, Mus musculus
actcggcgaagagctcggtgttact

SEQ ID NO: 276844 - DNA, 25 bp, Mus musculus
tgcggggtgtactccagcgtccaga

SEQ ID NO: 276845 - DNA, 25 bp, Mus musculus
aggagcccaagaagcgcccgagctc

SEQ ID NO: 276846 - DNA, 25 bp, Mus musculus
gcccaagtgggcagctcacgtgact

SEQ ID NO: 276847 - DNA, 25 bp, Mus musculus
ccgttaccttggacatggcggcggt

SEQ ID NO: 276848 - DNA, 25 bp, Mus musculus
cccagagccaggtactcggcgaaga

SEQ ID NO: 276849 - DNA, 25 bp, Mus musculus
cactccggaacagccgcttgctgaa

SEQ ID NO: 276850 - DNA, 25 bp, Mus musculus
ccagccgtgacccttcagttcagaa

SEQ ID NO: 276851 - DNA, 25 bp, Mus musculus
tatttccgaatagcaccgtggcatg

SEQ ID NO: 276852 - DNA, 25 bp, Mus musculus
gtcctggcttcggaggttcaaccta

SEQ ID NO: 276853 - DNA, 25 bp, Mus musculus
cttcccagactgcagcgagtcagtg

SEQ ID NO: 276854 - DNA, 25 bp, Mus musculus
ttgccgcaaaactacgcgccaggtc

SEQ ID NO: 276855 - DNA, 25 bp, Mus musculus
agctggcacgaagcagacggctttt

SEQ ID NO: 276856 - DNA, 25 bp, Mus musculus
agcccttgactgcagcgttgcgata

SEQ ID NO: 276857 - DNA, 25 bp, Mus musculus
cccacttgaagagcatgcgtttgac

SEQ ID NO: 276858 - DNA, 25 bp, Mus musculus
tctcggatcttctctgcctagctca

SEQ ID NO: 276859 - DNA, 25 bp, Mus musculus
gctgagacatccagagcttggcttg

SEQ ID NO: 276860 - DNA, 25 bp, Mus musculus
tcagaaaggtaagcccagccgcgtc

SEQ ID NO: 276861 - DNA, 25 bp, Mus musculus
gaggagcgtctccagactgtacaca

SEQ ID NO: 276862 - DNA, 25 bp, Mus musculus
gccttctccgggctaagacaagtcg

SEQ ID NO: 276863 - DNA, 25 bp, Mus musculus
aaagattattctgtccacgggtggc

SEQ ID NO: 276864 - DNA, 25 bp, Mus musculus
gttactatggagacggggactagca

SEQ ID NO: 276865 - DNA, 25 bp, Mus musculus
ggacagcccggagaaagtacacgta

SEQ ID NO: 276866 - DNA, 25 bp, Mus musculus
agtcacctaggttgtcagggacaaa

SEQ ID NO: 276867 - DNA, 25 bp, Mus musculus
cggtgtccagtcacctaggttgtca

SEQ ID NO: 276868 - DNA, 25 bp, Mus musculus
tgtactccaccagcggtgtccagtc

SEQ ID NO: 276869 - DNA, 25 bp, Mus musculus
cagcccggagaaagtacacgtaagc

SEQ ID NO: 276870 - DNA, 25 bp, Mus musculus
tgcgttgatcgtcgccctcctgtac

SEQ ID NO: 276871 - DNA, 25 bp, Mus musculus
acgcccaccaggtgcgttgatcgtc

SEQ ID NO: 276872 - DNA, 25 bp, Mus musculus
acaggcgagccgctgctctcactca

SEQ ID NO: 276873 - DNA, 25 bp, Mus musculus
gcgcttcactccagactccgcggga

SEQ ID NO: 276874 - DNA, 25 bp, Mus musculus
tctagacccgggtacgcgcttcact

SEQ ID NO: 276875 - DNA, 25 bp, Mus musculus
cccgctgagcgtctagacccgggta

SEQ ID NO: 276876 - DNA, 25 bp, Mus musculus
ctgcagcctgcagtgttactatgga

SEQ ID NO: 276877 - DNA, 25 bp, Mus musculus
gcagaccgaggctgccgttccgcag

SEQ ID NO: 276878 - DNA, 25 bp, Mus musculus
acctcacactggagcagcttcctaa

SEQ ID NO: 276879 - DNA, 25 bp, Mus musculus
gttccgtccccgacagcgactgaga

SEQ ID NO: 276880 - DNA, 25 bp, Mus musculus
acccgggcaatgaccgcagttccgt

SEQ ID NO: 276881 - DNA, 25 bp, Mus musculus
gcgcacccgggcaatgaccgcagtt

SEQ ID NO: 276882 - DNA, 25 bp, Mus musculus
aggtatgacagcgacctccgcgcgc

SEQ ID NO: 276883 - DNA, 25 bp, Mus musculus
cctaaacaggtatgacagcgacctc

SEQ ID NO: 276884 - DNA, 25 bp, Mus musculus
actggagcagcttcctaaacaggta

SEQ ID NO: 276885 - DNA, 25 bp, Mus musculus
ttagctgccatcacctcacactgga

SEQ ID NO: 276886 - DNA, 25 bp, Mus musculus
ggacgccaccaccttagctgccatc

SEQ ID NO: 276887 - DNA, 25 bp, Mus musculus
acagccactcggacgccaccacctt

SEQ ID NO: 276888 - DNA, 25 bp, Mus musculus
aggtgacccagctccacagccactc

SEQ ID NO: 276889 - DNA, 25 bp, Mus musculus
cagcgtcccgggctctacaggtgac

SEQ ID NO: 276890 - DNA, 25 bp, Mus musculus
tccgctctccctccgcctacagcgt

SEQ ID NO: 276891 - DNA, 25 bp, Mus musculus
ggagcagcttcctaaacaggtatga

SEQ ID NO: 276892 - DNA, 25 bp, Mus musculus
agcgcttcggacacctcagacggac

SEQ ID NO: 276893 - DNA, 25 bp, Mus musculus
ggacacctcagacggacggtggcca

SEQ ID NO: 276894 - DNA, 25 bp, Mus musculus
cagacggacggtggccaccccaaga

SEQ ID NO: 276895 - DNA, 25 bp, Mus musculus
cgccatggcccggatcctccgggca

SEQ ID NO: 276896 - DNA, 25 bp, Mus musculus
ctccgggcatcctgccttctgtccc

SEQ ID NO: 276897 - DNA, 25 bp, Mus musculus
ctgctcctggccgggtttgttccgc

SEQ ID NO: 276898 - DNA, 25 bp, Mus musculus
gcgggtatgtcttgccctttaaatc

SEQ ID NO: 276899 - DNA, 25 bp, Mus musculus
ctttaaatcttaaccgcgttgccat

SEQ ID NO: 276900 - DNA, 25 bp, Mus musculus
cgcgttgccattggctaggaagccc

SEQ ID NO: 276901 - DNA, 25 bp, Mus musculus
attggctaggaagcccccgcctggc

SEQ ID NO: 276902 - DNA, 25 bp, Mus musculus
gccacagtggatggcttgaaatgtg

SEQ ID NO: 276903 - DNA, 25 bp, Mus musculus
ggcttgaaatgtggctgagcgcttc

SEQ ID NO: 276904 - DNA, 25 bp, Mus musculus
aaatgtggctgagcgcttcggacac

SEQ ID NO: 276905 - DNA, 25 bp, Mus musculus
cttcggacacctcagacggacggtg

SEQ ID NO: 276906 - DNA, 25 bp, Mus musculus
gcagtccggacaggtacgacagttc

SEQ ID NO: 276907 - DNA, 25 bp, Mus musculus
ttagagcagcgagcttcgcgcagtc

SEQ ID NO: 276908 - DNA, 25 bp, Mus musculus
tagcaactgttcctgttagagcagc

SEQ ID NO: 276909 - DNA, 25 bp, Mus musculus
ccggaagtcggtgcctattaccata

SEQ ID NO: 276910 - DNA, 25 bp, Mus musculus
gcgcgccgtacttcttccggaagtc

SEQ ID NO: 276911 - DNA, 25 bp, Mus musculus
cgtcagccaggaacttggagaagtc

SEQ ID NO: 276912 - DNA, 25 bp, Mus musculus
ccagtccttcacgtcgaagtcgtca

SEQ ID NO: 276913 - DNA, 25 bp, Mus musculus
ggccgcattaatccagtccttcacg

SEQ ID NO: 276914 - DNA, 25 bp, Mus musculus
gggccggctctgaaggccgcattaa

SEQ ID NO: 276915 - DNA, 25 bp, Mus musculus
gcttcattaccagggtggctgcgtg

SEQ ID NO: 276916 - DNA, 25 bp, Mus musculus
tcctggatgaacagctgcagcttca

SEQ ID NO: 276917 - DNA, 25 bp, Mus musculus
cggcgtggttcacctcctggatgaa

SEQ ID NO: 276918 - DNA, 25 bp, Mus musculus
cgacagttcgttttctgctcttatt

SEQ ID NO: 276919 - DNA, 25 bp, Mus musculus
ctcttatttgtcgagcagtaaacta

SEQ ID NO: 276920 - DNA, 25 bp, Mus musculus
taaacccaggtactctcggtcctgc

SEQ ID NO: 276921 - DNA, 25 bp, Mus musculus
tcccgccgcggaggacaaccagggc

SEQ ID NO: 276922 - DNA, 25 bp, Mus musculus
atcccctgggtgagtctagaggccc

SEQ ID NO: 276923 - DNA, 25 bp, Mus musculus
ccactgagccatggcgtggtctgag

SEQ ID NO: 276924 - DNA, 25 bp, Mus musculus
ctccagctgttaagtggtgccgccc

SEQ ID NO: 276925 - DNA, 25 bp, Mus musculus
tcgctaagcattcgcgctccagctg

SEQ ID NO: 276926 - DNA, 25 bp, Mus musculus
tggcacaagagatcgctaagcattc

SEQ ID NO: 276927 - DNA, 25 bp, Mus musculus
cagtgcttggcacaagagatcgcta

SEQ ID NO: 276928 - DNA, 25 bp, Mus musculus
aacgctttctgcacagtgcttggca

SEQ ID NO: 276929 - DNA, 25 bp, Mus musculus
tgaaacgctttctgcacagtgcttg

SEQ ID NO: 276930 - DNA, 25 bp, Mus musculus
gactaacaatggctgaaacgctttc

SEQ ID NO: 276931 - DNA, 25 bp, Mus musculus
cctgcgaccagactaacaatggctg

SEQ ID NO: 276932 - DNA, 25 bp, Mus musculus
cggtcctgcgaccagactaacaatg

SEQ ID NO: 276933 - DNA, 25 bp, Mus musculus
aggtactctcggtcctgcgaccaga

SEQ ID NO: 276934 - DNA, 25 bp, Mus musculus
ggcgtaagccgcctatctgggctgc

SEQ ID NO: 276935 - DNA, 25 bp, Mus musculus
agcggcgtcacgtccgttaggatta

SEQ ID NO: 276936 - DNA, 25 bp, Mus musculus
ggctcggccagcagaagcctcttga

SEQ ID NO: 276937 - DNA, 25 bp, Mus musculus
ggcgccgccatgtggactagaaaca

SEQ ID NO: 276938 - DNA, 25 bp, Mus musculus
tagaaacacacacgtgggctccttc

SEQ ID NO: 276939 - DNA, 25 bp, Mus musculus
aaccaatcaactttcgccacagcga

SEQ ID NO: 276940 - DNA, 25 bp, Mus musculus
cgcggccctgccacttaaaggcgta

SEQ ID NO: 276941 - DNA, 25 bp, Mus musculus
agcgctgcgagcaggcgatctccca

SEQ ID NO: 276942 - DNA, 25 bp, Mus musculus
aggcgggtctccatagaaacctcca

SEQ ID NO: 276943 - DNA, 25 bp, Mus musculus
tccggccagcctgtgtgaaattagg

SEQ ID NO: 276944 - DNA, 25 bp, Mus musculus
tgttgtacacaatcatcatggcggc

SEQ ID NO: 276945 - DNA, 25 bp, Mus musculus
ccctttgcaggcatggaggagccag

SEQ ID NO: 276946 - DNA, 25 bp, Mus musculus
aggactcctgcgacgcgcgaggcaa

SEQ ID NO: 276947 - DNA, 25 bp, Mus musculus
cctcaactgcgtggaggccgaagca

SEQ ID NO: 276948 - DNA, 25 bp, Mus musculus
ccgtacgccggcgacgtacagagcg

SEQ ID NO: 276949 - DNA, 25 bp, Mus musculus
ggcggaccctagcggctcccagccg

SEQ ID NO: 276950 - DNA, 25 bp, Mus musculus
ctgacccctgactagccccggcaaa

SEQ ID NO: 276951 - DNA, 25 bp, Mus musculus
gcaaagtcaccgcaagtcacctgcg

SEQ ID NO: 276952 - DNA, 25 bp, Mus musculus
aaagtcaccgcaagtcacctgcgcg

SEQ ID NO: 276953 - DNA, 25 bp, Mus musculus
aagtcaccgcaagtcacctgcgcga

SEQ ID NO: 276954 - DNA, 25 bp, Mus musculus
agtcaccgcaagtcacctgcgcgag

SEQ ID NO: 276955 - DNA, 25 bp, Mus musculus
caccgcaagtcacctgcgcgagcgc

SEQ ID NO: 276956 - DNA, 25 bp, Mus musculus
aacccaggatgcactgcgccgcagc

SEQ ID NO: 276957 - DNA, 25 bp, Mus musculus
ccgcggccgcagctagcgccgtacg

SEQ ID NO: 276958 - DNA, 25 bp, Mus musculus
agctagcgccgtacgccggcgacgt

SEQ ID NO: 276959 - DNA, 25 bp, Mus musculus
gctagcgccgtacgccggcgacgta

SEQ ID NO: 276960 - DNA, 25 bp, Mus musculus
gcgacgtacagagcggcgcttgagg

SEQ ID NO: 276961 - DNA, 25 bp, Mus musculus
gccggcgacgtacagagcggcgctt

SEQ ID NO: 276962 - DNA, 25 bp, Mus musculus
aagccgaacgcaaggagcagccgtc

SEQ ID NO: 276963 - DNA, 25 bp, Mus musculus
gtggccgatcaaccggaagtagctg

SEQ ID NO: 276964 - DNA, 25 bp, Mus musculus
gagcgatcgagcaggcttgactaga

SEQ ID NO: 276965 - DNA, 25 bp, Mus musculus
ttaaaacctctgttcgctctgcgca

SEQ ID NO: 276966 - DNA, 25 bp, Mus musculus
ctggaatcaccgtctgcctgagcta

SEQ ID NO: 276967 - DNA, 25 bp, Mus musculus
tgttcctgccgagccacacaggttc

SEQ ID NO: 276968 - DNA, 25 bp, Mus musculus
gcgctcgtctcagtgacttctcgtg

SEQ ID NO: 276969 - DNA, 25 bp, Mus musculus
cggaaagctcttccatcgggttgga

SEQ ID NO: 276970 - DNA, 25 bp, Mus musculus
gctgtaggtaggaggacactgcctc

SEQ ID NO: 276971 - DNA, 25 bp, Mus musculus
cttctccgcatagctgaggggcttc

SEQ ID NO: 276972 - DNA, 25 bp, Mus musculus
cgcgctagccgctctggccaattaa

SEQ ID NO: 276973 - DNA, 25 bp, Mus musculus
tgcctcggatacaggaactaggttt

SEQ ID NO: 276974 - DNA, 25 bp, Mus musculus
tgggcgaactgctgtacaacaagtc

SEQ ID NO: 276975 - DNA, 25 bp, Mus musculus
gcctgagctactgacaggatcctga

SEQ ID NO: 276976 - DNA, 25 bp, Mus musculus
ggttcgtggagcaacttcggcatca

SEQ ID NO: 276977 - DNA, 25 bp, Mus musculus
ctgcaccgactcagccaggttcgtg

SEQ ID NO: 276978 - DNA, 25 bp, Mus musculus
tcccagcgccgcgtttgaattcggg

SEQ ID NO: 276979 - DNA, 25 bp, Mus musculus
gcgcaggcccttgtaacgttcccag

SEQ ID NO: 276980 - DNA, 25 bp, Mus musculus
tagagcactcccatggtgccgcgcg

SEQ ID NO: 276981 - DNA, 25 bp, Mus musculus
cgccggcaagatcggagtttaaagg

SEQ ID NO: 276982 - DNA, 25 bp, Mus musculus
ttcggcatcatgaatgcagcggcca

SEQ ID NO: 276983 - DNA, 25 bp, Mus musculus
cttcgagatctcagacgcagacaca

SEQ ID NO: 276984 - DNA, 25 bp, Mus musculus
ggaggcttcgccaaatgcttcgaga

SEQ ID NO: 276985 - DNA, 25 bp, Mus musculus
gcgctttctgggtaaaggaggcttc

SEQ ID NO: 276986 - DNA, 25 bp, Mus musculus
acaaaagaggtgttcgcaggcaaga

SEQ ID NO: 276987 - DNA, 25 bp, Mus musculus
tgcagcggccaaagctggaaagctg

SEQ ID NO: 276988 - DNA, 25 bp, Mus musculus
cccgctggcgaaagaaattccggag

SEQ ID NO: 276989 - DNA, 25 bp, Mus musculus
gcaccagccgacctcgggaaaggtg

SEQ ID NO: 276990 - DNA, 25 bp, Mus musculus
actggtggtgccgatatgtaaagca

SEQ ID NO: 276991 - DNA, 25 bp, Mus musculus
tatgtaaagcagctggcggctctgg

SEQ ID NO: 276992 - DNA, 25 bp, Mus musculus
gcctgggtttcatgcaaatgaggga

SEQ ID NO: 276993 - DNA, 25 bp, Mus musculus
cagcagctgggcgagtgacagccca

SEQ ID NO: 276994 - DNA, 25 bp, Mus musculus
aggcgccttttcgacacctggctca

SEQ ID NO: 276995 - DNA, 25 bp, Mus musculus
agcgctgcggctaagaacacttggc

SEQ ID NO: 276996 - DNA, 25 bp, Mus musculus
gagcacagtgcgcttcgcccgcaaa

SEQ ID NO: 276997 - DNA, 25 bp, Mus musculus
agctccgcgggtgtctttctcgcct

SEQ ID NO: 276998 - DNA, 25 bp, Mus musculus
tcgcctgaggttcccgatctttctg

SEQ ID NO: 276999 - DNA, 25 bp, Mus musculus
agtccctcaggtgctgggttctctg

SEQ ID NO: 277000 - DNA, 25 bp, Mus musculus
ggccctagagggcagcgacacgcat

SEQ ID NO: 277001 - DNA, 25 bp, Mus musculus
acttcatctggtgagagtgcgccgc

SEQ ID NO: 277002 - DNA, 25 bp, Mus musculus
tgcacgaggtgaagaaccacaaatt

SEQ ID NO: 277003 - DNA, 25 bp, Mus musculus
ggcgccctccggcagaagaacgtgc

SEQ ID NO: 277004 - DNA, 25 bp, Mus musculus
ctgcggacccacgtagtttctcctg

SEQ ID NO: 277005 - DNA, 25 bp, Mus musculus
cgtccgccatagtgcctggcgcgga

SEQ ID NO: 277006 - DNA, 25 bp, Mus musculus
tagcctcaggttccacgccgcaagt

SEQ ID NO: 277007 - DNA, 25 bp, Mus musculus
ccgcaagtcacaaagcgccgggtca

SEQ ID NO: 277008 - DNA, 25 bp, Mus musculus
cgcccgtgcagtccctgcttaagag

SEQ ID NO: 277009 - DNA, 25 bp, Mus musculus
gtttctcctgttctccgcgtagcct

SEQ ID NO: 277010 - DNA, 25 bp, Mus musculus
taataaagagggaatccagcgacgc

SEQ ID NO: 277011 - DNA, 25 bp, Mus musculus
cccgcaccggctttgtgtcaggcgg

SEQ ID NO: 277012 - DNA, 25 bp, Mus musculus
cccatccacggagagagactagccg

SEQ ID NO: 277013 - DNA, 25 bp, Mus musculus
tggactgaccgctactgactgcacc

SEQ ID NO: 277014 - DNA, 25 bp, Mus musculus
ggacccagccgggtgacattgtgcc

SEQ ID NO: 277015 - DNA, 25 bp, Mus musculus
tcggactctaacgtgtggactgacc

SEQ ID NO: 277016 - DNA, 25 bp, Mus musculus
cgcggggtcattcggactctaacgt

SEQ ID NO: 277017 - DNA, 25 bp, Mus musculus
ctgccggcccttagcatgagcgagt

SEQ ID NO: 277018 - DNA, 25 bp, Mus musculus
aggaaacttgtgtcgcagtaaagaa

SEQ ID NO: 277019 - DNA, 25 bp, Mus musculus
acacacatgaggagagcggaccgga

SEQ ID NO: 277020 - DNA, 25 bp, Mus musculus
gcgctagtgcactttacacacatga

SEQ ID NO: 277021 - DNA, 25 bp, Mus musculus
gcgcctcacgcgctagtgcacttta

SEQ ID NO: 277022 - DNA, 25 bp, Mus musculus
gggcattcacttccggactggggcc

SEQ ID NO: 277023 - DNA, 25 bp, Mus musculus
tgctaggacctccatcttggggctc

SEQ ID NO: 277024 - DNA, 25 bp, Mus musculus
tccggcaggcctagttgctaggacc

SEQ ID NO: 277025 - DNA, 25 bp, Mus musculus
acagttgtcaagtggctgcctcgtc

SEQ ID NO: 277026 - DNA, 25 bp, Mus musculus
ttctggacgcgtcagacagttgtca

SEQ ID NO: 277027 - DNA, 25 bp, Mus musculus
tccggcgaagttctggacgcgtcag

SEQ ID NO: 277028 - DNA, 25 bp, Mus musculus
tcggagttcccgacgctccggcgaa

SEQ ID NO: 277029 - DNA, 25 bp, Mus musculus
atggtccgaggcaagcccgagccag

SEQ ID NO: 277030 - DNA, 25 bp, Mus musculus
tggaatttgcggtttgctggatttt

SEQ ID NO: 277031 - DNA, 25 bp, Mus musculus
agcctcggcgaaaaaggccgcgctc

SEQ ID NO: 277032 - DNA, 25 bp, Mus musculus
agagcgcgcacaggctccaaaggcc

SEQ ID NO: 277033 - DNA, 25 bp, Mus musculus
cggacgaggattcagacacagagtc

SEQ ID NO: 277034 - DNA, 25 bp, Mus musculus
acacagagtcagagggagattccga

SEQ ID NO: 277035 - DNA, 25 bp, Mus musculus
gagattccgaggacactgacagcga

SEQ ID NO: 277036 - DNA, 25 bp, Mus musculus
acactgacagcgaagagtccgaacc

SEQ ID NO: 277037 - DNA, 25 bp, Mus musculus
agtccgaacctggtgacagcgtgtc

SEQ ID NO: 277038 - DNA, 25 bp, Mus musculus
caagaagaagaagggatccgcagga

SEQ ID NO: 277039 - DNA, 25 bp, Mus musculus
aagccgcgcgccaagagagcgcgca

SEQ ID NO: 277040 - DNA, 25 bp, Mus musculus
agcggggtttcaaccgaggaccatg

SEQ ID NO: 277041 - DNA, 25 bp, Mus musculus
gaccatgcggggaacaacaacaaga

SEQ ID NO: 277042 - DNA, 25 bp, Mus musculus
acagccagctgctgttcccaagtct

SEQ ID NO: 277043 - DNA, 25 bp, Mus musculus
cggaaagaaagcacgcaggggccca

SEQ ID NO: 277044 - DNA, 25 bp, Mus musculus
cgggcgcccaaatgccgttagtgcc

SEQ ID NO: 277045 - DNA, 25 bp, Mus musculus
tgacagcgtgtccaagaagccgcgc

SEQ ID NO: 277046 - DNA, 25 bp, Mus musculus
gctcgtggcggttttctaggaacta

SEQ ID NO: 277047 - DNA, 25 bp, Mus musculus
aaagagcttttattgctggagcaga

SEQ ID NO: 277048 - DNA, 25 bp, Mus musculus
tccaaggagtcgcagaaaagagctt

SEQ ID NO: 277049 - DNA, 25 bp, Mus musculus
tctgagagaggcgttaccatcgtcg

SEQ ID NO: 277050 - DNA, 25 bp, Mus musculus
cagcctcctgcggtcctctgagaga

SEQ ID NO: 277051 - DNA, 25 bp, Mus musculus
gagtccgccactcgtttacctgtca

SEQ ID NO: 277052 - DNA, 25 bp, Mus musculus
cacccttgtgggttttgtcagatga

SEQ ID NO: 277053 - DNA, 25 bp, Mus musculus
tgaccctcgtcgatggtcctcttgg

SEQ ID NO: 277054 - DNA, 25 bp, Mus musculus
tctaggaactaaccggagcagcatc

SEQ ID NO: 277055 - DNA, 25 bp, Mus musculus
atccgggcttgatgtgcagacggca

SEQ ID NO: 277056 - DNA, 25 bp, Mus musculus
gcttctctatggtcgcgagccggaa

SEQ ID NO: 277057 - DNA, 25 bp, Mus musculus
gtggctctcttcttccgcttctcta

SEQ ID NO: 277058 - DNA, 25 bp, Mus musculus
cgtgtctcacttccggcctgtggct

SEQ ID NO: 277059 - DNA, 25 bp, Mus musculus
tgtagtctcccgagagtgctgctgc

SEQ ID NO: 277060 - DNA, 25 bp, Mus musculus
cgagaggcacacaagtttacggagt

SEQ ID NO: 277061 - DNA, 25 bp, Mus musculus
acagggaggagtaaagaccctcgtg

SEQ ID NO: 277062 - DNA, 25 bp, Mus musculus
atgggcagcgcccaagccgtagcta

SEQ ID NO: 277063 - DNA, 25 bp, Mus musculus
ggccaggacaatgggcagcgcccaa

SEQ ID NO: 277064 - DNA, 25 bp, Mus musculus
tcctccggccaggacaatgggcagc

SEQ ID NO: 277065 - DNA, 25 bp, Mus musculus
gacgatgctcctccggccaggacaa

SEQ ID NO: 277066 - DNA, 25 bp, Mus musculus
tgagtctcccgaggacgatgctcct

SEQ ID NO: 277067 - DNA, 25 bp, Mus musculus
aagaccctcgtgagtctcccgagga

SEQ ID NO: 277068 - DNA, 25 bp, Mus musculus
ggcagcgcccaagccgtagctaggc

SEQ ID NO: 277069 - DNA, 25 bp, Mus musculus
cacacaagtttacggagttttcgca

SEQ ID NO: 277070 - DNA, 25 bp, Mus musculus
gcctggcactgcgagaggcacacaa

SEQ ID NO: 277071 - DNA, 25 bp, Mus musculus
atcagcggggagagcctgagaacac

SEQ ID NO: 277072 - DNA, 25 bp, Mus musculus
agttttcgcaccaggcggcgagctc

SEQ ID NO: 277073 - DNA, 25 bp, Mus musculus
ttacggagttttcgcaccaggcggc

SEQ ID NO: 277074 - DNA, 25 bp, Mus musculus
cgagtggacctaacctatagcggcg

SEQ ID NO: 277075 - DNA, 25 bp, Mus musculus
cttgtccagtcggacccggagtcag

SEQ ID NO: 277076 - DNA, 25 bp, Mus musculus
tccggccaagccgagcggaatagta

SEQ ID NO: 277077 - DNA, 25 bp, Mus musculus
ccgagcggaatagtagtcctagacg

SEQ ID NO: 277078 - DNA, 25 bp, Mus musculus
gtcctagacgagtgatgcccggtca

SEQ ID NO: 277079 - DNA, 25 bp, Mus musculus
cgcaagtgagcctcgcagatcctgg

SEQ ID NO: 277080 - DNA, 25 bp, Mus musculus
tgatgcccggtcaagtgaaggcgaa

SEQ ID NO: 277081 - DNA, 25 bp, Mus musculus
gtgaaggcgaactgaaacgagctga

SEQ ID NO: 277082 - DNA, 25 bp, Mus musculus
ctgaaacgagctgaggttaagctga

SEQ ID NO: 277083 - DNA, 25 bp, Mus musculus
gctgagcgagtggacctaacctata

SEQ ID NO: 277084 - DNA, 25 bp, Mus musculus
cgcagatcctggtccggtccggcaa

SEQ ID NO: 277085 - DNA, 25 bp, Mus musculus
tccggtccggcaaggcggaacacag

SEQ ID NO: 277086 - DNA, 25 bp, Mus musculus
gatggggtcttgtccagtcggaccc

SEQ ID NO: 277087 - DNA, 25 bp, Mus musculus
ttaagctgagcgagtggacctaacc

SEQ ID NO: 277088 - DNA, 25 bp, Mus musculus
acatggcctccagctcgagggagtc

SEQ ID NO: 277089 - DNA, 25 bp, Mus musculus
tggtccgacaaacgtcatgtcccgg

SEQ ID NO: 277090 - DNA, 25 bp, Mus musculus
cctgctcgtcgagctgtgacttgga

SEQ ID NO: 277091 - DNA, 25 bp, Mus musculus
ctctctagaaacttccgggttgtgc

SEQ ID NO: 277092 - DNA, 25 bp, Mus musculus
gcgggcggagcctaaagaatcctcc

SEQ ID NO: 277093 - DNA, 25 bp, Mus musculus
agaatcctccaatggtctgactgga

SEQ ID NO: 277094 - DNA, 25 bp, Mus musculus
tctgactggacgaggaacttggtcc

SEQ ID NO: 277095 - DNA, 25 bp, Mus musculus
cccgggagccagtcagctgaaaggt

SEQ ID NO: 277096 - DNA, 25 bp, Mus musculus
atcgcgccttatctttgcagcttta

SEQ ID NO: 277097 - DNA, 25 bp, Mus musculus
tgcagctttagtcggtgcctgtttc

SEQ ID NO: 277098 - DNA, 25 bp, Mus musculus
tccatgtccctggtgggtgccgcac

SEQ ID NO: 277099 - DNA, 25 bp, Mus musculus
gcatgtccgggctctctagaaactt

SEQ ID NO: 277100 - DNA, 25 bp, Mus musculus
ggagtcctcgttctcttcctgctcg

SEQ ID NO: 277101 - DNA, 25 bp, Mus musculus
cggtgcctgtttcttgcctctttcc

SEQ ID NO: 277102 - DNA, 25 bp, Mus musculus
cgggaggctggagtaatttctttag

SEQ ID NO: 277103 - DNA, 25 bp, Mus musculus
gggttcctccgcacgaggatgccga

SEQ ID NO: 277104 - DNA, 25 bp, Mus musculus
gtcctggtccaggtccaggccgctg

SEQ ID NO: 277105 - DNA, 25 bp, Mus musculus
aggtccaggccgctgcaggtgccca

SEQ ID NO: 277106 - DNA, 25 bp, Mus musculus
gagcgcaggaatgtccggactcgca

SEQ ID NO: 277107 - DNA, 25 bp, Mus musculus
aatgtccggactcgcagcggcgcct

SEQ ID NO: 277108 - DNA, 25 bp, Mus musculus
ccagagattgtgaagcaggacgcga

SEQ ID NO: 277109 - DNA, 25 bp, Mus musculus
tgatcctattcctccagagattgtg

SEQ ID NO: 277110 - DNA, 25 bp, Mus musculus
ggacacgctgaggtctgatcctatt

SEQ ID NO: 277111 - DNA, 25 bp, Mus musculus
tgccgccgagggactttaggaatga

SEQ ID NO: 277112 - DNA, 25 bp, Mus musculus
ccgtgcgaggcttcctcgcgggcaa

SEQ ID NO: 277113 - DNA, 25 bp, Mus musculus
tccgcacgaggatgccgagaacctc

SEQ ID NO: 277114 - DNA, 25 bp, Mus musculus
aggacgcgagctagcgtcctgcctc

SEQ ID NO: 277115 - DNA, 25 bp, Mus musculus
aacctcggccagaggggaagaagct

SEQ ID NO: 277116 - DNA, 25 bp, Mus musculus
ccgcgctagacctgctagggactta

SEQ ID NO: 277117 - DNA, 25 bp, Mus musculus
ctagggacttaggacgccgctgcaa

SEQ ID NO: 277118 - DNA, 25 bp, Mus musculus
tctggtcgcaggctcgcaaacctga

SEQ ID NO: 277119 - DNA, 25 bp, Mus musculus
tcgcaaacctgagcacgcgcgcagt

SEQ ID NO: 277120 - DNA, 25 bp, Mus musculus
tcttccctagggatgtgcgctgcac

SEQ ID NO: 277121 - DNA, 25 bp, Mus musculus
gaccttgcactcttccctagggatg

SEQ ID NO: 277122 - DNA, 25 bp, Mus musculus
tggcgggaccttgcactcttcccta

SEQ ID NO: 277123 - DNA, 25 bp, Mus musculus
tcatatgtggcactgcagcggcggt

SEQ ID NO: 277124 - DNA, 25 bp, Mus musculus
gagcacgcgcgcagtctcaactcgt

SEQ ID NO: 277125 - DNA, 25 bp, Mus musculus
ccctagcggtcatatgtggcactgc

SEQ ID NO: 277126 - DNA, 25 bp, Mus musculus
tagcagtcataaggcctgggtgccc

SEQ ID NO: 277127 - DNA, 25 bp, Mus musculus
tcaggctctagcagtcataaggcct

SEQ ID NO: 277128 - DNA, 25 bp, Mus musculus
agtctcaactcgtggacgccgctca

SEQ ID NO: 277129 - DNA, 25 bp, Mus musculus
ggatgtgcgctgcaccgagttcccg

SEQ ID NO: 277130 - DNA, 25 bp, Mus musculus
agctgcttgaaaagccgcgtgcgta

SEQ ID NO: 277131 - DNA, 25 bp, Mus musculus
ttgcgcaggcgccatgctaaagccc

SEQ ID NO: 277132 - DNA, 25 bp, Mus musculus
gcttagacttgcagcctggccgtga

SEQ ID NO: 277133 - DNA, 25 bp, Mus musculus
ccaggcagctgcagttgcttagact

SEQ ID NO: 277134 - DNA, 25 bp, Mus musculus
cgagtcagaagtgatcgatgctctc

SEQ ID NO: 277135 - DNA, 25 bp, Mus musculus
cgccagagaggttagttggagctcc

SEQ ID NO: 277136 - DNA, 25 bp, Mus musculus
cggtgataaagccagccgaagaatc

SEQ ID NO: 277137 - DNA, 25 bp, Mus musculus
acggaaccagtcgtcgccagcaacg

SEQ ID NO: 277138 - DNA, 25 bp, Mus musculus
ccacaaacagttgaaggagctgcta

SEQ ID NO: 277139 - DNA, 25 bp, Mus musculus
catgcgtgcaactgtcgtgcccttc

SEQ ID NO: 277140 - DNA, 25 bp, Mus musculus
tgctctcggtgtagtcggtgataaa

SEQ ID NO: 277141 - DNA, 25 bp, Mus musculus
cccgtcgcgatcagccgagtcagaa

SEQ ID NO: 277142 - DNA, 25 bp, Mus musculus
cgattgctccgcgttcctctaggca

SEQ ID NO: 277143 - DNA, 25 bp, Mus musculus
ccgcgtgcgtagtagctatctgctc

SEQ ID NO: 277144 - DNA, 25 bp, Mus musculus
ttggcacctgtgagccgccttctga

SEQ ID NO: 277145 - DNA, 25 bp, Mus musculus
ctctgttgctatggcgccttggcac

SEQ ID NO: 277146 - DNA, 25 bp, Mus musculus
gccttctgagctacgcggtttcccg

SEQ ID NO: 277147 - DNA, 25 bp, Mus musculus
ctctcgctcgctggaggagaaccca

SEQ ID NO: 277148 - DNA, 25 bp, Mus musculus
tcaccagcggagtacttccgttttc

SEQ ID NO: 277149 - DNA, 25 bp, Mus musculus
atcacgccggaagccatatcggagc

SEQ ID NO: 277150 - DNA, 25 bp, Mus musculus
cgcaaaccagcgagatcacgccgga

SEQ ID NO: 277151 - DNA, 25 bp, Mus musculus
agccttcatacgtaccgcaaaccag

SEQ ID NO: 277152 - DNA, 25 bp, Mus musculus
gttgcccacagatgcccgctctggt

SEQ ID NO: 277153 - DNA, 25 bp, Mus musculus
atggtcgatcccgttgcccacagat

SEQ ID NO: 277154 - DNA, 25 bp, Mus musculus
aatatctcgtcagcgccaaagcccg

SEQ ID NO: 277155 - DNA, 25 bp, Mus musculus
cggagagatcgccagactggagctc

SEQ ID NO: 277156 - DNA, 25 bp, Mus musculus
actggagctcctactggtgggctac

SEQ ID NO: 277157 - DNA, 25 bp, Mus musculus
actggtgggctacgcgcattctccc

SEQ ID NO: 277158 - DNA, 25 bp, Mus musculus
gcagtggtggctacagaaccgatct

SEQ ID NO: 277159 - DNA, 25 bp, Mus musculus
tcccgcagtcgtgggacttaaaagc

SEQ ID NO: 277160 - DNA, 25 bp, Mus musculus
cgtgggacttaaaagctggagctct

SEQ ID NO: 277161 - DNA, 25 bp, Mus musculus
atgcaaataagccagcgatcaggca

SEQ ID NO: 277162 - DNA, 25 bp, Mus musculus
cgatcaggcaaagtccggaggactg

SEQ ID NO: 277163 - DNA, 25 bp, Mus musculus
gcggggcatgtaaatgaccgtgcac

SEQ ID NO: 277164 - DNA, 25 bp, Mus musculus
gggcgtcgcatgtaaataagggaca

SEQ ID NO: 277165 - DNA, 25 bp, Mus musculus
taaataagggacaccaggcggcgta

SEQ ID NO: 277166 - DNA, 25 bp, Mus musculus
acgcgctagaactcagggagcctcg

SEQ ID NO: 277167 - DNA, 25 bp, Mus musculus
gtagacaactcacgcgctagaactc

SEQ ID NO: 277168 - DNA, 25 bp, Mus musculus
gcgcgggtcaagcaagtagacaact

SEQ ID NO: 277169 - DNA, 25 bp, Mus musculus
gctcagccagggtcggctgccttcg

SEQ ID NO: 277170 - DNA, 25 bp, Mus musculus
cctgaactcgcaggtaggaacgggc

SEQ ID NO: 277171 - DNA, 25 bp, Mus musculus
tggcctgaaaccagagcccgcggaa

SEQ ID NO: 277172 - DNA, 25 bp, Mus musculus
gcactgcgcgctgtgggttcacagc

SEQ ID NO: 277173 - DNA, 25 bp, Mus musculus
cgtagcctgttcaactttcctgaca

SEQ ID NO: 277174 - DNA, 25 bp, Mus musculus
caactttcctgacataaatttccca

SEQ ID NO: 277175 - DNA, 25 bp, Mus musculus
atttcccacttaagtcattaagtca

SEQ ID NO: 277176 - DNA, 25 bp, Mus musculus
cagaccacagggcacggttctgttc

SEQ ID NO: 277177 - DNA, 25 bp, Mus musculus
tgacaccactctggggtgaaacgcg

SEQ ID NO: 277178 - DNA, 25 bp, Mus musculus
cggttctgttcaccgcgggtgcact

SEQ ID NO: 277179 - DNA, 25 bp, Mus musculus
acatggcgtgacaccactctggggt

SEQ ID NO: 277180 - DNA, 25 bp, Mus musculus
cgctgtttgcgcttattctggttcc

SEQ ID NO: 277181 - DNA, 25 bp, Mus musculus
ttcacagcgccggtgacgtcgcgga

SEQ ID NO: 277182 - DNA, 25 bp, Mus musculus
acgtcgcggatttgcggtgatacca

SEQ ID NO: 277183 - DNA, 25 bp, Mus musculus
ttgcggtgataccacactgagctca

SEQ ID NO: 277184 - DNA, 25 bp, Mus musculus
gaccgtggacatggcgtgacaccac

SEQ ID NO: 277185 - DNA, 25 bp, Mus musculus
agcgcgcgtagcctgttcaactttc

SEQ ID NO: 277186 - DNA, 25 bp, Mus musculus
tcacgctacccgagggcgggctcaa

SEQ ID NO: 277187 - DNA, 25 bp, Mus musculus
aacaacgactcgagcgcgtccatgg

SEQ ID NO: 277188 - DNA, 25 bp, Mus musculus
agagttcctcctccattggtccgga

SEQ ID NO: 277189 - DNA, 25 bp, Mus musculus
taggagtccctctctcagacttagg

SEQ ID NO: 277190 - DNA, 25 bp, Mus musculus
tctcgcggctcctcgtagaaactga

SEQ ID NO: 277191 - DNA, 25 bp, Mus musculus
aaactcctgcgtgtagggttccaga

SEQ ID NO: 277192 - DNA, 25 bp, Mus musculus
gtccatggccgcttcagttagcagc

SEQ ID NO: 277193 - DNA, 25 bp, Mus musculus
aatgcgcctgcgtacagcgatccga

SEQ ID NO: 277194 - DNA, 25 bp, Mus musculus
gcgggctcaatgatcagagttcctc

SEQ ID NO: 277195 - DNA, 25 bp, Mus musculus
gtaaccaggggaactgcaaacactg

SEQ ID NO: 277196 - DNA, 25 bp, Mus musculus
tgcaaacactgtcagggccgcttcc

SEQ ID NO: 277197 - DNA, 25 bp, Mus musculus
cctctagggatggacggttagtgtc

SEQ ID NO: 277198 - DNA, 25 bp, Mus musculus
tctcagggaggaacgcctagccaca

SEQ ID NO: 277199 - DNA, 25 bp, Mus musculus
ctcgtagaaactgatgcccgggtgc

SEQ ID NO: 277200 - DNA, 25 bp, Mus musculus
ctgagggctcaaacgtaggggtcct

SEQ ID NO: 277201 - DNA, 25 bp, Mus musculus
tcccagcgggacagcactaagcgtc

SEQ ID NO: 277202 - DNA, 25 bp, Mus musculus
gtaaacagccgcagtggctcctctg

SEQ ID NO: 277203 - DNA, 25 bp, Mus musculus
tgtacggtctgtccaatggcgttgc

SEQ ID NO: 277204 - DNA, 25 bp, Mus musculus
ctccggtcggtaccaggaaatgcca

SEQ ID NO: 277205 - DNA, 25 bp, Mus musculus
cgcagaatctaagctccggtcggta

SEQ ID NO: 277206 - DNA, 25 bp, Mus musculus
cggggccagactcgcagaatctaag

SEQ ID NO: 277207 - DNA, 25 bp, Mus musculus
ctcaccctaggacgagagcttcggg

SEQ ID NO: 277208 - DNA, 25 bp, Mus musculus
tgtgccgcgactccagctactaggc

SEQ ID NO: 277209 - DNA, 25 bp, Mus musculus
caagcctggcgatggcgacaactca

SEQ ID NO: 277210 - DNA, 25 bp, Mus musculus
attggagtcagcaagccggtcccta

SEQ ID NO: 277211 - DNA, 25 bp, Mus musculus
ttcgacggacgtctgcacaccgcta

SEQ ID NO: 277212 - DNA, 25 bp, Mus musculus
actaagcgtccgcagcgaagcaagc

SEQ ID NO: 277213 - DNA, 25 bp, Mus musculus
cgtgggtatggtgatgattttcgtc

SEQ ID NO: 277214 - DNA, 25 bp, Mus musculus
tgcatagccatagcactcagtgcgc

SEQ ID NO: 277215 - DNA, 25 bp, Mus musculus
gactgtagaacttgatcgcgttctc

SEQ ID NO: 277216 - DNA, 25 bp, Mus musculus
ctcgatggcctgactgtagaacttg

SEQ ID NO: 277217 - DNA, 25 bp, Mus musculus
attgccggggttcaactcgatggcc

SEQ ID NO: 277218 - DNA, 25 bp, Mus musculus
atagtagatggcattgccggggttc

SEQ ID NO: 277219 - DNA, 25 bp, Mus musculus
atagcactcagtgcgcaggtaggcc

SEQ ID NO: 277220 - DNA, 25 bp, Mus musculus
cccggcggtagtagcctttgatgta

SEQ ID NO: 277221 - DNA, 25 bp, Mus musculus
tggcgtcgcccagtgcatagccata

SEQ ID NO: 277222 - DNA, 25 bp, Mus musculus
ttcttgtcaagctcgatggcccgtg

SEQ ID NO: 277223 - DNA, 25 bp, Mus musculus
gtagcctttgatgtacttcttgtca

SEQ ID NO: 277224 - DNA, 25 bp, Mus musculus
tcacgcagggcagcccggaacttgc

SEQ ID NO: 277225 - DNA, 25 bp, Mus musculus
gaacttgcccagtgccatgttgctg

SEQ ID NO: 277226 - DNA, 25 bp, Mus musculus
ccaggctgcggttgccatagtagat

SEQ ID NO: 277227 - DNA, 25 bp, Mus musculus
gctcaccgtctcgtagtcacgcagg

SEQ ID NO: 277228 - DNA, 25 bp, Mus musculus
gaagggttgcctacagcaaaggtcc

SEQ ID NO: 277229 - DNA, 25 bp, Mus musculus
agcagcgccagcaggttcaaggcca

SEQ ID NO: 277230 - DNA, 25 bp, Mus musculus
ccctccgtggggagacacctgcagg

SEQ ID NO: 277231 - DNA, 25 bp, Mus musculus
cgtagacgtttagcgcagcttgaga

SEQ ID NO: 277232 - DNA, 25 bp, Mus musculus
tagcagaaccgttgggttcctggcc

SEQ ID NO: 277233 - DNA, 25 bp, Mus musculus
gtacacggggaaatgacttcaggcc

SEQ ID NO: 277234 - DNA, 25 bp, Mus musculus
acttcaggccgaagagggaccgcac

SEQ ID NO: 277235 - DNA, 25 bp, Mus musculus
ggaccgcacgcactggaactcgcag

SEQ ID NO: 277236 - DNA, 25 bp, Mus musculus
actggaactcgcagccagggtgcgc

SEQ ID NO: 277237 - DNA, 25 bp, Mus musculus
gagctcttcctcacacgagtaccag

SEQ ID NO: 277238 - DNA, 25 bp, Mus musculus
cacgagtaccagatgccagtgtgga

SEQ ID NO: 277239 - DNA, 25 bp, Mus musculus
atgccagtgtggaaacggcgcagct

SEQ ID NO: 277240 - DNA, 25 bp, Mus musculus
gtgccctggcaccagtacgtggtga

SEQ ID NO: 277241 - DNA, 25 bp, Mus musculus
gcagcttgagagtagcagaaccgtt

SEQ ID NO: 277242 - DNA, 25 bp, Mus musculus
gttcagaggcggctacacgaggccc

SEQ ID NO: 277243 - DNA, 25 bp, Mus musculus
cacagttcaggtcatggtcccggca

SEQ ID NO: 277244 - DNA, 25 bp, Mus musculus
cggggaaacgcaaaagcagaaaatg

SEQ ID NO: 277245 - DNA, 25 bp, Mus musculus
caatccggaatcaagtgagggcaga

SEQ ID NO: 277246 - DNA, 25 bp, Mus musculus
cggaccaatccggaatcaagtgagg

SEQ ID NO: 277247 - DNA, 25 bp, Mus musculus
ctgcggcgctggaaccggaccaatc

SEQ ID NO: 277248 - DNA, 25 bp, Mus musculus
cctcagccgagactgaaggggcaga

SEQ ID NO: 277249 - DNA, 25 bp, Mus musculus
gtcgtgtcccgctcgcacagttcag

SEQ ID NO: 277250 - DNA, 25 bp, Mus musculus
gcgacgggcctcagccgagactgaa

SEQ ID NO: 277251 - DNA, 25 bp, Mus musculus
aaatggggttcagaggcggctacac

SEQ ID NO: 277252 - DNA, 25 bp, Mus musculus
cgaagcgattcatccagacctcggc

SEQ ID NO: 277253 - DNA, 25 bp, Mus musculus
cgccggcacctttaaaaggagcaca

SEQ ID NO: 277254 - DNA, 25 bp, Mus musculus
ccatgcaaagacaaccggttcccta

SEQ ID NO: 277255 - DNA, 25 bp, Mus musculus
gggccgcacctgactgttcactggc

SEQ ID NO: 277256 - DNA, 25 bp, Mus musculus
ccgcacacctcaagacacagagaga

SEQ ID NO: 277257 - DNA, 25 bp, Mus musculus
aagatctgcttgctacaaccgcaca

SEQ ID NO: 277258 - DNA, 25 bp, Mus musculus
aggcttggggcgctagcctccctaa

SEQ ID NO: 277259 - DNA, 25 bp, Mus musculus
taatccgctactccggcacacaggg

SEQ ID NO: 277260 - DNA, 25 bp, Mus musculus
aacctaggacagcaagatcctcttg

SEQ ID NO: 277261 - DNA, 25 bp, Mus musculus
tcttgctaacgagaagccgcgggca

SEQ ID NO: 277262 - DNA, 25 bp, Mus musculus
cagacgaagatcgacacggcgccca

SEQ ID NO: 277263 - DNA, 25 bp, Mus musculus
ccagcccaggtaagtgggacccagg

SEQ ID NO: 277264 - DNA, 25 bp, Mus musculus
gtaccgaggtccctagagtcctgca

SEQ ID NO: 277265 - DNA, 25 bp, Mus musculus
aaggaagtccagagtgcgcgctccc

SEQ ID NO: 277266 - DNA, 25 bp, Mus musculus
cctcagcgtcgccatggagccgagg

SEQ ID NO: 277267 - DNA, 25 bp, Mus musculus
aggctgaaggacgtctctttgtgtc

SEQ ID NO: 277268 - DNA, 25 bp, Mus musculus
ctctttgtgtctcgcttggaggagc

SEQ ID NO: 277269 - DNA, 25 bp, Mus musculus
tgctgggacgcagcgaccgatccaa

SEQ ID NO: 277270 - DNA, 25 bp, Mus musculus
cacggccatcgagatctgcgtctga

SEQ ID NO: 277271 - DNA, 25 bp, Mus musculus
aagctggctgacttcggcatgacgc

SEQ ID NO: 277272 - DNA, 25 bp, Mus musculus
tgccagttccagtacccgtgcctga

SEQ ID NO: 277273 - DNA, 25 bp, Mus musculus
cgcactgtgctcaccgagagtggca

SEQ ID NO: 277274 - DNA, 25 bp, Mus musculus
gaggtctttcgcttcctcaagcacg

SEQ ID NO: 277275 - DNA, 25 bp, Mus musculus
gctgcgtatgttccagcggcttctg

SEQ ID NO: 277276 - DNA, 25 bp, Mus musculus
ccgttttaccgagcctgcgctgcgt

SEQ ID NO: 277277 - DNA, 25 bp, Mus musculus
gcgctctaacccgtactggggacaa

SEQ ID NO: 277278 - DNA, 25 bp, Mus musculus
tgcggatgccttcttcgaggagttc

SEQ ID NO: 277279 - DNA, 25 bp, Mus musculus
tcactggcaacttcccgtgggaggc

SEQ ID NO: 277280 - DNA, 25 bp, Mus musculus
ggcgtgctcatcttctgtgtgctca

SEQ ID NO: 277281 - DNA, 25 bp, Mus musculus
taccgtacacagcacccgaggtgtg

SEQ ID NO: 277282 - DNA, 25 bp, Mus musculus
cgcgtgagcggcactataccgtaca

SEQ ID NO: 277283 - DNA, 25 bp, Mus musculus
tagtaaatgaccatgcgtacggccg

SEQ ID NO: 277284 - DNA, 25 bp, Mus musculus
tcagcaacacaactgccgccatgtt

SEQ ID NO: 277285 - DNA, 25 bp, Mus musculus
gctggcccgtcatcaggatcatctg

SEQ ID NO: 277286 - DNA, 25 bp, Mus musculus
ctacggaagcctccagggtttctag

SEQ ID NO: 277287 - DNA, 25 bp, Mus musculus
cgccatgttgcccaagagcaggtca

SEQ ID NO: 277288 - DNA, 25 bp, Mus musculus
tctagggctcctccgctatggtaac

SEQ ID NO: 277289 - DNA, 25 bp, Mus musculus
cacactcgctgttgctcagtccaag

SEQ ID NO: 277290 - DNA, 25 bp, Mus musculus
tctggttccgacagaggagagcaca

SEQ ID NO: 277291 - DNA, 25 bp, Mus musculus
tgggcttcgtcattccctctggttc

SEQ ID NO: 277292 - DNA, 25 bp, Mus musculus
accactgcgaaaagccctgggcttc

SEQ ID NO: 277293 - DNA, 25 bp, Mus musculus
gcgtggtccgatgcacagtgcacca

SEQ ID NO: 277294 - DNA, 25 bp, Mus musculus
gacttgcccactatcgcctaggagc

SEQ ID NO: 277295 - DNA, 25 bp, Mus musculus
agaggactgcgagaagacttgccca

SEQ ID NO: 277296 - DNA, 25 bp, Mus musculus
tggggaatcgcaaccgcccacgctt

SEQ ID NO: 277297 - DNA, 25 bp, Mus musculus
agtcacccggtgcaaggattgaaca

SEQ ID NO: 277298 - DNA, 25 bp, Mus musculus
ggcgaccggcacctctactgggtct

SEQ ID NO: 277299 - DNA, 25 bp, Mus musculus
tgtcctgctcaggtttagccggcgc

SEQ ID NO: 277300 - DNA, 25 bp, Mus musculus
tccctttcattggacgaacagcctg

SEQ ID NO: 277301 - DNA, 25 bp, Mus musculus
tctactgggtctgcgacttccaaga

SEQ ID NO: 277302 - DNA, 25 bp, Mus musculus
cttcactgtcactgtcgctgtcctg

SEQ ID NO: 277303 - DNA, 25 bp, Mus musculus
cgtcgcaccaatgtacgcggggctc

SEQ ID NO: 277304 - DNA, 25 bp, Mus musculus
aacagcctgccggtcatcatctctt

SEQ ID NO: 277305 - DNA, 25 bp, Mus musculus
gtattagcgtctgtccctttcattg

SEQ ID NO: 277306 - DNA, 25 bp, Mus musculus
agtcaccggcccaccgtattagcgt

SEQ ID NO: 277307 - DNA, 25 bp, Mus musculus
ggaatgagcctagccggagactgcc

SEQ ID NO: 277308 - DNA, 25 bp, Mus musculus
aagcacggtgtctggaatgagccta

SEQ ID NO: 277309 - DNA, 25 bp, Mus musculus
tgaccaagtccacaagcacggtgtc

SEQ ID NO: 277310 - DNA, 25 bp, Mus musculus
ttcgtcgctgtcactgaccaagtcc

SEQ ID NO: 277311 - DNA, 25 bp, Mus musculus
ttccaagacctcttcgtcgctgtca

SEQ ID NO: 277312 - DNA, 25 bp, Mus musculus
ggtcccacgaggctgcaagaaaggc

SEQ ID NO: 277313 - DNA, 25 bp, Mus musculus
ctaagaccaggcgttccaggaggtg

SEQ ID NO: 277314 - DNA, 25 bp, Mus musculus
tgactgcgccaagcttcagaacgcc

SEQ ID NO: 277315 - DNA, 25 bp, Mus musculus
ccgggcacacttcgcagtaacgcga

SEQ ID NO: 277316 - DNA, 25 bp, Mus musculus
cgcgcagcgtcctctaggactaaga

SEQ ID NO: 277317 - DNA, 25 bp, Mus musculus
ccagagaagactaccgcagacccga

SEQ ID NO: 277318 - DNA, 25 bp, Mus musculus
gatttcgcacctctgccactgactg

SEQ ID NO: 277319 - DNA, 25 bp, Mus musculus
gtccactcgagtgcagtcggcgtct

SEQ ID NO: 277320 - DNA, 25 bp, Mus musculus
cctgcagagccgatccggaaacagc

SEQ ID NO: 277321 - DNA, 25 bp, Mus musculus
cagccgagcggatccggaaacagcc

SEQ ID NO: 277322 - DNA, 25 bp, Mus musculus
tcaccagtgagtgcgggaatccgcc

SEQ ID NO: 277323 - DNA, 25 bp, Mus musculus
gaatccgccgtttgggctgagacga

SEQ ID NO: 277324 - DNA, 25 bp, Mus musculus
gcgccagcaaccctaggtgagaatc

SEQ ID NO: 277325 - DNA, 25 bp, Mus musculus
cgagtggagcctcagcagatcctca

SEQ ID NO: 277326 - DNA, 25 bp, Mus musculus
tgggtccgtcatccgaagcaaattc

SEQ ID NO: 277327 - DNA, 25 bp, Mus musculus
cgtggttaatcactcggacccgatc

SEQ ID NO: 277328 - DNA, 25 bp, Mus musculus
tctttgaagagctggctgcagccta

SEQ ID NO: 277329 - DNA, 25 bp, Mus musculus
gttaaccatagagaagccacttgag

SEQ ID NO: 277330 - DNA, 25 bp, Mus musculus
cgtggcttcggcagttgtacctaaa

SEQ ID NO: 277331 - DNA, 25 bp, Mus musculus
acaggtctcactaagctcccgtggc

SEQ ID NO: 277332 - DNA, 25 bp, Mus musculus
ccgaggttttcaggagctacgccaa

SEQ ID NO: 277333 - DNA, 25 bp, Mus musculus
aggagggcaccttcgtattcacttc

SEQ ID NO: 277334 - DNA, 25 bp, Mus musculus
cccgacgcggaaggaagcgaccata

SEQ ID NO: 277335 - DNA, 25 bp, Mus musculus
cccaggcttctcagacgacagggtc

SEQ ID NO: 277336 - DNA, 25 bp, Mus musculus
caactatctgctgccctctcgggag

SEQ ID NO: 277337 - DNA, 25 bp, Mus musculus
gagcctccgagggaccaactatctg

SEQ ID NO: 277338 - DNA, 25 bp, Mus musculus
cggacccgatcctagtcgttggaca

SEQ ID NO: 277339 - DNA, 25 bp, Mus musculus
gagtagccgcccactaaaagaaatc

SEQ ID NO: 277340 - DNA, 25 bp, Mus musculus
ctgggttcggatccctgactcccaa

SEQ ID NO: 277341 - DNA, 25 bp, Mus musculus
cattatggggcgctccgcattttcc

SEQ ID NO: 277342 - DNA, 25 bp, Mus musculus
tccatgcccggatatcagtggccgt

SEQ ID NO: 277343 - DNA, 25 bp, Mus musculus
gtggccgtggccatagaaactgtct

SEQ ID NO: 277344 - DNA, 25 bp, Mus musculus
agaaactgtctgctagaggctccta

SEQ ID NO: 277345 - DNA, 25 bp, Mus musculus
gaggctcctaaactcgctgtccgga

SEQ ID NO: 277346 - DNA, 25 bp, Mus musculus
cggaccctcatttccgccggaagtg

SEQ ID NO: 277347 - DNA, 25 bp, Mus musculus
cgccggaagtgatctgcagtcccaa

SEQ ID NO: 277348 - DNA, 25 bp, Mus musculus
gtgatctgcagtcccaagtgcccgt

SEQ ID NO: 277349 - DNA, 25 bp, Mus musculus
ccggtcaccgagtactaccacaatg

SEQ ID NO: 277350 - DNA, 25 bp, Mus musculus
agtactaccacaatggcggcagcca

SEQ ID NO: 277351 - DNA, 25 bp, Mus musculus
ccctcaggctgaactgtggaaattc

SEQ ID NO: 277352 - DNA, 25 bp, Mus musculus
gcggcagccactctattgcgagcga

SEQ ID NO: 277353 - DNA, 25 bp, Mus musculus
cccatttctgcaaggtcggctgcgg

SEQ ID NO: 277354 - DNA, 25 bp, Mus musculus
ggcctcagatcagggcgtatggaca

SEQ ID NO: 277355 - DNA, 25 bp, Mus musculus
acactcaccgcgctagggaggcctc

SEQ ID NO: 277356 - DNA, 25 bp, Mus musculus
tcagatcagggcgtatggacagacg

SEQ ID NO: 277357 - DNA, 25 bp, Mus musculus
cagggcgtatggacagacgcagctc

SEQ ID NO: 277358 - DNA, 25 bp, Mus musculus
tatggacagacgcagctcgaagccc

SEQ ID NO: 277359 - DNA, 25 bp, Mus musculus
gacagacgcagctcgaagcccgtta

SEQ ID NO: 277360 - DNA, 25 bp, Mus musculus
acgcagctcgaagcccgttagccta

SEQ ID NO: 277361 - DNA, 25 bp, Mus musculus
atggacccgaccaggtcccttcagt

SEQ ID NO: 277362 - DNA, 25 bp, Mus musculus
ctcgaagcccgttagcctagcagca

SEQ ID NO: 277363 - DNA, 25 bp, Mus musculus
aagcccgttagcctagcagcagccg

SEQ ID NO: 277364 - DNA, 25 bp, Mus musculus
cgcgcaggggccaatcggattcgct

SEQ ID NO: 277365 - DNA, 25 bp, Mus musculus
gggccaatcggattcgctcgctgcc

SEQ ID NO: 277366 - DNA, 25 bp, Mus musculus
gggtgaccgcacaccagcatggacc

SEQ ID NO: 277367 - DNA, 25 bp, Mus musculus
gtcccgcagcgactctgcacactca

SEQ ID NO: 277368 - DNA, 25 bp, Mus musculus
cccaagaggtgactaggcccagaga

SEQ ID NO: 277369 - DNA, 25 bp, Mus musculus
attggccaaactgtgggccgcgcgc

SEQ ID NO: 277370 - DNA, 25 bp, Mus musculus
ggagggaacaatccgctcccaagtc

SEQ ID NO: 277371 - DNA, 25 bp, Mus musculus
cctctcactggctacaccgggaaga

SEQ ID NO: 277372 - DNA, 25 bp, Mus musculus
aaagagatcgccaagcaggggaccc

SEQ ID NO: 277373 - DNA, 25 bp, Mus musculus
cttcaacatgatggcagcgtccgga

SEQ ID NO: 277374 - DNA, 25 bp, Mus musculus
cgctgacgccgctaagatgctttcg

SEQ ID NO: 277375 - DNA, 25 bp, Mus musculus
ccctggcctttcttgatgctgcggc

SEQ ID NO: 277376 - DNA, 25 bp, Mus musculus
gacctgttggcacgagggtccaccc

SEQ ID NO: 277377 - DNA, 25 bp, Mus musculus
tcctggagacctcccggagagcttt

SEQ ID NO: 277378 - DNA, 25 bp, Mus musculus
acaccctttgccgacggagctggcg

SEQ ID NO: 277379 - DNA, 25 bp, Mus musculus
ttcgtggtaatggagctagggaccc

SEQ ID NO: 277380 - DNA, 25 bp, Mus musculus
gagagctttctctccgacctgttgg

SEQ ID NO: 277381 - DNA, 25 bp, Mus musculus
gggaccgcgagatccttcgtggtaa

SEQ ID NO: 277382 - DNA, 25 bp, Mus musculus
catagcgggaagctcggctaccatc

SEQ ID NO: 277383 - DNA, 25 bp, Mus musculus
gactctggcgaagcgcctcaggtga

SEQ ID NO: 277384 - DNA, 25 bp, Mus musculus
acaccaggcgcgctcgaggcaacgt

SEQ ID NO: 277385 - DNA, 25 bp, Mus musculus
gcgctcgaggcaacgtgaactcata

SEQ ID NO: 277386 - DNA, 25 bp, Mus musculus
tgcatgcaagggcagcgttccgcgc

SEQ ID NO: 277387 - DNA, 25 bp, Mus musculus
aacgtgaactcatagcgggaagctc

SEQ ID NO: 277388 - DNA, 25 bp, Mus musculus
ggaagctcggctaccatcacccaga

SEQ ID NO: 277389 - DNA, 25 bp, Mus musculus
ctcggctaccatcacccagaaggtg

SEQ ID NO: 277390 - DNA, 25 bp, Mus musculus
cagaaggtgctcctgggacataaca

SEQ ID NO: 277391 - DNA, 25 bp, Mus musculus
tgctcctgggacataacacgccgtg

SEQ ID NO: 277392 - DNA, 25 bp, Mus musculus
agcagcaggtgttcctgagacacca

SEQ ID NO: 277393 - DNA, 25 bp, Mus musculus
acataacacgccgtgggttgggtgc

SEQ ID NO: 277394 - DNA, 25 bp, Mus musculus
atccatacggtagccacctccagtg

SEQ ID NO: 277395 - DNA, 25 bp, Mus musculus
tacggtagccacctccagtgccagg

SEQ ID NO: 277396 - DNA, 25 bp, Mus musculus
ccgcttcagagtgccatcggccggg

SEQ ID NO: 277397 - DNA, 25 bp, Mus musculus
ctactctgtagtgcttgcccggcgc

SEQ ID NO: 277398 - DNA, 25 bp, Mus musculus
ccgggcgcacctttgaagtagtcgt

SEQ ID NO: 277399 - DNA, 25 bp, Mus musculus
tttgaagtagtcgttggcctgtgtc

SEQ ID NO: 277400 - DNA, 25 bp, Mus musculus
gccgctgccgcacaagtgtcgtaaa

SEQ ID NO: 277401 - DNA, 25 bp, Mus musculus
cacaagtgtcgtaaagcgcgggccc

SEQ ID NO: 277402 - DNA, 25 bp, Mus musculus
ggcctgtgtcttgagctcctctgcc

SEQ ID NO: 277403 - DNA, 25 bp, Mus musculus
tctgcccgcttcagagtgccatcgg

SEQ ID NO: 277404 - DNA, 25 bp, Mus musculus
ttgagctcctctgcccgcttcagag

SEQ ID NO: 277405 - DNA, 25 bp, Mus musculus
ccgaaccgtcgcgaaggagtgccga

SEQ ID NO: 277406 - DNA, 25 bp, Mus musculus
ggcaccaggccgaaccgtcgcgaag

SEQ ID NO: 277407 - DNA, 25 bp, Mus musculus
tccgccatcgccatgccgcaaagcg

SEQ ID NO: 277408 - DNA, 25 bp, Mus musculus
ggggtctcagcacactcagtccgct

SEQ ID NO: 277409 - DNA, 25 bp, Mus musculus
cgcgcctggctactctgtagtgctt

SEQ ID NO: 277410 - DNA, 25 bp, Mus musculus
gcgcgctgaccacaatgccggcggt

SEQ ID NO: 277411 - DNA, 25 bp, Mus musculus
aaggcgcagtgggagagcctaaccc

SEQ ID NO: 277412 - DNA, 25 bp, Mus musculus
tgggagagcctaacccagaacgctg

SEQ ID NO: 277413 - DNA, 25 bp, Mus musculus
ccagaacgctggtgacctggctgtt

SEQ ID NO: 277414 - DNA, 25 bp, Mus musculus
acccaaggcagtcggaaagcaaggc

SEQ ID NO: 277415 - DNA, 25 bp, Mus musculus
gtgaatagcgggcaggtttgtaccc

SEQ ID NO: 277416 - DNA, 25 bp, Mus musculus
cccgaaaacagcattttggagaggc

SEQ ID NO: 277417 - DNA, 25 bp, Mus musculus
agcattttggagaggctgagccttg

SEQ ID NO: 277418 - DNA, 25 bp, Mus musculus
tgagccttgtccttaagcctccttg

SEQ ID NO: 277419 - DNA, 25 bp, Mus musculus
agcctccttgataggcaccggcgcg

SEQ ID NO: 277420 - DNA, 25 bp, Mus musculus
ccggcgcggagaagtgtgcactcca

SEQ ID NO: 277421 - DNA, 25 bp, Mus musculus
actccagggagttagtgccagtcgg

SEQ ID NO: 277422 - DNA, 25 bp, Mus musculus
agttagtgccagtcggtcggtaccg

SEQ ID NO: 277423 - DNA, 25 bp, Mus musculus
catcggacaggaggggccttagccc

SEQ ID NO: 277424 - DNA, 25 bp, Mus musculus
agaatcgcgacatggcgacggcgct

SEQ ID NO: 277425 - DNA, 25 bp, Mus musculus
gctcgctgcgagagctcctttctca

SEQ ID NO: 277426 - DNA, 25 bp, Mus musculus
acacggcctgggacgaattagtagc

SEQ ID NO: 277427 - DNA, 25 bp, Mus musculus
agaccggtttggtgacgagctcctc

SEQ ID NO: 277428 - DNA, 25 bp, Mus musculus
ggacagggacgactccgactcactg

SEQ ID NO: 277429 - DNA, 25 bp, Mus musculus
ccgactcactgtccgagccggtggt

SEQ ID NO: 277430 - DNA, 25 bp, Mus musculus
cctttgcgctatacacggcctggga

SEQ ID NO: 277431 - DNA, 25 bp, Mus musculus
agccggtggtgaagaatcgcgacat

SEQ ID NO: 277432 - DNA, 25 bp, Mus musculus
ccggaagcaccaaagaatgcgctaa

SEQ ID NO: 277433 - DNA, 25 bp, Mus musculus
aggcccaagagacacgaaccagcta

SEQ ID NO: 277434 - DNA, 25 bp, Mus musculus
cacgaaccagctaagctgccgagtc

SEQ ID NO: 277435 - DNA, 25 bp, Mus musculus
ctgccgagtccctctgagcaggtga

SEQ ID NO: 277436 - DNA, 25 bp, Mus musculus
ggggcgtcacttcccggaagcacca

SEQ ID NO: 277437 - DNA, 25 bp, Mus musculus
gcgagagctcctttctcagacgcgc

SEQ ID NO: 277438 - DNA, 25 bp, Mus musculus
atggcaaggtacctccaagcagcgc

SEQ ID NO: 277439 - DNA, 25 bp, Mus musculus
acccggcatgcgcagaggagtcctc

SEQ ID NO: 277440 - DNA, 25 bp, Mus musculus
cgctcgaccgcgctcataagagaaa

SEQ ID NO: 277441 - DNA, 25 bp, Mus musculus
acagcgtgtgtggttcttgacgcgc

SEQ ID NO: 277442 - DNA, 25 bp, Mus musculus
ttgacgcgccgcgaaccttcgaacg

SEQ ID NO: 277443 - DNA, 25 bp, Mus musculus
accttcgaacgcaagtgcgagacta

SEQ ID NO: 277444 - DNA, 25 bp, Mus musculus
tgcgagactaccctgtgaggaaacg

SEQ ID NO: 277445 - DNA, 25 bp, Mus musculus
ctgtgaggaaacgttccagggattc

SEQ ID NO: 277446 - DNA, 25 bp, Mus musculus
agggattcgcctgttcccgccatcg

SEQ ID NO: 277447 - DNA, 25 bp, Mus musculus
gccatcgcagttaccagcgcgacgt

SEQ ID NO: 277448 - DNA, 25 bp, Mus musculus
taccagcgcgacgtgctgtttcttc

SEQ ID NO: 277449 - DNA, 25 bp, Mus musculus
cgtcacagagaagtacccggcatgc

SEQ ID NO: 277450 - DNA, 25 bp, Mus musculus
gtgctgtttcttcctgtgctcggta

SEQ ID NO: 277451 - DNA, 25 bp, Mus musculus
caagcagcgcgggaacgaaaggcca

SEQ ID NO: 277452 - DNA, 25 bp, Mus musculus
gctgccttcgaagccgccctaggaa

SEQ ID NO: 277453 - DNA, 25 bp, Mus musculus
tggttatggaactcagcgccgatta

SEQ ID NO: 277454 - DNA, 25 bp, Mus musculus
agttcgagggaaagccactgctcca

SEQ ID NO: 277455 - DNA, 25 bp, Mus musculus
cacctttcttgcgacccgcgttgtg

SEQ ID NO: 277456 - DNA, 25 bp, Mus musculus
agcgccgattacctccgcgagaagc

SEQ ID NO: 277457 - DNA, 25 bp, Mus musculus
tgcaaactcctggaaagccggcaga

SEQ ID NO: 277458 - DNA, 25 bp, Mus musculus
tggctaactgttgggaggaaacctc

SEQ ID NO: 277459 - DNA, 25 bp, Mus musculus
cacgggagaatggtcctgcaaactc

SEQ ID NO: 277460 - DNA, 25 bp, Mus musculus
gccaggactgcaaaaccttggttta

SEQ ID NO: 277461 - DNA, 25 bp, Mus musculus
ccatccggactttctgggttgaagg

SEQ ID NO: 277462 - DNA, 25 bp, Mus musculus
ggtcttgctgcatggtccatccgga

SEQ ID NO: 277463 - DNA, 25 bp, Mus musculus
tctggcagtagagcaagtagacacc

SEQ ID NO: 277464 - DNA, 25 bp, Mus musculus
acccgacgagcaggattgacagtga

SEQ ID NO: 277465 - DNA, 25 bp, Mus musculus
ctctgaaccgttgcgcgaccagctt

SEQ ID NO: 277466 - DNA, 25 bp, Mus musculus
aacagatgctgacgcgaatcaactc

SEQ ID NO: 277467 - DNA, 25 bp, Mus musculus
acgcaaaaatatcccgttccttcat

SEQ ID NO: 277468 - DNA, 25 bp, Mus musculus
tgtcagaacgcaaaaatatcccgtt

SEQ ID NO: 277469 - DNA, 25 bp, Mus musculus
caactcttcttttaatgtcagaacg

SEQ ID NO: 277470 - DNA, 25 bp, Mus musculus
acgcgaatcaactcttcttttaatg

SEQ ID NO: 277471 - DNA, 25 bp, Mus musculus
ctgacgcgaatcaactcttctttta

SEQ ID NO: 277472 - DNA, 25 bp, Mus musculus
agatgctgacgcgaatcaactcttc

SEQ ID NO: 277473 - DNA, 25 bp, Mus musculus
cccgaacagatgctgacgcgaatca

SEQ ID NO: 277474 - DNA, 25 bp, Mus musculus
gggctgcaagactgggaccgctccc

SEQ ID NO: 277475 - DNA, 25 bp, Mus musculus
ctccagggctgcaagactgggaccg

SEQ ID NO: 277476 - DNA, 25 bp, Mus musculus
ttcgctccagggctgcaagactggg

SEQ ID NO: 277477 - DNA, 25 bp, Mus musculus
ggcccttcgctccagggctgcaaga

SEQ ID NO: 277478 - DNA, 25 bp, Mus musculus
ccctttgggcggagctcatggaggc

SEQ ID NO: 277479 - DNA, 25 bp, Mus musculus
tgctgacgcgaatcaactcttcttt

SEQ ID NO: 277480 - DNA, 25 bp, Mus musculus
taaacaagtcgaggcggctgtgaac

SEQ ID NO: 277481 - DNA, 25 bp, Mus musculus
aggctgcaagtcgtagccgcatttc

SEQ ID NO: 277482 - DNA, 25 bp, Mus musculus
tcgtagccgcatttccgggcgagac

SEQ ID NO: 277483 - DNA, 25 bp, Mus musculus
ctcatttgcatgaggcgctccgatt

SEQ ID NO: 277484 - DNA, 25 bp, Mus musculus
atgaggcgctccgattggccacgaa

SEQ ID NO: 277485 - DNA, 25 bp, Mus musculus
ggcgctccgattggccacgaaggcc

SEQ ID NO: 277486 - DNA, 25 bp, Mus musculus
agctggtctcggtgtaaacaagtcg

SEQ ID NO: 277487 - DNA, 25 bp, Mus musculus
tcggtgtaaacaagtcgaggcggct

SEQ ID NO: 277488 - DNA, 25 bp, Mus musculus
cctccacgcgcccaggcgaggtgag

SEQ ID NO: 277489 - DNA, 25 bp, Mus musculus
tggaccgacgtctctgcgcgttgcc

SEQ ID NO: 277490 - DNA, 25 bp, Mus musculus
tctcaggtaaggcttggcgatgcag

SEQ ID NO: 277491 - DNA, 25 bp, Mus musculus
gcttggcgatgcaggtaagattccc

SEQ ID NO: 277492 - DNA, 25 bp, Mus musculus
tagcctctgggttaggctgcaagtc

SEQ ID NO: 277493 - DNA, 25 bp, Mus musculus
gtgaggcctggaccgacgtctctgc

SEQ ID NO: 277494 - DNA, 25 bp, Mus musculus
gcctcgccgcggaagcaaagggaaa

SEQ ID NO: 277495 - DNA, 25 bp, Mus musculus
agccctaagttctcggcggagtttg

SEQ ID NO: 277496 - DNA, 25 bp, Mus musculus
gagcccgccaatcagagggtccgtg

SEQ ID NO: 277497 - DNA, 25 bp, Mus musculus
agggccttgacttcgctctctttga

SEQ ID NO: 277498 - DNA, 25 bp, Mus musculus
tctttgatcagctcgcagcgccgta

SEQ ID NO: 277499 - DNA, 25 bp, Mus musculus
ggtccaggtcgctgatctccgccat

SEQ ID NO: 277500 - DNA, 25 bp, Mus musculus
ggacctctctctggcgacgtttccg

SEQ ID NO: 277501 - DNA, 25 bp, Mus musculus
gagaagtggctctccggacctctct

SEQ ID NO: 277502 - DNA, 25 bp, Mus musculus
gaccgcacaggggtctcctgggaaa

SEQ ID NO: 277503 - DNA, 25 bp, Mus musculus
cctcggacaattaccgccgcggaga

SEQ ID NO: 277504 - DNA, 25 bp, Mus musculus
aaaccagtgctctcgcgcgccggaa

SEQ ID NO: 277505 - DNA, 25 bp, Mus musculus
cggaagtgacgcacacgagccacgc

SEQ ID NO: 277506 - DNA, 25 bp, Mus musculus
tgcgcctggtgtacttgtgtatgcc

SEQ ID NO: 277507 - DNA, 25 bp, Mus musculus
ttggaggcaaatacagcagtgcgcc

SEQ ID NO: 277508 - DNA, 25 bp, Mus musculus
ggcgaacgatcggtcctacccacga

SEQ ID NO: 277509 - DNA, 25 bp, Mus musculus
tgttcccgacttagctgcgtcccgg

SEQ ID NO: 277510 - DNA, 25 bp, Mus musculus
tgggcctttgttcccgacttagctg

SEQ ID NO: 277511 - DNA, 25 bp, Mus musculus
cacccggcctctcgaagaggatgga

SEQ ID NO: 277512 - DNA, 25 bp, Mus musculus
acgcgcacccggcaacttggggacg

SEQ ID NO: 277513 - DNA, 25 bp, Mus musculus
ccggcagctgcaactttgggagccc

SEQ ID NO: 277514 - DNA, 25 bp, Mus musculus
cacgactccgatcccgctagcgacc

SEQ ID NO: 277515 - DNA, 25 bp, Mus musculus
gtgtcctagctgcaggcgaacgatc

SEQ ID NO: 277516 - DNA, 25 bp, Mus musculus
cactctgcgtcctcggctagtgcgg

SEQ ID NO: 277517 - DNA, 25 bp, Mus musculus
tcagaaaatgctggggctgcgctcc

SEQ ID NO: 277518 - DNA, 25 bp, Mus musculus
gcgctctcggctcagaaaatgctgg

SEQ ID NO: 277519 - DNA, 25 bp, Mus musculus
cgacactccggaggtcggcgtccag

SEQ ID NO: 277520 - DNA, 25 bp, Mus musculus
tcctccaaaagtttggcgcgcgctc

SEQ ID NO: 277521 - DNA, 25 bp, Mus musculus
ctcctgagccggcagctgcaacttt

SEQ ID NO: 277522 - DNA, 25 bp, Mus musculus
tagaccgacacggaggaccatcgcc

SEQ ID NO: 277523 - DNA, 25 bp, Mus musculus
tggagcaggccttcagcgacatccc

SEQ ID NO: 277524 - DNA, 25 bp, Mus musculus
ctcctgctgggcttgctgctcgcag

SEQ ID NO: 277525 - DNA, 25 bp, Mus musculus
gaggaccatcgccatgcaccgtcta

SEQ ID NO: 277526 - DNA, 25 bp, Mus musculus
gcgcctcgtcccgaagcgcgtgagt

SEQ ID NO: 277527 - DNA, 25 bp, Mus musculus
tcgcattgcctagaccgacacggag

SEQ ID NO: 277528 - DNA, 25 bp, Mus musculus
ccgtgagtcgcattgcctagaccga

SEQ ID NO: 277529 - DNA, 25 bp, Mus musculus
ttaaaggcagccgtgagtcgcattg

SEQ ID NO: 277530 - DNA, 25 bp, Mus musculus
tagcgacctgctgtctttaaaggca

SEQ ID NO: 277531 - DNA, 25 bp, Mus musculus
gtgcattagcgacctgctgtcttta

SEQ ID NO: 277532 - DNA, 25 bp, Mus musculus
cagccaggctgtgcattagcgacct

SEQ ID NO: 277533 - DNA, 25 bp, Mus musculus
aagtcccgcctagggcctgcaatct

SEQ ID NO: 277534 - DNA, 25 bp, Mus musculus
gagaagtcccgcctagggcctgcaa

SEQ ID NO: 277535 - DNA, 25 bp, Mus musculus
atgcaccgtctaccgctgctgctcc

SEQ ID NO: 277536 - DNA, 25 bp, Mus musculus
gcgcgaacatcgtgactcagccgga

SEQ ID NO: 277537 - DNA, 25 bp, Mus musculus
gcctgacgtcactgctaagaacgca

SEQ ID NO: 277538 - DNA, 25 bp, Mus musculus
tcccagaactagtgtgccggccaca

SEQ ID NO: 277539 - DNA, 25 bp, Mus musculus
tggtacgcaggcaaaacctcccaga

SEQ ID NO: 277540 - DNA, 25 bp, Mus musculus
cacggcgcagctgacatggtacgca

SEQ ID NO: 277541 - DNA, 25 bp, Mus musculus
cttgactaaaatgcagggcgcgttc

SEQ ID NO: 277542 - DNA, 25 bp, Mus musculus
gctaggacgtgactcgagccacatc

SEQ ID NO: 277543 - DNA, 25 bp, Mus musculus
accgtccaattgaaggtgggcactg

SEQ ID NO: 277544 - DNA, 25 bp, Mus musculus
gttccaagagaacgcagcctattca

SEQ ID NO: 277545 - DNA, 25 bp, Mus musculus
aacctcgttctgctgcgcgttccaa

SEQ ID NO: 277546 - DNA, 25 bp, Mus musculus
ggctagggtcaccagaacctcgttc

SEQ ID NO: 277547 - DNA, 25 bp, Mus musculus
cacatcggaactgagtggcgtatcc

SEQ ID NO: 277548 - DNA, 25 bp, Mus musculus
gcacgtgtcaaatggcgctcacctg

SEQ ID NO: 277549 - DNA, 25 bp, Mus musculus
acaagcggctagaacacgatccctc

SEQ ID NO: 277550 - DNA, 25 bp, Mus musculus
catggggaccgcagtactgcgacta

SEQ ID NO: 277551 - DNA, 25 bp, Mus musculus
aacctgaggcccacggatggagact

SEQ ID NO: 277552 - DNA, 25 bp, Mus musculus
cgaggatcaggagagccagcgcctt

SEQ ID NO: 277553 - DNA, 25 bp, Mus musculus
tacaaccatcgacggcgggcagttt

SEQ ID NO: 277554 - DNA, 25 bp, Mus musculus
gggcagtttacagatcccgcgccgc

SEQ ID NO: 277555 - DNA, 25 bp, Mus musculus
gcttcttgcagttgccatggggacc

SEQ ID NO: 277556 - DNA, 25 bp, Mus musculus
tgcgactacggcagccgcagagatc

SEQ ID NO: 277557 - DNA, 25 bp, Mus musculus
gccgcagagatccaaacactgtatt

SEQ ID NO: 277558 - DNA, 25 bp, Mus musculus
ctgtattcccgcctcattggactgg

SEQ ID NO: 277559 - DNA, 25 bp, Mus musculus
tgccttcttcgaccctaggtaatcg

SEQ ID NO: 277560 - DNA, 25 bp, Mus musculus
agctttccctccgtaactagacaga

SEQ ID NO: 277561 - DNA, 25 bp, Mus musculus
ccctccgtaactagacagaaatagc

SEQ ID NO: 277562 - DNA, 25 bp, Mus musculus
ccgcccagaaggttggcgctgcttc

SEQ ID NO: 277563 - DNA, 25 bp, Mus musculus
agaaatagcacgcttctcgccaccg

SEQ ID NO: 277564 - DNA, 25 bp, Mus musculus
cgtcgctatggcaaccaggccgggt

SEQ ID NO: 277565 - DNA, 25 bp, Mus musculus
agccctgggagccagcgaaggcgag

SEQ ID NO: 277566 - DNA, 25 bp, Mus musculus
aggagctggggaacaccgggcgcct

SEQ ID NO: 277567 - DNA, 25 bp, Mus musculus
cctctcgcggaggtgcacgccaagt

SEQ ID NO: 277568 - DNA, 25 bp, Mus musculus
aggtgcacgccaagttctcgggtga

SEQ ID NO: 277569 - DNA, 25 bp, Mus musculus
cacgccaagttctcgggtgagtgtg

SEQ ID NO: 277570 - DNA, 25 bp, Mus musculus
cactcgcgtgcgttctggggcccgt

SEQ ID NO: 277571 - DNA, 25 bp, Mus musculus
cacgtgtcgagtgtgcactcgcgtg

SEQ ID NO: 277572 - DNA, 25 bp, Mus musculus
gcacacgtgtcgagtgtgcactcgc

SEQ ID NO: 277573 - DNA, 25 bp, Mus musculus
cacgagcacacgtgtcgagtgtgca

SEQ ID NO: 277574 - DNA, 25 bp, Mus musculus
gcgtgagcacgagcacacgtgtcga

SEQ ID NO: 277575 - DNA, 25 bp, Mus musculus
cgcgtgtgagctggcccaaggctca

SEQ ID NO: 277576 - DNA, 25 bp, Mus musculus
tgtgcacgcgtgtgagctggcccaa

SEQ ID NO: 277577 - DNA, 25 bp, Mus musculus
ccaagttctcgggtgagtgtgcacg

SEQ ID NO: 277578 - DNA, 25 bp, Mus musculus
aaggaaatggcacgcgacaggtcgc

SEQ ID NO: 277579 - DNA, 25 bp, Mus musculus
cacgtgggacacctccttttggcgt

SEQ ID NO: 277580 - DNA, 25 bp, Mus musculus
aggcgcatgatggaggccttgtcca

SEQ ID NO: 277581 - DNA, 25 bp, Mus musculus
aatggcacgcgacaggtcgcacgtg

SEQ ID NO: 277582 - DNA, 25 bp, Mus musculus
tgcatgcgcaggtagctgattgtga

SEQ ID NO: 277583 - DNA, 25 bp, Mus musculus
ttcgacctgtgggaaggaaatggca

SEQ ID NO: 277584 - DNA, 25 bp, Mus musculus
ttccgcagctcggtgttcgacctgt

SEQ ID NO: 277585 - DNA, 25 bp, Mus musculus
ttctccttccgcagctcggtgttcg

SEQ ID NO: 277586 - DNA, 25 bp, Mus musculus
gccgcgtcccgcgacttctccttcc

SEQ ID NO: 277587 - DNA, 25 bp, Mus musculus
tgtgcgccagctggtacagcacctc

SEQ ID NO: 277588 - DNA, 25 bp, Mus musculus
cgcgcaaagggcagagtgtgcgcca

SEQ ID NO: 277589 - DNA, 25 bp, Mus musculus
aggccttgtccaggtgcgcgctgac

SEQ ID NO: 277590 - DNA, 25 bp, Mus musculus
catgatggaggccttgtccaggtgc

SEQ ID NO: 277591 - DNA, 25 bp, Mus musculus
caggtcgcacgtgggacacctcctt

SEQ ID NO: 277592 - DNA, 25 bp, Mus musculus
tcgctcgggaaaccagccttgaaga

SEQ ID NO: 277593 - DNA, 25 bp, Mus musculus
gtccgttcatgacccgccagggaga

SEQ ID NO: 277594 - DNA, 25 bp, Mus musculus
tccggagactttgcaacgccgtatg

SEQ ID NO: 277595 - DNA, 25 bp, Mus musculus
ccgaccacagggattgattgaactg

SEQ ID NO: 277596 - DNA, 25 bp, Mus musculus
acgttataaagactgccggcgccga

SEQ ID NO: 277597 - DNA, 25 bp, Mus musculus
gcgccgaaccggcttctagcgaaaa

SEQ ID NO: 277598 - DNA, 25 bp, Mus musculus
aagttttccgtctcagtgctccaca

SEQ ID NO: 277599 - DNA, 25 bp, Mus musculus
gcgcgtgcgcaaactactgtcgctc

SEQ ID NO: 277600 - DNA, 25 bp, Mus musculus
caatccctggtgacgcaaaatggcg

SEQ ID NO: 277601 - DNA, 25 bp, Mus musculus
ccggacctcaggtgcatagagtctg

SEQ ID NO: 277602 - DNA, 25 bp, Mus musculus
taggctggaactctgtcatgacacg

SEQ ID NO: 277603 - DNA, 25 bp, Mus musculus
gacacgtgtctctgtagctcggtta

SEQ ID NO: 277604 - DNA, 25 bp, Mus musculus
cgccatcgtgcgacagaaatttttg

SEQ ID NO: 277605 - DNA, 25 bp, Mus musculus
atcggaggctcaacggtcccattcc

SEQ ID NO: 277606 - DNA, 25 bp, Mus musculus
gcttggcttgcttggggtggagccc

SEQ ID NO: 277607 - DNA, 25 bp, Mus musculus
gcatgcgcccgccacgctttcgcgc

SEQ ID NO: 277608 - DNA, 25 bp, Mus musculus
gctggtggagagagctgtggcgcat

SEQ ID NO: 277609 - DNA, 25 bp, Mus musculus
ccaaggactgctggtggagagagct

SEQ ID NO: 277610 - DNA, 25 bp, Mus musculus
ccaagcgcgcggtccaaggactgct

SEQ ID NO: 277611 - DNA, 25 bp, Mus musculus
agaaaggcttggcttgcttggggtg

SEQ ID NO: 277612 - DNA, 25 bp, Mus musculus
gccacgcggatccttggtgggaaga

SEQ ID NO: 277613 - DNA, 25 bp, Mus musculus
cgacaagctgccttcgagcccaagt

SEQ ID NO: 277614 - DNA, 25 bp, Mus musculus
agacgacaagctgccttcgagccca

SEQ ID NO: 277615 - DNA, 25 bp, Mus musculus
gcccctcgccagtagccgccgcggc

SEQ ID NO: 277616 - DNA, 25 bp, Mus musculus
ggcgcggtatgcacgccgggccaaa

SEQ ID NO: 277617 - DNA, 25 bp, Mus musculus
gcgcccgccacgctttcgcgctgcg

SEQ ID NO: 277618 - DNA, 25 bp, Mus musculus
gacaagctgccttcgagcccaagtg

SEQ ID NO: 277619 - DNA, 25 bp, Mus musculus
caagcgcgcggtccaaggactgctg

SEQ ID NO: 277620 - DNA, 25 bp, Mus musculus
cgctgctgaaatcgtcacgggttgc

SEQ ID NO: 277621 - DNA, 25 bp, Mus musculus
gggcggctcgctgcattacaccacg

SEQ ID NO: 277622 - DNA, 25 bp, Mus musculus
cccgaacagcaagtatgtgaagctg

SEQ ID NO: 277623 - DNA, 25 bp, Mus musculus
gctgcggccgaatgcttggagtccc

SEQ ID NO: 277624 - DNA, 25 bp, Mus musculus
tccgctcactggcatgtcggccgag

SEQ ID NO: 277625 - DNA, 25 bp, Mus musculus
tcgcgggatctcagggaaccggacc

SEQ ID NO: 277626 - DNA, 25 bp, Mus musculus
aacccgcaggctggactgcaacggc

SEQ ID NO: 277627 - DNA, 25 bp, Mus musculus
cgggttgcggtattctccatccaca

SEQ ID NO: 277628 - DNA, 25 bp, Mus musculus
ttttacgcgaatgaagcgctgctga

SEQ ID NO: 277629 - DNA, 25 bp, Mus musculus
cgcttgtttctttttacgcgaatga

SEQ ID NO: 277630 - DNA, 25 bp, Mus musculus
ggccgcgttgaagtgctcacagacg

SEQ ID NO: 277631 - DNA, 25 bp, Mus musculus
catgctcaaggccatgttcagcggc

SEQ ID NO: 277632 - DNA, 25 bp, Mus musculus
aggatcctttagacgttttctcaga

SEQ ID NO: 277633 - DNA, 25 bp, Mus musculus
tcacggggcaggacaccatgctcaa

SEQ ID NO: 277634 - DNA, 25 bp, Mus musculus
tccctggagaggtcggcctgtgact

SEQ ID NO: 277635 - DNA, 25 bp, Mus musculus
gcttggctacgccagagccagcaca

SEQ ID NO: 277636 - DNA, 25 bp, Mus musculus
ccagcacagagcaagacgcgggttc

SEQ ID NO: 277637 - DNA, 25 bp, Mus musculus
ctctggaactgcgagtccggccgtg

SEQ ID NO: 277638 - DNA, 25 bp, Mus musculus
ctcgtgaggccggtgctctggaact

SEQ ID NO: 277639 - DNA, 25 bp, Mus musculus
gcgagagccctgacccgctcgtgag

SEQ ID NO: 277640 - DNA, 25 bp, Mus musculus
gggacacagtgccaacctctagccg

SEQ ID NO: 277641 - DNA, 25 bp, Mus musculus
ggtacagggacacagtgccaacctc

SEQ ID NO: 277642 - DNA, 25 bp, Mus musculus
cacagagcaagacgcgggttcgcga

SEQ ID NO: 277643 - DNA, 25 bp, Mus musculus
cccgcaatgcgaaaagaagggcagg

SEQ ID NO: 277644 - DNA, 25 bp, Mus musculus
tacgccagagccagcacagagcaag

SEQ ID NO: 277645 - DNA, 25 bp, Mus musculus
gcggcttcagccaatcagtggcttc

SEQ ID NO: 277646 - DNA, 25 bp, Mus musculus
aatcagtggcttcaaggccgcccgt

SEQ ID NO: 277647 - DNA, 25 bp, Mus musculus
gggttcgcgaaagcggcttcagcca

SEQ ID NO: 277648 - DNA, 25 bp, Mus musculus
cagtttcttcctttgcggctggctc

SEQ ID NO: 277649 - DNA, 25 bp, Mus musculus
ggcatgctcggagcctctctagcca

SEQ ID NO: 277650 - DNA, 25 bp, Mus musculus
ggccttaaagggacctcagccatta

SEQ ID NO: 277651 - DNA, 25 bp, Mus musculus
agacgtcagctcctgcccatcggaa

SEQ ID NO: 277652 - DNA, 25 bp, Mus musculus
tgcagattccctctcaggtctcttc

SEQ ID NO: 277653 - DNA, 25 bp, Mus musculus
tacgccctctgtgaaatgcaaaatg

SEQ ID NO: 277654 - DNA, 25 bp, Mus musculus
tgcctccaggagtttacgccctctg

SEQ ID NO: 277655 - DNA, 25 bp, Mus musculus
ctacgccttacggttgcctccagga

SEQ ID NO: 277656 - DNA, 25 bp, Mus musculus
gggacggagtaatctctacgcctta

SEQ ID NO: 277657 - DNA, 25 bp, Mus musculus
acccaatctcttggggaggcgcaga

SEQ ID NO: 277658 - DNA, 25 bp, Mus musculus
gcgatgtgggctgtactaagtcacc

SEQ ID NO: 277659 - DNA, 25 bp, Mus musculus
tcccggagagcgacgaggatcgcaa

SEQ ID NO: 277660 - DNA, 25 bp, Mus musculus
cccggacagaagagtaggctccaga

SEQ ID NO: 277661 - DNA, 25 bp, Mus musculus
cgatgttcttaacgtcccggacaga

SEQ ID NO: 277662 - DNA, 25 bp, Mus musculus
tcccaggctgcgcagcatctcagta

SEQ ID NO: 277663 - DNA, 25 bp, Mus musculus
actgcggcagcgcatgcgtattccg

SEQ ID NO: 277664 - DNA, 25 bp, Mus musculus
catactaaagatggccactgcggca

SEQ ID NO: 277665 - DNA, 25 bp, Mus musculus
ggactcattaacctcggcccatact

SEQ ID NO: 277666 - DNA, 25 bp, Mus musculus
cgcatgcgcaatttggcccttagga

SEQ ID NO: 277667 - DNA, 25 bp, Mus musculus
cgcggtagtcaaagctacttggaag

SEQ ID NO: 277668 - DNA, 25 bp, Mus musculus
gcagcggtacaaacctggagctaaa

SEQ ID NO: 277669 - DNA, 25 bp, Mus musculus
cgcgtctactcagcagcggtacaaa

SEQ ID NO: 277670 - DNA, 25 bp, Mus musculus
gggcaaacctagttcgcgtctactc

SEQ ID NO: 277671 - DNA, 25 bp, Mus musculus
gaagtcatctttttagaccgggcaa

SEQ ID NO: 277672 - DNA, 25 bp, Mus musculus
ccatcaccgggatggaagtcatctt

SEQ ID NO: 277673 - DNA, 25 bp, Mus musculus
aagggcctgttttctcgctttcaca

SEQ ID NO: 277674 - DNA, 25 bp, Mus musculus
gacccagaattctgccgttcccagg

SEQ ID NO: 277675 - DNA, 25 bp, Mus musculus
gggacccgcaggaaacacgctcgga

SEQ ID NO: 277676 - DNA, 25 bp, Mus musculus
ggctagaaaaccatggctaggggtc

SEQ ID NO: 277677 - DNA, 25 bp, Mus musculus
tgagtagtgcgtgccctgcgctgca

SEQ ID NO: 277678 - DNA, 25 bp, Mus musculus
tagtgcgtgccctgcgctgcagtcg

SEQ ID NO: 277679 - DNA, 25 bp, Mus musculus
ccgaccggtgagtagtgcgtgccct

SEQ ID NO: 277680 - DNA, 25 bp, Mus musculus
gctacgcgaggtgggctgagcagga

SEQ ID NO: 277681 - DNA, 25 bp, Mus musculus
ggtcggcgctgaggctacgcgaggt

SEQ ID NO: 277682 - DNA, 25 bp, Mus musculus
aaaaccatggctaggggtcggcgct

SEQ ID NO: 277683 - DNA, 25 bp, Mus musculus
gctgtccaggaggctagaaaaccat

SEQ ID NO: 277684 - DNA, 25 bp, Mus musculus
cccggaagcggctgtccaggaggct

SEQ ID NO: 277685 - DNA, 25 bp, Mus musculus
agcatcacgtgacagggcccggaag

SEQ ID NO: 277686 - DNA, 25 bp, Mus musculus
ccagcatcacgtgacagggcccgga

SEQ ID NO: 277687 - DNA, 25 bp, Mus musculus
gagccagcatcacgtgacagggccc

SEQ ID NO: 277688 - DNA, 25 bp, Mus musculus
cacggaatggagcggcacgtgacct

SEQ ID NO: 277689 - DNA, 25 bp, Mus musculus
cggcacgtgacctgggctagggagc

SEQ ID NO: 277690 - DNA, 25 bp, Mus musculus
tgccaggccccgtgttacctgggta

SEQ ID NO: 277691 - DNA, 25 bp, Mus musculus
cccggatagcccaagagaacctcgt

SEQ ID NO: 277692 - DNA, 25 bp, Mus musculus
ccggatagcccaagagaacctcgtg

SEQ ID NO: 277693 - DNA, 25 bp, Mus musculus
cggatagcccaagagaacctcgtgc

SEQ ID NO: 277694 - DNA, 25 bp, Mus musculus
ggatagcccaagagaacctcgtgcc

SEQ ID NO: 277695 - DNA, 25 bp, Mus musculus
gatagcccaagagaacctcgtgcca

SEQ ID NO: 277696 - DNA, 25 bp, Mus musculus
tagcccaagagaacctcgtgccagg

SEQ ID NO: 277697 - DNA, 25 bp, Mus musculus
agcccaagagaacctcgtgccaggc

SEQ ID NO: 277698 - DNA, 25 bp, Mus musculus
tcccggatagcccaagagaacctcg

SEQ ID NO: 277699 - DNA, 25 bp, Mus musculus
gaacctcgtgccaggccccgtgtta

SEQ ID NO: 277700 - DNA, 25 bp, Mus musculus
acgcgcacctcctggtggggcaccc

SEQ ID NO: 277701 - DNA, 25 bp, Mus musculus
ttctcacgcgcacctcctggtgggg

SEQ ID NO: 277702 - DNA, 25 bp, Mus musculus
gggaccactcgtgccccctccctgc

SEQ ID NO: 277703 - DNA, 25 bp, Mus musculus
tttctcacgcgcacctcctggtggg

SEQ ID NO: 277704 - DNA, 25 bp, Mus musculus
tgtgagcgcacgtggtaactcatgc

SEQ ID NO: 277705 - DNA, 25 bp, Mus musculus
gcagtcgtggtcacaacgccaccgg

SEQ ID NO: 277706 - DNA, 25 bp, Mus musculus
cgcttgaagcgctgctggcacacag

SEQ ID NO: 277707 - DNA, 25 bp, Mus musculus
cactggtagggcttctcgtccgaat

SEQ ID NO: 277708 - DNA, 25 bp, Mus musculus
tagggcttctcgtccgaatgcgaca

SEQ ID NO: 277709 - DNA, 25 bp, Mus musculus
gcaggcgtgattcttccggatgcgc

SEQ ID NO: 277710 - DNA, 25 bp, Mus musculus
tcgtccgaatgcgacagcttatgtc

SEQ ID NO: 277711 - DNA, 25 bp, Mus musculus
ccgcacatctcgcaggcgtgattct

SEQ ID NO: 277712 - DNA, 25 bp, Mus musculus
tcccagaggcagtcgtggtcacaac

SEQ ID NO: 277713 - DNA, 25 bp, Mus musculus
cttccggatgcgcttcccagaggca

SEQ ID NO: 277714 - DNA, 25 bp, Mus musculus
acgtggtaactcatgcggtccttgc

SEQ ID NO: 277715 - DNA, 25 bp, Mus musculus
agcttatgtcggttcaggtggtaga

SEQ ID NO: 277716 - DNA, 25 bp, Mus musculus
tatgtcggttcaggtggtagacgtc

SEQ ID NO: 277717 - DNA, 25 bp, Mus musculus
tcatgcggtccttgcgcttgaagcg

SEQ ID NO: 277718 - DNA, 25 bp, Mus musculus
gtcggtcgctgtgcttaagctttcg

SEQ ID NO: 277719 - DNA, 25 bp, Mus musculus
ggagggactggggagccacccagca

SEQ ID NO: 277720 - DNA, 25 bp, Mus musculus
cgcgcacataacagggacgtcgttg

SEQ ID NO: 277721 - DNA, 25 bp, Mus musculus
gccagcggccgttatttcgcgcgca

SEQ ID NO: 277722 - DNA, 25 bp, Mus musculus
cacataacagggacgtcgttgctga

SEQ ID NO: 277723 - DNA, 25 bp, Mus musculus
ataacagggacgtcgttgctgagcg

SEQ ID NO: 277724 - DNA, 25 bp, Mus musculus
agcgcgtgcccgcttaacggtcggt

SEQ ID NO: 277725 - DNA, 25 bp, Mus musculus
ccgcttaacggtcggtcgctgtgct

SEQ ID NO: 277726 - DNA, 25 bp, Mus musculus
cttaacggtcggtcgctgtgcttaa

SEQ ID NO: 277727 - DNA, 25 bp, Mus musculus
gcgcgcacgcgcacataacagggac

SEQ ID NO: 277728 - DNA, 25 bp, Mus musculus
cccaagacggttgctgattggctgg

SEQ ID NO: 277729 - DNA, 25 bp, Mus musculus
agcggccgttatttcgcgcgcacgc

SEQ ID NO: 277730 - DNA, 25 bp, Mus musculus
cggtcgctgtgcttaagctttcgcg

SEQ ID NO: 277731 - DNA, 25 bp, Mus musculus
cgcgggagactaggcggcttctctt

SEQ ID NO: 277732 - DNA, 25 bp, Mus musculus
gctgcggacacgtcttagcccttaa

SEQ ID NO: 277733 - DNA, 25 bp, Mus musculus
cgccgaaggcagcgaatagaggaca

SEQ ID NO: 277734 - DNA, 25 bp, Mus musculus
ccggctggattttccgggaccactg

SEQ ID NO: 277735 - DNA, 25 bp, Mus musculus
cgggaccactgctactctgtaagtc

SEQ ID NO: 277736 - DNA, 25 bp, Mus musculus
ctctgtaagtctcacgcagtggtgc

SEQ ID NO: 277737 - DNA, 25 bp, Mus musculus
aagtctcacgcagtggtgctccctc

SEQ ID NO: 277738 - DNA, 25 bp, Mus musculus
tgaggtggccgacgccatctcccgt

SEQ ID NO: 277739 - DNA, 25 bp, Mus musculus
ggacacgtcttagcccttaagctca

SEQ ID NO: 277740 - DNA, 25 bp, Mus musculus
tcatagccttcccttcttcggcccg

SEQ ID NO: 277741 - DNA, 25 bp, Mus musculus
cggcccgcttctctcttttgaatta

SEQ ID NO: 277742 - DNA, 25 bp, Mus musculus
cgcttctctcttttgaattaccggg

SEQ ID NO: 277743 - DNA, 25 bp, Mus musculus
tcagattcgaccaatcgcagctacg

SEQ ID NO: 277744 - DNA, 25 bp, Mus musculus
caatcgcagctacgtgccgccggaa

SEQ ID NO: 277745 - DNA, 25 bp, Mus musculus
gtaattccgccgtctcgggctcact

SEQ ID NO: 277746 - DNA, 25 bp, Mus musculus
acgtgccgcggtaacatggcagagc

SEQ ID NO: 277747 - DNA, 25 bp, Mus musculus
ccgcccaagcgcctccactaccctg

SEQ ID NO: 277748 - DNA, 25 bp, Mus musculus
gcagtcaggcctcacgtgccgcggt

SEQ ID NO: 277749 - DNA, 25 bp, Mus musculus
cccaagcgcctccactaccctgccc

SEQ ID NO: 277750 - DNA, 25 bp, Mus musculus
cgtgccgcggtaacatggcagagca

SEQ ID NO: 277751 - DNA, 25 bp, Mus musculus
gaggagttttcactgcgcgcgcctc

SEQ ID NO: 277752 - DNA, 25 bp, Mus musculus
tcacgtgccgcggtaacatggcaga

SEQ ID NO: 277753 - DNA, 25 bp, Mus musculus
agtcaggcctcacgtgccgcggtaa

SEQ ID NO: 277754 - DNA, 25 bp, Mus musculus
cgccactcgcctctaattctcccga

SEQ ID NO: 277755 - DNA, 25 bp, Mus musculus
aagctgtggacagcccagcccactc

SEQ ID NO: 277756 - DNA, 25 bp, Mus musculus
gcgcgcctccagcacggctggacac

SEQ ID NO: 277757 - DNA, 25 bp, Mus musculus
agcacggctggacacgcactgctcg

SEQ ID NO: 277758 - DNA, 25 bp, Mus musculus
cccttccacgcgccatagcgggagg

SEQ ID NO: 277759 - DNA, 25 bp, Mus musculus
caggcctcacgtgccgcggtaacat

SEQ ID NO: 277760 - DNA, 25 bp, Mus musculus
gacctgcaaagactcgcgtgaacta

SEQ ID NO: 277761 - DNA, 25 bp, Mus musculus
ccaaggccgactcgcggcaggaagt

SEQ ID NO: 277762 - DNA, 25 bp, Mus musculus
ggtgctcacctaggaacccagggtc

SEQ ID NO: 277763 - DNA, 25 bp, Mus musculus
tgaactacgtccttgcctcacggga

SEQ ID NO: 277764 - DNA, 25 bp, Mus musculus
gcggatgcataccattagccaaggc

SEQ ID NO: 277765 - DNA, 25 bp, Mus musculus
acccgagtgctcacagaggccggtc

SEQ ID NO: 277766 - DNA, 25 bp, Mus musculus
tcggacccaagagctggagctgcct

SEQ ID NO: 277767 - DNA, 25 bp, Mus musculus
cccggaagtggcttcacttctattc

SEQ ID NO: 277768 - DNA, 25 bp, Mus musculus
tgtccttggcgtacaaactaaaggc

SEQ ID NO: 277769 - DNA, 25 bp, Mus musculus
ttcaaacaatcttacccgccggtgc

SEQ ID NO: 277770 - DNA, 25 bp, Mus musculus
gaaagatgctttcgccggtattaca

SEQ ID NO: 277771 - DNA, 25 bp, Mus musculus
cttctattcaaaaagggcggatgca

SEQ ID NO: 277772 - DNA, 25 bp, Mus musculus
gaataccacgtagcgacctgctcgg

SEQ ID NO: 277773 - DNA, 25 bp, Mus musculus
taccagtccggagctaccgaactca

SEQ ID NO: 277774 - DNA, 25 bp, Mus musculus
ggaactcttgcgtcttcgcggcttc

SEQ ID NO: 277775 - DNA, 25 bp, Mus musculus
gagcagccactgtcccggcgaacta

SEQ ID NO: 277776 - DNA, 25 bp, Mus musculus
ggacccgtctccatagctgcgggcg

SEQ ID NO: 277777 - DNA, 25 bp, Mus musculus
ccactaagtgcgatccggcccggga

SEQ ID NO: 277778 - DNA, 25 bp, Mus musculus
gtcccggttccaccactaagtgcga

SEQ ID NO: 277779 - DNA, 25 bp, Mus musculus
tagtcactggcggtcccggttccac

SEQ ID NO: 277780 - DNA, 25 bp, Mus musculus
ccaccaattcgactggggccgaagt

SEQ ID NO: 277781 - DNA, 25 bp, Mus musculus
tctgtgatgatcctgggacgcaggc

SEQ ID NO: 277782 - DNA, 25 bp, Mus musculus
agaggccgaggtctgtgatgatcct

SEQ ID NO: 277783 - DNA, 25 bp, Mus musculus
ctaccgtgctgctcgtagctgtcgt

SEQ ID NO: 277784 - DNA, 25 bp, Mus musculus
agggtcagcatcactaccgtgctgc

SEQ ID NO: 277785 - DNA, 25 bp, Mus musculus
tcttcgcggcttcgggtgaggcctc

SEQ ID NO: 277786 - DNA, 25 bp, Mus musculus
ggcgaactacgcctgcgcgaggaaa

SEQ ID NO: 277787 - DNA, 25 bp, Mus musculus
aggcctccagggtcagcatcactac

SEQ ID NO: 277788 - DNA, 25 bp, Mus musculus
ctgcacagccctggggcgccgagct

SEQ ID NO: 277789 - DNA, 25 bp, Mus musculus
gccgtgccagctgtccatccgagga

SEQ ID NO: 277790 - DNA, 25 bp, Mus musculus
aaagcggctgagagccatcggtaca

SEQ ID NO: 277791 - DNA, 25 bp, Mus musculus
ccgagcttcgcggtacagaggactt

SEQ ID NO: 277792 - DNA, 25 bp, Mus musculus
acttgaaagcggctgagagccatcg

SEQ ID NO: 277793 - DNA, 25 bp, Mus musculus
tgccctcggactcaccggggccgcg

SEQ ID NO: 277794 - DNA, 25 bp, Mus musculus
agcccgtacccgtgcggctggctgc

SEQ ID NO: 277795 - DNA, 25 bp, Mus musculus
ggtcctagagcagctcgccgaggcc

SEQ ID NO: 277796 - DNA, 25 bp, Mus musculus
ggctcctccgggtcctagagcagct

SEQ ID NO: 277797 - DNA, 25 bp, Mus musculus
gcacggctagaactggtccacgccg

SEQ ID NO: 277798 - DNA, 25 bp, Mus musculus
cagggcacggctagaactggtccac

SEQ ID NO: 277799 - DNA, 25 bp, Mus musculus
atccgaggaggcacgccgctagcgc

SEQ ID NO: 277800 - DNA, 25 bp, Mus musculus
tgccagctgtccatccgaggaggca

SEQ ID NO: 277801 - DNA, 25 bp, Mus musculus
ttcgcggtacagaggacttgaaagc

SEQ ID NO: 277802 - DNA, 25 bp, Mus musculus
cgacgcgagaaagaacgaagaagga

SEQ ID NO: 277803 - DNA, 25 bp, Mus musculus
agcgcacgtggcctacgcgggcaca

SEQ ID NO: 277804 - DNA, 25 bp, Mus musculus
cgcggacacctctgagtcccggcta

SEQ ID NO: 277805 - DNA, 25 bp, Mus musculus
agcaatctcggtggggcgtcaagat

SEQ ID NO: 277806 - DNA, 25 bp, Mus musculus
cgtcaagatccagcagcggcggagc

SEQ ID NO: 277807 - DNA, 25 bp, Mus musculus
gctaggcatggtctgttggttagga

SEQ ID NO: 277808 - DNA, 25 bp, Mus musculus
cctacgcgggcacagcaatctcggt

SEQ ID NO: 277809 - DNA, 25 bp, Mus musculus
acgggcgaaccaatgaatgtccgcc

SEQ ID NO: 277810 - DNA, 25 bp, Mus musculus
tcaggtcgccgacccaggctctggg

SEQ ID NO: 277811 - DNA, 25 bp, Mus musculus
ccagacgggcgaaccaatgaatgtc

SEQ ID NO: 277812 - DNA, 25 bp, Mus musculus
ggctcatcccttagcgctcaggtcg

SEQ ID NO: 277813 - DNA, 25 bp, Mus musculus
gggctggtgagtgcgcactccaccc

SEQ ID NO: 277814 - DNA, 25 bp, Mus musculus
cgagcaccgaacctcgggctggtga

SEQ ID NO: 277815 - DNA, 25 bp, Mus musculus
gccttcgcagagcacccaaccgccc

SEQ ID NO: 277816 - DNA, 25 bp, Mus musculus
tgcggcacgcgcttcgctcagagct

SEQ ID NO: 277817 - DNA, 25 bp, Mus musculus
cgagacttcaagctacccgccagtg

SEQ ID NO: 277818 - DNA, 25 bp, Mus musculus
ggcgctttgcgcagagctccaatta

SEQ ID NO: 277819 - DNA, 25 bp, Mus musculus
accgttccaacctggcggagcatgc

SEQ ID NO: 277820 - DNA, 25 bp, Mus musculus
cgtccctttgcgtgcacggaatgcg

SEQ ID NO: 277821 - DNA, 25 bp, Mus musculus
ttctcgcagaagtcggcgctgacca

SEQ ID NO: 277822 - DNA, 25 bp, Mus musculus
agcacggccgcacgcatacgggcga

SEQ ID NO: 277823 - DNA, 25 bp, Mus musculus
agcgaccctaccaatgcccggaatg

SEQ ID NO: 277824 - DNA, 25 bp, Mus musculus
gcccggaatgcgacaagcgcttctc

SEQ ID NO: 277825 - DNA, 25 bp, Mus musculus
agccgtacgcatgcgcacactgtgg

SEQ ID NO: 277826 - DNA, 25 bp, Mus musculus
gcctctacatctgcgcgggctgcgg

SEQ ID NO: 277827 - DNA, 25 bp, Mus musculus
cgagaagccttacgcgtgcccggac

SEQ ID NO: 277828 - DNA, 25 bp, Mus musculus
gagccttcggcggaagttcgtgcct

SEQ ID NO: 277829 - DNA, 25 bp, Mus musculus
gagctccaattacgcgcagcatctg

SEQ ID NO: 277830 - DNA, 25 bp, Mus musculus
tgcgccctgacagcagcgtcgggct

SEQ ID NO: 277831 - DNA, 25 bp, Mus musculus
cctcttccggggctagcttcgtcaa

SEQ ID NO: 277832 - DNA, 25 bp, Mus musculus
ttccggagagcgctcctgaaagccc

SEQ ID NO: 277833 - DNA, 25 bp, Mus musculus
gacaccaaagctgcgcttccggaga

SEQ ID NO: 277834 - DNA, 25 bp, Mus musculus
ggcgacgacgactggaactcctctc

SEQ ID NO: 277835 - DNA, 25 bp, Mus musculus
accggcatgactgacgcggcacaca

SEQ ID NO: 277836 - DNA, 25 bp, Mus musculus
aacggccacttaccggcatgactga

SEQ ID NO: 277837 - DNA, 25 bp, Mus musculus
ggtcgaacggccacttaccggcatg

SEQ ID NO: 277838 - DNA, 25 bp, Mus musculus
aactgagaaacgactgcagctctgg

SEQ ID NO: 277839 - DNA, 25 bp, Mus musculus
cgtcgggctcggaaacagtgcatcc

SEQ ID NO: 277840 - DNA, 25 bp, Mus musculus
aaacgactgcagctctggccacggc

SEQ ID NO: 277841 - DNA, 25 bp, Mus musculus
tccggggctagcttcgtcaaggccc

SEQ ID NO: 277842 - DNA, 25 bp, Mus musculus
gaaacagtgcatccgggctggagac

SEQ ID NO: 277843 - DNA, 25 bp, Mus musculus
gaccgtgcggaaggtaaactgagaa

SEQ ID NO: 277844 - DNA, 25 bp, Mus musculus
cgaggacggacaaggactgcttaca

SEQ ID NO: 277845 - DNA, 25 bp, Mus musculus
agccgtggacattccgcccactagt

SEQ ID NO: 277846 - DNA, 25 bp, Mus musculus
gagtcttcttgtcccacagtaccgc

SEQ ID NO: 277847 - DNA, 25 bp, Mus musculus
gggcagcagcagagtcttcttgtcc

SEQ ID NO: 277848 - DNA, 25 bp, Mus musculus
tgggctccggactgaatctgaacgg

SEQ ID NO: 277849 - DNA, 25 bp, Mus musculus
gactgcttacatgtcctcaagcgtg

SEQ ID NO: 277850 - DNA, 25 bp, Mus musculus
acatgtcctcaagcgtgggctccgg

SEQ ID NO: 277851 - DNA, 25 bp, Mus musculus
tcacggcttctcagtgcgttcccgg

SEQ ID NO: 277852 - DNA, 25 bp, Mus musculus
tcggagccgcctccagagttctgac

SEQ ID NO: 277853 - DNA, 25 bp, Mus musculus
ctccggactgaatctgaacgggcgg

SEQ ID NO: 277854 - DNA, 25 bp, Mus musculus
tacgtgaattttagctacggcccgc

SEQ ID NO: 277855 - DNA, 25 bp, Mus musculus
gccggaggaggacccagtcatatac

SEQ ID NO: 277856 - DNA, 25 bp, Mus musculus
cagagttctgaccaatcacggcttc

SEQ ID NO: 277857 - DNA, 25 bp, Mus musculus
ggacccagtcatatacgtgaatttt

SEQ ID NO: 277858 - DNA, 25 bp, Mus musculus
gagatgatcaaccacgcgagccgga

SEQ ID NO: 277859 - DNA, 25 bp, Mus musculus
ccaaggttacgccaggagatgatca

SEQ ID NO: 277860 - DNA, 25 bp, Mus musculus
cgagaggcgggcttcctttactcaa

SEQ ID NO: 277861 - DNA, 25 bp, Mus musculus
attaaccgtctgcttgcacaaccgg

SEQ ID NO: 277862 - DNA, 25 bp, Mus musculus
atgacgattcccgtaccgagaggcg

SEQ ID NO: 277863 - DNA, 25 bp, Mus musculus
acgcaggagtccatgccaatgctca

SEQ ID NO: 277864 - DNA, 25 bp, Mus musculus
cctccaggagtttgagcagggtctc

SEQ ID NO: 277865 - DNA, 25 bp, Mus musculus
agcctcagcccttcatgccggagaa

SEQ ID NO: 277866 - DNA, 25 bp, Mus musculus
gtagttggagaaactccggccggca

SEQ ID NO: 277867 - DNA, 25 bp, Mus musculus
aaggaaccttctgcggccactagcg

SEQ ID NO: 277868 - DNA, 25 bp, Mus musculus
tgcggaccagaaggcccagatacct

SEQ ID NO: 277869 - DNA, 25 bp, Mus musculus
aggcccagatacctgcagatgagtc

SEQ ID NO: 277870 - DNA, 25 bp, Mus musculus
agatgagtctcccagccacagcggg

SEQ ID NO: 277871 - DNA, 25 bp, Mus musculus
gccgcgcggcctctatttatataca

SEQ ID NO: 277872 - DNA, 25 bp, Mus musculus
cagcggtacggcctctcgcctgtgt

SEQ ID NO: 277873 - DNA, 25 bp, Mus musculus
cgtgactggttaacggcggccggct

SEQ ID NO: 277874 - DNA, 25 bp, Mus musculus
ttccacagtcatcacacttataagg

SEQ ID NO: 277875 - DNA, 25 bp, Mus musculus
gtcatcacacttataaggtcgctcc

SEQ ID NO: 277876 - DNA, 25 bp, Mus musculus
cccactatgcacgcgatggtgctgt

SEQ ID NO: 277877 - DNA, 25 bp, Mus musculus
cagcgtggaggagcgacagaagccc

SEQ ID NO: 277878 - DNA, 25 bp, Mus musculus
ccacacacagcgcagcggtacggcc

SEQ ID NO: 277879 - DNA, 25 bp, Mus musculus
aacgctggtgctgaatgagtgtaga

SEQ ID NO: 277880 - DNA, 25 bp, Mus musculus
aaggtcttgccacaatcggggcagc

SEQ ID NO: 277881 - DNA, 25 bp, Mus musculus
ccacaatcggggcagctgtacgtgc

SEQ ID NO: 277882 - DNA, 25 bp, Mus musculus
ggcatggatggccagaactgagctc

SEQ ID NO: 277883 - DNA, 25 bp, Mus musculus
gcactctgggcacttgaagggcttt

SEQ ID NO: 277884 - DNA, 25 bp, Mus musculus
tctgggcacttgaagggcttttcac

SEQ ID NO: 277885 - DNA, 25 bp, Mus musculus
acttgaagggcttttcacgggcgtg

SEQ ID NO: 277886 - DNA, 25 bp, Mus musculus
atgcgggctcgttgccagagaaaca

SEQ ID NO: 277887 - DNA, 25 bp, Mus musculus
cgtttgaccgcacaaccaggctctg

SEQ ID NO: 277888 - DNA, 25 bp, Mus musculus
gtcagcgagaaggagcgacgcttcc

SEQ ID NO: 277889 - DNA, 25 bp, Mus musculus
ccactcctcccaggattggttgttg

SEQ ID NO: 277890 - DNA, 25 bp, Mus musculus
tggcggacgatcctacgacccagtt

SEQ ID NO: 277891 - DNA, 25 bp, Mus musculus
cgaagcggcaagtgagaccaaggtc

SEQ ID NO: 277892 - DNA, 25 bp, Mus musculus
tccgaccatgtgctggctactgagt

SEQ ID NO: 277893 - DNA, 25 bp, Mus musculus
ctgtctgcaggtttctccgaccatg

SEQ ID NO: 277894 - DNA, 25 bp, Mus musculus
attaaccctggactggatctcccgg

SEQ ID NO: 277895 - DNA, 25 bp, Mus musculus
tggaaactcgttggcattaaccctg

SEQ ID NO: 277896 - DNA, 25 bp, Mus musculus
caggaagtgtccgtccctggccagt

SEQ ID NO: 277897 - DNA, 25 bp, Mus musculus
cgcgttcagagcctccgaggagacc

SEQ ID NO: 277898 - DNA, 25 bp, Mus musculus
cgacccagttcgagtgcctggagcc

SEQ ID NO: 277899 - DNA, 25 bp, Mus musculus
ccggctgtctctgcttcaccgtggt

SEQ ID NO: 277900 - DNA, 25 bp, Mus musculus
cgagaatgaactggatctgcgctgc

SEQ ID NO: 277901 - DNA, 25 bp, Mus musculus
gatctgcgctgctgccggctacagt

SEQ ID NO: 277902 - DNA, 25 bp, Mus musculus
tctacctggtctcccgagaatgaac

SEQ ID NO: 277903 - DNA, 25 bp, Mus musculus
gacactgctgcggagctgtgacagt

SEQ ID NO: 277904 - DNA, 25 bp, Mus musculus
cggctacagtgtgggcgctccttac

SEQ ID NO: 277905 - DNA, 25 bp, Mus musculus
tcgcctactcccagctcggggaagt

SEQ ID NO: 277906 - DNA, 25 bp, Mus musculus
cctactcccagctcggggaagttgc

SEQ ID NO: 277907 - DNA, 25 bp, Mus musculus
tgggcgctccttactagttgaggta

SEQ ID NO: 277908 - DNA, 25 bp, Mus musculus
tgaggtaggttctggctccgccgca

SEQ ID NO: 277909 - DNA, 25 bp, Mus musculus
tgacagtggacagcggagttagctc

SEQ ID NO: 277910 - DNA, 25 bp, Mus musculus
cggagttagctcaccggcttcattc

SEQ ID NO: 277911 - DNA, 25 bp, Mus musculus
cgctgcggccgtttctacctggtct

SEQ ID NO: 277912 - DNA, 25 bp, Mus musculus
gccgtttctacctggtctcccgaga

SEQ ID NO: 277913 - DNA, 25 bp, Mus musculus
actagttgaggtaggttctggctcc

SEQ ID NO: 277914 - DNA, 25 bp, Mus musculus
gtagaggagttttcaccaagccgcc

SEQ ID NO: 277915 - DNA, 25 bp, Mus musculus
gccagcgcggctggatgcgcaccgt

SEQ ID NO: 277916 - DNA, 25 bp, Mus musculus
agttttcaccaagccgccagcgcgg

SEQ ID NO: 277917 - DNA, 25 bp, Mus musculus
gaggagttttcaccaagccgccagc

SEQ ID NO: 277918 - DNA, 25 bp, Mus musculus
cgtgcgggtagaggagttttcacca

SEQ ID NO: 277919 - DNA, 25 bp, Mus musculus
ctcaagtgctgcagtaacagggcag

SEQ ID NO: 277920 - DNA, 25 bp, Mus musculus
cctcaagtgctgcagtaacagggca

SEQ ID NO: 277921 - DNA, 25 bp, Mus musculus
aggcctcaagtgctgcagtaacagg

SEQ ID NO: 277922 - DNA, 25 bp, Mus musculus
tcaggcctcaagtgctgcagtaaca

SEQ ID NO: 277923 - DNA, 25 bp, Mus musculus
cagtcaggcctcaagtgctgcagta

SEQ ID NO: 277924 - DNA, 25 bp, Mus musculus
tccattgcggtgagccaagcatccc

SEQ ID NO: 277925 - DNA, 25 bp, Mus musculus
cgtccattgcggtgagccaagcatc

SEQ ID NO: 277926 - DNA, 25 bp, Mus musculus
cttgtcgtccattgcggtgagccaa

SEQ ID NO: 277927 - DNA, 25 bp, Mus musculus
ggagttttcaccaagccgccagcgc

SEQ ID NO: 277928 - DNA, 25 bp, Mus musculus
gggcgcggcgtctcaaaactacgct

SEQ ID NO: 277929 - DNA, 25 bp, Mus musculus
cggggccatcacctgcgccatgtag

SEQ ID NO: 277930 - DNA, 25 bp, Mus musculus
cgtctcaaaactacgctccctagcg

SEQ ID NO: 277931 - DNA, 25 bp, Mus musculus
ggcgcggcgtctcaaaactacgctc

SEQ ID NO: 277932 - DNA, 25 bp, Mus musculus
tccgtgtgcaccttaacgtagggaa

SEQ ID NO: 277933 - DNA, 25 bp, Mus musculus
acctgcgccatgtagactccccgca

SEQ ID NO: 277934 - DNA, 25 bp, Mus musculus
catcacctgcgccatgtagactccc

SEQ ID NO: 277935 - DNA, 25 bp, Mus musculus
ggccatcacctgcgccatgtagact

SEQ ID NO: 277936 - DNA, 25 bp, Mus musculus
ctcacagtcccaggtttacagaaca

SEQ ID NO: 277937 - DNA, 25 bp, Mus musculus
gctcacagtcccaggtttacagaac

SEQ ID NO: 277938 - DNA, 25 bp, Mus musculus
gggccatcacctgcgccatgtagac

SEQ ID NO: 277939 - DNA, 25 bp, Mus musculus
gtccgtgtgcaccttaacgtaggga

SEQ ID NO: 277940 - DNA, 25 bp, Mus musculus
ggggccatcacctgcgccatgtaga

SEQ ID NO: 277941 - DNA, 25 bp, Mus musculus
ggcgtctcaaaactacgctccctag

SEQ ID NO: 277942 - DNA, 25 bp, Mus musculus
gtcaggaggacgacccagttggttc

SEQ ID NO: 277943 - DNA, 25 bp, Mus musculus
tggcgcatccgacgtctgtagggaa

SEQ ID NO: 277944 - DNA, 25 bp, Mus musculus
ctggtttggcgcatccgacgtctgt

SEQ ID NO: 277945 - DNA, 25 bp, Mus musculus
catccgacgtctgtagggaaagata

SEQ ID NO: 277946 - DNA, 25 bp, Mus musculus
tgtcacaggcatcgcgaccacggcg

SEQ ID NO: 277947 - DNA, 25 bp, Mus musculus
gcatcgcgaccacggcggccaggaa

SEQ ID NO: 277948 - DNA, 25 bp, Mus musculus
gtttacagaacacaggcggtaccga

SEQ ID NO: 277949 - DNA, 25 bp, Mus musculus
ttacagaacacaggcggtaccgagg

SEQ ID NO: 277950 - DNA, 25 bp, Mus musculus
acccacggtgtcacaggcatcgcga

SEQ ID NO: 277951 - DNA, 25 bp, Mus musculus
tccgacgtctgtagggaaagatagc

SEQ ID NO: 277952 - DNA, 25 bp, Mus musculus
cccactagtcaggaggacgacccag

SEQ ID NO: 277953 - DNA, 25 bp, Mus musculus
actagtcaggaggacgacccagttg

SEQ ID NO: 277954 - DNA, 25 bp, Mus musculus
gcgcatccgacgtctgtagggaaag

SEQ ID NO: 277955 - DNA, 25 bp, Mus musculus
cacggtgtcacaggcatcgcgacca

SEQ ID NO: 277956 - DNA, 25 bp, Mus musculus
cgcgaagttcacagcccagggttta

SEQ ID NO: 277957 - DNA, 25 bp, Mus musculus
cgtccgcgaagttcacagcccaggg

SEQ ID NO: 277958 - DNA, 25 bp, Mus musculus
ccgcgaagttcacagcccagggttt

SEQ ID NO: 277959 - DNA, 25 bp, Mus musculus
tccgcgaagttcacagcccagggtt

SEQ ID NO: 277960 - DNA, 25 bp, Mus musculus
gtccgcgaagttcacagcccagggt

SEQ ID NO: 277961 - DNA, 25 bp, Mus musculus
aagttcacagcccagggtttacaga

SEQ ID NO: 277962 - DNA, 25 bp, Mus musculus
gcgaagttcacagcccagggtttac

SEQ ID NO: 277963 - DNA, 25 bp, Mus musculus
gttcacagcccagggtttacagaac

SEQ ID NO: 277964 - DNA, 25 bp, Mus musculus
tgaccgcccgggcccagggctctct

SEQ ID NO: 277965 - DNA, 25 bp, Mus musculus
ttctgaccgcccgggcccagggctc

SEQ ID NO: 277966 - DNA, 25 bp, Mus musculus
tcacagcccagggtttacagaacac

SEQ ID NO: 277967 - DNA, 25 bp, Mus musculus
cacagcccagggtttacagaacaca

SEQ ID NO: 277968 - DNA, 25 bp, Mus musculus
cggtaccgaggcctcgtccagtgca

SEQ ID NO: 277969 - DNA, 25 bp, Mus musculus
agttcacagcccagggtttacagaa

SEQ ID NO: 277970 - DNA, 25 bp, Mus musculus
ctacgcgaacccaggcggccaggaa

SEQ ID NO: 277971 - DNA, 25 bp, Mus musculus
acgagtcaggtcgacccacttgtta

SEQ ID NO: 277972 - DNA, 25 bp, Mus musculus
caggtcgacccacttgttacgacca

SEQ ID NO: 277973 - DNA, 25 bp, Mus musculus
cagggaactccgatccaccgcatga

SEQ ID NO: 277974 - DNA, 25 bp, Mus musculus
caccgcatgacccacagtgtcaagg

SEQ ID NO: 277975 - DNA, 25 bp, Mus musculus
ccacagtgtcaagggctacgcgaac

SEQ ID NO: 277976 - DNA, 25 bp, Mus musculus
gctcacagtcccaggcttaaggaat

SEQ ID NO: 277977 - DNA, 25 bp, Mus musculus
cttaaggaatgcaggccaagcggag

SEQ ID NO: 277978 - DNA, 25 bp, Mus musculus
ccgcactgttccgtgatctgcctgg

SEQ ID NO: 277979 - DNA, 25 bp, Mus musculus
tgttccgtgatctgcctggcgtccc

SEQ ID NO: 277980 - DNA, 25 bp, Mus musculus
ggatcgcctgccagatcctaggttg

SEQ ID NO: 277981 - DNA, 25 bp, Mus musculus
gcctgccagatcctaggttgccgcg

SEQ ID NO: 277982 - DNA, 25 bp, Mus musculus
cccgacttctggagggaaagatagc

SEQ ID NO: 277983 - DNA, 25 bp, Mus musculus
tcccaggcttaaggaatgcaggcca

SEQ ID NO: 277984 - DNA, 25 bp, Mus musculus
gggattgccttctcagttcacggtg

SEQ ID NO: 277985 - DNA, 25 bp, Mus musculus
acccacggtgtcacgtgaggcgcga

SEQ ID NO: 277986 - DNA, 25 bp, Mus musculus
gccttctcagttcacggtgtccgtg

SEQ ID NO: 277987 - DNA, 25 bp, Mus musculus
gattgccttctcagttcacggtgtc

SEQ ID NO: 277988 - DNA, 25 bp, Mus musculus
tctcagttcacggtgtccgtggtcg

SEQ ID NO: 277989 - DNA, 25 bp, Mus musculus
gcctgggattgccttctcagttcac

SEQ ID NO: 277990 - DNA, 25 bp, Mus musculus
cccgggccatcctctgcgccatggg

SEQ ID NO: 277991 - DNA, 25 bp, Mus musculus
agcctcgggtttacaggacgcaggc

SEQ ID NO: 277992 - DNA, 25 bp, Mus musculus
cacagcctcgggtttacaggacgca

SEQ ID NO: 277993 - DNA, 25 bp, Mus musculus
agctcacagcctcgggtttacagga

SEQ ID NO: 277994 - DNA, 25 bp, Mus musculus
cgcgaagctcacagcctcgggttta

SEQ ID NO: 277995 - DNA, 25 bp, Mus musculus
aggcgcgaacacaggcggccaggaa

SEQ ID NO: 277996 - DNA, 25 bp, Mus musculus
cggtgtcacgtgaggcgcgaacaca

SEQ ID NO: 277997 - DNA, 25 bp, Mus musculus
ttgccttctcagttcacggtgtccg

SEQ ID NO: 277998 - DNA, 25 bp, Mus musculus
taaggaagccttcggatatggggat

SEQ ID NO: 277999 - DNA, 25 bp, Mus musculus
cctcccagggttgcagaacggaggc

SEQ ID NO: 278000 - DNA, 25 bp, Mus musculus
atcgcgcctcccagggttgcagaac

SEQ ID NO: 278001 - DNA, 25 bp, Mus musculus
gagcccaagctgagagcgtgatcgc

SEQ ID NO: 278002 - DNA, 25 bp, Mus musculus
ggccattggtccctgcatgcgaccg

SEQ ID NO: 278003 - DNA, 25 bp, Mus musculus
tggaccctaaggaagccttcggata

SEQ ID NO: 278004 - DNA, 25 bp, Mus musculus
tatagctgggcctggaccctaagga

SEQ ID NO: 278005 - DNA, 25 bp, Mus musculus
ctcttccggatggtatagctgggcc

SEQ ID NO: 278006 - DNA, 25 bp, Mus musculus
gcgccggctcttccggatggtatag

SEQ ID NO: 278007 - DNA, 25 bp, Mus musculus
tgcctgcgctttagggcccgcgcgt

SEQ ID NO: 278008 - DNA, 25 bp, Mus musculus
cgctcagccgcgcaggtacttgggc

SEQ ID NO: 278009 - DNA, 25 bp, Mus musculus
aggttcggctgagcgcggctatata

SEQ ID NO: 278010 - DNA, 25 bp, Mus musculus
tccctgcatgcgaccgggagcagca

SEQ ID NO: 278011 - DNA, 25 bp, Mus musculus
caagctgagagcgtgatcgcgcctc

SEQ ID NO: 278012 - DNA, 25 bp, Mus musculus
ctgccctagccttccgcttccggcc

SEQ ID NO: 278013 - DNA, 25 bp, Mus musculus
aacgaacgcggcagccttactggcc

SEQ ID NO: 278014 - DNA, 25 bp, Mus musculus
caacgcgtgcggaacgaacgcggca

SEQ ID NO: 278015 - DNA, 25 bp, Mus musculus
tcacagttgctagcaacgcgtgcgg

SEQ ID NO: 278016 - DNA, 25 bp, Mus musculus
cgcgggaaaccacgcccttggcacg

SEQ ID NO: 278017 - DNA, 25 bp, Mus musculus
gcagcggcttggctgccctagcctt

SEQ ID NO: 278018 - DNA, 25 bp, Mus musculus
gccatcggggatcctgcccaggcag

SEQ ID NO: 278019 - DNA, 25 bp, Mus musculus
aggcatcggaaccagcagtgaggcc

SEQ ID NO: 278020 - DNA, 25 bp, Mus musculus
cccaggcatcggaaccagcagtgag

SEQ ID NO: 278021 - DNA, 25 bp, Mus musculus
agctcacaagctcaggcttcctgaa

SEQ ID NO: 278022 - DNA, 25 bp, Mus musculus
ggctctgactcggggcctcaccgag

SEQ ID NO: 278023 - DNA, 25 bp, Mus musculus
tccgcgaagctcacaagctcaggct

SEQ ID NO: 278024 - DNA, 25 bp, Mus musculus
cttggcacgccccttggtcacagtt

SEQ ID NO: 278025 - DNA, 25 bp, Mus musculus
ctcaggcttcctgaaaccgggccag

SEQ ID NO: 278026 - DNA, 25 bp, Mus musculus
cgaagcgacgcccacaactagggca

SEQ ID NO: 278027 - DNA, 25 bp, Mus musculus
aacgaccggctcctgcgaaagcagc

SEQ ID NO: 278028 - DNA, 25 bp, Mus musculus
actagggcactgatgaggcttctca

SEQ ID NO: 278029 - DNA, 25 bp, Mus musculus
cacgcgccgatgactggccagcagt

SEQ ID NO: 278030 - DNA, 25 bp, Mus musculus
gacggctgcactctaggcaggtata

SEQ ID NO: 278031 - DNA, 25 bp, Mus musculus
tcaggacatgggtaaggcttctctc

SEQ ID NO: 278032 - DNA, 25 bp, Mus musculus
aacgccgctcacagtcaggacatgg

SEQ ID NO: 278033 - DNA, 25 bp, Mus musculus
ccagagtgcacacgccggtggctaa

SEQ ID NO: 278034 - DNA, 25 bp, Mus musculus
gggcttcgcagttctcacaggcata

SEQ ID NO: 278035 - DNA, 25 bp, Mus musculus
tgctgcgctgagaaaagcgggcttc

SEQ ID NO: 278036 - DNA, 25 bp, Mus musculus
tttctcgcctgtgtgcaagagctgg

SEQ ID NO: 278037 - DNA, 25 bp, Mus musculus
ctccggaaggcacgtccacagtctg

SEQ ID NO: 278038 - DNA, 25 bp, Mus musculus
cgtgcagcttctcctccgtgtgcgt

SEQ ID NO: 278039 - DNA, 25 bp, Mus musculus
cgcagtcatcgcaggcgtgcagctt

SEQ ID NO: 278040 - DNA, 25 bp, Mus musculus
ggaaggcccggaggaaatctgaatc

SEQ ID NO: 278041 - DNA, 25 bp, Mus musculus
accggaagatgccttcggggaagat

SEQ ID NO: 278042 - DNA, 25 bp, Mus musculus
tgcaccaccgctgcctagaacacag

SEQ ID NO: 278043 - DNA, 25 bp, Mus musculus
ttttattgacccgaacgccatgccg

SEQ ID NO: 278044 - DNA, 25 bp, Mus musculus
ccagctatcgattttattgacccga

SEQ ID NO: 278045 - DNA, 25 bp, Mus musculus
ggaactcccgctggaacttgggtga

SEQ ID NO: 278046 - DNA, 25 bp, Mus musculus
cagaccgttattcagggaactcccg

SEQ ID NO: 278047 - DNA, 25 bp, Mus musculus
ggcggcccgacacagaccgttattc

SEQ ID NO: 278048 - DNA, 25 bp, Mus musculus
aatctgaatcggctgcctgaggggc

SEQ ID NO: 278049 - DNA, 25 bp, Mus musculus
ggcaggttccagctatcgattttat

SEQ ID NO: 278050 - DNA, 25 bp, Mus musculus
cccggaggaaatctgaatcggctgc

SEQ ID NO: 278051 - DNA, 25 bp, Mus musculus
acccggagacctagaagctccgtcg

SEQ ID NO: 278052 - DNA, 25 bp, Mus musculus
cgaaggtggcgccatcggacctgct

SEQ ID NO: 278053 - DNA, 25 bp, Mus musculus
tgagaggcaccggaagatgccttcg

SEQ ID NO: 278054 - DNA, 25 bp, Mus musculus
ggcaggagatttcacgcagtttctc

SEQ ID NO: 278055 - DNA, 25 bp, Mus musculus
ttggacagcgctgcataaggcaggc

SEQ ID NO: 278056 - DNA, 25 bp, Mus musculus
agaaggcctctgacggttggacagc

SEQ ID NO: 278057 - DNA, 25 bp, Mus musculus
cttaagacacacagaagaaggcctc

SEQ ID NO: 278058 - DNA, 25 bp, Mus musculus
caattgggcggtgcttaagacacac

SEQ ID NO: 278059 - DNA, 25 bp, Mus musculus
gatttcacgcagtttctcctaaccc

SEQ ID NO: 278060 - DNA, 25 bp, Mus musculus
tattatggcgggcaggagatttcac

SEQ ID NO: 278061 - DNA, 25 bp, Mus musculus
taaggcaggctttaaagaagccgga

SEQ ID NO: 278062 - DNA, 25 bp, Mus musculus
tgaaacccggatccttggaaagctg

SEQ ID NO: 278063 - DNA, 25 bp, Mus musculus
ccggatccttggaaagctgcggtga

SEQ ID NO: 278064 - DNA, 25 bp, Mus musculus
ctctgacggttggacagcgctgcat

SEQ ID NO: 278065 - DNA, 25 bp, Mus musculus
cgctgcataaggcaggctttaaaga

SEQ ID NO: 278066 - DNA, 25 bp, Mus musculus
tgggagctgtttgaaacccggatcc

SEQ ID NO: 278067 - DNA, 25 bp, Mus musculus
gaaccggcaattgggcggtgcttaa

SEQ ID NO: 278068 - DNA, 25 bp, Mus musculus
ccatggacttgcctgggaactccag

SEQ ID NO: 278069 - DNA, 25 bp, Mus musculus
aggcctcagcctgggataccccagg

SEQ ID NO: 278070 - DNA, 25 bp, Mus musculus
ggcggactatgaagggcggagtccc

SEQ ID NO: 278071 - DNA, 25 bp, Mus musculus
ggcctgtgccctaccgggagccgca

SEQ ID NO: 278072 - DNA, 25 bp, Mus musculus
tgcagcgggaagacccggctccgag

SEQ ID NO: 278073 - DNA, 25 bp, Mus musculus
gagccgcaggcggactatgaagggc

SEQ ID NO: 278074 - DNA, 25 bp, Mus musculus
ggacttgcctgggaactccaggtga

SEQ ID NO: 278075 - DNA, 25 bp, Mus musculus
acttgcctgggaactccaggtgaga

SEQ ID NO: 278076 - DNA, 25 bp, Mus musculus
cctttggaggaagggcctgtgccct

SEQ ID NO: 278077 - DNA, 25 bp, Mus musculus
gggaactccaggtgagagcgtaccc

SEQ ID NO: 278078 - DNA, 25 bp, Mus musculus
agacggggatgctgacggctgcacc

SEQ ID NO: 278079 - DNA, 25 bp, Mus musculus
gcccgcctgacttgagctcgggaga

SEQ ID NO: 278080 - DNA, 25 bp, Mus musculus
ccgcctgacttgagctcgggagacg

SEQ ID NO: 278081 - DNA, 25 bp, Mus musculus
ctgggaactccaggtgagagcgtac

SEQ ID NO: 278082 - DNA, 25 bp, Mus musculus
gttcctcactgtccagtggcctttc

SEQ ID NO: 278083 - DNA, 25 bp, Mus musculus
agctacaagccggttaggaacggag

SEQ ID NO: 278084 - DNA, 25 bp, Mus musculus
ttctagctacaagccggttaggaac

SEQ ID NO: 278085 - DNA, 25 bp, Mus musculus
ccttctagctacaagccggttagga

SEQ ID NO: 278086 - DNA, 25 bp, Mus musculus
gatccttctagctacaagccggtta

SEQ ID NO: 278087 - DNA, 25 bp, Mus musculus
tccggatccttctagctacaagccg

SEQ ID NO: 278088 - DNA, 25 bp, Mus musculus
tttccggatccttctagctacaagc

SEQ ID NO: 278089 - DNA, 25 bp, Mus musculus
gcctttccggatccttctagctaca

SEQ ID NO: 278090 - DNA, 25 bp, Mus musculus
tccagtggcctttccggatccttct

SEQ ID NO: 278091 - DNA, 25 bp, Mus musculus
cggagttcctcactgtccagtggcc

SEQ ID NO: 278092 - DNA, 25 bp, Mus musculus
aacaggaggatacggcggagttcct

SEQ ID NO: 278093 - DNA, 25 bp, Mus musculus
acaacaggaggatacggcggagttc

SEQ ID NO: 278094 - DNA, 25 bp, Mus musculus
aagaagacaacaggaggatacggcg

SEQ ID NO: 278095 - DNA, 25 bp, Mus musculus
tggcctttccggatccttctagcta

SEQ ID NO: 278096 - DNA, 25 bp, Mus musculus
tgggtaccgaactcggccgactcca

SEQ ID NO: 278097 - DNA, 25 bp, Mus musculus
aggaagagtcttttatgtcggagga

SEQ ID NO: 278098 - DNA, 25 bp, Mus musculus
agtcttttatgtcggaggacagaga

SEQ ID NO: 278099 - DNA, 25 bp, Mus musculus
gaggacagagagagaagctctatcc

SEQ ID NO: 278100 - DNA, 25 bp, Mus musculus
ctcacatccgggactttggacggca

SEQ ID NO: 278101 - DNA, 25 bp, Mus musculus
accgttgcctcacatccgggacttt

SEQ ID NO: 278102 - DNA, 25 bp, Mus musculus
acatccgggactttggacggcaggc

SEQ ID NO: 278103 - DNA, 25 bp, Mus musculus
gcggagacctcgttaaatctcctta

SEQ ID NO: 278104 - DNA, 25 bp, Mus musculus
ggaggcggagacctcgttaaatctc

SEQ ID NO: 278105 - DNA, 25 bp, Mus musculus
cacctttcaaggctacgggaggcgg

SEQ ID NO: 278106 - DNA, 25 bp, Mus musculus
ccttgcacctttcaaggctacggga

SEQ ID NO: 278107 - DNA, 25 bp, Mus musculus
tccgggactttggacggcaggctcc

SEQ ID NO: 278108 - DNA, 25 bp, Mus musculus
gttgcctcacatccgggactttgga

SEQ ID NO: 278109 - DNA, 25 bp, Mus musculus
gagagaagctctatccgtcaccgtt

SEQ ID NO: 278110 - DNA, 25 bp, Mus musculus
ctggttacctgaggagctgcggttc

SEQ ID NO: 278111 - DNA, 25 bp, Mus musculus
agacgaagggcgtgaggcccaggag

SEQ ID NO: 278112 - DNA, 25 bp, Mus musculus
gccacaatgcctctccgggctggtt

SEQ ID NO: 278113 - DNA, 25 bp, Mus musculus
cacaatgcctctccgggctggttac

SEQ ID NO: 278114 - DNA, 25 bp, Mus musculus
tgagaccatgagacggacggaccgt

SEQ ID NO: 278115 - DNA, 25 bp, Mus musculus
ctgcggttccgggagcggttaactg

SEQ ID NO: 278116 - DNA, 25 bp, Mus musculus
cggctgcggaaactgtccactaggg

SEQ ID NO: 278117 - DNA, 25 bp, Mus musculus
tgagacggacggaccgtctccgctt

SEQ ID NO: 278118 - DNA, 25 bp, Mus musculus
ctgctgagaccatgagacggacgga

SEQ ID NO: 278119 - DNA, 25 bp, Mus musculus
ggccgagtctgctgagaccatgaga

SEQ ID NO: 278120 - DNA, 25 bp, Mus musculus
agcgggccgagtctgctgagaccat

SEQ ID NO: 278121 - DNA, 25 bp, Mus musculus
ccgtcacagcagcagcgggccgagt

SEQ ID NO: 278122 - DNA, 25 bp, Mus musculus
gagcggttaactgcgtcccctcggc

SEQ ID NO: 278123 - DNA, 25 bp, Mus musculus
ggacggaccgtctccgcttcctcca

SEQ ID NO: 278124 - DNA, 25 bp, Mus musculus
gccagcggatcctgttttaaagagg

SEQ ID NO: 278125 - DNA, 25 bp, Mus musculus
tcgtcagcttcatctggagagcggc

SEQ ID NO: 278126 - DNA, 25 bp, Mus musculus
cctggtcgtcagcttcatctggaga

SEQ ID NO: 278127 - DNA, 25 bp, Mus musculus
cgtccctggtcgtcagcttcatctg

SEQ ID NO: 278128 - DNA, 25 bp, Mus musculus
acgctgctcgcggcgagaccgtgat

SEQ ID NO: 278129 - DNA, 25 bp, Mus musculus
cgctgagggccgtcaccatggagac

SEQ ID NO: 278130 - DNA, 25 bp, Mus musculus
atgcggcgctgagggccgtcaccat

SEQ ID NO: 278131 - DNA, 25 bp, Mus musculus
ccgtccctgtgcaagcgccagcgcc

SEQ ID NO: 278132 - DNA, 25 bp, Mus musculus
agaggaagccggagctctcccgtcc

SEQ ID NO: 278133 - DNA, 25 bp, Mus musculus
tgttttaaagaggaagccggagctc

SEQ ID NO: 278134 - DNA, 25 bp, Mus musculus
cagaggccagcggatcctgttttaa

SEQ ID NO: 278135 - DNA, 25 bp, Mus musculus
caagccagaggccagcggatcctgt

SEQ ID NO: 278136 - DNA, 25 bp, Mus musculus
ggccttggccttggggcaagccaga

SEQ ID NO: 278137 - DNA, 25 bp, Mus musculus
accgcgagctcggaagcggcctgcc

SEQ ID NO: 278138 - DNA, 25 bp, Mus musculus
caagcacctcttcgcggcgtgactg

SEQ ID NO: 278139 - DNA, 25 bp, Mus musculus
tgacccggtctatgggatcgggttc

SEQ ID NO: 278140 - DNA, 25 bp, Mus musculus
catctgagtcctgtgacccggtcta

SEQ ID NO: 278141 - DNA, 25 bp, Mus musculus
ccgacggacgcggacatctgagtcc

SEQ ID NO: 278142 - DNA, 25 bp, Mus musculus
tcccgagctctttgcggtctgtgga

SEQ ID NO: 278143 - DNA, 25 bp, Mus musculus
agacttggcgcacgaacccttcctt

SEQ ID NO: 278144 - DNA, 25 bp, Mus musculus
aagccatttaggagcccgagacttg

SEQ ID NO: 278145 - DNA, 25 bp, Mus musculus
cccttcagcctccagttactgtgta

SEQ ID NO: 278146 - DNA, 25 bp, Mus musculus
tgcgcgaacgagcagccctcgagag

SEQ ID NO: 278147 - DNA, 25 bp, Mus musculus
gagtagcgtctcctttttcttcaac

SEQ ID NO: 278148 - DNA, 25 bp, Mus musculus
ccattttggtgaggcctcgggagca

SEQ ID NO: 278149 - DNA, 25 bp, Mus musculus
tctggcggtagcgataacgagcctt

SEQ ID NO: 278150 - DNA, 25 bp, Mus musculus
actgtgtatcgcgagaagacgggcc

SEQ ID NO: 278151 - DNA, 25 bp, Mus musculus
gcgcgcccaccataagccatttagg

SEQ ID NO: 278152 - DNA, 25 bp, Mus musculus
aatcgaacccattcgtctcggcggc

SEQ ID NO: 278153 - DNA, 25 bp, Mus musculus
ccacagctcagctctctgttttctg

SEQ ID NO: 278154 - DNA, 25 bp, Mus musculus
ccggtgaaatccaagatggtggcgc

SEQ ID NO: 278155 - DNA, 25 bp, Mus musculus
gctgaccctacggtaagtgcggacc

SEQ ID NO: 278156 - DNA, 25 bp, Mus musculus
cggtgacgtccggtgaaatccaaga

SEQ ID NO: 278157 - DNA, 25 bp, Mus musculus
aggactgcggagctccagacgcatc

SEQ ID NO: 278158 - DNA, 25 bp, Mus musculus
ttttctgcaggtgacggaagtgccg

SEQ ID NO: 278159 - DNA, 25 bp, Mus musculus
gccgctatgtctggcctcagcaaca

SEQ ID NO: 278160 - DNA, 25 bp, Mus musculus
ccagagaagaagatgaaccgcgagg

SEQ ID NO: 278161 - DNA, 25 bp, Mus musculus
gctctgacgcctgcgctgtgcgtct

SEQ ID NO: 278162 - DNA, 25 bp, Mus musculus
gaagaccacgaccactctaatcgaa

SEQ ID NO: 278163 - DNA, 25 bp, Mus musculus
tctcggcggcatttcttccacggtt

SEQ ID NO: 278164 - DNA, 25 bp, Mus musculus
tcttccacggttggtgggcttttgc

SEQ ID NO: 278165 - DNA, 25 bp, Mus musculus
tgaaccgcgaggagaagaccacgac

SEQ ID NO: 278166 - DNA, 25 bp, Mus musculus
ccacgtcacagtggagcacgtgggc

SEQ ID NO: 278167 - DNA, 25 bp, Mus musculus
cgagctggtgaaccacgtcacagtg

SEQ ID NO: 278168 - DNA, 25 bp, Mus musculus
cacgagctggtgaaccacgtcacag

SEQ ID NO: 278169 - DNA, 25 bp, Mus musculus
ctggtgaaccacgtcacagtggagc

SEQ ID NO: 278170 - DNA, 25 bp, Mus musculus
agtacaagctcatcaaccacatccg

SEQ ID NO: 278171 - DNA, 25 bp, Mus musculus
gaaccacgtcacagtggagcacgtg

SEQ ID NO: 278172 - DNA, 25 bp, Mus musculus
gtgaaccacgtcacagtggagcacg

SEQ ID NO: 278173 - DNA, 25 bp, Mus musculus
tctgcttttgggaggactgtccgcg

SEQ ID NO: 278174 - DNA, 25 bp, Mus musculus
ctgcttttgggaggactgtccgcgc

SEQ ID NO: 278175 - DNA, 25 bp, Mus musculus
caagcccttcaaggccaagtacaag

SEQ ID NO: 278176 - DNA, 25 bp, Mus musculus
agctggtgaaccacgtcacagtgga

SEQ ID NO: 278177 - DNA, 25 bp, Mus musculus
ggccaagtacaagctcatcaaccac

SEQ ID NO: 278178 - DNA, 25 bp, Mus musculus
gccaagtacaagctcatcaaccaca

SEQ ID NO: 278179 - DNA, 25 bp, Mus musculus
tacaagctcatcaaccacatccgcg

SEQ ID NO: 278180 - DNA, 25 bp, Mus musculus
ctccgagctctggatgaaactcttg

SEQ ID NO: 278181 - DNA, 25 bp, Mus musculus
gtcggcactcgccacacttgtaggg

SEQ ID NO: 278182 - DNA, 25 bp, Mus musculus
tgcggtagaaagcacgtcggcactc

SEQ ID NO: 278183 - DNA, 25 bp, Mus musculus
tatgattctggccaaagcgcttgcc

SEQ ID NO: 278184 - DNA, 25 bp, Mus musculus
gcttctcgcctgcatggatcttctg

SEQ ID NO: 278185 - DNA, 25 bp, Mus musculus
tgtcctctggtgcttgatgagcgtg

SEQ ID NO: 278186 - DNA, 25 bp, Mus musculus
gatcctcgcgcaaatgtgtcctctg

SEQ ID NO: 278187 - DNA, 25 bp, Mus musculus
ggtcttgccacagacggggcacttg

SEQ ID NO: 278188 - DNA, 25 bp, Mus musculus
gtggcactcagtgtgaaggtcttgc

SEQ ID NO: 278189 - DNA, 25 bp, Mus musculus
atgaggttagagctcacactgaagc

SEQ ID NO: 278190 - DNA, 25 bp, Mus musculus
gtgcgagctgcgaatgaaactcttg

SEQ ID NO: 278191 - DNA, 25 bp, Mus musculus
agtcggagcacacgaagaggttctc

SEQ ID NO: 278192 - DNA, 25 bp, Mus musculus
atcacgcggtgctgctccagctctt

SEQ ID NO: 278193 - DNA, 25 bp, Mus musculus
ctggtgcttgagcaggttatgattc

SEQ ID NO: 278194 - DNA, 25 bp, Mus musculus
accaagacttgagcgcctccggccg

SEQ ID NO: 278195 - DNA, 25 bp, Mus musculus
ccagggtgaccctgaccaggaggca

SEQ ID NO: 278196 - DNA, 25 bp, Mus musculus
ggaccaagacttgagcgcctccggc

SEQ ID NO: 278197 - DNA, 25 bp, Mus musculus
gcggaccaagacttgagcgcctccg

SEQ ID NO: 278198 - DNA, 25 bp, Mus musculus
cggcggaccaagacttgagcgcctc

SEQ ID NO: 278199 - DNA, 25 bp, Mus musculus
ggtgaccctgaccaggaggcagcgg

SEQ ID NO: 278200 - DNA, 25 bp, Mus musculus
ctccggccgggagcacccaccctgt

SEQ ID NO: 278201 - DNA, 25 bp, Mus musculus
ccggactcgctctctgggcgcgcgc

SEQ ID NO: 278202 - DNA, 25 bp, Mus musculus
ccagaggaccgaggcgggaaggact

SEQ ID NO: 278203 - DNA, 25 bp, Mus musculus
aaggactgccggagacggctgcctt

SEQ ID NO: 278204 - DNA, 25 bp, Mus musculus
ggactgccggagacggctgccttcc

SEQ ID NO: 278205 - DNA, 25 bp, Mus musculus
agacggctgccttcccgcggaggtg

SEQ ID NO: 278206 - DNA, 25 bp, Mus musculus
cggcccagggtgaccctgaccagga

SEQ ID NO: 278207 - DNA, 25 bp, Mus musculus
cagcgggaccgccctcgacgccgcc

SEQ ID NO: 278208 - DNA, 25 bp, Mus musculus
ccctctgccagccacggagagggag

SEQ ID NO: 278209 - DNA, 25 bp, Mus musculus
ccgcctggcttcctaagaccgcgcc

SEQ ID NO: 278210 - DNA, 25 bp, Mus musculus
tgggcgtccctgaaatgctctgtgc

SEQ ID NO: 278211 - DNA, 25 bp, Mus musculus
cggaccttctcgatggtcgccatca

SEQ ID NO: 278212 - DNA, 25 bp, Mus musculus
ccacgctttgtagacctctgggaat

SEQ ID NO: 278213 - DNA, 25 bp, Mus musculus
gcgatctcaggctgagcgccaggcc

SEQ ID NO: 278214 - DNA, 25 bp, Mus musculus
atctccggaccttctcgatggtcgc

SEQ ID NO: 278215 - DNA, 25 bp, Mus musculus
ctgtggtccggcgatctcaggctga

SEQ ID NO: 278216 - DNA, 25 bp, Mus musculus
ggcagcgctcaccatctccggacct

SEQ ID NO: 278217 - DNA, 25 bp, Mus musculus
aggtggcttggctgtatccctggcc

SEQ ID NO: 278218 - DNA, 25 bp, Mus musculus
cgccctgtcgattcagagcacagct

SEQ ID NO: 278219 - DNA, 25 bp, Mus musculus
gggcgccctgtcgattcagagcaca

SEQ ID NO: 278220 - DNA, 25 bp, Mus musculus
cggaccacgctttgtagacctctgg

SEQ ID NO: 278221 - DNA, 25 bp, Mus musculus
cagcgccgctctttcggcctgccgt

SEQ ID NO: 278222 - DNA, 25 bp, Mus musculus
ggccaacagcactgcaggcatcttc

SEQ ID NO: 278223 - DNA, 25 bp, Mus musculus
ggcttctcaccaccgcggctgccgc

SEQ ID NO: 278224 - DNA, 25 bp, Mus musculus
ctccgagccatgcagggctaccggt

SEQ ID NO: 278225 - DNA, 25 bp, Mus musculus
catgcagggctaccggtgtccgagc

SEQ ID NO: 278226 - DNA, 25 bp, Mus musculus
caggatgcagccgccctgagtgtgc

SEQ ID NO: 278227 - DNA, 25 bp, Mus musculus
cctgagtgtgctgcccgcgctgttg

SEQ ID NO: 278228 - DNA, 25 bp, Mus musculus
tgcccgcgctgttggatgccgtccg

SEQ ID NO: 278229 - DNA, 25 bp, Mus musculus
tcttcacggccaacagcactgcagg

SEQ ID NO: 278230 - DNA, 25 bp, Mus musculus
actgcaggcatcttctcagccaagg

SEQ ID NO: 278231 - DNA, 25 bp, Mus musculus
ggcatcttctcagccaaggtgctgg

SEQ ID NO: 278232 - DNA, 25 bp, Mus musculus
ggggttccacgtgtgcggcctctat

SEQ ID NO: 278233 - DNA, 25 bp, Mus musculus
cacgtgtgcggcctctatggcgagt

SEQ ID NO: 278234 - DNA, 25 bp, Mus musculus
gcacagagggcgacctgggccagct

SEQ ID NO: 278235 - DNA, 25 bp, Mus musculus
ggccagagcccgtcaccgtcgccac

SEQ ID NO: 278236 - DNA, 25 bp, Mus musculus
ggagtctcgggtcaactggactata

SEQ ID NO: 278237 - DNA, 25 bp, Mus musculus
tcaggtaccacacgcgcggagggtt

SEQ ID NO: 278238 - DNA, 25 bp, Mus musculus
aaggccatcttgcttgtagtcattc

SEQ ID NO: 278239 - DNA, 25 bp, Mus musculus
ttgtagtcattcttcccgctccttc

SEQ ID NO: 278240 - DNA, 25 bp, Mus musculus
gctccttctctatgtcctgctacgg

SEQ ID NO: 278241 - DNA, 25 bp, Mus musculus
tacaactcccgtcgtgctttgcacg

SEQ ID NO: 278242 - DNA, 25 bp, Mus musculus
tctatgtcctgctacggggagtctc

SEQ ID NO: 278243 - DNA, 25 bp, Mus musculus
tggactataattcccgccatgctcg

SEQ ID NO: 278244 - DNA, 25 bp, Mus musculus
tcgtatttgtagtaccggctggccc

SEQ ID NO: 278245 - DNA, 25 bp, Mus musculus
ccacgatagtgctagaatttggaga

SEQ ID NO: 278246 - DNA, 25 bp, Mus musculus
cggctggcccttgtgtcccactttt

SEQ ID NO: 278247 - DNA, 25 bp, Mus musculus
gtggcatccttctcgccatcgtatt

SEQ ID NO: 278248 - DNA, 25 bp, Mus musculus
ccatgctcggcttccagcgtggcat

SEQ ID NO: 278249 - DNA, 25 bp, Mus musculus
gtgtcccacttttcccacgatagtg

SEQ ID NO: 278250 - DNA, 25 bp, Mus musculus
agcgggtgcccgatacctcttcttc

SEQ ID NO: 278251 - DNA, 25 bp, Mus musculus
gacggcgggctatacgccctggcac

SEQ ID NO: 278252 - DNA, 25 bp, Mus musculus
tcaagcgcatgtgccagctgctgga

SEQ ID NO: 278253 - DNA, 25 bp, Mus musculus
accacggcctccacagttggagcga

SEQ ID NO: 278254 - DNA, 25 bp, Mus musculus
agctccggcgagaaggagaaccgtg

SEQ ID NO: 278255 - DNA, 25 bp, Mus musculus
tcagtgaggatgaagctcctggaga

SEQ ID NO: 278256 - DNA, 25 bp, Mus musculus
tcactcagtgaggatgaagctcctg

SEQ ID NO: 278257 - DNA, 25 bp, Mus musculus
tccggcacatcactcagtgaggatg

SEQ ID NO: 278258 - DNA, 25 bp, Mus musculus
gactcatccggcacatcactcagtg

SEQ ID NO: 278259 - DNA, 25 bp, Mus musculus
ggattcagactcatccggcacatca

SEQ ID NO: 278260 - DNA, 25 bp, Mus musculus
actcggactcggattcagactcatc

SEQ ID NO: 278261 - DNA, 25 bp, Mus musculus
ctgctggagcgggtgcccgatacct

SEQ ID NO: 278262 - DNA, 25 bp, Mus musculus
cgtttcaagcgcatgtgccagctgc

SEQ ID NO: 278263 - DNA, 25 bp, Mus musculus
tccacagttggagcgacatgtcgtg

SEQ ID NO: 278264 - DNA, 25 bp, Mus musculus
tgcaccgcggctacctggaccttat

SEQ ID NO: 278265 - DNA, 25 bp, Mus musculus
ccaatcatgtggtcaccgggctccg

SEQ ID NO: 278266 - DNA, 25 bp, Mus musculus
tgggccttctagacgcgtccgtaac

SEQ ID NO: 278267 - DNA, 25 bp, Mus musculus
agtcagcactctctgcgggcgctca

SEQ ID NO: 278268 - DNA, 25 bp, Mus musculus
tccgtaactgttcccgctgggtctg

SEQ ID NO: 278269 - DNA, 25 bp, Mus musculus
tctgccttgccacccaggatggggt

SEQ ID NO: 278270 - DNA, 25 bp, Mus musculus
tgggccgtcccttcttggggataca

SEQ ID NO: 278271 - DNA, 25 bp, Mus musculus
cttcttggggatacaaggcgcctcg

SEQ ID NO: 278272 - DNA, 25 bp, Mus musculus
cctccttgaccatctgcgcttgtgg

SEQ ID NO: 278273 - DNA, 25 bp, Mus musculus
gcgcttgtggtgtaactgctctcag

SEQ ID NO: 278274 - DNA, 25 bp, Mus musculus
aactgctctcaggatgaagggcggc

SEQ ID NO: 278275 - DNA, 25 bp, Mus musculus
gctcagccacgtaccgggagttcgt

SEQ ID NO: 278276 - DNA, 25 bp, Mus musculus
gcacatctgctctgctgtcgggctt

SEQ ID NO: 278277 - DNA, 25 bp, Mus musculus
gggctaagctcaaagcctccagccg

SEQ ID NO: 278278 - DNA, 25 bp, Mus musculus
cgactatcctggctgcggcggccag

SEQ ID NO: 278279 - DNA, 25 bp, Mus musculus
aggtccagagcaggccgacgacgtc

SEQ ID NO: 278280 - DNA, 25 bp, Mus musculus
cgctcctgccgtaactccagctcta

SEQ ID NO: 278281 - DNA, 25 bp, Mus musculus
cgcagattgcgctccgatgccttca

SEQ ID NO: 278282 - DNA, 25 bp, Mus musculus
tgccttcacctcctcgagctgcgga

SEQ ID NO: 278283 - DNA, 25 bp, Mus musculus
agcaggccgacgacgtccactgcgg

SEQ ID NO: 278284 - DNA, 25 bp, Mus musculus
acctccttagccagtcggcgactat

SEQ ID NO: 278285 - DNA, 25 bp, Mus musculus
ccagtcggcgactatcctggctgcg

SEQ ID NO: 278286 - DNA, 25 bp, Mus musculus
ctcagacgtcaagcgggtcaccctg

SEQ ID NO: 278287 - DNA, 25 bp, Mus musculus
cgcttctcagacgtcaagcgggtca

SEQ ID NO: 278288 - DNA, 25 bp, Mus musculus
cgccagagcctcctctcgggagcgg

SEQ ID NO: 278289 - DNA, 25 bp, Mus musculus
aacgactcggcctcctggcgtgctg

SEQ ID NO: 278290 - DNA, 25 bp, Mus musculus
ctcaccagcccacgcaacgactcgg

SEQ ID NO: 278291 - DNA, 25 bp, Mus musculus
agattgcgctccgatgccttcacct

SEQ ID NO: 278292 - DNA, 25 bp, Mus musculus
tgcgtcgttggacgcgccactcaaa

SEQ ID NO: 278293 - DNA, 25 bp, Mus musculus
cttggcgagccaggcgtcattttct

SEQ ID NO: 278294 - DNA, 25 bp, Mus musculus
ttcgctacccgactccttaggatta

SEQ ID NO: 278295 - DNA, 25 bp, Mus musculus
cttaggattatttgggcagcttttc

SEQ ID NO: 278296 - DNA, 25 bp, Mus musculus
caggaaacgccgagaagacttcttc

SEQ ID NO: 278297 - DNA, 25 bp, Mus musculus
ttgtaaccatttcgcactaagtagg

SEQ ID NO: 278298 - DNA, 25 bp, Mus musculus
gctgttccttgagtcgttctactga

SEQ ID NO: 278299 - DNA, 25 bp, Mus musculus
atccaggactagaggtcgactctgc

SEQ ID NO: 278300 - DNA, 25 bp, Mus musculus
cctcataggcattcgggctgcgcaa

SEQ ID NO: 278301 - DNA, 25 bp, Mus musculus
tcaaatctcccgagctctggctggc

SEQ ID NO: 278302 - DNA, 25 bp, Mus musculus
ggaatgcggcccatcttcaggctcc

SEQ ID NO: 278303 - DNA, 25 bp, Mus musculus
tccgcagtccttgtagcgaaagtgc

SEQ ID NO: 278304 - DNA, 25 bp, Mus musculus
attttcttgactctacagcaggtga

SEQ ID NO: 278305 - DNA, 25 bp, Mus musculus
ggcgaatctgcactgcagcctcata

SEQ ID NO: 278306 - DNA, 25 bp, Mus musculus
cctgggccgactgggctctgcctag

SEQ ID NO: 278307 - DNA, 25 bp, Mus musculus
tcttgcctctgtcctggaggccggg

SEQ ID NO: 278308 - DNA, 25 bp, Mus musculus
ctgagtccgatccttcatcctgcga

SEQ ID NO: 278309 - DNA, 25 bp, Mus musculus
gagtccgatccttcatcctgcgacg

SEQ ID NO: 278310 - DNA, 25 bp, Mus musculus
gtccgatccttcatcctgcgacggg

SEQ ID NO: 278311 - DNA, 25 bp, Mus musculus
ttcatcctgcgacgggctcctcctc

SEQ ID NO: 278312 - DNA, 25 bp, Mus musculus
ctgcctcttgcctctgtcctggagg

SEQ ID NO: 278313 - DNA, 25 bp, Mus musculus
gcaccgggctagacctccgagggat

SEQ ID NO: 278314 - DNA, 25 bp, Mus musculus
accgggctagacctccgagggatgt

SEQ ID NO: 278315 - DNA, 25 bp, Mus musculus
gggagctaaggccaggcagagacag

SEQ ID NO: 278316 - DNA, 25 bp, Mus musculus
gcagctcctgagtccgatccttcat

SEQ ID NO: 278317 - DNA, 25 bp, Mus musculus
ctctgcctaggctgcggtggcgatg

SEQ ID NO: 278318 - DNA, 25 bp, Mus musculus
atgcggctgcggcacagggttggat

SEQ ID NO: 278319 - DNA, 25 bp, Mus musculus
agacctccgagggatgtgcggataa

SEQ ID NO: 278320 - DNA, 25 bp, Mus musculus
tttccagaatactcgagggccagcg

SEQ ID NO: 278321 - DNA, 25 bp, Mus musculus
ggggttccgccatgaggtatttcca

SEQ ID NO: 278322 - DNA, 25 bp, Mus musculus
aggatgtccgccctccgtgaaggct

SEQ ID NO: 278323 - DNA, 25 bp, Mus musculus
ctccggtggcttcctgagaggtaaa

SEQ ID NO: 278324 - DNA, 25 bp, Mus musculus
agtgaatccgctgctccggtggctt

SEQ ID NO: 278325 - DNA, 25 bp, Mus musculus
ctgactgcagagaggtgagtgaatc

SEQ ID NO: 278326 - DNA, 25 bp, Mus musculus
tcaagcatcctctagggcggaaggc

SEQ ID NO: 278327 - DNA, 25 bp, Mus musculus
gtacttccgggtcaagcatcctcta

SEQ ID NO: 278328 - DNA, 25 bp, Mus musculus
gaagtactcctgacctcagcgcgga

SEQ ID NO: 278329 - DNA, 25 bp, Mus musculus
ccgaccgtcgcggaagtactcctga

SEQ ID NO: 278330 - DNA, 25 bp, Mus musculus
caccaaacatggctggaagcgttgc

SEQ ID NO: 278331 - DNA, 25 bp, Mus musculus
ccaggcctcaggtaaacaagctctc

SEQ ID NO: 278332 - DNA, 25 bp, Mus musculus
tggctgactagctggaagccgagcc

SEQ ID NO: 278333 - DNA, 25 bp, Mus musculus
cgtgaccatcgcctttacccggagg

SEQ ID NO: 278334 - DNA, 25 bp, Mus musculus
gctctggactcaggcagcctcgctt

SEQ ID NO: 278335 - DNA, 25 bp, Mus musculus
agactgaagcccgagacgtcgctga

SEQ ID NO: 278336 - DNA, 25 bp, Mus musculus
gctgacaggccggaacacatgactg

SEQ ID NO: 278337 - DNA, 25 bp, Mus musculus
gaggctctcagactgcgtgcaaatg

SEQ ID NO: 278338 - DNA, 25 bp, Mus musculus
aaatgacgcattcccaaccctttgg

SEQ ID NO: 278339 - DNA, 25 bp, Mus musculus
gggcaactagatctcggctccaata

SEQ ID NO: 278340 - DNA, 25 bp, Mus musculus
ggctccaatatgagatgttccggta

SEQ ID NO: 278341 - DNA, 25 bp, Mus musculus
agagaggtgcaggacttccaaattt

SEQ ID NO: 278342 - DNA, 25 bp, Mus musculus
accatgcgcgacaggacccacgagt

SEQ ID NO: 278343 - DNA, 25 bp, Mus musculus
cacgagttgaggcaggtgagaaacc

SEQ ID NO: 278344 - DNA, 25 bp, Mus musculus
ctgatggccaggaaggaaaatcccg

SEQ ID NO: 278345 - DNA, 25 bp, Mus musculus
agcaactgtcgccaatgactccggc

SEQ ID NO: 278346 - DNA, 25 bp, Mus musculus
tttccctctagcgaggacgagccga

SEQ ID NO: 278347 - DNA, 25 bp, Mus musculus
atcccggaagcccatggttcctgcg

SEQ ID NO: 278348 - DNA, 25 bp, Mus musculus
aggactcagcgaggatccctccacg

SEQ ID NO: 278349 - DNA, 25 bp, Mus musculus
ggctgcagagttagacccagtctca

SEQ ID NO: 278350 - DNA, 25 bp, Mus musculus
tctggacggaagtgtggcttaaatc

SEQ ID NO: 278351 - DNA, 25 bp, Mus musculus
taagcacgcgaagggtttcagcagc

SEQ ID NO: 278352 - DNA, 25 bp, Mus musculus
tgtgaccgtactgcccgaataagca

SEQ ID NO: 278353 - DNA, 25 bp, Mus musculus
ctgcagggtctttcctgtgaccgta

SEQ ID NO: 278354 - DNA, 25 bp, Mus musculus
ctgagcctgggcatccaaagcactg

SEQ ID NO: 278355 - DNA, 25 bp, Mus musculus
tttatggaacctcgtgaaaagtgtc

SEQ ID NO: 278356 - DNA, 25 bp, Mus musculus
cctgggagctccagcattctggaaa

SEQ ID NO: 278357 - DNA, 25 bp, Mus musculus
tctaacagcgaggaaaggactcagc

SEQ ID NO: 278358 - DNA, 25 bp, Mus musculus
cctgcggaagcagagaagtatcttg

SEQ ID NO: 278359 - DNA, 25 bp, Mus musculus
gcgtgtcctacctggatcggttttc

SEQ ID NO: 278360 - DNA, 25 bp, Mus musculus
cagcacacgtgaagccgggagcacc

SEQ ID NO: 278361 - DNA, 25 bp, Mus musculus
aaaagtgtcaccaaagcgccgtagc

SEQ ID NO: 278362 - DNA, 25 bp, Mus musculus
gcagagcgcgcggtaattttcatcg

SEQ ID NO: 278363 - DNA, 25 bp, Mus musculus
gccgccttcacgtgcagtgcgtaca

SEQ ID NO: 278364 - DNA, 25 bp, Mus musculus
tcctaccggaagattggtcggcctc

SEQ ID NO: 278365 - DNA, 25 bp, Mus musculus
ggtaattttcatcgcgggcgcgcgc

SEQ ID NO: 278366 - DNA, 25 bp, Mus musculus
gcccacatcgcagagcgcgcggtaa

SEQ ID NO: 278367 - DNA, 25 bp, Mus musculus
ggaacagctgatggccgtgcccaca

SEQ ID NO: 278368 - DNA, 25 bp, Mus musculus
ccttcacgtgcagtgcgtacagtga

SEQ ID NO: 278369 - DNA, 25 bp, Mus musculus
gtcgacagtacagcccagggacagg

SEQ ID NO: 278370 - DNA, 25 bp, Mus musculus
aggcacagtgcaagccgcacgagtc

SEQ ID NO: 278371 - DNA, 25 bp, Mus musculus
ggctaagccagcgaggcacagtgca

SEQ ID NO: 278372 - DNA, 25 bp, Mus musculus
tgcaagccgcacgagtccagggctc

SEQ ID NO: 278373 - DNA, 25 bp, Mus musculus
agtccagggctcctccaggtggtgc

SEQ ID NO: 278374 - DNA, 25 bp, Mus musculus
cgtacagtgagagggctaagccagc

SEQ ID NO: 278375 - DNA, 25 bp, Mus musculus
gtggtgcccatgtcgacagtacagc

SEQ ID NO: 278376 - DNA, 25 bp, Mus musculus
tccacctctgacagcaatgcgcatg

SEQ ID NO: 278377 - DNA, 25 bp, Mus musculus
ctctgacagcaatgcgcatgggccg

SEQ ID NO: 278378 - DNA, 25 bp, Mus musculus
gctcggcagcatagctcctcagcgt

SEQ ID NO: 278379 - DNA, 25 bp, Mus musculus
gacgctcggcagcatagctcctcag

SEQ ID NO: 278380 - DNA, 25 bp, Mus musculus
taactcacagtaactcacacagacc

SEQ ID NO: 278381 - DNA, 25 bp, Mus musculus
gtggaataactcacagtaactcaca

SEQ ID NO: 278382 - DNA, 25 bp, Mus musculus
gcggtaagtggaataactcacagta

SEQ ID NO: 278383 - DNA, 25 bp, Mus musculus
gcctcgcggtaagtggaataactca

SEQ ID NO: 278384 - DNA, 25 bp, Mus musculus
tggcctcgcggtaagtggaataact

SEQ ID NO: 278385 - DNA, 25 bp, Mus musculus
ggcccagcgtctggcctcgcggtaa

SEQ ID NO: 278386 - DNA, 25 bp, Mus musculus
tgctcccgcggttccgctcgaaccc

SEQ ID NO: 278387 - DNA, 25 bp, Mus musculus
agcgggtcgactgctcccgcggttc

SEQ ID NO: 278388 - DNA, 25 bp, Mus musculus
tcagcgtccacctctgacagcaatg

SEQ ID NO: 278389 - DNA, 25 bp, Mus musculus
tagccgagcgggtcgactgctcccg

SEQ ID NO: 278390 - DNA, 25 bp, Mus musculus
tcctggtccggacgagatttctgca

SEQ ID NO: 278391 - DNA, 25 bp, Mus musculus
gagttcctgctgctcacccaacata

SEQ ID NO: 278392 - DNA, 25 bp, Mus musculus
tcctcctcctggtaggcgggacaaa

SEQ ID NO: 278393 - DNA, 25 bp, Mus musculus
ctggcggccgtacaggcaatgacac

SEQ ID NO: 278394 - DNA, 25 bp, Mus musculus
aggcaatgacaccaccagccgttca

SEQ ID NO: 278395 - DNA, 25 bp, Mus musculus
tggctcccgggcagaaaatagtgtt

SEQ ID NO: 278396 - DNA, 25 bp, Mus musculus
tcccgggcagaaaatagtgttcgtg

SEQ ID NO: 278397 - DNA, 25 bp, Mus musculus
gcagcagcgccaggtccgaagcgaa

SEQ ID NO: 278398 - DNA, 25 bp, Mus musculus
ccgaagcgaagtccctggaagcgtt

SEQ ID NO: 278399 - DNA, 25 bp, Mus musculus
gaagtccctggaagcgttctcgtgc

SEQ ID NO: 278400 - DNA, 25 bp, Mus musculus
tggaagcgttctcgtgcgccacgag

SEQ ID NO: 278401 - DNA, 25 bp, Mus musculus
tcctcctccggacgggagggcagca

SEQ ID NO: 278402 - DNA, 25 bp, Mus musculus
agcagcacccgccaggtctcaaaat

SEQ ID NO: 278403 - DNA, 25 bp, Mus musculus
acgagatttctgcaacgagttcctg

SEQ ID NO: 278404 - DNA, 25 bp, Mus musculus
gccactgagcgcatgtgcgctcctt

SEQ ID NO: 278405 - DNA, 25 bp, Mus musculus
acgaggcaggcagaccggccgcaca

SEQ ID NO: 278406 - DNA, 25 bp, Mus musculus
ccgcacagaggggcccagcttggct

SEQ ID NO: 278407 - DNA, 25 bp, Mus musculus
agcagagccaagtctgcgcccagtt

SEQ ID NO: 278408 - DNA, 25 bp, Mus musculus
caagtctgcgcccagttccactgtg

SEQ ID NO: 278409 - DNA, 25 bp, Mus musculus
gcgcccagttccactgtgctgtagt

SEQ ID NO: 278410 - DNA, 25 bp, Mus musculus
gtgctgtagttgtccggtatcagga

SEQ ID NO: 278411 - DNA, 25 bp, Mus musculus
tatcaggatggtggccactgagcgc

SEQ ID NO: 278412 - DNA, 25 bp, Mus musculus
agcgcatgtgcgctccttccagggg

SEQ ID NO: 278413 - DNA, 25 bp, Mus musculus
gtcctgggagtgcacgcccagcaga

SEQ ID NO: 278414 - DNA, 25 bp, Mus musculus
gagtgcacgcccagcagaactgaca

SEQ ID NO: 278415 - DNA, 25 bp, Mus musculus
cgcccagcagaactgacaattcgtc

SEQ ID NO: 278416 - DNA, 25 bp, Mus musculus
cagcagaactgacaattcgtccgcg

SEQ ID NO: 278417 - DNA, 25 bp, Mus musculus
ttgtccggtatcaggatggtggcca

SEQ ID NO: 278418 - DNA, 25 bp, Mus musculus
tcgcagtgctgcatccgggcacttg

SEQ ID NO: 278419 - DNA, 25 bp, Mus musculus
gccgggtcgtaccattctgcctcta

SEQ ID NO: 278420 - DNA, 25 bp, Mus musculus
ccaccggccgcaaggagaaagcgcg

SEQ ID NO: 278421 - DNA, 25 bp, Mus musculus
cttctccacttggtacgtcccggtg

SEQ ID NO: 278422 - DNA, 25 bp, Mus musculus
agtcctcgcggcatcgcttcgcggt

SEQ ID NO: 278423 - DNA, 25 bp, Mus musculus
cttcgcggtcgtctggaactttgtt

SEQ ID NO: 278424 - DNA, 25 bp, Mus musculus
ctggaactttgttgcttggcggcct

SEQ ID NO: 278425 - DNA, 25 bp, Mus musculus
cgcggacatggcttcaaacggtatg

SEQ ID NO: 278426 - DNA, 25 bp, Mus musculus
cttcaaacggtatgtgggagcgcga

SEQ ID NO: 278427 - DNA, 25 bp, Mus musculus
ccctcgcagcaaggcttttggcttt

SEQ ID NO: 278428 - DNA, 25 bp, Mus musculus
tgggttttctctcctggcccggtca

SEQ ID NO: 278429 - DNA, 25 bp, Mus musculus
gcctcgctttgtcgcagtgctgcat

SEQ ID NO: 278430 - DNA, 25 bp, Mus musculus
gaccctcggcggaagacttgtggtc

SEQ ID NO: 278431 - DNA, 25 bp, Mus musculus
cccggtcacttgagtcgagtgttga

SEQ ID NO: 278432 - DNA, 25 bp, Mus musculus
tcctcctctggtcgccgagtggagt

SEQ ID NO: 278433 - DNA, 25 bp, Mus musculus
tacgccaatcttttctttccacgag

SEQ ID NO: 278434 - DNA, 25 bp, Mus musculus
tggctttctatgatgcgagcaaccc

SEQ ID NO: 278435 - DNA, 25 bp, Mus musculus
cagatggcgtcctggctttctatga

SEQ ID NO: 278436 - DNA, 25 bp, Mus musculus
ctacctaagcttcgcagatggcgtc

SEQ ID NO: 278437 - DNA, 25 bp, Mus musculus
gcgcgcattggcctctacctaagct

SEQ ID NO: 278438 - DNA, 25 bp, Mus musculus
tgggtctgcgcgatggcaagatcct

SEQ ID NO: 278439 - DNA, 25 bp, Mus musculus
ggcgacaaaccacgctgggccctgg

SEQ ID NO: 278440 - DNA, 25 bp, Mus musculus
agctgctgtcacagggcgagcacta

SEQ ID NO: 278441 - DNA, 25 bp, Mus musculus
agacacgcgtcagttcgacaaggca

SEQ ID NO: 278442 - DNA, 25 bp, Mus musculus
ccagcgggagaagacacgcgtcagt

SEQ ID NO: 278443 - DNA, 25 bp, Mus musculus
gtgctcagaccagaaggcgccgcca

SEQ ID NO: 278444 - DNA, 25 bp, Mus musculus
cccatctttgacgtgtgctggcacg

SEQ ID NO: 278445 - DNA, 25 bp, Mus musculus
tttctttccacgagcgtctgcccgg

SEQ ID NO: 278446 - DNA, 25 bp, Mus musculus
accgccgaagtttcagctccgccca

SEQ ID NO: 278447 - DNA, 25 bp, Mus musculus
ccataagtcaaaagcgacgcccgtc

SEQ ID NO: 278448 - DNA, 25 bp, Mus musculus
cgcgtatctcgcgagcgacaacatg

SEQ ID NO: 278449 - DNA, 25 bp, Mus musculus
tcgcgagcgacaacatgatgcatta

SEQ ID NO: 278450 - DNA, 25 bp, Mus musculus
cgacaacatgatgcattaaagaccc

SEQ ID NO: 278451 - DNA, 25 bp, Mus musculus
cccgtgaaatctccagcttgcatag

SEQ ID NO: 278452 - DNA, 25 bp, Mus musculus
agcttgcataggttctggcgtccac

SEQ ID NO: 278453 - DNA, 25 bp, Mus musculus
tggcgtccacctgcgtgaaagaatc

SEQ ID NO: 278454 - DNA, 25 bp, Mus musculus
cctgcgtgaaagaatcggtgctctg

SEQ ID NO: 278455 - DNA, 25 bp, Mus musculus
aaagaatcggtgctctggggactcc

SEQ ID NO: 278456 - DNA, 25 bp, Mus musculus
tccacggactcgatcttcacgagcg

SEQ ID NO: 278457 - DNA, 25 bp, Mus musculus
tcgatcttcacgagcggttcaaccg

SEQ ID NO: 278458 - DNA, 25 bp, Mus musculus
caggcagccatgtttccataagtca

SEQ ID NO: 278459 - DNA, 25 bp, Mus musculus
gattggtctgatcttacaggcagcc

SEQ ID NO: 278460 - DNA, 25 bp, Mus musculus
gcgagacctttctgtcgggaactta

SEQ ID NO: 278461 - DNA, 25 bp, Mus musculus
actgcactaagcttggcgccgacta

SEQ ID NO: 278462 - DNA, 25 bp, Mus musculus
gaagtggcagcgaactttcccggta

SEQ ID NO: 278463 - DNA, 25 bp, Mus musculus
ggaaaggacccagctaccaacgaga

SEQ ID NO: 278464 - DNA, 25 bp, Mus musculus
tgcgactgtgcaagtaccggagttc

SEQ ID NO: 278465 - DNA, 25 bp, Mus musculus
cgtctgatcctaggagcaacagttc

SEQ ID NO: 278466 - DNA, 25 bp, Mus musculus
gacagcactaagactccaccgcggg

SEQ ID NO: 278467 - DNA, 25 bp, Mus musculus
tcaagtctgaacgtcgccgacaagg

SEQ ID NO: 278468 - DNA, 25 bp, Mus musculus
accgcgctttgagggttgccaatca

SEQ ID NO: 278469 - DNA, 25 bp, Mus musculus
tcggagccattgatcaccgcgcttt

SEQ ID NO: 278470 - DNA, 25 bp, Mus musculus
ttctgcgagtctgtcagtccggctt

SEQ ID NO: 278471 - DNA, 25 bp, Mus musculus
taactctttcattcgcttggcgaga

SEQ ID NO: 278472 - DNA, 25 bp, Mus musculus
ttgcggccgaaaagcgctcggtttc

SEQ ID NO: 278473 - DNA, 25 bp, Mus musculus
cttccagttccgctctctcagagta

SEQ ID NO: 278474 - DNA, 25 bp, Mus musculus
agacacactcgaccctttcttgtcc

SEQ ID NO: 278475 - DNA, 25 bp, Mus musculus
ctttcttgtcctccacaagcaggca

SEQ ID NO: 278476 - DNA, 25 bp, Mus musculus
ttgtcctccacaagcaggcaaaaga

SEQ ID NO: 278477 - DNA, 25 bp, Mus musculus
gggaagcttccgcttcaacagaact

SEQ ID NO: 278478 - DNA, 25 bp, Mus musculus
gtccctctgaccgatccggagacgg

SEQ ID NO: 278479 - DNA, 25 bp, Mus musculus
catcgtctacaaacaccgtcgtcca

SEQ ID NO: 278480 - DNA, 25 bp, Mus musculus
gtccacttctacctagacgaccaaa

SEQ ID NO: 278481 - DNA, 25 bp, Mus musculus
ctacctagacgaccaaaaccagaga

SEQ ID NO: 278482 - DNA, 25 bp, Mus musculus
ctcgtaaccctgaaaccaaagcacg

SEQ ID NO: 278483 - DNA, 25 bp, Mus musculus
tagattttcacatagctctaaacac

SEQ ID NO: 278484 - DNA, 25 bp, Mus musculus
tgaaaccaaagcacgaggtgggact

SEQ ID NO: 278485 - DNA, 25 bp, Mus musculus
gcttccgcttcaacagaactcggtc

SEQ ID NO: 278486 - DNA, 25 bp, Mus musculus
accctgaaaccaaagcacgaggtgg

SEQ ID NO: 278487 - DNA, 25 bp, Mus musculus
accgatccggagacggccaggcgtc

SEQ ID NO: 278488 - DNA, 25 bp, Mus musculus
gagtcggtccaacgcggcaaaaagc

SEQ ID NO: 278489 - DNA, 25 bp, Mus musculus
agcagcacggatctgaggcccgaaa

SEQ ID NO: 278490 - DNA, 25 bp, Mus musculus
atcggccagccggacctgcacggaa

SEQ ID NO: 278491 - DNA, 25 bp, Mus musculus
cctgcacggaatcccacagctggta

SEQ ID NO: 278492 - DNA, 25 bp, Mus musculus
cccacagctggtatggcaggtaatc

SEQ ID NO: 278493 - DNA, 25 bp, Mus musculus
taatccgggctgacgctatctggga

SEQ ID NO: 278494 - DNA, 25 bp, Mus musculus
acgctatctgggaagccctgaggca

SEQ ID NO: 278495 - DNA, 25 bp, Mus musculus
tctgaggcccgaaagagcggtcagt

SEQ ID NO: 278496 - DNA, 25 bp, Mus musculus
agcggtcagtgctgcccagggtccc

SEQ ID NO: 278497 - DNA, 25 bp, Mus musculus
ccgcgtgctgcccaggtttcgctat

SEQ ID NO: 278498 - DNA, 25 bp, Mus musculus
ctgcccaggtttcgctatcggggcc

SEQ ID NO: 278499 - DNA, 25 bp, Mus musculus
gagccgaactgctccgtgcacagcg

SEQ ID NO: 278500 - DNA, 25 bp, Mus musculus
tcctcaagttcagcgagtcggtcca

SEQ ID NO: 278501 - DNA, 25 bp, Mus musculus
gcagcgtcagccatcctcaagttca

SEQ ID NO: 278502 - DNA, 25 bp, Mus musculus
tgcgctcaactaccggaatcctgta

SEQ ID NO: 278503 - DNA, 25 bp, Mus musculus
ttccgcccgagaaagaggctgcacg

SEQ ID NO: 278504 - DNA, 25 bp, Mus musculus
ccgtggttcccagaccttctctaga

SEQ ID NO: 278505 - DNA, 25 bp, Mus musculus
aagctgctctgactcccgcttcaag

SEQ ID NO: 278506 - DNA, 25 bp, Mus musculus
ggcactgggtccagccctcagttac

SEQ ID NO: 278507 - DNA, 25 bp, Mus musculus
tcgcggcctggagacatacagcgtt

SEQ ID NO: 278508 - DNA, 25 bp, Mus musculus
aggcgtcaccagagtcccgagccaa

SEQ ID NO: 278509 - DNA, 25 bp, Mus musculus
caaacctcggagaacgctgtctgga

SEQ ID NO: 278510 - DNA, 25 bp, Mus musculus
tgtctggagcctctgcggtttcaga

SEQ ID NO: 278511 - DNA, 25 bp, Mus musculus
tctgagcgcgccagcacatttttta

SEQ ID NO: 278512 - DNA, 25 bp, Mus musculus
tttaacttggacgacacttgggtgc

SEQ ID NO: 278513 - DNA, 25 bp, Mus musculus
tcaggagaacctttgcgctcaacta

SEQ ID NO: 278514 - DNA, 25 bp, Mus musculus
gaatcctgtagatcccagcgccggg

SEQ ID NO: 278515 - DNA, 25 bp, Mus musculus
cacttgggtgcagtctcaggagaac

SEQ ID NO: 278516 - DNA, 25 bp, Mus musculus
atggtccggacgcacaaacggatta

SEQ ID NO: 278517 - DNA, 25 bp, Mus musculus
aacggattaggaagcggcatcacta

SEQ ID NO: 278518 - DNA, 25 bp, Mus musculus
cggcatcactaactgagcgaaagga

SEQ ID NO: 278519 - DNA, 25 bp, Mus musculus
ctgagcgaaaggagtttaactggtt

SEQ ID NO: 278520 - DNA, 25 bp, Mus musculus
agcggttggaagatgcgattcattc

SEQ ID NO: 278521 - DNA, 25 bp, Mus musculus
tttaactggttgtcaggttggcgca

SEQ ID NO: 278522 - DNA, 25 bp, Mus musculus
gcgcagtaagcgctcaaagtaaact

SEQ ID NO: 278523 - DNA, 25 bp, Mus musculus
cttttatccaactccgatggtccgg

SEQ ID NO: 278524 - DNA, 25 bp, Mus musculus
tagcgggagcagtcatccttttatc

SEQ ID NO: 278525 - DNA, 25 bp, Mus musculus
gcactcaaaagacaggtaacaaata

SEQ ID NO: 278526 - DNA, 25 bp, Mus musculus
cccgacagctataccgcgaaaaata

SEQ ID NO: 278527 - DNA, 25 bp, Mus musculus
ggcttcaggtgaaacccgacagcta

SEQ ID NO: 278528 - DNA, 25 bp, Mus musculus
ttcattcattagattgggcttcagg

SEQ ID NO: 278529 - DNA, 25 bp, Mus musculus
cttcgttatccaagggacagaggtg

SEQ ID NO: 278530 - DNA, 25 bp, Mus musculus
gaactgtagttcaaggcagaccctg

SEQ ID NO: 278531 - DNA, 25 bp, Mus musculus
ctctcagaactgctggtccgtgttc

SEQ ID NO: 278532 - DNA, 25 bp, Mus musculus
cggccgaaatagagaggagctgtcc

SEQ ID NO: 278533 - DNA, 25 bp, Mus musculus
agagcggtttcttcaactgcagatc

SEQ ID NO: 278534 - DNA, 25 bp, Mus musculus
gggaagcccttctccagtggccttc

SEQ ID NO: 278535 - DNA, 25 bp, Mus musculus
cgcgaaaccaagtctccgggaattg

SEQ ID NO: 278536 - DNA, 25 bp, Mus musculus
tgctggccagtcaagacctatccgg

SEQ ID NO: 278537 - DNA, 25 bp, Mus musculus
gtacaccctgcgactggacacgacg

SEQ ID NO: 278538 - DNA, 25 bp, Mus musculus
aagcccggccaaagagtacaccctg

SEQ ID NO: 278539 - DNA, 25 bp, Mus musculus
ggcctgtccggcaaaagtagctaaa

SEQ ID NO: 278540 - DNA, 25 bp, Mus musculus
ggacactgcgctccaaccaggagga

SEQ ID NO: 278541 - DNA, 25 bp, Mus musculus
tgtccgtcgtcttccatcatggtgg

SEQ ID NO: 278542 - DNA, 25 bp, Mus musculus
cttctgttggtccagtgtgagcttc

SEQ ID NO: 278543 - DNA, 25 bp, Mus musculus
cccaggatcgctcttagcatcttaa

SEQ ID NO: 278544 - DNA, 25 bp, Mus musculus
ttcccggacacatcggctacacaga

SEQ ID NO: 278545 - DNA, 25 bp, Mus musculus
ccctgctgcgcaaggagagtcctta

SEQ ID NO: 278546 - DNA, 25 bp, Mus musculus
agtccttaaccatatccgcctcgaa

SEQ ID NO: 278547 - DNA, 25 bp, Mus musculus
tggcccttcttcgtggaccacaaca

SEQ ID NO: 278548 - DNA, 25 bp, Mus musculus
ggtggttttccacagcctcttgcga

SEQ ID NO: 278549 - DNA, 25 bp, Mus musculus
cccgccgcgattatagcctatgact

SEQ ID NO: 278550 - DNA, 25 bp, Mus musculus
tagcctatgactcagggcggagctc

SEQ ID NO: 278551 - DNA, 25 bp, Mus musculus
ccgccaagttctctggatgggacca

SEQ ID NO: 278552 - DNA, 25 bp, Mus musculus
accagaagtttctagccggccagtt

SEQ ID NO: 278553 - DNA, 25 bp, Mus musculus
cctttggcagctaggaggctatttc

SEQ ID NO: 278554 - DNA, 25 bp, Mus musculus
ttaattcataaaggtgcccggcgcc

SEQ ID NO: 278555 - DNA, 25 bp, Mus musculus
cccatgatgcagatggcgtccggca

SEQ ID NO: 278556 - DNA, 25 bp, Mus musculus
gggcggaccctaacccagcatgagc

SEQ ID NO: 278557 - DNA, 25 bp, Mus musculus
ccggccagttgctgccttctcttta

SEQ ID NO: 278558 - DNA, 25 bp, Mus musculus
agctctttcaggctaaggaccacta

SEQ ID NO: 278559 - DNA, 25 bp, Mus musculus
ttggggatgtcagcgctagtcctga

SEQ ID NO: 278560 - DNA, 25 bp, Mus musculus
ggactccagcatcgctccagggcgg

SEQ ID NO: 278561 - DNA, 25 bp, Mus musculus
tcggccgcccaagcgtgttcttggc

SEQ ID NO: 278562 - DNA, 25 bp, Mus musculus
ccactctgttcttccgtgggctggg

SEQ ID NO: 278563 - DNA, 25 bp, Mus musculus
tctgttcttccgtgggctgggtcct

SEQ ID NO: 278564 - DNA, 25 bp, Mus musculus
gctgggtcctcggagtctccttgag

SEQ ID NO: 278565 - DNA, 25 bp, Mus musculus
cctcggagtctccttgaggcacgga

SEQ ID NO: 278566 - DNA, 25 bp, Mus musculus
aaggaccactacatcctgcagcagg

SEQ ID NO: 278567 - DNA, 25 bp, Mus musculus
aggaggactccagcatcgctccagg

SEQ ID NO: 278568 - DNA, 25 bp, Mus musculus
acgcttggggatgtcagcgctagtc

SEQ ID NO: 278569 - DNA, 25 bp, Mus musculus
ccggcatggagctctttcaggctaa

SEQ ID NO: 278570 - DNA, 25 bp, Mus musculus
ctttcaggctaaggaccactacatc

SEQ ID NO: 278571 - DNA, 25 bp, Mus musculus
gtctccttgaggcacggactctggt

SEQ ID NO: 278572 - DNA, 25 bp, Mus musculus
gctgccaacgctgcggaacctaagt

SEQ ID NO: 278573 - DNA, 25 bp, Mus musculus
tagacagaggatgccgcgctcccat

SEQ ID NO: 278574 - DNA, 25 bp, Mus musculus
gcagtgccattctctgcaggcgcga

SEQ ID NO: 278575 - DNA, 25 bp, Mus musculus
tctgcccatcaagccgtggtaaagg

SEQ ID NO: 278576 - DNA, 25 bp, Mus musculus
ggatcgcggcaaagataacagcttg

SEQ ID NO: 278577 - DNA, 25 bp, Mus musculus
gcagggtattgcgactatcaggatc

SEQ ID NO: 278578 - DNA, 25 bp, Mus musculus
ccggtcatctatcctccgcagggta

SEQ ID NO: 278579 - DNA, 25 bp, Mus musculus
agcacctgcagaaacgccgactcta

SEQ ID NO: 278580 - DNA, 25 bp, Mus musculus
cgaaaggaactaggcgagctgcatc

SEQ ID NO: 278581 - DNA, 25 bp, Mus musculus
actttagcgcctggaaagaggctta

SEQ ID NO: 278582 - DNA, 25 bp, Mus musculus
tttgccacagaccagctggacttta

SEQ ID NO: 278583 - DNA, 25 bp, Mus musculus
ctcaactgtgtgtccttcctgcctg

SEQ ID NO: 278584 - DNA, 25 bp, Mus musculus
cagacaccggatagaagcagccctc

SEQ ID NO: 278585 - DNA, 25 bp, Mus musculus
aacgcagcgttcagcgcgcttcacg

SEQ ID NO: 278586 - DNA, 25 bp, Mus musculus
aagaagccttgcacgatcccgagcg

SEQ ID NO: 278587 - DNA, 25 bp, Mus musculus
tgcttggtatagtggtccctgtgtg

SEQ ID NO: 278588 - DNA, 25 bp, Mus musculus
cgtctgtgcttggtatagtggtccc

SEQ ID NO: 278589 - DNA, 25 bp, Mus musculus
agacggagacaggtcgggcaatccc

SEQ ID NO: 278590 - DNA, 25 bp, Mus musculus
gacggccattttggagacggagaca

SEQ ID NO: 278591 - DNA, 25 bp, Mus musculus
atggcgggaaatcgcggccaccgac

SEQ ID NO: 278592 - DNA, 25 bp, Mus musculus
ctccacttctcacaatggcgggaaa

SEQ ID NO: 278593 - DNA, 25 bp, Mus musculus
gcctccgcgcgtctcaaggagaggt

SEQ ID NO: 278594 - DNA, 25 bp, Mus musculus
atcttctccacagggcatggcgctg

SEQ ID NO: 278595 - DNA, 25 bp, Mus musculus
atcccgagcgggtggctcagccaat

SEQ ID NO: 278596 - DNA, 25 bp, Mus musculus
cactcaccgaagaagccttgcacga

SEQ ID NO: 278597 - DNA, 25 bp, Mus musculus
acggctgcttctgctaggcttccag

SEQ ID NO: 278598 - DNA, 25 bp, Mus musculus
ggctcagccaatcttctccacaggg

SEQ ID NO: 278599 - DNA, 25 bp, Mus musculus
gccacgcgagccctcggcagtgatt

SEQ ID NO: 278600 - DNA, 25 bp, Mus musculus
tcggccacggagttcagcttcaacg

SEQ ID NO: 278601 - DNA, 25 bp, Mus musculus
tgtgattccagaggctgacccagtc

SEQ ID NO: 278602 - DNA, 25 bp, Mus musculus
gtggcatcctcgctaaccggtttcc

SEQ ID NO: 278603 - DNA, 25 bp, Mus musculus
cctcgtcaggcactaacttactctt

SEQ ID NO: 278604 - DNA, 25 bp, Mus musculus
gcttccctgctcttacccggaggta

SEQ ID NO: 278605 - DNA, 25 bp, Mus musculus
aaaccgatcccggagtcgctggcct

SEQ ID NO: 278606 - DNA, 25 bp, Mus musculus
tgggcggcgtcaaattccggaagaa

SEQ ID NO: 278607 - DNA, 25 bp, Mus musculus
caccttattgattttgggcggcgtc

SEQ ID NO: 278608 - DNA, 25 bp, Mus musculus
gtctgaagccgattccaccttattg

SEQ ID NO: 278609 - DNA, 25 bp, Mus musculus
accgaggctgtcacgtgataggctt

SEQ ID NO: 278610 - DNA, 25 bp, Mus musculus
cgacttcgagcgtcaattaacgcta

SEQ ID NO: 278611 - DNA, 25 bp, Mus musculus
ttaacgctaggattcatcggccaca

SEQ ID NO: 278612 - DNA, 25 bp, Mus musculus
ggccacacctctctattctatgctg

SEQ ID NO: 278613 - DNA, 25 bp, Mus musculus
aaccggtttccggtctgtgtgcagc

SEQ ID NO: 278614 - DNA, 25 bp, Mus musculus
cgaagggggcatcgccgtcctccat

SEQ ID NO: 278615 - DNA, 25 bp, Mus musculus
cgaggccccggattcccgcaagaga

SEQ ID NO: 278616 - DNA, 25 bp, Mus musculus
aggtggtctgcaccaagcgcagcaa

SEQ ID NO: 278617 - DNA, 25 bp, Mus musculus
ggggctgagagctttgtctgcgacg

SEQ ID NO: 278618 - DNA, 25 bp, Mus musculus
ccctccgcgaggagatggggacccg

SEQ ID NO: 278619 - DNA, 25 bp, Mus musculus
ggggcatcgccgtcctccatcatcc

SEQ ID NO: 278620 - DNA, 25 bp, Mus musculus
aacacgggaggtgaggcaaagctga

SEQ ID NO: 278621 - DNA, 25 bp, Mus musculus
caccaagcgcagcaacacgggaggt

SEQ ID NO: 278622 - DNA, 25 bp, Mus musculus
ctgcaccaagcgcagcaacacggga

SEQ ID NO: 278623 - DNA, 25 bp, Mus musculus
ggtctgcaccaagcgcagcaacacg

SEQ ID NO: 278624 - DNA, 25 bp, Mus musculus
gtggtctgcaccaagcgcagcaaca

SEQ ID NO: 278625 - DNA, 25 bp, Mus musculus
cccgaggtggtctgcaccaagcgca

SEQ ID NO: 278626 - DNA, 25 bp, Mus musculus
gattcccgcaagagacccctcgaga

SEQ ID NO: 278627 - DNA, 25 bp, Mus musculus
ctggcaggtgcaagtgcttcaggga

SEQ ID NO: 278628 - DNA, 25 bp, Mus musculus
cgggaaaagagtggactgcagcatc

SEQ ID NO: 278629 - DNA, 25 bp, Mus musculus
cccaacgtggggctttgggctctgt

SEQ ID NO: 278630 - DNA, 25 bp, Mus musculus
ggccgctactgctggccgaactgct

SEQ ID NO: 278631 - DNA, 25 bp, Mus musculus
aaccgtgcatctgttggcggaaggc

SEQ ID NO: 278632 - DNA, 25 bp, Mus musculus
ggcgaataggactcaaccgtgcatc

SEQ ID NO: 278633 - DNA, 25 bp, Mus musculus
catcctggaggacggagatgctcta

SEQ ID NO: 278634 - DNA, 25 bp, Mus musculus
ggggccctcttgcatcctggaggac

SEQ ID NO: 278635 - DNA, 25 bp, Mus musculus
tagcaatcaggagccggggccctct

SEQ ID NO: 278636 - DNA, 25 bp, Mus musculus
gaagcaggacgcaccattggagccc

SEQ ID NO: 278637 - DNA, 25 bp, Mus musculus
taactccgggactttggcaaagctg

SEQ ID NO: 278638 - DNA, 25 bp, Mus musculus
cttgcagagagccacgcgaattccc

SEQ ID NO: 278639 - DNA, 25 bp, Mus musculus
cgctggctgagaacttgcagagagc

SEQ ID NO: 278640 - DNA, 25 bp, Mus musculus
tcggttgtagcatgtccgcacagtc

SEQ ID NO: 278641 - DNA, 25 bp, Mus musculus
agcatcccagcgcagtcggttgtag

SEQ ID NO: 278642 - DNA, 25 bp, Mus musculus
tcgtgtcgcttcctgcctgccggtg

SEQ ID NO: 278643 - DNA, 25 bp, Mus musculus
cggggctctcaacgcgcacaacaag

SEQ ID NO: 278644 - DNA, 25 bp, Mus musculus
cgcggacgcgactacccggactttg

SEQ ID NO: 278645 - DNA, 25 bp, Mus musculus
tcaacgcgcacaacaaggcggcggt

SEQ ID NO: 278646 - DNA, 25 bp, Mus musculus
ttcaaggtgtcagcgcgcaccctca

SEQ ID NO: 278647 - DNA, 25 bp, Mus musculus
gtaaacttcaaggtgtcagcgcgca

SEQ ID NO: 278648 - DNA, 25 bp, Mus musculus
ggtgccgccgcgatgttaccctaca

SEQ ID NO: 278649 - DNA, 25 bp, Mus musculus
gaagagctgctcgtgtcgcttcctg

SEQ ID NO: 278650 - DNA, 25 bp, Mus musculus
ccggactttggaacggaagagctgc

SEQ ID NO: 278651 - DNA, 25 bp, Mus musculus
gggatttcacggaacccaactgctg

SEQ ID NO: 278652 - DNA, 25 bp, Mus musculus
tggaaggaggaacctgggatttcac

SEQ ID NO: 278653 - DNA, 25 bp, Mus musculus
acggactattggaaggaggaacctg

SEQ ID NO: 278654 - DNA, 25 bp, Mus musculus
gccgcgatgttaccctacaccgtaa

SEQ ID NO: 278655 - DNA, 25 bp, Mus musculus
aacccaactgctggcgcggacgcga

SEQ ID NO: 278656 - DNA, 25 bp, Mus musculus
tccctttggggatgttgcctgacca

SEQ ID NO: 278657 - DNA, 25 bp, Mus musculus
cagagccactgcctccctaaaggtg

SEQ ID NO: 278658 - DNA, 25 bp, Mus musculus
ctttgctggcgagtagtgaacactc

SEQ ID NO: 278659 - DNA, 25 bp, Mus musculus
tgaacactcgcagcgctcaggaacg

SEQ ID NO: 278660 - DNA, 25 bp, Mus musculus
ttgcctgaccacactccagcagttt

SEQ ID NO: 278661 - DNA, 25 bp, Mus musculus
gtaccaggctggagcttccagaatc

SEQ ID NO: 278662 - DNA, 25 bp, Mus musculus
ttcccgaaccgcctatgggctgtgc

SEQ ID NO: 278663 - DNA, 25 bp, Mus musculus
gcgttcggcacgacgattaccttga

SEQ ID NO: 278664 - DNA, 25 bp, Mus musculus
taccttgaatggcagcgctcctctg

SEQ ID NO: 278665 - DNA, 25 bp, Mus musculus
agaacgattccttgggtagcagccg

SEQ ID NO: 278666 - DNA, 25 bp, Mus musculus
cggggatcgcagaacagctaggaca

SEQ ID NO: 278667 - DNA, 25 bp, Mus musculus
tggcgttgcctactccaaactttgc

SEQ ID NO: 278668 - DNA, 25 bp, Mus musculus
tgagctcaaaggaacgcgcccagta

SEQ ID NO: 278669 - DNA, 25 bp, Mus musculus
taggacatgacaccggagctgctct

SEQ ID NO: 278670 - DNA, 25 bp, Mus musculus
agccggccttcaggcccttgtattc

SEQ ID NO: 278671 - DNA, 25 bp, Mus musculus
aaggcgcgctccaagaagccatgtc

SEQ ID NO: 278672 - DNA, 25 bp, Mus musculus
aagatcgcgcgaagccactcgagtg

SEQ ID NO: 278673 - DNA, 25 bp, Mus musculus
gctagttccgttcctcctctgtgag

SEQ ID NO: 278674 - DNA, 25 bp, Mus musculus
ctgaagccggtaaaggcgacctgga

SEQ ID NO: 278675 - DNA, 25 bp, Mus musculus
cttgtattccaccaccgaggccatg

SEQ ID NO: 278676 - DNA, 25 bp, Mus musculus
ctggactcgcagtagccgcagtagt

SEQ ID NO: 278677 - DNA, 25 bp, Mus musculus
tctacaaggctaggtgaaggcgcgc

SEQ ID NO: 278678 - DNA, 25 bp, Mus musculus
tctccaaaatgacagcgaacaggtg

SEQ ID NO: 278679 - DNA, 25 bp, Mus musculus
gggacactcaccacacgacgtcttg

SEQ ID NO: 278680 - DNA, 25 bp, Mus musculus
ttgttcttgcagtagccacactgga

SEQ ID NO: 278681 - DNA, 25 bp, Mus musculus
ggccgagctcgctcaccataggagc

SEQ ID NO: 278682 - DNA, 25 bp, Mus musculus
ggtctggccctcaaaatactctaca

SEQ ID NO: 278683 - DNA, 25 bp, Mus musculus
ggagcgactgcccaacttgttcttg

SEQ ID NO: 278684 - DNA, 25 bp, Mus musculus
cgcgtaggctgcacttcgtaaacaa

SEQ ID NO: 278685 - DNA, 25 bp, Mus musculus
acagcgacacctgtggcccggaggt

SEQ ID NO: 278686 - DNA, 25 bp, Mus musculus
cggcacaggccctggtcgtactcgg

SEQ ID NO: 278687 - DNA, 25 bp, Mus musculus
tcgtaaacaagcgaaagcgcgctgc

SEQ ID NO: 278688 - DNA, 25 bp, Mus musculus
cgccaccttacgttggacagagttg

SEQ ID NO: 278689 - DNA, 25 bp, Mus musculus
acagagttgatgagagcgcggtact

SEQ ID NO: 278690 - DNA, 25 bp, Mus musculus
tactgatggcggatctggcggcaca

SEQ ID NO: 278691 - DNA, 25 bp, Mus musculus
cccagaatcagacagatcggagtcc

SEQ ID NO: 278692 - DNA, 25 bp, Mus musculus
atcggagtcctccaagctcggacgc

SEQ ID NO: 278693 - DNA, 25 bp, Mus musculus
gctgtcgccagacatcgcgccaatt

SEQ ID NO: 278694 - DNA, 25 bp, Mus musculus
gcgccaattcgccttgcaacttcgg

SEQ ID NO: 278695 - DNA, 25 bp, Mus musculus
tgcaacttcggagcggcggaagttc

SEQ ID NO: 278696 - DNA, 25 bp, Mus musculus
ctggcgcgtgagcacacagcgacac

SEQ ID NO: 278697 - DNA, 25 bp, Mus musculus
ggaagttcgcgccagaaactgaaac

SEQ ID NO: 278698 - DNA, 25 bp, Mus musculus
ccgcgtagggactgcgccaggctca

SEQ ID NO: 278699 - DNA, 25 bp, Mus musculus
tgatcatcccgggtaagtgcgcagt

SEQ ID NO: 278700 - DNA, 25 bp, Mus musculus
accctagcctgagggtgcacttcgg

SEQ ID NO: 278701 - DNA, 25 bp, Mus musculus
gcagcacattcctggccggggagga

SEQ ID NO: 278702 - DNA, 25 bp, Mus musculus
ctcccagtcattggccttttgtgct

SEQ ID NO: 278703 - DNA, 25 bp, Mus musculus
cagtcattggccttttgtgctgcaa

SEQ ID NO: 278704 - DNA, 25 bp, Mus musculus
tggccttttgtgctgcaacttttcc

SEQ ID NO: 278705 - DNA, 25 bp, Mus musculus
gtgctgcaacttttcccgagccctt

SEQ ID NO: 278706 - DNA, 25 bp, Mus musculus
tcatcccgggtaagtgcgcagtggt

SEQ ID NO: 278707 - DNA, 25 bp, Mus musculus
aggctcagaggactcatcctgtccg

SEQ ID NO: 278708 - DNA, 25 bp, Mus musculus
tgtgtcccgggagaaaggcggctac

SEQ ID NO: 278709 - DNA, 25 bp, Mus musculus
cggctacgttgagggccagccctga

SEQ ID NO: 278710 - DNA, 25 bp, Mus musculus
ggccagccctgatcatcccgggtaa

SEQ ID NO: 278711 - DNA, 25 bp, Mus musculus
gactcatcctgtccgggggactctg

SEQ ID NO: 278712 - DNA, 25 bp, Mus musculus
ttagacttcgacagcatcgagctgg

SEQ ID NO: 278713 - DNA, 25 bp, Mus musculus
gcatcgagctggtggataacttcca

SEQ ID NO: 278714 - DNA, 25 bp, Mus musculus
aggaaatccaccgagtccgtgccac

SEQ ID NO: 278715 - DNA, 25 bp, Mus musculus
tgagcacgcggaggaaatccaccga

SEQ ID NO: 278716 - DNA, 25 bp, Mus musculus
ccgactctaagggtcaggagtgtaa

SEQ ID NO: 278717 - DNA, 25 bp, Mus musculus
cgtgctctgccgactctaagggtca

SEQ ID NO: 278718 - DNA, 25 bp, Mus musculus
gcgggacttacaacttagacttcga

SEQ ID NO: 278719 - DNA, 25 bp, Mus musculus
agccagcagcgggacttacaactta

SEQ ID NO: 278720 - DNA, 25 bp, Mus musculus
tgaagacaagccgatagccagcagc

SEQ ID NO: 278721 - DNA, 25 bp, Mus musculus
cctcggcggtgttcgatgaagacaa

SEQ ID NO: 278722 - DNA, 25 bp, Mus musculus
agcgagtccgtggaaggaagccctt

SEQ ID NO: 278723 - DNA, 25 bp, Mus musculus
gatggccctcgcagcagcgagtccg

SEQ ID NO: 278724 - DNA, 25 bp, Mus musculus
gttgtggttcccgatggccctcgca

SEQ ID NO: 278725 - DNA, 25 bp, Mus musculus
acttccagagcttggagccgtgctc

SEQ ID NO: 278726 - DNA, 25 bp, Mus musculus
tgcatgtcccagcttcagcgcagtc

SEQ ID NO: 278727 - DNA, 25 bp, Mus musculus
cagtttgaatcatggtgtgacggag

SEQ ID NO: 278728 - DNA, 25 bp, Mus musculus
cgctgggatcttcccgagtatccgc

SEQ ID NO: 278729 - DNA, 25 bp, Mus musculus
tgggatcttcccgagtatccgcctg

SEQ ID NO: 278730 - DNA, 25 bp, Mus musculus
ggatcttcccgagtatccgcctggc

SEQ ID NO: 278731 - DNA, 25 bp, Mus musculus
tctcttcttgcatgtcccagcttca

SEQ ID NO: 278732 - DNA, 25 bp, Mus musculus
tcttgcatgtcccagcttcagcgca

SEQ ID NO: 278733 - DNA, 25 bp, Mus musculus
ggcgcagtttgaatcatggtgtgac

SEQ ID NO: 278734 - DNA, 25 bp, Mus musculus
ccagcttcagcgcagtccgagatgg

SEQ ID NO: 278735 - DNA, 25 bp, Mus musculus
gtttcccactcgcagcgagcgggtt

SEQ ID NO: 278736 - DNA, 25 bp, Mus musculus
ttcccactcgcagcgagcgggttgc

SEQ ID NO: 278737 - DNA, 25 bp, Mus musculus
agcgagcgggttgcagttccctgtg

SEQ ID NO: 278738 - DNA, 25 bp, Mus musculus
tcttcttgcatgtcccagcttcagc

SEQ ID NO: 278739 - DNA, 25 bp, Mus musculus
cgcgctgggatcttcccgagtatcc

SEQ ID NO: 278740 - DNA, 25 bp, Mus musculus
ttctattgaccctcccgggagagtg

SEQ ID NO: 278741 - DNA, 25 bp, Mus musculus
tcgtggtcctcaaaaactgcaagcc

SEQ ID NO: 278742 - DNA, 25 bp, Mus musculus
ttctgctcgacacccaagctgaggc

SEQ ID NO: 278743 - DNA, 25 bp, Mus musculus
ggtagaatcctcgttctgctcgaca

SEQ ID NO: 278744 - DNA, 25 bp, Mus musculus
cggtgctccgcttttggtagaatcc

SEQ ID NO: 278745 - DNA, 25 bp, Mus musculus
tgtcaggttgaaagcgccctgctgc

SEQ ID NO: 278746 - DNA, 25 bp, Mus musculus
cctttcggatgctttctattgaccc

SEQ ID NO: 278747 - DNA, 25 bp, Mus musculus
ctcggcttctggttcctttcggatg

SEQ ID NO: 278748 - DNA, 25 bp, Mus musculus
cgagaggcgcctgaactctgggttc

SEQ ID NO: 278749 - DNA, 25 bp, Mus musculus
ctcactcgctgtctggtctggtaga

SEQ ID NO: 278750 - DNA, 25 bp, Mus musculus
ggagtgcccgctccggaatctcact

SEQ ID NO: 278751 - DNA, 25 bp, Mus musculus
aagccgagcctcgtggtcctcaaaa

SEQ ID NO: 278752 - DNA, 25 bp, Mus musculus
cgagccaccaccctggaactaggaa

SEQ ID NO: 278753 - DNA, 25 bp, Mus musculus
ctggaactaggaagacgcccgattc

SEQ ID NO: 278754 - DNA, 25 bp, Mus musculus
cctgccttgcggctcagcgagtagt

SEQ ID NO: 278755 - DNA, 25 bp, Mus musculus
gctcttttatatccgcggtggcccg

SEQ ID NO: 278756 - DNA, 25 bp, Mus musculus
ctgggactccggctcttttatatcc

SEQ ID NO: 278757 - DNA, 25 bp, Mus musculus
cgaagctcatcatggccggagcagg

SEQ ID NO: 278758 - DNA, 25 bp, Mus musculus
agcgagtagtgcaggctgccgcctc

SEQ ID NO: 278759 - DNA, 25 bp, Mus musculus
cggacgtgagcgatgtcctccagca

SEQ ID NO: 278760 - DNA, 25 bp, Mus musculus
gacgtccgcgcccacgagtggaagc

SEQ ID NO: 278761 - DNA, 25 bp, Mus musculus
gacacggagctcacggacgtccgcg

SEQ ID NO: 278762 - DNA, 25 bp, Mus musculus
ccgttgcttagggtgtctagcgagt

SEQ ID NO: 278763 - DNA, 25 bp, Mus musculus
accttgtcgatgtagcccgcgaagc

SEQ ID NO: 278764 - DNA, 25 bp, Mus musculus
cgagctgcctcaccttgtcgatgta

SEQ ID NO: 278765 - DNA, 25 bp, Mus musculus
acgtcacgtcgcacttgagggcgtc

SEQ ID NO: 278766 - DNA, 25 bp, Mus musculus
agccctggatctgaccgagcagctc

SEQ ID NO: 278767 - DNA, 25 bp, Mus musculus
atcggcgctgccgaagctcatcatg

SEQ ID NO: 278768 - DNA, 25 bp, Mus musculus
cggcgctcaacacgttggccagcta

SEQ ID NO: 278769 - DNA, 25 bp, Mus musculus
gatctccaagaagggcgagttcctg

SEQ ID NO: 278770 - DNA, 25 bp, Mus musculus
gcgcgcgcatccagatctccaagaa

SEQ ID NO: 278771 - DNA, 25 bp, Mus musculus
gcggctgccaatggctacctcggtg

SEQ ID NO: 278772 - DNA, 25 bp, Mus musculus
agcgctgggttccttcgctctggcc

SEQ ID NO: 278773 - DNA, 25 bp, Mus musculus
gttggccagctacggctacaacacc

SEQ ID NO: 278774 - DNA, 25 bp, Mus musculus
ctcaacatcagctacgccaacgtgg

SEQ ID NO: 278775 - DNA, 25 bp, Mus musculus
ggtacaggaagacccgcagagcagc

SEQ ID NO: 278776 - DNA, 25 bp, Mus musculus
gcgccatcgtgcagaaggtacagga

SEQ ID NO: 278777 - DNA, 25 bp, Mus musculus
tgcacaaggccgtgagcgccatcgt

SEQ ID NO: 278778 - DNA, 25 bp, Mus musculus
agcccgagggcatcaacctgcaaga

SEQ ID NO: 278779 - DNA, 25 bp, Mus musculus
tgctggccatcagcacggcgctcaa

SEQ ID NO: 278780 - DNA, 25 bp, Mus musculus
cggaaccggcgggtcaccatcacgg

SEQ ID NO: 278781 - DNA, 25 bp, Mus musculus
gcacggcaggactgatcatcggtaa

SEQ ID NO: 278782 - DNA, 25 bp, Mus musculus
ggccctatttctgcgccaagcatcg

SEQ ID NO: 278783 - DNA, 25 bp, Mus musculus
atgggcttaaccgtacggccgcgca

SEQ ID NO: 278784 - DNA, 25 bp, Mus musculus
gcgtaccacgctcctgtctttgcta

SEQ ID NO: 278785 - DNA, 25 bp, Mus musculus
ggctgcaatgcgtagtgcccttcgg

SEQ ID NO: 278786 - DNA, 25 bp, Mus musculus
ggccacagtacgacggcgcgcacag

SEQ ID NO: 278787 - DNA, 25 bp, Mus musculus
gtgtggtagcgacgccaagacctac

SEQ ID NO: 278788 - DNA, 25 bp, Mus musculus
agaagcttcgccagccgccggtcat

SEQ ID NO: 278789 - DNA, 25 bp, Mus musculus
gggtgttctaggcatccagttagtg

SEQ ID NO: 278790 - DNA, 25 bp, Mus musculus
tcaccgccgctaggccaatgggctt

SEQ ID NO: 278791 - DNA, 25 bp, Mus musculus
caagcatcgggtcgtttcgagaaac

SEQ ID NO: 278792 - DNA, 25 bp, Mus musculus
ttcgagaaacgccaagcaggtgctt

SEQ ID NO: 278793 - DNA, 25 bp, Mus musculus
tgctttgcgcgctttggtccagcac

SEQ ID NO: 278794 - DNA, 25 bp, Mus musculus
cagagaagcactgcggggtgttcta

SEQ ID NO: 278795 - DNA, 25 bp, Mus musculus
ggagtcgtcatgcagtccctgcgta

SEQ ID NO: 278796 - DNA, 25 bp, Mus musculus
tgcttttgaagcagtgcgaccacgg

SEQ ID NO: 278797 - DNA, 25 bp, Mus musculus
ttccacgttggcaaagcagcgacgc

SEQ ID NO: 278798 - DNA, 25 bp, Mus musculus
ggctcctcagcagcgtgactgtcac

SEQ ID NO: 278799 - DNA, 25 bp, Mus musculus
ccagtagctgctcgaagtccaagtc

SEQ ID NO: 278800 - DNA, 25 bp, Mus musculus
cgcgtcttcgatcgcggtctccatt

SEQ ID NO: 278801 - DNA, 25 bp, Mus musculus
tcgcgttgtttcactgctcaggtca

SEQ ID NO: 278802 - DNA, 25 bp, Mus musculus
gagcttgcgtttccttcagtgccca

SEQ ID NO: 278803 - DNA, 25 bp, Mus musculus
tggccgaaggcactaaacactgaac

SEQ ID NO: 278804 - DNA, 25 bp, Mus musculus
gcaccctgagggtggtaccaaagca

SEQ ID NO: 278805 - DNA, 25 bp, Mus musculus
tgcggtctccttggctcaagcagcc

SEQ ID NO: 278806 - DNA, 25 bp, Mus musculus
gtaaagccagctcccaatccgaggt

SEQ ID NO: 278807 - DNA, 25 bp, Mus musculus
tgcgaccacggctgatcgcgttgtt

SEQ ID NO: 278808 - DNA, 25 bp, Mus musculus
gcgcggcgcttagcattgcagaata

SEQ ID NO: 278809 - DNA, 25 bp, Mus musculus
gtcggaacctctctcgcagagcttg

SEQ ID NO: 278810 - DNA, 25 bp, Mus musculus
cacccggcgcaaaggtttctggaga

SEQ ID NO: 278811 - DNA, 25 bp, Mus musculus
gttgctcctcctcaacgtcgccaga

SEQ ID NO: 278812 - DNA, 25 bp, Mus musculus
cgatggcacacagcctcgggtcagc

SEQ ID NO: 278813 - DNA, 25 bp, Mus musculus
tgcgctcccggactgcgatggcaca

SEQ ID NO: 278814 - DNA, 25 bp, Mus musculus
atgtgctgcctcttgcgctcccgga

SEQ ID NO: 278815 - DNA, 25 bp, Mus musculus
ctcctacgacgatgtgctgcctctt

SEQ ID NO: 278816 - DNA, 25 bp, Mus musculus
agtcgacttttgcacgtgcgctggc

SEQ ID NO: 278817 - DNA, 25 bp, Mus musculus
ggcggccggaaagtcgacttttgca

SEQ ID NO: 278818 - DNA, 25 bp, Mus musculus
taggactgtgcgtcctctgcggctt

SEQ ID NO: 278819 - DNA, 25 bp, Mus musculus
cagcccaaactaggactgtgcgtcc

SEQ ID NO: 278820 - DNA, 25 bp, Mus musculus
acacagcctcgggtcagcatcgggt

SEQ ID NO: 278821 - DNA, 25 bp, Mus musculus
caaaggtttctggagactgcagcaa

SEQ ID NO: 278822 - DNA, 25 bp, Mus musculus
tcgcagagacggacagcccaaacta

SEQ ID NO: 278823 - DNA, 25 bp, Mus musculus
tgggcgtcctctcctacgacgatgt

SEQ ID NO: 278824 - DNA, 25 bp, Mus musculus
tcttgcgcaagggttcgtggaaagc

SEQ ID NO: 278825 - DNA, 25 bp, Mus musculus
ttgcgagcttaacagggccaccctg

SEQ ID NO: 278826 - DNA, 25 bp, Mus musculus
attatgtctctcctggggttccgta

SEQ ID NO: 278827 - DNA, 25 bp, Mus musculus
ttgcccaagtctcgcgtgagcgtgc

SEQ ID NO: 278828 - DNA, 25 bp, Mus musculus
gccatatttgttgtgtctccgctcc

SEQ ID NO: 278829 - DNA, 25 bp, Mus musculus
gtcgcagctgtagccgccatatttg

SEQ ID NO: 278830 - DNA, 25 bp, Mus musculus
ctcagcgttcgtcagcgtcgcagct

SEQ ID NO: 278831 - DNA, 25 bp, Mus musculus
cccagtcacttacgagcccaagaga

SEQ ID NO: 278832 - DNA, 25 bp, Mus musculus
ggctagcaatgaacccggcacttta

SEQ ID NO: 278833 - DNA, 25 bp, Mus musculus
aaagcggtgttagccggctagcaat

SEQ ID NO: 278834 - DNA, 25 bp, Mus musculus
accctccgctgtggccaaggcgaaa

SEQ ID NO: 278835 - DNA, 25 bp, Mus musculus
cgtcaacgtgccctgagtaaccgta

SEQ ID NO: 278836 - DNA, 25 bp, Mus musculus
agcccaagagagtcccgagtcacca

SEQ ID NO: 278837 - DNA, 25 bp, Mus musculus
gatcgccacctgtcaaagccggaga

SEQ ID NO: 278838 - DNA, 25 bp, Mus musculus
ccctggcgtgggaaacgcgagataa

SEQ ID NO: 278839 - DNA, 25 bp, Mus musculus
ccttagcagtggagaattttcccgc

SEQ ID NO: 278840 - DNA, 25 bp, Mus musculus
gcctggaaggcagggttgaacctta

SEQ ID NO: 278841 - DNA, 25 bp, Mus musculus
ggaaaccaatcccacttgctgagaa

SEQ ID NO: 278842 - DNA, 25 bp, Mus musculus
ggctacgaggccaaggaaaccaatc

SEQ ID NO: 278843 - DNA, 25 bp, Mus musculus
tggttaacttccttcggcctctagc

SEQ ID NO: 278844 - DNA, 25 bp, Mus musculus
cgcgagataaaaggagcggccctga

SEQ ID NO: 278845 - DNA, 25 bp, Mus musculus
ccctctcagagatggtgtcactgca

SEQ ID NO: 278846 - DNA, 25 bp, Mus musculus
ggccggtcacattccctctcagaga

SEQ ID NO: 278847 - DNA, 25 bp, Mus musculus
ctttgagatcccagcgcagaggttt

SEQ ID NO: 278848 - DNA, 25 bp, Mus musculus
agttccgtttatggtctgatttccg

SEQ ID NO: 278849 - DNA, 25 bp, Mus musculus
ccgacacctgccaaccagagttttg

SEQ ID NO: 278850 - DNA, 25 bp, Mus musculus
aggaacctgctcaacggagaccatc

SEQ ID NO: 278851 - DNA, 25 bp, Mus musculus
ccagtcctagaaaggcgaagagatc

SEQ ID NO: 278852 - DNA, 25 bp, Mus musculus
cgagccctttgaggagttaagtagg

SEQ ID NO: 278853 - DNA, 25 bp, Mus musculus
tccttccgggttaatgagctgacac

SEQ ID NO: 278854 - DNA, 25 bp, Mus musculus
caaattgtatttcagcgccgggtcc

SEQ ID NO: 278855 - DNA, 25 bp, Mus musculus
cgcagagcaggacgcacaaattgta

SEQ ID NO: 278856 - DNA, 25 bp, Mus musculus
acctgctgtgatgaggcttcggagc

SEQ ID NO: 278857 - DNA, 25 bp, Mus musculus
ctgacaccatgattaaagctgacca

SEQ ID NO: 278858 - DNA, 25 bp, Mus musculus
cgcagtcggtaactcagtgaggcta

SEQ ID NO: 278859 - DNA, 25 bp, Mus musculus
gcgctttactcaataacccgggagc

SEQ ID NO: 278860 - DNA, 25 bp, Mus musculus
ttagcccattaacgagccctttgag

SEQ ID NO: 278861 - DNA, 25 bp, Mus musculus
ccctgaagaggttaatgcggtgacg

SEQ ID NO: 278862 - DNA, 25 bp, Mus musculus
cgccgcagagccctgaagaggttaa

SEQ ID NO: 278863 - DNA, 25 bp, Mus musculus
gaccatttgtaatgtgtctcgaccc

SEQ ID NO: 278864 - DNA, 25 bp, Mus musculus
tgcaggcgaggaactgcaccgtcac

SEQ ID NO: 278865 - DNA, 25 bp, Mus musculus
ttaagtagggagagttctgccacgg

SEQ ID NO: 278866 - DNA, 25 bp, Mus musculus
ggctccggcttgcttctgcccagat

SEQ ID NO: 278867 - DNA, 25 bp, Mus musculus
tccatggtcattctgtttgtgctca

SEQ ID NO: 278868 - DNA, 25 bp, Mus musculus
tttaaggctcatcaactccatggtc

SEQ ID NO: 278869 - DNA, 25 bp, Mus musculus
atgcaggcatcagtcaacctccttg

SEQ ID NO: 278870 - DNA, 25 bp, Mus musculus
ctgctgctttgaaaggccgaggctc

SEQ ID NO: 278871 - DNA, 25 bp, Mus musculus
gctcggattatatggaaccctcttc

SEQ ID NO: 278872 - DNA, 25 bp, Mus musculus
gctaccttgtagagctcagtcctca

SEQ ID NO: 278873 - DNA, 25 bp, Mus musculus
cggcctgtaaaatgatgctaccttg

SEQ ID NO: 278874 - DNA, 25 bp, Mus musculus
cgactctcaaagaaaacggcctgta

SEQ ID NO: 278875 - DNA, 25 bp, Mus musculus
cggcctcttctcgaagtgattagta

SEQ ID NO: 278876 - DNA, 25 bp, Mus musculus
agtcctgcaggctctatgtcttttc

SEQ ID NO: 278877 - DNA, 25 bp, Mus musculus
gccgggtactttctgtcctgactta

SEQ ID NO: 278878 - DNA, 25 bp, Mus musculus
gcggtacacaatgctggccaaaatg

SEQ ID NO: 278879 - DNA, 25 bp, Mus musculus
gcacccatggtgcattctcgaaaag

SEQ ID NO: 278880 - DNA, 25 bp, Mus musculus
tccagagccacaggcgactggcttg

SEQ ID NO: 278881 - DNA, 25 bp, Mus musculus
tcagatttcgttggagggattcgtg

SEQ ID NO: 278882 - DNA, 25 bp, Mus musculus
gatgcctaagggtcagatttcgttg

SEQ ID NO: 278883 - DNA, 25 bp, Mus musculus
ctggtgacacagttgcgagagttct

SEQ ID NO: 278884 - DNA, 25 bp, Mus musculus
tctcccgctggtgacacagttgcga

SEQ ID NO: 278885 - DNA, 25 bp, Mus musculus
aggcgactggcttgcagccctcgca

SEQ ID NO: 278886 - DNA, 25 bp, Mus musculus
cacgccgcgaaaggccggagctctt

SEQ ID NO: 278887 - DNA, 25 bp, Mus musculus
ttgggttccagagccacaggcgact

SEQ ID NO: 278888 - DNA, 25 bp, Mus musculus
aaagcgtccgcttgggttccagagc

SEQ ID NO: 278889 - DNA, 25 bp, Mus musculus
tcctcctgcgcggagtaaaacgtgg

SEQ ID NO: 278890 - DNA, 25 bp, Mus musculus
tggcgtcctcctgcgcggagtaaaa

SEQ ID NO: 278891 - DNA, 25 bp, Mus musculus
agctcttggcgttcttggcgtcctc

SEQ ID NO: 278892 - DNA, 25 bp, Mus musculus
cacagttgcgagagttctgcgcaga

SEQ ID NO: 278893 - DNA, 25 bp, Mus musculus
cctcgcaggggtctcccgctggtga

SEQ ID NO: 278894 - DNA, 25 bp, Mus musculus
gccttctccgctttgcctgcgagtg

SEQ ID NO: 278895 - DNA, 25 bp, Mus musculus
gttctacagatgaccggttcgaacg

SEQ ID NO: 278896 - DNA, 25 bp, Mus musculus
agcgttttgttctacagatgaccgg

SEQ ID NO: 278897 - DNA, 25 bp, Mus musculus
ctcagacttagcgttttgttctaca

SEQ ID NO: 278898 - DNA, 25 bp, Mus musculus
ctccggttaggaactcagacttagc

SEQ ID NO: 278899 - DNA, 25 bp, Mus musculus
ccggcctctgttgctccggttagga

SEQ ID NO: 278900 - DNA, 25 bp, Mus musculus
ttttatatggggatctgcgggcaag

SEQ ID NO: 278901 - DNA, 25 bp, Mus musculus
cattgtgttttatatggggatctgc

SEQ ID NO: 278902 - DNA, 25 bp, Mus musculus
tccggtcgaggtccattgtgtttta

SEQ ID NO: 278903 - DNA, 25 bp, Mus musculus
catcgatgcacagagggatccggtc

SEQ ID NO: 278904 - DNA, 25 bp, Mus musculus
cgtggccggcgcatcgatgcacaga

SEQ ID NO: 278905 - DNA, 25 bp, Mus musculus
agaaacgttgcttaggcggacagga

SEQ ID NO: 278906 - DNA, 25 bp, Mus musculus
tggccggtgcagaaacgttgcttag

SEQ ID NO: 278907 - DNA, 25 bp, Mus musculus
tccgctttgcctgcgagtgctcgga

SEQ ID NO: 278908 - DNA, 25 bp, Mus musculus
cttcagcacagaggaggacagccgc

SEQ ID NO: 278909 - DNA, 25 bp, Mus musculus
tgcaaaacaggggactcaggttctt

SEQ ID NO: 278910 - DNA, 25 bp, Mus musculus
cccgcctacataaagaatacgacca

SEQ ID NO: 278911 - DNA, 25 bp, Mus musculus
atacgaccattgagcgcacagaggc

SEQ ID NO: 278912 - DNA, 25 bp, Mus musculus
ctagcagccgcggagtggcctacag

SEQ ID NO: 278913 - DNA, 25 bp, Mus musculus
cggggagatgaacggcttcagcaca

SEQ ID NO: 278914 - DNA, 25 bp, Mus musculus
cgggcaacgcctccttcagcaagag

SEQ ID NO: 278915 - DNA, 25 bp, Mus musculus
agggtgcagaaaagcatctcgcaga

SEQ ID NO: 278916 - DNA, 25 bp, Mus musculus
atctcgcagaagaaactcaagctgg

SEQ ID NO: 278917 - DNA, 25 bp, Mus musculus
ctcaagctggacatagacaagagcg

SEQ ID NO: 278918 - DNA, 25 bp, Mus musculus
ctcgccgcgcagtctgtgcaaaaca

SEQ ID NO: 278919 - DNA, 25 bp, Mus musculus
gccagagctgctgcctcatcgcgga

SEQ ID NO: 278920 - DNA, 25 bp, Mus musculus
acaagagcgtgagtctcggggcata

SEQ ID NO: 278921 - DNA, 25 bp, Mus musculus
cccaatgggaactgccagcggcgac

SEQ ID NO: 278922 - DNA, 25 bp, Mus musculus
tgccactaacactggccggcgtcgt

SEQ ID NO: 278923 - DNA, 25 bp, Mus musculus
ctgcaagcgcatcgacgtgatcacc

SEQ ID NO: 278924 - DNA, 25 bp, Mus musculus
aaggtggcccgcttccactgcaagc

SEQ ID NO: 278925 - DNA, 25 bp, Mus musculus
tacctcaaggtgctcaaggtggccc

SEQ ID NO: 278926 - DNA, 25 bp, Mus musculus
gtgctctgcttcacgtacctcaagg

SEQ ID NO: 278927 - DNA, 25 bp, Mus musculus
agcgcctgcgctttgctgtcttcac

SEQ ID NO: 278928 - DNA, 25 bp, Mus musculus
ctatatgcctcgtgcacactgtgca

SEQ ID NO: 278929 - DNA, 25 bp, Mus musculus
tttccgctgagctaccgtgccaaga

SEQ ID NO: 278930 - DNA, 25 bp, Mus musculus
ggcaacctgctgtgtaccgtggtca

SEQ ID NO: 278931 - DNA, 25 bp, Mus musculus
tctcaacctcacgtgtggcaacctg

SEQ ID NO: 278932 - DNA, 25 bp, Mus musculus
gcgcgcaccatgaactcgtgggacg

SEQ ID NO: 278933 - DNA, 25 bp, Mus musculus
gccctctgggtagccatggcgacaa

SEQ ID NO: 278934 - DNA, 25 bp, Mus musculus
tgccgccttcatggtggcctacacg

SEQ ID NO: 278935 - DNA, 25 bp, Mus musculus
ccgtgccaagatgcgcctccgagat

SEQ ID NO: 278936 - DNA, 25 bp, Mus musculus
cccagctggtgtgtccgttccatcg

SEQ ID NO: 278937 - DNA, 25 bp, Mus musculus
ggcagagaagcctggtttacgcttt

SEQ ID NO: 278938 - DNA, 25 bp, Mus musculus
tggtgtgtccgttccatcgggtccc

SEQ ID NO: 278939 - DNA, 25 bp, Mus musculus
cctggtttacgctttgtggagtgtg

SEQ ID NO: 278940 - DNA, 25 bp, Mus musculus
ttacgctttgtggagtgtggacacc

SEQ ID NO: 278941 - DNA, 25 bp, Mus musculus
tttgtggagtgtggacaccgagcct

SEQ ID NO: 278942 - DNA, 25 bp, Mus musculus
tccaccacagtcagcggtctcgatg

SEQ ID NO: 278943 - DNA, 25 bp, Mus musculus
gccatccggaattgaggccggcgtc

SEQ ID NO: 278944 - DNA, 25 bp, Mus musculus
ggacaccgagccttgcggtccgagc

SEQ ID NO: 278945 - DNA, 25 bp, Mus musculus
ggggagcacagaaccgcaataccca

SEQ ID NO: 278946 - DNA, 25 bp, Mus musculus
gcgtcgtcaaaacctgaactggttg

SEQ ID NO: 278947 - DNA, 25 bp, Mus musculus
gccggcgtcgtcaaaacctgaactg

SEQ ID NO: 278948 - DNA, 25 bp, Mus musculus
acctgaactggttgtcaccatgggg

SEQ ID NO: 278949 - DNA, 25 bp, Mus musculus
cagaaccgcaatacccaggtcgggg

SEQ ID NO: 278950 - DNA, 25 bp, Mus musculus
caaatgacgactacggcgcgggaca

SEQ ID NO: 278951 - DNA, 25 bp, Mus musculus
agtcaggctcctcgaaggctgcgcc

SEQ ID NO: 278952 - DNA, 25 bp, Mus musculus
gcaggcgggctacaaatgacgacta

SEQ ID NO: 278953 - DNA, 25 bp, Mus musculus
aaggctgcgccctgggctctgactc

SEQ ID NO: 278954 - DNA, 25 bp, Mus musculus
gcgggctacaaatgacgactacggc

SEQ ID NO: 278955 - DNA, 25 bp, Mus musculus
cagggccaccgccacaagtgccagg

SEQ ID NO: 278956 - DNA, 25 bp, Mus musculus
tgccccgcacccagggtaggatcgg

SEQ ID NO: 278957 - DNA, 25 bp, Mus musculus
aatagtcaggctcctcgaaggctgc

SEQ ID NO: 278958 - DNA, 25 bp, Mus musculus
ggctgtaatagtcaggctcctcgaa

SEQ ID NO: 278959 - DNA, 25 bp, Mus musculus
ctcctggctgtaatagtcaggctcc

SEQ ID NO: 278960 - DNA, 25 bp, Mus musculus
tcaggctccggatgcccataatagc

SEQ ID NO: 278961 - DNA, 25 bp, Mus musculus
atgcccataatagcgcccgcgccgc

SEQ ID NO: 278962 - DNA, 25 bp, Mus musculus
gcgccgccagagctcctggctgtaa

SEQ ID NO: 278963 - DNA, 25 bp, Mus musculus
cagagctcctggctgtaatagtcag

SEQ ID NO: 278964 - DNA, 25 bp, Mus musculus
gagctcggcgcgctccaagttcatt

SEQ ID NO: 278965 - DNA, 25 bp, Mus musculus
gagagctcgctccagaaaatcgccg

SEQ ID NO: 278966 - DNA, 25 bp, Mus musculus
caagttcattgtctgcctgggccgc

SEQ ID NO: 278967 - DNA, 25 bp, Mus musculus
cgcgcagcgaaaaggacgcctccta

SEQ ID NO: 278968 - DNA, 25 bp, Mus musculus
ggaccacattcgctctgtctaggga

SEQ ID NO: 278969 - DNA, 25 bp, Mus musculus
cctctgtcttggagctcggaccaca

SEQ ID NO: 278970 - DNA, 25 bp, Mus musculus
tcgcgcgaattctgactccttgggg

SEQ ID NO: 278971 - DNA, 25 bp, Mus musculus
ccgatctgtctattcattggcctta

SEQ ID NO: 278972 - DNA, 25 bp, Mus musculus
cagtgaacacgactaggggaatccc

SEQ ID NO: 278973 - DNA, 25 bp, Mus musculus
cggctccgattggtacccagagaca

SEQ ID NO: 278974 - DNA, 25 bp, Mus musculus
tcgggaatcttgctcccacagacgc

SEQ ID NO: 278975 - DNA, 25 bp, Mus musculus
gttgagactgatccctcggttcctc

SEQ ID NO: 278976 - DNA, 25 bp, Mus musculus
agactccctagtcaggccgcttcgg

SEQ ID NO: 278977 - DNA, 25 bp, Mus musculus
ttggccttatatcagtcgtccttcc

SEQ ID NO: 278978 - DNA, 25 bp, Mus musculus
ccagaacaccgagtgggccctagtc

SEQ ID NO: 278979 - DNA, 25 bp, Mus musculus
ttcaaagtcgagacctccaaggccc

SEQ ID NO: 278980 - DNA, 25 bp, Mus musculus
agggccgcacaccaatcacaagagg

SEQ ID NO: 278981 - DNA, 25 bp, Mus musculus
cgagacgtaaaagctgcccaaggag

SEQ ID NO: 278982 - DNA, 25 bp, Mus musculus
ccggtgacgcgaccacaagttcgca

SEQ ID NO: 278983 - DNA, 25 bp, Mus musculus
cgcgtacgtcgtacctgacagcgtc

SEQ ID NO: 278984 - DNA, 25 bp, Mus musculus
ccctagacccggagattccagtgtt

SEQ ID NO: 278985 - DNA, 25 bp, Mus musculus
caacgccgccttttcaaagtcgaga

SEQ ID NO: 278986 - DNA, 25 bp, Mus musculus
aggagctcggacttggtccgcatca

SEQ ID NO: 278987 - DNA, 25 bp, Mus musculus
gcccgttctctcagttcattggtta

SEQ ID NO: 278988 - DNA, 25 bp, Mus musculus
tttaagacgacgtgtctgtcccgcc

SEQ ID NO: 278989 - DNA, 25 bp, Mus musculus
cggcgcgtcaggtcgtttaagacga

SEQ ID NO: 278990 - DNA, 25 bp, Mus musculus
tgtacttcagccacgaagcgcgatg

SEQ ID NO: 278991 - DNA, 25 bp, Mus musculus
cgtccgctaagcgacactgactgta

SEQ ID NO: 278992 - DNA, 25 bp, Mus musculus
ctgatagggcagagcgccaggaacc

SEQ ID NO: 278993 - DNA, 25 bp, Mus musculus
gaaagtctgatagggcagagcgcca

SEQ ID NO: 278994 - DNA, 25 bp, Mus musculus
aggactactcccagtggcactgcca

SEQ ID NO: 278995 - DNA, 25 bp, Mus musculus
gaaccaaattttgacctgcgtctcc

SEQ ID NO: 278996 - DNA, 25 bp, Mus musculus
tcaggcgttcgcacaccgacagata

SEQ ID NO: 278997 - DNA, 25 bp, Mus musculus
ttcgcacaccgacagatagcgcgtg

SEQ ID NO: 278998 - DNA, 25 bp, Mus musculus
atagcgcgtggctcgaaacttgttc

SEQ ID NO: 278999 - DNA, 25 bp, Mus musculus
tcgaaacttgttctctagggccacc

SEQ ID NO: 279000 - DNA, 25 bp, Mus musculus
gggccaccagctgctcgtaagtgaa

SEQ ID NO: 279001 - DNA, 25 bp, Mus musculus
ccagctgctcgtaagtgaaggcagt

SEQ ID NO: 279002 - DNA, 25 bp, Mus musculus
gggcctctggtgagccctcatggac

SEQ ID NO: 279003 - DNA, 25 bp, Mus musculus
ctccaccggagacccggggtcaatg

SEQ ID NO: 279004 - DNA, 25 bp, Mus musculus
gagacccggggtcaatgcctcggcc

SEQ ID NO: 279005 - DNA, 25 bp, Mus musculus
gggccaggactactcccagtggcac

SEQ ID NO: 279006 - DNA, 25 bp, Mus musculus
tcagccgctgtcttctgcagtggtt

SEQ ID NO: 279007 - DNA, 25 bp, Mus musculus
agggcagctcgcgtgaatttttgcg

SEQ ID NO: 279008 - DNA, 25 bp, Mus musculus
ttttgcggatccaagatgtccaaga

SEQ ID NO: 279009 - DNA, 25 bp, Mus musculus
tggatgcgctcagccgctgtcttct

SEQ ID NO: 279010 - DNA, 25 bp, Mus musculus
agtggtttggccacagctctccagc

SEQ ID NO: 279011 - DNA, 25 bp, Mus musculus
atgtccaagacagagaaggagatct

SEQ ID NO: 279012 - DNA, 25 bp, Mus musculus
ctctccagccgcgaactggaatttc

SEQ ID NO: 279013 - DNA, 25 bp, Mus musculus
cttccacgtgcagtgagcgcttgca

SEQ ID NO: 279014 - DNA, 25 bp, Mus musculus
agcgcttgcagcctccacgagacta

SEQ ID NO: 279015 - DNA, 25 bp, Mus musculus
agcctccacgagactatcctgggca

SEQ ID NO: 279016 - DNA, 25 bp, Mus musculus
gagcgctgactagagggaccctcgc

SEQ ID NO: 279017 - DNA, 25 bp, Mus musculus
caccgtggcatgctgtgtgaaaatc

SEQ ID NO: 279018 - DNA, 25 bp, Mus musculus
tctttccatgctgcggagactcgtg

SEQ ID NO: 279019 - DNA, 25 bp, Mus musculus
tgcttgaggattggcacttgagctg

SEQ ID NO: 279020 - DNA, 25 bp, Mus musculus
ccgagttcggatttatagctggaca

SEQ ID NO: 279021 - DNA, 25 bp, Mus musculus
caaccgctatcgcaggctctgtgga

SEQ ID NO: 279022 - DNA, 25 bp, Mus musculus
cagcgcaagcggtgcaaccgctatc

SEQ ID NO: 279023 - DNA, 25 bp, Mus musculus
ctatgtgatagcagcgcaagcggtg

SEQ ID NO: 279024 - DNA, 25 bp, Mus musculus
catctccggggtgctatgtgatagc

SEQ ID NO: 279025 - DNA, 25 bp, Mus musculus
ctgcttgacatctccggggtgctat

SEQ ID NO: 279026 - DNA, 25 bp, Mus musculus
tggcgaggttagtgagctcaatgca

SEQ ID NO: 279027 - DNA, 25 bp, Mus musculus
cggcgacgccgagttcggatttata

SEQ ID NO: 279028 - DNA, 25 bp, Mus musculus
gcggattacatttcccaggcaaccc

SEQ ID NO: 279029 - DNA, 25 bp, Mus musculus
cgccgcggattacatttcccaggca

SEQ ID NO: 279030 - DNA, 25 bp, Mus musculus
cacgtggttcccagtttgctcccgg

SEQ ID NO: 279031 - DNA, 25 bp, Mus musculus
caggctggtccacgtggttcccagt

SEQ ID NO: 279032 - DNA, 25 bp, Mus musculus
tatagctggacacgatggccgcatg

SEQ ID NO: 279033 - DNA, 25 bp, Mus musculus
cggggagtgctgcttgacatctccg

SEQ ID NO: 279034 - DNA, 25 bp, Mus musculus
ccgccgtataacaaggagacaggga

SEQ ID NO: 279035 - DNA, 25 bp, Mus musculus
tgacaagtctcacgcctgcaccagg

SEQ ID NO: 279036 - DNA, 25 bp, Mus musculus
ttgtctgcaaacgatgcggaacttc

SEQ ID NO: 279037 - DNA, 25 bp, Mus musculus
tagaaaccaccggatccgccgtata

SEQ ID NO: 279038 - DNA, 25 bp, Mus musculus
aagcgctcgccaagtcgtccgggct

SEQ ID NO: 279039 - DNA, 25 bp, Mus musculus
gggaggaggaaatcgacttgtcact

SEQ ID NO: 279040 - DNA, 25 bp, Mus musculus
cgacttgtcacttcctgaactgttt

SEQ ID NO: 279041 - DNA, 25 bp, Mus musculus
gaactgtttgcaactcgtcccttta

SEQ ID NO: 279042 - DNA, 25 bp, Mus musculus
cagacttttcggcagcgctaggttt

SEQ ID NO: 279043 - DNA, 25 bp, Mus musculus
ttcgctgctgccacaagccagggct

SEQ ID NO: 279044 - DNA, 25 bp, Mus musculus
tggcgggtgtaaacttccgtgaaca

SEQ ID NO: 279045 - DNA, 25 bp, Mus musculus
gtcagtcgtgtagccttggagtcgt

SEQ ID NO: 279046 - DNA, 25 bp, Mus musculus
ccgagcgctttgtaccgagcgactc

SEQ ID NO: 279047 - DNA, 25 bp, Mus musculus
ttccgtgaacaaaagagttgtctgc

SEQ ID NO: 279048 - DNA, 25 bp, Mus musculus
cgaagccgccatagagacgcgattt

SEQ ID NO: 279049 - DNA, 25 bp, Mus musculus
tgtggccctcagcatccgcgttcat

SEQ ID NO: 279050 - DNA, 25 bp, Mus musculus
agcatccgcgttcatgtcgctctgc

SEQ ID NO: 279051 - DNA, 25 bp, Mus musculus
ttcatgtcgctctgcgctcgaagcc

SEQ ID NO: 279052 - DNA, 25 bp, Mus musculus
tctgcgctcgaagccgccatagaga

SEQ ID NO: 279053 - DNA, 25 bp, Mus musculus
attgcgcggggaccacagcaccgct

SEQ ID NO: 279054 - DNA, 25 bp, Mus musculus
ccatagagacgcgatttgggcagag

SEQ ID NO: 279055 - DNA, 25 bp, Mus musculus
ggacgaagtcatccgccgcggaact

SEQ ID NO: 279056 - DNA, 25 bp, Mus musculus
cccattcaggagagggcgccatctc

SEQ ID NO: 279057 - DNA, 25 bp, Mus musculus
cgcggacgggacgaagtcatccgcc

SEQ ID NO: 279058 - DNA, 25 bp, Mus musculus
cgccgcggaactgccctctggagat

SEQ ID NO: 279059 - DNA, 25 bp, Mus musculus
ttaagccaccacaggtcgcctccgc

SEQ ID NO: 279060 - DNA, 25 bp, Mus musculus
aactgccctctggagattgcgcggg

SEQ ID NO: 279061 - DNA, 25 bp, Mus musculus
gagagggcgccatctccttccgggc

SEQ ID NO: 279062 - DNA, 25 bp, Mus musculus
cgccgcctctcccacttgggcagcc

SEQ ID NO: 279063 - DNA, 25 bp, Mus musculus
cggcggccggcaaacaccgcgagat

SEQ ID NO: 279064 - DNA, 25 bp, Mus musculus
tacggccacacaatatggcggcgcg

SEQ ID NO: 279065 - DNA, 25 bp, Mus musculus
cgcatcaaaatacggccacacaata

SEQ ID NO: 279066 - DNA, 25 bp, Mus musculus
cagcccagtccgcatcaaaatacgg

SEQ ID NO: 279067 - DNA, 25 bp, Mus musculus
gccagcgccgattccacccggcagg

SEQ ID NO: 279068 - DNA, 25 bp, Mus musculus
agcgccgtccgcttacccttcgccg

SEQ ID NO: 279069 - DNA, 25 bp, Mus musculus
ccgctagggcttcgcgcgccaggca

SEQ ID NO: 279070 - DNA, 25 bp, Mus musculus
tggcggggatgctctgtccacgccc

SEQ ID NO: 279071 - DNA, 25 bp, Mus musculus
aggagcacgcgggtccctcacgctc

SEQ ID NO: 279072 - DNA, 25 bp, Mus musculus
aaacaccgcgagatctgaggcggcg

SEQ ID NO: 279073 - DNA, 25 bp, Mus musculus
ggccggcaaacaccgcgagatctga

SEQ ID NO: 279074 - DNA, 25 bp, Mus musculus
ggcgcctgccgcggatcaaagcgat

SEQ ID NO: 279075 - DNA, 25 bp, Mus musculus
ccactcccggctcgccgtggccgga

SEQ ID NO: 279076 - DNA, 25 bp, Mus musculus
gagcctcgggtttcctttctgcttg

SEQ ID NO: 279077 - DNA, 25 bp, Mus musculus
cggtttagctccatactcacccgta

SEQ ID NO: 279078 - DNA, 25 bp, Mus musculus
gcagagatgcctgtcttagcgaacc

SEQ ID NO: 279079 - DNA, 25 bp, Mus musculus
accgttattcaccaccgcagagatg

SEQ ID NO: 279080 - DNA, 25 bp, Mus musculus
tccacacgcaggaaaccgattgctg

SEQ ID NO: 279081 - DNA, 25 bp, Mus musculus
acctgggagccgttgccagacagga

SEQ ID NO: 279082 - DNA, 25 bp, Mus musculus
acgcgcactcaatgccgagttcggg

SEQ ID NO: 279083 - DNA, 25 bp, Mus musculus
ggccaagatctgagcacgcgcactc

SEQ ID NO: 279084 - DNA, 25 bp, Mus musculus
tcctcagcaggaacaggccaagatc

SEQ ID NO: 279085 - DNA, 25 bp, Mus musculus
aggcgtccacccagggtctcggtct

SEQ ID NO: 279086 - DNA, 25 bp, Mus musculus
gccacggtgtttacagcccagacta

SEQ ID NO: 279087 - DNA, 25 bp, Mus musculus
ttggtctagttaaagcgcgggcttg

SEQ ID NO: 279088 - DNA, 25 bp, Mus musculus
ctcattacgacgaggtgttggtcta

SEQ ID NO: 279089 - DNA, 25 bp, Mus musculus
agcaaatgcgccagcggtgaacacg

SEQ ID NO: 279090 - DNA, 25 bp, Mus musculus
ccgggacaaaccgatgagctggtga

SEQ ID NO: 279091 - DNA, 25 bp, Mus musculus
accttcagcgctgtgtgtttccaca

SEQ ID NO: 279092 - DNA, 25 bp, Mus musculus
caaaccgatgagctggtgacccagg

SEQ ID NO: 279093 - DNA, 25 bp, Mus musculus
cgggtcctggcacagctgttctcag

SEQ ID NO: 279094 - DNA, 25 bp, Mus musculus
acagctgttctcagtccaaaggacc

SEQ ID NO: 279095 - DNA, 25 bp, Mus musculus
tctcagtccaaaggacctaaagcgc

SEQ ID NO: 279096 - DNA, 25 bp, Mus musculus
acagcaacgccgaccacgtaggtgc

SEQ ID NO: 279097 - DNA, 25 bp, Mus musculus
ccagtgtcaggagtcgcctagccaa

SEQ ID NO: 279098 - DNA, 25 bp, Mus musculus
tgtgtgtttccacagcgccaacagc

SEQ ID NO: 279099 - DNA, 25 bp, Mus musculus
gccaagcgacgaccgctggaggctc

SEQ ID NO: 279100 - DNA, 25 bp, Mus musculus
ttcgggctacaccttcagcgctgtg

SEQ ID NO: 279101 - DNA, 25 bp, Mus musculus
atggcggcttccatttcgggctaca

SEQ ID NO: 279102 - DNA, 25 bp, Mus musculus
tggagatttccatcatggcggcttc

SEQ ID NO: 279103 - DNA, 25 bp, Mus musculus
tcgcctagccaaaactgggtgccta

SEQ ID NO: 279104 - DNA, 25 bp, Mus musculus
tgcatcctgcacttagacttgaaga

SEQ ID NO: 279105 - DNA, 25 bp, Mus musculus
acttgaagacactcacccgggagga

SEQ ID NO: 279106 - DNA, 25 bp, Mus musculus
actctgcagcaaagagcggccggcg

SEQ ID NO: 279107 - DNA, 25 bp, Mus musculus
gcttgattcaaagcgctggcgactc

SEQ ID NO: 279108 - DNA, 25 bp, Mus musculus
ttagcaaacagatgcgtgactcacg

SEQ ID NO: 279109 - DNA, 25 bp, Mus musculus
caagcggtctcccagttagcaaaca

SEQ ID NO: 279110 - DNA, 25 bp, Mus musculus
gcgcgccgtagcctcacaatcagga

SEQ ID NO: 279111 - DNA, 25 bp, Mus musculus
cctcgggaccaatcacaggacggtg

SEQ ID NO: 279112 - DNA, 25 bp, Mus musculus
tcgcctattggctgcgcctcctgag

SEQ ID NO: 279113 - DNA, 25 bp, Mus musculus
cgaggtccagttcctgacgttgtgc

SEQ ID NO: 279114 - DNA, 25 bp, Mus musculus
cgccgcggggtttatttagctctag

SEQ ID NO: 279115 - DNA, 25 bp, Mus musculus
ttagctctagggtcctgaccgccgc

SEQ ID NO: 279116 - DNA, 25 bp, Mus musculus
ggcccgcggagaacatgtcctgact

SEQ ID NO: 279117 - DNA, 25 bp, Mus musculus
ctcacaatcaggacgcacgctgctg

SEQ ID NO: 279118 - DNA, 25 bp, Mus musculus
tctccaggtctcagcggcctgcgct

SEQ ID NO: 279119 - DNA, 25 bp, Mus musculus
ttgtcagtcagcaggaggaccctcc

SEQ ID NO: 279120 - DNA, 25 bp, Mus musculus
cgctaagactagatggaggcaggat

SEQ ID NO: 279121 - DNA, 25 bp, Mus musculus
gatggaggcaggatggcgggaccat

SEQ ID NO: 279122 - DNA, 25 bp, Mus musculus
gaccatggccggcatccgtgctgca

SEQ ID NO: 279123 - DNA, 25 bp, Mus musculus
catggccggcatccgtgctgcaggt

SEQ ID NO: 279124 - DNA, 25 bp, Mus musculus
tgcaggtgagcggtcctgggctcag

SEQ ID NO: 279125 - DNA, 25 bp, Mus musculus
gagatgctgcaaggggcgtttctct

SEQ ID NO: 279126 - DNA, 25 bp, Mus musculus
tttctctccaggtctcagcggcctg

SEQ ID NO: 279127 - DNA, 25 bp, Mus musculus
agcggcctgcgctgcagctgaagag

SEQ ID NO: 279128 - DNA, 25 bp, Mus musculus
cctgcgctgcagctgaagaggcggc

SEQ ID NO: 279129 - DNA, 25 bp, Mus musculus
cagggctgtgcaggagaaccggggc

SEQ ID NO: 279130 - DNA, 25 bp, Mus musculus
gttgtcagtcagcaggaggaccctc

SEQ ID NO: 279131 - DNA, 25 bp, Mus musculus
gcgtttctctccaggtctcagcggc

SEQ ID NO: 279132 - DNA, 25 bp, Mus musculus
atgccgggtcagcatcctgccatcg

SEQ ID NO: 279133 - DNA, 25 bp, Mus musculus
cgtcaagttcagtggctcgctgcgg

SEQ ID NO: 279134 - DNA, 25 bp, Mus musculus
cggcaactggcagagcgtcaccatt

SEQ ID NO: 279135 - DNA, 25 bp, Mus musculus
ggacatgcccaagcggacggcaact

SEQ ID NO: 279136 - DNA, 25 bp, Mus musculus
ggctgacgctgacggggttccacac

SEQ ID NO: 279137 - DNA, 25 bp, Mus musculus
tcagtggctcgctgcggctgacgct

SEQ ID NO: 279138 - DNA, 25 bp, Mus musculus
gcgtcaccattgaagaaccagcgga

SEQ ID NO: 279139 - DNA, 25 bp, Mus musculus
gggttccacacctcgcactggtagg

SEQ ID NO: 279140 - DNA, 25 bp, Mus musculus
cagcgcagtgtcgttggccatgacc

SEQ ID NO: 279141 - DNA, 25 bp, Mus musculus
tacgctccaccagcgcagtgtcgtt

SEQ ID NO: 279142 - DNA, 25 bp, Mus musculus
gaagggtatccctacgctccaccag

SEQ ID NO: 279143 - DNA, 25 bp, Mus musculus
acagacgagacgaagggtatcccta

SEQ ID NO: 279144 - DNA, 25 bp, Mus musculus
gctgctacagacgagacgaagggta

SEQ ID NO: 279145 - DNA, 25 bp, Mus musculus
agaaccagcggacctcagcggggct

SEQ ID NO: 279146 - DNA, 25 bp, Mus musculus
ggactgtcaggcccactcttcagca

SEQ ID NO: 279147 - DNA, 25 bp, Mus musculus
ctcttcagcacttccgattggctcg

SEQ ID NO: 279148 - DNA, 25 bp, Mus musculus
gtcgaacacacagacccgctcccgg

SEQ ID NO: 279149 - DNA, 25 bp, Mus musculus
cagtgccgacctcggactgtcaggc

SEQ ID NO: 279150 - DNA, 25 bp, Mus musculus
cacgcgggcaacattgtccttgttc

SEQ ID NO: 279151 - DNA, 25 bp, Mus musculus
tcccggcaccgagtgatagctaggc

SEQ ID NO: 279152 - DNA, 25 bp, Mus musculus
gagtgatagctaggcccgccgcgct

SEQ ID NO: 279153 - DNA, 25 bp, Mus musculus
cttccgattggctcgaggatgctcc

SEQ ID NO: 279154 - DNA, 25 bp, Mus musculus
gccgcacgcgggcaacattgtcctt

SEQ ID NO: 279155 - DNA, 25 bp, Mus musculus
agatattcatggctccagtgccgac

SEQ ID NO: 279156 - DNA, 25 bp, Mus musculus
tgttccggacgtgccagctcttctt

SEQ ID NO: 279157 - DNA, 25 bp, Mus musculus
gtgccagctcttcttcggcaagata

SEQ ID NO: 279158 - DNA, 25 bp, Mus musculus
tcttcggcaagatattcatggctcc

SEQ ID NO: 279159 - DNA, 25 bp, Mus musculus
cttacctcttgctgggcgagcagca

SEQ ID NO: 279160 - DNA, 25 bp, Mus musculus
aacgcttgcatttgcacgtctagga

SEQ ID NO: 279161 - DNA, 25 bp, Mus musculus
gccttcctgctagggtggaggtcca

SEQ ID NO: 279162 - DNA, 25 bp, Mus musculus
caggcacgcgcacgtacattctgcg

SEQ ID NO: 279163 - DNA, 25 bp, Mus musculus
accacgcgcatggaagcggcgagca

SEQ ID NO: 279164 - DNA, 25 bp, Mus musculus
agcacgcgtagcacctgggctagct

SEQ ID NO: 279165 - DNA, 25 bp, Mus musculus
tagctgcgtgtagactggcacgttc

SEQ ID NO: 279166 - DNA, 25 bp, Mus musculus
ggaaaagccggagcgcacgcctaca

SEQ ID NO: 279167 - DNA, 25 bp, Mus musculus
ctgagtgaattagaaaacgcttgca

SEQ ID NO: 279168 - DNA, 25 bp, Mus musculus
cacgtctaggatggttgaaatactc

SEQ ID NO: 279169 - DNA, 25 bp, Mus musculus
cacgcctacagcctgcagagcagtg

SEQ ID NO: 279170 - DNA, 25 bp, Mus musculus
tgcacacgcgcgctccaggaatgat

SEQ ID NO: 279171 - DNA, 25 bp, Mus musculus
tctgcagtgcgcatgtcccgagttt

SEQ ID NO: 279172 - DNA, 25 bp, Mus musculus
tgcagggtccaagctgagtgaatta

SEQ ID NO: 279173 - DNA, 25 bp, Mus musculus
gttgaaatactctgcagtgcgcatg

SEQ ID NO: 279174 - DNA, 25 bp, Mus musculus
actgaggaaggacccacacccgtcg

SEQ ID NO: 279175 - DNA, 25 bp, Mus musculus
ctcagcagggttccgactaggtctg

SEQ ID NO: 279176 - DNA, 25 bp, Mus musculus
agggaacgcagagcttcgccgccgc

SEQ ID NO: 279177 - DNA, 25 bp, Mus musculus
cgccgcccatccagcacgaggggag

SEQ ID NO: 279178 - DNA, 25 bp, Mus musculus
ccggggaaaccgcagcgaccgcctg

SEQ ID NO: 279179 - DNA, 25 bp, Mus musculus
acgtcacttccggtgtacacagccg

SEQ ID NO: 279180 - DNA, 25 bp, Mus musculus
tccggtgtacacagccggtccgggc

SEQ ID NO: 279181 - DNA, 25 bp, Mus musculus
ttccgactaggtctggaaacaggga

SEQ ID NO: 279182 - DNA, 25 bp, Mus musculus
cttcgcaggtgaggtacggtcgcca

SEQ ID NO: 279183 - DNA, 25 bp, Mus musculus
gcgactggcatcgaggcgagctcgc

SEQ ID NO: 279184 - DNA, 25 bp, Mus musculus
atccgctcccggaagctcggggcgc

SEQ ID NO: 279185 - DNA, 25 bp, Mus musculus
ttcctggctccctctgagcccgtgg

SEQ ID NO: 279186 - DNA, 25 bp, Mus musculus
ctaggactgaggaaggacccacacc

SEQ ID NO: 279187 - DNA, 25 bp, Mus musculus
aaacagggagggaacgcagagcttc

SEQ ID NO: 279188 - DNA, 25 bp, Mus musculus
tccggctttgttcggcgcttccgaa

SEQ ID NO: 279189 - DNA, 25 bp, Mus musculus
ttaggagttcactcgacaaccgtcg

SEQ ID NO: 279190 - DNA, 25 bp, Mus musculus
ccgacccagacgaagaacgctgaga

SEQ ID NO: 279191 - DNA, 25 bp, Mus musculus
tgggtgcccgaggaatcaacacatc

SEQ ID NO: 279192 - DNA, 25 bp, Mus musculus
catccgcattcatctcgaggtaggc

SEQ ID NO: 279193 - DNA, 25 bp, Mus musculus
gttttcacggcacctagatgtcgcg

SEQ ID NO: 279194 - DNA, 25 bp, Mus musculus
agattcttcgactcctccggctttg

SEQ ID NO: 279195 - DNA, 25 bp, Mus musculus
cgaatttcggtcttggaagccgcga

SEQ ID NO: 279196 - DNA, 25 bp, Mus musculus
aagccgcgaacctgggtgtgttctc

SEQ ID NO: 279197 - DNA, 25 bp, Mus musculus
gctgatcttgctgccgatgtaaggg

SEQ ID NO: 279198 - DNA, 25 bp, Mus musculus
agcagccgcctcagaaccaacatgg

SEQ ID NO: 279199 - DNA, 25 bp, Mus musculus
gcgctcccgacgtggaaggttttca

SEQ ID NO: 279200 - DNA, 25 bp, Mus musculus
gtctgcggcgcaaacccaaagtttg

SEQ ID NO: 279201 - DNA, 25 bp, Mus musculus
cgaggtaggcgtcaagattcttcga

SEQ ID NO: 279202 - DNA, 25 bp, Mus musculus
cgctttcggcgctggtaccaggagc

SEQ ID NO: 279203 - DNA, 25 bp, Mus musculus
ttggtgacgtcgcagctgtgcgagc

SEQ ID NO: 279204 - DNA, 25 bp, Mus musculus
ttgcagtgttgtgtgtaggttctcc

SEQ ID NO: 279205 - DNA, 25 bp, Mus musculus
ttctccgtggcggacacgggtacga

SEQ ID NO: 279206 - DNA, 25 bp, Mus musculus
taccaggagctctgagaggaacgtg

SEQ ID NO: 279207 - DNA, 25 bp, Mus musculus
tgggcgagctcggaagctgcgccat

SEQ ID NO: 279208 - DNA, 25 bp, Mus musculus
gcgggtcttctctggttgcagtgtt

SEQ ID NO: 279209 - DNA, 25 bp, Mus musculus
ggccgacatgctgcgaagcaaccta

SEQ ID NO: 279210 - DNA, 25 bp, Mus musculus
atgctgcgaagcaacctaggccctg

SEQ ID NO: 279211 - DNA, 25 bp, Mus musculus
tgcgaagcaacctaggccctggacc

SEQ ID NO: 279212 - DNA, 25 bp, Mus musculus
ccgcttctgcgcagagcaaggagta

SEQ ID NO: 279213 - DNA, 25 bp, Mus musculus
ttctgcgcagagcaaggagtagcga

SEQ ID NO: 279214 - DNA, 25 bp, Mus musculus
agagcaaggagtagcgaaaggctcc

SEQ ID NO: 279215 - DNA, 25 bp, Mus musculus
tgtgtaggttctccgtggcggacac

SEQ ID NO: 279216 - DNA, 25 bp, Mus musculus
cgagaggcgggtttttcgccgccat

SEQ ID NO: 279217 - DNA, 25 bp, Mus musculus
gagcaaggggctgctgtcctcagac

SEQ ID NO: 279218 - DNA, 25 bp, Mus musculus
cgccttttcgggtgacgtcactttg

SEQ ID NO: 279219 - DNA, 25 bp, Mus musculus
ctctcgccttttcgggtgacgtcac

SEQ ID NO: 279220 - DNA, 25 bp, Mus musculus
cctcgggccgcgcttgcgtagagcg

SEQ ID NO: 279221 - DNA, 25 bp, Mus musculus
tggtggagcctccttgcggctggag

SEQ ID NO: 279222 - DNA, 25 bp, Mus musculus
ctgctgtcctcagacggggaggaga

SEQ ID NO: 279223 - DNA, 25 bp, Mus musculus
tgcagtcgagatcggaagccgcgcc

SEQ ID NO: 279224 - DNA, 25 bp, Mus musculus
tccgctgccaggacctgtggggaga

SEQ ID NO: 279225 - DNA, 25 bp, Mus musculus
ttgagccgcgcttgcgagctccgct

SEQ ID NO: 279226 - DNA, 25 bp, Mus musculus
ggtgccacttgagccgcgcttgcga

SEQ ID NO: 279227 - DNA, 25 bp, Mus musculus
agcgaggtgccacttgagccgcgct

SEQ ID NO: 279228 - DNA, 25 bp, Mus musculus
taaggctgagcgaggtgccacttga

SEQ ID NO: 279229 - DNA, 25 bp, Mus musculus
aggcgggtttttcgccgccatgctc

SEQ ID NO: 279230 - DNA, 25 bp, Mus musculus
ttggcctggtctcactggtttagct

SEQ ID NO: 279231 - DNA, 25 bp, Mus musculus
atcctagtgggtagttgcaaccgcc

SEQ ID NO: 279232 - DNA, 25 bp, Mus musculus
gctccagcgcccagacttgctgagg

SEQ ID NO: 279233 - DNA, 25 bp, Mus musculus
cgtgcgatcctagtgggtagttgca

SEQ ID NO: 279234 - DNA, 25 bp, Mus musculus
aggccagccggtgcgccctttaatc

SEQ ID NO: 279235 - DNA, 25 bp, Mus musculus
tgggtagttgcaaccgccgaccctc

SEQ ID NO: 279236 - DNA, 25 bp, Mus musculus
accgccgaccctccggtgctccgca

SEQ ID NO: 279237 - DNA, 25 bp, Mus musculus
tgctccgcagagactgggcgaaacg

SEQ ID NO: 279238 - DNA, 25 bp, Mus musculus
tccgcagagactgggcgaaacgcgc

SEQ ID NO: 279239 - DNA, 25 bp, Mus musculus
cacgtagccaggtgggccagcctcg

SEQ ID NO: 279240 - DNA, 25 bp, Mus musculus
ttctccggcggcgttggcctggtct

SEQ ID NO: 279241 - DNA, 25 bp, Mus musculus
tggtttagctccagcgcccagactt

SEQ ID NO: 279242 - DNA, 25 bp, Mus musculus
cccagacttgctgaggccagccggt

SEQ ID NO: 279243 - DNA, 25 bp, Mus musculus
gagacccgccgtagccgctgcgtcc

SEQ ID NO: 279244 - DNA, 25 bp, Mus musculus
actcacgcgcattcggtgaggagca

SEQ ID NO: 279245 - DNA, 25 bp, Mus musculus
gacggatcgggacagtgtctttggc

SEQ ID NO: 279246 - DNA, 25 bp, Mus musculus
caactgcgcgactgcgcgtagtgta

SEQ ID NO: 279247 - DNA, 25 bp, Mus musculus
tccttgtctgcaactgcgcgactgc

SEQ ID NO: 279248 - DNA, 25 bp, Mus musculus
tccctgctggggtccttgtctgcaa

SEQ ID NO: 279249 - DNA, 25 bp, Mus musculus
tgctggccctgtgagatgccaggtc

SEQ ID NO: 279250 - DNA, 25 bp, Mus musculus
tggagcaactcacgcgcattcggtg

SEQ ID NO: 279251 - DNA, 25 bp, Mus musculus
aaggcgctgtcgagtggagcaactc

SEQ ID NO: 279252 - DNA, 25 bp, Mus musculus
aaacagcgatctggactctcgcccg

SEQ ID NO: 279253 - DNA, 25 bp, Mus musculus
cggggaaacagcgatctggactctc

SEQ ID NO: 279254 - DNA, 25 bp, Mus musculus
tccgccctgctcccgattgagttgt

SEQ ID NO: 279255 - DNA, 25 bp, Mus musculus
ctttggcgcggggaaacagcgatct

SEQ ID NO: 279256 - DNA, 25 bp, Mus musculus
cagctctctctgctgtccactcgga

SEQ ID NO: 279257 - DNA, 25 bp, Mus musculus
cctgtgagatgccaggtccctgctg

SEQ ID NO: 279258 - DNA, 25 bp, Mus musculus
cccgtagacgcgcatcagctgctgt

SEQ ID NO: 279259 - DNA, 25 bp, Mus musculus
ttcactaggtcgttgagcttgcgca

SEQ ID NO: 279260 - DNA, 25 bp, Mus musculus
tccaccatgtctgccttgttgagta

SEQ ID NO: 279261 - DNA, 25 bp, Mus musculus
gcgcccgtttcactaggtcgttgag

SEQ ID NO: 279262 - DNA, 25 bp, Mus musculus
ggtcctccgtcggacccgatgtgct

SEQ ID NO: 279263 - DNA, 25 bp, Mus musculus
cttgttgagtaccacgcggatctta

SEQ ID NO: 279264 - DNA, 25 bp, Mus musculus
cggatcttatcctcgtggccacgca

SEQ ID NO: 279265 - DNA, 25 bp, Mus musculus
tcagctgctgtgtctccaccatgtc

SEQ ID NO: 279266 - DNA, 25 bp, Mus musculus
catggcgcggtaggccttggatatc

SEQ ID NO: 279267 - DNA, 25 bp, Mus musculus
ggatatctcgtaagaggtcctgttc

SEQ ID NO: 279268 - DNA, 25 bp, Mus musculus
ttcctccagctcgaaaagacgccgg

SEQ ID NO: 279269 - DNA, 25 bp, Mus musculus
agacgccggttgtccggcacaagga

SEQ ID NO: 279270 - DNA, 25 bp, Mus musculus
agccaatgtagacgcgaaggacctc

SEQ ID NO: 279271 - DNA, 25 bp, Mus musculus
ggcaccgatggcctccgagaattca

SEQ ID NO: 279272 - DNA, 25 bp, Mus musculus
cttcgcgtccacagctcccgggcct

SEQ ID NO: 279273 - DNA, 25 bp, Mus musculus
gcgtctggctctgcccacgtgttca

SEQ ID NO: 279274 - DNA, 25 bp, Mus musculus
ggagaccccgcggtgtctgcgactc

SEQ ID NO: 279275 - DNA, 25 bp, Mus musculus
agtttccaccgtgctaacgcccaga

SEQ ID NO: 279276 - DNA, 25 bp, Mus musculus
cccatcctacactctttgatcccgc

SEQ ID NO: 279277 - DNA, 25 bp, Mus musculus
gcgtctccgcccaacgtcccgagcc

SEQ ID NO: 279278 - DNA, 25 bp, Mus musculus
tagtcctccaggcaaaactctggcc

SEQ ID NO: 279279 - DNA, 25 bp, Mus musculus
cccagaccgacacagcgttgcaagc

SEQ ID NO: 279280 - DNA, 25 bp, Mus musculus
cccactctggcagccgccagggctt

SEQ ID NO: 279281 - DNA, 25 bp, Mus musculus
ggcctgccagcacccgcgcgtctgg

SEQ ID NO: 279282 - DNA, 25 bp, Mus musculus
gctaacgcccagactccgcctctta

SEQ ID NO: 279283 - DNA, 25 bp, Mus musculus
gtgttcaccgcccaacctcagcacc

SEQ ID NO: 279284 - DNA, 25 bp, Mus musculus
acacatgtgggcgtcgggttcccgc

SEQ ID NO: 279285 - DNA, 25 bp, Mus musculus
ccctcaagcgacacatgtgggcgtc

SEQ ID NO: 279286 - DNA, 25 bp, Mus musculus
cggcgactccgtggcagtcctggct

SEQ ID NO: 279287 - DNA, 25 bp, Mus musculus
actccgtggcagtcctggctgcggt

SEQ ID NO: 279288 - DNA, 25 bp, Mus musculus
gccacggagctagaagggaccagcg

SEQ ID NO: 279289 - DNA, 25 bp, Mus musculus
cagatagacagacgcaggccacggt

SEQ ID NO: 279290 - DNA, 25 bp, Mus musculus
ccggtggtgcagatagacagacgca

SEQ ID NO: 279291 - DNA, 25 bp, Mus musculus
tcaggaccgcggcaaggagagaggc

SEQ ID NO: 279292 - DNA, 25 bp, Mus musculus
aataaggtcgggcaggatcaggacc

SEQ ID NO: 279293 - DNA, 25 bp, Mus musculus
ttattgccgatgagcgctgagtccc

SEQ ID NO: 279294 - DNA, 25 bp, Mus musculus
ctggagtttattgccgatgagcgct

SEQ ID NO: 279295 - DNA, 25 bp, Mus musculus
ccagctgaggctggagtttattgcc

SEQ ID NO: 279296 - DNA, 25 bp, Mus musculus
accacagaccaggtaagccagctga

SEQ ID NO: 279297 - DNA, 25 bp, Mus musculus
gaggccaacgaccacagaccaggta

SEQ ID NO: 279298 - DNA, 25 bp, Mus musculus
agcggccgaggccaacgaccacaga

SEQ ID NO: 279299 - DNA, 25 bp, Mus musculus
cccaagcaaacaggatgcgggtgcg

SEQ ID NO: 279300 - DNA, 25 bp, Mus musculus
ccagctctttgtagtccagttagta

SEQ ID NO: 279301 - DNA, 25 bp, Mus musculus
ctctccgaaaccctgaagtcaagtg

SEQ ID NO: 279302 - DNA, 25 bp, Mus musculus
ctggttgatgagtgaacgaccctga

SEQ ID NO: 279303 - DNA, 25 bp, Mus musculus
agccaagcacgtctgccgggctggt

SEQ ID NO: 279304 - DNA, 25 bp, Mus musculus
tgggcaggcgcacacagccaagcac

SEQ ID NO: 279305 - DNA, 25 bp, Mus musculus
aatctcagctaagcgggtgccgcct

SEQ ID NO: 279306 - DNA, 25 bp, Mus musculus
tgctggaatctcagctaagcgggtg

SEQ ID NO: 279307 - DNA, 25 bp, Mus musculus
ccctgaagtcaagtgctggaatctc

SEQ ID NO: 279308 - DNA, 25 bp, Mus musculus
ggccaagcgccttatctctccgaaa

SEQ ID NO: 279309 - DNA, 25 bp, Mus musculus
tctttgtagtccagttagtaacggc

SEQ ID NO: 279310 - DNA, 25 bp, Mus musculus
cggtccgatccagctctttgtagtc

SEQ ID NO: 279311 - DNA, 25 bp, Mus musculus
tggttccggtccgatccagctcttt

SEQ ID NO: 279312 - DNA, 25 bp, Mus musculus
gagttgagccatgtggttccggtcc

SEQ ID NO: 279313 - DNA, 25 bp, Mus musculus
tagtccagttagtaacggccaagcg

SEQ ID NO: 279314 - DNA, 25 bp, Mus musculus
cgactgcctcacgagtcagagcaaa

SEQ ID NO: 279315 - DNA, 25 bp, Mus musculus
cggacttaccaatacacgactcgaa

SEQ ID NO: 279316 - DNA, 25 bp, Mus musculus
cgagtcagagcaaaccaagtgcggg

SEQ ID NO: 279317 - DNA, 25 bp, Mus musculus
tgtggccaggggcgcgaacctcaac

SEQ ID NO: 279318 - DNA, 25 bp, Mus musculus
gagcgccatagctgcacgtcgcatc

SEQ ID NO: 279319 - DNA, 25 bp, Mus musculus
gcctcacgagtcagagcaaaccaag

SEQ ID NO: 279320 - DNA, 25 bp, Mus musculus
gaggacccgacccacaagcaacaag

SEQ ID NO: 279321 - DNA, 25 bp, Mus musculus
cctcaagctctgagcgtggggccgt

SEQ ID NO: 279322 - DNA, 25 bp, Mus musculus
acccacaagcaacaaggacctcaag

SEQ ID NO: 279323 - DNA, 25 bp, Mus musculus
ctcgaacggcgagcgccatagctgc

SEQ ID NO: 279324 - DNA, 25 bp, Mus musculus
atacacgactcgaacggcgagcgcc

SEQ ID NO: 279325 - DNA, 25 bp, Mus musculus
ttaccaatacacgactcgaacggcg

SEQ ID NO: 279326 - DNA, 25 bp, Mus musculus
acagccgactgcctcacgagtcaga

SEQ ID NO: 279327 - DNA, 25 bp, Mus musculus
acaaggacctcaagctctgagcgtg

SEQ ID NO: 279328 - DNA, 25 bp, Mus musculus
tagtcgctctaactccgatatccgg

SEQ ID NO: 279329 - DNA, 25 bp, Mus musculus
gggatgcccggtccgtctagcacca

SEQ ID NO: 279330 - DNA, 25 bp, Mus musculus
cggtccgtctagcaccaggtcgcaa

SEQ ID NO: 279331 - DNA, 25 bp, Mus musculus
gtctagcaccaggtcgcaaagcgca

SEQ ID NO: 279332 - DNA, 25 bp, Mus musculus
aaagcgcacggccacgccaccggaa

SEQ ID NO: 279333 - DNA, 25 bp, Mus musculus
acgtacccggtcgtgcgctcctgta

SEQ ID NO: 279334 - DNA, 25 bp, Mus musculus
aggaagagcttagtcgctctaactc

SEQ ID NO: 279335 - DNA, 25 bp, Mus musculus
ctctaactccgatatccggtttgga

SEQ ID NO: 279336 - DNA, 25 bp, Mus musculus
ccggtttggaacgtgcgcgtctcga

SEQ ID NO: 279337 - DNA, 25 bp, Mus musculus
cgtgcgcgtctcgagtgacgtaata

SEQ ID NO: 279338 - DNA, 25 bp, Mus musculus
gcgcgtctcgagtgacgtaatatga

SEQ ID NO: 279339 - DNA, 25 bp, Mus musculus
gtgacgtaatatgacgcacttcctg

SEQ ID NO: 279340 - DNA, 25 bp, Mus musculus
tgtttgcgaccatcttgataaagcg

SEQ ID NO: 279341 - DNA, 25 bp, Mus musculus
gcacttcctgtttgcgaccatcttg

SEQ ID NO: 279342 - DNA, 25 bp, Mus musculus
ttccgctatcaagacctccgacaga

SEQ ID NO: 279343 - DNA, 25 bp, Mus musculus
aggtgctcggcttccgctatcaaga

SEQ ID NO: 279344 - DNA, 25 bp, Mus musculus
tcttaaaggcaaggtgctcggcttc

SEQ ID NO: 279345 - DNA, 25 bp, Mus musculus
ttcaactacattcccggtgcgtggc

SEQ ID NO: 279346 - DNA, 25 bp, Mus musculus
tggctaaagagctgcaattcaacta

SEQ ID NO: 279347 - DNA, 25 bp, Mus musculus
ccgtggcagagggaccttgtccact

SEQ ID NO: 279348 - DNA, 25 bp, Mus musculus
cctccgacagaaaatccggcctgtg

SEQ ID NO: 279349 - DNA, 25 bp, Mus musculus
ttgctggccgccactcttaaaggca

SEQ ID NO: 279350 - DNA, 25 bp, Mus musculus
aagcaacgtgtacgggcttgctgga

SEQ ID NO: 279351 - DNA, 25 bp, Mus musculus
tcgtcgcaaagcaacgtgtacgggc

SEQ ID NO: 279352 - DNA, 25 bp, Mus musculus
ttcacgcgcttctcgtcgcaaagca

SEQ ID NO: 279353 - DNA, 25 bp, Mus musculus
ctggaggacagcttcacgcgcttct

SEQ ID NO: 279354 - DNA, 25 bp, Mus musculus
agagggaccttgtccactgctggag

SEQ ID NO: 279355 - DNA, 25 bp, Mus musculus
ccggcctgtggctaaagagctgcaa

SEQ ID NO: 279356 - DNA, 25 bp, Mus musculus
gcatcttctttgagcccagcctcta

SEQ ID NO: 279357 - DNA, 25 bp, Mus musculus
gcgactgctcttctacaagtacgtg

SEQ ID NO: 279358 - DNA, 25 bp, Mus musculus
cacccggataaggacctggagcagc

SEQ ID NO: 279359 - DNA, 25 bp, Mus musculus
gacttgaagcagaagcacccggata

SEQ ID NO: 279360 - DNA, 25 bp, Mus musculus
cggcgtgaggtcatccagatcctta

SEQ ID NO: 279361 - DNA, 25 bp, Mus musculus
tgcaccagcagaagagccgcgcctt

SEQ ID NO: 279362 - DNA, 25 bp, Mus musculus
gcggtgagggcaacagcaccttcta

SEQ ID NO: 279363 - DNA, 25 bp, Mus musculus
agcaccttctacgtggactaccgta

SEQ ID NO: 279364 - DNA, 25 bp, Mus musculus
cgaccctcgcagtggaatcatcatc

SEQ ID NO: 279365 - DNA, 25 bp, Mus musculus
cgtgaactagatgccagccggcgtg

SEQ ID NO: 279366 - DNA, 25 bp, Mus musculus
agcatcgagctggacggcacattcg

SEQ ID NO: 279367 - DNA, 25 bp, Mus musculus
ggagacccacccaagagcatcgagc

SEQ ID NO: 279368 - DNA, 25 bp, Mus musculus
aagtacgtgtacaagcgctaccgca

SEQ ID NO: 279369 - DNA, 25 bp, Mus musculus
atcgccaagtactatgcactgctgc

SEQ ID NO: 279370 - DNA, 25 bp, Mus musculus
cgcatcgggatcatcgacgacgaca

SEQ ID NO: 279371 - DNA, 25 bp, Mus musculus
cctgctgcatgtgagcgagtgcatg

SEQ ID NO: 279372 - DNA, 25 bp, Mus musculus
cgatgctcagggcatgttcgagccc

SEQ ID NO: 279373 - DNA, 25 bp, Mus musculus
tgaacctgcgtgtgggcgatgctca

SEQ ID NO: 279374 - DNA, 25 bp, Mus musculus
tggccactgtcaccatcctggacga

SEQ ID NO: 279375 - DNA, 25 bp, Mus musculus
cccgtggcggtggtgtacattacga

SEQ ID NO: 279376 - DNA, 25 bp, Mus musculus
tacattacgaggatgcttgtggaga

SEQ ID NO: 279377 - DNA, 25 bp, Mus musculus
cacttcttcgtgaggctgctgaacc

SEQ ID NO: 279378 - DNA, 25 bp, Mus musculus
cgacgacgacatcttcgaggaggat

SEQ ID NO: 279379 - DNA, 25 bp, Mus musculus
aggacctgcgcatcgggatcatcga

SEQ ID NO: 279380 - DNA, 25 bp, Mus musculus
ggagacgcagaaggacctgcgcatc

SEQ ID NO: 279381 - DNA, 25 bp, Mus musculus
cgagggcacgctggtgttcaagccc

SEQ ID NO: 279382 - DNA, 25 bp, Mus musculus
tcagggcatgttcgagcccgacggc

SEQ ID NO: 279383 - DNA, 25 bp, Mus musculus
gaggaggatgagcacttcttcgtga

SEQ ID NO: 279384 - DNA, 25 bp, Mus musculus
agccttttcgtttgggcaggcggct

SEQ ID NO: 279385 - DNA, 25 bp, Mus musculus
acctgggctctgactcggcctggca

SEQ ID NO: 279386 - DNA, 25 bp, Mus musculus
acgcagctccgcgaacgcgctgtta

SEQ ID NO: 279387 - DNA, 25 bp, Mus musculus
gaacgcgctgttaatgctctctgtg

SEQ ID NO: 279388 - DNA, 25 bp, Mus musculus
ggtcctgagccttttcgtttgggca

SEQ ID NO: 279389 - DNA, 25 bp, Mus musculus
taatgctctctgtgcgtctcctctc

SEQ ID NO: 279390 - DNA, 25 bp, Mus musculus
gcaggcggcttccaagagcctccag

SEQ ID NO: 279391 - DNA, 25 bp, Mus musculus
actcggcctggcatcgggaccatag

SEQ ID NO: 279392 - DNA, 25 bp, Mus musculus
cgggaccataggcagccgctgctac

SEQ ID NO: 279393 - DNA, 25 bp, Mus musculus
aaatctggggcagcatcagccgggc

SEQ ID NO: 279394 - DNA, 25 bp, Mus musculus
gccagctctggaagtaaggccgctc

SEQ ID NO: 279395 - DNA, 25 bp, Mus musculus
aagtaaggccgctcctggtggcaac

SEQ ID NO: 279396 - DNA, 25 bp, Mus musculus
caaacaggaagggttcgtggagcat

SEQ ID NO: 279397 - DNA, 25 bp, Mus musculus
tctccttcttgggtcctgagccttt

SEQ ID NO: 279398 - DNA, 25 bp, Mus musculus
tcttcgccttcgtgtgcatcgcagt

SEQ ID NO: 279399 - DNA, 25 bp, Mus musculus
gctgttcaccgtcttcgccttcgtg

SEQ ID NO: 279400 - DNA, 25 bp, Mus musculus
tctcggtcacgctgttcaccgtctt

SEQ ID NO: 279401 - DNA, 25 bp, Mus musculus
acgctggccttctcggtcacgctgt

SEQ ID NO: 279402 - DNA, 25 bp, Mus musculus
ccttcgaggtgcgtgcaggcacgct

SEQ ID NO: 279403 - DNA, 25 bp, Mus musculus
ggctccaatgcggtgaacgtgttcc

SEQ ID NO: 279404 - DNA, 25 bp, Mus musculus
cgacgcgtccatcggtaacgtgacc

SEQ ID NO: 279405 - DNA, 25 bp, Mus musculus
gaccagtgtgccgacgcgtccatcg

SEQ ID NO: 279406 - DNA, 25 bp, Mus musculus
ccgcgctgcaggaccagtgtgccga

SEQ ID NO: 279407 - DNA, 25 bp, Mus musculus
gtccctgtagacacgttcgccagca

SEQ ID NO: 279408 - DNA, 25 bp, Mus musculus
catcgcagtgctgttgtaccggcgc

SEQ ID NO: 279409 - DNA, 25 bp, Mus musculus
aatgcggtgaacgtgttcctgggcc

SEQ ID NO: 279410 - DNA, 25 bp, Mus musculus
acacgttcgccagcaaggtggccgc

SEQ ID NO: 279411 - DNA, 25 bp, Mus musculus
tcggtaacgtgaccggctccaatgc

SEQ ID NO: 279412 - DNA, 25 bp, Mus musculus
cccatactgggcgatgggaagtgcc

SEQ ID NO: 279413 - DNA, 25 bp, Mus musculus
cggttcccatactgggcgatgggaa

SEQ ID NO: 279414 - DNA, 25 bp, Mus musculus
gcgatgggaagtgccgctcgctcac

SEQ ID NO: 279415 - DNA, 25 bp, Mus musculus
gctcgctcacgctgcagtttgacga

SEQ ID NO: 279416 - DNA, 25 bp, Mus musculus
gctcacgctgcagtttgacgagcct

SEQ ID NO: 279417 - DNA, 25 bp, Mus musculus
tgacgagcctcccaaaagcctgctt

SEQ ID NO: 279418 - DNA, 25 bp, Mus musculus
tcccaaaagcctgcttctgctggaa

SEQ ID NO: 279419 - DNA, 25 bp, Mus musculus
ctgctggaagtctaggtagtgaagc

SEQ ID NO: 279420 - DNA, 25 bp, Mus musculus
tctaggtagtgaagcaatgcacggc

SEQ ID NO: 279421 - DNA, 25 bp, Mus musculus
agtgaagcaatgcacggcggaactc

SEQ ID NO: 279422 - DNA, 25 bp, Mus musculus
caatgcacggcggaactcggacact

SEQ ID NO: 279423 - DNA, 25 bp, Mus musculus
cggcggaactcggacactctctcgg

SEQ ID NO: 279424 - DNA, 25 bp, Mus musculus
ggcccatgacgaccccgagtgtctg

SEQ ID NO: 279425 - DNA, 25 bp, Mus musculus
ctgggctgagaatggagaggttgat

SEQ ID NO: 279426 - DNA, 25 bp, Mus musculus
gggccaatgcccatcgcacaaagcg

SEQ ID NO: 279427 - DNA, 25 bp, Mus musculus
tagcgggcgggccaatgcccatcgc

SEQ ID NO: 279428 - DNA, 25 bp, Mus musculus
caatgaagcccaatagggagtagcg

SEQ ID NO: 279429 - DNA, 25 bp, Mus musculus
tctccgtacaatgaagcccaatagg

SEQ ID NO: 279430 - DNA, 25 bp, Mus musculus
cgacctggcctctccgtacaatgaa

SEQ ID NO: 279431 - DNA, 25 bp, Mus musculus
cagatcgcgaaagcgcgacctggcc

SEQ ID NO: 279432 - DNA, 25 bp, Mus musculus
cgcatgcgcagatcgcgaaagcgcg

SEQ ID NO: 279433 - DNA, 25 bp, Mus musculus
tgcgcctgcgcacgctcccgccact

SEQ ID NO: 279434 - DNA, 25 bp, Mus musculus
ccttacctccgaaatagcacggacg

SEQ ID NO: 279435 - DNA, 25 bp, Mus musculus
cccgccactctccagactgcgcatg

SEQ ID NO: 279436 - DNA, 25 bp, Mus musculus
cggtcctaaatggtctgcgcctgcg

SEQ ID NO: 279437 - DNA, 25 bp, Mus musculus
acttccggtcctaaatggtctgcgc

SEQ ID NO: 279438 - DNA, 25 bp, Mus musculus
acgcctcaacttccggtcctaaatg

SEQ ID NO: 279439 - DNA, 25 bp, Mus musculus
cgaaatagcacggacgcctcaactt

SEQ ID NO: 279440 - DNA, 25 bp, Mus musculus
cgctcctgcgcgtaacatccgtttg

SEQ ID NO: 279441 - DNA, 25 bp, Mus musculus
aagttccgacctgatcctcaccgtg

SEQ ID NO: 279442 - DNA, 25 bp, Mus musculus
cgggcgctgccaacaaactagtttc

SEQ ID NO: 279443 - DNA, 25 bp, Mus musculus
taaaccgcgcctctgtgacggatgg

SEQ ID NO: 279444 - DNA, 25 bp, Mus musculus
cggatgggtcgactgacccgtaata

SEQ ID NO: 279445 - DNA, 25 bp, Mus musculus
cccgtaatacagtcgcgtgagaaga

SEQ ID NO: 279446 - DNA, 25 bp, Mus musculus
aaagggacggtcgtccaggccatcg

SEQ ID NO: 279447 - DNA, 25 bp, Mus musculus
gagcaggatcgctcgctgtcccggt

SEQ ID NO: 279448 - DNA, 25 bp, Mus musculus
tgcccggcgatcctcgagcaggatc

SEQ ID NO: 279449 - DNA, 25 bp, Mus musculus
acccagtgaactgggcctgcggtcc

SEQ ID NO: 279450 - DNA, 25 bp, Mus musculus
tctgaacataacagtacggggtccc

SEQ ID NO: 279451 - DNA, 25 bp, Mus musculus
ttcccttggcgggagctctgaacat

SEQ ID NO: 279452 - DNA, 25 bp, Mus musculus
tgtcccggtgacaagttccgacctg

SEQ ID NO: 279453 - DNA, 25 bp, Mus musculus
catccgtttggaaaacaattcattc

SEQ ID NO: 279454 - DNA, 25 bp, Mus musculus
tatactggagggtgtccagtgcaca

SEQ ID NO: 279455 - DNA, 25 bp, Mus musculus
actcagttcttcttagttcacgccc

SEQ ID NO: 279456 - DNA, 25 bp, Mus musculus
tgaggactcagttcttcttagttca

SEQ ID NO: 279457 - DNA, 25 bp, Mus musculus
cattgttttcatgaggactcagttc

SEQ ID NO: 279458 - DNA, 25 bp, Mus musculus
caggcattgttttcatgaggactca

SEQ ID NO: 279459 - DNA, 25 bp, Mus musculus
gtccagtgcacacaggcattgtttt

SEQ ID NO: 279460 - DNA, 25 bp, Mus musculus
gctgtcaccagggatctatactgga

SEQ ID NO: 279461 - DNA, 25 bp, Mus musculus
acactgctgtcaccagggatctata

SEQ ID NO: 279462 - DNA, 25 bp, Mus musculus
tcagggaacactgctgtcaccaggg

SEQ ID NO: 279463 - DNA, 25 bp, Mus musculus
gtctccatcattcagggaacactgc

SEQ ID NO: 279464 - DNA, 25 bp, Mus musculus
agtggtctccatcattcagggaaca

SEQ ID NO: 279465 - DNA, 25 bp, Mus musculus
gctttagtggtctccatcattcagg

SEQ ID NO: 279466 - DNA, 25 bp, Mus musculus
ccagggatctatactggagggtgtc

SEQ ID NO: 279467 - DNA, 25 bp, Mus musculus
gtgcacacaggcattgttttcatga

SEQ ID NO: 279468 - DNA, 25 bp, Mus musculus
agtgaaggacacacagcgcctcgta

SEQ ID NO: 279469 - DNA, 25 bp, Mus musculus
caagtaggcgggcagtgattttctg

SEQ ID NO: 279470 - DNA, 25 bp, Mus musculus
tggcatttagaagcaccacgcctga

SEQ ID NO: 279471 - DNA, 25 bp, Mus musculus
aatggtctaaactgcctgtttggtg

SEQ ID NO: 279472 - DNA, 25 bp, Mus musculus
tgcctagagaaacacagctctcttg

SEQ ID NO: 279473 - DNA, 25 bp, Mus musculus
tgagtgattttgtcacagtcaaagc

SEQ ID NO: 279474 - DNA, 25 bp, Mus musculus
cacgcctgagttctgtgcctagaga

SEQ ID NO: 279475 - DNA, 25 bp, Mus musculus
agctttcccagtgtcgtggcagcac

SEQ ID NO: 279476 - DNA, 25 bp, Mus musculus
gtggcagcaccatcgcctgcctgtt

SEQ ID NO: 279477 - DNA, 25 bp, Mus musculus
tgcctgttctcttcttcagacactt

SEQ ID NO: 279478 - DNA, 25 bp, Mus musculus
atgacgtcacacgacctgccgcaga

SEQ ID NO: 279479 - DNA, 25 bp, Mus musculus
ctgccgcagacagccgcgctgaaga

SEQ ID NO: 279480 - DNA, 25 bp, Mus musculus
aggaggatgatctaggacgctgtcc

SEQ ID NO: 279481 - DNA, 25 bp, Mus musculus
cccggatgaggaaggcatttaagtc

SEQ ID NO: 279482 - DNA, 25 bp, Mus musculus
gcctgtgtggctcctgtccaaggac

SEQ ID NO: 279483 - DNA, 25 bp, Mus musculus
tgtgtggctcctgtccaaggacgcc

SEQ ID NO: 279484 - DNA, 25 bp, Mus musculus
gtggctcctgtccaaggacgccgct

SEQ ID NO: 279485 - DNA, 25 bp, Mus musculus
gcgggcctgtgtggctcctgtccaa

SEQ ID NO: 279486 - DNA, 25 bp, Mus musculus
tcagctccgcgtcgcgcacgctcct

SEQ ID NO: 279487 - DNA, 25 bp, Mus musculus
cgcacgctccttctgcaccctcgca

SEQ ID NO: 279488 - DNA, 25 bp, Mus musculus
cttcctccttggaaaagactcttgg

SEQ ID NO: 279489 - DNA, 25 bp, Mus musculus
tccttggaaaagactcttggggtgc

SEQ ID NO: 279490 - DNA, 25 bp, Mus musculus
cagcccactgcacccacctttattt

SEQ ID NO: 279491 - DNA, 25 bp, Mus musculus
cactgcacccacctttattttctac

SEQ ID NO: 279492 - DNA, 25 bp, Mus musculus
cgccgcgggccctacccgacctctg

SEQ ID NO: 279493 - DNA, 25 bp, Mus musculus
ctacccgacctctgcgacttctgca

SEQ ID NO: 279494 - DNA, 25 bp, Mus musculus
gacttctgcaccgcggccttgcatt

SEQ ID NO: 279495 - DNA, 25 bp, Mus musculus
cctgtccaaggacgccgctcagctc

SEQ ID NO: 279496 - DNA, 25 bp, Mus musculus
tccttgggcatgatgagccggagta

SEQ ID NO: 279497 - DNA, 25 bp, Mus musculus
agaactcgcagtccttcttctccgg

SEQ ID NO: 279498 - DNA, 25 bp, Mus musculus
tgattagtgtgacccagttccgccg

SEQ ID NO: 279499 - DNA, 25 bp, Mus musculus
gccgtggccctatggctgacgacac

SEQ ID NO: 279500 - DNA, 25 bp, Mus musculus
tgacgacacccgctgactggtggcc

SEQ ID NO: 279501 - DNA, 25 bp, Mus musculus
tctccggcctctttgggtgagcaat

SEQ ID NO: 279502 - DNA, 25 bp, Mus musculus
aagcggagcgcaaggtgaagaactc

SEQ ID NO: 279503 - DNA, 25 bp, Mus musculus
tcatggacaactccgggaagcaggc

SEQ ID NO: 279504 - DNA, 25 bp, Mus musculus
agctgcgcgacgtcatggacaactc

SEQ ID NO: 279505 - DNA, 25 bp, Mus musculus
gcagcttgagcccactggttggttc

SEQ ID NO: 279506 - DNA, 25 bp, Mus musculus
attggcttatttggtgtcacgtggc

SEQ ID NO: 279507 - DNA, 25 bp, Mus musculus
cggttcgggcttatgattggcttat

SEQ ID NO: 279508 - DNA, 25 bp, Mus musculus
aggcgtggcagaacaagtctataga

SEQ ID NO: 279509 - DNA, 25 bp, Mus musculus
agcgggctcttctgctctgcacttt

SEQ ID NO: 279510 - DNA, 25 bp, Mus musculus
accgtgttcgcagtgcccgttatcc

SEQ ID NO: 279511 - DNA, 25 bp, Mus musculus
cgaccgtgttcgcagtgcccgttat

SEQ ID NO: 279512 - DNA, 25 bp, Mus musculus
gcagtgcccgttatccggacggcct

SEQ ID NO: 279513 - DNA, 25 bp, Mus musculus
aggagcgcccggaagcgtgtggaac

SEQ ID NO: 279514 - DNA, 25 bp, Mus musculus
tatccggacggcctccttgcggcag

SEQ ID NO: 279515 - DNA, 25 bp, Mus musculus
tccggacggcctccttgcggcagga

SEQ ID NO: 279516 - DNA, 25 bp, Mus musculus
ggagtttgggtcgagatagcagccg

SEQ ID NO: 279517 - DNA, 25 bp, Mus musculus
ttcgcagtgcccgttatccggacgg

SEQ ID NO: 279518 - DNA, 25 bp, Mus musculus
tcctggccgaccgtgttcgcagtgc

SEQ ID NO: 279519 - DNA, 25 bp, Mus musculus
cggcagcactgcgtcagcggcggcg

SEQ ID NO: 279520 - DNA, 25 bp, Mus musculus
agggacttgcagtgcgtgagctgca

SEQ ID NO: 279521 - DNA, 25 bp, Mus musculus
tgcgtgagctgcatggtgagtaccg

SEQ ID NO: 279522 - DNA, 25 bp, Mus musculus
gtgagtaccgggttgagtcctggcc

SEQ ID NO: 279523 - DNA, 25 bp, Mus musculus
tgagtcctggccgaccgtgttcgca

SEQ ID NO: 279524 - DNA, 25 bp, Mus musculus
gattccggagcttctgactggcgag

SEQ ID NO: 279525 - DNA, 25 bp, Mus musculus
caatcagagagcggcgcagctgttc

SEQ ID NO: 279526 - DNA, 25 bp, Mus musculus
gtcccgcggacacgcggagttcttc

SEQ ID NO: 279527 - DNA, 25 bp, Mus musculus
cactgtcccgcggacacgcggagtt

SEQ ID NO: 279528 - DNA, 25 bp, Mus musculus
aagccgctgacacaggcccggtggc

SEQ ID NO: 279529 - DNA, 25 bp, Mus musculus
caggaagccgctgacacaggcccgg

SEQ ID NO: 279530 - DNA, 25 bp, Mus musculus
gaggcctggagacacgcgcaccttc

SEQ ID NO: 279531 - DNA, 25 bp, Mus musculus
caggaggcctggagacacgcgcacc

SEQ ID NO: 279532 - DNA, 25 bp, Mus musculus
cgcagctgttctcgggcaggaggcc

SEQ ID NO: 279533 - DNA, 25 bp, Mus musculus
cggacacgcggagttcttctacacg

SEQ ID NO: 279534 - DNA, 25 bp, Mus musculus
caagttaccaaattaccgcaggatt

SEQ ID NO: 279535 - DNA, 25 bp, Mus musculus
gcgcgggccagttaccaagttacca

SEQ ID NO: 279536 - DNA, 25 bp, Mus musculus
tccggagcttctgactggcgaggct

SEQ ID NO: 279537 - DNA, 25 bp, Mus musculus
gcttctgactggcgaggctgcagcc

SEQ ID NO: 279538 - DNA, 25 bp, Mus musculus
ccagtgaccttgacgccacaggcaa

SEQ ID NO: 279539 - DNA, 25 bp, Mus musculus
tccgggtaattacaggaactccata

SEQ ID NO: 279540 - DNA, 25 bp, Mus musculus
cgcgattcgtcgagtccagtgacct

SEQ ID NO: 279541 - DNA, 25 bp, Mus musculus
ccggccggccgcctgtttatattag

SEQ ID NO: 279542 - DNA, 25 bp, Mus musculus
gcctgtttatattagcgcggtgtaa

SEQ ID NO: 279543 - DNA, 25 bp, Mus musculus
cgcggtgtaaaatattctcgctgtc

SEQ ID NO: 279544 - DNA, 25 bp, Mus musculus
tctcgctgtcttagggaatcgcgtc

SEQ ID NO: 279545 - DNA, 25 bp, Mus musculus
ttagggaatcgcgtcgcgcaggaac

SEQ ID NO: 279546 - DNA, 25 bp, Mus musculus
gtcgcgcaggaacgcgccataaatc

SEQ ID NO: 279547 - DNA, 25 bp, Mus musculus
aacgcgccataaatcagccctcagg

SEQ ID NO: 279548 - DNA, 25 bp, Mus musculus
aaatcagccctcaggccatttgccg

SEQ ID NO: 279549 - DNA, 25 bp, Mus musculus
tagggcagtaaatcaaggacctgtc

SEQ ID NO: 279550 - DNA, 25 bp, Mus musculus
ccttatctaaatagggcagtaaatc

SEQ ID NO: 279551 - DNA, 25 bp, Mus musculus
catttgccgcggcagcctgagcgcg

SEQ ID NO: 279552 - DNA, 25 bp, Mus musculus
cccaaccggccacagagctcgcggg

SEQ ID NO: 279553 - DNA, 25 bp, Mus musculus
gatgtcgctccctatccggaccagg

SEQ ID NO: 279554 - DNA, 25 bp, Mus musculus
cccgccgcccagtgcatcctggccc

SEQ ID NO: 279555 - DNA, 25 bp, Mus musculus
agcctggaccctgaggacgcccgga

SEQ ID NO: 279556 - DNA, 25 bp, Mus musculus
gtaaccttcacacgcgcagcctgga

SEQ ID NO: 279557 - DNA, 25 bp, Mus musculus
cgcgcggagctgtaaccttcacacg

SEQ ID NO: 279558 - DNA, 25 bp, Mus musculus
gcaacggcggcgagtaccgctcact

SEQ ID NO: 279559 - DNA, 25 bp, Mus musculus
tgggccaggcttgttgctgggtaac

SEQ ID NO: 279560 - DNA, 25 bp, Mus musculus
tcctcgcgcctggttgggccaggct

SEQ ID NO: 279561 - DNA, 25 bp, Mus musculus
ggcgaccaatgagcgctctcgccgt

SEQ ID NO: 279562 - DNA, 25 bp, Mus musculus
gcccgcctggcattgggcacgcgat

SEQ ID NO: 279563 - DNA, 25 bp, Mus musculus
ggctctgcccgcctggcattgggca

SEQ ID NO: 279564 - DNA, 25 bp, Mus musculus
aatgagcgctctcgccgtctccggg

SEQ ID NO: 279565 - DNA, 25 bp, Mus musculus
gcgggccgcacagcctgaagctccc

SEQ ID NO: 279566 - DNA, 25 bp, Mus musculus
cggcagcaaaatcaggcagcgatta

SEQ ID NO: 279567 - DNA, 25 bp, Mus musculus
cggagcgctgtaatccggcagcaaa

SEQ ID NO: 279568 - DNA, 25 bp, Mus musculus
atcaggcagcgattagcccagcccg

SEQ ID NO: 279569 - DNA, 25 bp, Mus musculus
tctggcctttgattggccgcatgtg

SEQ ID NO: 279570 - DNA, 25 bp, Mus musculus
ggggtcctcagcaccgcaagtgcga

SEQ ID NO: 279571 - DNA, 25 bp, Mus musculus
cacacaagataaaataggcttcgcg

SEQ ID NO: 279572 - DNA, 25 bp, Mus musculus
taaaataggcttcgcgccctggtgc

SEQ ID NO: 279573 - DNA, 25 bp, Mus musculus
gcgccctggtgctcgaaattattcg

SEQ ID NO: 279574 - DNA, 25 bp, Mus musculus
cgaaattattcgtgtagtgggtgtg

SEQ ID NO: 279575 - DNA, 25 bp, Mus musculus
gcttatgtttgtttacacgcttcta

SEQ ID NO: 279576 - DNA, 25 bp, Mus musculus
tggctgcatttgaatcggcccgagc

SEQ ID NO: 279577 - DNA, 25 bp, Mus musculus
ccggcggctgacagctcttagagta

SEQ ID NO: 279578 - DNA, 25 bp, Mus musculus
agtgggtgtggcttatgtttgttta

SEQ ID NO: 279579 - DNA, 25 bp, Mus musculus
tgacagctcttagagtaccgaaacg

SEQ ID NO: 279580 - DNA, 25 bp, Mus musculus
agcagaggagctgaaggttagtaca

SEQ ID NO: 279581 - DNA, 25 bp, Mus musculus
ttcgaccagacgagtgcggtcggac

SEQ ID NO: 279582 - DNA, 25 bp, Mus musculus
cgagtgcggtcggactggcaccact

SEQ ID NO: 279583 - DNA, 25 bp, Mus musculus
ggcaccactgggtcctcagcgaatt

SEQ ID NO: 279584 - DNA, 25 bp, Mus musculus
ccactgggtcctcagcgaatttaga

SEQ ID NO: 279585 - DNA, 25 bp, Mus musculus
tcctcagcgaatttagaagactccc

SEQ ID NO: 279586 - DNA, 25 bp, Mus musculus
ttaaccctggcctggacggagtgta

SEQ ID NO: 279587 - DNA, 25 bp, Mus musculus
ggttagtacagagcgaggcaccctg

SEQ ID NO: 279588 - DNA, 25 bp, Mus musculus
acagagcgaggcaccctggtctgct

SEQ ID NO: 279589 - DNA, 25 bp, Mus musculus
accttgcagaaacgcaccctctgga

SEQ ID NO: 279590 - DNA, 25 bp, Mus musculus
acgcaccctctggaagtctgtgatc

SEQ ID NO: 279591 - DNA, 25 bp, Mus musculus
ctggaagtctgtgatctccgccgtc

SEQ ID NO: 279592 - DNA, 25 bp, Mus musculus
aagtctgtgatctccgccgtctcct

SEQ ID NO: 279593 - DNA, 25 bp, Mus musculus
gggctcgttgctaacctgcttcctc

SEQ ID NO: 279594 - DNA, 25 bp, Mus musculus
ctgagacgcggcatagagccacatg

SEQ ID NO: 279595 - DNA, 25 bp, Mus musculus
gaggatcggccacacccagagcgcg

SEQ ID NO: 279596 - DNA, 25 bp, Mus musculus
aagcacctgggactcagggcgccct

SEQ ID NO: 279597 - DNA, 25 bp, Mus musculus
ttcatcactgggactaaggctgggc

SEQ ID NO: 279598 - DNA, 25 bp, Mus musculus
cgataggacggtcgccttgcattcc

SEQ ID NO: 279599 - DNA, 25 bp, Mus musculus
cgaagctgcttacgagcggcaaggc

SEQ ID NO: 279600 - DNA, 25 bp, Mus musculus
tcctttctccggagtgttcatgccc

SEQ ID NO: 279601 - DNA, 25 bp, Mus musculus
ggtgcctcaatagcaacccactcgg

SEQ ID NO: 279602 - DNA, 25 bp, Mus musculus
ggagcagcagcaaggtgcctcaata

SEQ ID NO: 279603 - DNA, 25 bp, Mus musculus
cactgcagttagagcagcaggagca

SEQ ID NO: 279604 - DNA, 25 bp, Mus musculus
cacgaagactccagaagcagcagca

SEQ ID NO: 279605 - DNA, 25 bp, Mus musculus
agcggtgatccggacacgaagactc

SEQ ID NO: 279606 - DNA, 25 bp, Mus musculus
cggcgacaccagcaagcaagcagca

SEQ ID NO: 279607 - DNA, 25 bp, Mus musculus
tggctcccgagtttgtatccctaca

SEQ ID NO: 279608 - DNA, 25 bp, Mus musculus
tccgctgtatcctgcagcctttgcg

SEQ ID NO: 279609 - DNA, 25 bp, Mus musculus
cccaccgctccacctgccgtcaccg

SEQ ID NO: 279610 - DNA, 25 bp, Mus musculus
agcccgtagagggtctagcccgcga

SEQ ID NO: 279611 - DNA, 25 bp, Mus musculus
caggctccagggagcgccatggccc

SEQ ID NO: 279612 - DNA, 25 bp, Mus musculus
tatcctgcagcctttgcgagcccgg

SEQ ID NO: 279613 - DNA, 25 bp, Mus musculus
ctgccggccgcctacctctgcgccc

SEQ ID NO: 279614 - DNA, 25 bp, Mus musculus
tctccggagcccgtagagggtctag

SEQ ID NO: 279615 - DNA, 25 bp, Mus musculus
gtagagggtctagcccgcgacagtc

SEQ ID NO: 279616 - DNA, 25 bp, Mus musculus
ggtctagcccgcgacagtccgcgcc

SEQ ID NO: 279617 - DNA, 25 bp, Mus musculus
cggccgcctgatgccctccgctgta

SEQ ID NO: 279618 - DNA, 25 bp, Mus musculus
ctgtatcctgcagcctttgcgagcc

SEQ ID NO: 279619 - DNA, 25 bp, Mus musculus
tgcagcctttgcgagcccggcctgc

SEQ ID NO: 279620 - DNA, 25 bp, Mus musculus
ccctgccttgctgccggccgcctac

SEQ ID NO: 279621 - DNA, 25 bp, Mus musculus
cagctctccggagcccgtagagggt

SEQ ID NO: 279622 - DNA, 25 bp, Mus musculus
aatggatctgctggatgctgggatc

SEQ ID NO: 279623 - DNA, 25 bp, Mus musculus
gaggtcgcgccagggacaagcagat

SEQ ID NO: 279624 - DNA, 25 bp, Mus musculus
ggcggacgacctcaacgcgcagtac

SEQ ID NO: 279625 - DNA, 25 bp, Mus musculus
cggacgacctcaacgcgcagtacga

SEQ ID NO: 279626 - DNA, 25 bp, Mus musculus
ggacgacctcaacgcgcagtacgag

SEQ ID NO: 279627 - DNA, 25 bp, Mus musculus
gacctcaacgcgcagtacgagcggc

SEQ ID NO: 279628 - DNA, 25 bp, Mus musculus
tctgctggatgctgggatccggtgt

SEQ ID NO: 279629 - DNA, 25 bp, Mus musculus
atccggtgtgggccagatcaggact

SEQ ID NO: 279630 - DNA, 25 bp, Mus musculus
agatcaggactggagcccctagcca

SEQ ID NO: 279631 - DNA, 25 bp, Mus musculus
ctagccagggtcggggaaagctact

SEQ ID NO: 279632 - DNA, 25 bp, Mus musculus
cggagcccgcggtcgcggggactga

SEQ ID NO: 279633 - DNA, 25 bp, Mus musculus
cggatggcggacgacctcaacgcgc

SEQ ID NO: 279634 - DNA, 25 bp, Mus musculus
tcggggaaagctactcggagcccgc

SEQ ID NO: 279635 - DNA, 25 bp, Mus musculus
cctcaacgcgcagtacgagcggcgg

SEQ ID NO: 279636 - DNA, 25 bp, Mus musculus
gagtaagtacaggtttggagctcgc

SEQ ID NO: 279637 - DNA, 25 bp, Mus musculus
agctcgcggggatcaagtagttcca

SEQ ID NO: 279638 - DNA, 25 bp, Mus musculus
gggatcaagtagttccaggaaactg

SEQ ID NO: 279639 - DNA, 25 bp, Mus musculus
gttccaggaaactgtgggctgatcc

SEQ ID NO: 279640 - DNA, 25 bp, Mus musculus
ccaggaaactgtgggctgatccgtg

SEQ ID NO: 279641 - DNA, 25 bp, Mus musculus
gctgatccgtggctgagtctcagtg

SEQ ID NO: 279642 - DNA, 25 bp, Mus musculus
tccgtcccagaataggggcgcggca

SEQ ID NO: 279643 - DNA, 25 bp, Mus musculus
cgcggggatcaagtagttccaggaa

SEQ ID NO: 279644 - DNA, 25 bp, Mus musculus
cggggcctcacgcaaggagaaggac

SEQ ID NO: 279645 - DNA, 25 bp, Mus musculus
cgtggctgagtctcagtggagcctt

SEQ ID NO: 279646 - DNA, 25 bp, Mus musculus
gagctccgctccttgtcgccgccaa

SEQ ID NO: 279647 - DNA, 25 bp, Mus musculus
tgtcgccgccaagaacaagatggcc

SEQ ID NO: 279648 - DNA, 25 bp, Mus musculus
aacaagatggccgggagtaagtaca

SEQ ID NO: 279649 - DNA, 25 bp, Mus musculus
gtaatccgtcccagaataggggcgc

SEQ ID NO: 279650 - DNA, 25 bp, Mus musculus
tccaggcaacgtagaagcgcatgcg

SEQ ID NO: 279651 - DNA, 25 bp, Mus musculus
aagaccgggatcatgtagaagaggc

SEQ ID NO: 279652 - DNA, 25 bp, Mus musculus
gcaatgcaaccgcactcggccgcaa

SEQ ID NO: 279653 - DNA, 25 bp, Mus musculus
actcggccgcaatccaggcaacgta

SEQ ID NO: 279654 - DNA, 25 bp, Mus musculus
gcaatccaggcaacgtagaagcgca

SEQ ID NO: 279655 - DNA, 25 bp, Mus musculus
aggcaacgtagaagcgcatgcggaa

SEQ ID NO: 279656 - DNA, 25 bp, Mus musculus
aagcgcatgcggaaggcgaagaaga

SEQ ID NO: 279657 - DNA, 25 bp, Mus musculus
aagaagaccgggatcatgtagaaga

SEQ ID NO: 279658 - DNA, 25 bp, Mus musculus
cgaagcccgcggcaatgcaaccgca

SEQ ID NO: 279659 - DNA, 25 bp, Mus musculus
agaaggcgtcctcacgcacagcttc

SEQ ID NO: 279660 - DNA, 25 bp, Mus musculus
aagagcaggccaaagagcggggctg

SEQ ID NO: 279661 - DNA, 25 bp, Mus musculus
gggcctcaggctgggcacggcttcc

SEQ ID NO: 279662 - DNA, 25 bp, Mus musculus
cggccgcaatccaggcaacgtagaa

SEQ ID NO: 279663 - DNA, 25 bp, Mus musculus
ggcgtagaaggcgtcctcacgcaca

SEQ ID NO: 279664 - DNA, 25 bp, Mus musculus
atcgtccacgttgtcaccttcttta

SEQ ID NO: 279665 - DNA, 25 bp, Mus musculus
tttgcacccgactccaaattgcggc

SEQ ID NO: 279666 - DNA, 25 bp, Mus musculus
tactcctgtcttgtcgcagtgtcga

SEQ ID NO: 279667 - DNA, 25 bp, Mus musculus
gtgtcgactagccaaagcgaatctc

SEQ ID NO: 279668 - DNA, 25 bp, Mus musculus
agcgaatctctgtttagcaggctca

SEQ ID NO: 279669 - DNA, 25 bp, Mus musculus
agcaggctcaatccacggcgacgta

SEQ ID NO: 279670 - DNA, 25 bp, Mus musculus
ccgcgaggcggctgctaataaagtt

SEQ ID NO: 279671 - DNA, 25 bp, Mus musculus
ttgtccaaacgctgccggaaatgtc

SEQ ID NO: 279672 - DNA, 25 bp, Mus musculus
gtttatcctctagcgcctgcaccga

SEQ ID NO: 279673 - DNA, 25 bp, Mus musculus
cggaaatgtcgtaaacggccaatca

SEQ ID NO: 279674 - DNA, 25 bp, Mus musculus
ttatcggcggcaagtaaacgtcatc

SEQ ID NO: 279675 - DNA, 25 bp, Mus musculus
cgtcatcaaagagagccgaagctct

SEQ ID NO: 279676 - DNA, 25 bp, Mus musculus
ctggggaagcagatttcttggaaac

SEQ ID NO: 279677 - DNA, 25 bp, Mus musculus
gcggcttgaagccttcggtttatcc

SEQ ID NO: 279678 - DNA, 25 bp, Mus musculus
ctaggaaccaatggggcgcgcctaa

SEQ ID NO: 279679 - DNA, 25 bp, Mus musculus
agctccattcgggagcgttgcctca

SEQ ID NO: 279680 - DNA, 25 bp, Mus musculus
ctcttatcgcgatagcgcccgggct

SEQ ID NO: 279681 - DNA, 25 bp, Mus musculus
gtcgtctagaacaatcccgggccca

SEQ ID NO: 279682 - DNA, 25 bp, Mus musculus
ccctactcggtcgtctagaacaatc

SEQ ID NO: 279683 - DNA, 25 bp, Mus musculus
cgggcctttccttgatccctgaatc

SEQ ID NO: 279684 - DNA, 25 bp, Mus musculus
gcccgttcagcttccgtggagccgt

SEQ ID NO: 279685 - DNA, 25 bp, Mus musculus
tgacggacctatattcggggctcgg

SEQ ID NO: 279686 - DNA, 25 bp, Mus musculus
cagagcgacgtactgcgggagcaat

SEQ ID NO: 279687 - DNA, 25 bp, Mus musculus
gaggttggcctcattctcgctagga

SEQ ID NO: 279688 - DNA, 25 bp, Mus musculus
gccttgccgagatcagccaatcata

SEQ ID NO: 279689 - DNA, 25 bp, Mus musculus
gaggccaatcgaacgccgcgccttg

SEQ ID NO: 279690 - DNA, 25 bp, Mus musculus
tacccgagccaatccaagcaagctg

SEQ ID NO: 279691 - DNA, 25 bp, Mus musculus
gcgggagcaatgacggacctatatt

SEQ ID NO: 279692 - DNA, 25 bp, Mus musculus
gccgcgtggccaggtcccatgtgct

SEQ ID NO: 279693 - DNA, 25 bp, Mus musculus
aacacttgtcaccagcgttagcagg

SEQ ID NO: 279694 - DNA, 25 bp, Mus musculus
gaaacacttgtcaccagcgttagca

SEQ ID NO: 279695 - DNA, 25 bp, Mus musculus
cccgagaaacacttgtcaccagcgt

SEQ ID NO: 279696 - DNA, 25 bp, Mus musculus
cgagaaacacttgtcaccagcgtta

SEQ ID NO: 279697 - DNA, 25 bp, Mus musculus
cacttgtcaccagcgttagcaggcc

SEQ ID NO: 279698 - DNA, 25 bp, Mus musculus
cttgtcaccagcgttagcaggccgg

SEQ ID NO: 279699 - DNA, 25 bp, Mus musculus
tcaccagcgttagcaggccgggccg

SEQ ID NO: 279700 - DNA, 25 bp, Mus musculus
tgctccacctgcgaccgttctgggg

SEQ ID NO: 279701 - DNA, 25 bp, Mus musculus
gcgtggccaggtcccatgtgctcca

SEQ ID NO: 279702 - DNA, 25 bp, Mus musculus
atgtgctccacctgcgaccgttctg

SEQ ID NO: 279703 - DNA, 25 bp, Mus musculus
cgaccgttctggggcgctggccctt

SEQ ID NO: 279704 - DNA, 25 bp, Mus musculus
cacctgcgaccgttctggggcgctg

SEQ ID NO: 279705 - DNA, 25 bp, Mus musculus
tgtcaccagcgttagcaggccgggc

SEQ ID NO: 279706 - DNA, 25 bp, Mus musculus
cggctcggaattagatgcgtttaca

SEQ ID NO: 279707 - DNA, 25 bp, Mus musculus
tccgccttagccgagagttggtgtt

SEQ ID NO: 279708 - DNA, 25 bp, Mus musculus
ccgctttgctgacctgacgggatga

SEQ ID NO: 279709 - DNA, 25 bp, Mus musculus
aggactcccgattgagccgaattta

SEQ ID NO: 279710 - DNA, 25 bp, Mus musculus
tccgaaggctgaaacgcttgcgttc

SEQ ID NO: 279711 - DNA, 25 bp, Mus musculus
agggtcgaatgctgaaccttttgca

SEQ ID NO: 279712 - DNA, 25 bp, Mus musculus
gggttgacttattgcctctgcctga

SEQ ID NO: 279713 - DNA, 25 bp, Mus musculus
gaatgctttttcaggtcacggtcaa

SEQ ID NO: 279714 - DNA, 25 bp, Mus musculus
ggcgggatcgcatatttggacttac

SEQ ID NO: 279715 - DNA, 25 bp, Mus musculus
cgcatgcttcggcttacttcggaga

SEQ ID NO: 279716 - DNA, 25 bp, Mus musculus
cgggaccacacacttcggcttgatt

SEQ ID NO: 279717 - DNA, 25 bp, Mus musculus
tgcgtttacaaactcggccggatgt

SEQ ID NO: 279718 - DNA, 25 bp, Mus musculus
tcccatttgtgcagaccggagtggc

SEQ ID NO: 279719 - DNA, 25 bp, Mus musculus
ctcgagtgcgactgtggattcaatc

SEQ ID NO: 279720 - DNA, 25 bp, Mus musculus
ctgcacatgcgccacaagattattt

SEQ ID NO: 279721 - DNA, 25 bp, Mus musculus
cgtctcgaccaggagctaaagttga

SEQ ID NO: 279722 - DNA, 25 bp, Mus musculus
agccatgatgtctgtctcccacgtg

SEQ ID NO: 279723 - DNA, 25 bp, Mus musculus
cgccagaggattgcagtttagtttt

SEQ ID NO: 279724 - DNA, 25 bp, Mus musculus
gtgttctctagtcgccatgcacatg

SEQ ID NO: 279725 - DNA, 25 bp, Mus musculus
tcccaaccacgtgcaggagagtatg

SEQ ID NO: 279726 - DNA, 25 bp, Mus musculus
gtcaacatgccggtcgccagaagct

SEQ ID NO: 279727 - DNA, 25 bp, Mus musculus
gtcaagtttaccctggccaagatcc

SEQ ID NO: 279728 - DNA, 25 bp, Mus musculus
gttgacgctagacgagaaggatccc

SEQ ID NO: 279729 - DNA, 25 bp, Mus musculus
tcaagttttctaaggcggatttctc

SEQ ID NO: 279730 - DNA, 25 bp, Mus musculus
ggtaacggagccattcgaatcttca

SEQ ID NO: 279731 - DNA, 25 bp, Mus musculus
ttgtctctctttgtctcgggcctga

SEQ ID NO: 279732 - DNA, 25 bp, Mus musculus
cctgctcgtctctatggctttcctg

SEQ ID NO: 279733 - DNA, 25 bp, Mus musculus
agcggtgcgtgatgacgtcactaca

SEQ ID NO: 279734 - DNA, 25 bp, Mus musculus
cccagtcgagcattctgcacggttc

SEQ ID NO: 279735 - DNA, 25 bp, Mus musculus
cgttcccgggtcagtctgctttggg

SEQ ID NO: 279736 - DNA, 25 bp, Mus musculus
gtgcgcaaacgagctagcccgcgca

SEQ ID NO: 279737 - DNA, 25 bp, Mus musculus
ctgcgcactcacaggccttttacga

SEQ ID NO: 279738 - DNA, 25 bp, Mus musculus
acaggccttttacgacgccatcaag

SEQ ID NO: 279739 - DNA, 25 bp, Mus musculus
ttacgacgccatcaaggagttccgc

SEQ ID NO: 279740 - DNA, 25 bp, Mus musculus
gccatcaaggagttccgctgacccg

SEQ ID NO: 279741 - DNA, 25 bp, Mus musculus
gcccgcagcacagttccggttgaga

SEQ ID NO: 279742 - DNA, 25 bp, Mus musculus
gcacagttccggttgagacctttcc

SEQ ID NO: 279743 - DNA, 25 bp, Mus musculus
ccgagaaccttctccggcgcgctcg

SEQ ID NO: 279744 - DNA, 25 bp, Mus musculus
tccggagcagcgttcccgggtcagt

SEQ ID NO: 279745 - DNA, 25 bp, Mus musculus
cgtcctagagcagcccagtcgagca

SEQ ID NO: 279746 - DNA, 25 bp, Mus musculus
gagcattctgcacggttcctttccc

SEQ ID NO: 279747 - DNA, 25 bp, Mus musculus
tcgtctttttttctgtgcgtccgga

SEQ ID NO: 279748 - DNA, 25 bp, Mus musculus
gggagccgctcattaacacctacat

SEQ ID NO: 279749 - DNA, 25 bp, Mus musculus
ttctcttctccgagctggtgcagca

SEQ ID NO: 279750 - DNA, 25 bp, Mus musculus
tggccgagcttcaagcacgcttggc

SEQ ID NO: 279751 - DNA, 25 bp, Mus musculus
cgagtcctagatgccctggtggccc

SEQ ID NO: 279752 - DNA, 25 bp, Mus musculus
ggcgcattgctcttcgtcaagggtg

SEQ ID NO: 279753 - DNA, 25 bp, Mus musculus
cggacaagctggagcaggccaatga

SEQ ID NO: 279754 - DNA, 25 bp, Mus musculus
ggccaatgatgacgcccgcactttc

SEQ ID NO: 279755 - DNA, 25 bp, Mus musculus
atcgtggaggctgtgctcacgcaca

SEQ ID NO: 279756 - DNA, 25 bp, Mus musculus
cagcggcttccctgccaaggttacg

SEQ ID NO: 279757 - DNA, 25 bp, Mus musculus
cgtgcccaaggagaacagcacactg

SEQ ID NO: 279758 - DNA, 25 bp, Mus musculus
tgccagcttcacagcgggcatcgtg

SEQ ID NO: 279759 - DNA, 25 bp, Mus musculus
gcagcactgtcagagccgcgttttc

SEQ ID NO: 279760 - DNA, 25 bp, Mus musculus
ccgcgttttctctgtggccgagctt

SEQ ID NO: 279761 - DNA, 25 bp, Mus musculus
ttctacatcatcgagagggagccgc

SEQ ID NO: 279762 - DNA, 25 bp, Mus musculus
agcatcatctctgtccgtgttgtcg

SEQ ID NO: 279763 - DNA, 25 bp, Mus musculus
ggtctagcagtatgcgcacacagcg

SEQ ID NO: 279764 - DNA, 25 bp, Mus musculus
gaccagagctgcactgtttgaactg

SEQ ID NO: 279765 - DNA, 25 bp, Mus musculus
tccctttgttctccaaggcccaaga

SEQ ID NO: 279766 - DNA, 25 bp, Mus musculus
tcgcgctgggacagagaccagagct

SEQ ID NO: 279767 - DNA, 25 bp, Mus musculus
tttctcggaactcgtgcgctgcttt

SEQ ID NO: 279768 - DNA, 25 bp, Mus musculus
ccgggacaggtcagcttagatctgc

SEQ ID NO: 279769 - DNA, 25 bp, Mus musculus
ggactcaactccagcggtgcgcgca

SEQ ID NO: 279770 - DNA, 25 bp, Mus musculus
cacatcgccgcgctctgaggagaga

SEQ ID NO: 279771 - DNA, 25 bp, Mus musculus
cggtgatagtgtccacgccgaactc

SEQ ID NO: 279772 - DNA, 25 bp, Mus musculus
acaccacgagcaggcagagcacgaa

SEQ ID NO: 279773 - DNA, 25 bp, Mus musculus
cgcatagtcgaactgcccgcgttcg

SEQ ID NO: 279774 - DNA, 25 bp, Mus musculus
aacaccgtgcgttgctcgacgtcca

SEQ ID NO: 279775 - DNA, 25 bp, Mus musculus
gggatgaggctatgcccttcctgca

SEQ ID NO: 279776 - DNA, 25 bp, Mus musculus
ggcgcttcctcttctattttgatag

SEQ ID NO: 279777 - DNA, 25 bp, Mus musculus
aggcgcttcctcttctattttgata

SEQ ID NO: 279778 - DNA, 25 bp, Mus musculus
ctcttctattttgatagccaaagcg

SEQ ID NO: 279779 - DNA, 25 bp, Mus musculus
aagcgaaaatgagccgcccagttcg

SEQ ID NO: 279780 - DNA, 25 bp, Mus musculus
ccaaagcgaaaatgagccgcccagt

SEQ ID NO: 279781 - DNA, 25 bp, Mus musculus
tagccaaagcgaaaatgagccgccc

SEQ ID NO: 279782 - DNA, 25 bp, Mus musculus
gcttcctcttctattttgatagcca

SEQ ID NO: 279783 - DNA, 25 bp, Mus musculus
gcaggcgcttcctcttctattttga

SEQ ID NO: 279784 - DNA, 25 bp, Mus musculus
cgcaggcgcttcctcttctattttg

SEQ ID NO: 279785 - DNA, 25 bp, Mus musculus
gatgaaaccgcaggcgcttcctctt

SEQ ID NO: 279786 - DNA, 25 bp, Mus musculus
cgaaagctcccctgatgaaaccgca

SEQ ID NO: 279787 - DNA, 25 bp, Mus musculus
gagccggcaggaaggcgggacgccc

SEQ ID NO: 279788 - DNA, 25 bp, Mus musculus
ctgcagccaggtgagccggcaggaa

SEQ ID NO: 279789 - DNA, 25 bp, Mus musculus
ttgatagccaaagcgaaaatgagcc

SEQ ID NO: 279790 - DNA, 25 bp, Mus musculus
tcttgcccacaaggggaaaacgcta

SEQ ID NO: 279791 - DNA, 25 bp, Mus musculus
tgaaactcagggatttggtctcggc

SEQ ID NO: 279792 - DNA, 25 bp, Mus musculus
ccgcctgcatctcggctgggatgcg

SEQ ID NO: 279793 - DNA, 25 bp, Mus musculus
gcacacagcattgaccgcggtggga

SEQ ID NO: 279794 - DNA, 25 bp, Mus musculus
gcggtggagcgacttcttgcccaca

SEQ ID NO: 279795 - DNA, 25 bp, Mus musculus
ttggtctcggcttgcgagtcctctt

SEQ ID NO: 279796 - DNA, 25 bp, Mus musculus
aagcacacgggcagacagaacatcc

SEQ ID NO: 279797 - DNA, 25 bp, Mus musculus
ctgggttcagaaagcttacagcgaa

SEQ ID NO: 279798 - DNA, 25 bp, Mus musculus
ttcgagaaagcgacccaggcaaacc

SEQ ID NO: 279799 - DNA, 25 bp, Mus musculus
caaatcgcacctggccttatcaact

SEQ ID NO: 279800 - DNA, 25 bp, Mus musculus
ggaaaacgctacaaatcgcacctgg

SEQ ID NO: 279801 - DNA, 25 bp, Mus musculus
atcccgaactttcgggtacacagcg

SEQ ID NO: 279802 - DNA, 25 bp, Mus musculus
acggttgcgcgcacacagcattgac

SEQ ID NO: 279803 - DNA, 25 bp, Mus musculus
cagcgaagacagaggacgaaaagca

SEQ ID NO: 279804 - DNA, 25 bp, Mus musculus
ccgagttccttaacggtacttgctg

SEQ ID NO: 279805 - DNA, 25 bp, Mus musculus
cggttccgacagttctttatcaaca

SEQ ID NO: 279806 - DNA, 25 bp, Mus musculus
ccagctgtcgctgtcccggaacaaa

SEQ ID NO: 279807 - DNA, 25 bp, Mus musculus
ctgtcccggaacaaagcacttactg

SEQ ID NO: 279808 - DNA, 25 bp, Mus musculus
caaagcacttactgcagcgacaatg

SEQ ID NO: 279809 - DNA, 25 bp, Mus musculus
cagcgacaatgctgcccttctctga

SEQ ID NO: 279810 - DNA, 25 bp, Mus musculus
aggtcatcatgaaactcgccgcaaa

SEQ ID NO: 279811 - DNA, 25 bp, Mus musculus
ttgggagccacaagcgccacattcc

SEQ ID NO: 279812 - DNA, 25 bp, Mus musculus
aggcccggaccggtctcagcgagca

SEQ ID NO: 279813 - DNA, 25 bp, Mus musculus
agactcacgcgacatccacggctgt

SEQ ID NO: 279814 - DNA, 25 bp, Mus musculus
ctgggagtgcgagccgcccatcaca

SEQ ID NO: 279815 - DNA, 25 bp, Mus musculus
cagcccacgggtgacctcgcaggag

SEQ ID NO: 279816 - DNA, 25 bp, Mus musculus
tcgccgcaaacaagagggaattctt

SEQ ID NO: 279817 - DNA, 25 bp, Mus musculus
gcgtgtgcacactcgcgcgaacaca

SEQ ID NO: 279818 - DNA, 25 bp, Mus musculus
aactcgggctgccagaagcctgaga

SEQ ID NO: 279819 - DNA, 25 bp, Mus musculus
cgcagcgccaagtgaggtaagagtc

SEQ ID NO: 279820 - DNA, 25 bp, Mus musculus
ccacagccgtgctgcagtcaatgca

SEQ ID NO: 279821 - DNA, 25 bp, Mus musculus
catcaggatctgaacggagcccgga

SEQ ID NO: 279822 - DNA, 25 bp, Mus musculus
cgagctctccagaggcgggaccgca

SEQ ID NO: 279823 - DNA, 25 bp, Mus musculus
gggcaccagcttcggctccattgtt

SEQ ID NO: 279824 - DNA, 25 bp, Mus musculus
ctcggagcgctcctgcgggtacttt

SEQ ID NO: 279825 - DNA, 25 bp, Mus musculus
tgcttagcgcattgcggcgacctcg

SEQ ID NO: 279826 - DNA, 25 bp, Mus musculus
cgaggacttttctcaggtcccaggg

SEQ ID NO: 279827 - DNA, 25 bp, Mus musculus
cagcggagaccgaggacttttctca

SEQ ID NO: 279828 - DNA, 25 bp, Mus musculus
cgcagctggaaaagcagcggagacc

SEQ ID NO: 279829 - DNA, 25 bp, Mus musculus
tgcagccgctgcgtgcagaggaccc

SEQ ID NO: 279830 - DNA, 25 bp, Mus musculus
ctggactgagactgtgcttagcgca

SEQ ID NO: 279831 - DNA, 25 bp, Mus musculus
ccgagacgtccggactggactgaga

SEQ ID NO: 279832 - DNA, 25 bp, Mus musculus
agccgcgcggaaggcaacaaggtcc

SEQ ID NO: 279833 - DNA, 25 bp, Mus musculus
caggtacaccgtaggggagaatgtc

SEQ ID NO: 279834 - DNA, 25 bp, Mus musculus
cccttgtccgctgcgaggtgactaa

SEQ ID NO: 279835 - DNA, 25 bp, Mus musculus
gccggaagcccagtctccatggttc

SEQ ID NO: 279836 - DNA, 25 bp, Mus musculus
cgccctgtgacgtcactccgagtga

SEQ ID NO: 279837 - DNA, 25 bp, Mus musculus
gtgacgccactaccatccaatgagc

SEQ ID NO: 279838 - DNA, 25 bp, Mus musculus
tctcggccggtagtctccgcggaaa

SEQ ID NO: 279839 - DNA, 25 bp, Mus musculus
ggactggctcgcgtccttcacggca

SEQ ID NO: 279840 - DNA, 25 bp, Mus musculus
tactggcataacactgcgatctcgc

SEQ ID NO: 279841 - DNA, 25 bp, Mus musculus
gagccgcttctcagctactggcata

SEQ ID NO: 279842 - DNA, 25 bp, Mus musculus
cgatctcgcaatcgtgccggaagga

SEQ ID NO: 279843 - DNA, 25 bp, Mus musculus
ccctatggaaacctcagctaaaaag

SEQ ID NO: 279844 - DNA, 25 bp, Mus musculus
cacgagcccgcgaagtcacttctgg

SEQ ID NO: 279845 - DNA, 25 bp, Mus musculus
gtaaacatcgcgaaccgggcacagc

SEQ ID NO: 279846 - DNA, 25 bp, Mus musculus
ctcgggaatcctagccgggcgcgat

SEQ ID NO: 279847 - DNA, 25 bp, Mus musculus
agtgcgtgttcagagaacatgtgtc

SEQ ID NO: 279848 - DNA, 25 bp, Mus musculus
cgtgggcatctagtggcgcaccact

SEQ ID NO: 279849 - DNA, 25 bp, Mus musculus
caacggcatgcctcgggcctagctt

SEQ ID NO: 279850 - DNA, 25 bp, Mus musculus
cgagctgggcctggctttgaacttt

SEQ ID NO: 279851 - DNA, 25 bp, Mus musculus
ccgtgccaggactgttcgcagcgct

SEQ ID NO: 279852 - DNA, 25 bp, Mus musculus
ggtgaacggacagccgcctccaggt

SEQ ID NO: 279853 - DNA, 25 bp, Mus musculus
tgtgccctgtgctccctatgcgtct

SEQ ID NO: 279854 - DNA, 25 bp, Mus musculus
cgcctcgagagtgcgtgttcagaga

SEQ ID NO: 279855 - DNA, 25 bp, Mus musculus
tagtggcgcaccactcgggcacagc

SEQ ID NO: 279856 - DNA, 25 bp, Mus musculus
aacatgtgtcatggctccgagctgg

SEQ ID NO: 279857 - DNA, 25 bp, Mus musculus
actttgcaactttgcgcttcgggga

SEQ ID NO: 279858 - DNA, 25 bp, Mus musculus
acagttgggcgccatgcgccgtgcc

SEQ ID NO: 279859 - DNA, 25 bp, Mus musculus
tgaacccgtggacgaagcacgcgcc

SEQ ID NO: 279860 - DNA, 25 bp, Mus musculus
cagctgtcaggctgtcagtgactcc

SEQ ID NO: 279861 - DNA, 25 bp, Mus musculus
ctgtcgtcctaacgtgctggcccgt

SEQ ID NO: 279862 - DNA, 25 bp, Mus musculus
gcgcagggccactcgagtaccatat

SEQ ID NO: 279863 - DNA, 25 bp, Mus musculus
ccatatggcgtctagtacgtgctgc

SEQ ID NO: 279864 - DNA, 25 bp, Mus musculus
acgtgctgccgtttagtaagtatta

SEQ ID NO: 279865 - DNA, 25 bp, Mus musculus
gtattagcctcgcaggcccgacctg

SEQ ID NO: 279866 - DNA, 25 bp, Mus musculus
tgcggtctcgcgtctgctccagact

SEQ ID NO: 279867 - DNA, 25 bp, Mus musculus
gagctccggactgcatttcccggca

SEQ ID NO: 279868 - DNA, 25 bp, Mus musculus
cggccagtagccaataggagaccta

SEQ ID NO: 279869 - DNA, 25 bp, Mus musculus
tgtgcagctttcgatcagaaccctg

SEQ ID NO: 279870 - DNA, 25 bp, Mus musculus
ccgcgtaccggtcatcaggttcttc

SEQ ID NO: 279871 - DNA, 25 bp, Mus musculus
tgccttctgttgctggacgcggact

SEQ ID NO: 279872 - DNA, 25 bp, Mus musculus
catctaggaatggtagcgcagggcc

SEQ ID NO: 279873 - DNA, 25 bp, Mus musculus
tctctcccggggaaggagactgccc

SEQ ID NO: 279874 - DNA, 25 bp, Mus musculus
tccgtggagatcctcagcagaactg

SEQ ID NO: 279875 - DNA, 25 bp, Mus musculus
tgtgtttccaccattccacagggtc

SEQ ID NO: 279876 - DNA, 25 bp, Mus musculus
cattccacagggtcggcggaccgag

SEQ ID NO: 279877 - DNA, 25 bp, Mus musculus
ggagcgcagggctctgtcagattca

SEQ ID NO: 279878 - DNA, 25 bp, Mus musculus
cagggctctgtcagattcagtgaca

SEQ ID NO: 279879 - DNA, 25 bp, Mus musculus
gcagcgatggtctccgtggagatcc

SEQ ID NO: 279880 - DNA, 25 bp, Mus musculus
tcagcagaactgaacgcctctcgga

SEQ ID NO: 279881 - DNA, 25 bp, Mus musculus
ctgaacgcctctcggagggaacact

SEQ ID NO: 279882 - DNA, 25 bp, Mus musculus
cctctcggagggaacactgcttggc

SEQ ID NO: 279883 - DNA, 25 bp, Mus musculus
gacatcgcgatcgatcgctgcgaga

SEQ ID NO: 279884 - DNA, 25 bp, Mus musculus
cgctgcgagattaggaggcctgatt

SEQ ID NO: 279885 - DNA, 25 bp, Mus musculus
aggcctgattgcgttgtgtttccac

SEQ ID NO: 279886 - DNA, 25 bp, Mus musculus
ttcagtgacagctccgtctccgcag

SEQ ID NO: 279887 - DNA, 25 bp, Mus musculus
gagaagtctgcagcgatggtctccg

SEQ ID NO: 279888 - DNA, 25 bp, Mus musculus
tcgcacttcctaagcggctcggggc

SEQ ID NO: 279889 - DNA, 25 bp, Mus musculus
cgccgaggtagcctgtcaatcttcc

SEQ ID NO: 279890 - DNA, 25 bp, Mus musculus
cggcaggttcttccgccgaggtagc

SEQ ID NO: 279891 - DNA, 25 bp, Mus musculus
agttcgctaggtggcgctggacacc

SEQ ID NO: 279892 - DNA, 25 bp, Mus musculus
cgtcagcgtctgatccgcacgtatg

SEQ ID NO: 279893 - DNA, 25 bp, Mus musculus
tctgatccgcacgtatggcgggatg

SEQ ID NO: 279894 - DNA, 25 bp, Mus musculus
tgcgggtcctgctctttgtggcttt

SEQ ID NO: 279895 - DNA, 25 bp, Mus musculus
ctgggcgctcgcacttcctaagcgg

SEQ ID NO: 279896 - DNA, 25 bp, Mus musculus
atgtttgtgcgtgagctgccctccc

SEQ ID NO: 279897 - DNA, 25 bp, Mus musculus
atccagcccgaggagctgtggctct

SEQ ID NO: 279898 - DNA, 25 bp, Mus musculus
tgtggctttcctgtaaggatctgtc

SEQ ID NO: 279899 - DNA, 25 bp, Mus musculus
ctacaggaacccgtacgtggaggcg

SEQ ID NO: 279900 - DNA, 25 bp, Mus musculus
ccaccggccgcatgtttgtgcgtga

SEQ ID NO: 279901 - DNA, 25 bp, Mus musculus
agctgtggctctacaggaacccgta

SEQ ID NO: 279902 - DNA, 25 bp, Mus musculus
gcggactagcgctgcagacatagaa

SEQ ID NO: 279903 - DNA, 25 bp, Mus musculus
tcctccgaagtgtcgcgagatgtgc

SEQ ID NO: 279904 - DNA, 25 bp, Mus musculus
gcgcagaaagatcctccgaagtgtc

SEQ ID NO: 279905 - DNA, 25 bp, Mus musculus
ctcagcgctccagcggaggagagca

SEQ ID NO: 279906 - DNA, 25 bp, Mus musculus
cccgggataccgtgcacactggagc

SEQ ID NO: 279907 - DNA, 25 bp, Mus musculus
gagagcagccgagccgtccacggat

SEQ ID NO: 279908 - DNA, 25 bp, Mus musculus
tccgagttcgggatctaggagagca

SEQ ID NO: 279909 - DNA, 25 bp, Mus musculus
agaagcagaacccaaaagcccagga

SEQ ID NO: 279910 - DNA, 25 bp, Mus musculus
cagcactaaagcacccggcggacta

SEQ ID NO: 279911 - DNA, 25 bp, Mus musculus
aagtgacaaatgacctcaactgccc

SEQ ID NO: 279912 - DNA, 25 bp, Mus musculus
ccagagtttcggatgaaaagtgaca

SEQ ID NO: 279913 - DNA, 25 bp, Mus musculus
caccgagacgcagagccagagtttc

SEQ ID NO: 279914 - DNA, 25 bp, Mus musculus
ggatgtcgggcgagttcccaccgac

SEQ ID NO: 279915 - DNA, 25 bp, Mus musculus
ggaccgcacagctcaggaaccaaca

SEQ ID NO: 279916 - DNA, 25 bp, Mus musculus
agcggccgtaagaagggccgtcact

SEQ ID NO: 279917 - DNA, 25 bp, Mus musculus
agctgcaggtgagcgaccggttccc

SEQ ID NO: 279918 - DNA, 25 bp, Mus musculus
gggtcacctgaaacgcttccggcga

SEQ ID NO: 279919 - DNA, 25 bp, Mus musculus
gcacgcctctttcggcggacgggca

SEQ ID NO: 279920 - DNA, 25 bp, Mus musculus
aacgtggtcggccaccgactggcaa

SEQ ID NO: 279921 - DNA, 25 bp, Mus musculus
acttcactgcactgactggagggga

SEQ ID NO: 279922 - DNA, 25 bp, Mus musculus
ttccgacctggacttcactgcactg

SEQ ID NO: 279923 - DNA, 25 bp, Mus musculus
cacgcgtgaggaaacgcctatcctc

SEQ ID NO: 279924 - DNA, 25 bp, Mus musculus
cagcgctcgtcacgcgtgaggaaac

SEQ ID NO: 279925 - DNA, 25 bp, Mus musculus
aggacggctacagccaatcccgagc

SEQ ID NO: 279926 - DNA, 25 bp, Mus musculus
gaggtacgtgcaccgggacatcgcc

SEQ ID NO: 279927 - DNA, 25 bp, Mus musculus
cccgaggggtagtagccatcgccac

SEQ ID NO: 279928 - DNA, 25 bp, Mus musculus
agacttcgaagcttacctggtggcc

SEQ ID NO: 279929 - DNA, 25 bp, Mus musculus
ggtcatggacggtacgggtcaatcc

SEQ ID NO: 279930 - DNA, 25 bp, Mus musculus
tgtgaccttcctgcgtcgctcatcg

SEQ ID NO: 279931 - DNA, 25 bp, Mus musculus
cacccgcggacagcggcaccagcca

SEQ ID NO: 279932 - DNA, 25 bp, Mus musculus
cataagaaaaaacgagagcgatccg

SEQ ID NO: 279933 - DNA, 25 bp, Mus musculus
aagagcccgtgtgaccttcctgcgt

SEQ ID NO: 279934 - DNA, 25 bp, Mus musculus
gccatgttggaagagcccgtgtgac

SEQ ID NO: 279935 - DNA, 25 bp, Mus musculus
tgcgtcgctcatcgatcgcgtcatc

SEQ ID NO: 279936 - DNA, 25 bp, Mus musculus
ccgcacgtctgctcacccgcggaca

SEQ ID NO: 279937 - DNA, 25 bp, Mus musculus
cgagcgtccagaccccttatttctg

SEQ ID NO: 279938 - DNA, 25 bp, Mus musculus
tcatcgatcgcgtcatcggctgcgc

SEQ ID NO: 279939 - DNA, 25 bp, Mus musculus
gagatcttaaaagccgagcgtccag

SEQ ID NO: 279940 - DNA, 25 bp, Mus musculus
aaggagatcttaaaagccgagcgtc

SEQ ID NO: 279941 - DNA, 25 bp, Mus musculus
ctgaagagaaggagatcttaaaagc

SEQ ID NO: 279942 - DNA, 25 bp, Mus musculus
aacgagagcgatccgggactgaaga

SEQ ID NO: 279943 - DNA, 25 bp, Mus musculus
ggctgacccaatgaccgaaccctaa

SEQ ID NO: 279944 - DNA, 25 bp, Mus musculus
gagtccacaagcaagcagccagcgg

SEQ ID NO: 279945 - DNA, 25 bp, Mus musculus
agctctcgcgagaatatatctatgc

SEQ ID NO: 279946 - DNA, 25 bp, Mus musculus
tccttcccaagctctcgcgagaata

SEQ ID NO: 279947 - DNA, 25 bp, Mus musculus
ccgttgtggcacttgcagcggctcc

SEQ ID NO: 279948 - DNA, 25 bp, Mus musculus
tcctccgccgttgtggcacttgcag

SEQ ID NO: 279949 - DNA, 25 bp, Mus musculus
accggctctgtctctcggtcctccg

SEQ ID NO: 279950 - DNA, 25 bp, Mus musculus
gaatatatctatgcggcgagttgcc

SEQ ID NO: 279951 - DNA, 25 bp, Mus musculus
tggattgccttacccactttcggcc

SEQ ID NO: 279952 - DNA, 25 bp, Mus musculus
ggctgcgagtggattgccttaccca

SEQ ID NO: 279953 - DNA, 25 bp, Mus musculus
aaacgctcttggctcacactggtgc

SEQ ID NO: 279954 - DNA, 25 bp, Mus musculus
gggaaacgctcttggctcacactgg

SEQ ID NO: 279955 - DNA, 25 bp, Mus musculus
tcacactggtgctgatgggagccga

SEQ ID NO: 279956 - DNA, 25 bp, Mus musculus
actttcggcctctccggagctgggc

SEQ ID NO: 279957 - DNA, 25 bp, Mus musculus
aggagcggcttggagtccacaagca

SEQ ID NO: 279958 - DNA, 25 bp, Mus musculus
gcggctcctgcgacgccggcactgc

SEQ ID NO: 279959 - DNA, 25 bp, Mus musculus
tgcgcgagctcgacccgcccgtcat

SEQ ID NO: 279960 - DNA, 25 bp, Mus musculus
gtcatcgcccgctcccgtggcgtca

SEQ ID NO: 279961 - DNA, 25 bp, Mus musculus
tctctccgggagttgcgctctgtcc

SEQ ID NO: 279962 - DNA, 25 bp, Mus musculus
cctctctccgggagttgcgctctgt

SEQ ID NO: 279963 - DNA, 25 bp, Mus musculus
tcccacagcctctctccgggagttg

SEQ ID NO: 279964 - DNA, 25 bp, Mus musculus
cgggcccgcgcccatgcctcccaca

SEQ ID NO: 279965 - DNA, 25 bp, Mus musculus
tcccgtggcgtcaccgctcctgtcc

SEQ ID NO: 279966 - DNA, 25 bp, Mus musculus
ggccagcagcgtggcgctcagcacc

SEQ ID NO: 279967 - DNA, 25 bp, Mus musculus
ctcctgtcccgcaggggatggcggg

SEQ ID NO: 279968 - DNA, 25 bp, Mus musculus
gaccgggcgcgacgctcaagtcctg

SEQ ID NO: 279969 - DNA, 25 bp, Mus musculus
tggaccgggcgcgacgctcaagtcc

SEQ ID NO: 279970 - DNA, 25 bp, Mus musculus
ccgagctgcgctcttctgcccggcg

SEQ ID NO: 279971 - DNA, 25 bp, Mus musculus
gcgacgccggcactgcggtccaccc

SEQ ID NO: 279972 - DNA, 25 bp, Mus musculus
gcccggaggacagcgcctagagtcc

SEQ ID NO: 279973 - DNA, 25 bp, Mus musculus
tggcagcaagcaggaatactcactc

SEQ ID NO: 279974 - DNA, 25 bp, Mus musculus
acgcgcttcagctgcctgacttctg

SEQ ID NO: 279975 - DNA, 25 bp, Mus musculus
tgacttctgtcctcagctcttcaca

SEQ ID NO: 279976 - DNA, 25 bp, Mus musculus
gctcttcacaggacagccagcgtga

SEQ ID NO: 279977 - DNA, 25 bp, Mus musculus
agccagcgtgagcagtttctcatcc

SEQ ID NO: 279978 - DNA, 25 bp, Mus musculus
ccattctgaagtagcccggaggaca

SEQ ID NO: 279979 - DNA, 25 bp, Mus musculus
ctagagtccgcggtggatcgtccag

SEQ ID NO: 279980 - DNA, 25 bp, Mus musculus
tgaaaagctgatcaaggcagaggta

SEQ ID NO: 279981 - DNA, 25 bp, Mus musculus
ccaatggcagcaagcaggaatactc

SEQ ID NO: 279982 - DNA, 25 bp, Mus musculus
cataagggccatggcgagcagcagc

SEQ ID NO: 279983 - DNA, 25 bp, Mus musculus
gccacgttcataagggccatggcga

SEQ ID NO: 279984 - DNA, 25 bp, Mus musculus
ggcagaggtagagcgccacgttcat

SEQ ID NO: 279985 - DNA, 25 bp, Mus musculus
agcgtgagcagtttctcatccgccc

SEQ ID NO: 279986 - DNA, 25 bp, Mus musculus
cgagctgtcaaaagggcgcctttcg

SEQ ID NO: 279987 - DNA, 25 bp, Mus musculus
tcgtccataggggacgccgccgctt

SEQ ID NO: 279988 - DNA, 25 bp, Mus musculus
tcagaaacccgtcgtccatagggga

SEQ ID NO: 279989 - DNA, 25 bp, Mus musculus
agtccaggctcagaaacccgtcgtc

SEQ ID NO: 279990 - DNA, 25 bp, Mus musculus
tacaagacataggtgggcgagtcca

SEQ ID NO: 279991 - DNA, 25 bp, Mus musculus
gagggcgttacctgtacaagacata

SEQ ID NO: 279992 - DNA, 25 bp, Mus musculus
ccgcaggagggcgttacctgtacaa

SEQ ID NO: 279993 - DNA, 25 bp, Mus musculus
ctagcttcagaagagcgccgccgca

SEQ ID NO: 279994 - DNA, 25 bp, Mus musculus
gtcaccgcaccctagcttcagaaga

SEQ ID NO: 279995 - DNA, 25 bp, Mus musculus
gggaccacggaagtgtcaccgcacc

SEQ ID NO: 279996 - DNA, 25 bp, Mus musculus
cagcactgcgggaccacggaagtgt

SEQ ID NO: 279997 - DNA, 25 bp, Mus musculus
acggctctcagcagggcagcactgc

SEQ ID NO: 279998 - DNA, 25 bp, Mus musculus
cctttcggatgatgcacggctctca

SEQ ID NO: 279999 - DNA, 25 bp, Mus musculus
aaaagggcgcctttcggatgatgca

SEQ ID NO: 280000 - DNA, 25 bp, Mus musculus
tgctgaggaccgcactctacctgta

SEQ ID NO: 280001 - DNA, 25 bp, Mus musculus
tacctgtaagctcctgtcacactgc

SEQ ID NO: 280002 - DNA, 25 bp, Mus musculus
tttgcggcgtgcaccctgcctgcgg

SEQ ID NO: 280003 - DNA, 25 bp, Mus musculus
ggctttgcggcgtgcaccctgcctg

SEQ ID NO: 280004 - DNA, 25 bp, Mus musculus
atgtccatctgtgggcattgcggga

SEQ ID NO: 280005 - DNA, 25 bp, Mus musculus
cagcatgtccatctgtgggcattgc

SEQ ID NO: 280006 - DNA, 25 bp, Mus musculus
tgcagcatgtccatctgtgggcatt

SEQ ID NO: 280007 - DNA, 25 bp, Mus musculus
gtcacactgccgtcctcagcccagg

SEQ ID NO: 280008 - DNA, 25 bp, Mus musculus
tgtaagctcctgtcacactgccgtc

SEQ ID NO: 280009 - DNA, 25 bp, Mus musculus
aggaccgcactctacctgtaagctc

SEQ ID NO: 280010 - DNA, 25 bp, Mus musculus
aaggcgtgctgaggaccgcactcta

SEQ ID NO: 280011 - DNA, 25 bp, Mus musculus
cccgaaggcgtgctgaggaccgcac

SEQ ID NO: 280012 - DNA, 25 bp, Mus musculus
tgaggaccgcactctacctgtaagc

SEQ ID NO: 280013 - DNA, 25 bp, Mus musculus
gcactctacctgtaagctcctgtca

SEQ ID NO: 280014 - DNA, 25 bp, Mus musculus
gaagccgcctgtagtttgcacggga

SEQ ID NO: 280015 - DNA, 25 bp, Mus musculus
tccgcgaaaaggtggcggagctttc

SEQ ID NO: 280016 - DNA, 25 bp, Mus musculus
agtgagcaggctctcgcacagctcc

SEQ ID NO: 280017 - DNA, 25 bp, Mus musculus
gctccacagactccacgttaaacat

SEQ ID NO: 280018 - DNA, 25 bp, Mus musculus
taaacatcttcctggggtggccgca

SEQ ID NO: 280019 - DNA, 25 bp, Mus musculus
cagaccgggcgtctggcggaccttc

SEQ ID NO: 280020 - DNA, 25 bp, Mus musculus
gacgctggcaatcgctccgcactgt

SEQ ID NO: 280021 - DNA, 25 bp, Mus musculus
cgagtcccgaggtccgagggccact

SEQ ID NO: 280022 - DNA, 25 bp, Mus musculus
gctctggcttaagaagccgcctgta

SEQ ID NO: 280023 - DNA, 25 bp, Mus musculus
aatgagctctatgccgacccgccga

SEQ ID NO: 280024 - DNA, 25 bp, Mus musculus
accacgtacccaagtgagcaggctc

SEQ ID NO: 280025 - DNA, 25 bp, Mus musculus
ccagagtctccctccgggcgaaggt

SEQ ID NO: 280026 - DNA, 25 bp, Mus musculus
ccggtagttcctcggccgcgacgag

SEQ ID NO: 280027 - DNA, 25 bp, Mus musculus
tgacgccggcgctctggcttaagaa

SEQ ID NO: 280028 - DNA, 25 bp, Mus musculus
gcccgtctccttccacaagtaggta

SEQ ID NO: 280029 - DNA, 25 bp, Mus musculus
tcctgcaggctttcggacccaacag

SEQ ID NO: 280030 - DNA, 25 bp, Mus musculus
ggccgttctttatcaagctgcagca

SEQ ID NO: 280031 - DNA, 25 bp, Mus musculus
tgcagcagaaaacgccggacaaatt

SEQ ID NO: 280032 - DNA, 25 bp, Mus musculus
caccactacgagaacgactgcagtc

SEQ ID NO: 280033 - DNA, 25 bp, Mus musculus
ggatcccaaacaaacgcgctctctt

SEQ ID NO: 280034 - DNA, 25 bp, Mus musculus
tccctgggaacgttaccttcagcca

SEQ ID NO: 280035 - DNA, 25 bp, Mus musculus
atcagagacggcgagccgagtcctc

SEQ ID NO: 280036 - DNA, 25 bp, Mus musculus
cgacagctgtggtccttctgctaaa

SEQ ID NO: 280037 - DNA, 25 bp, Mus musculus
taactgctgaccgacgccaccgaga

SEQ ID NO: 280038 - DNA, 25 bp, Mus musculus
ccagaaggatggtgcagtcctgctc

SEQ ID NO: 280039 - DNA, 25 bp, Mus musculus
ggacgagctcttccacgttctcctg

SEQ ID NO: 280040 - DNA, 25 bp, Mus musculus
tacggctgcaagaaccgctacgaca

SEQ ID NO: 280041 - DNA, 25 bp, Mus musculus
caagtaggtaactggcgtgctccgc

SEQ ID NO: 280042 - DNA, 25 bp, Mus musculus
caggcagcctgtcagctctggctgg

SEQ ID NO: 280043 - DNA, 25 bp, Mus musculus
agagctctccgtcccactctgcctg

SEQ ID NO: 280044 - DNA, 25 bp, Mus musculus
ccgccagacagcagagctctccgtc

SEQ ID NO: 280045 - DNA, 25 bp, Mus musculus
gtcacagccgccagacagcagagct

SEQ ID NO: 280046 - DNA, 25 bp, Mus musculus
tgtcacagccgccagacagcagagc

SEQ ID NO: 280047 - DNA, 25 bp, Mus musculus
aggcaggtacccactgtcacagccg

SEQ ID NO: 280048 - DNA, 25 bp, Mus musculus
agcaggcaggtacccactgtcacag

SEQ ID NO: 280049 - DNA, 25 bp, Mus musculus
cccagcaaatctcctccgtgatttc

SEQ ID NO: 280050 - DNA, 25 bp, Mus musculus
aggccagcaggcaggtacccactgt

SEQ ID NO: 280051 - DNA, 25 bp, Mus musculus
taacaggcagcctgtcagctctggc

SEQ ID NO: 280052 - DNA, 25 bp, Mus musculus
cccactctgcctgccagcgccgccc

SEQ ID NO: 280053 - DNA, 25 bp, Mus musculus
ccaattaacaggcagcctgtcagct

SEQ ID NO: 280054 - DNA, 25 bp, Mus musculus
gccagcaggcaggtacccactgtca

SEQ ID NO: 280055 - DNA, 25 bp, Mus musculus
gagtgcatcacacgggcgccgagcc

SEQ ID NO: 280056 - DNA, 25 bp, Mus musculus
aggggctactcacagggccaactgc

SEQ ID NO: 280057 - DNA, 25 bp, Mus musculus
gccctttggagctgcgtgttttcta

SEQ ID NO: 280058 - DNA, 25 bp, Mus musculus
ccgactggatttgctcttatggtgc

SEQ ID NO: 280059 - DNA, 25 bp, Mus musculus
agtcctgtccaaagacggcttctgg

SEQ ID NO: 280060 - DNA, 25 bp, Mus musculus
cccgtctgtttaggggcacagtgca

SEQ ID NO: 280061 - DNA, 25 bp, Mus musculus
actcgggatcctgggtctttcttca

SEQ ID NO: 280062 - DNA, 25 bp, Mus musculus
ggccaactgcggctctgcctttaga

SEQ ID NO: 280063 - DNA, 25 bp, Mus musculus
ggggcgaatcaccatccggattaca

SEQ ID NO: 280064 - DNA, 25 bp, Mus musculus
ccggattacagagaagtcaccttta

SEQ ID NO: 280065 - DNA, 25 bp, Mus musculus
cgcccatgtcacactcggggactaa

SEQ ID NO: 280066 - DNA, 25 bp, Mus musculus
cggggactaacccacaaggcaagtg

SEQ ID NO: 280067 - DNA, 25 bp, Mus musculus
aggcaagtgtcattccgcccagcta

SEQ ID NO: 280068 - DNA, 25 bp, Mus musculus
gcgcgcttagtgagtctcccagtct

SEQ ID NO: 280069 - DNA, 25 bp, Mus musculus
tgcagacaaccaggcactcgggatc

SEQ ID NO: 280070 - DNA, 25 bp, Mus musculus
tgcacgctcggcatcgctgaggctc

SEQ ID NO: 280071 - DNA, 25 bp, Mus musculus
ctgcccacgggtccgagcggaagct

SEQ ID NO: 280072 - DNA, 25 bp, Mus musculus
cggctggagctgacgtcctgagccc

SEQ ID NO: 280073 - DNA, 25 bp, Mus musculus
actgatggcgtcatcgaagcgactg

SEQ ID NO: 280074 - DNA, 25 bp, Mus musculus
cgaacactgcggctcgcagcgcgag

SEQ ID NO: 280075 - DNA, 25 bp, Mus musculus
agccagtgtgccagctcgcgagcgt

SEQ ID NO: 280076 - DNA, 25 bp, Mus musculus
ccgcaagcctaggtgcgcagccagt

SEQ ID NO: 280077 - DNA, 25 bp, Mus musculus
cagcgcctcggaaggtgataccaga

SEQ ID NO: 280078 - DNA, 25 bp, Mus musculus
gaatctctagcaacctccgaagcca

SEQ ID NO: 280079 - DNA, 25 bp, Mus musculus
cttgaagcgaaggagaatctctagc

SEQ ID NO: 280080 - DNA, 25 bp, Mus musculus
gaaaagaaatccagctcggacttga

SEQ ID NO: 280081 - DNA, 25 bp, Mus musculus
gcatcgcattgatcccggctccgga

SEQ ID NO: 280082 - DNA, 25 bp, Mus musculus
agcggaagctctcggccgtgtctgc

SEQ ID NO: 280083 - DNA, 25 bp, Mus musculus
taccagagccttggtgtccggagcc

SEQ ID NO: 280084 - DNA, 25 bp, Mus musculus
cgtgaacgagcgagtccagcagagt

SEQ ID NO: 280085 - DNA, 25 bp, Mus musculus
gtgtccacccgcgatcacgtgcgtt

SEQ ID NO: 280086 - DNA, 25 bp, Mus musculus
accacggtactagagccctgggagg

SEQ ID NO: 280087 - DNA, 25 bp, Mus musculus
cgccattcgtcaccacggtactaga

SEQ ID NO: 280088 - DNA, 25 bp, Mus musculus
tcgccattcgtcattgccctcggta

SEQ ID NO: 280089 - DNA, 25 bp, Mus musculus
tgactcgtatccaggcgtctcgcca

SEQ ID NO: 280090 - DNA, 25 bp, Mus musculus
gttcatttagggcaagtgactcgta

SEQ ID NO: 280091 - DNA, 25 bp, Mus musculus
tttccatggcggtcggtctggcctt

SEQ ID NO: 280092 - DNA, 25 bp, Mus musculus
agcggcgattggacctctcaggaag

SEQ ID NO: 280093 - DNA, 25 bp, Mus musculus
cacctacgtgggacgaggtgtcacg

SEQ ID NO: 280094 - DNA, 25 bp, Mus musculus
ccgggcatcctcttgggaatgttga

SEQ ID NO: 280095 - DNA, 25 bp, Mus musculus
tctagctgcgcgtgaacttgacaca

SEQ ID NO: 280096 - DNA, 25 bp, Mus musculus
tcacggtgacgcagaaggggctccc

SEQ ID NO: 280097 - DNA, 25 bp, Mus musculus
gccaacctccgctggggaagtggct

SEQ ID NO: 280098 - DNA, 25 bp, Mus musculus
aacgcacgtcgtgtgatcctcacaa

SEQ ID NO: 280099 - DNA, 25 bp, Mus musculus
ttgagcaccggctgacgtcactgag

SEQ ID NO: 280100 - DNA, 25 bp, Mus musculus
gtctgcctgcagttgagcaccggct

SEQ ID NO: 280101 - DNA, 25 bp, Mus musculus
ggcccggacatttccggtctgcctg

SEQ ID NO: 280102 - DNA, 25 bp, Mus musculus
agccctcgctaggaggacaggatcc

SEQ ID NO: 280103 - DNA, 25 bp, Mus musculus
aaagcaagttggtcatcgggagccc

SEQ ID NO: 280104 - DNA, 25 bp, Mus musculus
tgatcctcacaatgcgggctgtgca

SEQ ID NO: 280105 - DNA, 25 bp, Mus musculus
tgtctttgaagaagcgacgctcatt

SEQ ID NO: 280106 - DNA, 25 bp, Mus musculus
acgctcattggttggcatggctgtc

SEQ ID NO: 280107 - DNA, 25 bp, Mus musculus
acgccgtctggacgtcgaggccaaa

SEQ ID NO: 280108 - DNA, 25 bp, Mus musculus
cgaggccaaagagtggcgctcttta

SEQ ID NO: 280109 - DNA, 25 bp, Mus musculus
tggcgctctttatagaacgcacgtc

SEQ ID NO: 280110 - DNA, 25 bp, Mus musculus
ctctgctattggtcagtgtctttga

SEQ ID NO: 280111 - DNA, 25 bp, Mus musculus
gtgcagccgcttacgtccagagaaa

SEQ ID NO: 280112 - DNA, 25 bp, Mus musculus
ccacaacccggctcgaaggagggtg

SEQ ID NO: 280113 - DNA, 25 bp, Mus musculus
accaagcttccgtcggctcggagcg

SEQ ID NO: 280114 - DNA, 25 bp, Mus musculus
gctcggagcgctgcgctgagactcc

SEQ ID NO: 280115 - DNA, 25 bp, Mus musculus
acgcgcagggaccaagcttccgtcg

SEQ ID NO: 280116 - DNA, 25 bp, Mus musculus
cccgaggcttgcctccgcccatggc

SEQ ID NO: 280117 - DNA, 25 bp, Mus musculus
ccgggactcccgctgagcactcctc

SEQ ID NO: 280118 - DNA, 25 bp, Mus musculus
ggatgccggtgcctcccgcgcgttt

SEQ ID NO: 280119 - DNA, 25 bp, Mus musculus
ttctgctcctggctcctggaactcg

SEQ ID NO: 280120 - DNA, 25 bp, Mus musculus
tcctggctcctggaactcggggtgc

SEQ ID NO: 280121 - DNA, 25 bp, Mus musculus
caagggactaagtggcggcgcccac

SEQ ID NO: 280122 - DNA, 25 bp, Mus musculus
gcagcaacaggagcccggcacgatc

SEQ ID NO: 280123 - DNA, 25 bp, Mus musculus
ccagatcccggccttctgccaaacg

SEQ ID NO: 280124 - DNA, 25 bp, Mus musculus
aggagcccggcacgatccgctaggt

SEQ ID NO: 280125 - DNA, 25 bp, Mus musculus
ccctatccgcggttgcaagtgctct

SEQ ID NO: 280126 - DNA, 25 bp, Mus musculus
agcgccagccgtgacaacctcaagg

SEQ ID NO: 280127 - DNA, 25 bp, Mus musculus
ggcagtgacacaagcgccgcgccaa

SEQ ID NO: 280128 - DNA, 25 bp, Mus musculus
agcccatgcttacgccgtcggaggg

SEQ ID NO: 280129 - DNA, 25 bp, Mus musculus
tcttccactcgagggtgagcccatg

SEQ ID NO: 280130 - DNA, 25 bp, Mus musculus
ccgcaacagtccaggcgacggtctt

SEQ ID NO: 280131 - DNA, 25 bp, Mus musculus
cgtctgacagctacccgggcagcag

SEQ ID NO: 280132 - DNA, 25 bp, Mus musculus
gtttgcacaacagcccgtctgacag

SEQ ID NO: 280133 - DNA, 25 bp, Mus musculus
tgagagcggcagtttgcacaacagc

SEQ ID NO: 280134 - DNA, 25 bp, Mus musculus
gagctcccgagctgttgtccagtga

SEQ ID NO: 280135 - DNA, 25 bp, Mus musculus
agactggtggtaagagccggctcaa

SEQ ID NO: 280136 - DNA, 25 bp, Mus musculus
tcatgggcgccgagtacacaagagt

SEQ ID NO: 280137 - DNA, 25 bp, Mus musculus
cggcaccataacaacctgcatcatg

SEQ ID NO: 280138 - DNA, 25 bp, Mus musculus
ccaatctgcaggtggcccagagtca

SEQ ID NO: 280139 - DNA, 25 bp, Mus musculus
atggagagccagagcccaccggctc

SEQ ID NO: 280140 - DNA, 25 bp, Mus musculus
tgcggtaccgccgtcaggcacaaac

SEQ ID NO: 280141 - DNA, 25 bp, Mus musculus
caggcacaaactcccagagaacttg

SEQ ID NO: 280142 - DNA, 25 bp, Mus musculus
agagaacttgtaactgggcagcggc

SEQ ID NO: 280143 - DNA, 25 bp, Mus musculus
caataaagtggaggggcgcttattc

SEQ ID NO: 280144 - DNA, 25 bp, Mus musculus
ttcggcatctcgtcggtcggtccag

SEQ ID NO: 280145 - DNA, 25 bp, Mus musculus
ccaatcggctggcagtttgctcctc

SEQ ID NO: 280146 - DNA, 25 bp, Mus musculus
cagcggcttccgttcggcatctcgt

SEQ ID NO: 280147 - DNA, 25 bp, Mus musculus
ggggcgcttattccggatgcaccat

SEQ ID NO: 280148 - DNA, 25 bp, Mus musculus
cctgaagttgccctcgtcgctaaag

SEQ ID NO: 280149 - DNA, 25 bp, Mus musculus
cacgagctcggaggagccgcaatcc

SEQ ID NO: 280150 - DNA, 25 bp, Mus musculus
taatgcgaatcttccacgagctcgg

SEQ ID NO: 280151 - DNA, 25 bp, Mus musculus
gctggctctgagaataatgcgaatc

SEQ ID NO: 280152 - DNA, 25 bp, Mus musculus
agtcggagcacaccagctggctctg

SEQ ID NO: 280153 - DNA, 25 bp, Mus musculus
cctcgtcgctaaaggtggtagttag

SEQ ID NO: 280154 - DNA, 25 bp, Mus musculus
ccatttcttctaacgggccgctgct

SEQ ID NO: 280155 - DNA, 25 bp, Mus musculus
tcatgatactccagaacctaggcgg

SEQ ID NO: 280156 - DNA, 25 bp, Mus musculus
ggcggggaccaagtttacactgcta

SEQ ID NO: 280157 - DNA, 25 bp, Mus musculus
ctgctagacgccgtttgaggcctca

SEQ ID NO: 280158 - DNA, 25 bp, Mus musculus
ctcagggcaaacctcgttttacgca

SEQ ID NO: 280159 - DNA, 25 bp, Mus musculus
acctcttggtttggtgcccatcgtc

SEQ ID NO: 280160 - DNA, 25 bp, Mus musculus
acgtctccctgtcgagctgggtttc

SEQ ID NO: 280161 - DNA, 25 bp, Mus musculus
gtggcgacccatcctacacacggga

SEQ ID NO: 280162 - DNA, 25 bp, Mus musculus
aggggacctgttgccatttcttcta

SEQ ID NO: 280163 - DNA, 25 bp, Mus musculus
tggaactgagttctgcacggctagc

SEQ ID NO: 280164 - DNA, 25 bp, Mus musculus
cccagacgctctggcgcaaacaaaa

SEQ ID NO: 280165 - DNA, 25 bp, Mus musculus
gtgaagctgattgtctcccagacgc

SEQ ID NO: 280166 - DNA, 25 bp, Mus musculus
ctgcgcccgtcttgcactgctaaag

SEQ ID NO: 280167 - DNA, 25 bp, Mus musculus
ttcccgaggcgcgactcatgatact

SEQ ID NO: 280168 - DNA, 25 bp, Mus musculus
ttatcgagaccgagcaacgcgcggt

SEQ ID NO: 280169 - DNA, 25 bp, Mus musculus
agccgctttaatgcttccggccacg

SEQ ID NO: 280170 - DNA, 25 bp, Mus musculus
gctccgacaccgacgtggcgtactt

SEQ ID NO: 280171 - DNA, 25 bp, Mus musculus
tagccgctgtcctcggtctggaccg

SEQ ID NO: 280172 - DNA, 25 bp, Mus musculus
gacgtggcgtacttctccttgccca

SEQ ID NO: 280173 - DNA, 25 bp, Mus musculus
gcgcggcccaggaacttatcgagac

SEQ ID NO: 280174 - DNA, 25 bp, Mus musculus
cctgcacgtgggtaggggaccacat

SEQ ID NO: 280175 - DNA, 25 bp, Mus musculus
gaggcagctcgaaggtggcttcctc

SEQ ID NO: 280176 - DNA, 25 bp, Mus musculus
gacgcggcaccaggctaggaagcca

SEQ ID NO: 280177 - DNA, 25 bp, Mus musculus
ctgtagcaccgtcacctgcacgtgg

SEQ ID NO: 280178 - DNA, 25 bp, Mus musculus
ggagccaagggccatcctcccatag

SEQ ID NO: 280179 - DNA, 25 bp, Mus musculus
atagcgcggtagctgccactctcgc

SEQ ID NO: 280180 - DNA, 25 bp, Mus musculus
gggccatcctcccatagcgcggtag

SEQ ID NO: 280181 - DNA, 25 bp, Mus musculus
aggaagccagaaggtagccgctgtc

SEQ ID NO: 280182 - DNA, 25 bp, Mus musculus
ccgctgtggagccacggcatctgct

SEQ ID NO: 280183 - DNA, 25 bp, Mus musculus
agctccgctgtggagccacggcatc

SEQ ID NO: 280184 - DNA, 25 bp, Mus musculus
tcggctgtgagctttgcagccctca

SEQ ID NO: 280185 - DNA, 25 bp, Mus musculus
ccaaagctccgctgtggagccacgg

SEQ ID NO: 280186 - DNA, 25 bp, Mus musculus
agccacggcatctgctgggctcgca

SEQ ID NO: 280187 - DNA, 25 bp, Mus musculus
tgtgagctttgcagccctcagcggt

SEQ ID NO: 280188 - DNA, 25 bp, Mus musculus
gctttgcagccctcagcggtctaga

SEQ ID NO: 280189 - DNA, 25 bp, Mus musculus
ttgcagccctcagcggtctagacgc

SEQ ID NO: 280190 - DNA, 25 bp, Mus musculus
cagcggtctagacgcgcctgaggca

SEQ ID NO: 280191 - DNA, 25 bp, Mus musculus
aggcagctggggacacaggtgactt

SEQ ID NO: 280192 - DNA, 25 bp, Mus musculus
acaggtgacttgagtggacggggca

SEQ ID NO: 280193 - DNA, 25 bp, Mus musculus
cgggcagccacccttggtagcagct

SEQ ID NO: 280194 - DNA, 25 bp, Mus musculus
cggcggaggtcgtagggatgctacc

SEQ ID NO: 280195 - DNA, 25 bp, Mus musculus
agccacccttggtagcagctcgcgg

SEQ ID NO: 280196 - DNA, 25 bp, Mus musculus
cagctgcggccagtgaagtcacgaa

SEQ ID NO: 280197 - DNA, 25 bp, Mus musculus
cacgttggttatggtctgtagtctc

SEQ ID NO: 280198 - DNA, 25 bp, Mus musculus
ggagtcccactaccaagtcagctgc

SEQ ID NO: 280199 - DNA, 25 bp, Mus musculus
tgacgtccacagttcgcaaccagtt

SEQ ID NO: 280200 - DNA, 25 bp, Mus musculus
cccagccagttcagggcgatgaaaa

SEQ ID NO: 280201 - DNA, 25 bp, Mus musculus
gcgatgaaaactccgctgggaacta

SEQ ID NO: 280202 - DNA, 25 bp, Mus musculus
acggccaccgtagctacacagaaga

SEQ ID NO: 280203 - DNA, 25 bp, Mus musculus
cactcgagcatagacgaagagcatc

SEQ ID NO: 280204 - DNA, 25 bp, Mus musculus
agtggcattcctgtgcctcggcatc

SEQ ID NO: 280205 - DNA, 25 bp, Mus musculus
accactggctcatgatgggcgcaaa

SEQ ID NO: 280206 - DNA, 25 bp, Mus musculus
gcagcggacacgatccacaccagga

SEQ ID NO: 280207 - DNA, 25 bp, Mus musculus
cacaaggtctcgatgctagcagtta

SEQ ID NO: 280208 - DNA, 25 bp, Mus musculus
ctagcagttacacagagcacgtcca

SEQ ID NO: 280209 - DNA, 25 bp, Mus musculus
ggcgcttagccacaacgaacactcg

SEQ ID NO: 280210 - DNA, 25 bp, Mus musculus
agaagggtcaccgtctcggttgctc

SEQ ID NO: 280211 - DNA, 25 bp, Mus musculus
aggatacgtcgggatccggagtctc

SEQ ID NO: 280212 - DNA, 25 bp, Mus musculus
tgtggtggagcgtggtctggaaccc

SEQ ID NO: 280213 - DNA, 25 bp, Mus musculus
agccctcggcgatggcgtgcagctc

SEQ ID NO: 280214 - DNA, 25 bp, Mus musculus
ctcccgcccggggactacagcacca

SEQ ID NO: 280215 - DNA, 25 bp, Mus musculus
tacagcaccactccgggcggcacgc

SEQ ID NO: 280216 - DNA, 25 bp, Mus musculus
ggcggcacgctcttcagcaccaccc

SEQ ID NO: 280217 - DNA, 25 bp, Mus musculus
atacgtcgggatccggagtctcacg

SEQ ID NO: 280218 - DNA, 25 bp, Mus musculus
cgggatccggagtctcacgtgcgac

SEQ ID NO: 280219 - DNA, 25 bp, Mus musculus
gggaaagcagaagggtcaccgtctc

SEQ ID NO: 280220 - DNA, 25 bp, Mus musculus
actcgccgcgtagccctcggcgatg

SEQ ID NO: 280221 - DNA, 25 bp, Mus musculus
gggtcaccgtctcggttgctcgcct

SEQ ID NO: 280222 - DNA, 25 bp, Mus musculus
cgtctcggttgctcgccttctgggt

SEQ ID NO: 280223 - DNA, 25 bp, Mus musculus
attcgaggggttcggtagctggcca

SEQ ID NO: 280224 - DNA, 25 bp, Mus musculus
ttgagttccacttttacccgcagtc

SEQ ID NO: 280225 - DNA, 25 bp, Mus musculus
caaggtttcgctcaactttgagttc

SEQ ID NO: 280226 - DNA, 25 bp, Mus musculus
cagcggcttccaggaaaccaaggtt

SEQ ID NO: 280227 - DNA, 25 bp, Mus musculus
actctgagtgagacagcggcttcca

SEQ ID NO: 280228 - DNA, 25 bp, Mus musculus
ggcgtctggcttgctaactctgagt

SEQ ID NO: 280229 - DNA, 25 bp, Mus musculus
ctggagaccgcatcgctaatgagcc

SEQ ID NO: 280230 - DNA, 25 bp, Mus musculus
gggactaccaaaccgagcctggaga

SEQ ID NO: 280231 - DNA, 25 bp, Mus musculus
ctacagcagcggaacagggatatca

SEQ ID NO: 280232 - DNA, 25 bp, Mus musculus
ttccacgccctggaagtccgcgagg

SEQ ID NO: 280233 - DNA, 25 bp, Mus musculus
tgctccgagctcctctcaggattcg

SEQ ID NO: 280234 - DNA, 25 bp, Mus musculus
gcagggagccaacgccagtaggttt

SEQ ID NO: 280235 - DNA, 25 bp, Mus musculus
gcgcggagagaagccagaacaactt

SEQ ID NO: 280236 - DNA, 25 bp, Mus musculus
gttcccactgagtcgggctacgcgc

SEQ ID NO: 280237 - DNA, 25 bp, Mus musculus
agagtcctagccatgggagccaccg

SEQ ID NO: 280238 - DNA, 25 bp, Mus musculus
tgttactaccgcgacagcagacgga

SEQ ID NO: 280239 - DNA, 25 bp, Mus musculus
aaaatagctgccatccacctgcgcg

SEQ ID NO: 280240 - DNA, 25 bp, Mus musculus
ccgcgaaagagccatgggcaccgga

SEQ ID NO: 280241 - DNA, 25 bp, Mus musculus
ggccacctcgggatctgagaccctt

SEQ ID NO: 280242 - DNA, 25 bp, Mus musculus
cccttgcgaccaggaggtagagaca

SEQ ID NO: 280243 - DNA, 25 bp, Mus musculus
caggttcacaggagcatcgccgcac

SEQ ID NO: 280244 - DNA, 25 bp, Mus musculus
gagcatcgccgcacgtctcgctgtg

SEQ ID NO: 280245 - DNA, 25 bp, Mus musculus
ggcgacagccacgaacctgttacta

SEQ ID NO: 280246 - DNA, 25 bp, Mus musculus
accgctgcgtgacacggtgtccctg

SEQ ID NO: 280247 - DNA, 25 bp, Mus musculus
tgggtgtcaccagcgcgcacaccga

SEQ ID NO: 280248 - DNA, 25 bp, Mus musculus
gcgcacaccgagaggaacctgcttc

SEQ ID NO: 280249 - DNA, 25 bp, Mus musculus
aacctgcttcgatgtgcgtgtcatg

SEQ ID NO: 280250 - DNA, 25 bp, Mus musculus
gcgtgtcatggcgtaaaaatagctg

SEQ ID NO: 280251 - DNA, 25 bp, Mus musculus
ttggcacaaggctaaggcgacagcc

SEQ ID NO: 280252 - DNA, 25 bp, Mus musculus
ttccagtggtgtaacggtgagtccc

SEQ ID NO: 280253 - DNA, 25 bp, Mus musculus
tcggtagggcttcgctccgaaaaga

SEQ ID NO: 280254 - DNA, 25 bp, Mus musculus
ttcattgatgcacccattccagtgg

SEQ ID NO: 280255 - DNA, 25 bp, Mus musculus
agctccaacaccttgcctcggtttg

SEQ ID NO: 280256 - DNA, 25 bp, Mus musculus
agttgcatctccatcccggcggtct

SEQ ID NO: 280257 - DNA, 25 bp, Mus musculus
cttgactccactcctccgggagttg

SEQ ID NO: 280258 - DNA, 25 bp, Mus musculus
gaaaagactttgcttcctcctctgc

SEQ ID NO: 280259 - DNA, 25 bp, Mus musculus
ttcgtgtcctggctactgccttctc

SEQ ID NO: 280260 - DNA, 25 bp, Mus musculus
ctgctcagcgcagtgggacccaagc

SEQ ID NO: 280261 - DNA, 25 bp, Mus musculus
agttttcggaatcccagcgcgcact

SEQ ID NO: 280262 - DNA, 25 bp, Mus musculus
agccgtgcggtgtcagttttcggaa

SEQ ID NO: 280263 - DNA, 25 bp, Mus musculus
ggttcaggtcctgagccgagtttcc

SEQ ID NO: 280264 - DNA, 25 bp, Mus musculus
ccggaagccgaccttgacttcattg

SEQ ID NO: 280265 - DNA, 25 bp, Mus musculus
tctgccctctttgttgctctgcaaa

SEQ ID NO: 280266 - DNA, 25 bp, Mus musculus
cgccggttgggcagtttaggactca

SEQ ID NO: 280267 - DNA, 25 bp, Mus musculus
ttcggattagctgatctccgcaccg

SEQ ID NO: 280268 - DNA, 25 bp, Mus musculus
aggcatcttcggattagctgatctc

SEQ ID NO: 280269 - DNA, 25 bp, Mus musculus
gtctaaggcatcttcggattagctg

SEQ ID NO: 280270 - DNA, 25 bp, Mus musculus
gcttgtctaaggcatcttcggatta

SEQ ID NO: 280271 - DNA, 25 bp, Mus musculus
tctgcggcttgtctaaggcatcttc

SEQ ID NO: 280272 - DNA, 25 bp, Mus musculus
agtttctcggcccagagcggtctgc

SEQ ID NO: 280273 - DNA, 25 bp, Mus musculus
ctccggtcctatttcctccctcgcg

SEQ ID NO: 280274 - DNA, 25 bp, Mus musculus
ttggaccaagcggttctttggccca

SEQ ID NO: 280275 - DNA, 25 bp, Mus musculus
gaccaagcggttctttggcccactg

SEQ ID NO: 280276 - DNA, 25 bp, Mus musculus
caagcggttctttggcccactgggc

SEQ ID NO: 280277 - DNA, 25 bp, Mus musculus
cccactgggcccgaccgcactgaag

SEQ ID NO: 280278 - DNA, 25 bp, Mus musculus
gaccgcactgaagccacgccctttt

SEQ ID NO: 280279 - DNA, 25 bp, Mus musculus
ccagagcggtctgcggcttgtctaa

SEQ ID NO: 280280 - DNA, 25 bp, Mus musculus
gtgcgactaggaatgaagctggaca

SEQ ID NO: 280281 - DNA, 25 bp, Mus musculus
aaagtcatcaggacagggcggcgca

SEQ ID NO: 280282 - DNA, 25 bp, Mus musculus
ggcggcgcaagaaatgcggctctta

SEQ ID NO: 280283 - DNA, 25 bp, Mus musculus
cggctcttaaagacctcggcgcttt

SEQ ID NO: 280284 - DNA, 25 bp, Mus musculus
agacctcggcgctttaatagaagcc

SEQ ID NO: 280285 - DNA, 25 bp, Mus musculus
cctcggcgctttaatagaagccgcc

SEQ ID NO: 280286 - DNA, 25 bp, Mus musculus
gtctcagccgcccaaagtcatcagg

SEQ ID NO: 280287 - DNA, 25 bp, Mus musculus
caagattctgaaccgtctcagccgc

SEQ ID NO: 280288 - DNA, 25 bp, Mus musculus
gccttctccaagattctgaaccgtc

SEQ ID NO: 280289 - DNA, 25 bp, Mus musculus
gaaccagccttctccaagattctga

SEQ ID NO: 280290 - DNA, 25 bp, Mus musculus
ctgctccctgcctgcagagggctct

SEQ ID NO: 280291 - DNA, 25 bp, Mus musculus
aagctggacagtgccgaagagaagt

SEQ ID NO: 280292 - DNA, 25 bp, Mus musculus
agccgcccaaagtcatcaggacagg

SEQ ID NO: 280293 - DNA, 25 bp, Mus musculus
actaggaatgaagctggacagtgcc

SEQ ID NO: 280294 - DNA, 25 bp, Mus musculus
ttaccgtcccatttctggccgtggc

SEQ ID NO: 280295 - DNA, 25 bp, Mus musculus
cactatcggaaatcggggctctgca

SEQ ID NO: 280296 - DNA, 25 bp, Mus musculus
acgcgcggggctttaatgctaatta

SEQ ID NO: 280297 - DNA, 25 bp, Mus musculus
tggggcttctttgtcctctctaacc

SEQ ID NO: 280298 - DNA, 25 bp, Mus musculus
atatcgtcttgtcctgcttgctgtg

SEQ ID NO: 280299 - DNA, 25 bp, Mus musculus
gccctaggagcgcacatatcgtctt

SEQ ID NO: 280300 - DNA, 25 bp, Mus musculus
gtctcagtgtcccagaagcccgtga

SEQ ID NO: 280301 - DNA, 25 bp, Mus musculus
gagccactaacctatcgcgagaacg

SEQ ID NO: 280302 - DNA, 25 bp, Mus musculus
gagccacttccggagagccactaac

SEQ ID NO: 280303 - DNA, 25 bp, Mus musculus
tcagctcgccgcattaggaaggacc

SEQ ID NO: 280304 - DNA, 25 bp, Mus musculus
gaggaaaactcacgtcgtccgactg

SEQ ID NO: 280305 - DNA, 25 bp, Mus musculus
aaatgccgcgcaaaacccagtggtg

SEQ ID NO: 280306 - DNA, 25 bp, Mus musculus
agcgtgcgggactgaatcctaaatg

SEQ ID NO: 280307 - DNA, 25 bp, Mus musculus
aagcctgaagccgtcagctctttta

SEQ ID NO: 280308 - DNA, 25 bp, Mus musculus
cccgtgaggggctcacctcgaaacg

SEQ ID NO: 280309 - DNA, 25 bp, Mus musculus
ctacggagcgcgttgaggcccaacc

SEQ ID NO: 280310 - DNA, 25 bp, Mus musculus
agctctgggacggtggttcgcaacc

SEQ ID NO: 280311 - DNA, 25 bp, Mus musculus
caagctcagcagaggagctctggga

SEQ ID NO: 280312 - DNA, 25 bp, Mus musculus
ggccgcccaagctcagcagaggagc

SEQ ID NO: 280313 - DNA, 25 bp, Mus musculus
tccggcttcatctccgcggccgccc

SEQ ID NO: 280314 - DNA, 25 bp, Mus musculus
ctgcagcgtgagcagtaccagttgg

SEQ ID NO: 280315 - DNA, 25 bp, Mus musculus
cgtcgctgcagcgtgagcagtacca

SEQ ID NO: 280316 - DNA, 25 bp, Mus musculus
gaagccaaagatgcctccgggcgcc

SEQ ID NO: 280317 - DNA, 25 bp, Mus musculus
tgggtcagtccctccaagcgagaga

SEQ ID NO: 280318 - DNA, 25 bp, Mus musculus
gcacccggacccacgcggacgagga

SEQ ID NO: 280319 - DNA, 25 bp, Mus musculus
ggcgacttacagaactcccccaaga

SEQ ID NO: 280320 - DNA, 25 bp, Mus musculus
cctccaagcgagagaggccacgtgc

SEQ ID NO: 280321 - DNA, 25 bp, Mus musculus
gtccgcgcagcgaagccaaagatgc

SEQ ID NO: 280322 - DNA, 25 bp, Mus musculus
caattgcccgcaagttggacgcagg

SEQ ID NO: 280323 - DNA, 25 bp, Mus musculus
gtcctagccggctctttttcaattg

SEQ ID NO: 280324 - DNA, 25 bp, Mus musculus
ggtctatgctcgcatctcccggcag

SEQ ID NO: 280325 - DNA, 25 bp, Mus musculus
aaggtgctcacagtccggtctatgc

SEQ ID NO: 280326 - DNA, 25 bp, Mus musculus
tcgctcccttacagcccgaagaggg

SEQ ID NO: 280327 - DNA, 25 bp, Mus musculus
cgcgacaagtttggtccaagggctt

SEQ ID NO: 280328 - DNA, 25 bp, Mus musculus
taaagatgagcgctctacgcggacc

SEQ ID NO: 280329 - DNA, 25 bp, Mus musculus
gcgctcagacatctcgctaaagatg

SEQ ID NO: 280330 - DNA, 25 bp, Mus musculus
tgcctctgccttctttgcgctcaga

SEQ ID NO: 280331 - DNA, 25 bp, Mus musculus
cgccaagagagctgcgcgaggacac

SEQ ID NO: 280332 - DNA, 25 bp, Mus musculus
acccgggaggaacggccagcaatct

SEQ ID NO: 280333 - DNA, 25 bp, Mus musculus
gaccaacgtggggtccgagatcaga

SEQ ID NO: 280334 - DNA, 25 bp, Mus musculus
ttcccgcttctctcgctagagggca

SEQ ID NO: 280335 - DNA, 25 bp, Mus musculus
cgcagccggtagagatcccgcaatc

SEQ ID NO: 280336 - DNA, 25 bp, Mus musculus
caccgccttggttgcgagagtgaca

SEQ ID NO: 280337 - DNA, 25 bp, Mus musculus
cgcacggtgagtagcgagtccttct

SEQ ID NO: 280338 - DNA, 25 bp, Mus musculus
gagtagcgagtccttcttcaagccc

SEQ ID NO: 280339 - DNA, 25 bp, Mus musculus
tgcaccttcaccagatagggcgcgg

SEQ ID NO: 280340 - DNA, 25 bp, Mus musculus
ggcgggtgcacctttccctcgatca

SEQ ID NO: 280341 - DNA, 25 bp, Mus musculus
gcgcgtcgccatctcatggtgtgag

SEQ ID NO: 280342 - DNA, 25 bp, Mus musculus
ccatctcatggtgtgaggtgcgtgc

SEQ ID NO: 280343 - DNA, 25 bp, Mus musculus
cgccttgtcggtgcggactctgcct

SEQ ID NO: 280344 - DNA, 25 bp, Mus musculus
agatgggtggaaccacagaaaggca

SEQ ID NO: 280345 - DNA, 25 bp, Mus musculus
aaagcctttgccaccgccttggttg

SEQ ID NO: 280346 - DNA, 25 bp, Mus musculus
acccgagccctgctgtcggggatgc

SEQ ID NO: 280347 - DNA, 25 bp, Mus musculus
tgctcggcggggaacagtcctttgt

SEQ ID NO: 280348 - DNA, 25 bp, Mus musculus
ggaacagtcctttgtgtggagtgct

SEQ ID NO: 280349 - DNA, 25 bp, Mus musculus
ccacagaaaggcaaagaggcgaatt

SEQ ID NO: 280350 - DNA, 25 bp, Mus musculus
ggtgagtcgcgggaaatcacaaccc

SEQ ID NO: 280351 - DNA, 25 bp, Mus musculus
catgctcagagctgacggccgctgg

SEQ ID NO: 280352 - DNA, 25 bp, Mus musculus
gccacctctcctgccggctctctcg

SEQ ID NO: 280353 - DNA, 25 bp, Mus musculus
cggtgacggagatgatgtgagtgtc

SEQ ID NO: 280354 - DNA, 25 bp, Mus musculus
gtgcacttctggtctggcgactgcc

SEQ ID NO: 280355 - DNA, 25 bp, Mus musculus
cgcgcagcacgcatgctcagagctg

SEQ ID NO: 280356 - DNA, 25 bp, Mus musculus
cgcctcggtgcacttctggtctggc

SEQ ID NO: 280357 - DNA, 25 bp, Mus musculus
gggaaatgtagtctcaacgcaggtg

SEQ ID NO: 280358 - DNA, 25 bp, Mus musculus
atgtagtctcaacgcaggtgcgggt

SEQ ID NO: 280359 - DNA, 25 bp, Mus musculus
gagtcgcgggaaatcacaaccctcc

SEQ ID NO: 280360 - DNA, 25 bp, Mus musculus
ccggctctctcgcacgccgggtccc

SEQ ID NO: 280361 - DNA, 25 bp, Mus musculus
ccgtctttccgctagcgcggctggg

SEQ ID NO: 280362 - DNA, 25 bp, Mus musculus
tcgggccggtgcccgaatccaggca

SEQ ID NO: 280363 - DNA, 25 bp, Mus musculus
tgcccttccctgcactccgcccgcg

SEQ ID NO: 280364 - DNA, 25 bp, Mus musculus
tcgcccggcgaagcggctcacgaga

SEQ ID NO: 280365 - DNA, 25 bp, Mus musculus
cgcggaccatcccaggtaggggaga

SEQ ID NO: 280366 - DNA, 25 bp, Mus musculus
tgcaaagagccagtggacgcccgcc

SEQ ID NO: 280367 - DNA, 25 bp, Mus musculus
tcgctgcaaagagccagtggacgcc

SEQ ID NO: 280368 - DNA, 25 bp, Mus musculus
cgcggcctcgctgcaaagagccagt

SEQ ID NO: 280369 - DNA, 25 bp, Mus musculus
ccggacgatgtccttgggctccggc

SEQ ID NO: 280370 - DNA, 25 bp, Mus musculus
ctgcccggacgatgtccttgggctc

SEQ ID NO: 280371 - DNA, 25 bp, Mus musculus
gcgtcctgcccggacgatgtccttg

SEQ ID NO: 280372 - DNA, 25 bp, Mus musculus
atgcgggctccgagggcctcactga

SEQ ID NO: 280373 - DNA, 25 bp, Mus musculus
gttctactcggtgctcacctcagcg

SEQ ID NO: 280374 - DNA, 25 bp, Mus musculus
aggccgcgttctactcggtgctcac

SEQ ID NO: 280375 - DNA, 25 bp, Mus musculus
aagaaggtgtgaggccgcgttctac

SEQ ID NO: 280376 - DNA, 25 bp, Mus musculus
ccgccctggcgctctgtggaagaag

SEQ ID NO: 280377 - DNA, 25 bp, Mus musculus
ggatttcctccccagcgtcgagtgc

SEQ ID NO: 280378 - DNA, 25 bp, Mus musculus
tgaacgagaaccaagtgcggacgct

SEQ ID NO: 280379 - DNA, 25 bp, Mus musculus
atgccggggcgatgacggaaacccg

SEQ ID NO: 280380 - DNA, 25 bp, Mus musculus
tctgcgctccgagccgtaagccctt

SEQ ID NO: 280381 - DNA, 25 bp, Mus musculus
taagcagctgaacgagaaccaagtg

SEQ ID NO: 280382 - DNA, 25 bp, Mus musculus
cactcgccttttcccggcggaaatg

SEQ ID NO: 280383 - DNA, 25 bp, Mus musculus
accaagtgcggacgctgtgcgagaa

SEQ ID NO: 280384 - DNA, 25 bp, Mus musculus
ccgaaaaccaggctgctgcagtccc

SEQ ID NO: 280385 - DNA, 25 bp, Mus musculus
gggctccacggacaactgccctgaa

SEQ ID NO: 280386 - DNA, 25 bp, Mus musculus
cggacaactgccctgaaagtcgtta

SEQ ID NO: 280387 - DNA, 25 bp, Mus musculus
ctgccctgaaagtcgttaacaccga

SEQ ID NO: 280388 - DNA, 25 bp, Mus musculus
tgaaagtcgttaacaccgagcggtg

SEQ ID NO: 280389 - DNA, 25 bp, Mus musculus
cgttaacaccgagcggtggttagtg

SEQ ID NO: 280390 - DNA, 25 bp, Mus musculus
gtcgatcgctcgcaggtgatccacg

SEQ ID NO: 280391 - DNA, 25 bp, Mus musculus
ctgaacgagtgtaagcagctgaacg

SEQ ID NO: 280392 - DNA, 25 bp, Mus musculus
gagctccagacacaagagagggaga

SEQ ID NO: 280393 - DNA, 25 bp, Mus musculus
tctggggattgtagtcaaaagcgcg

SEQ ID NO: 280394 - DNA, 25 bp, Mus musculus
ttgtagtcaaaagcgcgcggaggtc

SEQ ID NO: 280395 - DNA, 25 bp, Mus musculus
cgctcaggtgacaacactccagctg

SEQ ID NO: 280396 - DNA, 25 bp, Mus musculus
tgacaacactccagctgggagcacc

SEQ ID NO: 280397 - DNA, 25 bp, Mus musculus
actccagctgggagcaccgagagga

SEQ ID NO: 280398 - DNA, 25 bp, Mus musculus
aaggcaacacttaccgagactcggg

SEQ ID NO: 280399 - DNA, 25 bp, Mus musculus
gccggagctccagacacaagagagg

SEQ ID NO: 280400 - DNA, 25 bp, Mus musculus
agaaaaggcccacgacgccacgaga

SEQ ID NO: 280401 - DNA, 25 bp, Mus musculus
acgccacgagaagccatggcgcgga

SEQ ID NO: 280402 - DNA, 25 bp, Mus musculus
gcccggatgcgattgctcagacggc

SEQ ID NO: 280403 - DNA, 25 bp, Mus musculus
cgattgctcagacggcgcgggtcat

SEQ ID NO: 280404 - DNA, 25 bp, Mus musculus
gcgggtcatctccttcggctgggac

SEQ ID NO: 280405 - DNA, 25 bp, Mus musculus
acttaccgagactcgggatcccgcg

SEQ ID NO: 280406 - DNA, 25 bp, Mus musculus
cacttgcgtgagtaccggggccctc

SEQ ID NO: 280407 - DNA, 25 bp, Mus musculus
cgttctcgccctcggtccacgcgct

SEQ ID NO: 280408 - DNA, 25 bp, Mus musculus
ccctcgggcgcggtgcttagtcacg

SEQ ID NO: 280409 - DNA, 25 bp, Mus musculus
ggtgcttagtcacggcgacgctgca

SEQ ID NO: 280410 - DNA, 25 bp, Mus musculus
cgcacttccgcgcatggcgctgctg

SEQ ID NO: 280411 - DNA, 25 bp, Mus musculus
tcacctgcgccatggcgagtcccgg

SEQ ID NO: 280412 - DNA, 25 bp, Mus musculus
acctcttccttcgactacctggtga

SEQ ID NO: 280413 - DNA, 25 bp, Mus musculus
gccgcgccggctgcgcgctttctcc

SEQ ID NO: 280414 - DNA, 25 bp, Mus musculus
ttccttcgactacctggtgatcggc

SEQ ID NO: 280415 - DNA, 25 bp, Mus musculus
caggcccgggatcccaagaagtggc

SEQ ID NO: 280416 - DNA, 25 bp, Mus musculus
cttcgactacctggtgatcggcggc

SEQ ID NO: 280417 - DNA, 25 bp, Mus musculus
actacctggtgatcggcggcggctc

SEQ ID NO: 280418 - DNA, 25 bp, Mus musculus
gagagtcacaagctgggtggcactt

SEQ ID NO: 280419 - DNA, 25 bp, Mus musculus
cacaagctgggtggcacttgcgtga

SEQ ID NO: 280420 - DNA, 25 bp, Mus musculus
aggtattttcccgatcgaactctgc

SEQ ID NO: 280421 - DNA, 25 bp, Mus musculus
gctaccggcagcctttgagcgcgct

SEQ ID NO: 280422 - DNA, 25 bp, Mus musculus
ctctgcgctccgttttcctgatgtg

SEQ ID NO: 280423 - DNA, 25 bp, Mus musculus
cgctccggtcgtcatggaaactcgg

SEQ ID NO: 280424 - DNA, 25 bp, Mus musculus
ttcggaggagtcgagaggtattttc

SEQ ID NO: 280425 - DNA, 25 bp, Mus musculus
tcccgactggcttttctaatgctgc

SEQ ID NO: 280426 - DNA, 25 bp, Mus musculus
ggtgccgaccgcttcttggccacaa

SEQ ID NO: 280427 - DNA, 25 bp, Mus musculus
catacagcaaactttcgggttggaa

SEQ ID NO: 280428 - DNA, 25 bp, Mus musculus
gccggacgtccatacagcaaacttt

SEQ ID NO: 280429 - DNA, 25 bp, Mus musculus
agcattgtcttttaggccggacgtc

SEQ ID NO: 280430 - DNA, 25 bp, Mus musculus
cccgaagcgggacgcgtcttccgag

SEQ ID NO: 280431 - DNA, 25 bp, Mus musculus
acgccgtgacgcaggcgccttttcg

SEQ ID NO: 280432 - DNA, 25 bp, Mus musculus
agccgagctcatccctgtgtggagt

SEQ ID NO: 280433 - DNA, 25 bp, Mus musculus
ttttcctgatgtgctccggtactcg

SEQ ID NO: 280434 - DNA, 25 bp, Mus musculus
gattggaaacccgtgccgtcagtca

SEQ ID NO: 280435 - DNA, 25 bp, Mus musculus
ttgtagttacttccctcctcgcgcg

SEQ ID NO: 280436 - DNA, 25 bp, Mus musculus
aggcacatcctgtctggcgcagaaa

SEQ ID NO: 280437 - DNA, 25 bp, Mus musculus
ctaggcatgctaggagtcgtaattc

SEQ ID NO: 280438 - DNA, 25 bp, Mus musculus
ccgtcagtcacggtgccattcggta

SEQ ID NO: 280439 - DNA, 25 bp, Mus musculus
cgaagcttcctgactggactgcatc

SEQ ID NO: 280440 - DNA, 25 bp, Mus musculus
cggggcttcctaccatctcatgtca

SEQ ID NO: 280441 - DNA, 25 bp, Mus musculus
ggccttgcctcagctcctttattca

SEQ ID NO: 280442 - DNA, 25 bp, Mus musculus
cgtgcctcagctgcagacagtgatt

SEQ ID NO: 280443 - DNA, 25 bp, Mus musculus
gggcggctacatcactgcgtttgtt

SEQ ID NO: 280444 - DNA, 25 bp, Mus musculus
cggaagtctctctcctgttgtctca

SEQ ID NO: 280445 - DNA, 25 bp, Mus musculus
tccgcgttctgactcctgtgacgtc

SEQ ID NO: 280446 - DNA, 25 bp, Mus musculus
cgcccactgacgtagactttgacgc

SEQ ID NO: 280447 - DNA, 25 bp, Mus musculus
cccgcgaggtttttctctgattggc

SEQ ID NO: 280448 - DNA, 25 bp, Mus musculus
gctttctctcgccttcctcgatccg

SEQ ID NO: 280449 - DNA, 25 bp, Mus musculus
gcctcgctcggggtgttctccttct

SEQ ID NO: 280450 - DNA, 25 bp, Mus musculus
ggtgttctccttctcggctttgccg

SEQ ID NO: 280451 - DNA, 25 bp, Mus musculus
gggccgcaagcagcgcgctttctct

SEQ ID NO: 280452 - DNA, 25 bp, Mus musculus
ctcgatccgaatccaccacatggag

SEQ ID NO: 280453 - DNA, 25 bp, Mus musculus
acgcagcccagagagacgcggatcg

SEQ ID NO: 280454 - DNA, 25 bp, Mus musculus
cacatggactggagcgcgctacttt

SEQ ID NO: 280455 - DNA, 25 bp, Mus musculus
gagcgcgctacttttgtttgcttgc

SEQ ID NO: 280456 - DNA, 25 bp, Mus musculus
gtttgcttgcttttcacgacgggtg

SEQ ID NO: 280457 - DNA, 25 bp, Mus musculus
ttcacgacgggtgtgcacccaaacc

SEQ ID NO: 280458 - DNA, 25 bp, Mus musculus
gcaatacccgccgagactcggttct

SEQ ID NO: 280459 - DNA, 25 bp, Mus musculus
gagactcggttcttcccgggcagaa

SEQ ID NO: 280460 - DNA, 25 bp, Mus musculus
gctcagagccgaggacaagcctttc

SEQ ID NO: 280461 - DNA, 25 bp, Mus musculus
tgccgccgccgttcatcttcccggt

SEQ ID NO: 280462 - DNA, 25 bp, Mus musculus
gaggctgcggacattttgctgctga

SEQ ID NO: 280463 - DNA, 25 bp, Mus musculus
cgtcatttcaggtccgcagtccggt

SEQ ID NO: 280464 - DNA, 25 bp, Mus musculus
cggcgtcaagccgtccgtcatttca

SEQ ID NO: 280465 - DNA, 25 bp, Mus musculus
cattcattcccgacggcttggcggc

SEQ ID NO: 280466 - DNA, 25 bp, Mus musculus
gtgctcattcattcccgacggcttg

SEQ ID NO: 280467 - DNA, 25 bp, Mus musculus
aaggtgaaaggcctgcgtgctcatt

SEQ ID NO: 280468 - DNA, 25 bp, Mus musculus
gcccggcgagataggaaaacaaaca

SEQ ID NO: 280469 - DNA, 25 bp, Mus musculus
aggaaaaaggcagcccggcgagata

SEQ ID NO: 280470 - DNA, 25 bp, Mus musculus
cggacattttgctgctgaagcgagc

SEQ ID NO: 280471 - DNA, 25 bp, Mus musculus
cttccgctcggcaggtgacagccgt

SEQ ID NO: 280472 - DNA, 25 bp, Mus musculus
ggcctcttacttccgctcggcaggt

SEQ ID NO: 280473 - DNA, 25 bp, Mus musculus
ggtgtgcgtccaccggaagttccgc

SEQ ID NO: 280474 - DNA, 25 bp, Mus musculus
gcacccggagccgtttggatttgtg

SEQ ID NO: 280475 - DNA, 25 bp, Mus musculus
aagttccgcgcacgggcctcttact

SEQ ID NO: 280476 - DNA, 25 bp, Mus musculus
tgcatgggattgcagagcctggcac

SEQ ID NO: 280477 - DNA, 25 bp, Mus musculus
gacggtgcagccaccgctgagcagc

SEQ ID NO: 280478 - DNA, 25 bp, Mus musculus
cccacggacgccaggtatgggatta

SEQ ID NO: 280479 - DNA, 25 bp, Mus musculus
ccaggtatgggattatggagccatc

SEQ ID NO: 280480 - DNA, 25 bp, Mus musculus
tatggagccatccacctatacaccg

SEQ ID NO: 280481 - DNA, 25 bp, Mus musculus
cacgccgcgaccagaaacgggttct

SEQ ID NO: 280482 - DNA, 25 bp, Mus musculus
tgttaacacgtacctcttttgcgtc

SEQ ID NO: 280483 - DNA, 25 bp, Mus musculus
ttttgcgtcttctccgccatcgtca

SEQ ID NO: 280484 - DNA, 25 bp, Mus musculus
ccgggtctcaggaagagctgagatc

SEQ ID NO: 280485 - DNA, 25 bp, Mus musculus
ctgagatcgatttttgcagcctggc

SEQ ID NO: 280486 - DNA, 25 bp, Mus musculus
agcgatgatctctgcatgggattgc

SEQ ID NO: 280487 - DNA, 25 bp, Mus musculus
gggcctgagagacccgccttctgct

SEQ ID NO: 280488 - DNA, 25 bp, Mus musculus
ttctgctttccaggttcgcgcttgc

SEQ ID NO: 280489 - DNA, 25 bp, Mus musculus
ttgcagcctggctagagcgatgatc

SEQ ID NO: 280490 - DNA, 25 bp, Mus musculus
cgatcgcagccctcaatgtctctgg

SEQ ID NO: 280491 - DNA, 25 bp, Mus musculus
ttgcgggatcgcctcactttctgcc

SEQ ID NO: 280492 - DNA, 25 bp, Mus musculus
tgtctttgcgggatcgcctcacttt

SEQ ID NO: 280493 - DNA, 25 bp, Mus musculus
tcgtgaagatgcgggcgatgtcttt

SEQ ID NO: 280494 - DNA, 25 bp, Mus musculus
ctcgagaagagagcgtgcggagctc

SEQ ID NO: 280495 - DNA, 25 bp, Mus musculus
ggcggccagacaacacccggaagtg

SEQ ID NO: 280496 - DNA, 25 bp, Mus musculus
atggcggtgacgtcgctcctggctc

SEQ ID NO: 280497 - DNA, 25 bp, Mus musculus
tttgatgcccgccatggcggtgacg

SEQ ID NO: 280498 - DNA, 25 bp, Mus musculus
aaactcgcgcagaccgcgtcggtgg

SEQ ID NO: 280499 - DNA, 25 bp, Mus musculus
cctcaatgtctctgggtgcaaactc

SEQ ID NO: 280500 - DNA, 25 bp, Mus musculus
cgtgcctcgggtgggaaaccacact

SEQ ID NO: 280501 - DNA, 25 bp, Mus musculus
tctgggtgcaaactcgcgcagaccg

SEQ ID NO: 280502 - DNA, 25 bp, Mus musculus
aaccacactggtttgccgtgccggg

SEQ ID NO: 280503 - DNA, 25 bp, Mus musculus
actggtttgccgtgccgggcattcc

SEQ ID NO: 280504 - DNA, 25 bp, Mus musculus
cagtgacgtcagattggcgcaggac

SEQ ID NO: 280505 - DNA, 25 bp, Mus musculus
ttccggaacatttgagcactcgcta

SEQ ID NO: 280506 - DNA, 25 bp, Mus musculus
tgagcactcgctagggtaccacggt

SEQ ID NO: 280507 - DNA, 25 bp, Mus musculus
gaacgaccctggtgagtgccgccct

SEQ ID NO: 280508 - DNA, 25 bp, Mus musculus
ggtaccacggtactgacaagtcaga

SEQ ID NO: 280509 - DNA, 25 bp, Mus musculus
ctgacaagtcagaaggtgtctgccc

SEQ ID NO: 280510 - DNA, 25 bp, Mus musculus
gcccacaaggcggtgccacgctagg

SEQ ID NO: 280511 - DNA, 25 bp, Mus musculus
gtaacgtcgcgtcttgctgctgtca

SEQ ID NO: 280512 - DNA, 25 bp, Mus musculus
agtcacggacgcctacgtgccgcag

SEQ ID NO: 280513 - DNA, 25 bp, Mus musculus
ttggcgcaggacaaagtaacgtcgc

SEQ ID NO: 280514 - DNA, 25 bp, Mus musculus
tgttgctcctgctgtcactcctgct

SEQ ID NO: 280515 - DNA, 25 bp, Mus musculus
cttttatggtgggttcctgtggtcg

SEQ ID NO: 280516 - DNA, 25 bp, Mus musculus
ctgctgtcaggtggtcccttttatg

SEQ ID NO: 280517 - DNA, 25 bp, Mus musculus
gggccgaacgcgaccagtcacggac

SEQ ID NO: 280518 - DNA, 25 bp, Mus musculus
tccgcacgcgtcttggagtttccgt

SEQ ID NO: 280519 - DNA, 25 bp, Mus musculus
ctcggtgaacgtgcgctgcaatacc

SEQ ID NO: 280520 - DNA, 25 bp, Mus musculus
ctgcaataccatcgtgcggcggagg

SEQ ID NO: 280521 - DNA, 25 bp, Mus musculus
tgcagacctggggagctatctcttt

SEQ ID NO: 280522 - DNA, 25 bp, Mus musculus
tctcaggagttcatacacatcggtc

SEQ ID NO: 280523 - DNA, 25 bp, Mus musculus
tgagaacgcgctcttaggtcccacg

SEQ ID NO: 280524 - DNA, 25 bp, Mus musculus
tttacgcgaacggttctggcctgga

SEQ ID NO: 280525 - DNA, 25 bp, Mus musculus
tgtctttgtgcgtgtcagtgtgaac

SEQ ID NO: 280526 - DNA, 25 bp, Mus musculus
gcctctactcggctgtcatcgtcta

SEQ ID NO: 280527 - DNA, 25 bp, Mus musculus
gagcgcacggacatctgcctgctta

SEQ ID NO: 280528 - DNA, 25 bp, Mus musculus
agcttactgcgttttgccggcgaca

SEQ ID NO: 280529 - DNA, 25 bp, Mus musculus
tgcagcgtgctcaaaaggctgatga

SEQ ID NO: 280530 - DNA, 25 bp, Mus musculus
ttctggctcacagcgcgggctacat

SEQ ID NO: 280531 - DNA, 25 bp, Mus musculus
tgcgcagcccagcttcaagtactga

SEQ ID NO: 280532 - DNA, 25 bp, Mus musculus
gacgacgcggagttgttcccgccgc

SEQ ID NO: 280533 - DNA, 25 bp, Mus musculus
tggcattcacgttcgcggcgtccac

SEQ ID NO: 280534 - DNA, 25 bp, Mus musculus
ggccatgtccttggcattcacgttc

SEQ ID NO: 280535 - DNA, 25 bp, Mus musculus
cccggctcccaaagttgccgtggag

SEQ ID NO: 280536 - DNA, 25 bp, Mus musculus
tcgggactctccgctaagctcgagc

SEQ ID NO: 280537 - DNA, 25 bp, Mus musculus
atgatgctgagagcgacgcgacgcc

SEQ ID NO: 280538 - DNA, 25 bp, Mus musculus
gagagcgacgcgacgccgccatctt

SEQ ID NO: 280539 - DNA, 25 bp, Mus musculus
cgtactgtcactgcggcaacggcgc

SEQ ID NO: 280540 - DNA, 25 bp, Mus musculus
ctcacttccggattctggaccaatc

SEQ ID NO: 280541 - DNA, 25 bp, Mus musculus
cggattctggaccaatcgggatcca

SEQ ID NO: 280542 - DNA, 25 bp, Mus musculus
tcgggatccaacatacccggaaatg

SEQ ID NO: 280543 - DNA, 25 bp, Mus musculus
cccggaaatgattcctgccgaagtg

SEQ ID NO: 280544 - DNA, 25 bp, Mus musculus
attcctgccgaagtgggtggagtcc

SEQ ID NO: 280545 - DNA, 25 bp, Mus musculus
aagttgccgtggagccaactccggc

SEQ ID NO: 280546 - DNA, 25 bp, Mus musculus
ggtcccgccctgatgtgataacttg

SEQ ID NO: 280547 - DNA, 25 bp, Mus musculus
cgctgtgtcgtctcgggtctcggaa

SEQ ID NO: 280548 - DNA, 25 bp, Mus musculus
tcaggctctcccatgaggccagcga

SEQ ID NO: 280549 - DNA, 25 bp, Mus musculus
caatgggctcgaggcgagctccacc

SEQ ID NO: 280550 - DNA, 25 bp, Mus musculus
tcccatgaggccagcgagcagcggc

SEQ ID NO: 280551 - DNA, 25 bp, Mus musculus
ctgatgtgataacttgggctcctcc

SEQ ID NO: 280552 - DNA, 25 bp, Mus musculus
tcgtctccgggaactaagcccaggc

SEQ ID NO: 280553 - DNA, 25 bp, Mus musculus
cccgacgctcacgtagttcagtggc

SEQ ID NO: 280554 - DNA, 25 bp, Mus musculus
ctcacgtagttcagtggcagcaatc

SEQ ID NO: 280555 - DNA, 25 bp, Mus musculus
agttcagtggcagcaatcaaccctg

SEQ ID NO: 280556 - DNA, 25 bp, Mus musculus
tggcagcaatcaaccctgacacttc

SEQ ID NO: 280557 - DNA, 25 bp, Mus musculus
aatcaaccctgacacttctctcagg

SEQ ID NO: 280558 - DNA, 25 bp, Mus musculus
acttctctcaggctctcccatgagg

SEQ ID NO: 280559 - DNA, 25 bp, Mus musculus
tcgtctcgggtctcggaaggcaatg

SEQ ID NO: 280560 - DNA, 25 bp, Mus musculus
gcgacagaatttagcatctcgctca

SEQ ID NO: 280561 - DNA, 25 bp, Mus musculus
cagaagtccggggatcatctcctga

SEQ ID NO: 280562 - DNA, 25 bp, Mus musculus
atctcctgatcttgcccatgccgtg

SEQ ID NO: 280563 - DNA, 25 bp, Mus musculus
ccatgccgtgaggaagtagcaaatc

SEQ ID NO: 280564 - DNA, 25 bp, Mus musculus
aatcacttagaaagccggtcgtggc

SEQ ID NO: 280565 - DNA, 25 bp, Mus musculus
tcctctcgggaacagatgcacctcg

SEQ ID NO: 280566 - DNA, 25 bp, Mus musculus
gaagacacgggctgtccgagcaccc

SEQ ID NO: 280567 - DNA, 25 bp, Mus musculus
tggagagaacccagccaatcagcgc

SEQ ID NO: 280568 - DNA, 25 bp, Mus musculus
cgcgccgaatgtttacgcggaattc

SEQ ID NO: 280569 - DNA, 25 bp, Mus musculus
acgcggaattctcactcggaacttc

SEQ ID NO: 280570 - DNA, 25 bp, Mus musculus
cgcggcgctagccaacactaattca

SEQ ID NO: 280571 - DNA, 25 bp, Mus musculus
gtagcccgcaggttcgaaaatggtg

SEQ ID NO: 280572 - DNA, 25 bp, Mus musculus
gacgcctcctacttccgggagcgtg

SEQ ID NO: 280573 - DNA, 25 bp, Mus musculus
gacgctcactgtcggtccaccgaga

SEQ ID NO: 280574 - DNA, 25 bp, Mus musculus
ccatggctggccaggacagtggcaa

SEQ ID NO: 280575 - DNA, 25 bp, Mus musculus
ttggtcttgcgcaggaaccgttttg

SEQ ID NO: 280576 - DNA, 25 bp, Mus musculus
ggcagccttcgcgtcttggtcttgc

SEQ ID NO: 280577 - DNA, 25 bp, Mus musculus
caacggcctcgaggatgtgcctgaa

SEQ ID NO: 280578 - DNA, 25 bp, Mus musculus
ctgaacctggggaacaacggcctcg

SEQ ID NO: 280579 - DNA, 25 bp, Mus musculus
tcggggacattgaggtgctgaacct

SEQ ID NO: 280580 - DNA, 25 bp, Mus musculus
gctgccggccaacatcggggacatt

SEQ ID NO: 280581 - DNA, 25 bp, Mus musculus
gacagtggcaacctgaagacggtga

SEQ ID NO: 280582 - DNA, 25 bp, Mus musculus
cccaggagcacggagaatgcgagcc

SEQ ID NO: 280583 - DNA, 25 bp, Mus musculus
tcctcctgcagctcgcggaggtgac

SEQ ID NO: 280584 - DNA, 25 bp, Mus musculus
ggagacaaggagacgccttcacctc

SEQ ID NO: 280585 - DNA, 25 bp, Mus musculus
ggcgctgtagcttcccgatcgcgct

SEQ ID NO: 280586 - DNA, 25 bp, Mus musculus
aaagcctgcgcttacttgcaactcc

SEQ ID NO: 280587 - DNA, 25 bp, Mus musculus
gagccaggaagctgcggagcaacct

SEQ ID NO: 280588 - DNA, 25 bp, Mus musculus
gcccagcaggagcaagatcccgcgg

SEQ ID NO: 280589 - DNA, 25 bp, Mus musculus
agcagtattgtacgcgctgcgctgc

SEQ ID NO: 280590 - DNA, 25 bp, Mus musculus
ggtcgcatcgcagctctggtttgca

SEQ ID NO: 280591 - DNA, 25 bp, Mus musculus
gccctcggaagggtcgcatcgcagc

SEQ ID NO: 280592 - DNA, 25 bp, Mus musculus
cagctttggacgctcaggagcaggt

SEQ ID NO: 280593 - DNA, 25 bp, Mus musculus
ctttgagtggcagctttggacgctc

SEQ ID NO: 280594 - DNA, 25 bp, Mus musculus
cttgatgctggtatctttgagtggc

SEQ ID NO: 280595 - DNA, 25 bp, Mus musculus
gctccctttctccttgatgctggta

SEQ ID NO: 280596 - DNA, 25 bp, Mus musculus
taggcatgcggtgccggatgttctt

SEQ ID NO: 280597 - DNA, 25 bp, Mus musculus
agcaggagcaagatcccgcggcccg

SEQ ID NO: 280598 - DNA, 25 bp, Mus musculus
gggttgtcctcactcaggcgcccag

SEQ ID NO: 280599 - DNA, 25 bp, Mus musculus
gacagaaggcgaacttcggatgcct

SEQ ID NO: 280600 - DNA, 25 bp, Mus musculus
ggtccgtccctgctaggcatgcggt

SEQ ID NO: 280601 - DNA, 25 bp, Mus musculus
tcccttctgggttgtcctcactcag

SEQ ID NO: 280602 - DNA, 25 bp, Mus musculus
ccatagctataggttccagaactcc

SEQ ID NO: 280603 - DNA, 25 bp, Mus musculus
ccacccaggtaatcgcgtccttagg

SEQ ID NO: 280604 - DNA, 25 bp, Mus musculus
gtaatcgcgtccttagggtggccag

SEQ ID NO: 280605 - DNA, 25 bp, Mus musculus
ggccggcaaccacgaaaacagctct

SEQ ID NO: 280606 - DNA, 25 bp, Mus musculus
cgaaaacagctctccgactcgggtt

SEQ ID NO: 280607 - DNA, 25 bp, Mus musculus
ctccgactcgggttgaggtgctcac

SEQ ID NO: 280608 - DNA, 25 bp, Mus musculus
gttgaggtgctcaccttccttccag

SEQ ID NO: 280609 - DNA, 25 bp, Mus musculus
aggtctcggtggaaccatagctata

SEQ ID NO: 280610 - DNA, 25 bp, Mus musculus
agcccgcaaatcatcagccatttca

SEQ ID NO: 280611 - DNA, 25 bp, Mus musculus
catttcaaatttacgcgggcggctg

SEQ ID NO: 280612 - DNA, 25 bp, Mus musculus
cgggcggctgtcacaaaccagaacg

SEQ ID NO: 280613 - DNA, 25 bp, Mus musculus
aaccagaacgcgatgacgacatctc

SEQ ID NO: 280614 - DNA, 25 bp, Mus musculus
acgacatctctagcgtcagtactcg

SEQ ID NO: 280615 - DNA, 25 bp, Mus musculus
gccgccaagtcaggtctcggtggaa

SEQ ID NO: 280616 - DNA, 25 bp, Mus musculus
ggcgttttcagcctgctcctcttcg

SEQ ID NO: 280617 - DNA, 25 bp, Mus musculus
ctggtcagctgacgttctgcattgc

SEQ ID NO: 280618 - DNA, 25 bp, Mus musculus
ttctgcattgcagcctgcgaagtga

SEQ ID NO: 280619 - DNA, 25 bp, Mus musculus
tgaagcggcgccatgtacgccctcg

SEQ ID NO: 280620 - DNA, 25 bp, Mus musculus
cagccttctggccaccggtgagctt

SEQ ID NO: 280621 - DNA, 25 bp, Mus musculus
cgctgagtcaagctgcgcccagttt

SEQ ID NO: 280622 - DNA, 25 bp, Mus musculus
gccaccggtgagcttagaagggtcc

SEQ ID NO: 280623 - DNA, 25 bp, Mus musculus
ccctggtctggtagagaagaacgct

SEQ ID NO: 280624 - DNA, 25 bp, Mus musculus
cgcgcttaggcaggcctcgctgtgc

SEQ ID NO: 280625 - DNA, 25 bp, Mus musculus
ggggtagatttatattcgtctggtc

SEQ ID NO: 280626 - DNA, 25 bp, Mus musculus
cttccctgggcgttttcagcctgct

SEQ ID NO: 280627 - DNA, 25 bp, Mus musculus
caccagatatggttttcttttatta

SEQ ID NO: 280628 - DNA, 25 bp, Mus musculus
tcggcgcctgaccttgatttaatca

SEQ ID NO: 280629 - DNA, 25 bp, Mus musculus
cgttagataccgttcggcgcctgac

SEQ ID NO: 280630 - DNA, 25 bp, Mus musculus
aggcagtactttcggcctcaggtgg

SEQ ID NO: 280631 - DNA, 25 bp, Mus musculus
cgcctgatctgcatcgatcacagtg

SEQ ID NO: 280632 - DNA, 25 bp, Mus musculus
ctgcatcgatcacagtgcacttgtg

SEQ ID NO: 280633 - DNA, 25 bp, Mus musculus
aggctgcgcctgatctgcatcgatc

SEQ ID NO: 280634 - DNA, 25 bp, Mus musculus
tgccaggcagtactttcggcctcag

SEQ ID NO: 280635 - DNA, 25 bp, Mus musculus
cccatagagactgttgcctccgggg

SEQ ID NO: 280636 - DNA, 25 bp, Mus musculus
gggctcctctcggtgttttctgacc

SEQ ID NO: 280637 - DNA, 25 bp, Mus musculus
ctcggtgttttctgaccagcctctc

SEQ ID NO: 280638 - DNA, 25 bp, Mus musculus
tctccctattccgtaggcacgattc

SEQ ID NO: 280639 - DNA, 25 bp, Mus musculus
tccgtaggcacgattcgaatcttcg

SEQ ID NO: 280640 - DNA, 25 bp, Mus musculus
ccacgaagatcttgcaggctgcgcc

SEQ ID NO: 280641 - DNA, 25 bp, Mus musculus
cggtaagagtcctgccacgaagatc

SEQ ID NO: 280642 - DNA, 25 bp, Mus musculus
cgctgcggtaagagtcctgccacga

SEQ ID NO: 280643 - DNA, 25 bp, Mus musculus
cagtgcacttgtgtgccaggcagta

SEQ ID NO: 280644 - DNA, 25 bp, Mus musculus
cggggccagtgtactgacaagatta

SEQ ID NO: 280645 - DNA, 25 bp, Mus musculus
ttgccaacagcgcacaccgagggaa

SEQ ID NO: 280646 - DNA, 25 bp, Mus musculus
agcaccaggctgtagctgacctgca

SEQ ID NO: 280647 - DNA, 25 bp, Mus musculus
cgggatctgacaagaagtggttata

SEQ ID NO: 280648 - DNA, 25 bp, Mus musculus
aggcagctgcctaggtagcccagca

SEQ ID NO: 280649 - DNA, 25 bp, Mus musculus
acctcggactctgaggacccggaca

SEQ ID NO: 280650 - DNA, 25 bp, Mus musculus
tccgcatcctgcgtagcctcttggg

SEQ ID NO: 280651 - DNA, 25 bp, Mus musculus
tggctggtccagaaagcccttcacc

SEQ ID NO: 280652 - DNA, 25 bp, Mus musculus
cgtagtggggctcatcttgccaaca

SEQ ID NO: 280653 - DNA, 25 bp, Mus musculus
tggtacagcaccacgtccactggct

SEQ ID NO: 280654 - DNA, 25 bp, Mus musculus
gcgactgctctgctcgcgacatatg

SEQ ID NO: 280655 - DNA, 25 bp, Mus musculus
aagtagttccactcgtcgggctggc

SEQ ID NO: 280656 - DNA, 25 bp, Mus musculus
ggcgacaacgctcttcacaccaggg

SEQ ID NO: 280657 - DNA, 25 bp, Mus musculus
tgtccctaatcgaaaccagctccga

SEQ ID NO: 280658 - DNA, 25 bp, Mus musculus
cccaggggctttcgcagagtcgctg

SEQ ID NO: 280659 - DNA, 25 bp, Mus musculus
ggcaacggactgctgggtcaccgac

SEQ ID NO: 280660 - DNA, 25 bp, Mus musculus
ccctcctggactggggacgagcaga

SEQ ID NO: 280661 - DNA, 25 bp, Mus musculus
gctgggcaagcactccgcgcagaca

SEQ ID NO: 280662 - DNA, 25 bp, Mus musculus
cgcgcagacacgctaaagacaatgc

SEQ ID NO: 280663 - DNA, 25 bp, Mus musculus
taaagacaatgctccgaggcgtccg

SEQ ID NO: 280664 - DNA, 25 bp, Mus musculus
tgccctcggtgcaggttccgagacg

SEQ ID NO: 280665 - DNA, 25 bp, Mus musculus
tttgtctgacgaacgtggcggccca

SEQ ID NO: 280666 - DNA, 25 bp, Mus musculus
cccaggggtgacaggctaccgatcc

SEQ ID NO: 280667 - DNA, 25 bp, Mus musculus
acaggctaccgatccggagcgcgtg

SEQ ID NO: 280668 - DNA, 25 bp, Mus musculus
gtggagagtccggacctcgtgctca

SEQ ID NO: 280669 - DNA, 25 bp, Mus musculus
acctcgtgctcagggttgtgccctc

SEQ ID NO: 280670 - DNA, 25 bp, Mus musculus
tcaccgacggcgaggctgcgagacc

SEQ ID NO: 280671 - DNA, 25 bp, Mus musculus
gatcccgccgctttttgtctgacga

SEQ ID NO: 280672 - DNA, 25 bp, Mus musculus
cggcctgcagcaactcgcccatcta

SEQ ID NO: 280673 - DNA, 25 bp, Mus musculus
cccgctgcccacactgtccctctac

SEQ ID NO: 280674 - DNA, 25 bp, Mus musculus
gcaactcgcccatctactgcttgag

SEQ ID NO: 280675 - DNA, 25 bp, Mus musculus
gcccatctactgcttgaggctgatc

SEQ ID NO: 280676 - DNA, 25 bp, Mus musculus
tctactgcttgaggctgatcccatc

SEQ ID NO: 280677 - DNA, 25 bp, Mus musculus
tactgcttgaggctgatcccatcaa

SEQ ID NO: 280678 - DNA, 25 bp, Mus musculus
tgatcccatcaagcgcatccgcata

SEQ ID NO: 280679 - DNA, 25 bp, Mus musculus
ccatcaagcgcatccgcataggtga

SEQ ID NO: 280680 - DNA, 25 bp, Mus musculus
aagcgcatccgcataggtgaagcta

SEQ ID NO: 280681 - DNA, 25 bp, Mus musculus
cgcatccgcataggtgaagctaagc

SEQ ID NO: 280682 - DNA, 25 bp, Mus musculus
aagctaagcgggtgctgcagtgctt

SEQ ID NO: 280683 - DNA, 25 bp, Mus musculus
ctaagcgggtgctgcagtgcttgct

SEQ ID NO: 280684 - DNA, 25 bp, Mus musculus
tgaggctgatcccatcaagcgcatc

SEQ ID NO: 280685 - DNA, 25 bp, Mus musculus
tccgggagcgcgactaccggcggga

SEQ ID NO: 280686 - DNA, 25 bp, Mus musculus
gccggtagctgaacaccaggcagtc

SEQ ID NO: 280687 - DNA, 25 bp, Mus musculus
cagctcaggcagctgagcagcccgg

SEQ ID NO: 280688 - DNA, 25 bp, Mus musculus
aggcagtccactagcgacccgaggc

SEQ ID NO: 280689 - DNA, 25 bp, Mus musculus
cacttctccgccaggtggttgagca

SEQ ID NO: 280690 - DNA, 25 bp, Mus musculus
cggtcaccggctcgcttaggaagcc

SEQ ID NO: 280691 - DNA, 25 bp, Mus musculus
agctgtggccgcacggcacggtcac

SEQ ID NO: 280692 - DNA, 25 bp, Mus musculus
tccctccgtaggcaacggcggcagt

SEQ ID NO: 280693 - DNA, 25 bp, Mus musculus
ttgagcacgacgctggttcggaagt

SEQ ID NO: 280694 - DNA, 25 bp, Mus musculus
gtagcgcccttcgtgcagcagttcc

SEQ ID NO: 280695 - DNA, 25 bp, Mus musculus
atcacctgctcgcagggcgtcgcag

SEQ ID NO: 280696 - DNA, 25 bp, Mus musculus
gcgtcacttgcagctcccaggcgat

SEQ ID NO: 280697 - DNA, 25 bp, Mus musculus
ccggccagagtactgagggaagcct

SEQ ID NO: 280698 - DNA, 25 bp, Mus musculus
actttagtgcacgaccaaggtagac

SEQ ID NO: 280699 - DNA, 25 bp, Mus musculus
cccggtgactttagtgcacgaccaa

SEQ ID NO: 280700 - DNA, 25 bp, Mus musculus
gcccgagttgcagcggctgtgcacc

SEQ ID NO: 280701 - DNA, 25 bp, Mus musculus
accgctctatggtgacccgaatctc

SEQ ID NO: 280702 - DNA, 25 bp, Mus musculus
tgaccttcgtctgcaccgctctatg

SEQ ID NO: 280703 - DNA, 25 bp, Mus musculus
aagaccgcccaaaacctggtgctga

SEQ ID NO: 280704 - DNA, 25 bp, Mus musculus
tccgagctagagctcggccgagcct

SEQ ID NO: 280705 - DNA, 25 bp, Mus musculus
tgcgctactgaagagctccgagcta

SEQ ID NO: 280706 - DNA, 25 bp, Mus musculus
ccgtggaagttgcatcctggatagc

SEQ ID NO: 280707 - DNA, 25 bp, Mus musculus
cgctcctaggccgacccgtggaagt

SEQ ID NO: 280708 - DNA, 25 bp, Mus musculus
aacttctctacggagccgcgctcta

SEQ ID NO: 280709 - DNA, 25 bp, Mus musculus
cgaatctccgctgcccgagttgcag

SEQ ID NO: 280710 - DNA, 25 bp, Mus musculus
actctggcgcccaagcggtgcagct

SEQ ID NO: 280711 - DNA, 25 bp, Mus musculus
tcgcggctgcattccaacttctcta

SEQ ID NO: 280712 - DNA, 25 bp, Mus musculus
cagagcagccacacggcttgggcta

SEQ ID NO: 280713 - DNA, 25 bp, Mus musculus
cgtgggaagtcgcagctgtcactct

SEQ ID NO: 280714 - DNA, 25 bp, Mus musculus
cgcgaagtccacagtccttggtagc

SEQ ID NO: 280715 - DNA, 25 bp, Mus musculus
cacgctgcaagaaggctcggagcta

SEQ ID NO: 280716 - DNA, 25 bp, Mus musculus
ctcggagctacgtgactgagggctc

SEQ ID NO: 280717 - DNA, 25 bp, Mus musculus
agctacgtgactgagggctcgccac

SEQ ID NO: 280718 - DNA, 25 bp, Mus musculus
tggccaccctaggtcgagttcccag

SEQ ID NO: 280719 - DNA, 25 bp, Mus musculus
gagttcccagctgggccggctcaac

SEQ ID NO: 280720 - DNA, 25 bp, Mus musculus
gctcaaccgcctgggactggctgct

SEQ ID NO: 280721 - DNA, 25 bp, Mus musculus
tgggactggctgctcagacacgccc

SEQ ID NO: 280722 - DNA, 25 bp, Mus musculus
caactgcgctagaccggccaggtcg

SEQ ID NO: 280723 - DNA, 25 bp, Mus musculus
caggtcgcccatccacgtgcagagt

SEQ ID NO: 280724 - DNA, 25 bp, Mus musculus
atccacgtgcagagtccttcctgcg

SEQ ID NO: 280725 - DNA, 25 bp, Mus musculus
gcagagtccttcctgcgtgcagaac

SEQ ID NO: 280726 - DNA, 25 bp, Mus musculus
ttggtagcgcagagccacgctgcaa

SEQ ID NO: 280727 - DNA, 25 bp, Mus musculus
cacagtccttggtagcgcagagcca

SEQ ID NO: 280728 - DNA, 25 bp, Mus musculus
ctggaatgttttcccagggtctgca

SEQ ID NO: 280729 - DNA, 25 bp, Mus musculus
ccaaacgctgaagtgctctgctctc

SEQ ID NO: 280730 - DNA, 25 bp, Mus musculus
taggggccgcgccttcctactgagc

SEQ ID NO: 280731 - DNA, 25 bp, Mus musculus
cgaggacgcacagccatggctcagg

SEQ ID NO: 280732 - DNA, 25 bp, Mus musculus
ccgtggctccaacagcgaggacgca

SEQ ID NO: 280733 - DNA, 25 bp, Mus musculus
tttagattgccaccgcgaagggagc

SEQ ID NO: 280734 - DNA, 25 bp, Mus musculus
ccagctcgggcaaaatcgtgggttt

SEQ ID NO: 280735 - DNA, 25 bp, Mus musculus
ctggttcgcagcttccttacgcttc

SEQ ID NO: 280736 - DNA, 25 bp, Mus musculus
gagcctctcgcggtcgtcagcacat

SEQ ID NO: 280737 - DNA, 25 bp, Mus musculus
gctgccagaagtaatcgggatccca

SEQ ID NO: 280738 - DNA, 25 bp, Mus musculus
cgcactgggaacgtcgaggctgcca

SEQ ID NO: 280739 - DNA, 25 bp, Mus musculus
ctacacattaaggtcggcgcagggc

SEQ ID NO: 280740 - DNA, 25 bp, Mus musculus
cggctcgtctctacacattaaggtc

SEQ ID NO: 280741 - DNA, 25 bp, Mus musculus
ggtcgtcagcacatcctggttcgca

SEQ ID NO: 280742 - DNA, 25 bp, Mus musculus
gagccatcacgtggccctcggggtc

SEQ ID NO: 280743 - DNA, 25 bp, Mus musculus
gctgaaggacctccgcagcgggcct

SEQ ID NO: 280744 - DNA, 25 bp, Mus musculus
accctcgttcttcccgggcgctcag

SEQ ID NO: 280745 - DNA, 25 bp, Mus musculus
atcacctcacttgctacgcggcgcc

SEQ ID NO: 280746 - DNA, 25 bp, Mus musculus
atgtggtcgctgaaggacctccgca

SEQ ID NO: 280747 - DNA, 25 bp, Mus musculus
ctctcaggggccgagccatcacgtg

SEQ ID NO: 280748 - DNA, 25 bp, Mus musculus
caccctcgagcgacttcgggcggat

SEQ ID NO: 280749 - DNA, 25 bp, Mus musculus
tgcaggcggcctcttggcccgtagc

SEQ ID NO: 280750 - DNA, 25 bp, Mus musculus
cgcggccacatctggaaaggcttag

SEQ ID NO: 280751 - DNA, 25 bp, Mus musculus
ccacatctggaaaggcttagggcca

SEQ ID NO: 280752 - DNA, 25 bp, Mus musculus
cgctatcgggatgcgcccggtgtaa

SEQ ID NO: 280753 - DNA, 25 bp, Mus musculus
gatgcgcccggtgtaacccaatcac

SEQ ID NO: 280754 - DNA, 25 bp, Mus musculus
cggtgtaacccaatcacctcacttg

SEQ ID NO: 280755 - DNA, 25 bp, Mus musculus
tggagtctctgatgtggtcgctgaa

SEQ ID NO: 280756 - DNA, 25 bp, Mus musculus
agcgggacccgcgactactccggag

SEQ ID NO: 280757 - DNA, 25 bp, Mus musculus
cgaatttacgaacggaaacaggctg

SEQ ID NO: 280758 - DNA, 25 bp, Mus musculus
ttgccgggaatacgggcgacctcga

SEQ ID NO: 280759 - DNA, 25 bp, Mus musculus
atacgggcgacctcgagtagagatg

SEQ ID NO: 280760 - DNA, 25 bp, Mus musculus
cctcgagtagagatggggagacctc

SEQ ID NO: 280761 - DNA, 25 bp, Mus musculus
ggggagacctccgtatcctcagcca

SEQ ID NO: 280762 - DNA, 25 bp, Mus musculus
ggcaccgaggacctcgggtcctgca

SEQ ID NO: 280763 - DNA, 25 bp, Mus musculus
gaggacctcgggtcctgcagcccag

SEQ ID NO: 280764 - DNA, 25 bp, Mus musculus
ccagctgccgttgtcacccgtgagg

SEQ ID NO: 280765 - DNA, 25 bp, Mus musculus
cgttgtcacccgtgaggggagcacc

SEQ ID NO: 280766 - DNA, 25 bp, Mus musculus
gaaacaggctgtcccggtgtcgcac

SEQ ID NO: 280767 - DNA, 25 bp, Mus musculus
tccagccggaacaacgacgcggagg

SEQ ID NO: 280768 - DNA, 25 bp, Mus musculus
gcgactactccggagacgccgggta

SEQ ID NO: 280769 - DNA, 25 bp, Mus musculus
gggtggcctccagccggaacaacga

SEQ ID NO: 280770 - DNA, 25 bp, Mus musculus
agacacagccctgcggccatgagtg

SEQ ID NO: 280771 - DNA, 25 bp, Mus musculus
agtttgtcgcgttgctaggaagccc

SEQ ID NO: 280772 - DNA, 25 bp, Mus musculus
tgctgctctgcatccagctcggggg

SEQ ID NO: 280773 - DNA, 25 bp, Mus musculus
tgcctactggtagctttcccttcct

SEQ ID NO: 280774 - DNA, 25 bp, Mus musculus
cggttgcgctacctgcctactggta

SEQ ID NO: 280775 - DNA, 25 bp, Mus musculus
cagccctgcggccatgagtgccagg

SEQ ID NO: 280776 - DNA, 25 bp, Mus musculus
taccgcgcgtggaggagacacagcc

SEQ ID NO: 280777 - DNA, 25 bp, Mus musculus
cagctccctggagaagccgctgcca

SEQ ID NO: 280778 - DNA, 25 bp, Mus musculus
cgcgtccttagcctccacccagctc

SEQ ID NO: 280779 - DNA, 25 bp, Mus musculus
aaccggatgcgctgtcagtctcctc

SEQ ID NO: 280780 - DNA, 25 bp, Mus musculus
tgtccctctcctggtgaaccggatg

SEQ ID NO: 280781 - DNA, 25 bp, Mus musculus
ccattcttgtccctctcctggtgaa

SEQ ID NO: 280782 - DNA, 25 bp, Mus musculus
agagccgctttctcgccacgcccac

SEQ ID NO: 280783 - DNA, 25 bp, Mus musculus
tccttcacgccggagacaggcgggc

SEQ ID NO: 280784 - DNA, 25 bp, Mus musculus
cagactgtagcgctgtagaggcatc

SEQ ID NO: 280785 - DNA, 25 bp, Mus musculus
tagaggcatcaacctcagggcccgc

SEQ ID NO: 280786 - DNA, 25 bp, Mus musculus
ccctggcgacatacggagatcatcg

SEQ ID NO: 280787 - DNA, 25 bp, Mus musculus
gagatcatcgtttgccggtccattg

SEQ ID NO: 280788 - DNA, 25 bp, Mus musculus
tttgccggtccattgtcctggtccg

SEQ ID NO: 280789 - DNA, 25 bp, Mus musculus
ggtccgggtcctgtcagtccaccat

SEQ ID NO: 280790 - DNA, 25 bp, Mus musculus
tccacgcacaagcaatgaccacaaa

SEQ ID NO: 280791 - DNA, 25 bp, Mus musculus
caaacgatatggacgctactaggga

SEQ ID NO: 280792 - DNA, 25 bp, Mus musculus
tagggaacacttaagggcccgctgc

SEQ ID NO: 280793 - DNA, 25 bp, Mus musculus
tgcccacctgggcagctcagactgt

SEQ ID NO: 280794 - DNA, 25 bp, Mus musculus
ctggagagccaaccggtcgatgccc

SEQ ID NO: 280795 - DNA, 25 bp, Mus musculus
tcagaagcgtgcctggagagccaac

SEQ ID NO: 280796 - DNA, 25 bp, Mus musculus
tgccataccaaagtcagaagcgtgc

SEQ ID NO: 280797 - DNA, 25 bp, Mus musculus
gggcccgctgctgccataccaaagt

SEQ ID NO: 280798 - DNA, 25 bp, Mus musculus
ctggagatcgcagttctgcacaaaa

SEQ ID NO: 280799 - DNA, 25 bp, Mus musculus
tcagagcactataaacgcggggccc

SEQ ID NO: 280800 - DNA, 25 bp, Mus musculus
attgggcagcattcccgtcagtctg

SEQ ID NO: 280801 - DNA, 25 bp, Mus musculus
gggcgcgctgtcagagcactataaa

SEQ ID NO: 280802 - DNA, 25 bp, Mus musculus
gcaactcgcggccactaagcagtca

SEQ ID NO: 280803 - DNA, 25 bp, Mus musculus
aaagggcgcctcctgaatcctcgca

SEQ ID NO: 280804 - DNA, 25 bp, Mus musculus
ctatagatccaggacagcgggcagt

SEQ ID NO: 280805 - DNA, 25 bp, Mus musculus
ggctctaaaactatcgatctggaga

SEQ ID NO: 280806 - DNA, 25 bp, Mus musculus
tcgaggaattccagtagataggctc

SEQ ID NO: 280807 - DNA, 25 bp, Mus musculus
cacttacttggagttcgaggaattc

SEQ ID NO: 280808 - DNA, 25 bp, Mus musculus
ggctcgtggacaccacttacttgga

SEQ ID NO: 280809 - DNA, 25 bp, Mus musculus
tctagaaacagggtccaaggcctcc

SEQ ID NO: 280810 - DNA, 25 bp, Mus musculus
tggaccgggccatggccatgcccaa

SEQ ID NO: 280811 - DNA, 25 bp, Mus musculus
agaggggccgcctgactatagatcc

SEQ ID NO: 280812 - DNA, 25 bp, Mus musculus
aggtgcgccagctccacggaaccgg

SEQ ID NO: 280813 - DNA, 25 bp, Mus musculus
atgccgtgcaggtgcgccagctcca

SEQ ID NO: 280814 - DNA, 25 bp, Mus musculus
gggcgggatgcttgtacctaccgaa

SEQ ID NO: 280815 - DNA, 25 bp, Mus musculus
tgcacggtgccgtcgggcaggatct

SEQ ID NO: 280816 - DNA, 25 bp, Mus musculus
atcctgccgggtgccctgcacggtg

SEQ ID NO: 280817 - DNA, 25 bp, Mus musculus
agactgtgatcctgccgggtgccct

SEQ ID NO: 280818 - DNA, 25 bp, Mus musculus
cgaagagactgtgatcctgccgggt

SEQ ID NO: 280819 - DNA, 25 bp, Mus musculus
taccgaagagactgtgatcctgccg

SEQ ID NO: 280820 - DNA, 25 bp, Mus musculus
acctaccgaagagactgtgatcctg

SEQ ID NO: 280821 - DNA, 25 bp, Mus musculus
tgtacctaccgaagagactgtgatc

SEQ ID NO: 280822 - DNA, 25 bp, Mus musculus
tgcttgtacctaccgaagagactgt

SEQ ID NO: 280823 - DNA, 25 bp, Mus musculus
gggatgcttgtacctaccgaagaga

SEQ ID NO: 280824 - DNA, 25 bp, Mus musculus
cgtaagggcgggatgcttgtaccta

SEQ ID NO: 280825 - DNA, 25 bp, Mus musculus
tgcaggtgcgccagctccacggaac

SEQ ID NO: 280826 - DNA, 25 bp, Mus musculus
aagcaggaaggagaacagcctggac

SEQ ID NO: 280827 - DNA, 25 bp, Mus musculus
tgctgccaaggagacggtaagtgcc

SEQ ID NO: 280828 - DNA, 25 bp, Mus musculus
ctggtcggccttgtgtgctaccagc

SEQ ID NO: 280829 - DNA, 25 bp, Mus musculus
cagcagcccttcctctcaccgtggg

SEQ ID NO: 280830 - DNA, 25 bp, Mus musculus
atcccacggcgactctcggggaagc

SEQ ID NO: 280831 - DNA, 25 bp, Mus musculus
tgtgctaccagctgtatggggaccc

SEQ ID NO: 280832 - DNA, 25 bp, Mus musculus
cagcctggacttgggaagctttgga

SEQ ID NO: 280833 - DNA, 25 bp, Mus musculus
ctctaccacggcgtggctgggctga

SEQ ID NO: 280834 - DNA, 25 bp, Mus musculus
ttgcccacagccgtggttacgggcg

SEQ ID NO: 280835 - DNA, 25 bp, Mus musculus
aattcggcaccgagcagggcaccca

SEQ ID NO: 280836 - DNA, 25 bp, Mus musculus
tcggagcatcagagaattcggcacc

SEQ ID NO: 280837 - DNA, 25 bp, Mus musculus
accacaaagcgctcggagcatcaga

SEQ ID NO: 280838 - DNA, 25 bp, Mus musculus
ggtctgcacgcaaccacaaagcgct

SEQ ID NO: 280839 - DNA, 25 bp, Mus musculus
gggaagctttggagcttctctcgcc

SEQ ID NO: 280840 - DNA, 25 bp, Mus musculus
gtcaattctcatcacagtcccgcga

SEQ ID NO: 280841 - DNA, 25 bp, Mus musculus
ccactctgtgcatccgctgggttct

SEQ ID NO: 280842 - DNA, 25 bp, Mus musculus
gctctgcgattgcttccactctgtg

SEQ ID NO: 280843 - DNA, 25 bp, Mus musculus
ccatccagctgtgcataggtgagtg

SEQ ID NO: 280844 - DNA, 25 bp, Mus musculus
gcctacgccatccagctgtgcatag

SEQ ID NO: 280845 - DNA, 25 bp, Mus musculus
tgggctggtcctactacgcctacgc

SEQ ID NO: 280846 - DNA, 25 bp, Mus musculus
ggatcccggtggtgttcatcagctt

SEQ ID NO: 280847 - DNA, 25 bp, Mus musculus
ccggcgggtgctctactggatcccg

SEQ ID NO: 280848 - DNA, 25 bp, Mus musculus
tcccgcgatccagggccaagtgcag

SEQ ID NO: 280849 - DNA, 25 bp, Mus musculus
gggtgacccaaagcgagtgtcaatt

SEQ ID NO: 280850 - DNA, 25 bp, Mus musculus
ccgatccgcgccctgggagtggctt

SEQ ID NO: 280851 - DNA, 25 bp, Mus musculus
ctacaagcgacaccttgcagctcgt

SEQ ID NO: 280852 - DNA, 25 bp, Mus musculus
gggctgacgctcgtcctcctacaag

SEQ ID NO: 280853 - DNA, 25 bp, Mus musculus
gggagtccgcgtccggatccctgca

SEQ ID NO: 280854 - DNA, 25 bp, Mus musculus
acaacgaagtcccaggtacaaagcg

SEQ ID NO: 280855 - DNA, 25 bp, Mus musculus
cgcaatttccttcccacaacgaagt

SEQ ID NO: 280856 - DNA, 25 bp, Mus musculus
gaagagcgcgtcatcctccgcggct

SEQ ID NO: 280857 - DNA, 25 bp, Mus musculus
gagcagcaggccagaaccttgtagg

SEQ ID NO: 280858 - DNA, 25 bp, Mus musculus
gccgtgctcgatcgcccgggaagca

SEQ ID NO: 280859 - DNA, 25 bp, Mus musculus
agccgcccgcagtggtagctcggac

SEQ ID NO: 280860 - DNA, 25 bp, Mus musculus
gggttccgtccagccgacgagtcgc

SEQ ID NO: 280861 - DNA, 25 bp, Mus musculus
ggcgaccaggcctagctaactgacc

SEQ ID NO: 280862 - DNA, 25 bp, Mus musculus
acagccacgcttaggcgggcgccat

SEQ ID NO: 280863 - DNA, 25 bp, Mus musculus
atagacgcctctcgccctgcgaaag

SEQ ID NO: 280864 - DNA, 25 bp, Mus musculus
tcgccatagagctagcacccggcgg

SEQ ID NO: 280865 - DNA, 25 bp, Mus musculus
cgccggatctacttgggtctctgag

SEQ ID NO: 280866 - DNA, 25 bp, Mus musculus
aaccactgccgaggacgaaagccac

SEQ ID NO: 280867 - DNA, 25 bp, Mus musculus
gtacaaagcggtggcgtcatcactg

SEQ ID NO: 280868 - DNA, 25 bp, Mus musculus
cctgcgcgggcctgagatcgcggct

SEQ ID NO: 280869 - DNA, 25 bp, Mus musculus
agatgctagggcgccgccagctcct

SEQ ID NO: 280870 - DNA, 25 bp, Mus musculus
ctcctccaggtgcgccggtggtgct

SEQ ID NO: 280871 - DNA, 25 bp, Mus musculus
gcgcgtgcggcgcaatgggaagggc

SEQ ID NO: 280872 - DNA, 25 bp, Mus musculus
cctcacgcacctgcgcgcgcgcgtg

SEQ ID NO: 280873 - DNA, 25 bp, Mus musculus
cgggcgcggcctcacgcacctgcgc

SEQ ID NO: 280874 - DNA, 25 bp, Mus musculus
tgtgctccatggcgggcccgcgtct

SEQ ID NO: 280875 - DNA, 25 bp, Mus musculus
aaccttgggcgtgcggatgtgctcc

SEQ ID NO: 280876 - DNA, 25 bp, Mus musculus
ccaaccttgggcgtgcggatgtgct

SEQ ID NO: 280877 - DNA, 25 bp, Mus musculus
gccaccaaccttgggcgtgcggatg

SEQ ID NO: 280878 - DNA, 25 bp, Mus musculus
ggcctgagatcgcggctctgcgcct

SEQ ID NO: 280879 - DNA, 25 bp, Mus musculus
agctcctccctcgttcgcggtccag

SEQ ID NO: 280880 - DNA, 25 bp, Mus musculus
tgctctgggagatgctagggcgccg

SEQ ID NO: 280881 - DNA, 25 bp, Mus musculus
cgtgcgcttagcatccctcctcctt

SEQ ID NO: 280882 - DNA, 25 bp, Mus musculus
ctcgtccaaccttcgcgagcttgga

SEQ ID NO: 280883 - DNA, 25 bp, Mus musculus
gtgacaaacgctccaggcgagggtc

SEQ ID NO: 280884 - DNA, 25 bp, Mus musculus
ggtgccgctggctgactctcactcg

SEQ ID NO: 280885 - DNA, 25 bp, Mus musculus
gactgccgctcaggaccctgggtct

SEQ ID NO: 280886 - DNA, 25 bp, Mus musculus
cagctgcttgcagctgcccggaggc

SEQ ID NO: 280887 - DNA, 25 bp, Mus musculus
cttggaatccgcagagcgctgcagc

SEQ ID NO: 280888 - DNA, 25 bp, Mus musculus
tctgcgcggacctggaaaggctgct

SEQ ID NO: 280889 - DNA, 25 bp, Mus musculus
cctctactcagaggggtgcccacgt

SEQ ID NO: 280890 - DNA, 25 bp, Mus musculus
agacaccgccttcctggagtctctg

SEQ ID NO: 280891 - DNA, 25 bp, Mus musculus
tcagaagcttggagttagacaccgc

SEQ ID NO: 280892 - DNA, 25 bp, Mus musculus
ctgaccctgacctttcagaagcttg

SEQ ID NO: 280893 - DNA, 25 bp, Mus musculus
agcgtgtaatccacgtgcgcgcgcg

SEQ ID NO: 280894 - DNA, 25 bp, Mus musculus
cccagcgggcaagcgtgtaatccac

SEQ ID NO: 280895 - DNA, 25 bp, Mus musculus
ttcaggccgcgtccagctgcttgca

SEQ ID NO: 280896 - DNA, 25 bp, Mus musculus
ccaagactggatctgcgtatctata

SEQ ID NO: 280897 - DNA, 25 bp, Mus musculus
cgcgcgatgtctgatccggagaaaa

SEQ ID NO: 280898 - DNA, 25 bp, Mus musculus
tcacactggacagccttgaagattc

SEQ ID NO: 280899 - DNA, 25 bp, Mus musculus
gccttgaagattccaaactctgccg

SEQ ID NO: 280900 - DNA, 25 bp, Mus musculus
tctgccgctgcttaaccaccgtgga

SEQ ID NO: 280901 - DNA, 25 bp, Mus musculus
tggggaagtcgccaaagccgattct

SEQ ID NO: 280902 - DNA, 25 bp, Mus musculus
caaagccgattctggcccgagtatc

SEQ ID NO: 280903 - DNA, 25 bp, Mus musculus
cccgagtatcgtggtgtctttcctc

SEQ ID NO: 280904 - DNA, 25 bp, Mus musculus
ctggcctcggttatggccggccttt

SEQ ID NO: 280905 - DNA, 25 bp, Mus musculus
tatctatacacttacgtcacggtcg

SEQ ID NO: 280906 - DNA, 25 bp, Mus musculus
gtgtctttcctcatcgctgccctgg

SEQ ID NO: 280907 - DNA, 25 bp, Mus musculus
ccaccgtggacctcatcgctttggg

SEQ ID NO: 280908 - DNA, 25 bp, Mus musculus
gccggcctttgctatgctgaatttg

SEQ ID NO: 280909 - DNA, 25 bp, Mus musculus
ggcccgagtacccaagactggatct

SEQ ID NO: 280910 - DNA, 25 bp, Mus musculus
cctgagagacgagcaggggttcctt

SEQ ID NO: 280911 - DNA, 25 bp, Mus musculus
atcgcgctgcacctgttgccacgtg

SEQ ID NO: 280912 - DNA, 25 bp, Mus musculus
ggttccttgaggcacgatgactccc

SEQ ID NO: 280913 - DNA, 25 bp, Mus musculus
ggctccctggctaaacgtcaacata

SEQ ID NO: 280914 - DNA, 25 bp, Mus musculus
tagagcccagacaaaggccaggttg

SEQ ID NO: 280915 - DNA, 25 bp, Mus musculus
gacgtctgtacctggggcttgcaga

SEQ ID NO: 280916 - DNA, 25 bp, Mus musculus
cggaatgggatccactccgcgcttg

SEQ ID NO: 280917 - DNA, 25 bp, Mus musculus
tgagtgcgttgcagtcgccgctccc

SEQ ID NO: 280918 - DNA, 25 bp, Mus musculus
ccagtccggtcaccgtgagtgcgtt

SEQ ID NO: 280919 - DNA, 25 bp, Mus musculus
ttgccacgtgtgtcgcaaagccacc

SEQ ID NO: 280920 - DNA, 25 bp, Mus musculus
gtcgcaaagccaccgctgctgactg

SEQ ID NO: 280921 - DNA, 25 bp, Mus musculus
gcgtacgtcctggatcgcgctgcac

SEQ ID NO: 280922 - DNA, 25 bp, Mus musculus
gtcctgccttggagacgtctgtacc

SEQ ID NO: 280923 - DNA, 25 bp, Mus musculus
aggcacgatgactcccgcggagctc

SEQ ID NO: 280924 - DNA, 25 bp, Mus musculus
tccagcagcggctgtacgaccctga

SEQ ID NO: 280925 - DNA, 25 bp, Mus musculus
acgaccctgagtgctttagctccca

SEQ ID NO: 280926 - DNA, 25 bp, Mus musculus
tttagctcccaacggaaggccacgc

SEQ ID NO: 280927 - DNA, 25 bp, Mus musculus
gcaccgccctgcagaacagtcatgg

SEQ ID NO: 280928 - DNA, 25 bp, Mus musculus
ttcggtgagtatcgctccagcagcg

SEQ ID NO: 280929 - DNA, 25 bp, Mus musculus
gcggatggccttcctctgagatcac

SEQ ID NO: 280930 - DNA, 25 bp, Mus musculus
gaacagtcatggacccgcttgcgga

SEQ ID NO: 280931 - DNA, 25 bp, Mus musculus
tgcgtttaccgctccgagagacctg

SEQ ID NO: 280932 - DNA, 25 bp, Mus musculus
ccaggctaggggctctgcgtttacc

SEQ ID NO: 280933 - DNA, 25 bp, Mus musculus
cgagtacgcaccgtaactcttgctc

SEQ ID NO: 280934 - DNA, 25 bp, Mus musculus
gtaactcttgctcccatgcaaacgc

SEQ ID NO: 280935 - DNA, 25 bp, Mus musculus
tgcaaacgcacccagcattcggagg

SEQ ID NO: 280936 - DNA, 25 bp, Mus musculus
gcacccagcattcggaggccaggct

SEQ ID NO: 280937 - DNA, 25 bp, Mus musculus
ccgagagacctgagttcggtgagta

SEQ ID NO: 280938 - DNA, 25 bp, Mus musculus
agctaatgtagagaaggcggccatt

SEQ ID NO: 280939 - DNA, 25 bp, Mus musculus
cccgagcgtcacgtgactcaggtca

SEQ ID NO: 280940 - DNA, 25 bp, Mus musculus
acccgccgaattccatcctgggagg

SEQ ID NO: 280941 - DNA, 25 bp, Mus musculus
tgagttccgaaagaaactggccttg

SEQ ID NO: 280942 - DNA, 25 bp, Mus musculus
tcgcccggtgctggagatttcaccc

SEQ ID NO: 280943 - DNA, 25 bp, Mus musculus
ggcgtcccatgtgaggaccgctcgc

SEQ ID NO: 280944 - DNA, 25 bp, Mus musculus
ctccacgatcttggggcgtcccatg

SEQ ID NO: 280945 - DNA, 25 bp, Mus musculus
gcgccgactgacacgctagctctgg

SEQ ID NO: 280946 - DNA, 25 bp, Mus musculus
taactctgaggtcccatggctgcgc

SEQ ID NO: 280947 - DNA, 25 bp, Mus musculus
tcccttccgcggtcttggaggaaga

SEQ ID NO: 280948 - DNA, 25 bp, Mus musculus
ggttggcgcctagttagctaatgta

SEQ ID NO: 280949 - DNA, 25 bp, Mus musculus
cccaccacaatgaggtcctaagatg

SEQ ID NO: 280950 - DNA, 25 bp, Mus musculus
ttgccgaggagaccgcgctcgtctc

SEQ ID NO: 280951 - DNA, 25 bp, Mus musculus
cacgcctgcccgttttaactctgag

SEQ ID NO: 280952 - DNA, 25 bp, Mus musculus
agcgcgagcggctgcgcttcttgtt

SEQ ID NO: 280953 - DNA, 25 bp, Mus musculus
cggagtccctaagatggcagctgtg

SEQ ID NO: 280954 - DNA, 25 bp, Mus musculus
ccggcccggagtccctaagatggca

SEQ ID NO: 280955 - DNA, 25 bp, Mus musculus
cttagagcgggacgagctccggctc

SEQ ID NO: 280956 - DNA, 25 bp, Mus musculus
gcgcttcttgttgtgcttggagctc

SEQ ID NO: 280957 - DNA, 25 bp, Mus musculus
ccctgacgacgtcgcctaggagggc

SEQ ID NO: 280958 - DNA, 25 bp, Mus musculus
tgcgcccgaagatgtcgatgcggtc

SEQ ID NO: 280959 - DNA, 25 bp, Mus musculus
caccgtgcgcccgaagatgtcgatg

SEQ ID NO: 280960 - DNA, 25 bp, Mus musculus
aggctgctgcgcttgctcaccgtgc

SEQ ID NO: 280961 - DNA, 25 bp, Mus musculus
cttctgcttctcgtccaggctgctg

SEQ ID NO: 280962 - DNA, 25 bp, Mus musculus
atttttcgctgtcgctcgaactccg

SEQ ID NO: 280963 - DNA, 25 bp, Mus musculus
cctcacatttttcgctgtcgctcga

SEQ ID NO: 280964 - DNA, 25 bp, Mus musculus
tcgcgccctcaactcggacttccgg

SEQ ID NO: 280965 - DNA, 25 bp, Mus musculus
gcttggagctcttggtgtgcttaga

SEQ ID NO: 280966 - DNA, 25 bp, Mus musculus
tggtttcgtccagccttagccgcac

SEQ ID NO: 280967 - DNA, 25 bp, Mus musculus
cctctggccttcactcgtttggagc

SEQ ID NO: 280968 - DNA, 25 bp, Mus musculus
cagcacgccacgcagtggtttcgtc

SEQ ID NO: 280969 - DNA, 25 bp, Mus musculus
gccacaccatgcacggcaggggaca

SEQ ID NO: 280970 - DNA, 25 bp, Mus musculus
caacgcgtgatcagcgaccctgggc

SEQ ID NO: 280971 - DNA, 25 bp, Mus musculus
gagggactctagcagcagctgcagc

SEQ ID NO: 280972 - DNA, 25 bp, Mus musculus
tgcaagcgccgctccgagggactct

SEQ ID NO: 280973 - DNA, 25 bp, Mus musculus
ctaggacccaggtgagaagactttg

SEQ ID NO: 280974 - DNA, 25 bp, Mus musculus
acatcctgtgcctgggcgcaggtga

SEQ ID NO: 280975 - DNA, 25 bp, Mus musculus
ccatctgtgcctcggctggagctca

SEQ ID NO: 280976 - DNA, 25 bp, Mus musculus
acagaccgcgagcaggtgtccctca

SEQ ID NO: 280977 - DNA, 25 bp, Mus musculus
cgacgcctcacggaagatacagacc

SEQ ID NO: 280978 - DNA, 25 bp, Mus musculus
tttctgagggcggacgccgactgac

SEQ ID NO: 280979 - DNA, 25 bp, Mus musculus
cacggcaggggacacgccagagata

SEQ ID NO: 280980 - DNA, 25 bp, Mus musculus
aagtggctctaacggccggagctga

SEQ ID NO: 280981 - DNA, 25 bp, Mus musculus
gcttccgatgcactacggcggccgt

SEQ ID NO: 280982 - DNA, 25 bp, Mus musculus
gagggtccaatcacgtcagcgttcc

SEQ ID NO: 280983 - DNA, 25 bp, Mus musculus
cacgcagcgtcagctaagaagtgtc

SEQ ID NO: 280984 - DNA, 25 bp, Mus musculus
ggcttcctgtttactgcttccgatg

SEQ ID NO: 280985 - DNA, 25 bp, Mus musculus
aaggctacgattctccggcttcctg

SEQ ID NO: 280986 - DNA, 25 bp, Mus musculus
ctcggtcttcttcaacccaaggcta

SEQ ID NO: 280987 - DNA, 25 bp, Mus musculus
acataggaatattcggccatggccc

SEQ ID NO: 280988 - DNA, 25 bp, Mus musculus
gcacgagtttggtggactttacata

SEQ ID NO: 280989 - DNA, 25 bp, Mus musculus
tttagtgcccttgagcacgagtttg

SEQ ID NO: 280990 - DNA, 25 bp, Mus musculus
gccgcctcacctcttggctttagtg

SEQ ID NO: 280991 - DNA, 25 bp, Mus musculus
atggatgcactgagaaccgcgcctc

SEQ ID NO: 280992 - DNA, 25 bp, Mus musculus
ctgtccacgcaggtctgagtgtcct

SEQ ID NO: 280993 - DNA, 25 bp, Mus musculus
cctctggcagagcttccgtaggact

SEQ ID NO: 280994 - DNA, 25 bp, Mus musculus
tgggcgtccttagctgcaactggct

SEQ ID NO: 280995 - DNA, 25 bp, Mus musculus
ggctgcctggacatgtcctgacaaa

SEQ ID NO: 280996 - DNA, 25 bp, Mus musculus
aactcctcaactcggcagctggctg

SEQ ID NO: 280997 - DNA, 25 bp, Mus musculus
aagcagagagatccgccgcagttgc

SEQ ID NO: 280998 - DNA, 25 bp, Mus musculus
cgaatgaagtcggagaacccggtca

SEQ ID NO: 280999 - DNA, 25 bp, Mus musculus
agcttgcagagactgatcgcggttc

SEQ ID NO: 281000 - DNA, 25 bp, Mus musculus
ctgcggccacggagatcactgcaac

SEQ ID NO: 281001 - DNA, 25 bp, Mus musculus
gacggacatttcttcctgggacggc

SEQ ID NO: 281002 - DNA, 25 bp, Mus musculus
ctgattccgtggtgagtgcgaagaa

SEQ ID NO: 281003 - DNA, 25 bp, Mus musculus
gagccacagagaaggcgcccacctg

SEQ ID NO: 281004 - DNA, 25 bp, Mus musculus
ctcgttgcgaggagtttcagctgca

SEQ ID NO: 281005 - DNA, 25 bp, Mus musculus
gtccgagtcgtccagtaagcttgca

SEQ ID NO: 281006 - DNA, 25 bp, Mus musculus
aggaagagcatcacctgcagtccga

SEQ ID NO: 281007 - DNA, 25 bp, Mus musculus
tcccgccagcactggaggaggatcg

SEQ ID NO: 281008 - DNA, 25 bp, Mus musculus
aaaggcgctcgcctcgctctgggtc

SEQ ID NO: 281009 - DNA, 25 bp, Mus musculus
tctggcaagctcctcgaaaggcgct

SEQ ID NO: 281010 - DNA, 25 bp, Mus musculus
accgcaccgtcgctaactttggagc

SEQ ID NO: 281011 - DNA, 25 bp, Mus musculus
tgcgcgcactgagtcgaggagtctc

SEQ ID NO: 281012 - DNA, 25 bp, Mus musculus
tggagccaactttgcagtaagtttg

SEQ ID NO: 281013 - DNA, 25 bp, Mus musculus
ccgagggtgaatgccggctctccct

SEQ ID NO: 281014 - DNA, 25 bp, Mus musculus
ccttgcccactagcagagttgagtg

SEQ ID NO: 281015 - DNA, 25 bp, Mus musculus
tgtctgacccgggaaaccggactgc

SEQ ID NO: 281016 - DNA, 25 bp, Mus musculus
catctcggctttggagcggtttcta

SEQ ID NO: 281017 - DNA, 25 bp, Mus musculus
agatgaaagcagagccgatcgcttg

SEQ ID NO: 281018 - DNA, 25 bp, Mus musculus
tcgcttgagcgtgggatctttgaaa

SEQ ID NO: 281019 - DNA, 25 bp, Mus musculus
aatggagtcgctgagttttcttaga

SEQ ID NO: 281020 - DNA, 25 bp, Mus musculus
tcttagatgttctgtgctcggagga

SEQ ID NO: 281021 - DNA, 25 bp, Mus musculus
gggttcgactcctgtccatctcggc

SEQ ID NO: 281022 - DNA, 25 bp, Mus musculus
gacagaactgacgtgtttgctatcc

SEQ ID NO: 281023 - DNA, 25 bp, Mus musculus
ctctttgccggaaaacacagccata

SEQ ID NO: 281024 - DNA, 25 bp, Mus musculus
ctacagcgtctctttgccggaaaac

SEQ ID NO: 281025 - DNA, 25 bp, Mus musculus
tcgtcaaggcagtggagaaagccac

SEQ ID NO: 281026 - DNA, 25 bp, Mus musculus
gaaagccaccgatgctgaggcccga

SEQ ID NO: 281027 - DNA, 25 bp, Mus musculus
aaggttcgggtacaagtgctggata

SEQ ID NO: 281028 - DNA, 25 bp, Mus musculus
cacagccataaggaccagcatcgca

SEQ ID NO: 281029 - DNA, 25 bp, Mus musculus
accagcatcgcaagagtcagtgcca

SEQ ID NO: 281030 - DNA, 25 bp, Mus musculus
tcgcaagagtcagtgccacggatgc

SEQ ID NO: 281031 - DNA, 25 bp, Mus musculus
ccacggatgcggacattgggaccaa

SEQ ID NO: 281032 - DNA, 25 bp, Mus musculus
tactacagttttaaagacagaactg

SEQ ID NO: 281033 - DNA, 25 bp, Mus musculus
tgctggatacaaacgacttaaggcc

SEQ ID NO: 281034 - DNA, 25 bp, Mus musculus
tgtttgctatccacccgaccagcgg

SEQ ID NO: 281035 - DNA, 25 bp, Mus musculus
gggaccaatggcgaattttactaca

SEQ ID NO: 281036 - DNA, 25 bp, Mus musculus
acacgctgaggatccgtgcgtctga

SEQ ID NO: 281037 - DNA, 25 bp, Mus musculus
ttgcaaacttaaatcacgtgccgtt

SEQ ID NO: 281038 - DNA, 25 bp, Mus musculus
ctgatgcctcgcgtgtacacgctga

SEQ ID NO: 281039 - DNA, 25 bp, Mus musculus
tctgactggggcttgccataccgcc

SEQ ID NO: 281040 - DNA, 25 bp, Mus musculus
gcatccatcgatgagaacgcgccta

SEQ ID NO: 281041 - DNA, 25 bp, Mus musculus
agaacgcgcctatcggtgccgcagt

SEQ ID NO: 281042 - DNA, 25 bp, Mus musculus
cgtgacttacagtattgcaaactta

SEQ ID NO: 281043 - DNA, 25 bp, Mus musculus
tctggactatgaactgatgcctcgc

SEQ ID NO: 281044 - DNA, 25 bp, Mus musculus
atcacgtgccgtttgtcattgacca

SEQ ID NO: 281045 - DNA, 25 bp, Mus musculus
gtcattgaccacttcacgggaaccg

SEQ ID NO: 281046 - DNA, 25 bp, Mus musculus
acgggaaccgtgagtacctctgaga

SEQ ID NO: 281047 - DNA, 25 bp, Mus musculus
cataccgccgggaagtcgaagtcct

SEQ ID NO: 281048 - DNA, 25 bp, Mus musculus
gtacctctgagaatctggactatga

SEQ ID NO: 281049 - DNA, 25 bp, Mus musculus
ggggagaatggctacgtgacttaca

SEQ ID NO: 281050 - DNA, 25 bp, Mus musculus
tgtcgcaacctgaacttggcgtttg

SEQ ID NO: 281051 - DNA, 25 bp, Mus musculus
gggcccaatgcggagctctcctaca

SEQ ID NO: 281052 - DNA, 25 bp, Mus musculus
ctctaccgcgtcatagccgcggata

SEQ ID NO: 281053 - DNA, 25 bp, Mus musculus
accggagcgcttcgaagcgcgagcc

SEQ ID NO: 281054 - DNA, 25 bp, Mus musculus
cctacagcatcgaggaaggcaacga

SEQ ID NO: 281055 - DNA, 25 bp, Mus musculus
aaggcaacgagcacggcaggttctc

SEQ ID NO: 281056 - DNA, 25 bp, Mus musculus
cgagcacggcaggttctccatcgaa

SEQ ID NO: 281057 - DNA, 25 bp, Mus musculus
ctccatcgaacccaaaacgggagtg

SEQ ID NO: 281058 - DNA, 25 bp, Mus musculus
caacctgaacttggcgtttggggag

SEQ ID NO: 281059 - DNA, 25 bp, Mus musculus
tctgcggccggagaatatgacattc

SEQ ID NO: 281060 - DNA, 25 bp, Mus musculus
agaaagcagtttcagtgtcgcaacc

SEQ ID NO: 281061 - DNA, 25 bp, Mus musculus
tccgtgagtccgattcctctcttct

SEQ ID NO: 281062 - DNA, 25 bp, Mus musculus
tatgacattctttccgtgagtccga

SEQ ID NO: 281063 - DNA, 25 bp, Mus musculus
cggagctctcctacagcatcgagga

SEQ ID NO: 281064 - DNA, 25 bp, Mus musculus
ttctcatttaccgtaatggaaagtg

SEQ ID NO: 281065 - DNA, 25 bp, Mus musculus
ccaggctccatatcgagtggatctc

SEQ ID NO: 281066 - DNA, 25 bp, Mus musculus
atggaaagtgatccggtggctcaca

SEQ ID NO: 281067 - DNA, 25 bp, Mus musculus
ttgacatcatcggtacgtggcgggc

SEQ ID NO: 281068 - DNA, 25 bp, Mus musculus
aagccgtcctcggagccgatttcgt

SEQ ID NO: 281069 - DNA, 25 bp, Mus musculus
cgtttgaggaatcggttttctcatt

SEQ ID NO: 281070 - DNA, 25 bp, Mus musculus
ggtggctcacatgatcggcgtgatc

SEQ ID NO: 281071 - DNA, 25 bp, Mus musculus
cctctgtggtttgacatcatcggta

SEQ ID NO: 281072 - DNA, 25 bp, Mus musculus
cctggcatgcctctgtggtttgaca

SEQ ID NO: 281073 - DNA, 25 bp, Mus musculus
gatcggcgtgatctcagttgagccc

SEQ ID NO: 281074 - DNA, 25 bp, Mus musculus
agaagtcgtccaccaccaggctcca

SEQ ID NO: 281075 - DNA, 25 bp, Mus musculus
agtggatctccaaacccaagccgtc

SEQ ID NO: 281076 - DNA, 25 bp, Mus musculus
acgtggcgggcgctcttagctctcg

SEQ ID NO: 281077 - DNA, 25 bp, Mus musculus
cggagccgatttcgtttgaggaatc

SEQ ID NO: 281078 - DNA, 25 bp, Mus musculus
ccttctgtggctttcggagtgagca

SEQ ID NO: 281079 - DNA, 25 bp, Mus musculus
ggcgcagacagctgtcttcccgctg

SEQ ID NO: 281080 - DNA, 25 bp, Mus musculus
acgtctatggcctctccggtggcag

SEQ ID NO: 281081 - DNA, 25 bp, Mus musculus
ttaaaagagaaacagcggcggcgcg

SEQ ID NO: 281082 - DNA, 25 bp, Mus musculus
agcaagtgccgcatccgcctgggcg

SEQ ID NO: 281083 - DNA, 25 bp, Mus musculus
gtcctagcattgctgggtgggcttc

SEQ ID NO: 281084 - DNA, 25 bp, Mus musculus
caaggcgcggctgcacgcagacctg

SEQ ID NO: 281085 - DNA, 25 bp, Mus musculus
caaggagagcaagtttccagtcttt

SEQ ID NO: 281086 - DNA, 25 bp, Mus musculus
tgtcctccctggctctaagaagggg

SEQ ID NO: 281087 - DNA, 25 bp, Mus musculus
cgctgcggaggcactatggtctccc

SEQ ID NO: 281088 - DNA, 25 bp, Mus musculus
cccattcattgcagacggagcgagg

SEQ ID NO: 281089 - DNA, 25 bp, Mus musculus
aggggctgtgtctgtcccgaaagcc

SEQ ID NO: 281090 - DNA, 25 bp, Mus musculus
gacgacagcacgttcctcccgtagg

SEQ ID NO: 281091 - DNA, 25 bp, Mus musculus
ttcccgctgcaagtccaggccgtag

SEQ ID NO: 281092 - DNA, 25 bp, Mus musculus
tccaagtgcacgacatggggactcc

SEQ ID NO: 281093 - DNA, 25 bp, Mus musculus
catcactgcgatagggaacccactc

SEQ ID NO: 281094 - DNA, 25 bp, Mus musculus
acgcctactccgcagttgtgaaaga

SEQ ID NO: 281095 - DNA, 25 bp, Mus musculus
agcatggcctccgtgaaaatcaacg

SEQ ID NO: 281096 - DNA, 25 bp, Mus musculus
gcctccgacggcaggttcacaagca

SEQ ID NO: 281097 - DNA, 25 bp, Mus musculus
cgactcagctacgaagccgctatga

SEQ ID NO: 281098 - DNA, 25 bp, Mus musculus
ccaaggcattctcccaggtcatgta

SEQ ID NO: 281099 - DNA, 25 bp, Mus musculus
cgcccgttttcacgcaggcagaata

SEQ ID NO: 281100 - DNA, 25 bp, Mus musculus
ggactcctcgtctgttcgccgagta

SEQ ID NO: 281101 - DNA, 25 bp, Mus musculus
tccgtacagtgctgagtctggacta

SEQ ID NO: 281102 - DNA, 25 bp, Mus musculus
agcgagtcagcctccgtcaacagtg

SEQ ID NO: 281103 - DNA, 25 bp, Mus musculus
gagccgtccgtgcacaactattttg

SEQ ID NO: 281104 - DNA, 25 bp, Mus musculus
gggaatccaatgctctgctcgtcta

SEQ ID NO: 281105 - DNA, 25 bp, Mus musculus
tgtgactgtgcacgtgatcgacatc

SEQ ID NO: 281106 - DNA, 25 bp, Mus musculus
ccaagtacgaggtgaacatcgggtc

SEQ ID NO: 281107 - DNA, 25 bp, Mus musculus
tcctcacagacgacaatgacaacgc

SEQ ID NO: 281108 - DNA, 25 bp, Mus musculus
acgtcggtcgtcaaggtctttgcga

SEQ ID NO: 281109 - DNA, 25 bp, Mus musculus
gtttcgctcaaccaagtacgaggtg

SEQ ID NO: 281110 - DNA, 25 bp, Mus musculus
aacatcgggtccagcgctgccaaag

SEQ ID NO: 281111 - DNA, 25 bp, Mus musculus
gctgccaaagggacgtcggtcgtca

SEQ ID NO: 281112 - DNA, 25 bp, Mus musculus
tctcgatccgcttgatggctaagga

SEQ ID NO: 281113 - DNA, 25 bp, Mus musculus
cggcggagaaagtgatctcgatccg

SEQ ID NO: 281114 - DNA, 25 bp, Mus musculus
gggaaggttgctttctgcaccgtca

SEQ ID NO: 281115 - DNA, 25 bp, Mus musculus
aggtctttgcgagtgacgctgatga

SEQ ID NO: 281116 - DNA, 25 bp, Mus musculus
acgctgatgagggatcgaatgctga

SEQ ID NO: 281117 - DNA, 25 bp, Mus musculus
ggatcgaatgctgacgtcacctacg

SEQ ID NO: 281118 - DNA, 25 bp, Mus musculus
gcaccgtcaatgtcatcctcacaga

SEQ ID NO: 281119 - DNA, 25 bp, Mus musculus
tgacaacgcacctcagtttcgctca

SEQ ID NO: 281120 - DNA, 25 bp, Mus musculus
tggctgcgctcagtcctcccgggtg

SEQ ID NO: 281121 - DNA, 25 bp, Mus musculus
gcacagtctagtggccgaggacact

SEQ ID NO: 281122 - DNA, 25 bp, Mus musculus
gtacacacagcttcagccggccggg

SEQ ID NO: 281123 - DNA, 25 bp, Mus musculus
gacgagtacacacagcttcagccgg

SEQ ID NO: 281124 - DNA, 25 bp, Mus musculus
gaggacgagtacacacagcttcagc

SEQ ID NO: 281125 - DNA, 25 bp, Mus musculus
aatgaggacgagtacacacagcttc

SEQ ID NO: 281126 - DNA, 25 bp, Mus musculus
gcgctcagtcctcccgggtggagtt

SEQ ID NO: 281127 - DNA, 25 bp, Mus musculus
gaggagaatgaggacgagtacacac

SEQ ID NO: 281128 - DNA, 25 bp, Mus musculus
ccgtgagcactgtgtggaggagaat

SEQ ID NO: 281129 - DNA, 25 bp, Mus musculus
ctgcgctgcggaggccgtgagcact

SEQ ID NO: 281130 - DNA, 25 bp, Mus musculus
cagtcccgtggagttctgcgctgcg

SEQ ID NO: 281131 - DNA, 25 bp, Mus musculus
tcctcgagcgtggggaggccaccca

SEQ ID NO: 281132 - DNA, 25 bp, Mus musculus
tctagtggccgaggacactgtgagc

SEQ ID NO: 281133 - DNA, 25 bp, Mus musculus
aggcccagtcccgtggagttctgcg

SEQ ID NO: 281134 - DNA, 25 bp, Mus musculus
gtcgccattcgcttcgcgaatctca

SEQ ID NO: 281135 - DNA, 25 bp, Mus musculus
agcaacttctgcataagattaattc

SEQ ID NO: 281136 - DNA, 25 bp, Mus musculus
ccacgtttcaacaaagcaacttctg

SEQ ID NO: 281137 - DNA, 25 bp, Mus musculus
tcaggcggcacccacgtttcaacaa

SEQ ID NO: 281138 - DNA, 25 bp, Mus musculus
ctctttgtcgagaggtcaggcggca

SEQ ID NO: 281139 - DNA, 25 bp, Mus musculus
ctggacgtcttactctttgtcgaga

SEQ ID NO: 281140 - DNA, 25 bp, Mus musculus
cccattcgcatctggacgtcttact

SEQ ID NO: 281141 - DNA, 25 bp, Mus musculus
atacagatcgtcagcctgcagccct

SEQ ID NO: 281142 - DNA, 25 bp, Mus musculus
ccggaagaatgacatacagatcgtc

SEQ ID NO: 281143 - DNA, 25 bp, Mus musculus
ctgggcgtccggaagaatgacatac

SEQ ID NO: 281144 - DNA, 25 bp, Mus musculus
ctacgcaacatcctgggcgtccgga

SEQ ID NO: 281145 - DNA, 25 bp, Mus musculus
ttggtgactactggcgcaacttcca

SEQ ID NO: 281146 - DNA, 25 bp, Mus musculus
aagattaattcttccgtgacggacg

SEQ ID NO: 281147 - DNA, 25 bp, Mus musculus
ccggaggagtttgttggtgactact

SEQ ID NO: 281148 - DNA, 25 bp, Mus musculus
gagcatccagaattcagcaccttca

SEQ ID NO: 281149 - DNA, 25 bp, Mus musculus
gccgccttccaactcgccctcagac

SEQ ID NO: 281150 - DNA, 25 bp, Mus musculus
tgcagcgtagctccaaacttgcctc

SEQ ID NO: 281151 - DNA, 25 bp, Mus musculus
ctgtgtgcagcgtagctccaaactt

SEQ ID NO: 281152 - DNA, 25 bp, Mus musculus
catcgaaaagccgtggctgtgtgca

SEQ ID NO: 281153 - DNA, 25 bp, Mus musculus
cccgagtctatgcacgggcatcgaa

SEQ ID NO: 281154 - DNA, 25 bp, Mus musculus
gcgatcccagagcatccagaattca

SEQ ID NO: 281155 - DNA, 25 bp, Mus musculus
gaaggctccgcgatcccagagcatc

SEQ ID NO: 281156 - DNA, 25 bp, Mus musculus
caattccttcgaaggctccgcgatc

SEQ ID NO: 281157 - DNA, 25 bp, Mus musculus
ttgaccgcaattccttcgaaggctc

SEQ ID NO: 281158 - DNA, 25 bp, Mus musculus
cgagaaacaaccttgaccgcaattc

SEQ ID NO: 281159 - DNA, 25 bp, Mus musculus
agcgactcgagaaacaaccttgacc

SEQ ID NO: 281160 - DNA, 25 bp, Mus musculus
tcccagcattccaagcgactcgaga

SEQ ID NO: 281161 - DNA, 25 bp, Mus musculus
ctatgcacgggcatcgaaaagccgt

SEQ ID NO: 281162 - DNA, 25 bp, Mus musculus
atgcccatgtccgtgtacgcctcga

SEQ ID NO: 281163 - DNA, 25 bp, Mus musculus
ttttgcagccgtctgggccgcttct

SEQ ID NO: 281164 - DNA, 25 bp, Mus musculus
cgaagcgcccaccatagaaaacatg

SEQ ID NO: 281165 - DNA, 25 bp, Mus musculus
atgctatcggtgacatccgccgttg

SEQ ID NO: 281166 - DNA, 25 bp, Mus musculus
ttcatgaacctagagatgctatcgg

SEQ ID NO: 281167 - DNA, 25 bp, Mus musculus
agtgcctggactttcatgaacctag

SEQ ID NO: 281168 - DNA, 25 bp, Mus musculus
tacggaagtgtgacgctcaaactcc

SEQ ID NO: 281169 - DNA, 25 bp, Mus musculus
cgctagattcccagcagcatacgga

SEQ ID NO: 281170 - DNA, 25 bp, Mus musculus
aggtgacgatccctccgctagattc

SEQ ID NO: 281171 - DNA, 25 bp, Mus musculus
cggccacttcgaagaggtgacgatc

SEQ ID NO: 281172 - DNA, 25 bp, Mus musculus
tcatgatgagcgactacgagagcgg

SEQ ID NO: 281173 - DNA, 25 bp, Mus musculus
ctccgacgtgtcagcgtgctgtgaa

SEQ ID NO: 281174 - DNA, 25 bp, Mus musculus
cgccgttgtgttgttcttttgcagc

SEQ ID NO: 281175 - DNA, 25 bp, Mus musculus
acggcttcctgctccgacgtgtcag

SEQ ID NO: 281176 - DNA, 25 bp, Mus musculus
atgccctgcacgagtctgcgtacta

SEQ ID NO: 281177 - DNA, 25 bp, Mus musculus
tgcaccacgccctggggacaaactt

SEQ ID NO: 281178 - DNA, 25 bp, Mus musculus
agctcccgcaggtttgttgtgatgc

SEQ ID NO: 281179 - DNA, 25 bp, Mus musculus
aattcgcatcgccagttccggacac

SEQ ID NO: 281180 - DNA, 25 bp, Mus musculus
acgagtctgcgtactacgcgccagc

SEQ ID NO: 281181 - DNA, 25 bp, Mus musculus
cactggggttcaaggcgaaagcgaa

SEQ ID NO: 281182 - DNA, 25 bp, Mus musculus
ttcaaggcgaaagcgaaagaccgga

SEQ ID NO: 281183 - DNA, 25 bp, Mus musculus
gaccggaacaacttctgagctctga

SEQ ID NO: 281184 - DNA, 25 bp, Mus musculus
gaagaaactagaaattcgcatcgcc

SEQ ID NO: 281185 - DNA, 25 bp, Mus musculus
caacttctgagctctgaagttcaga

SEQ ID NO: 281186 - DNA, 25 bp, Mus musculus
gttcagaatgcacgtgaaagctcac

SEQ ID NO: 281187 - DNA, 25 bp, Mus musculus
tgaaagctcacggtgtggaaagatg

SEQ ID NO: 281188 - DNA, 25 bp, Mus musculus
tagcttcgggatggagaagaaacta

SEQ ID NO: 281189 - DNA, 25 bp, Mus musculus
aggtttgttgtgatgccctgcacga

SEQ ID NO: 281190 - DNA, 25 bp, Mus musculus
tgaacccgcggagtgtccgggacca

SEQ ID NO: 281191 - DNA, 25 bp, Mus musculus
gccgttctcacgcagggcaagggct

SEQ ID NO: 281192 - DNA, 25 bp, Mus musculus
cgctagcgctgaacccgcggagtgt

SEQ ID NO: 281193 - DNA, 25 bp, Mus musculus
cgcgccgttctcacgcagggcaagg

SEQ ID NO: 281194 - DNA, 25 bp, Mus musculus
ttgtccgcgccgttctcacgcaggg

SEQ ID NO: 281195 - DNA, 25 bp, Mus musculus
gttgtccgcgccgttctcacgcagg

SEQ ID NO: 281196 - DNA, 25 bp, Mus musculus
tgcggtggttgtccgcgccgttctc

SEQ ID NO: 281197 - DNA, 25 bp, Mus musculus
cagcactgtgcggtggttgtccgcg

SEQ ID NO: 281198 - DNA, 25 bp, Mus musculus
cagggcaagggctgcagcatgtccc

SEQ ID NO: 281199 - DNA, 25 bp, Mus musculus
agggctgcagcatgtccccggatcc

SEQ ID NO: 281200 - DNA, 25 bp, Mus musculus
cagcgagccggcagagacggagcca

SEQ ID NO: 281201 - DNA, 25 bp, Mus musculus
ccgctagcgctgaacccgcggagtg

SEQ ID NO: 281202 - DNA, 25 bp, Mus musculus
cgggaccagcgagccggcagagacg

SEQ ID NO: 281203 - DNA, 25 bp, Mus musculus
cagagacggagccaggggcgctggc

SEQ ID NO: 281204 - DNA, 25 bp, Mus musculus
tactgtaggccctcggaacgttcga

SEQ ID NO: 281205 - DNA, 25 bp, Mus musculus
tcggggatcactccacagcagagcc

SEQ ID NO: 281206 - DNA, 25 bp, Mus musculus
tccgtgatggttgacgcgaagcatt

SEQ ID NO: 281207 - DNA, 25 bp, Mus musculus
gcacggcgcgtccacgaaaacggaa

SEQ ID NO: 281208 - DNA, 25 bp, Mus musculus
ggccatagaatacgtaagtctcagc

SEQ ID NO: 281209 - DNA, 25 bp, Mus musculus
agtctcagccaataaaatctctcga

SEQ ID NO: 281210 - DNA, 25 bp, Mus musculus
gcacagttccgcaagctgccgctgg

SEQ ID NO: 281211 - DNA, 25 bp, Mus musculus
atctctcgaaactaagccttctgtt

SEQ ID NO: 281212 - DNA, 25 bp, Mus musculus
ccgccatcggcgaatagtttccctg

SEQ ID NO: 281213 - DNA, 25 bp, Mus musculus
gtttccctgtggtacgctccgtgat

SEQ ID NO: 281214 - DNA, 25 bp, Mus musculus
acttccgggacgacccttgcttgca

SEQ ID NO: 281215 - DNA, 25 bp, Mus musculus
gagttgtagtcacctgtcggagccc

SEQ ID NO: 281216 - DNA, 25 bp, Mus musculus
ctccagcctagagcgcagcagcaga

SEQ ID NO: 281217 - DNA, 25 bp, Mus musculus
agaaccctttcccaacgtgctactg

SEQ ID NO: 281218 - DNA, 25 bp, Mus musculus
acggcctggttctgcccagcgcgat

SEQ ID NO: 281219 - DNA, 25 bp, Mus musculus
gagcacgcacgtagcccggaaaaga

SEQ ID NO: 281220 - DNA, 25 bp, Mus musculus
ctttgtgactgagagcacgcacgta

SEQ ID NO: 281221 - DNA, 25 bp, Mus musculus
caatcgccggtgcatggctttgtga

SEQ ID NO: 281222 - DNA, 25 bp, Mus musculus
agtcaagcccttttagccctctgga

SEQ ID NO: 281223 - DNA, 25 bp, Mus musculus
gtactgctgggtggagtcaagccct

SEQ ID NO: 281224 - DNA, 25 bp, Mus musculus
atgcgagccgagctaggcacgtact

SEQ ID NO: 281225 - DNA, 25 bp, Mus musculus
ccgccctgttgggagcgaagcccag

SEQ ID NO: 281226 - DNA, 25 bp, Mus musculus
cgcggcctgccagctgattggccag

SEQ ID NO: 281227 - DNA, 25 bp, Mus musculus
tcacgtacccaaacactgacatgtg

SEQ ID NO: 281228 - DNA, 25 bp, Mus musculus
cgttagagggcatgtcgatgagact

SEQ ID NO: 281229 - DNA, 25 bp, Mus musculus
cagcttggtccgaaggtgcttcctc

SEQ ID NO: 281230 - DNA, 25 bp, Mus musculus
cactgacatgtgcagcctggaaccc

SEQ ID NO: 281231 - DNA, 25 bp, Mus musculus
gaagcagaagtagcccacacccatc

SEQ ID NO: 281232 - DNA, 25 bp, Mus musculus
tctcaccagtcttcggagggccgct

SEQ ID NO: 281233 - DNA, 25 bp, Mus musculus
cgagccgcgttcacctcaaagcgtt

SEQ ID NO: 281234 - DNA, 25 bp, Mus musculus
tcacctcaaagcgttgcggacagcg

SEQ ID NO: 281235 - DNA, 25 bp, Mus musculus
agacagcacgctgattggcccactc

SEQ ID NO: 281236 - DNA, 25 bp, Mus musculus
tggcccactctgtccgcagggttac

SEQ ID NO: 281237 - DNA, 25 bp, Mus musculus
tccgcagggttactggggcatctag

SEQ ID NO: 281238 - DNA, 25 bp, Mus musculus
ggcgctgaggcaagacacacgcttc

SEQ ID NO: 281239 - DNA, 25 bp, Mus musculus
ggaatcctttcccaccgcgatggca

SEQ ID NO: 281240 - DNA, 25 bp, Mus musculus
gcaagacacacgcttcctcgggtct

SEQ ID NO: 281241 - DNA, 25 bp, Mus musculus
caggtccctcgacccggtattgaga

SEQ ID NO: 281242 - DNA, 25 bp, Mus musculus
ctcgacccggtattgagaggagacg

SEQ ID NO: 281243 - DNA, 25 bp, Mus musculus
gtcactaccggccacaggctgtcat

SEQ ID NO: 281244 - DNA, 25 bp, Mus musculus
tcgggtctcctgaagctgtcactac

SEQ ID NO: 281245 - DNA, 25 bp, Mus musculus
actggggcatctagcccgcgcaagc

SEQ ID NO: 281246 - DNA, 25 bp, Mus musculus
aggcccgtgtgtcgctgcacactct

SEQ ID NO: 281247 - DNA, 25 bp, Mus musculus
tcagacccgggtgtcgctgcacact

SEQ ID NO: 281248 - DNA, 25 bp, Mus musculus
actctcaggcccgtgtgtcgctgca

SEQ ID NO: 281249 - DNA, 25 bp, Mus musculus
agacccgggtgtcgctgcacactct

SEQ ID NO: 281250 - DNA, 25 bp, Mus musculus
cgtgtgtcggtgcacactctcaggc

SEQ ID NO: 281251 - DNA, 25 bp, Mus musculus
ctctcaggcccgtgtgtcggtgcac

SEQ ID NO: 281252 - DNA, 25 bp, Mus musculus
ccgtgtgtcggtgcacactctcaga

SEQ ID NO: 281253 - DNA, 25 bp, Mus musculus
tgtcggtgcacactctcagacccgg

SEQ ID NO: 281254 - DNA, 25 bp, Mus musculus
tgcacactctcagacccgggtgtcg

SEQ ID NO: 281255 - DNA, 25 bp, Mus musculus
gtgcacactctcagacccgggtgtc

SEQ ID NO: 281256 - DNA, 25 bp, Mus musculus
actctcaggcccgtgtgtcggtgca

SEQ ID NO: 281257 - DNA, 25 bp, Mus musculus
gcccgtgtgtcggtgcacactctca

SEQ ID NO: 281258 - DNA, 25 bp, Mus musculus
tgtcggtgcacactctcaggcccgt

SEQ ID NO: 281259 - DNA, 25 bp, Mus musculus
tctcaggcccgtgtgtcgctgcaca

SEQ ID NO: 281260 - DNA, 25 bp, Mus musculus
cgcagagcgagcgagaacccgaacg

SEQ ID NO: 281261 - DNA, 25 bp, Mus musculus
gggacacaggctgtcctcagcccta

SEQ ID NO: 281262 - DNA, 25 bp, Mus musculus
agacctcgcgaggtcctgccgagaa

SEQ ID NO: 281263 - DNA, 25 bp, Mus musculus
cggtctccgttagcttctaccgcgg

SEQ ID NO: 281264 - DNA, 25 bp, Mus musculus
tcgggcttccgcatccggtcggtct

SEQ ID NO: 281265 - DNA, 25 bp, Mus musculus
cgcaagagtccgtggcggccacagt

SEQ ID NO: 281266 - DNA, 25 bp, Mus musculus
tctcccggaactacggacgacagga

SEQ ID NO: 281267 - DNA, 25 bp, Mus musculus
gcgagcgacgtggtaaccgctatta

SEQ ID NO: 281268 - DNA, 25 bp, Mus musculus
ccacagttcgcaggtgagcggcgct

SEQ ID NO: 281269 - DNA, 25 bp, Mus musculus
tggtggcctcctttccatgagcctc

SEQ ID NO: 281270 - DNA, 25 bp, Mus musculus
tgccctggacaacagggaggccttg

SEQ ID NO: 281271 - DNA, 25 bp, Mus musculus
cgtctagacctaccgcagcgtcgtg

SEQ ID NO: 281272 - DNA, 25 bp, Mus musculus
agcgccggcctgatcactttgaccg

SEQ ID NO: 281273 - DNA, 25 bp, Mus musculus
tgatcactttgaccgggtctcccgg

SEQ ID NO: 281274 - DNA, 25 bp, Mus musculus
aaagccgggcgcacacagcctgcaa

SEQ ID NO: 281275 - DNA, 25 bp, Mus musculus
ccgcccgcctgaccgcagccctcct

SEQ ID NO: 281276 - DNA, 25 bp, Mus musculus
gtccctgcacgacgcgaagggaccg

SEQ ID NO: 281277 - DNA, 25 bp, Mus musculus
aatccgtccctgcacgacgcgaagg

SEQ ID NO: 281278 - DNA, 25 bp, Mus musculus
cctacgcccggccaggcaccgccac

SEQ ID NO: 281279 - DNA, 25 bp, Mus musculus
agccgctcgtttgctcttgcctacg

SEQ ID NO: 281280 - DNA, 25 bp, Mus musculus
acagcctgcaaggagccgctcgttt

SEQ ID NO: 281281 - DNA, 25 bp, Mus musculus
ctgatcccccatgctgaaagccggg

SEQ ID NO: 281282 - DNA, 25 bp, Mus musculus
ttaagaaagctcaaagcctgatccc

SEQ ID NO: 281283 - DNA, 25 bp, Mus musculus
gccaggaagtccttaagaaagctca

SEQ ID NO: 281284 - DNA, 25 bp, Mus musculus
cggcgatgccacctgccaggaagtc

SEQ ID NO: 281285 - DNA, 25 bp, Mus musculus
gccacctgccaggaagtccttaaga

SEQ ID NO: 281286 - DNA, 25 bp, Mus musculus
ggagccgctcgtttgctcttgccta

SEQ ID NO: 281287 - DNA, 25 bp, Mus musculus
agtccttaagaaagctcaaagcctg

SEQ ID NO: 281288 - DNA, 25 bp, Mus musculus
tctccacggtgaagcactggccgga

SEQ ID NO: 281289 - DNA, 25 bp, Mus musculus
ttcttgcctcggttgcccttgctgc

SEQ ID NO: 281290 - DNA, 25 bp, Mus musculus
ctccggttgttcttgcctcggttgc

SEQ ID NO: 281291 - DNA, 25 bp, Mus musculus
agaaaaagagccctgctccggttgt

SEQ ID NO: 281292 - DNA, 25 bp, Mus musculus
gtttcctagaaaaagagccctgctc

SEQ ID NO: 281293 - DNA, 25 bp, Mus musculus
cggcttggcagagtttcctagaaaa

SEQ ID NO: 281294 - DNA, 25 bp, Mus musculus
ctaggcgccacaccggcttggcaga

SEQ ID NO: 281295 - DNA, 25 bp, Mus musculus
gggtaacaagtctctaggcgccaca

SEQ ID NO: 281296 - DNA, 25 bp, Mus musculus
ggcgcacacagcgtccgcgctctcc

SEQ ID NO: 281297 - DNA, 25 bp, Mus musculus
ccgactccagttcctggcgcacaca

SEQ ID NO: 281298 - DNA, 25 bp, Mus musculus
ccacagcggagttggccgagagccc

SEQ ID NO: 281299 - DNA, 25 bp, Mus musculus
agttccacagcggagttggccgaga

SEQ ID NO: 281300 - DNA, 25 bp, Mus musculus
cgacaagttccacagcggagttggc

SEQ ID NO: 281301 - DNA, 25 bp, Mus musculus
aacaagtctctaggcgccacaccgg

SEQ ID NO: 281302 - DNA, 25 bp, Mus musculus
atcagattgagataatgccggtcca

SEQ ID NO: 281303 - DNA, 25 bp, Mus musculus
caagaaggggctgtgctgctgtgcc

SEQ ID NO: 281304 - DNA, 25 bp, Mus musculus
ccctgcatcggagccaagaaggggc

SEQ ID NO: 281305 - DNA, 25 bp, Mus musculus
agataatgccggtccaggccctgca

SEQ ID NO: 281306 - DNA, 25 bp, Mus musculus
tggccgatcagattgagataatgcc

SEQ ID NO: 281307 - DNA, 25 bp, Mus musculus
ggccatggccgatcagattgagata

SEQ ID NO: 281308 - DNA, 25 bp, Mus musculus
taatctaggcagtgagtgggtgtca

SEQ ID NO: 281309 - DNA, 25 bp, Mus musculus
ccaccgaatcgcaaagtaatctagg

SEQ ID NO: 281310 - DNA, 25 bp, Mus musculus
gccgccaccgaatcgcaaagtaatc

SEQ ID NO: 281311 - DNA, 25 bp, Mus musculus
caagccgccaccgaatcgcaaagta

SEQ ID NO: 281312 - DNA, 25 bp, Mus musculus
acatatacatcgtctcaagccgcca

SEQ ID NO: 281313 - DNA, 25 bp, Mus musculus
tacaacatatacatcgtctcaagcc

SEQ ID NO: 281314 - DNA, 25 bp, Mus musculus
cgcaaagtaatctaggcagtgagtg

SEQ ID NO: 281315 - DNA, 25 bp, Mus musculus
ccaggccctgcatcggagccaagaa

SEQ ID NO: 281316 - DNA, 25 bp, Mus musculus
gcctgcactcttagccggcgcagag

SEQ ID NO: 281317 - DNA, 25 bp, Mus musculus
acaccgctttatttgtccggacatc

SEQ ID NO: 281318 - DNA, 25 bp, Mus musculus
cacgacttggtgacacgtccgtctc

SEQ ID NO: 281319 - DNA, 25 bp, Mus musculus
cccaggcttttctcacacgacttgg

SEQ ID NO: 281320 - DNA, 25 bp, Mus musculus
ccgccgggttcaagggagagcttct

SEQ ID NO: 281321 - DNA, 25 bp, Mus musculus
ttaataggctgttccgccgggttca

SEQ ID NO: 281322 - DNA, 25 bp, Mus musculus
cctgtccagagtcattaaagtaatt

SEQ ID NO: 281323 - DNA, 25 bp, Mus musculus
gtgcgttttaaagcctgtccagagt

SEQ ID NO: 281324 - DNA, 25 bp, Mus musculus
gtcccagcgccgagtgcgttttaaa

SEQ ID NO: 281325 - DNA, 25 bp, Mus musculus
gtttacaaatcccagcaagcccgcg

SEQ ID NO: 281326 - DNA, 25 bp, Mus musculus
tgagtctcacacgatcgcctgttta

SEQ ID NO: 281327 - DNA, 25 bp, Mus musculus
ttcctttagtcccaccgctgagtct

SEQ ID NO: 281328 - DNA, 25 bp, Mus musculus
gggcgaggaccttcacaaaacagcg

SEQ ID NO: 281329 - DNA, 25 bp, Mus musculus
aacagcgtcgcttcctttagtccca

SEQ ID NO: 281330 - DNA, 25 bp, Mus musculus
gattgcagtgacagccgcctgtgga

SEQ ID NO: 281331 - DNA, 25 bp, Mus musculus
aaatagcatcgcaacccggcgcggg

SEQ ID NO: 281332 - DNA, 25 bp, Mus musculus
cccgatgtcataagtagaaattctc

SEQ ID NO: 281333 - DNA, 25 bp, Mus musculus
cgctcagagcccgatgtcataagta

SEQ ID NO: 281334 - DNA, 25 bp, Mus musculus
ctccttaaatagcatcgcaacccgg

SEQ ID NO: 281335 - DNA, 25 bp, Mus musculus
tgacagccgcctgtggagcagcccg

SEQ ID NO: 281336 - DNA, 25 bp, Mus musculus
gcgagtcggccaaggcgaccctagc

SEQ ID NO: 281337 - DNA, 25 bp, Mus musculus
ctctgcgggacgttccgcttttccg

SEQ ID NO: 281338 - DNA, 25 bp, Mus musculus
cacggcctcgtttccctcggcttcg

SEQ ID NO: 281339 - DNA, 25 bp, Mus musculus
tgcaccgcggagtcaagaggttcct

SEQ ID NO: 281340 - DNA, 25 bp, Mus musculus
caagaggttcctctctgcacggtcc

SEQ ID NO: 281341 - DNA, 25 bp, Mus musculus
actcaccgcgcgtggacacggactg

SEQ ID NO: 281342 - DNA, 25 bp, Mus musculus
gactgtcccggtgccgctctgtgac

SEQ ID NO: 281343 - DNA, 25 bp, Mus musculus
agggtcagaagcagcgctcagagcc

SEQ ID NO: 281344 - DNA, 25 bp, Mus musculus
agcctgcagcagctaagccggttgc

SEQ ID NO: 281345 - DNA, 25 bp, Mus musculus
ccctgcctttgggaacggtaggatg

SEQ ID NO: 281346 - DNA, 25 bp, Mus musculus
gcgcgagtttggagtccctgccttt

SEQ ID NO: 281347 - DNA, 25 bp, Mus musculus
agcaagaccggctaggcgcgagttt

SEQ ID NO: 281348 - DNA, 25 bp, Mus musculus
ctgattggctgttcagagcaagacc

SEQ ID NO: 281349 - DNA, 25 bp, Mus musculus
aaaaggcggagcatagcgaggacta

SEQ ID NO: 281350 - DNA, 25 bp, Mus musculus
cactggagttttggatccgctggcg

SEQ ID NO: 281351 - DNA, 25 bp, Mus musculus
tttccaggcctggatttcatcgtgc

SEQ ID NO: 281352 - DNA, 25 bp, Mus musculus
aagccggttgctttggactccgctc

SEQ ID NO: 281353 - DNA, 25 bp, Mus musculus
taaatttacggaacggagcgagagc

SEQ ID NO: 281354 - DNA, 25 bp, Mus musculus
ctgcaaggagaagtttgagatactc

SEQ ID NO: 281355 - DNA, 25 bp, Mus musculus
tagcgaggactaggctctgattggc

SEQ ID NO: 281356 - DNA, 25 bp, Mus musculus
cgctccgctgttgggtgttttccag

SEQ ID NO: 281357 - DNA, 25 bp, Mus musculus
gatttcatcgtgctctcgcccagga

SEQ ID NO: 281358 - DNA, 25 bp, Mus musculus
aggatcctttgtgttgcctccaggc

SEQ ID NO: 281359 - DNA, 25 bp, Mus musculus
ggcgtggccgaaagacctctctaaa

SEQ ID NO: 281360 - DNA, 25 bp, Mus musculus
gcggtgtccctaaacctgggtgagc

SEQ ID NO: 281361 - DNA, 25 bp, Mus musculus
tgagaacccagacccgggaggccaa

SEQ ID NO: 281362 - DNA, 25 bp, Mus musculus
gcctccaggcttgctcaggcaaaca

SEQ ID NO: 281363 - DNA, 25 bp, Mus musculus
gcaatctgggcggaggatcctttgt

SEQ ID NO: 281364 - DNA, 25 bp, Mus musculus
gtctgctgctctcgcgccttcgaag

SEQ ID NO: 281365 - DNA, 25 bp, Mus musculus
aacggtacggtgagtgtctgctgct

SEQ ID NO: 281366 - DNA, 25 bp, Mus musculus
tggtgggatcaaagcgcagtgtcct

SEQ ID NO: 281367 - DNA, 25 bp, Mus musculus
accaccaatcgcgactggcgtgtgc

SEQ ID NO: 281368 - DNA, 25 bp, Mus musculus
tcagtcggggctgaaaccaccaatc

SEQ ID NO: 281369 - DNA, 25 bp, Mus musculus
gaaccagagcttgaaacccgcgcga

SEQ ID NO: 281370 - DNA, 25 bp, Mus musculus
tttacctcaagtggcgcaagtcggc

SEQ ID NO: 281371 - DNA, 25 bp, Mus musculus
agcgcgatcccgagctgagaaccca

SEQ ID NO: 281372 - DNA, 25 bp, Mus musculus
tgaaggctgccctaaggcggtccca

SEQ ID NO: 281373 - DNA, 25 bp, Mus musculus
cccgggaagccttcgcgagagctca

SEQ ID NO: 281374 - DNA, 25 bp, Mus musculus
gaggctagtagcctccgccgcgagc

SEQ ID NO: 281375 - DNA, 25 bp, Mus musculus
accggcgtctggtgccagtggacac

SEQ ID NO: 281376 - DNA, 25 bp, Mus musculus
agctagtccctgtcgctcggccttg

SEQ ID NO: 281377 - DNA, 25 bp, Mus musculus
ggccaatcgcggtgcccagctagtc

SEQ ID NO: 281378 - DNA, 25 bp, Mus musculus
ccgccggccgaacatggttggtgca

SEQ ID NO: 281379 - DNA, 25 bp, Mus musculus
ccggcggtctctggtgtaaatagac

SEQ ID NO: 281380 - DNA, 25 bp, Mus musculus
accgggttcttctcggtgcccagcg

SEQ ID NO: 281381 - DNA, 25 bp, Mus musculus
tgaccactgtaaacttgaaggctgc

SEQ ID NO: 281382 - DNA, 25 bp, Mus musculus
ccgggcagtgaccactgtaaacttg

SEQ ID NO: 281383 - DNA, 25 bp, Mus musculus
ctatatgcccgtgcccgggcagtga

SEQ ID NO: 281384 - DNA, 25 bp, Mus musculus
taaatagactggcacccgcggtccc

SEQ ID NO: 281385 - DNA, 25 bp, Mus musculus
ccctaaggcggtcccaggatgcgct

SEQ ID NO: 281386 - DNA, 25 bp, Mus musculus
ttcctctctgccagggcgtttttgg

SEQ ID NO: 281387 - DNA, 25 bp, Mus musculus
gctcccgcgtacgacactattgcta

SEQ ID NO: 281388 - DNA, 25 bp, Mus musculus
agattgtttgctccgtagacgctcc

SEQ ID NO: 281389 - DNA, 25 bp, Mus musculus
cgcgatggcgtatttccgtttcctc

SEQ ID NO: 281390 - DNA, 25 bp, Mus musculus
ctgaacgtttagcacgccgagcgtg

SEQ ID NO: 281391 - DNA, 25 bp, Mus musculus
cgtgagcttacatcgggcaatactt

SEQ ID NO: 281392 - DNA, 25 bp, Mus musculus
ttgggagggactatcgattttcatc

SEQ ID NO: 281393 - DNA, 25 bp, Mus musculus
tcgggagaggttcacccacctgtct

SEQ ID NO: 281394 - DNA, 25 bp, Mus musculus
gaagttgcatcacctccggtcgcgc

SEQ ID NO: 281395 - DNA, 25 bp, Mus musculus
tctcgacctagagtccgccggattc

SEQ ID NO: 281396 - DNA, 25 bp, Mus musculus
agcgccatcttgtacggaccctgaa

SEQ ID NO: 281397 - DNA, 25 bp, Mus musculus
acccagataggagctagccgaaacc

SEQ ID NO: 281398 - DNA, 25 bp, Mus musculus
gcgccaggcagtgacagtccttagc

SEQ ID NO: 281399 - DNA, 25 bp, Mus musculus
ttcctaaagcaacgatggccgctcc

SEQ ID NO: 281400 - DNA, 25 bp, Mus musculus
ctccacttcccgagggatggtcgtg

SEQ ID NO: 281401 - DNA, 25 bp, Mus musculus
tgatccgccggatgatctccatctc

SEQ ID NO: 281402 - DNA, 25 bp, Mus musculus
ttccaccgtcaagtctgggttgatc

SEQ ID NO: 281403 - DNA, 25 bp, Mus musculus
gggcagtgtgcctcatgacattttc

SEQ ID NO: 281404 - DNA, 25 bp, Mus musculus
ttcaagtttcttcatcagggcagtg

SEQ ID NO: 281405 - DNA, 25 bp, Mus musculus
gctccggtgagctttttcttcttca

SEQ ID NO: 281406 - DNA, 25 bp, Mus musculus
cggggatatccagatgcgagccatc

SEQ ID NO: 281407 - DNA, 25 bp, Mus musculus
cgagccatccgaaggatctcctttg

SEQ ID NO: 281408 - DNA, 25 bp, Mus musculus
atctcctttggacactcgcgtcttg

SEQ ID NO: 281409 - DNA, 25 bp, Mus musculus
tcttgctgtgtgaccgagacttccc

SEQ ID NO: 281410 - DNA, 25 bp, Mus musculus
tgaccgagacttcccgtgggacttg

SEQ ID NO: 281411 - DNA, 25 bp, Mus musculus
acttgcggtgagtccggctcttttt

SEQ ID NO: 281412 - DNA, 25 bp, Mus musculus
ggctctttttactccttccactgtg

SEQ ID NO: 281413 - DNA, 25 bp, Mus musculus
gcgtgtcctcgtctcgcagaggcca

SEQ ID NO: 281414 - DNA, 25 bp, Mus musculus
gcttccagcttccagattcctgagg

SEQ ID NO: 281415 - DNA, 25 bp, Mus musculus
tcaggcttcctccttccgaggctgg

SEQ ID NO: 281416 - DNA, 25 bp, Mus musculus
ggatcgttccacgtctttccgatgg

SEQ ID NO: 281417 - DNA, 25 bp, Mus musculus
gggacggctacccagtgtcatgcta

SEQ ID NO: 281418 - DNA, 25 bp, Mus musculus
atactcttactcacgggccgcggtg

SEQ ID NO: 281419 - DNA, 25 bp, Mus musculus
ggcagtcttcattccagaggctcga

SEQ ID NO: 281420 - DNA, 25 bp, Mus musculus
tctctcgcagtcctcgggaggcagt

SEQ ID NO: 281421 - DNA, 25 bp, Mus musculus
caaccgcactaggaggcttcagcgc

SEQ ID NO: 281422 - DNA, 25 bp, Mus musculus
ggagtgcttagccaactgtgcgcca

SEQ ID NO: 281423 - DNA, 25 bp, Mus musculus
cgccgagacttgcagcgtggaagca

SEQ ID NO: 281424 - DNA, 25 bp, Mus musculus
cttcatttgcaatccgccgggcttc

SEQ ID NO: 281425 - DNA, 25 bp, Mus musculus
agaaggctcggattttacactcgtc

SEQ ID NO: 281426 - DNA, 25 bp, Mus musculus
tgtcatgctaatctcggggcagcgc

SEQ ID NO: 281427 - DNA, 25 bp, Mus musculus
cccgattcagcgcaggagtgcttag

SEQ ID NO: 281428 - DNA, 25 bp, Mus musculus
gatgctttcgctcgtactttatgga

SEQ ID NO: 281429 - DNA, 25 bp, Mus musculus
cgtactttatggaaggtctacctgc

SEQ ID NO: 281430 - DNA, 25 bp, Mus musculus
aagccattatctgcattccgtgacg

SEQ ID NO: 281431 - DNA, 25 bp, Mus musculus
cacaggaggaaacgaagccattatc

SEQ ID NO: 281432 - DNA, 25 bp, Mus musculus
ggtttctgccgattaaaacacagga

SEQ ID NO: 281433 - DNA, 25 bp, Mus musculus
aggtctacctgctcgcacaggtttc

SEQ ID NO: 281434 - DNA, 25 bp, Mus musculus
taaccgtggcacgatgctttcgctc

SEQ ID NO: 281435 - DNA, 25 bp, Mus musculus
ttctcttagggtcacgcggtaacgc

SEQ ID NO: 281436 - DNA, 25 bp, Mus musculus
ctctggcatgaataaccgtggcacg

SEQ ID NO: 281437 - DNA, 25 bp, Mus musculus
gctggctgcactctggcatgaataa

SEQ ID NO: 281438 - DNA, 25 bp, Mus musculus
agagtcccggggctggctgcactct

SEQ ID NO: 281439 - DNA, 25 bp, Mus musculus
agacgttgaggttttctggaaagag

SEQ ID NO: 281440 - DNA, 25 bp, Mus musculus
gagcaggaaagacgttgaggttttc

SEQ ID NO: 281441 - DNA, 25 bp, Mus musculus
cggtaacgcgtccagcagagagcag

SEQ ID NO: 281442 - DNA, 25 bp, Mus musculus
tccacgttccaagtgccctaaagtc

SEQ ID NO: 281443 - DNA, 25 bp, Mus musculus
ctccgctttgaaatctgcgaagatc

SEQ ID NO: 281444 - DNA, 25 bp, Mus musculus
ggctgtgaccttcttgttccagaag

SEQ ID NO: 281445 - DNA, 25 bp, Mus musculus
tgcgaagatctcgtacccgatgtgg

SEQ ID NO: 281446 - DNA, 25 bp, Mus musculus
gcggcgcgatctgcagaaacttctc

SEQ ID NO: 281447 - DNA, 25 bp, Mus musculus
cttaaccaggcatcggtcgcgcaga

SEQ ID NO: 281448 - DNA, 25 bp, Mus musculus
gtcgcgcagactgcactcaccggtg

SEQ ID NO: 281449 - DNA, 25 bp, Mus musculus
tggtgcaaggagcagtccacgttcc

SEQ ID NO: 281450 - DNA, 25 bp, Mus musculus
aactcggcctaagcgcaggctcagc

SEQ ID NO: 281451 - DNA, 25 bp, Mus musculus
agcaagacctgctcgtcgatccagc

SEQ ID NO: 281452 - DNA, 25 bp, Mus musculus
tccagcctaggaaaaaagtctcggc

SEQ ID NO: 281453 - DNA, 25 bp, Mus musculus
cgtggaaaagctgacatccgtagcc

SEQ ID NO: 281454 - DNA, 25 bp, Mus musculus
tccagaagtgttgcatgttctccgc

SEQ ID NO: 281455 - DNA, 25 bp, Mus musculus
cccagaccgagatgcgcgcgagaat

SEQ ID NO: 281456 - DNA, 25 bp, Mus musculus
aaggacgtgggtcgctctccgcgtt

SEQ ID NO: 281457 - DNA, 25 bp, Mus musculus
cggcgttaggggaccatgcgtagtt

SEQ ID NO: 281458 - DNA, 25 bp, Mus musculus
ctgtgtacggcgccgctccttgcag

SEQ ID NO: 281459 - DNA, 25 bp, Mus musculus
ggacgtgggtcgctctccgcgttcc

SEQ ID NO: 281460 - DNA, 25 bp, Mus musculus
gactatagcggcaaggacgtgggtc

SEQ ID NO: 281461 - DNA, 25 bp, Mus musculus
ttgtattggaggactatagcggcaa

SEQ ID NO: 281462 - DNA, 25 bp, Mus musculus
gattgtattggaggactatagcggc

SEQ ID NO: 281463 - DNA, 25 bp, Mus musculus
ccggattgtattggaggactatagc

SEQ ID NO: 281464 - DNA, 25 bp, Mus musculus
agccggattgtattggaggactata

SEQ ID NO: 281465 - DNA, 25 bp, Mus musculus
cgagccggattgtattggaggacta

SEQ ID NO: 281466 - DNA, 25 bp, Mus musculus
ccgagccggattgtattggaggact

SEQ ID NO: 281467 - DNA, 25 bp, Mus musculus
cgctgagcgtcgagaggagcgcggg

SEQ ID NO: 281468 - DNA, 25 bp, Mus musculus
actcagcgcggcgttaggggaccat

SEQ ID NO: 281469 - DNA, 25 bp, Mus musculus
gctctccgcgttccctgtgtacggc

SEQ ID NO: 281470 - DNA, 25 bp, Mus musculus
tcgtcctggaggcacacttttttgg

SEQ ID NO: 281471 - DNA, 25 bp, Mus musculus
tgctgcccactgacggcgaccggag

SEQ ID NO: 281472 - DNA, 25 bp, Mus musculus
ccgcgcctacttcgcgctggctctc

SEQ ID NO: 281473 - DNA, 25 bp, Mus musculus
tcccgaggccacagtcatcttcagt

SEQ ID NO: 281474 - DNA, 25 bp, Mus musculus
acagtcatcttcagtccccgggcta

SEQ ID NO: 281475 - DNA, 25 bp, Mus musculus
ccgggctaagttgccgccatcttcg

SEQ ID NO: 281476 - DNA, 25 bp, Mus musculus
aagttgccgccatcttcgtcctgga

SEQ ID NO: 281477 - DNA, 25 bp, Mus musculus
ggagcgctggattttgcgtcatctc

SEQ ID NO: 281478 - DNA, 25 bp, Mus musculus
tggattttgcgtcatctcctcccgc

SEQ ID NO: 281479 - DNA, 25 bp, Mus musculus
ccgaggtctctccatcctggtgcag

SEQ ID NO: 281480 - DNA, 25 bp, Mus musculus
gtctctccatcctggtgcagtgaca

SEQ ID NO: 281481 - DNA, 25 bp, Mus musculus
cggcagcttgaagacccgctgtcca

SEQ ID NO: 281482 - DNA, 25 bp, Mus musculus
tggtgcagtgacagcagcttggccc

SEQ ID NO: 281483 - DNA, 25 bp, Mus musculus
atggcccagctgaggacagcccgct

SEQ ID NO: 281484 - DNA, 25 bp, Mus musculus
ctaggtgtcccttaacgtgatcccg

SEQ ID NO: 281485 - DNA, 25 bp, Mus musculus
cgggcgacagaaggcgacacttcct

SEQ ID NO: 281486 - DNA, 25 bp, Mus musculus
tccgctggcacaggaagcacttcct

SEQ ID NO: 281487 - DNA, 25 bp, Mus musculus
tcctgggcttgagtgacagcactcc

SEQ ID NO: 281488 - DNA, 25 bp, Mus musculus
aaggtgttccatttcctagaggaga

SEQ ID NO: 281489 - DNA, 25 bp, Mus musculus
gagccaataggagacgcgatcgtga

SEQ ID NO: 281490 - DNA, 25 bp, Mus musculus
taactggtcagaggtctaggtgtcc

SEQ ID NO: 281491 - DNA, 25 bp, Mus musculus
cggttcccgatcacacataacgcga

SEQ ID NO: 281492 - DNA, 25 bp, Mus musculus
cggctgcgaggaggatttctctaga

SEQ ID NO: 281493 - DNA, 25 bp, Mus musculus
cacgatgggtgccaacgaggaccaa

SEQ ID NO: 281494 - DNA, 25 bp, Mus musculus
gtcacgacgtggagcacccagactt

SEQ ID NO: 281495 - DNA, 25 bp, Mus musculus
tgagaaccttcttcgcctgtccgga

SEQ ID NO: 281496 - DNA, 25 bp, Mus musculus
cgcacgtgtcctttgctctgagaac

SEQ ID NO: 281497 - DNA, 25 bp, Mus musculus
tcggtaccgcccatcagtaactggt

SEQ ID NO: 281498 - DNA, 25 bp, Mus musculus
tccattctggtgtacggacgggtgt

SEQ ID NO: 281499 - DNA, 25 bp, Mus musculus
aggagtctcagatatacagctcaga

SEQ ID NO: 281500 - DNA, 25 bp, Mus musculus
cggcagtgaggagtctcagatatac

SEQ ID NO: 281501 - DNA, 25 bp, Mus musculus
ctcgacggcagtgaggagtctcaga

SEQ ID NO: 281502 - DNA, 25 bp, Mus musculus
agctcagactgtgccatgccggtgt

SEQ ID NO: 281503 - DNA, 25 bp, Mus musculus
agactgtgccatgccggtgtacgga

SEQ ID NO: 281504 - DNA, 25 bp, Mus musculus
cggtgtacggacaggcgtccattct

SEQ ID NO: 281505 - DNA, 25 bp, Mus musculus
acaggcgtccattctggtgtacgga

SEQ ID NO: 281506 - DNA, 25 bp, Mus musculus
tcagatatacagctcagactgtgcc

SEQ ID NO: 281507 - DNA, 25 bp, Mus musculus
ttctggtgtacggacgggtgtccat

SEQ ID NO: 281508 - DNA, 25 bp, Mus musculus
gtccatgacggtgtacagataggcg

SEQ ID NO: 281509 - DNA, 25 bp, Mus musculus
tgacggtgtacagataggcgtccat

SEQ ID NO: 281510 - DNA, 25 bp, Mus musculus
atgccggtgtacagataggcgaccg

SEQ ID NO: 281511 - DNA, 25 bp, Mus musculus
cggacaggcgtccattctggtgtac

SEQ ID NO: 281512 - DNA, 25 bp, Mus musculus
cacgtagcaggagagcagccggctc

SEQ ID NO: 281513 - DNA, 25 bp, Mus musculus
ggtcctcggaagtcctcgtcagccg

SEQ ID NO: 281514 - DNA, 25 bp, Mus musculus
ggcgcacactgtcacccgaaagaag

SEQ ID NO: 281515 - DNA, 25 bp, Mus musculus
ttggtatttgttgtccagctcccgc

SEQ ID NO: 281516 - DNA, 25 bp, Mus musculus
actccaggtagtcctgcacgtagca

SEQ ID NO: 281517 - DNA, 25 bp, Mus musculus
agcgcggccgacgagtacagctgct

SEQ ID NO: 281518 - DNA, 25 bp, Mus musculus
ctccctctctaggagagcgagcagc

SEQ ID NO: 281519 - DNA, 25 bp, Mus musculus
atcagcctccgtgcctgtcggagtc

SEQ ID NO: 281520 - DNA, 25 bp, Mus musculus
tgtcggagtctcacaggactagtcc

SEQ ID NO: 281521 - DNA, 25 bp, Mus musculus
cgaagagttcgcattctcccgcctt

SEQ ID NO: 281522 - DNA, 25 bp, Mus musculus
ccctatcgtcctaccgaagagttcg

SEQ ID NO: 281523 - DNA, 25 bp, Mus musculus
cgccacccgggcgattggtctgtca

SEQ ID NO: 281524 - DNA, 25 bp, Mus musculus
tgcgcagcactcactcctaataagg

SEQ ID NO: 281525 - DNA, 25 bp, Mus musculus
acgttcctctgcatgtcgtggggca

SEQ ID NO: 281526 - DNA, 25 bp, Mus musculus
acatggttcgcccaggccatggaga

SEQ ID NO: 281527 - DNA, 25 bp, Mus musculus
ccatggagaaggagaccagctgctg

SEQ ID NO: 281528 - DNA, 25 bp, Mus musculus
ttgcgaagcagaaactcccggcggt

SEQ ID NO: 281529 - DNA, 25 bp, Mus musculus
agtgtttgtccgtctcgccctcgca

SEQ ID NO: 281530 - DNA, 25 bp, Mus musculus
tttggctcaggtactcggacacctc

SEQ ID NO: 281531 - DNA, 25 bp, Mus musculus
tcggacacctcctgcgccatgttgg

SEQ ID NO: 281532 - DNA, 25 bp, Mus musculus
caaacaacagaacaaggcgccgacg

SEQ ID NO: 281533 - DNA, 25 bp, Mus musculus
ccggcaccctaggaagacatggttc

SEQ ID NO: 281534 - DNA, 25 bp, Mus musculus
ccaggatgctttgcagcgcccagtc

SEQ ID NO: 281535 - DNA, 25 bp, Mus musculus
agtcgccagcgactcgctcggcggt

SEQ ID NO: 281536 - DNA, 25 bp, Mus musculus
gttccgccggcgctttgtgacgccg

SEQ ID NO: 281537 - DNA, 25 bp, Mus musculus
acctggaggcgtccgagttgccgcc

SEQ ID NO: 281538 - DNA, 25 bp, Mus musculus
gtcgcacgcggccaaaataaacaaa

SEQ ID NO: 281539 - DNA, 25 bp, Mus musculus
aacaaaagctggcttccgcgcctgc

SEQ ID NO: 281540 - DNA, 25 bp, Mus musculus
cggtgcatctcggagttctgcgaga

SEQ ID NO: 281541 - DNA, 25 bp, Mus musculus
ccacagtttctgtctgcggtgcatc

SEQ ID NO: 281542 - DNA, 25 bp, Mus musculus
tctgcgagaagtcggacagcgctca

SEQ ID NO: 281543 - DNA, 25 bp, Mus musculus
aggggtcccttcaggcccgccagct

SEQ ID NO: 281544 - DNA, 25 bp, Mus musculus
ggacagcgctcagggcgtctacgcc

SEQ ID NO: 281545 - DNA, 25 bp, Mus musculus
tttctgtctgcggtgcatctcggag

SEQ ID NO: 281546 - DNA, 25 bp, Mus musculus
agcttcagacccaaccggcagctgg

SEQ ID NO: 281547 - DNA, 25 bp, Mus musculus
ggtgctccgtgtgcctggacttcct

SEQ ID NO: 281548 - DNA, 25 bp, Mus musculus
tgtgcctggacttcctgcaggagcc

SEQ ID NO: 281549 - DNA, 25 bp, Mus musculus
ctggacttcctgcaggagcccatca

SEQ ID NO: 281550 - DNA, 25 bp, Mus musculus
ctgcaggagcccatcagcgtggact

SEQ ID NO: 281551 - DNA, 25 bp, Mus musculus
catcagcgtggactgcggccacagt

SEQ ID NO: 281552 - DNA, 25 bp, Mus musculus
gtggactgcggccacagtttctgtc

SEQ ID NO: 281553 - DNA, 25 bp, Mus musculus
tcggagttctgcgagaagtcggaca

SEQ ID NO: 281554 - DNA, 25 bp, Mus musculus
cggcgactggcctgctcatttgcat

SEQ ID NO: 281555 - DNA, 25 bp, Mus musculus
tgcaaaaagcgctgggagtgtgtcc

SEQ ID NO: 281556 - DNA, 25 bp, Mus musculus
ctcaacctctttccgtcttctaggg

SEQ ID NO: 281557 - DNA, 25 bp, Mus musculus
ctttggggatttagagggctttctg

SEQ ID NO: 281558 - DNA, 25 bp, Mus musculus
ctctccgccagaccctttggggatt

SEQ ID NO: 281559 - DNA, 25 bp, Mus musculus
tgagcttaaccctgcagctgccggg

SEQ ID NO: 281560 - DNA, 25 bp, Mus musculus
tgtagaaaaccttgccgtcgtagtc

SEQ ID NO: 281561 - DNA, 25 bp, Mus musculus
tcggaacagacgagcgagccctcct

SEQ ID NO: 281562 - DNA, 25 bp, Mus musculus
tccaccatgtctgcgtcggaacaga

SEQ ID NO: 281563 - DNA, 25 bp, Mus musculus
tgccggagatcagtccaccatgtct

SEQ ID NO: 281564 - DNA, 25 bp, Mus musculus
gctctcagccctgccggagatcagt

SEQ ID NO: 281565 - DNA, 25 bp, Mus musculus
gaagcctcggggatccctgctctca

SEQ ID NO: 281566 - DNA, 25 bp, Mus musculus
ggaaaccacaagactttcgagagga

SEQ ID NO: 281567 - DNA, 25 bp, Mus musculus
ggcggaggaatgcacagctcgctcc

SEQ ID NO: 281568 - DNA, 25 bp, Mus musculus
gccgggcagtctgcagatcctctct

SEQ ID NO: 281569 - DNA, 25 bp, Mus musculus
ccctgcgggataagctctggctccc

SEQ ID NO: 281570 - DNA, 25 bp, Mus musculus
ctgcagatcctctctctttacaagg

SEQ ID NO: 281571 - DNA, 25 bp, Mus musculus
ctctttacaaggatccgtggtcacg

SEQ ID NO: 281572 - DNA, 25 bp, Mus musculus
tccgtggtcacggatgcccgcagct

SEQ ID NO: 281573 - DNA, 25 bp, Mus musculus
acggatgcccgcagcttgtgaccgc

SEQ ID NO: 281574 - DNA, 25 bp, Mus musculus
cttgtgaccgcgtggagctgcacgc

SEQ ID NO: 281575 - DNA, 25 bp, Mus musculus
tctgcacctcgaaggagcggacggt

SEQ ID NO: 281576 - DNA, 25 bp, Mus musculus
gaccctgctcgtgggtgctcagcct

SEQ ID NO: 281577 - DNA, 25 bp, Mus musculus
tgctcagcctgcacgtgggctgcac

SEQ ID NO: 281578 - DNA, 25 bp, Mus musculus
tgcagcccacgtgagcgccgagtct

SEQ ID NO: 281579 - DNA, 25 bp, Mus musculus
cgccgagtctcttctggcgcccacg

SEQ ID NO: 281580 - DNA, 25 bp, Mus musculus
tgcaagcgtggtctgcacctcgaag

SEQ ID NO: 281581 - DNA, 25 bp, Mus musculus
gtaaaggtcaccgcgacactgaggt

SEQ ID NO: 281582 - DNA, 25 bp, Mus musculus
acgtagtacccatcgtagccctgca

SEQ ID NO: 281583 - DNA, 25 bp, Mus musculus
agcgacttgaccgtggcgaaccaca

SEQ ID NO: 281584 - DNA, 25 bp, Mus musculus
acgcccttgccgatgagcgacttga

SEQ ID NO: 281585 - DNA, 25 bp, Mus musculus
ggccttggctcacggccagcatgac

SEQ ID NO: 281586 - DNA, 25 bp, Mus musculus
cctcgttggcgatgttgagcacgtt

SEQ ID NO: 281587 - DNA, 25 bp, Mus musculus
cgccaccttgatgcagtcctcgttg

SEQ ID NO: 281588 - DNA, 25 bp, Mus musculus
ctcgatggtgaagtgcaggttctcc

SEQ ID NO: 281589 - DNA, 25 bp, Mus musculus
ggtcacgttgatcccgttctccagg

SEQ ID NO: 281590 - DNA, 25 bp, Mus musculus
gcgaacctgcgagtcctgccgttca

SEQ ID NO: 281591 - DNA, 25 bp, Mus musculus
tgctccaccgacagtacgtagtacc

SEQ ID NO: 281592 - DNA, 25 bp, Mus musculus
tgccagcgctcagcagctgccgttt

SEQ ID NO: 281593 - DNA, 25 bp, Mus musculus
agtgccagggcaccgaactgcatct

SEQ ID NO: 281594 - DNA, 25 bp, Mus musculus
tcgtccagcgtcatgccatagcgca

SEQ ID NO: 281595 - DNA, 25 bp, Mus musculus
caccaccgtggtggactgagacacg

SEQ ID NO: 281596 - DNA, 25 bp, Mus musculus
ctgactccagggtggtctgaaccgc

SEQ ID NO: 281597 - DNA, 25 bp, Mus musculus
ggcgtcgttcttgcagtcacattcc

SEQ ID NO: 281598 - DNA, 25 bp, Mus musculus
tagcagtcacagttggcgtcgttct

SEQ ID NO: 281599 - DNA, 25 bp, Mus musculus
gccgtctccgctttggtagcagtca

SEQ ID NO: 281600 - DNA, 25 bp, Mus musculus
ggcatctttggcgtagccgtctccg

SEQ ID NO: 281601 - DNA, 25 bp, Mus musculus
cggcgcattgagtttggcatctttg

SEQ ID NO: 281602 - DNA, 25 bp, Mus musculus
atccaggacgtagatggagttatcc

SEQ ID NO: 281603 - DNA, 25 bp, Mus musculus
cgggtattccactccagggacctga

SEQ ID NO: 281604 - DNA, 25 bp, Mus musculus
tgtaggacacagcaatggccgtggc

SEQ ID NO: 281605 - DNA, 25 bp, Mus musculus
tcagtttccgtgatgtaaaggaccc

SEQ ID NO: 281606 - DNA, 25 bp, Mus musculus
ctgccttattcggttgatcttcttc

SEQ ID NO: 281607 - DNA, 25 bp, Mus musculus
cccgtctgtcgtgacctgccttatt

SEQ ID NO: 281608 - DNA, 25 bp, Mus musculus
ttccgaaggtatcccagccactaag

SEQ ID NO: 281609 - DNA, 25 bp, Mus musculus
acctgacggttttcagtgatctgta

SEQ ID NO: 281610 - DNA, 25 bp, Mus musculus
tctggagcggatcgcgttacagcgc

SEQ ID NO: 281611 - DNA, 25 bp, Mus musculus
cgctgccaacttgcctgggtctgga

SEQ ID NO: 281612 - DNA, 25 bp, Mus musculus
cgagcggcagccagacatgataggc

SEQ ID NO: 281613 - DNA, 25 bp, Mus musculus
tgaagctgctctgtttacacccggc

SEQ ID NO: 281614 - DNA, 25 bp, Mus musculus
acccgagccgaagcagcctggaaac

SEQ ID NO: 281615 - DNA, 25 bp, Mus musculus
agcctggaaactgcccaccaactga

SEQ ID NO: 281616 - DNA, 25 bp, Mus musculus
accaactgatcaggtggcgtgctcc

SEQ ID NO: 281617 - DNA, 25 bp, Mus musculus
gtgcatcctgcaaacgtccatagtc

SEQ ID NO: 281618 - DNA, 25 bp, Mus musculus
tttcttgcacagcacaggcttcatc

SEQ ID NO: 281619 - DNA, 25 bp, Mus musculus
aggggaccgccacttctcctctggt

SEQ ID NO: 281620 - DNA, 25 bp, Mus musculus
tggtcggcccaactaagtcccggca

SEQ ID NO: 281621 - DNA, 25 bp, Mus musculus
ggtcacgttgctccgccactcttgg

SEQ ID NO: 281622 - DNA, 25 bp, Mus musculus
ggagcggcagctggtacacacacac

SEQ ID NO: 281623 - DNA, 25 bp, Mus musculus
tggaaccgcgcgaggaaccgcccag

SEQ ID NO: 281624 - DNA, 25 bp, Mus musculus
ctccgagtctgtgagctgggatgct

SEQ ID NO: 281625 - DNA, 25 bp, Mus musculus
tccaggaccgtaattgtgggcaagg

SEQ ID NO: 281626 - DNA, 25 bp, Mus musculus
gggagcagcatccaggaccgtaatt

SEQ ID NO: 281627 - DNA, 25 bp, Mus musculus
cgctgtgccagggagcagcatccag

SEQ ID NO: 281628 - DNA, 25 bp, Mus musculus
cgccaatgagttcactttctttttc

SEQ ID NO: 281629 - DNA, 25 bp, Mus musculus
gcgggcgccaatgagttcactttct

SEQ ID NO: 281630 - DNA, 25 bp, Mus musculus
ggggagatgcaagtgttacaacttc

SEQ ID NO: 281631 - DNA, 25 bp, Mus musculus
ctgcgctcgcctggccaaattcaaa

SEQ ID NO: 281632 - DNA, 25 bp, Mus musculus
cgcctgtagggctggccaactcgca

SEQ ID NO: 281633 - DNA, 25 bp, Mus musculus
gactccagagctccgagtctgtgag

SEQ ID NO: 281634 - DNA, 25 bp, Mus musculus
ttctgggcgagtgtgcccgagacca

SEQ ID NO: 281635 - DNA, 25 bp, Mus musculus
aagtgttacaacttcctccgctgcc

SEQ ID NO: 281636 - DNA, 25 bp, Mus musculus
gtagggctggccaactcgcagccgc

SEQ ID NO: 281637 - DNA, 25 bp, Mus musculus
gccaaattcaaaggcgccgggcgcg

SEQ ID NO: 281638 - DNA, 25 bp, Mus musculus
gggcgtttccgccagctgcttgccg

SEQ ID NO: 281639 - DNA, 25 bp, Mus musculus
acacgatttcttcacccggtggctg

SEQ ID NO: 281640 - DNA, 25 bp, Mus musculus
ggcttttaaaggcacaggcgaggca

SEQ ID NO: 281641 - DNA, 25 bp, Mus musculus
aaaggatgttcggtccctcgccgct

SEQ ID NO: 281642 - DNA, 25 bp, Mus musculus
cgtgcggatacaactaagcatcagg

SEQ ID NO: 281643 - DNA, 25 bp, Mus musculus
ctaagcatcaggacacgatttcttc

SEQ ID NO: 281644 - DNA, 25 bp, Mus musculus
gacgcagcctccctaggaccaagaa

SEQ ID NO: 281645 - DNA, 25 bp, Mus musculus
cgccacaccacttgcttagcagagg

SEQ ID NO: 281646 - DNA, 25 bp, Mus musculus
accacttgcttagcagaggttgccc

SEQ ID NO: 281647 - DNA, 25 bp, Mus musculus
ggaagctgccgccacaagaagccgg

SEQ ID NO: 281648 - DNA, 25 bp, Mus musculus
acaggcgagcctgccggcttttaaa

SEQ ID NO: 281649 - DNA, 25 bp, Mus musculus
ctccactgtctctgcctgtagcaaa

SEQ ID NO: 281650 - DNA, 25 bp, Mus musculus
tctctgcctgtagcaaaggatgttc

SEQ ID NO: 281651 - DNA, 25 bp, Mus musculus
cctcgccgctggatgtcatcgttga

SEQ ID NO: 281652 - DNA, 25 bp, Mus musculus
ccactaagtgtctctgagcccagcg

SEQ ID NO: 281653 - DNA, 25 bp, Mus musculus
ttagtttgaactttccagctccagt

SEQ ID NO: 281654 - DNA, 25 bp, Mus musculus
tattggcgcggaggttattgtttta

SEQ ID NO: 281655 - DNA, 25 bp, Mus musculus
tctccctcgctcttattggcgcgga

SEQ ID NO: 281656 - DNA, 25 bp, Mus musculus
cggtggctctctggccgcgtctttc

SEQ ID NO: 281657 - DNA, 25 bp, Mus musculus
agcggactggcaccggtggctctct

SEQ ID NO: 281658 - DNA, 25 bp, Mus musculus
cacccgggagagcaacacgtttagt

SEQ ID NO: 281659 - DNA, 25 bp, Mus musculus
cagagcctctgtggcgagcctcggc

SEQ ID NO: 281660 - DNA, 25 bp, Mus musculus
cccagagaagttgggcagagcctct

SEQ ID NO: 281661 - DNA, 25 bp, Mus musculus
agcagcctgcgactcgccaagggcg

SEQ ID NO: 281662 - DNA, 25 bp, Mus musculus
ggcactgccagtcacttggcccaga

SEQ ID NO: 281663 - DNA, 25 bp, Mus musculus
atctgttggggcgagcgtccagccc

SEQ ID NO: 281664 - DNA, 25 bp, Mus musculus
ggctccttcccaggttgaccggaga

SEQ ID NO: 281665 - DNA, 25 bp, Mus musculus
gttgaccggagacgctgctgccgct

SEQ ID NO: 281666 - DNA, 25 bp, Mus musculus
ggtccatccaccatgcacttgctgt

SEQ ID NO: 281667 - DNA, 25 bp, Mus musculus
ggaccaggagaggacctcagcctca

SEQ ID NO: 281668 - DNA, 25 bp, Mus musculus
caaaagttgcgagccgccgagtccc

SEQ ID NO: 281669 - DNA, 25 bp, Mus musculus
ctgccagagccgagggcaaaagttg

SEQ ID NO: 281670 - DNA, 25 bp, Mus musculus
aggctcgtacctgacacccgggagc

SEQ ID NO: 281671 - DNA, 25 bp, Mus musculus
ggtttcctgtgaggctcgtacctga

SEQ ID NO: 281672 - DNA, 25 bp, Mus musculus
gctcctttcacttcgggcgagggga

SEQ ID NO: 281673 - DNA, 25 bp, Mus musculus
cagttcggatgtccggtttcctgtg

SEQ ID NO: 281674 - DNA, 25 bp, Mus musculus
tgtctctggcgtgttccctgctcgc

SEQ ID NO: 281675 - DNA, 25 bp, Mus musculus
gccaccgagggcagttcggatgtcc

SEQ ID NO: 281676 - DNA, 25 bp, Mus musculus
aacaaaaccgcgatcggcggagccg

SEQ ID NO: 281677 - DNA, 25 bp, Mus musculus
aacatcgcggggtgactgggcttaa

SEQ ID NO: 281678 - DNA, 25 bp, Mus musculus
cacttgctgtgcttcttgtctctgg

SEQ ID NO: 281679 - DNA, 25 bp, Mus musculus
ctcttcgggacgagtggaacatcgc

SEQ ID NO: 281680 - DNA, 25 bp, Mus musculus
gacgtgcagccgcactgggacgctc

SEQ ID NO: 281681 - DNA, 25 bp, Mus musculus
gtcccacccactgggcggccgtgca

SEQ ID NO: 281682 - DNA, 25 bp, Mus musculus
acactcgcacttcaggctctgcttc

SEQ ID NO: 281683 - DNA, 25 bp, Mus musculus
acggtgttcatcgtggcgacctttc

SEQ ID NO: 281684 - DNA, 25 bp, Mus musculus
cgcactcacagcatgatccgcgaga

SEQ ID NO: 281685 - DNA, 25 bp, Mus musculus
agcatgatccgcgagacgtgcagcc

SEQ ID NO: 281686 - DNA, 25 bp, Mus musculus
tcgcgcgcgacaggacggtgttcat

SEQ ID NO: 281687 - DNA, 25 bp, Mus musculus
cagcgagaaggcgaacagggagttc

SEQ ID NO: 281688 - DNA, 25 bp, Mus musculus
cgcactgggacgctcctgtctttga

SEQ ID NO: 281689 - DNA, 25 bp, Mus musculus
tgtgctgttgtgttgctccctcatt

SEQ ID NO: 281690 - DNA, 25 bp, Mus musculus
gtgttgctccctcattggcccgggt

SEQ ID NO: 281691 - DNA, 25 bp, Mus musculus
aaggggagcgctgacccaggccact

SEQ ID NO: 281692 - DNA, 25 bp, Mus musculus
aggccactcgggagacgaccgcgca

SEQ ID NO: 281693 - DNA, 25 bp, Mus musculus
ctgacccaggccactcgggagacga

SEQ ID NO: 281694 - DNA, 25 bp, Mus musculus
aacctgcgcgggtctgagcttaccg

SEQ ID NO: 281695 - DNA, 25 bp, Mus musculus
ttatgcgtgcagacagtgcgaggct

SEQ ID NO: 281696 - DNA, 25 bp, Mus musculus
aggctgacatctggcaccgaggtga

SEQ ID NO: 281697 - DNA, 25 bp, Mus musculus
ccctcggctgttatgcgtgcagaca

SEQ ID NO: 281698 - DNA, 25 bp, Mus musculus
agcaggctgcggtcggcccttatcc

SEQ ID NO: 281699 - DNA, 25 bp, Mus musculus
agtgcagcttctggggaatcggcag

SEQ ID NO: 281700 - DNA, 25 bp, Mus musculus
tggcaccgaggtgagtgcagcttct

SEQ ID NO: 281701 - DNA, 25 bp, Mus musculus
tgtatttcggtgaaaggcaccggga

SEQ ID NO: 281702 - DNA, 25 bp, Mus musculus
ctacgctgtatttcggtgaaaggca

SEQ ID NO: 281703 - DNA, 25 bp, Mus musculus
ttggttctacgctgtatttcggtga

SEQ ID NO: 281704 - DNA, 25 bp, Mus musculus
cctggctatttggttctacgctgta

SEQ ID NO: 281705 - DNA, 25 bp, Mus musculus
cgatttgtcttgggctccgccatcc

SEQ ID NO: 281706 - DNA, 25 bp, Mus musculus
cggctgttatgcgtgcagacagtgc

SEQ ID NO: 281707 - DNA, 25 bp, Mus musculus
tccgccatccttgttgcttccggtt

SEQ ID NO: 281708 - DNA, 25 bp, Mus musculus
cacgcgcacggagtgggctataaaa

SEQ ID NO: 281709 - DNA, 25 bp, Mus musculus
aggctctgctgctccatggcgccaa

SEQ ID NO: 281710 - DNA, 25 bp, Mus musculus
ccacccgcagagacgcgacccgcca

SEQ ID NO: 281711 - DNA, 25 bp, Mus musculus
acccgccatgcacgtgaacggcaaa

SEQ ID NO: 281712 - DNA, 25 bp, Mus musculus
gcacgtgaacggcaaagtggctctg

SEQ ID NO: 281713 - DNA, 25 bp, Mus musculus
gggctataaaagctgctgcggcgtc

SEQ ID NO: 281714 - DNA, 25 bp, Mus musculus
tgctgcggcgtccagactctgagct

SEQ ID NO: 281715 - DNA, 25 bp, Mus musculus
gtaaggacttctccgtgtccaccca

SEQ ID NO: 281716 - DNA, 25 bp, Mus musculus
agactctgagctcgcccaccacccg

SEQ ID NO: 281717 - DNA, 25 bp, Mus musculus
gaacggcaaagtggctctggtgacc

SEQ ID NO: 281718 - DNA, 25 bp, Mus musculus
acagggcataggcaaagccttcgct

SEQ ID NO: 281719 - DNA, 25 bp, Mus musculus
aaagccttcgctgaggctctgctgc

SEQ ID NO: 281720 - DNA, 25 bp, Mus musculus
gcgccaaggtaaggacttctccgtg

SEQ ID NO: 281721 - DNA, 25 bp, Mus musculus
tccatggcgccaaggtaaggacttc

SEQ ID NO: 281722 - DNA, 25 bp, Mus musculus
tgctggcattcctagatgcagattc

SEQ ID NO: 281723 - DNA, 25 bp, Mus musculus
aaccttgcaaggtccgccactcggg

SEQ ID NO: 281724 - DNA, 25 bp, Mus musculus
tggagatcccaggtcgctcaggtac

SEQ ID NO: 281725 - DNA, 25 bp, Mus musculus
gagccattttcttctcggctgacag

SEQ ID NO: 281726 - DNA, 25 bp, Mus musculus
accagttcccggctgagccattttc

SEQ ID NO: 281727 - DNA, 25 bp, Mus musculus
gcagccatcgtgttctccagcgcga

SEQ ID NO: 281728 - DNA, 25 bp, Mus musculus
ctaaacattccgagccagaggctgc

SEQ ID NO: 281729 - DNA, 25 bp, Mus musculus
cgtcacttccggcaacaataggaaa

SEQ ID NO: 281730 - DNA, 25 bp, Mus musculus
ttgatggccaaagcagttcagaatg

SEQ ID NO: 281731 - DNA, 25 bp, Mus musculus
gcagcttcttcaggatactctactg

SEQ ID NO: 281732 - DNA, 25 bp, Mus musculus
atgcagattccacactccgttcgcg

SEQ ID NO: 281733 - DNA, 25 bp, Mus musculus
actcagagttcgagccgagagttcg

SEQ ID NO: 281734 - DNA, 25 bp, Mus musculus
cgagagttcgaacagcggctaaaca

SEQ ID NO: 281735 - DNA, 25 bp, Mus musculus
cctctccatggcttgggcaccagtt

SEQ ID NO: 281736 - DNA, 25 bp, Mus musculus
ttgctgggaaaatcggcttgctccc

SEQ ID NO: 281737 - DNA, 25 bp, Mus musculus
cgtgaggagcctctgacgacatata

SEQ ID NO: 281738 - DNA, 25 bp, Mus musculus
acccgagcggccctaaagatgtagc

SEQ ID NO: 281739 - DNA, 25 bp, Mus musculus
ccgagagtccattcgccgcttccca

SEQ ID NO: 281740 - DNA, 25 bp, Mus musculus
tgtctgagcacacccctccgagagt

SEQ ID NO: 281741 - DNA, 25 bp, Mus musculus
gtccagcccaagagaaccgccgccg

SEQ ID NO: 281742 - DNA, 25 bp, Mus musculus
tcttgctgggaaaatcggcttgctc

SEQ ID NO: 281743 - DNA, 25 bp, Mus musculus
ggagcctctgacgacatatattaac

SEQ ID NO: 281744 - DNA, 25 bp, Mus musculus
acatggagatcttgctgggaaaatc

SEQ ID NO: 281745 - DNA, 25 bp, Mus musculus
gctgtacatggagatcttgctggga

SEQ ID NO: 281746 - DNA, 25 bp, Mus musculus
atgtagctgtacatggagatcttgc

SEQ ID NO: 281747 - DNA, 25 bp, Mus musculus
gcggccctaaagatgtagctgtaca

SEQ ID NO: 281748 - DNA, 25 bp, Mus musculus
tgacgacatatattaacccgagcgg

SEQ ID NO: 281749 - DNA, 25 bp, Mus musculus
agcttccgcggccactgtctgagca

SEQ ID NO: 281750 - DNA, 25 bp, Mus musculus
ccaaccgcaaggagcggcgcaggac

SEQ ID NO: 281751 - DNA, 25 bp, Mus musculus
tggtgcaccatgagggctacccatt

SEQ ID NO: 281752 - DNA, 25 bp, Mus musculus
gctgcagccacgaggagaaccccta

SEQ ID NO: 281753 - DNA, 25 bp, Mus musculus
ctacttccacggctggcttattggc

SEQ ID NO: 281754 - DNA, 25 bp, Mus musculus
ggctggcttattggccacccggaga

SEQ ID NO: 281755 - DNA, 25 bp, Mus musculus
ccgactacagtatggccctgtccta

SEQ ID NO: 281756 - DNA, 25 bp, Mus musculus
ccaaggacgaccagaacggagaggc

SEQ ID NO: 281757 - DNA, 25 bp, Mus musculus
cggcgcaggactcagagcatcaaca

SEQ ID NO: 281758 - DNA, 25 bp, Mus musculus
agagcatcaacagcgccttcgccga

SEQ ID NO: 281759 - DNA, 25 bp, Mus musculus
agctacatcgcctacctcatggatc

SEQ ID NO: 281760 - DNA, 25 bp, Mus musculus
atcgcctacctcatggatctgctgg

SEQ ID NO: 281761 - DNA, 25 bp, Mus musculus
catggatctgctggccaaggacgac

SEQ ID NO: 281762 - DNA, 25 bp, Mus musculus
gggcctggaccactcccattatggg

SEQ ID NO: 281763 - DNA, 25 bp, Mus musculus
tacagtatggccctgtcctacagcc

SEQ ID NO: 281764 - DNA, 25 bp, Mus musculus
ttctggcctacccaagcgagcgagc

SEQ ID NO: 281765 - DNA, 25 bp, Mus musculus
gagcgttcgtttctgagtctgattc

SEQ ID NO: 281766 - DNA, 25 bp, Mus musculus
agttggaggtcagcaaagcacagtc

SEQ ID NO: 281767 - DNA, 25 bp, Mus musculus
gcacagtcggtttctggcctaccca

SEQ ID NO: 281768 - DNA, 25 bp, Mus musculus
cacaaggtgtgactttggagcttca

SEQ ID NO: 281769 - DNA, 25 bp, Mus musculus
tggtccttcgtgctccctgagagcg

SEQ ID NO: 281770 - DNA, 25 bp, Mus musculus
gttgctgaggcctttggtccttcgt

SEQ ID NO: 281771 - DNA, 25 bp, Mus musculus
ctcggctctcccaggaggccggttt

SEQ ID NO: 281772 - DNA, 25 bp, Mus musculus
gaaagaagttgcgagctccggtcct

SEQ ID NO: 281773 - DNA, 25 bp, Mus musculus
ctcctatagcttcggtttgttgatc

SEQ ID NO: 281774 - DNA, 25 bp, Mus musculus
aaggccgggctagtagtcgctgccc

SEQ ID NO: 281775 - DNA, 25 bp, Mus musculus
acgccctcgctgtttttctcctata

SEQ ID NO: 281776 - DNA, 25 bp, Mus musculus
tctgattctccttgcgcattcccta

SEQ ID NO: 281777 - DNA, 25 bp, Mus musculus
gccgctggaggaagtgagttcaccc

SEQ ID NO: 281778 - DNA, 25 bp, Mus musculus
ctctgttctgattacgtgcgggacc

SEQ ID NO: 281779 - DNA, 25 bp, Mus musculus
tccaggtggcccagaagctgacact

SEQ ID NO: 281780 - DNA, 25 bp, Mus musculus
ctaccaggtcctgtgactgtgatca

SEQ ID NO: 281781 - DNA, 25 bp, Mus musculus
tcttgatcgaggagctaacttgcgc

SEQ ID NO: 281782 - DNA, 25 bp, Mus musculus
tttcgtttccagatcgcagcaaagg

SEQ ID NO: 281783 - DNA, 25 bp, Mus musculus
gcagggactttgtttcaatcagaga

SEQ ID NO: 281784 - DNA, 25 bp, Mus musculus
ggtccctgggccacttacactctta

SEQ ID NO: 281785 - DNA, 25 bp, Mus musculus
cgtcctcccgcaaacaacagagttg

SEQ ID NO: 281786 - DNA, 25 bp, Mus musculus
ctcctccggagtgaagccgttcatg

SEQ ID NO: 281787 - DNA, 25 bp, Mus musculus
tctgtcggtgctggaatagctacca

SEQ ID NO: 281788 - DNA, 25 bp, Mus musculus
tcactgtcacatggagacttcagca

SEQ ID NO: 281789 - DNA, 25 bp, Mus musculus
acttcagcagttggaccgcagctcc

SEQ ID NO: 281790 - DNA, 25 bp, Mus musculus
cccacgggaatggtagttcttgatc

SEQ ID NO: 281791 - DNA, 25 bp, Mus musculus
tctggatccttttgctgaagctggc

SEQ ID NO: 281792 - DNA, 25 bp, Mus musculus
agaaagcccttgagcccggccgcgt

SEQ ID NO: 281793 - DNA, 25 bp, Mus musculus
ggcctggctcttaacgcgtagacgt

SEQ ID NO: 281794 - DNA, 25 bp, Mus musculus
aaaaactggattggctgtgggtctc

SEQ ID NO: 281795 - DNA, 25 bp, Mus musculus
ctcgcggtggcttgtgtaagtgtaa

SEQ ID NO: 281796 - DNA, 25 bp, Mus musculus
ccgggtttgaataatcctccacagc

SEQ ID NO: 281797 - DNA, 25 bp, Mus musculus
gggccgagcagtacattcctctcta

SEQ ID NO: 281798 - DNA, 25 bp, Mus musculus
ttttcctgccgccaatcagggccga

SEQ ID NO: 281799 - DNA, 25 bp, Mus musculus
cagcgggcccgccatttttcaaacg

SEQ ID NO: 281800 - DNA, 25 bp, Mus musculus
gctagttttaaatctggccggggca

SEQ ID NO: 281801 - DNA, 25 bp, Mus musculus
caggcgccctccttgctagttttaa

SEQ ID NO: 281802 - DNA, 25 bp, Mus musculus
ctgaagagtttagcgccaggcgccc

SEQ ID NO: 281803 - DNA, 25 bp, Mus musculus
attcctctctagaccggttccaacg

SEQ ID NO: 281804 - DNA, 25 bp, Mus musculus
gacccaccgaacctgctaggcttag

SEQ ID NO: 281805 - DNA, 25 bp, Mus musculus
tggccagacacccaccaatcggaag

SEQ ID NO: 281806 - DNA, 25 bp, Mus musculus
gcagctcggattcgggagcccgtat

SEQ ID NO: 281807 - DNA, 25 bp, Mus musculus
tgctaacctcgcagctgcgggcgac

SEQ ID NO: 281808 - DNA, 25 bp, Mus musculus
tgcagacctgctaacctcgcagctg

SEQ ID NO: 281809 - DNA, 25 bp, Mus musculus
ttgtctgtaacaggtgcagacctgc

SEQ ID NO: 281810 - DNA, 25 bp, Mus musculus
gactgggcgcgtttgtctgtaacag

SEQ ID NO: 281811 - DNA, 25 bp, Mus musculus
actcccagaacagtcggccagcaaa

SEQ ID NO: 281812 - DNA, 25 bp, Mus musculus
ggagcccgtatctactcccagaaca

SEQ ID NO: 281813 - DNA, 25 bp, Mus musculus
ccgcccgcgagcctgagtaagtgcg

SEQ ID NO: 281814 - DNA, 25 bp, Mus musculus
gggttatttgccagggacaccgcgc

SEQ ID NO: 281815 - DNA, 25 bp, Mus musculus
cctgcgcatgcgcataggggtgcac

SEQ ID NO: 281816 - DNA, 25 bp, Mus musculus
cagtgtcctgcgcatgcgcataggg

SEQ ID NO: 281817 - DNA, 25 bp, Mus musculus
catgaaggcggagcccagtgtcctg

SEQ ID NO: 281818 - DNA, 25 bp, Mus musculus
ccctacgggctaccgtagcatgaag

SEQ ID NO: 281819 - DNA, 25 bp, Mus musculus
taccgtagcatgaaggcggagccca

SEQ ID NO: 281820 - DNA, 25 bp, Mus musculus
tcctccggcggcgagagacacacag

SEQ ID NO: 281821 - DNA, 25 bp, Mus musculus
caagttgcaggtcgcctctgccgga

SEQ ID NO: 281822 - DNA, 25 bp, Mus musculus
cctgtccgggaatcgaagggacaag

SEQ ID NO: 281823 - DNA, 25 bp, Mus musculus
gcgaggcctcagctacacgttgcac

SEQ ID NO: 281824 - DNA, 25 bp, Mus musculus
gccacaggccgcagctcggaccaac

SEQ ID NO: 281825 - DNA, 25 bp, Mus musculus
gagccgactctgtcctgcgattccg

SEQ ID NO: 281826 - DNA, 25 bp, Mus musculus
aaaaacaagttgcaggtcgcctctg

SEQ ID NO: 281827 - DNA, 25 bp, Mus musculus
aggcgggtcactcaccctcatcctg

SEQ ID NO: 281828 - DNA, 25 bp, Mus musculus
cagggaagaccagaggaccacgagc

SEQ ID NO: 281829 - DNA, 25 bp, Mus musculus
caccaccagcaaactgcgtaagatg

SEQ ID NO: 281830 - DNA, 25 bp, Mus musculus
actgcgtaagatgaacccgatcttc

SEQ ID NO: 281831 - DNA, 25 bp, Mus musculus
tgaacccgatcttcagcctcatctt

SEQ ID NO: 281832 - DNA, 25 bp, Mus musculus
gcgagagacacacagcccggcgcag

SEQ ID NO: 281833 - DNA, 25 bp, Mus musculus
cccggcgttggagcggccgcctata

SEQ ID NO: 281834 - DNA, 25 bp, Mus musculus
cctccatggtcctgatgggatcgca

SEQ ID NO: 281835 - DNA, 25 bp, Mus musculus
tcttctcgggtaatctcgaaccggc

SEQ ID NO: 281836 - DNA, 25 bp, Mus musculus
gcgccaggccagaaattccggagta

SEQ ID NO: 281837 - DNA, 25 bp, Mus musculus
cgggagggcaatggaagaattcctc

SEQ ID NO: 281838 - DNA, 25 bp, Mus musculus
caggcggcgaatgtcaagtgtgacc

SEQ ID NO: 281839 - DNA, 25 bp, Mus musculus
tcgtctctgagctcacccgaaaggc

SEQ ID NO: 281840 - DNA, 25 bp, Mus musculus
gacaatcggatcctctcttctcggg

SEQ ID NO: 281841 - DNA, 25 bp, Mus musculus
atcgatttgcagctccgggacaatc

SEQ ID NO: 281842 - DNA, 25 bp, Mus musculus
gctacataaacaaacccagaggcta

SEQ ID NO: 281843 - DNA, 25 bp, Mus musculus
tcacggccggaaggtagtggccact

SEQ ID NO: 281844 - DNA, 25 bp, Mus musculus
tgtctaccacgtgcgggagcctaga

SEQ ID NO: 281845 - DNA, 25 bp, Mus musculus
gctggcgatgatactggtgtctacc

SEQ ID NO: 281846 - DNA, 25 bp, Mus musculus
tgtctcctgcctgctggcgatgata

SEQ ID NO: 281847 - DNA, 25 bp, Mus musculus
gtgtgaccgggctttacaggcaagt

SEQ ID NO: 281848 - DNA, 25 bp, Mus musculus
acctgccttctggtgagtaccgctg

SEQ ID NO: 281849 - DNA, 25 bp, Mus musculus
ttccggtctatttccggcgtcgcca

SEQ ID NO: 281850 - DNA, 25 bp, Mus musculus
ttggattgtggcctcagtcctgtgc

SEQ ID NO: 281851 - DNA, 25 bp, Mus musculus
tggcctcagtcctgtgccagcctgt

SEQ ID NO: 281852 - DNA, 25 bp, Mus musculus
cctgtgccagcctgtctgggcgtct

SEQ ID NO: 281853 - DNA, 25 bp, Mus musculus
tgtgtgcagtcagacacctgccttc

SEQ ID NO: 281854 - DNA, 25 bp, Mus musculus
cggctcccgcgaacttccggtctat

SEQ ID NO: 281855 - DNA, 25 bp, Mus musculus
gtgagtaccgctggcttctgcctgc

SEQ ID NO: 281856 - DNA, 25 bp, Mus musculus
cgtgcgctgtgcaaatggtgcgatc

SEQ ID NO: 281857 - DNA, 25 bp, Mus musculus
caaatggtgcgatccggggagccct

SEQ ID NO: 281858 - DNA, 25 bp, Mus musculus
ccctgcgcggggctgagttcccagt

SEQ ID NO: 281859 - DNA, 25 bp, Mus musculus
ggctgagttcccagtctctgtcgcc

SEQ ID NO: 281860 - DNA, 25 bp, Mus musculus
cttctggtgagtaccgctggcttct

SEQ ID NO: 281861 - DNA, 25 bp, Mus musculus
tctgggcgtctgtgtgcagtcagac

SEQ ID NO: 281862 - DNA, 25 bp, Mus musculus
cacagcgcgttagcacagagccttc

SEQ ID NO: 281863 - DNA, 25 bp, Mus musculus
cccatatgctcctgctcgcgaggtg

SEQ ID NO: 281864 - DNA, 25 bp, Mus musculus
gcccgtggcatccaagatgacattc

SEQ ID NO: 281865 - DNA, 25 bp, Mus musculus
tgacattcgaagacgcctttgcctg

SEQ ID NO: 281866 - DNA, 25 bp, Mus musculus
cgctccggaaagttgaggtgacaac

SEQ ID NO: 281867 - DNA, 25 bp, Mus musculus
gctgccctagcaccactgagtctgg

SEQ ID NO: 281868 - DNA, 25 bp, Mus musculus
tgagcacgatgcttccctgcagact

SEQ ID NO: 281869 - DNA, 25 bp, Mus musculus
cggggctcgtaacccgcatcgagaa

SEQ ID NO: 281870 - DNA, 25 bp, Mus musculus
aggctcgtgccacaaccttctgatg

SEQ ID NO: 281871 - DNA, 25 bp, Mus musculus
agagccttcccaatctcccgggaga

SEQ ID NO: 281872 - DNA, 25 bp, Mus musculus
atgccacgcagagacagggctcttc

SEQ ID NO: 281873 - DNA, 25 bp, Mus musculus
cgaaaacccggttgtgcagagtgca

SEQ ID NO: 281874 - DNA, 25 bp, Mus musculus
ctggtcgcaggatgctggaagtaca

SEQ ID NO: 281875 - DNA, 25 bp, Mus musculus
ctgcagaactttcggacgcctgggc

SEQ ID NO: 281876 - DNA, 25 bp, Mus musculus
agcctggtctctaaattggcgcctc

SEQ ID NO: 281877 - DNA, 25 bp, Mus musculus
agttcccacgaagctctgcagccag

SEQ ID NO: 281878 - DNA, 25 bp, Mus musculus
cagcgccagcccagttcccacgaag

SEQ ID NO: 281879 - DNA, 25 bp, Mus musculus
gaagtcgttcctttccagcgccagc

SEQ ID NO: 281880 - DNA, 25 bp, Mus musculus
gggaagtcgttcctttccagcgcca

SEQ ID NO: 281881 - DNA, 25 bp, Mus musculus
acccggaagcactagcgggcgctcg

SEQ ID NO: 281882 - DNA, 25 bp, Mus musculus
cttttgaacccggaagcactagcgg

SEQ ID NO: 281883 - DNA, 25 bp, Mus musculus
gcggcttttgaacccggaagcacta

SEQ ID NO: 281884 - DNA, 25 bp, Mus musculus
ttggcggcttttgaacccggaagca

SEQ ID NO: 281885 - DNA, 25 bp, Mus musculus
gcagctcggattggcggcttttgaa

SEQ ID NO: 281886 - DNA, 25 bp, Mus musculus
cctctgagtggctaagcggcagctc

SEQ ID NO: 281887 - DNA, 25 bp, Mus musculus
cacgaagctctgcagccagcggacg

SEQ ID NO: 281888 - DNA, 25 bp, Mus musculus
ctggtctctaaattggcgcctctga

SEQ ID NO: 281889 - DNA, 25 bp, Mus musculus
aattggcgcctctgagtggctaagc

SEQ ID NO: 281890 - DNA, 25 bp, Mus musculus
cgcgtctaatgctacagggcctgta

SEQ ID NO: 281891 - DNA, 25 bp, Mus musculus
gccttatgcgccgtcgcaggttatg

SEQ ID NO: 281892 - DNA, 25 bp, Mus musculus
gaagctgacagctggcgactcacct

SEQ ID NO: 281893 - DNA, 25 bp, Mus musculus
cgactcaccttgcagctcagaggca

SEQ ID NO: 281894 - DNA, 25 bp, Mus musculus
gctaccggcctttcaggagaggtta

SEQ ID NO: 281895 - DNA, 25 bp, Mus musculus
gaagttcaatcctccggctccagcg

SEQ ID NO: 281896 - DNA, 25 bp, Mus musculus
actgcgctctccaaggactacagga

SEQ ID NO: 281897 - DNA, 25 bp, Mus musculus
aagtaacgcggttctcacgcctccg

SEQ ID NO: 281898 - DNA, 25 bp, Mus musculus
tgtactacggtatcatccagcctta

SEQ ID NO: 281899 - DNA, 25 bp, Mus musculus
tgacagccgagcgattccgcgacca

SEQ ID NO: 281900 - DNA, 25 bp, Mus musculus
ccctgacccgctgaactggaagaga

SEQ ID NO: 281901 - DNA, 25 bp, Mus musculus
ctctgcgcctattggtcggaatgga

SEQ ID NO: 281902 - DNA, 25 bp, Mus musculus
cggcatcgtggcaatgcctggcttc

SEQ ID NO: 281903 - DNA, 25 bp, Mus musculus
ttccgctcagcggtgagaagccgaa

SEQ ID NO: 281904 - DNA, 25 bp, Mus musculus
tcgcggagtactgtgcctgacccga

SEQ ID NO: 281905 - DNA, 25 bp, Mus musculus
gctgacgtcacacgccagcgacagt

SEQ ID NO: 281906 - DNA, 25 bp, Mus musculus
tgtgtttgtttcgtccgcgtagcca

SEQ ID NO: 281907 - DNA, 25 bp, Mus musculus
ggtcaggaaccgctgtgtttgtttc

SEQ ID NO: 281908 - DNA, 25 bp, Mus musculus
gacttgggcgacaggtagcctccca

SEQ ID NO: 281909 - DNA, 25 bp, Mus musculus
tggccaagccacctcgacctgtgaa

SEQ ID NO: 281910 - DNA, 25 bp, Mus musculus
tctgacgcgtcagccagagaccggt

SEQ ID NO: 281911 - DNA, 25 bp, Mus musculus
cccggaatccatagtcactgtgacg

SEQ ID NO: 281912 - DNA, 25 bp, Mus musculus
ttgagcctgtgcagttgccctcacc

SEQ ID NO: 281913 - DNA, 25 bp, Mus musculus
agcgtccttaccttgagcctgtgca

SEQ ID NO: 281914 - DNA, 25 bp, Mus musculus
gcggcaacgtgcagcgtccttacct

SEQ ID NO: 281915 - DNA, 25 bp, Mus musculus
tagctctatggtttcagggcggcaa

SEQ ID NO: 281916 - DNA, 25 bp, Mus musculus
tgcctgacccgacggtggcaagtct

SEQ ID NO: 281917 - DNA, 25 bp, Mus musculus
tgcagccgccgtttccaaggggtca

SEQ ID NO: 281918 - DNA, 25 bp, Mus musculus
cccaaatttgctcggggtgcacgtc

SEQ ID NO: 281919 - DNA, 25 bp, Mus musculus
agcaaagcgcgatcggttcccgcca

SEQ ID NO: 281920 - DNA, 25 bp, Mus musculus
caggccaccgggaagagtcggtctc

SEQ ID NO: 281921 - DNA, 25 bp, Mus musculus
ccttctgcctctggggtggcagtct

SEQ ID NO: 281922 - DNA, 25 bp, Mus musculus
cctcctcctgggtagcccaaatttg

SEQ ID NO: 281923 - DNA, 25 bp, Mus musculus
cccgagccttcctcccgctaagtgc

SEQ ID NO: 281924 - DNA, 25 bp, Mus musculus
cggggctgcatctaccagcgctgcg

SEQ ID NO: 281925 - DNA, 25 bp, Mus musculus
tggtcgcccgcatcccagtggtgcg

SEQ ID NO: 281926 - DNA, 25 bp, Mus musculus
tctccgggacctgccgggaacgagc

SEQ ID NO: 281927 - DNA, 25 bp, Mus musculus
gcggcctctctcgtctcttccgaag

SEQ ID NO: 281928 - DNA, 25 bp, Mus musculus
ttccgaagcctctgccgggccttgg

SEQ ID NO: 281929 - DNA, 25 bp, Mus musculus
cggggactgtcgctgagctcatccc

SEQ ID NO: 281930 - DNA, 25 bp, Mus musculus
cagtctccggggactgtcgctgagc

SEQ ID NO: 281931 - DNA, 25 bp, Mus musculus
agagtcggtctccaggcaccggcca

SEQ ID NO: 281932 - DNA, 25 bp, Mus musculus
aagtctgtgcggtttttggaggctc

SEQ ID NO: 281933 - DNA, 25 bp, Mus musculus
tccagaaacctggaagtggccaaag

SEQ ID NO: 281934 - DNA, 25 bp, Mus musculus
gtccaagatggacaaagtctgtgcg

SEQ ID NO: 281935 - DNA, 25 bp, Mus musculus
atgtaccggaagtgtcctcgccgtg

SEQ ID NO: 281936 - DNA, 25 bp, Mus musculus
tcctcgccgtgcgaccaaggtgcaa

SEQ ID NO: 281937 - DNA, 25 bp, Mus musculus
ccaaggtgcaagtccttgagttcca

SEQ ID NO: 281938 - DNA, 25 bp, Mus musculus
aagtccttgagttccagtccacggg

SEQ ID NO: 281939 - DNA, 25 bp, Mus musculus
aatggcccagaagggttaccgtctg

SEQ ID NO: 281940 - DNA, 25 bp, Mus musculus
aagggttaccgtctggcgatcgtct

SEQ ID NO: 281941 - DNA, 25 bp, Mus musculus
cgtctggcgatcgtctccagaaacc

SEQ ID NO: 281942 - DNA, 25 bp, Mus musculus
atcggcagggcggtagcccagctaa

SEQ ID NO: 281943 - DNA, 25 bp, Mus musculus
gtagcccagctaatggcccagaagg

SEQ ID NO: 281944 - DNA, 25 bp, Mus musculus
ttgagttccagtccacgggccctgc

SEQ ID NO: 281945 - DNA, 25 bp, Mus musculus
tggccaaagtcaccgccggcgagct

SEQ ID NO: 281946 - DNA, 25 bp, Mus musculus
gaagccaccgtgcagtcttacctta

SEQ ID NO: 281947 - DNA, 25 bp, Mus musculus
agcaccgggactgtgcaagttctga

SEQ ID NO: 281948 - DNA, 25 bp, Mus musculus
catgcagtatctgatgcgtcgtttc

SEQ ID NO: 281949 - DNA, 25 bp, Mus musculus
cgctcaccgatttgcatgcagtatc

SEQ ID NO: 281950 - DNA, 25 bp, Mus musculus
tgaggtggcggcactcccgagacac

SEQ ID NO: 281951 - DNA, 25 bp, Mus musculus
tgcgtcgtttcagctagcaccggga

SEQ ID NO: 281952 - DNA, 25 bp, Mus musculus
tgcaagttctgaggtagacgaagcc

SEQ ID NO: 281953 - DNA, 25 bp, Mus musculus
gcagtcttaccttactcgctcagtg

SEQ ID NO: 281954 - DNA, 25 bp, Mus musculus
ccttactcgctcagtgctgtgagtg

SEQ ID NO: 281955 - DNA, 25 bp, Mus musculus
tgctgtgagtgagcgattcattttc

SEQ ID NO: 281956 - DNA, 25 bp, Mus musculus
agtgagcgattcattttctttcttc

SEQ ID NO: 281957 - DNA, 25 bp, Mus musculus
tcttccaaaatatctgaggtggcgg

SEQ ID NO: 281958 - DNA, 25 bp, Mus musculus
aaatatctgaggtggcggcactccc

SEQ ID NO: 281959 - DNA, 25 bp, Mus musculus
atggcttttacgctcaccgatttgc

SEQ ID NO: 281960 - DNA, 25 bp, Mus musculus
tggcgctcgccgatctggggtctca

SEQ ID NO: 281961 - DNA, 25 bp, Mus musculus
tcgggctgcaacctttcaaaataag

SEQ ID NO: 281962 - DNA, 25 bp, Mus musculus
ggcttcgggctgcaacctttcaaaa

SEQ ID NO: 281963 - DNA, 25 bp, Mus musculus
actcagtgagcctcccagggcttcg

SEQ ID NO: 281964 - DNA, 25 bp, Mus musculus
gccaagcagctcagtgactcagtga

SEQ ID NO: 281965 - DNA, 25 bp, Mus musculus
atctggggtctcagcgaagcaagag

SEQ ID NO: 281966 - DNA, 25 bp, Mus musculus
ttcaaaataagagtccgtcggcggc

SEQ ID NO: 281967 - DNA, 25 bp, Mus musculus
agcagccacggtgctaggactccca

SEQ ID NO: 281968 - DNA, 25 bp, Mus musculus
ttcaaactttttccagcagccacgg

SEQ ID NO: 281969 - DNA, 25 bp, Mus musculus
ctgtcagctctttaattcaaacttt

SEQ ID NO: 281970 - DNA, 25 bp, Mus musculus
gcagccctgtactgtcagctcttta

SEQ ID NO: 281971 - DNA, 25 bp, Mus musculus
gctcgctcttaagggctgtcccgca

SEQ ID NO: 281972 - DNA, 25 bp, Mus musculus
agcctgtcccggctcgctcttaagg

SEQ ID NO: 281973 - DNA, 25 bp, Mus musculus
gctttatagcgccaagcagctcagt

SEQ ID NO: 281974 - DNA, 25 bp, Mus musculus
aggaccaggcgaccgccctgttctt

SEQ ID NO: 281975 - DNA, 25 bp, Mus musculus
ccctgttcttgcgtggagacccaaa

SEQ ID NO: 281976 - DNA, 25 bp, Mus musculus
gaccagaagggacggaacccagctg

SEQ ID NO: 281977 - DNA, 25 bp, Mus musculus
acggaacccagctgtggactgtgta

SEQ ID NO: 281978 - DNA, 25 bp, Mus musculus
acatctccgccagtctgctccgtga

SEQ ID NO: 281979 - DNA, 25 bp, Mus musculus
cggcgtccaggagcagagcagaacc

SEQ ID NO: 281980 - DNA, 25 bp, Mus musculus
caccggggatcgttcttcgtcaggt

SEQ ID NO: 281981 - DNA, 25 bp, Mus musculus
atcgttcttcgtcaggtagggtcgg

SEQ ID NO: 281982 - DNA, 25 bp, Mus musculus
gcagggtgtctcatgtagggaactt

SEQ ID NO: 281983 - DNA, 25 bp, Mus musculus
ctcatgtagggaacttggagaatcc

SEQ ID NO: 281984 - DNA, 25 bp, Mus musculus
gaggttccgggtcctgtagcatgaa

SEQ ID NO: 281985 - DNA, 25 bp, Mus musculus
atgaagggaccacgcagggtcgcca

SEQ ID NO: 281986 - DNA, 25 bp, Mus musculus
agcagagcagaaccgccgggaccgt

SEQ ID NO: 281987 - DNA, 25 bp, Mus musculus
tcctgtagcatgaagggaccacgca

SEQ ID NO: 281988 - DNA, 25 bp, Mus musculus
gcaccacgggctctgcatctgtaga

SEQ ID NO: 281989 - DNA, 25 bp, Mus musculus
cgcgcgagtgcaccgcgtctgcaga

SEQ ID NO: 281990 - DNA, 25 bp, Mus musculus
agggccatgcgtagcaccacgggct

SEQ ID NO: 281991 - DNA, 25 bp, Mus musculus
tgcatctgtagaacgcggccactta

SEQ ID NO: 281992 - DNA, 25 bp, Mus musculus
agaacgcggccacttacaccactta

SEQ ID NO: 281993 - DNA, 25 bp, Mus musculus
ccacttaccaactgggcaccaaata

SEQ ID NO: 281994 - DNA, 25 bp, Mus musculus
ctgggcaccaaatacgctctgtaca

SEQ ID NO: 281995 - DNA, 25 bp, Mus musculus
agaagctcttctgggctctttcgga

SEQ ID NO: 281996 - DNA, 25 bp, Mus musculus
ggctctttcggatcccgccagctgt

SEQ ID NO: 281997 - DNA, 25 bp, Mus musculus
gccagctgtccgagtgcaacttttt

SEQ ID NO: 281998 - DNA, 25 bp, Mus musculus
agtgcaactttttaggctcgagatt

SEQ ID NO: 281999 - DNA, 25 bp, Mus musculus
tttttaggctcgagattgcgggtgc

SEQ ID NO: 282000 - DNA, 25 bp, Mus musculus
agcagagccgccttgcgcagggctc

SEQ ID NO: 282001 - DNA, 25 bp, Mus musculus
gcacaggcagcagagccgccttgcg

SEQ ID NO: 282002 - DNA, 25 bp, Mus musculus
aaccgcctgcacagggcaaagcgga

SEQ ID NO: 282003 - DNA, 25 bp, Mus musculus
agctgactggcctgaggcacccgga

SEQ ID NO: 282004 - DNA, 25 bp, Mus musculus
tgcacagggcaaagcggaggaaacc

SEQ ID NO: 282005 - DNA, 25 bp, Mus musculus
ggaaccctgccggttcctgcgggca

SEQ ID NO: 282006 - DNA, 25 bp, Mus musculus
ggttcctgcgggcagcactcaccat

SEQ ID NO: 282007 - DNA, 25 bp, Mus musculus
ttcctgcgggcagcactcaccatgg

SEQ ID NO: 282008 - DNA, 25 bp, Mus musculus
ccgcgaactagcgaacccgccaagg

SEQ ID NO: 282009 - DNA, 25 bp, Mus musculus
tggcgcgagacaaagcccccgcgaa

SEQ ID NO: 282010 - DNA, 25 bp, Mus musculus
tcaaatgtaaagatggcgcgagaca

SEQ ID NO: 282011 - DNA, 25 bp, Mus musculus
ctgaccgatcaaatgtaaagatggc

SEQ ID NO: 282012 - DNA, 25 bp, Mus musculus
gctcaactgaccgatcaaatgtaaa

SEQ ID NO: 282013 - DNA, 25 bp, Mus musculus
cccagctcaactgaccgatcaaatg

SEQ ID NO: 282014 - DNA, 25 bp, Mus musculus
tgactggcctgaggcacccggacac

SEQ ID NO: 282015 - DNA, 25 bp, Mus musculus
agccgaaccgcctgcacagggcaaa

SEQ ID NO: 282016 - DNA, 25 bp, Mus musculus
ccgctgctcggggaagatgaatccg

SEQ ID NO: 282017 - DNA, 25 bp, Mus musculus
agccaacccggctcggtctaggtcg

SEQ ID NO: 282018 - DNA, 25 bp, Mus musculus
gtcgtccttccagcggtcgaacttc

SEQ ID NO: 282019 - DNA, 25 bp, Mus musculus
gggctctagggacagtgttcttatc

SEQ ID NO: 282020 - DNA, 25 bp, Mus musculus
cggctcggtctaggtcgtccttcca

SEQ ID NO: 282021 - DNA, 25 bp, Mus musculus
agagggcaaatgtctccctgtctcc

SEQ ID NO: 282022 - DNA, 25 bp, Mus musculus
ttcaggacgctagagagggcaaatg

SEQ ID NO: 282023 - DNA, 25 bp, Mus musculus
acatgcggatgtcttcaggacgcta

SEQ ID NO: 282024 - DNA, 25 bp, Mus musculus
tgtccggagacatgcggatgtcttc

SEQ ID NO: 282025 - DNA, 25 bp, Mus musculus
ctgaatgttcaggtgtccggagaca

SEQ ID NO: 282026 - DNA, 25 bp, Mus musculus
ctcctcggaaagacctgaatgttca

SEQ ID NO: 282027 - DNA, 25 bp, Mus musculus
tcccgactgggaagctcctcggaaa

SEQ ID NO: 282028 - DNA, 25 bp, Mus musculus
gacagtgttcttatcccgactggga

SEQ ID NO: 282029 - DNA, 25 bp, Mus musculus
gcggtcgaacttcccgcgatcacga

SEQ ID NO: 282030 - DNA, 25 bp, Mus musculus
gcagagcacttacccggctcatgga

SEQ ID NO: 282031 - DNA, 25 bp, Mus musculus
accgctcaatgaacggtgcgctctg

SEQ ID NO: 282032 - DNA, 25 bp, Mus musculus
ggagttggcgagctcagcaccagcc

SEQ ID NO: 282033 - DNA, 25 bp, Mus musculus
tgcactgccggcctcttttgtctgc

SEQ ID NO: 282034 - DNA, 25 bp, Mus musculus
ggctcctgggcttcagccgtcagca

SEQ ID NO: 282035 - DNA, 25 bp, Mus musculus
agatgccgtcctcttgctggagccg

SEQ ID NO: 282036 - DNA, 25 bp, Mus musculus
gtggtactcgaaggagatgccgtcc

SEQ ID NO: 282037 - DNA, 25 bp, Mus musculus
cagctctggatagcggtggtactcg

SEQ ID NO: 282038 - DNA, 25 bp, Mus musculus
gtgcactgcagccatacggacacca

SEQ ID NO: 282039 - DNA, 25 bp, Mus musculus
agattctgctgatggcggtgcactg

SEQ ID NO: 282040 - DNA, 25 bp, Mus musculus
cccactgtgtagattctgctgatgg

SEQ ID NO: 282041 - DNA, 25 bp, Mus musculus
cggggttgtcagacagctcgatgac

SEQ ID NO: 282042 - DNA, 25 bp, Mus musculus
gaacggtgcgctctggggccaccca

SEQ ID NO: 282043 - DNA, 25 bp, Mus musculus
agctcgatgaccaggagctcccggc

SEQ ID NO: 282044 - DNA, 25 bp, Mus musculus
cccggcagcgtgtgactcaagtcaa

SEQ ID NO: 282045 - DNA, 25 bp, Mus musculus
tccacccggatcaggctagagagcg

SEQ ID NO: 282046 - DNA, 25 bp, Mus musculus
gctagagagcgccttacctggcgtc

SEQ ID NO: 282047 - DNA, 25 bp, Mus musculus
tagcggcgccagtcattggctgcgc

SEQ ID NO: 282048 - DNA, 25 bp, Mus musculus
cggcgtcgccttggcaaccaagcgg

SEQ ID NO: 282049 - DNA, 25 bp, Mus musculus
aacgaagccctagcggcgccagtca

SEQ ID NO: 282050 - DNA, 25 bp, Mus musculus
tgactcaagtcaacgaagccctagc

SEQ ID NO: 282051 - DNA, 25 bp, Mus musculus
cccgcgacagacagcggtctaagcg

SEQ ID NO: 282052 - DNA, 25 bp, Mus musculus
atggagtgagaatagtgagacccgc

SEQ ID NO: 282053 - DNA, 25 bp, Mus musculus
attggtccgtgctaaggcccggcag

SEQ ID NO: 282054 - DNA, 25 bp, Mus musculus
ccgtgcagtgattggtccgtgctaa

SEQ ID NO: 282055 - DNA, 25 bp, Mus musculus
cggctcgcctgtcgtaattggtccg

SEQ ID NO: 282056 - DNA, 25 bp, Mus musculus
caaccaagcggtgggttcctaggcg

SEQ ID NO: 282057 - DNA, 25 bp, Mus musculus
ctaagcgcaagtcctggcaggtgca

SEQ ID NO: 282058 - DNA, 25 bp, Mus musculus
ggcgagcgtgctgctcggccacttc

SEQ ID NO: 282059 - DNA, 25 bp, Mus musculus
agatcggcctgaccagtgtcccaag

SEQ ID NO: 282060 - DNA, 25 bp, Mus musculus
aaaccgaggcaagacgagatagatc

SEQ ID NO: 282061 - DNA, 25 bp, Mus musculus
accattcactgcctttccgaagggg

SEQ ID NO: 282062 - DNA, 25 bp, Mus musculus
gggagggcagaccattcactgcctt

SEQ ID NO: 282063 - DNA, 25 bp, Mus musculus
acatccttgtcttggcgtccgagtg

SEQ ID NO: 282064 - DNA, 25 bp, Mus musculus
gtgcaccgcttgctctgattcaccg

SEQ ID NO: 282065 - DNA, 25 bp, Mus musculus
gcttcagaacgcaggcagcgaccgc

SEQ ID NO: 282066 - DNA, 25 bp, Mus musculus
gctcctcgcgggcttcagaacgcag

SEQ ID NO: 282067 - DNA, 25 bp, Mus musculus
ggcgtctccattgtggctcctcgcg

SEQ ID NO: 282068 - DNA, 25 bp, Mus musculus
agctccatcccgaacgttcaattcg

SEQ ID NO: 282069 - DNA, 25 bp, Mus musculus
aaggggtgctctccggtgcaccgct

SEQ ID NO: 282070 - DNA, 25 bp, Mus musculus
ggtgtgttcacatccttgtcttggc

SEQ ID NO: 282071 - DNA, 25 bp, Mus musculus
ttgctctgattcaccggtgtgttca

SEQ ID NO: 282072 - DNA, 25 bp, Mus musculus
aggtcctagtaggtgcgactgtccc

SEQ ID NO: 282073 - DNA, 25 bp, Mus musculus
tcatctcccggaaacgcagattggc

SEQ ID NO: 282074 - DNA, 25 bp, Mus musculus
gacttgtagctctcatctcccggaa

SEQ ID NO: 282075 - DNA, 25 bp, Mus musculus
tccagcatccctcgggcggacttgt

SEQ ID NO: 282076 - DNA, 25 bp, Mus musculus
tggagtgactctaacctccagcatc

SEQ ID NO: 282077 - DNA, 25 bp, Mus musculus
gcacccggaacttggagtgactcta

SEQ ID NO: 282078 - DNA, 25 bp, Mus musculus
ccctcctgcgttggtcggagagcac

SEQ ID NO: 282079 - DNA, 25 bp, Mus musculus
tccttcctgggagagactgacaggc

SEQ ID NO: 282080 - DNA, 25 bp, Mus musculus
cgagctggcttgatctgtccttcct

SEQ ID NO: 282081 - DNA, 25 bp, Mus musculus
cggaaatgggagcttcacgtgatgc

SEQ ID NO: 282082 - DNA, 25 bp, Mus musculus
agtgcgcgtctttggttccggaaat

SEQ ID NO: 282083 - DNA, 25 bp, Mus musculus
ttcactcggcggctcacgtgcagtg

SEQ ID NO: 282084 - DNA, 25 bp, Mus musculus
gggaacgtcttcctgaacgatcgga

SEQ ID NO: 282085 - DNA, 25 bp, Mus musculus
tgcgggctaggagctaaccagagcc

SEQ ID NO: 282086 - DNA, 25 bp, Mus musculus
tgagacgtaatgtttttccgcccgc

SEQ ID NO: 282087 - DNA, 25 bp, Mus musculus
gccacccagagcgagttgagaacgc

SEQ ID NO: 282088 - DNA, 25 bp, Mus musculus
ctaaagcgtccctagaaactgagac

SEQ ID NO: 282089 - DNA, 25 bp, Mus musculus
tttacagcccgggagccacacaaag

SEQ ID NO: 282090 - DNA, 25 bp, Mus musculus
aggagctggtgctttctctaaagcg

SEQ ID NO: 282091 - DNA, 25 bp, Mus musculus
acaatttcacagagggcagcgcagc

SEQ ID NO: 282092 - DNA, 25 bp, Mus musculus
ggagacgtggacaacgccacccaga

SEQ ID NO: 282093 - DNA, 25 bp, Mus musculus
tgagaacgcgctggagcactccgat

SEQ ID NO: 282094 - DNA, 25 bp, Mus musculus
cttctcccgggtccgagcttgtact

SEQ ID NO: 282095 - DNA, 25 bp, Mus musculus
cagagcctcccggagaacctaaggg

SEQ ID NO: 282096 - DNA, 25 bp, Mus musculus
gccgctcaccatggcgatgtcttgg

SEQ ID NO: 282097 - DNA, 25 bp, Mus musculus
gagcactccgatcctggggcagcac

SEQ ID NO: 282098 - DNA, 25 bp, Mus musculus
ggcgatgtcccgatgcgacaatttc

SEQ ID NO: 282099 - DNA, 25 bp, Mus musculus
catggcgatgtcttggccaccgagg

SEQ ID NO: 282100 - DNA, 25 bp, Mus musculus
tttagaagagcctcgggaacacgtg

SEQ ID NO: 282101 - DNA, 25 bp, Mus musculus
aagagcctcgggaacacgtgacagt

SEQ ID NO: 282102 - DNA, 25 bp, Mus musculus
ggtacctcgggatgccctggccgct

SEQ ID NO: 282103 - DNA, 25 bp, Mus musculus
agcggtggcagcaggagcaggacct

SEQ ID NO: 282104 - DNA, 25 bp, Mus musculus
cgcttctgcttgagatggaagcggt

SEQ ID NO: 282105 - DNA, 25 bp, Mus musculus
gcggtcgcttctgcttgagatggaa

SEQ ID NO: 282106 - DNA, 25 bp, Mus musculus
ttctcgtaggggcaggcgaggcctg

SEQ ID NO: 282107 - DNA, 25 bp, Mus musculus
aggcgaggcctggagtgggtacctc

SEQ ID NO: 282108 - DNA, 25 bp, Mus musculus
tacgcggctgagtgcggtcgcttct

SEQ ID NO: 282109 - DNA, 25 bp, Mus musculus
gtgacagtccctgagaccccggaca

SEQ ID NO: 282110 - DNA, 25 bp, Mus musculus
gaacacgtgacagtccctgagaccc

SEQ ID NO: 282111 - DNA, 25 bp, Mus musculus
ctcgggaacacgtgacagtccctga

SEQ ID NO: 282112 - DNA, 25 bp, Mus musculus
agcctcgggaacacgtgacagtccc

SEQ ID NO: 282113 - DNA, 25 bp, Mus musculus
tgcgggtgcctggactccggggtac

SEQ ID NO: 282114 - DNA, 25 bp, Mus musculus
ttacctgagaaacgcgcgggcttca

SEQ ID NO: 282115 - DNA, 25 bp, Mus musculus
ctcggattcggacaggtcgagtgca

SEQ ID NO: 282116 - DNA, 25 bp, Mus musculus
cgcagccacctgaggatcgccggga

SEQ ID NO: 282117 - DNA, 25 bp, Mus musculus
ggcagcaccgcagccacctgaggat

SEQ ID NO: 282118 - DNA, 25 bp, Mus musculus
attcggacaggtcgagtgcacgaga

SEQ ID NO: 282119 - DNA, 25 bp, Mus musculus
tggccgagttggctagcttggcttc

SEQ ID NO: 282120 - DNA, 25 bp, Mus musculus
cgtgtcctcaggtcggtccgcgtgc

SEQ ID NO: 282121 - DNA, 25 bp, Mus musculus
cccggaagtcccgtgaatgatgccg

SEQ ID NO: 282122 - DNA, 25 bp, Mus musculus
gccctcccggaagtcccgtgaatga

SEQ ID NO: 282123 - DNA, 25 bp, Mus musculus
gcgtctcgttcatgacgtcaccggc

SEQ ID NO: 282124 - DNA, 25 bp, Mus musculus
tgggaaccggcgtctcgttcatgac

SEQ ID NO: 282125 - DNA, 25 bp, Mus musculus
tcctccatagttggaatccttcagc

SEQ ID NO: 282126 - DNA, 25 bp, Mus musculus
ccgccgcgcagctgcagacgctcaa

SEQ ID NO: 282127 - DNA, 25 bp, Mus musculus
gtccgcgtgcggttacctgagaaac

SEQ ID NO: 282128 - DNA, 25 bp, Mus musculus
tgctttgtctccttccgcaacaccc

SEQ ID NO: 282129 - DNA, 25 bp, Mus musculus
ccagagccttcagtcgctggacgct

SEQ ID NO: 282130 - DNA, 25 bp, Mus musculus
agtgcgtccgcctacgagggcgctc

SEQ ID NO: 282131 - DNA, 25 bp, Mus musculus
cctctccacagggtcgcggctgtgg

SEQ ID NO: 282132 - DNA, 25 bp, Mus musculus
cccgagaaaagtgagaggcgcgctc

SEQ ID NO: 282133 - DNA, 25 bp, Mus musculus
cctctgctgcctgttgctttgtctc

SEQ ID NO: 282134 - DNA, 25 bp, Mus musculus
agtagcgtcctgcagccctctgctg

SEQ ID NO: 282135 - DNA, 25 bp, Mus musculus
ctcggcggagtagcgtcctgcagcc

SEQ ID NO: 282136 - DNA, 25 bp, Mus musculus
cccggcaacgtcaaggcgaaggcgg

SEQ ID NO: 282137 - DNA, 25 bp, Mus musculus
ttccatcttccatcgcccgcgcggg

SEQ ID NO: 282138 - DNA, 25 bp, Mus musculus
cggcgtttctcccttccatcttcca

SEQ ID NO: 282139 - DNA, 25 bp, Mus musculus
aggtacggacgcctgacacactcca

SEQ ID NO: 282140 - DNA, 25 bp, Mus musculus
ggctcaggtacggacgcctgacaca

SEQ ID NO: 282141 - DNA, 25 bp, Mus musculus
agaggcgcgctcacgggcgtttcct

SEQ ID NO: 282142 - DNA, 25 bp, Mus musculus
tgagagcagtaaacaaaaccctggc

SEQ ID NO: 282143 - DNA, 25 bp, Mus musculus
gcgaggacactgagccaagagctta

SEQ ID NO: 282144 - DNA, 25 bp, Mus musculus
aaggcgaacgtctgctctgagagca

SEQ ID NO: 282145 - DNA, 25 bp, Mus musculus
cctcgaaagttcaggagcatccgtg

SEQ ID NO: 282146 - DNA, 25 bp, Mus musculus
ctgcagaagccacggcaatgaaccc

SEQ ID NO: 282147 - DNA, 25 bp, Mus musculus
gggcctgcagaagccacggcaatga

SEQ ID NO: 282148 - DNA, 25 bp, Mus musculus
gccgtccgtccgtgggcctgcagaa

SEQ ID NO: 282149 - DNA, 25 bp, Mus musculus
gagccaagagcttaatgtcttcaga

SEQ ID NO: 282150 - DNA, 25 bp, Mus musculus
aagttcaggagcatccgtgcggctg

SEQ ID NO: 282151 - DNA, 25 bp, Mus musculus
ggccactggccagcgagctgctgca

SEQ ID NO: 282152 - DNA, 25 bp, Mus musculus
tgaaccgaacaaccctgagctgatc

SEQ ID NO: 282153 - DNA, 25 bp, Mus musculus
tcaggagcatccgtgcggctgccgt

SEQ ID NO: 282154 - DNA, 25 bp, Mus musculus
ctgctgcaggcatgaaccgaacaac

SEQ ID NO: 282155 - DNA, 25 bp, Mus musculus
ccctgagctgatcctcgaaagttca

SEQ ID NO: 282156 - DNA, 25 bp, Mus musculus
aggccgtcagagtctccagcgagcg

SEQ ID NO: 282157 - DNA, 25 bp, Mus musculus
agcgagcggtccagccccttctggt

SEQ ID NO: 282158 - DNA, 25 bp, Mus musculus
cagaggccgtcagagtctccagcga

SEQ ID NO: 282159 - DNA, 25 bp, Mus musculus
ctcaaaggcagtggcctcagaggcc

SEQ ID NO: 282160 - DNA, 25 bp, Mus musculus
cattgcgctcaaaggcagtggcctc

SEQ ID NO: 282161 - DNA, 25 bp, Mus musculus
actctgtgcgggcattgcgctcaaa

SEQ ID NO: 282162 - DNA, 25 bp, Mus musculus
gacttggccgactctgtgcgggcat

SEQ ID NO: 282163 - DNA, 25 bp, Mus musculus
ctccatgataacgtcccggagctta

SEQ ID NO: 282164 - DNA, 25 bp, Mus musculus
gggctctccatgataacgtcccgga

SEQ ID NO: 282165 - DNA, 25 bp, Mus musculus
ccagagggctctccatgataacgtc

SEQ ID NO: 282166 - DNA, 25 bp, Mus musculus
gtgggcaggcttgccatcacagctc

SEQ ID NO: 282167 - DNA, 25 bp, Mus musculus
tccgtgatttccagagggctctcca

SEQ ID NO: 282168 - DNA, 25 bp, Mus musculus
gcttgccatcacagctccgtgattt

SEQ ID NO: 282169 - DNA, 25 bp, Mus musculus
taacgtcccggagcttatgcagagg

SEQ ID NO: 282170 - DNA, 25 bp, Mus musculus
ctcgacggcgcggtctacgacctga

SEQ ID NO: 282171 - DNA, 25 bp, Mus musculus
tctacgacctgagtatccgcgatgg

SEQ ID NO: 282172 - DNA, 25 bp, Mus musculus
cggggcggacagttacctcatcgcc

SEQ ID NO: 282173 - DNA, 25 bp, Mus musculus
cccagaagtcttgaggtagcggttc

SEQ ID NO: 282174 - DNA, 25 bp, Mus musculus
agtatccgcgatggtgacgtcgctg

SEQ ID NO: 282175 - DNA, 25 bp, Mus musculus
cgccaattcttgtttggtgactatc

SEQ ID NO: 282176 - DNA, 25 bp, Mus musculus
tggtgactatcctgagcgccaccga

SEQ ID NO: 282177 - DNA, 25 bp, Mus musculus
gccatcatccgccaattcttgtttg

SEQ ID NO: 282178 - DNA, 25 bp, Mus musculus
ggagtgggtaagaccgccatcatcc

SEQ ID NO: 282179 - DNA, 25 bp, Mus musculus
cgcagaacgggctcatgaagctccc

SEQ ID NO: 282180 - DNA, 25 bp, Mus musculus
gcaagcaaggcgcagaacgggctca

SEQ ID NO: 282181 - DNA, 25 bp, Mus musculus
cctggcctcttgtggctgaggtgct

SEQ ID NO: 282182 - DNA, 25 bp, Mus musculus
caccgggtgcactcttcctgcggag

SEQ ID NO: 282183 - DNA, 25 bp, Mus musculus
tgacgtcgctggacccggctcaagc

SEQ ID NO: 282184 - DNA, 25 bp, Mus musculus
cccaggcaacactgcagacagcgga

SEQ ID NO: 282185 - DNA, 25 bp, Mus musculus
tggaaaacggcagcgacacgcccgc

SEQ ID NO: 282186 - DNA, 25 bp, Mus musculus
acactgcagacagcggagccggatc

SEQ ID NO: 282187 - DNA, 25 bp, Mus musculus
ggagccggatccctcggctacgctg

SEQ ID NO: 282188 - DNA, 25 bp, Mus musculus
gcgggctgaacagcggccaagcaca

SEQ ID NO: 282189 - DNA, 25 bp, Mus musculus
gctgaactttccctcctgcgaggcg

SEQ ID NO: 282190 - DNA, 25 bp, Mus musculus
tgacagagagccaccctgaggtcga

SEQ ID NO: 282191 - DNA, 25 bp, Mus musculus
tgcaggcgtcctcccggctgacaga

SEQ ID NO: 282192 - DNA, 25 bp, Mus musculus
acagcagtggtctctggaagccagc

SEQ ID NO: 282193 - DNA, 25 bp, Mus musculus
cctcagccctaggacagcagtggtc

SEQ ID NO: 282194 - DNA, 25 bp, Mus musculus
tgattccggagtcctcagccctagg

SEQ ID NO: 282195 - DNA, 25 bp, Mus musculus
cgcggactggaaaacggcagcgaca

SEQ ID NO: 282196 - DNA, 25 bp, Mus musculus
cacgcgcctcgcaagggctacagag

SEQ ID NO: 282197 - DNA, 25 bp, Mus musculus
ctacagagggcagtgattccggagt

SEQ ID NO: 282198 - DNA, 25 bp, Mus musculus
gtcgtcttgcacagtccaggcccag

SEQ ID NO: 282199 - DNA, 25 bp, Mus musculus
cgactgtgagtttctggtgcagcga

SEQ ID NO: 282200 - DNA, 25 bp, Mus musculus
ggcgccctagtgtcgcctactggaa

SEQ ID NO: 282201 - DNA, 25 bp, Mus musculus
tacagaacctctgcggcctgtggtt

SEQ ID NO: 282202 - DNA, 25 bp, Mus musculus
tccaggtctccgtagtttccatagg

SEQ ID NO: 282203 - DNA, 25 bp, Mus musculus
tccgagtaatgaaaatccaggtctc

SEQ ID NO: 282204 - DNA, 25 bp, Mus musculus
acctggagcacagggttgccgactc

SEQ ID NO: 282205 - DNA, 25 bp, Mus musculus
agcgtgtcgcggaccttcaaacccg

SEQ ID NO: 282206 - DNA, 25 bp, Mus musculus
tatttacaccgaaggaccgccgctc

SEQ ID NO: 282207 - DNA, 25 bp, Mus musculus
cgcgacacttcgaaactacacctta

SEQ ID NO: 282208 - DNA, 25 bp, Mus musculus
ccggccgacttcaacatccaggtga

SEQ ID NO: 282209 - DNA, 25 bp, Mus musculus
tctgacgcttactcccaggcggtca

SEQ ID NO: 282210 - DNA, 25 bp, Mus musculus
ctgggcaccaggtttatttacaccg

SEQ ID NO: 282211 - DNA, 25 bp, Mus musculus
tcaaacccgggctggaatcaaagga

SEQ ID NO: 282212 - DNA, 25 bp, Mus musculus
ttggctccagagtttgaccgccttc

SEQ ID NO: 282213 - DNA, 25 bp, Mus musculus
gagtttggctccagagtttgaccgc

SEQ ID NO: 282214 - DNA, 25 bp, Mus musculus
caccgggagatggagagcaaagccc

SEQ ID NO: 282215 - DNA, 25 bp, Mus musculus
agcagcaaagcagaagggtgcaccg

SEQ ID NO: 282216 - DNA, 25 bp, Mus musculus
tccagtcctcttgcgcctcctgctc

SEQ ID NO: 282217 - DNA, 25 bp, Mus musculus
ttccagcagcaaagcagaagggtgc

SEQ ID NO: 282218 - DNA, 25 bp, Mus musculus
tccagagtttgaccgccttccgagg

SEQ ID NO: 282219 - DNA, 25 bp, Mus musculus
tggccgcagcagacggtacgttttt

SEQ ID NO: 282220 - DNA, 25 bp, Mus musculus
cgcgtagttccagcagcaaagcaga

SEQ ID NO: 282221 - DNA, 25 bp, Mus musculus
gccgcgtagttccagcagcaaagca

SEQ ID NO: 282222 - DNA, 25 bp, Mus musculus
cacgccgcgtagttccagcagcaaa

SEQ ID NO: 282223 - DNA, 25 bp, Mus musculus
tgcgcctcctgctcaacccgctcct

SEQ ID NO: 282224 - DNA, 25 bp, Mus musculus
gctccaccgcgctccagtcctcttg

SEQ ID NO: 282225 - DNA, 25 bp, Mus musculus
cgcagcagacggtacgtttttcgcg

SEQ ID NO: 282226 - DNA, 25 bp, Mus musculus
ggcgtcctgcaagcgttcctgtgct

SEQ ID NO: 282227 - DNA, 25 bp, Mus musculus
cgtcctgcaagcgttcctgtgctcg

SEQ ID NO: 282228 - DNA, 25 bp, Mus musculus
aagctggcgtcctgcaagcgttcct

SEQ ID NO: 282229 - DNA, 25 bp, Mus musculus
cattccaactgtacagggcgctgtc

SEQ ID NO: 282230 - DNA, 25 bp, Mus musculus
gctggcgtcctgcaagcgttcctgt

SEQ ID NO: 282231 - DNA, 25 bp, Mus musculus
agctacagtgaaagtgggagtgcgc

SEQ ID NO: 282232 - DNA, 25 bp, Mus musculus
gcattccaactgtacagggcgctgt

SEQ ID NO: 282233 - DNA, 25 bp, Mus musculus
ggcgcccgggaacgcgtggcgcaga

SEQ ID NO: 282234 - DNA, 25 bp, Mus musculus
attccaactgtacagggcgctgtcg

SEQ ID NO: 282235 - DNA, 25 bp, Mus musculus
ttccaactgtacagggcgctgtcgc

SEQ ID NO: 282236 - DNA, 25 bp, Mus musculus
tccaactgtacagggcgctgtcgct

SEQ ID NO: 282237 - DNA, 25 bp, Mus musculus
tgtacagggcgctgtcgctctcggc

SEQ ID NO: 282238 - DNA, 25 bp, Mus musculus
ggggttgtgagctacagtgaaagtg

SEQ ID NO: 282239 - DNA, 25 bp, Mus musculus
ctggaagctggcgtcctgcaagcgt

SEQ ID NO: 282240 - DNA, 25 bp, Mus musculus
tgaccctaactttgctgggactgcg

SEQ ID NO: 282241 - DNA, 25 bp, Mus musculus
cctatagggaataggggtgctgaat

SEQ ID NO: 282242 - DNA, 25 bp, Mus musculus
tgctgaatgcaaggcacgcgggcca

SEQ ID NO: 282243 - DNA, 25 bp, Mus musculus
cggtggtgacctccctatagggaat

SEQ ID NO: 282244 - DNA, 25 bp, Mus musculus
ggcacgcgggccaaagtgaccctaa

SEQ ID NO: 282245 - DNA, 25 bp, Mus musculus
ctacggcgactctgggttcccgctt

SEQ ID NO: 282246 - DNA, 25 bp, Mus musculus
tgggactgcgggtcagacccctcta

SEQ ID NO: 282247 - DNA, 25 bp, Mus musculus
ctctagaagcgggaagagtgaatcg

SEQ ID NO: 282248 - DNA, 25 bp, Mus musculus
aggacgcgttgtgtgcattccaact

SEQ ID NO: 282249 - DNA, 25 bp, Mus musculus
caaagctgtagtgaccggtggtgac

SEQ ID NO: 282250 - DNA, 25 bp, Mus musculus
cgcagaggccgagcaaagctgtagt

SEQ ID NO: 282251 - DNA, 25 bp, Mus musculus
cgactgccatcgcagggaacggctg

SEQ ID NO: 282252 - DNA, 25 bp, Mus musculus
tgagttcccactcggtctcctgctc

SEQ ID NO: 282253 - DNA, 25 bp, Mus musculus
cgcgttgtgtgcattccaactgtac

SEQ ID NO: 282254 - DNA, 25 bp, Mus musculus
gtcagctccctatgcgcctagcatg

SEQ ID NO: 282255 - DNA, 25 bp, Mus musculus
ccagcctcgtctcagtgagtacggg

SEQ ID NO: 282256 - DNA, 25 bp, Mus musculus
cggtgagccggaactacctatccca

SEQ ID NO: 282257 - DNA, 25 bp, Mus musculus
gaatcgtgaacggggccgcacccga

SEQ ID NO: 282258 - DNA, 25 bp, Mus musculus
ccagtcgggacggaggagacaagat

SEQ ID NO: 282259 - DNA, 25 bp, Mus musculus
cgtctcagtgagtacgggaaagtga

SEQ ID NO: 282260 - DNA, 25 bp, Mus musculus
gcacgggcctccctgctatatgtgc

SEQ ID NO: 282261 - DNA, 25 bp, Mus musculus
ccgcagcttcgaagcgcgcatgggt

SEQ ID NO: 282262 - DNA, 25 bp, Mus musculus
cagatccgcgctcccagcactctgg

SEQ ID NO: 282263 - DNA, 25 bp, Mus musculus
ccgcagagctccagtcacgagtctg

SEQ ID NO: 282264 - DNA, 25 bp, Mus musculus
agcactctggtcagctccctatgcg

SEQ ID NO: 282265 - DNA, 25 bp, Mus musculus
agacaagatggcgttgcgagcgatg

SEQ ID NO: 282266 - DNA, 25 bp, Mus musculus
gggcctctgccgcagcttcgaagcg

SEQ ID NO: 282267 - DNA, 25 bp, Mus musculus
ggcctccctgctatatgtgcgcctg

SEQ ID NO: 282268 - DNA, 25 bp, Mus musculus
ccaagcttgcgcgagtacttttctc

SEQ ID NO: 282269 - DNA, 25 bp, Mus musculus
aaaagagccgagagcacggcgcccg

SEQ ID NO: 282270 - DNA, 25 bp, Mus musculus
caccacttcagaaaagagccgagag

SEQ ID NO: 282271 - DNA, 25 bp, Mus musculus
agctcctacaccacttcagaaaaga

SEQ ID NO: 282272 - DNA, 25 bp, Mus musculus
tctcagcagaggcacagaaccgcca

SEQ ID NO: 282273 - DNA, 25 bp, Mus musculus
gagtacttttctcggctctcagcag

SEQ ID NO: 282274 - DNA, 25 bp, Mus musculus
ggcctccaagcttgcgcgagtactt

SEQ ID NO: 282275 - DNA, 25 bp, Mus musculus
ggctcaccatagcttggcctccaag

SEQ ID NO: 282276 - DNA, 25 bp, Mus musculus
acacggcttcccgacgctcagcagc

SEQ ID NO: 282277 - DNA, 25 bp, Mus musculus
gagggagggcccaccacacggcttc

SEQ ID NO: 282278 - DNA, 25 bp, Mus musculus
ccgactcagaccgagggagggccca

SEQ ID NO: 282279 - DNA, 25 bp, Mus musculus
actagctccgactcagaccgaggga

SEQ ID NO: 282280 - DNA, 25 bp, Mus musculus
gtctggccactagctccgactcaga

SEQ ID NO: 282281 - DNA, 25 bp, Mus musculus
cggctctcagcagaggcacagaacc

SEQ ID NO: 282282 - DNA, 25 bp, Mus musculus
agtcactccgtgctcggcaaaaccg

SEQ ID NO: 282283 - DNA, 25 bp, Mus musculus
tgctttacgggtatcccgcggctgt

SEQ ID NO: 282284 - DNA, 25 bp, Mus musculus
gagtggggacccatccaagcggaac

SEQ ID NO: 282285 - DNA, 25 bp, Mus musculus
ggacccatccaagcggaaccttcag

SEQ ID NO: 282286 - DNA, 25 bp, Mus musculus
cttcagccaccacggccctccaggc

SEQ ID NO: 282287 - DNA, 25 bp, Mus musculus
ggccctccaggcaggggcccacaga

SEQ ID NO: 282288 - DNA, 25 bp, Mus musculus
cagcagggtacaaggaacctgaccc

SEQ ID NO: 282289 - DNA, 25 bp, Mus musculus
aactgggactagaggtcggacagcg

SEQ ID NO: 282290 - DNA, 25 bp, Mus musculus
tccgtgctcggcaaaaccgtgctgt

SEQ ID NO: 282291 - DNA, 25 bp, Mus musculus
ggcaaaaccgtgctgtggctcccgc

SEQ ID NO: 282292 - DNA, 25 bp, Mus musculus
gtggctcccgcacgcccaccaccca

SEQ ID NO: 282293 - DNA, 25 bp, Mus musculus
gggaccctaactcccttctcagcgc

SEQ ID NO: 282294 - DNA, 25 bp, Mus musculus
cccgacggcagcagggtacaaggaa

SEQ ID NO: 282295 - DNA, 25 bp, Mus musculus
ggcccacagacagcccggggaactg

SEQ ID NO: 282296 - DNA, 25 bp, Mus musculus
ggccgctcctcccatcaggggacag

SEQ ID NO: 282297 - DNA, 25 bp, Mus musculus
gccagcccggatcgtgacgtcatcc

SEQ ID NO: 282298 - DNA, 25 bp, Mus musculus
ccaagaggatcagggcggaagtacc

SEQ ID NO: 282299 - DNA, 25 bp, Mus musculus
gaagtacctacggaccgcaggcgga

SEQ ID NO: 282300 - DNA, 25 bp, Mus musculus
gctcagcgctgacgccaagaggatc

SEQ ID NO: 282301 - DNA, 25 bp, Mus musculus
cagcggccctcgctcaccattgcca

SEQ ID NO: 282302 - DNA, 25 bp, Mus musculus
tcaccattgccaggctccgagctca

SEQ ID NO: 282303 - DNA, 25 bp, Mus musculus
gacgtcatccgcgtactggcttccg

SEQ ID NO: 282304 - DNA, 25 bp, Mus musculus
tccaagcactggctcccacaacggc

SEQ ID NO: 282305 - DNA, 25 bp, Mus musculus
ccacaacggctttcctcagtttcgg

SEQ ID NO: 282306 - DNA, 25 bp, Mus musculus
cggctttcctcagtttcggtgaaga

SEQ ID NO: 282307 - DNA, 25 bp, Mus musculus
tcagtttcggtgaagaacctttagc

SEQ ID NO: 282308 - DNA, 25 bp, Mus musculus
gaacctttagctaacatggcggccg

SEQ ID NO: 282309 - DNA, 25 bp, Mus musculus
gatcagggcggaagtacctacggac

SEQ ID NO: 282310 - DNA, 25 bp, Mus musculus
ccttcgacggcgcaggtttctccta

SEQ ID NO: 282311 - DNA, 25 bp, Mus musculus
cagtaaacccgcagctgttggagga

SEQ ID NO: 282312 - DNA, 25 bp, Mus musculus
cctgcgtgcgggcttcacagtaaac

SEQ ID NO: 282313 - DNA, 25 bp, Mus musculus
cactcacttgtaaccctgcgtgcgg

SEQ ID NO: 282314 - DNA, 25 bp, Mus musculus
gacagcttaacgtcgcactcacttg

SEQ ID NO: 282315 - DNA, 25 bp, Mus musculus
ctagtgcgggttgtgacagcttaac

SEQ ID NO: 282316 - DNA, 25 bp, Mus musculus
gtttctcctagtgcgggttgtgaca

SEQ ID NO: 282317 - DNA, 25 bp, Mus musculus
tgctgagctggtctgcccacagctc

SEQ ID NO: 282318 - DNA, 25 bp, Mus musculus
tgcagagcccagagcacccgcgtgg

SEQ ID NO: 282319 - DNA, 25 bp, Mus musculus
tttaaaaggcgaagccgcgagctcc

SEQ ID NO: 282320 - DNA, 25 bp, Mus musculus
cggcttggtgcgaagattagagttt

SEQ ID NO: 282321 - DNA, 25 bp, Mus musculus
ccactgcggcccgtagctaagggga

SEQ ID NO: 282322 - DNA, 25 bp, Mus musculus
ggaggcgggctccatcgcaatcccg

SEQ ID NO: 282323 - DNA, 25 bp, Mus musculus
caatcccgctgtgcattccgctggg

SEQ ID NO: 282324 - DNA, 25 bp, Mus musculus
cgctctgcgcagacatggctggaaa

SEQ ID NO: 282325 - DNA, 25 bp, Mus musculus
agaatctgcagcatggcggcggata

SEQ ID NO: 282326 - DNA, 25 bp, Mus musculus
tgcctgcttaagaacagaatctgca

SEQ ID NO: 282327 - DNA, 25 bp, Mus musculus
ggaccacgcgatgcctgcttaagaa

SEQ ID NO: 282328 - DNA, 25 bp, Mus musculus
ggcgatcacaccgcagctcacggga

SEQ ID NO: 282329 - DNA, 25 bp, Mus musculus
gcggttgctgagctcgcctgcgctc

SEQ ID NO: 282330 - DNA, 25 bp, Mus musculus
gaacgcacagggtgtccgctcggcc

SEQ ID NO: 282331 - DNA, 25 bp, Mus musculus
aagcactggccagtgacggggccca

SEQ ID NO: 282332 - DNA, 25 bp, Mus musculus
catggctggaaaagcggaagtgatt

SEQ ID NO: 282333 - DNA, 25 bp, Mus musculus
ccctgattaggaggagtcttccgct

SEQ ID NO: 282334 - DNA, 25 bp, Mus musculus
gcggcggataggacccacctctcgt

SEQ ID NO: 282335 - DNA, 25 bp, Mus musculus
cacgtcgcccagtggaacgcacagg

SEQ ID NO: 282336 - DNA, 25 bp, Mus musculus
cggaagtgattagagtcctccgaga

SEQ ID NO: 282337 - DNA, 25 bp, Mus musculus
tcctccgagacaagcactggccagt

SEQ ID NO: 282338 - DNA, 25 bp, Mus musculus
agcagtcatcggcacactccgggca

SEQ ID NO: 282339 - DNA, 25 bp, Mus musculus
caccttgccgcgcagggccttcctc

SEQ ID NO: 282340 - DNA, 25 bp, Mus musculus
tcctccagcgcggttcccactccgg

SEQ ID NO: 282341 - DNA, 25 bp, Mus musculus
caggcggagcacagcggatccccgt

SEQ ID NO: 282342 - DNA, 25 bp, Mus musculus
ccgtcggcgcgacagagcagctgca

SEQ ID NO: 282343 - DNA, 25 bp, Mus musculus
cgacagagcagctgcagcgcggcct

SEQ ID NO: 282344 - DNA, 25 bp, Mus musculus
agcgcggcctcgctggcagggccat

SEQ ID NO: 282345 - DNA, 25 bp, Mus musculus
agtcatcggcacactccgggcacgg

SEQ ID NO: 282346 - DNA, 25 bp, Mus musculus
catcggcacactccgggcacgggaa

SEQ ID NO: 282347 - DNA, 25 bp, Mus musculus
cctcctcggcccagaagcgcaccac

SEQ ID NO: 282348 - DNA, 25 bp, Mus musculus
cccagaagcgcaccacgcacgcccg

SEQ ID NO: 282349 - DNA, 25 bp, Mus musculus
acgcacgcccggcagaaacggtggc

SEQ ID NO: 282350 - DNA, 25 bp, Mus musculus
cgcgctgccagcagtcatcggcaca

SEQ ID NO: 282351 - DNA, 25 bp, Mus musculus
gccgcctcctcgagagccaggaggc

SEQ ID NO: 282352 - DNA, 25 bp, Mus musculus
gcgaagtactcgtccttggtgtaga

SEQ ID NO: 282353 - DNA, 25 bp, Mus musculus
ggccggaactcgaagagctctttga

SEQ ID NO: 282354 - DNA, 25 bp, Mus musculus
cgatcaggtacttgtgcttggcgtc

SEQ ID NO: 282355 - DNA, 25 bp, Mus musculus
cttcatagcttctaggatggtctca

SEQ ID NO: 282356 - DNA, 25 bp, Mus musculus
cttcgctgaccaagtcggtgagtgc

SEQ ID NO: 282357 - DNA, 25 bp, Mus musculus
ttcagacagcagtcgagcgcgatca

SEQ ID NO: 282358 - DNA, 25 bp, Mus musculus
cgttctccgccgctacagcgaagta

SEQ ID NO: 282359 - DNA, 25 bp, Mus musculus
agcccgtagttgtcatcgcagccag

SEQ ID NO: 282360 - DNA, 25 bp, Mus musculus
taggcggtatacaccagtcaggttc

SEQ ID NO: 282361 - DNA, 25 bp, Mus musculus
caccgacggctgttcgcaattgagc

SEQ ID NO: 282362 - DNA, 25 bp, Mus musculus
gccgcagcggcgaatgttcataagc

SEQ ID NO: 282363 - DNA, 25 bp, Mus musculus
catggatgttctgcgccaccaccga

SEQ ID NO: 282364 - DNA, 25 bp, Mus musculus
gctctcgtagtactccagccgcgga

SEQ ID NO: 282365 - DNA, 25 bp, Mus musculus
acgacccggacgactgactcttgct

SEQ ID NO: 282366 - DNA, 25 bp, Mus musculus
gccgccaaccgcagcgggcctaacg

SEQ ID NO: 282367 - DNA, 25 bp, Mus musculus
gcacacgcacccacggggcctccct

SEQ ID NO: 282368 - DNA, 25 bp, Mus musculus
gaagagctaccgatagctgccactc

SEQ ID NO: 282369 - DNA, 25 bp, Mus musculus
agcgacacagccgcagcgacctagt

SEQ ID NO: 282370 - DNA, 25 bp, Mus musculus
cgtgacgtcaccgacacggagggcg

SEQ ID NO: 282371 - DNA, 25 bp, Mus musculus
ggcctaacgccgcacaagcgaagag

SEQ ID NO: 282372 - DNA, 25 bp, Mus musculus
ccgcacaagcgaagagctaccgata

SEQ ID NO: 282373 - DNA, 25 bp, Mus musculus
agctgccactcctctccacctggga

SEQ ID NO: 282374 - DNA, 25 bp, Mus musculus
cggccacagcgcagcacacgcaccc

SEQ ID NO: 282375 - DNA, 25 bp, Mus musculus
gggcctccctgagccacggagttca

SEQ ID NO: 282376 - DNA, 25 bp, Mus musculus
gagccacggagttcagtctacaaca

SEQ ID NO: 282377 - DNA, 25 bp, Mus musculus
ttcagtctacaacacggcggacaga

SEQ ID NO: 282378 - DNA, 25 bp, Mus musculus
tacaacacggcggacagagaaaatc

SEQ ID NO: 282379 - DNA, 25 bp, Mus musculus
ccacctgggacagcggccctgcgct

SEQ ID NO: 282380 - DNA, 25 bp, Mus musculus
ccgcagagccgagccacaatatggc

SEQ ID NO: 282381 - DNA, 25 bp, Mus musculus
cgactctttcctgcgcgaggcggag

SEQ ID NO: 282382 - DNA, 25 bp, Mus musculus
ccagtagtcctgattagacggcacg

SEQ ID NO: 282383 - DNA, 25 bp, Mus musculus
tgccgctctccagtagtcctgatta

SEQ ID NO: 282384 - DNA, 25 bp, Mus musculus
cgagccacaatatggcggccgtgaa

SEQ ID NO: 282385 - DNA, 25 bp, Mus musculus
ctgtgccgcagagccgagccacaat

SEQ ID NO: 282386 - DNA, 25 bp, Mus musculus
cggcagcagcgctcacagcacaaca

SEQ ID NO: 282387 - DNA, 25 bp, Mus musculus
gctctcctcactggtcccggcagca

SEQ ID NO: 282388 - DNA, 25 bp, Mus musculus
ggcttccgaactcgcccgcgctctc

SEQ ID NO: 282389 - DNA, 25 bp, Mus musculus
ggatccaccacagcgggcagggaca

SEQ ID NO: 282390 - DNA, 25 bp, Mus musculus
gcctcggggaggatccaccacagcg

SEQ ID NO: 282391 - DNA, 25 bp, Mus musculus
gcccagcgccacacagcactgaatg

SEQ ID NO: 282392 - DNA, 25 bp, Mus musculus
tttcctgcgcgaggcggagcctccg

SEQ ID NO: 282393 - DNA, 25 bp, Mus musculus
cgaagaggacacagggcccagcgcc

SEQ ID NO: 282394 - DNA, 25 bp, Mus musculus
cggccgaccttagcaagctgatttg

SEQ ID NO: 282395 - DNA, 25 bp, Mus musculus
tgcgttcttagttcgccacggccga

SEQ ID NO: 282396 - DNA, 25 bp, Mus musculus
caagctgatttggacctttggtacc

SEQ ID NO: 282397 - DNA, 25 bp, Mus musculus
taccttctttgtcatggcggcgccc

SEQ ID NO: 282398 - DNA, 25 bp, Mus musculus
ggcgccctgaacagacacttgtgtt

SEQ ID NO: 282399 - DNA, 25 bp, Mus musculus
taggcgcttcctattccaaggtggc

SEQ ID NO: 282400 - DNA, 25 bp, Mus musculus
tggcgctcagaccttaccggaagta

SEQ ID NO: 282401 - DNA, 25 bp, Mus musculus
actcatagcgaacggcgacgaactg

SEQ ID NO: 282402 - DNA, 25 bp, Mus musculus
gcagcagctggacccagatacccga

SEQ ID NO: 282403 - DNA, 25 bp, Mus musculus
gcactcactgtcctgtcggggcatt

SEQ ID NO: 282404 - DNA, 25 bp, Mus musculus
gcattggtctgtgcacgcgcactgc

SEQ ID NO: 282405 - DNA, 25 bp, Mus musculus
cgggcttgcgagtctccaatcttaa

SEQ ID NO: 282406 - DNA, 25 bp, Mus musculus
ttaacagctcgattctccagcggcg

SEQ ID NO: 282407 - DNA, 25 bp, Mus musculus
cccgtctacatcttttgcgttctta

SEQ ID NO: 282408 - DNA, 25 bp, Mus musculus
cgatggcgacttccgggaggggcgt

SEQ ID NO: 282409 - DNA, 25 bp, Mus musculus
tcgccatggactcagcggagacagg

SEQ ID NO: 282410 - DNA, 25 bp, Mus musculus
cgtggtcgtctcgaggcgtggcata

SEQ ID NO: 282411 - DNA, 25 bp, Mus musculus
tcgtctcgaggcgtggcatagctgg

SEQ ID NO: 282412 - DNA, 25 bp, Mus musculus
gggcgacaccactgggtcggcagag

SEQ ID NO: 282413 - DNA, 25 bp, Mus musculus
ctgggtcggcagaggcaggaaatcg

SEQ ID NO: 282414 - DNA, 25 bp, Mus musculus
gcagaggcaggaaatcgggctggtc

SEQ ID NO: 282415 - DNA, 25 bp, Mus musculus
tgtccctttctcagcattgccgcgc

SEQ ID NO: 282416 - DNA, 25 bp, Mus musculus
tttctcagcattgccgcgcgttccc

SEQ ID NO: 282417 - DNA, 25 bp, Mus musculus
ccgggcatcgccatggactcagcgg

SEQ ID NO: 282418 - DNA, 25 bp, Mus musculus
catcgccatggactcagcggagaca

SEQ ID NO: 282419 - DNA, 25 bp, Mus musculus
gccatggactcagcggagacaggta

SEQ ID NO: 282420 - DNA, 25 bp, Mus musculus
actcagcggagacaggtacggggtg

SEQ ID NO: 282421 - DNA, 25 bp, Mus musculus
ggcatcgccatggactcagcggaga

SEQ ID NO: 282422 - DNA, 25 bp, Mus musculus
aggccatgacacgagcgacgtcctg

SEQ ID NO: 282423 - DNA, 25 bp, Mus musculus
cgaagatagatgaaaagggcgtttt

SEQ ID NO: 282424 - DNA, 25 bp, Mus musculus
gcgttttattggctagtggacttga

SEQ ID NO: 282425 - DNA, 25 bp, Mus musculus
tggacttgaaggaggcgtggtccct

SEQ ID NO: 282426 - DNA, 25 bp, Mus musculus
ccggcgggacctgtccctctgcgct

SEQ ID NO: 282427 - DNA, 25 bp, Mus musculus
gtcctgcagcagatcatggccatca

SEQ ID NO: 282428 - DNA, 25 bp, Mus musculus
tgcagcagatcatggccatcaccga

SEQ ID NO: 282429 - DNA, 25 bp, Mus musculus
gcgctcgctcgggactgtagcccat

SEQ ID NO: 282430 - DNA, 25 bp, Mus musculus
gctcgggactgtagcccatggccgc

SEQ ID NO: 282431 - DNA, 25 bp, Mus musculus
cgccgcctgccgaccacagctccac

SEQ ID NO: 282432 - DNA, 25 bp, Mus musculus
acagctccactaggccatgacacga

SEQ ID NO: 282433 - DNA, 25 bp, Mus musculus
tccactaggccatgacacgagcgac

SEQ ID NO: 282434 - DNA, 25 bp, Mus musculus
acgagcgacgtcctgcagcagatca

SEQ ID NO: 282435 - DNA, 25 bp, Mus musculus
gatgcacggcgaagatagatgaaaa

SEQ ID NO: 282436 - DNA, 25 bp, Mus musculus
ctgtgaccgcgctgtcgaagcgacc

SEQ ID NO: 282437 - DNA, 25 bp, Mus musculus
ggttcaagcggaagccagtgcgttt

SEQ ID NO: 282438 - DNA, 25 bp, Mus musculus
gcctcccagagcagcggtcacaaag

SEQ ID NO: 282439 - DNA, 25 bp, Mus musculus
agtgactgtcagtgactggcgcgtc

SEQ ID NO: 282440 - DNA, 25 bp, Mus musculus
tccaggttgagcagcgtcaccacca

SEQ ID NO: 282441 - DNA, 25 bp, Mus musculus
gcgcgaaacgatccgtgccgtaggc

SEQ ID NO: 282442 - DNA, 25 bp, Mus musculus
cgtaggcgcgaaccttcacgaagca

SEQ ID NO: 282443 - DNA, 25 bp, Mus musculus
tcaggcacgtctaggttaaacaagc

SEQ ID NO: 282444 - DNA, 25 bp, Mus musculus
tctaggttaaacaagcggcgctcgc

SEQ ID NO: 282445 - DNA, 25 bp, Mus musculus
tgcgcgcaggtccactgcaaacatg

SEQ ID NO: 282446 - DNA, 25 bp, Mus musculus
atgccataggttcgcagaggcgcca

SEQ ID NO: 282447 - DNA, 25 bp, Mus musculus
caggtcacgagggtccacgaaagtg

SEQ ID NO: 282448 - DNA, 25 bp, Mus musculus
cggcaggactagctcgcctagcgct

SEQ ID NO: 282449 - DNA, 25 bp, Mus musculus
gtcgtgatcagtgcgctggtagcct

SEQ ID NO: 282450 - DNA, 25 bp, Mus musculus
aagccacgctctgggttggcgtgca

SEQ ID NO: 282451 - DNA, 25 bp, Mus musculus
ccattgcagctggtagcgcccagtc

SEQ ID NO: 282452 - DNA, 25 bp, Mus musculus
tgcgcgcctccagtgccagtggtct

SEQ ID NO: 282453 - DNA, 25 bp, Mus musculus
cagtgccagtggtctcgggcacacc

SEQ ID NO: 282454 - DNA, 25 bp, Mus musculus
cacccgcgcgggaccatagtagaat

SEQ ID NO: 282455 - DNA, 25 bp, Mus musculus
tagtagaatcgaatggcggccaggc

SEQ ID NO: 282456 - DNA, 25 bp, Mus musculus
ggccaggctctcgaagtcgccatct

SEQ ID NO: 282457 - DNA, 25 bp, Mus musculus
ctcctcccgggtgatccacgttgaa

SEQ ID NO: 282458 - DNA, 25 bp, Mus musculus
gatccacgttgaaccacgacgtcca

SEQ ID NO: 282459 - DNA, 25 bp, Mus musculus
gcctctgtgagcatcgcacgctgag

SEQ ID NO: 282460 - DNA, 25 bp, Mus musculus
ttgagacaccaaaagccacgctctg

SEQ ID NO: 282461 - DNA, 25 bp, Mus musculus
ctcgaggctgctcacgattgagaca

SEQ ID NO: 282462 - DNA, 25 bp, Mus musculus
ttggcgtgcaccctttcgcccattg

SEQ ID NO: 282463 - DNA, 25 bp, Mus musculus
acgtccactcgctggcctctgtgag

SEQ ID NO: 282464 - DNA, 25 bp, Mus musculus
tccgaactgctctgcgaagctctga

SEQ ID NO: 282465 - DNA, 25 bp, Mus musculus
gtccgaactgctctgcgaagctctg

SEQ ID NO: 282466 - DNA, 25 bp, Mus musculus
aagggcagaggtgatgccatcgcca

SEQ ID NO: 282467 - DNA, 25 bp, Mus musculus
ccgctaggtgtaaggcggcaaggca

SEQ ID NO: 282468 - DNA, 25 bp, Mus musculus
cagaggtgatgccatcgccaggtcc

SEQ ID NO: 282469 - DNA, 25 bp, Mus musculus
aaggcagagatagagcaagggcaga

SEQ ID NO: 282470 - DNA, 25 bp, Mus musculus
cgctcccgctaggtgtaaggcggca

SEQ ID NO: 282471 - DNA, 25 bp, Mus musculus
aactgctctgcgaagctctgagatc

SEQ ID NO: 282472 - DNA, 25 bp, Mus musculus
caagggcagaggtgatgccatcgcc

SEQ ID NO: 282473 - DNA, 25 bp, Mus musculus
aaggcggcaaggcagagatagagca

SEQ ID NO: 282474 - DNA, 25 bp, Mus musculus
ccgaactgctctgcgaagctctgag

SEQ ID NO: 282475 - DNA, 25 bp, Mus musculus
ctcccgctaggtgtaaggcggcaag

SEQ ID NO: 282476 - DNA, 25 bp, Mus musculus
ctgctctgcgaagctctgagatctg

SEQ ID NO: 282477 - DNA, 25 bp, Mus musculus
actgctctgcgaagctctgagatct

SEQ ID NO: 282478 - DNA, 25 bp, Mus musculus
ggcggaacgggccacaagccacgcc

SEQ ID NO: 282479 - DNA, 25 bp, Mus musculus
tgggtcttctaagcctcccgcggta

SEQ ID NO: 282480 - DNA, 25 bp, Mus musculus
ctctgagatctgactgtggcgggcc

SEQ ID NO: 282481 - DNA, 25 bp, Mus musculus
agatctgactgtggcgggcctagcc

SEQ ID NO: 282482 - DNA, 25 bp, Mus musculus
ggcctagccgctgcttggacctaaa

SEQ ID NO: 282483 - DNA, 25 bp, Mus musculus
ctagccgctgcttggacctaaaagg

SEQ ID NO: 282484 - DNA, 25 bp, Mus musculus
agccgctgcttggacctaaaagggc

SEQ ID NO: 282485 - DNA, 25 bp, Mus musculus
gctgcttggacctaaaagggcggaa

SEQ ID NO: 282486 - DNA, 25 bp, Mus musculus
gactgggtcttctaagcctcccgcg

SEQ ID NO: 282487 - DNA, 25 bp, Mus musculus
cccgcacaccagactgggtcttcta

SEQ ID NO: 282488 - DNA, 25 bp, Mus musculus
tagactgcccttgcccggtgtcctg

SEQ ID NO: 282489 - DNA, 25 bp, Mus musculus
cctccgcccttagactgcccttgcc

SEQ ID NO: 282490 - DNA, 25 bp, Mus musculus
tcttctaagcctcccgcggtacctc

SEQ ID NO: 282491 - DNA, 25 bp, Mus musculus
ttagactgcccttgcccggtgtcct

SEQ ID NO: 282492 - DNA, 25 bp, Mus musculus
cgcatcccagcctgagggcggaaga

SEQ ID NO: 282493 - DNA, 25 bp, Mus musculus
tgcctccctccacgcacgcgggtag

SEQ ID NO: 282494 - DNA, 25 bp, Mus musculus
ccacgcacgcgggtagcggtcagac

SEQ ID NO: 282495 - DNA, 25 bp, Mus musculus
acgcacgcgggtagcggtcagacct

SEQ ID NO: 282496 - DNA, 25 bp, Mus musculus
acgcgggtagcggtcagacctgcta

SEQ ID NO: 282497 - DNA, 25 bp, Mus musculus
gcgggtagcggtcagacctgctaac

SEQ ID NO: 282498 - DNA, 25 bp, Mus musculus
cgggtagcggtcagacctgctaacc

SEQ ID NO: 282499 - DNA, 25 bp, Mus musculus
gtagcggtcagacctgctaaccgca

SEQ ID NO: 282500 - DNA, 25 bp, Mus musculus
agcggtcagacctgctaaccgcaaa

SEQ ID NO: 282501 - DNA, 25 bp, Mus musculus
tgctaaccgcaaaccgcctccaccc

SEQ ID NO: 282502 - DNA, 25 bp, Mus musculus
ccgggaccaagtctgctctgcctcc

SEQ ID NO: 282503 - DNA, 25 bp, Mus musculus
tccggcccgggaccaagtctgctct

SEQ ID NO: 282504 - DNA, 25 bp, Mus musculus
accaagtctgctctgcctccctcca

SEQ ID NO: 282505 - DNA, 25 bp, Mus musculus
ggtcagacctgctaaccgcaaaccg

SEQ ID NO: 282506 - DNA, 25 bp, Mus musculus
ctgccggctacaaagtggagacgtc

SEQ ID NO: 282507 - DNA, 25 bp, Mus musculus
tgcaagggacaccagcacatcgggc

SEQ ID NO: 282508 - DNA, 25 bp, Mus musculus
gcgtcctttgcgtctccgccagcct

SEQ ID NO: 282509 - DNA, 25 bp, Mus musculus
ggctgcaccgcgtcctttgcgtctc

SEQ ID NO: 282510 - DNA, 25 bp, Mus musculus
agggacaccagcacatcgggctgca

SEQ ID NO: 282511 - DNA, 25 bp, Mus musculus
gcgctgcaagggacaccagcacatc

SEQ ID NO: 282512 - DNA, 25 bp, Mus musculus
agctcttgggcgctgcaagggacac

SEQ ID NO: 282513 - DNA, 25 bp, Mus musculus
cggctacaaagtggagacgtccgga

SEQ ID NO: 282514 - DNA, 25 bp, Mus musculus
cgccagcctccgcatcccagcctga

SEQ ID NO: 282515 - DNA, 25 bp, Mus musculus
cgaacctgccggctacaaagtggag

SEQ ID NO: 282516 - DNA, 25 bp, Mus musculus
tcatcaggcacgaacctgccggcta

SEQ ID NO: 282517 - DNA, 25 bp, Mus musculus
caggcacgaacctgccggctacaaa

SEQ ID NO: 282518 - DNA, 25 bp, Mus musculus
ggcggacgtcatcaggcacgaacct

SEQ ID NO: 282519 - DNA, 25 bp, Mus musculus
acaaagtggagacgtccggagaagc

SEQ ID NO: 282520 - DNA, 25 bp, Mus musculus
gctcaaaaaaggagcgtgctacctg

SEQ ID NO: 282521 - DNA, 25 bp, Mus musculus
taaccctgccttcaccgtttgcttg

SEQ ID NO: 282522 - DNA, 25 bp, Mus musculus
ccgtttgcttgttcgtctgggtgca

SEQ ID NO: 282523 - DNA, 25 bp, Mus musculus
tgttcgtctgggtgcagccagtgca

SEQ ID NO: 282524 - DNA, 25 bp, Mus musculus
ccagtgcagcaggatgccggagcct

SEQ ID NO: 282525 - DNA, 25 bp, Mus musculus
agcaggatgccggagccttcccgct

SEQ ID NO: 282526 - DNA, 25 bp, Mus musculus
gaaaggctccaagaaagccatcacc

SEQ ID NO: 282527 - DNA, 25 bp, Mus musculus
agccatcaccaaggctcagaaaaag

SEQ ID NO: 282528 - DNA, 25 bp, Mus musculus
agcgtgctacctgaataagattgtc

SEQ ID NO: 282529 - DNA, 25 bp, Mus musculus
cacttgatgaacattgggatgggcc

SEQ ID NO: 282530 - DNA, 25 bp, Mus musculus
ggtgttgtactggaccttgggatcc

SEQ ID NO: 282531 - DNA, 25 bp, Mus musculus
tggaccttgggatcctgagataata

SEQ ID NO: 282532 - DNA, 25 bp, Mus musculus
gatgacaaataaccctgccttcacc

SEQ ID NO: 282533 - DNA, 25 bp, Mus musculus
taagattgtcattcacttgatgaac

SEQ ID NO: 282534 - DNA, 25 bp, Mus musculus
acaggaaggggatgtccatcttctc

SEQ ID NO: 282535 - DNA, 25 bp, Mus musculus
gttactcacgaacacccgcaggtgc

SEQ ID NO: 282536 - DNA, 25 bp, Mus musculus
atcacggccctgttactcacgaaca

SEQ ID NO: 282537 - DNA, 25 bp, Mus musculus
gcagaagatgctgggctggtattcc

SEQ ID NO: 282538 - DNA, 25 bp, Mus musculus
ttctcgcactgcgtggtcaggtcac

SEQ ID NO: 282539 - DNA, 25 bp, Mus musculus
gatgtccatcttctcgcactgcgtg

SEQ ID NO: 282540 - DNA, 25 bp, Mus musculus
cagagtgggtgcatctgacctcggc

SEQ ID NO: 282541 - DNA, 25 bp, Mus musculus
acgcgtcgtcgatgagccgcacctg

SEQ ID NO: 282542 - DNA, 25 bp, Mus musculus
cagcccgtacgcgtcgtcgatgagc

SEQ ID NO: 282543 - DNA, 25 bp, Mus musculus
agagtcgcttcagcgtggccagcgc

SEQ ID NO: 282544 - DNA, 25 bp, Mus musculus
cacaagcgggatggagagtcgcttc

SEQ ID NO: 282545 - DNA, 25 bp, Mus musculus
cctgaggggacgtccaggctcacaa

SEQ ID NO: 282546 - DNA, 25 bp, Mus musculus
tctgacctcggcaggcaggaaggac

SEQ ID NO: 282547 - DNA, 25 bp, Mus musculus
cgtccaggctcacaagcgggatgga

SEQ ID NO: 282548 - DNA, 25 bp, Mus musculus
ccagcacccgggctatgggcgggcg

SEQ ID NO: 282549 - DNA, 25 bp, Mus musculus
aggaaaatgcggtttccatagtgcc

SEQ ID NO: 282550 - DNA, 25 bp, Mus musculus
gaaaatgcggtttccatagtgccgg

SEQ ID NO: 282551 - DNA, 25 bp, Mus musculus
tgctggcgtaggaaaatgcggtttc

SEQ ID NO: 282552 - DNA, 25 bp, Mus musculus
aaatgcggtttccatagtgccggga

SEQ ID NO: 282553 - DNA, 25 bp, Mus musculus
aatgcggtttccatagtgccgggaa

SEQ ID NO: 282554 - DNA, 25 bp, Mus musculus
atgcggtttccatagtgccgggaaa

SEQ ID NO: 282555 - DNA, 25 bp, Mus musculus
tgcggtttccatagtgccgggaaag

SEQ ID NO: 282556 - DNA, 25 bp, Mus musculus
tcgccgaacctaggagcgcggccgc

SEQ ID NO: 282557 - DNA, 25 bp, Mus musculus
ggagcgagtgctggcgggcgtcctc

SEQ ID NO: 282558 - DNA, 25 bp, Mus musculus
ctatgggcgggcgtcgccgaaccta

SEQ ID NO: 282559 - DNA, 25 bp, Mus musculus
ctggcgtaggaaaatgcggtttcca

SEQ ID NO: 282560 - DNA, 25 bp, Mus musculus
ggcgtaggaaaatgcggtttccata

SEQ ID NO: 282561 - DNA, 25 bp, Mus musculus
catagtgccgggaaagggcgggcct

SEQ ID NO: 282562 - DNA, 25 bp, Mus musculus
caggcgcgcgaactcttctcgcaga

SEQ ID NO: 282563 - DNA, 25 bp, Mus musculus
ttcgacgactcggacattgctggcc

SEQ ID NO: 282564 - DNA, 25 bp, Mus musculus
ggcgttgtgctctacgtcatggtca

SEQ ID NO: 282565 - DNA, 25 bp, Mus musculus
tcacggatttcggtttcggccgcca

SEQ ID NO: 282566 - DNA, 25 bp, Mus musculus
cctcaagtgcgaaaacgtgctgcta

SEQ ID NO: 282567 - DNA, 25 bp, Mus musculus
ggcacccgcacatcgtacacgtttt

SEQ ID NO: 282568 - DNA, 25 bp, Mus musculus
gttcctgcctcgagagctgtccatc

SEQ ID NO: 282569 - DNA, 25 bp, Mus musculus
gagcgcctccggacttcgtcaacaa

SEQ ID NO: 282570 - DNA, 25 bp, Mus musculus
cttggctataagctgggccgcacga

SEQ ID NO: 282571 - DNA, 25 bp, Mus musculus
ggcgacaaactcctgagcgaacttg

SEQ ID NO: 282572 - DNA, 25 bp, Mus musculus
ggcaataaaagtcatcgcggctgta

SEQ ID NO: 282573 - DNA, 25 bp, Mus musculus
ggcagaaattgttacccgggcaata

SEQ ID NO: 282574 - DNA, 25 bp, Mus musculus
tgacgcccgcagtcacttcacaagg

SEQ ID NO: 282575 - DNA, 25 bp, Mus musculus
gcgccgcgtcaagatcacggatttc

SEQ ID NO: 282576 - DNA, 25 bp, Mus musculus
ggggcctcgcaaagcttcctctcag

SEQ ID NO: 282577 - DNA, 25 bp, Mus musculus
actgggtttcccacttgggctgcta

SEQ ID NO: 282578 - DNA, 25 bp, Mus musculus
ttcctctcaggaacttcggtgttga

SEQ ID NO: 282579 - DNA, 25 bp, Mus musculus
cttcggtgttgacctccagtgagaa

SEQ ID NO: 282580 - DNA, 25 bp, Mus musculus
cttgtaactctgagacgcgcccggg

SEQ ID NO: 282581 - DNA, 25 bp, Mus musculus
acggccacctcttgtaactctgaga

SEQ ID NO: 282582 - DNA, 25 bp, Mus musculus
tggccagcttagtgcacagagctcg

SEQ ID NO: 282583 - DNA, 25 bp, Mus musculus
tcagccatggccagcttagtgcaca

SEQ ID NO: 282584 - DNA, 25 bp, Mus musculus
acgctgcgctaagcgactgggtttc

SEQ ID NO: 282585 - DNA, 25 bp, Mus musculus
ccgggacatgcgcaccaggtcagcg

SEQ ID NO: 282586 - DNA, 25 bp, Mus musculus
ccgccttgccaagtttgctaggaac

SEQ ID NO: 282587 - DNA, 25 bp, Mus musculus
gcagcaaaccgaatacgaccgcgct

SEQ ID NO: 282588 - DNA, 25 bp, Mus musculus
gaaccgcagcgcagcaaaccgaata

SEQ ID NO: 282589 - DNA, 25 bp, Mus musculus
cctccagtgagaaggtgcgatcggc

SEQ ID NO: 282590 - DNA, 25 bp, Mus musculus
ctggggctcctaggttcttctagtg

SEQ ID NO: 282591 - DNA, 25 bp, Mus musculus
ccaccttctgaagagcgtccgggga

SEQ ID NO: 282592 - DNA, 25 bp, Mus musculus
ctggtgacttggcttggttcccatg

SEQ ID NO: 282593 - DNA, 25 bp, Mus musculus
ttgatgcacgtctctccgagtggcg

SEQ ID NO: 282594 - DNA, 25 bp, Mus musculus
tcaactcgccatcggggagggattt

SEQ ID NO: 282595 - DNA, 25 bp, Mus musculus
gcggtcttggaggacacgtcaattc

SEQ ID NO: 282596 - DNA, 25 bp, Mus musculus
ggcggccaacaactggctgagctga

SEQ ID NO: 282597 - DNA, 25 bp, Mus musculus
tgactgacagacgagcatccaatgg

SEQ ID NO: 282598 - DNA, 25 bp, Mus musculus
gacagacagttatcagcagccaatg

SEQ ID NO: 282599 - DNA, 25 bp, Mus musculus
gcgggttccagagccagtcaactcg

SEQ ID NO: 282600 - DNA, 25 bp, Mus musculus
ggcgcctctgagtagtcctcaagtg

SEQ ID NO: 282601 - DNA, 25 bp, Mus musculus
accgctccttctctcactgaaattg

SEQ ID NO: 282602 - DNA, 25 bp, Mus musculus
ccggttgctaggcagattttgcctc

SEQ ID NO: 282603 - DNA, 25 bp, Mus musculus
tgcctctcacacttccgggttgatg

SEQ ID NO: 282604 - DNA, 25 bp, Mus musculus
tgttcaccctactttctgtcacgga

SEQ ID NO: 282605 - DNA, 25 bp, Mus musculus
gctacgcaaggacttctgggtctta

SEQ ID NO: 282606 - DNA, 25 bp, Mus musculus
tggtaaagcaccgagccgagctgca

SEQ ID NO: 282607 - DNA, 25 bp, Mus musculus
acggcctgcaggcaatgaacgcaca

SEQ ID NO: 282608 - DNA, 25 bp, Mus musculus
cccaggagagccagataccacgact

SEQ ID NO: 282609 - DNA, 25 bp, Mus musculus
tggcgacccgcaattctcgcgagaa

SEQ ID NO: 282610 - DNA, 25 bp, Mus musculus
ctgttcttcgtgtggtggtaaagca

SEQ ID NO: 282611 - DNA, 25 bp, Mus musculus
ctgggtcttatggtgtgtgttcgaa

SEQ ID NO: 282612 - DNA, 25 bp, Mus musculus
gatacctctgcatcatcgtaactga

SEQ ID NO: 282613 - DNA, 25 bp, Mus musculus
tacacgttcgtgaactgacgccggc

SEQ ID NO: 282614 - DNA, 25 bp, Mus musculus
ttctcgcgactgcacgtctcctgtt

SEQ ID NO: 282615 - DNA, 25 bp, Mus musculus
gtcacggacctgacacgcggacttc

SEQ ID NO: 282616 - DNA, 25 bp, Mus musculus
tacagtaacgttgcgtgtgcccttc

SEQ ID NO: 282617 - DNA, 25 bp, Mus musculus
acgccggcgtttctgtggagaagac

SEQ ID NO: 282618 - DNA, 25 bp, Mus musculus
ttcgccgatgtcttcgtggctctgg

SEQ ID NO: 282619 - DNA, 25 bp, Mus musculus
caccaatgagctggaggatgacgtc

SEQ ID NO: 282620 - DNA, 25 bp, Mus musculus
tgaccctccgtcagttccacggttg

SEQ ID NO: 282621 - DNA, 25 bp, Mus musculus
ttccacggttgattcgcgcctgaga

SEQ ID NO: 282622 - DNA, 25 bp, Mus musculus
agttttgtgggaagctctggtcatc

SEQ ID NO: 282623 - DNA, 25 bp, Mus musculus
tgagggaccctaccgcacctttgac

SEQ ID NO: 282624 - DNA, 25 bp, Mus musculus
caccgcggtggtaccattgtcttac

SEQ ID NO: 282625 - DNA, 25 bp, Mus musculus
ttgtcttaccctgccgttaccacta

SEQ ID NO: 282626 - DNA, 25 bp, Mus musculus
ccgcctcaagtggacgaaagtggta

SEQ ID NO: 282627 - DNA, 25 bp, Mus musculus
tggtagaccctttggctttcgccga

SEQ ID NO: 282628 - DNA, 25 bp, Mus musculus
gccgaactgcagaatgacggacctg

SEQ ID NO: 282629 - DNA, 25 bp, Mus musculus
cccttcaggactacgggcgctacga

SEQ ID NO: 282630 - DNA, 25 bp, Mus musculus
tggtcctccgaaatgtcacccttca

SEQ ID NO: 282631 - DNA, 25 bp, Mus musculus
gctacgagtgcgaggtcaccaatga

SEQ ID NO: 282632 - DNA, 25 bp, Mus musculus
ggcgtgcgcaactatggatatcgtc

SEQ ID NO: 282633 - DNA, 25 bp, Mus musculus
cgcggaggtcgctacaagatgactt

SEQ ID NO: 282634 - DNA, 25 bp, Mus musculus
aagatgactttcgtggaagcgcagc

SEQ ID NO: 282635 - DNA, 25 bp, Mus musculus
aagcgcagcgtgcttgtgccgaaca

SEQ ID NO: 282636 - DNA, 25 bp, Mus musculus
cttgtgccgaacaggatggcatttt

SEQ ID NO: 282637 - DNA, 25 bp, Mus musculus
aacaggatggcattttggcgtccgc

SEQ ID NO: 282638 - DNA, 25 bp, Mus musculus
gcattttggcgtccgcggagcagct

SEQ ID NO: 282639 - DNA, 25 bp, Mus musculus
tgcaacgcgggatggttacgcgatg

SEQ ID NO: 282640 - DNA, 25 bp, Mus musculus
ttacgcgatggctcggtgcagtacc

SEQ ID NO: 282641 - DNA, 25 bp, Mus musculus
tgcagtacccagtgagccatgcccg

SEQ ID NO: 282642 - DNA, 25 bp, Mus musculus
tggatatcgtcataacgctgaggaa

SEQ ID NO: 282643 - DNA, 25 bp, Mus musculus
cgctgaggaacgctacgatgccttc

SEQ ID NO: 282644 - DNA, 25 bp, Mus musculus
acgctacgatgccttctgcttcacg

SEQ ID NO: 282645 - DNA, 25 bp, Mus musculus
cggtgcagtacccagtgagccatgc

SEQ ID NO: 282646 - DNA, 25 bp, Mus musculus
tgtctactgctaccgcgctccaggt

SEQ ID NO: 282647 - DNA, 25 bp, Mus musculus
tgaaaccgctgcgacctgtggcctt

SEQ ID NO: 282648 - DNA, 25 bp, Mus musculus
ccacagtggccaaggtcgggcagct

SEQ ID NO: 282649 - DNA, 25 bp, Mus musculus
cagctgttcgctgcgtggaagctgc

SEQ ID NO: 282650 - DNA, 25 bp, Mus musculus
tggaagctgcagctgttggaccgct

SEQ ID NO: 282651 - DNA, 25 bp, Mus musculus
gcagctgttggaccgctgcactgca

SEQ ID NO: 282652 - DNA, 25 bp, Mus musculus
cagcgcgcgctatcccatcgtgaat

SEQ ID NO: 282653 - DNA, 25 bp, Mus musculus
atcccatcgtgaatccgcgaactcg

SEQ ID NO: 282654 - DNA, 25 bp, Mus musculus
tccgcgaactcgctgtggaggtcct

SEQ ID NO: 282655 - DNA, 25 bp, Mus musculus
gacgtctcttcggtgtctactgcta

SEQ ID NO: 282656 - DNA, 25 bp, Mus musculus
tttttcctgaaaccgctgcgacctg

SEQ ID NO: 282657 - DNA, 25 bp, Mus musculus
ctggccggggtctaacacactctcg

SEQ ID NO: 282658 - DNA, 25 bp, Mus musculus
gggtctaacacactctcgggtccca

SEQ ID NO: 282659 - DNA, 25 bp, Mus musculus
ccacaggccgcgtgtttttcctgaa

SEQ ID NO: 282660 - DNA, 25 bp, Mus musculus
acatcgtagagttcctgcgggtcgc

SEQ ID NO: 282661 - DNA, 25 bp, Mus musculus
gcccgataatggaacacgacgcctg

SEQ ID NO: 282662 - DNA, 25 bp, Mus musculus
ccgcgtcgcagttgtcaaagccatc

SEQ ID NO: 282663 - DNA, 25 bp, Mus musculus
tattgccgtgtgttcttggagcctc

SEQ ID NO: 282664 - DNA, 25 bp, Mus musculus
gctgcggtcaccatagcaaccagga

SEQ ID NO: 282665 - DNA, 25 bp, Mus musculus
cgcgggcaaagcagtagacatcgta

SEQ ID NO: 282666 - DNA, 25 bp, Mus musculus
tgggacagtaccttacactcacgga

SEQ ID NO: 282667 - DNA, 25 bp, Mus musculus
tggtcagatcccacgtgcagctttg

SEQ ID NO: 282668 - DNA, 25 bp, Mus musculus
actttcaaggagaggtggtcagatc

SEQ ID NO: 282669 - DNA, 25 bp, Mus musculus
ggctggaaaaacacctgacactttc

SEQ ID NO: 282670 - DNA, 25 bp, Mus musculus
ccaactttggagctttctgaggaga

SEQ ID NO: 282671 - DNA, 25 bp, Mus musculus
ggcccaagtcctggctccaactttg

SEQ ID NO: 282672 - DNA, 25 bp, Mus musculus
cgcggacctgtggataggaagttca

SEQ ID NO: 282673 - DNA, 25 bp, Mus musculus
cgcgactgagtgatcgggtacctaa

SEQ ID NO: 282674 - DNA, 25 bp, Mus musculus
gtctagcctccctcctgatcatata

SEQ ID NO: 282675 - DNA, 25 bp, Mus musculus
cgcggggtaaggcatatgcaaatta

SEQ ID NO: 282676 - DNA, 25 bp, Mus musculus
tctgactgctgagatcctggaattg

SEQ ID NO: 282677 - DNA, 25 bp, Mus musculus
acctggcggctgtgctagaatatct

SEQ ID NO: 282678 - DNA, 25 bp, Mus musculus
gtgcaccgccttctccgtaagggta

SEQ ID NO: 282679 - DNA, 25 bp, Mus musculus
gcttgctggcgcttacgaattcgtt

SEQ ID NO: 282680 - DNA, 25 bp, Mus musculus
tccaataggaaggtgcagtctagcc

SEQ ID NO: 282681 - DNA, 25 bp, Mus musculus
gctcgtgcaaaagcgaagtctcgtt

SEQ ID NO: 282682 - DNA, 25 bp, Mus musculus
aggcatcactccctttgattgaata

SEQ ID NO: 282683 - DNA, 25 bp, Mus musculus
ttttacattacgtcatcgcggggta

SEQ ID NO: 282684 - DNA, 25 bp, Mus musculus
aagagcctttgaattgagggcaccc

SEQ ID NO: 282685 - DNA, 25 bp, Mus musculus
cttggtgaccgcctttttggagcct

SEQ ID NO: 282686 - DNA, 25 bp, Mus musculus
cttttaacgactgtatgggtggctc

SEQ ID NO: 282687 - DNA, 25 bp, Mus musculus
aggctccgcgttcttttctgattgg

SEQ ID NO: 282688 - DNA, 25 bp, Mus musculus
cccgcgaacggaacagtgtctgtgt

SEQ ID NO: 282689 - DNA, 25 bp, Mus musculus
accttgtcatatagaggtggccggg

SEQ ID NO: 282690 - DNA, 25 bp, Mus musculus
cagatcgcccaccttgtcatataga

SEQ ID NO: 282691 - DNA, 25 bp, Mus musculus
agtgttcctccggttcccagatcgc

SEQ ID NO: 282692 - DNA, 25 bp, Mus musculus
gctgcttttagtgttcctccggttc

SEQ ID NO: 282693 - DNA, 25 bp, Mus musculus
aaagctgcttttagtgttcctccgg

SEQ ID NO: 282694 - DNA, 25 bp, Mus musculus
ctcggttggtttagaaagctgcttt

SEQ ID NO: 282695 - DNA, 25 bp, Mus musculus
tagatctgcagagccgctggggctc

SEQ ID NO: 282696 - DNA, 25 bp, Mus musculus
ggttcgtagatctgcagagccgctg

SEQ ID NO: 282697 - DNA, 25 bp, Mus musculus
gttccgggttcgtagatctgcagag

SEQ ID NO: 282698 - DNA, 25 bp, Mus musculus
acgcggttccgggttcgtagatctg

SEQ ID NO: 282699 - DNA, 25 bp, Mus musculus
gcgcgtgcgctatccgcacgcggtt

SEQ ID NO: 282700 - DNA, 25 bp, Mus musculus
ccgctagatcaagttgggagtggca

SEQ ID NO: 282701 - DNA, 25 bp, Mus musculus
agtgtctgtgtagcactgcgcgtgc

SEQ ID NO: 282702 - DNA, 25 bp, Mus musculus
ttccgctgaggccaatgggtacagt

SEQ ID NO: 282703 - DNA, 25 bp, Mus musculus
ctgaagattttattgcgcgtgcgct

SEQ ID NO: 282704 - DNA, 25 bp, Mus musculus
catgggcgggacttgtcaaatttaa

SEQ ID NO: 282705 - DNA, 25 bp, Mus musculus
tgccctggtccctgagaattatctg

SEQ ID NO: 282706 - DNA, 25 bp, Mus musculus
tctgtacgtgtagcagggagtcctt

SEQ ID NO: 282707 - DNA, 25 bp, Mus musculus
ggagtccttgacgaggcatactata

SEQ ID NO: 282708 - DNA, 25 bp, Mus musculus
gcataggactgcctccttccgtcta

SEQ ID NO: 282709 - DNA, 25 bp, Mus musculus
cttccgtctatctcgtgtctgaata

SEQ ID NO: 282710 - DNA, 25 bp, Mus musculus
acctcgtaagaggagccagcgcaca

SEQ ID NO: 282711 - DNA, 25 bp, Mus musculus
gccagaacccatacctgaacgttta

SEQ ID NO: 282712 - DNA, 25 bp, Mus musculus
tgctggctgccttcactatggaaga

SEQ ID NO: 282713 - DNA, 25 bp, Mus musculus
cgcgggaaggtacatgacaaagagc

SEQ ID NO: 282714 - DNA, 25 bp, Mus musculus
atgcgcacgctatccttcctaaagg

SEQ ID NO: 282715 - DNA, 25 bp, Mus musculus
ggagccttagactcgctgaagattt

SEQ ID NO: 282716 - DNA, 25 bp, Mus musculus
ttcaaaagcgcgcaggccactgggt

SEQ ID NO: 282717 - DNA, 25 bp, Mus musculus
tccaggtacacgctgtgccaaactt

SEQ ID NO: 282718 - DNA, 25 bp, Mus musculus
tgtgccaaacttgcccgcagcaaca

SEQ ID NO: 282719 - DNA, 25 bp, Mus musculus
ccgcagcaacaagccaagggaatcg

SEQ ID NO: 282720 - DNA, 25 bp, Mus musculus
tcgcgtgggaaaatggaaaacaggc

SEQ ID NO: 282721 - DNA, 25 bp, Mus musculus
tggaaaacaggcctgcacgcctccg

SEQ ID NO: 282722 - DNA, 25 bp, Mus musculus
cctccgcgggaagttgatgatcagc

SEQ ID NO: 282723 - DNA, 25 bp, Mus musculus
tgatcagcaggaaccgaatctccga

SEQ ID NO: 282724 - DNA, 25 bp, Mus musculus
cccgctcagactggcagtctaaaaa

SEQ ID NO: 282725 - DNA, 25 bp, Mus musculus
gtttcccggtgactcagcgccgcaa

SEQ ID NO: 282726 - DNA, 25 bp, Mus musculus
tgtgcaccgctattccgggtgaggc

SEQ ID NO: 282727 - DNA, 25 bp, Mus musculus
ctcaggaagctcaaagtggggtgta

SEQ ID NO: 282728 - DNA, 25 bp, Mus musculus
gttcccaactgcatccgcaagctgg

SEQ ID NO: 282729 - DNA, 25 bp, Mus musculus
tgactcagctgcgacacaacgctcg

SEQ ID NO: 282730 - DNA, 25 bp, Mus musculus
agtcctgggagcaggtgatgaaacc

SEQ ID NO: 282731 - DNA, 25 bp, Mus musculus
gttctcgtaatgaggagtcctggga

SEQ ID NO: 282732 - DNA, 25 bp, Mus musculus
gatgaaaccgcagcccgggttgcgt

SEQ ID NO: 282733 - DNA, 25 bp, Mus musculus
gtgatgaaaccgcagcccgggttgc

SEQ ID NO: 282734 - DNA, 25 bp, Mus musculus
gagcaggtgatgaaaccgcagcccg

SEQ ID NO: 282735 - DNA, 25 bp, Mus musculus
cctgggagcaggtgatgaaaccgca

SEQ ID NO: 282736 - DNA, 25 bp, Mus musculus
cctgttctcgtaatgaggagtcctg

SEQ ID NO: 282737 - DNA, 25 bp, Mus musculus
agatgggcagctggggtcgctctca

SEQ ID NO: 282738 - DNA, 25 bp, Mus musculus
cttcctgttctcgtaatgaggagtc

SEQ ID NO: 282739 - DNA, 25 bp, Mus musculus
gcgcttcctgttctcgtaatgagga

SEQ ID NO: 282740 - DNA, 25 bp, Mus musculus
ctggggtcgctctcagcggctgctg

SEQ ID NO: 282741 - DNA, 25 bp, Mus musculus
tcgtcggctgtagcggcaaggagat

SEQ ID NO: 282742 - DNA, 25 bp, Mus musculus
cccacaggggcgtgtcgtcggctgt

SEQ ID NO: 282743 - DNA, 25 bp, Mus musculus
gggcgcttcctgttctcgtaatgag

SEQ ID NO: 282744 - DNA, 25 bp, Mus musculus
ctctcagggcagctcggtgtgaaat

SEQ ID NO: 282745 - DNA, 25 bp, Mus musculus
ttccggccaattgccaaggggtata

SEQ ID NO: 282746 - DNA, 25 bp, Mus musculus
caccttggcctcacaggggttgtca

SEQ ID NO: 282747 - DNA, 25 bp, Mus musculus
tagccaatcgctgaagagcaaggtc

SEQ ID NO: 282748 - DNA, 25 bp, Mus musculus
gaagatcaggtctgcgaggcacgca

SEQ ID NO: 282749 - DNA, 25 bp, Mus musculus
aggggatctgtcacctctccacgct

SEQ ID NO: 282750 - DNA, 25 bp, Mus musculus
gtggcacccgaagcttgcacccgaa

SEQ ID NO: 282751 - DNA, 25 bp, Mus musculus
ttggtcacgccctgtccaatcagcg

SEQ ID NO: 282752 - DNA, 25 bp, Mus musculus
atcagcgctggagacggcaagaatt

SEQ ID NO: 282753 - DNA, 25 bp, Mus musculus
ggcacagacgggcatcctttttaac

SEQ ID NO: 282754 - DNA, 25 bp, Mus musculus
ggcggctcttggtttctgagaattc

SEQ ID NO: 282755 - DNA, 25 bp, Mus musculus
acaagcaacgctttgggccaataac

SEQ ID NO: 282756 - DNA, 25 bp, Mus musculus
ttctacaccgggtacaaggcggaga

SEQ ID NO: 282757 - DNA, 25 bp, Mus musculus
ccctggttcttctgagcgttctaca

SEQ ID NO: 282758 - DNA, 25 bp, Mus musculus
ctcgcagctgtcacccgagactttg

SEQ ID NO: 282759 - DNA, 25 bp, Mus musculus
cctgtctggcgggtccattcattac

SEQ ID NO: 282760 - DNA, 25 bp, Mus musculus
ctgcggaaaccgttggctcatttgc

SEQ ID NO: 282761 - DNA, 25 bp, Mus musculus
cgaaagagcgaagatggctgccctc

SEQ ID NO: 282762 - DNA, 25 bp, Mus musculus
tctcaatgctactcctaggtgtcgc

SEQ ID NO: 282763 - DNA, 25 bp, Mus musculus
tgggcctgagactcttgcagtactc

SEQ ID NO: 282764 - DNA, 25 bp, Mus musculus
cacagaatacgcgtgggcctgagac

SEQ ID NO: 282765 - DNA, 25 bp, Mus musculus
cacaggtaaagcgaagggagccaca

SEQ ID NO: 282766 - DNA, 25 bp, Mus musculus
cgcgagagtcgtgcaaacaccacca

SEQ ID NO: 282767 - DNA, 25 bp, Mus musculus
gactttgcctttggctccttcgagc

SEQ ID NO: 282768 - DNA, 25 bp, Mus musculus
attcattacgcttgagccctcagtc

SEQ ID NO: 282769 - DNA, 25 bp, Mus musculus
gcgcaccaaggcaaggcagaggctt

SEQ ID NO: 282770 - DNA, 25 bp, Mus musculus
tcgagccaccatataagcgcaagcg

SEQ ID NO: 282771 - DNA, 25 bp, Mus musculus
ttcacctaggtagactcggccctga

SEQ ID NO: 282772 - DNA, 25 bp, Mus musculus
ccggtgccaaatgggaagccggcgt

SEQ ID NO: 282773 - DNA, 25 bp, Mus musculus
gcgcaggaaacgcagacggtttcca

SEQ ID NO: 282774 - DNA, 25 bp, Mus musculus
cttccgaggcacaatcagggagtcg

SEQ ID NO: 282775 - DNA, 25 bp, Mus musculus
gccctcacgagctgccctggaggga

SEQ ID NO: 282776 - DNA, 25 bp, Mus musculus
gtagttgccctcacgagctgccctg

SEQ ID NO: 282777 - DNA, 25 bp, Mus musculus
gggtcagcggctcccgtagttgccc

SEQ ID NO: 282778 - DNA, 25 bp, Mus musculus
cacttagaagttgcgggtcagcggc

SEQ ID NO: 282779 - DNA, 25 bp, Mus musculus
cgccacttagaagttgcgggtcagc

SEQ ID NO: 282780 - DNA, 25 bp, Mus musculus
cgaggctccgccacttagaagttgc

SEQ ID NO: 282781 - DNA, 25 bp, Mus musculus
ttcctcagccgaggtccgggtgttg

SEQ ID NO: 282782 - DNA, 25 bp, Mus musculus
gtcttcaccgggttcctcagccgag

SEQ ID NO: 282783 - DNA, 25 bp, Mus musculus
gtttccaaagttgcggactgtgagg

SEQ ID NO: 282784 - DNA, 25 bp, Mus musculus
cagacggtttccaaagttgcggact

SEQ ID NO: 282785 - DNA, 25 bp, Mus musculus
cccagcttccgaggcacaatcaggg

SEQ ID NO: 282786 - DNA, 25 bp, Mus musculus
cctagaaatgagtgcttccggcgcg

SEQ ID NO: 282787 - DNA, 25 bp, Mus musculus
agaacgctttctacatcggcagcta

SEQ ID NO: 282788 - DNA, 25 bp, Mus musculus
taccagcagtgcatcaacgaggctc

SEQ ID NO: 282789 - DNA, 25 bp, Mus musculus
gcagtccggcctggaaaagttgtga

SEQ ID NO: 282790 - DNA, 25 bp, Mus musculus
tccggcctacgtgtcccagaagaag

SEQ ID NO: 282791 - DNA, 25 bp, Mus musculus
catcgcctctgatttgtcccataga

SEQ ID NO: 282792 - DNA, 25 bp, Mus musculus
ccgaactatagttctcgggaggctt

SEQ ID NO: 282793 - DNA, 25 bp, Mus musculus
aggccttgtgtttgttgacggaatc

SEQ ID NO: 282794 - DNA, 25 bp, Mus musculus
ttccggcgcgtgaatgctacgtcac

SEQ ID NO: 282795 - DNA, 25 bp, Mus musculus
gacccgggcagagaacctagaaatg

SEQ ID NO: 282796 - DNA, 25 bp, Mus musculus
gacactgttctaccagccacgacga

SEQ ID NO: 282797 - DNA, 25 bp, Mus musculus
aatgtgacgtcacggagagaccctc

SEQ ID NO: 282798 - DNA, 25 bp, Mus musculus
gctgttcgacgtgaagaacgctttc

SEQ ID NO: 282799 - DNA, 25 bp, Mus musculus
gatccttcaaccaatccgagctttg

SEQ ID NO: 282800 - DNA, 25 bp, Mus musculus
ccgagttatgcgcagatgttgcaac

SEQ ID NO: 282801 - DNA, 25 bp, Mus musculus
atagcatggctgctgccgcggcgac

SEQ ID NO: 282802 - DNA, 25 bp, Mus musculus
cccattcttgctctgggggggcccg

SEQ ID NO: 282803 - DNA, 25 bp, Mus musculus
cgactcggaccggtgcaggcaacag

SEQ ID NO: 282804 - DNA, 25 bp, Mus musculus
cggtgcaggcaacagcggagacagc

SEQ ID NO: 282805 - DNA, 25 bp, Mus musculus
acagcggagaattggatagcatggc

SEQ ID NO: 282806 - DNA, 25 bp, Mus musculus
aattggatagcatggctgctgccgc

SEQ ID NO: 282807 - DNA, 25 bp, Mus musculus
cctggcggagcacgcgcacctggct

SEQ ID NO: 282808 - DNA, 25 bp, Mus musculus
tgcaacgaagctgggcctcggcgct

SEQ ID NO: 282809 - DNA, 25 bp, Mus musculus
ttatgcgcagatgttgcaacgaagc

SEQ ID NO: 282810 - DNA, 25 bp, Mus musculus
gcccatgccgagttatgcgcagatg

SEQ ID NO: 282811 - DNA, 25 bp, Mus musculus
gccagagcccatgccgagttatgcg

SEQ ID NO: 282812 - DNA, 25 bp, Mus musculus
ggcgccagagcccatgccgagttat

SEQ ID NO: 282813 - DNA, 25 bp, Mus musculus
agatgttgcaacgaagctgggcctc

SEQ ID NO: 282814 - DNA, 25 bp, Mus musculus
cgccagcatccatgggccccgctgc

SEQ ID NO: 282815 - DNA, 25 bp, Mus musculus
ccgcgccagcatccatgggccccgc

SEQ ID NO: 282816 - DNA, 25 bp, Mus musculus
cgcgccagcatccatgggccccgct

SEQ ID NO: 282817 - DNA, 25 bp, Mus musculus
acctgtgcctcctgtcatgtggcgc

SEQ ID NO: 282818 - DNA, 25 bp, Mus musculus
gccagcatccatgggccccgctgcc

SEQ ID NO: 282819 - DNA, 25 bp, Mus musculus
gcatccatgggccccgctgccgccc

SEQ ID NO: 282820 - DNA, 25 bp, Mus musculus
cccacacaccgacctgtgcctcctg

SEQ ID NO: 282821 - DNA, 25 bp, Mus musculus
ccacacaccgacctgtgcctcctgt

SEQ ID NO: 282822 - DNA, 25 bp, Mus musculus
cacacaccgacctgtgcctcctgtc

SEQ ID NO: 282823 - DNA, 25 bp, Mus musculus
acacaccgacctgtgcctcctgtca

SEQ ID NO: 282824 - DNA, 25 bp, Mus musculus
accgacctgtgcctcctgtcatgtg

SEQ ID NO: 282825 - DNA, 25 bp, Mus musculus
ccgacctgtgcctcctgtcatgtgg

SEQ ID NO: 282826 - DNA, 25 bp, Mus musculus
cgacctgtgcctcctgtcatgtggc

SEQ ID NO: 282827 - DNA, 25 bp, Mus musculus
gacctgtgcctcctgtcatgtggcg

SEQ ID NO: 282828 - DNA, 25 bp, Mus musculus
tgtggcgcctattccgtcgccgcga

SEQ ID NO: 282829 - DNA, 25 bp, Mus musculus
cgccggaaacattgtgcgccacatc

SEQ ID NO: 282830 - DNA, 25 bp, Mus musculus
gtcgccggaaacattgtgcgccaca

SEQ ID NO: 282831 - DNA, 25 bp, Mus musculus
gggtcgccggaaacattgtgcgcca

SEQ ID NO: 282832 - DNA, 25 bp, Mus musculus
cacgtggaggaactaggggtcgccg

SEQ ID NO: 282833 - DNA, 25 bp, Mus musculus
cggccatgccacgtggaggaactag

SEQ ID NO: 282834 - DNA, 25 bp, Mus musculus
cctctgcggccatgccacgtggagg

SEQ ID NO: 282835 - DNA, 25 bp, Mus musculus
gtcatgtggcgcctattccgtcgcc

SEQ ID NO: 282836 - DNA, 25 bp, Mus musculus
ggcgcctattccgtcgccgcgaccc

SEQ ID NO: 282837 - DNA, 25 bp, Mus musculus
gccggaaacattgtgcgccacatcc

SEQ ID NO: 282838 - DNA, 25 bp, Mus musculus
tcatgtggcgcctattccgtcgccg

SEQ ID NO: 282839 - DNA, 25 bp, Mus musculus
ctgcggccatgccacgtggaggaac

SEQ ID NO: 282840 - DNA, 25 bp, Mus musculus
cccaggaggccagagtgggacgccc

SEQ ID NO: 282841 - DNA, 25 bp, Mus musculus
gccagagtgggacgccctctgcggc

SEQ ID NO: 282842 - DNA, 25 bp, Mus musculus
gtgcgctatccacgccaagcgggtg

SEQ ID NO: 282843 - DNA, 25 bp, Mus musculus
cgattcaggaagatggcacgcacca

SEQ ID NO: 282844 - DNA, 25 bp, Mus musculus
gcacgcaccaagcagacggcacgga

SEQ ID NO: 282845 - DNA, 25 bp, Mus musculus
ctagccacgaaggtggcccgcaaga

SEQ ID NO: 282846 - DNA, 25 bp, Mus musculus
ccaccgagctgctgattcgcaagtt

SEQ ID NO: 282847 - DNA, 25 bp, Mus musculus
tcgcaagttgccattccagcgcttg

SEQ ID NO: 282848 - DNA, 25 bp, Mus musculus
attccagcgcttggtgcgtgagatc

SEQ ID NO: 282849 - DNA, 25 bp, Mus musculus
ttggtgcgtgagatcgcccaggact

SEQ ID NO: 282850 - DNA, 25 bp, Mus musculus
ctgcaggaggcctgcgagtcgtacc

SEQ ID NO: 282851 - DNA, 25 bp, Mus musculus
cgagtcgtacctcgtggggctgttc

SEQ ID NO: 282852 - DNA, 25 bp, Mus musculus
atccagttggctcggcgcatccgcg

SEQ ID NO: 282853 - DNA, 25 bp, Mus musculus
cgaagacacgaacctgtgcgctatc

SEQ ID NO: 282854 - DNA, 25 bp, Mus musculus
caagcgggtgaccatcatgcccaaa

SEQ ID NO: 282855 - DNA, 25 bp, Mus musculus
ctcgtggggctgttcgaagacacga

SEQ ID NO: 282856 - DNA, 25 bp, Mus musculus
tccagtgggcacttgtcgtacccga

SEQ ID NO: 282857 - DNA, 25 bp, Mus musculus
tcagcgctgcctttcccggaagctt

SEQ ID NO: 282858 - DNA, 25 bp, Mus musculus
tcaaaaacaaatcctccggctgcgg

SEQ ID NO: 282859 - DNA, 25 bp, Mus musculus
cacgagttcgcctgtggcctctgaa

SEQ ID NO: 282860 - DNA, 25 bp, Mus musculus
aggcctccaccctcgatggggaaga

SEQ ID NO: 282861 - DNA, 25 bp, Mus musculus
ggtcctgcgacactacgaagacatg

SEQ ID NO: 282862 - DNA, 25 bp, Mus musculus
ccgtgctcttcttcgacaatagtga

SEQ ID NO: 282863 - DNA, 25 bp, Mus musculus
agagcgtctatcacccatctccgtg

SEQ ID NO: 282864 - DNA, 25 bp, Mus musculus
acgtgcgcactacccgaaacgctga

SEQ ID NO: 282865 - DNA, 25 bp, Mus musculus
gtacccgacggttgcatgtgagctt

SEQ ID NO: 282866 - DNA, 25 bp, Mus musculus
ccacacggagcccagggtagaagtt

SEQ ID NO: 282867 - DNA, 25 bp, Mus musculus
ggaagcttctcgcatctctcaggtt

SEQ ID NO: 282868 - DNA, 25 bp, Mus musculus
ctcaggtttaacagtcaggtctcta

SEQ ID NO: 282869 - DNA, 25 bp, Mus musculus
tagccaacttctgccagggcacgtg

SEQ ID NO: 282870 - DNA, 25 bp, Mus musculus
ctccgagtcggcctccgaaagcaga

SEQ ID NO: 282871 - DNA, 25 bp, Mus musculus
ccaactgctgcctagcggtgcgcat

SEQ ID NO: 282872 - DNA, 25 bp, Mus musculus
cctaaaggacctgggctcgcgaact

SEQ ID NO: 282873 - DNA, 25 bp, Mus musculus
gaagaggcgggccttcaaccgccta

SEQ ID NO: 282874 - DNA, 25 bp, Mus musculus
gggtgaagtcggtgaattcgaactc

SEQ ID NO: 282875 - DNA, 25 bp, Mus musculus
accgcaccggagcactgggagctaa

SEQ ID NO: 282876 - DNA, 25 bp, Mus musculus
ggaaagtagccaaccgcaccggagc

SEQ ID NO: 282877 - DNA, 25 bp, Mus musculus
gcctcctcagtgtccaagaaggtga

SEQ ID NO: 282878 - DNA, 25 bp, Mus musculus
ccggttctgagctctgagttgccgc

SEQ ID NO: 282879 - DNA, 25 bp, Mus musculus
aattcgaactcggagccctgggtgt

SEQ ID NO: 282880 - DNA, 25 bp, Mus musculus
taggcctaggccgtaatccggagta

SEQ ID NO: 282881 - DNA, 25 bp, Mus musculus
gcactcgagcccgaggcttcggcta

SEQ ID NO: 282882 - DNA, 25 bp, Mus musculus
gccgctcaactcacttgtgcgtcga

SEQ ID NO: 282883 - DNA, 25 bp, Mus musculus
gcgcgcgttcctcccggaaagtagc

SEQ ID NO: 282884 - DNA, 25 bp, Mus musculus
ggccctgaatgcagagcccggcctg

SEQ ID NO: 282885 - DNA, 25 bp, Mus musculus
cctgaatgcagagcccggcctgttt

SEQ ID NO: 282886 - DNA, 25 bp, Mus musculus
gcagagcccggcctgtttaccttgt

SEQ ID NO: 282887 - DNA, 25 bp, Mus musculus
agcccggcctgtttaccttgtggcg

SEQ ID NO: 282888 - DNA, 25 bp, Mus musculus
ctgtttaccttgtggcgggctctgg

SEQ ID NO: 282889 - DNA, 25 bp, Mus musculus
cctggctatcctgcgggcgacaggc

SEQ ID NO: 282890 - DNA, 25 bp, Mus musculus
ataaataggccgcgggctcgaaggc

SEQ ID NO: 282891 - DNA, 25 bp, Mus musculus
cgcgggctcgaaggcgcagacagca

SEQ ID NO: 282892 - DNA, 25 bp, Mus musculus
tgcctgcgttctagtgctcgccctg

SEQ ID NO: 282893 - DNA, 25 bp, Mus musculus
gcgttctagtgctcgccctggctat

SEQ ID NO: 282894 - DNA, 25 bp, Mus musculus
tagtgctcgccctggctatcctgcg

SEQ ID NO: 282895 - DNA, 25 bp, Mus musculus
gccctggctatcctgcgggcgacag

SEQ ID NO: 282896 - DNA, 25 bp, Mus musculus
acaggccagggccagatcccgctgg

SEQ ID NO: 282897 - DNA, 25 bp, Mus musculus
ggcctgtttaccttgtggcgggctc

SEQ ID NO: 282898 - DNA, 25 bp, Mus musculus
ttcaaatctcactggctcctcggta

SEQ ID NO: 282899 - DNA, 25 bp, Mus musculus
gggaagaatgcacctggccgtgcca

SEQ ID NO: 282900 - DNA, 25 bp, Mus musculus
ccttggcgatgagggttcaaatctc

SEQ ID NO: 282901 - DNA, 25 bp, Mus musculus
ccgccgtggtacacgctaagcttca

SEQ ID NO: 282902 - DNA, 25 bp, Mus musculus
tcccgcacccagtgtataacaaagg

SEQ ID NO: 282903 - DNA, 25 bp, Mus musculus
tccgtaatggatgtgcgatcgctgc

SEQ ID NO: 282904 - DNA, 25 bp, Mus musculus
cgatcgctgcccacagggactagga

SEQ ID NO: 282905 - DNA, 25 bp, Mus musculus
ggaaatgcagcccagttcccgtggg

SEQ ID NO: 282906 - DNA, 25 bp, Mus musculus
tgactctgcgcagagacctgagcgc

SEQ ID NO: 282907 - DNA, 25 bp, Mus musculus
ttggctcgccaatcccgggcaagca

SEQ ID NO: 282908 - DNA, 25 bp, Mus musculus
gcaagcaccagcaaggcacgccggg

SEQ ID NO: 282909 - DNA, 25 bp, Mus musculus
gccaacgcttcttcaggggcccatg

SEQ ID NO: 282910 - DNA, 25 bp, Mus musculus
tcctgaccctgaggtgagagcgacc

SEQ ID NO: 282911 - DNA, 25 bp, Mus musculus
gcttgactgcgccaggcgctggaca

SEQ ID NO: 282912 - DNA, 25 bp, Mus musculus
ccagtcccagcttgggctaaaccga

SEQ ID NO: 282913 - DNA, 25 bp, Mus musculus
tcgaccggaccacgtgtctactttg

SEQ ID NO: 282914 - DNA, 25 bp, Mus musculus
tgggagatgcgcgaagaccaacgac

SEQ ID NO: 282915 - DNA, 25 bp, Mus musculus
acgttaatgaggtgcgcgggctctt

SEQ ID NO: 282916 - DNA, 25 bp, Mus musculus
ggctcgcactgcaccgacgttaatg

SEQ ID NO: 282917 - DNA, 25 bp, Mus musculus
ggcgtagtctgctccgagacagcta

SEQ ID NO: 282918 - DNA, 25 bp, Mus musculus
gggtccgcaggaatgcagcccgcac

SEQ ID NO: 282919 - DNA, 25 bp, Mus musculus
tcaagcccatcttgtgggcggggcc

SEQ ID NO: 282920 - DNA, 25 bp, Mus musculus
cagaagacctcacgtctaacagggg

SEQ ID NO: 282921 - DNA, 25 bp, Mus musculus
ctactgagggtgttctcctggacca

SEQ ID NO: 282922 - DNA, 25 bp, Mus musculus
tggcctaacttctgcgggtccgcag

SEQ ID NO: 282923 - DNA, 25 bp, Mus musculus
cgaaagcagacagcgacagagcgga

SEQ ID NO: 282924 - DNA, 25 bp, Mus musculus
cggggctccaaaccagaagacctca

SEQ ID NO: 282925 - DNA, 25 bp, Mus musculus
aagaccaacgacagggctggcagga

SEQ ID NO: 282926 - DNA, 25 bp, Mus musculus
ccctatgcagtgtgcagttggctgg

SEQ ID NO: 282927 - DNA, 25 bp, Mus musculus
ttcccaggacaactgcgtgacggtg

SEQ ID NO: 282928 - DNA, 25 bp, Mus musculus
tcctgacgagaagcttcgctgctca

SEQ ID NO: 282929 - DNA, 25 bp, Mus musculus
gtgagcaaggtagacacgagcctta

SEQ ID NO: 282930 - DNA, 25 bp, Mus musculus
gacctggacggttttcctgacgaga

SEQ ID NO: 282931 - DNA, 25 bp, Mus musculus
tcggagatgcttgtgacccggatgc

SEQ ID NO: 282932 - DNA, 25 bp, Mus musculus
ggatggagtccctaacgagcaagta

SEQ ID NO: 282933 - DNA, 25 bp, Mus musculus
caagtaaggctgtgtaggatcgtcc

SEQ ID NO: 282934 - DNA, 25 bp, Mus musculus
gcgaccagacgtcaggctgccagcg

SEQ ID NO: 282935 - DNA, 25 bp, Mus musculus
gctcagagcgccagtgtcgcaaggt

SEQ ID NO: 282936 - DNA, 25 bp, Mus musculus
tgccatgagaaagcaaactgcgtcc

SEQ ID NO: 282937 - DNA, 25 bp, Mus musculus
cttgcgtggtgagtgcagaagcaaa

SEQ ID NO: 282938 - DNA, 25 bp, Mus musculus
ctccggcgtacgtggacatttccac

SEQ ID NO: 282939 - DNA, 25 bp, Mus musculus
tcacccagcccgtgccatgagaaag

SEQ ID NO: 282940 - DNA, 25 bp, Mus musculus
gatcttctcgctaaatttccgcgga

SEQ ID NO: 282941 - DNA, 25 bp, Mus musculus
cctccgcctgcttctggttgtgcag

SEQ ID NO: 282942 - DNA, 25 bp, Mus musculus
cgcgtcaggctcaggtccttcatga

SEQ ID NO: 282943 - DNA, 25 bp, Mus musculus
gcagtgcgatcttctcgctaaattt

SEQ ID NO: 282944 - DNA, 25 bp, Mus musculus
aggtccttcatgacctcctcgaagg

SEQ ID NO: 282945 - DNA, 25 bp, Mus musculus
ctcgctaaatttccgcggattgttc

SEQ ID NO: 282946 - DNA, 25 bp, Mus musculus
ccgcggattgttcgaagtcgccatc

SEQ ID NO: 282947 - DNA, 25 bp, Mus musculus
attgttcgaagtcgccatcttctcg

SEQ ID NO: 282948 - DNA, 25 bp, Mus musculus
gcccacggccggagagaacgcgcag

SEQ ID NO: 282949 - DNA, 25 bp, Mus musculus
caggcgcaagcacggcccagagcgt

SEQ ID NO: 282950 - DNA, 25 bp, Mus musculus
aacacgcctgcgcgtgcctgggcaa

SEQ ID NO: 282951 - DNA, 25 bp, Mus musculus
cgcactgcagtgcgcgtggttcgct

SEQ ID NO: 282952 - DNA, 25 bp, Mus musculus
gttgtgcagtgcgatcttctcgcta

SEQ ID NO: 282953 - DNA, 25 bp, Mus musculus
cttctggttgtgcagtgcgatcttc

SEQ ID NO: 282954 - DNA, 25 bp, Mus musculus
gcagccggttgctctgcagaaagaa

SEQ ID NO: 282955 - DNA, 25 bp, Mus musculus
ggcatccggcacgtagtactccaca

SEQ ID NO: 282956 - DNA, 25 bp, Mus musculus
atgcggccacctagggcatagatgc

SEQ ID NO: 282957 - DNA, 25 bp, Mus musculus
tggatcatagcactgcagcgccttc

SEQ ID NO: 282958 - DNA, 25 bp, Mus musculus
agcgccttcttgtcctccgctgaga

SEQ ID NO: 282959 - DNA, 25 bp, Mus musculus
accacctgagatgtagaggcgacca

SEQ ID NO: 282960 - DNA, 25 bp, Mus musculus
aggcaaaatcccagctgtcacggcg

SEQ ID NO: 282961 - DNA, 25 bp, Mus musculus
gtggcatacaacagccctcccagtg

SEQ ID NO: 282962 - DNA, 25 bp, Mus musculus
gccgcctgccacgtacacgaagtta

SEQ ID NO: 282963 - DNA, 25 bp, Mus musculus
tacagcccagttccatctccgtgag

SEQ ID NO: 282964 - DNA, 25 bp, Mus musculus
taactggaacaccttgctgctgaca

SEQ ID NO: 282965 - DNA, 25 bp, Mus musculus
aggccaccagggacgctacatcaga

SEQ ID NO: 282966 - DNA, 25 bp, Mus musculus
gtccaccagttcagcaggttgcatg

SEQ ID NO: 282967 - DNA, 25 bp, Mus musculus
gaacaggtcaatctcggcgcagctc

SEQ ID NO: 282968 - DNA, 25 bp, Mus musculus
gcctacgccatagctcaggacctta

SEQ ID NO: 282969 - DNA, 25 bp, Mus musculus
tcggggctctgactagagccgctgc

SEQ ID NO: 282970 - DNA, 25 bp, Mus musculus
ctcaggaccttaacgacagggactc

SEQ ID NO: 282971 - DNA, 25 bp, Mus musculus
taacgacagggactcggaacgtcca

SEQ ID NO: 282972 - DNA, 25 bp, Mus musculus
taggactcacctgctcgggcgctcg

SEQ ID NO: 282973 - DNA, 25 bp, Mus musculus
gacagggactcggaacgtccacgcc

SEQ ID NO: 282974 - DNA, 25 bp, Mus musculus
cttgtggagcttcccacgtcacctt

SEQ ID NO: 282975 - DNA, 25 bp, Mus musculus
gactccgccatcttccgccgcgcgc

SEQ ID NO: 282976 - DNA, 25 bp, Mus musculus
gcccgagccaagtggtgcatgccaa

SEQ ID NO: 282977 - DNA, 25 bp, Mus musculus
ccaagtggtgcatgccaacagaggc

SEQ ID NO: 282978 - DNA, 25 bp, Mus musculus
catgccaacagaggcgtaggactca

SEQ ID NO: 282979 - DNA, 25 bp, Mus musculus
acagaggcgtaggactcacctgctc

SEQ ID NO: 282980 - DNA, 25 bp, Mus musculus
ccagggtccttgtggagcttcccac

SEQ ID NO: 282981 - DNA, 25 bp, Mus musculus
gctctgactagagccgctgctgcca

SEQ ID NO: 282982 - DNA, 25 bp, Mus musculus
tccggtcggggacatattcttgata

SEQ ID NO: 282983 - DNA, 25 bp, Mus musculus
accgggtgttgacgtcactgagcga

SEQ ID NO: 282984 - DNA, 25 bp, Mus musculus
ctttgaccggacttggatctgcgtg

SEQ ID NO: 282985 - DNA, 25 bp, Mus musculus
ggcgggcaggtgaatctctactccg

SEQ ID NO: 282986 - DNA, 25 bp, Mus musculus
ccggctctttgaccggacttggatc

SEQ ID NO: 282987 - DNA, 25 bp, Mus musculus
ttgatactcatggtccggctctttg

SEQ ID NO: 282988 - DNA, 25 bp, Mus musculus
cggggacatattcttgatactcatg

SEQ ID NO: 282989 - DNA, 25 bp, Mus musculus
gcaatgctaccgcagccatggctga

SEQ ID NO: 282990 - DNA, 25 bp, Mus musculus
gcagcagcggcaatgctaccgcagc

SEQ ID NO: 282991 - DNA, 25 bp, Mus musculus
accagtgacgccaacaacagcagca

SEQ ID NO: 282992 - DNA, 25 bp, Mus musculus
tggggtgaccagtgacgccaacaac

SEQ ID NO: 282993 - DNA, 25 bp, Mus musculus
gcgacaccgctgctggcacctctga

SEQ ID NO: 282994 - DNA, 25 bp, Mus musculus
caggtgaatctctactccggtcggg

SEQ ID NO: 282995 - DNA, 25 bp, Mus musculus
ggcacctctgagtgtccccgagctg

SEQ ID NO: 282996 - DNA, 25 bp, Mus musculus
aaactgcgcttggttcgtgcagctc

SEQ ID NO: 282997 - DNA, 25 bp, Mus musculus
cttggttcgtgcagctctgagaagc

SEQ ID NO: 282998 - DNA, 25 bp, Mus musculus
tggttcgtgcagctctgagaagctg

SEQ ID NO: 282999 - DNA, 25 bp, Mus musculus
agctctgagaagctgctcgcctgcg

SEQ ID NO: 283000 - DNA, 25 bp, Mus musculus
gctctgagaagctgctcgcctgcgg

SEQ ID NO: 283001 - DNA, 25 bp, Mus musculus
gcgggccacgccagaggctcgtggc

SEQ ID NO: 283002 - DNA, 25 bp, Mus musculus
cgtggccggccgctgcctgactcag

SEQ ID NO: 283003 - DNA, 25 bp, Mus musculus
gctgcctgactcagcagccgcggga

SEQ ID NO: 283004 - DNA, 25 bp, Mus musculus
tgcctgactcagcagccgcgggagt

SEQ ID NO: 283005 - DNA, 25 bp, Mus musculus
cctgactcagcagccgcgggagtgc

SEQ ID NO: 283006 - DNA, 25 bp, Mus musculus
cagcagccgcgggagtgctagaccc

SEQ ID NO: 283007 - DNA, 25 bp, Mus musculus
cgggccgctgcagacgcaggctgga

SEQ ID NO: 283008 - DNA, 25 bp, Mus musculus
cgcttggttcgtgcagctctgagaa

SEQ ID NO: 283009 - DNA, 25 bp, Mus musculus
actgcgcttggttcgtgcagctctg

SEQ ID NO: 283010 - DNA, 25 bp, Mus musculus
atagacggccgctcaagcgctcagc

SEQ ID NO: 283011 - DNA, 25 bp, Mus musculus
tccggctcgctacccagttgcttat

SEQ ID NO: 283012 - DNA, 25 bp, Mus musculus
ggctcgctacccagttgcttataga

SEQ ID NO: 283013 - DNA, 25 bp, Mus musculus
cgctacccagttgcttatagacggc

SEQ ID NO: 283014 - DNA, 25 bp, Mus musculus
ccagttgcttatagacggccgctca

SEQ ID NO: 283015 - DNA, 25 bp, Mus musculus
cagcccgccgctacgggaaatctta

SEQ ID NO: 283016 - DNA, 25 bp, Mus musculus
gagagaagccgtgcctggctttcta

SEQ ID NO: 283017 - DNA, 25 bp, Mus musculus
ccgtgcctggctttctagtttagca

SEQ ID NO: 283018 - DNA, 25 bp, Mus musculus
tggctttctagtttagcactcgctg

SEQ ID NO: 283019 - DNA, 25 bp, Mus musculus
ttctagtttagcactcgctgtccac

SEQ ID NO: 283020 - DNA, 25 bp, Mus musculus
cactcgctgtccacaacttttctaa

SEQ ID NO: 283021 - DNA, 25 bp, Mus musculus
cacaacttttctaagttgctggccc

SEQ ID NO: 283022 - DNA, 25 bp, Mus musculus
agtgcgttccggctcgctacccagt

SEQ ID NO: 283023 - DNA, 25 bp, Mus musculus
gctacgggaaatcttacgggagaga

SEQ ID NO: 283024 - DNA, 25 bp, Mus musculus
acctgaacatctggatcccggcgcg

SEQ ID NO: 283025 - DNA, 25 bp, Mus musculus
cttggcacaggtgccttgcggcctg

SEQ ID NO: 283026 - DNA, 25 bp, Mus musculus
ttccaccagcgcaccctgggcacgg

SEQ ID NO: 283027 - DNA, 25 bp, Mus musculus
cacagggagccgcaggttccggtcc

SEQ ID NO: 283028 - DNA, 25 bp, Mus musculus
ctgtgcctggcggacctgaacatct

SEQ ID NO: 283029 - DNA, 25 bp, Mus musculus
acgtggcttaatcaggcgcggctgt

SEQ ID NO: 283030 - DNA, 25 bp, Mus musculus
cccacgtggcttaatcaggcgcggc

SEQ ID NO: 283031 - DNA, 25 bp, Mus musculus
gtcctggattcggaggtctccacgg

SEQ ID NO: 283032 - DNA, 25 bp, Mus musculus
tggattcggaggtctccacggtttc

SEQ ID NO: 283033 - DNA, 25 bp, Mus musculus
ccagtggcctgcttggcacaggtgc

SEQ ID NO: 283034 - DNA, 25 bp, Mus musculus
ctggcggacctgaacatctggatcc

SEQ ID NO: 283035 - DNA, 25 bp, Mus musculus
gtgccttgcggcctgcgcgtccagt

SEQ ID NO: 283036 - DNA, 25 bp, Mus musculus
cccagtagacgaggaggccgctcgc

SEQ ID NO: 283037 - DNA, 25 bp, Mus musculus
ccgctcgcagggtcgtcgggtcaca

SEQ ID NO: 283038 - DNA, 25 bp, Mus musculus
ccaaacggagtccagcccggcaagg

SEQ ID NO: 283039 - DNA, 25 bp, Mus musculus
aggccgcagacaagcgccctttgtc

SEQ ID NO: 283040 - DNA, 25 bp, Mus musculus
agccacccggtcagggcaggccgca

SEQ ID NO: 283041 - DNA, 25 bp, Mus musculus
gtccgggaagcagccacccggtcag

SEQ ID NO: 283042 - DNA, 25 bp, Mus musculus
aatcagcggactcccggcgtccggg

SEQ ID NO: 283043 - DNA, 25 bp, Mus musculus
cgtgaatcagcggactcccggcgtc

SEQ ID NO: 283044 - DNA, 25 bp, Mus musculus
cgctgtccgcgtgaatcagcggact

SEQ ID NO: 283045 - DNA, 25 bp, Mus musculus
agagggaaagttgactcgccgccgc

SEQ ID NO: 283046 - DNA, 25 bp, Mus musculus
gcttaagagggaaagttgactcgcc

SEQ ID NO: 283047 - DNA, 25 bp, Mus musculus
ccgacattccttcggggcttaagag

SEQ ID NO: 283048 - DNA, 25 bp, Mus musculus
tccgccgacattccttcggggctta

SEQ ID NO: 283049 - DNA, 25 bp, Mus musculus
gatttcaggaaatccgccgacattc

SEQ ID NO: 283050 - DNA, 25 bp, Mus musculus
gccgccttcgtcacgaccctgctga

SEQ ID NO: 283051 - DNA, 25 bp, Mus musculus
aaacggagtccagcccggcaaggca

SEQ ID NO: 283052 - DNA, 25 bp, Mus musculus
gcgcattagcgccttgtcaatttcg

SEQ ID NO: 283053 - DNA, 25 bp, Mus musculus
ggagcccgtgagtaccgtgcgccct

SEQ ID NO: 283054 - DNA, 25 bp, Mus musculus
ttgctctgtgtcctcggggtgcctc

SEQ ID NO: 283055 - DNA, 25 bp, Mus musculus
cgcctctgttgctctgtgtcctcgg

SEQ ID NO: 283056 - DNA, 25 bp, Mus musculus
cccgtcgcccaatccgcgcggcggc

SEQ ID NO: 283057 - DNA, 25 bp, Mus musculus
agtcaccgcccgttgcgcgccaccc

SEQ ID NO: 283058 - DNA, 25 bp, Mus musculus
ggcgttgcagtcaccgcccgttgcg

SEQ ID NO: 283059 - DNA, 25 bp, Mus musculus
gtgaggacccgagccccaatctgca

SEQ ID NO: 283060 - DNA, 25 bp, Mus musculus
tgtccgcgcccagtgacgcgcgtga

SEQ ID NO: 283061 - DNA, 25 bp, Mus musculus
acttgctccggccttcgctgtccgc

SEQ ID NO: 283062 - DNA, 25 bp, Mus musculus
atttcggctgctcagacttgctccg

SEQ ID NO: 283063 - DNA, 25 bp, Mus musculus
tgtcaatttcggctgctcagacttg

SEQ ID NO: 283064 - DNA, 25 bp, Mus musculus
gccttgtcaatttcggctgctcaga

SEQ ID NO: 283065 - DNA, 25 bp, Mus musculus
attagcgccttgtcaatttcggctg

SEQ ID NO: 283066 - DNA, 25 bp, Mus musculus
gcacgcatactgctcgaaccttagt

SEQ ID NO: 283067 - DNA, 25 bp, Mus musculus
attctctttagagcgcccgggcccg

SEQ ID NO: 283068 - DNA, 25 bp, Mus musculus
agctcaagcagttcctcggctggct

SEQ ID NO: 283069 - DNA, 25 bp, Mus musculus
tccattctctttagagcgcccgggc

SEQ ID NO: 283070 - DNA, 25 bp, Mus musculus
ttcctcggctggctcaagaagcacg

SEQ ID NO: 283071 - DNA, 25 bp, Mus musculus
tcggctggctcaagaagcacgcata

SEQ ID NO: 283072 - DNA, 25 bp, Mus musculus
gctggctcaagaagcacgcatactg

SEQ ID NO: 283073 - DNA, 25 bp, Mus musculus
aagaagcacgcatactgctcgaacc

SEQ ID NO: 283074 - DNA, 25 bp, Mus musculus
cgcatactgctcgaaccttagtttc

SEQ ID NO: 283075 - DNA, 25 bp, Mus musculus
atactgctcgaaccttagtttccgc

SEQ ID NO: 283076 - DNA, 25 bp, Mus musculus
gctcgaaccttagtttccgcctgta

SEQ ID NO: 283077 - DNA, 25 bp, Mus musculus
ttagtttccgcctgtacgaccagtg

SEQ ID NO: 283078 - DNA, 25 bp, Mus musculus
gtttccgcctgtacgaccagtggcg

SEQ ID NO: 283079 - DNA, 25 bp, Mus musculus
gctcaagaagcacgcatactgctcg

SEQ ID NO: 283080 - DNA, 25 bp, Mus musculus
acgctccatgtagcgctgcagcagc

SEQ ID NO: 283081 - DNA, 25 bp, Mus musculus
actgcttcaggtagaaggcgccgcc

SEQ ID NO: 283082 - DNA, 25 bp, Mus musculus
ccacggtgctgaccgtgtccgggaa

SEQ ID NO: 283083 - DNA, 25 bp, Mus musculus
tgaacgcagccctgcgaccacgtgg

SEQ ID NO: 283084 - DNA, 25 bp, Mus musculus
tctgtaccggagtgtgaacgcagcc

SEQ ID NO: 283085 - DNA, 25 bp, Mus musculus
aagcgcgccacagctctgtaccgga

SEQ ID NO: 283086 - DNA, 25 bp, Mus musculus
atgaagtgccaaagaggaagcgcgc

SEQ ID NO: 283087 - DNA, 25 bp, Mus musculus
cctggcctgagatccgaactcgatg

SEQ ID NO: 283088 - DNA, 25 bp, Mus musculus
ccgaactctagtggccctggcctga

SEQ ID NO: 283089 - DNA, 25 bp, Mus musculus
ccggcttccgcatagccgcggagga

SEQ ID NO: 283090 - DNA, 25 bp, Mus musculus
gcagtacgatcttcccatccggctt

SEQ ID NO: 283091 - DNA, 25 bp, Mus musculus
gcagcagcgacgttttacccacgtt

SEQ ID NO: 283092 - DNA, 25 bp, Mus musculus
tccgggaagcgacgctccatgtagc

SEQ ID NO: 283093 - DNA, 25 bp, Mus musculus
gatgttgaaggaacgccactgcttc

SEQ ID NO: 283094 - DNA, 25 bp, Mus musculus
gaccgggaggatgctgaatcgacac

SEQ ID NO: 283095 - DNA, 25 bp, Mus musculus
gtctgttctagctcctgcaggctgc

SEQ ID NO: 283096 - DNA, 25 bp, Mus musculus
actcgggaagtcatagtgctgacca

SEQ ID NO: 283097 - DNA, 25 bp, Mus musculus
cactccggtaactcgggaagtcata

SEQ ID NO: 283098 - DNA, 25 bp, Mus musculus
catagtgctgaccactgagcaggta

SEQ ID NO: 283099 - DNA, 25 bp, Mus musculus
caggcgcgtctgttctagctcctgc

SEQ ID NO: 283100 - DNA, 25 bp, Mus musculus
gctgaatcgacacgctgacaagcag

SEQ ID NO: 283101 - DNA, 25 bp, Mus musculus
ggcctgggtcacctcgtgcacgaca

SEQ ID NO: 283102 - DNA, 25 bp, Mus musculus
tcgtgcacgacactccggtaactcg

SEQ ID NO: 283103 - DNA, 25 bp, Mus musculus
tactgacggtgagctctgcagtgga

SEQ ID NO: 283104 - DNA, 25 bp, Mus musculus
cactgccaatacctcccgcgaggca

SEQ ID NO: 283105 - DNA, 25 bp, Mus musculus
ggccctgccaactctgcttccactg

SEQ ID NO: 283106 - DNA, 25 bp, Mus musculus
ggatgctgaatcgacacgctgacaa

SEQ ID NO: 283107 - DNA, 25 bp, Mus musculus
accactgagcaggtactgacggtga

SEQ ID NO: 283108 - DNA, 25 bp, Mus musculus
cagtgtagcgatcggggcgtctctc

SEQ ID NO: 283109 - DNA, 25 bp, Mus musculus
tcaagtggcactagggaatggccgc

SEQ ID NO: 283110 - DNA, 25 bp, Mus musculus
ctgcgcagtcaagtggcactaggga

SEQ ID NO: 283111 - DNA, 25 bp, Mus musculus
atgactgcgcagtcaagtggcacta

SEQ ID NO: 283112 - DNA, 25 bp, Mus musculus
ggtgagcatgactgcgcagtcaagt

SEQ ID NO: 283113 - DNA, 25 bp, Mus musculus
gccaacacctctgtggcggcggtga

SEQ ID NO: 283114 - DNA, 25 bp, Mus musculus
cgggaccgtctgcagcagccaacac

SEQ ID NO: 283115 - DNA, 25 bp, Mus musculus
cccacgcggactccgcagacccggg

SEQ ID NO: 283116 - DNA, 25 bp, Mus musculus
ggccatgaagccggagtcctgagcc

SEQ ID NO: 283117 - DNA, 25 bp, Mus musculus
ctgccggccgggaggtccaccacca

SEQ ID NO: 283118 - DNA, 25 bp, Mus musculus
caacacctctgtggcggcggtgagc

SEQ ID NO: 283119 - DNA, 25 bp, Mus musculus
ccgcaaccgggctcacccaggccca

SEQ ID NO: 283120 - DNA, 25 bp, Mus musculus
tgcagcagccaacacctctgtggcg

SEQ ID NO: 283121 - DNA, 25 bp, Mus musculus
tctgcaccagtgtagcgatcggggc

SEQ ID NO: 283122 - DNA, 25 bp, Mus musculus
ggcacgttaccatcaccatcacggt

SEQ ID NO: 283123 - DNA, 25 bp, Mus musculus
accgaacatgcacgacgccgaagcg

SEQ ID NO: 283124 - DNA, 25 bp, Mus musculus
tcggccgcctcgttgaagagaaaga

SEQ ID NO: 283125 - DNA, 25 bp, Mus musculus
agtctcctctgagagcgcctgcgca

SEQ ID NO: 283126 - DNA, 25 bp, Mus musculus
cacgctgcgcgtttacgtcacaatc

SEQ ID NO: 283127 - DNA, 25 bp, Mus musculus
ttgggtcctggcgagaatagtcgtt

SEQ ID NO: 283128 - DNA, 25 bp, Mus musculus
gaatagtcgttctgtctggagccgc

SEQ ID NO: 283129 - DNA, 25 bp, Mus musculus
agccgcttccgggtggagcttaaca

SEQ ID NO: 283130 - DNA, 25 bp, Mus musculus
tggcggccgagtcccaccgaacatg

SEQ ID NO: 283131 - DNA, 25 bp, Mus musculus
acacatgagtgatagcagctcctgc

SEQ ID NO: 283132 - DNA, 25 bp, Mus musculus
taattgaggcgttgtgctgtcaccg

SEQ ID NO: 283133 - DNA, 25 bp, Mus musculus
gtgagtactaggctagcccgcgcta

SEQ ID NO: 283134 - DNA, 25 bp, Mus musculus
ggggttcagagtaagccgctttctc

SEQ ID NO: 283135 - DNA, 25 bp, Mus musculus
ctacctaccagtcggctggggttca

SEQ ID NO: 283136 - DNA, 25 bp, Mus musculus
tgaacgccaaaaggatgagcaatcg

SEQ ID NO: 283137 - DNA, 25 bp, Mus musculus
tttccatctagattggcccgcgcta

SEQ ID NO: 283138 - DNA, 25 bp, Mus musculus
attggcccgcgctatcgctgcgaat

SEQ ID NO: 283139 - DNA, 25 bp, Mus musculus
agggctccaggtcacacaactaggg

SEQ ID NO: 283140 - DNA, 25 bp, Mus musculus
tcgcagcactagatacgcgcacgcg

SEQ ID NO: 283141 - DNA, 25 bp, Mus musculus
gtcacacaactagggtttccatcta

SEQ ID NO: 283142 - DNA, 25 bp, Mus musculus
atcgctgcgaatccgggaaaactga

SEQ ID NO: 283143 - DNA, 25 bp, Mus musculus
tgtagaagccctaacgtgaacgcca

SEQ ID NO: 283144 - DNA, 25 bp, Mus musculus
gcgggaggaccaaattgtagaagcc

SEQ ID NO: 283145 - DNA, 25 bp, Mus musculus
gcgcctaggagcctgcgcgtactca

SEQ ID NO: 283146 - DNA, 25 bp, Mus musculus
tcatcatagagcgtccacgagcgcc

SEQ ID NO: 283147 - DNA, 25 bp, Mus musculus
gcgccctagcgcttacgtcatcata

SEQ ID NO: 283148 - DNA, 25 bp, Mus musculus
ggcacctgcacatctggcggcctgg

SEQ ID NO: 283149 - DNA, 25 bp, Mus musculus
tgagcaatcgcagcactagatacgc

SEQ ID NO: 283150 - DNA, 25 bp, Mus musculus
ccgagccgcaggcacgtgtgacggg

SEQ ID NO: 283151 - DNA, 25 bp, Mus musculus
atctgaagctgtttcccgaggcgcg

SEQ ID NO: 283152 - DNA, 25 bp, Mus musculus
ctgcgtatctgaagctgtttcccga

SEQ ID NO: 283153 - DNA, 25 bp, Mus musculus
ggggctgcgtatctgaagctgtttc

SEQ ID NO: 283154 - DNA, 25 bp, Mus musculus
tgtgaacagccaatgggtgcgcggg

SEQ ID NO: 283155 - DNA, 25 bp, Mus musculus
ccaaggcctcccgaggctgcgggag

SEQ ID NO: 283156 - DNA, 25 bp, Mus musculus
cagacgcggtgtgaacagccaatgg

SEQ ID NO: 283157 - DNA, 25 bp, Mus musculus
tgtgcacaagccaataaacacggca

SEQ ID NO: 283158 - DNA, 25 bp, Mus musculus
ggccagcggagcttaccaggaagga

SEQ ID NO: 283159 - DNA, 25 bp, Mus musculus
cttaccaggaaggaggtggtgtcga

SEQ ID NO: 283160 - DNA, 25 bp, Mus musculus
cgcgagacggacgtgtgcacaagcc

SEQ ID NO: 283161 - DNA, 25 bp, Mus musculus
ggacgtgtgcacaagccaataaaca

SEQ ID NO: 283162 - DNA, 25 bp, Mus musculus
agacggacgtgtgcacaagccaata

SEQ ID NO: 283163 - DNA, 25 bp, Mus musculus
agccaataaacacggcagacgcggt

SEQ ID NO: 283164 - DNA, 25 bp, Mus musculus
acgacctcaaggtgcgttccattgg

SEQ ID NO: 283165 - DNA, 25 bp, Mus musculus
ggcgcagacgccagcaccatggctg

SEQ ID NO: 283166 - DNA, 25 bp, Mus musculus
ctgagagcttagtgccggatgtacc

SEQ ID NO: 283167 - DNA, 25 bp, Mus musculus
cggatgtacccactacccaggaggc

SEQ ID NO: 283168 - DNA, 25 bp, Mus musculus
ctgagagtgccgctacctgctcctg

SEQ ID NO: 283169 - DNA, 25 bp, Mus musculus
cgatcccggtgcaccacgaaaagct

SEQ ID NO: 283170 - DNA, 25 bp, Mus musculus
acgaaaagctcgatccaggcgcaga

SEQ ID NO: 283171 - DNA, 25 bp, Mus musculus
caggaggaggccacctgcgccatct

SEQ ID NO: 283172 - DNA, 25 bp, Mus musculus
ctggattacttcaccgacccggtga

SEQ ID NO: 283173 - DNA, 25 bp, Mus musculus
cggtgatgaccgactgcggccacaa

SEQ ID NO: 283174 - DNA, 25 bp, Mus musculus
cggcgcagaggaacctacggcccaa

SEQ ID NO: 283175 - DNA, 25 bp, Mus musculus
cgcccgctcgccaaaatggcagaaa

SEQ ID NO: 283176 - DNA, 25 bp, Mus musculus
agcgttcggagcactggactcaccg

SEQ ID NO: 283177 - DNA, 25 bp, Mus musculus
tggcagaaatggcacgacgcctgca

SEQ ID NO: 283178 - DNA, 25 bp, Mus musculus
cgtggctatgctggcctcatgaata

SEQ ID NO: 283179 - DNA, 25 bp, Mus musculus
ctctgtcaaagaaggcacgcgcgcc

SEQ ID NO: 283180 - DNA, 25 bp, Mus musculus
gcgggcccgaggcaaaatgttcctc

SEQ ID NO: 283181 - DNA, 25 bp, Mus musculus
agactcacagtctccggtcccgaga

SEQ ID NO: 283182 - DNA, 25 bp, Mus musculus
cgtggctaacctctcttcttgaata

SEQ ID NO: 283183 - DNA, 25 bp, Mus musculus
ggccagttgcgctgtggttagtttt

SEQ ID NO: 283184 - DNA, 25 bp, Mus musculus
gcacgcgcatgggagttgtttgcaa

SEQ ID NO: 283185 - DNA, 25 bp, Mus musculus
agcctgtctgtgaactggcgcacgc

SEQ ID NO: 283186 - DNA, 25 bp, Mus musculus
cgaggctgccttcgtctcatgaata

SEQ ID NO: 283187 - DNA, 25 bp, Mus musculus
gatcacggccagtttctcataaata

SEQ ID NO: 283188 - DNA, 25 bp, Mus musculus
tggcagtctaccaacacgtcggaga

SEQ ID NO: 283189 - DNA, 25 bp, Mus musculus
gctggcaactgcgaacaaacgtgtt

SEQ ID NO: 283190 - DNA, 25 bp, Mus musculus
ggctcgctgcatatgagtgaccatc

SEQ ID NO: 283191 - DNA, 25 bp, Mus musculus
gtgtcggtgttccacgtgaagctca

SEQ ID NO: 283192 - DNA, 25 bp, Mus musculus
atagcccggacgtggtctacagccc

SEQ ID NO: 283193 - DNA, 25 bp, Mus musculus
ctcactgctgctgttctggccaatc

SEQ ID NO: 283194 - DNA, 25 bp, Mus musculus
acgcgcaagacgctcgcgcctgaga

SEQ ID NO: 283195 - DNA, 25 bp, Mus musculus
gtttagagcacccagaaccctggtc

SEQ ID NO: 283196 - DNA, 25 bp, Mus musculus
ctggtcgcaagtcacgcccatcagg

SEQ ID NO: 283197 - DNA, 25 bp, Mus musculus
gctgccgcagtctgatccaactctg

SEQ ID NO: 283198 - DNA, 25 bp, Mus musculus
tgatccaactctgggccggtaagta

SEQ ID NO: 283199 - DNA, 25 bp, Mus musculus
atcctaggccgtaaggttggctctc

SEQ ID NO: 283200 - DNA, 25 bp, Mus musculus
ccgccgccgagatcctcgtggatag

SEQ ID NO: 283201 - DNA, 25 bp, Mus musculus
ccgaaaccatcgaggcgcgctacga

SEQ ID NO: 283202 - DNA, 25 bp, Mus musculus
ctacgagtaccggacaacgcgcgtc

SEQ ID NO: 283203 - DNA, 25 bp, Mus musculus
actcttccttaggtgcagcccaggg

SEQ ID NO: 283204 - DNA, 25 bp, Mus musculus
agcccagggctacgcgtttcacctt

SEQ ID NO: 283205 - DNA, 25 bp, Mus musculus
tggcccacagctcgccacgatggag

SEQ ID NO: 283206 - DNA, 25 bp, Mus musculus
aggcgcttacgctttcgctcgggaa

SEQ ID NO: 283207 - DNA, 25 bp, Mus musculus
actcacccagggatccgttcacgtg

SEQ ID NO: 283208 - DNA, 25 bp, Mus musculus
cacccatcaagtgtgcaggacctca

SEQ ID NO: 283209 - DNA, 25 bp, Mus musculus
tccatatcgcccgagcctgtgggga

SEQ ID NO: 283210 - DNA, 25 bp, Mus musculus
cactgagctcaagaactgggtaccc

SEQ ID NO: 283211 - DNA, 25 bp, Mus musculus
tcgtttctgtaacctaggggcaatg

SEQ ID NO: 283212 - DNA, 25 bp, Mus musculus
cacccgcgagtttggggacagaaga

SEQ ID NO: 283213 - DNA, 25 bp, Mus musculus
ctcagtgagtctctcagagtcgccc

SEQ ID NO: 283214 - DNA, 25 bp, Mus musculus
cactagccggtgtaggcgtcagcaa

SEQ ID NO: 283215 - DNA, 25 bp, Mus musculus
tcagcaaccgggtaacctaacaggc

SEQ ID NO: 283216 - DNA, 25 bp, Mus musculus
aacaggctctcgtcctggctcctgg

SEQ ID NO: 283217 - DNA, 25 bp, Mus musculus
tgcccgccgatgaaaccggtaggtg

SEQ ID NO: 283218 - DNA, 25 bp, Mus musculus
tccatcgtgctcattgaggccattg

SEQ ID NO: 283219 - DNA, 25 bp, Mus musculus
gccgggactatcacacgctcatggt

SEQ ID NO: 283220 - DNA, 25 bp, Mus musculus
tcccaatcactaacgccaggccaga

SEQ ID NO: 283221 - DNA, 25 bp, Mus musculus
tcccgtgcagaacagcccggcactg

SEQ ID NO: 283222 - DNA, 25 bp, Mus musculus
gagggcagtctgaagagtaactctc

SEQ ID NO: 283223 - DNA, 25 bp, Mus musculus
cctcccgacgcccatgctgccatgg

SEQ ID NO: 283224 - DNA, 25 bp, Mus musculus
ggcgcctaggaccagcttgctctgg

SEQ ID NO: 283225 - DNA, 25 bp, Mus musculus
gggcagtctgaagagtaactctccc

SEQ ID NO: 283226 - DNA, 25 bp, Mus musculus
cgtttccaggagacgccaaggtcgg

SEQ ID NO: 283227 - DNA, 25 bp, Mus musculus
caaggcccgttagcgtttccaggag

SEQ ID NO: 283228 - DNA, 25 bp, Mus musculus
aggcaaggcccgttagcgtttccag

SEQ ID NO: 283229 - DNA, 25 bp, Mus musculus
atgacgacaggcaaggcccgttagc

SEQ ID NO: 283230 - DNA, 25 bp, Mus musculus
tgccaatcagcccaaggaggcactg

SEQ ID NO: 283231 - DNA, 25 bp, Mus musculus
atcagcccaaggaggcactggcgcc

SEQ ID NO: 283232 - DNA, 25 bp, Mus musculus
ttaccatgacgacaggcaaggcccg

SEQ ID NO: 283233 - DNA, 25 bp, Mus musculus
gcccgcgttaccatgacgacaggca

SEQ ID NO: 283234 - DNA, 25 bp, Mus musculus
acacacccttctggtctcgcgtgac

SEQ ID NO: 283235 - DNA, 25 bp, Mus musculus
cgctccagcagttgctatttgtgca

SEQ ID NO: 283236 - DNA, 25 bp, Mus musculus
ggacgcgctccagcagttgctattt

SEQ ID NO: 283237 - DNA, 25 bp, Mus musculus
ccaaagatattcaagcccgggacgc

SEQ ID NO: 283238 - DNA, 25 bp, Mus musculus
ctgcgcaccaataagtacagacttc

SEQ ID NO: 283239 - DNA, 25 bp, Mus musculus
ccaccaataggctgcgcaccaataa

SEQ ID NO: 283240 - DNA, 25 bp, Mus musculus
ggcggcactgcccaccaataggctg

SEQ ID NO: 283241 - DNA, 25 bp, Mus musculus
gtacatgctccgcacctgtcaggcg

SEQ ID NO: 283242 - DNA, 25 bp, Mus musculus
cccgcaccattctggtctcgcgtga

SEQ ID NO: 283243 - DNA, 25 bp, Mus musculus
cgatctcctcgggatctcctgtgtc

SEQ ID NO: 283244 - DNA, 25 bp, Mus musculus
gcaccattttgatctccagtcactc

SEQ ID NO: 283245 - DNA, 25 bp, Mus musculus
aatcccgcaccattttgatctccag

SEQ ID NO: 283246 - DNA, 25 bp, Mus musculus
cccttgatctcgtgtgtacccctga

SEQ ID NO: 283247 - DNA, 25 bp, Mus musculus
gctatttgtgcaattgggaagctga

SEQ ID NO: 283248 - DNA, 25 bp, Mus musculus
tcggacgacacagcgcagggacagc

SEQ ID NO: 283249 - DNA, 25 bp, Mus musculus
gtttgcgggaccctcgagcagacgt

SEQ ID NO: 283250 - DNA, 25 bp, Mus musculus
tcggggcatcggacgacacagcgca

SEQ ID NO: 283251 - DNA, 25 bp, Mus musculus
taagacccagtgtctcttcgcgacg

SEQ ID NO: 283252 - DNA, 25 bp, Mus musculus
gcctcttctccttgggggcgtcagt

SEQ ID NO: 283253 - DNA, 25 bp, Mus musculus
gggaagccaaaccaggagcgtgacc

SEQ ID NO: 283254 - DNA, 25 bp, Mus musculus
caaaccaggagcgtgacctggggtc

SEQ ID NO: 283255 - DNA, 25 bp, Mus musculus
tcgcctccagaatccacgctgggag

SEQ ID NO: 283256 - DNA, 25 bp, Mus musculus
cagaatccacgctgggagccttggc

SEQ ID NO: 283257 - DNA, 25 bp, Mus musculus
atccacgctgggagccttggcattc

SEQ ID NO: 283258 - DNA, 25 bp, Mus musculus
tggcattcccagtcccggaccctgg

SEQ ID NO: 283259 - DNA, 25 bp, Mus musculus
aggatccctcccagggctcctaaga

SEQ ID NO: 283260 - DNA, 25 bp, Mus musculus
gggctcctaagacccagtgtctctt

SEQ ID NO: 283261 - DNA, 25 bp, Mus musculus
ccctcgagcagacgtgaccgtgggt

SEQ ID NO: 283262 - DNA, 25 bp, Mus musculus
agtccgctgtgtggcaatccgcgcc

SEQ ID NO: 283263 - DNA, 25 bp, Mus musculus
gtaattgatggacgctgaccctggg

SEQ ID NO: 283264 - DNA, 25 bp, Mus musculus
gtgcctcgctggtcaagcggagtaa

SEQ ID NO: 283265 - DNA, 25 bp, Mus musculus
ccacaacgcttaacctggggccagg

SEQ ID NO: 283266 - DNA, 25 bp, Mus musculus
gatgaacccggagtacgcttccggc

SEQ ID NO: 283267 - DNA, 25 bp, Mus musculus
cccagaagaccaatggcggtggccc

SEQ ID NO: 283268 - DNA, 25 bp, Mus musculus
gacacctgggaacccggaagtgcgc

SEQ ID NO: 283269 - DNA, 25 bp, Mus musculus
gtcgccgctgtacgcaggtaccggc

SEQ ID NO: 283270 - DNA, 25 bp, Mus musculus
ttctgcctggcgcttgcgcgttcag

SEQ ID NO: 283271 - DNA, 25 bp, Mus musculus
accggcctgcgtgaggactaggctc

SEQ ID NO: 283272 - DNA, 25 bp, Mus musculus
cctatgcaggagatgcgggccgttt

SEQ ID NO: 283273 - DNA, 25 bp, Mus musculus
tttcctgagctggatcgcgtccaca

SEQ ID NO: 283274 - DNA, 25 bp, Mus musculus
gaggtaagatcgatccgggcgtccc

SEQ ID NO: 283275 - DNA, 25 bp, Mus musculus
tggatcgcgtccacacactggctcg

SEQ ID NO: 283276 - DNA, 25 bp, Mus musculus
attgcgcacaggtgggtcgtcagca

SEQ ID NO: 283277 - DNA, 25 bp, Mus musculus
acacagagaggttgcgagtgcagcc

SEQ ID NO: 283278 - DNA, 25 bp, Mus musculus
tttgcaggccctgttctcagcgaga

SEQ ID NO: 283279 - DNA, 25 bp, Mus musculus
accgcgcactacagctctttgcagg

SEQ ID NO: 283280 - DNA, 25 bp, Mus musculus
ttccaggcgctcaggaaaggctgcc

SEQ ID NO: 283281 - DNA, 25 bp, Mus musculus
ctaagtctcgcgtggtgtccctggt

SEQ ID NO: 283282 - DNA, 25 bp, Mus musculus
tcaccacggcgctaagtctcgcgtg

SEQ ID NO: 283283 - DNA, 25 bp, Mus musculus
tgacagcatgcaggtcaccacggcg

SEQ ID NO: 283284 - DNA, 25 bp, Mus musculus
ttcctgtgtgagtgtgacagcatgc

SEQ ID NO: 283285 - DNA, 25 bp, Mus musculus
cgtcagcacccggtggcgcagtcat

SEQ ID NO: 283286 - DNA, 25 bp, Mus musculus
caggctaaggcttgctatcgctgca

SEQ ID NO: 283287 - DNA, 25 bp, Mus musculus
cgcagacgcacgtgtataacacgcg

SEQ ID NO: 283288 - DNA, 25 bp, Mus musculus
cgcagtcatgagctcaggtttcctg

SEQ ID NO: 283289 - DNA, 25 bp, Mus musculus
gtcgggaagcatccaggctaaggct

SEQ ID NO: 283290 - DNA, 25 bp, Mus musculus
ccgcgggagtcgctgcaaaacgcat

SEQ ID NO: 283291 - DNA, 25 bp, Mus musculus
tgagaacttctaagctgcaccgatc

SEQ ID NO: 283292 - DNA, 25 bp, Mus musculus
gcagactgttcccaccgcttgagaa

SEQ ID NO: 283293 - DNA, 25 bp, Mus musculus
ggagagagagacgtccgccctcact

SEQ ID NO: 283294 - DNA, 25 bp, Mus musculus
ctgctctctcggagccacgctggaa

SEQ ID NO: 283295 - DNA, 25 bp, Mus musculus
agcccgagtttggacgctgcttgct

SEQ ID NO: 283296 - DNA, 25 bp, Mus musculus
tactgggtgcaaaagcccgagtttg

SEQ ID NO: 283297 - DNA, 25 bp, Mus musculus
cgaagttcccaaagtagagttactg

SEQ ID NO: 283298 - DNA, 25 bp, Mus musculus
tgggtaattttctaagtgcaacaca

SEQ ID NO: 283299 - DNA, 25 bp, Mus musculus
ctctccgtagctgtaattatgggta

SEQ ID NO: 283300 - DNA, 25 bp, Mus musculus
cggctgtacacggagactgcttcct

SEQ ID NO: 283301 - DNA, 25 bp, Mus musculus
gctgcacagctggagcacggctgta

SEQ ID NO: 283302 - DNA, 25 bp, Mus musculus
cctgagacaggatacacttctgata

SEQ ID NO: 283303 - DNA, 25 bp, Mus musculus
ccagctgtgctttggaggctgcaca

SEQ ID NO: 283304 - DNA, 25 bp, Mus musculus
tcagcaggagcagcgctcggtgcac

SEQ ID NO: 283305 - DNA, 25 bp, Mus musculus
cgtgctttgatctgcgcatgcgtgt

SEQ ID NO: 283306 - DNA, 25 bp, Mus musculus
gcggctacccgtaagcgcagttcca

SEQ ID NO: 283307 - DNA, 25 bp, Mus musculus
taggcttcggggagaccctgactca

SEQ ID NO: 283308 - DNA, 25 bp, Mus musculus
ctgactcagcgacgcccggttgacg

SEQ ID NO: 283309 - DNA, 25 bp, Mus musculus
gcttcaggggcctagtgatgtccca

SEQ ID NO: 283310 - DNA, 25 bp, Mus musculus
ccgccagagggcagcatagccaggt

SEQ ID NO: 283311 - DNA, 25 bp, Mus musculus
taagcgcagttccagctgcgtgccg

SEQ ID NO: 283312 - DNA, 25 bp, Mus musculus
gcacgagtctcttgggtgcgcatgc

SEQ ID NO: 283313 - DNA, 25 bp, Mus musculus
gcacagtctccaagtgacagcagcg

SEQ ID NO: 283314 - DNA, 25 bp, Mus musculus
caagtcttcaagagttgcctgcaca

SEQ ID NO: 283315 - DNA, 25 bp, Mus musculus
cacgcacatgctcagctgcagctgg

SEQ ID NO: 283316 - DNA, 25 bp, Mus musculus
cgcatgcgtgttcgcggagcgatac

SEQ ID NO: 283317 - DNA, 25 bp, Mus musculus
agcgatacaggtggggacactcgcc

SEQ ID NO: 283318 - DNA, 25 bp, Mus musculus
tcgagctggagctcagcttcttccc

SEQ ID NO: 283319 - DNA, 25 bp, Mus musculus
tgggccacctcgcagctcagtgtgg

SEQ ID NO: 283320 - DNA, 25 bp, Mus musculus
gtcacctcagtctgggcctgggcca

SEQ ID NO: 283321 - DNA, 25 bp, Mus musculus
accatgtcacctcagtctgggcctg

SEQ ID NO: 283322 - DNA, 25 bp, Mus musculus
ttgaaccatgtcacctcagtctggg

SEQ ID NO: 283323 - DNA, 25 bp, Mus musculus
cgtccttgaaccatgtcacctcagt

SEQ ID NO: 283324 - DNA, 25 bp, Mus musculus
agcttcttcccgtccttgaaccatg

SEQ ID NO: 283325 - DNA, 25 bp, Mus musculus
ggcctccacgcgcaccttcgagctg

SEQ ID NO: 283326 - DNA, 25 bp, Mus musculus
cgcctgctgcaccaccagcctcctg

SEQ ID NO: 283327 - DNA, 25 bp, Mus musculus
tccaggcggaaggaaagcttctgcc

SEQ ID NO: 283328 - DNA, 25 bp, Mus musculus
acctcgcagctcagtgtggcgctgg

SEQ ID NO: 283329 - DNA, 25 bp, Mus musculus
cccagcatccgccttgcccgcctgc

SEQ ID NO: 283330 - DNA, 25 bp, Mus musculus
ttcttcccgtccttgaaccatgtca

SEQ ID NO: 283331 - DNA, 25 bp, Mus musculus
gcaccaccagcctcctggagcagcc

SEQ ID NO: 283332 - DNA, 25 bp, Mus musculus
tgcactctctaggatcctggctgta

SEQ ID NO: 283333 - DNA, 25 bp, Mus musculus
cgcgaggtgacctgtctgcacccta

SEQ ID NO: 283334 - DNA, 25 bp, Mus musculus
gcactccgaactcccggccgcgtga

SEQ ID NO: 283335 - DNA, 25 bp, Mus musculus
ctctaggatcctggctgtagggact

SEQ ID NO: 283336 - DNA, 25 bp, Mus musculus
gctccatggtggaatgcactctcta

SEQ ID NO: 283337 - DNA, 25 bp, Mus musculus
aggtgacctgtctgcaccctagtcc

SEQ ID NO: 283338 - DNA, 25 bp, Mus musculus
cgggcggcgacaactgcaaacctct

SEQ ID NO: 283339 - DNA, 25 bp, Mus musculus
cagatgcacctaccggttaccacta

SEQ ID NO: 283340 - DNA, 25 bp, Mus musculus
ccggtccagatgcacctaccggtta

SEQ ID NO: 283341 - DNA, 25 bp, Mus musculus
aacctctggcaaccgcgaacacttg

SEQ ID NO: 283342 - DNA, 25 bp, Mus musculus
actgcaaacctctggcaaccgcgaa

SEQ ID NO: 283343 - DNA, 25 bp, Mus musculus
taccaggaccgaacggtgctatcgc

SEQ ID NO: 283344 - DNA, 25 bp, Mus musculus
ttccgcggctgctccatggtggaat

SEQ ID NO: 283345 - DNA, 25 bp, Mus musculus
caggttaccaggaccgaacggtgct

SEQ ID NO: 283346 - DNA, 25 bp, Mus musculus
ctgctcgctgattggtcatagtttc

SEQ ID NO: 283347 - DNA, 25 bp, Mus musculus
gcgcgactcgcatgcattagccagc

SEQ ID NO: 283348 - DNA, 25 bp, Mus musculus
attagccagcttcgcccacagtgtg

SEQ ID NO: 283349 - DNA, 25 bp, Mus musculus
ggcgtaacttgtgctgcggcctttt

SEQ ID NO: 283350 - DNA, 25 bp, Mus musculus
cggccttttgcgtcgttctagtgtc

SEQ ID NO: 283351 - DNA, 25 bp, Mus musculus
gtgtcgcactttacggctacctctc

SEQ ID NO: 283352 - DNA, 25 bp, Mus musculus
gatagatgtccgttgagctgctcgc

SEQ ID NO: 283353 - DNA, 25 bp, Mus musculus
agtctttttcagtctggggcgcgcg

SEQ ID NO: 283354 - DNA, 25 bp, Mus musculus
gtcaccgttggggatttatctcttg

SEQ ID NO: 283355 - DNA, 25 bp, Mus musculus
atctcttgatggacacggtttttgc

SEQ ID NO: 283356 - DNA, 25 bp, Mus musculus
ccggaagagggactatgatcgtttc

SEQ ID NO: 283357 - DNA, 25 bp, Mus musculus
ctatgatcgtttccggggcttgtca

SEQ ID NO: 283358 - DNA, 25 bp, Mus musculus
tcaccgtcattgataggaaagctgc

SEQ ID NO: 283359 - DNA, 25 bp, Mus musculus
ctagcccgtcccgattggatagatg

SEQ ID NO: 283360 - DNA, 25 bp, Mus musculus
ccagcactagctggctcagtcgttt

SEQ ID NO: 283361 - DNA, 25 bp, Mus musculus
ccaaggccaagtcccaaggtcaggg

SEQ ID NO: 283362 - DNA, 25 bp, Mus musculus
aaggccaagtcccaaggtcagggcg

SEQ ID NO: 283363 - DNA, 25 bp, Mus musculus
ccaagtcccaaggtcagggcggagc

SEQ ID NO: 283364 - DNA, 25 bp, Mus musculus
aagtcccaaggtcagggcggagcct

SEQ ID NO: 283365 - DNA, 25 bp, Mus musculus
cgcgcgctccgccaagctccgtacg

SEQ ID NO: 283366 - DNA, 25 bp, Mus musculus
cgctccgccaagctccgtacggccc

SEQ ID NO: 283367 - DNA, 25 bp, Mus musculus
gcgttgggccagcactagctggctc

SEQ ID NO: 283368 - DNA, 25 bp, Mus musculus
gatatggctcgcgaagcgcaaaccc

SEQ ID NO: 283369 - DNA, 25 bp, Mus musculus
ctgggatatggctcgcgaagcgcaa

SEQ ID NO: 283370 - DNA, 25 bp, Mus musculus
actagctggctcagtcgtttggcgg

SEQ ID NO: 283371 - DNA, 25 bp, Mus musculus
cactagctggctcagtcgtttggcg

SEQ ID NO: 283372 - DNA, 25 bp, Mus musculus
agcactagctggctcagtcgtttgg

SEQ ID NO: 283373 - DNA, 25 bp, Mus musculus
tgggccagcactagctggctcagtc

SEQ ID NO: 283374 - DNA, 25 bp, Mus musculus
caggagttcgccgaaggcttcgtca

SEQ ID NO: 283375 - DNA, 25 bp, Mus musculus
ccgcaagcgcaagctggagcgtatc

SEQ ID NO: 283376 - DNA, 25 bp, Mus musculus
tggacacgcaagaacgcatcaaggc

SEQ ID NO: 283377 - DNA, 25 bp, Mus musculus
cgcctggaggagaaagtcaagaccc

SEQ ID NO: 283378 - DNA, 25 bp, Mus musculus
gcaggtggcgcagctcaaacagaaa

SEQ ID NO: 283379 - DNA, 25 bp, Mus musculus
ctggaggacctgcacaagcaaagcc

SEQ ID NO: 283380 - DNA, 25 bp, Mus musculus
ttcctctacccgaaggtggcagcta

SEQ ID NO: 283381 - DNA, 25 bp, Mus musculus
tgatcatccagtccaacgggctggt

SEQ ID NO: 283382 - DNA, 25 bp, Mus musculus
tcgccggatcttgggctgctcaaac

SEQ ID NO: 283383 - DNA, 25 bp, Mus musculus
ggattgaaaccagggtcggccactg

SEQ ID NO: 283384 - DNA, 25 bp, Mus musculus
gctgaagaaagacgcgctgacgctc

SEQ ID NO: 283385 - DNA, 25 bp, Mus musculus
gtggggatggaaacgcccttctatg

SEQ ID NO: 283386 - DNA, 25 bp, Mus musculus
aagtcctcagccacgtcaacagcgg

SEQ ID NO: 283387 - DNA, 25 bp, Mus musculus
ggtctacgccaacctgagcagtttc

SEQ ID NO: 283388 - DNA, 25 bp, Mus musculus
tggttaccgtgtacgacggaatctg

SEQ ID NO: 283389 - DNA, 25 bp, Mus musculus
aggccgttgtcaccatccaagcgtg

SEQ ID NO: 283390 - DNA, 25 bp, Mus musculus
gcggctattgcattcgccgggcccg

SEQ ID NO: 283391 - DNA, 25 bp, Mus musculus
tgcctggcgcggctattgcattcgc

SEQ ID NO: 283392 - DNA, 25 bp, Mus musculus
gaaaggctgttcagggccaccacca

SEQ ID NO: 283393 - DNA, 25 bp, Mus musculus
cgacggaatctggaaaggctgttca

SEQ ID NO: 283394 - DNA, 25 bp, Mus musculus
ccgcactgtgaaagtgtggcaccaa

SEQ ID NO: 283395 - DNA, 25 bp, Mus musculus
ttgtcaccatccaagcgtgcgctcg

SEQ ID NO: 283396 - DNA, 25 bp, Mus musculus
tccaagctacgtggcgtggttaccg

SEQ ID NO: 283397 - DNA, 25 bp, Mus musculus
aaagtgtggcaccaatgggccacca

SEQ ID NO: 283398 - DNA, 25 bp, Mus musculus
tagtgcgccgcactgtgaaagtgtg

SEQ ID NO: 283399 - DNA, 25 bp, Mus musculus
tcgtggctacctagtgcgccgcact

SEQ ID NO: 283400 - DNA, 25 bp, Mus musculus
tccaagcgtgcgctcgtggctacct

SEQ ID NO: 283401 - DNA, 25 bp, Mus musculus
gggccaccatcatccaagctacgtg

SEQ ID NO: 283402 - DNA, 25 bp, Mus musculus
cccgaagcacctgtgggggcagcta

SEQ ID NO: 283403 - DNA, 25 bp, Mus musculus
cagttcctttcaccgccggtaggtg

SEQ ID NO: 283404 - DNA, 25 bp, Mus musculus
aagtcgcggctctcgtggcccagtt

SEQ ID NO: 283405 - DNA, 25 bp, Mus musculus
gtaaagtcgcggctctcgtggccca

SEQ ID NO: 283406 - DNA, 25 bp, Mus musculus
gcgccggtaaagtcgcggctctcgt

SEQ ID NO: 283407 - DNA, 25 bp, Mus musculus
cctgatcggcccgcgccggtaaagt

SEQ ID NO: 283408 - DNA, 25 bp, Mus musculus
actcggacccagagcgccctgatcg

SEQ ID NO: 283409 - DNA, 25 bp, Mus musculus
cggcgcttccactcggacccagagc

SEQ ID NO: 283410 - DNA, 25 bp, Mus musculus
acctgtgggggcagctacagcgccc

SEQ ID NO: 283411 - DNA, 25 bp, Mus musculus
agacccagcttgtcggccgcgcagg

SEQ ID NO: 283412 - DNA, 25 bp, Mus musculus
tcatggagacccagcttgtcggccg

SEQ ID NO: 283413 - DNA, 25 bp, Mus musculus
agctcatggagacccagcttgtcgg

SEQ ID NO: 283414 - DNA, 25 bp, Mus musculus
tcgtcggggacagctcatggagacc

SEQ ID NO: 283415 - DNA, 25 bp, Mus musculus
catccagcggcgcttccactcggac

SEQ ID NO: 283416 - DNA, 25 bp, Mus musculus
tgaatcagagcatccgcctgcagcg

SEQ ID NO: 283417 - DNA, 25 bp, Mus musculus
aagctgctggtgaatcagagcatcc

SEQ ID NO: 283418 - DNA, 25 bp, Mus musculus
cccatccgctgtggtgaggggacca

SEQ ID NO: 283419 - DNA, 25 bp, Mus musculus
gtgacacgcaggagcagccacagcc

SEQ ID NO: 283420 - DNA, 25 bp, Mus musculus
cagccacagccacgctaggatcagg

SEQ ID NO: 283421 - DNA, 25 bp, Mus musculus
taggatcaggcgtccgtctgtccac

SEQ ID NO: 283422 - DNA, 25 bp, Mus musculus
ttccctgtctctctcgcagttggtg

SEQ ID NO: 283423 - DNA, 25 bp, Mus musculus
tcaccgcttcgatgcacgcctaggg

SEQ ID NO: 283424 - DNA, 25 bp, Mus musculus
gatgcacgcctaggggtccagccca

SEQ ID NO: 283425 - DNA, 25 bp, Mus musculus
ggtccagcccattgttctcacggtc

SEQ ID NO: 283426 - DNA, 25 bp, Mus musculus
tctcacggtccctgtgcagctgtga

SEQ ID NO: 283427 - DNA, 25 bp, Mus musculus
tgagggcctgcacatctcgttctga

SEQ ID NO: 283428 - DNA, 25 bp, Mus musculus
ttctgaccctgctgacctactgcgg

SEQ ID NO: 283429 - DNA, 25 bp, Mus musculus
cgcagttggtgactatctctgtccc

SEQ ID NO: 283430 - DNA, 25 bp, Mus musculus
ccagtgaggctgttatgcacctgca

SEQ ID NO: 283431 - DNA, 25 bp, Mus musculus
ccgcagcatattggggacagatcca

SEQ ID NO: 283432 - DNA, 25 bp, Mus musculus
agccacgcccgttcctcatggggct

SEQ ID NO: 283433 - DNA, 25 bp, Mus musculus
cccagccgggcgaaccagaagccac

SEQ ID NO: 283434 - DNA, 25 bp, Mus musculus
aaggcaagatcctgcaggccaggcc

SEQ ID NO: 283435 - DNA, 25 bp, Mus musculus
agcgaacaggcggaaggcaagatcc

SEQ ID NO: 283436 - DNA, 25 bp, Mus musculus
ttggggacagatccagcgaacaggc

SEQ ID NO: 283437 - DNA, 25 bp, Mus musculus
ccgcgcgcccgcagcatattgggga

SEQ ID NO: 283438 - DNA, 25 bp, Mus musculus
ggccttgcggccgttgccatgaccg

SEQ ID NO: 283439 - DNA, 25 bp, Mus musculus
tatgcacctgcacgccggtgtcctg

SEQ ID NO: 283440 - DNA, 25 bp, Mus musculus
ctccttcctgccagtgaggctgtta

SEQ ID NO: 283441 - DNA, 25 bp, Mus musculus
agcgggccactatcagcggctcctt

SEQ ID NO: 283442 - DNA, 25 bp, Mus musculus
agactgcgtccgagcgggccactat

SEQ ID NO: 283443 - DNA, 25 bp, Mus musculus
tgtcctggccttgcggccgttgcca

SEQ ID NO: 283444 - DNA, 25 bp, Mus musculus
ggggcgctcacgacgacagtaaaag

SEQ ID NO: 283445 - DNA, 25 bp, Mus musculus
agtgcttcccaaggtcgctaccgtc

SEQ ID NO: 283446 - DNA, 25 bp, Mus musculus
acctctagggtacagcggatgatca

SEQ ID NO: 283447 - DNA, 25 bp, Mus musculus
aggaccagaatggaatgacctctag

SEQ ID NO: 283448 - DNA, 25 bp, Mus musculus
gagcttactcggcactactggtgag

SEQ ID NO: 283449 - DNA, 25 bp, Mus musculus
cagccaaatcgagccgagcttactc

SEQ ID NO: 283450 - DNA, 25 bp, Mus musculus
tccttgccggaaacagccaaatcga

SEQ ID NO: 283451 - DNA, 25 bp, Mus musculus
actgggtcgagaatgcacgaatcta

SEQ ID NO: 283452 - DNA, 25 bp, Mus musculus
agcgcagctgagctcacccgagtga

SEQ ID NO: 283453 - DNA, 25 bp, Mus musculus
ccgctccacgtgacgtcataaaatg

SEQ ID NO: 283454 - DNA, 25 bp, Mus musculus
gagggcccaccacctgaagtccttg

SEQ ID NO: 283455 - DNA, 25 bp, Mus musculus
cgcgcccgagggttagaacctagca

SEQ ID NO: 283456 - DNA, 25 bp, Mus musculus
gcggatgatcacgtgaccgcatctc

SEQ ID NO: 283457 - DNA, 25 bp, Mus musculus
tctgtctccaaaacccgagagaatc

SEQ ID NO: 283458 - DNA, 25 bp, Mus musculus
cttagttcaagtatgtgctcacacg

SEQ ID NO: 283459 - DNA, 25 bp, Mus musculus
cgtttcactgacagctgggggatca

SEQ ID NO: 283460 - DNA, 25 bp, Mus musculus
agcgcaactcgggtgtagtggctat

SEQ ID NO: 283461 - DNA, 25 bp, Mus musculus
tgtagtggctatgggtctcgcattt

SEQ ID NO: 283462 - DNA, 25 bp, Mus musculus
aagtatgtgctcacacgcgtgtgga

SEQ ID NO: 283463 - DNA, 25 bp, Mus musculus
gatacgttgtgcgtgcatggtccgc

SEQ ID NO: 283464 - DNA, 25 bp, Mus musculus
atgggtctcgcatttggcattcttg

SEQ ID NO: 283465 - DNA, 25 bp, Mus musculus
ctcacacgcgtgtggagccatgcgc

SEQ ID NO: 283466 - DNA, 25 bp, Mus musculus
ggtgcgcgtggatcttagttcaagt

SEQ ID NO: 283467 - DNA, 25 bp, Mus musculus
acgcgcagcgtgcacacttgtgata

SEQ ID NO: 283468 - DNA, 25 bp, Mus musculus
cgcatttggcattcttggtcccgca

SEQ ID NO: 283469 - DNA, 25 bp, Mus musculus
ctcgcccttaacctggcacctgggg

SEQ ID NO: 283470 - DNA, 25 bp, Mus musculus
ttggcattcttggtcccgcatcccg

SEQ ID NO: 283471 - DNA, 25 bp, Mus musculus
acacttgtgatacgttgtgcgtgca

SEQ ID NO: 283472 - DNA, 25 bp, Mus musculus
tttacgatggttcaggccagaggcc

SEQ ID NO: 283473 - DNA, 25 bp, Mus musculus
gcggattttctgctcggacttcgta

SEQ ID NO: 283474 - DNA, 25 bp, Mus musculus
cgtgtttgccttcggtcaccgtgca

SEQ ID NO: 283475 - DNA, 25 bp, Mus musculus
tgggctcgccggtcacaaaacagct

SEQ ID NO: 283476 - DNA, 25 bp, Mus musculus
ttcttccacactgtctcgggcttgg

SEQ ID NO: 283477 - DNA, 25 bp, Mus musculus
cgaagttctcttgctcgtcctcata

SEQ ID NO: 283478 - DNA, 25 bp, Mus musculus
ccgcggtcggactgcttgcagaaaa

SEQ ID NO: 283479 - DNA, 25 bp, Mus musculus
gtggggctacaagcttgctcacctc

SEQ ID NO: 283480 - DNA, 25 bp, Mus musculus
ggtcatctcctggaaacgcagctgg

SEQ ID NO: 283481 - DNA, 25 bp, Mus musculus
tagcagatctttgcaccaggtcatc

SEQ ID NO: 283482 - DNA, 25 bp, Mus musculus
tgtagccacgcgaccttagcagatc

SEQ ID NO: 283483 - DNA, 25 bp, Mus musculus
gctcagacctccaactcaggatgta

SEQ ID NO: 283484 - DNA, 25 bp, Mus musculus
tcggacttcgtaggtgccaccatcg

SEQ ID NO: 283485 - DNA, 25 bp, Mus musculus
ggccatcatcgccagtgtgttttga

SEQ ID NO: 283486 - DNA, 25 bp, Mus musculus
atgagcacgccgcagcccagtgtgt

SEQ ID NO: 283487 - DNA, 25 bp, Mus musculus
tttacccacttttctgctctcagcg

SEQ ID NO: 283488 - DNA, 25 bp, Mus musculus
cgccgaacacggaagtcctattttg

SEQ ID NO: 283489 - DNA, 25 bp, Mus musculus
agtgaccaatcgtcctcaagcgttg

SEQ ID NO: 283490 - DNA, 25 bp, Mus musculus
cgcctctcaaaggaagtgaccaatc

SEQ ID NO: 283491 - DNA, 25 bp, Mus musculus
gcgcgctgaatctctgtccaggccg

SEQ ID NO: 283492 - DNA, 25 bp, Mus musculus
ctacagacaccagggagccgcggca

SEQ ID NO: 283493 - DNA, 25 bp, Mus musculus
tttctgctctcagcggaccaatggg

SEQ ID NO: 283494 - DNA, 25 bp, Mus musculus
gggtccctctcgttcgcgcacaggt

SEQ ID NO: 283495 - DNA, 25 bp, Mus musculus
cggtccaggtgaccgctcggtctct

SEQ ID NO: 283496 - DNA, 25 bp, Mus musculus
gccctattcagaacggaccaatcca

SEQ ID NO: 283497 - DNA, 25 bp, Mus musculus
agcgcacatgagtctcgcgggcctc

SEQ ID NO: 283498 - DNA, 25 bp, Mus musculus
ctgaccaatggtaggtggctgcctc

SEQ ID NO: 283499 - DNA, 25 bp, Mus musculus
cggaccaatgggcaagcgcacatga

SEQ ID NO: 283500 - DNA, 25 bp, Mus musculus
agctcctttcaggacccgtaccagg

SEQ ID NO: 283501 - DNA, 25 bp, Mus musculus
tcctggaaaccacctagcgcggttc

SEQ ID NO: 283502 - DNA, 25 bp, Mus musculus
ccggggatatggcttgaagaactca

SEQ ID NO: 283503 - DNA, 25 bp, Mus musculus
ttgaagaactcagggcgcccaggcc

SEQ ID NO: 283504 - DNA, 25 bp, Mus musculus
cctctgtaaacatggcaggcgcagc

SEQ ID NO: 283505 - DNA, 25 bp, Mus musculus
cccgtaccaggttatagggctctgc

SEQ ID NO: 283506 - DNA, 25 bp, Mus musculus
cctcctgcgcgtgttcaccagggga

SEQ ID NO: 283507 - DNA, 25 bp, Mus musculus
atagggctctgcgaagccgaagccg

SEQ ID NO: 283508 - DNA, 25 bp, Mus musculus
atctggagacagacatggacaggga

SEQ ID NO: 283509 - DNA, 25 bp, Mus musculus
acggtaagtgcgtcattgtgctgca

SEQ ID NO: 283510 - DNA, 25 bp, Mus musculus
cattgtgctgcacgagtgatgcgtg

SEQ ID NO: 283511 - DNA, 25 bp, Mus musculus
tgatgcgtgctggtagtgcagcacc

SEQ ID NO: 283512 - DNA, 25 bp, Mus musculus
tccaggcctgagttcctggaaacca

SEQ ID NO: 283513 - DNA, 25 bp, Mus musculus
gctggtagtgcagcaccagctcctt

SEQ ID NO: 283514 - DNA, 25 bp, Mus musculus
aggtactggtccctgatcttgcgca

SEQ ID NO: 283515 - DNA, 25 bp, Mus musculus
cagaacgtggtttacccagcacagc

SEQ ID NO: 283516 - DNA, 25 bp, Mus musculus
tggtttacccagcacagcagtgatg

SEQ ID NO: 283517 - DNA, 25 bp, Mus musculus
gcacagcagtgatgcgcacgagcgc

SEQ ID NO: 283518 - DNA, 25 bp, Mus musculus
gtgcgactcacacgaggtactggtc

SEQ ID NO: 283519 - DNA, 25 bp, Mus musculus
gatcttgcgcagctgcatgaggtca

SEQ ID NO: 283520 - DNA, 25 bp, Mus musculus
gaggctgttcatgcgcttgtcgatc

SEQ ID NO: 283521 - DNA, 25 bp, Mus musculus
gcttgtcgatctcacggttgtcgga

SEQ ID NO: 283522 - DNA, 25 bp, Mus musculus
tgtcggaggcctgcgcccgcagatc

SEQ ID NO: 283523 - DNA, 25 bp, Mus musculus
gctccaacttcgtgcggctttcgtg

SEQ ID NO: 283524 - DNA, 25 bp, Mus musculus
cggctttcgtgtatctccgcgatgc

SEQ ID NO: 283525 - DNA, 25 bp, Mus musculus
ccgcgatgcgagacttgagtcgctc

SEQ ID NO: 283526 - DNA, 25 bp, Mus musculus
cccaaaggggcgctcagaacgtggt

SEQ ID NO: 283527 - DNA, 25 bp, Mus musculus
catgaggtcaggtttgaggctgttc

SEQ ID NO: 283528 - DNA, 25 bp, Mus musculus
tcggcagctgtaccctcaatggaga

SEQ ID NO: 283529 - DNA, 25 bp, Mus musculus
ccgtcggaggctcacgaaaacacta

SEQ ID NO: 283530 - DNA, 25 bp, Mus musculus
aggggcctacgatgcacgcatagtc

SEQ ID NO: 283531 - DNA, 25 bp, Mus musculus
acacgcgcgagaatgcggcttatca

SEQ ID NO: 283532 - DNA, 25 bp, Mus musculus
agcccggttttgtgcggctccttct

SEQ ID NO: 283533 - DNA, 25 bp, Mus musculus
tcagcgtccggaagcgagattgttt

SEQ ID NO: 283534 - DNA, 25 bp, Mus musculus
ggactctgagatacccgagccattc

SEQ ID NO: 283535 - DNA, 25 bp, Mus musculus
tccggaagcagcagaacgtgccata

SEQ ID NO: 283536 - DNA, 25 bp, Mus musculus
tttacgaagtcgtgaacctgccaga

SEQ ID NO: 283537 - DNA, 25 bp, Mus musculus
tgtctgggaggaaccgaacgacctc

SEQ ID NO: 283538 - DNA, 25 bp, Mus musculus
gaacgacctcaactccaggccttgg

SEQ ID NO: 283539 - DNA, 25 bp, Mus musculus
ggccgccgatagcttccggaaattg

SEQ ID NO: 283540 - DNA, 25 bp, Mus musculus
gccatgacaaccctaggcgtccgga

SEQ ID NO: 283541 - DNA, 25 bp, Mus musculus
cacgcatagtctgtgtgctcacaca

SEQ ID NO: 283542 - DNA, 25 bp, Mus musculus
gctgtccgaccgctcgtgagcctgt

SEQ ID NO: 283543 - DNA, 25 bp, Mus musculus
gggcccgtcttctgcttaccaagca

SEQ ID NO: 283544 - DNA, 25 bp, Mus musculus
atgtagcggggcagatcagtcttca

SEQ ID NO: 283545 - DNA, 25 bp, Mus musculus
gcagatcagtcttcacgccctggtc

SEQ ID NO: 283546 - DNA, 25 bp, Mus musculus
cctccagcagatggtagaattcttc

SEQ ID NO: 283547 - DNA, 25 bp, Mus musculus
gatggtagaattcttccgggtcaaa

SEQ ID NO: 283548 - DNA, 25 bp, Mus musculus
ccgggtcaaactcctgcgcgggaga

SEQ ID NO: 283549 - DNA, 25 bp, Mus musculus
gctgtgagccgtgagccctcactta

SEQ ID NO: 283550 - DNA, 25 bp, Mus musculus
gagccctcacttagttcccggaatc

SEQ ID NO: 283551 - DNA, 25 bp, Mus musculus
agctttcggaccagctgcactatga

SEQ ID NO: 283552 - DNA, 25 bp, Mus musculus
cctggagatgatgatgagcagcttt

SEQ ID NO: 283553 - DNA, 25 bp, Mus musculus
agctgcactatgaagcccacctcgg

SEQ ID NO: 283554 - DNA, 25 bp, Mus musculus
tgggcaagcgcacctgacgagaccc

SEQ ID NO: 283555 - DNA, 25 bp, Mus musculus
tgcttaccaagcactcgagcagccg

SEQ ID NO: 283556 - DNA, 25 bp, Mus musculus
ccaagttcaaataccggcgtccaca

SEQ ID NO: 283557 - DNA, 25 bp, Mus musculus
acgttgctagggctctgggactaac

SEQ ID NO: 283558 - DNA, 25 bp, Mus musculus
aacgctgtagcagcgcacccttggc

SEQ ID NO: 283559 - DNA, 25 bp, Mus musculus
agatcggccggattcggcctgagcc

SEQ ID NO: 283560 - DNA, 25 bp, Mus musculus
cccaactaaggagcttttgttgcta

SEQ ID NO: 283561 - DNA, 25 bp, Mus musculus
cttttgttgctacagctctgccgga

SEQ ID NO: 283562 - DNA, 25 bp, Mus musculus
ttgctacagctctgccggaagcgct

SEQ ID NO: 283563 - DNA, 25 bp, Mus musculus
tgcaaggcccgagtcccaagttcaa

SEQ ID NO: 283564 - DNA, 25 bp, Mus musculus
ggatggagcgcagttagaacccgcc

SEQ ID NO: 283565 - DNA, 25 bp, Mus musculus
ttagaacccgcctgtcggtgcccag

SEQ ID NO: 283566 - DNA, 25 bp, Mus musculus
gtgcccagcattgccagggccttga

SEQ ID NO: 283567 - DNA, 25 bp, Mus musculus
ctagggctctgggactaacgtgagc

SEQ ID NO: 283568 - DNA, 25 bp, Mus musculus
aaataccggcgtccacagctagacc

SEQ ID NO: 283569 - DNA, 25 bp, Mus musculus
tccctaccttttggaacgctgtagc

SEQ ID NO: 283570 - DNA, 25 bp, Mus musculus
tcggtactcactcgagcgtcagcgc

SEQ ID NO: 283571 - DNA, 25 bp, Mus musculus
ctgtgggcggtaccgcttaagaact

SEQ ID NO: 283572 - DNA, 25 bp, Mus musculus
tgcgcgctcggaaaagagagacctg

SEQ ID NO: 283573 - DNA, 25 bp, Mus musculus
tgaccctctttgaccagtttccgga

SEQ ID NO: 283574 - DNA, 25 bp, Mus musculus
tcccacccgagatctcattgtcgtg

SEQ ID NO: 283575 - DNA, 25 bp, Mus musculus
ccctacagatctggtccctgaaagc

SEQ ID NO: 283576 - DNA, 25 bp, Mus musculus
cgagtcacgtacagcacgggtggca

SEQ ID NO: 283577 - DNA, 25 bp, Mus musculus
ggttgggcctcaaaagtgtactatg

SEQ ID NO: 283578 - DNA, 25 bp, Mus musculus
gcctagtacaacagagcccgatgcg

SEQ ID NO: 283579 - DNA, 25 bp, Mus musculus
tactacaaagatgcggggctgaact

SEQ ID NO: 283580 - DNA, 25 bp, Mus musculus
gggcaggactataggcagtactaca

SEQ ID NO: 283581 - DNA, 25 bp, Mus musculus
ttctccctgcgggacttcatggcgg

SEQ ID NO: 283582 - DNA, 25 bp, Mus musculus
cgtttggaagcaacttgcaggaccc

SEQ ID NO: 283583 - DNA, 25 bp, Mus musculus
agcgcggggatcagtaatttctccc

SEQ ID NO: 283584 - DNA, 25 bp, Mus musculus
ccggaggcggtgtctctattttaag

SEQ ID NO: 283585 - DNA, 25 bp, Mus musculus
ttcactcacccggaggcggtgtctc

SEQ ID NO: 283586 - DNA, 25 bp, Mus musculus
cagctttacttaatcttcacttccc

SEQ ID NO: 283587 - DNA, 25 bp, Mus musculus
cacccggaggcggtgtctctatttt

SEQ ID NO: 283588 - DNA, 25 bp, Mus musculus
tcccgcggccggtgccactctgcgc

SEQ ID NO: 283589 - DNA, 25 bp, Mus musculus
cggaggcggtgtctctattttaaga

SEQ ID NO: 283590 - DNA, 25 bp, Mus musculus
ctctattttaagaggccgagggcgg

SEQ ID NO: 283591 - DNA, 25 bp, Mus musculus
gccgagggcgggctcgcatctaact

SEQ ID NO: 283592 - DNA, 25 bp, Mus musculus
gcgggctcgcatctaactggggccc

SEQ ID NO: 283593 - DNA, 25 bp, Mus musculus
gccttcccgccagggtctccgctcc

SEQ ID NO: 283594 - DNA, 25 bp, Mus musculus
tccgctccgcggcttcttcggggag

SEQ ID NO: 283595 - DNA, 25 bp, Mus musculus
cctgtccaaacagctttacttaatc

SEQ ID NO: 283596 - DNA, 25 bp, Mus musculus
gtccaaacagctttacttaatcttc

SEQ ID NO: 283597 - DNA, 25 bp, Mus musculus
cactcacccggaggcggtgtctcta

SEQ ID NO: 283598 - DNA, 25 bp, Mus musculus
tttccacgttggacaagtgcggcga

SEQ ID NO: 283599 - DNA, 25 bp, Mus musculus
ctccggggtgaaccatgttgagtcc

SEQ ID NO: 283600 - DNA, 25 bp, Mus musculus
atgttgagtcctgccaacggggagc

SEQ ID NO: 283601 - DNA, 25 bp, Mus musculus
gggagcagatccacctggtgaacta

SEQ ID NO: 283602 - DNA, 25 bp, Mus musculus
tgtggaggattacctggactcaatc

SEQ ID NO: 283603 - DNA, 25 bp, Mus musculus
gagtcactgcctttcgacctgcaga

SEQ ID NO: 283604 - DNA, 25 bp, Mus musculus
gacctgcagaggaacgtctcgctga

SEQ ID NO: 283605 - DNA, 25 bp, Mus musculus
tgcgggagatcgacgccaaatacca

SEQ ID NO: 283606 - DNA, 25 bp, Mus musculus
ctaggaacaaaaggtctggagcgcc

SEQ ID NO: 283607 - DNA, 25 bp, Mus musculus
gagcgcctttgatacgccgaggtcc

SEQ ID NO: 283608 - DNA, 25 bp, Mus musculus
gggcgagagagctttgcattttgca

SEQ ID NO: 283609 - DNA, 25 bp, Mus musculus
agcgctctttgtagtgaagtgatga

SEQ ID NO: 283610 - DNA, 25 bp, Mus musculus
ggctgcgcgaccaaagcgctctttg

SEQ ID NO: 283611 - DNA, 25 bp, Mus musculus
tccttgtgtaccgagctccgggaca

SEQ ID NO: 283612 - DNA, 25 bp, Mus musculus
cgtacgcaaaccgttctggacagca

SEQ ID NO: 283613 - DNA, 25 bp, Mus musculus
gctcgtccatcgctgtgtgttcccg

SEQ ID NO: 283614 - DNA, 25 bp, Mus musculus
gccgcaggaggctcggctcgtccat

SEQ ID NO: 283615 - DNA, 25 bp, Mus musculus
agcgtttcgcaaagctgccttcgga

SEQ ID NO: 283616 - DNA, 25 bp, Mus musculus
tttcccgacctggaaggctctgtcc

SEQ ID NO: 283617 - DNA, 25 bp, Mus musculus
ctgccttagtttcccgacctggaag

SEQ ID NO: 283618 - DNA, 25 bp, Mus musculus
gagggcgcaatctgacgcttcccgc

SEQ ID NO: 283619 - DNA, 25 bp, Mus musculus
ccgttctggacagcaagtgagcaga

SEQ ID NO: 283620 - DNA, 25 bp, Mus musculus
cctggcaccattggtcctgttgatc

SEQ ID NO: 283621 - DNA, 25 bp, Mus musculus
tcctgttgatcagctgacgcccggc

SEQ ID NO: 283622 - DNA, 25 bp, Mus musculus
ctccggcccggagcgtttcgcaaag

SEQ ID NO: 283623 - DNA, 25 bp, Mus musculus
gttttgagctagctgaggtcacaca

SEQ ID NO: 283624 - DNA, 25 bp, Mus musculus
tcgcaaagctgccttcggaggggcc

SEQ ID NO: 283625 - DNA, 25 bp, Mus musculus
agcagagggcgcaatctgacgcttc

SEQ ID NO: 283626 - DNA, 25 bp, Mus musculus
ccgaaagcggcagctcattggtcga

SEQ ID NO: 283627 - DNA, 25 bp, Mus musculus
gcgctaagtgaaggcgggcaccaca

SEQ ID NO: 283628 - DNA, 25 bp, Mus musculus
cgctgccatcttgggcgctaagtga

SEQ ID NO: 283629 - DNA, 25 bp, Mus musculus
taggcagtgactcgcggtcccgctc

SEQ ID NO: 283630 - DNA, 25 bp, Mus musculus
aaagccacgggctaggcagtgactc

SEQ ID NO: 283631 - DNA, 25 bp, Mus musculus
accgtccgcggggttgctgccaaga

SEQ ID NO: 283632 - DNA, 25 bp, Mus musculus
tcccaacaggaagggtgcagcgtcc

SEQ ID NO: 283633 - DNA, 25 bp, Mus musculus
gaaatgggcatacgccgcacgcgca

SEQ ID NO: 283634 - DNA, 25 bp, Mus musculus
tccctgcacattcaggaaatgggca

SEQ ID NO: 283635 - DNA, 25 bp, Mus musculus
gtcatagagcgtgcgtccctgcaca

SEQ ID NO: 283636 - DNA, 25 bp, Mus musculus
agctcacccatacagaatgacgtca

SEQ ID NO: 283637 - DNA, 25 bp, Mus musculus
ctcattggtcgatagtcccaacagg

SEQ ID NO: 283638 - DNA, 25 bp, Mus musculus
ggaagcaagtccaggccacaccgtc

SEQ ID NO: 283639 - DNA, 25 bp, Mus musculus
ccgtccagccggaagcaagtccagg

SEQ ID NO: 283640 - DNA, 25 bp, Mus musculus
actcggtgtccgtggagtggacggc

SEQ ID NO: 283641 - DNA, 25 bp, Mus musculus
atacgtcgtgcgctgcgaggctgaa

SEQ ID NO: 283642 - DNA, 25 bp, Mus musculus
cgcaatacgtcgtgcgctgcgaggc

SEQ ID NO: 283643 - DNA, 25 bp, Mus musculus
tcctgacgcaatacgtcgtgcgctg

SEQ ID NO: 283644 - DNA, 25 bp, Mus musculus
ggggtcctgacgcaatacgtcgtgc

SEQ ID NO: 283645 - DNA, 25 bp, Mus musculus
agtggacggcgtcacagctgagcac

SEQ ID NO: 283646 - DNA, 25 bp, Mus musculus
cacgacacgtgtcggtgaggaacca

SEQ ID NO: 283647 - DNA, 25 bp, Mus musculus
ggtactccacgacacgtgtcggtga

SEQ ID NO: 283648 - DNA, 25 bp, Mus musculus
gagccggtactccacgacacgtgtc

SEQ ID NO: 283649 - DNA, 25 bp, Mus musculus
cgagagccggtactccacgacacgt

SEQ ID NO: 283650 - DNA, 25 bp, Mus musculus
gcgttgcacagcctcgagagccggt

SEQ ID NO: 283651 - DNA, 25 bp, Mus musculus
actgaggcgttgcacagcctcgaga

SEQ ID NO: 283652 - DNA, 25 bp, Mus musculus
ttcccttcctttgccccattggtga

SEQ ID NO: 283653 - DNA, 25 bp, Mus musculus
gacggcgtcacagctgagcacctgc

SEQ ID NO: 283654 - DNA, 25 bp, Mus musculus
cccaaaaaagagatcggccaggtgc

SEQ ID NO: 283655 - DNA, 25 bp, Mus musculus
gtacacacacaagcgggacaacagg

SEQ ID NO: 283656 - DNA, 25 bp, Mus musculus
cccagaaaagactaggccaatagcg

SEQ ID NO: 283657 - DNA, 25 bp, Mus musculus
agcgggctcgaactacgtacacaca

SEQ ID NO: 283658 - DNA, 25 bp, Mus musculus
ccgcagctgcgtcgcacttatagga

SEQ ID NO: 283659 - DNA, 25 bp, Mus musculus
agaagaccgcacctaccggaagaga

SEQ ID NO: 283660 - DNA, 25 bp, Mus musculus
acagcattgcggtgacggtcgcgaa

SEQ ID NO: 283661 - DNA, 25 bp, Mus musculus
gccttcaccttatcgaacagcattg

SEQ ID NO: 283662 - DNA, 25 bp, Mus musculus
tctgagtataagcagtgctggagcc

SEQ ID NO: 283663 - DNA, 25 bp, Mus musculus
cgcgctcgctgtaactctgagtata

SEQ ID NO: 283664 - DNA, 25 bp, Mus musculus
gtggttcacgacttccacgcgctcg

SEQ ID NO: 283665 - DNA, 25 bp, Mus musculus
acgtaggcctgggaatcgcatgctc

SEQ ID NO: 283666 - DNA, 25 bp, Mus musculus
gtctaggaacaagacccggggctca

SEQ ID NO: 283667 - DNA, 25 bp, Mus musculus
gagactccgcaaacacagcagtagg

SEQ ID NO: 283668 - DNA, 25 bp, Mus musculus
tcctactccatgacgttgattatta

SEQ ID NO: 283669 - DNA, 25 bp, Mus musculus
ccggacttcctactccatgacgttg

SEQ ID NO: 283670 - DNA, 25 bp, Mus musculus
cgttcacgcctacgctgcgctccaa

SEQ ID NO: 283671 - DNA, 25 bp, Mus musculus
gctgcgctccaaccgcgcaccacca

SEQ ID NO: 283672 - DNA, 25 bp, Mus musculus
accacctcaggtgcttgcacatgca

SEQ ID NO: 283673 - DNA, 25 bp, Mus musculus
tcaggtgcttgcacatgcagcagtg

SEQ ID NO: 283674 - DNA, 25 bp, Mus musculus
gcttgcacatgcagcagtgcggctg

SEQ ID NO: 283675 - DNA, 25 bp, Mus musculus
agcagtgcggctgcctggaacatca

SEQ ID NO: 283676 - DNA, 25 bp, Mus musculus
tgcctggaacatcaccagcctggca

SEQ ID NO: 283677 - DNA, 25 bp, Mus musculus
ccggggcagggaaaatgtgtcctct

SEQ ID NO: 283678 - DNA, 25 bp, Mus musculus
agctgcatgtcccacgaaccgggtc

SEQ ID NO: 283679 - DNA, 25 bp, Mus musculus
cgttgattattaagtccggggcagg

SEQ ID NO: 283680 - DNA, 25 bp, Mus musculus
gggaaaatgtgtcctctgaccgagg

SEQ ID NO: 283681 - DNA, 25 bp, Mus musculus
ggagcccagctgcatgtcccacgaa

SEQ ID NO: 283682 - DNA, 25 bp, Mus musculus
gtgccgtccacgtgaagcgatagtg

SEQ ID NO: 283683 - DNA, 25 bp, Mus musculus
ccagcaggtagaggcgcaggaacat

SEQ ID NO: 283684 - DNA, 25 bp, Mus musculus
tcttggtgacgaagcgtgtgttgaa

SEQ ID NO: 283685 - DNA, 25 bp, Mus musculus
agagaaggccagtcgtgccgtccac

SEQ ID NO: 283686 - DNA, 25 bp, Mus musculus
acgtcatggcgatacgccagtcgtc

SEQ ID NO: 283687 - DNA, 25 bp, Mus musculus
agggacacgcgctcccacgtcatgg

SEQ ID NO: 283688 - DNA, 25 bp, Mus musculus
ccaactccagcgagatcagggacac

SEQ ID NO: 283689 - DNA, 25 bp, Mus musculus
ggtggatggcacacacgaccaactc

SEQ ID NO: 283690 - DNA, 25 bp, Mus musculus
agcacatccaggtctgcctcggctg

SEQ ID NO: 283691 - DNA, 25 bp, Mus musculus
agcatgacccgagccagcaggtaga

SEQ ID NO: 283692 - DNA, 25 bp, Mus musculus
gaggagacgctgaagaccaacaaca

SEQ ID NO: 283693 - DNA, 25 bp, Mus musculus
ctgtccacgcagcaacgatccagga

SEQ ID NO: 283694 - DNA, 25 bp, Mus musculus
tgccgacggcaccagagagaaggcc

SEQ ID NO: 283695 - DNA, 25 bp, Mus musculus
accaacaacacagtgccggggcaga

SEQ ID NO: 283696 - DNA, 25 bp, Mus musculus
tcgcatagcccagggacccgctatt

SEQ ID NO: 283697 - DNA, 25 bp, Mus musculus
cctgacccctgaccgcgtggcaaca

SEQ ID NO: 283698 - DNA, 25 bp, Mus musculus
gtggcaacaccatccccagcgtcgt

SEQ ID NO: 283699 - DNA, 25 bp, Mus musculus
ctctcgccaatacctgcgggcgggg

SEQ ID NO: 283700 - DNA, 25 bp, Mus musculus
atagcccagggacccgctattactg

SEQ ID NO: 283701 - DNA, 25 bp, Mus musculus
accctctcttctgtgtccctgaccc

SEQ ID NO: 283702 - DNA, 25 bp, Mus musculus
cggggacctggaccctcgtgccagc

SEQ ID NO: 283703 - DNA, 25 bp, Mus musculus
cactcgcaatcttccctcaccgggg

SEQ ID NO: 283704 - DNA, 25 bp, Mus musculus
ctggaccctcgtgccagcgcgtccc

SEQ ID NO: 283705 - DNA, 25 bp, Mus musculus
ccagcgtcgtccctagtcgcatagc

SEQ ID NO: 283706 - DNA, 25 bp, Mus musculus
gtctcccactcgcaatcttccctca

SEQ ID NO: 283707 - DNA, 25 bp, Mus musculus
gtcgcatagcccagggacccgctat

SEQ ID NO: 283708 - DNA, 25 bp, Mus musculus
gggacacgcgcaccctctcttctgt

SEQ ID NO: 283709 - DNA, 25 bp, Mus musculus
gcgcaccctctcttctgtgtccctg

SEQ ID NO: 283710 - DNA, 25 bp, Mus musculus
acgcgcgcagttttcagacggggaa

SEQ ID NO: 283711 - DNA, 25 bp, Mus musculus
cgcgcagttttcagacggggaaact

SEQ ID NO: 283712 - DNA, 25 bp, Mus musculus
ccaagtgagtaagcagacgggcaag

SEQ ID NO: 283713 - DNA, 25 bp, Mus musculus
gctttacgcgcgcagttttcagacg

SEQ ID NO: 283714 - DNA, 25 bp, Mus musculus
tttacgcgcgcagttttcagacggg

SEQ ID NO: 283715 - DNA, 25 bp, Mus musculus
tgggaacagaggtgcgcgcgccgct

SEQ ID NO: 283716 - DNA, 25 bp, Mus musculus
cccggcccgagagcaaaaccaagtg

SEQ ID NO: 283717 - DNA, 25 bp, Mus musculus
tccgctggctttacgcgcgcagttt

SEQ ID NO: 283718 - DNA, 25 bp, Mus musculus
cttggtgtccgctggctttacgcgc

SEQ ID NO: 283719 - DNA, 25 bp, Mus musculus
agtgaccgaggacacgccaagggct

SEQ ID NO: 283720 - DNA, 25 bp, Mus musculus
acagtgaccgaggacacgccaaggg

SEQ ID NO: 283721 - DNA, 25 bp, Mus musculus
aaaccaagtgagtaagcagacgggc

SEQ ID NO: 283722 - DNA, 25 bp, Mus musculus
ccgaggacagtgaccgaggacacgc

SEQ ID NO: 283723 - DNA, 25 bp, Mus musculus
cggcccgagagcaaaaccaagtgag

SEQ ID NO: 283724 - DNA, 25 bp, Mus musculus
ctgcggggaactcccttctagcaac

SEQ ID NO: 283725 - DNA, 25 bp, Mus musculus
tatccttggcaactgcggggaactc

SEQ ID NO: 283726 - DNA, 25 bp, Mus musculus
gcccgcctggtatccttggcaactg

SEQ ID NO: 283727 - DNA, 25 bp, Mus musculus
gtgtgactcttaggcccgcctggta

SEQ ID NO: 283728 - DNA, 25 bp, Mus musculus
acatgcgcagcgtgtgactcttagg

SEQ ID NO: 283729 - DNA, 25 bp, Mus musculus
tccgcacatgcgcagcgtgtgactc

SEQ ID NO: 283730 - DNA, 25 bp, Mus musculus
atgcgcgcgggttaacactctctcc

SEQ ID NO: 283731 - DNA, 25 bp, Mus musculus
gctcctcccttgttcgagccgatta

SEQ ID NO: 283732 - DNA, 25 bp, Mus musculus
atggcgaccgcgagggccgaaacct

SEQ ID NO: 283733 - DNA, 25 bp, Mus musculus
agctcccgcacggttgccatggcga

SEQ ID NO: 283734 - DNA, 25 bp, Mus musculus
agccctgatggcgcatgcgcacatc

SEQ ID NO: 283735 - DNA, 25 bp, Mus musculus
ctcttctctacagcagcgcgccggt

SEQ ID NO: 283736 - DNA, 25 bp, Mus musculus
gggctgacccggctcttctctacag

SEQ ID NO: 283737 - DNA, 25 bp, Mus musculus
ggaaacaaagtactccgcacatgcg

SEQ ID NO: 283738 - DNA, 25 bp, Mus musculus
ctcaggatgccggtcagcttcctca

SEQ ID NO: 283739 - DNA, 25 bp, Mus musculus
cgcctttgagccgtgagtcttcctc

SEQ ID NO: 283740 - DNA, 25 bp, Mus musculus
ctcgatctgtgcacgtgtgaccttg

SEQ ID NO: 283741 - DNA, 25 bp, Mus musculus
ctccgcagcgagtcctcgatctgtg

SEQ ID NO: 283742 - DNA, 25 bp, Mus musculus
ggctcttagccttttccactgtggg

SEQ ID NO: 283743 - DNA, 25 bp, Mus musculus
tcttccagtggcagctctaggtggc

SEQ ID NO: 283744 - DNA, 25 bp, Mus musculus
cgccggttaaggttctcttccagtg

SEQ ID NO: 283745 - DNA, 25 bp, Mus musculus
tcagccacactgcaagtcaaggagt

SEQ ID NO: 283746 - DNA, 25 bp, Mus musculus
tcctcaaacgcggtgaaggccgctc

SEQ ID NO: 283747 - DNA, 25 bp, Mus musculus
accgtggcagttgcacctcctcaaa

SEQ ID NO: 283748 - DNA, 25 bp, Mus musculus
gggttctcctgcttcaaccgtggca

SEQ ID NO: 283749 - DNA, 25 bp, Mus musculus
gcttcagttgcgacagccgcatgtt

SEQ ID NO: 283750 - DNA, 25 bp, Mus musculus
ggggagcgcaaccactccttcttca

SEQ ID NO: 283751 - DNA, 25 bp, Mus musculus
gtcaaggagtcaggacccagaccta

SEQ ID NO: 283752 - DNA, 25 bp, Mus musculus
cgcgccacagccgttcctacctctt

SEQ ID NO: 283753 - DNA, 25 bp, Mus musculus
tgtcaatgacgtcgccgcgcctgcg

SEQ ID NO: 283754 - DNA, 25 bp, Mus musculus
ctactcatgacgttctcgaatgccg

SEQ ID NO: 283755 - DNA, 25 bp, Mus musculus
gcgctctactcatgacgttctcgaa

SEQ ID NO: 283756 - DNA, 25 bp, Mus musculus
ggtggcgctctactcatgacgttct

SEQ ID NO: 283757 - DNA, 25 bp, Mus musculus
tcaactttcggtggcgctctactca

SEQ ID NO: 283758 - DNA, 25 bp, Mus musculus
gtactcaactttcggtggcgctcta

SEQ ID NO: 283759 - DNA, 25 bp, Mus musculus
cgcgcctgcgtactcaactttcggt

SEQ ID NO: 283760 - DNA, 25 bp, Mus musculus
ctcggtcgcgtgtcaatgacgtcgc

SEQ ID NO: 283761 - DNA, 25 bp, Mus musculus
cccatctccagttccgccttcccgc

SEQ ID NO: 283762 - DNA, 25 bp, Mus musculus
ctgggagcacccaccaccgggcacc

SEQ ID NO: 283763 - DNA, 25 bp, Mus musculus
tgggccggaaactggctgaactccc

SEQ ID NO: 283764 - DNA, 25 bp, Mus musculus
acctgggccggaaactggctgaact

SEQ ID NO: 283765 - DNA, 25 bp, Mus musculus
gcgtgtcaatgacgtcgccgcgcct

SEQ ID NO: 283766 - DNA, 25 bp, Mus musculus
catgatgacatcacctcaggaacgc

SEQ ID NO: 283767 - DNA, 25 bp, Mus musculus
gcgtcgaataatcacgaccatgatg

SEQ ID NO: 283768 - DNA, 25 bp, Mus musculus
acaatgagaatcgagagaacgcgtc

SEQ ID NO: 283769 - DNA, 25 bp, Mus musculus
ggtccaggaggcagcgaaacaatga

SEQ ID NO: 283770 - DNA, 25 bp, Mus musculus
taagccgaataacaagcggtccagg

SEQ ID NO: 283771 - DNA, 25 bp, Mus musculus
agtgaggccatcacacaggcagata

SEQ ID NO: 283772 - DNA, 25 bp, Mus musculus
tcggctgtgacaacgacgaatgccc

SEQ ID NO: 283773 - DNA, 25 bp, Mus musculus
gaagaaacgctccaaggccaaagca

SEQ ID NO: 283774 - DNA, 25 bp, Mus musculus
ctcaggaacgcccaaggagaagaaa

SEQ ID NO: 283775 - DNA, 25 bp, Mus musculus
gccaaagcagagagggaagcgtctc

SEQ ID NO: 283776 - DNA, 25 bp, Mus musculus
ccaacgagcccacgtactgtctgtg

SEQ ID NO: 283777 - DNA, 25 bp, Mus musculus
actgtctgtgcaaccaggtctccta

SEQ ID NO: 283778 - DNA, 25 bp, Mus musculus
tctcctacggggagatgatcggctg

SEQ ID NO: 283779 - DNA, 25 bp, Mus musculus
ccaggacaagtcgaagagtgaggcc

SEQ ID NO: 283780 - DNA, 25 bp, Mus musculus
tcagcattcactctagcgagcgagc

SEQ ID NO: 283781 - DNA, 25 bp, Mus musculus
agtctctttctgctcttgcccggct

SEQ ID NO: 283782 - DNA, 25 bp, Mus musculus
ctttctgctcttgcccggctcgacg

SEQ ID NO: 283783 - DNA, 25 bp, Mus musculus
tgggctcagcattcactctagcgag

SEQ ID NO: 283784 - DNA, 25 bp, Mus musculus
attcactctagcgagcgagcggcgt

SEQ ID NO: 283785 - DNA, 25 bp, Mus musculus
ctctagcgagcgagcggcgtgtaca

SEQ ID NO: 283786 - DNA, 25 bp, Mus musculus
agcggcgtgtacagccggctccctg

SEQ ID NO: 283787 - DNA, 25 bp, Mus musculus
ggagtcccgcttgctccaagcgcac

SEQ ID NO: 283788 - DNA, 25 bp, Mus musculus
agcgcactccagcagtctctttctg

SEQ ID NO: 283789 - DNA, 25 bp, Mus musculus
ctccagcagtctctttctgctcttg

SEQ ID NO: 283790 - DNA, 25 bp, Mus musculus
gcagtctctttctgctcttgcccgg

SEQ ID NO: 283791 - DNA, 25 bp, Mus musculus
cgccttgggctcagcattcactcta

SEQ ID NO: 283792 - DNA, 25 bp, Mus musculus
ccttgggctcagcattcactctagc

SEQ ID NO: 283793 - DNA, 25 bp, Mus musculus
cggctcgacggcgacatgggtgtcc

SEQ ID NO: 283794 - DNA, 25 bp, Mus musculus
agaggttgcattgagcccagcgcac

SEQ ID NO: 283795 - DNA, 25 bp, Mus musculus
tccgcctctcccagatcggtggtgt

SEQ ID NO: 283796 - DNA, 25 bp, Mus musculus
atcctcctctagagccaatatgggc

SEQ ID NO: 283797 - DNA, 25 bp, Mus musculus
caggagtgaccaccgtcttgccatc

SEQ ID NO: 283798 - DNA, 25 bp, Mus musculus
tgagccacgtacacacgcatcaggc

SEQ ID NO: 283799 - DNA, 25 bp, Mus musculus
gtacagtaggtactggcccaccaga

SEQ ID NO: 283800 - DNA, 25 bp, Mus musculus
ggtggcacctcgaagccgtacagta

SEQ ID NO: 283801 - DNA, 25 bp, Mus musculus
tgcaggcaaagaagggtggcacctc

SEQ ID NO: 283802 - DNA, 25 bp, Mus musculus
ggccgcgacacgaagcaatccacta

SEQ ID NO: 283803 - DNA, 25 bp, Mus musculus
catgaccagcaagaagaccgtcttc

SEQ ID NO: 283804 - DNA, 25 bp, Mus musculus
ccaggtgcgccatctcacagaggtt

SEQ ID NO: 283805 - DNA, 25 bp, Mus musculus
gctgcacgcaccaccaggctgtagt

SEQ ID NO: 283806 - DNA, 25 bp, Mus musculus
tcgccaagttctggtcgtgcgctcg

SEQ ID NO: 283807 - DNA, 25 bp, Mus musculus
ctgcagcgctaggttcgccaagttc

SEQ ID NO: 283808 - DNA, 25 bp, Mus musculus
ccacaagcttttcgcgcggcggatt

SEQ ID NO: 283809 - DNA, 25 bp, Mus musculus
ccaggcggtagaagatcggcaagaa

SEQ ID NO: 283810 - DNA, 25 bp, Mus musculus
agatcggcaagaagagcaaggctgt

SEQ ID NO: 283811 - DNA, 25 bp, Mus musculus
ctgtgagcagcgaattgagcaactg

SEQ ID NO: 283812 - DNA, 25 bp, Mus musculus
gaattgagcaactggcccacgcaca

SEQ ID NO: 283813 - DNA, 25 bp, Mus musculus
aaacttgagaccgtagcgcgctgcc

SEQ ID NO: 283814 - DNA, 25 bp, Mus musculus
cgagcacctgcacagccgacatgaa

SEQ ID NO: 283815 - DNA, 25 bp, Mus musculus
atttattgggctccggggtcagcgc

SEQ ID NO: 283816 - DNA, 25 bp, Mus musculus
ctgggccgtcgacccacaagctttt

SEQ ID NO: 283817 - DNA, 25 bp, Mus musculus
gactctcagagcgagcgtcgtcgca

SEQ ID NO: 283818 - DNA, 25 bp, Mus musculus
gccctccatggagacaggtaactcg

SEQ ID NO: 283819 - DNA, 25 bp, Mus musculus
catggtcgcgaacacgccgtagtcc

SEQ ID NO: 283820 - DNA, 25 bp, Mus musculus
tgcccgtggacaccagcagcatggt

SEQ ID NO: 283821 - DNA, 25 bp, Mus musculus
ccgacatgaagctagcggccagcga

SEQ ID NO: 283822 - DNA, 25 bp, Mus musculus
tcaccatggtctctgacggaagtcc

SEQ ID NO: 283823 - DNA, 25 bp, Mus musculus
ggatcctgggagtctacgcgtaatc

SEQ ID NO: 283824 - DNA, 25 bp, Mus musculus
cgcgacgggcctttgcaagtttctc

SEQ ID NO: 283825 - DNA, 25 bp, Mus musculus
taagtcccgcctctcttcacggaga

SEQ ID NO: 283826 - DNA, 25 bp, Mus musculus
ggtaccgatcagctacgtataagtc

SEQ ID NO: 283827 - DNA, 25 bp, Mus musculus
tggcttttttattgggtaccgatca

SEQ ID NO: 283828 - DNA, 25 bp, Mus musculus
cttccattgggtacagctagtagcg

SEQ ID NO: 283829 - DNA, 25 bp, Mus musculus
ctcgttcaccgccagtcacaaaagg

SEQ ID NO: 283830 - DNA, 25 bp, Mus musculus
gccttcatggcactgcgcactcgtt

SEQ ID NO: 283831 - DNA, 25 bp, Mus musculus
agctgcccgtaaccgctgagggacc

SEQ ID NO: 283832 - DNA, 25 bp, Mus musculus
cgaaaaggagtgtaacgctgatata

SEQ ID NO: 283833 - DNA, 25 bp, Mus musculus
gaagtgttgtctttcgcgcaggctc

SEQ ID NO: 283834 - DNA, 25 bp, Mus musculus
ctagtagcggtctaagttcttggct

SEQ ID NO: 283835 - DNA, 25 bp, Mus musculus
gaagtcccgccctcctgatgcggtg

SEQ ID NO: 283836 - DNA, 25 bp, Mus musculus
gtggcctacgatccagacgggcata

SEQ ID NO: 283837 - DNA, 25 bp, Mus musculus
aggcgcacctgccacactggggcat

SEQ ID NO: 283838 - DNA, 25 bp, Mus musculus
ttctggcggtgtgcggcctcactcc

SEQ ID NO: 283839 - DNA, 25 bp, Mus musculus
tcacattccggggatacagggttcg

SEQ ID NO: 283840 - DNA, 25 bp, Mus musculus
gcacgttagatgtggcgtcacattc

SEQ ID NO: 283841 - DNA, 25 bp, Mus musculus
tctgccacacgggttactgggtctg

SEQ ID NO: 283842 - DNA, 25 bp, Mus musculus
catagggttgcgcacgtgcctagcg

SEQ ID NO: 283843 - DNA, 25 bp, Mus musculus
ccctggacgcaacgttccgggcgtg

SEQ ID NO: 283844 - DNA, 25 bp, Mus musculus
tgctggcctacgtcatggaggagtt

SEQ ID NO: 283845 - DNA, 25 bp, Mus musculus
cagctccctactgttgctggtggtg

SEQ ID NO: 283846 - DNA, 25 bp, Mus musculus
tggaggcgcccagctccctactgtt

SEQ ID NO: 283847 - DNA, 25 bp, Mus musculus
taagctccctgaaggggcgtggcca

SEQ ID NO: 283848 - DNA, 25 bp, Mus musculus
cggtgcttccggtaagctccctgaa

SEQ ID NO: 283849 - DNA, 25 bp, Mus musculus
ggcctggacaaaactctgccacacg

SEQ ID NO: 283850 - DNA, 25 bp, Mus musculus
tccagggccaacagccaagacagtc

SEQ ID NO: 283851 - DNA, 25 bp, Mus musculus
acgagtcgctctctgtgtctttcga

SEQ ID NO: 283852 - DNA, 25 bp, Mus musculus
ctcaactgaggtggacgagtcgctc

SEQ ID NO: 283853 - DNA, 25 bp, Mus musculus
tggtaatagccctgagcgcctgtca

SEQ ID NO: 283854 - DNA, 25 bp, Mus musculus
tgccctggagaagcggagaacatct

SEQ ID NO: 283855 - DNA, 25 bp, Mus musculus
ctcgtgtatcacagaatgggcctcg

SEQ ID NO: 283856 - DNA, 25 bp, Mus musculus
aggacacaagatctgggcccactca

SEQ ID NO: 283857 - DNA, 25 bp, Mus musculus
cgcaggccagtagttaccacgcatg

SEQ ID NO: 283858 - DNA, 25 bp, Mus musculus
tgtactatttcctggccgcacgccg

SEQ ID NO: 283859 - DNA, 25 bp, Mus musculus
gcgacaaggttgtgcgtgtactatt

SEQ ID NO: 283860 - DNA, 25 bp, Mus musculus
gtaggccgcctagagctttttgtgc

SEQ ID NO: 283861 - DNA, 25 bp, Mus musculus
cactgtccttttcgagaagctgggc

SEQ ID NO: 283862 - DNA, 25 bp, Mus musculus
tcctgaatgctcgtgaggctgcttc

SEQ ID NO: 283863 - DNA, 25 bp, Mus musculus
tgtggtcaacacaaagcctcgtgta

SEQ ID NO: 283864 - DNA, 25 bp, Mus musculus
tcccgttctgaggaatccgccattc

SEQ ID NO: 283865 - DNA, 25 bp, Mus musculus
tccggaacccggaagtgaaatcgca

SEQ ID NO: 283866 - DNA, 25 bp, Mus musculus
cggccgaggtccaggtaagttctcg

SEQ ID NO: 283867 - DNA, 25 bp, Mus musculus
tgtggaacacttagcatctggaatg

SEQ ID NO: 283868 - DNA, 25 bp, Mus musculus
agggtgctctcttcacgcgagccgc

SEQ ID NO: 283869 - DNA, 25 bp, Mus musculus
cgggcttaccgcgtctttcagcggc

SEQ ID NO: 283870 - DNA, 25 bp, Mus musculus
ttgctcctgaagtcgtgggacgtga

SEQ ID NO: 283871 - DNA, 25 bp, Mus musculus
gaaagggacttctgcactcgcggtc

SEQ ID NO: 283872 - DNA, 25 bp, Mus musculus
ctggaatgcaccaaccgcagagggc

SEQ ID NO: 283873 - DNA, 25 bp, Mus musculus
tcaaaggcaagcgtctcagggtccc

SEQ ID NO: 283874 - DNA, 25 bp, Mus musculus
cggcaccaacctgagcgggctaaaa

SEQ ID NO: 283875 - DNA, 25 bp, Mus musculus
tggctccaaggtgtccctcagacgt

SEQ ID NO: 283876 - DNA, 25 bp, Mus musculus
tacagttcgttcagcctggccaaga

SEQ ID NO: 283877 - DNA, 25 bp, Mus musculus
ggcgggctccaagcttgctacagtt

SEQ ID NO: 283878 - DNA, 25 bp, Mus musculus
tacttccgtcccaagcgtagcaggg

SEQ ID NO: 283879 - DNA, 25 bp, Mus musculus
cggccagatggaaacgcccaactga

SEQ ID NO: 283880 - DNA, 25 bp, Mus musculus
cgatggcggcagaaaaacgagaacc

SEQ ID NO: 283881 - DNA, 25 bp, Mus musculus
ttgaacctggtacggctgctttgtc

SEQ ID NO: 283882 - DNA, 25 bp, Mus musculus
atggcttttccagtcctttcaacga

SEQ ID NO: 283883 - DNA, 25 bp, Mus musculus
ggggaaggacctcactcaggcactt

SEQ ID NO: 283884 - DNA, 25 bp, Mus musculus
cgacgtcgcggttggagttgaacct

SEQ ID NO: 283885 - DNA, 25 bp, Mus musculus
ctgcggcttgaaataaaactctact

SEQ ID NO: 283886 - DNA, 25 bp, Mus musculus
gcctacatggactacagagactctg

SEQ ID NO: 283887 - DNA, 25 bp, Mus musculus
taatcggctgttcagggcctacatg

SEQ ID NO: 283888 - DNA, 25 bp, Mus musculus
tttcaacgaattctcgccggacata

SEQ ID NO: 283889 - DNA, 25 bp, Mus musculus
cccaggtcaaggttcccgctacaga

SEQ ID NO: 283890 - DNA, 25 bp, Mus musculus
aaaacacgtgcactgcgcgcgcaga

SEQ ID NO: 283891 - DNA, 25 bp, Mus musculus
ggaaggagcctatcatcgcccgctg

SEQ ID NO: 283892 - DNA, 25 bp, Mus musculus
gcactctgggttgcgcggccagcca

SEQ ID NO: 283893 - DNA, 25 bp, Mus musculus
aaccgcgctcgcgtatgcaaataca

SEQ ID NO: 283894 - DNA, 25 bp, Mus musculus
cctttccgggatccgcactctgggt

SEQ ID NO: 283895 - DNA, 25 bp, Mus musculus
tgcaaatacatgcaggtcccgcctc

SEQ ID NO: 283896 - DNA, 25 bp, Mus musculus
actctcgagcatgacgccgcggtga

SEQ ID NO: 283897 - DNA, 25 bp, Mus musculus
gaagccacttgcaattcgcgccctg

SEQ ID NO: 283898 - DNA, 25 bp, Mus musculus
gtgccaacggctccacccgcagttc

SEQ ID NO: 283899 - DNA, 25 bp, Mus musculus
atcgtgtttgcggatgagctgcgcc

SEQ ID NO: 283900 - DNA, 25 bp, Mus musculus
gcccggaagccacttgcaattcgcg

SEQ ID NO: 283901 - DNA, 25 bp, Mus musculus
gctttgcgctcttccggtttcaaga

SEQ ID NO: 283902 - DNA, 25 bp, Mus musculus
gctggaagctttgtgggccgtaacc

SEQ ID NO: 283903 - DNA, 25 bp, Mus musculus
gatcctcggataaccacaggcgggc

SEQ ID NO: 283904 - DNA, 25 bp, Mus musculus
tgcacagctgcgttcccggcggcag

SEQ ID NO: 283905 - DNA, 25 bp, Mus musculus
acaggtgacaccgagtgggatcctc

SEQ ID NO: 283906 - DNA, 25 bp, Mus musculus
gcagcagctgcgcaatcagctcgga

SEQ ID NO: 283907 - DNA, 25 bp, Mus musculus
agagctcactccagctgagccgcag

SEQ ID NO: 283908 - DNA, 25 bp, Mus musculus
tgaaaggttcgacgcccgtcgcgcc

SEQ ID NO: 283909 - DNA, 25 bp, Mus musculus
cttgtccacctgctcctggaaggca

SEQ ID NO: 283910 - DNA, 25 bp, Mus musculus
ccgcgttcagcacgaagagctcact

SEQ ID NO: 283911 - DNA, 25 bp, Mus musculus
ggccttgaggcagccgtactccgca

SEQ ID NO: 283912 - DNA, 25 bp, Mus musculus
gggcccactcgaccgtgctgaacag

SEQ ID NO: 283913 - DNA, 25 bp, Mus musculus
tgaacagcaggcgtgccgccaactc

SEQ ID NO: 283914 - DNA, 25 bp, Mus musculus
cgccaactcgcacacgttgtcgatg

SEQ ID NO: 283915 - DNA, 25 bp, Mus musculus
gcacacgttgtcgatgcccagtaca

SEQ ID NO: 283916 - DNA, 25 bp, Mus musculus
ttgtcgatgcccagtacagcgccgc

SEQ ID NO: 283917 - DNA, 25 bp, Mus musculus
ctcaccaggcgtgaagagcgcgatg

SEQ ID NO: 283918 - DNA, 25 bp, Mus musculus
gcaatcagctcggacactggcggcc

SEQ ID NO: 283919 - DNA, 25 bp, Mus musculus
ggaaggcacgcacctggtccatgaa

SEQ ID NO: 283920 - DNA, 25 bp, Mus musculus
aggtgacgccgaatcgtcctcggtc

SEQ ID NO: 283921 - DNA, 25 bp, Mus musculus
tagtggctcaccatccgagcgcgcg

SEQ ID NO: 283922 - DNA, 25 bp, Mus musculus
caggccaacttagtggctcaccatc

SEQ ID NO: 283923 - DNA, 25 bp, Mus musculus
aaagttttgcggcaacttcctgcgg

SEQ ID NO: 283924 - DNA, 25 bp, Mus musculus
gtgggtagctcccaccagccttgtc

SEQ ID NO: 283925 - DNA, 25 bp, Mus musculus
acacgccgtaatgctttccactgga

SEQ ID NO: 283926 - DNA, 25 bp, Mus musculus
gccctcgcaggtgaacacgccgtaa

SEQ ID NO: 283927 - DNA, 25 bp, Mus musculus
atgctgcgcttgaagaaactcttgc

SEQ ID NO: 283928 - DNA, 25 bp, Mus musculus
ccactagggccgaacccgtggtctg

SEQ ID NO: 283929 - DNA, 25 bp, Mus musculus
ggggagcacctgcacgcatgtatca

SEQ ID NO: 283930 - DNA, 25 bp, Mus musculus
cgcgcccggccgtaatcgcagaggt

SEQ ID NO: 283931 - DNA, 25 bp, Mus musculus
tcgcagaggtccaggcgatagagct

SEQ ID NO: 283932 - DNA, 25 bp, Mus musculus
gcatgtatcaccaactccactaggg

SEQ ID NO: 283933 - DNA, 25 bp, Mus musculus
actttggccgcaagttacgcggcga

SEQ ID NO: 283934 - DNA, 25 bp, Mus musculus
ccgcacaaacttccggccaggaaga

SEQ ID NO: 283935 - DNA, 25 bp, Mus musculus
atggcggcttcctagagtcctgatt

SEQ ID NO: 283936 - DNA, 25 bp, Mus musculus
tagagtcctgattgactggccgcgg

SEQ ID NO: 283937 - DNA, 25 bp, Mus musculus
ctacagagtggaacctgcggcactg

SEQ ID NO: 283938 - DNA, 25 bp, Mus musculus
gaacctgcggcactgtgaacgcgcg

SEQ ID NO: 283939 - DNA, 25 bp, Mus musculus
tgaacgcgcgtgagctttgtgtcgc

SEQ ID NO: 283940 - DNA, 25 bp, Mus musculus
ttgtgtcgccgtggtctaacttcga

SEQ ID NO: 283941 - DNA, 25 bp, Mus musculus
ttcgacccggattgctgtagctcca

SEQ ID NO: 283942 - DNA, 25 bp, Mus musculus
gtagctccaggttcgttcttcttga

SEQ ID NO: 283943 - DNA, 25 bp, Mus musculus
cgttcttcttgaggacttaggggtg

SEQ ID NO: 283944 - DNA, 25 bp, Mus musculus
gggattcgaggtcccgagatgccac

SEQ ID NO: 283945 - DNA, 25 bp, Mus musculus
gcgcatccatcgcagggtcacttgg

SEQ ID NO: 283946 - DNA, 25 bp, Mus musculus
ggtcacttgggcttcctgtgtttcc

SEQ ID NO: 283947 - DNA, 25 bp, Mus musculus
tgggcttcctgtgtttccctaggga

SEQ ID NO: 283948 - DNA, 25 bp, Mus musculus
cgctgtggctacctcgagtgctcag

SEQ ID NO: 283949 - DNA, 25 bp, Mus musculus
gaccgtcagcggctgcgcttcggac

SEQ ID NO: 283950 - DNA, 25 bp, Mus musculus
tcgccgtgcactggccactctagtt

SEQ ID NO: 283951 - DNA, 25 bp, Mus musculus
tgcactggccactctagttcgtagg

SEQ ID NO: 283952 - DNA, 25 bp, Mus musculus
ccactctagttcgtaggggctggcg

SEQ ID NO: 283953 - DNA, 25 bp, Mus musculus
ctcttccgagagcttctgcgttgtg

SEQ ID NO: 283954 - DNA, 25 bp, Mus musculus
ccgagagcttctgcgttgtgctttg

SEQ ID NO: 283955 - DNA, 25 bp, Mus musculus
cttctgcgttgtgctttggtgcgca

SEQ ID NO: 283956 - DNA, 25 bp, Mus musculus
gcacatccgaccctccgcctgcagg

SEQ ID NO: 283957 - DNA, 25 bp, Mus musculus
gtgctgcgtctcttccgagagcttc

SEQ ID NO: 283958 - DNA, 25 bp, Mus musculus
cgagtgctcagccaaatacaattgg

SEQ ID NO: 283959 - DNA, 25 bp, Mus musculus
atacaattggcacgtgctgcgtctc

SEQ ID NO: 283960 - DNA, 25 bp, Mus musculus
gctacctcgagtgctcagccaaata

SEQ ID NO: 283961 - DNA, 25 bp, Mus musculus
ttggtgcgcacacgtcctgcacatc

SEQ ID NO: 283962 - DNA, 25 bp, Mus musculus
cgcatccgagcgcagcgagcactga

SEQ ID NO: 283963 - DNA, 25 bp, Mus musculus
gctgccgccactcgaacacaaagga

SEQ ID NO: 283964 - DNA, 25 bp, Mus musculus
gccacaagtgtgcacatgcgccctg

SEQ ID NO: 283965 - DNA, 25 bp, Mus musculus
cacatgcgccttgaagccctcgagg

SEQ ID NO: 283966 - DNA, 25 bp, Mus musculus
gcggtaccgcacatgcgccctggaa

SEQ ID NO: 283967 - DNA, 25 bp, Mus musculus
ggggtgcgctctgaccctaacagca

SEQ ID NO: 283968 - DNA, 25 bp, Mus musculus
acaccacgcggaaaatggcgcctta

SEQ ID NO: 283969 - DNA, 25 bp, Mus musculus
accttgccgaagtgcgcagcccagt

SEQ ID NO: 283970 - DNA, 25 bp, Mus musculus
cgtccagccgtagaaggagtcctca

SEQ ID NO: 283971 - DNA, 25 bp, Mus musculus
gcagcgaacagagcgcgaccaggtc

SEQ ID NO: 283972 - DNA, 25 bp, Mus musculus
ctcccgctgacatgatgggtcgcta

SEQ ID NO: 283973 - DNA, 25 bp, Mus musculus
tcgctaggaagcacgcgactgatcg

SEQ ID NO: 283974 - DNA, 25 bp, Mus musculus
tgcacccggtttccattagacagaa

SEQ ID NO: 283975 - DNA, 25 bp, Mus musculus
cgactgatcggccagaggaatgtgc

SEQ ID NO: 283976 - DNA, 25 bp, Mus musculus
tcaggaggtctgaggtctactgtgc

SEQ ID NO: 283977 - DNA, 25 bp, Mus musculus
agcggatcccaatgctcggtgaggc

SEQ ID NO: 283978 - DNA, 25 bp, Mus musculus
acagcggcactggacgtcaggctcc

SEQ ID NO: 283979 - DNA, 25 bp, Mus musculus
gcgccctgcattgccttcggatgct

SEQ ID NO: 283980 - DNA, 25 bp, Mus musculus
ccaacctggtgttggacgatggcgc

SEQ ID NO: 283981 - DNA, 25 bp, Mus musculus
aggtctactgtgctcgtcctcctgc

SEQ ID NO: 283982 - DNA, 25 bp, Mus musculus
acgtagggtgcagctagtcaatccc

SEQ ID NO: 283983 - DNA, 25 bp, Mus musculus
tagtcaatcccgatcggcgtggggc

SEQ ID NO: 283984 - DNA, 25 bp, Mus musculus
tgcgtagacagttgccgcgcgaatt

SEQ ID NO: 283985 - DNA, 25 bp, Mus musculus
cgcgcgaatttgaactgcagagggc

SEQ ID NO: 283986 - DNA, 25 bp, Mus musculus
ctcctatgggacatggccgatactg

SEQ ID NO: 283987 - DNA, 25 bp, Mus musculus
gccgatactgcatgcttggctctga

SEQ ID NO: 283988 - DNA, 25 bp, Mus musculus
ttggctctgaggctgctagcagcac

SEQ ID NO: 283989 - DNA, 25 bp, Mus musculus
tgctagcagcactacgcgaggagga

SEQ ID NO: 283990 - DNA, 25 bp, Mus musculus
tgaagaacagcaccacatcagcctg

SEQ ID NO: 283991 - DNA, 25 bp, Mus musculus
tggactcgacactctccagtggccg

SEQ ID NO: 283992 - DNA, 25 bp, Mus musculus
ggcctggcttgacctccacgaatgt

SEQ ID NO: 283993 - DNA, 25 bp, Mus musculus
agtgagccaccgactccgtgaatga

SEQ ID NO: 283994 - DNA, 25 bp, Mus musculus
ccctggatcatcttcaggaggtggt

SEQ ID NO: 283995 - DNA, 25 bp, Mus musculus
tacactgtgatacggcgctggcagc

SEQ ID NO: 283996 - DNA, 25 bp, Mus musculus
actgcggccttgcaggtcggcacga

SEQ ID NO: 283997 - DNA, 25 bp, Mus musculus
agctcaacctcgagtgcagcaggcg

SEQ ID NO: 283998 - DNA, 25 bp, Mus musculus
acagtcgatgtggatggtcctcttc

SEQ ID NO: 283999 - DNA, 25 bp, Mus musculus
gtagccgtcactggactcgacactc

SEQ ID NO: 284000 - DNA, 25 bp, Mus musculus
tgcgcacccttgcagctggtgatgc

SEQ ID NO: 284001 - DNA, 25 bp, Mus musculus
ctccacgaatgtgtagccgtcactg

SEQ ID NO: 284002 - DNA, 25 bp, Mus musculus
ccgactccgtgaatgaagaacagca

SEQ ID NO: 284003 - DNA, 25 bp, Mus musculus
ggtgatgcgctgctcacagtcgatg

SEQ ID NO: 284004 - DNA, 25 bp, Mus musculus
gagccgtctggcctagataaccgtc

SEQ ID NO: 284005 - DNA, 25 bp, Mus musculus
gcaggccttgctcctcatttctaag

SEQ ID NO: 284006 - DNA, 25 bp, Mus musculus
cccggatgcacttgaggggaaagca

SEQ ID NO: 284007 - DNA, 25 bp, Mus musculus
tcctagcagtacgaatgcggagctt

SEQ ID NO: 284008 - DNA, 25 bp, Mus musculus
cgccgctggagtgatggtcattaaa

SEQ ID NO: 284009 - DNA, 25 bp, Mus musculus
gtttttccatcacggcctgggcgcc

SEQ ID NO: 284010 - DNA, 25 bp, Mus musculus
gataaccgtccaaccagaggcttct

SEQ ID NO: 284011 - DNA, 25 bp, Mus musculus
ccacctgcaggtgccgcttacatgg

SEQ ID NO: 284012 - DNA, 25 bp, Mus musculus
gggcatcccgcagccgcgtagcaaa

SEQ ID NO: 284013 - DNA, 25 bp, Mus musculus
gagccagctcacctgaggtcatcga

SEQ ID NO: 284014 - DNA, 25 bp, Mus musculus
ggtgactcctctctcggggaacaga

SEQ ID NO: 284015 - DNA, 25 bp, Mus musculus
cctcatttctaaggctgtggaaccc

SEQ ID NO: 284016 - DNA, 25 bp, Mus musculus
aaagcgcagcgccagtcctgtttcc

SEQ ID NO: 284017 - DNA, 25 bp, Mus musculus
aatgcggagcttggcggttatccac

SEQ ID NO: 284018 - DNA, 25 bp, Mus musculus
cgcaagcacaagcacggctgggtcc

SEQ ID NO: 284019 - DNA, 25 bp, Mus musculus
gccgcgcgcgcggaaacgagtatca

SEQ ID NO: 284020 - DNA, 25 bp, Mus musculus
ggaaacgagtatcagccgagcaaca

SEQ ID NO: 284021 - DNA, 25 bp, Mus musculus
tcaagcgcaagcacaagcacggctg

SEQ ID NO: 284022 - DNA, 25 bp, Mus musculus
acaagcacggctgggtccgtcggct

SEQ ID NO: 284023 - DNA, 25 bp, Mus musculus
aggtcatcctccgtcgcatgctgaa

SEQ ID NO: 284024 - DNA, 25 bp, Mus musculus
atcctccgtcgcatgctgaagggcc

SEQ ID NO: 284025 - DNA, 25 bp, Mus musculus
tcagacgccggtagagttgcccgag

SEQ ID NO: 284026 - DNA, 25 bp, Mus musculus
agggccgcaagtccctgagccactg

SEQ ID NO: 284027 - DNA, 25 bp, Mus musculus
gcaagtccctgagccactgaggagc

SEQ ID NO: 284028 - DNA, 25 bp, Mus musculus
gcgcaacgtcgcagggaatagactc

SEQ ID NO: 284029 - DNA, 25 bp, Mus musculus
cagggaatagactcagacgccggta

SEQ ID NO: 284030 - DNA, 25 bp, Mus musculus
tcgcatgctgaagggccgcaagtcc

SEQ ID NO: 284031 - DNA, 25 bp, Mus musculus
agccgagcaacatcaagcgcaagca

SEQ ID NO: 284032 - DNA, 25 bp, Mus musculus
ccctcccggaaatcgcttgcgatgg

SEQ ID NO: 284033 - DNA, 25 bp, Mus musculus
gggtcgcgactgtctcttgtctccc

SEQ ID NO: 284034 - DNA, 25 bp, Mus musculus
accctaggtatgcttccaggccctg

SEQ ID NO: 284035 - DNA, 25 bp, Mus musculus
ctagagctctttctgcgaaccctga

SEQ ID NO: 284036 - DNA, 25 bp, Mus musculus
gctgacctgtgacctatgacccttc

SEQ ID NO: 284037 - DNA, 25 bp, Mus musculus
ggcggagatgcagagaccaattata

SEQ ID NO: 284038 - DNA, 25 bp, Mus musculus
gctgttcctcgacatggctcctcgg

SEQ ID NO: 284039 - DNA, 25 bp, Mus musculus
caactcattcatttccgggtcgcga

SEQ ID NO: 284040 - DNA, 25 bp, Mus musculus
ttataacgcgaacgagcaccggtcg

SEQ ID NO: 284041 - DNA, 25 bp, Mus musculus
cccacgtccggatctcaagttctta

SEQ ID NO: 284042 - DNA, 25 bp, Mus musculus
tctgcgaaccctgaccctaggtatg

SEQ ID NO: 284043 - DNA, 25 bp, Mus musculus
ccgaactcgacgacgaaggcggaga

SEQ ID NO: 284044 - DNA, 25 bp, Mus musculus
ggtttgatccttcaaccgaactcga

SEQ ID NO: 284045 - DNA, 25 bp, Mus musculus
catcgctggcgacctgtgaactaca

SEQ ID NO: 284046 - DNA, 25 bp, Mus musculus
caggggcatccgctgggacatccgc

SEQ ID NO: 284047 - DNA, 25 bp, Mus musculus
cctgtgacctgcgtcctccggccgc

SEQ ID NO: 284048 - DNA, 25 bp, Mus musculus
cggttaaggcctgtgacctgcgtcc

SEQ ID NO: 284049 - DNA, 25 bp, Mus musculus
agggagagcgcggttcgcagggccc

SEQ ID NO: 284050 - DNA, 25 bp, Mus musculus
ggcaggctgtgcaggggcatccgct

SEQ ID NO: 284051 - DNA, 25 bp, Mus musculus
catccgctgggacatccgcggggac

SEQ ID NO: 284052 - DNA, 25 bp, Mus musculus
cccggttaaggcctgtgacctgcgt

SEQ ID NO: 284053 - DNA, 25 bp, Mus musculus
gcgcccactgccctcgcgacgcgcg

SEQ ID NO: 284054 - DNA, 25 bp, Mus musculus
gaggcggaccctgcggagggagagc

SEQ ID NO: 284055 - DNA, 25 bp, Mus musculus
agcaggaggcgaggcggaccctgcg

SEQ ID NO: 284056 - DNA, 25 bp, Mus musculus
gggcgcgtcccagcgccaacagcca

SEQ ID NO: 284057 - DNA, 25 bp, Mus musculus
cagggcgcgtcccagcgccaacagc

SEQ ID NO: 284058 - DNA, 25 bp, Mus musculus
tccgctgggacatccgcggggacac

SEQ ID NO: 284059 - DNA, 25 bp, Mus musculus
ctagtggcgggctgtgggccagcag

SEQ ID NO: 284060 - DNA, 25 bp, Mus musculus
acccattttgcgcatgcgccctatg

SEQ ID NO: 284061 - DNA, 25 bp, Mus musculus
tgccactgccacatgacgacctgag

SEQ ID NO: 284062 - DNA, 25 bp, Mus musculus
acaccgtgggaaggctcgccacctg

SEQ ID NO: 284063 - DNA, 25 bp, Mus musculus
ggtgggtcttactaggcctgcacta

SEQ ID NO: 284064 - DNA, 25 bp, Mus musculus
gcattgtctagtaccctgggcgcct

SEQ ID NO: 284065 - DNA, 25 bp, Mus musculus
ccacactgcccaggcattgtctagt

SEQ ID NO: 284066 - DNA, 25 bp, Mus musculus
gacaggccaagattctcaaagcatc

SEQ ID NO: 284067 - DNA, 25 bp, Mus musculus
acaaccctggtcgtgaggccacagc

SEQ ID NO: 284068 - DNA, 25 bp, Mus musculus
actgggcaccagagggtcacaatcc

SEQ ID NO: 284069 - DNA, 25 bp, Mus musculus
caaacgaaaagagaccgcgcggtgt

SEQ ID NO: 284070 - DNA, 25 bp, Mus musculus
taggcctgcactaagacccattttg

SEQ ID NO: 284071 - DNA, 25 bp, Mus musculus
agctccaggatggttcgcaagccca

SEQ ID NO: 284072 - DNA, 25 bp, Mus musculus
cgcaaggggttcagcaggcctagca

SEQ ID NO: 284073 - DNA, 25 bp, Mus musculus
gggtggccagcatctgcaaacgaaa

SEQ ID NO: 284074 - DNA, 25 bp, Mus musculus
cgcccgcacaagtcgagaaccagag

SEQ ID NO: 284075 - DNA, 25 bp, Mus musculus
tgcctatcccggaacacacatcgga

SEQ ID NO: 284076 - DNA, 25 bp, Mus musculus
gcccagaacctggtattcgagcctg

SEQ ID NO: 284077 - DNA, 25 bp, Mus musculus
tcgagaaccagagaattggcagtgc

SEQ ID NO: 284078 - DNA, 25 bp, Mus musculus
agaaccagagaattggcagtgcgag

SEQ ID NO: 284079 - DNA, 25 bp, Mus musculus
gcccgcccagaacctggtattcgag

SEQ ID NO: 284080 - DNA, 25 bp, Mus musculus
cgcacaagtcgagaaccagagaatt

SEQ ID NO: 284081 - DNA, 25 bp, Mus musculus
gaacctggtattcgagcctgctcct

SEQ ID NO: 284082 - DNA, 25 bp, Mus musculus
ccgcagttcagtgctgtcccgggtt

SEQ ID NO: 284083 - DNA, 25 bp, Mus musculus
cagttcagtgctgtcccgggttaac

SEQ ID NO: 284084 - DNA, 25 bp, Mus musculus
caggatgcctatcccggaacacaca

SEQ ID NO: 284085 - DNA, 25 bp, Mus musculus
tatcccggaacacacatcggacctg

SEQ ID NO: 284086 - DNA, 25 bp, Mus musculus
gaacacacatcggacctgcggccaa

SEQ ID NO: 284087 - DNA, 25 bp, Mus musculus
cgaagttaactggaggccccaggat

SEQ ID NO: 284088 - DNA, 25 bp, Mus musculus
gtgtctttccaagcccatcgcctgg

SEQ ID NO: 284089 - DNA, 25 bp, Mus musculus
tggaccgctcactcgtcctctggtt

SEQ ID NO: 284090 - DNA, 25 bp, Mus musculus
gtcggccaaggtgcttgcaaaattg

SEQ ID NO: 284091 - DNA, 25 bp, Mus musculus
tcacaccgcaaaggggcaggacttt

SEQ ID NO: 284092 - DNA, 25 bp, Mus musculus
cccagagtttcacgggtgaggattg

SEQ ID NO: 284093 - DNA, 25 bp, Mus musculus
gtgatccgcaccagcggtccagcta

SEQ ID NO: 284094 - DNA, 25 bp, Mus musculus
cagcaccagtgcagagtccttagtc

SEQ ID NO: 284095 - DNA, 25 bp, Mus musculus
ctttccgatctccaggctgtgcgca

SEQ ID NO: 284096 - DNA, 25 bp, Mus musculus
gggtttctggatgcgcttactcgtt

SEQ ID NO: 284097 - DNA, 25 bp, Mus musculus
cttgggcatcaacgggcgaccatcc

SEQ ID NO: 284098 - DNA, 25 bp, Mus musculus
caccgctcgtacagcttgggcatca

SEQ ID NO: 284099 - DNA, 25 bp, Mus musculus
ctgtcacgcgctagacgttgcttta

SEQ ID NO: 284100 - DNA, 25 bp, Mus musculus
tcttcccgaacttgaagccctgcgg

SEQ ID NO: 284101 - DNA, 25 bp, Mus musculus
agtttcacgtacacggaggtcctgc

SEQ ID NO: 284102 - DNA, 25 bp, Mus musculus
cgcaggactacgtcacagcggcgcg

SEQ ID NO: 284103 - DNA, 25 bp, Mus musculus
gcgtgcccatccctgtcgttctggg

SEQ ID NO: 284104 - DNA, 25 bp, Mus musculus
tctggggtcccgagaaacacgttca

SEQ ID NO: 284105 - DNA, 25 bp, Mus musculus
ccacaagatggagacggcacgcaag

SEQ ID NO: 284106 - DNA, 25 bp, Mus musculus
gcagcatcagggaccgcccgcagga

SEQ ID NO: 284107 - DNA, 25 bp, Mus musculus
caccggaacacaccggagggcggca

SEQ ID NO: 284108 - DNA, 25 bp, Mus musculus
catggctacgcacaccgagtacgca

SEQ ID NO: 284109 - DNA, 25 bp, Mus musculus
cgagtacgcaaagcaccagcgccgg

SEQ ID NO: 284110 - DNA, 25 bp, Mus musculus
acctttgcccgctgacattacgtct

SEQ ID NO: 284111 - DNA, 25 bp, Mus musculus
ggccgcgatgatgcacaggcgcact

SEQ ID NO: 284112 - DNA, 25 bp, Mus musculus
tgcacaggcgcactgcgcggttctc

SEQ ID NO: 284113 - DNA, 25 bp, Mus musculus
cgcccacttctcttcgttgtttctt

SEQ ID NO: 284114 - DNA, 25 bp, Mus musculus
tcgttgtttcttctccaaactccgc

SEQ ID NO: 284115 - DNA, 25 bp, Mus musculus
caagggaaatatgctgccacaagtc

SEQ ID NO: 284116 - DNA, 25 bp, Mus musculus
tatcttggtggtcatgatcccgggc

SEQ ID NO: 284117 - DNA, 25 bp, Mus musculus
tgacgcaggtgtccagcgcgctaat

SEQ ID NO: 284118 - DNA, 25 bp, Mus musculus
cagttcgcgctctaggttgtcccgc

SEQ ID NO: 284119 - DNA, 25 bp, Mus musculus
acctcggtgcgcagttgctccagct

SEQ ID NO: 284120 - DNA, 25 bp, Mus musculus
gcactccgcccgtagctgggtttct

SEQ ID NO: 284121 - DNA, 25 bp, Mus musculus
agctccaacttctggcgccgcagtt

SEQ ID NO: 284122 - DNA, 25 bp, Mus musculus
cgcagttctgcattctcacgggtca

SEQ ID NO: 284123 - DNA, 25 bp, Mus musculus
gcgggccagctcttctatcttggtg

SEQ ID NO: 284124 - DNA, 25 bp, Mus musculus
actccggcatcagctggtagtggta

SEQ ID NO: 284125 - DNA, 25 bp, Mus musculus
ggtttccaaggtacggtagatcagc

SEQ ID NO: 284126 - DNA, 25 bp, Mus musculus
gtagatcagcgagtcccgccacgca

SEQ ID NO: 284127 - DNA, 25 bp, Mus musculus
gcccaccttggccttgacgcaggtg

SEQ ID NO: 284128 - DNA, 25 bp, Mus musculus
ttctcacgggtcacgcgctcaatgc

SEQ ID NO: 284129 - DNA, 25 bp, Mus musculus
gctaatgcgcacatccacctcggtg

SEQ ID NO: 284130 - DNA, 25 bp, Mus musculus
gcaggttcctgctgaggacgatgcc

SEQ ID NO: 284131 - DNA, 25 bp, Mus musculus
atgcctgaggcgctacttctaaata

SEQ ID NO: 284132 - DNA, 25 bp, Mus musculus
gttcctgctgaggacgatgcctgag

SEQ ID NO: 284133 - DNA, 25 bp, Mus musculus
gcctgaggcgctacttctaaataga

SEQ ID NO: 284134 - DNA, 25 bp, Mus musculus
ctgaggcgctacttctaaatagagc

SEQ ID NO: 284135 - DNA, 25 bp, Mus musculus
gcgctacttctaaatagagctgctg

SEQ ID NO: 284136 - DNA, 25 bp, Mus musculus
tgctctgccaggcacactcgcgagt

SEQ ID NO: 284137 - DNA, 25 bp, Mus musculus
tctgccaggcacactcgcgagtggg

SEQ ID NO: 284138 - DNA, 25 bp, Mus musculus
aggcacactcgcgagtggggactca

SEQ ID NO: 284139 - DNA, 25 bp, Mus musculus
acactcgcgagtggggactcaggac

SEQ ID NO: 284140 - DNA, 25 bp, Mus musculus
ctcgcgagtggggactcaggactct

SEQ ID NO: 284141 - DNA, 25 bp, Mus musculus
gagctcggccgcaggttcctgctga

SEQ ID NO: 284142 - DNA, 25 bp, Mus musculus
cttctaaatagagctgctgctctgc

SEQ ID NO: 284143 - DNA, 25 bp, Mus musculus
aggacgatgcctgaggcgctacttc

SEQ ID NO: 284144 - DNA, 25 bp, Mus musculus
cagtggtggcgtgcacattgccata

SEQ ID NO: 284145 - DNA, 25 bp, Mus musculus
ctgcggtccatggagagccccattt

SEQ ID NO: 284146 - DNA, 25 bp, Mus musculus
cgcaggtagtaccagcagccgcgct

SEQ ID NO: 284147 - DNA, 25 bp, Mus musculus
gaggaagaaatagcgcaggtagtac

SEQ ID NO: 284148 - DNA, 25 bp, Mus musculus
tgagcgacacgaagaggaagaaata

SEQ ID NO: 284149 - DNA, 25 bp, Mus musculus
aggaactgaatgagcgacacgaaga

SEQ ID NO: 284150 - DNA, 25 bp, Mus musculus
cccaggatgatgaggaactgaatga

SEQ ID NO: 284151 - DNA, 25 bp, Mus musculus
tagatcatgaagaggaccaggccca

SEQ ID NO: 284152 - DNA, 25 bp, Mus musculus
accaggcccaggatgatgaggaact

SEQ ID NO: 284153 - DNA, 25 bp, Mus musculus
agtgtccacagggcgcactgtctgg

SEQ ID NO: 284154 - DNA, 25 bp, Mus musculus
ctggactcagtggtggcgtgcacat

SEQ ID NO: 284155 - DNA, 25 bp, Mus musculus
ctccgtggcgcgcaggctggactca

SEQ ID NO: 284156 - DNA, 25 bp, Mus musculus
ttgccatagatcatgaagaggacca

SEQ ID NO: 284157 - DNA, 25 bp, Mus musculus
ggcgtgcacattgccatagatcatg

SEQ ID NO: 284158 - DNA, 25 bp, Mus musculus
gtcgccgcagttcttcgacctcggg

SEQ ID NO: 284159 - DNA, 25 bp, Mus musculus
tccatcggcggcttctcgaggggta

SEQ ID NO: 284160 - DNA, 25 bp, Mus musculus
cttcgacctcgggtgccgagtctgg

SEQ ID NO: 284161 - DNA, 25 bp, Mus musculus
gggccgcaccgtggcattcatctgc

SEQ ID NO: 284162 - DNA, 25 bp, Mus musculus
gcaccgtggcattcatctgctcagg

SEQ ID NO: 284163 - DNA, 25 bp, Mus musculus
ggcattcatctgctcaggttctgga

SEQ ID NO: 284164 - DNA, 25 bp, Mus musculus
tctgctcaggttctggacaacgggg

SEQ ID NO: 284165 - DNA, 25 bp, Mus musculus
gccgccagattccaggccaccaggg

SEQ ID NO: 284166 - DNA, 25 bp, Mus musculus
tgccatcccgccgtagctctgaccc

SEQ ID NO: 284167 - DNA, 25 bp, Mus musculus
ccagaagggccactcacacttaatt

SEQ ID NO: 284168 - DNA, 25 bp, Mus musculus
cactcacacttaattggcaccttgg

SEQ ID NO: 284169 - DNA, 25 bp, Mus musculus
gcagttcttcgacctcgggtgccga

SEQ ID NO: 284170 - DNA, 25 bp, Mus musculus
tggcaccttggggttccaaggacac

SEQ ID NO: 284171 - DNA, 25 bp, Mus musculus
tcacacttaattggcaccttggggt

SEQ ID NO: 284172 - DNA, 25 bp, Mus musculus
cgaagtccgatgacctgtgcgtccc

SEQ ID NO: 284173 - DNA, 25 bp, Mus musculus
agctgctttgcggagcactttcaaa

SEQ ID NO: 284174 - DNA, 25 bp, Mus musculus
cctccgcacactgggtagtgattta

SEQ ID NO: 284175 - DNA, 25 bp, Mus musculus
aacgtatcttaagcgtccagagggc

SEQ ID NO: 284176 - DNA, 25 bp, Mus musculus
cacggttactttggactggtcagca

SEQ ID NO: 284177 - DNA, 25 bp, Mus musculus
cttcgcgcagaaagccggctacttc

SEQ ID NO: 284178 - DNA, 25 bp, Mus musculus
ttgcgcatgcgtactagctgctttg

SEQ ID NO: 284179 - DNA, 25 bp, Mus musculus
cctgagcacgctgggcatcccggag

SEQ ID NO: 284180 - DNA, 25 bp, Mus musculus
tccctccgagggctgtagctgcctt

SEQ ID NO: 284181 - DNA, 25 bp, Mus musculus
gtagctgccttctgagctcccagga

SEQ ID NO: 284182 - DNA, 25 bp, Mus musculus
agctcccaggaaggatggatcccgg

SEQ ID NO: 284183 - DNA, 25 bp, Mus musculus
gcagatcacctgcaccgtggagggc

SEQ ID NO: 284184 - DNA, 25 bp, Mus musculus
cggctacttcctgtgcctgagcacg

SEQ ID NO: 284185 - DNA, 25 bp, Mus musculus
actggtcagcagtgcttgcgcatgc

SEQ ID NO: 284186 - DNA, 25 bp, Mus musculus
cgctgaggccctgttagtatcaccc

SEQ ID NO: 284187 - DNA, 25 bp, Mus musculus
aaaccggtgtgctctcggagtctca

SEQ ID NO: 284188 - DNA, 25 bp, Mus musculus
tcagtttccctctctgtaggtagag

SEQ ID NO: 284189 - DNA, 25 bp, Mus musculus
tagaggcggtggtatcctacctgcc

SEQ ID NO: 284190 - DNA, 25 bp, Mus musculus
cgacctccgtaggaacggcccatgg

SEQ ID NO: 284191 - DNA, 25 bp, Mus musculus
ccatacacgggaagcaccagcgcag

SEQ ID NO: 284192 - DNA, 25 bp, Mus musculus
gcggcgagcagcaagcagctaagcc

SEQ ID NO: 284193 - DNA, 25 bp, Mus musculus
tgttcttttactgcgcgtcggccga

SEQ ID NO: 284194 - DNA, 25 bp, Mus musculus
ctcgagtgctggtaccagataggtc

SEQ ID NO: 284195 - DNA, 25 bp, Mus musculus
atgcccagtagggtcatcgcggcca

SEQ ID NO: 284196 - DNA, 25 bp, Mus musculus
tggaacagcagctgcgcagccagcg

SEQ ID NO: 284197 - DNA, 25 bp, Mus musculus
agccgcagcttcaggtagcccggca

SEQ ID NO: 284198 - DNA, 25 bp, Mus musculus
cagctaagcccgaggacctgtgcca

SEQ ID NO: 284199 - DNA, 25 bp, Mus musculus
ccagataggtcgtggaaaatgagca

SEQ ID NO: 284200 - DNA, 25 bp, Mus musculus
gcaggctcatccaaatcctccggtt

SEQ ID NO: 284201 - DNA, 25 bp, Mus musculus
gccgacaggagtcgcccgaggactc

SEQ ID NO: 284202 - DNA, 25 bp, Mus musculus
gcgggtcccagacgctggatctcct

SEQ ID NO: 284203 - DNA, 25 bp, Mus musculus
tctactcggtacttgcgacggcgca

SEQ ID NO: 284204 - DNA, 25 bp, Mus musculus
aatcctccggttgcaggaagctgcg

SEQ ID NO: 284205 - DNA, 25 bp, Mus musculus
ctgcggcctcctgccagttggcaaa

SEQ ID NO: 284206 - DNA, 25 bp, Mus musculus
cagttggcaaagcaggcgggtccca

SEQ ID NO: 284207 - DNA, 25 bp, Mus musculus
tcctccgtggcgtcgcttgtcagca

SEQ ID NO: 284208 - DNA, 25 bp, Mus musculus
ccaggcttaagtaccacaaccgctg

SEQ ID NO: 284209 - DNA, 25 bp, Mus musculus
cacaaccgctggcagttgacggaca

SEQ ID NO: 284210 - DNA, 25 bp, Mus musculus
ggagagagcgctgtcagcctccctc

SEQ ID NO: 284211 - DNA, 25 bp, Mus musculus
gacatcccggtctactcggtacttg

SEQ ID NO: 284212 - DNA, 25 bp, Mus musculus
gctgcctccgatggccgacaggagt

SEQ ID NO: 284213 - DNA, 25 bp, Mus musculus
ttgacggacagagaactggcgcccg

SEQ ID NO: 284214 - DNA, 25 bp, Mus musculus
tgccgtggagactcgtaggtaccct

SEQ ID NO: 284215 - DNA, 25 bp, Mus musculus
cctgtgggcggagccataggcatca

SEQ ID NO: 284216 - DNA, 25 bp, Mus musculus
aatgccagatagtctcgggactgtg

SEQ ID NO: 284217 - DNA, 25 bp, Mus musculus
tgggtcccgaatgccagatagtctc

SEQ ID NO: 284218 - DNA, 25 bp, Mus musculus
ggctcaggtagaatctgggtcccga

SEQ ID NO: 284219 - DNA, 25 bp, Mus musculus
cagtgactgtcgaagcctggaggca

SEQ ID NO: 284220 - DNA, 25 bp, Mus musculus
gaccgggcctctctgtgaacagtga

SEQ ID NO: 284221 - DNA, 25 bp, Mus musculus
tcgatggcctaagccttccggaagg

SEQ ID NO: 284222 - DNA, 25 bp, Mus musculus
ccgcggttcttctcgatggcctaag

SEQ ID NO: 284223 - DNA, 25 bp, Mus musculus
agtctcgttgggttgcgggctctct

SEQ ID NO: 284224 - DNA, 25 bp, Mus musculus
ccgctctagcttgagagtctcgttg

SEQ ID NO: 284225 - DNA, 25 bp, Mus musculus
taccctgggctagccgctctagctt

SEQ ID NO: 284226 - DNA, 25 bp, Mus musculus
agactcgtaggtaccctgggctagc

SEQ ID NO: 284227 - DNA, 25 bp, Mus musculus
ataggcatcacctggcgcgtagccc

SEQ ID NO: 284228 - DNA, 25 bp, Mus musculus
aagcgtttgggtttaggctacagtg

SEQ ID NO: 284229 - DNA, 25 bp, Mus musculus
ctcactggcgctgctttggtttctg

SEQ ID NO: 284230 - DNA, 25 bp, Mus musculus
tgctttggtttctgggacttccgtg

SEQ ID NO: 284231 - DNA, 25 bp, Mus musculus
ggctggcgctttctgcgtatcgtct

SEQ ID NO: 284232 - DNA, 25 bp, Mus musculus
cgtatcgtctgcaagacggcgaggc

SEQ ID NO: 284233 - DNA, 25 bp, Mus musculus
gggcgggacctgatactaaggtaca

SEQ ID NO: 284234 - DNA, 25 bp, Mus musculus
aaagaacgcggccagggtctgtgac

SEQ ID NO: 284235 - DNA, 25 bp, Mus musculus
ctacagtgtggaaaaagaacgcggc

SEQ ID NO: 284236 - DNA, 25 bp, Mus musculus
ctggagcaggaacagcctctgtggc

SEQ ID NO: 284237 - DNA, 25 bp, Mus musculus
gtacctgcggtctcagctgtgtgct

SEQ ID NO: 284238 - DNA, 25 bp, Mus musculus
gtctcagctgtgtgctccgcaggat

SEQ ID NO: 284239 - DNA, 25 bp, Mus musculus
tgtgctccgcaggatgcgggctcct

SEQ ID NO: 284240 - DNA, 25 bp, Mus musculus
gaacagcctctgtggcctcactggc

SEQ ID NO: 284241 - DNA, 25 bp, Mus musculus
cctgatactaaggtacacgctgggg

SEQ ID NO: 284242 - DNA, 25 bp, Mus musculus
cccatccgtctggtcaaggtcaatg

SEQ ID NO: 284243 - DNA, 25 bp, Mus musculus
ggcgctaccgagtgcaactgcagca

SEQ ID NO: 284244 - DNA, 25 bp, Mus musculus
ggtttcctacgacacaagagccttc

SEQ ID NO: 284245 - DNA, 25 bp, Mus musculus
acagccgtatcctcacgcatgtgta

SEQ ID NO: 284246 - DNA, 25 bp, Mus musculus
ttctcgtgggccagatcaaccagca

SEQ ID NO: 284247 - DNA, 25 bp, Mus musculus
ctgcggcgtttcgatggttatgtta

SEQ ID NO: 284248 - DNA, 25 bp, Mus musculus
tgacagtgccaccaacaagaagatt

SEQ ID NO: 284249 - DNA, 25 bp, Mus musculus
attgcccacagcgttttccgaaagg

SEQ ID NO: 284250 - DNA, 25 bp, Mus musculus
cggccagccatctgggaggagttca

SEQ ID NO: 284251 - DNA, 25 bp, Mus musculus
gcgatagcgcctacctctcaggtgc

SEQ ID NO: 284252 - DNA, 25 bp, Mus musculus
gctgtcagactgcaaagcccggtcc

SEQ ID NO: 284253 - DNA, 25 bp, Mus musculus
tcttccctgcaggtgacgtgctagt

SEQ ID NO: 284254 - DNA, 25 bp, Mus musculus
ggctacatgtatttccgtgaccgca

SEQ ID NO: 284255 - DNA, 25 bp, Mus musculus
tgtattcaccctaggtcggctcctg

SEQ ID NO: 284256 - DNA, 25 bp, Mus musculus
acactctctggccttgggtagtccg

SEQ ID NO: 284257 - DNA, 25 bp, Mus musculus
gaggtctctcccacgctaaggtagc

SEQ ID NO: 284258 - DNA, 25 bp, Mus musculus
agtaaagttctgcacggcgggtcta

SEQ ID NO: 284259 - DNA, 25 bp, Mus musculus
gacctagcctacttcagtttcgcca

SEQ ID NO: 284260 - DNA, 25 bp, Mus musculus
gcgacgccagaacctggacaactaa

SEQ ID NO: 284261 - DNA, 25 bp, Mus musculus
ggcgccttcaggacatctgggttat

SEQ ID NO: 284262 - DNA, 25 bp, Mus musculus
tctgggttatggtgaaggattatca

SEQ ID NO: 284263 - DNA, 25 bp, Mus musculus
tcatctacagtgacgggacgggttc

SEQ ID NO: 284264 - DNA, 25 bp, Mus musculus
ttcccacctatcgagtaaagttctg

SEQ ID NO: 284265 - DNA, 25 bp, Mus musculus
cgtttcttgggtgccggcagcaacc

SEQ ID NO: 284266 - DNA, 25 bp, Mus musculus
tagcggctgcaggttggcgtttctt

SEQ ID NO: 284267 - DNA, 25 bp, Mus musculus
ggtctacgaggtctctcccacgcta

SEQ ID NO: 284268 - DNA, 25 bp, Mus musculus
cgacttgcgcgtcgggtggataaaa

SEQ ID NO: 284269 - DNA, 25 bp, Mus musculus
tgggtagtccgtcgacctagcctac

SEQ ID NO: 284270 - DNA, 25 bp, Mus musculus
ccctgaaaaacgctcaagagtgctg

SEQ ID NO: 284271 - DNA, 25 bp, Mus musculus
gccacctgagagcttactgacctta

SEQ ID NO: 284272 - DNA, 25 bp, Mus musculus
actgaccttatcacgctgcagctgg

SEQ ID NO: 284273 - DNA, 25 bp, Mus musculus
gtcggagctactagactccagctta

SEQ ID NO: 284274 - DNA, 25 bp, Mus musculus
cagctggcgcactctgtgcttccga

SEQ ID NO: 284275 - DNA, 25 bp, Mus musculus
accttggctcaaagtgctcggaccc

SEQ ID NO: 284276 - DNA, 25 bp, Mus musculus
cggcgacgcttcttttgtgcaactg

SEQ ID NO: 284277 - DNA, 25 bp, Mus musculus
gcctggtctccatgctagcccgaga

SEQ ID NO: 284278 - DNA, 25 bp, Mus musculus
ttcgaccacgccgagagcacgtacg

SEQ ID NO: 284279 - DNA, 25 bp, Mus musculus
ctggctcagcctaccgtggaaactc

SEQ ID NO: 284280 - DNA, 25 bp, Mus musculus
aactcaagatacaagggccgccgtg

SEQ ID NO: 284281 - DNA, 25 bp, Mus musculus
tcagcctgcctaggaaacgcaagga

SEQ ID NO: 284282 - DNA, 25 bp, Mus musculus
acgcaaggatctgcttcaacgccta

SEQ ID NO: 284283 - DNA, 25 bp, Mus musculus
gagcactgcggtttcgggaaccacc

SEQ ID NO: 284284 - DNA, 25 bp, Mus musculus
ctttggatcccacggtgtgcgaggc

SEQ ID NO: 284285 - DNA, 25 bp, Mus musculus
cgcagagcaaggttccgtgggtccc

SEQ ID NO: 284286 - DNA, 25 bp, Mus musculus
cctctgaggcaggtcctggtctcgc

SEQ ID NO: 284287 - DNA, 25 bp, Mus musculus
aggtcctggtctcgcacacagcgca

SEQ ID NO: 284288 - DNA, 25 bp, Mus musculus
cacagcgcatcctggaggacaagga

SEQ ID NO: 284289 - DNA, 25 bp, Mus musculus
acaaggagggcacgttgcccgccgc

SEQ ID NO: 284290 - DNA, 25 bp, Mus musculus
cctctgctggttcctggacgaggca

SEQ ID NO: 284291 - DNA, 25 bp, Mus musculus
ggctgctgtctgtgcccttcgagaa

SEQ ID NO: 284292 - DNA, 25 bp, Mus musculus
gcccttcgagaagcattccacattg

SEQ ID NO: 284293 - DNA, 25 bp, Mus musculus
cgagaagcattccacattgtagggg

SEQ ID NO: 284294 - DNA, 25 bp, Mus musculus
gtgcgccatgcacgccgtgggcact

SEQ ID NO: 284295 - DNA, 25 bp, Mus musculus
catgcacgccgtgggcacttcgggt

SEQ ID NO: 284296 - DNA, 25 bp, Mus musculus
cgaagctttggatcccacggtgtgc

SEQ ID NO: 284297 - DNA, 25 bp, Mus musculus
cccagaccgaacagaccagtgtgag

SEQ ID NO: 284298 - DNA, 25 bp, Mus musculus
agtaagtggccatggcacggtcttc

SEQ ID NO: 284299 - DNA, 25 bp, Mus musculus
aggtcttcttgcaggcgtcgctcaa

SEQ ID NO: 284300 - DNA, 25 bp, Mus musculus
gctggagtcgcccaagaaaaccatc

SEQ ID NO: 284301 - DNA, 25 bp, Mus musculus
ttacgtggctcatcaccctgggcgt

SEQ ID NO: 284302 - DNA, 25 bp, Mus musculus
ttctgccgagcagaccgttacgtgg

SEQ ID NO: 284303 - DNA, 25 bp, Mus musculus
agccgccgcagcgatgaattctgcc

SEQ ID NO: 284304 - DNA, 25 bp, Mus musculus
ttcctgcgccgctaatgaaaaggca

SEQ ID NO: 284305 - DNA, 25 bp, Mus musculus
gcgtctttcttctccggtgatgtca

SEQ ID NO: 284306 - DNA, 25 bp, Mus musculus
gcattctgggaagcgcttactaatc

SEQ ID NO: 284307 - DNA, 25 bp, Mus musculus
cggcgggctagctcaagagagcatt

SEQ ID NO: 284308 - DNA, 25 bp, Mus musculus
ctaacgagcatgtgcgtgccatccc

SEQ ID NO: 284309 - DNA, 25 bp, Mus musculus
tctggtcacagatctaacgagcatg

SEQ ID NO: 284310 - DNA, 25 bp, Mus musculus
cccgggaccatcgagaaagtaagtg

SEQ ID NO: 284311 - DNA, 25 bp, Mus musculus
gacgctcgttcctgcccgagtgaga

SEQ ID NO: 284312 - DNA, 25 bp, Mus musculus
tgagcttcgcgctcttcctcgtgca

SEQ ID NO: 284313 - DNA, 25 bp, Mus musculus
tcttgattgggccttcagtcctgca

SEQ ID NO: 284314 - DNA, 25 bp, Mus musculus
atgccgtgctgctctatcgacgacg

SEQ ID NO: 284315 - DNA, 25 bp, Mus musculus
atactgggctccgacgcagaggtga

SEQ ID NO: 284316 - DNA, 25 bp, Mus musculus
tgcgagcacagacgctccgaagcct

SEQ ID NO: 284317 - DNA, 25 bp, Mus musculus
acaagctcactcatgctgccttcga

SEQ ID NO: 284318 - DNA, 25 bp, Mus musculus
tgccttcgaactctgcagttcctcg

SEQ ID NO: 284319 - DNA, 25 bp, Mus musculus
cttccagccagagaaagacgcacta

SEQ ID NO: 284320 - DNA, 25 bp, Mus musculus
aagacgcactactggcggctctgga

SEQ ID NO: 284321 - DNA, 25 bp, Mus musculus
tgcgcgcagacctcgagcagatcct

SEQ ID NO: 284322 - DNA, 25 bp, Mus musculus
agatcctgcagcagcgcgcactcgg

SEQ ID NO: 284323 - DNA, 25 bp, Mus musculus
actcggagcccggagaatagaaggt

SEQ ID NO: 284324 - DNA, 25 bp, Mus musculus
ctgcagggtgccattcgtctgagag

SEQ ID NO: 284325 - DNA, 25 bp, Mus musculus
ccctgagcgcagtgggctcttgatt

SEQ ID NO: 284326 - DNA, 25 bp, Mus musculus
agtctctaccggagggaggttgcta

SEQ ID NO: 284327 - DNA, 25 bp, Mus musculus
tgacgtcttgtgaccgggttattgc

SEQ ID NO: 284328 - DNA, 25 bp, Mus musculus
tcggcggaaagcagtggaagctttt

SEQ ID NO: 284329 - DNA, 25 bp, Mus musculus
cagtggaagcttttaaaggcgtagc

SEQ ID NO: 284330 - DNA, 25 bp, Mus musculus
aaggcgtagccttgtcatgcctctc

SEQ ID NO: 284331 - DNA, 25 bp, Mus musculus
atgcctctctccaggactcacagta

SEQ ID NO: 284332 - DNA, 25 bp, Mus musculus
gactcacagtatgacccgcgggcca

SEQ ID NO: 284333 - DNA, 25 bp, Mus musculus
acttccctttaaggagcgtgtcagg

SEQ ID NO: 284334 - DNA, 25 bp, Mus musculus
tgggacctggatgtgtccttcccgc

SEQ ID NO: 284335 - DNA, 25 bp, Mus musculus
aagctgcttaaaggcgacgcgtggc

SEQ ID NO: 284336 - DNA, 25 bp, Mus musculus
cgcggacggctactttccagaggag

SEQ ID NO: 284337 - DNA, 25 bp, Mus musculus
cccttgcgcggtgcaccgggactag

SEQ ID NO: 284338 - DNA, 25 bp, Mus musculus
actaggcgggactcaagtctctacc

SEQ ID NO: 284339 - DNA, 25 bp, Mus musculus
aggttgctatgcacttgggctcggc

SEQ ID NO: 284340 - DNA, 25 bp, Mus musculus
agtagtccttcacgcacacctgcag

SEQ ID NO: 284341 - DNA, 25 bp, Mus musculus
agctaccagcgagcggttcacacca

SEQ ID NO: 284342 - DNA, 25 bp, Mus musculus
cagggcaccggaccctctatggctt

SEQ ID NO: 284343 - DNA, 25 bp, Mus musculus
tattttgcacagacaccagaggcta

SEQ ID NO: 284344 - DNA, 25 bp, Mus musculus
cgtgtgcttttgagagcccatccca

SEQ ID NO: 284345 - DNA, 25 bp, Mus musculus
cagcccaccgtgtgtggcacgagca

SEQ ID NO: 284346 - DNA, 25 bp, Mus musculus
gggctgagcctttcgtcggagctca

SEQ ID NO: 284347 - DNA, 25 bp, Mus musculus
ctctatggcttttccaggggcagga

SEQ ID NO: 284348 - DNA, 25 bp, Mus musculus
ttcgcgcgcaaagcagtagtccttc

SEQ ID NO: 284349 - DNA, 25 bp, Mus musculus
gcttgacgaattccttggccacctc

SEQ ID NO: 284350 - DNA, 25 bp, Mus musculus
cgcgtgtccgacttgagcttgacga

SEQ ID NO: 284351 - DNA, 25 bp, Mus musculus
acaccgccacatacgttagtagttc

SEQ ID NO: 284352 - DNA, 25 bp, Mus musculus
acacctgcagctcgtagcactcggg

SEQ ID NO: 284353 - DNA, 25 bp, Mus musculus
ttggccacctcatcgttgctgcgct

SEQ ID NO: 284354 - DNA, 25 bp, Mus musculus
ttaaggcttgcagggtcttcttgta

SEQ ID NO: 284355 - DNA, 25 bp, Mus musculus
ctcttacatcatcgcggagtccctt

SEQ ID NO: 284356 - DNA, 25 bp, Mus musculus
atgtaacgcgggagtctcggacacc

SEQ ID NO: 284357 - DNA, 25 bp, Mus musculus
cttcttgtaaacgtgatttttctgc

SEQ ID NO: 284358 - DNA, 25 bp, Mus musculus
gtagattaaggcttgcagggtcttc

SEQ ID NO: 284359 - DNA, 25 bp, Mus musculus
acctcgaaattgtgcggcgtggtgc

SEQ ID NO: 284360 - DNA, 25 bp, Mus musculus
ggtggccgtccacacctcgaaattg

SEQ ID NO: 284361 - DNA, 25 bp, Mus musculus
ccctcgcactcatagcagtaggtgg

SEQ ID NO: 284362 - DNA, 25 bp, Mus musculus
cgcactcggtgcatcgcatgccctg

SEQ ID NO: 284363 - DNA, 25 bp, Mus musculus
cgtggcacttaacgccgcactcggt

SEQ ID NO: 284364 - DNA, 25 bp, Mus musculus
gtcctggcacttctcgtggcactta

SEQ ID NO: 284365 - DNA, 25 bp, Mus musculus
atccgcattgagcaggtcctggcac

SEQ ID NO: 284366 - DNA, 25 bp, Mus musculus
caggcaatccgcattgagcaggtcc

SEQ ID NO: 284367 - DNA, 25 bp, Mus musculus
tgatttttctgcagaggaacaaggg

SEQ ID NO: 284368 - DNA, 25 bp, Mus musculus
tcgcacggagtactggtgcacagag

SEQ ID NO: 284369 - DNA, 25 bp, Mus musculus
cgttgggctgcgaagtcgtatagta

SEQ ID NO: 284370 - DNA, 25 bp, Mus musculus
gatgctgttgctggtctcactccta

SEQ ID NO: 284371 - DNA, 25 bp, Mus musculus
tgttgctggtctcactcctatagtc

SEQ ID NO: 284372 - DNA, 25 bp, Mus musculus
ctgtgcatggagtcactgtaggact

SEQ ID NO: 284373 - DNA, 25 bp, Mus musculus
gctggtctcactcctatagtcactg

SEQ ID NO: 284374 - DNA, 25 bp, Mus musculus
actcctatagtcactgtcccggtca

SEQ ID NO: 284375 - DNA, 25 bp, Mus musculus
ggtcatccaccgcactgtcggggtc

SEQ ID NO: 284376 - DNA, 25 bp, Mus musculus
gagtcactgtaggactcccgggacc

SEQ ID NO: 284377 - DNA, 25 bp, Mus musculus
cggtcgcacggagtactggtgcaca

SEQ ID NO: 284378 - DNA, 25 bp, Mus musculus
actcctcatagctgtgcatggagtc

SEQ ID NO: 284379 - DNA, 25 bp, Mus musculus
cgcccgcggctcagagaactcctca

SEQ ID NO: 284380 - DNA, 25 bp, Mus musculus
agagaactcctcatagctgtgcatg

SEQ ID NO: 284381 - DNA, 25 bp, Mus musculus
ctccacagccacctgagcgcccgcg

SEQ ID NO: 284382 - DNA, 25 bp, Mus musculus
agtccctcatccactcgtgtgagtg

SEQ ID NO: 284383 - DNA, 25 bp, Mus musculus
cacctagggctgatccaagtgcgcc

SEQ ID NO: 284384 - DNA, 25 bp, Mus musculus
ccagggcctataaaccgtctacaca

SEQ ID NO: 284385 - DNA, 25 bp, Mus musculus
agaggttgctcctacgctcagtccg

SEQ ID NO: 284386 - DNA, 25 bp, Mus musculus
cactgtttagggcatactggggatc

SEQ ID NO: 284387 - DNA, 25 bp, Mus musculus
ccctactctccaaatgcggagcgtg

SEQ ID NO: 284388 - DNA, 25 bp, Mus musculus
tcccacgcacagcagagacatgact

SEQ ID NO: 284389 - DNA, 25 bp, Mus musculus
caggggtcacacctctcccgttatt

SEQ ID NO: 284390 - DNA, 25 bp, Mus musculus
cgccttaaagggctcgtaaactgcg

SEQ ID NO: 284391 - DNA, 25 bp, Mus musculus
agacatgactccaggcggctagagc

SEQ ID NO: 284392 - DNA, 25 bp, Mus musculus
cgcccaaggtctcccgctgtagagt

SEQ ID NO: 284393 - DNA, 25 bp, Mus musculus
cgcatcgctacatggccagtcggtc

SEQ ID NO: 284394 - DNA, 25 bp, Mus musculus
ggtatcggcacgcatcgctacatgg

SEQ ID NO: 284395 - DNA, 25 bp, Mus musculus
tcgtgtgagtgacaggaagagcacc

SEQ ID NO: 284396 - DNA, 25 bp, Mus musculus
gtaaatgacggcggccaggaagctc

SEQ ID NO: 284397 - DNA, 25 bp, Mus musculus
ccgcacaggaaggagcagggacttt

SEQ ID NO: 284398 - DNA, 25 bp, Mus musculus
aaggagcagggactttcctgtcgca

SEQ ID NO: 284399 - DNA, 25 bp, Mus musculus
gcagggactttcctgtcgcagcctc

SEQ ID NO: 284400 - DNA, 25 bp, Mus musculus
ggactttcctgtcgcagcctcggct

SEQ ID NO: 284401 - DNA, 25 bp, Mus musculus
tcggctgtcctttgcctcggcacag

SEQ ID NO: 284402 - DNA, 25 bp, Mus musculus
tgtcctttgcctcggcacagctgca

SEQ ID NO: 284403 - DNA, 25 bp, Mus musculus
tttgcctcggcacagctgcaggtag

SEQ ID NO: 284404 - DNA, 25 bp, Mus musculus
gcggggcgctgcctagacaccgcat

SEQ ID NO: 284405 - DNA, 25 bp, Mus musculus
ggcgctgcctagacaccgcattggc

SEQ ID NO: 284406 - DNA, 25 bp, Mus musculus
gcctagacaccgcattggcggctca

SEQ ID NO: 284407 - DNA, 25 bp, Mus musculus
agacaccgcattggcggctcagcag

SEQ ID NO: 284408 - DNA, 25 bp, Mus musculus
attggcggctcagcagcgcgcatgc

SEQ ID NO: 284409 - DNA, 25 bp, Mus musculus
ccaggaagctcaggggccgcacagg

SEQ ID NO: 284410 - DNA, 25 bp, Mus musculus
cgccatgttcggctccaatcgcggt

SEQ ID NO: 284411 - DNA, 25 bp, Mus musculus
cgtggcggacaagaccagttcaatt

SEQ ID NO: 284412 - DNA, 25 bp, Mus musculus
caattgggaggacgtgaagactgac

SEQ ID NO: 284413 - DNA, 25 bp, Mus musculus
ctgacaagcagagggagaactactt

SEQ ID NO: 284414 - DNA, 25 bp, Mus musculus
ctacttgggcaactcgctgatggcg

SEQ ID NO: 284415 - DNA, 25 bp, Mus musculus
gcgacctcacctggtacgcgaagga

SEQ ID NO: 284416 - DNA, 25 bp, Mus musculus
ctgctggccgcactgtaagtgcctg

SEQ ID NO: 284417 - DNA, 25 bp, Mus musculus
cgcacgtggcactaggatgaaggat

SEQ ID NO: 284418 - DNA, 25 bp, Mus musculus
ccagagaagccctgaacgcccttta

SEQ ID NO: 284419 - DNA, 25 bp, Mus musculus
acgccctttagaaagaggatcttga

SEQ ID NO: 284420 - DNA, 25 bp, Mus musculus
ggatcttgattgataaggccctcgg

SEQ ID NO: 284421 - DNA, 25 bp, Mus musculus
tgataaggccctcggatacgcagtg

SEQ ID NO: 284422 - DNA, 25 bp, Mus musculus
tccgactagagaccgcgggtactga

SEQ ID NO: 284423 - DNA, 25 bp, Mus musculus
tactgaaggctgtgcagtggctcca

SEQ ID NO: 284424 - DNA, 25 bp, Mus musculus
ccgtccgaacaatcaggaaagtggc

SEQ ID NO: 284425 - DNA, 25 bp, Mus musculus
attttggacctggagcggctacatc

SEQ ID NO: 284426 - DNA, 25 bp, Mus musculus
caccgagaccttccgtgtggggctc

SEQ ID NO: 284427 - DNA, 25 bp, Mus musculus
gcgatgtgatccagggccagaactt

SEQ ID NO: 284428 - DNA, 25 bp, Mus musculus
tggagcggctacatccagcggccac

SEQ ID NO: 284429 - DNA, 25 bp, Mus musculus
tagtccgggcgggactgattgcact

SEQ ID NO: 284430 - DNA, 25 bp, Mus musculus
aagtatattttggacctggagcggc

SEQ ID NO: 284431 - DNA, 25 bp, Mus musculus
cgcgctcatggccaagtatattttg

SEQ ID NO: 284432 - DNA, 25 bp, Mus musculus
cgctacgcgctcatggccaagtata

SEQ ID NO: 284433 - DNA, 25 bp, Mus musculus
atccgcaggaccgtggtcttggcgc

SEQ ID NO: 284434 - DNA, 25 bp, Mus musculus
acgcaggcgcatccgcaggaccgtg

SEQ ID NO: 284435 - DNA, 25 bp, Mus musculus
gaacttcgtgacacgcaggcgcatc

SEQ ID NO: 284436 - DNA, 25 bp, Mus musculus
tccagggccagaacttcgtgacacg

SEQ ID NO: 284437 - DNA, 25 bp, Mus musculus
caacggcatctcctggagctccggg

SEQ ID NO: 284438 - DNA, 25 bp, Mus musculus
gttggtgatggagtacctgcccagc

SEQ ID NO: 284439 - DNA, 25 bp, Mus musculus
cggacttcggcctcgctaagctgct

SEQ ID NO: 284440 - DNA, 25 bp, Mus musculus
gctcatgtgaagatcgcggacttcg

SEQ ID NO: 284441 - DNA, 25 bp, Mus musculus
tgcgcgcaacatcttggtggagagc

SEQ ID NO: 284442 - DNA, 25 bp, Mus musculus
tacaccgtgacctggctgcgcgcaa

SEQ ID NO: 284443 - DNA, 25 bp, Mus musculus
gtgcgcgccgctgcgtacaccgtga

SEQ ID NO: 284444 - DNA, 25 bp, Mus musculus
ctctctgcagggcatggagtacctg

SEQ ID NO: 284445 - DNA, 25 bp, Mus musculus
tgctatcatggctctctgcagggca

SEQ ID NO: 284446 - DNA, 25 bp, Mus musculus
atcccgggcccacgtgctatcatgg

SEQ ID NO: 284447 - DNA, 25 bp, Mus musculus
cgcttggcagatctgcaaggtgcga

SEQ ID NO: 284448 - DNA, 25 bp, Mus musculus
tgcgagacttcctgcagcgccatcg

SEQ ID NO: 284449 - DNA, 25 bp, Mus musculus
cgctgttcgcaggtcgccagagcct

SEQ ID NO: 284450 - DNA, 25 bp, Mus musculus
cgagagctactgtcgctgttcgcag

SEQ ID NO: 284451 - DNA, 25 bp, Mus musculus
cgaccgcctactgctgttcgcttgg

SEQ ID NO: 284452 - DNA, 25 bp, Mus musculus
cgagcctcgaccttttgggtgctgc

SEQ ID NO: 284453 - DNA, 25 bp, Mus musculus
ttataaggagcatccctgcccactg

SEQ ID NO: 284454 - DNA, 25 bp, Mus musculus
gcgcgaggcagttataaggagcatc

SEQ ID NO: 284455 - DNA, 25 bp, Mus musculus
gtgttcccgccaaggcccatgggcg

SEQ ID NO: 284456 - DNA, 25 bp, Mus musculus
tcgaccttttgggtgctgcttgcct

SEQ ID NO: 284457 - DNA, 25 bp, Mus musculus
ttggacacgcgtggataaccgaggg

SEQ ID NO: 284458 - DNA, 25 bp, Mus musculus
cgtgactcgagcctcgaccttttgg

SEQ ID NO: 284459 - DNA, 25 bp, Mus musculus
gcccactgcctcctgccaccatgcg

SEQ ID NO: 284460 - DNA, 25 bp, Mus musculus
cgctgctactgatgctcctggctct

SEQ ID NO: 284461 - DNA, 25 bp, Mus musculus
tgctactgatgctcctggctctggg

SEQ ID NO: 284462 - DNA, 25 bp, Mus musculus
aagctctgcggccaccacctggtgc

SEQ ID NO: 284463 - DNA, 25 bp, Mus musculus
cgaggccacgcagcctgtggagacc

SEQ ID NO: 284464 - DNA, 25 bp, Mus musculus
cacgcagcctgtggagacccgggac

SEQ ID NO: 284465 - DNA, 25 bp, Mus musculus
gctgcttgcctgtgttcccgccaag

SEQ ID NO: 284466 - DNA, 25 bp, Mus musculus
agcaacatccgcgagttcctgcgcg

SEQ ID NO: 284467 - DNA, 25 bp, Mus musculus
ccacgccttgttctggttccacgcg

SEQ ID NO: 284468 - DNA, 25 bp, Mus musculus
taccgggaagaagcctctcgacgtc

SEQ ID NO: 284469 - DNA, 25 bp, Mus musculus
tgagctgacgctgtcccgagcgacc

SEQ ID NO: 284470 - DNA, 25 bp, Mus musculus
gtgcctgagcaacatccgcgagttc

SEQ ID NO: 284471 - DNA, 25 bp, Mus musculus
aacgagagcgagtgcctgagcaaca

SEQ ID NO: 284472 - DNA, 25 bp, Mus musculus
tgtgttgcaggtctacccggagccg

SEQ ID NO: 284473 - DNA, 25 bp, Mus musculus
cgctcagcgccgctgtgtgttgcag

SEQ ID NO: 284474 - DNA, 25 bp, Mus musculus
gcggatgaagcgtccagcccgctca

SEQ ID NO: 284475 - DNA, 25 bp, Mus musculus
ggcgcggtttgacgccgtcacttcc

SEQ ID NO: 284476 - DNA, 25 bp, Mus musculus
gtagactgccgcagcccaagacgca

SEQ ID NO: 284477 - DNA, 25 bp, Mus musculus
tggggagtagactgccgcagcccaa

SEQ ID NO: 284478 - DNA, 25 bp, Mus musculus
gcacgataccggagcagggcccgaa

SEQ ID NO: 284479 - DNA, 25 bp, Mus musculus
tacctgtaccgggaagaagcctctc

SEQ ID NO: 284480 - DNA, 25 bp, Mus musculus
gctgccactccaggaaaaggaccta

SEQ ID NO: 284481 - DNA, 25 bp, Mus musculus
ccagctccagcagtcggttgtattt

SEQ ID NO: 284482 - DNA, 25 bp, Mus musculus
cccattgagcacgaagctggcgttg

SEQ ID NO: 284483 - DNA, 25 bp, Mus musculus
gccaccacagtagggcgggtatctg

SEQ ID NO: 284484 - DNA, 25 bp, Mus musculus
gcccatagtttgcaggcgaggactt

SEQ ID NO: 284485 - DNA, 25 bp, Mus musculus
ccactggagaatgtcgccgtatttc

SEQ ID NO: 284486 - DNA, 25 bp, Mus musculus
ccgatatctctacgtgggtctcgta

SEQ ID NO: 284487 - DNA, 25 bp, Mus musculus
agcaccagaagtcctccctgttgta

SEQ ID NO: 284488 - DNA, 25 bp, Mus musculus
tggtacagtaggttagctgccactc

SEQ ID NO: 284489 - DNA, 25 bp, Mus musculus
accatgttgtccgtgtgtgcgaaca

SEQ ID NO: 284490 - DNA, 25 bp, Mus musculus
cctgcaggtaggtgaccatgttgtc

SEQ ID NO: 284491 - DNA, 25 bp, Mus musculus
gatgaagtacttgctccagggcacc

SEQ ID NO: 284492 - DNA, 25 bp, Mus musculus
tccgccatcaccagagcggggatga

SEQ ID NO: 284493 - DNA, 25 bp, Mus musculus
gacacggatagattagctcggcacc

SEQ ID NO: 284494 - DNA, 25 bp, Mus musculus
gtttacctgggcgaccgccttgagc

SEQ ID NO: 284495 - DNA, 25 bp, Mus musculus
cggcgtctaagagacccggagccca

SEQ ID NO: 284496 - DNA, 25 bp, Mus musculus
gaacaggggaaaccgagtcagagcc

SEQ ID NO: 284497 - DNA, 25 bp, Mus musculus
aggccacccggctgtgcagacactg

SEQ ID NO: 284498 - DNA, 25 bp, Mus musculus
aaacgcgggcttctgatcctggaaa

SEQ ID NO: 284499 - DNA, 25 bp, Mus musculus
tgatcctggaaagtagcggggctac

SEQ ID NO: 284500 - DNA, 25 bp, Mus musculus
agcggggctacttcgcggcgtctaa

SEQ ID NO: 284501 - DNA, 25 bp, Mus musculus
tgcggagcatcttcagcacggtgca

SEQ ID NO: 284502 - DNA, 25 bp, Mus musculus
agcacggtgcagctagaaagcgcca

SEQ ID NO: 284503 - DNA, 25 bp, Mus musculus
gaaagcgccacagatttcaacttcg

SEQ ID NO: 284504 - DNA, 25 bp, Mus musculus
gagaccctggcactcactgcgatcg

SEQ ID NO: 284505 - DNA, 25 bp, Mus musculus
cccggaggccacactgtttacctgg

SEQ ID NO: 284506 - DNA, 25 bp, Mus musculus
gagctggctcttggctactcgcctt

SEQ ID NO: 284507 - DNA, 25 bp, Mus musculus
actcactgcgatcgcgggctccaga

SEQ ID NO: 284508 - DNA, 25 bp, Mus musculus
ttaggaacgaaaagacagaggtggc

SEQ ID NO: 284509 - DNA, 25 bp, Mus musculus
gagaacttaggaacgaaaagacaga

SEQ ID NO: 284510 - DNA, 25 bp, Mus musculus
ctcaggtccagggcgggagaactta

SEQ ID NO: 284511 - DNA, 25 bp, Mus musculus
tgcaggggcactgactcaggtccag

SEQ ID NO: 284512 - DNA, 25 bp, Mus musculus
catttgcaggggcactgactcaggt

SEQ ID NO: 284513 - DNA, 25 bp, Mus musculus
ggtagctgtactccaccgagacccg

SEQ ID NO: 284514 - DNA, 25 bp, Mus musculus
aggctgcagccgcacactggtcacc

SEQ ID NO: 284515 - DNA, 25 bp, Mus musculus
caggaggatctggacattagtgagt

SEQ ID NO: 284516 - DNA, 25 bp, Mus musculus
gacattagtgagtggcgtggacaca

SEQ ID NO: 284517 - DNA, 25 bp, Mus musculus
cgtggacacagcagtggcgcccgca

SEQ ID NO: 284518 - DNA, 25 bp, Mus musculus
agtggcgcccgcacggtagctgtac

SEQ ID NO: 284519 - DNA, 25 bp, Mus musculus
cgctcatttgcaggggcactgactc

SEQ ID NO: 284520 - DNA, 25 bp, Mus musculus
cactgccagtgggcgctcatttgca

SEQ ID NO: 284521 - DNA, 25 bp, Mus musculus
gcacggtagctgtactccaccgaga

SEQ ID NO: 284522 - DNA, 25 bp, Mus musculus
ccagcttagggccaggctagagacc

SEQ ID NO: 284523 - DNA, 25 bp, Mus musculus
acctgtcaagtctctcgggagactg

SEQ ID NO: 284524 - DNA, 25 bp, Mus musculus
tctgcacctgtcaagtctctcggga

SEQ ID NO: 284525 - DNA, 25 bp, Mus musculus
agaagctccttgatctctgcacctg

SEQ ID NO: 284526 - DNA, 25 bp, Mus musculus
attttaaagtgacaggagaagctcc

SEQ ID NO: 284527 - DNA, 25 bp, Mus musculus
ccgcaggctatttgcatattttaaa

SEQ ID NO: 284528 - DNA, 25 bp, Mus musculus
ctggaaattcatccgcaggctattt

SEQ ID NO: 284529 - DNA, 25 bp, Mus musculus
gttggctgagcctggaaattcatcc

SEQ ID NO: 284530 - DNA, 25 bp, Mus musculus
aaaccctgcactggttggctgagcc

SEQ ID NO: 284531 - DNA, 25 bp, Mus musculus
gcggtgcttcataaaccctgcactg

SEQ ID NO: 284532 - DNA, 25 bp, Mus musculus
ttctgcagacggcacctgcgctcgg

SEQ ID NO: 284533 - DNA, 25 bp, Mus musculus
tgagagatgccatagagtggcgccc

SEQ ID NO: 284534 - DNA, 25 bp, Mus musculus
ctcccagcccaggattgagagatgc

SEQ ID NO: 284535 - DNA, 25 bp, Mus musculus
agcctcccagcccaggattgagaga

SEQ ID NO: 284536 - DNA, 25 bp, Mus musculus
ggtgctgtccggtcagctgagaacc

SEQ ID NO: 284537 - DNA, 25 bp, Mus musculus
ccggtcagctgagaacccgaggtga

SEQ ID NO: 284538 - DNA, 25 bp, Mus musculus
gcgtgcgtctgctgacccttcagaa

SEQ ID NO: 284539 - DNA, 25 bp, Mus musculus
acaaggcggaagtgcctctgccgcc

SEQ ID NO: 284540 - DNA, 25 bp, Mus musculus
tcctgcggacaaggcggaagtgcct

SEQ ID NO: 284541 - DNA, 25 bp, Mus musculus
cttcagaagctcctgcggacaaggc

SEQ ID NO: 284542 - DNA, 25 bp, Mus musculus
gaacccgaggtgactgatcgatcct

SEQ ID NO: 284543 - DNA, 25 bp, Mus musculus
ctgcaggtctgcacctgggactcct

SEQ ID NO: 284544 - DNA, 25 bp, Mus musculus
gtcttcttcaccttcgcctctgcag

SEQ ID NO: 284545 - DNA, 25 bp, Mus musculus
cctgggagcagacatggtgagccct

SEQ ID NO: 284546 - DNA, 25 bp, Mus musculus
tcgatcctccgtggcccggagacgg

SEQ ID NO: 284547 - DNA, 25 bp, Mus musculus
gtgactgatcgatcctccgtggccc

SEQ ID NO: 284548 - DNA, 25 bp, Mus musculus
ctgacccttcagaagctcctgcgga

SEQ ID NO: 284549 - DNA, 25 bp, Mus musculus
cacctgggactcctgagtgcgcggt

SEQ ID NO: 284550 - DNA, 25 bp, Mus musculus
ccggagctcagctatggtgagcatc

SEQ ID NO: 284551 - DNA, 25 bp, Mus musculus
aagactgcagctgcgcgcgcgactc

SEQ ID NO: 284552 - DNA, 25 bp, Mus musculus
caaagactgcagctgcgcgcgcgac

SEQ ID NO: 284553 - DNA, 25 bp, Mus musculus
ccacggcaaagactgcagctgcgcg

SEQ ID NO: 284554 - DNA, 25 bp, Mus musculus
cgggaaccacggcaaagactgcagc

SEQ ID NO: 284555 - DNA, 25 bp, Mus musculus
gtacgggaaccacggcaaagactgc

SEQ ID NO: 284556 - DNA, 25 bp, Mus musculus
aatgcaggcgagtccctcggtacgg

SEQ ID NO: 284557 - DNA, 25 bp, Mus musculus
ggaatgcaggcgagtccctcggtac

SEQ ID NO: 284558 - DNA, 25 bp, Mus musculus
ttgaggtccggagctcagctatggt

SEQ ID NO: 284559 - DNA, 25 bp, Mus musculus
ctcagctatggtgagcatcggggat

SEQ ID NO: 284560 - DNA, 25 bp, Mus musculus
gctgcttgaggtccggagctcagct

SEQ ID NO: 284561 - DNA, 25 bp, Mus musculus
ggactgcgcggccagctgtgttggc

SEQ ID NO: 284562 - DNA, 25 bp, Mus musculus
agcatcggggatgcggggaatgcag

SEQ ID NO: 284563 - DNA, 25 bp, Mus musculus
gacctcaggccgctccaccctggag

SEQ ID NO: 284564 - DNA, 25 bp, Mus musculus
actcggtccttagcagccgcagctg

SEQ ID NO: 284565 - DNA, 25 bp, Mus musculus
tcggggcccaaatcacggctaattg

SEQ ID NO: 284566 - DNA, 25 bp, Mus musculus
ccgcaaatgcgcgtgttaaatccca

SEQ ID NO: 284567 - DNA, 25 bp, Mus musculus
cgacaggaaccggactcgagagaca

SEQ ID NO: 284568 - DNA, 25 bp, Mus musculus
acccgagtgaccttgacgtcgtctc

SEQ ID NO: 284569 - DNA, 25 bp, Mus musculus
agcccgcggttcatgccgtatctga

SEQ ID NO: 284570 - DNA, 25 bp, Mus musculus
gaagcggccggctagcctttaagaa

SEQ ID NO: 284571 - DNA, 25 bp, Mus musculus
tgccgccgagctcactgagcataga

SEQ ID NO: 284572 - DNA, 25 bp, Mus musculus
gcgttggtttcgctcccacaagatg

SEQ ID NO: 284573 - DNA, 25 bp, Mus musculus
gcgcgtctgcactttgtagccttca

SEQ ID NO: 284574 - DNA, 25 bp, Mus musculus
agccgaggtcgctctgtttccggat

SEQ ID NO: 284575 - DNA, 25 bp, Mus musculus
tctggctcccggcactagaacgagc

SEQ ID NO: 284576 - DNA, 25 bp, Mus musculus
aaacctggcttcctggagaagagcc

SEQ ID NO: 284577 - DNA, 25 bp, Mus musculus
atcacagtgggtattctggtatccc

SEQ ID NO: 284578 - DNA, 25 bp, Mus musculus
aaagtcagtcgaaagcgggattccg

SEQ ID NO: 284579 - DNA, 25 bp, Mus musculus
ccgagctggaagtttaggagacaat

SEQ ID NO: 284580 - DNA, 25 bp, Mus musculus
ctgcggctccagaaaagctgctttt

SEQ ID NO: 284581 - DNA, 25 bp, Mus musculus
gcctgggcacagacatggtgagcca

SEQ ID NO: 284582 - DNA, 25 bp, Mus musculus
agtccaagttgctgagcctccgcgg

SEQ ID NO: 284583 - DNA, 25 bp, Mus musculus
gctctcagctgaggaagtccaagtt

SEQ ID NO: 284584 - DNA, 25 bp, Mus musculus
acaccagtgtgtgagctggccaatc

SEQ ID NO: 284585 - DNA, 25 bp, Mus musculus
gaaactcccggtacagacaccagtg

SEQ ID NO: 284586 - DNA, 25 bp, Mus musculus
tgacgccataccctaggaaaggtcg

SEQ ID NO: 284587 - DNA, 25 bp, Mus musculus
gcgtccttggctgtatgacgccata

SEQ ID NO: 284588 - DNA, 25 bp, Mus musculus
cagtaaccaactgtgggagtcccgg

SEQ ID NO: 284589 - DNA, 25 bp, Mus musculus
ccgggcggttctcagtaaccaactg

SEQ ID NO: 284590 - DNA, 25 bp, Mus musculus
agaggcagcgccttgtccgccatct

SEQ ID NO: 284591 - DNA, 25 bp, Mus musculus
ttcttgcgagtgagaatttacgccc

SEQ ID NO: 284592 - DNA, 25 bp, Mus musculus
gcaaggcctgcagcgcgaactggat

SEQ ID NO: 284593 - DNA, 25 bp, Mus musculus
gcccacagggcaaaggcggctagct

SEQ ID NO: 284594 - DNA, 25 bp, Mus musculus
ggcggctagctgcaccgacgtcagc

SEQ ID NO: 284595 - DNA, 25 bp, Mus musculus
cccgggtgacctcatgggcctgaca

SEQ ID NO: 284596 - DNA, 25 bp, Mus musculus
ccggagcccagcagaacgattgagc

SEQ ID NO: 284597 - DNA, 25 bp, Mus musculus
aacgattgagctatggccggcctca

SEQ ID NO: 284598 - DNA, 25 bp, Mus musculus
cagacgacgcagaggatcgcgcgca

SEQ ID NO: 284599 - DNA, 25 bp, Mus musculus
cgcgagaaagtgagagaccaggacc

SEQ ID NO: 284600 - DNA, 25 bp, Mus musculus
cgccttgatcatccatacccttgga

SEQ ID NO: 284601 - DNA, 25 bp, Mus musculus
ctccggagtagtggggcaaataccg

SEQ ID NO: 284602 - DNA, 25 bp, Mus musculus
acgtccttagggtgcggccgcgaca

SEQ ID NO: 284603 - DNA, 25 bp, Mus musculus
gcaaataccgcgctcccattgtctg

SEQ ID NO: 284604 - DNA, 25 bp, Mus musculus
gctcccattgtctgcggctgaccaa

SEQ ID NO: 284605 - DNA, 25 bp, Mus musculus
atggccggcctcaactcactggagg

SEQ ID NO: 284606 - DNA, 25 bp, Mus musculus
ggcttgcctgtacagcacctaagta

SEQ ID NO: 284607 - DNA, 25 bp, Mus musculus
gcgccacttttgcaccgccgaaaat

SEQ ID NO: 284608 - DNA, 25 bp, Mus musculus
gccgaaaatcctcctcagaagcatt

SEQ ID NO: 284609 - DNA, 25 bp, Mus musculus
aaacacgaggcgttctctgcgcgcg

SEQ ID NO: 284610 - DNA, 25 bp, Mus musculus
ttcccagtacgcttgcgcctgttca

SEQ ID NO: 284611 - DNA, 25 bp, Mus musculus
ctctaccataggtagcggggccttg

SEQ ID NO: 284612 - DNA, 25 bp, Mus musculus
ctaagtaagtccaatggtgggcgcc

SEQ ID NO: 284613 - DNA, 25 bp, Mus musculus
tccctataccaagcgtcaaccaatg

SEQ ID NO: 284614 - DNA, 25 bp, Mus musculus
aggagcgagtctgcagcacatctta

SEQ ID NO: 284615 - DNA, 25 bp, Mus musculus
acacccatcgctggtcatttgacgc

SEQ ID NO: 284616 - DNA, 25 bp, Mus musculus
tcaaccaatgggctgtgcagtcggc

SEQ ID NO: 284617 - DNA, 25 bp, Mus musculus
tctcatcaaccagcgcgcggaattg

SEQ ID NO: 284618 - DNA, 25 bp, Mus musculus
tatggcgaagacctacgattacctg

SEQ ID NO: 284619 - DNA, 25 bp, Mus musculus
tcgactcaggatccactcgggccga

SEQ ID NO: 284620 - DNA, 25 bp, Mus musculus
caaggccaagatgctggaggccatg

SEQ ID NO: 284621 - DNA, 25 bp, Mus musculus
caatcagaaggaagcgaggagggtt

SEQ ID NO: 284622 - DNA, 25 bp, Mus musculus
gccggaagtactgtatgcaaacagg

SEQ ID NO: 284623 - DNA, 25 bp, Mus musculus
actgtatgcaaacaggaagtgtggc

SEQ ID NO: 284624 - DNA, 25 bp, Mus musculus
aggcgctgcctggacaagcgcacgc

SEQ ID NO: 284625 - DNA, 25 bp, Mus musculus
cgcgtgcgtcctagctgaccaatca

SEQ ID NO: 284626 - DNA, 25 bp, Mus musculus
ccatggggacgagcaagaagagcga

SEQ ID NO: 284627 - DNA, 25 bp, Mus musculus
agcccgcggtctgtccctgagggcc

SEQ ID NO: 284628 - DNA, 25 bp, Mus musculus
agagctcggcgtgacaaagcggtga

SEQ ID NO: 284629 - DNA, 25 bp, Mus musculus
ccctgaagctgaaaggcgtggcaga

SEQ ID NO: 284630 - DNA, 25 bp, Mus musculus
cctacgagcaagtccagaagggccc

SEQ ID NO: 284631 - DNA, 25 bp, Mus musculus
tggaggcctacgagcaagtccagaa

SEQ ID NO: 284632 - DNA, 25 bp, Mus musculus
cgctatggaggcctacgagcaagtc

SEQ ID NO: 284633 - DNA, 25 bp, Mus musculus
gagaaaaggcgctgcctggacaagc

SEQ ID NO: 284634 - DNA, 25 bp, Mus musculus
agcaacggctcccttctattcactg

SEQ ID NO: 284635 - DNA, 25 bp, Mus musculus
ccggaaagccgctccaggtgacagt

SEQ ID NO: 284636 - DNA, 25 bp, Mus musculus
ccgcccgtgggatgccacaagtgac

SEQ ID NO: 284637 - DNA, 25 bp, Mus musculus
ccacaagtgactgctgacagggata

SEQ ID NO: 284638 - DNA, 25 bp, Mus musculus
gtcccagctgctcgcgaagcaacgg

SEQ ID NO: 284639 - DNA, 25 bp, Mus musculus
gcaggaacaaaaacgcggctattta

SEQ ID NO: 284640 - DNA, 25 bp, Mus musculus
gcgcttcattatgtggcgggatccc

SEQ ID NO: 284641 - DNA, 25 bp, Mus musculus
cctgaaattgtcttgcgagtctttt

SEQ ID NO: 284642 - DNA, 25 bp, Mus musculus
tttcttgtctctctcgcctgcagtg

SEQ ID NO: 284643 - DNA, 25 bp, Mus musculus
cgggctgcaggaagaactaactgta

SEQ ID NO: 284644 - DNA, 25 bp, Mus musculus
tgtaagtgtgtctcgaactcgcgcg

SEQ ID NO: 284645 - DNA, 25 bp, Mus musculus
acgcgggtctccatcgatactttcc

SEQ ID NO: 284646 - DNA, 25 bp, Mus musculus
gtctcgcgggtccattggtcatttt

SEQ ID NO: 284647 - DNA, 25 bp, Mus musculus
atggtccaagggtcccgaacctctg

SEQ ID NO: 284648 - DNA, 25 bp, Mus musculus
actatggccttaggtcggtccctcg

SEQ ID NO: 284649 - DNA, 25 bp, Mus musculus
gcggctcccttcagaccggacataa

SEQ ID NO: 284650 - DNA, 25 bp, Mus musculus
ttgcactcagttacgcgcctgcgca

SEQ ID NO: 284651 - DNA, 25 bp, Mus musculus
acgcgctgcttcatggaccggaagt

SEQ ID NO: 284652 - DNA, 25 bp, Mus musculus
cggctactgccgagaccttccaaag

SEQ ID NO: 284653 - DNA, 25 bp, Mus musculus
gcgccgtctacgtactggatctgaa

SEQ ID NO: 284654 - DNA, 25 bp, Mus musculus
gcaaggtactgaagggttcgccacc

SEQ ID NO: 284655 - DNA, 25 bp, Mus musculus
tgtcaggacccaccctgttgctagg

SEQ ID NO: 284656 - DNA, 25 bp, Mus musculus
ttgctaggcaactggccgaccagcc

SEQ ID NO: 284657 - DNA, 25 bp, Mus musculus
gccagccctaccaagttactaggaa

SEQ ID NO: 284658 - DNA, 25 bp, Mus musculus
tgctaggtaactgtccgctttgccc

SEQ ID NO: 284659 - DNA, 25 bp, Mus musculus
gggtaccggactctagcttctcctg

SEQ ID NO: 284660 - DNA, 25 bp, Mus musculus
gcttctcctgcgaactcctgtagca

SEQ ID NO: 284661 - DNA, 25 bp, Mus musculus
gacataacggtccacgcgctgcttc

SEQ ID NO: 284662 - DNA, 25 bp, Mus musculus
cgccaggcttatataccgcggctaa

SEQ ID NO: 284663 - DNA, 25 bp, Mus musculus
atggcgctcagcgagcctatcttgc

SEQ ID NO: 284664 - DNA, 25 bp, Mus musculus
taaatttaggctgagcccggagctc

SEQ ID NO: 284665 - DNA, 25 bp, Mus musculus
atcttgccgtcctttgccactttcg

SEQ ID NO: 284666 - DNA, 25 bp, Mus musculus
cggggtagcaaggtaccaggctaca

SEQ ID NO: 284667 - DNA, 25 bp, Mus musculus
agccagtactggagatgacaaggtc

SEQ ID NO: 284668 - DNA, 25 bp, Mus musculus
gaccgcctcagggagttagacttca

SEQ ID NO: 284669 - DNA, 25 bp, Mus musculus
cttgagggcctagttgttagacttt

SEQ ID NO: 284670 - DNA, 25 bp, Mus musculus
agcgctggccgcgaaatgaacccga

SEQ ID NO: 284671 - DNA, 25 bp, Mus musculus
ggatgaggacctaaacaacgtgttg

SEQ ID NO: 284672 - DNA, 25 bp, Mus musculus
cgtgttggacttcatcctctccatg

SEQ ID NO: 284673 - DNA, 25 bp, Mus musculus
cctctccatgggattggacggtctg

SEQ ID NO: 284674 - DNA, 25 bp, Mus musculus
cctgccgcgcctataaggcctgggt

SEQ ID NO: 284675 - DNA, 25 bp, Mus musculus
gtctgggcgccgaaaatcctcccga

SEQ ID NO: 284676 - DNA, 25 bp, Mus musculus
cctttatggggaaggctctgtcgca

SEQ ID NO: 284677 - DNA, 25 bp, Mus musculus
cgtgcctgcgcactagtacgaagga

SEQ ID NO: 284678 - DNA, 25 bp, Mus musculus
caggaccagagtacacgtgcgcaga

SEQ ID NO: 284679 - DNA, 25 bp, Mus musculus
tgcgcagaagggaatccaagtcctc

SEQ ID NO: 284680 - DNA, 25 bp, Mus musculus
taggatccgcgcttttcgcaccgca

SEQ ID NO: 284681 - DNA, 25 bp, Mus musculus
ttttgcagtaagagggcggagcctc

SEQ ID NO: 284682 - DNA, 25 bp, Mus musculus
gacgacttatctttctcgcggcaac

SEQ ID NO: 284683 - DNA, 25 bp, Mus musculus
tgtcgcatagccttaccagagttgg

SEQ ID NO: 284684 - DNA, 25 bp, Mus musculus
cgtaccgggtgatttagagagccta

SEQ ID NO: 284685 - DNA, 25 bp, Mus musculus
agagcctagcctaaagcacagcgtg

SEQ ID NO: 284686 - DNA, 25 bp, Mus musculus
ccttgcgactccagtatgggacacc

SEQ ID NO: 284687 - DNA, 25 bp, Mus musculus
ctgaggacgaagactggtgcatacc

SEQ ID NO: 284688 - DNA, 25 bp, Mus musculus
gcacagcgtgactagaaggttcgga

SEQ ID NO: 284689 - DNA, 25 bp, Mus musculus
tcctcccgtgagaagttttgcagta

SEQ ID NO: 284690 - DNA, 25 bp, Mus musculus
cgcagcacacagatggcccagagca

SEQ ID NO: 284691 - DNA, 25 bp, Mus musculus
aactctctgctctcaggcgtccgta

SEQ ID NO: 284692 - DNA, 25 bp, Mus musculus
ctgcacgtgcgacttcaactctctg

SEQ ID NO: 284693 - DNA, 25 bp, Mus musculus
cacgagccgagaccatagctgcacg

SEQ ID NO: 284694 - DNA, 25 bp, Mus musculus
cagagcaatgcacgagccgagacca

SEQ ID NO: 284695 - DNA, 25 bp, Mus musculus
cgtaccgcttgacgggcgcaactca

SEQ ID NO: 284696 - DNA, 25 bp, Mus musculus
tgacctgagttgctcattggtgggt

SEQ ID NO: 284697 - DNA, 25 bp, Mus musculus
ccgggattgtgacctgagttgctca

SEQ ID NO: 284698 - DNA, 25 bp, Mus musculus
ctggtcccgtgacgcccgggattgt

SEQ ID NO: 284699 - DNA, 25 bp, Mus musculus
tgcgctgaaattactggtcccgtga

SEQ ID NO: 284700 - DNA, 25 bp, Mus musculus
gacgctaatgggtgcgctgaaatta

SEQ ID NO: 284701 - DNA, 25 bp, Mus musculus
ggattatgacctggggacgctaatg

SEQ ID NO: 284702 - DNA, 25 bp, Mus musculus
ccggcatgccttgggattatgacct

SEQ ID NO: 284703 - DNA, 25 bp, Mus musculus
tctcaggcgtccgtaccgcttgacg

SEQ ID NO: 284704 - DNA, 25 bp, Mus musculus
tgagcgagcttatcgatgacatttc

SEQ ID NO: 284705 - DNA, 25 bp, Mus musculus
cgtcattttctcgaactcgggtccg

SEQ ID NO: 284706 - DNA, 25 bp, Mus musculus
tgacatttcgaagctcctgatctgc

SEQ ID NO: 284707 - DNA, 25 bp, Mus musculus
aagaacccaacgacctcagctcagg

SEQ ID NO: 284708 - DNA, 25 bp, Mus musculus
cggcatcggcatctccatggctgca

SEQ ID NO: 284709 - DNA, 25 bp, Mus musculus
cgccatttacggctgtcgctgggaa

SEQ ID NO: 284710 - DNA, 25 bp, Mus musculus
cgctgggaaacaccggaagtgaaga

SEQ ID NO: 284711 - DNA, 25 bp, Mus musculus
agacgcatgcgcgtgagcctctttg

SEQ ID NO: 284712 - DNA, 25 bp, Mus musculus
tactctgggtttctgctgcgttctt

SEQ ID NO: 284713 - DNA, 25 bp, Mus musculus
tgcgttcttgcgaacgcgtgcactc

SEQ ID NO: 284714 - DNA, 25 bp, Mus musculus
ggcctctgcgtctttcacatccttt

SEQ ID NO: 284715 - DNA, 25 bp, Mus musculus
tttacgccatccagaaggcgggatc

SEQ ID NO: 284716 - DNA, 25 bp, Mus musculus
ttttggcgaatcacacctcactcgg

SEQ ID NO: 284717 - DNA, 25 bp, Mus musculus
aactcgggtccgttgcgagccacaa

SEQ ID NO: 284718 - DNA, 25 bp, Mus musculus
ctgtcggcaccttgaagtacgtgta

SEQ ID NO: 284719 - DNA, 25 bp, Mus musculus
ttgggtgaggcctcgtagtagacca

SEQ ID NO: 284720 - DNA, 25 bp, Mus musculus
ttgtccttgaggaaatccccgatgg

SEQ ID NO: 284721 - DNA, 25 bp, Mus musculus
cgagactctcggtgtttctctacca

SEQ ID NO: 284722 - DNA, 25 bp, Mus musculus
cccagccacgagactctcggtgttt

SEQ ID NO: 284723 - DNA, 25 bp, Mus musculus
cttgaagtacgtgtaacgtggcctc

SEQ ID NO: 284724 - DNA, 25 bp, Mus musculus
gcgttctgtcggcaccttgaagtac

SEQ ID NO: 284725 - DNA, 25 bp, Mus musculus
tagtagaccaggtcgcgttctgtcg

SEQ ID NO: 284726 - DNA, 25 bp, Mus musculus
acaggtcgcacccatctatgccatg

SEQ ID NO: 284727 - DNA, 25 bp, Mus musculus
tctatgccatgcgagctcacattgc

SEQ ID NO: 284728 - DNA, 25 bp, Mus musculus
cgagctcacattgcaggtgcggtca

SEQ ID NO: 284729 - DNA, 25 bp, Mus musculus
ctcacattgcaggtgcggtcacgcg

SEQ ID NO: 284730 - DNA, 25 bp, Mus musculus
tgcggtcacgcgtcccgaaggagcc

SEQ ID NO: 284731 - DNA, 25 bp, Mus musculus
tgtaacgtggcctcagggtctccac

SEQ ID NO: 284732 - DNA, 25 bp, Mus musculus
taggagaccggcaccttccagatgc

SEQ ID NO: 284733 - DNA, 25 bp, Mus musculus
agcacttaccggtgtgcgcgtagga

SEQ ID NO: 284734 - DNA, 25 bp, Mus musculus
ccttccagatgctgacgtgcgccga

SEQ ID NO: 284735 - DNA, 25 bp, Mus musculus
tgcgccgacaccgacgcgaagtact

SEQ ID NO: 284736 - DNA, 25 bp, Mus musculus
cgacgcgaagtacttgccaaaggca

SEQ ID NO: 284737 - DNA, 25 bp, Mus musculus
caagcggcagtacgtaacgcggata

SEQ ID NO: 284738 - DNA, 25 bp, Mus musculus
gcacagcgctaggatgtggcacagc

SEQ ID NO: 284739 - DNA, 25 bp, Mus musculus
atcaccttgttgaccacgttaccgc

SEQ ID NO: 284740 - DNA, 25 bp, Mus musculus
cgcgctcagcgcgtaccatagtaga

SEQ ID NO: 284741 - DNA, 25 bp, Mus musculus
gtaccatagtagacacagcaccgcc

SEQ ID NO: 284742 - DNA, 25 bp, Mus musculus
aagcgcgttacgttctctccggtga

SEQ ID NO: 284743 - DNA, 25 bp, Mus musculus
ccgcccacttgaggctgtggaagcc

SEQ ID NO: 284744 - DNA, 25 bp, Mus musculus
gcgtagacagggcttagatctttta

SEQ ID NO: 284745 - DNA, 25 bp, Mus musculus
cgggaaggcgctcaaaatcaccttg

SEQ ID NO: 284746 - DNA, 25 bp, Mus musculus
ctggaacaccgactctatcttctga

SEQ ID NO: 284747 - DNA, 25 bp, Mus musculus
ttagactcgtgcctcgaggagctcg

SEQ ID NO: 284748 - DNA, 25 bp, Mus musculus
aaaccagaggattggagcggccata

SEQ ID NO: 284749 - DNA, 25 bp, Mus musculus
ccgatcgcgaggcagtcacttacgt

SEQ ID NO: 284750 - DNA, 25 bp, Mus musculus
agtcacttacgttgctctgggagtc

SEQ ID NO: 284751 - DNA, 25 bp, Mus musculus
cggtccctcatctgctgcggagacg

SEQ ID NO: 284752 - DNA, 25 bp, Mus musculus
agccgctgtcattgcctgggcgaag

SEQ ID NO: 284753 - DNA, 25 bp, Mus musculus
cgcctcgagaaccaaactccagtga

SEQ ID NO: 284754 - DNA, 25 bp, Mus musculus
gctgagcactctgggtaacccgcgc

SEQ ID NO: 284755 - DNA, 25 bp, Mus musculus
ccctcctattgattgtgcgcacgcg

SEQ ID NO: 284756 - DNA, 25 bp, Mus musculus
atgagggcctcctgcgtttagaaac

SEQ ID NO: 284757 - DNA, 25 bp, Mus musculus
agcgcacccttcaagtcctggaaca

SEQ ID NO: 284758 - DNA, 25 bp, Mus musculus
atcttctgactgctttggggttgcg

SEQ ID NO: 284759 - DNA, 25 bp, Mus musculus
cgcgcaggcgcaattagcaggtcct

SEQ ID NO: 284760 - DNA, 25 bp, Mus musculus
atgtcacctacagggcggagcttgg

SEQ ID NO: 284761 - DNA, 25 bp, Mus musculus
cacagtttaaagttgagcacagccc

SEQ ID NO: 284762 - DNA, 25 bp, Mus musculus
gcgttcatcagtagcgtcctgcgga

SEQ ID NO: 284763 - DNA, 25 bp, Mus musculus
gacagtaacggtcagtaagggtcac

SEQ ID NO: 284764 - DNA, 25 bp, Mus musculus
cccgaacagcagtatgtctccgatc

SEQ ID NO: 284765 - DNA, 25 bp, Mus musculus
aatcagcattggttgggttcgactg

SEQ ID NO: 284766 - DNA, 25 bp, Mus musculus
aattgcgcccttgacccttgagccg

SEQ ID NO: 284767 - DNA, 25 bp, Mus musculus
cccgtgaacggcttggatatggata

SEQ ID NO: 284768 - DNA, 25 bp, Mus musculus
gattccgggctacagaaattgcgcc

SEQ ID NO: 284769 - DNA, 25 bp, Mus musculus
gtggaacgagaactgaccaattctg

SEQ ID NO: 284770 - DNA, 25 bp, Mus musculus
tgccacagctggtccctgctgttga

SEQ ID NO: 284771 - DNA, 25 bp, Mus musculus
tgtcgcggcctactcacagtttaaa

SEQ ID NO: 284772 - DNA, 25 bp, Mus musculus
cgcatgctcagtgttacgtgccaca

SEQ ID NO: 284773 - DNA, 25 bp, Mus musculus
actgaggatgtagcatgatgtcacc

SEQ ID NO: 284774 - DNA, 25 bp, Mus musculus
ttctgacgtccctacggccccgcat

SEQ ID NO: 284775 - DNA, 25 bp, Mus musculus
ccgcattttgggctcccggctgcta

SEQ ID NO: 284776 - DNA, 25 bp, Mus musculus
cgggtgccgctcttccctgttttcg

SEQ ID NO: 284777 - DNA, 25 bp, Mus musculus
cgagggagcattcgtcgggcagcgg

SEQ ID NO: 284778 - DNA, 25 bp, Mus musculus
gggaggcgccctccatcgccatgga

SEQ ID NO: 284779 - DNA, 25 bp, Mus musculus
atcgccatggacctgatgtcagcgc

SEQ ID NO: 284780 - DNA, 25 bp, Mus musculus
gccatggacctgatgtcagcgctga

SEQ ID NO: 284781 - DNA, 25 bp, Mus musculus
atggacctgatgtcagcgctgagcc

SEQ ID NO: 284782 - DNA, 25 bp, Mus musculus
gacctgatgtcagcgctgagcctgg

SEQ ID NO: 284783 - DNA, 25 bp, Mus musculus
ctgagcctgggcgagctagcgctca

SEQ ID NO: 284784 - DNA, 25 bp, Mus musculus
ctgggcgagctagcgctcagcttct

SEQ ID NO: 284785 - DNA, 25 bp, Mus musculus
agctagcgctcagcttctcgcgggt

SEQ ID NO: 284786 - DNA, 25 bp, Mus musculus
cgagctagcgctcagcttctcgcgg

SEQ ID NO: 284787 - DNA, 25 bp, Mus musculus
agcgctcagcttctcgcgggtgccg

SEQ ID NO: 284788 - DNA, 25 bp, Mus musculus
aggtctttctcgacatctctcagtc

SEQ ID NO: 284789 - DNA, 25 bp, Mus musculus
tctcggtccttctagtcggacgtcg

SEQ ID NO: 284790 - DNA, 25 bp, Mus musculus
aggctcttggtcctacccgcaggct

SEQ ID NO: 284791 - DNA, 25 bp, Mus musculus
agggatttcgcgtcctcctcgagac

SEQ ID NO: 284792 - DNA, 25 bp, Mus musculus
cctcggtcttccaagggatttcgcg

SEQ ID NO: 284793 - DNA, 25 bp, Mus musculus
ttccgcggaatccttcggtcttcgc

SEQ ID NO: 284794 - DNA, 25 bp, Mus musculus
agtcattcctgcgatccctgtcatc

SEQ ID NO: 284795 - DNA, 25 bp, Mus musculus
cttctcagagatacagaggtctttc

SEQ ID NO: 284796 - DNA, 25 bp, Mus musculus
ccgctcctcggacttctcagagata

SEQ ID NO: 284797 - DNA, 25 bp, Mus musculus
tgcacgtgagtgatgtccttagcct

SEQ ID NO: 284798 - DNA, 25 bp, Mus musculus
tgacttccaacatggcgcatgcagg

SEQ ID NO: 284799 - DNA, 25 bp, Mus musculus
gcagaagcggctctgacttccaaca

SEQ ID NO: 284800 - DNA, 25 bp, Mus musculus
cttcgatcctcctagttggcccgta

SEQ ID NO: 284801 - DNA, 25 bp, Mus musculus
cttagcctcttcctggggactcgga

SEQ ID NO: 284802 - DNA, 25 bp, Mus musculus
caagtggtttgtgcaccgggagaaa

SEQ ID NO: 284803 - DNA, 25 bp, Mus musculus
ggcacagctggcctacgggcagcac

SEQ ID NO: 284804 - DNA, 25 bp, Mus musculus
cggccatgatgcaggaggcacagct

SEQ ID NO: 284805 - DNA, 25 bp, Mus musculus
acgcgcatgtcaacggctgggctaa

SEQ ID NO: 284806 - DNA, 25 bp, Mus musculus
catgaaggaacacccggattacaag

SEQ ID NO: 284807 - DNA, 25 bp, Mus musculus
acgaggccaagagactgcgcgcgct

SEQ ID NO: 284808 - DNA, 25 bp, Mus musculus
aaccaggatcgggtcaagcggccca

SEQ ID NO: 284809 - DNA, 25 bp, Mus musculus
ggcaccaaggccaaccaggatcggg

SEQ ID NO: 284810 - DNA, 25 bp, Mus musculus
tgatgatggagaccgacctgcactc

SEQ ID NO: 284811 - DNA, 25 bp, Mus musculus
gccgcccagatgtacagcatgatga

SEQ ID NO: 284812 - DNA, 25 bp, Mus musculus
gtgaacccgctagccgcccagatgt

SEQ ID NO: 284813 - DNA, 25 bp, Mus musculus
caggccctctctttgcggtaccggt

SEQ ID NO: 284814 - DNA, 25 bp, Mus musculus
ggagaaactttccacctgcgagctg

SEQ ID NO: 284815 - DNA, 25 bp, Mus musculus
cgctaagtgcgtgtgcttttgcctc

SEQ ID NO: 284816 - DNA, 25 bp, Mus musculus
cttcgtgtatgaggaccgacagatc

SEQ ID NO: 284817 - DNA, 25 bp, Mus musculus
gcgagccgcaccttatcttcgtgta

SEQ ID NO: 284818 - DNA, 25 bp, Mus musculus
acagatcctagaggacgcagcagca

SEQ ID NO: 284819 - DNA, 25 bp, Mus musculus
gcagcagcactcatcagctactatg

SEQ ID NO: 284820 - DNA, 25 bp, Mus musculus
ctactatgttaagcggcagccagcc

SEQ ID NO: 284821 - DNA, 25 bp, Mus musculus
cagccagccattcagaaagaggacc

SEQ ID NO: 284822 - DNA, 25 bp, Mus musculus
ccagcctgttcttctcgcagcagtg

SEQ ID NO: 284823 - DNA, 25 bp, Mus musculus
gatgcatctccagaaccgcccaagg

SEQ ID NO: 284824 - DNA, 25 bp, Mus musculus
cgcccaaggtcctggacgatgtgta

SEQ ID NO: 284825 - DNA, 25 bp, Mus musculus
gtgtacagtctgttttttgccaaca

SEQ ID NO: 284826 - DNA, 25 bp, Mus musculus
aacaactggtacttcttcctgcggc

SEQ ID NO: 284827 - DNA, 25 bp, Mus musculus
tgctcaagatctaccggcaggcgca

SEQ ID NO: 284828 - DNA, 25 bp, Mus musculus
agcagctgctggaacatcgacgaga

SEQ ID NO: 284829 - DNA, 25 bp, Mus musculus
ggcacctccgatgactctgctgatg

SEQ ID NO: 284830 - DNA, 25 bp, Mus musculus
gcagctcagccggaccgagagacca

SEQ ID NO: 284831 - DNA, 25 bp, Mus musculus
ctccgctccttggttcattggaacg

SEQ ID NO: 284832 - DNA, 25 bp, Mus musculus
ccaggaatgtgcgtctctagtgccc

SEQ ID NO: 284833 - DNA, 25 bp, Mus musculus
cagccaatgggtagcgccaggaatg

SEQ ID NO: 284834 - DNA, 25 bp, Mus musculus
cccgtgatcgcatggacagccaatg

SEQ ID NO: 284835 - DNA, 25 bp, Mus musculus
tgtctgtgtcatgtctgtgcagctg

SEQ ID NO: 284836 - DNA, 25 bp, Mus musculus
tgttggagctccaggctagtccagc

SEQ ID NO: 284837 - DNA, 25 bp, Mus musculus
cgggatagatgctccttggaaggtc

SEQ ID NO: 284838 - DNA, 25 bp, Mus musculus
accgtagctgcttgcggtgaccctc

SEQ ID NO: 284839 - DNA, 25 bp, Mus musculus
atccgggaaaccagcgccaggaaga

SEQ ID NO: 284840 - DNA, 25 bp, Mus musculus
accgagagaccagcgtggcgaacga

SEQ ID NO: 284841 - DNA, 25 bp, Mus musculus
cattggaacgcaggcggatgaaaca

SEQ ID NO: 284842 - DNA, 25 bp, Mus musculus
agcgctcaggtttggagccgctcgt

SEQ ID NO: 284843 - DNA, 25 bp, Mus musculus
cgaacgagcactgggaccgaccgta

SEQ ID NO: 284844 - DNA, 25 bp, Mus musculus
ggtttattcgatgcgctcgacgctc

SEQ ID NO: 284845 - DNA, 25 bp, Mus musculus
gcttttctctccttctccaagatgg

SEQ ID NO: 284846 - DNA, 25 bp, Mus musculus
agaggatgcccggagcttcctgcgc

SEQ ID NO: 284847 - DNA, 25 bp, Mus musculus
gcccttgttgctcgcgcttttctct

SEQ ID NO: 284848 - DNA, 25 bp, Mus musculus
ctctgggctcgactgaggcgccctt

SEQ ID NO: 284849 - DNA, 25 bp, Mus musculus
tcgacgctctttcgccggcgcggta

SEQ ID NO: 284850 - DNA, 25 bp, Mus musculus
cgatctcgtattgtgtgtgttcttt

SEQ ID NO: 284851 - DNA, 25 bp, Mus musculus
ttggggactgtatggataaacgatc

SEQ ID NO: 284852 - DNA, 25 bp, Mus musculus
ctgccgaggttatcacagcggggac

SEQ ID NO: 284853 - DNA, 25 bp, Mus musculus
ggttgcagcagacctgccgaggtta

SEQ ID NO: 284854 - DNA, 25 bp, Mus musculus
ctttgttgaactagcggttgcagca

SEQ ID NO: 284855 - DNA, 25 bp, Mus musculus
ctgcgctgcgcagagctttgttgaa

SEQ ID NO: 284856 - DNA, 25 bp, Mus musculus
ccgcgctcaacaagcaggtttattc

SEQ ID NO: 284857 - DNA, 25 bp, Mus musculus
ccgctgcagtaggagtctgcgctct

SEQ ID NO: 284858 - DNA, 25 bp, Mus musculus
agccgcggcaatggactttctcctg

SEQ ID NO: 284859 - DNA, 25 bp, Mus musculus
gtcaccgactcttcacattccgaga

SEQ ID NO: 284860 - DNA, 25 bp, Mus musculus
ctttctcctgggaaatccgttcagc

SEQ ID NO: 284861 - DNA, 25 bp, Mus musculus
cggttgctgtcacctgattctggga

SEQ ID NO: 284862 - DNA, 25 bp, Mus musculus
tccgttcagctctccggtgggacaa

SEQ ID NO: 284863 - DNA, 25 bp, Mus musculus
cggatgtggttcagccaatgtgtgc

SEQ ID NO: 284864 - DNA, 25 bp, Mus musculus
acctgtcggagtccgcagtctggca

SEQ ID NO: 284865 - DNA, 25 bp, Mus musculus
cctatgacccacctgattgacaaga

SEQ ID NO: 284866 - DNA, 25 bp, Mus musculus
ttgacaagaacacgggccaatcgga

SEQ ID NO: 284867 - DNA, 25 bp, Mus musculus
acgggccaatcggaagtcttatatg

SEQ ID NO: 284868 - DNA, 25 bp, Mus musculus
tgatgcttgatgtagccaataggca

SEQ ID NO: 284869 - DNA, 25 bp, Mus musculus
gcgtcttgatcattcgccgcgtcac

SEQ ID NO: 284870 - DNA, 25 bp, Mus musculus
agtctcgggtttatgtgacgtcgcc

SEQ ID NO: 284871 - DNA, 25 bp, Mus musculus
cacattccgagacgccggggtgtct

SEQ ID NO: 284872 - DNA, 25 bp, Mus musculus
ccacaatggccagcgatattttata

SEQ ID NO: 284873 - DNA, 25 bp, Mus musculus
atcgccggccagtcatagcaacctg

SEQ ID NO: 284874 - DNA, 25 bp, Mus musculus
gtcgcggtggcatttggtaatcaca

SEQ ID NO: 284875 - DNA, 25 bp, Mus musculus
ggtaatcacacggaggcacaaaagg

SEQ ID NO: 284876 - DNA, 25 bp, Mus musculus
agccacctgagagcggaatgcgccg

SEQ ID NO: 284877 - DNA, 25 bp, Mus musculus
tgcgacactgtcacgccgcgttagc

SEQ ID NO: 284878 - DNA, 25 bp, Mus musculus
gggaaatcctctttcagacgcttta

SEQ ID NO: 284879 - DNA, 25 bp, Mus musculus
cgtgtgaatcgccaacagcattttc

SEQ ID NO: 284880 - DNA, 25 bp, Mus musculus
cttaatcttgtcgtcctcgcaggga

SEQ ID NO: 284881 - DNA, 25 bp, Mus musculus
gacattgtgctcagagccgagcgca

SEQ ID NO: 284882 - DNA, 25 bp, Mus musculus
cccacagcggagagttaatgatata

SEQ ID NO: 284883 - DNA, 25 bp, Mus musculus
agttaatgatataccggagaggccc

SEQ ID NO: 284884 - DNA, 25 bp, Mus musculus
tagcaacctggaagtatgcgctgcc

SEQ ID NO: 284885 - DNA, 25 bp, Mus musculus
atgaatccggctttgtgcgacactg

SEQ ID NO: 284886 - DNA, 25 bp, Mus musculus
cgtgacccgcgtacttaaagggctg

SEQ ID NO: 284887 - DNA, 25 bp, Mus musculus
ccagtccggtgatggagcgtccaca

SEQ ID NO: 284888 - DNA, 25 bp, Mus musculus
ggagcgtccacagcccgacaggcaa

SEQ ID NO: 284889 - DNA, 25 bp, Mus musculus
cctccgggctggatgttgcaacagc

SEQ ID NO: 284890 - DNA, 25 bp, Mus musculus
cctgaactagcccagtccggtgatg

SEQ ID NO: 284891 - DNA, 25 bp, Mus musculus
acagcagcgagaacgccggctcagc

SEQ ID NO: 284892 - DNA, 25 bp, Mus musculus
gagcatagcccggagcctgaatcga

SEQ ID NO: 284893 - DNA, 25 bp, Mus musculus
tcgagcagaaccagcctgaactagc

SEQ ID NO: 284894 - DNA, 25 bp, Mus musculus
atgttgcaacagcagcgagaacgcc

SEQ ID NO: 284895 - DNA, 25 bp, Mus musculus
ccggagcctgaatcgagcagaacca

SEQ ID NO: 284896 - DNA, 25 bp, Mus musculus
acggtctccagtcgcctccagagtt

SEQ ID NO: 284897 - DNA, 25 bp, Mus musculus
agagccgtctcgagcatagcccgga

SEQ ID NO: 284898 - DNA, 25 bp, Mus musculus
acaaccagtgagtggagcctgcccg

SEQ ID NO: 284899 - DNA, 25 bp, Mus musculus
ccagagtttccgcatacaaccagtg

SEQ ID NO: 284900 - DNA, 25 bp, Mus musculus
cgacagtgtccgtgaaccattctta

SEQ ID NO: 284901 - DNA, 25 bp, Mus musculus
cccgggcattttctacagcgacagc

SEQ ID NO: 284902 - DNA, 25 bp, Mus musculus
atcgcacgggcttcaccttcaagta

SEQ ID NO: 284903 - DNA, 25 bp, Mus musculus
ttcctgagacagtaccgagtgggca

SEQ ID NO: 284904 - DNA, 25 bp, Mus musculus
actgcagaggcgattcaaggagttc

SEQ ID NO: 284905 - DNA, 25 bp, Mus musculus
caggcccgcaagtcgcaactgcaga

SEQ ID NO: 284906 - DNA, 25 bp, Mus musculus
tccgccatctttgctcggttagctg

SEQ ID NO: 284907 - DNA, 25 bp, Mus musculus
tgtctcccttgacccaggtacagtc

SEQ ID NO: 284908 - DNA, 25 bp, Mus musculus
tatccgcggcgctgaacgaaccaat

SEQ ID NO: 284909 - DNA, 25 bp, Mus musculus
ccggcgcagagcagtccaatagcta

SEQ ID NO: 284910 - DNA, 25 bp, Mus musculus
atcatcttgggaaccaggccttgga

SEQ ID NO: 284911 - DNA, 25 bp, Mus musculus
gaactttcgcgccaaaacgtccagc

SEQ ID NO: 284912 - DNA, 25 bp, Mus musculus
cggttagctgctagcgccaagaact

SEQ ID NO: 284913 - DNA, 25 bp, Mus musculus
cttcaagtacaggtgcgacagtgtc

SEQ ID NO: 284914 - DNA, 25 bp, Mus musculus
catctggagcccgagcttgagccac

SEQ ID NO: 284915 - DNA, 25 bp, Mus musculus
cacccgctttgcgtccagagaagga

SEQ ID NO: 284916 - DNA, 25 bp, Mus musculus
tcggagcccacccatgggtcatcat

SEQ ID NO: 284917 - DNA, 25 bp, Mus musculus
tcgagcacctggctcaaccggagtc

SEQ ID NO: 284918 - DNA, 25 bp, Mus musculus
gagtctccggggttcgcttctatat

SEQ ID NO: 284919 - DNA, 25 bp, Mus musculus
caaaagtcctcctgagtctccgggg

SEQ ID NO: 284920 - DNA, 25 bp, Mus musculus
aaggaggtaacgtaagctgccaggc

SEQ ID NO: 284921 - DNA, 25 bp, Mus musculus
gagcacgagggaggaacccacccta

SEQ ID NO: 284922 - DNA, 25 bp, Mus musculus
tggccgaagcctcgggatagccctc

SEQ ID NO: 284923 - DNA, 25 bp, Mus musculus
cgtgccttacggtcttccggtcacg

SEQ ID NO: 284924 - DNA, 25 bp, Mus musculus
gtgcgtgctcagtgtcagcctccca

SEQ ID NO: 284925 - DNA, 25 bp, Mus musculus
ttcccacagtttgggctggcttgcg

SEQ ID NO: 284926 - DNA, 25 bp, Mus musculus
cttcaggcgaagttggagctgctga

SEQ ID NO: 284927 - DNA, 25 bp, Mus musculus
taagaaacttctcctcgcttgggga

SEQ ID NO: 284928 - DNA, 25 bp, Mus musculus
gggtatctgcacagtcgctctatta

SEQ ID NO: 284929 - DNA, 25 bp, Mus musculus
gctggacagcctcatactgcaagtg

SEQ ID NO: 284930 - DNA, 25 bp, Mus musculus
agacgctctgttgcctgagctgtca

SEQ ID NO: 284931 - DNA, 25 bp, Mus musculus
cgggacctccacagtcactgcagga

SEQ ID NO: 284932 - DNA, 25 bp, Mus musculus
gcaatttagtgcctccagctcgcca

SEQ ID NO: 284933 - DNA, 25 bp, Mus musculus
ctcgccgcctccaatagggtatctg

SEQ ID NO: 284934 - DNA, 25 bp, Mus musculus
tacccaccgtcagtagggcgactgc

SEQ ID NO: 284935 - DNA, 25 bp, Mus musculus
cctgattgccgatcagccggtattg

SEQ ID NO: 284936 - DNA, 25 bp, Mus musculus
gccggtattggacttgctgttgacg

SEQ ID NO: 284937 - DNA, 25 bp, Mus musculus
tctccctaccatgtcctagaaaagg

SEQ ID NO: 284938 - DNA, 25 bp, Mus musculus
ctgctccgtgccattctaacctaga

SEQ ID NO: 284939 - DNA, 25 bp, Mus musculus
caaggagcttcgatccagggcaaaa

SEQ ID NO: 284940 - DNA, 25 bp, Mus musculus
ttccctcggccttcttgctgtcagt

SEQ ID NO: 284941 - DNA, 25 bp, Mus musculus
agggcgactgccaggattgctatcc

SEQ ID NO: 284942 - DNA, 25 bp, Mus musculus
gctgtgtcgcagcaactttgtatca

SEQ ID NO: 284943 - DNA, 25 bp, Mus musculus
tttaaggaagctgcggagtccaggc

SEQ ID NO: 284944 - DNA, 25 bp, Mus musculus
ccgcctctgcggctttaaggaagct

SEQ ID NO: 284945 - DNA, 25 bp, Mus musculus
aaccaggagaactcgccgcctctgc

SEQ ID NO: 284946 - DNA, 25 bp, Mus musculus
ttctggacatgtgacccggtttaaa

SEQ ID NO: 284947 - DNA, 25 bp, Mus musculus
gcgacctgaactttctggacatgtg

SEQ ID NO: 284948 - DNA, 25 bp, Mus musculus
gcgggacagcgacctgaactttctg

SEQ ID NO: 284949 - DNA, 25 bp, Mus musculus
gccaatggaaatggctccagcgggc

SEQ ID NO: 284950 - DNA, 25 bp, Mus musculus
cccttggccaatggaaatggctcca

SEQ ID NO: 284951 - DNA, 25 bp, Mus musculus
cgcacagcgtggagccttgtttccc

SEQ ID NO: 284952 - DNA, 25 bp, Mus musculus
ttgcccaatgagaagcgcgcctggc

SEQ ID NO: 284953 - DNA, 25 bp, Mus musculus
ccctgttgcccaatgagaagcgcgc

SEQ ID NO: 284954 - DNA, 25 bp, Mus musculus
ggagtccaggctgtgtcgcagcaac

SEQ ID NO: 284955 - DNA, 25 bp, Mus musculus
tgtatcagtcatgtcgcccgcctgg

SEQ ID NO: 284956 - DNA, 25 bp, Mus musculus
cctggagaacatcgagcccgagatc

SEQ ID NO: 284957 - DNA, 25 bp, Mus musculus
catcgagcccgagatcgtgtatgca

SEQ ID NO: 284958 - DNA, 25 bp, Mus musculus
ctcgcctcgatcacgcgtgcgctca

SEQ ID NO: 284959 - DNA, 25 bp, Mus musculus
cccgtccatgatcctggagaacatc

SEQ ID NO: 284960 - DNA, 25 bp, Mus musculus
attccaagcctgacaccgccgagag

SEQ ID NO: 284961 - DNA, 25 bp, Mus musculus
agagcctgctctccacgctcaaccg

SEQ ID NO: 284962 - DNA, 25 bp, Mus musculus
gctcaaccgcctggcgggcaagcag

SEQ ID NO: 284963 - DNA, 25 bp, Mus musculus
ggcgggcaagcagatgatccaagtc

SEQ ID NO: 284964 - DNA, 25 bp, Mus musculus
agcagatgatccaagtcgtgaagtg

SEQ ID NO: 284965 - DNA, 25 bp, Mus musculus
ccaagtcgtgaagtgggccaaggta

SEQ ID NO: 284966 - DNA, 25 bp, Mus musculus
cgtgaagtgggccaaggtacttcca

SEQ ID NO: 284967 - DNA, 25 bp, Mus musculus
tacttccaggtaggaccgcgggctg

SEQ ID NO: 284968 - DNA, 25 bp, Mus musculus
tatgcaggctacgacaattccaagc

SEQ ID NO: 284969 - DNA, 25 bp, Mus musculus
cccgagatcgtgtatgcaggctacg

SEQ ID NO: 284970 - DNA, 25 bp, Mus musculus
gacccgctggctttcgatgggctca

SEQ ID NO: 284971 - DNA, 25 bp, Mus musculus
atcttctgatgaggagctgctgggc

SEQ ID NO: 284972 - DNA, 25 bp, Mus musculus
tgctgaaaggcccaccgacattcga

SEQ ID NO: 284973 - DNA, 25 bp, Mus musculus
gaggattcgctaccatcttctgatg

SEQ ID NO: 284974 - DNA, 25 bp, Mus musculus
taacgcggcacctggatgaggattc

SEQ ID NO: 284975 - DNA, 25 bp, Mus musculus
ggctcagcctaacgcggcacctgga

SEQ ID NO: 284976 - DNA, 25 bp, Mus musculus
tgcaggacccactctaccctctctc

SEQ ID NO: 284977 - DNA, 25 bp, Mus musculus
ttcgatgggctcagcctaacgcggc

SEQ ID NO: 284978 - DNA, 25 bp, Mus musculus
ggcacctggatgaggattcgctacc

SEQ ID NO: 284979 - DNA, 25 bp, Mus musculus
gctggctttcgatgggctcagccta

SEQ ID NO: 284980 - DNA, 25 bp, Mus musculus
gatctacgtctccaacgcgcgggcg

SEQ ID NO: 284981 - DNA, 25 bp, Mus musculus
acaccaggtgcggttgctgaaaggc

SEQ ID NO: 284982 - DNA, 25 bp, Mus musculus
cgcgcacaccaggtgcggttgctga

SEQ ID NO: 284983 - DNA, 25 bp, Mus musculus
accgacattcgaggacccgctggct

SEQ ID NO: 284984 - DNA, 25 bp, Mus musculus
ttatccgccctattcagcgggaccg

SEQ ID NO: 284985 - DNA, 25 bp, Mus musculus
catccaggccagcacagcacgagta

SEQ ID NO: 284986 - DNA, 25 bp, Mus musculus
ctcccagggtagagcttgcaaaagg

SEQ ID NO: 284987 - DNA, 25 bp, Mus musculus
gaaagaactacaggtcgcggggaca

SEQ ID NO: 284988 - DNA, 25 bp, Mus musculus
tctgcctgggagaattaacgacgtc

SEQ ID NO: 284989 - DNA, 25 bp, Mus musculus
atgagtcatactgagagcgaccttc

SEQ ID NO: 284990 - DNA, 25 bp, Mus musculus
cctcagcttgtcttcatttttcgtc

SEQ ID NO: 284991 - DNA, 25 bp, Mus musculus
actttggtaatcgaggccgcactga

SEQ ID NO: 284992 - DNA, 25 bp, Mus musculus
cgtggacagtgcgtaactttggtaa

SEQ ID NO: 284993 - DNA, 25 bp, Mus musculus
agcgaagatgctcagtgcgtggaca

SEQ ID NO: 284994 - DNA, 25 bp, Mus musculus
ccgacagcggtcagcgaaatccatc

SEQ ID NO: 284995 - DNA, 25 bp, Mus musculus
gcgctgcgtttgttcccaccgacag

SEQ ID NO: 284996 - DNA, 25 bp, Mus musculus
acagcacgagtaacgccagcctaga

SEQ ID NO: 284997 - DNA, 25 bp, Mus musculus
agatcaccaggttgtccagtgcacc

SEQ ID NO: 284998 - DNA, 25 bp, Mus musculus
gtttgtaatagcaggcctcggtccc

SEQ ID NO: 284999 - DNA, 25 bp, Mus musculus
cccgagatcagacgacttaaaagtc

SEQ ID NO: 285000 - DNA, 25 bp, Mus musculus
atcagacgacttaaaagtcggggcg

SEQ ID NO: 285001 - DNA, 25 bp, Mus musculus
ggcgggtggaaatgattgactcatt

SEQ ID NO: 285002 - DNA, 25 bp, Mus musculus
tgcttcgctgtgcaagggctcgcac

SEQ ID NO: 285003 - DNA, 25 bp, Mus musculus
tggtgggtttgtaatagcaggcctc

SEQ ID NO: 285004 - DNA, 25 bp, Mus musculus
ttcgctgtgcaagggctcgcacgcc

SEQ ID NO: 285005 - DNA, 25 bp, Mus musculus
ctctctctccttgtctaatcagctg

SEQ ID NO: 285006 - DNA, 25 bp, Mus musculus
ttgtctaatcagctgccttcgcggg

SEQ ID NO: 285007 - DNA, 25 bp, Mus musculus
ccttcgcgggaatgcttaacgtctc

SEQ ID NO: 285008 - DNA, 25 bp, Mus musculus
cgggaatgcttaacgtctccaactc

SEQ ID NO: 285009 - DNA, 25 bp, Mus musculus
aatgcttaacgtctccaactcagcg

SEQ ID NO: 285010 - DNA, 25 bp, Mus musculus
taatcagctgccttcgcgggaatgc

SEQ ID NO: 285011 - DNA, 25 bp, Mus musculus
tcattttatctgtgtaccgaaggaa

SEQ ID NO: 285012 - DNA, 25 bp, Mus musculus
acccagtgcctctgtgcgtccagtt

SEQ ID NO: 285013 - DNA, 25 bp, Mus musculus
atcacagcgcttcgccgcaggatgc

SEQ ID NO: 285014 - DNA, 25 bp, Mus musculus
ctgtgtgcacccagtgcctctgtgc

SEQ ID NO: 285015 - DNA, 25 bp, Mus musculus
gcgctccctggtgtgacgtcatcac

SEQ ID NO: 285016 - DNA, 25 bp, Mus musculus
ctctgtgcgtccagttgctgcgacc

SEQ ID NO: 285017 - DNA, 25 bp, Mus musculus
cagttgctgcgaccggcccagggaa

SEQ ID NO: 285018 - DNA, 25 bp, Mus musculus
aagcgcgccgtggagactcttttcc

SEQ ID NO: 285019 - DNA, 25 bp, Mus musculus
gggcttcctgctgtgtgcacccagt

SEQ ID NO: 285020 - DNA, 25 bp, Mus musculus
cggacgaggccatcctccttcgtgg

SEQ ID NO: 285021 - DNA, 25 bp, Mus musculus
atcctccttcgtgggcttccgagcg

SEQ ID NO: 285022 - DNA, 25 bp, Mus musculus
ggcttccgagcgagacttatccatg

SEQ ID NO: 285023 - DNA, 25 bp, Mus musculus
gcgagacttatccatgccgaactcg

SEQ ID NO: 285024 - DNA, 25 bp, Mus musculus
gtgacgtcatcacagcgcttcgccg

SEQ ID NO: 285025 - DNA, 25 bp, Mus musculus
tggagactcttttcccggacgaggc

SEQ ID NO: 285026 - DNA, 25 bp, Mus musculus
tctcggactgtctttacgtaactgc

SEQ ID NO: 285027 - DNA, 25 bp, Mus musculus
ttccaggcaagctgtcggagtgttc

SEQ ID NO: 285028 - DNA, 25 bp, Mus musculus
aggcttctgtccaactgagtctcca

SEQ ID NO: 285029 - DNA, 25 bp, Mus musculus
tccggtctcaatcctctagcttgtg

SEQ ID NO: 285030 - DNA, 25 bp, Mus musculus
gatctgcgcactgatggtgacctta

SEQ ID NO: 285031 - DNA, 25 bp, Mus musculus
tttctccttctctcgggttgcgtgc

SEQ ID NO: 285032 - DNA, 25 bp, Mus musculus
gattagatgtacttcggctcgctgg

SEQ ID NO: 285033 - DNA, 25 bp, Mus musculus
catccctaggctgagaagagtcttc

SEQ ID NO: 285034 - DNA, 25 bp, Mus musculus
agattaaagctgtggacggccgacc

SEQ ID NO: 285035 - DNA, 25 bp, Mus musculus
aagagtctcttccttgcgctgcttc

SEQ ID NO: 285036 - DNA, 25 bp, Mus musculus
gctgacccgctttctgccattcttg

SEQ ID NO: 285037 - DNA, 25 bp, Mus musculus
ccattcttgttcgacgccagggaca

SEQ ID NO: 285038 - DNA, 25 bp, Mus musculus
cgccagggacagcatggactttcac

SEQ ID NO: 285039 - DNA, 25 bp, Mus musculus
cggcagcagcgtttcttgtcagcta

SEQ ID NO: 285040 - DNA, 25 bp, Mus musculus
tggaggtcacccagagtctccgctg

SEQ ID NO: 285041 - DNA, 25 bp, Mus musculus
ctggcgccctataggaaaagattta

SEQ ID NO: 285042 - DNA, 25 bp, Mus musculus
cgcgttctcgggtcgctctgtgttt

SEQ ID NO: 285043 - DNA, 25 bp, Mus musculus
tcgctctgtgtttgcggctgctgca

SEQ ID NO: 285044 - DNA, 25 bp, Mus musculus
gcaggtgcaggctgcatcctcgccg

SEQ ID NO: 285045 - DNA, 25 bp, Mus musculus
atcctcgccggccaacccgcatgga

SEQ ID NO: 285046 - DNA, 25 bp, Mus musculus
catggactcagtgccgccgcggcgt

SEQ ID NO: 285047 - DNA, 25 bp, Mus musculus
gtcgcctccgcctcacctggaggtc

SEQ ID NO: 285048 - DNA, 25 bp, Mus musculus
gcgccctataggaaaagatttacta

SEQ ID NO: 285049 - DNA, 25 bp, Mus musculus
cgctttttcggttgtcttctccgct

SEQ ID NO: 285050 - DNA, 25 bp, Mus musculus
ttttcggttgtcttctccgctggcg

SEQ ID NO: 285051 - DNA, 25 bp, Mus musculus
tccgctggcgccctataggaaaaga

SEQ ID NO: 285052 - DNA, 25 bp, Mus musculus
gaaaagatttactagccgctggcgc

SEQ ID NO: 285053 - DNA, 25 bp, Mus musculus
cagagtctccgctgcatcgtgaccc

SEQ ID NO: 285054 - DNA, 25 bp, Mus musculus
ctcttactctgggagacgatgtcca

SEQ ID NO: 285055 - DNA, 25 bp, Mus musculus
gcgatcttctccgaggagggccttg

SEQ ID NO: 285056 - DNA, 25 bp, Mus musculus
agtaggcttccagagagcgcttctc

SEQ ID NO: 285057 - DNA, 25 bp, Mus musculus
ttctccgcgccattgaagagctccg

SEQ ID NO: 285058 - DNA, 25 bp, Mus musculus
tccggcttagtgagcttctcgcggt

SEQ ID NO: 285059 - DNA, 25 bp, Mus musculus
cggtgggatttctcagcttcctcca

SEQ ID NO: 285060 - DNA, 25 bp, Mus musculus
tgtgacagcgtgagagactcaaacc

SEQ ID NO: 285061 - DNA, 25 bp, Mus musculus
cgtcgctgcttgaaacgctcggcga

SEQ ID NO: 285062 - DNA, 25 bp, Mus musculus
gcgggtctgcatccacgtcgctcat

SEQ ID NO: 285063 - DNA, 25 bp, Mus musculus
aggcacacattacgctcagcaggga

SEQ ID NO: 285064 - DNA, 25 bp, Mus musculus
gggcttaggtgctcaagcagctcgc

SEQ ID NO: 285065 - DNA, 25 bp, Mus musculus
gcccgccgaatatattgctctgcaa

SEQ ID NO: 285066 - DNA, 25 bp, Mus musculus
gcagggaattgtgagcgctctctcc

SEQ ID NO: 285067 - DNA, 25 bp, Mus musculus
ctcatgcagcccatgtgcgagggca

SEQ ID NO: 285068 - DNA, 25 bp, Mus musculus
gcgcgctcgtcgctggcgcactccg

SEQ ID NO: 285069 - DNA, 25 bp, Mus musculus
cgtgaggcatgctgaacgcctgctt

SEQ ID NO: 285070 - DNA, 25 bp, Mus musculus
ccagctacccgaccctccggagaag

SEQ ID NO: 285071 - DNA, 25 bp, Mus musculus
ctgcctgcgtgaggcatgctgaacg

SEQ ID NO: 285072 - DNA, 25 bp, Mus musculus
gcgcactccggtcccagctacccga

SEQ ID NO: 285073 - DNA, 25 bp, Mus musculus
aggcatgctgaacgcctgcttgctg

SEQ ID NO: 285074 - DNA, 25 bp, Mus musculus
catgctgaacgcctgcttgctgttc

SEQ ID NO: 285075 - DNA, 25 bp, Mus musculus
tgaacgcctgcttgctgttcaggga

SEQ ID NO: 285076 - DNA, 25 bp, Mus musculus
ctgcttgctgttcagggacatcatc

SEQ ID NO: 285077 - DNA, 25 bp, Mus musculus
gcttgctgttcagggacatcatcat

SEQ ID NO: 285078 - DNA, 25 bp, Mus musculus
gctgttcagggacatcatcatcatc

SEQ ID NO: 285079 - DNA, 25 bp, Mus musculus
atcatctttccttgcgcggcgcgct

SEQ ID NO: 285080 - DNA, 25 bp, Mus musculus
cctgcgtgaggcatgctgaacgcct

SEQ ID NO: 285081 - DNA, 25 bp, Mus musculus
cgcctgcttgctgttcagggacatc

SEQ ID NO: 285082 - DNA, 25 bp, Mus musculus
tctcagcggattggacagccacaca

SEQ ID NO: 285083 - DNA, 25 bp, Mus musculus
gcgacccgggtcctctgctctgctc

SEQ ID NO: 285084 - DNA, 25 bp, Mus musculus
cgttagtgtcctctatgcgcatgcg

SEQ ID NO: 285085 - DNA, 25 bp, Mus musculus
agcccgttagtgtcctctatgcgca

SEQ ID NO: 285086 - DNA, 25 bp, Mus musculus
acacagcccgttagtgtcctctatg

SEQ ID NO: 285087 - DNA, 25 bp, Mus musculus
tggacagccacacagcccgttagtg

SEQ ID NO: 285088 - DNA, 25 bp, Mus musculus
gattggacagccacacagcccgtta

SEQ ID NO: 285089 - DNA, 25 bp, Mus musculus
ctccctcgatttccctcagctctca

SEQ ID NO: 285090 - DNA, 25 bp, Mus musculus
aaagacgtgggtctgcccggctgca

SEQ ID NO: 285091 - DNA, 25 bp, Mus musculus
cgggtgcctagtgcagaaagacgtg

SEQ ID NO: 285092 - DNA, 25 bp, Mus musculus
ctttgcatcccaccgcccggcgggt

SEQ ID NO: 285093 - DNA, 25 bp, Mus musculus
ctgagctcccgccttgatgcgtgct

SEQ ID NO: 285094 - DNA, 25 bp, Mus musculus
cagctctcagcggattggacagcca

SEQ ID NO: 285095 - DNA, 25 bp, Mus musculus
ccttgatgcgtgctgaggtcagccc

SEQ ID NO: 285096 - DNA, 25 bp, Mus musculus
cgcgtctattctgaggtgcgtggta

SEQ ID NO: 285097 - DNA, 25 bp, Mus musculus
tcgtcgccgtaatgtctcgagtata

SEQ ID NO: 285098 - DNA, 25 bp, Mus musculus
tacgcgcatagacatagcaggcatt

SEQ ID NO: 285099 - DNA, 25 bp, Mus musculus
agagacgctctctgcaaggcatgtc

SEQ ID NO: 285100 - DNA, 25 bp, Mus musculus
tcgggccgccgtcaatatagcttta

SEQ ID NO: 285101 - DNA, 25 bp, Mus musculus
tttactgcagcgacacccatgatga

SEQ ID NO: 285102 - DNA, 25 bp, Mus musculus
actcgtctcacttgcgtgctcctgg

SEQ ID NO: 285103 - DNA, 25 bp, Mus musculus
cgctcagcgaggctttcctgtcact

SEQ ID NO: 285104 - DNA, 25 bp, Mus musculus
tcctgtcactgggtactactactcc

SEQ ID NO: 285105 - DNA, 25 bp, Mus musculus
cggtctttagtttacgagtggcaat

SEQ ID NO: 285106 - DNA, 25 bp, Mus musculus
tgacttgctctgctgcatgtctgga

SEQ ID NO: 285107 - DNA, 25 bp, Mus musculus
tcgcagtttggaaagcaagccagcc

SEQ ID NO: 285108 - DNA, 25 bp, Mus musculus
tgctcggccaccgattttcaaccta

SEQ ID NO: 285109 - DNA, 25 bp, Mus musculus
gtcctgttagtgcagcccgtgactc

SEQ ID NO: 285110 - DNA, 25 bp, Mus musculus
cagaacgcgttagtgagctggcttc

SEQ ID NO: 285111 - DNA, 25 bp, Mus musculus
ccgcggggatcaaaaacagtcagaa

SEQ ID NO: 285112 - DNA, 25 bp, Mus musculus
cttgcctatggcgacccgcggggat

SEQ ID NO: 285113 - DNA, 25 bp, Mus musculus
atcagcgtcctccttgcctatggcg

SEQ ID NO: 285114 - DNA, 25 bp, Mus musculus
tccagaacgctcacaggccgggctt

SEQ ID NO: 285115 - DNA, 25 bp, Mus musculus
cttgcagccggatccagaacgctca

SEQ ID NO: 285116 - DNA, 25 bp, Mus musculus
ttagtgagctggcttccaagaccgg

SEQ ID NO: 285117 - DNA, 25 bp, Mus musculus
agcatctcctgggacgcaggcccgg

SEQ ID NO: 285118 - DNA, 25 bp, Mus musculus
accagcgagcatctcctgggacgca

SEQ ID NO: 285119 - DNA, 25 bp, Mus musculus
gcgtggcccagaccagcgagcatct

SEQ ID NO: 285120 - DNA, 25 bp, Mus musculus
atttactttccgtcgcgcagggctc

SEQ ID NO: 285121 - DNA, 25 bp, Mus musculus
cctccgctcgtctgtatttactttc

SEQ ID NO: 285122 - DNA, 25 bp, Mus musculus
agcaaggaccatttcctccgctcgt

SEQ ID NO: 285123 - DNA, 25 bp, Mus musculus
cgaggccgtcagcaaggaccatttc

SEQ ID NO: 285124 - DNA, 25 bp, Mus musculus
tgctcggagcccgatcctgcaaaac

SEQ ID NO: 285125 - DNA, 25 bp, Mus musculus
acataaaatcactcgcaggcggctg

SEQ ID NO: 285126 - DNA, 25 bp, Mus musculus
cttcgcgaaatctccgcggcggtgc

SEQ ID NO: 285127 - DNA, 25 bp, Mus musculus
ctttcttcgcctgcccgctagaggt

SEQ ID NO: 285128 - DNA, 25 bp, Mus musculus
cgcacagggctagggttatgctttt

SEQ ID NO: 285129 - DNA, 25 bp, Mus musculus
ttcccggtatgcaaggagtcgacgc

SEQ ID NO: 285130 - DNA, 25 bp, Mus musculus
cgggcagtctgctccgcaaacattc

SEQ ID NO: 285131 - DNA, 25 bp, Mus musculus
cccgctagaggttctgaggataata

SEQ ID NO: 285132 - DNA, 25 bp, Mus musculus
cggctgcgagtgtaggaaaattttg

SEQ ID NO: 285133 - DNA, 25 bp, Mus musculus
cccgcttttctttgcgagactctta

SEQ ID NO: 285134 - DNA, 25 bp, Mus musculus
gacggagggtcagtttctcctcttc

SEQ ID NO: 285135 - DNA, 25 bp, Mus musculus
tggtcggtcacctgaagttcacgga

SEQ ID NO: 285136 - DNA, 25 bp, Mus musculus
gcgagcgcgatcgatctctccttcg

SEQ ID NO: 285137 - DNA, 25 bp, Mus musculus
tcggagtgttccgagatgctgctga

SEQ ID NO: 285138 - DNA, 25 bp, Mus musculus
actagactggggatatagctcggga

SEQ ID NO: 285139 - DNA, 25 bp, Mus musculus
ttggtcggctattgaactctctgtc

SEQ ID NO: 285140 - DNA, 25 bp, Mus musculus
tagagcgtgtgagagccgagcattc

SEQ ID NO: 285141 - DNA, 25 bp, Mus musculus
cagagcatgcgtgggctgagcattt

SEQ ID NO: 285142 - DNA, 25 bp, Mus musculus
aacactgtcagagcgtgcgtggtca

SEQ ID NO: 285143 - DNA, 25 bp, Mus musculus
tagctcgggatggaacactgtcaga

SEQ ID NO: 285144 - DNA, 25 bp, Mus musculus
ggctcagtctcaaggaaggaaagga

SEQ ID NO: 285145 - DNA, 25 bp, Mus musculus
ctttccagatgaatacatagtggta

SEQ ID NO: 285146 - DNA, 25 bp, Mus musculus
atcctagcttagcttaatgagaccc

SEQ ID NO: 285147 - DNA, 25 bp, Mus musculus
agactcctcaacaaatcctagctta

SEQ ID NO: 285148 - DNA, 25 bp, Mus musculus
agactcacagggtcaagactcctca

SEQ ID NO: 285149 - DNA, 25 bp, Mus musculus
actcaggatcagttctggcctcagc

SEQ ID NO: 285150 - DNA, 25 bp, Mus musculus
ctctgtcacctaggctaccttgaac

SEQ ID NO: 285151 - DNA, 25 bp, Mus musculus
cctaagtgctttggtttcatgcggc

SEQ ID NO: 285152 - DNA, 25 bp, Mus musculus
cgtgctgtctggacgaacccaaaaa

SEQ ID NO: 285153 - DNA, 25 bp, Mus musculus
agaaattctgtgctgtctgggacgc

SEQ ID NO: 285154 - DNA, 25 bp, Mus musculus
tgagcgctgccgcaaaggaaaaatc

SEQ ID NO: 285155 - DNA, 25 bp, Mus musculus
cccttgacgtcaccaggaggtagtc

SEQ ID NO: 285156 - DNA, 25 bp, Mus musculus
cggactactacgcagggctctcgta

SEQ ID NO: 285157 - DNA, 25 bp, Mus musculus
ctgggcgctgcttgtgaacagcact

SEQ ID NO: 285158 - DNA, 25 bp, Mus musculus
gcaacgcgttcctaggatgcccgta

SEQ ID NO: 285159 - DNA, 25 bp, Mus musculus
tctccgcgctggaaaagtcgttgct

SEQ ID NO: 285160 - DNA, 25 bp, Mus musculus
tcccggcttctgcacttggcagctt

SEQ ID NO: 285161 - DNA, 25 bp, Mus musculus
ataatgcaccgcttcccgcgcgaga

SEQ ID NO: 285162 - DNA, 25 bp, Mus musculus
aaaagcgcgcgcctcccataatgca

SEQ ID NO: 285163 - DNA, 25 bp, Mus musculus
cttctgatccggagtcgccattacc

SEQ ID NO: 285164 - DNA, 25 bp, Mus musculus
agagtcctcgtcactgggagcccag

SEQ ID NO: 285165 - DNA, 25 bp, Mus musculus
tctgcagcagaacgttgggcgactt

SEQ ID NO: 285166 - DNA, 25 bp, Mus musculus
ggcccacgagaacctgacagcagcg

SEQ ID NO: 285167 - DNA, 25 bp, Mus musculus
agacaccgctttgtgactcccagtg

SEQ ID NO: 285168 - DNA, 25 bp, Mus musculus
gtgactcccagtgaaccctgcttta

SEQ ID NO: 285169 - DNA, 25 bp, Mus musculus
ccctgctttataacctgcaaatctg

SEQ ID NO: 285170 - DNA, 25 bp, Mus musculus
tagcactgaacagcctccgggcctg

SEQ ID NO: 285171 - DNA, 25 bp, Mus musculus
cgactgcgacgcctttcttatgtaa

SEQ ID NO: 285172 - DNA, 25 bp, Mus musculus
agtcgcttagcgaaggctgtcccgc

SEQ ID NO: 285173 - DNA, 25 bp, Mus musculus
cacctggaatgcgtcctggcttcgg

SEQ ID NO: 285174 - DNA, 25 bp, Mus musculus
tccttccgcgcctggaaacgtgaga

SEQ ID NO: 285175 - DNA, 25 bp, Mus musculus
tgaggacgacgtaggcaaactttgc

SEQ ID NO: 285176 - DNA, 25 bp, Mus musculus
actttgcagagcacgttgccacctg

SEQ ID NO: 285177 - DNA, 25 bp, Mus musculus
ttgccacctgttggagtagccgctc

SEQ ID NO: 285178 - DNA, 25 bp, Mus musculus
gcgacggtgtttggcaacccagaca

SEQ ID NO: 285179 - DNA, 25 bp, Mus musculus
ttatgtaaggaaaaagcgctcagtc

SEQ ID NO: 285180 - DNA, 25 bp, Mus musculus
cgcctacttcgggtaggtgcccgcg

SEQ ID NO: 285181 - DNA, 25 bp, Mus musculus
gcgcttttttctggcgctcgcccga

SEQ ID NO: 285182 - DNA, 25 bp, Mus musculus
atccagatgttccttgcactgagcc

SEQ ID NO: 285183 - DNA, 25 bp, Mus musculus
ctgccaaaaggctggagcctccctg

SEQ ID NO: 285184 - DNA, 25 bp, Mus musculus
ttaggccgcggtgttcctgccaaaa

SEQ ID NO: 285185 - DNA, 25 bp, Mus musculus
gcggtccacggtgactcccgagtcg

SEQ ID NO: 285186 - DNA, 25 bp, Mus musculus
gttgcccgccgtgcgccctagaggt

SEQ ID NO: 285187 - DNA, 25 bp, Mus musculus
gcaagatgctggatgggtcccttct

SEQ ID NO: 285188 - DNA, 25 bp, Mus musculus
cttctggctccgttactcgaccggg

SEQ ID NO: 285189 - DNA, 25 bp, Mus musculus
gggtctaaccctgctctgtctctca

SEQ ID NO: 285190 - DNA, 25 bp, Mus musculus
cgcacttgtgtcctggctgcagaca

SEQ ID NO: 285191 - DNA, 25 bp, Mus musculus
cacccggtccctaactgtcaggaga

SEQ ID NO: 285192 - DNA, 25 bp, Mus musculus
atcgagcccggggtagcactcgcca

SEQ ID NO: 285193 - DNA, 25 bp, Mus musculus
tcgttagttggcagcgagcgcgcct

SEQ ID NO: 285194 - DNA, 25 bp, Mus musculus
cgcgcggcacaggacaagtctgtct

SEQ ID NO: 285195 - DNA, 25 bp, Mus musculus
gagaactggacacgcccgacaaaga

SEQ ID NO: 285196 - DNA, 25 bp, Mus musculus
cccaaatcaggctgtgtggggaccc

SEQ ID NO: 285197 - DNA, 25 bp, Mus musculus
cagagggaactacgctacgaacttt

SEQ ID NO: 285198 - DNA, 25 bp, Mus musculus
ggccgccagacctttgaataaatca

SEQ ID NO: 285199 - DNA, 25 bp, Mus musculus
acaagtctgtctcgagtcggctcgg

SEQ ID NO: 285200 - DNA, 25 bp, Mus musculus
gaaacactaacaaagacggtctgga

SEQ ID NO: 285201 - DNA, 25 bp, Mus musculus
gcgtcccggagctcgtcccagattt

SEQ ID NO: 285202 - DNA, 25 bp, Mus musculus
gaacagttgttctcggcgctcggaa

SEQ ID NO: 285203 - DNA, 25 bp, Mus musculus
acggtctggacgagaacagttgttc

SEQ ID NO: 285204 - DNA, 25 bp, Mus musculus
cgcagtgaggcaatcgaatccggta

SEQ ID NO: 285205 - DNA, 25 bp, Mus musculus
gtacgctcggctttaccggctcggc

SEQ ID NO: 285206 - DNA, 25 bp, Mus musculus
cccgagcctggattgatctggtcgc

SEQ ID NO: 285207 - DNA, 25 bp, Mus musculus
gcgcgtccatccagggagacccgag

SEQ ID NO: 285208 - DNA, 25 bp, Mus musculus
aaggcagttctaggttcggcaccgc

SEQ ID NO: 285209 - DNA, 25 bp, Mus musculus
gggctcacctatgctccgggagagc

SEQ ID NO: 285210 - DNA, 25 bp, Mus musculus
ttcggcaccgctagcattgtaggga

SEQ ID NO: 285211 - DNA, 25 bp, Mus musculus
tcctgccgcggcttaaactacaact

SEQ ID NO: 285212 - DNA, 25 bp, Mus musculus
cgccgagggctgaaagcgaaaacaa

SEQ ID NO: 285213 - DNA, 25 bp, Mus musculus
attctaggctgcgaggttgctgccc

SEQ ID NO: 285214 - DNA, 25 bp, Mus musculus
gcaggcctcgcttaatctcagccgg

SEQ ID NO: 285215 - DNA, 25 bp, Mus musculus
ttttctcgcctcacaccggtcgaga

SEQ ID NO: 285216 - DNA, 25 bp, Mus musculus
atggccatgcactaggctgggctca

SEQ ID NO: 285217 - DNA, 25 bp, Mus musculus
gcttgtatcggaaattggtcgccaa

SEQ ID NO: 285218 - DNA, 25 bp, Mus musculus
cctatctgcgcaaactgggcttgta

SEQ ID NO: 285219 - DNA, 25 bp, Mus musculus
gtggctttctctccgcgtttcctcg

SEQ ID NO: 285220 - DNA, 25 bp, Mus musculus
taagcgacagacaccctcgggcctg

SEQ ID NO: 285221 - DNA, 25 bp, Mus musculus
atgagacgcccatggacgcctatct

SEQ ID NO: 285222 - DNA, 25 bp, Mus musculus
gtctccgctactgaggcctaactta

SEQ ID NO: 285223 - DNA, 25 bp, Mus musculus
cagcggctctccctcggtttagaga

SEQ ID NO: 285224 - DNA, 25 bp, Mus musculus
gtagagcccttctccctagtctcgg

SEQ ID NO: 285225 - DNA, 25 bp, Mus musculus
agcgggccgtgtctggaatacagac

SEQ ID NO: 285226 - DNA, 25 bp, Mus musculus
aggcgttccgactgtgtccctaaga

SEQ ID NO: 285227 - DNA, 25 bp, Mus musculus
ccctaagagtcttcccaaggtggca

SEQ ID NO: 285228 - DNA, 25 bp, Mus musculus
ccgcgaattctcgtacctggagaca

SEQ ID NO: 285229 - DNA, 25 bp, Mus musculus
tcaggtcttagcacacagcgtgttc

SEQ ID NO: 285230 - DNA, 25 bp, Mus musculus
ctcgcgcaaggcatgagggcatagt

SEQ ID NO: 285231 - DNA, 25 bp, Mus musculus
gacgccaatgaactgagggagccta

SEQ ID NO: 285232 - DNA, 25 bp, Mus musculus
agcctagaatcgtcgagccgcagtg

SEQ ID NO: 285233 - DNA, 25 bp, Mus musculus
aatcaggtgtgtaagacagcggctc

SEQ ID NO: 285234 - DNA, 25 bp, Mus musculus
ccaaagcagcgctagccgtcaggtc

SEQ ID NO: 285235 - DNA, 25 bp, Mus musculus
ctgagaaccggaattgtggcgaatc

SEQ ID NO: 285236 - DNA, 25 bp, Mus musculus
tctgcccggagcagcaagggcagga

SEQ ID NO: 285237 - DNA, 25 bp, Mus musculus
cagtagcagcttaaacgagagcatc

SEQ ID NO: 285238 - DNA, 25 bp, Mus musculus
tagcagcttaaacgagagcatcttc

SEQ ID NO: 285239 - DNA, 25 bp, Mus musculus
agcttaaacgagagcatcttcagca

SEQ ID NO: 285240 - DNA, 25 bp, Mus musculus
cgagagcatcttcagcatcgtctgc

SEQ ID NO: 285241 - DNA, 25 bp, Mus musculus
cactagggcgcagctccaggagagt

SEQ ID NO: 285242 - DNA, 25 bp, Mus musculus
cttcagcatcgtctgcccggagcag

SEQ ID NO: 285243 - DNA, 25 bp, Mus musculus
cggccagcagtagcagcttaaacga

SEQ ID NO: 285244 - DNA, 25 bp, Mus musculus
cgcatctccttcaaagaagcccaga

SEQ ID NO: 285245 - DNA, 25 bp, Mus musculus
gcatcttcagcatcgtctgcccgga

SEQ ID NO: 285246 - DNA, 25 bp, Mus musculus
ccaaacttcgcatctccttcaaaga

SEQ ID NO: 285247 - DNA, 25 bp, Mus musculus
aagcccagagccacggccagcagta

SEQ ID NO: 285248 - DNA, 25 bp, Mus musculus
agccacggccagcagtagcagctta

SEQ ID NO: 285249 - DNA, 25 bp, Mus musculus
ccacggccagcagtagcagcttaaa

SEQ ID NO: 285250 - DNA, 25 bp, Mus musculus
acggacgagggagccctccgagcca

SEQ ID NO: 285251 - DNA, 25 bp, Mus musculus
ggcccaggagctagcgctcgccggg

SEQ ID NO: 285252 - DNA, 25 bp, Mus musculus
tcggaacctggaacgcaacggtgcc

SEQ ID NO: 285253 - DNA, 25 bp, Mus musculus
acacggacgagggagccctccgagc

SEQ ID NO: 285254 - DNA, 25 bp, Mus musculus
cggaacctggaacgcaacggtgccg

SEQ ID NO: 285255 - DNA, 25 bp, Mus musculus
agggagccctccgagccagcctctg

SEQ ID NO: 285256 - DNA, 25 bp, Mus musculus
cagcctctggggctcggaacctgga

SEQ ID NO: 285257 - DNA, 25 bp, Mus musculus
agcctctggggctcggaacctggaa

SEQ ID NO: 285258 - DNA, 25 bp, Mus musculus
ctctggggctcggaacctggaacgc

SEQ ID NO: 285259 - DNA, 25 bp, Mus musculus
ctggggctcggaacctggaacgcaa

SEQ ID NO: 285260 - DNA, 25 bp, Mus musculus
tggggctcggaacctggaacgcaac

SEQ ID NO: 285261 - DNA, 25 bp, Mus musculus
gctcggaacctggaacgcaacggtg

SEQ ID NO: 285262 - DNA, 25 bp, Mus musculus
ctcggaacctggaacgcaacggtgc

SEQ ID NO: 285263 - DNA, 25 bp, Mus musculus
aggagctagcgctcgccggggccca

SEQ ID NO: 285264 - DNA, 25 bp, Mus musculus
gcagggttggcgctgggctcccgag

SEQ ID NO: 285265 - DNA, 25 bp, Mus musculus
ctcccgaggatgctgaggtctcctc

SEQ ID NO: 285266 - DNA, 25 bp, Mus musculus
tcccgaggatgctgaggtctcctct

SEQ ID NO: 285267 - DNA, 25 bp, Mus musculus
cccgaggatgctgaggtctcctctg

SEQ ID NO: 285268 - DNA, 25 bp, Mus musculus
cgaggatgctgaggtctcctctgcc

SEQ ID NO: 285269 - DNA, 25 bp, Mus musculus
aggatgctgaggtctcctctgccgg

SEQ ID NO: 285270 - DNA, 25 bp, Mus musculus
atgctgaggtctcctctgccggcgg

SEQ ID NO: 285271 - DNA, 25 bp, Mus musculus
gctgaggtctcctctgccggcggct

SEQ ID NO: 285272 - DNA, 25 bp, Mus musculus
gaggtctcctctgccggcggctgca

SEQ ID NO: 285273 - DNA, 25 bp, Mus musculus
cggcggctgcagcttctcacacagc

SEQ ID NO: 285274 - DNA, 25 bp, Mus musculus
gctcccgaggatgctgaggtctcct

SEQ ID NO: 285275 - DNA, 25 bp, Mus musculus
cttcttctttttaactagcgcgcgg

SEQ ID NO: 285276 - DNA, 25 bp, Mus musculus
tctcatgtttcgctccctcttttct

SEQ ID NO: 285277 - DNA, 25 bp, Mus musculus
tcacacagcctctcatgtttcgctc

SEQ ID NO: 285278 - DNA, 25 bp, Mus musculus
atctagtgattcgagtgcagcgcgg

SEQ ID NO: 285279 - DNA, 25 bp, Mus musculus
cccactgcgggatctagtgattcga

SEQ ID NO: 285280 - DNA, 25 bp, Mus musculus
tccctgtgatttcggggcccaacag

SEQ ID NO: 285281 - DNA, 25 bp, Mus musculus
cacagggccgctcggtttggcttaa

SEQ ID NO: 285282 - DNA, 25 bp, Mus musculus
ccgcaccaatttccctgtgatttcg

SEQ ID NO: 285283 - DNA, 25 bp, Mus musculus
aactccgggttccaagtgccacagg

SEQ ID NO: 285284 - DNA, 25 bp, Mus musculus
ttggcttaacccactgcgggatcta

SEQ ID NO: 285285 - DNA, 25 bp, Mus musculus
agtgctggacttcccgcggctccaa

SEQ ID NO: 285286 - DNA, 25 bp, Mus musculus
gcgctatgacgcagggaattccacg

SEQ ID NO: 285287 - DNA, 25 bp, Mus musculus
tacagctgcaggtgcgctatgacgc

SEQ ID NO: 285288 - DNA, 25 bp, Mus musculus
acaagaacccggatacagctgcagg

SEQ ID NO: 285289 - DNA, 25 bp, Mus musculus
gttaagtacactcacttcggctcgc

SEQ ID NO: 285290 - DNA, 25 bp, Mus musculus
gggcccaacaggttaagtacactca

SEQ ID NO: 285291 - DNA, 25 bp, Mus musculus
tgcaaggtgacagtgctggacttcc

SEQ ID NO: 285292 - DNA, 25 bp, Mus musculus
aacctaaatcgggagaaattgagcg

SEQ ID NO: 285293 - DNA, 25 bp, Mus musculus
aggaacatgtgtttcgtaagagcga

SEQ ID NO: 285294 - DNA, 25 bp, Mus musculus
aacatgtgtttcgtaagagcgatcc

SEQ ID NO: 285295 - DNA, 25 bp, Mus musculus
atgtgtttcgtaagagcgatccgcg

SEQ ID NO: 285296 - DNA, 25 bp, Mus musculus
tcggccccagtaatcaggaacatgt

SEQ ID NO: 285297 - DNA, 25 bp, Mus musculus
tttcgtaagagcgatccgcggtcgg

SEQ ID NO: 285298 - DNA, 25 bp, Mus musculus
ccgcggtcgggctaggctagctaca

SEQ ID NO: 285299 - DNA, 25 bp, Mus musculus
ggtcgggctaggctagctacaccga

SEQ ID NO: 285300 - DNA, 25 bp, Mus musculus
ctaggctagctacaccgaggggaaa

SEQ ID NO: 285301 - DNA, 25 bp, Mus musculus
aggctagctacaccgaggggaaaag

SEQ ID NO: 285302 - DNA, 25 bp, Mus musculus
gaaaaggtaaaggtgaagagcagga

SEQ ID NO: 285303 - DNA, 25 bp, Mus musculus
aagagcaggagacgcgccggccgag

SEQ ID NO: 285304 - DNA, 25 bp, Mus musculus
acgcgccggccgagcatccacctcc

SEQ ID NO: 285305 - DNA, 25 bp, Mus musculus
tgtttcgtaagagcgatccgcggtc

SEQ ID NO: 285306 - DNA, 25 bp, Mus musculus
ggcgatcgaacctctcccgcagatt

SEQ ID NO: 285307 - DNA, 25 bp, Mus musculus
aggtcctgatcagcctagggagttc

SEQ ID NO: 285308 - DNA, 25 bp, Mus musculus
ccctctgctcggaaaagggcgcctg

SEQ ID NO: 285309 - DNA, 25 bp, Mus musculus
agaggggctcgatcttctctttccc

SEQ ID NO: 285310 - DNA, 25 bp, Mus musculus
cccgttggcgcattcacactgagag

SEQ ID NO: 285311 - DNA, 25 bp, Mus musculus
agcccagaactggaagccctgcgct

SEQ ID NO: 285312 - DNA, 25 bp, Mus musculus
actctgtccggacagggagcccaga

SEQ ID NO: 285313 - DNA, 25 bp, Mus musculus
tcgcggactgaagaggaactcgatc

SEQ ID NO: 285314 - DNA, 25 bp, Mus musculus
caccaaaggggtcggtggacacagt

SEQ ID NO: 285315 - DNA, 25 bp, Mus musculus
ccgtgaggactcgaggaccagacac

SEQ ID NO: 285316 - DNA, 25 bp, Mus musculus
ttgcggagccatcccgagcaaacca

SEQ ID NO: 285317 - DNA, 25 bp, Mus musculus
ataacgcttcaacttcttctccggg

SEQ ID NO: 285318 - DNA, 25 bp, Mus musculus
cggtgacctgacctgtacttacata

SEQ ID NO: 285319 - DNA, 25 bp, Mus musculus
ggctcgccgaccttctttcagtgcg

SEQ ID NO: 285320 - DNA, 25 bp, Mus musculus
tcttgttgaagaaggactcgaactc

SEQ ID NO: 285321 - DNA, 25 bp, Mus musculus
ggaacaccctgaacccggaagcaga

SEQ ID NO: 285322 - DNA, 25 bp, Mus musculus
tgcgagtacctcgatctgccaagga

SEQ ID NO: 285323 - DNA, 25 bp, Mus musculus
aggaggcactgtcaatgcgagtacc

SEQ ID NO: 285324 - DNA, 25 bp, Mus musculus
gcagttaaaagtcgccctgggttga

SEQ ID NO: 285325 - DNA, 25 bp, Mus musculus
cacatttatcgagtgggaaggccca

SEQ ID NO: 285326 - DNA, 25 bp, Mus musculus
atcgtcgccactctgcaaggccagg

SEQ ID NO: 285327 - DNA, 25 bp, Mus musculus
tccagaatcttgtccatcgtcgcca

SEQ ID NO: 285328 - DNA, 25 bp, Mus musculus
cccacttgtcgctggaaagggtcct

SEQ ID NO: 285329 - DNA, 25 bp, Mus musculus
ggctacgttcgacccatttcctgct

SEQ ID NO: 285330 - DNA, 25 bp, Mus musculus
tagccctgctgaaggaggcccaaca

SEQ ID NO: 285331 - DNA, 25 bp, Mus musculus
gaggagctcaccaggccttccagaa

SEQ ID NO: 285332 - DNA, 25 bp, Mus musculus
ttccgcacaatcatccgcttgaggg

SEQ ID NO: 285333 - DNA, 25 bp, Mus musculus
tcaggtcaaacatggcctcgcactg

SEQ ID NO: 285334 - DNA, 25 bp, Mus musculus
ccgggaccggctgggacatatgtac

SEQ ID NO: 285335 - DNA, 25 bp, Mus musculus
atacgtgagtggctctctgtgatgg

SEQ ID NO: 285336 - DNA, 25 bp, Mus musculus
tgcgcagatacgtgagtggctctct

SEQ ID NO: 285337 - DNA, 25 bp, Mus musculus
gacgctcgtgcgcagatacgtgagt

SEQ ID NO: 285338 - DNA, 25 bp, Mus musculus
agtctattgaggacgctcgtgcgca

SEQ ID NO: 285339 - DNA, 25 bp, Mus musculus
atggactgcagtctattgaggacgc

SEQ ID NO: 285340 - DNA, 25 bp, Mus musculus
ggtggatcagcacccgacgagccac

SEQ ID NO: 285341 - DNA, 25 bp, Mus musculus
aggcccacccggaaggcagttgcag

SEQ ID NO: 285342 - DNA, 25 bp, Mus musculus
tcgagggacatccatccttatgggg

SEQ ID NO: 285343 - DNA, 25 bp, Mus musculus
aaggcagttgcagccgggtcgatcc

SEQ ID NO: 285344 - DNA, 25 bp, Mus musculus
ccgggagcgataaccatggactgca

SEQ ID NO: 285345 - DNA, 25 bp, Mus musculus
gggtcgagggacatccatccttatg

SEQ ID NO: 285346 - DNA, 25 bp, Mus musculus
atccttatgggggttgcgctcagcc

SEQ ID NO: 285347 - DNA, 25 bp, Mus musculus
tcgatcccggggtcgagggacatcc

SEQ ID NO: 285348 - DNA, 25 bp, Mus musculus
gcccttttcctgtcggcgccacgcc

SEQ ID NO: 285349 - DNA, 25 bp, Mus musculus
gccgcaccgcccttttcctgtcggc

SEQ ID NO: 285350 - DNA, 25 bp, Mus musculus
attgtagggccatcctccttgcttc

SEQ ID NO: 285351 - DNA, 25 bp, Mus musculus
ggcgggattgtagggccatcctcct

SEQ ID NO: 285352 - DNA, 25 bp, Mus musculus
ggacatcagcagtggcgggattgta

SEQ ID NO: 285353 - DNA, 25 bp, Mus musculus
cttcagtagtgggacatcagcagtg

SEQ ID NO: 285354 - DNA, 25 bp, Mus musculus
ctccttcagtagtgggacatcagca

SEQ ID NO: 285355 - DNA, 25 bp, Mus musculus
ccctccttcagtagtgggacatcag

SEQ ID NO: 285356 - DNA, 25 bp, Mus musculus
cctagacctagagggcttccgcaag

SEQ ID NO: 285357 - DNA, 25 bp, Mus musculus
cgcctagacctagagggcttccgca

SEQ ID NO: 285358 - DNA, 25 bp, Mus musculus
cgtacgcctagacctagagggcttc

SEQ ID NO: 285359 - DNA, 25 bp, Mus musculus
cggaccgtacgcctagacctagagg

SEQ ID NO: 285360 - DNA, 25 bp, Mus musculus
gagcggaccgtacgcctagacctag

SEQ ID NO: 285361 - DNA, 25 bp, Mus musculus
cgatgctccggagcggaccgtacgc

SEQ ID NO: 285362 - DNA, 25 bp, Mus musculus
agtggccaagggcacaggatctcca

SEQ ID NO: 285363 - DNA, 25 bp, Mus musculus
tggccaagggcacaggatctccact

SEQ ID NO: 285364 - DNA, 25 bp, Mus musculus
gccaagggcacaggatctccacttg

SEQ ID NO: 285365 - DNA, 25 bp, Mus musculus
ctgcaaggctaatttctaaccaagg

SEQ ID NO: 285366 - DNA, 25 bp, Mus musculus
aggctaatttctaaccaaggtgtga

SEQ ID NO: 285367 - DNA, 25 bp, Mus musculus
tttctaaccaaggtgtgaccacgcc

SEQ ID NO: 285368 - DNA, 25 bp, Mus musculus
taaccaaggtgtgaccacgccaggg

SEQ ID NO: 285369 - DNA, 25 bp, Mus musculus
ccaaggtgtgaccacgccagggccg

SEQ ID NO: 285370 - DNA, 25 bp, Mus musculus
actcctgcaaggctaatttctaacc

SEQ ID NO: 285371 - DNA, 25 bp, Mus musculus
gggcgtgttactactcctgcaaggc

SEQ ID NO: 285372 - DNA, 25 bp, Mus musculus
gtgggcgtgttactactcctgcaag

SEQ ID NO: 285373 - DNA, 25 bp, Mus musculus
cgtgtccgctttctgggacgcgtgg

SEQ ID NO: 285374 - DNA, 25 bp, Mus musculus
gcaaggctaatttctaaccaaggtg

SEQ ID NO: 285375 - DNA, 25 bp, Mus musculus
gacgcgtgggcgtgttactactcct

SEQ ID NO: 285376 - DNA, 25 bp, Mus musculus
tagacattacccaaggccggccagc

SEQ ID NO: 285377 - DNA, 25 bp, Mus musculus
cgaagctcgagaggcatgcggctcc

SEQ ID NO: 285378 - DNA, 25 bp, Mus musculus
ctggctgtggagatgagtagacatt

SEQ ID NO: 285379 - DNA, 25 bp, Mus musculus
caacaggggcagtgttcccagggct

SEQ ID NO: 285380 - DNA, 25 bp, Mus musculus
ctgacctgcgaggacaacaggggca

SEQ ID NO: 285381 - DNA, 25 bp, Mus musculus
aaacccagcctgacctgcgaggaca

SEQ ID NO: 285382 - DNA, 25 bp, Mus musculus
gggatctgcacgaaacccagcctga

SEQ ID NO: 285383 - DNA, 25 bp, Mus musculus
gccaccaccctagaatgcgcgggat

SEQ ID NO: 285384 - DNA, 25 bp, Mus musculus
gaatgccgggcggatgcctcgccac

SEQ ID NO: 285385 - DNA, 25 bp, Mus musculus
ctctgggcaagaaggaatgaatgcc

SEQ ID NO: 285386 - DNA, 25 bp, Mus musculus
ctgttctcgctctgggcaagaagga

SEQ ID NO: 285387 - DNA, 25 bp, Mus musculus
aggtactggttctctgttctcgctc

SEQ ID NO: 285388 - DNA, 25 bp, Mus musculus
gaatgcgcgggatctgcacgaaacc

SEQ ID NO: 285389 - DNA, 25 bp, Mus musculus
tgcctctcgcggaggtactggttct

SEQ ID NO: 285390 - DNA, 25 bp, Mus musculus
tgtgctgactctctcgctgcaggag

SEQ ID NO: 285391 - DNA, 25 bp, Mus musculus
agacgcaatggcacgctccactgga

SEQ ID NO: 285392 - DNA, 25 bp, Mus musculus
cccgcgttcctgctggaatgtcgca

SEQ ID NO: 285393 - DNA, 25 bp, Mus musculus
atgtcgcacctgtggcttttcgttc

SEQ ID NO: 285394 - DNA, 25 bp, Mus musculus
cgggctctttctctgtggttaccac

SEQ ID NO: 285395 - DNA, 25 bp, Mus musculus
taccactccgagctgattttagggg

SEQ ID NO: 285396 - DNA, 25 bp, Mus musculus
ccctatttggggtgtagcgagaagc

SEQ ID NO: 285397 - DNA, 25 bp, Mus musculus
agacacgcacctttgccgagcggta

SEQ ID NO: 285398 - DNA, 25 bp, Mus musculus
ccagcggcgtgaccttcattcagac

SEQ ID NO: 285399 - DNA, 25 bp, Mus musculus
cgccttctcctatgctgacttcgtg

SEQ ID NO: 285400 - DNA, 25 bp, Mus musculus
gcgtgttttctagcgccttcaccga

SEQ ID NO: 285401 - DNA, 25 bp, Mus musculus
tgacctcggagggaaagcctgactt

SEQ ID NO: 285402 - DNA, 25 bp, Mus musculus
cccaagatggtgaactacgtgtatg

SEQ ID NO: 285403 - DNA, 25 bp, Mus musculus
agcctgacttcgagtatctgcagca

SEQ ID NO: 285404 - DNA, 25 bp, Mus musculus
cgctccgagggagtgagcctaagac

SEQ ID NO: 285405 - DNA, 25 bp, Mus musculus
tgcacgctaccatcctccgggttcc

SEQ ID NO: 285406 - DNA, 25 bp, Mus musculus
cctgcacgctaccatcctccgggtt

SEQ ID NO: 285407 - DNA, 25 bp, Mus musculus
cgccctgcacgctaccatcctccgg

SEQ ID NO: 285408 - DNA, 25 bp, Mus musculus
ccgcgccctgcacgctaccatcctc

SEQ ID NO: 285409 - DNA, 25 bp, Mus musculus
agctgccagcccagagcagggagcg

SEQ ID NO: 285410 - DNA, 25 bp, Mus musculus
agcgtgagctgccagcccagagcag

SEQ ID NO: 285411 - DNA, 25 bp, Mus musculus
tgcgggcgaggagcaacttctcccg

SEQ ID NO: 285412 - DNA, 25 bp, Mus musculus
ctgcgggcgaggagcaacttctccc

SEQ ID NO: 285413 - DNA, 25 bp, Mus musculus
gctgcgggcgaggagcaacttctcc

SEQ ID NO: 285414 - DNA, 25 bp, Mus musculus
agctgcgggcgaggagcaacttctc

SEQ ID NO: 285415 - DNA, 25 bp, Mus musculus
ggagtgagcctaagacgaggaggaa

SEQ ID NO: 285416 - DNA, 25 bp, Mus musculus
ctccgagggagtgagcctaagacga

SEQ ID NO: 285417 - DNA, 25 bp, Mus musculus
cgctaccatcctccgggttcccagc

SEQ ID NO: 285418 - DNA, 25 bp, Mus musculus
cagaagcagcccgtttccaacggtg

SEQ ID NO: 285419 - DNA, 25 bp, Mus musculus
tgaacacgtcaacaggaagaatccc

SEQ ID NO: 285420 - DNA, 25 bp, Mus musculus
cgcccaggttgaacacgtcaacagg

SEQ ID NO: 285421 - DNA, 25 bp, Mus musculus
cagagcgcccaggttgaacacgtca

SEQ ID NO: 285422 - DNA, 25 bp, Mus musculus
tatcctgctatgtcagagcgcccag

SEQ ID NO: 285423 - DNA, 25 bp, Mus musculus
accggatatcctgctatgtcagagc

SEQ ID NO: 285424 - DNA, 25 bp, Mus musculus
cagcccgtttccaacggtgggagcg

SEQ ID NO: 285425 - DNA, 25 bp, Mus musculus
gccgcgggctagaacggcagaagca

SEQ ID NO: 285426 - DNA, 25 bp, Mus musculus
cgccactcaccgcagtggccgagga

SEQ ID NO: 285427 - DNA, 25 bp, Mus musculus
ggcctcacggggacgcgccactcac

SEQ ID NO: 285428 - DNA, 25 bp, Mus musculus
gttctccagacccacccacgtcgcg

SEQ ID NO: 285429 - DNA, 25 bp, Mus musculus
agccacgcggctcgcgacccgccag

SEQ ID NO: 285430 - DNA, 25 bp, Mus musculus
aacaggaagaatcccgcatgttccg

SEQ ID NO: 285431 - DNA, 25 bp, Mus musculus
gagcgagaccggatatcctgctatg

SEQ ID NO: 285432 - DNA, 25 bp, Mus musculus
gaggaatggtacaccgccttcgtga

SEQ ID NO: 285433 - DNA, 25 bp, Mus musculus
gtcgcagcgacaggagaaccagagt

SEQ ID NO: 285434 - DNA, 25 bp, Mus musculus
tgacaatgtctctcatccaagcgtg

SEQ ID NO: 285435 - DNA, 25 bp, Mus musculus
gtgccgcagtctggctctctcaaca

SEQ ID NO: 285436 - DNA, 25 bp, Mus musculus
tggctctctcaacatggctgctttc

SEQ ID NO: 285437 - DNA, 25 bp, Mus musculus
gcctggacttcaccgtggcggagaa

SEQ ID NO: 285438 - DNA, 25 bp, Mus musculus
tgcccatgggaacccacgcataaca

SEQ ID NO: 285439 - DNA, 25 bp, Mus musculus
gtcatctttaacgtgggctccaaca

SEQ ID NO: 285440 - DNA, 25 bp, Mus musculus
atcacctatttggagcccgagcccg

SEQ ID NO: 285441 - DNA, 25 bp, Mus musculus
tggtcatggccagctcggcccaaga

SEQ ID NO: 285442 - DNA, 25 bp, Mus musculus
aagggcaactgcacgtacagggata

SEQ ID NO: 285443 - DNA, 25 bp, Mus musculus
cagggataagatccggaacgcgttc

SEQ ID NO: 285444 - DNA, 25 bp, Mus musculus
aacgcctccgctgtggtcatcttta

SEQ ID NO: 285445 - DNA, 25 bp, Mus musculus
ttccttttgtttcgtgcatctgctc

SEQ ID NO: 285446 - DNA, 25 bp, Mus musculus
atgctacttgctgggtcccgatccc

SEQ ID NO: 285447 - DNA, 25 bp, Mus musculus
ctgtggatcaccgagagagccaacc

SEQ ID NO: 285448 - DNA, 25 bp, Mus musculus
tgcgggcctctttgtgcgactgccc

SEQ ID NO: 285449 - DNA, 25 bp, Mus musculus
agccgtagggaggatgctacttgct

SEQ ID NO: 285450 - DNA, 25 bp, Mus musculus
ggggctcggattcccgcacaagctc

SEQ ID NO: 285451 - DNA, 25 bp, Mus musculus
cgcagtgtccacgagcggtgatctc

SEQ ID NO: 285452 - DNA, 25 bp, Mus musculus
gggagcgtccttccagctcgttgcc

SEQ ID NO: 285453 - DNA, 25 bp, Mus musculus
gtcgtcattcattcccagcgccggg

SEQ ID NO: 285454 - DNA, 25 bp, Mus musculus
actgagccgcgctgtcgtcattcat

SEQ ID NO: 285455 - DNA, 25 bp, Mus musculus
ttctgcaacgaaggaagggccacgg

SEQ ID NO: 285456 - DNA, 25 bp, Mus musculus
gcttcctccctgctgggatgggcgt

SEQ ID NO: 285457 - DNA, 25 bp, Mus musculus
gtcccgccgagcgtcagccttgaat

SEQ ID NO: 285458 - DNA, 25 bp, Mus musculus
tactgctggccaacgcgctgtggat

SEQ ID NO: 285459 - DNA, 25 bp, Mus musculus
gtcagccttgaatacacacgccaca

SEQ ID NO: 285460 - DNA, 25 bp, Mus musculus
cacctcacaggagcggaagaactag

SEQ ID NO: 285461 - DNA, 25 bp, Mus musculus
gaactttgctctgggctttccggga

SEQ ID NO: 285462 - DNA, 25 bp, Mus musculus
tccctgtggactcggcctgggaact

SEQ ID NO: 285463 - DNA, 25 bp, Mus musculus
ccagcgccaacgagttccctgtgga

SEQ ID NO: 285464 - DNA, 25 bp, Mus musculus
agacgctggacggttcccatggcaa

SEQ ID NO: 285465 - DNA, 25 bp, Mus musculus
ctcttcgtcttcttccgattggctc

SEQ ID NO: 285466 - DNA, 25 bp, Mus musculus
caccggcaacggaaacgacgctcta

SEQ ID NO: 285467 - DNA, 25 bp, Mus musculus
gccgcacgccagcaactcagagtga

SEQ ID NO: 285468 - DNA, 25 bp, Mus musculus
ttaaaatgagtcatcccgtcggcgc

SEQ ID NO: 285469 - DNA, 25 bp, Mus musculus
gccagacacgcggatcaggatcttt

SEQ ID NO: 285470 - DNA, 25 bp, Mus musculus
cccgcaaggcaaggcaccaggtgtc

SEQ ID NO: 285471 - DNA, 25 bp, Mus musculus
ggcccgaggagctgtcaaattcgaa

SEQ ID NO: 285472 - DNA, 25 bp, Mus musculus
tccagccctgggattcgcagacaca

SEQ ID NO: 285473 - DNA, 25 bp, Mus musculus
tacgtggagcgctccctgcgaacac

SEQ ID NO: 285474 - DNA, 25 bp, Mus musculus
tgcgcactggggctgcctctgcatc

SEQ ID NO: 285475 - DNA, 25 bp, Mus musculus
cacaagcccgcaggacaggtgtgta

SEQ ID NO: 285476 - DNA, 25 bp, Mus musculus
cctgcggcttgttctctggggaccg

SEQ ID NO: 285477 - DNA, 25 bp, Mus musculus
acgcgcagttagcagtcgctgctgg

SEQ ID NO: 285478 - DNA, 25 bp, Mus musculus
tctgcatcctgcatcctcccgcgcg

SEQ ID NO: 285479 - DNA, 25 bp, Mus musculus
gacgccgggcaccaagtagcggcca

SEQ ID NO: 285480 - DNA, 25 bp, Mus musculus
ccaagtagcggccagtcggacacct

SEQ ID NO: 285481 - DNA, 25 bp, Mus musculus
agtcggacacctgagctgccgctgc

SEQ ID NO: 285482 - DNA, 25 bp, Mus musculus
gagctgccgctgctggacacaagcc

SEQ ID NO: 285483 - DNA, 25 bp, Mus musculus
gccttcctgcggcttgttctctggg

SEQ ID NO: 285484 - DNA, 25 bp, Mus musculus
ttctctggggaccgggtgagaaatc

SEQ ID NO: 285485 - DNA, 25 bp, Mus musculus
ctcgcgcacgcgcagttagcagtcg

SEQ ID NO: 285486 - DNA, 25 bp, Mus musculus
ggtgagaaatcggatccaggtgccc

SEQ ID NO: 285487 - DNA, 25 bp, Mus musculus
cccgcaggacaggtgtgtagaccgc

SEQ ID NO: 285488 - DNA, 25 bp, Mus musculus
ctttgccctaacaaaagggcattga

SEQ ID NO: 285489 - DNA, 25 bp, Mus musculus
tgtggcagagcaccggggtccacct

SEQ ID NO: 285490 - DNA, 25 bp, Mus musculus
agatgcgcctaagaaagcggtcctc

SEQ ID NO: 285491 - DNA, 25 bp, Mus musculus
ccaatcacggcgcagaagagaagat

SEQ ID NO: 285492 - DNA, 25 bp, Mus musculus
caccttgcgtctgaagcgccgggaa

SEQ ID NO: 285493 - DNA, 25 bp, Mus musculus
tgtcctaaaaaagcagcgaccaatc

SEQ ID NO: 285494 - DNA, 25 bp, Mus musculus
tttgggcgtgtcctaaaaaagcagc

SEQ ID NO: 285495 - DNA, 25 bp, Mus musculus
gggcattgacgaccaatcaggattt

SEQ ID NO: 285496 - DNA, 25 bp, Mus musculus
agcgaggaggcgtcctcccaccaat

SEQ ID NO: 285497 - DNA, 25 bp, Mus musculus
gagccgcctcaccttgcgtctgaag

SEQ ID NO: 285498 - DNA, 25 bp, Mus musculus
tcctaactggaaattgcacgcctgc

SEQ ID NO: 285499 - DNA, 25 bp, Mus musculus
gcactggctgctggacgcctcgaca

SEQ ID NO: 285500 - DNA, 25 bp, Mus musculus
gacgcctcgacaggcctgtggcaga

SEQ ID NO: 285501 - DNA, 25 bp, Mus musculus
ccaatcaggatttttgggcgtgtcc

SEQ ID NO: 285502 - DNA, 25 bp, Mus musculus
tgacccggaagacactgaaggggca

SEQ ID NO: 285503 - DNA, 25 bp, Mus musculus
tcagcgagccaggaagcgttccatc

SEQ ID NO: 285504 - DNA, 25 bp, Mus musculus
cgcagcctagatgacccggaagaca

SEQ ID NO: 285505 - DNA, 25 bp, Mus musculus
ctaaagaagggtaaggcagagtagc

SEQ ID NO: 285506 - DNA, 25 bp, Mus musculus
cctgacccggcgctatctgtgggat

SEQ ID NO: 285507 - DNA, 25 bp, Mus musculus
acccggcgctatctgtgggatgcct

SEQ ID NO: 285508 - DNA, 25 bp, Mus musculus
aggcgcgaccgcagatcccgcggaa

SEQ ID NO: 285509 - DNA, 25 bp, Mus musculus
acctccttgagtgtggaggctgtgc

SEQ ID NO: 285510 - DNA, 25 bp, Mus musculus
ctgtgcggggatggctaaagcaaaa

SEQ ID NO: 285511 - DNA, 25 bp, Mus musculus
taaagcaaaaggctgggacgagaca

SEQ ID NO: 285512 - DNA, 25 bp, Mus musculus
cagagaacgggaagatgagactgcc

SEQ ID NO: 285513 - DNA, 25 bp, Mus musculus
ccggtgcacttcgtcctgggcacag

SEQ ID NO: 285514 - DNA, 25 bp, Mus musculus
cggacctcggctttccggagcgcaa

SEQ ID NO: 285515 - DNA, 25 bp, Mus musculus
agcgttccatcgttcatctctatga

SEQ ID NO: 285516 - DNA, 25 bp, Mus musculus
actcggggagcagcactcccggact

SEQ ID NO: 285517 - DNA, 25 bp, Mus musculus
gggtcaatgcggcaaaacgagaaca

SEQ ID NO: 285518 - DNA, 25 bp, Mus musculus
cattgcagtgttgcggtggaaatcc

SEQ ID NO: 285519 - DNA, 25 bp, Mus musculus
ccaccaatcaaaaggaagcctgggc

SEQ ID NO: 285520 - DNA, 25 bp, Mus musculus
cggccacccaccaatcaaaaggaag

SEQ ID NO: 285521 - DNA, 25 bp, Mus musculus
gcaagcaagattaaaacccggccac

SEQ ID NO: 285522 - DNA, 25 bp, Mus musculus
cccactttggcaagcaagattaaaa

SEQ ID NO: 285523 - DNA, 25 bp, Mus musculus
cagatttctcgatccaaggagcgca

SEQ ID NO: 285524 - DNA, 25 bp, Mus musculus
gcgccacacaactgaccaatcagat

SEQ ID NO: 285525 - DNA, 25 bp, Mus musculus
ctgccaatcagcgtggggtgcaccc

SEQ ID NO: 285526 - DNA, 25 bp, Mus musculus
aaacgagaacaaagagctgcgtggc

SEQ ID NO: 285527 - DNA, 25 bp, Mus musculus
tggaaatccagcgacgtcaggctga

SEQ ID NO: 285528 - DNA, 25 bp, Mus musculus
agcgtggggtgcacccactgctcgc

SEQ ID NO: 285529 - DNA, 25 bp, Mus musculus
tggctccgcccattgcagtgttgcg

SEQ ID NO: 285530 - DNA, 25 bp, Mus musculus
actactatcagacgctgggcctggc

SEQ ID NO: 285531 - DNA, 25 bp, Mus musculus
ccgacgacgagatcaagcgagccta

SEQ ID NO: 285532 - DNA, 25 bp, Mus musculus
acaagaacaaggagcccggcgctga

SEQ ID NO: 285533 - DNA, 25 bp, Mus musculus
agttcaaggagatcgccgaggccta

SEQ ID NO: 285534 - DNA, 25 bp, Mus musculus
cgaggcctacgacgtgctcagcgac

SEQ ID NO: 285535 - DNA, 25 bp, Mus musculus
ccgcgcaagcgcgagattttcgacc

SEQ ID NO: 285536 - DNA, 25 bp, Mus musculus
ttcgaccgctatggagaggaaggta

SEQ ID NO: 285537 - DNA, 25 bp, Mus musculus
cgaggcactcggagcctctccaaga

SEQ ID NO: 285538 - DNA, 25 bp, Mus musculus
tctccaagacctcggccggggacag

SEQ ID NO: 285539 - DNA, 25 bp, Mus musculus
tggccatgggcaaggactactatca

SEQ ID NO: 285540 - DNA, 25 bp, Mus musculus
gcgccgctggcacagaagcttctag

SEQ ID NO: 285541 - DNA, 25 bp, Mus musculus
agaagcttctagcacgtctgccgca

SEQ ID NO: 285542 - DNA, 25 bp, Mus musculus
tccacctgtccgcagagagagagag

SEQ ID NO: 285543 - DNA, 25 bp, Mus musculus
agcttccgccggacgggtatataga

SEQ ID NO: 285544 - DNA, 25 bp, Mus musculus
tgtagccagcgtcggccggaacgct

SEQ ID NO: 285545 - DNA, 25 bp, Mus musculus
aggacacccaggacaccggacagca

SEQ ID NO: 285546 - DNA, 25 bp, Mus musculus
acaccggacagcaccgggatcgggc

SEQ ID NO: 285547 - DNA, 25 bp, Mus musculus
ggatcgggccgcagacaccagctac

SEQ ID NO: 285548 - DNA, 25 bp, Mus musculus
cccaagtcctgaggtgagtcggtca

SEQ ID NO: 285549 - DNA, 25 bp, Mus musculus
gcagacaccagctacggaggccttc

SEQ ID NO: 285550 - DNA, 25 bp, Mus musculus
acctcataaggacgctagctacagc

SEQ ID NO: 285551 - DNA, 25 bp, Mus musculus
cgtcgtcgtctgcacctcataagga

SEQ ID NO: 285552 - DNA, 25 bp, Mus musculus
tgctgtcccgcatcgtcgtcgtctg

SEQ ID NO: 285553 - DNA, 25 bp, Mus musculus
ttccgaatttctgctgtcccgcatc

SEQ ID NO: 285554 - DNA, 25 bp, Mus musculus
ggaacgctcaccatttccgaatttc

SEQ ID NO: 285555 - DNA, 25 bp, Mus musculus
agcgtcggccggaacgctcaccatt

SEQ ID NO: 285556 - DNA, 25 bp, Mus musculus
gaggggacccaggacacccaggaca

SEQ ID NO: 285557 - DNA, 25 bp, Mus musculus
ctggtactggttggctgtagccagc

SEQ ID NO: 285558 - DNA, 25 bp, Mus musculus
tctggggatcggttttgttgaatcg

SEQ ID NO: 285559 - DNA, 25 bp, Mus musculus
atcttctggggatcggttttgttga

SEQ ID NO: 285560 - DNA, 25 bp, Mus musculus
aggacgatcttctggggatcggttt

SEQ ID NO: 285561 - DNA, 25 bp, Mus musculus
ctggtgcagcggaggacgatcttct

SEQ ID NO: 285562 - DNA, 25 bp, Mus musculus
acctctggtgcagcggaggacgatc

SEQ ID NO: 285563 - DNA, 25 bp, Mus musculus
acccgacagcacctctggtgcagcg

SEQ ID NO: 285564 - DNA, 25 bp, Mus musculus
ggaagccaaggaaagcgccacaacc

SEQ ID NO: 285565 - DNA, 25 bp, Mus musculus
ccaatcctgggaagccaaggaaagc

SEQ ID NO: 285566 - DNA, 25 bp, Mus musculus
ggagaccaatcctgggaagccaagg

SEQ ID NO: 285567 - DNA, 25 bp, Mus musculus
cgcggagaccaatcctgggaagcca

SEQ ID NO: 285568 - DNA, 25 bp, Mus musculus
ccctgtggcgcggagaccaatcctg

SEQ ID NO: 285569 - DNA, 25 bp, Mus musculus
ggcaggctcagtgcttccgcttccg

SEQ ID NO: 285570 - DNA, 25 bp, Mus musculus
ctccaggtgcggtggtgacacgccc

SEQ ID NO: 285571 - DNA, 25 bp, Mus musculus
catgactccaggtgcggtggtgaca

SEQ ID NO: 285572 - DNA, 25 bp, Mus musculus
agtactggagagatgcaagtgctcc

SEQ ID NO: 285573 - DNA, 25 bp, Mus musculus
aaacactgaggccgggaagacgatg

SEQ ID NO: 285574 - DNA, 25 bp, Mus musculus
catcggtcggggaaacactgaggcc

SEQ ID NO: 285575 - DNA, 25 bp, Mus musculus
actgggtgctctgatgtcaggaaga

SEQ ID NO: 285576 - DNA, 25 bp, Mus musculus
ccctctcgtggccatcggtcgggga

SEQ ID NO: 285577 - DNA, 25 bp, Mus musculus
ggtgctctgatgtcaggaagatcgc

SEQ ID NO: 285578 - DNA, 25 bp, Mus musculus
ctggagagatgcaagtgctccttgc

SEQ ID NO: 285579 - DNA, 25 bp, Mus musculus
gatcatcagctctgggtgagcgcga

SEQ ID NO: 285580 - DNA, 25 bp, Mus musculus
agcagagatcatcagctctgggtga

SEQ ID NO: 285581 - DNA, 25 bp, Mus musculus
taccgcaagccagcggtaggactgg

SEQ ID NO: 285582 - DNA, 25 bp, Mus musculus
aaccgcatcggagcacgcgagcgcg

SEQ ID NO: 285583 - DNA, 25 bp, Mus musculus
gatcgcaaccgcatcggagcacgcg

SEQ ID NO: 285584 - DNA, 25 bp, Mus musculus
tcaggaagatcgcaaccgcatcgga

SEQ ID NO: 285585 - DNA, 25 bp, Mus musculus
gatgcaagtgctccttgcgccctct

SEQ ID NO: 285586 - DNA, 25 bp, Mus musculus
ccctcgcaagcccggatcggtgttt

SEQ ID NO: 285587 - DNA, 25 bp, Mus musculus
gggataacagtaacaaccgcagcac

SEQ ID NO: 285588 - DNA, 25 bp, Mus musculus
gtgcacacggccgtcgctgattagt

SEQ ID NO: 285589 - DNA, 25 bp, Mus musculus
ccgcagcactagtttaatgactccc

SEQ ID NO: 285590 - DNA, 25 bp, Mus musculus
gacccaggtcgggataacagtaaca

SEQ ID NO: 285591 - DNA, 25 bp, Mus musculus
caccgagacccaggtcgggataaca

SEQ ID NO: 285592 - DNA, 25 bp, Mus musculus
tcccaggacgctccctgttggtggt

SEQ ID NO: 285593 - DNA, 25 bp, Mus musculus
cgggcctcccgtccgcctctgctct

SEQ ID NO: 285594 - DNA, 25 bp, Mus musculus
gcggagtttcgagaggaccgagcag

SEQ ID NO: 285595 - DNA, 25 bp, Mus musculus
tcgctgattagtccgcccgggacgc

SEQ ID NO: 285596 - DNA, 25 bp, Mus musculus
agcgttccgacgggaggcgcccatt

SEQ ID NO: 285597 - DNA, 25 bp, Mus musculus
acacggccgtcgctgattagtccgc

SEQ ID NO: 285598 - DNA, 25 bp, Mus musculus
gcgcccattggtcgcgagtgcacac

SEQ ID NO: 285599 - DNA, 25 bp, Mus musculus
cagtaacaaccgcagcactagttta

SEQ ID NO: 285600 - DNA, 25 bp, Mus musculus
cgtgtcatttcctgggtggctgcat

SEQ ID NO: 285601 - DNA, 25 bp, Mus musculus
tggtgcttcgcctgtatactgcggg

SEQ ID NO: 285602 - DNA, 25 bp, Mus musculus
ggctgccaccttcctgttgttcgtc

SEQ ID NO: 285603 - DNA, 25 bp, Mus musculus
ctgctgccactggtacacgtgggtc

SEQ ID NO: 285604 - DNA, 25 bp, Mus musculus
tgccatcgacctagcaggccatgtg

SEQ ID NO: 285605 - DNA, 25 bp, Mus musculus
ctgcatggtcttcttcggcctgtgc

SEQ ID NO: 285606 - DNA, 25 bp, Mus musculus
gtgggtgtcacgcagccactgatcc

SEQ ID NO: 285607 - DNA, 25 bp, Mus musculus
acgtgggtcgctacgagttacagta

SEQ ID NO: 285608 - DNA, 25 bp, Mus musculus
agttacagtaccctggcacctggtg

SEQ ID NO: 285609 - DNA, 25 bp, Mus musculus
gcacctggtgttttattagccttgg

SEQ ID NO: 285610 - DNA, 25 bp, Mus musculus
tgcggcattagtgtgcaatacgctc

SEQ ID NO: 285611 - DNA, 25 bp, Mus musculus
cgtcgctctcgacgattccgaaaga

SEQ ID NO: 285612 - DNA, 25 bp, Mus musculus
aagaccgcaggtcccgatgatcgcc

SEQ ID NO: 285613 - DNA, 25 bp, Mus musculus
cggcctgtgcccacttttgcttggc

SEQ ID NO: 285614 - DNA, 25 bp, Mus musculus
gccaggcacctgctccaggtgaagc

SEQ ID NO: 285615 - DNA, 25 bp, Mus musculus
ctccttgtagcgtaggggactctga

SEQ ID NO: 285616 - DNA, 25 bp, Mus musculus
accatcgtaaagacgtctgcaggcg

SEQ ID NO: 285617 - DNA, 25 bp, Mus musculus
tacctgtacggcgtcgccggccatg

SEQ ID NO: 285618 - DNA, 25 bp, Mus musculus
cccagcgccaaggaagggcttgcga

SEQ ID NO: 285619 - DNA, 25 bp, Mus musculus
tgcggcaagcgctccttgtagcgta

SEQ ID NO: 285620 - DNA, 25 bp, Mus musculus
ggcacctgacagaaaccgaacgctg

SEQ ID NO: 285621 - DNA, 25 bp, Mus musculus
accgaacgctgcaggacccagagta

SEQ ID NO: 285622 - DNA, 25 bp, Mus musculus
acaggcaccgggatccgcagctagc

SEQ ID NO: 285623 - DNA, 25 bp, Mus musculus
cgcagctagcctcggacaccgaagt

SEQ ID NO: 285624 - DNA, 25 bp, Mus musculus
cgctacacacgctgactctcgggga

SEQ ID NO: 285625 - DNA, 25 bp, Mus musculus
ctggggtagaatcccgaacagcacc

SEQ ID NO: 285626 - DNA, 25 bp, Mus musculus
gtgcggacaagtcgcctacctgtac

SEQ ID NO: 285627 - DNA, 25 bp, Mus musculus
cttgcagcggggaaatagggtccct

SEQ ID NO: 285628 - DNA, 25 bp, Mus musculus
agacgtcccgagtctgcagtcaccg

SEQ ID NO: 285629 - DNA, 25 bp, Mus musculus
cgcctactttacgactgcccaatga

SEQ ID NO: 285630 - DNA, 25 bp, Mus musculus
tggccattcactcggcgtcgctttc

SEQ ID NO: 285631 - DNA, 25 bp, Mus musculus
cgcctcttaggaacgtggccattca

SEQ ID NO: 285632 - DNA, 25 bp, Mus musculus
ctccagactctgatgcggaaggcca

SEQ ID NO: 285633 - DNA, 25 bp, Mus musculus
cacggcgagaggactcaggctatct

SEQ ID NO: 285634 - DNA, 25 bp, Mus musculus
gccagctatccagtgagcgagactc

SEQ ID NO: 285635 - DNA, 25 bp, Mus musculus
ttcctctgttgagtgataagccagc

SEQ ID NO: 285636 - DNA, 25 bp, Mus musculus
agccggtcgacagcgtccttataaa

SEQ ID NO: 285637 - DNA, 25 bp, Mus musculus
ttaacgtgcggatgccagctaaaag

SEQ ID NO: 285638 - DNA, 25 bp, Mus musculus
cctgagtctaggtacgcccaatagc

SEQ ID NO: 285639 - DNA, 25 bp, Mus musculus
cacactgcgttttcggtcacggcga

SEQ ID NO: 285640 - DNA, 25 bp, Mus musculus
tgtggcccttaactcatctcacgtg

SEQ ID NO: 285641 - DNA, 25 bp, Mus musculus
gtggcagtatccactgtggccctta

SEQ ID NO: 285642 - DNA, 25 bp, Mus musculus
gcgcggcacggaacggacagcgtct

SEQ ID NO: 285643 - DNA, 25 bp, Mus musculus
cgcgagttccctcccggctccgcgc

SEQ ID NO: 285644 - DNA, 25 bp, Mus musculus
ccgaggtctcaccaagcaggccggg

SEQ ID NO: 285645 - DNA, 25 bp, Mus musculus
aggtctcaccaagcaggccggggca

SEQ ID NO: 285646 - DNA, 25 bp, Mus musculus
tctcaccaagcaggccggggcatct

SEQ ID NO: 285647 - DNA, 25 bp, Mus musculus
aggtgcgccggcttcgactgtccct

SEQ ID NO: 285648 - DNA, 25 bp, Mus musculus
atctgacgcccctcatggtggcgcg

SEQ ID NO: 285649 - DNA, 25 bp, Mus musculus
acagcgtctggggttgatagagggc

SEQ ID NO: 285650 - DNA, 25 bp, Mus musculus
ctgggcttttatgcagcgggcgtga

SEQ ID NO: 285651 - DNA, 25 bp, Mus musculus
cccgctggaaagtaacaggaaagtg

SEQ ID NO: 285652 - DNA, 25 bp, Mus musculus
cgctggaaagtaacaggaaagtgcc

SEQ ID NO: 285653 - DNA, 25 bp, Mus musculus
ctggaaagtaacaggaaagtgccgg

SEQ ID NO: 285654 - DNA, 25 bp, Mus musculus
aagcaggccggggcatctgacgccc

SEQ ID NO: 285655 - DNA, 25 bp, Mus musculus
ccctcctggccacgtcccgcgagtt

SEQ ID NO: 285656 - DNA, 25 bp, Mus musculus
agctgcggggtctcattagcaccac

SEQ ID NO: 285657 - DNA, 25 bp, Mus musculus
tccacttgcggggttggagggatct

SEQ ID NO: 285658 - DNA, 25 bp, Mus musculus
aaagccagagccacgtcccggtccg

SEQ ID NO: 285659 - DNA, 25 bp, Mus musculus
ctttcgggccaaagccagagccacg

SEQ ID NO: 285660 - DNA, 25 bp, Mus musculus
agctagcgggttctagagccgccgc

SEQ ID NO: 285661 - DNA, 25 bp, Mus musculus
acgggctgcagtaggcaccagtgcg

SEQ ID NO: 285662 - DNA, 25 bp, Mus musculus
cgatccctcccgcactctggggccg

SEQ ID NO: 285663 - DNA, 25 bp, Mus musculus
agatttatgtgcgatccctcccgca

SEQ ID NO: 285664 - DNA, 25 bp, Mus musculus
acggcagatttatgtgcgatccctc

SEQ ID NO: 285665 - DNA, 25 bp, Mus musculus
tcattagcaccaccatcattacggc

SEQ ID NO: 285666 - DNA, 25 bp, Mus musculus
ggagcgggcgcttctccaaacacca

SEQ ID NO: 285667 - DNA, 25 bp, Mus musculus
cgctgctactgctcatgcgcagtgc

SEQ ID NO: 285668 - DNA, 25 bp, Mus musculus
ccctcctccgcctgcgagacggctg

SEQ ID NO: 285669 - DNA, 25 bp, Mus musculus
ccaccatcattacggcagatttatg

SEQ ID NO: 285670 - DNA, 25 bp, Mus musculus
tgcttccagctgtgtagctccggcc

SEQ ID NO: 285671 - DNA, 25 bp, Mus musculus
gctaggcgcctttctgcacagcacg

SEQ ID NO: 285672 - DNA, 25 bp, Mus musculus
cggaccgaaatttgcgtgcctcgag

SEQ ID NO: 285673 - DNA, 25 bp, Mus musculus
atttgcgtgcctcgagtgcatctgg

SEQ ID NO: 285674 - DNA, 25 bp, Mus musculus
gtgcatctggccctgtcgcagctac

SEQ ID NO: 285675 - DNA, 25 bp, Mus musculus
tctctgccaaatccggaccaggttt

SEQ ID NO: 285676 - DNA, 25 bp, Mus musculus
ccaggttttgcgcagtccttgcaca

SEQ ID NO: 285677 - DNA, 25 bp, Mus musculus
ttctgcacagcacggctgcagagtc

SEQ ID NO: 285678 - DNA, 25 bp, Mus musculus
gctgcagagtccgttccgttttttc

SEQ ID NO: 285679 - DNA, 25 bp, Mus musculus
cgagtggaactccaggccaggtttc

SEQ ID NO: 285680 - DNA, 25 bp, Mus musculus
gtagtccaggccaggttttgcgctt

SEQ ID NO: 285681 - DNA, 25 bp, Mus musculus
aggccaggttttgcgcttgtccgcc

SEQ ID NO: 285682 - DNA, 25 bp, Mus musculus
gcgcctgcttccagctgtgtagctc

SEQ ID NO: 285683 - DNA, 25 bp, Mus musculus
aggcggcttgtcattgctggtgccc

SEQ ID NO: 285684 - DNA, 25 bp, Mus musculus
ccgtcatcggtccttagcggcgatt

SEQ ID NO: 285685 - DNA, 25 bp, Mus musculus
gccgtcttctcagcgcgttttagtg

SEQ ID NO: 285686 - DNA, 25 bp, Mus musculus
tctgtgaggtgcgtctaccggaaaa

SEQ ID NO: 285687 - DNA, 25 bp, Mus musculus
agcgagctattccagtcggagactc

SEQ ID NO: 285688 - DNA, 25 bp, Mus musculus
tccagggattggttcccgatagacc

SEQ ID NO: 285689 - DNA, 25 bp, Mus musculus
aagagattaacgttccgcctcctgg

SEQ ID NO: 285690 - DNA, 25 bp, Mus musculus
cgcgcctgaagacgcctcgagattg

SEQ ID NO: 285691 - DNA, 25 bp, Mus musculus
tcttctctgtcgcaagtcactgtga

SEQ ID NO: 285692 - DNA, 25 bp, Mus musculus
ccttccggttcgagatcagcttcga

SEQ ID NO: 285693 - DNA, 25 bp, Mus musculus
tcagcttcgaatgcagtgaggccct

SEQ ID NO: 285694 - DNA, 25 bp, Mus musculus
ccggggccaactagatctcccatta

SEQ ID NO: 285695 - DNA, 25 bp, Mus musculus
agccggctctgtccagtgtacattg

SEQ ID NO: 285696 - DNA, 25 bp, Mus musculus
tgtccttgtacgctttccctggaga

SEQ ID NO: 285697 - DNA, 25 bp, Mus musculus
cttctctgattggtctgagggtcca

SEQ ID NO: 285698 - DNA, 25 bp, Mus musculus
agtctgcggggtactcctcccagaa

SEQ ID NO: 285699 - DNA, 25 bp, Mus musculus
agaaagtcccggtcctctgctgggg

SEQ ID NO: 285700 - DNA, 25 bp, Mus musculus
gcgctcactcccagggactgggcta

SEQ ID NO: 285701 - DNA, 25 bp, Mus musculus
ctcctttgtgcctcgcaggctgatg

SEQ ID NO: 285702 - DNA, 25 bp, Mus musculus
aggtgatcgatcctccaacctctca

SEQ ID NO: 285703 - DNA, 25 bp, Mus musculus
acttttcccagggtgtgagtcatcg

SEQ ID NO: 285704 - DNA, 25 bp, Mus musculus
ccatggagatggaaagccggtaccg

SEQ ID NO: 285705 - DNA, 25 bp, Mus musculus
cccagctgtgttgttggtttgtctg

SEQ ID NO: 285706 - DNA, 25 bp, Mus musculus
agggttggatcagccaccgcccgga

SEQ ID NO: 285707 - DNA, 25 bp, Mus musculus
acttccaggcacaagtgagcgtcca

SEQ ID NO: 285708 - DNA, 25 bp, Mus musculus
tgagagagatgtgtatcactggcgc

SEQ ID NO: 285709 - DNA, 25 bp, Mus musculus
ctgaatcgtcgctgcgggcacccat

SEQ ID NO: 285710 - DNA, 25 bp, Mus musculus
cagccggtctcgagactggctgcga

SEQ ID NO: 285711 - DNA, 25 bp, Mus musculus
acccacgagtgctggccgtctcggt

SEQ ID NO: 285712 - DNA, 25 bp, Mus musculus
tcatccaggagcctatggtggcgcg

SEQ ID NO: 285713 - DNA, 25 bp, Mus musculus
gctgcccagtgtcgggcctccttat

SEQ ID NO: 285714 - DNA, 25 bp, Mus musculus
gggcctccttatgaatgacaccgaa

SEQ ID NO: 285715 - DNA, 25 bp, Mus musculus
cttatgaatgacaccgaacggcgcc

SEQ ID NO: 285716 - DNA, 25 bp, Mus musculus
gtggcgtcaacctctggcccgtggc

SEQ ID NO: 285717 - DNA, 25 bp, Mus musculus
tgcagcgcgcacattgccgcacggg

SEQ ID NO: 285718 - DNA, 25 bp, Mus musculus
tccgccaatcgacggcttcgcaggg

SEQ ID NO: 285719 - DNA, 25 bp, Mus musculus
ttctcggccaatcacgtgcgttcgc

SEQ ID NO: 285720 - DNA, 25 bp, Mus musculus
gcggagagtctgcaactcgcgtcac

SEQ ID NO: 285721 - DNA, 25 bp, Mus musculus
cgcgtcactcatccaggagcctatg

SEQ ID NO: 285722 - DNA, 25 bp, Mus musculus
agctagttgggtcacggctgcccag

SEQ ID NO: 285723 - DNA, 25 bp, Mus musculus
tctcgggcttctcggccaatcacgt

SEQ ID NO: 285724 - DNA, 25 bp, Mus musculus
tgcaactcgcgtcactcatccagga

SEQ ID NO: 285725 - DNA, 25 bp, Mus musculus
ctgcggcctcacgagcccgtgagtg

SEQ ID NO: 285726 - DNA, 25 bp, Mus musculus
ttcgttgtagaacgcctgcgagtcc

SEQ ID NO: 285727 - DNA, 25 bp, Mus musculus
cgagccctccttgggcggagttcgc

SEQ ID NO: 285728 - DNA, 25 bp, Mus musculus
aaatgggtgcagagcatcccgtccc

SEQ ID NO: 285729 - DNA, 25 bp, Mus musculus
ccctctcgcgagcattcgttgtaga

SEQ ID NO: 285730 - DNA, 25 bp, Mus musculus
ccctgagcatcctaggtgtaaggtg

SEQ ID NO: 285731 - DNA, 25 bp, Mus musculus
catcctaggtgtaaggtgatccagg

SEQ ID NO: 285732 - DNA, 25 bp, Mus musculus
ctagcgcacggagcagcatccctga

SEQ ID NO: 285733 - DNA, 25 bp, Mus musculus
caaggttgccgggtgcttttatcca

SEQ ID NO: 285734 - DNA, 25 bp, Mus musculus
ccgggtgcttttatccactcaagtc

SEQ ID NO: 285735 - DNA, 25 bp, Mus musculus
tccactcaagtcctcgccggggtgt

SEQ ID NO: 285736 - DNA, 25 bp, Mus musculus
ggggtgtcctcgtcacggccctcga

SEQ ID NO: 285737 - DNA, 25 bp, Mus musculus
tcgtcacggccctcgacgtgacgtg

SEQ ID NO: 285738 - DNA, 25 bp, Mus musculus
ctcggtgcaggtgtcacggcgccct

SEQ ID NO: 285739 - DNA, 25 bp, Mus musculus
ccagataaatgggtgcagagcatcc

SEQ ID NO: 285740 - DNA, 25 bp, Mus musculus
agaggcgctcctgactctcccggaa

SEQ ID NO: 285741 - DNA, 25 bp, Mus musculus
cacggtaacctctgcacgttggttc

SEQ ID NO: 285742 - DNA, 25 bp, Mus musculus
tgttgagtgcctcacttccggcgca

SEQ ID NO: 285743 - DNA, 25 bp, Mus musculus
ggatgtgttcctgagtcctcccaca

SEQ ID NO: 285744 - DNA, 25 bp, Mus musculus
gtcccgcgcactcctaggatgtgtt

SEQ ID NO: 285745 - DNA, 25 bp, Mus musculus
taatggtgatgtgcgccatagcggc

SEQ ID NO: 285746 - DNA, 25 bp, Mus musculus
cggaaccaaagtccagagcccactg

SEQ ID NO: 285747 - DNA, 25 bp, Mus musculus
gtgtgctagcgacccgattcctcgc

SEQ ID NO: 285748 - DNA, 25 bp, Mus musculus
cgacttgggaacgtgtccctggtca

SEQ ID NO: 285749 - DNA, 25 bp, Mus musculus
gactgacgtggaggagttcccaacc

SEQ ID NO: 285750 - DNA, 25 bp, Mus musculus
gataccaagcgaaacccacctgctg

SEQ ID NO: 285751 - DNA, 25 bp, Mus musculus
tggcccgtaggccaggataccaagc

SEQ ID NO: 285752 - DNA, 25 bp, Mus musculus
tccagagcccactgggaaggcgtcc

SEQ ID NO: 285753 - DNA, 25 bp, Mus musculus
cccacctgctgtaggtactggttaa

SEQ ID NO: 285754 - DNA, 25 bp, Mus musculus
cctgcgggaagtcgtgcgctacctc

SEQ ID NO: 285755 - DNA, 25 bp, Mus musculus
ctattgagggctttattaacccaga

SEQ ID NO: 285756 - DNA, 25 bp, Mus musculus
gacttggctattgagggctttatta

SEQ ID NO: 285757 - DNA, 25 bp, Mus musculus
cgagtttagtaagacttggctattg

SEQ ID NO: 285758 - DNA, 25 bp, Mus musculus
agttgaacgagtttagtaagacttg

SEQ ID NO: 285759 - DNA, 25 bp, Mus musculus
cgtggattgctgacagtagcgaccc

SEQ ID NO: 285760 - DNA, 25 bp, Mus musculus
ctcggctgtaaacgtggattgctga

SEQ ID NO: 285761 - DNA, 25 bp, Mus musculus
cagtttcctcggctgtaaacgtgga

SEQ ID NO: 285762 - DNA, 25 bp, Mus musculus
tctgatctgcgggagcctcagtttc

SEQ ID NO: 285763 - DNA, 25 bp, Mus musculus
cagtgatctgatctgcgggagcctc

SEQ ID NO: 285764 - DNA, 25 bp, Mus musculus
cggtggtcttggtcagtgatctgat

SEQ ID NO: 285765 - DNA, 25 bp, Mus musculus
actccgaacgcggtggtcttggtca

SEQ ID NO: 285766 - DNA, 25 bp, Mus musculus
ccgtggactccgaacgcggtggtct

SEQ ID NO: 285767 - DNA, 25 bp, Mus musculus
acccgcctgggagcgctcgcgctac

SEQ ID NO: 285768 - DNA, 25 bp, Mus musculus
gatggctgccgaaccctggttcacg

SEQ ID NO: 285769 - DNA, 25 bp, Mus musculus
agctgcgcaccgcaaacacgaggca

SEQ ID NO: 285770 - DNA, 25 bp, Mus musculus
caccgcaaacacgaggcaggtctgg

SEQ ID NO: 285771 - DNA, 25 bp, Mus musculus
cccgagacttcagcggagcaggagc

SEQ ID NO: 285772 - DNA, 25 bp, Mus musculus
agctccgtgcgcagtgcaggcccag

SEQ ID NO: 285773 - DNA, 25 bp, Mus musculus
cgccctccgcgtgctgaaattcaaa

SEQ ID NO: 285774 - DNA, 25 bp, Mus musculus
cccagcgggcacagcccatgatgga

SEQ ID NO: 285775 - DNA, 25 bp, Mus musculus
tatggagacccttcgtggtcgcccg

SEQ ID NO: 285776 - DNA, 25 bp, Mus musculus
ccgccctatggagacccttcgtggt

SEQ ID NO: 285777 - DNA, 25 bp, Mus musculus
gcaccgccttcggaggaactgggac

SEQ ID NO: 285778 - DNA, 25 bp, Mus musculus
cccggagaagcaccgccttcggagg

SEQ ID NO: 285779 - DNA, 25 bp, Mus musculus
ctggttcacggggtcgctggcccta

SEQ ID NO: 285780 - DNA, 25 bp, Mus musculus
tgaaattcaaaagaggcgaaagccc

SEQ ID NO: 285781 - DNA, 25 bp, Mus musculus
agcccatgatggaagctccagcctc

SEQ ID NO: 285782 - DNA, 25 bp, Mus musculus
ctcgcgttcgatgtcccgttgcatc

SEQ ID NO: 285783 - DNA, 25 bp, Mus musculus
acgctggcattctggggtctttttt

SEQ ID NO: 285784 - DNA, 25 bp, Mus musculus
gtgccctgtgcagtacctgtagtta

SEQ ID NO: 285785 - DNA, 25 bp, Mus musculus
tgcccaaataggtaggacacggtgc

SEQ ID NO: 285786 - DNA, 25 bp, Mus musculus
cggacacccgaggacatggatgttt

SEQ ID NO: 285787 - DNA, 25 bp, Mus musculus
gctccagagtctgcaagtgctcctc

SEQ ID NO: 285788 - DNA, 25 bp, Mus musculus
tgctcaactggcacctgcgggacct

SEQ ID NO: 285789 - DNA, 25 bp, Mus musculus
cgttatactagtgccaggcggccca

SEQ ID NO: 285790 - DNA, 25 bp, Mus musculus
ttccctctggtaccacgctggcatt

SEQ ID NO: 285791 - DNA, 25 bp, Mus musculus
atgggcgtctccatctgcaattccg

SEQ ID NO: 285792 - DNA, 25 bp, Mus musculus
tcagagccgaattgagatgcccaaa

SEQ ID NO: 285793 - DNA, 25 bp, Mus musculus
aaacacacctggaggcctctgagcc

SEQ ID NO: 285794 - DNA, 25 bp, Mus musculus
gccacctgaacacacgggttgactg

SEQ ID NO: 285795 - DNA, 25 bp, Mus musculus
gctcccggaacacgtagccttcagg

SEQ ID NO: 285796 - DNA, 25 bp, Mus musculus
atcctgagaagttgatagcgctccc

SEQ ID NO: 285797 - DNA, 25 bp, Mus musculus
ggctggtaaataattcatcctgaga

SEQ ID NO: 285798 - DNA, 25 bp, Mus musculus
ggaggctggtaaataattcatcctg

SEQ ID NO: 285799 - DNA, 25 bp, Mus musculus
gccggaggctggtaaataattcatc

SEQ ID NO: 285800 - DNA, 25 bp, Mus musculus
aactgggaggcagcctagcgcagcg

SEQ ID NO: 285801 - DNA, 25 bp, Mus musculus
attcatcctgagaagttgatagcgc

SEQ ID NO: 285802 - DNA, 25 bp, Mus musculus
aggccggaggctggtaaataattca

SEQ ID NO: 285803 - DNA, 25 bp, Mus musculus
agttgatagcgctccccagcactgc

SEQ ID NO: 285804 - DNA, 25 bp, Mus musculus
cagcctagcgcagcgtggaggccgg

SEQ ID NO: 285805 - DNA, 25 bp, Mus musculus
cggcgtggctgcgtgtatatgaact

SEQ ID NO: 285806 - DNA, 25 bp, Mus musculus
caccggcgtggctgcgtgtatatga

SEQ ID NO: 285807 - DNA, 25 bp, Mus musculus
cacctgctggagcaccggcgtggct

SEQ ID NO: 285808 - DNA, 25 bp, Mus musculus
gtcagtgcttggctgctgtccccca

SEQ ID NO: 285809 - DNA, 25 bp, Mus musculus
tggctgcgtgtatatgaactgggag

SEQ ID NO: 285810 - DNA, 25 bp, Mus musculus
gctgctgagtcagcgctctgcagcc

SEQ ID NO: 285811 - DNA, 25 bp, Mus musculus
atttgcggaccaccattgggcgtgg

SEQ ID NO: 285812 - DNA, 25 bp, Mus musculus
cgtgggcctggcttccgcagcatga

SEQ ID NO: 285813 - DNA, 25 bp, Mus musculus
ccatttgcggaccaccattgggcgt

SEQ ID NO: 285814 - DNA, 25 bp, Mus musculus
cgcggccgcctggtcctgccccgcc

SEQ ID NO: 285815 - DNA, 25 bp, Mus musculus
ttgcggaccaccattgggcgtgggc

SEQ ID NO: 285816 - DNA, 25 bp, Mus musculus
ctgggtcgtgtgtgcgcaggagaag

SEQ ID NO: 285817 - DNA, 25 bp, Mus musculus
tgtgtgcgcaggagaagcggcggct

SEQ ID NO: 285818 - DNA, 25 bp, Mus musculus
ggctgcaggaggagatcggcgccgc

SEQ ID NO: 285819 - DNA, 25 bp, Mus musculus
ggcgccgcgcgtcgcgagctggagg

SEQ ID NO: 285820 - DNA, 25 bp, Mus musculus
cccatttgcggaccaccattgggcg

SEQ ID NO: 285821 - DNA, 25 bp, Mus musculus
cttccgcagcatgagggcgcggccg

SEQ ID NO: 285822 - DNA, 25 bp, Mus musculus
cctggcttccgcagcatgagggcgc

SEQ ID NO: 285823 - DNA, 25 bp, Mus musculus
catttgcggaccaccattgggcgtg

SEQ ID NO: 285824 - DNA, 25 bp, Mus musculus
tacagcctgcgggaaggaagccacc

SEQ ID NO: 285825 - DNA, 25 bp, Mus musculus
gacaagtgacaccaccaggcttggg

SEQ ID NO: 285826 - DNA, 25 bp, Mus musculus
tccaacggcgtgaggcgtgcaaccc

SEQ ID NO: 285827 - DNA, 25 bp, Mus musculus
ctttccgacctgctacatcctgttg

SEQ ID NO: 285828 - DNA, 25 bp, Mus musculus
gccggttcatggctcccagggacaa

SEQ ID NO: 285829 - DNA, 25 bp, Mus musculus
cccgagccagccactcacgaagctg

SEQ ID NO: 285830 - DNA, 25 bp, Mus musculus
tcacgaagctgctcaccgtggggcc

SEQ ID NO: 285831 - DNA, 25 bp, Mus musculus
gcgtcccgagcagcagcgacatcag

SEQ ID NO: 285832 - DNA, 25 bp, Mus musculus
gcgacatcagcgacagcagaagctc

SEQ ID NO: 285833 - DNA, 25 bp, Mus musculus
gacagcagaagctccaacggcgtga

SEQ ID NO: 285834 - DNA, 25 bp, Mus musculus
cgtgcaacccggagccggttcatgg

SEQ ID NO: 285835 - DNA, 25 bp, Mus musculus
gctacatcctgttgtcgcccagttc

SEQ ID NO: 285836 - DNA, 25 bp, Mus musculus
tggctcccagggacaagtgacacca

SEQ ID NO: 285837 - DNA, 25 bp, Mus musculus
gttcccgatgccctacaactgtgac

SEQ ID NO: 285838 - DNA, 25 bp, Mus musculus
gtcttgaggttttcatcggtacgta

SEQ ID NO: 285839 - DNA, 25 bp, Mus musculus
tcttggaccaagagaacgcgcctgt

SEQ ID NO: 285840 - DNA, 25 bp, Mus musculus
gcctgtcgcttgagtacagtcctga

SEQ ID NO: 285841 - DNA, 25 bp, Mus musculus
tagtcgtggcgaccaagcaacccag

SEQ ID NO: 285842 - DNA, 25 bp, Mus musculus
aggcgccatagccacggtagtcgtg

SEQ ID NO: 285843 - DNA, 25 bp, Mus musculus
acgcgcctgtgaagtcaacgaattc

SEQ ID NO: 285844 - DNA, 25 bp, Mus musculus
agcacagagtcgctgcgttccttgg

SEQ ID NO: 285845 - DNA, 25 bp, Mus musculus
tgacggacgtccgaactgaggaatc

SEQ ID NO: 285846 - DNA, 25 bp, Mus musculus
cgcgacaaacttttggacgagattg

SEQ ID NO: 285847 - DNA, 25 bp, Mus musculus
ctcgttagtccaaccagagagccga

SEQ ID NO: 285848 - DNA, 25 bp, Mus musculus
tgacgggcttcgcttgccttttagg

SEQ ID NO: 285849 - DNA, 25 bp, Mus musculus
agggtttagctttctctgacggacg

SEQ ID NO: 285850 - DNA, 25 bp, Mus musculus
gccaatagcatgctggaagcgccca

SEQ ID NO: 285851 - DNA, 25 bp, Mus musculus
tgacgtcacagaagggcagcacaga

SEQ ID NO: 285852 - DNA, 25 bp, Mus musculus
agcgacctcaatcgggtggacttcg

SEQ ID NO: 285853 - DNA, 25 bp, Mus musculus
cctcaatcgggtggacttcgcaaac

SEQ ID NO: 285854 - DNA, 25 bp, Mus musculus
caatcgggtggacttcgcaaacgtc

SEQ ID NO: 285855 - DNA, 25 bp, Mus musculus
cgcaaacgtccaggtgagcaccatt

SEQ ID NO: 285856 - DNA, 25 bp, Mus musculus
cttcgcaaacgtccaggtgagcacc

SEQ ID NO: 285857 - DNA, 25 bp, Mus musculus
atgctaagcgacctcaatcgggtgg

SEQ ID NO: 285858 - DNA, 25 bp, Mus musculus
gatcaaccagatgctaagcgacctc

SEQ ID NO: 285859 - DNA, 25 bp, Mus musculus
tgcacagatcaaccagatgctaagc

SEQ ID NO: 285860 - DNA, 25 bp, Mus musculus
ttcgcacagacactgcggcgctaca

SEQ ID NO: 285861 - DNA, 25 bp, Mus musculus
acatcgctcaaccacttggcgcagg

SEQ ID NO: 285862 - DNA, 25 bp, Mus musculus
acactgcggcgctacacatcgctca

SEQ ID NO: 285863 - DNA, 25 bp, Mus musculus
cgtccaggtgagcaccattggggct

SEQ ID NO: 285864 - DNA, 25 bp, Mus musculus
gcagaacactgcacagatcaaccag

SEQ ID NO: 285865 - DNA, 25 bp, Mus musculus
cgcgggcagtgctgcagaacactgc

SEQ ID NO: 285866 - DNA, 25 bp, Mus musculus
aggtctcctcatctcagtggttcgc

SEQ ID NO: 285867 - DNA, 25 bp, Mus musculus
ggctttagctttgtgggccttccta

SEQ ID NO: 285868 - DNA, 25 bp, Mus musculus
tgctcttctctgctcctcttgtgtg

SEQ ID NO: 285869 - DNA, 25 bp, Mus musculus
caaatcggtaggactggagaaatgc

SEQ ID NO: 285870 - DNA, 25 bp, Mus musculus
tggagaaatgcagacccagcgatcc

SEQ ID NO: 285871 - DNA, 25 bp, Mus musculus
gcggcgctggcgaaatgccagaatt

SEQ ID NO: 285872 - DNA, 25 bp, Mus musculus
gggacacttcctgcaccgctctagg

SEQ ID NO: 285873 - DNA, 25 bp, Mus musculus
aggggatctcccagtgaccatttgc

SEQ ID NO: 285874 - DNA, 25 bp, Mus musculus
gaccatttgcatcccgtgtgtgctg

SEQ ID NO: 285875 - DNA, 25 bp, Mus musculus
agccgcaattccatttcaaagccaa

SEQ ID NO: 285876 - DNA, 25 bp, Mus musculus
gctgccagagccacccaaatcggta

SEQ ID NO: 285877 - DNA, 25 bp, Mus musculus
gaagccgggccacagtatactcacc

SEQ ID NO: 285878 - DNA, 25 bp, Mus musculus
gctctaggaccgaggaggtctcctc

SEQ ID NO: 285879 - DNA, 25 bp, Mus musculus
agcgatccacggtgctcgccgaagc

SEQ ID NO: 285880 - DNA, 25 bp, Mus musculus
ggcctgaataagctgcgggaactga

SEQ ID NO: 285881 - DNA, 25 bp, Mus musculus
cgggatctggtctcagcgagagcct

SEQ ID NO: 285882 - DNA, 25 bp, Mus musculus
ctgcacacgttgcacctctatggca

SEQ ID NO: 285883 - DNA, 25 bp, Mus musculus
ctctatggcaacaagctggagcgtg

SEQ ID NO: 285884 - DNA, 25 bp, Mus musculus
ggaactgaacttggcacacaatcgg

SEQ ID NO: 285885 - DNA, 25 bp, Mus musculus
agccagagcagctcgccggcctgaa

SEQ ID NO: 285886 - DNA, 25 bp, Mus musculus
accaactgcggactctggagccaga

SEQ ID NO: 285887 - DNA, 25 bp, Mus musculus
gctgagactgcaacgcaaccaactg

SEQ ID NO: 285888 - DNA, 25 bp, Mus musculus
ccagtttgcgctcgctgagactgca

SEQ ID NO: 285889 - DNA, 25 bp, Mus musculus
tgcctgagggcctgcccgccagttt

SEQ ID NO: 285890 - DNA, 25 bp, Mus musculus
gtaaccagttgacccggctgcctga

SEQ ID NO: 285891 - DNA, 25 bp, Mus musculus
gcttggacctggctggtaaccagtt

SEQ ID NO: 285892 - DNA, 25 bp, Mus musculus
agcgagagccttggccgagctcaac

SEQ ID NO: 285893 - DNA, 25 bp, Mus musculus
ttggcacacaatcggctccgcgtgg

SEQ ID NO: 285894 - DNA, 25 bp, Mus musculus
tcgagtctcagagctcgcgctgttc

SEQ ID NO: 285895 - DNA, 25 bp, Mus musculus
tcagagctcgcgctgttcctgagcc

SEQ ID NO: 285896 - DNA, 25 bp, Mus musculus
tggattcgtgggctctctagttaaa

SEQ ID NO: 285897 - DNA, 25 bp, Mus musculus
gggctctctagttaaactacaattc

SEQ ID NO: 285898 - DNA, 25 bp, Mus musculus
tacaattcccggcagtcagagcgtg

SEQ ID NO: 285899 - DNA, 25 bp, Mus musculus
cgtggaggcgcatgcgcctagcata

SEQ ID NO: 285900 - DNA, 25 bp, Mus musculus
cgcatgcgcctagcataaagtaggg

SEQ ID NO: 285901 - DNA, 25 bp, Mus musculus
ctagcataaagtagggcagagagaa

SEQ ID NO: 285902 - DNA, 25 bp, Mus musculus
cggagcatgcgtaaggtgtgtagtc

SEQ ID NO: 285903 - DNA, 25 bp, Mus musculus
tgtgtagtcggtactacgcgtgcgt

SEQ ID NO: 285904 - DNA, 25 bp, Mus musculus
gcagtgtgacgtctgtggctccaca

SEQ ID NO: 285905 - DNA, 25 bp, Mus musculus
tgtgacgtctgtggctccacaccgc

SEQ ID NO: 285906 - DNA, 25 bp, Mus musculus
cgaagtcgagtctcagagctcgcgc

SEQ ID NO: 285907 - DNA, 25 bp, Mus musculus
agcttccgccttggccttcaggagc

SEQ ID NO: 285908 - DNA, 25 bp, Mus musculus
tggtccagcgcccacgtgatgccga

SEQ ID NO: 285909 - DNA, 25 bp, Mus musculus
aggactgggtgctgcctcggaccct

SEQ ID NO: 285910 - DNA, 25 bp, Mus musculus
ctctgagctgccttgtgagaggact

SEQ ID NO: 285911 - DNA, 25 bp, Mus musculus
tggagttcctgccaggcagtgctgc

SEQ ID NO: 285912 - DNA, 25 bp, Mus musculus
cagtctgagccgctctggaaggagc

SEQ ID NO: 285913 - DNA, 25 bp, Mus musculus
ttgggagcccagtctgagccgctct

SEQ ID NO: 285914 - DNA, 25 bp, Mus musculus
actgctcacgtgacaggcgctgccg

SEQ ID NO: 285915 - DNA, 25 bp, Mus musculus
cgggcgcggcactgctcacgtgaca

SEQ ID NO: 285916 - DNA, 25 bp, Mus musculus
agtaagctggcggtccacgggctct

SEQ ID NO: 285917 - DNA, 25 bp, Mus musculus
tcccgaagaagtgaggagtaagctg

SEQ ID NO: 285918 - DNA, 25 bp, Mus musculus
gtgcggaacggagcctcccgaagaa

SEQ ID NO: 285919 - DNA, 25 bp, Mus musculus
gtgaccacatcacgtgcggaacgga

SEQ ID NO: 285920 - DNA, 25 bp, Mus musculus
gtatcccggcaacgcggagcgtttc

SEQ ID NO: 285921 - DNA, 25 bp, Mus musculus
atgccgactggcacgtgaccacatc

SEQ ID NO: 285922 - DNA, 25 bp, Mus musculus
gatcaccgtgcagatgcggtctgta

SEQ ID NO: 285923 - DNA, 25 bp, Mus musculus
gagcggttcgaacccgcggccacgc

SEQ ID NO: 285924 - DNA, 25 bp, Mus musculus
gggccgcctgcaagccctcgtactc

SEQ ID NO: 285925 - DNA, 25 bp, Mus musculus
tcgtactccacgctgcagctcgagg

SEQ ID NO: 285926 - DNA, 25 bp, Mus musculus
cagggacctgggatgcatgcagccc

SEQ ID NO: 285927 - DNA, 25 bp, Mus musculus
acctgggatgcatgcagcccttctg

SEQ ID NO: 285928 - DNA, 25 bp, Mus musculus
atgcatgcagcccttctggctcggc

SEQ ID NO: 285929 - DNA, 25 bp, Mus musculus
atgcagcccttctggctcggcggga

SEQ ID NO: 285930 - DNA, 25 bp, Mus musculus
ctcggcgggagcacgcgcgcacaaa

SEQ ID NO: 285931 - DNA, 25 bp, Mus musculus
cgcacaaaggcacgcgggccacaga

SEQ ID NO: 285932 - DNA, 25 bp, Mus musculus
ggcggccacacacgtagggacacct

SEQ ID NO: 285933 - DNA, 25 bp, Mus musculus
acacacgtagggacacctgggagcg

SEQ ID NO: 285934 - DNA, 25 bp, Mus musculus
caccgtgcagatgcggtctgtaccc

SEQ ID NO: 285935 - DNA, 25 bp, Mus musculus
gccgggaacaatggaggcctcggcc

SEQ ID NO: 285936 - DNA, 25 bp, Mus musculus
cctcagtcctctcgtcgccgccagc

SEQ ID NO: 285937 - DNA, 25 bp, Mus musculus
ccacgtcggggttcagatcggtcct

SEQ ID NO: 285938 - DNA, 25 bp, Mus musculus
cctgatgattttccccacgtcgggg

SEQ ID NO: 285939 - DNA, 25 bp, Mus musculus
ggcagggacgctcccctgatgattt

SEQ ID NO: 285940 - DNA, 25 bp, Mus musculus
ctagccctgacaggagtctggcagg

SEQ ID NO: 285941 - DNA, 25 bp, Mus musculus
gggttcgagcctcctagccctgaca

SEQ ID NO: 285942 - DNA, 25 bp, Mus musculus
tcggccggggttcgagcctcctagc

SEQ ID NO: 285943 - DNA, 25 bp, Mus musculus
ggcaacgtcctccaacatccttcgg

SEQ ID NO: 285944 - DNA, 25 bp, Mus musculus
aaacatcgtgttgcccggcaacgtc

SEQ ID NO: 285945 - DNA, 25 bp, Mus musculus
acaaacatcgtgttgcccggcaacg

SEQ ID NO: 285946 - DNA, 25 bp, Mus musculus
gcgccaacaaacatcgtgttgcccg

SEQ ID NO: 285947 - DNA, 25 bp, Mus musculus
gtccgcgtcacgccgcgatgagtca

SEQ ID NO: 285948 - DNA, 25 bp, Mus musculus
cggggttcagatcggtccttgcagt

SEQ ID NO: 285949 - DNA, 25 bp, Mus musculus
gccgccagccctgggctgcaggcca

SEQ ID NO: 285950 - DNA, 25 bp, Mus musculus
cgctcagttcccttgtccggaccca

SEQ ID NO: 285951 - DNA, 25 bp, Mus musculus
aggcgctctttaaccctgtgcgctc

SEQ ID NO: 285952 - DNA, 25 bp, Mus musculus
ccgagaaaggcgctctttaaccctg

SEQ ID NO: 285953 - DNA, 25 bp, Mus musculus
aaagtcgggcggttgccatagcaac

SEQ ID NO: 285954 - DNA, 25 bp, Mus musculus
tgctcgcccgcagtaattttatttg

SEQ ID NO: 285955 - DNA, 25 bp, Mus musculus
agccgactccaggaaactttgctcg

SEQ ID NO: 285956 - DNA, 25 bp, Mus musculus
tgtttactccgcagccgactccagg

SEQ ID NO: 285957 - DNA, 25 bp, Mus musculus
tcgcttgttttacctcctccggcag

SEQ ID NO: 285958 - DNA, 25 bp, Mus musculus
ggttgttgcctgctcgcttgtttta

SEQ ID NO: 285959 - DNA, 25 bp, Mus musculus
gtacagcgggcctggtcctccctgt

SEQ ID NO: 285960 - DNA, 25 bp, Mus musculus
tcacttaaaagtacgtgggtgatgg

SEQ ID NO: 285961 - DNA, 25 bp, Mus musculus
cgggagtgagaaacgggttatcact

SEQ ID NO: 285962 - DNA, 25 bp, Mus musculus
ccatctcccagaggcctgggacagg

SEQ ID NO: 285963 - DNA, 25 bp, Mus musculus
gccattgtttactccgcagccgact

SEQ ID NO: 285964 - DNA, 25 bp, Mus musculus
acaacacagtcggtcgccacggcga

SEQ ID NO: 285965 - DNA, 25 bp, Mus musculus
tctgtgctgcgttgccatggggccc

SEQ ID NO: 285966 - DNA, 25 bp, Mus musculus
ttgatgtctctgtgctgcgttgcca

SEQ ID NO: 285967 - DNA, 25 bp, Mus musculus
ccctgtttgatgtctctgtgctgcg

SEQ ID NO: 285968 - DNA, 25 bp, Mus musculus
ggcctccctgtttgatgtctctgtg

SEQ ID NO: 285969 - DNA, 25 bp, Mus musculus
aaccgcagtgacgtggggcctccct

SEQ ID NO: 285970 - DNA, 25 bp, Mus musculus
tccctaaccgcagtgacgtggggcc

SEQ ID NO: 285971 - DNA, 25 bp, Mus musculus
ggagcctccctaaccgcagtgacgt

SEQ ID NO: 285972 - DNA, 25 bp, Mus musculus
cagtggggaggagcctccctaaccg

SEQ ID NO: 285973 - DNA, 25 bp, Mus musculus
acagtcggtcgccacggcgacagga

SEQ ID NO: 285974 - DNA, 25 bp, Mus musculus
gggacagtccacaacacagtcggtc

SEQ ID NO: 285975 - DNA, 25 bp, Mus musculus
tgggcccgggacagtccacaacaca

SEQ ID NO: 285976 - DNA, 25 bp, Mus musculus
ctctacgtgtgtgcccgggtgacct

SEQ ID NO: 285977 - DNA, 25 bp, Mus musculus
ctgcctgacggcctgaggcgctagc

SEQ ID NO: 285978 - DNA, 25 bp, Mus musculus
ggcggcgacaactttcccgcgcggc

SEQ ID NO: 285979 - DNA, 25 bp, Mus musculus
tcccgggaggcaagcactggatctg

SEQ ID NO: 285980 - DNA, 25 bp, Mus musculus
attggggtccgactcgggagagact

SEQ ID NO: 285981 - DNA, 25 bp, Mus musculus
acagcaggtagacttacggggccga

SEQ ID NO: 285982 - DNA, 25 bp, Mus musculus
cgcctgtcccgggaggcaagcactg

SEQ ID NO: 285983 - DNA, 25 bp, Mus musculus
tgtcccgggaggcaagcactggatc

SEQ ID NO: 285984 - DNA, 25 bp, Mus musculus
tccgactcgggagagactcgcgggg

SEQ ID NO: 285985 - DNA, 25 bp, Mus musculus
cagcaggtagacttacggggccgaa

SEQ ID NO: 285986 - DNA, 25 bp, Mus musculus
cgacagcaggtagacttacggggcc

SEQ ID NO: 285987 - DNA, 25 bp, Mus musculus
tgcgggcgacagcaggtagacttac

SEQ ID NO: 285988 - DNA, 25 bp, Mus musculus
ctgcgggcgacagcaggtagactta

SEQ ID NO: 285989 - DNA, 25 bp, Mus musculus
aagcactggatctggctgcgggcga

SEQ ID NO: 285990 - DNA, 25 bp, Mus musculus
aggcaagcactggatctggctgcgg

SEQ ID NO: 285991 - DNA, 25 bp, Mus musculus
tagacttacggggccgaaggcctga

SEQ ID NO: 285992 - DNA, 25 bp, Mus musculus
ggctgcgcctacacacggctttgtt

SEQ ID NO: 285993 - DNA, 25 bp, Mus musculus
cgtccgtcttttctgtgccatccaa

SEQ ID NO: 285994 - DNA, 25 bp, Mus musculus
tcacggggcggtatgagccaatcaa

SEQ ID NO: 285995 - DNA, 25 bp, Mus musculus
ggggaggtctcacgttcattcacaa

SEQ ID NO: 285996 - DNA, 25 bp, Mus musculus
gtcgcaagaagagtcgctgtccatc

SEQ ID NO: 285997 - DNA, 25 bp, Mus musculus
tgccatccaataagaggtcgcaaga

SEQ ID NO: 285998 - DNA, 25 bp, Mus musculus
gttcattcgacaatctccacgtccg

SEQ ID NO: 285999 - DNA, 25 bp, Mus musculus
cgcctccaagatgccgctgttcatt

SEQ ID NO: 286000 - DNA, 25 bp, Mus musculus
tctccctttctattggctgtcctca

SEQ ID NO: 286001 - DNA, 25 bp, Mus musculus
aatgaagccgtcttagcagccgctg

SEQ ID NO: 286002 - DNA, 25 bp, Mus musculus
tcggccacccgcttggcgctaaggt

SEQ ID NO: 286003 - DNA, 25 bp, Mus musculus
caggccggggccttacctgctcgaa

SEQ ID NO: 286004 - DNA, 25 bp, Mus musculus
acggcttggccttgtgaggagtttc

SEQ ID NO: 286005 - DNA, 25 bp, Mus musculus
cgctaaggtccaacaacggctcggg

SEQ ID NO: 286006 - DNA, 25 bp, Mus musculus
tggctacagtgggacgcaaagtctc

SEQ ID NO: 286007 - DNA, 25 bp, Mus musculus
tccaactagcggaggacaaagcctt

SEQ ID NO: 286008 - DNA, 25 bp, Mus musculus
aagccttgcagttgggaaccctctc

SEQ ID NO: 286009 - DNA, 25 bp, Mus musculus
cggatcacttgcatcgcttcactca

SEQ ID NO: 286010 - DNA, 25 bp, Mus musculus
gctgctgaacaacgcgcgccttctt

SEQ ID NO: 286011 - DNA, 25 bp, Mus musculus
cgccttcttgggagcgatgactcga

SEQ ID NO: 286012 - DNA, 25 bp, Mus musculus
cgcggcagccttgcttttaggtttc

SEQ ID NO: 286013 - DNA, 25 bp, Mus musculus
ttctgcgcctggaacttgcgttgtc

SEQ ID NO: 286014 - DNA, 25 bp, Mus musculus
gtcgaagacgtcattggctacagtg

SEQ ID NO: 286015 - DNA, 25 bp, Mus musculus
acagagcggcgcacttaaaggaacc

SEQ ID NO: 286016 - DNA, 25 bp, Mus musculus
gggcgggccaggattcatccaacta

SEQ ID NO: 286017 - DNA, 25 bp, Mus musculus
ttgcgttgtccctgcgccatgttct

SEQ ID NO: 286018 - DNA, 25 bp, Mus musculus
atgttctaccgcaacccggaagagg

SEQ ID NO: 286019 - DNA, 25 bp, Mus musculus
ccacgtgcagaaaagcggaagtcga

SEQ ID NO: 286020 - DNA, 25 bp, Mus musculus
aggccgcagcgaagagactacgaga

SEQ ID NO: 286021 - DNA, 25 bp, Mus musculus
tcaacgacgaggacctgacgcaggt

SEQ ID NO: 286022 - DNA, 25 bp, Mus musculus
gcgagtcgcatctgctcaacgacga

SEQ ID NO: 286023 - DNA, 25 bp, Mus musculus
gcaagtgtcagaactgcttcaagcc

SEQ ID NO: 286024 - DNA, 25 bp, Mus musculus
ggccaacatcttcaacaagagcaag

SEQ ID NO: 286025 - DNA, 25 bp, Mus musculus
gcaggaaatttcaggccaacatctt

SEQ ID NO: 286026 - DNA, 25 bp, Mus musculus
tcggcggccaaggaaaacccgtgca

SEQ ID NO: 286027 - DNA, 25 bp, Mus musculus
tcgacgggtttctttgttagcagga

SEQ ID NO: 286028 - DNA, 25 bp, Mus musculus
tcatccattggtcgacgggtttctt

SEQ ID NO: 286029 - DNA, 25 bp, Mus musculus
ggacaagttaccttgcgcccgctgc

SEQ ID NO: 286030 - DNA, 25 bp, Mus musculus
ttcccagcctggacaagttaccttg

SEQ ID NO: 286031 - DNA, 25 bp, Mus musculus
gtccaccaaacctgaaagttccatc

SEQ ID NO: 286032 - DNA, 25 bp, Mus musculus
agatctccggcgtccttccgggagc

SEQ ID NO: 286033 - DNA, 25 bp, Mus musculus
actacgagaaagacaggggcccgca

SEQ ID NO: 286034 - DNA, 25 bp, Mus musculus
cacggagctcagtgcctcatagtgg

SEQ ID NO: 286035 - DNA, 25 bp, Mus musculus
gggctgccacttgacccagatcgcg

SEQ ID NO: 286036 - DNA, 25 bp, Mus musculus
actaagaggcgcagctggtctcgca

SEQ ID NO: 286037 - DNA, 25 bp, Mus musculus
gtctcgcacgaaggccaccagagca

SEQ ID NO: 286038 - DNA, 25 bp, Mus musculus
acggccaggctgaggcagccgacca

SEQ ID NO: 286039 - DNA, 25 bp, Mus musculus
cttcatggcgcggatggcttcacta

SEQ ID NO: 286040 - DNA, 25 bp, Mus musculus
gccacgaggaatcctgcacaggctg

SEQ ID NO: 286041 - DNA, 25 bp, Mus musculus
gcgctcctaggttatcgggcgatta

SEQ ID NO: 286042 - DNA, 25 bp, Mus musculus
ctcatagtggcagtgctctggcagc

SEQ ID NO: 286043 - DNA, 25 bp, Mus musculus
cagctgcagctggtcgaggatctgc

SEQ ID NO: 286044 - DNA, 25 bp, Mus musculus
cggatcgcttccagtgtcatgttgc

SEQ ID NO: 286045 - DNA, 25 bp, Mus musculus
tcatgttgcctaccctgcagggcca

SEQ ID NO: 286046 - DNA, 25 bp, Mus musculus
ttcccgcacggtctcttcagtggca

SEQ ID NO: 286047 - DNA, 25 bp, Mus musculus
gcttcactagcctgctgcacggagc

SEQ ID NO: 286048 - DNA, 25 bp, Mus musculus
cctgcgcaagctggagcgaggcact

SEQ ID NO: 286049 - DNA, 25 bp, Mus musculus
gctcgcgtccgcagatacagcatct

SEQ ID NO: 286050 - DNA, 25 bp, Mus musculus
gtccgcagatacagcatctcccgtg

SEQ ID NO: 286051 - DNA, 25 bp, Mus musculus
agatacagcatctcccgtgccagga

SEQ ID NO: 286052 - DNA, 25 bp, Mus musculus
agcatctcccgtgccaggacgcagt

SEQ ID NO: 286053 - DNA, 25 bp, Mus musculus
catctcccgtgccaggacgcagtgg

SEQ ID NO: 286054 - DNA, 25 bp, Mus musculus
gcgcaagctggagcgaggcactttc

SEQ ID NO: 286055 - DNA, 25 bp, Mus musculus
tgcggcccaaaagcgcctgcgcaag

SEQ ID NO: 286056 - DNA, 25 bp, Mus musculus
aggaacccgcagagcgcccgcctct

SEQ ID NO: 286057 - DNA, 25 bp, Mus musculus
tcacgcctccaccagcccggaagca

SEQ ID NO: 286058 - DNA, 25 bp, Mus musculus
tgccctctccctgacgtcacgcctc

SEQ ID NO: 286059 - DNA, 25 bp, Mus musculus
ccgtacctacctgccctctccctga

SEQ ID NO: 286060 - DNA, 25 bp, Mus musculus
tggtgggattgaggacctgccaccc

SEQ ID NO: 286061 - DNA, 25 bp, Mus musculus
ttgccgtcgcggaccggtcctcacc

SEQ ID NO: 286062 - DNA, 25 bp, Mus musculus
ctgctctccagtcgggttgaatttg

SEQ ID NO: 286063 - DNA, 25 bp, Mus musculus
tggggaattttcaagactgcgctgc

SEQ ID NO: 286064 - DNA, 25 bp, Mus musculus
ggggaccagcggctccctgaagcct

SEQ ID NO: 286065 - DNA, 25 bp, Mus musculus
ggctgcagcgttttcaggaattttc

SEQ ID NO: 286066 - DNA, 25 bp, Mus musculus
attttctattctttccaggtctagg

SEQ ID NO: 286067 - DNA, 25 bp, Mus musculus
ggtctaggaaagtcagcaaaacaga

SEQ ID NO: 286068 - DNA, 25 bp, Mus musculus
cttcctatagcaaagacctggtttt

SEQ ID NO: 286069 - DNA, 25 bp, Mus musculus
ccgagcccacgcctttagcaagatg

SEQ ID NO: 286070 - DNA, 25 bp, Mus musculus
cctttagcaagatgccaagctgacc

SEQ ID NO: 286071 - DNA, 25 bp, Mus musculus
aagctgacccggacctcggaggaat

SEQ ID NO: 286072 - DNA, 25 bp, Mus musculus
gaagccagtctctgcgtccaaggga

SEQ ID NO: 286073 - DNA, 25 bp, Mus musculus
gtgcattggagcgttgctttaaaaa

SEQ ID NO: 286074 - DNA, 25 bp, Mus musculus
agacggacaaatccttcgctgccac

SEQ ID NO: 286075 - DNA, 25 bp, Mus musculus
tgctgaatcaggaggaaaacagatc

SEQ ID NO: 286076 - DNA, 25 bp, Mus musculus
agacccagtccggagagggcgccca

SEQ ID NO: 286077 - DNA, 25 bp, Mus musculus
gggcacccgagctcgcgccgcctgc

SEQ ID NO: 286078 - DNA, 25 bp, Mus musculus
agccccgagcgctggaccccggtgc

SEQ ID NO: 286079 - DNA, 25 bp, Mus musculus
cgcgggactcacaacctctgcagcc

SEQ ID NO: 286080 - DNA, 25 bp, Mus musculus
gggaccgcgggactcacaacctctg

SEQ ID NO: 286081 - DNA, 25 bp, Mus musculus
agggaccgcgggactcacaacctct

SEQ ID NO: 286082 - DNA, 25 bp, Mus musculus
atccatgcggagaagggccagggac

SEQ ID NO: 286083 - DNA, 25 bp, Mus musculus
cgctctgcgggatccatgcggagaa

SEQ ID NO: 286084 - DNA, 25 bp, Mus musculus
tccgcacccacctgggcacccgagc

SEQ ID NO: 286085 - DNA, 25 bp, Mus musculus
ctcagacccagtccggagagggcgc

SEQ ID NO: 286086 - DNA, 25 bp, Mus musculus
ctggctcagacccagtccggagagg

SEQ ID NO: 286087 - DNA, 25 bp, Mus musculus
gactggctcagacccagtccggaga

SEQ ID NO: 286088 - DNA, 25 bp, Mus musculus
cccgcgcagcatcgactggctcaga

SEQ ID NO: 286089 - DNA, 25 bp, Mus musculus
acccacctgggcacccgagctcgcg

SEQ ID NO: 286090 - DNA, 25 bp, Mus musculus
gagcagcgcaccagcgagatgcgca

SEQ ID NO: 286091 - DNA, 25 bp, Mus musculus
ccaacaagagccgtgcgccagaagc

SEQ ID NO: 286092 - DNA, 25 bp, Mus musculus
gcgagatgcgcaagcagaacctgct

SEQ ID NO: 286093 - DNA, 25 bp, Mus musculus
tgcggcccgacgtgaagactcactt

SEQ ID NO: 286094 - DNA, 25 bp, Mus musculus
aagactcacttggaccggccgcttg

SEQ ID NO: 286095 - DNA, 25 bp, Mus musculus
accggccgcttgtggtggacccgca

SEQ ID NO: 286096 - DNA, 25 bp, Mus musculus
agcagaacctgctggccagccgcga

SEQ ID NO: 286097 - DNA, 25 bp, Mus musculus
caacaacaccaacaagagccgtgcg

SEQ ID NO: 286098 - DNA, 25 bp, Mus musculus
agagcgagcctcagcagcgcgagca

SEQ ID NO: 286099 - DNA, 25 bp, Mus musculus
gggacgaacccgacgacaggccaga

SEQ ID NO: 286100 - DNA, 25 bp, Mus musculus
aacccgacgacaggccagagcgcag

SEQ ID NO: 286101 - DNA, 25 bp, Mus musculus
agcgcaagcggcgacaccgacacgg

SEQ ID NO: 286102 - DNA, 25 bp, Mus musculus
cccacgacgacagggagcgcagaca

SEQ ID NO: 286103 - DNA, 25 bp, Mus musculus
gacccgcaggagaaccgtaacaaca

SEQ ID NO: 286104 - DNA, 25 bp, Mus musculus
gtaggcctcgctgcatgtccaccag

SEQ ID NO: 286105 - DNA, 25 bp, Mus musculus
gggtgcctaccatctgcccgttctg

SEQ ID NO: 286106 - DNA, 25 bp, Mus musculus
gagctatgaatgagtctcgagattc

SEQ ID NO: 286107 - DNA, 25 bp, Mus musculus
tctcgagattccgtctgcatgtgcc

SEQ ID NO: 286108 - DNA, 25 bp, Mus musculus
ttccgtctgcatgtgcccgtttgta

SEQ ID NO: 286109 - DNA, 25 bp, Mus musculus
tgcatgtgcccgtttgtaccgctct

SEQ ID NO: 286110 - DNA, 25 bp, Mus musculus
tgcccgtttgtaccgctctgtgtag

SEQ ID NO: 286111 - DNA, 25 bp, Mus musculus
gtttgtaccgctctgtgtaggcctc

SEQ ID NO: 286112 - DNA, 25 bp, Mus musculus
cttcccacggagctatgaatgagtc

SEQ ID NO: 286113 - DNA, 25 bp, Mus musculus
gctgcatgtccaccagggcctgcgt

SEQ ID NO: 286114 - DNA, 25 bp, Mus musculus
gtgcctgccgcttctgaggatggaa

SEQ ID NO: 286115 - DNA, 25 bp, Mus musculus
ctgccgcttctgaggatggaatggt

SEQ ID NO: 286116 - DNA, 25 bp, Mus musculus
cgacagtcacttcccacggagctat

SEQ ID NO: 286117 - DNA, 25 bp, Mus musculus
catctgcccgttctgggccgagcag

SEQ ID NO: 286118 - DNA, 25 bp, Mus musculus
ctcgcccagcgaaggtcgggagcac

SEQ ID NO: 286119 - DNA, 25 bp, Mus musculus
cgaccgggatcgctacgcacaggag

SEQ ID NO: 286120 - DNA, 25 bp, Mus musculus
gcgaaggtcgggagcacacgacaca

SEQ ID NO: 286121 - DNA, 25 bp, Mus musculus
aggtcgggagcacacgacacacaga

SEQ ID NO: 286122 - DNA, 25 bp, Mus musculus
gggagcacacgacacacagacaggt

SEQ ID NO: 286123 - DNA, 25 bp, Mus musculus
agcacacgacacacagacaggtgcg

SEQ ID NO: 286124 - DNA, 25 bp, Mus musculus
ggccgacccaaggaccggaagcatc

SEQ ID NO: 286125 - DNA, 25 bp, Mus musculus
acccaaggaccggaagcatcggcca

SEQ ID NO: 286126 - DNA, 25 bp, Mus musculus
cccagcgaaggtcgggagcacacga

SEQ ID NO: 286127 - DNA, 25 bp, Mus musculus
ccaaggaccggaagcatcggccaca

SEQ ID NO: 286128 - DNA, 25 bp, Mus musculus
accgggatcgctacgcacaggagcg

SEQ ID NO: 286129 - DNA, 25 bp, Mus musculus
gagcagcgctggtcccgctcgccca

SEQ ID NO: 286130 - DNA, 25 bp, Mus musculus
ggaagcatcggccacaccaccacca

SEQ ID NO: 286131 - DNA, 25 bp, Mus musculus
aggaccggaagcatcggccacacca

SEQ ID NO: 286132 - DNA, 25 bp, Mus musculus
aaaccgaggtggctgcaagccggaa

SEQ ID NO: 286133 - DNA, 25 bp, Mus musculus
caagccggaaggacggctgcacgcc

SEQ ID NO: 286134 - DNA, 25 bp, Mus musculus
cttctcagacccacgggagtgcttg

SEQ ID NO: 286135 - DNA, 25 bp, Mus musculus
cccaatggttactacgcggggcacg

SEQ ID NO: 286136 - DNA, 25 bp, Mus musculus
ctcgattgaatctttcgttttcccg

SEQ ID NO: 286137 - DNA, 25 bp, Mus musculus
tgagttttatcatctcgattgaatc

SEQ ID NO: 286138 - DNA, 25 bp, Mus musculus
atagcttctattgatgagttttatc

SEQ ID NO: 286139 - DNA, 25 bp, Mus musculus
ggcgcactgcaaatgataaacaata

SEQ ID NO: 286140 - DNA, 25 bp, Mus musculus
tgcgggcgcactgcaaatgataaac

SEQ ID NO: 286141 - DNA, 25 bp, Mus musculus
cgcccgtaaagtgcgggcgcactgc

SEQ ID NO: 286142 - DNA, 25 bp, Mus musculus
tcccggtgaatgaaaccgaggtggc

SEQ ID NO: 286143 - DNA, 25 bp, Mus musculus
cgcacgacgcgtacagcgagagcga

SEQ ID NO: 286144 - DNA, 25 bp, Mus musculus
ccgcaggctgcccaatggttactac

SEQ ID NO: 286145 - DNA, 25 bp, Mus musculus
cgaggacgactggtgctaagccgcc

SEQ ID NO: 286146 - DNA, 25 bp, Mus musculus
cccaccctgactctgattgacgtaa

SEQ ID NO: 286147 - DNA, 25 bp, Mus musculus
gtgagctccggaactccgcctctga

SEQ ID NO: 286148 - DNA, 25 bp, Mus musculus
gctaggctagtgagctccggaactc

SEQ ID NO: 286149 - DNA, 25 bp, Mus musculus
gactctgattgacgtaatcgggccc

SEQ ID NO: 286150 - DNA, 25 bp, Mus musculus
cggaactccgcctctgactcgtttc

SEQ ID NO: 286151 - DNA, 25 bp, Mus musculus
gcaggtcccaccctgactctgattg

SEQ ID NO: 286152 - DNA, 25 bp, Mus musculus
caggagcgaagtctgcaggtcccac

SEQ ID NO: 286153 - DNA, 25 bp, Mus musculus
cacgcaggagcgaagtctgcaggtc

SEQ ID NO: 286154 - DNA, 25 bp, Mus musculus
gaagcaagttactgcacgcaggagc

SEQ ID NO: 286155 - DNA, 25 bp, Mus musculus
cccagaagaagcaagttactgcacg

SEQ ID NO: 286156 - DNA, 25 bp, Mus musculus
cactctcgggaccttgtggcgtgct

SEQ ID NO: 286157 - DNA, 25 bp, Mus musculus
agagcccactctcgggaccttgtgg

SEQ ID NO: 286158 - DNA, 25 bp, Mus musculus
aacagagcccactctcgggaccttg

SEQ ID NO: 286159 - DNA, 25 bp, Mus musculus
ccctagacttggtcggctaggctag

SEQ ID NO: 286160 - DNA, 25 bp, Mus musculus
ttcaggagactggagaagcgccttt

SEQ ID NO: 286161 - DNA, 25 bp, Mus musculus
cagcacgttgagcatattgtcggcc

SEQ ID NO: 286162 - DNA, 25 bp, Mus musculus
caggtactctgctagacgttcgggc

SEQ ID NO: 286163 - DNA, 25 bp, Mus musculus
cttccatgcttgttcgacgagagta

SEQ ID NO: 286164 - DNA, 25 bp, Mus musculus
cgctgcgcttctttctgtacttcca

SEQ ID NO: 286165 - DNA, 25 bp, Mus musculus
tcgctgcatgcgagagtggtacatc

SEQ ID NO: 286166 - DNA, 25 bp, Mus musculus
ctgcgcataacgagggacagctgca

SEQ ID NO: 286167 - DNA, 25 bp, Mus musculus
ggggacgctacttccactgcaactt

SEQ ID NO: 286168 - DNA, 25 bp, Mus musculus
ctcttgcgtatccatgggctccgga

SEQ ID NO: 286169 - DNA, 25 bp, Mus musculus
actaccgtcgctcaaatcgctgctg

SEQ ID NO: 286170 - DNA, 25 bp, Mus musculus
gcttggtaccagtccggcatcacta

SEQ ID NO: 286171 - DNA, 25 bp, Mus musculus
gcgccgctcgaaagaagccaccaga

SEQ ID NO: 286172 - DNA, 25 bp, Mus musculus
accttcgctttgtgccggaggaagc

SEQ ID NO: 286173 - DNA, 25 bp, Mus musculus
ctagacgggccttcttgcttggtac

SEQ ID NO: 286174 - DNA, 25 bp, Mus musculus
caaccctggggcctgcagtaaagcc

SEQ ID NO: 286175 - DNA, 25 bp, Mus musculus
ggcggtttacctgccttgcgcagca

SEQ ID NO: 286176 - DNA, 25 bp, Mus musculus
agcaggccgatctgagagccgttga

SEQ ID NO: 286177 - DNA, 25 bp, Mus musculus
ttgagggccatgtagtcgcagtcag

SEQ ID NO: 286178 - DNA, 25 bp, Mus musculus
cagtcagtgatgacccgcacgcgca

SEQ ID NO: 286179 - DNA, 25 bp, Mus musculus
cgcagcaggcggctcagtgaactct

SEQ ID NO: 286180 - DNA, 25 bp, Mus musculus
aagcctcggtgcaggtcacctgtga

SEQ ID NO: 286181 - DNA, 25 bp, Mus musculus
cacctgtgaggggaagaagagcacc

SEQ ID NO: 286182 - DNA, 25 bp, Mus musculus
ggaagaagagcacctcgcgccttgg

SEQ ID NO: 286183 - DNA, 25 bp, Mus musculus
agccaacgcatcagccacggcagtg

SEQ ID NO: 286184 - DNA, 25 bp, Mus musculus
agccacggcagtgcctctagggcca

SEQ ID NO: 286185 - DNA, 25 bp, Mus musculus
gccacctctaaggtcagccgtagca

SEQ ID NO: 286186 - DNA, 25 bp, Mus musculus
tcagccgtagcaccaagcgcttgcg

SEQ ID NO: 286187 - DNA, 25 bp, Mus musculus
cgaagaggcagagctccaagctgga

SEQ ID NO: 286188 - DNA, 25 bp, Mus musculus
cgtcccggagagaactcgatgtttc

SEQ ID NO: 286189 - DNA, 25 bp, Mus musculus
ttctttggacagtctgcacggcgtc

SEQ ID NO: 286190 - DNA, 25 bp, Mus musculus
tggtgctacagttctttggacagtc

SEQ ID NO: 286191 - DNA, 25 bp, Mus musculus
tcgttcgagtctgtttggtgctaca

SEQ ID NO: 286192 - DNA, 25 bp, Mus musculus
actaagtgttgtctcgggtcgttcg

SEQ ID NO: 286193 - DNA, 25 bp, Mus musculus
gccctcaggagcctaactaagtgtt

SEQ ID NO: 286194 - DNA, 25 bp, Mus musculus
gtcttagcccgaggagagggcttcc

SEQ ID NO: 286195 - DNA, 25 bp, Mus musculus
catataagaacaagggcagccggtc

SEQ ID NO: 286196 - DNA, 25 bp, Mus musculus
accacttccggatgcccatataaga

SEQ ID NO: 286197 - DNA, 25 bp, Mus musculus
atgtaatgacgtaggttggcgccgc

SEQ ID NO: 286198 - DNA, 25 bp, Mus musculus
gccgacttccctggctaaatttgga

SEQ ID NO: 286199 - DNA, 25 bp, Mus musculus
tcgcaccctgtggagttacggaaaa

SEQ ID NO: 286200 - DNA, 25 bp, Mus musculus
tccgggtggagtgagattcgcaccc

SEQ ID NO: 286201 - DNA, 25 bp, Mus musculus
gatgtttccttctctcatgctctca

SEQ ID NO: 286202 - DNA, 25 bp, Mus musculus
tgagacttcaaggatcccgcgaccc

SEQ ID NO: 286203 - DNA, 25 bp, Mus musculus
agcttagccgcgcttcgagcgcttc

SEQ ID NO: 286204 - DNA, 25 bp, Mus musculus
ccttaggcaagcttagccgcgcttc

SEQ ID NO: 286205 - DNA, 25 bp, Mus musculus
gcagggaggaaaactgcctcggccc

SEQ ID NO: 286206 - DNA, 25 bp, Mus musculus
gccattcattgtgggccaggccgcc

SEQ ID NO: 286207 - DNA, 25 bp, Mus musculus
gcgggccatctcacctgcgctgtgg

SEQ ID NO: 286208 - DNA, 25 bp, Mus musculus
ggaacctctgatgtcctcgggccgc

SEQ ID NO: 286209 - DNA, 25 bp, Mus musculus
cgccggaacctctgatgtcctcggg

SEQ ID NO: 286210 - DNA, 25 bp, Mus musculus
cactcttgccctcccgccgctgtca

SEQ ID NO: 286211 - DNA, 25 bp, Mus musculus
cgccagctgagattcggccatctca

SEQ ID NO: 286212 - DNA, 25 bp, Mus musculus
ctggacgctgtaggccgccagctga

SEQ ID NO: 286213 - DNA, 25 bp, Mus musculus
ctccggccctgagacttcaaggatc

SEQ ID NO: 286214 - DNA, 25 bp, Mus musculus
cgcctgccggctccacgcgattacc

SEQ ID NO: 286215 - DNA, 25 bp, Mus musculus
tgtaggccgccagctgagattcggc

SEQ ID NO: 286216 - DNA, 25 bp, Mus musculus
tacgagaatatcagtccgggacgcg

SEQ ID NO: 286217 - DNA, 25 bp, Mus musculus
cccagtgctaacgaggttttctata

SEQ ID NO: 286218 - DNA, 25 bp, Mus musculus
cggtgcaggaattcaaccgggacct

SEQ ID NO: 286219 - DNA, 25 bp, Mus musculus
gccaaaatcgtctttcccagtgcta

SEQ ID NO: 286220 - DNA, 25 bp, Mus musculus
taggtagaggttgtacgagaatatc

SEQ ID NO: 286221 - DNA, 25 bp, Mus musculus
atgtccctcgcgaggacgatcctgt

SEQ ID NO: 286222 - DNA, 25 bp, Mus musculus
tgagggcgccgccaaaatcgtcttt

SEQ ID NO: 286223 - DNA, 25 bp, Mus musculus
acccggttgcgactgtcactgaggg

SEQ ID NO: 286224 - DNA, 25 bp, Mus musculus
tccaccagcgatggagaacggcacc

SEQ ID NO: 286225 - DNA, 25 bp, Mus musculus
tcatggaacggaaggcccagaagcc

SEQ ID NO: 286226 - DNA, 25 bp, Mus musculus
cagcctctgtagagctcagttcatg

SEQ ID NO: 286227 - DNA, 25 bp, Mus musculus
gatcctgtggctaagccgtcctctc

SEQ ID NO: 286228 - DNA, 25 bp, Mus musculus
tcaaccgggacctgacgtgagcaag

SEQ ID NO: 286229 - DNA, 25 bp, Mus musculus
cgaggttttctataacccggtgcag

SEQ ID NO: 286230 - DNA, 25 bp, Mus musculus
cgaagctactcaggccctccggagc

SEQ ID NO: 286231 - DNA, 25 bp, Mus musculus
cctccggggtcagcattgcttctta

SEQ ID NO: 286232 - DNA, 25 bp, Mus musculus
agcattgcttcttatcagccgcggc

SEQ ID NO: 286233 - DNA, 25 bp, Mus musculus
tgcttcttatcagccgcggccaggc

SEQ ID NO: 286234 - DNA, 25 bp, Mus musculus
gcagccagacccttatctgcacagg

SEQ ID NO: 286235 - DNA, 25 bp, Mus musculus
gtcggtccaggagcagctcactttc

SEQ ID NO: 286236 - DNA, 25 bp, Mus musculus
agcagctcactttctcttggaggta

SEQ ID NO: 286237 - DNA, 25 bp, Mus musculus
tctcttggaggtacccaccacgacg

SEQ ID NO: 286238 - DNA, 25 bp, Mus musculus
accacgacgcctccgaagctactca

SEQ ID NO: 286239 - DNA, 25 bp, Mus musculus
tgcccgctggtttcctccggggtca

SEQ ID NO: 286240 - DNA, 25 bp, Mus musculus
ggcgcagcccagctctgaggcccaa

SEQ ID NO: 286241 - DNA, 25 bp, Mus musculus
ccaacgggagggattacctggagca

SEQ ID NO: 286242 - DNA, 25 bp, Mus musculus
cgggagggattacctggagcacacc

SEQ ID NO: 286243 - DNA, 25 bp, Mus musculus
aggaggtgcgcgctccgtgatccct

SEQ ID NO: 286244 - DNA, 25 bp, Mus musculus
gctcaccgtgccgaggtaaagcata

SEQ ID NO: 286245 - DNA, 25 bp, Mus musculus
cttctttcgtggtccctgtcgccgt

SEQ ID NO: 286246 - DNA, 25 bp, Mus musculus
ctgtcgccgtccgtttcttgagatt

SEQ ID NO: 286247 - DNA, 25 bp, Mus musculus
gccgtccgtttcttgagatttcaga

SEQ ID NO: 286248 - DNA, 25 bp, Mus musculus
cttgagatttcagactctgggcttg

SEQ ID NO: 286249 - DNA, 25 bp, Mus musculus
ctgggcttggaaaccagttgactgc

SEQ ID NO: 286250 - DNA, 25 bp, Mus musculus
ccagttgactgcctttcttagcgag

SEQ ID NO: 286251 - DNA, 25 bp, Mus musculus
ctgcctttcttagcgaggtgccctc

SEQ ID NO: 286252 - DNA, 25 bp, Mus musculus
gccgagcttctttcgtggtccctgt

SEQ ID NO: 286253 - DNA, 25 bp, Mus musculus
cgtgccgaggtaaagcatagggctt

SEQ ID NO: 286254 - DNA, 25 bp, Mus musculus
tcttagcgaggtgccctcggaaacc

SEQ ID NO: 286255 - DNA, 25 bp, Mus musculus
ctcggaaacctgtggaggaatgttt

SEQ ID NO: 286256 - DNA, 25 bp, Mus musculus
tttggattatgaatgctcaccgtgc

SEQ ID NO: 286257 - DNA, 25 bp, Mus musculus
aagcatagggctttggcgccttcgg

SEQ ID NO: 286258 - DNA, 25 bp, Mus musculus
ggcgagtgttcaccaacagccgtga

SEQ ID NO: 286259 - DNA, 25 bp, Mus musculus
cagagtagaggctgcacgctcacag

SEQ ID NO: 286260 - DNA, 25 bp, Mus musculus
ctggcggcagcagcacgttaacggc

SEQ ID NO: 286261 - DNA, 25 bp, Mus musculus
gcagcacgttaacggcgccttcgca

SEQ ID NO: 286262 - DNA, 25 bp, Mus musculus
gttaacggcgccttcgcagagctca

SEQ ID NO: 286263 - DNA, 25 bp, Mus musculus
cggcgccttcgcagagctcaggaag

SEQ ID NO: 286264 - DNA, 25 bp, Mus musculus
cgcccgaccggaagctgagcaagaa

SEQ ID NO: 286265 - DNA, 25 bp, Mus musculus
ctgagcaagaacgaggtgctgcgcc

SEQ ID NO: 286266 - DNA, 25 bp, Mus musculus
ctgcgcctggccatgaagtatatag

SEQ ID NO: 286267 - DNA, 25 bp, Mus musculus
atgaagtatataggcttcctggtgc

SEQ ID NO: 286268 - DNA, 25 bp, Mus musculus
tgctgcgagaccaaacggctgtgct

SEQ ID NO: 286269 - DNA, 25 bp, Mus musculus
tcaccaacagccgtgagcgctggcg

SEQ ID NO: 286270 - DNA, 25 bp, Mus musculus
gtagaggctgcacgctcacagcccg

SEQ ID NO: 286271 - DNA, 25 bp, Mus musculus
accaaacggctgtgctgacctccgg

SEQ ID NO: 286272 - DNA, 25 bp, Mus musculus
cgggcctgggcaaatcgacctgtca

SEQ ID NO: 286273 - DNA, 25 bp, Mus musculus
gaaacggtgggtcgtctgagccacc

SEQ ID NO: 286274 - DNA, 25 bp, Mus musculus
tggagcatcgaacctcccggaggga

SEQ ID NO: 286275 - DNA, 25 bp, Mus musculus
acctgtcagcgtggctggacctgtc

SEQ ID NO: 286276 - DNA, 25 bp, Mus musculus
ggggaggaaactaccaacttgctga

SEQ ID NO: 286277 - DNA, 25 bp, Mus musculus
taccaacttgctgagcgcgctcctg

SEQ ID NO: 286278 - DNA, 25 bp, Mus musculus
ctgagcgcgctcctgattaatgctg

SEQ ID NO: 286279 - DNA, 25 bp, Mus musculus
cctgattaatgctggtgagggtcaa

SEQ ID NO: 286280 - DNA, 25 bp, Mus musculus
gtcaagttggcgtctggctcaaaga

SEQ ID NO: 286281 - DNA, 25 bp, Mus musculus
tctggctcaaagaagggcgctcgga

SEQ ID NO: 286282 - DNA, 25 bp, Mus musculus
agggacgtttgttcgttggcattga

SEQ ID NO: 286283 - DNA, 25 bp, Mus musculus
gttcgttggcattgacctctgcggg

SEQ ID NO: 286284 - DNA, 25 bp, Mus musculus
aaatcgacctgtcagcgtggctgga

SEQ ID NO: 286285 - DNA, 25 bp, Mus musculus
tggacctgtcctggagcatcgaacc

SEQ ID NO: 286286 - DNA, 25 bp, Mus musculus
cgcaggggagggcttcgctcaactt

SEQ ID NO: 286287 - DNA, 25 bp, Mus musculus
tcccacagcgcccacagcccgactg

SEQ ID NO: 286288 - DNA, 25 bp, Mus musculus
cgactgtcctcgaccgaccgaagag

SEQ ID NO: 286289 - DNA, 25 bp, Mus musculus
aacgcagggacagccgcctcgcagc

SEQ ID NO: 286290 - DNA, 25 bp, Mus musculus
agggcttcgctcaacttccacacag

SEQ ID NO: 286291 - DNA, 25 bp, Mus musculus
ccgaactgaaaaatcattgcacttt

SEQ ID NO: 286292 - DNA, 25 bp, Mus musculus
agccaaccgaactgaaaaatcattg

SEQ ID NO: 286293 - DNA, 25 bp, Mus musculus
tgaccctgtttagccaaccgaactg

SEQ ID NO: 286294 - DNA, 25 bp, Mus musculus
gctctgaccctgtttagccaaccga

SEQ ID NO: 286295 - DNA, 25 bp, Mus musculus
tagctcttagctctgaccctgttta

SEQ ID NO: 286296 - DNA, 25 bp, Mus musculus
gggaccctctttcgctagctcttag

SEQ ID NO: 286297 - DNA, 25 bp, Mus musculus
gccgggcagggaccctctttcgcta

SEQ ID NO: 286298 - DNA, 25 bp, Mus musculus
tcgaccgaccgaagaggcgcacgcg

SEQ ID NO: 286299 - DNA, 25 bp, Mus musculus
tcaacttccacacagaacgcaggga

SEQ ID NO: 286300 - DNA, 25 bp, Mus musculus
gctgtggtatcggtttcatcgtcca

SEQ ID NO: 286301 - DNA, 25 bp, Mus musculus
gacgcatgaaggcacatcacacaca

SEQ ID NO: 286302 - DNA, 25 bp, Mus musculus
atagagtgacgcatgaaggcacatc

SEQ ID NO: 286303 - DNA, 25 bp, Mus musculus
ggctgcgaacaacataaatagagtg

SEQ ID NO: 286304 - DNA, 25 bp, Mus musculus
cgttgggctgcgaacaacataaata

SEQ ID NO: 286305 - DNA, 25 bp, Mus musculus
gccgctaccgttgggctgcgaacaa

SEQ ID NO: 286306 - DNA, 25 bp, Mus musculus
ttgccctggccgctaccgttgggct

SEQ ID NO: 286307 - DNA, 25 bp, Mus musculus
gcggcggcggtagcaaaaatgaccc

SEQ ID NO: 286308 - DNA, 25 bp, Mus musculus
ggaatcaggcataggaaggggcaca

SEQ ID NO: 286309 - DNA, 25 bp, Mus musculus
gccgtgctggtggttttggaatcag

SEQ ID NO: 286310 - DNA, 25 bp, Mus musculus
ccacttacaaggtgatggaggagtc

SEQ ID NO: 286311 - DNA, 25 bp, Mus musculus
ggtttcatcgtccacttacaaggtg

SEQ ID NO: 286312 - DNA, 25 bp, Mus musculus
atgaaggcacatcacacacagacac

SEQ ID NO: 286313 - DNA, 25 bp, Mus musculus
tggtatcggtttcatcgtccactta

SEQ ID NO: 286314 - DNA, 25 bp, Mus musculus
cgcaggcagtcaatccgccggatct

SEQ ID NO: 286315 - DNA, 25 bp, Mus musculus
ggcttcttgcccgtgatggttagca

SEQ ID NO: 286316 - DNA, 25 bp, Mus musculus
tcttgcccgtgatggttagcacaaa

SEQ ID NO: 286317 - DNA, 25 bp, Mus musculus
ttagcacaaagtcctcgcggaactc

SEQ ID NO: 286318 - DNA, 25 bp, Mus musculus
tcctcgcggaactcgggccggatgt

SEQ ID NO: 286319 - DNA, 25 bp, Mus musculus
gcgcagcttggccaacagccgggat

SEQ ID NO: 286320 - DNA, 25 bp, Mus musculus
gcttggccaacagccgggatgccca

SEQ ID NO: 286321 - DNA, 25 bp, Mus musculus
atgcccacttctgcttgatctcagg

SEQ ID NO: 286322 - DNA, 25 bp, Mus musculus
ttctgcttgatctcaggcttctcgc

SEQ ID NO: 286323 - DNA, 25 bp, Mus musculus
tgatctcaggcttctcgcccagcag

SEQ ID NO: 286324 - DNA, 25 bp, Mus musculus
accaggtgtaggagaaggctcggac

SEQ ID NO: 286325 - DNA, 25 bp, Mus musculus
tggaactcatcctgcaggcggcaag

SEQ ID NO: 286326 - DNA, 25 bp, Mus musculus
aactcatcctgcaggcggcaagccg

SEQ ID NO: 286327 - DNA, 25 bp, Mus musculus
aatccgccggatcttgcccttctgg

SEQ ID NO: 286328 - DNA, 25 bp, Mus musculus
gtcacgtaatgctcctccaggcaag

SEQ ID NO: 286329 - DNA, 25 bp, Mus musculus
ccgtctcccggatgctgggccggaa

SEQ ID NO: 286330 - DNA, 25 bp, Mus musculus
ggaacccgctcgcaactgtcctggg

SEQ ID NO: 286331 - DNA, 25 bp, Mus musculus
cgcaactgtcctggggctgtcgcca

SEQ ID NO: 286332 - DNA, 25 bp, Mus musculus
tggggctgtcgccactgttctgccc

SEQ ID NO: 286333 - DNA, 25 bp, Mus musculus
tcggcaagtgctagcccgttccgca

SEQ ID NO: 286334 - DNA, 25 bp, Mus musculus
cgcaggcccttgcactgagccttag

SEQ ID NO: 286335 - DNA, 25 bp, Mus musculus
gcactgagccttagcgcgtgaccca

SEQ ID NO: 286336 - DNA, 25 bp, Mus musculus
tagcgcgtgacccagccggaccgaa

SEQ ID NO: 286337 - DNA, 25 bp, Mus musculus
cgaaccatccgcaggccggcagagg

SEQ ID NO: 286338 - DNA, 25 bp, Mus musculus
caacgccagtgactagccggagcga

SEQ ID NO: 286339 - DNA, 25 bp, Mus musculus
gcggagccttgctgtgtcacgtaat

SEQ ID NO: 286340 - DNA, 25 bp, Mus musculus
aaagcgtagatggttccggccgccg

SEQ ID NO: 286341 - DNA, 25 bp, Mus musculus
cgactaggatgtgcggagccttgct

SEQ ID NO: 286342 - DNA, 25 bp, Mus musculus
gactccggcttctgaacctcttagg

SEQ ID NO: 286343 - DNA, 25 bp, Mus musculus
cacggtgtccactgttcggtcttaa

SEQ ID NO: 286344 - DNA, 25 bp, Mus musculus
acgatggttagcaaggtcctcctgc

SEQ ID NO: 286345 - DNA, 25 bp, Mus musculus
atgctccctacaaagcggcggcttg

SEQ ID NO: 286346 - DNA, 25 bp, Mus musculus
tcggccaagccacggcacaaaaatc

SEQ ID NO: 286347 - DNA, 25 bp, Mus musculus
cttaggaaaaacaccggagcctctg

SEQ ID NO: 286348 - DNA, 25 bp, Mus musculus
taccacccggcttctgtaggctgga

SEQ ID NO: 286349 - DNA, 25 bp, Mus musculus
cgcaccctggaaggaaccctcgagg

SEQ ID NO: 286350 - DNA, 25 bp, Mus musculus
tttagccggtgtaaatggtcctgtc

SEQ ID NO: 286351 - DNA, 25 bp, Mus musculus
ttgcggtctttttcacactagtccc

SEQ ID NO: 286352 - DNA, 25 bp, Mus musculus
ggtaggtgtccgcaagactcactcc

SEQ ID NO: 286353 - DNA, 25 bp, Mus musculus
gccacaggcgcgctactctacttag

SEQ ID NO: 286354 - DNA, 25 bp, Mus musculus
cccgctgtcccatcaggaagatcgg

SEQ ID NO: 286355 - DNA, 25 bp, Mus musculus
tcggtcttaagacagtagcagcagc

SEQ ID NO: 286356 - DNA, 25 bp, Mus musculus
atgcgaggcctgaacaaagactttg

SEQ ID NO: 286357 - DNA, 25 bp, Mus musculus
agcggcggtcctggtcttcgagacc

SEQ ID NO: 286358 - DNA, 25 bp, Mus musculus
gcacttccaggttcacgcagcggcg

SEQ ID NO: 286359 - DNA, 25 bp, Mus musculus
gccgcgtctgcaaacgtccaggatc

SEQ ID NO: 286360 - DNA, 25 bp, Mus musculus
tcccaacagggtcgacctgcggtgg

SEQ ID NO: 286361 - DNA, 25 bp, Mus musculus
cgctacaccatagcgcagggaactt

SEQ ID NO: 286362 - DNA, 25 bp, Mus musculus
tgctgtgcccgaggctgacccgacg

SEQ ID NO: 286363 - DNA, 25 bp, Mus musculus
ccaaggtcggcgctgctgtgcccga

SEQ ID NO: 286364 - DNA, 25 bp, Mus musculus
tgaacaaagactttggggagacgcc

SEQ ID NO: 286365 - DNA, 25 bp, Mus musculus
ccgaagcacgccaaggtcggcgctg

SEQ ID NO: 286366 - DNA, 25 bp, Mus musculus
cgctcccatgcgaggcctgaacaaa

SEQ ID NO: 286367 - DNA, 25 bp, Mus musculus
ccatagcgcagggaacttcgctgga

SEQ ID NO: 286368 - DNA, 25 bp, Mus musculus
tcttcgagaccggaaagtttgcacg

SEQ ID NO: 286369 - DNA, 25 bp, Mus musculus
tgacccgacggctgatcccaacagg

SEQ ID NO: 286370 - DNA, 25 bp, Mus musculus
ccgctatgtggccaagcagttcgga

SEQ ID NO: 286371 - DNA, 25 bp, Mus musculus
gaccatgcaagagtcgctgcgcttg

SEQ ID NO: 286372 - DNA, 25 bp, Mus musculus
ggtacccgagcttagcgaccatgca

SEQ ID NO: 286373 - DNA, 25 bp, Mus musculus
aggccgaggagcaagaatggtaccc

SEQ ID NO: 286374 - DNA, 25 bp, Mus musculus
cagttcggacgacatggcgccatct

SEQ ID NO: 286375 - DNA, 25 bp, Mus musculus
ctctgtggctctgggtcccaggtcc

SEQ ID NO: 286376 - DNA, 25 bp, Mus musculus
gagtggctatctcctgcggctctct

SEQ ID NO: 286377 - DNA, 25 bp, Mus musculus
gctcgcaatgcggagtggctatctc

SEQ ID NO: 286378 - DNA, 25 bp, Mus musculus
cgcgaggacccacagccaagatggc

SEQ ID NO: 286379 - DNA, 25 bp, Mus musculus
tacggactaaagcagcgcggcgctc

SEQ ID NO: 286380 - DNA, 25 bp, Mus musculus
tcacctgcgccgtacggactaaagc

SEQ ID NO: 286381 - DNA, 25 bp, Mus musculus
gcattaaacgttcacctgcgccgta

SEQ ID NO: 286382 - DNA, 25 bp, Mus musculus
ccgaaaccaggaatcatccgtagta

SEQ ID NO: 286383 - DNA, 25 bp, Mus musculus
tccgtagtaggcacgcggatccctt

SEQ ID NO: 286384 - DNA, 25 bp, Mus musculus
cgtcaggttccatgcggatcttgaa

SEQ ID NO: 286385 - DNA, 25 bp, Mus musculus
ctgggaagaactcccagggactggc

SEQ ID NO: 286386 - DNA, 25 bp, Mus musculus
gcccgcagctgacacgggagccaga

SEQ ID NO: 286387 - DNA, 25 bp, Mus musculus
gcaccgtctcgtcaggttccatgcg

SEQ ID NO: 286388 - DNA, 25 bp, Mus musculus
cacgggagccagactgggaagaact

SEQ ID NO: 286389 - DNA, 25 bp, Mus musculus
cgccgatcgtcagcgccggtgacac

SEQ ID NO: 286390 - DNA, 25 bp, Mus musculus
cctcccgttggatcccggcatccct

SEQ ID NO: 286391 - DNA, 25 bp, Mus musculus
cacttccggggcaagtgtgcagcgc

SEQ ID NO: 286392 - DNA, 25 bp, Mus musculus
ggtgacaccctcctcgacctctaga

SEQ ID NO: 286393 - DNA, 25 bp, Mus musculus
gttccatgcggatcttgaaggtctg

SEQ ID NO: 286394 - DNA, 25 bp, Mus musculus
cgcgccaagcacttccggggcaagt

SEQ ID NO: 286395 - DNA, 25 bp, Mus musculus
atcctcgtactacatgcaactcacg

SEQ ID NO: 286396 - DNA, 25 bp, Mus musculus
cccgggatcctcgtactacatgcaa

SEQ ID NO: 286397 - DNA, 25 bp, Mus musculus
ctgctgcaacgttttaagggtgatg

SEQ ID NO: 286398 - DNA, 25 bp, Mus musculus
agcccactcaggcacggtcacgtga

SEQ ID NO: 286399 - DNA, 25 bp, Mus musculus
tgcacctagggaacgcccaccgatg

SEQ ID NO: 286400 - DNA, 25 bp, Mus musculus
tctctggctcgctaggagtcgttta

SEQ ID NO: 286401 - DNA, 25 bp, Mus musculus
taagacgatcttcaggcagcggctc

SEQ ID NO: 286402 - DNA, 25 bp, Mus musculus
cactatgggccaatgagggtcgacc

SEQ ID NO: 286403 - DNA, 25 bp, Mus musculus
tgggatcccagatggctgatttcta

SEQ ID NO: 286404 - DNA, 25 bp, Mus musculus
tcccagttggctcagcaagttaggc

SEQ ID NO: 286405 - DNA, 25 bp, Mus musculus
gtccctttccattgcttcccagttg

SEQ ID NO: 286406 - DNA, 25 bp, Mus musculus
ggccaccgccgcttcaatttatatt

SEQ ID NO: 286407 - DNA, 25 bp, Mus musculus
ggctgagccttcctagtcccacaag

SEQ ID NO: 286408 - DNA, 25 bp, Mus musculus
tcgtttaaagaatccgcgcgagcgg

SEQ ID NO: 286409 - DNA, 25 bp, Mus musculus
ggcacacaggccttttaagacgatc

SEQ ID NO: 286410 - DNA, 25 bp, Mus musculus
acctccgtccaagaactgctctttg

SEQ ID NO: 286411 - DNA, 25 bp, Mus musculus
gttggccctctgaacggtaattaca

SEQ ID NO: 286412 - DNA, 25 bp, Mus musculus
tcggcgtcactgtccactcagaagc

SEQ ID NO: 286413 - DNA, 25 bp, Mus musculus
tcctaatgccgccacagagaggtga

SEQ ID NO: 286414 - DNA, 25 bp, Mus musculus
tgcagagcgcaaagctagccaccta

SEQ ID NO: 286415 - DNA, 25 bp, Mus musculus
ggctgccgaagcgacttcaattttc

SEQ ID NO: 286416 - DNA, 25 bp, Mus musculus
cctctcggttcggttatcctaatgc

SEQ ID NO: 286417 - DNA, 25 bp, Mus musculus
gcagtgttcgaacgctcccttcagg

SEQ ID NO: 286418 - DNA, 25 bp, Mus musculus
tgagcggatcgcaaaccatgctaac

SEQ ID NO: 286419 - DNA, 25 bp, Mus musculus
cctcagctccgaggcacagcgtttg

SEQ ID NO: 286420 - DNA, 25 bp, Mus musculus
acctactttccagctgcgcgtcaga

SEQ ID NO: 286421 - DNA, 25 bp, Mus musculus
tgggtcacatcgtaacctctctcgg

SEQ ID NO: 286422 - DNA, 25 bp, Mus musculus
ctgaggctcttaggcttacgcactc

SEQ ID NO: 286423 - DNA, 25 bp, Mus musculus
ttacgcactctctggaagctggctg

SEQ ID NO: 286424 - DNA, 25 bp, Mus musculus
gctgtccatcggcagcctgcttaaa

SEQ ID NO: 286425 - DNA, 25 bp, Mus musculus
gcctgcttaaaggagccgcacctac

SEQ ID NO: 286426 - DNA, 25 bp, Mus musculus
cgccaagcacgctgggagtagccat

SEQ ID NO: 286427 - DNA, 25 bp, Mus musculus
gaccagcttccaagtcgccctttgc

SEQ ID NO: 286428 - DNA, 25 bp, Mus musculus
actaaaaatggcaacgcacgcgcta

SEQ ID NO: 286429 - DNA, 25 bp, Mus musculus
cgccctttgcgccacactaaaaatg

SEQ ID NO: 286430 - DNA, 25 bp, Mus musculus
gctatcgcgacttccggttccagtt

SEQ ID NO: 286431 - DNA, 25 bp, Mus musculus
aatggcaacgcacgcgctatcgcga

SEQ ID NO: 286432 - DNA, 25 bp, Mus musculus
tgcacacgccaagcacgctgggagt

SEQ ID NO: 286433 - DNA, 25 bp, Mus musculus
ctgggagtagccatggcggataatc

SEQ ID NO: 286434 - DNA, 25 bp, Mus musculus
agccatggcggataatcccgttttg

SEQ ID NO: 286435 - DNA, 25 bp, Mus musculus
aatcccgttttggagctgttgctgc

SEQ ID NO: 286436 - DNA, 25 bp, Mus musculus
acagcgcggagttggctacgcagct

SEQ ID NO: 286437 - DNA, 25 bp, Mus musculus
ctacgcagctgggtgtggagcacca

SEQ ID NO: 286438 - DNA, 25 bp, Mus musculus
gcgcagtgaagagccttcaagctct

SEQ ID NO: 286439 - DNA, 25 bp, Mus musculus
agagccttcaagctctgggtgaggt

SEQ ID NO: 286440 - DNA, 25 bp, Mus musculus
tggagttaaaggaccaggagccgcc

SEQ ID NO: 286441 - DNA, 25 bp, Mus musculus
cccgccttggtcacgtaggtcattc

SEQ ID NO: 286442 - DNA, 25 bp, Mus musculus
aaaagacggaatggagcgccacgga

SEQ ID NO: 286443 - DNA, 25 bp, Mus musculus
gagcatcggcagagtgagaaccacg

SEQ ID NO: 286444 - DNA, 25 bp, Mus musculus
gtggccgcgcctcccgtggagttaa

SEQ ID NO: 286445 - DNA, 25 bp, Mus musculus
gctagcgcgtcccttttgagcttcc

SEQ ID NO: 286446 - DNA, 25 bp, Mus musculus
tactctccgcgggaaggtgttagcg

SEQ ID NO: 286447 - DNA, 25 bp, Mus musculus
gtgtgccacactcggcctcctttta

SEQ ID NO: 286448 - DNA, 25 bp, Mus musculus
acagcacacggtgtagaccaggccg

SEQ ID NO: 286449 - DNA, 25 bp, Mus musculus
ctggtcgaagacagcacacggtgta

SEQ ID NO: 286450 - DNA, 25 bp, Mus musculus
cctgactaacgagacggtggggcct

SEQ ID NO: 286451 - DNA, 25 bp, Mus musculus
ggagaggcgaggtttcctgactaac

SEQ ID NO: 286452 - DNA, 25 bp, Mus musculus
ccgcggggaacagagacttcctcca

SEQ ID NO: 286453 - DNA, 25 bp, Mus musculus
agtgagaaccacgaggagacgcccg

SEQ ID NO: 286454 - DNA, 25 bp, Mus musculus
agccggcgaactttggcacctaaga

SEQ ID NO: 286455 - DNA, 25 bp, Mus musculus
gccgcctgagtctctgggcgcctat

SEQ ID NO: 286456 - DNA, 25 bp, Mus musculus
tttgggctccgaggagcacacaagc

SEQ ID NO: 286457 - DNA, 25 bp, Mus musculus
tcgtactccgactcgcgagcgggct

SEQ ID NO: 286458 - DNA, 25 bp, Mus musculus
cctatgggctgctgtcgggataccc

SEQ ID NO: 286459 - DNA, 25 bp, Mus musculus
tttccaggttccgagtctcccggca

SEQ ID NO: 286460 - DNA, 25 bp, Mus musculus
acctgggactgtggccacagaactc

SEQ ID NO: 286461 - DNA, 25 bp, Mus musculus
ggccgtcccatcacgtgagtctgaa

SEQ ID NO: 286462 - DNA, 25 bp, Mus musculus
gcacctaagaggcaggcggcacata

SEQ ID NO: 286463 - DNA, 25 bp, Mus musculus
gccagtggcacagttcgagccgcct

SEQ ID NO: 286464 - DNA, 25 bp, Mus musculus
ccagttctaggggtcgtgaagaccg

SEQ ID NO: 286465 - DNA, 25 bp, Mus musculus
aggacccttccggagaggacgatga

SEQ ID NO: 286466 - DNA, 25 bp, Mus musculus
tgagtctgaaatcggaggacccttc

SEQ ID NO: 286467 - DNA, 25 bp, Mus musculus
tcttgaattgtctgggacctgggac

SEQ ID NO: 286468 - DNA, 25 bp, Mus musculus
gcagcttgcagccattgtaccgaaa

SEQ ID NO: 286469 - DNA, 25 bp, Mus musculus
ttggcaagacggtgtagggtacatc

SEQ ID NO: 286470 - DNA, 25 bp, Mus musculus
ctccaaagggactgacgtataaata

SEQ ID NO: 286471 - DNA, 25 bp, Mus musculus
cacagcgggtctagggatactccaa

SEQ ID NO: 286472 - DNA, 25 bp, Mus musculus
caacactgagatcgctgctgctggc

SEQ ID NO: 286473 - DNA, 25 bp, Mus musculus
gcgcgggaatccaaaaaacctcaga

SEQ ID NO: 286474 - DNA, 25 bp, Mus musculus
tgctgtcgcctcatggcaacactga

SEQ ID NO: 286475 - DNA, 25 bp, Mus musculus
cccgggtcttttagagtccattgct

SEQ ID NO: 286476 - DNA, 25 bp, Mus musculus
atctgaatctcgtgacccggctgtc

SEQ ID NO: 286477 - DNA, 25 bp, Mus musculus
acacagatctcttcggtttttaggg

SEQ ID NO: 286478 - DNA, 25 bp, Mus musculus
tccgcttgtgggacaacttcatagg

SEQ ID NO: 286479 - DNA, 25 bp, Mus musculus
ttcgtggtatacaagctgccggctc

SEQ ID NO: 286480 - DNA, 25 bp, Mus musculus
agcctatccggagctgagtcggcca

SEQ ID NO: 286481 - DNA, 25 bp, Mus musculus
atgtcttcacggacctccaggttcg

SEQ ID NO: 286482 - DNA, 25 bp, Mus musculus
tcacgccttctagccaaggagccta

SEQ ID NO: 286483 - DNA, 25 bp, Mus musculus
gcgcacgacagcacgaggactgctc

SEQ ID NO: 286484 - DNA, 25 bp, Mus musculus
actgttcacgaactgctccagagca

SEQ ID NO: 286485 - DNA, 25 bp, Mus musculus
aggttgtgtcacttccgccggccaa

SEQ ID NO: 286486 - DNA, 25 bp, Mus musculus
ccggcgacccactaaagcctggagg

SEQ ID NO: 286487 - DNA, 25 bp, Mus musculus
cggacaggacgctagaccaatcacc

SEQ ID NO: 286488 - DNA, 25 bp, Mus musculus
tggcccgagcaacagaggtaagctc

SEQ ID NO: 286489 - DNA, 25 bp, Mus musculus
cctccagccgctagaagggcctggt

SEQ ID NO: 286490 - DNA, 25 bp, Mus musculus
agctgagagctgtcggacactgttc

SEQ ID NO: 286491 - DNA, 25 bp, Mus musculus
gcccaggcctcaccttgagctgaga

SEQ ID NO: 286492 - DNA, 25 bp, Mus musculus
aaatccgcaccggtgccagggcata

SEQ ID NO: 286493 - DNA, 25 bp, Mus musculus
gcaccaaggcttgagcaggtccagg

SEQ ID NO: 286494 - DNA, 25 bp, Mus musculus
gaccaatgggtgctccggaatgccc

SEQ ID NO: 286495 - DNA, 25 bp, Mus musculus
gcgcgggaaaaagcgactgctctag

SEQ ID NO: 286496 - DNA, 25 bp, Mus musculus
accggttcaaagaggacagcgatcg

SEQ ID NO: 286497 - DNA, 25 bp, Mus musculus
cgctggacgacaaggaccggttcaa

SEQ ID NO: 286498 - DNA, 25 bp, Mus musculus
cgcaggcgcagaacatacctaggta

SEQ ID NO: 286499 - DNA, 25 bp, Mus musculus
atgttgccagccgatttacagcgcg

SEQ ID NO: 286500 - DNA, 25 bp, Mus musculus
ttctccgctgactgcacgcgcttga

SEQ ID NO: 286501 - DNA, 25 bp, Mus musculus
ggtgtcccacttccaggctgtgttt

SEQ ID NO: 286502 - DNA, 25 bp, Mus musculus
tcctttcggaaatcagggtgtccca

SEQ ID NO: 286503 - DNA, 25 bp, Mus musculus
ggccagctcaccatggaagtccttt

SEQ ID NO: 286504 - DNA, 25 bp, Mus musculus
taggaggcgtctcaccatcagactc

SEQ ID NO: 286505 - DNA, 25 bp, Mus musculus
ccgcgcccaagcttaggggtgattc

SEQ ID NO: 286506 - DNA, 25 bp, Mus musculus
ataggtctctggacaccatcgggta

SEQ ID NO: 286507 - DNA, 25 bp, Mus musculus
ggaatcctccttgcttgacgccata

SEQ ID NO: 286508 - DNA, 25 bp, Mus musculus
aagctggcgagctactctgtgacga

SEQ ID NO: 286509 - DNA, 25 bp, Mus musculus
gtagtttcggtgacagcccgtgcaa

SEQ ID NO: 286510 - DNA, 25 bp, Mus musculus
tgatcttcttcatggcgaagcgctg

SEQ ID NO: 286511 - DNA, 25 bp, Mus musculus
tctcaaaggagcagaacatgccgac

SEQ ID NO: 286512 - DNA, 25 bp, Mus musculus
acatgccgaccacaaatgggttctc

SEQ ID NO: 286513 - DNA, 25 bp, Mus musculus
acaaatgggttctctgcaaacgtga

SEQ ID NO: 286514 - DNA, 25 bp, Mus musculus
tgcaaacgtgaggatgtcgcgctcc

SEQ ID NO: 286515 - DNA, 25 bp, Mus musculus
ggatgtcgcgctccacaaacgcctg

SEQ ID NO: 286516 - DNA, 25 bp, Mus musculus
acaaacgcctgctggatctggttgc

SEQ ID NO: 286517 - DNA, 25 bp, Mus musculus
ctgctggatctggttgcgcaggatc

SEQ ID NO: 286518 - DNA, 25 bp, Mus musculus
caggttctgtttgttgatcttcttc

SEQ ID NO: 286519 - DNA, 25 bp, Mus musculus
tcttcatggcgaagcgctgcctcgt

SEQ ID NO: 286520 - DNA, 25 bp, Mus musculus
gaagcgctgcctcgtgtcccggtgc

SEQ ID NO: 286521 - DNA, 25 bp, Mus musculus
tgccgcaccaggtagacggctctgc

SEQ ID NO: 286522 - DNA, 25 bp, Mus musculus
agagagcgaggaccggccatcacct

SEQ ID NO: 286523 - DNA, 25 bp, Mus musculus
tggttgcgcaggatcaggttctgtt

SEQ ID NO: 286524 - DNA, 25 bp, Mus musculus
gtccagagagagtcagacatgaccc

SEQ ID NO: 286525 - DNA, 25 bp, Mus musculus
agagagtcagacatgacccggcggc

SEQ ID NO: 286526 - DNA, 25 bp, Mus musculus
agcgcggacacctctggcgcagctg

SEQ ID NO: 286527 - DNA, 25 bp, Mus musculus
agaaattggaaagcgcggtccagag

SEQ ID NO: 286528 - DNA, 25 bp, Mus musculus
catcgagaaattggaaagcgcggtc

SEQ ID NO: 286529 - DNA, 25 bp, Mus musculus
aaggagggcatcgagaaattggaaa

SEQ ID NO: 286530 - DNA, 25 bp, Mus musculus
tggtgcggcgaaacatgctgccgcc

SEQ ID NO: 286531 - DNA, 25 bp, Mus musculus
ctacctcttggtgcggcgaaacatg

SEQ ID NO: 286532 - DNA, 25 bp, Mus musculus
gggtctacctcttggtgcggcgaaa

SEQ ID NO: 286533 - DNA, 25 bp, Mus musculus
tggcttcacccggaggtcccggaca

SEQ ID NO: 286534 - DNA, 25 bp, Mus musculus
cagcagccggcagggtggcttcacc

SEQ ID NO: 286535 - DNA, 25 bp, Mus musculus
agctggacagctagcagcatcccgg

SEQ ID NO: 286536 - DNA, 25 bp, Mus musculus
tggcgcagctggacagctagcagca

SEQ ID NO: 286537 - DNA, 25 bp, Mus musculus
agggccctgttgctgcagccagtcg

SEQ ID NO: 286538 - DNA, 25 bp, Mus musculus
ccgagagcatcctctggcagtacga

SEQ ID NO: 286539 - DNA, 25 bp, Mus musculus
tccagcagcctctgggataccgggg

SEQ ID NO: 286540 - DNA, 25 bp, Mus musculus
gcgctgccaggactcgcggacacag

SEQ ID NO: 286541 - DNA, 25 bp, Mus musculus
gactcgcggacacagcactcttcgg

SEQ ID NO: 286542 - DNA, 25 bp, Mus musculus
gacacagcactcttcggccgagagc

SEQ ID NO: 286543 - DNA, 25 bp, Mus musculus
actcttcggccgagagcatcctctg

SEQ ID NO: 286544 - DNA, 25 bp, Mus musculus
atcctctggcagtacgaaggggcgc

SEQ ID NO: 286545 - DNA, 25 bp, Mus musculus
ccctggtgcaagttctcctgcgttc

SEQ ID NO: 286546 - DNA, 25 bp, Mus musculus
aagttctcctgcgttctgctcggcc

SEQ ID NO: 286547 - DNA, 25 bp, Mus musculus
cctccggcggcggatcaggccagaa

SEQ ID NO: 286548 - DNA, 25 bp, Mus musculus
gcggatcaggccagaatcgtccatg

SEQ ID NO: 286549 - DNA, 25 bp, Mus musculus
tcaggccagaatcgtccatggcggc

SEQ ID NO: 286550 - DNA, 25 bp, Mus musculus
aggcgccacccaggccatcctcgag

SEQ ID NO: 286551 - DNA, 25 bp, Mus musculus
ctctggcagtacgaaggggcgccac

SEQ ID NO: 286552 - DNA, 25 bp, Mus musculus
ggctccttgagacacacagcaggta

SEQ ID NO: 286553 - DNA, 25 bp, Mus musculus
gccctccggcgtggtcgtttacgca

SEQ ID NO: 286554 - DNA, 25 bp, Mus musculus
tgaccaatcggctcgcaggatccgc

SEQ ID NO: 286555 - DNA, 25 bp, Mus musculus
cagtggctcttgatgctgaccaatc

SEQ ID NO: 286556 - DNA, 25 bp, Mus musculus
tccgcgaaaactgcagtggctcttg

SEQ ID NO: 286557 - DNA, 25 bp, Mus musculus
tcccagcgcgcgttttccgcgaaaa

SEQ ID NO: 286558 - DNA, 25 bp, Mus musculus
ttgtagaaaacaacactgcaagcgc

SEQ ID NO: 286559 - DNA, 25 bp, Mus musculus
gcctctgcgacagccaacaattgta

SEQ ID NO: 286560 - DNA, 25 bp, Mus musculus
gctgagatccatgctgcctctgcga

SEQ ID NO: 286561 - DNA, 25 bp, Mus musculus
actcagacgacaacgacccgtattg

SEQ ID NO: 286562 - DNA, 25 bp, Mus musculus
cacagcaggtacaggagaactcaga

SEQ ID NO: 286563 - DNA, 25 bp, Mus musculus
ctggaagcgcaccaagcacagggcc

SEQ ID NO: 286564 - DNA, 25 bp, Mus musculus
gtcgtttacgcacgcgctgctgtcg

SEQ ID NO: 286565 - DNA, 25 bp, Mus musculus
gcccagaacgcacggctccttgaga

SEQ ID NO: 286566 - DNA, 25 bp, Mus musculus
tctttcctgtctctacccgtgtctg

SEQ ID NO: 286567 - DNA, 25 bp, Mus musculus
acgtccgtgtgtccggctcttgctc

SEQ ID NO: 286568 - DNA, 25 bp, Mus musculus
tctctacccgtgtctggacgtccgt

SEQ ID NO: 286569 - DNA, 25 bp, Mus musculus
cgcataaaaggttctccggcctagg

SEQ ID NO: 286570 - DNA, 25 bp, Mus musculus
caatggatccgaccgcggcgctgtc

SEQ ID NO: 286571 - DNA, 25 bp, Mus musculus
ggcagccgcaatggatccgaccgcg

SEQ ID NO: 286572 - DNA, 25 bp, Mus musculus
acccttgtgaaagcgtgtggaccgg

SEQ ID NO: 286573 - DNA, 25 bp, Mus musculus
gcctagggctctctcggttttgaga

SEQ ID NO: 286574 - DNA, 25 bp, Mus musculus
tcggttttgagatctctttcctgtc

SEQ ID NO: 286575 - DNA, 25 bp, Mus musculus
ggagcccacagcacagacaatcttg

SEQ ID NO: 286576 - DNA, 25 bp, Mus musculus
cacccaacccttgtgaaagcgtgtg

SEQ ID NO: 286577 - DNA, 25 bp, Mus musculus
tttgggccacgcataaaaggttctc

SEQ ID NO: 286578 - DNA, 25 bp, Mus musculus
caatcttggcgtccgaaagggcaca

SEQ ID NO: 286579 - DNA, 25 bp, Mus musculus
cccgcgcactgcctggtgtggtttg

SEQ ID NO: 286580 - DNA, 25 bp, Mus musculus
aggagggcgccgaaggcgcgaaaag

SEQ ID NO: 286581 - DNA, 25 bp, Mus musculus
cgcacatggagacgcgcgcagcgct

SEQ ID NO: 286582 - DNA, 25 bp, Mus musculus
cgctgttcggcgtcggcggtctcca

SEQ ID NO: 286583 - DNA, 25 bp, Mus musculus
cgccgaaggcgcgaaaaggcgcgca

SEQ ID NO: 286584 - DNA, 25 bp, Mus musculus
ttcccgcgtccggtcgcatcccgcc

SEQ ID NO: 286585 - DNA, 25 bp, Mus musculus
ctcagctggagtcggcctcgacgcg

SEQ ID NO: 286586 - DNA, 25 bp, Mus musculus
agtcggcctcgacgcggcgtggcgt

SEQ ID NO: 286587 - DNA, 25 bp, Mus musculus
caggggtcctggccaccctccggct

SEQ ID NO: 286588 - DNA, 25 bp, Mus musculus
ctgggcctagtgacaggtggggcga

SEQ ID NO: 286589 - DNA, 25 bp, Mus musculus
cgggagcccacctgtcagagtggtc

SEQ ID NO: 286590 - DNA, 25 bp, Mus musculus
gagcccacctgtcagagtggtcggc

SEQ ID NO: 286591 - DNA, 25 bp, Mus musculus
cccacctgtcagagtggtcggcggc

SEQ ID NO: 286592 - DNA, 25 bp, Mus musculus
cacctgtcagagtggtcggcggccc

SEQ ID NO: 286593 - DNA, 25 bp, Mus musculus
catggagacgcgcgcagcgctgttc

SEQ ID NO: 286594 - DNA, 25 bp, Mus musculus
tttaaaggcggaagcgccgcgactc

SEQ ID NO: 286595 - DNA, 25 bp, Mus musculus
cagccgttgctgacatgggtcatga

SEQ ID NO: 286596 - DNA, 25 bp, Mus musculus
catgaccttctgcttgagctgcgcc

SEQ ID NO: 286597 - DNA, 25 bp, Mus musculus
tgcgccacttgctcccgtaggagac

SEQ ID NO: 286598 - DNA, 25 bp, Mus musculus
cgcgttctcagccttgagtgtcttc

SEQ ID NO: 286599 - DNA, 25 bp, Mus musculus
agtgtcttcaccttgtcctccaggc

SEQ ID NO: 286600 - DNA, 25 bp, Mus musculus
tcgctccactttgatgcgctcctgg

SEQ ID NO: 286601 - DNA, 25 bp, Mus musculus
tctgcggttcctctttaaaggcgga

SEQ ID NO: 286602 - DNA, 25 bp, Mus musculus
cgactcaagcccagctgtgccgggt

SEQ ID NO: 286603 - DNA, 25 bp, Mus musculus
ggcgtcacgtggttcatcttgtgca

SEQ ID NO: 286604 - DNA, 25 bp, Mus musculus
aggctctcagaaggcgtgtcccttg

SEQ ID NO: 286605 - DNA, 25 bp, Mus musculus
gcaggtcgtccagggctttgacaaa

SEQ ID NO: 286606 - DNA, 25 bp, Mus musculus
gcgctcctggtcttccatgttgatg

SEQ ID NO: 286607 - DNA, 25 bp, Mus musculus
gggccatgtaaacctcgaggtggaa

SEQ ID NO: 286608 - DNA, 25 bp, Mus musculus
gggtaatgctttcgggcatccctgg

SEQ ID NO: 286609 - DNA, 25 bp, Mus musculus
cggacggctagtccggaccagcctc

SEQ ID NO: 286610 - DNA, 25 bp, Mus musculus
ctcggaacagctctggggctgagtc

SEQ ID NO: 286611 - DNA, 25 bp, Mus musculus
tctcggaacagctctggggctgagt

SEQ ID NO: 286612 - DNA, 25 bp, Mus musculus
gtaatgctttcgggcatccctggcg

SEQ ID NO: 286613 - DNA, 25 bp, Mus musculus
cggggtaatgctttcgggcatccct

SEQ ID NO: 286614 - DNA, 25 bp, Mus musculus
gcggggtaatgctttcgggcatccc

SEQ ID NO: 286615 - DNA, 25 bp, Mus musculus
acagctctggggctgagtcctgtcc

SEQ ID NO: 286616 - DNA, 25 bp, Mus musculus
gctctggggctgagtcctgtcccgc

SEQ ID NO: 286617 - DNA, 25 bp, Mus musculus
aggttggacccagcctggcaggtcc

SEQ ID NO: 286618 - DNA, 25 bp, Mus musculus
gctgagtcctgtcccgcccggccag

SEQ ID NO: 286619 - DNA, 25 bp, Mus musculus
gcctgggtcggactttgcccctggc

SEQ ID NO: 286620 - DNA, 25 bp, Mus musculus
ccaggttggacccagcctggcaggt

SEQ ID NO: 286621 - DNA, 25 bp, Mus musculus
cggaacagctctggggctgagtcct

SEQ ID NO: 286622 - DNA, 25 bp, Mus musculus
acgcacgcagcgaactccttcgtgt

SEQ ID NO: 286623 - DNA, 25 bp, Mus musculus
accgcgtcgggctccacgcacgcag

SEQ ID NO: 286624 - DNA, 25 bp, Mus musculus
tgccagtttcacctgcgctccaaag

SEQ ID NO: 286625 - DNA, 25 bp, Mus musculus
gtttcacctgcgctccaaagtctct

SEQ ID NO: 286626 - DNA, 25 bp, Mus musculus
aaagtctctcgttccgcagcactgg

SEQ ID NO: 286627 - DNA, 25 bp, Mus musculus
gcgcgctcacgtacgcttacagcca

SEQ ID NO: 286628 - DNA, 25 bp, Mus musculus
tgtcgcacgtcacgaacgacgcacg

SEQ ID NO: 286629 - DNA, 25 bp, Mus musculus
tactcgcacgcaagaccgcgtcggg

SEQ ID NO: 286630 - DNA, 25 bp, Mus musculus
gcgaactccttcgtgtcgcacgtca

SEQ ID NO: 286631 - DNA, 25 bp, Mus musculus
ccgcaatgcggggtggagttctccc

SEQ ID NO: 286632 - DNA, 25 bp, Mus musculus
ctcccagaggagagtcgtagacagc

SEQ ID NO: 286633 - DNA, 25 bp, Mus musculus
cagaggagagtcgtagacagcgaca

SEQ ID NO: 286634 - DNA, 25 bp, Mus musculus
ggagttctcccagaggagagtcgta

SEQ ID NO: 286635 - DNA, 25 bp, Mus musculus
ggcttgtactcgcacgcaagaccgc

SEQ ID NO: 286636 - DNA, 25 bp, Mus musculus
gcgatgcataggctgcgcggctgct

SEQ ID NO: 286637 - DNA, 25 bp, Mus musculus
tcagcacccacgtcgcgctcacctt

SEQ ID NO: 286638 - DNA, 25 bp, Mus musculus
gcgctcaccttctctgggcgcatgt

SEQ ID NO: 286639 - DNA, 25 bp, Mus musculus
cttctctgggcgcatgtccctttaa

SEQ ID NO: 286640 - DNA, 25 bp, Mus musculus
cctgggctaagcgtgagcaccagcc

SEQ ID NO: 286641 - DNA, 25 bp, Mus musculus
tacagcctgggctaagcgtgagcac

SEQ ID NO: 286642 - DNA, 25 bp, Mus musculus
tacggacggctacagcctgggctaa

SEQ ID NO: 286643 - DNA, 25 bp, Mus musculus
tgtcggagcagtacggacggctaca

SEQ ID NO: 286644 - DNA, 25 bp, Mus musculus
cctgcccttcgtggcgctggaggac

SEQ ID NO: 286645 - DNA, 25 bp, Mus musculus
tgagggcggcttcctccggaagttc

SEQ ID NO: 286646 - DNA, 25 bp, Mus musculus
ccggcctcgctctgggccggagcct

SEQ ID NO: 286647 - DNA, 25 bp, Mus musculus
tctgggcgcatgtccctttaagggc

SEQ ID NO: 286648 - DNA, 25 bp, Mus musculus
ggctaagcgtgagcaccagccggcc

SEQ ID NO: 286649 - DNA, 25 bp, Mus musculus
cgacctgcccttcgtggcgctggag

SEQ ID NO: 286650 - DNA, 25 bp, Mus musculus
gaattcgatccggagccatgagtgt

SEQ ID NO: 286651 - DNA, 25 bp, Mus musculus
ggtctctgctcacctgggtaggtcg

SEQ ID NO: 286652 - DNA, 25 bp, Mus musculus
atgcgggtctctgctcacctgggta

SEQ ID NO: 286653 - DNA, 25 bp, Mus musculus
agctatgcgggtctctgctcacctg

SEQ ID NO: 286654 - DNA, 25 bp, Mus musculus
cgagctatgcgggtctctgctcacc

SEQ ID NO: 286655 - DNA, 25 bp, Mus musculus
aaggccgagctatgcgggtctctgc

SEQ ID NO: 286656 - DNA, 25 bp, Mus musculus
acaaggccgagctatgcgggtctct

SEQ ID NO: 286657 - DNA, 25 bp, Mus musculus
atgagtgtggacaaggccgagctat

SEQ ID NO: 286658 - DNA, 25 bp, Mus musculus
gcgctctaggccgagcgggaggtct

SEQ ID NO: 286659 - DNA, 25 bp, Mus musculus
aattcgatccggagccatgagtgtg

SEQ ID NO: 286660 - DNA, 25 bp, Mus musculus
gctccttggcccggatcgaattcga

SEQ ID NO: 286661 - DNA, 25 bp, Mus musculus
tctctgctcacctgggtaggtcggg

SEQ ID NO: 286662 - DNA, 25 bp, Mus musculus
gtcaggtgtgcgccctctcctctcg

SEQ ID NO: 286663 - DNA, 25 bp, Mus musculus
catgagtgtggacaaggccgagcta

SEQ ID NO: 286664 - DNA, 25 bp, Mus musculus
gaggcctctgacacgcagctgtttt

SEQ ID NO: 286665 - DNA, 25 bp, Mus musculus
acgcagctgtttttacgccttaaca

SEQ ID NO: 286666 - DNA, 25 bp, Mus musculus
agcagtggaggcctctgacacgcag

SEQ ID NO: 286667 - DNA, 25 bp, Mus musculus
tgcacagccacagctggcagcagtg

SEQ ID NO: 286668 - DNA, 25 bp, Mus musculus
tgggtctccacaaccgcactcaacg

SEQ ID NO: 286669 - DNA, 25 bp, Mus musculus
gggtcaagcaatgggtctccacaac

SEQ ID NO: 286670 - DNA, 25 bp, Mus musculus
ctcccgcaggctggggtcaagcaat

SEQ ID NO: 286671 - DNA, 25 bp, Mus musculus
ggctcaggacatgcgggagactcca

SEQ ID NO: 286672 - DNA, 25 bp, Mus musculus
gtgaacctctcccagcgggccatcc

SEQ ID NO: 286673 - DNA, 25 bp, Mus musculus
ggcgctgcagaaagtccccgtgaac

SEQ ID NO: 286674 - DNA, 25 bp, Mus musculus
atcgacacggtggtaaaaggttcag

SEQ ID NO: 286675 - DNA, 25 bp, Mus musculus
ccgaggacccggaatcgacacggtg

SEQ ID NO: 286676 - DNA, 25 bp, Mus musculus
atgcgggagactccagctcaggctc

SEQ ID NO: 286677 - DNA, 25 bp, Mus musculus
tacgccttaacagcgacaggcgccg

SEQ ID NO: 286678 - DNA, 25 bp, Mus musculus
tgttgtaggacgaattcaagttctc

SEQ ID NO: 286679 - DNA, 25 bp, Mus musculus
catgcacggtgccagccactatgca

SEQ ID NO: 286680 - DNA, 25 bp, Mus musculus
agagccctgcgtagcgcatgagcgt

SEQ ID NO: 286681 - DNA, 25 bp, Mus musculus
acgaaggatcagcaccgcggagagc

SEQ ID NO: 286682 - DNA, 25 bp, Mus musculus
tgctgtgctaacagaacgaaggatc

SEQ ID NO: 286683 - DNA, 25 bp, Mus musculus
accagcctcgaccacgtggtctata

SEQ ID NO: 286684 - DNA, 25 bp, Mus musculus
gaaccgtttgaagactgctgtgcta

SEQ ID NO: 286685 - DNA, 25 bp, Mus musculus
cacgtggtctatagtggggaaccgt

SEQ ID NO: 286686 - DNA, 25 bp, Mus musculus
cgcagggcacccagtatttgttgta

SEQ ID NO: 286687 - DNA, 25 bp, Mus musculus
ggggtgatccaacgttactcgcacc

SEQ ID NO: 286688 - DNA, 25 bp, Mus musculus
tctcgaacttcttgcgctcttctcg

SEQ ID NO: 286689 - DNA, 25 bp, Mus musculus
gctcttctcgggtcataaatcctgg

SEQ ID NO: 286690 - DNA, 25 bp, Mus musculus
gccactatgcacatgagtgcgtccg

SEQ ID NO: 286691 - DNA, 25 bp, Mus musculus
gccaggctcgagaaccatacgcagg

SEQ ID NO: 286692 - DNA, 25 bp, Mus musculus
ccaagcgcgcggtctgagagccttt

SEQ ID NO: 286693 - DNA, 25 bp, Mus musculus
tgctgagaatctcgagcctggattc

SEQ ID NO: 286694 - DNA, 25 bp, Mus musculus
agagcctttcccgacgtcctttgca

SEQ ID NO: 286695 - DNA, 25 bp, Mus musculus
ttgcacggcatctggccacaaaatg

SEQ ID NO: 286696 - DNA, 25 bp, Mus musculus
cggcatctggccacaaaatggctgc

SEQ ID NO: 286697 - DNA, 25 bp, Mus musculus
agtccggtgtccagcggtgtgaact

SEQ ID NO: 286698 - DNA, 25 bp, Mus musculus
ccagcggtgtgaacttgtttgccaa

SEQ ID NO: 286699 - DNA, 25 bp, Mus musculus
cttgtttgccaacgatggcagcttc

SEQ ID NO: 286700 - DNA, 25 bp, Mus musculus
cctggagctgttcaagcggaagatg

SEQ ID NO: 286701 - DNA, 25 bp, Mus musculus
ggccccacgctcagcttcgtaagga

SEQ ID NO: 286702 - DNA, 25 bp, Mus musculus
gcgtcatggtccaaggcagtcctcc

SEQ ID NO: 286703 - DNA, 25 bp, Mus musculus
gctgcctggacggtcccggtcgctt

SEQ ID NO: 286704 - DNA, 25 bp, Mus musculus
cgacgtcctttgcacggcatctggc

SEQ ID NO: 286705 - DNA, 25 bp, Mus musculus
cccggtcgcttgctgagaatctcga

SEQ ID NO: 286706 - DNA, 25 bp, Mus musculus
ggaatcctcgtggactgagccttca

SEQ ID NO: 286707 - DNA, 25 bp, Mus musculus
gccagaggtccgtcagcattaattc

SEQ ID NO: 286708 - DNA, 25 bp, Mus musculus
agaaatctaggaggcggctggcatc

SEQ ID NO: 286709 - DNA, 25 bp, Mus musculus
ggacctagaggagctcagaaatcta

SEQ ID NO: 286710 - DNA, 25 bp, Mus musculus
actgagcttgtagagccggtttaga

SEQ ID NO: 286711 - DNA, 25 bp, Mus musculus
cctatcgggtattgcttgtattctg

SEQ ID NO: 286712 - DNA, 25 bp, Mus musculus
cacagggccgcgtctaggtcagaaa

SEQ ID NO: 286713 - DNA, 25 bp, Mus musculus
agagacattggaaacctatcgggta

SEQ ID NO: 286714 - DNA, 25 bp, Mus musculus
gggtgattctgactggctctcattc

SEQ ID NO: 286715 - DNA, 25 bp, Mus musculus
agctagagaagcttggccagatctg

SEQ ID NO: 286716 - DNA, 25 bp, Mus musculus
cattaattcctgctgactggggcgg

SEQ ID NO: 286717 - DNA, 25 bp, Mus musculus
tcctaatagggaggggcgtcagact

SEQ ID NO: 286718 - DNA, 25 bp, Mus musculus
ccttcacctgaaagaccgctggggc

SEQ ID NO: 286719 - DNA, 25 bp, Mus musculus
ccatgtggcgtctactgagcttgta

SEQ ID NO: 286720 - DNA, 25 bp, Mus musculus
cgacctcgtgcgtgatcgtgtcacc

SEQ ID NO: 286721 - DNA, 25 bp, Mus musculus
ctaggaaacaagacgcggctctggc

SEQ ID NO: 286722 - DNA, 25 bp, Mus musculus
acgcggctctggctaaacctgtaca

SEQ ID NO: 286723 - DNA, 25 bp, Mus musculus
gccatggatctttcctcagggcgga

SEQ ID NO: 286724 - DNA, 25 bp, Mus musculus
tcaagctgaggcctacgtagcccgt

SEQ ID NO: 286725 - DNA, 25 bp, Mus musculus
gcgctcgtcactgcagtccatgttc

SEQ ID NO: 286726 - DNA, 25 bp, Mus musculus
agtccatgttctccgcgtccctagg

SEQ ID NO: 286727 - DNA, 25 bp, Mus musculus
gccggagcgaaaggccgcctccaaa

SEQ ID NO: 286728 - DNA, 25 bp, Mus musculus
tgctgctggagatctgtgcctacct

SEQ ID NO: 286729 - DNA, 25 bp, Mus musculus
gtgccaagcgttgcacgacctcgtg

SEQ ID NO: 286730 - DNA, 25 bp, Mus musculus
gatgcgcgagtcgtgcttcaagtcc

SEQ ID NO: 286731 - DNA, 25 bp, Mus musculus
tcaagtcctgccgtgcgtgtgccaa

SEQ ID NO: 286732 - DNA, 25 bp, Mus musculus
tgatcgtgtcacctggaggctacgc

SEQ ID NO: 286733 - DNA, 25 bp, Mus musculus
gtgatctcgcgctgcctaggaaaca

SEQ ID NO: 286734 - DNA, 25 bp, Mus musculus
cggcttccaggctaccaacttcggg

SEQ ID NO: 286735 - DNA, 25 bp, Mus musculus
tccaaggctacgacttcaaccgcgg

SEQ ID NO: 286736 - DNA, 25 bp, Mus musculus
ccgctgcgcgcggatttccgcgtga

SEQ ID NO: 286737 - DNA, 25 bp, Mus musculus
caagtcaacgccatggtgaggcgcg

SEQ ID NO: 286738 - DNA, 25 bp, Mus musculus
cgcggtgcagcaagtcaacgccatg

SEQ ID NO: 286739 - DNA, 25 bp, Mus musculus
aggctaccaacttcgggcgcgcggt

SEQ ID NO: 286740 - DNA, 25 bp, Mus musculus
tcaaccgcggcgtagattaccatgc

SEQ ID NO: 286741 - DNA, 25 bp, Mus musculus
attaccatgcgcttctggacgccta

SEQ ID NO: 286742 - DNA, 25 bp, Mus musculus
agagcgcccaggtccaaggctacga

SEQ ID NO: 286743 - DNA, 25 bp, Mus musculus
aaggctctcgagtcgcacttcctgg

SEQ ID NO: 286744 - DNA, 25 bp, Mus musculus
ggccgacctcgctgagggattttgc

SEQ ID NO: 286745 - DNA, 25 bp, Mus musculus
tcgctgagggattttgcgggtctca

SEQ ID NO: 286746 - DNA, 25 bp, Mus musculus
cgctgcccaaggtcacgagaccaag

SEQ ID NO: 286747 - DNA, 25 bp, Mus musculus
caaggtcacgagaccaagtgacttc

SEQ ID NO: 286748 - DNA, 25 bp, Mus musculus
gtccgggccactcagcgtactggac

SEQ ID NO: 286749 - DNA, 25 bp, Mus musculus
tcgggcccactatcgtagccgcgga

SEQ ID NO: 286750 - DNA, 25 bp, Mus musculus
gccgcggagctcctctggtgtgctc

SEQ ID NO: 286751 - DNA, 25 bp, Mus musculus
cagcgccagggtcagccgtggacct

SEQ ID NO: 286752 - DNA, 25 bp, Mus musculus
cctgtgatagggacatctggacccg

SEQ ID NO: 286753 - DNA, 25 bp, Mus musculus
gccgtggacctgtgatagggacatc

SEQ ID NO: 286754 - DNA, 25 bp, Mus musculus
tcctctggtgtgctcgtggcactac

SEQ ID NO: 286755 - DNA, 25 bp, Mus musculus
tgctcgtggcactactgctgtgacc

SEQ ID NO: 286756 - DNA, 25 bp, Mus musculus
ggcccactatcgtagccgcggagct

SEQ ID NO: 286757 - DNA, 25 bp, Mus musculus
gctgtgacctgccaggtccgggcca

SEQ ID NO: 286758 - DNA, 25 bp, Mus musculus
actcagcgtactggacgggcttcgc

SEQ ID NO: 286759 - DNA, 25 bp, Mus musculus
gattgtaggacagccctcgggccca

SEQ ID NO: 286760 - DNA, 25 bp, Mus musculus
ccggggagattgtaggacagccctc

SEQ ID NO: 286761 - DNA, 25 bp, Mus musculus
cactactgctgtgacctgccaggtc

SEQ ID NO: 286762 - DNA, 25 bp, Mus musculus
tttagggttttatcgctgccgcacg

SEQ ID NO: 286763 - DNA, 25 bp, Mus musculus
ttaccattaaatcgcacggctcgca

SEQ ID NO: 286764 - DNA, 25 bp, Mus musculus
ctggctgcagtccagcgtcttcatc

SEQ ID NO: 286765 - DNA, 25 bp, Mus musculus
gcagtccagcgtcttcatccgtttc

SEQ ID NO: 286766 - DNA, 25 bp, Mus musculus
tcatccgtttctgcggcagctccgg

SEQ ID NO: 286767 - DNA, 25 bp, Mus musculus
ccgtccactggggaacaaagggcag

SEQ ID NO: 286768 - DNA, 25 bp, Mus musculus
ctgccgcacgtcaggcagtagttgc

SEQ ID NO: 286769 - DNA, 25 bp, Mus musculus
ttccacagctttagggttttatcgc

SEQ ID NO: 286770 - DNA, 25 bp, Mus musculus
cacgcagcgggttccacagctttag

SEQ ID NO: 286771 - DNA, 25 bp, Mus musculus
ccgtggccactgtaggtccgcagca

SEQ ID NO: 286772 - DNA, 25 bp, Mus musculus
tagcacttcgtagccgtggccactg

SEQ ID NO: 286773 - DNA, 25 bp, Mus musculus
agccgcatctagcacttcgtagccg

SEQ ID NO: 286774 - DNA, 25 bp, Mus musculus
cagtagttgccgtccactggggaac

SEQ ID NO: 286775 - DNA, 25 bp, Mus musculus
cgaaggcgcttaccattaaatcgca

SEQ ID NO: 286776 - DNA, 25 bp, Mus musculus
ctggttttttcacgaatgtacatga

SEQ ID NO: 286777 - DNA, 25 bp, Mus musculus
ttttcacgaatgtacatgaggtcgc

SEQ ID NO: 286778 - DNA, 25 bp, Mus musculus
cgaatgtacatgaggtcgctgtgca

SEQ ID NO: 286779 - DNA, 25 bp, Mus musculus
tgtacatgaggtcgctgtgcacgct

SEQ ID NO: 286780 - DNA, 25 bp, Mus musculus
tctgcgagcaaagggcgccaagatg

SEQ ID NO: 286781 - DNA, 25 bp, Mus musculus
caaagggcgccaagatgccaaaggc

SEQ ID NO: 286782 - DNA, 25 bp, Mus musculus
atgccaaaggcatcgccgtggtcgc

SEQ ID NO: 286783 - DNA, 25 bp, Mus musculus
gctgcccgcacgcagaagcttcttg

SEQ ID NO: 286784 - DNA, 25 bp, Mus musculus
gcccgcacgcagaagcttcttgttc

SEQ ID NO: 286785 - DNA, 25 bp, Mus musculus
cgcagaagcttcttgttcctcagag

SEQ ID NO: 286786 - DNA, 25 bp, Mus musculus
gaagcttcttgttcctcagagcctt

SEQ ID NO: 286787 - DNA, 25 bp, Mus musculus
tcttgttcctcagagccttcttgtg

SEQ ID NO: 286788 - DNA, 25 bp, Mus musculus
agggcgccaagatgccaaaggcatc

SEQ ID NO: 286789 - DNA, 25 bp, Mus musculus
cgacactggttttttcacgaatgta

SEQ ID NO: 286790 - DNA, 25 bp, Mus musculus
cagagccttcttgtgcagtacgtcg

SEQ ID NO: 286791 - DNA, 25 bp, Mus musculus
tgagggtcgtcacccaccagctgct

SEQ ID NO: 286792 - DNA, 25 bp, Mus musculus
gcacaacgctgagggtcgtcaccca

SEQ ID NO: 286793 - DNA, 25 bp, Mus musculus
cttggctgagatctcgaagtaggca

SEQ ID NO: 286794 - DNA, 25 bp, Mus musculus
tggcaaagagcgcacggaacatctg

SEQ ID NO: 286795 - DNA, 25 bp, Mus musculus
cagcttggccatggcaaagagcgca

SEQ ID NO: 286796 - DNA, 25 bp, Mus musculus
ctcatctcgctaggcagcttggcca

SEQ ID NO: 286797 - DNA, 25 bp, Mus musculus
tgcaagtcggggctcatctcgctag

SEQ ID NO: 286798 - DNA, 25 bp, Mus musculus
gcacagataccttgcggtgcaagtc

SEQ ID NO: 286799 - DNA, 25 bp, Mus musculus
ccttcttgtgcagtacgtcgcagta

SEQ ID NO: 286800 - DNA, 25 bp, Mus musculus
tttgttaccgcaaatgaccagcggc

SEQ ID NO: 286801 - DNA, 25 bp, Mus musculus
gatctcgaagtaggcacaacgctga

SEQ ID NO: 286802 - DNA, 25 bp, Mus musculus
agtacgtcgcagtactgcacagata

SEQ ID NO: 286803 - DNA, 25 bp, Mus musculus
ggaacatctggtccaagctgctgtt

SEQ ID NO: 286804 - DNA, 25 bp, Mus musculus
tttagctagggtagagaaagccacg

SEQ ID NO: 286805 - DNA, 25 bp, Mus musculus
aggttcgccagtcctgcctatttcc

SEQ ID NO: 286806 - DNA, 25 bp, Mus musculus
tgcaacctaggttcgccagtcctgc

SEQ ID NO: 286807 - DNA, 25 bp, Mus musculus
gctctggatgagctcctgcaaccta

SEQ ID NO: 286808 - DNA, 25 bp, Mus musculus
ggcggagcattctcagggatttagc

SEQ ID NO: 286809 - DNA, 25 bp, Mus musculus
caccggaccgctcacctctggtgtc

SEQ ID NO: 286810 - DNA, 25 bp, Mus musculus
cgtcgccggaaccatgggcaccgga

SEQ ID NO: 286811 - DNA, 25 bp, Mus musculus
cacggaagcggcgtcgccggaacca

SEQ ID NO: 286812 - DNA, 25 bp, Mus musculus
tttttggctgttgctggccgcgcct

SEQ ID NO: 286813 - DNA, 25 bp, Mus musculus
cattctcagggatttagctagggta

SEQ ID NO: 286814 - DNA, 25 bp, Mus musculus
atgagctcctgcaacctaggttcgc

SEQ ID NO: 286815 - DNA, 25 bp, Mus musculus
gccagtcctgcctatttcctttctt

SEQ ID NO: 286816 - DNA, 25 bp, Mus musculus
tagagaaagccacggaagcggcgtc

SEQ ID NO: 286817 - DNA, 25 bp, Mus musculus
aacaccgggtggctctggatgagct

SEQ ID NO: 286818 - DNA, 25 bp, Mus musculus
tggcccacttaaaatctcgcgtagt

SEQ ID NO: 286819 - DNA, 25 bp, Mus musculus
tcgcaaccaatctggacgcgccggg

SEQ ID NO: 286820 - DNA, 25 bp, Mus musculus
tcctcccaaggcagcgtcggatgag

SEQ ID NO: 286821 - DNA, 25 bp, Mus musculus
gcgcctcatcgtgtgcacatgcgta

SEQ ID NO: 286822 - DNA, 25 bp, Mus musculus
agagaaccttctgcgcgtccacttc

SEQ ID NO: 286823 - DNA, 25 bp, Mus musculus
ttaaccctctgacaatctgcgcgcg

SEQ ID NO: 286824 - DNA, 25 bp, Mus musculus
cgagaatagtacaacgctgcggcga

SEQ ID NO: 286825 - DNA, 25 bp, Mus musculus
agcggcttttcgattggcccactta

SEQ ID NO: 286826 - DNA, 25 bp, Mus musculus
tccgccgaaggaaaacgtggactgc

SEQ ID NO: 286827 - DNA, 25 bp, Mus musculus
ctcgatcgaaatgcagggcctccta

SEQ ID NO: 286828 - DNA, 25 bp, Mus musculus
tctcggggtaacgaccaaattctgc

SEQ ID NO: 286829 - DNA, 25 bp, Mus musculus
tggccgttccgtacaagagtctgac

SEQ ID NO: 286830 - DNA, 25 bp, Mus musculus
ggcgcgcatttcttccagcgatgga

SEQ ID NO: 286831 - DNA, 25 bp, Mus musculus
cttagttaaggagatccgcggccga

SEQ ID NO: 286832 - DNA, 25 bp, Mus musculus
ccctcctgagcagcggtggaagcag

SEQ ID NO: 286833 - DNA, 25 bp, Mus musculus
ttggctcgagttgcagacatgctcc

SEQ ID NO: 286834 - DNA, 25 bp, Mus musculus
gggcacgatttggtggccatcttca

SEQ ID NO: 286835 - DNA, 25 bp, Mus musculus
agcccacctgttggtcgcactcggg

SEQ ID NO: 286836 - DNA, 25 bp, Mus musculus
tctgctttatgctgccacccaggtg

SEQ ID NO: 286837 - DNA, 25 bp, Mus musculus
agcaccattactgtccttttgtctg

SEQ ID NO: 286838 - DNA, 25 bp, Mus musculus
cgttccggaagtccacaaatttgca

SEQ ID NO: 286839 - DNA, 25 bp, Mus musculus
ccacacatcaaactggttggttttt

SEQ ID NO: 286840 - DNA, 25 bp, Mus musculus
tggaaggactagaaaccacacatca

SEQ ID NO: 286841 - DNA, 25 bp, Mus musculus
caacgccgactttattcgaaccgtg

SEQ ID NO: 286842 - DNA, 25 bp, Mus musculus
aggaagagcctcaacgccgacttta

SEQ ID NO: 286843 - DNA, 25 bp, Mus musculus
ggcacacgcagagaggaagagcctc

SEQ ID NO: 286844 - DNA, 25 bp, Mus musculus
tcgccacgccctctaaggcggtgga

SEQ ID NO: 286845 - DNA, 25 bp, Mus musculus
aaccaacgcacaggtgggccgagcc

SEQ ID NO: 286846 - DNA, 25 bp, Mus musculus
atacccacattaggcgcagctccgg

SEQ ID NO: 286847 - DNA, 25 bp, Mus musculus
aggctcaccttaaccggagcggtgc

SEQ ID NO: 286848 - DNA, 25 bp, Mus musculus
gcgacaggcacgttgcatacccaca

SEQ ID NO: 286849 - DNA, 25 bp, Mus musculus
gccgtagtcacagcagcgctgcagc

SEQ ID NO: 286850 - DNA, 25 bp, Mus musculus
tgtgcggggacccatcgtgctcaaa

SEQ ID NO: 286851 - DNA, 25 bp, Mus musculus
tccggcaacctagcggtgtagcgtc

SEQ ID NO: 286852 - DNA, 25 bp, Mus musculus
ctggagtccatgaacccgcaggtga

SEQ ID NO: 286853 - DNA, 25 bp, Mus musculus
ctaatctcggcaggttcgcgatgca

SEQ ID NO: 286854 - DNA, 25 bp, Mus musculus
ctttctgggccagggctaatctcgg

SEQ ID NO: 286855 - DNA, 25 bp, Mus musculus
acgtcttgctctccttctttctggg

SEQ ID NO: 286856 - DNA, 25 bp, Mus musculus
tacagccctggagctaggctggcgc

SEQ ID NO: 286857 - DNA, 25 bp, Mus musculus
taaccagagggtgggaatacagccc

SEQ ID NO: 286858 - DNA, 25 bp, Mus musculus
agggtgcaaggtcccagtaaccaga

SEQ ID NO: 286859 - DNA, 25 bp, Mus musculus
atcgtgctcaaagccggcgagatcg

SEQ ID NO: 286860 - DNA, 25 bp, Mus musculus
tacagcttcgtgtcggccacgttcg

SEQ ID NO: 286861 - DNA, 25 bp, Mus musculus
gaggttcccaaatagcgagttacgc

SEQ ID NO: 286862 - DNA, 25 bp, Mus musculus
tgagtgtgtgaggttcccaaatagc

SEQ ID NO: 286863 - DNA, 25 bp, Mus musculus
cggggccacggtgaaaaacagcacg

SEQ ID NO: 286864 - DNA, 25 bp, Mus musculus
aaagaagccggcgtggaatcctcac

SEQ ID NO: 286865 - DNA, 25 bp, Mus musculus
cataaagaactctcggtgcggctga

SEQ ID NO: 286866 - DNA, 25 bp, Mus musculus
cggggctgaactttgacccggcgca

SEQ ID NO: 286867 - DNA, 25 bp, Mus musculus
gacgcccaggatgtcgtacagcttc

SEQ ID NO: 286868 - DNA, 25 bp, Mus musculus
agctcgttctcgctagcgccgggag

SEQ ID NO: 286869 - DNA, 25 bp, Mus musculus
cagtaccttcttcagctcgttctcg

SEQ ID NO: 286870 - DNA, 25 bp, Mus musculus
cgagcaccgcggtccgacctgtttt

SEQ ID NO: 286871 - DNA, 25 bp, Mus musculus
ctgccgggcagcactcgcaagcagg

SEQ ID NO: 286872 - DNA, 25 bp, Mus musculus
gcggtgtgcggcgttcataaagaac

SEQ ID NO: 286873 - DNA, 25 bp, Mus musculus
gcagcgccatgacgtcgccacaagg

SEQ ID NO: 286874 - DNA, 25 bp, Mus musculus
aggcagcctctcagtggctttagga

SEQ ID NO: 286875 - DNA, 25 bp, Mus musculus
ccggctcatttaagcagcgagcgca

SEQ ID NO: 286876 - DNA, 25 bp, Mus musculus
tccagggccatgttcctcagcgtcg

SEQ ID NO: 286877 - DNA, 25 bp, Mus musculus
cgcttacctttgaggaccgcgcaga

SEQ ID NO: 286878 - DNA, 25 bp, Mus musculus
gcctggcccagacaaagggcgcgaa

SEQ ID NO: 286879 - DNA, 25 bp, Mus musculus
gcacactttgcaaggcgcggagtcg

SEQ ID NO: 286880 - DNA, 25 bp, Mus musculus
gccttcgcttcgcacactttgcaag

SEQ ID NO: 286881 - DNA, 25 bp, Mus musculus
ccactttctgcggtggcaacctggg

SEQ ID NO: 286882 - DNA, 25 bp, Mus musculus
ttgtgtgctaccactttctgcggtg

SEQ ID NO: 286883 - DNA, 25 bp, Mus musculus
gggctttcgtggtttgtgtgctacc

SEQ ID NO: 286884 - DNA, 25 bp, Mus musculus
gggcttctccgaaaccgctgcggcg

SEQ ID NO: 286885 - DNA, 25 bp, Mus musculus
caggactcatgaggcagcgggactc

SEQ ID NO: 286886 - DNA, 25 bp, Mus musculus
catcctccgcacaggactcatgagg

SEQ ID NO: 286887 - DNA, 25 bp, Mus musculus
tggctttaggagctcgatgctgtca

SEQ ID NO: 286888 - DNA, 25 bp, Mus musculus
ctgaccggccgaccgagaaaagact

SEQ ID NO: 286889 - DNA, 25 bp, Mus musculus
cgcagcacgaagaggtccgtctgtt

SEQ ID NO: 286890 - DNA, 25 bp, Mus musculus
gcacgaagaggtccgtctgtttgtc

SEQ ID NO: 286891 - DNA, 25 bp, Mus musculus
tctgtttgtcggagttgaggtcacc

SEQ ID NO: 286892 - DNA, 25 bp, Mus musculus
gagttgaggtcaccgaaggccgcca

SEQ ID NO: 286893 - DNA, 25 bp, Mus musculus
aagagctcggccgtgacgttgtgca

SEQ ID NO: 286894 - DNA, 25 bp, Mus musculus
cgtgacgttgtgcagagcccgcgcc

SEQ ID NO: 286895 - DNA, 25 bp, Mus musculus
aaagcaccgtgcgactgaccggccg

SEQ ID NO: 286896 - DNA, 25 bp, Mus musculus
aaaagactcggggtgcggcctcacg

SEQ ID NO: 286897 - DNA, 25 bp, Mus musculus
ctggggctgtttctccgacgaccaa

SEQ ID NO: 286898 - DNA, 25 bp, Mus musculus
gtttctccgacgaccaagacgccga

SEQ ID NO: 286899 - DNA, 25 bp, Mus musculus
cgacgaccaagacgccgaggagcta

SEQ ID NO: 286900 - DNA, 25 bp, Mus musculus
ggctgtcgtgcctcccgacagtgtc

SEQ ID NO: 286901 - DNA, 25 bp, Mus musculus
ggcagccgcaaagcaccgtgcgact

SEQ ID NO: 286902 - DNA, 25 bp, Mus musculus
attgcacaggtaggcccgccgggca

SEQ ID NO: 286903 - DNA, 25 bp, Mus musculus
gccggatcagtcacggagcaatgcc

SEQ ID NO: 286904 - DNA, 25 bp, Mus musculus
gaccgttagtgagccggatcagtca

SEQ ID NO: 286905 - DNA, 25 bp, Mus musculus
tttcgccagtgaccgttagtgagcc

SEQ ID NO: 286906 - DNA, 25 bp, Mus musculus
cagtcacggagcaatgcctgacacg

SEQ ID NO: 286907 - DNA, 25 bp, Mus musculus
gagcggagttgtggctcaagtctcc

SEQ ID NO: 286908 - DNA, 25 bp, Mus musculus
agagcaccattctaggagtcatccc

SEQ ID NO: 286909 - DNA, 25 bp, Mus musculus
ggcacgtcgttgcagagcaccattc

SEQ ID NO: 286910 - DNA, 25 bp, Mus musculus
gccgcttgctcaagggcacgtcgtt

SEQ ID NO: 286911 - DNA, 25 bp, Mus musculus
cgcaacttgcagctggtgcggagcc

SEQ ID NO: 286912 - DNA, 25 bp, Mus musculus
ggacacggcccgcaacttgcagctg

SEQ ID NO: 286913 - DNA, 25 bp, Mus musculus
cgcacaagtgtggacacggcccgca

SEQ ID NO: 286914 - DNA, 25 bp, Mus musculus
agggacgcttttcgccagtgaccgt

SEQ ID NO: 286915 - DNA, 25 bp, Mus musculus
ggacctgccaccattgcacaggtag

SEQ ID NO: 286916 - DNA, 25 bp, Mus musculus
taagtaccacacactgcggcggccg

SEQ ID NO: 286917 - DNA, 25 bp, Mus musculus
acactaagttgcatctgggagcttg

SEQ ID NO: 286918 - DNA, 25 bp, Mus musculus
cgaactatcccgcaaaggaagctgg

SEQ ID NO: 286919 - DNA, 25 bp, Mus musculus
cttaggcttaaaggctggagctgcc

SEQ ID NO: 286920 - DNA, 25 bp, Mus musculus
cgcgctcgctcgtggcgacataaac

SEQ ID NO: 286921 - DNA, 25 bp, Mus musculus
cgacataaacaagggaggaggctgc

SEQ ID NO: 286922 - DNA, 25 bp, Mus musculus
cccgcacaataaaggcgcgggtccg

SEQ ID NO: 286923 - DNA, 25 bp, Mus musculus
gccatgttggccgtacaccgggcca

SEQ ID NO: 286924 - DNA, 25 bp, Mus musculus
cacaacaaagactgagcgagggcgc

SEQ ID NO: 286925 - DNA, 25 bp, Mus musculus
ccgcccgcttacctgtgggcggaga

SEQ ID NO: 286926 - DNA, 25 bp, Mus musculus
ttggcgtcgagacgcttcggttacc

SEQ ID NO: 286927 - DNA, 25 bp, Mus musculus
ccgttactgtgggattgactgggtt

SEQ ID NO: 286928 - DNA, 25 bp, Mus musculus
attgactgggttcgcgccgtcctct

SEQ ID NO: 286929 - DNA, 25 bp, Mus musculus
ttcggttaccggagcagcgtcccga

SEQ ID NO: 286930 - DNA, 25 bp, Mus musculus
ctccgggtccgtgatgcctagagct

SEQ ID NO: 286931 - DNA, 25 bp, Mus musculus
tcggggtcgttctcgaacacctctc

SEQ ID NO: 286932 - DNA, 25 bp, Mus musculus
gcttggcctcctcgaagacttggta

SEQ ID NO: 286933 - DNA, 25 bp, Mus musculus
gcccgcaacagcacagctgcagaaa

SEQ ID NO: 286934 - DNA, 25 bp, Mus musculus
ctgcagaaagaagggtgtacggtca

SEQ ID NO: 286935 - DNA, 25 bp, Mus musculus
tggggatcgtaatgcctgtgtgtct

SEQ ID NO: 286936 - DNA, 25 bp, Mus musculus
cctagagctcagaggtccggggaca

SEQ ID NO: 286937 - DNA, 25 bp, Mus musculus
ggtacccggcaccaggatgctgcgc

SEQ ID NO: 286938 - DNA, 25 bp, Mus musculus
ccctgcggtactcactgtgagaaga

SEQ ID NO: 286939 - DNA, 25 bp, Mus musculus
tgagaagactcggaagccagcagga

SEQ ID NO: 286940 - DNA, 25 bp, Mus musculus
ggctccggtcatcctggctaagcga

SEQ ID NO: 286941 - DNA, 25 bp, Mus musculus
gctaagcgacggtgaaggtcacatc

SEQ ID NO: 286942 - DNA, 25 bp, Mus musculus
aaggtcacatccctgcggcggcagc

SEQ ID NO: 286943 - DNA, 25 bp, Mus musculus
cctacacccactcggggctggaatg

SEQ ID NO: 286944 - DNA, 25 bp, Mus musculus
tcactgctcgctggctgcaacttca

SEQ ID NO: 286945 - DNA, 25 bp, Mus musculus
caacgctctcgggaagcaggaaggc

SEQ ID NO: 286946 - DNA, 25 bp, Mus musculus
caaaggtccgggatccaaccgcagc

SEQ ID NO: 286947 - DNA, 25 bp, Mus musculus
cgtgttcgtgatctcgcaaaggtcc

SEQ ID NO: 286948 - DNA, 25 bp, Mus musculus
tggcagccagtggaatccctcaagg

SEQ ID NO: 286949 - DNA, 25 bp, Mus musculus
gtcgccagtccgatagtgaccctga

SEQ ID NO: 286950 - DNA, 25 bp, Mus musculus
cgggccatgcatcgtgtcttgcttc

SEQ ID NO: 286951 - DNA, 25 bp, Mus musculus
ggactcaggactagtgtgctccatc

SEQ ID NO: 286952 - DNA, 25 bp, Mus musculus
ttgccctacacggagccacacgggg

SEQ ID NO: 286953 - DNA, 25 bp, Mus musculus
tgcaacttcagacgcgccgcgagat

SEQ ID NO: 286954 - DNA, 25 bp, Mus musculus
cgaaggtctctctgggatccactcc

SEQ ID NO: 286955 - DNA, 25 bp, Mus musculus
actggccgcggatgccatgacattg

SEQ ID NO: 286956 - DNA, 25 bp, Mus musculus
gcgagatcagaagaggcttgcccta

SEQ ID NO: 286957 - DNA, 25 bp, Mus musculus
aaaacgagccttgggagcgtgcccg

SEQ ID NO: 286958 - DNA, 25 bp, Mus musculus
gttcttggccgggatactcagttca

SEQ ID NO: 286959 - DNA, 25 bp, Mus musculus
ctcagttcagagtcgcttgggcaca

SEQ ID NO: 286960 - DNA, 25 bp, Mus musculus
gggcacatcttcttgatcatcgcgg

SEQ ID NO: 286961 - DNA, 25 bp, Mus musculus
tcatcgcggccagtttcattgggta

SEQ ID NO: 286962 - DNA, 25 bp, Mus musculus
ctgcagagaactccggagtgacgga

SEQ ID NO: 286963 - DNA, 25 bp, Mus musculus
ctggtctgggctcttgggtacagac

SEQ ID NO: 286964 - DNA, 25 bp, Mus musculus
ttgggtacagacagcaggctcaggc

SEQ ID NO: 286965 - DNA, 25 bp, Mus musculus
gcccttatattcagttggccgaagc

SEQ ID NO: 286966 - DNA, 25 bp, Mus musculus
acctcccagctaaggtgcgtcacgt

SEQ ID NO: 286967 - DNA, 25 bp, Mus musculus
gacctccgccttggagcctgaggct

SEQ ID NO: 286968 - DNA, 25 bp, Mus musculus
tcctcttcagacctacgtgcgctga

SEQ ID NO: 286969 - DNA, 25 bp, Mus musculus
cgtgcgctgaaaggaaaactaaatc

SEQ ID NO: 286970 - DNA, 25 bp, Mus musculus
ctaaatccaaactacggccagtggg

SEQ ID NO: 286971 - DNA, 25 bp, Mus musculus
tgggatccggcgcttcccacttttg

SEQ ID NO: 286972 - DNA, 25 bp, Mus musculus
tgagggcaacggaagtcgacgccac

SEQ ID NO: 286973 - DNA, 25 bp, Mus musculus
ttgcgcacatccaagggaccagcgg

SEQ ID NO: 286974 - DNA, 25 bp, Mus musculus
ttctgcgcacttcgcgagggaccag

SEQ ID NO: 286975 - DNA, 25 bp, Mus musculus
gaccagtcagggagatgctttcgca

SEQ ID NO: 286976 - DNA, 25 bp, Mus musculus
agatgctttcgcagcgccctttaca

SEQ ID NO: 286977 - DNA, 25 bp, Mus musculus
gcagcgccctttacaaacagggacc

SEQ ID NO: 286978 - DNA, 25 bp, Mus musculus
gccggactcaccttggcgctgtgca

SEQ ID NO: 286979 - DNA, 25 bp, Mus musculus
ttgcagccagatacgcgcgggcagc

SEQ ID NO: 286980 - DNA, 25 bp, Mus musculus
gaacagagcctcgatgcgcccgcgg

SEQ ID NO: 286981 - DNA, 25 bp, Mus musculus
gcgggcgccgtgaactcatccagca

SEQ ID NO: 286982 - DNA, 25 bp, Mus musculus
agcccgccgccgttgtggaaactcg

SEQ ID NO: 286983 - DNA, 25 bp, Mus musculus
gacgccacacgctgtcaccatgttg

SEQ ID NO: 286984 - DNA, 25 bp, Mus musculus
accatgttgaccgtgggcaagcgtc

SEQ ID NO: 286985 - DNA, 25 bp, Mus musculus
ccgcagcttagcaactgcgggcaga

SEQ ID NO: 286986 - DNA, 25 bp, Mus musculus
tgctctcacttatcgggctttgccg

SEQ ID NO: 286987 - DNA, 25 bp, Mus musculus
gggcctggccgatttagacactcag

SEQ ID NO: 286988 - DNA, 25 bp, Mus musculus
agacactcagctctaattgcgccga

SEQ ID NO: 286989 - DNA, 25 bp, Mus musculus
tcagctctaattgcgccgagccgag

SEQ ID NO: 286990 - DNA, 25 bp, Mus musculus
gcacccgcgccgagaggatgtgcct

SEQ ID NO: 286991 - DNA, 25 bp, Mus musculus
gccaggcccaattgctctcacttat

SEQ ID NO: 286992 - DNA, 25 bp, Mus musculus
cacagtggcgcaggccatcgatctg

SEQ ID NO: 286993 - DNA, 25 bp, Mus musculus
ggccatcgatctgacgccagggatc

SEQ ID NO: 286994 - DNA, 25 bp, Mus musculus
tctgacgccagggatcgaagaggcc

SEQ ID NO: 286995 - DNA, 25 bp, Mus musculus
ggacgcggtcgatgagtcttcagac

SEQ ID NO: 286996 - DNA, 25 bp, Mus musculus
agtcttcagactcagcgagccaagg

SEQ ID NO: 286997 - DNA, 25 bp, Mus musculus
cgagccaagggacacctgtctgtca

SEQ ID NO: 286998 - DNA, 25 bp, Mus musculus
gacacctgtctgtcaggtcgccacg

SEQ ID NO: 286999 - DNA, 25 bp, Mus musculus
agaggatgtgcctcgctgtcgccag

SEQ ID NO: 287000 - DNA, 25 bp, Mus musculus
tccaaggaaagtaggcgtgaagaca

SEQ ID NO: 287001 - DNA, 25 bp, Mus musculus
cacccgggctgcgtatctcggtctt

SEQ ID NO: 287002 - DNA, 25 bp, Mus musculus
tgcgtcacccgcgttcaacacaggg

SEQ ID NO: 287003 - DNA, 25 bp, Mus musculus
ttcaacacagggtcagcgttccaga

SEQ ID NO: 287004 - DNA, 25 bp, Mus musculus
ggtcagcgttccagacttaaaacga

SEQ ID NO: 287005 - DNA, 25 bp, Mus musculus
cgaagtcgtttatttcaattttgct

SEQ ID NO: 287006 - DNA, 25 bp, Mus musculus
gctttgcacattatgtttcggtaca

SEQ ID NO: 287007 - DNA, 25 bp, Mus musculus
tttcggtacaatcaaaacttctgga

SEQ ID NO: 287008 - DNA, 25 bp, Mus musculus
cccttgaaagtcctgcgaatgagcg

SEQ ID NO: 287009 - DNA, 25 bp, Mus musculus
aatgagcgcaatcgcgagtccggcc

SEQ ID NO: 287010 - DNA, 25 bp, Mus musculus
ttcagaggcgctggtacaaagtgtc

SEQ ID NO: 287011 - DNA, 25 bp, Mus musculus
gagcggatagagctggagacatcca

SEQ ID NO: 287012 - DNA, 25 bp, Mus musculus
tatctcggtcttggaccctccgctt

SEQ ID NO: 287013 - DNA, 25 bp, Mus musculus
acaaagtgtcaggtgcttcgggcgc

SEQ ID NO: 287014 - DNA, 25 bp, Mus musculus
gtcaccggcgaaggctgaaatcacc

SEQ ID NO: 287015 - DNA, 25 bp, Mus musculus
gcctctgcgggtgctctaaggaaac

SEQ ID NO: 287016 - DNA, 25 bp, Mus musculus
cgcaccttggtacccagtgtagcta

SEQ ID NO: 287017 - DNA, 25 bp, Mus musculus
ccattcccgatacgtgccagtcaga

SEQ ID NO: 287018 - DNA, 25 bp, Mus musculus
cggtcgcctttctccatctggatga

SEQ ID NO: 287019 - DNA, 25 bp, Mus musculus
gctgctcactgtggaggctctaaca

SEQ ID NO: 287020 - DNA, 25 bp, Mus musculus
ggacccacgccgtatctaggtagtg

SEQ ID NO: 287021 - DNA, 25 bp, Mus musculus
cgatccaatttagtgaacccgcagg

SEQ ID NO: 287022 - DNA, 25 bp, Mus musculus
caggagcgccctgaattactaaaca

SEQ ID NO: 287023 - DNA, 25 bp, Mus musculus
agtggctgtccgcacttccgagatc

SEQ ID NO: 287024 - DNA, 25 bp, Mus musculus
cgagatccgcgaaactgcactagtg

SEQ ID NO: 287025 - DNA, 25 bp, Mus musculus
tgcactagtgcttcgttcccaagtc

SEQ ID NO: 287026 - DNA, 25 bp, Mus musculus
atcgcctgtttgtgcccttgcagtg

SEQ ID NO: 287027 - DNA, 25 bp, Mus musculus
cccgctccagcttgaggtatgctcg

SEQ ID NO: 287028 - DNA, 25 bp, Mus musculus
gccgcacttggatgcatagcctctg

SEQ ID NO: 287029 - DNA, 25 bp, Mus musculus
ttcaggggaagacatccaaacgacc

SEQ ID NO: 287030 - DNA, 25 bp, Mus musculus
cgctggtaggagctatgcgccctac

SEQ ID NO: 287031 - DNA, 25 bp, Mus musculus
ccggcagtttccttcttggttcttg

SEQ ID NO: 287032 - DNA, 25 bp, Mus musculus
ccggcatcgcaagcgccggcagttt

SEQ ID NO: 287033 - DNA, 25 bp, Mus musculus
agtcacgcgtggactctttcgcgcg

SEQ ID NO: 287034 - DNA, 25 bp, Mus musculus
gagccttctacttggccaacacagc

SEQ ID NO: 287035 - DNA, 25 bp, Mus musculus
ctagggcgccgttgttattaggagc

SEQ ID NO: 287036 - DNA, 25 bp, Mus musculus
gccgagccaatggttgccctgtccg

SEQ ID NO: 287037 - DNA, 25 bp, Mus musculus
caaaggcgcggatcaagcctggccc

SEQ ID NO: 287038 - DNA, 25 bp, Mus musculus
tgaattattgatgcagcgggcgctg

SEQ ID NO: 287039 - DNA, 25 bp, Mus musculus
cgtgcacttgtccacggtagattta

SEQ ID NO: 287040 - DNA, 25 bp, Mus musculus
gtagatttaaaccacacacgaattc

SEQ ID NO: 287041 - DNA, 25 bp, Mus musculus
ccgccgccgctctgaattattgatg

SEQ ID NO: 287042 - DNA, 25 bp, Mus musculus
gccgctgattcccacttggcgtgaa

SEQ ID NO: 287043 - DNA, 25 bp, Mus musculus
ttgacagcgatgaaggcaagtccca

SEQ ID NO: 287044 - DNA, 25 bp, Mus musculus
cacagccagcggagaacaatggggc

SEQ ID NO: 287045 - DNA, 25 bp, Mus musculus
gcagcagccggcttcgccgctgatt

SEQ ID NO: 287046 - DNA, 25 bp, Mus musculus
tcccacttggcgtgaaaagctctta

SEQ ID NO: 287047 - DNA, 25 bp, Mus musculus
ggcagtgactaatttagccctacgc

SEQ ID NO: 287048 - DNA, 25 bp, Mus musculus
accgtcaaatcacatcttctgttgg

SEQ ID NO: 287049 - DNA, 25 bp, Mus musculus
ttctgttggtacttactgagggctc

SEQ ID NO: 287050 - DNA, 25 bp, Mus musculus
acttactgagggctcacctgggctg

SEQ ID NO: 287051 - DNA, 25 bp, Mus musculus
ctgcatggggctcggataaatccgg

SEQ ID NO: 287052 - DNA, 25 bp, Mus musculus
aggtgctaagcctggggacctgacc

SEQ ID NO: 287053 - DNA, 25 bp, Mus musculus
cactgcctgcggacggccagtacat

SEQ ID NO: 287054 - DNA, 25 bp, Mus musculus
tggcccgacccagctactttaggaa

SEQ ID NO: 287055 - DNA, 25 bp, Mus musculus
ctggcagccttgtcaccgccataaa

SEQ ID NO: 287056 - DNA, 25 bp, Mus musculus
ttacaaaacaaaatgcgaggtgctc

SEQ ID NO: 287057 - DNA, 25 bp, Mus musculus
cgtctccggcaagccttctgcggag

SEQ ID NO: 287058 - DNA, 25 bp, Mus musculus
gtccctcactgtgcgtgctggctca

SEQ ID NO: 287059 - DNA, 25 bp, Mus musculus
ctggctcatcgtgtggttctgcaaa

SEQ ID NO: 287060 - DNA, 25 bp, Mus musculus
catcgtgtggttctgcaaaggcgaa

SEQ ID NO: 287061 - DNA, 25 bp, Mus musculus
ctgcaaaggcgaagaaaggagacac

SEQ ID NO: 287062 - DNA, 25 bp, Mus musculus
agacacgcatgagggcgaaagaatg

SEQ ID NO: 287063 - DNA, 25 bp, Mus musculus
aaagaatggcgagcatgcctgtccc

SEQ ID NO: 287064 - DNA, 25 bp, Mus musculus
tcccacccagggcatggacgcagag

SEQ ID NO: 287065 - DNA, 25 bp, Mus musculus
gcatggacgcagagagctgcagaaa

SEQ ID NO: 287066 - DNA, 25 bp, Mus musculus
gtgtcctgtcgcgaggtccctcact

SEQ ID NO: 287067 - DNA, 25 bp, Mus musculus
aaagcggctcgatcattacaaaaca

SEQ ID NO: 287068 - DNA, 25 bp, Mus musculus
ccacgtcgatccgagcttggggatc

SEQ ID NO: 287069 - DNA, 25 bp, Mus musculus
agagctgcagaaagcggctcgatca

SEQ ID NO: 287070 - DNA, 25 bp, Mus musculus
tccgagaagaaagtccgagagcaca

SEQ ID NO: 287071 - DNA, 25 bp, Mus musculus
cgagagcacacgttacacttatggc

SEQ ID NO: 287072 - DNA, 25 bp, Mus musculus
tatggctgccctttatgaattctgc

SEQ ID NO: 287073 - DNA, 25 bp, Mus musculus
attctgccttcttgcgtgagccgtc

SEQ ID NO: 287074 - DNA, 25 bp, Mus musculus
ggcggtggttctgcagcaacacctc

SEQ ID NO: 287075 - DNA, 25 bp, Mus musculus
acctccatggtgtaggctgcaccgc

SEQ ID NO: 287076 - DNA, 25 bp, Mus musculus
ccatacatgggctctgatgcgtcca

SEQ ID NO: 287077 - DNA, 25 bp, Mus musculus
gatgcgtccacgtcatcctcactgg

SEQ ID NO: 287078 - DNA, 25 bp, Mus musculus
atcctcactggcctcgtggctgttc

SEQ ID NO: 287079 - DNA, 25 bp, Mus musculus
ttcggcgcctcaggattcttgagca

SEQ ID NO: 287080 - DNA, 25 bp, Mus musculus
tcttgagcagcatgccctgcaggtc

SEQ ID NO: 287081 - DNA, 25 bp, Mus musculus
tccgcggcagcgtcaaacacgcagt

SEQ ID NO: 287082 - DNA, 25 bp, Mus musculus
ctgcaccgcagatgtcacagccata

SEQ ID NO: 287083 - DNA, 25 bp, Mus musculus
cgccacagatgggacacatgtagtg

SEQ ID NO: 287084 - DNA, 25 bp, Mus musculus
cgcgcttgcacacgctgcacttgaa

SEQ ID NO: 287085 - DNA, 25 bp, Mus musculus
ctcttcaagtagctcaggcggatga

SEQ ID NO: 287086 - DNA, 25 bp, Mus musculus
ggatctgttcatgcctcttcaagta

SEQ ID NO: 287087 - DNA, 25 bp, Mus musculus
cagcttgtcgctgtggatctgttca

SEQ ID NO: 287088 - DNA, 25 bp, Mus musculus
aggtgcacttgaacggcagcttgtc

SEQ ID NO: 287089 - DNA, 25 bp, Mus musculus
ctcttgtgtttgaagaggcggctgc

SEQ ID NO: 287090 - DNA, 25 bp, Mus musculus
ggtctcggctcctcttgtgtttgaa

SEQ ID NO: 287091 - DNA, 25 bp, Mus musculus
gcagcttgatgtgccggtctcggct

SEQ ID NO: 287092 - DNA, 25 bp, Mus musculus
tcttgtcgcccgtgtgcagcttgat

SEQ ID NO: 287093 - DNA, 25 bp, Mus musculus
tgcgggagaaagctgcctcgcactc

SEQ ID NO: 287094 - DNA, 25 bp, Mus musculus
cggatgaaggacttgtcgcagaact

SEQ ID NO: 287095 - DNA, 25 bp, Mus musculus
ctgcctcgcactcgtgacagtggta

SEQ ID NO: 287096 - DNA, 25 bp, Mus musculus
acagtggtacttcttgtcgcccgtg

SEQ ID NO: 287097 - DNA, 25 bp, Mus musculus
cgctgcacttgaacggcttgctgga

SEQ ID NO: 287098 - DNA, 25 bp, Mus musculus
cgcggccgctttgtgccaagtccag

SEQ ID NO: 287099 - DNA, 25 bp, Mus musculus
agtccaggccctgagttactgcgtc

SEQ ID NO: 287100 - DNA, 25 bp, Mus musculus
aggccctgagttactgcgtcgcagc

SEQ ID NO: 287101 - DNA, 25 bp, Mus musculus
tgagttactgcgtcgcagccatgga

SEQ ID NO: 287102 - DNA, 25 bp, Mus musculus
gttactgcgtcgcagccatggagcc

SEQ ID NO: 287103 - DNA, 25 bp, Mus musculus
agccatggagccctcagcacgggtg

SEQ ID NO: 287104 - DNA, 25 bp, Mus musculus
ccaggacggcgcctcaaaggagtcc

SEQ ID NO: 287105 - DNA, 25 bp, Mus musculus
ggacggcgcctcaaaggagtcccag

SEQ ID NO: 287106 - DNA, 25 bp, Mus musculus
ccaggaccgcctccatgggcaggag

SEQ ID NO: 287107 - DNA, 25 bp, Mus musculus
ggcgcaacccgtgccttcccagcca

SEQ ID NO: 287108 - DNA, 25 bp, Mus musculus
ttcccaaggccaccaggctctcgca

SEQ ID NO: 287109 - DNA, 25 bp, Mus musculus
gtcacgaagcagaaagggccccgga

SEQ ID NO: 287110 - DNA, 25 bp, Mus musculus
cccggcaccctgcaggagtcgcgac

SEQ ID NO: 287111 - DNA, 25 bp, Mus musculus
ccgggcctgggtctctgaggcctga

SEQ ID NO: 287112 - DNA, 25 bp, Mus musculus
ctgaagtcgatattgccgaagcctc

SEQ ID NO: 287113 - DNA, 25 bp, Mus musculus
cccagccggtcgttgcttgggaaca

SEQ ID NO: 287114 - DNA, 25 bp, Mus musculus
cttgggaacagagtagtcccgccca

SEQ ID NO: 287115 - DNA, 25 bp, Mus musculus
agtcccgcccatcaagcgttgaagg

SEQ ID NO: 287116 - DNA, 25 bp, Mus musculus
accctaccctctctgtaaagcggag

SEQ ID NO: 287117 - DNA, 25 bp, Mus musculus
gctgtacctgcctgaagtcgatatt

SEQ ID NO: 287118 - DNA, 25 bp, Mus musculus
tgccgaagcctccacagcagtcgtg

SEQ ID NO: 287119 - DNA, 25 bp, Mus musculus
cccgctaccgagctgctgataagtg

SEQ ID NO: 287120 - DNA, 25 bp, Mus musculus
ctgataagtgcagttgtcgggctcg

SEQ ID NO: 287121 - DNA, 25 bp, Mus musculus
gtcgggctcgtattttcttccatca

SEQ ID NO: 287122 - DNA, 25 bp, Mus musculus
gtattttcttccatcacgcgagccc

SEQ ID NO: 287123 - DNA, 25 bp, Mus musculus
cggagaacgggcctcttggcattta

SEQ ID NO: 287124 - DNA, 25 bp, Mus musculus
tcttggcatttagggaagcgcggcc

SEQ ID NO: 287125 - DNA, 25 bp, Mus musculus
ctctgtaaagcggagctgtacctgc

SEQ ID NO: 287126 - DNA, 25 bp, Mus musculus
tgaccgccaggtcccgtaagaccga

SEQ ID NO: 287127 - DNA, 25 bp, Mus musculus
gtattgatctgtgttttgaccgcca

SEQ ID NO: 287128 - DNA, 25 bp, Mus musculus
ccggtctctctggacctgggacaaa

SEQ ID NO: 287129 - DNA, 25 bp, Mus musculus
ctgcattccattggtcgggtctgta

SEQ ID NO: 287130 - DNA, 25 bp, Mus musculus
gggtagtacgactccgcctactgtc

SEQ ID NO: 287131 - DNA, 25 bp, Mus musculus
gatcttcattggctaaggctctgca

SEQ ID NO: 287132 - DNA, 25 bp, Mus musculus
atgctgcttgtcgacctcgccaacg

SEQ ID NO: 287133 - DNA, 25 bp, Mus musculus
tgatcctcacgctctggaagacccg

SEQ ID NO: 287134 - DNA, 25 bp, Mus musculus
cagcccggccggataccaagaacag

SEQ ID NO: 287135 - DNA, 25 bp, Mus musculus
ccgggcagtctaggcggagaaacac

SEQ ID NO: 287136 - DNA, 25 bp, Mus musculus
gcgcgtgctcgtgcatgtaaagtca

SEQ ID NO: 287137 - DNA, 25 bp, Mus musculus
ccgatccctgaagtgggagcaccca

SEQ ID NO: 287138 - DNA, 25 bp, Mus musculus
ctgacatcagtagacccgatccctg

SEQ ID NO: 287139 - DNA, 25 bp, Mus musculus
ggaaataagttcctgcgcacaactg

SEQ ID NO: 287140 - DNA, 25 bp, Mus musculus
ctgtcccacaccaaagagaatcttc

SEQ ID NO: 287141 - DNA, 25 bp, Mus musculus
acgggcattgctcagccgatgtgcc

SEQ ID NO: 287142 - DNA, 25 bp, Mus musculus
gctagctgcctccatggaccaaggg

SEQ ID NO: 287143 - DNA, 25 bp, Mus musculus
agagaatcttccactactgagctaa

SEQ ID NO: 287144 - DNA, 25 bp, Mus musculus
ccatctgtataactctcgcgcctag

SEQ ID NO: 287145 - DNA, 25 bp, Mus musculus
tggttcggtattccaaaactatctc

SEQ ID NO: 287146 - DNA, 25 bp, Mus musculus
cctggcttttcttgctggttcggta

SEQ ID NO: 287147 - DNA, 25 bp, Mus musculus
cccgagatttatccacgcacaagaa

SEQ ID NO: 287148 - DNA, 25 bp, Mus musculus
gcttgcccggatgcctttagtatca

SEQ ID NO: 287149 - DNA, 25 bp, Mus musculus
agagaacagataacaggcccgtgcg

SEQ ID NO: 287150 - DNA, 25 bp, Mus musculus
gccaggcttggctggaaatgtagcc

SEQ ID NO: 287151 - DNA, 25 bp, Mus musculus
gctgcactgcagagacacataataa

SEQ ID NO: 287152 - DNA, 25 bp, Mus musculus
tcgcgctcctgtcttctttgtggtc

SEQ ID NO: 287153 - DNA, 25 bp, Mus musculus
gagctaactcatgcctccatctgta

SEQ ID NO: 287154 - DNA, 25 bp, Mus musculus
ccgtctcagtgacgagcccttgcga

SEQ ID NO: 287155 - DNA, 25 bp, Mus musculus
gcgaattcattttctgtttgacaac

SEQ ID NO: 287156 - DNA, 25 bp, Mus musculus
agagtgcgaattcattttctgtttg

SEQ ID NO: 287157 - DNA, 25 bp, Mus musculus
gcccttgcgagttatagagtgcgaa

SEQ ID NO: 287158 - DNA, 25 bp, Mus musculus
acgagcccttgcgagttatagagtg

SEQ ID NO: 287159 - DNA, 25 bp, Mus musculus
cagtgacgagcccttgcgagttata

SEQ ID NO: 287160 - DNA, 25 bp, Mus musculus
tagagtgtgtcttccgccgggtccc

SEQ ID NO: 287161 - DNA, 25 bp, Mus musculus
caagcggaaggtagagtgtgtcttc

SEQ ID NO: 287162 - DNA, 25 bp, Mus musculus
ctcgctggaacaagcggaaggtaga

SEQ ID NO: 287163 - DNA, 25 bp, Mus musculus
tgccgcccgacatgaactcgctgga

SEQ ID NO: 287164 - DNA, 25 bp, Mus musculus
cattttctgtttgacaacctaacga

SEQ ID NO: 287165 - DNA, 25 bp, Mus musculus
ccgacatgaactcgctggaacaagc

SEQ ID NO: 287166 - DNA, 25 bp, Mus musculus
cgtttctagaaaatgggcggtgcca

SEQ ID NO: 287167 - DNA, 25 bp, Mus musculus
tttctagaaaatgggcggtgccaaa

SEQ ID NO: 287168 - DNA, 25 bp, Mus musculus
tgtccctgcgagcaaacaaacctgg

SEQ ID NO: 287169 - DNA, 25 bp, Mus musculus
ggtaagagtcggacgaagcgcttca

SEQ ID NO: 287170 - DNA, 25 bp, Mus musculus
agcgcttcaagcgacctcagttctc

SEQ ID NO: 287171 - DNA, 25 bp, Mus musculus
ccctatcgagagctgtcaggccgag

SEQ ID NO: 287172 - DNA, 25 bp, Mus musculus
tgcagcgcgcgtgctcactacgcga

SEQ ID NO: 287173 - DNA, 25 bp, Mus musculus
ctacgcgactctgacgtctcggttc

SEQ ID NO: 287174 - DNA, 25 bp, Mus musculus
ctgctggactcgagtctggcggtaa

SEQ ID NO: 287175 - DNA, 25 bp, Mus musculus
agcctccgtcgccatgggtaagagt

SEQ ID NO: 287176 - DNA, 25 bp, Mus musculus
tcttctggtctgtcactgcagcctc

SEQ ID NO: 287177 - DNA, 25 bp, Mus musculus
gacggctgctgcagtcgtcctcttc

SEQ ID NO: 287178 - DNA, 25 bp, Mus musculus
ccaagtaacgtcgagcctggaagtc

SEQ ID NO: 287179 - DNA, 25 bp, Mus musculus
cgtgctgcttttccatgtgtgctca

SEQ ID NO: 287180 - DNA, 25 bp, Mus musculus
ctaccagacttagcccgtcgggatg

SEQ ID NO: 287181 - DNA, 25 bp, Mus musculus
tgctcaggccgtcacattggacccg

SEQ ID NO: 287182 - DNA, 25 bp, Mus musculus
gccgccgtttgatggatccgaggat

SEQ ID NO: 287183 - DNA, 25 bp, Mus musculus
ccagctaagctagcgcgggacggtt

SEQ ID NO: 287184 - DNA, 25 bp, Mus musculus
gccgccgccatttgcacgggaaccc

SEQ ID NO: 287185 - DNA, 25 bp, Mus musculus
tggatccgaggatcgcctggttcca

SEQ ID NO: 287186 - DNA, 25 bp, Mus musculus
cgaggatcgcctggttccagccaga

SEQ ID NO: 287187 - DNA, 25 bp, Mus musculus
tgaggaacctctacttcaaccacca

SEQ ID NO: 287188 - DNA, 25 bp, Mus musculus
cgagcagcacggacgctacggagca

SEQ ID NO: 287189 - DNA, 25 bp, Mus musculus
accactgtcacagcagcggcgcgag

SEQ ID NO: 287190 - DNA, 25 bp, Mus musculus
ctggttccagccagagcagctcgga

SEQ ID NO: 287191 - DNA, 25 bp, Mus musculus
ccaggggctgaggaacctctacttc

SEQ ID NO: 287192 - DNA, 25 bp, Mus musculus
gtccaatagtctgtggatgcagatc

SEQ ID NO: 287193 - DNA, 25 bp, Mus musculus
ctcggaccgtccaatagtctgtgga

SEQ ID NO: 287194 - DNA, 25 bp, Mus musculus
gccagagcagctcggaccgtccaat

SEQ ID NO: 287195 - DNA, 25 bp, Mus musculus
tgcccgcggagcagcgggacttcct

SEQ ID NO: 287196 - DNA, 25 bp, Mus musculus
cccgcacggtcagtgtgaccagctg

SEQ ID NO: 287197 - DNA, 25 bp, Mus musculus
aaggctgcgggcgtggctccctcct

SEQ ID NO: 287198 - DNA, 25 bp, Mus musculus
ctttgggaacccggagatgaggtct

SEQ ID NO: 287199 - DNA, 25 bp, Mus musculus
tgcagcctcagggacaccggagatg

SEQ ID NO: 287200 - DNA, 25 bp, Mus musculus
gacaccggagatggcccagtgccgc

SEQ ID NO: 287201 - DNA, 25 bp, Mus musculus
agatggcccagtgccgcaggtaaca

SEQ ID NO: 287202 - DNA, 25 bp, Mus musculus
cccagtgccgcaggtaacagggtcg

SEQ ID NO: 287203 - DNA, 25 bp, Mus musculus
acacacagggtggtcatgggaggct

SEQ ID NO: 287204 - DNA, 25 bp, Mus musculus
tggaccacgtgggagaggtactttg

SEQ ID NO: 287205 - DNA, 25 bp, Mus musculus
tcccgcgggacaggacacacagggt

SEQ ID NO: 287206 - DNA, 25 bp, Mus musculus
cgatcccgcgggacaggacacacag

SEQ ID NO: 287207 - DNA, 25 bp, Mus musculus
ttgtggggtccttgcctccgatccc

SEQ ID NO: 287208 - DNA, 25 bp, Mus musculus
cctctgaagctttcttcccagcccg

SEQ ID NO: 287209 - DNA, 25 bp, Mus musculus
gggatccaggcaggccgcctccgac

SEQ ID NO: 287210 - DNA, 25 bp, Mus musculus
ggaccagcttcaggggcttctccac

SEQ ID NO: 287211 - DNA, 25 bp, Mus musculus
cctcgtagaagtggcggtccgactt

SEQ ID NO: 287212 - DNA, 25 bp, Mus musculus
ctgtcttgactttctttttccatcc

SEQ ID NO: 287213 - DNA, 25 bp, Mus musculus
ggcgcgaggtccctcacgagaaaaa

SEQ ID NO: 287214 - DNA, 25 bp, Mus musculus
caaaccagcgggaaagagaggccgc

SEQ ID NO: 287215 - DNA, 25 bp, Mus musculus
tgcttcttgcccatgtccgaccggg

SEQ ID NO: 287216 - DNA, 25 bp, Mus musculus
ccgaagcgcgacaccagtggcgaga

SEQ ID NO: 287217 - DNA, 25 bp, Mus musculus
gggacgcgaccgaagcgcgacacca

SEQ ID NO: 287218 - DNA, 25 bp, Mus musculus
tactctgaaacaagagcaggacgcg

SEQ ID NO: 287219 - DNA, 25 bp, Mus musculus
aggggcttctccacgtactctgaaa

SEQ ID NO: 287220 - DNA, 25 bp, Mus musculus
tcttcgaagaggctggagtcgtgcc

SEQ ID NO: 287221 - DNA, 25 bp, Mus musculus
cgcttctgtcttcgaagaggctgga

SEQ ID NO: 287222 - DNA, 25 bp, Mus musculus
tggcggtccgacttgtgcttcttgt

SEQ ID NO: 287223 - DNA, 25 bp, Mus musculus
cccgactttgaggaccagcttcagg

SEQ ID NO: 287224 - DNA, 25 bp, Mus musculus
ctgtcacggcttgagcagtgctccg

SEQ ID NO: 287225 - DNA, 25 bp, Mus musculus
gcggctttcccttggcgctggcaca

SEQ ID NO: 287226 - DNA, 25 bp, Mus musculus
aggccaaggcttcgtccaaggctcg

SEQ ID NO: 287227 - DNA, 25 bp, Mus musculus
gcaggcttataaaggccaaggcttc

SEQ ID NO: 287228 - DNA, 25 bp, Mus musculus
gcgaccgaacaaacgcaggcttata

SEQ ID NO: 287229 - DNA, 25 bp, Mus musculus
tgcagagccactgagcaagccaccg

SEQ ID NO: 287230 - DNA, 25 bp, Mus musculus
ctgcgcgtgtttacccaggtgctcg

SEQ ID NO: 287231 - DNA, 25 bp, Mus musculus
cgaagtctgcaagtggcgtcgccag

SEQ ID NO: 287232 - DNA, 25 bp, Mus musculus
ttcttgtcggcgtttattacatgcg

SEQ ID NO: 287233 - DNA, 25 bp, Mus musculus
tattacatgcggctgtcacggcttg

SEQ ID NO: 287234 - DNA, 25 bp, Mus musculus
gccgcaggacaaggacggttcttgt

SEQ ID NO: 287235 - DNA, 25 bp, Mus musculus
ccagcactgggtaccagcgtgagca

SEQ ID NO: 287236 - DNA, 25 bp, Mus musculus
ttagcagagcgctcggcacgcacca

SEQ ID NO: 287237 - DNA, 25 bp, Mus musculus
ccggcgcactaacccggagcagatg

SEQ ID NO: 287238 - DNA, 25 bp, Mus musculus
gccggtgctaactctccctctcctt

SEQ ID NO: 287239 - DNA, 25 bp, Mus musculus
cgctggatctcattaccagggttgc

SEQ ID NO: 287240 - DNA, 25 bp, Mus musculus
ggaaacttcactcgaagccgggtca

SEQ ID NO: 287241 - DNA, 25 bp, Mus musculus
aagccgggtcagtgtcctcgcctgc

SEQ ID NO: 287242 - DNA, 25 bp, Mus musculus
cgccgcctaaggctgcgctcggcgc

SEQ ID NO: 287243 - DNA, 25 bp, Mus musculus
tggatctcattaccagggttgcctc

SEQ ID NO: 287244 - DNA, 25 bp, Mus musculus
cctgccgctggatctcattaccagg

SEQ ID NO: 287245 - DNA, 25 bp, Mus musculus
cccgcagccgccgtgtgcaagcgca

SEQ ID NO: 287246 - DNA, 25 bp, Mus musculus
actcgaagccgggtcagtgtcctcg

SEQ ID NO: 287247 - DNA, 25 bp, Mus musculus
agcatggggaaacttcactcgaagc

SEQ ID NO: 287248 - DNA, 25 bp, Mus musculus
aacttcactcgaagccgggtcagtg

SEQ ID NO: 287249 - DNA, 25 bp, Mus musculus
cccagcatggggaaacttcactcga

SEQ ID NO: 287250 - DNA, 25 bp, Mus musculus
gccggacgcatggcttaggacgctc

SEQ ID NO: 287251 - DNA, 25 bp, Mus musculus
atctcattaccagggttgcctcagc

SEQ ID NO: 287252 - DNA, 25 bp, Mus musculus
caggcgcaccatggcgtccagcagt

SEQ ID NO: 287253 - DNA, 25 bp, Mus musculus
gcctccggagctggttctcgtccag

SEQ ID NO: 287254 - DNA, 25 bp, Mus musculus
gatggcgacccacgacactgtctgc

SEQ ID NO: 287255 - DNA, 25 bp, Mus musculus
cactgtctgcgcagcctggatgcca

SEQ ID NO: 287256 - DNA, 25 bp, Mus musculus
tcaggacagatactcccgcaccgtg

SEQ ID NO: 287257 - DNA, 25 bp, Mus musculus
gaggatgagcctcaggacagcctga

SEQ ID NO: 287258 - DNA, 25 bp, Mus musculus
cggcgtaaagcagccgcaggtactc

SEQ ID NO: 287259 - DNA, 25 bp, Mus musculus
tctgcagcctctcgaagtccgagta

SEQ ID NO: 287260 - DNA, 25 bp, Mus musculus
gaagtccgagtagcgccgttccacc

SEQ ID NO: 287261 - DNA, 25 bp, Mus musculus
ttgtcgctgtcgaagctcccggtct

SEQ ID NO: 287262 - DNA, 25 bp, Mus musculus
tcccggtctggatgaccacgacttg

SEQ ID NO: 287263 - DNA, 25 bp, Mus musculus
ccacgacttggtacatctgcaggca

SEQ ID NO: 287264 - DNA, 25 bp, Mus musculus
agtgcgccgtcagcttctcctgcag

SEQ ID NO: 287265 - DNA, 25 bp, Mus musculus
ccgcaccgtgagctccttcagggtg

SEQ ID NO: 287266 - DNA, 25 bp, Mus musculus
ccttttggaggcaagaagacctgtg

SEQ ID NO: 287267 - DNA, 25 bp, Mus musculus
gctctggtcacaactggaggccttc

SEQ ID NO: 287268 - DNA, 25 bp, Mus musculus
aaacacaaggcaggctccaggtcgc

SEQ ID NO: 287269 - DNA, 25 bp, Mus musculus
cagaggggaagcgaaacacaaggca

SEQ ID NO: 287270 - DNA, 25 bp, Mus musculus
aactggaggccttcaaggaggagca

SEQ ID NO: 287271 - DNA, 25 bp, Mus musculus
gaggtgacatttggagctctggtca

SEQ ID NO: 287272 - DNA, 25 bp, Mus musculus
cgagtcccacgccttttggaggcaa

SEQ ID NO: 287273 - DNA, 25 bp, Mus musculus
tgggccctttcgaggccgagtccca

SEQ ID NO: 287274 - DNA, 25 bp, Mus musculus
agcttggtgcccttccgaaagcggc

SEQ ID NO: 287275 - DNA, 25 bp, Mus musculus
acccaggagtcccttcgtggccagg

SEQ ID NO: 287276 - DNA, 25 bp, Mus musculus
agctggctgccttgtcgaggtccga

SEQ ID NO: 287277 - DNA, 25 bp, Mus musculus
ctgctcccgggtgtccggactgcga

SEQ ID NO: 287278 - DNA, 25 bp, Mus musculus
gacctgaggcccagtgtcaccgagt

SEQ ID NO: 287279 - DNA, 25 bp, Mus musculus
tcggacaggccgcttgcagagccag

SEQ ID NO: 287280 - DNA, 25 bp, Mus musculus
cacgcagggtcggatctctgaatac

SEQ ID NO: 287281 - DNA, 25 bp, Mus musculus
tgcaggactccgtctttctctctgg

SEQ ID NO: 287282 - DNA, 25 bp, Mus musculus
gcttctgacgtcaaccgcggttgtc

SEQ ID NO: 287283 - DNA, 25 bp, Mus musculus
cgggccgacgagcttctgacgtcaa

SEQ ID NO: 287284 - DNA, 25 bp, Mus musculus
cagtgttcctgctctgcctcaggcg

SEQ ID NO: 287285 - DNA, 25 bp, Mus musculus
atacgattggctagcgcggcatcta

SEQ ID NO: 287286 - DNA, 25 bp, Mus musculus
agccattggaggaaggtctgttaca

SEQ ID NO: 287287 - DNA, 25 bp, Mus musculus
agcaccctgccagcagccattggag

SEQ ID NO: 287288 - DNA, 25 bp, Mus musculus
cttgaccgagcggaaagtcccttca

SEQ ID NO: 287289 - DNA, 25 bp, Mus musculus
tttgcctccaccgagcttgaccgag

SEQ ID NO: 287290 - DNA, 25 bp, Mus musculus
ttcagccaatggtgacatgacactg

SEQ ID NO: 287291 - DNA, 25 bp, Mus musculus
ccgcccaggcgtggtttcagccaat

SEQ ID NO: 287292 - DNA, 25 bp, Mus musculus
aaaacccaatcagagcgcacgcagg

SEQ ID NO: 287293 - DNA, 25 bp, Mus musculus
ccgcgcgcctgaggtaaatactggg

SEQ ID NO: 287294 - DNA, 25 bp, Mus musculus
gcccaagatcgccacggaaccatta

SEQ ID NO: 287295 - DNA, 25 bp, Mus musculus
ttccactcccggaaggcacggagtc

SEQ ID NO: 287296 - DNA, 25 bp, Mus musculus
cacggagtcccgctagatccctttt

SEQ ID NO: 287297 - DNA, 25 bp, Mus musculus
gtccggcagtacctggaccaggtgc

SEQ ID NO: 287298 - DNA, 25 bp, Mus musculus
aacgcgtccggcagtacctggacca

SEQ ID NO: 287299 - DNA, 25 bp, Mus musculus
tgcgcaaacgcgtccggcagtacct

SEQ ID NO: 287300 - DNA, 25 bp, Mus musculus
tggcctcgcggccatgaacctggag

SEQ ID NO: 287301 - DNA, 25 bp, Mus musculus
tcggcgggcttgggtccctcgacac

SEQ ID NO: 287302 - DNA, 25 bp, Mus musculus
attagagtgggcacacacccgacgg

SEQ ID NO: 287303 - DNA, 25 bp, Mus musculus
agatcgccacggaaccattagagtg

SEQ ID NO: 287304 - DNA, 25 bp, Mus musculus
ggactaggagctggcgcccaagatc

SEQ ID NO: 287305 - DNA, 25 bp, Mus musculus
gttaggactaggagctggcgcccaa

SEQ ID NO: 287306 - DNA, 25 bp, Mus musculus
gacaaaggcgaacaggttaggacta

SEQ ID NO: 287307 - DNA, 25 bp, Mus musculus
acggaaccattagagtgggcacaca

SEQ ID NO: 287308 - DNA, 25 bp, Mus musculus
ggcagctaatacaaagccctgggca

SEQ ID NO: 287309 - DNA, 25 bp, Mus musculus
cgacaatgacatttggccgcactgc

SEQ ID NO: 287310 - DNA, 25 bp, Mus musculus
acatttggccgcactgcaggtgcgg

SEQ ID NO: 287311 - DNA, 25 bp, Mus musculus
cccgcagaagcgacaatgacatttg

SEQ ID NO: 287312 - DNA, 25 bp, Mus musculus
tattagtcatctgccgcctcggagg

SEQ ID NO: 287313 - DNA, 25 bp, Mus musculus
gttattagtcatctgccgcctcgga

SEQ ID NO: 287314 - DNA, 25 bp, Mus musculus
ctcatcaagcgttattagtcatctg

SEQ ID NO: 287315 - DNA, 25 bp, Mus musculus
aatacaaagccctgggcaccgcgcg

SEQ ID NO: 287316 - DNA, 25 bp, Mus musculus
gggaagtcggggcagctaatacaaa

SEQ ID NO: 287317 - DNA, 25 bp, Mus musculus
ctttgtggcgttccggtcctttgat

SEQ ID NO: 287318 - DNA, 25 bp, Mus musculus
gttccggtcctttgatctgggcaca

SEQ ID NO: 287319 - DNA, 25 bp, Mus musculus
tccggtcctttgatctgggcacaaa

SEQ ID NO: 287320 - DNA, 25 bp, Mus musculus
ctttgatctgggcacaaagggcggc

SEQ ID NO: 287321 - DNA, 25 bp, Mus musculus
tcccatcaattctcatcaagcgtta

SEQ ID NO: 287322 - DNA, 25 bp, Mus musculus
agacacggcgggactatggcaacca

SEQ ID NO: 287323 - DNA, 25 bp, Mus musculus
agaccgtggcctctcggacagccga

SEQ ID NO: 287324 - DNA, 25 bp, Mus musculus
cctcgcaactctgtgggcatcgcgg

SEQ ID NO: 287325 - DNA, 25 bp, Mus musculus
gagaaaccgggaccgcgatcttatc

SEQ ID NO: 287326 - DNA, 25 bp, Mus musculus
tagttcgccttaacttaatcgcaga

SEQ ID NO: 287327 - DNA, 25 bp, Mus musculus
cccaggcttcgtgccgggaccagga

SEQ ID NO: 287328 - DNA, 25 bp, Mus musculus
ggctgaacccagagcaactttagtt

SEQ ID NO: 287329 - DNA, 25 bp, Mus musculus
cccagagcaactttagttcgcctta

SEQ ID NO: 287330 - DNA, 25 bp, Mus musculus
ggcggcctccgaaaatctggctgaa

SEQ ID NO: 287331 - DNA, 25 bp, Mus musculus
cttaatcgcagaaggccctagaagg

SEQ ID NO: 287332 - DNA, 25 bp, Mus musculus
ccctagaagggagcttcaagggcta

SEQ ID NO: 287333 - DNA, 25 bp, Mus musculus
agacggcctcgcaactctgtgggca

SEQ ID NO: 287334 - DNA, 25 bp, Mus musculus
gatcttatcatcgaggcggcctccg

SEQ ID NO: 287335 - DNA, 25 bp, Mus musculus
acaaggcgagacctgtgaggagacc

SEQ ID NO: 287336 - DNA, 25 bp, Mus musculus
tgcgattaatcatagaggggctctt

SEQ ID NO: 287337 - DNA, 25 bp, Mus musculus
gcctggcccggcaaattgaaatcga

SEQ ID NO: 287338 - DNA, 25 bp, Mus musculus
ttagttcgtgatttgctgcagaccc

SEQ ID NO: 287339 - DNA, 25 bp, Mus musculus
acccgctcgccttaatcaattagtt

SEQ ID NO: 287340 - DNA, 25 bp, Mus musculus
cccatttcgtgagtgttccttcatt

SEQ ID NO: 287341 - DNA, 25 bp, Mus musculus
ggctctttgaaaggcgattggcacc

SEQ ID NO: 287342 - DNA, 25 bp, Mus musculus
ggcgagcggcgaacttcctaactcc

SEQ ID NO: 287343 - DNA, 25 bp, Mus musculus
gcgcgcatgtgtcctgctataatta

SEQ ID NO: 287344 - DNA, 25 bp, Mus musculus
ctcaaacatcagctggggcagaata

SEQ ID NO: 287345 - DNA, 25 bp, Mus musculus
tccgcgacatgctggctcaaacatc

SEQ ID NO: 287346 - DNA, 25 bp, Mus musculus
aaatgttgaggcttcgcttgcttcc

SEQ ID NO: 287347 - DNA, 25 bp, Mus musculus
gactcttggttaaccctcttggcga

SEQ ID NO: 287348 - DNA, 25 bp, Mus musculus
ctgggccgacccgaattagcatgct

SEQ ID NO: 287349 - DNA, 25 bp, Mus musculus
ggcaccgggccagcgctattcaaac

SEQ ID NO: 287350 - DNA, 25 bp, Mus musculus
gttcttttgagtcctcgacgacgta

SEQ ID NO: 287351 - DNA, 25 bp, Mus musculus
cgaacgaaaacgcaaaatctgctgc

SEQ ID NO: 287352 - DNA, 25 bp, Mus musculus
aaaatctgctgcttcgcgctgttta

SEQ ID NO: 287353 - DNA, 25 bp, Mus musculus
gctgcttcgcgctgtttaattaaaa

SEQ ID NO: 287354 - DNA, 25 bp, Mus musculus
ctgtttaattaaaaatgggcgagca

SEQ ID NO: 287355 - DNA, 25 bp, Mus musculus
tgggcgagcagagacgaattaattg

SEQ ID NO: 287356 - DNA, 25 bp, Mus musculus
gtcgccgaagtgtcagcaagctggc

SEQ ID NO: 287357 - DNA, 25 bp, Mus musculus
tgcgggtatctaaactttgataact

SEQ ID NO: 287358 - DNA, 25 bp, Mus musculus
ccaagttccgcggttcgctggtgcg

SEQ ID NO: 287359 - DNA, 25 bp, Mus musculus
atggccgggagagaattggtcttta

SEQ ID NO: 287360 - DNA, 25 bp, Mus musculus
ctttattgttggtggcgatacatca

SEQ ID NO: 287361 - DNA, 25 bp, Mus musculus
gcgatacatcaattacaggccattg

SEQ ID NO: 287362 - DNA, 25 bp, Mus musculus
tacaggccattgtctcgcgcccaag

SEQ ID NO: 287363 - DNA, 25 bp, Mus musculus
cagagacgaattaattgcgggtatc

SEQ ID NO: 287364 - DNA, 25 bp, Mus musculus
gctgcagcacacaaaggcgcggcca

SEQ ID NO: 287365 - DNA, 25 bp, Mus musculus
tagaacctcacatccatgccggggc

SEQ ID NO: 287366 - DNA, 25 bp, Mus musculus
cactgcgcgaagtccaggccggctg

SEQ ID NO: 287367 - DNA, 25 bp, Mus musculus
cgcggggtagaacctcacatccatg

SEQ ID NO: 287368 - DNA, 25 bp, Mus musculus
gccgtacgatccaccgtcgaggacg

SEQ ID NO: 287369 - DNA, 25 bp, Mus musculus
tcaccttgctgtagccgtagtaccc

SEQ ID NO: 287370 - DNA, 25 bp, Mus musculus
cggtcaccttgctgtagccgtagta

SEQ ID NO: 287371 - DNA, 25 bp, Mus musculus
atcagaaagaaagtgcagcaggcta

SEQ ID NO: 287372 - DNA, 25 bp, Mus musculus
ctaaggcgcaccgagaagccagcgg

SEQ ID NO: 287373 - DNA, 25 bp, Mus musculus
ttggtcggagactaaggcgcaccga

SEQ ID NO: 287374 - DNA, 25 bp, Mus musculus
gacgaaaagagttggtcggagacta

SEQ ID NO: 287375 - DNA, 25 bp, Mus musculus
cgtaaagagaagacgaaaagagttg

SEQ ID NO: 287376 - DNA, 25 bp, Mus musculus
gccgccgcggggtagaacctcacat

SEQ ID NO: 287377 - DNA, 25 bp, Mus musculus
caggcactgcgcgaagtccaggccg

SEQ ID NO: 287378 - DNA, 25 bp, Mus musculus
catcttacggccactaggtggtgcc

SEQ ID NO: 287379 - DNA, 25 bp, Mus musculus
gaagccaccagcgtgggaaggccca

SEQ ID NO: 287380 - DNA, 25 bp, Mus musculus
gggaaggcccagctgcatttccgcc

SEQ ID NO: 287381 - DNA, 25 bp, Mus musculus
ccagctgcatttccgccctgcactg

SEQ ID NO: 287382 - DNA, 25 bp, Mus musculus
ctgcactgcgctcgcacctcccagc

SEQ ID NO: 287383 - DNA, 25 bp, Mus musculus
gcgctaccatcttacggccactagg

SEQ ID NO: 287384 - DNA, 25 bp, Mus musculus
ctaaggtaaggattcctcgggcgtg

SEQ ID NO: 287385 - DNA, 25 bp, Mus musculus
tgcctgcgctctagtggcgcctgtc

SEQ ID NO: 287386 - DNA, 25 bp, Mus musculus
cctcgggcgtgtccctagaatgtct

SEQ ID NO: 287387 - DNA, 25 bp, Mus musculus
ccggcagctaaggtaaggattcctc

SEQ ID NO: 287388 - DNA, 25 bp, Mus musculus
acagcgccggcagctaaggtaagga

SEQ ID NO: 287389 - DNA, 25 bp, Mus musculus
gacagatggaaccagagtcctaggg

SEQ ID NO: 287390 - DNA, 25 bp, Mus musculus
ctctagtggcgcctgtctggcgccg

SEQ ID NO: 287391 - DNA, 25 bp, Mus musculus
acggccactaggtggtgcctgcgct

SEQ ID NO: 287392 - DNA, 25 bp, Mus musculus
cccgctcttaaggggcggatgattg

SEQ ID NO: 287393 - DNA, 25 bp, Mus musculus
gcccgcctgtcatggctgcagcggt

SEQ ID NO: 287394 - DNA, 25 bp, Mus musculus
tagccggaccgagcgacgacccgag

SEQ ID NO: 287395 - DNA, 25 bp, Mus musculus
ctcctgctgccctccgtcggaggtc

SEQ ID NO: 287396 - DNA, 25 bp, Mus musculus
gagccgcgtgggtatcctcctttct

SEQ ID NO: 287397 - DNA, 25 bp, Mus musculus
gtggcggtgagtacatgcgcctccc

SEQ ID NO: 287398 - DNA, 25 bp, Mus musculus
attgctcaactggtggagactggcg

SEQ ID NO: 287399 - DNA, 25 bp, Mus musculus
gcgcagcgggacagcaaacattgct

SEQ ID NO: 287400 - DNA, 25 bp, Mus musculus
cagatatgcaaatgaggcgccggtt

SEQ ID NO: 287401 - DNA, 25 bp, Mus musculus
cggcgcggtcacagatatgcaaatg

SEQ ID NO: 287402 - DNA, 25 bp, Mus musculus
cgtgggtatcctcctttcttgggca

SEQ ID NO: 287403 - DNA, 25 bp, Mus musculus
ggaccgagcgacgacccgagctgca

SEQ ID NO: 287404 - DNA, 25 bp, Mus musculus
gcaaacattgctcaactggtggaga

SEQ ID NO: 287405 - DNA, 25 bp, Mus musculus
ctgtcatggctgcagcggtgccctc

SEQ ID NO: 287406 - DNA, 25 bp, Mus musculus
gtgcccgcatgggactgaggaactt

SEQ ID NO: 287407 - DNA, 25 bp, Mus musculus
cgcagcatgagcgagagctacacgc

SEQ ID NO: 287408 - DNA, 25 bp, Mus musculus
cctggagcagctaccgcagcatgag

SEQ ID NO: 287409 - DNA, 25 bp, Mus musculus
tgtgcagccgcctcaacatggacga

SEQ ID NO: 287410 - DNA, 25 bp, Mus musculus
atccagcagcggttcgaggagctgt

SEQ ID NO: 287411 - DNA, 25 bp, Mus musculus
gagccatcagatccagcagcggttc

SEQ ID NO: 287412 - DNA, 25 bp, Mus musculus
gcgccatggcatctggaggcaacca

SEQ ID NO: 287413 - DNA, 25 bp, Mus musculus
cggcacagtagcaggacaggctgct

SEQ ID NO: 287414 - DNA, 25 bp, Mus musculus
tgctcagacctacgggtgcccgcat

SEQ ID NO: 287415 - DNA, 25 bp, Mus musculus
catttcccagcaggccgtgctcaga

SEQ ID NO: 287416 - DNA, 25 bp, Mus musculus
ggccctaggatcacttggtcgtttg

SEQ ID NO: 287417 - DNA, 25 bp, Mus musculus
tgcgtgctcagatcctccgtggaga

SEQ ID NO: 287418 - DNA, 25 bp, Mus musculus
gggccctgagcgcatctgaagagcc

SEQ ID NO: 287419 - DNA, 25 bp, Mus musculus
gctacacgctggaggtgcgtgctca

SEQ ID NO: 287420 - DNA, 25 bp, Mus musculus
tcagcccggcaccagccgatgaaag

SEQ ID NO: 287421 - DNA, 25 bp, Mus musculus
tggaaggccacacctcgggttggac

SEQ ID NO: 287422 - DNA, 25 bp, Mus musculus
gccacactgtgtgcctggaaggcca

SEQ ID NO: 287423 - DNA, 25 bp, Mus musculus
gttgtctcgggccatgaaggagcca

SEQ ID NO: 287424 - DNA, 25 bp, Mus musculus
agccgatgaaagaggccacgttgtc

SEQ ID NO: 287425 - DNA, 25 bp, Mus musculus
gcgtagcaccaggtcctctgtctca

SEQ ID NO: 287426 - DNA, 25 bp, Mus musculus
atgagcacttcaggcacgcccagct

SEQ ID NO: 287427 - DNA, 25 bp, Mus musculus
gagccaggcgccacactgtgtgcct

SEQ ID NO: 287428 - DNA, 25 bp, Mus musculus
cctctgtctcaaacatgagcacttc

SEQ ID NO: 287429 - DNA, 25 bp, Mus musculus
cgctcgatctcctgctcgaactgta

SEQ ID NO: 287430 - DNA, 25 bp, Mus musculus
tctcgttcttgcgtagcaccaggtc

SEQ ID NO: 287431 - DNA, 25 bp, Mus musculus
gagcaccacactcttctcgttcttg

SEQ ID NO: 287432 - DNA, 25 bp, Mus musculus
ccagcctcggggcaagcaggccaag

SEQ ID NO: 287433 - DNA, 25 bp, Mus musculus
ctcgaactgtaccagcctcggggca

SEQ ID NO: 287434 - DNA, 25 bp, Mus musculus
tccgctcggatacccatgccgaatg

SEQ ID NO: 287435 - DNA, 25 bp, Mus musculus
tgccaatcaagttagcgccgctcgg

SEQ ID NO: 287436 - DNA, 25 bp, Mus musculus
ggagctccgtcctgccaatcaagtt

SEQ ID NO: 287437 - DNA, 25 bp, Mus musculus
tcgccgtccatcaaaaacgtacttc

SEQ ID NO: 287438 - DNA, 25 bp, Mus musculus
atgccgaatggctctctctcgccgt

SEQ ID NO: 287439 - DNA, 25 bp, Mus musculus
acgcttacctggatgccctcggtgc

SEQ ID NO: 287440 - DNA, 25 bp, Mus musculus
ccagcccagaggtgagacgcttacc

SEQ ID NO: 287441 - DNA, 25 bp, Mus musculus
aaccctctgtcctgacgactcggta

SEQ ID NO: 287442 - DNA, 25 bp, Mus musculus
gagagcctggggcttcatgtcagcc

SEQ ID NO: 287443 - DNA, 25 bp, Mus musculus
cccggccctagcctggaagcgagtt

SEQ ID NO: 287444 - DNA, 25 bp, Mus musculus
ccttacgtaacagcgcccagggacg

SEQ ID NO: 287445 - DNA, 25 bp, Mus musculus
cgtagagaatctggacaaacctgtc

SEQ ID NO: 287446 - DNA, 25 bp, Mus musculus
cctgtcccgaggtgatgtaaggctg

SEQ ID NO: 287447 - DNA, 25 bp, Mus musculus
gcccggggcacaatcccatttcgga

SEQ ID NO: 287448 - DNA, 25 bp, Mus musculus
gattctgtgttagtcccgggctaga

SEQ ID NO: 287449 - DNA, 25 bp, Mus musculus
agcggactacgctagccctgctagc

SEQ ID NO: 287450 - DNA, 25 bp, Mus musculus
cagtgagtcccgttacccactggga

SEQ ID NO: 287451 - DNA, 25 bp, Mus musculus
cccagaggagcacgggaaaacagtg

SEQ ID NO: 287452 - DNA, 25 bp, Mus musculus
ttcgccctcagctagctaccggttg

SEQ ID NO: 287453 - DNA, 25 bp, Mus musculus
ccctgctagctgactggagaaattc

SEQ ID NO: 287454 - DNA, 25 bp, Mus musculus
tggagaaattcagctccggagccca

SEQ ID NO: 287455 - DNA, 25 bp, Mus musculus
gccttgtttgcaagagacctgcaga

SEQ ID NO: 287456 - DNA, 25 bp, Mus musculus
agcccaaggagtactcgggagtctc

SEQ ID NO: 287457 - DNA, 25 bp, Mus musculus
ggagtctcgcgcagcattctgggaa

SEQ ID NO: 287458 - DNA, 25 bp, Mus musculus
ttctaggtattagagcaaatggctc

SEQ ID NO: 287459 - DNA, 25 bp, Mus musculus
agagccgttgagagaactacacaca

SEQ ID NO: 287460 - DNA, 25 bp, Mus musculus
tagcagcatgaagcgcgtccagacc

SEQ ID NO: 287461 - DNA, 25 bp, Mus musculus
cgaaggcggctttagtagcagcatg

SEQ ID NO: 287462 - DNA, 25 bp, Mus musculus
acgtccggagtgagcatctgctctc

SEQ ID NO: 287463 - DNA, 25 bp, Mus musculus
ccgttctaggacgtccgctgtcttt

SEQ ID NO: 287464 - DNA, 25 bp, Mus musculus
ggaggggacactgaacaccgaattc

SEQ ID NO: 287465 - DNA, 25 bp, Mus musculus
caccgaattccaagggaggggctgc

SEQ ID NO: 287466 - DNA, 25 bp, Mus musculus
tagtcctcgcgaggcttcgttctcg

SEQ ID NO: 287467 - DNA, 25 bp, Mus musculus
ctggagggagaaactatcgagctca

SEQ ID NO: 287468 - DNA, 25 bp, Mus musculus
agtctcgcgagaggacggcttctaa

SEQ ID NO: 287469 - DNA, 25 bp, Mus musculus
cacctgagtgaacgcaatggtcatc

SEQ ID NO: 287470 - DNA, 25 bp, Mus musculus
cgggcctcaccaaagagcagctgga

SEQ ID NO: 287471 - DNA, 25 bp, Mus musculus
tgccggcgcacgattacttcgaggt

SEQ ID NO: 287472 - DNA, 25 bp, Mus musculus
cccactggtgaaggatggaggaccc

SEQ ID NO: 287473 - DNA, 25 bp, Mus musculus
agctgtcagtgcacgcccacgttag

SEQ ID NO: 287474 - DNA, 25 bp, Mus musculus
tactgtcccagtgactccgggtgga

SEQ ID NO: 287475 - DNA, 25 bp, Mus musculus
tgtcttttaaaaactgccgcgctgc

SEQ ID NO: 287476 - DNA, 25 bp, Mus musculus
cccttcgtcctgtagagggagctca

SEQ ID NO: 287477 - DNA, 25 bp, Mus musculus
ccacgccctttgcacctataaggag

SEQ ID NO: 287478 - DNA, 25 bp, Mus musculus
cggtcacacgccaccaagcgggaaa

SEQ ID NO: 287479 - DNA, 25 bp, Mus musculus
gatttccaacaccagcgcggtcaca

SEQ ID NO: 287480 - DNA, 25 bp, Mus musculus
ttggatttccaacaccagcgcggtc

SEQ ID NO: 287481 - DNA, 25 bp, Mus musculus
cctggcttcggccttggatttccaa

SEQ ID NO: 287482 - DNA, 25 bp, Mus musculus
ctagggaccaaacgccgcctggctt

SEQ ID NO: 287483 - DNA, 25 bp, Mus musculus
agtactcataagcacctagggacca

SEQ ID NO: 287484 - DNA, 25 bp, Mus musculus
cgcgtgatttctaaaagtactcata

SEQ ID NO: 287485 - DNA, 25 bp, Mus musculus
cgaacccacgcgtgatttctaaaag

SEQ ID NO: 287486 - DNA, 25 bp, Mus musculus
cagctccaaaggttcccgggctgta

SEQ ID NO: 287487 - DNA, 25 bp, Mus musculus
ggctcacccgacttctgacacgatc

SEQ ID NO: 287488 - DNA, 25 bp, Mus musculus
tgcacctataaggagccgttggaga

SEQ ID NO: 287489 - DNA, 25 bp, Mus musculus
tcgtcctgtagagggagctcaagcc

SEQ ID NO: 287490 - DNA, 25 bp, Mus musculus
tccaagccttcggagctgtcgtccg

SEQ ID NO: 287491 - DNA, 25 bp, Mus musculus
tgccgcgctgtctaagttttccaaa

SEQ ID NO: 287492 - DNA, 25 bp, Mus musculus
ctacggggagcccacgtcatcttgt

SEQ ID NO: 287493 - DNA, 25 bp, Mus musculus
gatgatggccaacatgatcttctcg

SEQ ID NO: 287494 - DNA, 25 bp, Mus musculus
aggccttgagcgtgctcgtgctttc

SEQ ID NO: 287495 - DNA, 25 bp, Mus musculus
cgaactggtactggccataggggta

SEQ ID NO: 287496 - DNA, 25 bp, Mus musculus
cgccagggctgtccttcagctcata

SEQ ID NO: 287497 - DNA, 25 bp, Mus musculus
tgagcgccctgtacgcacatggaaa

SEQ ID NO: 287498 - DNA, 25 bp, Mus musculus
agctttcttctgcacgctcaccttg

SEQ ID NO: 287499 - DNA, 25 bp, Mus musculus
tcccgggtttctctggctcttacca

SEQ ID NO: 287500 - DNA, 25 bp, Mus musculus
cttaccagctgtgggaagatgggca

SEQ ID NO: 287501 - DNA, 25 bp, Mus musculus
cccgtacactgatgaaagcacattg

SEQ ID NO: 287502 - DNA, 25 bp, Mus musculus
cgtccgagtcgctagttttgcagtc

SEQ ID NO: 287503 - DNA, 25 bp, Mus musculus
ttgcagtccgaaatgggtcccaggc

SEQ ID NO: 287504 - DNA, 25 bp, Mus musculus
ctcccccgcgagtacagagcgccgg

SEQ ID NO: 287505 - DNA, 25 bp, Mus musculus
tcggaggggagagccgagaccacga

SEQ ID NO: 287506 - DNA, 25 bp, Mus musculus
cactcggaggggagagccgagacca

SEQ ID NO: 287507 - DNA, 25 bp, Mus musculus
cccgcactcggaggggagagccgag

SEQ ID NO: 287508 - DNA, 25 bp, Mus musculus
cctgcccgcactcggaggggagagc

SEQ ID NO: 287509 - DNA, 25 bp, Mus musculus
ctcctgcccgcactcggaggggaga

SEQ ID NO: 287510 - DNA, 25 bp, Mus musculus
ggactcagtctcttcccgccccctc

SEQ ID NO: 287511 - DNA, 25 bp, Mus musculus
gactggactcagtctcttcccgccc

SEQ ID NO: 287512 - DNA, 25 bp, Mus musculus
ggactggactcagtctcttcccgcc

SEQ ID NO: 287513 - DNA, 25 bp, Mus musculus
gggactggactcagtctcttcccgc

SEQ ID NO: 287514 - DNA, 25 bp, Mus musculus
cgggactggactcagtctcttcccg

SEQ ID NO: 287515 - DNA, 25 bp, Mus musculus
gcgggactggactcagtctcttccc

SEQ ID NO: 287516 - DNA, 25 bp, Mus musculus
actcggaggggagagccgagaccac

SEQ ID NO: 287517 - DNA, 25 bp, Mus musculus
ggcgggactggactcagtctcttcc

SEQ ID NO: 287518 - DNA, 25 bp, Mus musculus
aatcacccgggagccttctgggcga

SEQ ID NO: 287519 - DNA, 25 bp, Mus musculus
cccaaatctcgagtctgacgtcgcg

SEQ ID NO: 287520 - DNA, 25 bp, Mus musculus
ggagtcgccaatcacccgggagcct

SEQ ID NO: 287521 - DNA, 25 bp, Mus musculus
tcctggagtcgccaatcacccggga

SEQ ID NO: 287522 - DNA, 25 bp, Mus musculus
cttattcgacttttccctgcgtctc

SEQ ID NO: 287523 - DNA, 25 bp, Mus musculus
cgagtctgacgtcgcgccctcttat

SEQ ID NO: 287524 - DNA, 25 bp, Mus musculus
tgtgtccgcgtcagtgtctgtgtgt

SEQ ID NO: 287525 - DNA, 25 bp, Mus musculus
aagacacttagaacgctgtgcgggg

SEQ ID NO: 287526 - DNA, 25 bp, Mus musculus
gttgaagacacttagaacgctgtgc

SEQ ID NO: 287527 - DNA, 25 bp, Mus musculus
ggcggcttaaagttgaagacactta

SEQ ID NO: 287528 - DNA, 25 bp, Mus musculus
accctgagctaaggcggcttaaagt

SEQ ID NO: 287529 - DNA, 25 bp, Mus musculus
cgcaccctgagctaaggcggcttaa

SEQ ID NO: 287530 - DNA, 25 bp, Mus musculus
gtctccgcaccctgagctaaggcgg

SEQ ID NO: 287531 - DNA, 25 bp, Mus musculus
gtcgcgccctcttattcgacttttc

SEQ ID NO: 287532 - DNA, 25 bp, Mus musculus
gcgctacgggaaactttgaggcaaa

SEQ ID NO: 287533 - DNA, 25 bp, Mus musculus
tccagaggcgctacgggaaactttg

SEQ ID NO: 287534 - DNA, 25 bp, Mus musculus
cggcctcggagcatcccaggaggcg

SEQ ID NO: 287535 - DNA, 25 bp, Mus musculus
ggcacgtctgccgtgcaacgctggc

SEQ ID NO: 287536 - DNA, 25 bp, Mus musculus
gtgcaacgctggctgagccctgtaa

SEQ ID NO: 287537 - DNA, 25 bp, Mus musculus
tggctgagccctgtaagccgtcagg

SEQ ID NO: 287538 - DNA, 25 bp, Mus musculus
gcaaacttctttctcggagttaaga

SEQ ID NO: 287539 - DNA, 25 bp, Mus musculus
tttctcggagttaagagaggccgcc

SEQ ID NO: 287540 - DNA, 25 bp, Mus musculus
agaggccgccggtcagaaaggctgc

SEQ ID NO: 287541 - DNA, 25 bp, Mus musculus
ccaggccggatttgtacaccgccga

SEQ ID NO: 287542 - DNA, 25 bp, Mus musculus
cggatttgtacaccgccgaactggc

SEQ ID NO: 287543 - DNA, 25 bp, Mus musculus
cagaaggagcgcgaggctctccagc

SEQ ID NO: 287544 - DNA, 25 bp, Mus musculus
gggaaactttgaggcaaactttgca

SEQ ID NO: 287545 - DNA, 25 bp, Mus musculus
tccctggtccagaggcgctacggga

SEQ ID NO: 287546 - DNA, 25 bp, Mus musculus
tttcgcccacaggaggagcagagca

SEQ ID NO: 287547 - DNA, 25 bp, Mus musculus
tccacgcctctgacagcctgggttt

SEQ ID NO: 287548 - DNA, 25 bp, Mus musculus
gatcgccacatcctcggacaaggtc

SEQ ID NO: 287549 - DNA, 25 bp, Mus musculus
taaggagtcgtcctccgaaggccgc

SEQ ID NO: 287550 - DNA, 25 bp, Mus musculus
ccgcaaccgctcgtctggcggaaga

SEQ ID NO: 287551 - DNA, 25 bp, Mus musculus
cgtgctagccaagcccaaactgtgg

SEQ ID NO: 287552 - DNA, 25 bp, Mus musculus
caaactgtggtctctggccgagatc

SEQ ID NO: 287553 - DNA, 25 bp, Mus musculus
gctgtcccggcctctttattacacg

SEQ ID NO: 287554 - DNA, 25 bp, Mus musculus
atggctccttcggacatcttcacgg

SEQ ID NO: 287555 - DNA, 25 bp, Mus musculus
gggtcctggctctcatttcaatgga

SEQ ID NO: 287556 - DNA, 25 bp, Mus musculus
taaaccagacggtgttgaatcgtgc

SEQ ID NO: 287557 - DNA, 25 bp, Mus musculus
tcgtgcggacgttttggctaaagac

SEQ ID NO: 287558 - DNA, 25 bp, Mus musculus
gacgagccacagaagcccgaggaca

SEQ ID NO: 287559 - DNA, 25 bp, Mus musculus
atccgggctacacgaactatggctc

SEQ ID NO: 287560 - DNA, 25 bp, Mus musculus
gcttcagcagccgaccgcttctggt

SEQ ID NO: 287561 - DNA, 25 bp, Mus musculus
tttcgcgtgccgatcagtctagctc

SEQ ID NO: 287562 - DNA, 25 bp, Mus musculus
gtctgttttgccttctcactgtgtg

SEQ ID NO: 287563 - DNA, 25 bp, Mus musculus
gtcccaaagcttcagtgcgtttgta

SEQ ID NO: 287564 - DNA, 25 bp, Mus musculus
tgtgtattgttacgctccagcctgc

SEQ ID NO: 287565 - DNA, 25 bp, Mus musculus
gcttgctggctagtgagaatcatta

SEQ ID NO: 287566 - DNA, 25 bp, Mus musculus
gcggaacctgtatcctgagtgctaa

SEQ ID NO: 287567 - DNA, 25 bp, Mus musculus
taggcctagaggttcttggagaatg

SEQ ID NO: 287568 - DNA, 25 bp, Mus musculus
ggctaatggagaccaacgcccaatc

SEQ ID NO: 287569 - DNA, 25 bp, Mus musculus
acgtcatccagaggaggggctaatg

SEQ ID NO: 287570 - DNA, 25 bp, Mus musculus
ccgagggaagcggattacgtcatcc

SEQ ID NO: 287571 - DNA, 25 bp, Mus musculus
ggtctccatgacaatacgcagccaa

SEQ ID NO: 287572 - DNA, 25 bp, Mus musculus
tggaccagagccgagacactgatgc

SEQ ID NO: 287573 - DNA, 25 bp, Mus musculus
tcagaagtcttcgtcctggaccaga

SEQ ID NO: 287574 - DNA, 25 bp, Mus musculus
taaagaacggcatttggctcaaagc

SEQ ID NO: 287575 - DNA, 25 bp, Mus musculus
aaagccgcgtcttgctgggatcgcc

SEQ ID NO: 287576 - DNA, 25 bp, Mus musculus
attcagcttcactcgagccgcgggc

SEQ ID NO: 287577 - DNA, 25 bp, Mus musculus
ttcgcggcccttgcaaacttgagca

SEQ ID NO: 287578 - DNA, 25 bp, Mus musculus
gccgctgccttctcttacgtggtga

SEQ ID NO: 287579 - DNA, 25 bp, Mus musculus
cacggatgagctcggccgctcttct

SEQ ID NO: 287580 - DNA, 25 bp, Mus musculus
tacagcaccagcgtcatttcggggc

SEQ ID NO: 287581 - DNA, 25 bp, Mus musculus
tacccgcagggctacttgtaccagc

SEQ ID NO: 287582 - DNA, 25 bp, Mus musculus
atgcccgtgtgtggccatgtcctac

SEQ ID NO: 287583 - DNA, 25 bp, Mus musculus
agagaaagcctagcccgggcaagcg

SEQ ID NO: 287584 - DNA, 25 bp, Mus musculus
ttagcatcttggcaggacctttgca

SEQ ID NO: 287585 - DNA, 25 bp, Mus musculus
aaggcgtcagaatcctcaatttcca

SEQ ID NO: 287586 - DNA, 25 bp, Mus musculus
ttcgcgcgcacacaaggcgtcagaa

SEQ ID NO: 287587 - DNA, 25 bp, Mus musculus
tggctcaaagctctgggacaacccg

SEQ ID NO: 287588 - DNA, 25 bp, Mus musculus
tgcaactcttcgcagccctggtgta

SEQ ID NO: 287589 - DNA, 25 bp, Mus musculus
gcaaatgtaaatgtgcacttattta

SEQ ID NO: 287590 - DNA, 25 bp, Mus musculus
gcacttatttaattggatcaggccc

SEQ ID NO: 287591 - DNA, 25 bp, Mus musculus
cccgcctgatggatgcaaatgtaaa

SEQ ID NO: 287592 - DNA, 25 bp, Mus musculus
tctgcttttatttgctccgagcaaa

SEQ ID NO: 287593 - DNA, 25 bp, Mus musculus
tcccagtgaaatctgcttttatttg

SEQ ID NO: 287594 - DNA, 25 bp, Mus musculus
gcccagacgtcactttcccagtgaa

SEQ ID NO: 287595 - DNA, 25 bp, Mus musculus
gcagcgctgctttctgacgccggaa

SEQ ID NO: 287596 - DNA, 25 bp, Mus musculus
tcgcagccctggtgtacagaaaggc

SEQ ID NO: 287597 - DNA, 25 bp, Mus musculus
tctgaggcatgcagcgcctcgtgga

SEQ ID NO: 287598 - DNA, 25 bp, Mus musculus
acttcttttctgaggcatgcagcgc

SEQ ID NO: 287599 - DNA, 25 bp, Mus musculus
tttctgacgccggaatgagcccagc

SEQ ID NO: 287600 - DNA, 25 bp, Mus musculus
cccgtttgctaacttcttttctgag

SEQ ID NO: 287601 - DNA, 25 bp, Mus musculus
tggtgtacagaaaggcccgcgccac

SEQ ID NO: 287602 - DNA, 25 bp, Mus musculus
cccgctgattgattttcccgccgaa

SEQ ID NO: 287603 - DNA, 25 bp, Mus musculus
gcggtccggctgtaattgctcccag

SEQ ID NO: 287604 - DNA, 25 bp, Mus musculus
ctcccagcccgggattgtgcaaagc

SEQ ID NO: 287605 - DNA, 25 bp, Mus musculus
cgcgttttatctggcgcggtgaata

SEQ ID NO: 287606 - DNA, 25 bp, Mus musculus
tgcgccgctgctttgcagtcaaacg

SEQ ID NO: 287607 - DNA, 25 bp, Mus musculus
cgccggccgctgtgatttattattt

SEQ ID NO: 287608 - DNA, 25 bp, Mus musculus
ggctgctcgcagaactgttacaatc

SEQ ID NO: 287609 - DNA, 25 bp, Mus musculus
gccgtgccatgaaatcccagcgctg

SEQ ID NO: 287610 - DNA, 25 bp, Mus musculus
gctgctctcaaagcggctgcggaaa

SEQ ID NO: 287611 - DNA, 25 bp, Mus musculus
ttcccgcaacaagagcccgcgtttg

SEQ ID NO: 287612 - DNA, 25 bp, Mus musculus
gcgaccacaaagttttcctgccttg

SEQ ID NO: 287613 - DNA, 25 bp, Mus musculus
tcctgccttggaagttttcaaacgc

SEQ ID NO: 287614 - DNA, 25 bp, Mus musculus
tttcaaacgcgctaggctgatccga

SEQ ID NO: 287615 - DNA, 25 bp, Mus musculus
tttattatttaccagcgcgcggccg

SEQ ID NO: 287616 - DNA, 25 bp, Mus musculus
tgcgtggttgctccggggccatttc

SEQ ID NO: 287617 - DNA, 25 bp, Mus musculus
ggtgccacagccttggtgcttcttt

SEQ ID NO: 287618 - DNA, 25 bp, Mus musculus
agggctctctgctgtctagctctcc

SEQ ID NO: 287619 - DNA, 25 bp, Mus musculus
ctgggaaggtactctcagggctctc

SEQ ID NO: 287620 - DNA, 25 bp, Mus musculus
tccagacctgggaaggtactctcag

SEQ ID NO: 287621 - DNA, 25 bp, Mus musculus
atggcagctcctggcccgtcatgct

SEQ ID NO: 287622 - DNA, 25 bp, Mus musculus
cacagccttggtgcttctttgcgcg

SEQ ID NO: 287623 - DNA, 25 bp, Mus musculus
ccctaagcagcgttccacacgggag

SEQ ID NO: 287624 - DNA, 25 bp, Mus musculus
tttccgggattgcaaagccggaggc

SEQ ID NO: 287625 - DNA, 25 bp, Mus musculus
acgatcaggcagctgcgtggttgct

SEQ ID NO: 287626 - DNA, 25 bp, Mus musculus
tcgggccagacgatcaggcagctgc

SEQ ID NO: 287627 - DNA, 25 bp, Mus musculus
gcagcgttccacacgggaggtgcaa

SEQ ID NO: 287628 - DNA, 25 bp, Mus musculus
gcactgagtcgccatggcagctcct

SEQ ID NO: 287629 - DNA, 25 bp, Mus musculus
tctttgcgcggtccttcacggacga

SEQ ID NO: 287630 - DNA, 25 bp, Mus musculus
ctgcaggcgaaagagggtaggatct

SEQ ID NO: 287631 - DNA, 25 bp, Mus musculus
gtgtatccgagagtgcgtgcatgta

SEQ ID NO: 287632 - DNA, 25 bp, Mus musculus
caagaacgagtgtatccgagagtgc

SEQ ID NO: 287633 - DNA, 25 bp, Mus musculus
tcgcagagcaagaacgagtgtatcc

SEQ ID NO: 287634 - DNA, 25 bp, Mus musculus
gtctttgacgtttctcgcccgttgc

SEQ ID NO: 287635 - DNA, 25 bp, Mus musculus
ggctcgccgggaggcgtatttccca

SEQ ID NO: 287636 - DNA, 25 bp, Mus musculus
cgtgcatgtacacgggctggctgcc

SEQ ID NO: 287637 - DNA, 25 bp, Mus musculus
gctggctgcccttggcacactcggt

SEQ ID NO: 287638 - DNA, 25 bp, Mus musculus
cggggattaccgtgacgtcacgttg

SEQ ID NO: 287639 - DNA, 25 bp, Mus musculus
gtgacgtcacgttgagcctctggcc

SEQ ID NO: 287640 - DNA, 25 bp, Mus musculus
ctctggccaccttggactgggacac

SEQ ID NO: 287641 - DNA, 25 bp, Mus musculus
actgggacacctcgggaacctcaca

SEQ ID NO: 287642 - DNA, 25 bp, Mus musculus
cagcccgacgctgcgctgtacctca

SEQ ID NO: 287643 - DNA, 25 bp, Mus musculus
ccgttgcacaaacctcgcagagcaa

SEQ ID NO: 287644 - DNA, 25 bp, Mus musculus
cgtgggaccccgttatgagctcctg

SEQ ID NO: 287645 - DNA, 25 bp, Mus musculus
gccgcgccatcgctgcaccatcgcc

SEQ ID NO: 287646 - DNA, 25 bp, Mus musculus
ctctgcgtcctgtgctgcctgttgg

SEQ ID NO: 287647 - DNA, 25 bp, Mus musculus
ctggccggacctctgcgggttctct

SEQ ID NO: 287648 - DNA, 25 bp, Mus musculus
caacgatggaggcacgagtggcctg

SEQ ID NO: 287649 - DNA, 25 bp, Mus musculus
cccgggagcgcaacgatggaggcac

SEQ ID NO: 287650 - DNA, 25 bp, Mus musculus
agccagagacctcagggtgacacgc

SEQ ID NO: 287651 - DNA, 25 bp, Mus musculus
gtagagtaaggggatcgccgtgcag

SEQ ID NO: 287652 - DNA, 25 bp, Mus musculus
ccgttatgagctcctgagccccgag

SEQ ID NO: 287653 - DNA, 25 bp, Mus musculus
catcatcaagttccccggcgatgtc

SEQ ID NO: 287654 - DNA, 25 bp, Mus musculus
agtggtgtgtattgggacgtgggac

SEQ ID NO: 287655 - DNA, 25 bp, Mus musculus
tgcaccatcgcccatcatcaagttc

SEQ ID NO: 287656 - DNA, 25 bp, Mus musculus
aagcagaggcagtagagtaagggga

SEQ ID NO: 287657 - DNA, 25 bp, Mus musculus
tgtgctgcctgttgggccgcgccat

SEQ ID NO: 287658 - DNA, 25 bp, Mus musculus
gaattcggccgctctcttcgggtcc

SEQ ID NO: 287659 - DNA, 25 bp, Mus musculus
cagctagtggctaggtgactctggc

SEQ ID NO: 287660 - DNA, 25 bp, Mus musculus
ctttgctcgggtcgggcacctggat

SEQ ID NO: 287661 - DNA, 25 bp, Mus musculus
tggatccatcatgaaccgatgcgcc

SEQ ID NO: 287662 - DNA, 25 bp, Mus musculus
ggactgtgaattcggccgctctctt

SEQ ID NO: 287663 - DNA, 25 bp, Mus musculus
ttctgaggttgggactgtgaattcg

SEQ ID NO: 287664 - DNA, 25 bp, Mus musculus
tctctggttctgaggttgggactgt

SEQ ID NO: 287665 - DNA, 25 bp, Mus musculus
tggtacctcgccaggcgtccttctt

SEQ ID NO: 287666 - DNA, 25 bp, Mus musculus
ttcgtccagcagactacgatcagtg

SEQ ID NO: 287667 - DNA, 25 bp, Mus musculus
gactacgatcagtgcctcccgaagg

SEQ ID NO: 287668 - DNA, 25 bp, Mus musculus
cagtgcctcccgaaggctgcaggta

SEQ ID NO: 287669 - DNA, 25 bp, Mus musculus
tcccgaaggctgcaggtaaaggcaa

SEQ ID NO: 287670 - DNA, 25 bp, Mus musculus
atcatgaaccgatgcgccgaggcgg

SEQ ID NO: 287671 - DNA, 25 bp, Mus musculus
gtcgggcacctggatccatcatgaa

SEQ ID NO: 287672 - DNA, 25 bp, Mus musculus
tgtttttcttgcgtggcggcgcaca

SEQ ID NO: 287673 - DNA, 25 bp, Mus musculus
acgcgacggcacttccggtgcgagc

SEQ ID NO: 287674 - DNA, 25 bp, Mus musculus
ctcgcccaggtaccctttcggatgg

SEQ ID NO: 287675 - DNA, 25 bp, Mus musculus
ggtacttcccggctggtcctgcgtc

SEQ ID NO: 287676 - DNA, 25 bp, Mus musculus
ccagagtttcctgtgggcgtttcct

SEQ ID NO: 287677 - DNA, 25 bp, Mus musculus
ggggccagccttgtgtttttcttgc

SEQ ID NO: 287678 - DNA, 25 bp, Mus musculus
cggtatcggtctggaatctgcttta

SEQ ID NO: 287679 - DNA, 25 bp, Mus musculus
tctgctttagggctgctgtcccgag

SEQ ID NO: 287680 - DNA, 25 bp, Mus musculus
ctgtcccgaggctccgaaggtctct

SEQ ID NO: 287681 - DNA, 25 bp, Mus musculus
aggtctctggacgtggaccgtatcc

SEQ ID NO: 287682 - DNA, 25 bp, Mus musculus
gtatccgggcttagcctcgcccagg

SEQ ID NO: 287683 - DNA, 25 bp, Mus musculus
cagcctagcggggtgttttcccgag

SEQ ID NO: 287684 - DNA, 25 bp, Mus musculus
gacccggaggcacgcgacggcactt

SEQ ID NO: 287685 - DNA, 25 bp, Mus musculus
taccctttcggatggatggctgcag

SEQ ID NO: 287686 - DNA, 25 bp, Mus musculus
gctgcaccctctagagtgtccctga

SEQ ID NO: 287687 - DNA, 25 bp, Mus musculus
ggggcacaggctacattaccaggtc

SEQ ID NO: 287688 - DNA, 25 bp, Mus musculus
tccctgaaggttcctagtgctgtcg

SEQ ID NO: 287689 - DNA, 25 bp, Mus musculus
gggcccgcaggaaacttggcattta

SEQ ID NO: 287690 - DNA, 25 bp, Mus musculus
tcggacgcgcgtcacaactcagtct

SEQ ID NO: 287691 - DNA, 25 bp, Mus musculus
aggcgctccttttcttggaagctgg

SEQ ID NO: 287692 - DNA, 25 bp, Mus musculus
gggagtccgctcagccctaagatcc

SEQ ID NO: 287693 - DNA, 25 bp, Mus musculus
ctaagatcctgacgtctgggctccc

SEQ ID NO: 287694 - DNA, 25 bp, Mus musculus
cggcaagccttgttgactgcttttt

SEQ ID NO: 287695 - DNA, 25 bp, Mus musculus
gcacccatgcttctggcgcgaatga

SEQ ID NO: 287696 - DNA, 25 bp, Mus musculus
gaggccctgcaaaaccgccgatcta

SEQ ID NO: 287697 - DNA, 25 bp, Mus musculus
tctactagtggtgaaggaacgcaac

SEQ ID NO: 287698 - DNA, 25 bp, Mus musculus
acgcaacggagtccagtgcctcttg

SEQ ID NO: 287699 - DNA, 25 bp, Mus musculus
gggctaatgcaataggcgcgttacc

SEQ ID NO: 287700 - DNA, 25 bp, Mus musculus
cagcgccgccaaagacgtgaaatta

SEQ ID NO: 287701 - DNA, 25 bp, Mus musculus
ccaccatgggatgtacgctgagcgc

SEQ ID NO: 287702 - DNA, 25 bp, Mus musculus
cggcgatgcacatgcactagcggca

SEQ ID NO: 287703 - DNA, 25 bp, Mus musculus
tactcctgctgggtaaggacctggg

SEQ ID NO: 287704 - DNA, 25 bp, Mus musculus
aaacctcaaagaagatggcatcagc

SEQ ID NO: 287705 - DNA, 25 bp, Mus musculus
ccaaggagaggatatcgtgattttc

SEQ ID NO: 287706 - DNA, 25 bp, Mus musculus
cgacaattttgttcccagccaagga

SEQ ID NO: 287707 - DNA, 25 bp, Mus musculus
ggattctggtctttcgacaattttg

SEQ ID NO: 287708 - DNA, 25 bp, Mus musculus
cgctggaatcttaatagaggctgtc

SEQ ID NO: 287709 - DNA, 25 bp, Mus musculus
gccgctaatcttcgccgctggaatc

SEQ ID NO: 287710 - DNA, 25 bp, Mus musculus
cgtgcactagcctcggtgcctgcaa

SEQ ID NO: 287711 - DNA, 25 bp, Mus musculus
atttattttgggtcgtgcactagcc

SEQ ID NO: 287712 - DNA, 25 bp, Mus musculus
ggatccagcctcgactcctatttta

SEQ ID NO: 287713 - DNA, 25 bp, Mus musculus
cggagcaaggcgattgagaaaaacc

SEQ ID NO: 287714 - DNA, 25 bp, Mus musculus
aatccactgtggcaggccgggagtc

SEQ ID NO: 287715 - DNA, 25 bp, Mus musculus
cagcgcccagccgaggctggaaaag

SEQ ID NO: 287716 - DNA, 25 bp, Mus musculus
ccagccgaggctggaaaagtcgatg

SEQ ID NO: 287717 - DNA, 25 bp, Mus musculus
gctcggaggatctcgacagtgttcg

SEQ ID NO: 287718 - DNA, 25 bp, Mus musculus
ttcggagcacagtcggggtccaagc

SEQ ID NO: 287719 - DNA, 25 bp, Mus musculus
cgttgtaagtggtggacagcgccca

SEQ ID NO: 287720 - DNA, 25 bp, Mus musculus
agtccggtagaagcctcggcctcct

SEQ ID NO: 287721 - DNA, 25 bp, Mus musculus
tctcgacagtgttcggagcacagtc

SEQ ID NO: 287722 - DNA, 25 bp, Mus musculus
caagtctgtaatccactgtggcagg

SEQ ID NO: 287723 - DNA, 25 bp, Mus musculus
ggtttcgaaacttcacaagtctgta

SEQ ID NO: 287724 - DNA, 25 bp, Mus musculus
taggggcaggtttcgaaacttcaca

SEQ ID NO: 287725 - DNA, 25 bp, Mus musculus
gggaaatgcaaaccgcgccacctct

SEQ ID NO: 287726 - DNA, 25 bp, Mus musculus
cgtgtcgggaaatgcaaaccgcgcc

SEQ ID NO: 287727 - DNA, 25 bp, Mus musculus
tttcaggcgttgtaagtggtggaca

SEQ ID NO: 287728 - DNA, 25 bp, Mus musculus
taaaccggacgtgtcgcggcttctc

SEQ ID NO: 287729 - DNA, 25 bp, Mus musculus
aggcgctgacgatggtgcccagcaa

SEQ ID NO: 287730 - DNA, 25 bp, Mus musculus
tccgacagcaggtactgggccacgt

SEQ ID NO: 287731 - DNA, 25 bp, Mus musculus
cacacgaacaggctgtccgacagca

SEQ ID NO: 287732 - DNA, 25 bp, Mus musculus
gataatgggtgacatggcggctccc

SEQ ID NO: 287733 - DNA, 25 bp, Mus musculus
gtcgcggcttctcacagcctcgggt

SEQ ID NO: 287734 - DNA, 25 bp, Mus musculus
ttaaatagcgcccatcgggactaac

SEQ ID NO: 287735 - DNA, 25 bp, Mus musculus
caacaacgccgagctaaaccggacg

SEQ ID NO: 287736 - DNA, 25 bp, Mus musculus
ctaacttcggccttctcttcgtcgg

SEQ ID NO: 287737 - DNA, 25 bp, Mus musculus
tgtctggcgaagagtaaaatgtccc

SEQ ID NO: 287738 - DNA, 25 bp, Mus musculus
gcaccatttcgaagttgtctggcga

SEQ ID NO: 287739 - DNA, 25 bp, Mus musculus
cgcattgacaaatagcaccatttcg

SEQ ID NO: 287740 - DNA, 25 bp, Mus musculus
ccctgcggataatgggtgacatggc

SEQ ID NO: 287741 - DNA, 25 bp, Mus musculus
gcccatcgggactaacgcattgaca

SEQ ID NO: 287742 - DNA, 25 bp, Mus musculus
agcgcgcatcccggaagggacaacc

SEQ ID NO: 287743 - DNA, 25 bp, Mus musculus
cgcgcactgggagagcatcaacggc

SEQ ID NO: 287744 - DNA, 25 bp, Mus musculus
gaaaactgccaagtcggggtcgaga

SEQ ID NO: 287745 - DNA, 25 bp, Mus musculus
caagtcggggtcgagaaacaggtct

SEQ ID NO: 287746 - DNA, 25 bp, Mus musculus
ggtcgagaaacaggtctaggaaaga

SEQ ID NO: 287747 - DNA, 25 bp, Mus musculus
tcgagaaacaggtctaggaaagaaa

SEQ ID NO: 287748 - DNA, 25 bp, Mus musculus
gagaaacaggtctaggaaagaaagc

SEQ ID NO: 287749 - DNA, 25 bp, Mus musculus
gaaacaggtctaggaaagaaagcgc

SEQ ID NO: 287750 - DNA, 25 bp, Mus musculus
gaaagcgcgcatcccggaagggaca

SEQ ID NO: 287751 - DNA, 25 bp, Mus musculus
cggaagggacaacccgcatccggcg

SEQ ID NO: 287752 - DNA, 25 bp, Mus musculus
agggacaacccgcatccggcgtgag

SEQ ID NO: 287753 - DNA, 25 bp, Mus musculus
gacaacccgcatccggcgtgaggga

SEQ ID NO: 287754 - DNA, 25 bp, Mus musculus
agcgcgcactgggagagcatcaacg

SEQ ID NO: 287755 - DNA, 25 bp, Mus musculus
aacaggtctaggaaagaaagcgcgc

SEQ ID NO: 287756 - DNA, 25 bp, Mus musculus
cggaagtgaatacgctccggaggca

SEQ ID NO: 287757 - DNA, 25 bp, Mus musculus
tttgaccaattgctggcggcgtgac

SEQ ID NO: 287758 - DNA, 25 bp, Mus musculus
aatacgctccggaggcaggaagttg

SEQ ID NO: 287759 - DNA, 25 bp, Mus musculus
ggccgcgccgcacttacagattaat

SEQ ID NO: 287760 - DNA, 25 bp, Mus musculus
gcgcggaacacacgccggaagtgaa

SEQ ID NO: 287761 - DNA, 25 bp, Mus musculus
tcgagagcaagaggcgcggaacaca

SEQ ID NO: 287762 - DNA, 25 bp, Mus musculus
cacccgccattaacagtcgagagca

SEQ ID NO: 287763 - DNA, 25 bp, Mus musculus
catgctgaacagctccgacgccggg

SEQ ID NO: 287764 - DNA, 25 bp, Mus musculus
ggcggcaccacagacatgctgaaca

SEQ ID NO: 287765 - DNA, 25 bp, Mus musculus
tctgcgagcgattgggcggcaccac

SEQ ID NO: 287766 - DNA, 25 bp, Mus musculus
tacttgttgccgaactggttgaccc

SEQ ID NO: 287767 - DNA, 25 bp, Mus musculus
cttggtctgctggatgtacttgttg

SEQ ID NO: 287768 - DNA, 25 bp, Mus musculus
gcggttatctgcgtcccgctcagca

SEQ ID NO: 287769 - DNA, 25 bp, Mus musculus
gcaggccactgcgaccatttgacca

SEQ ID NO: 287770 - DNA, 25 bp, Mus musculus
gctgtcactgaagaaatcctgagga

SEQ ID NO: 287771 - DNA, 25 bp, Mus musculus
caccgtgagaagatgaacgggaagc

SEQ ID NO: 287772 - DNA, 25 bp, Mus musculus
cgcggccaatgaagaagggaaagaa

SEQ ID NO: 287773 - DNA, 25 bp, Mus musculus
agaagcaggtatcggcagagttttc

SEQ ID NO: 287774 - DNA, 25 bp, Mus musculus
atcggcagagttttcggacgctgtc

SEQ ID NO: 287775 - DNA, 25 bp, Mus musculus
ggtctgtgcaccgtgagaagatgaa

SEQ ID NO: 287776 - DNA, 25 bp, Mus musculus
cctgacttccttggcgtgggtctgt

SEQ ID NO: 287777 - DNA, 25 bp, Mus musculus
tggggaggatcgcagccacctccga

SEQ ID NO: 287778 - DNA, 25 bp, Mus musculus
ttcggacgctgtcactgaagaaatc

SEQ ID NO: 287779 - DNA, 25 bp, Mus musculus
cggacaccgttcagccatggtaatg

SEQ ID NO: 287780 - DNA, 25 bp, Mus musculus
aggcctggagctgccggacaccgtt

SEQ ID NO: 287781 - DNA, 25 bp, Mus musculus
tcagccatggtaatggggtgctgta

SEQ ID NO: 287782 - DNA, 25 bp, Mus musculus
agaaatcctgaggaagcaggtggct

SEQ ID NO: 287783 - DNA, 25 bp, Mus musculus
gatcctggcccagcgcggccaatga

SEQ ID NO: 287784 - DNA, 25 bp, Mus musculus
gcccgcatcgtgctagcccagtgga

SEQ ID NO: 287785 - DNA, 25 bp, Mus musculus
gagaaaggaatcgtgtgagcgctca

SEQ ID NO: 287786 - DNA, 25 bp, Mus musculus
ctcgcggcgcgcagagaaaggaatc

SEQ ID NO: 287787 - DNA, 25 bp, Mus musculus
actgagggcactcgcaggcgctgct

SEQ ID NO: 287788 - DNA, 25 bp, Mus musculus
aataatggctactgagggcactcgc

SEQ ID NO: 287789 - DNA, 25 bp, Mus musculus
ccactcggtctttaggcgcctagga

SEQ ID NO: 287790 - DNA, 25 bp, Mus musculus
cagtgacctggccacagcggtgaga

SEQ ID NO: 287791 - DNA, 25 bp, Mus musculus
gtgagagccgcgagagcgtctcctt

SEQ ID NO: 287792 - DNA, 25 bp, Mus musculus
tgctagcccagtggacgtggccaca

SEQ ID NO: 287793 - DNA, 25 bp, Mus musculus
ggacgtggccacaaggccgtctcta

SEQ ID NO: 287794 - DNA, 25 bp, Mus musculus
cccggcggccagtgaataatggcta

SEQ ID NO: 287795 - DNA, 25 bp, Mus musculus
gaacctcgcagcagtgacctggcca

SEQ ID NO: 287796 - DNA, 25 bp, Mus musculus
tttaggcgcctaggaacctcgcagc

SEQ ID NO: 287797 - DNA, 25 bp, Mus musculus
aggccgtctctaattacctcctgtc

SEQ ID NO: 287798 - DNA, 25 bp, Mus musculus
gtcgtagcgccctatggccaccatg

SEQ ID NO: 287799 - DNA, 25 bp, Mus musculus
gggctgattttgtggcgcagtttca

SEQ ID NO: 287800 - DNA, 25 bp, Mus musculus
tttcagagtgaacacaggcagcagc

SEQ ID NO: 287801 - DNA, 25 bp, Mus musculus
cggaagacagatgcccgacgcaggc

SEQ ID NO: 287802 - DNA, 25 bp, Mus musculus
gatcggtgtcgccaactctctctac

SEQ ID NO: 287803 - DNA, 25 bp, Mus musculus
gcagcagcatgatggcgccagctag

SEQ ID NO: 287804 - DNA, 25 bp, Mus musculus
caggcgcaaggcaagcagcttggcc

SEQ ID NO: 287805 - DNA, 25 bp, Mus musculus
cggaagcgcagactagagcgcgatc

SEQ ID NO: 287806 - DNA, 25 bp, Mus musculus
ggcagagctacgcaagtcccaacta

SEQ ID NO: 287807 - DNA, 25 bp, Mus musculus
caactagctcctgcgactgcgcagt

SEQ ID NO: 287808 - DNA, 25 bp, Mus musculus
cctgcgttctttgtctgtcctcgga

SEQ ID NO: 287809 - DNA, 25 bp, Mus musculus
cggcagccaagcacgggtgagtccc

SEQ ID NO: 287810 - DNA, 25 bp, Mus musculus
agcggttaccttgcccgcttgggtg

SEQ ID NO: 287811 - DNA, 25 bp, Mus musculus
ggaggtaaatacacgcaggactgcg

SEQ ID NO: 287812 - DNA, 25 bp, Mus musculus
ccgcttgcagaattcgggtcgtgcg

SEQ ID NO: 287813 - DNA, 25 bp, Mus musculus
caaaccgatctctcgtcgatcttca

SEQ ID NO: 287814 - DNA, 25 bp, Mus musculus
gctcctagaactcttcaaaccgatc

SEQ ID NO: 287815 - DNA, 25 bp, Mus musculus
cgctataaaggtcgcgctccgcgtg

SEQ ID NO: 287816 - DNA, 25 bp, Mus musculus
gacccaatactctccgctataaagg

SEQ ID NO: 287817 - DNA, 25 bp, Mus musculus
ggcggagcttttgcgctcgacccaa

SEQ ID NO: 287818 - DNA, 25 bp, Mus musculus
gtgtgctggccatatcccttgagcc

SEQ ID NO: 287819 - DNA, 25 bp, Mus musculus
ccacgagcaaaaagagggccgcttg

SEQ ID NO: 287820 - DNA, 25 bp, Mus musculus
gtgcaggctctgtcccacgagcaaa

SEQ ID NO: 287821 - DNA, 25 bp, Mus musculus
ggatcgcagaccctttgcgctcagc

SEQ ID NO: 287822 - DNA, 25 bp, Mus musculus
gaaccggttcccaccggatcgcaga

SEQ ID NO: 287823 - DNA, 25 bp, Mus musculus
gccagaggtctcgtcgctcagcatc

SEQ ID NO: 287824 - DNA, 25 bp, Mus musculus
cttgagccagaaaaagggcgtgtgc

SEQ ID NO: 287825 - DNA, 25 bp, Mus musculus
caagcaggtgtcctggaaccggttc

SEQ ID NO: 287826 - DNA, 25 bp, Mus musculus
accgcctgctgggtgcaaacccttt

SEQ ID NO: 287827 - DNA, 25 bp, Mus musculus
tccagagcagcgataggccgtaata

SEQ ID NO: 287828 - DNA, 25 bp, Mus musculus
tccacacgtcacatgggtcgtccta

SEQ ID NO: 287829 - DNA, 25 bp, Mus musculus
gtcgtcctatccgagccagtcgtgc

SEQ ID NO: 287830 - DNA, 25 bp, Mus musculus
cgaaaagtgcgctcggctctgccaa

SEQ ID NO: 287831 - DNA, 25 bp, Mus musculus
cgctgcgaatgggtttacggagata

SEQ ID NO: 287832 - DNA, 25 bp, Mus musculus
gcccggactcgtccaacgactataa

SEQ ID NO: 287833 - DNA, 25 bp, Mus musculus
gcaggctgtcctctaagcgtcacca

SEQ ID NO: 287834 - DNA, 25 bp, Mus musculus
gtagctccagcttcaccagatctcg

SEQ ID NO: 287835 - DNA, 25 bp, Mus musculus
ctcccgatccttggtctttagaata

SEQ ID NO: 287836 - DNA, 25 bp, Mus musculus
ggcacctttagttggcgattcattc

SEQ ID NO: 287837 - DNA, 25 bp, Mus musculus
tccgctcttgcaaaagccttcatta

SEQ ID NO: 287838 - DNA, 25 bp, Mus musculus
cgagtattgtcgaacgggtcctttg

SEQ ID NO: 287839 - DNA, 25 bp, Mus musculus
gggagctctgcactccgcccgaaaa

SEQ ID NO: 287840 - DNA, 25 bp, Mus musculus
aacaccgagcctagttcgaagaggc

SEQ ID NO: 287841 - DNA, 25 bp, Mus musculus
gggccgttcttctagagaatggctc

SEQ ID NO: 287842 - DNA, 25 bp, Mus musculus
ctccttttacggagaatccgacagg

SEQ ID NO: 287843 - DNA, 25 bp, Mus musculus
ctgtcaactttaatctccttttacg

SEQ ID NO: 287844 - DNA, 25 bp, Mus musculus
ctagagaatggctcttccgggtgaa

SEQ ID NO: 287845 - DNA, 25 bp, Mus musculus
gaagaggctcgtgcttcctctcttg

SEQ ID NO: 287846 - DNA, 25 bp, Mus musculus
gcctgactgccctctttggggcgtg

SEQ ID NO: 287847 - DNA, 25 bp, Mus musculus
tgactaggctcttccgagcgtggtc

SEQ ID NO: 287848 - DNA, 25 bp, Mus musculus
gactgctcgccgagtgctgtgacta

SEQ ID NO: 287849 - DNA, 25 bp, Mus musculus
tcctctcttgctgtagctgggcatg

SEQ ID NO: 287850 - DNA, 25 bp, Mus musculus
gggcttctgggagcttactgcctca

SEQ ID NO: 287851 - DNA, 25 bp, Mus musculus
ccgacaggatgctaatgattgccgc

SEQ ID NO: 287852 - DNA, 25 bp, Mus musculus
ctggccttgaagcagaacaccgagc

SEQ ID NO: 287853 - DNA, 25 bp, Mus musculus
ggagcttactgcctcagccaatcag

SEQ ID NO: 287854 - DNA, 25 bp, Mus musculus
gcctcctgcgaactccgctcgcccg

SEQ ID NO: 287855 - DNA, 25 bp, Mus musculus
ggcagcgcgtgaaccccgcggtttc

SEQ ID NO: 287856 - DNA, 25 bp, Mus musculus
gccagctccgcgttccctgcattca

SEQ ID NO: 287857 - DNA, 25 bp, Mus musculus
cctgcattcactcccgcagatgctc

SEQ ID NO: 287858 - DNA, 25 bp, Mus musculus
cagtgtccctctcccttcagcgcca

SEQ ID NO: 287859 - DNA, 25 bp, Mus musculus
agccacagcctagggctcgggtccg

SEQ ID NO: 287860 - DNA, 25 bp, Mus musculus
tcccgcgcccactgccgttaccggc

SEQ ID NO: 287861 - DNA, 25 bp, Mus musculus
gacgctccggcacgtgacggccgac

SEQ ID NO: 287862 - DNA, 25 bp, Mus musculus
aggctctctgcgtgcactcgcgcgg

SEQ ID NO: 287863 - DNA, 25 bp, Mus musculus
acagccaggcgcctgggacgctccg

SEQ ID NO: 287864 - DNA, 25 bp, Mus musculus
acgggctgcggacaagccaatcggc

SEQ ID NO: 287865 - DNA, 25 bp, Mus musculus
gcacgcccacctgcgttgttgtgcg

SEQ ID NO: 287866 - DNA, 25 bp, Mus musculus
cccacctgcgttgttgtgcgggacc

SEQ ID NO: 287867 - DNA, 25 bp, Mus musculus
ttaccggccaggctctctgcgtgca

SEQ ID NO: 287868 - DNA, 25 bp, Mus musculus
catcccgcgctaaggagcctgaaca

SEQ ID NO: 287869 - DNA, 25 bp, Mus musculus
gcagttggagtgtgagtcgcctcaa

SEQ ID NO: 287870 - DNA, 25 bp, Mus musculus
cagcgccaccgcgacttggagctga

SEQ ID NO: 287871 - DNA, 25 bp, Mus musculus
ctggtgaagagtcccaatcagcgcc

SEQ ID NO: 287872 - DNA, 25 bp, Mus musculus
acgcagacatggagcccgagccaca

SEQ ID NO: 287873 - DNA, 25 bp, Mus musculus
agtcgagccgccagcgacgcagaca

SEQ ID NO: 287874 - DNA, 25 bp, Mus musculus
ccaagtgtcgttgtgtggtctcaga

SEQ ID NO: 287875 - DNA, 25 bp, Mus musculus
cgtgtcccaaagacgccaagtgtcg

SEQ ID NO: 287876 - DNA, 25 bp, Mus musculus
tggcagccacagagagcgctatctg

SEQ ID NO: 287877 - DNA, 25 bp, Mus musculus
ggccacgttggacactgacctctgt

SEQ ID NO: 287878 - DNA, 25 bp, Mus musculus
tttctccgggcgctgattgggccac

SEQ ID NO: 287879 - DNA, 25 bp, Mus musculus
caggatgacgcaaccacggcgggtt

SEQ ID NO: 287880 - DNA, 25 bp, Mus musculus
tcaaggcccacctgagccgagtcta

SEQ ID NO: 287881 - DNA, 25 bp, Mus musculus
ctgtcgggactcaggatgacgcaac

SEQ ID NO: 287882 - DNA, 25 bp, Mus musculus
tgcgatctccaagccgcggcgggtt

SEQ ID NO: 287883 - DNA, 25 bp, Mus musculus
gctggcactttgaatccacgtgatt

SEQ ID NO: 287884 - DNA, 25 bp, Mus musculus
atccacgtgatttctcggcagcggc

SEQ ID NO: 287885 - DNA, 25 bp, Mus musculus
tctcggcagcggcagtagagtctat

SEQ ID NO: 287886 - DNA, 25 bp, Mus musculus
cagcggcagtagagtctatgaacta

SEQ ID NO: 287887 - DNA, 25 bp, Mus musculus
agtctatgaactagcgaacagcgcc

SEQ ID NO: 287888 - DNA, 25 bp, Mus musculus
aactagcgaacagcgcccgctcagt

SEQ ID NO: 287889 - DNA, 25 bp, Mus musculus
ccgctcagtggccactttcagtttc

SEQ ID NO: 287890 - DNA, 25 bp, Mus musculus
ctttcagtttccacagagcgcggtg

SEQ ID NO: 287891 - DNA, 25 bp, Mus musculus
cagtttccacagagcgcggtggaga

SEQ ID NO: 287892 - DNA, 25 bp, Mus musculus
ctgaactggtgagttacctgcccaa

SEQ ID NO: 287893 - DNA, 25 bp, Mus musculus
actggtgagttacctgcccaagccg

SEQ ID NO: 287894 - DNA, 25 bp, Mus musculus
agttacctgcccaagccggggcgcg

SEQ ID NO: 287895 - DNA, 25 bp, Mus musculus
ccctggggctggcactttgaatcca

SEQ ID NO: 287896 - DNA, 25 bp, Mus musculus
cactgtgtgcgctcaagttcggcct

SEQ ID NO: 287897 - DNA, 25 bp, Mus musculus
cgactccctgctccaactggggaga

SEQ ID NO: 287898 - DNA, 25 bp, Mus musculus
aggacctggcgctactcgggatcag

SEQ ID NO: 287899 - DNA, 25 bp, Mus musculus
gcagccgccagcacaattgtttgga

SEQ ID NO: 287900 - DNA, 25 bp, Mus musculus
ggagaccctcttccaccgttagatg

SEQ ID NO: 287901 - DNA, 25 bp, Mus musculus
ctggctagctatttaggagaccctc

SEQ ID NO: 287902 - DNA, 25 bp, Mus musculus
ttcagccgaagggactccgatgtcc

SEQ ID NO: 287903 - DNA, 25 bp, Mus musculus
tggcagcctgctgcatccaggtcct

SEQ ID NO: 287904 - DNA, 25 bp, Mus musculus
gcgaattcgcggcatcgctcggagt

SEQ ID NO: 287905 - DNA, 25 bp, Mus musculus
cgcatcttgaactggagcgcaacgc

SEQ ID NO: 287906 - DNA, 25 bp, Mus musculus
tctagcggaccaggagatcgcaccc

SEQ ID NO: 287907 - DNA, 25 bp, Mus musculus
ccctgcgcgctttagggtgagagcc

SEQ ID NO: 287908 - DNA, 25 bp, Mus musculus
tcgggatcagctctagggccgactc

SEQ ID NO: 287909 - DNA, 25 bp, Mus musculus
ttcggggacactggctagctattta

SEQ ID NO: 287910 - DNA, 25 bp, Mus musculus
gggcgactcaggacaccgcactaga

SEQ ID NO: 287911 - DNA, 25 bp, Mus musculus
cccaggagctagtgcaagtcagtgc

SEQ ID NO: 287912 - DNA, 25 bp, Mus musculus
tgtcacaaaggagtcgcgccgctgt

SEQ ID NO: 287913 - DNA, 25 bp, Mus musculus
gcgtccatctttaccgctctcttgg

SEQ ID NO: 287914 - DNA, 25 bp, Mus musculus
caaggggattagctggttcattcca

SEQ ID NO: 287915 - DNA, 25 bp, Mus musculus
cgatctgattgggtcgttcgccctt

SEQ ID NO: 287916 - DNA, 25 bp, Mus musculus
caagaccgtatggagcgatctgatt

SEQ ID NO: 287917 - DNA, 25 bp, Mus musculus
cgcctcgtggaaatccggtgctcca

SEQ ID NO: 287918 - DNA, 25 bp, Mus musculus
ttccggcggcatagtccaatcaaca

SEQ ID NO: 287919 - DNA, 25 bp, Mus musculus
gggcttcctgttccttacagccaca

SEQ ID NO: 287920 - DNA, 25 bp, Mus musculus
ggccactctcgctcttaaaaaacta

SEQ ID NO: 287921 - DNA, 25 bp, Mus musculus
actctggcttggagttcaccctctc

SEQ ID NO: 287922 - DNA, 25 bp, Mus musculus
gggctctaatcctaactctggcttg

SEQ ID NO: 287923 - DNA, 25 bp, Mus musculus
ctggagacaaacctgggctctaatc

SEQ ID NO: 287924 - DNA, 25 bp, Mus musculus
taagagccaggatgcggtgagtaaa

SEQ ID NO: 287925 - DNA, 25 bp, Mus musculus
ccagcagataggtgtggcgttaaga

SEQ ID NO: 287926 - DNA, 25 bp, Mus musculus
gtgcggtcacattcaccagcagata

SEQ ID NO: 287927 - DNA, 25 bp, Mus musculus
aaacccagaggccttgagctgccca

SEQ ID NO: 287928 - DNA, 25 bp, Mus musculus
cggtgagtaaatcctgcgggtaata

SEQ ID NO: 287929 - DNA, 25 bp, Mus musculus
tcacaatcctctggcctcaatcgtg

SEQ ID NO: 287930 - DNA, 25 bp, Mus musculus
gtcacagataaccagcgcttccatc

SEQ ID NO: 287931 - DNA, 25 bp, Mus musculus
ccaccacgggcatatgtcacagata

SEQ ID NO: 287932 - DNA, 25 bp, Mus musculus
ccttgtaagtgaagcggccagggtc

SEQ ID NO: 287933 - DNA, 25 bp, Mus musculus
gagagcttcgcgctgtccttgtaag

SEQ ID NO: 287934 - DNA, 25 bp, Mus musculus
ccctacgatggacgccctagaagaa

SEQ ID NO: 287935 - DNA, 25 bp, Mus musculus
ttctgcgggcccttgatgcagttga

SEQ ID NO: 287936 - DNA, 25 bp, Mus musculus
tctgccctaacacaccggcggggta

SEQ ID NO: 287937 - DNA, 25 bp, Mus musculus
tcaatcgtggccgtcagcaaaaacc

SEQ ID NO: 287938 - DNA, 25 bp, Mus musculus
cgcaatctgtgtcggaaagctggtc

SEQ ID NO: 287939 - DNA, 25 bp, Mus musculus
gcaccggtcctactgtgagcaacca

SEQ ID NO: 287940 - DNA, 25 bp, Mus musculus
cgaccgagctactggtggaagaatt

SEQ ID NO: 287941 - DNA, 25 bp, Mus musculus
gaaggaaggagttcacctcaagttc

SEQ ID NO: 287942 - DNA, 25 bp, Mus musculus
cctcaagttcgcaatctgtgtcgga

SEQ ID NO: 287943 - DNA, 25 bp, Mus musculus
ccagtgagaaacttcccgagagtgc

SEQ ID NO: 287944 - DNA, 25 bp, Mus musculus
ctgtgtcggaaagctggtccggcct

SEQ ID NO: 287945 - DNA, 25 bp, Mus musculus
gagggcgtttcgagcaccggtccta

SEQ ID NO: 287946 - DNA, 25 bp, Mus musculus
tcgagcaccggtcctactgtgagca

SEQ ID NO: 287947 - DNA, 25 bp, Mus musculus
cggtcctactgtgagcaaccagtga

SEQ ID NO: 287948 - DNA, 25 bp, Mus musculus
ctgtgagcaaccagtgagaaacttc

SEQ ID NO: 287949 - DNA, 25 bp, Mus musculus
cggtcacggcgaccgagctactggt

SEQ ID NO: 287950 - DNA, 25 bp, Mus musculus
gaaacttcccgagagtgccgtctcc

SEQ ID NO: 287951 - DNA, 25 bp, Mus musculus
gagttcacctcaagttcgcaatctg

SEQ ID NO: 287952 - DNA, 25 bp, Mus musculus
tctcagctacggtatcgccacggta

SEQ ID NO: 287953 - DNA, 25 bp, Mus musculus
gtcgcagcgcagacacagaggctcc

SEQ ID NO: 287954 - DNA, 25 bp, Mus musculus
gacagttgtgcgcagctatctcagc

SEQ ID NO: 287955 - DNA, 25 bp, Mus musculus
gatcgcgagcctacgacgctctggc

SEQ ID NO: 287956 - DNA, 25 bp, Mus musculus
aagagcggagcgcacgaagcccaga

SEQ ID NO: 287957 - DNA, 25 bp, Mus musculus
gcttgggtaccctagacagaactca

SEQ ID NO: 287958 - DNA, 25 bp, Mus musculus
acaagagtcatgctgtgctcgcagg

SEQ ID NO: 287959 - DNA, 25 bp, Mus musculus
gggaactccgccatagcgatcgcga

SEQ ID NO: 287960 - DNA, 25 bp, Mus musculus
tgctcactttcgacgggaactccgc

SEQ ID NO: 287961 - DNA, 25 bp, Mus musculus
tgctggtcctcgtgctcactttcga

SEQ ID NO: 287962 - DNA, 25 bp, Mus musculus
acgaagcccagatccggtcgcagcg

SEQ ID NO: 287963 - DNA, 25 bp, Mus musculus
aggtgcaagcttcccggcgatcttg

SEQ ID NO: 287964 - DNA, 25 bp, Mus musculus
ctcgcagggatgtcacacgagcgtc

SEQ ID NO: 287965 - DNA, 25 bp, Mus musculus
agaactcacaggtgcgcgaagccca

SEQ ID NO: 287966 - DNA, 25 bp, Mus musculus
ctggcaacctgggaggaatccagcc

SEQ ID NO: 287967 - DNA, 25 bp, Mus musculus
gcaacctgggaggaatccagccgca

SEQ ID NO: 287968 - DNA, 25 bp, Mus musculus
cagcgcaggattgcaactggttccc

SEQ ID NO: 287969 - DNA, 25 bp, Mus musculus
gaccagccgcgagtgactactagga

SEQ ID NO: 287970 - DNA, 25 bp, Mus musculus
cggagcccagcgcaggattgcaact

SEQ ID NO: 287971 - DNA, 25 bp, Mus musculus
gccgcagctacaggctcttcctctc

SEQ ID NO: 287972 - DNA, 25 bp, Mus musculus
ggcggaggctgccagcccattataa

SEQ ID NO: 287973 - DNA, 25 bp, Mus musculus
ggctgccagcccattataaaaagca

SEQ ID NO: 287974 - DNA, 25 bp, Mus musculus
ttataaaaagcaaccgagaccagcc

SEQ ID NO: 287975 - DNA, 25 bp, Mus musculus
caaccgagaccagccgcgagtgact

SEQ ID NO: 287976 - DNA, 25 bp, Mus musculus
gaattcctgcactccagccatggct

SEQ ID NO: 287977 - DNA, 25 bp, Mus musculus
taggagctgcgacacggcccagcct

SEQ ID NO: 287978 - DNA, 25 bp, Mus musculus
tgactactaggagctgcgacacggc

SEQ ID NO: 287979 - DNA, 25 bp, Mus musculus
gattgcaactggttccctggcaacc

SEQ ID NO: 287980 - DNA, 25 bp, Mus musculus
tgcgtgcgtgcccacttccaagatg

SEQ ID NO: 287981 - DNA, 25 bp, Mus musculus
ctagcaaggtaaagggcatcggcgt

SEQ ID NO: 287982 - DNA, 25 bp, Mus musculus
agaagacgccgcacaacacctgagt

SEQ ID NO: 287983 - DNA, 25 bp, Mus musculus
ggtcccgatgccagctccgggtttc

SEQ ID NO: 287984 - DNA, 25 bp, Mus musculus
gtcgcgagctggaaaaagccactta

SEQ ID NO: 287985 - DNA, 25 bp, Mus musculus
tgcctgcccggtgaggtgacagcca

SEQ ID NO: 287986 - DNA, 25 bp, Mus musculus
cgacagcagccgtgtctggtgtcct

SEQ ID NO: 287987 - DNA, 25 bp, Mus musculus
caacacctgagtcctagtgagcgga

SEQ ID NO: 287988 - DNA, 25 bp, Mus musculus
ctcgtcctggtctctcgcgagaaga

SEQ ID NO: 287989 - DNA, 25 bp, Mus musculus
ggacgccggcttctcgtcctggtct

SEQ ID NO: 287990 - DNA, 25 bp, Mus musculus
ccgttaagcccgctcagatgctcga

SEQ ID NO: 287991 - DNA, 25 bp, Mus musculus
cgccagaagccgaagcgagagcacg

SEQ ID NO: 287992 - DNA, 25 bp, Mus musculus
cccaaggggtgacaatgacggcgcc

SEQ ID NO: 287993 - DNA, 25 bp, Mus musculus
agccacttaagggtttcagtcgccg

SEQ ID NO: 287994 - DNA, 25 bp, Mus musculus
cactgttaaacagcggagggctgca

SEQ ID NO: 287995 - DNA, 25 bp, Mus musculus
accgcctgtctttcctcctgtaggg

SEQ ID NO: 287996 - DNA, 25 bp, Mus musculus
cgactagccggaagcgccgattgcc

SEQ ID NO: 287997 - DNA, 25 bp, Mus musculus
cgccgacaaactgctggtggccgcg

SEQ ID NO: 287998 - DNA, 25 bp, Mus musculus
cgcttttgctttgacgtcagtgttc

SEQ ID NO: 287999 - DNA, 25 bp, Mus musculus
tgcccataataggtaagcgaccgtc

SEQ ID NO: 288000 - DNA, 25 bp, Mus musculus
gctgagaacactgcggtgctgtacg

SEQ ID NO: 288001 - DNA, 25 bp, Mus musculus
cctcctgtagggtggccaattccat

SEQ ID NO: 288002 - DNA, 25 bp, Mus musculus
tgcgggtttcccagtactgttcgtc

SEQ ID NO: 288003 - DNA, 25 bp, Mus musculus
ctcatccgggcggtgtagatgctag

SEQ ID NO: 288004 - DNA, 25 bp, Mus musculus
cgttagcaggtgatgcagcgattgc

SEQ ID NO: 288005 - DNA, 25 bp, Mus musculus
gcagcgattgccgaagtagtgtaga

SEQ ID NO: 288006 - DNA, 25 bp, Mus musculus
agtagtgtagatgatgcgcttttgc

SEQ ID NO: 288007 - DNA, 25 bp, Mus musculus
cgtgccttgctcagctgcgggtttc

SEQ ID NO: 288008 - DNA, 25 bp, Mus musculus
taaagtaggacgctcccatagctgg

SEQ ID NO: 288009 - DNA, 25 bp, Mus musculus
ctgagtcctccttccttaaagtagg

SEQ ID NO: 288010 - DNA, 25 bp, Mus musculus
gcgcgtctgagtcctccttccttaa

SEQ ID NO: 288011 - DNA, 25 bp, Mus musculus
ttcgagaggcgcgtctgagtcctcc

SEQ ID NO: 288012 - DNA, 25 bp, Mus musculus
gctccggaggtgaccacaggcgccc

SEQ ID NO: 288013 - DNA, 25 bp, Mus musculus
agctagaagtgaagcgcagccgcca

SEQ ID NO: 288014 - DNA, 25 bp, Mus musculus
tctggttgtaagctagaagtgaagc

SEQ ID NO: 288015 - DNA, 25 bp, Mus musculus
cccaggatgagagttgcgggagtct

SEQ ID NO: 288016 - DNA, 25 bp, Mus musculus
ctatttacctaggcgccgaggcccg

SEQ ID NO: 288017 - DNA, 25 bp, Mus musculus
gctcccatagctgggagagcccgcg

SEQ ID NO: 288018 - DNA, 25 bp, Mus musculus
tctcggtgaggcctagggatccccc

SEQ ID NO: 288019 - DNA, 25 bp, Mus musculus
ttgcgggagtctcacgtctcggtga

SEQ ID NO: 288020 - DNA, 25 bp, Mus musculus
gcgcggctctggttgtaagctagaa

SEQ ID NO: 288021 - DNA, 25 bp, Mus musculus
ttccttaaagtaggacgctcccata

SEQ ID NO: 288022 - DNA, 25 bp, Mus musculus
tccaacctcggtagatgcaggcgtc

SEQ ID NO: 288023 - DNA, 25 bp, Mus musculus
gtgggctcgtccaacctcggtagat

SEQ ID NO: 288024 - DNA, 25 bp, Mus musculus
aacctcggtagatgcaggcgtccgc

SEQ ID NO: 288025 - DNA, 25 bp, Mus musculus
ataattggacgctgcggctcggtgt

SEQ ID NO: 288026 - DNA, 25 bp, Mus musculus
cggcaataattggacgctgcggctc

SEQ ID NO: 288027 - DNA, 25 bp, Mus musculus
aggcggacggcttccggcaataatt

SEQ ID NO: 288028 - DNA, 25 bp, Mus musculus
gcaacacgaatcacgtggctcctct

SEQ ID NO: 288029 - DNA, 25 bp, Mus musculus
ttcgggtagcaacacgaatcacgtg

SEQ ID NO: 288030 - DNA, 25 bp, Mus musculus
cgaggcctccgagttcgggtagcaa

SEQ ID NO: 288031 - DNA, 25 bp, Mus musculus
ggcctcccgtgcacacctgtgtgtg

SEQ ID NO: 288032 - DNA, 25 bp, Mus musculus
acacctgtgtgtgcaccatccttca

SEQ ID NO: 288033 - DNA, 25 bp, Mus musculus
tgcaccatccttcaggccggcgtgt

SEQ ID NO: 288034 - DNA, 25 bp, Mus musculus
cgtggctcctctccggccaatcagc

SEQ ID NO: 288035 - DNA, 25 bp, Mus musculus
ctgtctcgtctggaagggacccgca

SEQ ID NO: 288036 - DNA, 25 bp, Mus musculus
atctaacatgatctcactgcgtgtg

SEQ ID NO: 288037 - DNA, 25 bp, Mus musculus
ttctcgcgccagttcgccgtgcagt

SEQ ID NO: 288038 - DNA, 25 bp, Mus musculus
tccttggtgagcgtatccaggcgct

SEQ ID NO: 288039 - DNA, 25 bp, Mus musculus
gcccgccaactccttggtgagcgta

SEQ ID NO: 288040 - DNA, 25 bp, Mus musculus
accgtcgtgagtcttgtcggccgca

SEQ ID NO: 288041 - DNA, 25 bp, Mus musculus
gcgcattgttttctccatctgcaag

SEQ ID NO: 288042 - DNA, 25 bp, Mus musculus
tttctccatctgcaaggctcgcgcg

SEQ ID NO: 288043 - DNA, 25 bp, Mus musculus
ccaggatggtgagcaggctgctctt

SEQ ID NO: 288044 - DNA, 25 bp, Mus musculus
ctcttggacagctgcggagactcag

SEQ ID NO: 288045 - DNA, 25 bp, Mus musculus
tcggaccgtggctcatagtgaggct

SEQ ID NO: 288046 - DNA, 25 bp, Mus musculus
cggcgcgtaggacagagatctaaca

SEQ ID NO: 288047 - DNA, 25 bp, Mus musculus
ctcatagtgaggctgggctggcctt

SEQ ID NO: 288048 - DNA, 25 bp, Mus musculus
gcagtccgaccaccagcgcattgtt

SEQ ID NO: 288049 - DNA, 25 bp, Mus musculus
cgaacttggggctaggctcaaggac

SEQ ID NO: 288050 - DNA, 25 bp, Mus musculus
ggtccggtcctgcaagacgcggtcc

SEQ ID NO: 288051 - DNA, 25 bp, Mus musculus
tccggtcctgcaagacgcggtcccg

SEQ ID NO: 288052 - DNA, 25 bp, Mus musculus
cggtcctgcaagacgcggtcccgcc

SEQ ID NO: 288053 - DNA, 25 bp, Mus musculus
ttggtttccattggtagcgcaacgg

SEQ ID NO: 288054 - DNA, 25 bp, Mus musculus
tggtttccattggtagcgcaacggg

SEQ ID NO: 288055 - DNA, 25 bp, Mus musculus
gtttccattggtagcgcaacgggtc

SEQ ID NO: 288056 - DNA, 25 bp, Mus musculus
tttccattggtagcgcaacgggtct

SEQ ID NO: 288057 - DNA, 25 bp, Mus musculus
ttccattggtagcgcaacgggtctg

SEQ ID NO: 288058 - DNA, 25 bp, Mus musculus
tccattggtagcgcaacgggtctgg

SEQ ID NO: 288059 - DNA, 25 bp, Mus musculus
cattggtagcgcaacgggtctgggc

SEQ ID NO: 288060 - DNA, 25 bp, Mus musculus
gtagcgcaacgggtctgggcgtaaa

SEQ ID NO: 288061 - DNA, 25 bp, Mus musculus
gtctgggcgtaaagccgtgctccga

SEQ ID NO: 288062 - DNA, 25 bp, Mus musculus
ggcgtaaagccgtgctccgattggc

SEQ ID NO: 288063 - DNA, 25 bp, Mus musculus
tctgggcgtaaagccgtgctccgat

SEQ ID NO: 288064 - DNA, 25 bp, Mus musculus
agcctgtattggttcttctgggacc

SEQ ID NO: 288065 - DNA, 25 bp, Mus musculus
cagctcgcggattttttaaacacaa

SEQ ID NO: 288066 - DNA, 25 bp, Mus musculus
caaccgggttccaggaaatgcagga

SEQ ID NO: 288067 - DNA, 25 bp, Mus musculus
ttccaggaaatgcaggaaaagggcg

SEQ ID NO: 288068 - DNA, 25 bp, Mus musculus
cgggactaagaacgcagaagcctgt

SEQ ID NO: 288069 - DNA, 25 bp, Mus musculus
actaagaacgcagaagcctgtattg

SEQ ID NO: 288070 - DNA, 25 bp, Mus musculus
ggcggtccgtaagcgcttctttctc

SEQ ID NO: 288071 - DNA, 25 bp, Mus musculus
tcgtgattagtctgagtcggggaaa

SEQ ID NO: 288072 - DNA, 25 bp, Mus musculus
tagttacgtaaatcggcggaagcgc

SEQ ID NO: 288073 - DNA, 25 bp, Mus musculus
cgtaaatcggcggaagcgcttgctt

SEQ ID NO: 288074 - DNA, 25 bp, Mus musculus
agcgcttgcttccattggtcaattc

SEQ ID NO: 288075 - DNA, 25 bp, Mus musculus
ccattggtcaattctagaggaaggc

SEQ ID NO: 288076 - DNA, 25 bp, Mus musculus
gtgcagctcgcggattttttaaaca

SEQ ID NO: 288077 - DNA, 25 bp, Mus musculus
aagcgcttctttctcgtgattagtc

SEQ ID NO: 288078 - DNA, 25 bp, Mus musculus
aggaagctcaagatgtgccagaacg

SEQ ID NO: 288079 - DNA, 25 bp, Mus musculus
gggtctggcgaagcatggccaacta

SEQ ID NO: 288080 - DNA, 25 bp, Mus musculus
gcgaagcatggccaactaaggaagc

SEQ ID NO: 288081 - DNA, 25 bp, Mus musculus
aagtaaagagggtctggcgaagcat

SEQ ID NO: 288082 - DNA, 25 bp, Mus musculus
aagcatggccaactaaggaagctca

SEQ ID NO: 288083 - DNA, 25 bp, Mus musculus
caactaaggaagctcaagatgtgcc

SEQ ID NO: 288084 - DNA, 25 bp, Mus musculus
ggcaacaggagaaagagaatccagc

SEQ ID NO: 288085 - DNA, 25 bp, Mus musculus
aagctcaagatgtgccagaacggga

SEQ ID NO: 288086 - DNA, 25 bp, Mus musculus
caagatgtgccagaacgggagcata

SEQ ID NO: 288087 - DNA, 25 bp, Mus musculus
ccagaacgggagcataggcaacagg

SEQ ID NO: 288088 - DNA, 25 bp, Mus musculus
aacgggagcataggcaacaggagaa

SEQ ID NO: 288089 - DNA, 25 bp, Mus musculus
tctggcgaagcatggccaactaagg

SEQ ID NO: 288090 - DNA, 25 bp, Mus musculus
tggccaactaaggaagctcaagatg

SEQ ID NO: 288091 - DNA, 25 bp, Mus musculus
cataggcaacaggagaaagagaatc

SEQ ID NO: 288092 - DNA, 25 bp, Mus musculus
ggaaaatggctctagtcttcgccga

SEQ ID NO: 288093 - DNA, 25 bp, Mus musculus
attgagtcggggctccagaaacagg

SEQ ID NO: 288094 - DNA, 25 bp, Mus musculus
ggctctagtcttcgccgagcctgga

SEQ ID NO: 288095 - DNA, 25 bp, Mus musculus
ccagaaacaggagagcgaatgaatg

SEQ ID NO: 288096 - DNA, 25 bp, Mus musculus
aggcaaagggaaaatggctctagtc

SEQ ID NO: 288097 - DNA, 25 bp, Mus musculus
cagagctacagctgcaggtagagtg

SEQ ID NO: 288098 - DNA, 25 bp, Mus musculus
atagcagcggggcaagagaagtaaa

SEQ ID NO: 288099 - DNA, 25 bp, Mus musculus
ttggcctccagagctacagctgcag

SEQ ID NO: 288100 - DNA, 25 bp, Mus musculus
attctgatagcagcggggcaagaga

SEQ ID NO: 288101 - DNA, 25 bp, Mus musculus
cgcctggagggaagccttggcctcc

SEQ ID NO: 288102 - DNA, 25 bp, Mus musculus
caatcagggcaaaggatggaggcaa

SEQ ID NO: 288103 - DNA, 25 bp, Mus musculus
cagcgaccaatcagggcaaaggatg

SEQ ID NO: 288104 - DNA, 25 bp, Mus musculus
gtcggttgtcaagcagcgaccaatc

SEQ ID NO: 288105 - DNA, 25 bp, Mus musculus
aggatcgtattgagtcggggctcca

SEQ ID NO: 288106 - DNA, 25 bp, Mus musculus
ggggagagctcacacgcaatttcgc

SEQ ID NO: 288107 - DNA, 25 bp, Mus musculus
cctgacgcagctctggcctcattta

SEQ ID NO: 288108 - DNA, 25 bp, Mus musculus
tcatcatctttggtcaagtggagtg

SEQ ID NO: 288109 - DNA, 25 bp, Mus musculus
gagtgtgcaaggaacagctgcttca

SEQ ID NO: 288110 - DNA, 25 bp, Mus musculus
agctgcttcactcggctgacttccg

SEQ ID NO: 288111 - DNA, 25 bp, Mus musculus
ggagcatcttggctgcctttgcctc

SEQ ID NO: 288112 - DNA, 25 bp, Mus musculus
acagtccctgcggatctgtggctta

SEQ ID NO: 288113 - DNA, 25 bp, Mus musculus
tcgccgtgaccttgctggggtcagt

SEQ ID NO: 288114 - DNA, 25 bp, Mus musculus
atcgccgaggcagatatagaaaggg

SEQ ID NO: 288115 - DNA, 25 bp, Mus musculus
tcgcctcgttcggtgccagaggact

SEQ ID NO: 288116 - DNA, 25 bp, Mus musculus
tcctgcggattttctcccggcgaca

SEQ ID NO: 288117 - DNA, 25 bp, Mus musculus
gccctctccggattggcggaaggcc

SEQ ID NO: 288118 - DNA, 25 bp, Mus musculus
tcccgcacccagagcggctgtagga

SEQ ID NO: 288119 - DNA, 25 bp, Mus musculus
aaccctcttcggctgggaagctcgc

SEQ ID NO: 288120 - DNA, 25 bp, Mus musculus
gatgcaaacagaccgggcccggatg

SEQ ID NO: 288121 - DNA, 25 bp, Mus musculus
attcctacggcccactacagtactg

SEQ ID NO: 288122 - DNA, 25 bp, Mus musculus
acttgaagccggaggtgacccagaa

SEQ ID NO: 288123 - DNA, 25 bp, Mus musculus
aagccggaggtgacccagaactggc

SEQ ID NO: 288124 - DNA, 25 bp, Mus musculus
cgggtagggaaagatgcaaacagac

SEQ ID NO: 288125 - DNA, 25 bp, Mus musculus
cactacagtactgcctcaaccagaa

SEQ ID NO: 288126 - DNA, 25 bp, Mus musculus
ggaaagatgcaaacagaccgggccc

SEQ ID NO: 288127 - DNA, 25 bp, Mus musculus
agcctggaccgctacggacagaagc

SEQ ID NO: 288128 - DNA, 25 bp, Mus musculus
gctacggacagaagcccctgccttt

SEQ ID NO: 288129 - DNA, 25 bp, Mus musculus
ccctgcctttcgactcgctgtaagt

SEQ ID NO: 288130 - DNA, 25 bp, Mus musculus
tttcgactcgctgtaagtgacaatc

SEQ ID NO: 288131 - DNA, 25 bp, Mus musculus
gactcgctgtaagtgacaatctgca

SEQ ID NO: 288132 - DNA, 25 bp, Mus musculus
tgcaggaccccttcgtgacctcgat

SEQ ID NO: 288133 - DNA, 25 bp, Mus musculus
ctgtaagtgacaatctgcaggaccc

SEQ ID NO: 288134 - DNA, 25 bp, Mus musculus
tcttctcgcagacagcgcacttgta

SEQ ID NO: 288135 - DNA, 25 bp, Mus musculus
gccttgttacacacggggcacttga

SEQ ID NO: 288136 - DNA, 25 bp, Mus musculus
ggatgcccgcttgtaggccttgtta

SEQ ID NO: 288137 - DNA, 25 bp, Mus musculus
gtctgaggcatacttgaagcgcttc

SEQ ID NO: 288138 - DNA, 25 bp, Mus musculus
gctctcgctgcttgaaggctttatc

SEQ ID NO: 288139 - DNA, 25 bp, Mus musculus
ttgaactgctgctctcgggcatgca

SEQ ID NO: 288140 - DNA, 25 bp, Mus musculus
tgtagcagcgccacatccagaaagc

SEQ ID NO: 288141 - DNA, 25 bp, Mus musculus
tgcgtactgctgtttgaagcccatg

SEQ ID NO: 288142 - DNA, 25 bp, Mus musculus
cccatggggcacagatcacacttga

SEQ ID NO: 288143 - DNA, 25 bp, Mus musculus
cagctcggacgactctttgaaatgc

SEQ ID NO: 288144 - DNA, 25 bp, Mus musculus
tttgaaatgcagctcgcacacgttg

SEQ ID NO: 288145 - DNA, 25 bp, Mus musculus
gctcgccagaatgcgcgtacatgtg

SEQ ID NO: 288146 - DNA, 25 bp, Mus musculus
acaccgggcacttgaacagagtctc

SEQ ID NO: 288147 - DNA, 25 bp, Mus musculus
atgcgagcggtgcttaaaggtcttc

SEQ ID NO: 288148 - DNA, 25 bp, Mus musculus
gtccgtcctaagctccactgggctt

SEQ ID NO: 288149 - DNA, 25 bp, Mus musculus
gaagaccagctgctttctctgccgc

SEQ ID NO: 288150 - DNA, 25 bp, Mus musculus
ggagcaaaccgggtactggcttcca

SEQ ID NO: 288151 - DNA, 25 bp, Mus musculus
agcacttccggctcagaggaactcc

SEQ ID NO: 288152 - DNA, 25 bp, Mus musculus
ggaaggccgcctcctacagccttta

SEQ ID NO: 288153 - DNA, 25 bp, Mus musculus
aacagacccgcagacctgtggaacc

SEQ ID NO: 288154 - DNA, 25 bp, Mus musculus
gggatcctgagactccaactttttg

SEQ ID NO: 288155 - DNA, 25 bp, Mus musculus
ccgttggtgaggatcgaggaatttt

SEQ ID NO: 288156 - DNA, 25 bp, Mus musculus
agctcgctctcaagagggatcctga

SEQ ID NO: 288157 - DNA, 25 bp, Mus musculus
tgactctccggtcttctgcagctga

SEQ ID NO: 288158 - DNA, 25 bp, Mus musculus
cagaccgacgggtcttgcagagacc

SEQ ID NO: 288159 - DNA, 25 bp, Mus musculus
aatcgacccgcgcactcgggttagc

SEQ ID NO: 288160 - DNA, 25 bp, Mus musculus
tgcagcagccggaaccgacgaatcg

SEQ ID NO: 288161 - DNA, 25 bp, Mus musculus
cagcagcagcggttcagaggatgaa

SEQ ID NO: 288162 - DNA, 25 bp, Mus musculus
gccagggagcgtcgcaagtttccca

SEQ ID NO: 288163 - DNA, 25 bp, Mus musculus
tctaaagacgccgaagtgtacgccg

SEQ ID NO: 288164 - DNA, 25 bp, Mus musculus
aacccgagggatgtagtgcgaacca

SEQ ID NO: 288165 - DNA, 25 bp, Mus musculus
cctgattgaaaaagcgggactggca

SEQ ID NO: 288166 - DNA, 25 bp, Mus musculus
actccctggtcagagctctgctgcg

SEQ ID NO: 288167 - DNA, 25 bp, Mus musculus
tcgcagctgctgtgcaccctgaaag

SEQ ID NO: 288168 - DNA, 25 bp, Mus musculus
cctgaaagccgctcggggcactgac

SEQ ID NO: 288169 - DNA, 25 bp, Mus musculus
acaaaggctctggagttctgcttgc

SEQ ID NO: 288170 - DNA, 25 bp, Mus musculus
accttgggcatggacagagagtgca

SEQ ID NO: 288171 - DNA, 25 bp, Mus musculus
ctcacccggtttgggaattggcaga

SEQ ID NO: 288172 - DNA, 25 bp, Mus musculus
tcccgctgctactggtgcttctgga

SEQ ID NO: 288173 - DNA, 25 bp, Mus musculus
tgggccatggtacagcgtctaaaga

SEQ ID NO: 288174 - DNA, 25 bp, Mus musculus
cactcggacgtccaggctgcactgg

SEQ ID NO: 288175 - DNA, 25 bp, Mus musculus
tagcttgagtccctgcagccgcttc

SEQ ID NO: 288176 - DNA, 25 bp, Mus musculus
gtcctgccgcagaaagaacggtttc

SEQ ID NO: 288177 - DNA, 25 bp, Mus musculus
agtttacctcacgtgtttacagtgc

SEQ ID NO: 288178 - DNA, 25 bp, Mus musculus
tttacagtgcctgcgtggtgtcatg

SEQ ID NO: 288179 - DNA, 25 bp, Mus musculus
tgacgcagatccgtaagcctcggtg

SEQ ID NO: 288180 - DNA, 25 bp, Mus musculus
ttcttgaacatctcgccagccgcgg

SEQ ID NO: 288181 - DNA, 25 bp, Mus musculus
ccactctggaacgtgttcttgaaca

SEQ ID NO: 288182 - DNA, 25 bp, Mus musculus
tggaaaggaagccactctggaacgt

SEQ ID NO: 288183 - DNA, 25 bp, Mus musculus
gggacgtcaaggctcggtagccact

SEQ ID NO: 288184 - DNA, 25 bp, Mus musculus
ccactccatcacgtgggcggctagt

SEQ ID NO: 288185 - DNA, 25 bp, Mus musculus
ttgtcccagatctgcaggggcttgc

SEQ ID NO: 288186 - DNA, 25 bp, Mus musculus
ctgccgatgctgtagaggatggaaa

SEQ ID NO: 288187 - DNA, 25 bp, Mus musculus
tcggaggcgcattgcccagtcctgc

SEQ ID NO: 288188 - DNA, 25 bp, Mus musculus
gggcccagacttggtttagaacagc

SEQ ID NO: 288189 - DNA, 25 bp, Mus musculus
gcggaacttggttgccaagggacta

SEQ ID NO: 288190 - DNA, 25 bp, Mus musculus
aaagcgagtttgaagccggccctag

SEQ ID NO: 288191 - DNA, 25 bp, Mus musculus
caggctcgccgaaatcgactgctcg

SEQ ID NO: 288192 - DNA, 25 bp, Mus musculus
ccgaggcgtatttcccagtggagtc

SEQ ID NO: 288193 - DNA, 25 bp, Mus musculus
atttcccagtggagtcgggcgctct

SEQ ID NO: 288194 - DNA, 25 bp, Mus musculus
gccggaggagaacttcctgtctttg

SEQ ID NO: 288195 - DNA, 25 bp, Mus musculus
gagaacttcctgtctttggacgaca

SEQ ID NO: 288196 - DNA, 25 bp, Mus musculus
tctttggacgacatcctgatgtcgc

SEQ ID NO: 288197 - DNA, 25 bp, Mus musculus
ggaccatccgctccctcaggtgagg

SEQ ID NO: 288198 - DNA, 25 bp, Mus musculus
gactgtgctgcgagctgccatgtcc

SEQ ID NO: 288199 - DNA, 25 bp, Mus musculus
gaaatcgactgctcgggtctggcga

SEQ ID NO: 288200 - DNA, 25 bp, Mus musculus
aagccggccctagttcgctgaggtg

SEQ ID NO: 288201 - DNA, 25 bp, Mus musculus
gctgcacagcactcggaggactctc

SEQ ID NO: 288202 - DNA, 25 bp, Mus musculus
cgagctgccatgtccgaggcgtatt

SEQ ID NO: 288203 - DNA, 25 bp, Mus musculus
tcctgatgtcgcaggagaagctgcc

SEQ ID NO: 288204 - DNA, 25 bp, Mus musculus
tccaactccggaatagaaatacctg

SEQ ID NO: 288205 - DNA, 25 bp, Mus musculus
ctggatcaccaaggcaacgccgagg

SEQ ID NO: 288206 - DNA, 25 bp, Mus musculus
ggcgtggtccatcctggatcaccaa

SEQ ID NO: 288207 - DNA, 25 bp, Mus musculus
gacgcaccaaaaccacgtgacattt

SEQ ID NO: 288208 - DNA, 25 bp, Mus musculus
ggggccaagaacactgacgcaccaa

SEQ ID NO: 288209 - DNA, 25 bp, Mus musculus
cgagtgctttaccaaggggccaaga

SEQ ID NO: 288210 - DNA, 25 bp, Mus musculus
gctccgggactgaaggaggacaccc

SEQ ID NO: 288211 - DNA, 25 bp, Mus musculus
taggacccggccactcatcagaggg

SEQ ID NO: 288212 - DNA, 25 bp, Mus musculus
aatacctggcctggaagcggtcacc

SEQ ID NO: 288213 - DNA, 25 bp, Mus musculus
gcaccatgattcaggacttctctgt

SEQ ID NO: 288214 - DNA, 25 bp, Mus musculus
gcgctttacgcatgctcgcccagtt

SEQ ID NO: 288215 - DNA, 25 bp, Mus musculus
aatcagcgggccgagtgctttacca

SEQ ID NO: 288216 - DNA, 25 bp, Mus musculus
cccaaagcccttgtggcagcagagc

SEQ ID NO: 288217 - DNA, 25 bp, Mus musculus
gggctcgtccagaagcactcgactt

SEQ ID NO: 288218 - DNA, 25 bp, Mus musculus
gtcaggcgctgcagattgcatctgg

SEQ ID NO: 288219 - DNA, 25 bp, Mus musculus
cgctctccgacttggagcgggttcg

SEQ ID NO: 288220 - DNA, 25 bp, Mus musculus
agcatgccgggctctactgagccgc

SEQ ID NO: 288221 - DNA, 25 bp, Mus musculus
gaccctctttgggaggtcaggcgct

SEQ ID NO: 288222 - DNA, 25 bp, Mus musculus
tgcgcgttcccagttgagcgaaacc

SEQ ID NO: 288223 - DNA, 25 bp, Mus musculus
gcctgtgggtcttctcaccgggcct

SEQ ID NO: 288224 - DNA, 25 bp, Mus musculus
gagacagcccgagacagtccagctc

SEQ ID NO: 288225 - DNA, 25 bp, Mus musculus
cggctgtgccattggtggatttttt

SEQ ID NO: 288226 - DNA, 25 bp, Mus musculus
gcgctccaccgtcgccaagatgaag

SEQ ID NO: 288227 - DNA, 25 bp, Mus musculus
gccaagatgaaggtgctgggacaca

SEQ ID NO: 288228 - DNA, 25 bp, Mus musculus
ctgggacacaggctccaactgctga

SEQ ID NO: 288229 - DNA, 25 bp, Mus musculus
ttgagcgaaacctgaagcatgccgg

SEQ ID NO: 288230 - DNA, 25 bp, Mus musculus
aactgctgacaggtaccgaggcttg

SEQ ID NO: 288231 - DNA, 25 bp, Mus musculus
gctggacagagacgggaccctcttt

SEQ ID NO: 288232 - DNA, 25 bp, Mus musculus
tgtcttccctagagcgaggcgcgct

SEQ ID NO: 288233 - DNA, 25 bp, Mus musculus
ctctccgggacacggccagaactag

SEQ ID NO: 288234 - DNA, 25 bp, Mus musculus
gcgcacgcgcgattcctaaaccgga

SEQ ID NO: 288235 - DNA, 25 bp, Mus musculus
cgcgcgattcctaaaccggagcggt

SEQ ID NO: 288236 - DNA, 25 bp, Mus musculus
gagcggtttagtagaaacgcccagc

SEQ ID NO: 288237 - DNA, 25 bp, Mus musculus
gtttagtagaaacgcccagctccgc

SEQ ID NO: 288238 - DNA, 25 bp, Mus musculus
ccggaagcgcagtgaggacccggct

SEQ ID NO: 288239 - DNA, 25 bp, Mus musculus
ccggctgctcgcagcatggcggccc

SEQ ID NO: 288240 - DNA, 25 bp, Mus musculus
ctgagtcctaaggtgacggtgagcc

SEQ ID NO: 288241 - DNA, 25 bp, Mus musculus
gcagtgccgcggtccgcgcttctgt

SEQ ID NO: 288242 - DNA, 25 bp, Mus musculus
acctgttccatcagcggcctgctgg

SEQ ID NO: 288243 - DNA, 25 bp, Mus musculus
gttcacctggtgtcttccctagagc

SEQ ID NO: 288244 - DNA, 25 bp, Mus musculus
acctggtgtcttccctagagcgagg

SEQ ID NO: 288245 - DNA, 25 bp, Mus musculus
gcgcttggacgttcacctggtgtct

SEQ ID NO: 288246 - DNA, 25 bp, Mus musculus
ccagactcctagtttgcggggctca

SEQ ID NO: 288247 - DNA, 25 bp, Mus musculus
tcgacctatggggactggctggtca

SEQ ID NO: 288248 - DNA, 25 bp, Mus musculus
ttctccaagagagcaaagccgccgc

SEQ ID NO: 288249 - DNA, 25 bp, Mus musculus
ccgcagcgctggacacaggaaactc

SEQ ID NO: 288250 - DNA, 25 bp, Mus musculus
gttaactccgcttgttttctcgaca

SEQ ID NO: 288251 - DNA, 25 bp, Mus musculus
ggcgctccgaatccaggaacgtgag

SEQ ID NO: 288252 - DNA, 25 bp, Mus musculus
tctcgacaaaatggcgcccgaggtc

SEQ ID NO: 288253 - DNA, 25 bp, Mus musculus
tttcaccattcgctgcccgctttgg

SEQ ID NO: 288254 - DNA, 25 bp, Mus musculus
gaaaccaggctcctgctagcaacca

SEQ ID NO: 288255 - DNA, 25 bp, Mus musculus
gcacccgggtgtaagccaatggtta

SEQ ID NO: 288256 - DNA, 25 bp, Mus musculus
aagccttcgaggtgttcgacctatg

SEQ ID NO: 288257 - DNA, 25 bp, Mus musculus
ggctcaggccaattgccgctcatca

SEQ ID NO: 288258 - DNA, 25 bp, Mus musculus
gctggtcattgcctccgggaaacaa

SEQ ID NO: 288259 - DNA, 25 bp, Mus musculus
tttgggactcgaagacataagcctt

SEQ ID NO: 288260 - DNA, 25 bp, Mus musculus
acggcgtctggctttgatcccggaa

SEQ ID NO: 288261 - DNA, 25 bp, Mus musculus
ctttgatcccggaagctctgtgttc

SEQ ID NO: 288262 - DNA, 25 bp, Mus musculus
cgtctggctttgatcccggaagctc

SEQ ID NO: 288263 - DNA, 25 bp, Mus musculus
agggcgtgcagacgctaccccgaca

SEQ ID NO: 288264 - DNA, 25 bp, Mus musculus
ttccgcgccgatttcacctgtcagg

SEQ ID NO: 288265 - DNA, 25 bp, Mus musculus
aaagcccgccgatcgcctccgtgcc

SEQ ID NO: 288266 - DNA, 25 bp, Mus musculus
ggtgagcgcacatggccaatcagca

SEQ ID NO: 288267 - DNA, 25 bp, Mus musculus
cccgacggcggcagctcgggtttct

SEQ ID NO: 288268 - DNA, 25 bp, Mus musculus
gctcgggtttctcccggtgctctga

SEQ ID NO: 288269 - DNA, 25 bp, Mus musculus
tttctcccggtgctctgaatggggc

SEQ ID NO: 288270 - DNA, 25 bp, Mus musculus
ggcgtccgcctttaaccgcgtctgc

SEQ ID NO: 288271 - DNA, 25 bp, Mus musculus
ttactggcggtcactgtcgtcccaa

SEQ ID NO: 288272 - DNA, 25 bp, Mus musculus
tccggaatccggacggcgtctggct

SEQ ID NO: 288273 - DNA, 25 bp, Mus musculus
ctctgtgttcccaccgctggttcgt

SEQ ID NO: 288274 - DNA, 25 bp, Mus musculus
ccaggaggaaattaagaaggagccg

SEQ ID NO: 288275 - DNA, 25 bp, Mus musculus
ttctcccgcgggaacgtgccttcga

SEQ ID NO: 288276 - DNA, 25 bp, Mus musculus
gaaattaagaaggagccggagaagc

SEQ ID NO: 288277 - DNA, 25 bp, Mus musculus
cggagaagccgatcgaccgcgagaa

SEQ ID NO: 288278 - DNA, 25 bp, Mus musculus
cctgcccgctcctgctgcgggtctt

SEQ ID NO: 288279 - DNA, 25 bp, Mus musculus
tgctgcgggtcttcaccaccaacaa

SEQ ID NO: 288280 - DNA, 25 bp, Mus musculus
tgcgggtcttcaccaccaacaacgg

SEQ ID NO: 288281 - DNA, 25 bp, Mus musculus
tcaccaccaacaacggccgccacca

SEQ ID NO: 288282 - DNA, 25 bp, Mus musculus
gccgccaccaccgaatggacgagtt

SEQ ID NO: 288283 - DNA, 25 bp, Mus musculus
gccaccaccgaatggacgagttctc

SEQ ID NO: 288284 - DNA, 25 bp, Mus musculus
accgaatggacgagttctcccgcgg

SEQ ID NO: 288285 - DNA, 25 bp, Mus musculus
atggacgagttctcccgcgggaacg

SEQ ID NO: 288286 - DNA, 25 bp, Mus musculus
tcccgcgggaacgtgccttcgagcg

SEQ ID NO: 288287 - DNA, 25 bp, Mus musculus
tcgcgcgttacccaggaggaaatta

SEQ ID NO: 288288 - DNA, 25 bp, Mus musculus
ctgggtgaaaggcagcagccatccc

SEQ ID NO: 288289 - DNA, 25 bp, Mus musculus
acagggtccacagttcggctgggca

SEQ ID NO: 288290 - DNA, 25 bp, Mus musculus
ccgcggtgccgctgcatctctgtat

SEQ ID NO: 288291 - DNA, 25 bp, Mus musculus
cctccacggaggtcatggaaactcg

SEQ ID NO: 288292 - DNA, 25 bp, Mus musculus
tcacctggctctggcagaggctgca

SEQ ID NO: 288293 - DNA, 25 bp, Mus musculus
cagccatcccggagaggatgcggct

SEQ ID NO: 288294 - DNA, 25 bp, Mus musculus
atctggggaagcgtccgctggaacc

SEQ ID NO: 288295 - DNA, 25 bp, Mus musculus
cgcgggctcctaaaaggtgaggaca

SEQ ID NO: 288296 - DNA, 25 bp, Mus musculus
cctaaaaggtgaggacagtgacttc

SEQ ID NO: 288297 - DNA, 25 bp, Mus musculus
acagtgacttccctgggcgtggcta

SEQ ID NO: 288298 - DNA, 25 bp, Mus musculus
cctgcgcctggagcgaatcatgtcg

SEQ ID NO: 288299 - DNA, 25 bp, Mus musculus
ggagcgaatcatgtcgcagcggccc

SEQ ID NO: 288300 - DNA, 25 bp, Mus musculus
ggtagaacgacgacgcctccacgga

SEQ ID NO: 288301 - DNA, 25 bp, Mus musculus
atctctgtatccctcggctcacctg

SEQ ID NO: 288302 - DNA, 25 bp, Mus musculus
gcgtccactgtgcaactcagatccg

SEQ ID NO: 288303 - DNA, 25 bp, Mus musculus
ggactcctcggattccaaagccgca

SEQ ID NO: 288304 - DNA, 25 bp, Mus musculus
cccagggctcgctgattacagaaag

SEQ ID NO: 288305 - DNA, 25 bp, Mus musculus
cgctgattacagaaaggactcctcg

SEQ ID NO: 288306 - DNA, 25 bp, Mus musculus
ggatcagcgtccactgtgcaactca

SEQ ID NO: 288307 - DNA, 25 bp, Mus musculus
ttttttgaaggatcagcgtccactg

SEQ ID NO: 288308 - DNA, 25 bp, Mus musculus
ctgccatcgttctccgttctttttt

SEQ ID NO: 288309 - DNA, 25 bp, Mus musculus
agcgctgccatcgttctccgttctt

SEQ ID NO: 288310 - DNA, 25 bp, Mus musculus
ttctccagctgtgtgagcgctgcca

SEQ ID NO: 288311 - DNA, 25 bp, Mus musculus
ggattccaaagccgcaccttcgctt

SEQ ID NO: 288312 - DNA, 25 bp, Mus musculus
gaaaggactcctcggattccaaagc

SEQ ID NO: 288313 - DNA, 25 bp, Mus musculus
tgtgcaactcagatccgccgcttcg

SEQ ID NO: 288314 - DNA, 25 bp, Mus musculus
gattttcttctccagctgtgtgagc

SEQ ID NO: 288315 - DNA, 25 bp, Mus musculus
caccccaggctagatctcgattttc

SEQ ID NO: 288316 - DNA, 25 bp, Mus musculus
gagtatttccctttcaccgcaccga

SEQ ID NO: 288317 - DNA, 25 bp, Mus musculus
cgtctccagggtgaaaccgacaagc

SEQ ID NO: 288318 - DNA, 25 bp, Mus musculus
ggctccgagagcagtttgcaaaaca

SEQ ID NO: 288319 - DNA, 25 bp, Mus musculus
ggttatcagtgctagcgttcctcca

SEQ ID NO: 288320 - DNA, 25 bp, Mus musculus
catgcggaaaacaaggaacctgctc

SEQ ID NO: 288321 - DNA, 25 bp, Mus musculus
agttcccgagaacagctaatgtcca

SEQ ID NO: 288322 - DNA, 25 bp, Mus musculus
atagtacttactcaggtcgggctcc

SEQ ID NO: 288323 - DNA, 25 bp, Mus musculus
gctctgcgtccacagcctaaaagta

SEQ ID NO: 288324 - DNA, 25 bp, Mus musculus
agtacagctccggtgttgacgctca

SEQ ID NO: 288325 - DNA, 25 bp, Mus musculus
gacgctcaggtctatgcccaaagtg

SEQ ID NO: 288326 - DNA, 25 bp, Mus musculus
agctcagaggcaggtctaccacttg

SEQ ID NO: 288327 - DNA, 25 bp, Mus musculus
tccactaattctgggccgagcgctc

SEQ ID NO: 288328 - DNA, 25 bp, Mus musculus
tgcggaaaagcctcaagactctggg

SEQ ID NO: 288329 - DNA, 25 bp, Mus musculus
cgcctgcctgccaaatgtaactgtg

SEQ ID NO: 288330 - DNA, 25 bp, Mus musculus
ccggctatcttctgggcttcgaccg

SEQ ID NO: 288331 - DNA, 25 bp, Mus musculus
cggccaatccaatcgccgctccctc

SEQ ID NO: 288332 - DNA, 25 bp, Mus musculus
ggccgccggctatcttctgggcttc

SEQ ID NO: 288333 - DNA, 25 bp, Mus musculus
gccggctatcttctgggcttcgacc

SEQ ID NO: 288334 - DNA, 25 bp, Mus musculus
cggctatcttctgggcttcgaccgc

SEQ ID NO: 288335 - DNA, 25 bp, Mus musculus
ctatcttctgggcttcgaccgcact

SEQ ID NO: 288336 - DNA, 25 bp, Mus musculus
tatcttctgggcttcgaccgcactc

SEQ ID NO: 288337 - DNA, 25 bp, Mus musculus
atcttctgggcttcgaccgcactct

SEQ ID NO: 288338 - DNA, 25 bp, Mus musculus
ttctgggcttcgaccgcactctcta

SEQ ID NO: 288339 - DNA, 25 bp, Mus musculus
ccgccggctatcttctgggcttcga

SEQ ID NO: 288340 - DNA, 25 bp, Mus musculus
tctgggcttcgaccgcactctctac

SEQ ID NO: 288341 - DNA, 25 bp, Mus musculus
cactctctacacaggcaccgggtct

SEQ ID NO: 288342 - DNA, 25 bp, Mus musculus
gccgccggctatcttctgggcttcg

SEQ ID NO: 288343 - DNA, 25 bp, Mus musculus
cgccggctatcttctgggcttcgac

SEQ ID NO: 288344 - DNA, 25 bp, Mus musculus
cccgcagagagcgatcttgtctggg

SEQ ID NO: 288345 - DNA, 25 bp, Mus musculus
gtctaggggagctctttaggaaggc

SEQ ID NO: 288346 - DNA, 25 bp, Mus musculus
tcgactttccctagagacatcacgg

SEQ ID NO: 288347 - DNA, 25 bp, Mus musculus
gcgcgggaggatcccctctaggaac

SEQ ID NO: 288348 - DNA, 25 bp, Mus musculus
ccctagagacatcacgggagcagtc

SEQ ID NO: 288349 - DNA, 25 bp, Mus musculus
agacatcacgggagcagtctgcgtg

SEQ ID NO: 288350 - DNA, 25 bp, Mus musculus
agagagcgatcttgtctggggaaca

SEQ ID NO: 288351 - DNA, 25 bp, Mus musculus
caggggtcgactttccctagagaca

SEQ ID NO: 288352 - DNA, 25 bp, Mus musculus
cgcacaggggtcgactttccctaga

SEQ ID NO: 288353 - DNA, 25 bp, Mus musculus
ggggtcgactttccctagagacatc

SEQ ID NO: 288354 - DNA, 25 bp, Mus musculus
gctctttaggaaggcgcgggaggat

SEQ ID NO: 288355 - DNA, 25 bp, Mus musculus
ctttccctagagacatcacgggagc

SEQ ID NO: 288356 - DNA, 25 bp, Mus musculus
gcaccgggtctaggggagctcttta

SEQ ID NO: 288357 - DNA, 25 bp, Mus musculus
atcacgggagcagtctgcgtgtcca

SEQ ID NO: 288358 - DNA, 25 bp, Mus musculus
ggtccgagtcccattcacaagtcgg

SEQ ID NO: 288359 - DNA, 25 bp, Mus musculus
cgagtcccattcacaagtcggcggc

SEQ ID NO: 288360 - DNA, 25 bp, Mus musculus
agtcccattcacaagtcggcggcgg

SEQ ID NO: 288361 - DNA, 25 bp, Mus musculus
tccgagtcccattcacaagtcggcg

SEQ ID NO: 288362 - DNA, 25 bp, Mus musculus
cggtccgagtcccattcacaagtcg

SEQ ID NO: 288363 - DNA, 25 bp, Mus musculus
ccggctgtccctggcacggggcgag

SEQ ID NO: 288364 - DNA, 25 bp, Mus musculus
cctcctggccggctgtccctggcac

SEQ ID NO: 288365 - DNA, 25 bp, Mus musculus
tgcgggtggacacgacctcctggcc

SEQ ID NO: 288366 - DNA, 25 bp, Mus musculus
agagcgcctcacctggggccgttgc

SEQ ID NO: 288367 - DNA, 25 bp, Mus musculus
gcggcatctgctcctcggcccgcga

SEQ ID NO: 288368 - DNA, 25 bp, Mus musculus
tcccattcacaagtcggcggcggct

SEQ ID NO: 288369 - DNA, 25 bp, Mus musculus
cccattcacaagtcggcggcggctg

SEQ ID NO: 288370 - DNA, 25 bp, Mus musculus
ccgttgcgggtggacacgacctcct

SEQ ID NO: 288371 - DNA, 25 bp, Mus musculus
agcagagcgcctcacctggggccgt

SEQ ID NO: 288372 - DNA, 25 bp, Mus musculus
cggtgcacacatacaccccggttag

SEQ ID NO: 288373 - DNA, 25 bp, Mus musculus
cttccggtgcacacatacaccccgg

SEQ ID NO: 288374 - DNA, 25 bp, Mus musculus
tgtgcttccggtgcacacatacacc

SEQ ID NO: 288375 - DNA, 25 bp, Mus musculus
agcatgtgcttccggtgcacacata

SEQ ID NO: 288376 - DNA, 25 bp, Mus musculus
gtgcttccggtgcacacatacaccc

SEQ ID NO: 288377 - DNA, 25 bp, Mus musculus
acaccccggttagcatgtgcttccg

SEQ ID NO: 288378 - DNA, 25 bp, Mus musculus
catacaccccggttagcatgtgctt

SEQ ID NO: 288379 - DNA, 25 bp, Mus musculus
atgtgcttccggtgcacacatacac

SEQ ID NO: 288380 - DNA, 25 bp, Mus musculus
catgtgcttccggtgcacacataca

SEQ ID NO: 288381 - DNA, 25 bp, Mus musculus
tgcacacatacaccccggttagcat

SEQ ID NO: 288382 - DNA, 25 bp, Mus musculus
ggtgcacacatacaccccggttagc

SEQ ID NO: 288383 - DNA, 25 bp, Mus musculus
tagcatgtgcttccggtgcacacat

SEQ ID NO: 288384 - DNA, 25 bp, Mus musculus
tacaccccggttagcatgtgcttcc

SEQ ID NO: 288385 - DNA, 25 bp, Mus musculus
cccggttagcatgtgcttccggtgc

SEQ ID NO: 288386 - DNA, 25 bp, Mus musculus
tcggatccagtctccgttcgcgttc

SEQ ID NO: 288387 - DNA, 25 bp, Mus musculus
tgtaggcccgcccacaatattagga

SEQ ID NO: 288388 - DNA, 25 bp, Mus musculus
ggatgtcaatcatccatattcgggg

SEQ ID NO: 288389 - DNA, 25 bp, Mus musculus
cgccgctggatgtcaatcatccata

SEQ ID NO: 288390 - DNA, 25 bp, Mus musculus
taggagtgcctaatccggacccgaa

SEQ ID NO: 288391 - DNA, 25 bp, Mus musculus
ccgcccacaatattaggagtgccta

SEQ ID NO: 288392 - DNA, 25 bp, Mus musculus
tccggattcctctcgtgtaggcccg

SEQ ID NO: 288393 - DNA, 25 bp, Mus musculus
agtcgcgcggcgcttccggattcct

SEQ ID NO: 288394 - DNA, 25 bp, Mus musculus
tccgaagagaagacatactggaccc

SEQ ID NO: 288395 - DNA, 25 bp, Mus musculus
ccctgcttccgaagagaagacatac

SEQ ID NO: 288396 - DNA, 25 bp, Mus musculus
tcgcgttccgcgcttcctgcctacc

SEQ ID NO: 288397 - DNA, 25 bp, Mus musculus
tactggaccccagccgggatctctg

SEQ ID NO: 288398 - DNA, 25 bp, Mus musculus
ctgcctaccctgcttccgaagagaa

SEQ ID NO: 288399 - DNA, 25 bp, Mus musculus
gcgcttccggattcctctcgtgtag

SEQ ID NO: 288400 - DNA, 25 bp, Mus musculus
ccaccatgatcgacgtgaagaaaga

SEQ ID NO: 288401 - DNA, 25 bp, Mus musculus
acatctacggctacgagggcgcaga

SEQ ID NO: 288402 - DNA, 25 bp, Mus musculus
gaaagaagaggcagacaatgacggc

SEQ ID NO: 288403 - DNA, 25 bp, Mus musculus
gcccagggagatggccaccatgatc

SEQ ID NO: 288404 - DNA, 25 bp, Mus musculus
tgtacacgcaggtgcagaagccgcc

SEQ ID NO: 288405 - DNA, 25 bp, Mus musculus
tgtgcgcggtggctccactaagccc

SEQ ID NO: 288406 - DNA, 25 bp, Mus musculus
ctggagattcacgagcagttggtca

SEQ ID NO: 288407 - DNA, 25 bp, Mus musculus
agtgcttaattctgtgcgcggtggc

SEQ ID NO: 288408 - DNA, 25 bp, Mus musculus
ccagctatgatgtgtcagtgcttaa

SEQ ID NO: 288409 - DNA, 25 bp, Mus musculus
gatggacaccaccagctatgatgtg

SEQ ID NO: 288410 - DNA, 25 bp, Mus musculus
agcagttggtcacttacgatgagga

SEQ ID NO: 288411 - DNA, 25 bp, Mus musculus
catagcaagagtgcgctggagattc

SEQ ID NO: 288412 - DNA, 25 bp, Mus musculus
catacgacacactgcacatctacgg

SEQ ID NO: 288413 - DNA, 25 bp, Mus musculus
cggaagcaggcgcatgctcatagca

SEQ ID NO: 288414 - DNA, 25 bp, Mus musculus
cagccggagcgccacggcatccgag

SEQ ID NO: 288415 - DNA, 25 bp, Mus musculus
catctcagcaatgacccgggccgtg

SEQ ID NO: 288416 - DNA, 25 bp, Mus musculus
gaatccgaggtctgcctgagtctca

SEQ ID NO: 288417 - DNA, 25 bp, Mus musculus
cacagcaggcccaggcgaagcggct

SEQ ID NO: 288418 - DNA, 25 bp, Mus musculus
tgcctgagtctcagacgagtatcct

SEQ ID NO: 288419 - DNA, 25 bp, Mus musculus
ggggtaccgctgcttatgcacgcag

SEQ ID NO: 288420 - DNA, 25 bp, Mus musculus
tgcttatgcacgcagctggggacgc

SEQ ID NO: 288421 - DNA, 25 bp, Mus musculus
ggacgtggtcccgagcggaacctca

SEQ ID NO: 288422 - DNA, 25 bp, Mus musculus
agcggaacctcagcgcgcgaggaac

SEQ ID NO: 288423 - DNA, 25 bp, Mus musculus
acctcagcgcgcgaggaactgagcg

SEQ ID NO: 288424 - DNA, 25 bp, Mus musculus
ggtttgcccgagactcctgcggttc

SEQ ID NO: 288425 - DNA, 25 bp, Mus musculus
gcccgagactcctgcggttcctgat

SEQ ID NO: 288426 - DNA, 25 bp, Mus musculus
aaacgcgaggaatccgaggtctgcc

SEQ ID NO: 288427 - DNA, 25 bp, Mus musculus
gctgttcctgctgcagggcagggca

SEQ ID NO: 288428 - DNA, 25 bp, Mus musculus
ggtccggaaagctcaaccctagatc

SEQ ID NO: 288429 - DNA, 25 bp, Mus musculus
tcaaccctagatctcaggcgccaga

SEQ ID NO: 288430 - DNA, 25 bp, Mus musculus
tcaccgaaggccagctcgtccatgg

SEQ ID NO: 288431 - DNA, 25 bp, Mus musculus
caggcgccagatcgcgcagtgcgca

SEQ ID NO: 288432 - DNA, 25 bp, Mus musculus
tctcggccagtgtctgttccagagc

SEQ ID NO: 288433 - DNA, 25 bp, Mus musculus
tgttccagagccgcctcaccgaagg

SEQ ID NO: 288434 - DNA, 25 bp, Mus musculus
cacccggcttcggactaggcccacg

SEQ ID NO: 288435 - DNA, 25 bp, Mus musculus
gcacgcgccaaagttcccggccaag

SEQ ID NO: 288436 - DNA, 25 bp, Mus musculus
ctcgccggacgtgcgaccctgcaca

SEQ ID NO: 288437 - DNA, 25 bp, Mus musculus
ccgggacacgcaccttcgatgtcgt

SEQ ID NO: 288438 - DNA, 25 bp, Mus musculus
ttcgatgtcgttcaaaaccgctgtg

SEQ ID NO: 288439 - DNA, 25 bp, Mus musculus
cgttcaaaaccgctgtgtccagttc

SEQ ID NO: 288440 - DNA, 25 bp, Mus musculus
aaccgctgtgtccagttcgcacatc

SEQ ID NO: 288441 - DNA, 25 bp, Mus musculus
tccagttcgcacatctcggccagtg

SEQ ID NO: 288442 - DNA, 25 bp, Mus musculus
cgcccgaatcgaggctcccggggct

SEQ ID NO: 288443 - DNA, 25 bp, Mus musculus
agggaccgggcagcccaactacgca

SEQ ID NO: 288444 - DNA, 25 bp, Mus musculus
ggcagcccaactacgcagcgaccgc

SEQ ID NO: 288445 - DNA, 25 bp, Mus musculus
agcgaccgcagcagcatagtccctg

SEQ ID NO: 288446 - DNA, 25 bp, Mus musculus
ccgcagcagcatagtccctggctga

SEQ ID NO: 288447 - DNA, 25 bp, Mus musculus
agcatagtccctggctgatgtgcaa

SEQ ID NO: 288448 - DNA, 25 bp, Mus musculus
tagtccctggctgatgtgcaagtcc

SEQ ID NO: 288449 - DNA, 25 bp, Mus musculus
tccctggctgatgtgcaagtcctac

SEQ ID NO: 288450 - DNA, 25 bp, Mus musculus
ctggctgatgtgcaagtcctacttc

SEQ ID NO: 288451 - DNA, 25 bp, Mus musculus
gctgatgtgcaagtcctacttcctt

SEQ ID NO: 288452 - DNA, 25 bp, Mus musculus
ccgggcccacgctacgcagggaccg

SEQ ID NO: 288453 - DNA, 25 bp, Mus musculus
tacttccttccggtgcgtcctggag

SEQ ID NO: 288454 - DNA, 25 bp, Mus musculus
caagtcctacttccttccggtgcgt

SEQ ID NO: 288455 - DNA, 25 bp, Mus musculus
gtgcaagtcctacttccttccggtg

SEQ ID NO: 288456 - DNA, 25 bp, Mus musculus
ctgaaatgctttgtgaagttcctgc

SEQ ID NO: 288457 - DNA, 25 bp, Mus musculus
tggagcagcgtttgctcggccacct

SEQ ID NO: 288458 - DNA, 25 bp, Mus musculus
gacgcaaggcattgattgctctgtg

SEQ ID NO: 288459 - DNA, 25 bp, Mus musculus
acgcctttccagacgcaaggcattg

SEQ ID NO: 288460 - DNA, 25 bp, Mus musculus
gcgcgagtcctggaaagagccatta

SEQ ID NO: 288461 - DNA, 25 bp, Mus musculus
tggaaagagccattaatcgagaagg

SEQ ID NO: 288462 - DNA, 25 bp, Mus musculus
aatcgagaaggcttgaaagagaggc

SEQ ID NO: 288463 - DNA, 25 bp, Mus musculus
caagatggagactccacggccggtc

SEQ ID NO: 288464 - DNA, 25 bp, Mus musculus
atggagactccacggccggtcgtaa

SEQ ID NO: 288465 - DNA, 25 bp, Mus musculus
cggtcgtaagccgtcggcccttctg

SEQ ID NO: 288466 - DNA, 25 bp, Mus musculus
gtcggcccttctgctgtactctgaa

SEQ ID NO: 288467 - DNA, 25 bp, Mus musculus
ctgctgtactctgaaatgctttgtg

SEQ ID NO: 288468 - DNA, 25 bp, Mus musculus
tttgtgaagttcctgcggttggtga

SEQ ID NO: 288469 - DNA, 25 bp, Mus musculus
tcggccacctggtttccagccacgc

SEQ ID NO: 288470 - DNA, 25 bp, Mus musculus
tgctgcgctcgctaagcttcttctg

SEQ ID NO: 288471 - DNA, 25 bp, Mus musculus
gctgctgtgtgacctcgagcgcctc

SEQ ID NO: 288472 - DNA, 25 bp, Mus musculus
gccctcgaaagggaccagaagtcaa

SEQ ID NO: 288473 - DNA, 25 bp, Mus musculus
attctccagtctgcgaggccctcga

SEQ ID NO: 288474 - DNA, 25 bp, Mus musculus
agccgtgttcttcccggattctcca

SEQ ID NO: 288475 - DNA, 25 bp, Mus musculus
ctcgagtcagaatcaggcccgagcc

SEQ ID NO: 288476 - DNA, 25 bp, Mus musculus
ctgtagcggagctcgagtcagaatc

SEQ ID NO: 288477 - DNA, 25 bp, Mus musculus
ccaagcttgctacgacttctctgta

SEQ ID NO: 288478 - DNA, 25 bp, Mus musculus
agcccgatccagagtccgcgcatgg

SEQ ID NO: 288479 - DNA, 25 bp, Mus musculus
acgcagagccagagcccgatccaga

SEQ ID NO: 288480 - DNA, 25 bp, Mus musculus
ggctcgaccagatagcgccgctatg

SEQ ID NO: 288481 - DNA, 25 bp, Mus musculus
ttcttccgcacagcgggtttccgct

SEQ ID NO: 288482 - DNA, 25 bp, Mus musculus
actttttcttcttccgcacagcggg

SEQ ID NO: 288483 - DNA, 25 bp, Mus musculus
gggtaaggcagcgtccacggaacac

SEQ ID NO: 288484 - DNA, 25 bp, Mus musculus
taagcacagtagtagccaggcgatg

SEQ ID NO: 288485 - DNA, 25 bp, Mus musculus
ttacgcgagccggaaaacctgctac

SEQ ID NO: 288486 - DNA, 25 bp, Mus musculus
agatcatggaggtgctcgaggcctc

SEQ ID NO: 288487 - DNA, 25 bp, Mus musculus
cgcccgagatcatggaggtgctcga

SEQ ID NO: 288488 - DNA, 25 bp, Mus musculus
ggcacctaccacttgggcgaccttg

SEQ ID NO: 288489 - DNA, 25 bp, Mus musculus
ccaaggacctcggagtacggagtgc

SEQ ID NO: 288490 - DNA, 25 bp, Mus musculus
agcagggactgcagcccaaggacct

SEQ ID NO: 288491 - DNA, 25 bp, Mus musculus
caaaaggcagactccggccgagggc

SEQ ID NO: 288492 - DNA, 25 bp, Mus musculus
cttcggagctgcaaaaggcagactc

SEQ ID NO: 288493 - DNA, 25 bp, Mus musculus
caacctcttgtcgatgaagcaggga

SEQ ID NO: 288494 - DNA, 25 bp, Mus musculus
tctgcgcaccaacctcttgtcgatg

SEQ ID NO: 288495 - DNA, 25 bp, Mus musculus
tagccaggcgatggcacggccctcg

SEQ ID NO: 288496 - DNA, 25 bp, Mus musculus
ctgctacaagttgctaagcacagta

SEQ ID NO: 288497 - DNA, 25 bp, Mus musculus
ccggaaaacctgctacaagttgcta

SEQ ID NO: 288498 - DNA, 25 bp, Mus musculus
cagaagctccgttatccagcgcgtc

SEQ ID NO: 288499 - DNA, 25 bp, Mus musculus
gccagccggacagccttacgcggga

SEQ ID NO: 288500 - DNA, 25 bp, Mus musculus
acgttgctgggtcaggcagccagcc

SEQ ID NO: 288501 - DNA, 25 bp, Mus musculus
atcgccgcagctagggacgttgctg

SEQ ID NO: 288502 - DNA, 25 bp, Mus musculus
ggcccgttgggacccagcagcagct

SEQ ID NO: 288503 - DNA, 25 bp, Mus musculus
tcctcttcacttgtcaggtcgccgg

SEQ ID NO: 288504 - DNA, 25 bp, Mus musculus
atacgctcctcaccatagactctgg

SEQ ID NO: 288505 - DNA, 25 bp, Mus musculus
gctgctcaccgaacaccagaatgtt

SEQ ID NO: 288506 - DNA, 25 bp, Mus musculus
tttgccggacggcagcttggacctg

SEQ ID NO: 288507 - DNA, 25 bp, Mus musculus
acgggtggacacttcgctcaagatc

SEQ ID NO: 288508 - DNA, 25 bp, Mus musculus
agatcgaagacctgcggcgacaatg

SEQ ID NO: 288509 - DNA, 25 bp, Mus musculus
ctgcggcgacaatgacaagagtggt

SEQ ID NO: 288510 - DNA, 25 bp, Mus musculus
accagaatgtttttgccggacggca

SEQ ID NO: 288511 - DNA, 25 bp, Mus musculus
aactgcagccacaaagagggccctc

SEQ ID NO: 288512 - DNA, 25 bp, Mus musculus
cagttcccagcgtcagctgctgctg

SEQ ID NO: 288513 - DNA, 25 bp, Mus musculus
ggctcacatccgctgggcgggactt

SEQ ID NO: 288514 - DNA, 25 bp, Mus musculus
acgacgcctgactgggtttcccacg

SEQ ID NO: 288515 - DNA, 25 bp, Mus musculus
agaccacgacgcctgactgggtttc

SEQ ID NO: 288516 - DNA, 25 bp, Mus musculus
gtggcagcctagaccacgacgcctg

SEQ ID NO: 288517 - DNA, 25 bp, Mus musculus
cagctcgtccctgtggcagcctaga

SEQ ID NO: 288518 - DNA, 25 bp, Mus musculus
ggaagccgagaccttggcctctcca

SEQ ID NO: 288519 - DNA, 25 bp, Mus musculus
tgggcagatggggacgaccttttcc

SEQ ID NO: 288520 - DNA, 25 bp, Mus musculus
ggagcaatcgcccagttcccagcgt

SEQ ID NO: 288521 - DNA, 25 bp, Mus musculus
caggcaggcccacgactttcctcta

SEQ ID NO: 288522 - DNA, 25 bp, Mus musculus
ctaaagagctggaagaaggaacgcc

SEQ ID NO: 288523 - DNA, 25 bp, Mus musculus
ggcctggctcacctaaagagctgga

SEQ ID NO: 288524 - DNA, 25 bp, Mus musculus
caccgtctttccgtgggttatggct

SEQ ID NO: 288525 - DNA, 25 bp, Mus musculus
ctcacaggtcgtgggcctggcgcca

SEQ ID NO: 288526 - DNA, 25 bp, Mus musculus
tgccggtcgtacttttgctccttga

SEQ ID NO: 288527 - DNA, 25 bp, Mus musculus
cactgcgcacgcgtcactgggaagc

SEQ ID NO: 288528 - DNA, 25 bp, Mus musculus
cgcgaacagcaaagccgcctaagga

SEQ ID NO: 288529 - DNA, 25 bp, Mus musculus
gctccttgagtatcttccctggctg

SEQ ID NO: 288530 - DNA, 25 bp, Mus musculus
tggccggcttgctcactcgtaaacc

SEQ ID NO: 288531 - DNA, 25 bp, Mus musculus
ttcgccgaacactcgggccagtggc

SEQ ID NO: 288532 - DNA, 25 bp, Mus musculus
agggcctgccgagactgtgcagccc

SEQ ID NO: 288533 - DNA, 25 bp, Mus musculus
cctcgtttagcgaacgagtagggag

SEQ ID NO: 288534 - DNA, 25 bp, Mus musculus
gtagaccaatacctgccggggcgca

SEQ ID NO: 288535 - DNA, 25 bp, Mus musculus
gccagcgcgggcgtagaccaatacc

SEQ ID NO: 288536 - DNA, 25 bp, Mus musculus
agcatgacgcatttctattggccag

SEQ ID NO: 288537 - DNA, 25 bp, Mus musculus
tccgataaagctagcatgacgcatt

SEQ ID NO: 288538 - DNA, 25 bp, Mus musculus
cgaacacggtttgctccgataaagc

SEQ ID NO: 288539 - DNA, 25 bp, Mus musculus
gagtatcttccctggctgcgccatg

SEQ ID NO: 288540 - DNA, 25 bp, Mus musculus
ggttctcacccagctggactcactg

SEQ ID NO: 288541 - DNA, 25 bp, Mus musculus
ctcccgcgaaccactgggtagctga

SEQ ID NO: 288542 - DNA, 25 bp, Mus musculus
tctgggcgcaaagtccgtgctgcgc

SEQ ID NO: 288543 - DNA, 25 bp, Mus musculus
accactgggtagctgagcgcgtcct

SEQ ID NO: 288544 - DNA, 25 bp, Mus musculus
ctgcttcctctgctctgggcgcaaa

SEQ ID NO: 288545 - DNA, 25 bp, Mus musculus
cgcgcgtcggaccagcttttcggaa

SEQ ID NO: 288546 - DNA, 25 bp, Mus musculus
ccaggacgacggtaggcgcagaccc

SEQ ID NO: 288547 - DNA, 25 bp, Mus musculus
gccaccactgttggggctacggcca

SEQ ID NO: 288548 - DNA, 25 bp, Mus musculus
catgaccggccaccactgttggggc

SEQ ID NO: 288549 - DNA, 25 bp, Mus musculus
ggacagcagcggcatgaccggccac

SEQ ID NO: 288550 - DNA, 25 bp, Mus musculus
cgcagacagagcgagcggacagaac

SEQ ID NO: 288551 - DNA, 25 bp, Mus musculus
actttaagaggctgctccaccgcgg

SEQ ID NO: 288552 - DNA, 25 bp, Mus musculus
gccgccactttaagaggctgctcca

SEQ ID NO: 288553 - DNA, 25 bp, Mus musculus
tcggaccagcttttcggaacccgca

SEQ ID NO: 288554 - DNA, 25 bp, Mus musculus
gatccgcccgatccacctgctcaca

SEQ ID NO: 288555 - DNA, 25 bp, Mus musculus
ttcaagcgacagagcctagggagct

SEQ ID NO: 288556 - DNA, 25 bp, Mus musculus
gctaagaaaagaggcgcgcctccga

SEQ ID NO: 288557 - DNA, 25 bp, Mus musculus
agccgctccacacagggtcgcttgg

SEQ ID NO: 288558 - DNA, 25 bp, Mus musculus
ccgctccacacagggtcgcttgggg

SEQ ID NO: 288559 - DNA, 25 bp, Mus musculus
tagcggggagcagcgaaaaggcaag

SEQ ID NO: 288560 - DNA, 25 bp, Mus musculus
ggcttcaagcgacagagcctaggga

SEQ ID NO: 288561 - DNA, 25 bp, Mus musculus
ctgctcacagcacgcgttcacctcc

SEQ ID NO: 288562 - DNA, 25 bp, Mus musculus
cgacagagcctagggagcttggcca

SEQ ID NO: 288563 - DNA, 25 bp, Mus musculus
cccagcttcgggtggggagagtaga

SEQ ID NO: 288564 - DNA, 25 bp, Mus musculus
agagtagaggatgcgcgcactcgct

SEQ ID NO: 288565 - DNA, 25 bp, Mus musculus
actcgctctcggtccagagccgaga

SEQ ID NO: 288566 - DNA, 25 bp, Mus musculus
agggctaagaaaagaggcgcgcctc

SEQ ID NO: 288567 - DNA, 25 bp, Mus musculus
tctcggtccagagccgagagcgtgc

SEQ ID NO: 288568 - DNA, 25 bp, Mus musculus
gtaattattacagccctgcgcggcg

SEQ ID NO: 288569 - DNA, 25 bp, Mus musculus
gacgcacggacccaaggattctcga

SEQ ID NO: 288570 - DNA, 25 bp, Mus musculus
ggtggccaccttgccatgtcgctct

SEQ ID NO: 288571 - DNA, 25 bp, Mus musculus
tgtcgctctgcacccactgaactag

SEQ ID NO: 288572 - DNA, 25 bp, Mus musculus
gcccaaggatgtctgctctgaggaa

SEQ ID NO: 288573 - DNA, 25 bp, Mus musculus
cccggacctagactgggaatgaatg

SEQ ID NO: 288574 - DNA, 25 bp, Mus musculus
ggggccacttgtgccctttgcaaca

SEQ ID NO: 288575 - DNA, 25 bp, Mus musculus
ggctcctctgcttgacgctggccag

SEQ ID NO: 288576 - DNA, 25 bp, Mus musculus
ctgctgggctctccaagtgcgagcc

SEQ ID NO: 288577 - DNA, 25 bp, Mus musculus
gttgctaagcgaagcgctacccagc

SEQ ID NO: 288578 - DNA, 25 bp, Mus musculus
cgctacccagcgcagggttttgtaa

SEQ ID NO: 288579 - DNA, 25 bp, Mus musculus
tgctgttgctgttctcgggctcttt

SEQ ID NO: 288580 - DNA, 25 bp, Mus musculus
gacagactgcggatcgacgcacgga

SEQ ID NO: 288581 - DNA, 25 bp, Mus musculus
gggctctttccctaacgatcgcaga

SEQ ID NO: 288582 - DNA, 25 bp, Mus musculus
cgctgggccactgtgaccagagctc

SEQ ID NO: 288583 - DNA, 25 bp, Mus musculus
tggcctacggcagtaactgcaggcg

SEQ ID NO: 288584 - DNA, 25 bp, Mus musculus
tcttcctggcctacggcagtaactg

SEQ ID NO: 288585 - DNA, 25 bp, Mus musculus
agcgcttccgggtttgccgactcct

SEQ ID NO: 288586 - DNA, 25 bp, Mus musculus
gccctccttttctcagctcaccacg

SEQ ID NO: 288587 - DNA, 25 bp, Mus musculus
tacctccaccaggtccaaggcgctg

SEQ ID NO: 288588 - DNA, 25 bp, Mus musculus
gctgcacccgcacttactgtcgctg

SEQ ID NO: 288589 - DNA, 25 bp, Mus musculus
cgggaagggaagacccagccaagca

SEQ ID NO: 288590 - DNA, 25 bp, Mus musculus
ctcagcctcgggaagggaagaccca

SEQ ID NO: 288591 - DNA, 25 bp, Mus musculus
cccacacgcgggaccagagaagagt

SEQ ID NO: 288592 - DNA, 25 bp, Mus musculus
ttctggatctttcgggccgacctgt

SEQ ID NO: 288593 - DNA, 25 bp, Mus musculus
aagccttctggatctttcgggccga

SEQ ID NO: 288594 - DNA, 25 bp, Mus musculus
cggacccgcaaagccttctggatct

SEQ ID NO: 288595 - DNA, 25 bp, Mus musculus
ccgttcagcgcttccgggtttgccg

SEQ ID NO: 288596 - DNA, 25 bp, Mus musculus
actccgggtgccagaggacaggccc

SEQ ID NO: 288597 - DNA, 25 bp, Mus musculus
cccgaactccgggtgccagaggaca

SEQ ID NO: 288598 - DNA, 25 bp, Mus musculus
ccaatgggtgcaaggcccccgagtg

SEQ ID NO: 288599 - DNA, 25 bp, Mus musculus
cgtcagcgtgcgctcgcggtactct

SEQ ID NO: 288600 - DNA, 25 bp, Mus musculus
cgccgtagccaatgggtgcaaggcc

SEQ ID NO: 288601 - DNA, 25 bp, Mus musculus
ctcgcggtactctggttttggtcac

SEQ ID NO: 288602 - DNA, 25 bp, Mus musculus
tgccagaggacaggccccgttcgcg

SEQ ID NO: 288603 - DNA, 25 bp, Mus musculus
cgcggtactctggttttggtcacgt

SEQ ID NO: 288604 - DNA, 25 bp, Mus musculus
cggtactctggttttggtcacgtgc

SEQ ID NO: 288605 - DNA, 25 bp, Mus musculus
gccgtagccaatgggtgcaaggccc

SEQ ID NO: 288606 - DNA, 25 bp, Mus musculus
ctctggttttggtcacgtgcccagc

SEQ ID NO: 288607 - DNA, 25 bp, Mus musculus
tggttttggtcacgtgcccagcgcc

SEQ ID NO: 288608 - DNA, 25 bp, Mus musculus
gggcagtatgacctgagggtacgcg

SEQ ID NO: 288609 - DNA, 25 bp, Mus musculus
tactctggttttggtcacgtgccca

SEQ ID NO: 288610 - DNA, 25 bp, Mus musculus
gcagcaaccgcggaactgtgctcag

SEQ ID NO: 288611 - DNA, 25 bp, Mus musculus
actgtgctcaggaccagagtgagcc

SEQ ID NO: 288612 - DNA, 25 bp, Mus musculus
ccagagtgagccgagaggatccgcc

SEQ ID NO: 288613 - DNA, 25 bp, Mus musculus
tgcggacgccttccctagcctagtt

SEQ ID NO: 288614 - DNA, 25 bp, Mus musculus
ctagcctagtttacgggtacctcag

SEQ ID NO: 288615 - DNA, 25 bp, Mus musculus
tagtttacgggtacctcaggtgatg

SEQ ID NO: 288616 - DNA, 25 bp, Mus musculus
acgagctggcccctggtcatggtca

SEQ ID NO: 288617 - DNA, 25 bp, Mus musculus
gaggagacgactgcttagccggttc

SEQ ID NO: 288618 - DNA, 25 bp, Mus musculus
gacgactgcttagccggttctctgc

SEQ ID NO: 288619 - DNA, 25 bp, Mus musculus
ttagccggttctctgcaccagcttc

SEQ ID NO: 288620 - DNA, 25 bp, Mus musculus
aaccgcggaactgtgctcaggacca

SEQ ID NO: 288621 - DNA, 25 bp, Mus musculus
ttagtactggagcaccggtgagctg

SEQ ID NO: 288622 - DNA, 25 bp, Mus musculus
agcttccttagtactggagcaccgg

SEQ ID NO: 288623 - DNA, 25 bp, Mus musculus
gttctctgcaccagcttccttagta

SEQ ID NO: 288624 - DNA, 25 bp, Mus musculus
acgaagaattgggatggcagctcta

SEQ ID NO: 288625 - DNA, 25 bp, Mus musculus
tcggaggagccttcgggccagtcca

SEQ ID NO: 288626 - DNA, 25 bp, Mus musculus
ccgagcagcagcaccttgtaaacgc

SEQ ID NO: 288627 - DNA, 25 bp, Mus musculus
cactgcctccagaactgagcgagtc

SEQ ID NO: 288628 - DNA, 25 bp, Mus musculus
aaggtctcgctcgtccaccggcatg

SEQ ID NO: 288629 - DNA, 25 bp, Mus musculus
aactgagcgagtcggaggagccttc

SEQ ID NO: 288630 - DNA, 25 bp, Mus musculus
acgccgtctggggaacgaagaattg

SEQ ID NO: 288631 - DNA, 25 bp, Mus musculus
ctctggccctgtgtccgagttccag

SEQ ID NO: 288632 - DNA, 25 bp, Mus musculus
agttccagcggcagtcgttgccagg

SEQ ID NO: 288633 - DNA, 25 bp, Mus musculus
gctagcgccgcctgaaggtctcgct

SEQ ID NO: 288634 - DNA, 25 bp, Mus musculus
caccggcatgctcctgcggtgcagt

SEQ ID NO: 288635 - DNA, 25 bp, Mus musculus
ttgctccgctgccaccattcagggt

SEQ ID NO: 288636 - DNA, 25 bp, Mus musculus
gaattgggatggcagctctatcgcg

SEQ ID NO: 288637 - DNA, 25 bp, Mus musculus
cattcagggtcatcgtgttggacgc

SEQ ID NO: 288638 - DNA, 25 bp, Mus musculus
ggatatcgaagatctcccgggcgtc

SEQ ID NO: 288639 - DNA, 25 bp, Mus musculus
atgctgtccggcacttcctcatctt

SEQ ID NO: 288640 - DNA, 25 bp, Mus musculus
ttagcgttctctaagagcccgccgc

SEQ ID NO: 288641 - DNA, 25 bp, Mus musculus
tccgcgcacttcctgggaacgagga

SEQ ID NO: 288642 - DNA, 25 bp, Mus musculus
gggacacgccacactccagggattc

SEQ ID NO: 288643 - DNA, 25 bp, Mus musculus
attcggcgagtagtttgctagaagc

SEQ ID NO: 288644 - DNA, 25 bp, Mus musculus
cttcggttcttagccgtgggatcct

SEQ ID NO: 288645 - DNA, 25 bp, Mus musculus
agctggatcgcaggaagccaacacc

SEQ ID NO: 288646 - DNA, 25 bp, Mus musculus
caccgtctgacaagggcactaaagg

SEQ ID NO: 288647 - DNA, 25 bp, Mus musculus
tccagctcgctgtcacgctatcgta

SEQ ID NO: 288648 - DNA, 25 bp, Mus musculus
cgctatcgtagaaccgtagatctaa

SEQ ID NO: 288649 - DNA, 25 bp, Mus musculus
ggctgcgcatcacttcttgccgaca

SEQ ID NO: 288650 - DNA, 25 bp, Mus musculus
ctagaagcggtgtatttgtcgtgcg

SEQ ID NO: 288651 - DNA, 25 bp, Mus musculus
gcgccctgcagcgacggatatcgaa

SEQ ID NO: 288652 - DNA, 25 bp, Mus musculus
gactcctgatttcggggccgtctct

SEQ ID NO: 288653 - DNA, 25 bp, Mus musculus
cctgaaacaaagagaagcgggagtc

SEQ ID NO: 288654 - DNA, 25 bp, Mus musculus
tcccggaccagaggagcaagttcga

SEQ ID NO: 288655 - DNA, 25 bp, Mus musculus
caagttcgagaacgaggagttcttc

SEQ ID NO: 288656 - DNA, 25 bp, Mus musculus
agttcttcaggaagctgagccgcga

SEQ ID NO: 288657 - DNA, 25 bp, Mus musculus
tctgcttgcccttatcggagccgcg

SEQ ID NO: 288658 - DNA, 25 bp, Mus musculus
ccgccgcggatttgactcctgattt

SEQ ID NO: 288659 - DNA, 25 bp, Mus musculus
cttgcagattaagtacacgggcttc

SEQ ID NO: 288660 - DNA, 25 bp, Mus musculus
gaggagcgccagacacgcttccaga

SEQ ID NO: 288661 - DNA, 25 bp, Mus musculus
acggtcgctcggagatcgtaagtcg

SEQ ID NO: 288662 - DNA, 25 bp, Mus musculus
gggcgcaggctcacttccttagtcc

SEQ ID NO: 288663 - DNA, 25 bp, Mus musculus
ttccttagtccggattcgaaaagca

SEQ ID NO: 288664 - DNA, 25 bp, Mus musculus
ctcggcaatccgagcggagctccaa

SEQ ID NO: 288665 - DNA, 25 bp, Mus musculus
aggttgtcgcctaggctgtgacctc

SEQ ID NO: 288666 - DNA, 25 bp, Mus musculus
tctttacagtgcgctgggcagtgac

SEQ ID NO: 288667 - DNA, 25 bp, Mus musculus
cagtgacggtgtggtctttacagtg

SEQ ID NO: 288668 - DNA, 25 bp, Mus musculus
cggtgtggtctttacagtgcgctgg

SEQ ID NO: 288669 - DNA, 25 bp, Mus musculus
ctttacagtgcgctgggcagtgacg

SEQ ID NO: 288670 - DNA, 25 bp, Mus musculus
gtgtggtctttacagtgcgctgggc

SEQ ID NO: 288671 - DNA, 25 bp, Mus musculus
tttacagtgcgctgggcagtgacgg

SEQ ID NO: 288672 - DNA, 25 bp, Mus musculus
tggtctttacagtgcgctgggcagt

SEQ ID NO: 288673 - DNA, 25 bp, Mus musculus
gtgacggtgtggtctttacagtgcg

SEQ ID NO: 288674 - DNA, 25 bp, Mus musculus
agtgacggtgtggtctttacagtgc

SEQ ID NO: 288675 - DNA, 25 bp, Mus musculus
gcagtgacggtgtggtctttacagt

SEQ ID NO: 288676 - DNA, 25 bp, Mus musculus
gtctttacagtgcgctgggcagtga

SEQ ID NO: 288677 - DNA, 25 bp, Mus musculus
tgacggtgtggtctttacagtgcgc

SEQ ID NO: 288678 - DNA, 25 bp, Mus musculus
tgtggtctttacagtgcgctgggca

SEQ ID NO: 288679 - DNA, 25 bp, Mus musculus
ggcagtgacggtgtggtctttacag

SEQ ID NO: 288680 - DNA, 25 bp, Mus musculus
ctctgatccagagtttgcgcgtgcg

SEQ ID NO: 288681 - DNA, 25 bp, Mus musculus
gatccagagtttgcgcgtgcgcgac

SEQ ID NO: 288682 - DNA, 25 bp, Mus musculus
gccttcatgatttagccccgccttt

SEQ ID NO: 288683 - DNA, 25 bp, Mus musculus
ctttgccacgctttacggcccggca

SEQ ID NO: 288684 - DNA, 25 bp, Mus musculus
cggcacgccacttttgctgcagttg

SEQ ID NO: 288685 - DNA, 25 bp, Mus musculus
ccacttttgctgcagttgctctggg

SEQ ID NO: 288686 - DNA, 25 bp, Mus musculus
aagtgtgttgttgtgttcgtgctgc

SEQ ID NO: 288687 - DNA, 25 bp, Mus musculus
ttgtgttcgtgctgccgtcgccgcc

SEQ ID NO: 288688 - DNA, 25 bp, Mus musculus
tggcgagagcgaccagtcagcagct

SEQ ID NO: 288689 - DNA, 25 bp, Mus musculus
gtcagcagctgcgtgctctcctcag

SEQ ID NO: 288690 - DNA, 25 bp, Mus musculus
agctgcgtgctctcctcaggccggg

SEQ ID NO: 288691 - DNA, 25 bp, Mus musculus
tcaggccgggtcctgtctgcgctgc

SEQ ID NO: 288692 - DNA, 25 bp, Mus musculus
ggcgctgctgttgctacagcctctc

SEQ ID NO: 288693 - DNA, 25 bp, Mus musculus
cgggtctggcctctgatccagagtt

SEQ ID NO: 288694 - DNA, 25 bp, Mus musculus
ctccagcagggtgcgccagtgcgaa

SEQ ID NO: 288695 - DNA, 25 bp, Mus musculus
tgagcagcagcgtaagccacgcgtc

SEQ ID NO: 288696 - DNA, 25 bp, Mus musculus
cagatacccgccgaagtcaaagggg

SEQ ID NO: 288697 - DNA, 25 bp, Mus musculus
tggcgcgcagatacccgccgaagtc

SEQ ID NO: 288698 - DNA, 25 bp, Mus musculus
aagcgccgttggtccttggcgcgca

SEQ ID NO: 288699 - DNA, 25 bp, Mus musculus
tttgcgacgctggttaatgagcagc

SEQ ID NO: 288700 - DNA, 25 bp, Mus musculus
tgcggcatttgcgacgctggttaat

SEQ ID NO: 288701 - DNA, 25 bp, Mus musculus
cgatgagcaggtccggcgaaccgcc

SEQ ID NO: 288702 - DNA, 25 bp, Mus musculus
acttgacagcgatgagcaggtccgg

SEQ ID NO: 288703 - DNA, 25 bp, Mus musculus
ccaacaagaacactcggcgcacgag

SEQ ID NO: 288704 - DNA, 25 bp, Mus musculus
taagccacgcgtctgggcaaaggcg

SEQ ID NO: 288705 - DNA, 25 bp, Mus musculus
gctcaaagtccgcagccacagactt

SEQ ID NO: 288706 - DNA, 25 bp, Mus musculus
gccacagacttgacagcgatgagca

SEQ ID NO: 288707 - DNA, 25 bp, Mus musculus
tgggcacgcccaacaagaacactcg

SEQ ID NO: 288708 - DNA, 25 bp, Mus musculus
ctggcccaacagatcctctgctaga

SEQ ID NO: 288709 - DNA, 25 bp, Mus musculus
ccctcggcttgcatgaaacggcgca

SEQ ID NO: 288710 - DNA, 25 bp, Mus musculus
aggcctgctcgtatagcccatcacg

SEQ ID NO: 288711 - DNA, 25 bp, Mus musculus
aggatctctcagtgcccgacagtta

SEQ ID NO: 288712 - DNA, 25 bp, Mus musculus
gcgcgcaaacgtctgctggtcttga

SEQ ID NO: 288713 - DNA, 25 bp, Mus musculus
gtggccggttcactgcagaagaagt

SEQ ID NO: 288714 - DNA, 25 bp, Mus musculus
cctgctcagatcgacctgctggtga

SEQ ID NO: 288715 - DNA, 25 bp, Mus musculus
cgcttctgctgatgaacctcaccta

SEQ ID NO: 288716 - DNA, 25 bp, Mus musculus
gctgcccgtggaacagaaaagtctg

SEQ ID NO: 288717 - DNA, 25 bp, Mus musculus
ttcgaacctgcagaagctacctgta

SEQ ID NO: 288718 - DNA, 25 bp, Mus musculus
agctacctgtatggctccaccctgg

SEQ ID NO: 288719 - DNA, 25 bp, Mus musculus
gtcacacgtcagtttgcagagctca

SEQ ID NO: 288720 - DNA, 25 bp, Mus musculus
gcagcaccttctgggctaagatgta

SEQ ID NO: 288721 - DNA, 25 bp, Mus musculus
gaaccgcaactggacgatgagctga

SEQ ID NO: 288722 - DNA, 25 bp, Mus musculus
gtgccctagcagagtcgccgggtcc

SEQ ID NO: 288723 - DNA, 25 bp, Mus musculus
ccgccgcacactcgcctggctctgc

SEQ ID NO: 288724 - DNA, 25 bp, Mus musculus
tccgcactaacctggccgccgcaca

SEQ ID NO: 288725 - DNA, 25 bp, Mus musculus
tgcaccgagggagcccacccaccct

SEQ ID NO: 288726 - DNA, 25 bp, Mus musculus
tctcgctttgctggggctgcaccga

SEQ ID NO: 288727 - DNA, 25 bp, Mus musculus
atctctcgctttgctggggctgcac

SEQ ID NO: 288728 - DNA, 25 bp, Mus musculus
agccagatctctcgctttgctgggg

SEQ ID NO: 288729 - DNA, 25 bp, Mus musculus
tcgggaagccagatctctcgctttg

SEQ ID NO: 288730 - DNA, 25 bp, Mus musculus
ggtgctcgccctcgggaagccagat

SEQ ID NO: 288731 - DNA, 25 bp, Mus musculus
aatcgcgtgtcaccaccgcgcggtg

SEQ ID NO: 288732 - DNA, 25 bp, Mus musculus
aactggccagcaatcgcgtgtcacc

SEQ ID NO: 288733 - DNA, 25 bp, Mus musculus
ccactaactggccagcaatcgcgtg

SEQ ID NO: 288734 - DNA, 25 bp, Mus musculus
gctgccactaactggccagcaatcg

SEQ ID NO: 288735 - DNA, 25 bp, Mus musculus
caccaaaacagtccgaccggccgct

SEQ ID NO: 288736 - DNA, 25 bp, Mus musculus
ggctccgttgactaaggcgcttttg

SEQ ID NO: 288737 - DNA, 25 bp, Mus musculus
tgcgcgggcttgagagaaatacact

SEQ ID NO: 288738 - DNA, 25 bp, Mus musculus
cgggcaccctatacctcgggaatga

SEQ ID NO: 288739 - DNA, 25 bp, Mus musculus
caagggcctttgtactgtgactgtg

SEQ ID NO: 288740 - DNA, 25 bp, Mus musculus
ggcccgacattcaaggagacctcaa

SEQ ID NO: 288741 - DNA, 25 bp, Mus musculus
tcctgcgtcctgtgatctcgagtca

SEQ ID NO: 288742 - DNA, 25 bp, Mus musculus
accagtttcctagcgtcctcgcaga

SEQ ID NO: 288743 - DNA, 25 bp, Mus musculus
cctctgcctgatgaagcctgggcga

SEQ ID NO: 288744 - DNA, 25 bp, Mus musculus
tacactgcttctgcgtggtgagacc

SEQ ID NO: 288745 - DNA, 25 bp, Mus musculus
cgctgaaactttgcgcgccctcgag

SEQ ID NO: 288746 - DNA, 25 bp, Mus musculus
tgctgcgtctcaacctctccggtga

SEQ ID NO: 288747 - DNA, 25 bp, Mus musculus
ctgtgcttccagatgaggccgtgac

SEQ ID NO: 288748 - DNA, 25 bp, Mus musculus
ctagtctctttaggggctccgttga

SEQ ID NO: 288749 - DNA, 25 bp, Mus musculus
tgagaccctcggtactggacgcctt

SEQ ID NO: 288750 - DNA, 25 bp, Mus musculus
ctacaggggtgctgaacggattccc

SEQ ID NO: 288751 - DNA, 25 bp, Mus musculus
gtctaaccagcccacttccgattgg

SEQ ID NO: 288752 - DNA, 25 bp, Mus musculus
ctcgccctctgggtgcatctctatt

SEQ ID NO: 288753 - DNA, 25 bp, Mus musculus
gtgcatctctattgggcagcgtcta

SEQ ID NO: 288754 - DNA, 25 bp, Mus musculus
ctctattgggcagcgtctaaccagc

SEQ ID NO: 288755 - DNA, 25 bp, Mus musculus
ccggactcctgtgtgccacgggtct

SEQ ID NO: 288756 - DNA, 25 bp, Mus musculus
agcccacttccgattggacgacact

SEQ ID NO: 288757 - DNA, 25 bp, Mus musculus
ggacgacactccactctcagtgaag

SEQ ID NO: 288758 - DNA, 25 bp, Mus musculus
gtccgattgggcacgaagcaagcta

SEQ ID NO: 288759 - DNA, 25 bp, Mus musculus
ggtcagccgctgtggctcactcgac

SEQ ID NO: 288760 - DNA, 25 bp, Mus musculus
gggtctccgtcagcctagcggcaca

SEQ ID NO: 288761 - DNA, 25 bp, Mus musculus
ttaccaagacactgccctacagggg

SEQ ID NO: 288762 - DNA, 25 bp, Mus musculus
cgcacgtgaggtgatttcagtgccg

SEQ ID NO: 288763 - DNA, 25 bp, Mus musculus
agctaagtcactagggtctccgtca

SEQ ID NO: 288764 - DNA, 25 bp, Mus musculus
tcgtgggtgatttctccggtgctag

SEQ ID NO: 288765 - DNA, 25 bp, Mus musculus
tggggccctagtctccagtgccact

SEQ ID NO: 288766 - DNA, 25 bp, Mus musculus
agtgtttgctcagcgcgcgacactg

SEQ ID NO: 288767 - DNA, 25 bp, Mus musculus
cgtgcgcagtggatagtgtttgctc

SEQ ID NO: 288768 - DNA, 25 bp, Mus musculus
gtctaccttggtagcgtcctaggga

SEQ ID NO: 288769 - DNA, 25 bp, Mus musculus
ggcgctggatgggatgatcctaccc

SEQ ID NO: 288770 - DNA, 25 bp, Mus musculus
cccatggcgctggatgggatgatcc

SEQ ID NO: 288771 - DNA, 25 bp, Mus musculus
aactgtgtagcctgctccaggcacc

SEQ ID NO: 288772 - DNA, 25 bp, Mus musculus
cgctgcgaactgtgtagcctgctcc

SEQ ID NO: 288773 - DNA, 25 bp, Mus musculus
attctatctggctccggtcacgagg

SEQ ID NO: 288774 - DNA, 25 bp, Mus musculus
cagcgaccggtattctatctggctc

SEQ ID NO: 288775 - DNA, 25 bp, Mus musculus
gctccggtcacgaggtgtgtctacg

SEQ ID NO: 288776 - DNA, 25 bp, Mus musculus
ccagtgccactcagcgaccggtatt

SEQ ID NO: 288777 - DNA, 25 bp, Mus musculus
cgacactgtcgtgggtgatttctcc

SEQ ID NO: 288778 - DNA, 25 bp, Mus musculus
agagccagtgaagcatgcccttccc

SEQ ID NO: 288779 - DNA, 25 bp, Mus musculus
cagcgtcgccaccagagttcgcaga

SEQ ID NO: 288780 - DNA, 25 bp, Mus musculus
cgccaccagagttcgcagagccagt

SEQ ID NO: 288781 - DNA, 25 bp, Mus musculus
ttcgcagagccagtgaagcatgccc

SEQ ID NO: 288782 - DNA, 25 bp, Mus musculus
ttgcagctgctgttcgcgtacccac

SEQ ID NO: 288783 - DNA, 25 bp, Mus musculus
gctcgcttggccctttctgcactgt

SEQ ID NO: 288784 - DNA, 25 bp, Mus musculus
ttggccctttctgcactgtcatctg

SEQ ID NO: 288785 - DNA, 25 bp, Mus musculus
tctgcactgtcatctgccccggtga

SEQ ID NO: 288786 - DNA, 25 bp, Mus musculus
cccggtgaggctcaactccggagtg

SEQ ID NO: 288787 - DNA, 25 bp, Mus musculus
gctcaactccggagtgggactatcc

SEQ ID NO: 288788 - DNA, 25 bp, Mus musculus
tccggagtgggactatccgaaacgc

SEQ ID NO: 288789 - DNA, 25 bp, Mus musculus
gtgggactatccgaaacgctccgga

SEQ ID NO: 288790 - DNA, 25 bp, Mus musculus
tatccgaaacgctccggaccacaag

SEQ ID NO: 288791 - DNA, 25 bp, Mus musculus
ccagagttcgcagagccagtgaagc

SEQ ID NO: 288792 - DNA, 25 bp, Mus musculus
tcactgggcccgagtacgaagcctt

SEQ ID NO: 288793 - DNA, 25 bp, Mus musculus
cttcttgacacagcagaaatgggca

SEQ ID NO: 288794 - DNA, 25 bp, Mus musculus
gatgcgctgcccgatgcagagcgca

SEQ ID NO: 288795 - DNA, 25 bp, Mus musculus
aaatgggcaacgtgcaggagcgccc

SEQ ID NO: 288796 - DNA, 25 bp, Mus musculus
gcaggagcgcccatcagagaccatt

SEQ ID NO: 288797 - DNA, 25 bp, Mus musculus
agcgcccatcagagaccattgaccg

SEQ ID NO: 288798 - DNA, 25 bp, Mus musculus
tggtagagacattgcaggctgactc

SEQ ID NO: 288799 - DNA, 25 bp, Mus musculus
cccgagtacgaagccttggatgcgc

SEQ ID NO: 288800 - DNA, 25 bp, Mus musculus
gggcgtcctcactgggcccgagtac

SEQ ID NO: 288801 - DNA, 25 bp, Mus musculus
tcagagaccattgaccgggaacgga

SEQ ID NO: 288802 - DNA, 25 bp, Mus musculus
actctgggctgctgctggatgcgct

SEQ ID NO: 288803 - DNA, 25 bp, Mus musculus
cggaaacggctggtagagacattgc

SEQ ID NO: 288804 - DNA, 25 bp, Mus musculus
cattgaccgggaacggaaacggctg

SEQ ID NO: 288805 - DNA, 25 bp, Mus musculus
gtacgaagccttggatgcgctgccc

SEQ ID NO: 288806 - DNA, 25 bp, Mus musculus
cgaactgagtgctgcctgacgatgc

SEQ ID NO: 288807 - DNA, 25 bp, Mus musculus
agacgtgatcctcgctgcaggaata

SEQ ID NO: 288808 - DNA, 25 bp, Mus musculus
cctcgcacctcacgtcgggaaattg

SEQ ID NO: 288809 - DNA, 25 bp, Mus musculus
tgcaggaataccaccacgtgcgtca

SEQ ID NO: 288810 - DNA, 25 bp, Mus musculus
ggcgagggcgatgaaaccatttact

SEQ ID NO: 288811 - DNA, 25 bp, Mus musculus
cgtggctttattacgcaaacagatg

SEQ ID NO: 288812 - DNA, 25 bp, Mus musculus
cgggaaattgctgcctcaagcctgc

SEQ ID NO: 288813 - DNA, 25 bp, Mus musculus
cataggtgagatgctgccagaatac

SEQ ID NO: 288814 - DNA, 25 bp, Mus musculus
gggcacgcagtccacaaagagagca

SEQ ID NO: 288815 - DNA, 25 bp, Mus musculus
actgcttgccggtagtagatacata

SEQ ID NO: 288816 - DNA, 25 bp, Mus musculus
cagacgtgtcgtagacgtggcttta

SEQ ID NO: 288817 - DNA, 25 bp, Mus musculus
cgctcacacgaagacgcaagggcca

SEQ ID NO: 288818 - DNA, 25 bp, Mus musculus
ttgagcagttccctcagcgcgagca

SEQ ID NO: 288819 - DNA, 25 bp, Mus musculus
tagatgtaccactgtgcacggaccc

SEQ ID NO: 288820 - DNA, 25 bp, Mus musculus
ccacacggtagcttggtgggcagca

SEQ ID NO: 288821 - DNA, 25 bp, Mus musculus
agggtgccaccaatgcctccgctgt

SEQ ID NO: 288822 - DNA, 25 bp, Mus musculus
acgctacggcgcaggccactgtgca

SEQ ID NO: 288823 - DNA, 25 bp, Mus musculus
gggcccatagctcaaccacacggta

SEQ ID NO: 288824 - DNA, 25 bp, Mus musculus
gaagacatcgctgccgccagtctcg

SEQ ID NO: 288825 - DNA, 25 bp, Mus musculus
cctgtagcgcccgaagacatcgctg

SEQ ID NO: 288826 - DNA, 25 bp, Mus musculus
atgcaaagtggacccgctccaggcc

SEQ ID NO: 288827 - DNA, 25 bp, Mus musculus
ccactgtgcagggtgtgggcccata

SEQ ID NO: 288828 - DNA, 25 bp, Mus musculus
agcacaggcgatgcaaagtggaccc

SEQ ID NO: 288829 - DNA, 25 bp, Mus musculus
cccgcgaggagttgctgcacgctac

SEQ ID NO: 288830 - DNA, 25 bp, Mus musculus
ccctggctccggaagcacaggcgat

SEQ ID NO: 288831 - DNA, 25 bp, Mus musculus
aggctacctgcagagcctcaagcca

SEQ ID NO: 288832 - DNA, 25 bp, Mus musculus
caactcggcgggcaaggctacctgc

SEQ ID NO: 288833 - DNA, 25 bp, Mus musculus
aatgcctccgctgttgccaactcgg

SEQ ID NO: 288834 - DNA, 25 bp, Mus musculus
ccaaggacggcgtgcttgacctcaa

SEQ ID NO: 288835 - DNA, 25 bp, Mus musculus
agcagccttgatagctccggtggcc

SEQ ID NO: 288836 - DNA, 25 bp, Mus musculus
ccggagttttgcgtccggatcagca

SEQ ID NO: 288837 - DNA, 25 bp, Mus musculus
tccggatcagcagacgggagttgca

SEQ ID NO: 288838 - DNA, 25 bp, Mus musculus
cagacgggagttgcaccagataccc

SEQ ID NO: 288839 - DNA, 25 bp, Mus musculus
cttgacctcaagctggtgcgctccg

SEQ ID NO: 288840 - DNA, 25 bp, Mus musculus
gaagcggaagcagccttgatagctc

SEQ ID NO: 288841 - DNA, 25 bp, Mus musculus
tcgctcttgcaggaagccaaggacg

SEQ ID NO: 288842 - DNA, 25 bp, Mus musculus
gatagctccggtggcccggcgacta

SEQ ID NO: 288843 - DNA, 25 bp, Mus musculus
cggggactccaagccggcacgagaa

SEQ ID NO: 288844 - DNA, 25 bp, Mus musculus
gaagagtctgggacttctcaccacc

SEQ ID NO: 288845 - DNA, 25 bp, Mus musculus
gggacttctcaccaccaagttcgtg

SEQ ID NO: 288846 - DNA, 25 bp, Mus musculus
ccaagttcgtgtcgctcttgcagga

SEQ ID NO: 288847 - DNA, 25 bp, Mus musculus
cagataccctgggaaggcgcgagac

SEQ ID NO: 288848 - DNA, 25 bp, Mus musculus
tgaaatccacttccgcccaggagcg

SEQ ID NO: 288849 - DNA, 25 bp, Mus musculus
ccagagttttcaggtcgtgggatcc

SEQ ID NO: 288850 - DNA, 25 bp, Mus musculus
gggcgagctgtcagatagcctttcc

SEQ ID NO: 288851 - DNA, 25 bp, Mus musculus
agcgagtccgccatcgcagttctgc

SEQ ID NO: 288852 - DNA, 25 bp, Mus musculus
aagtgtagtcccaccgactcagggg

SEQ ID NO: 288853 - DNA, 25 bp, Mus musculus
cgaacgattgcgctctttaccggaa

SEQ ID NO: 288854 - DNA, 25 bp, Mus musculus
ctttaccggaagtgcatgtgctgcc

SEQ ID NO: 288855 - DNA, 25 bp, Mus musculus
tgtggtgtctactgactgcagttcc

SEQ ID NO: 288856 - DNA, 25 bp, Mus musculus
gttccagttactcgcccttgtttca

SEQ ID NO: 288857 - DNA, 25 bp, Mus musculus
accggcaaagctttcccgatgttgg

SEQ ID NO: 288858 - DNA, 25 bp, Mus musculus
cagaagggctcgaaggcataaggca

SEQ ID NO: 288859 - DNA, 25 bp, Mus musculus
gggcgccacccaatggactgtgcta

SEQ ID NO: 288860 - DNA, 25 bp, Mus musculus
gccgtgcaggactacaccaggacta

SEQ ID NO: 288861 - DNA, 25 bp, Mus musculus
ccacgcaaggttttctgggaagtgt

SEQ ID NO: 288862 - DNA, 25 bp, Mus musculus
tgctgcaacttcaactcgactaaac

SEQ ID NO: 288863 - DNA, 25 bp, Mus musculus
tgcactctcacagttaccacggata

SEQ ID NO: 288864 - DNA, 25 bp, Mus musculus
tccattgctaggagggcgggaaaac

SEQ ID NO: 288865 - DNA, 25 bp, Mus musculus
ggtgatcccgttagttccattgcta

SEQ ID NO: 288866 - DNA, 25 bp, Mus musculus
agccactcagagagctggtgatccc

SEQ ID NO: 288867 - DNA, 25 bp, Mus musculus
tcgactaaactttgctgttagggcc

SEQ ID NO: 288868 - DNA, 25 bp, Mus musculus
gctaccgctggacgcctcttgtgtc

SEQ ID NO: 288869 - DNA, 25 bp, Mus musculus
caagcgaaagggtcggtgtcttcca

SEQ ID NO: 288870 - DNA, 25 bp, Mus musculus
ttccgggaagttggcacaagcgaaa

SEQ ID NO: 288871 - DNA, 25 bp, Mus musculus
ctctcctagaagcactgtctgtcca

SEQ ID NO: 288872 - DNA, 25 bp, Mus musculus
cggagccagatgaaggtaggaccaa

SEQ ID NO: 288873 - DNA, 25 bp, Mus musculus
gcccgtgacgatctctctcctagaa

SEQ ID NO: 288874 - DNA, 25 bp, Mus musculus
gagacttttctggaggcgagcaccc

SEQ ID NO: 288875 - DNA, 25 bp, Mus musculus
gtgtcttccaggtactgcactctca

SEQ ID NO: 288876 - DNA, 25 bp, Mus musculus
cagcaagatgctgagcgccgcactg

SEQ ID NO: 288877 - DNA, 25 bp, Mus musculus
tggtcacctttctgaatccggagga

SEQ ID NO: 288878 - DNA, 25 bp, Mus musculus
gcaccgttgtccattaggctttctg

SEQ ID NO: 288879 - DNA, 25 bp, Mus musculus
aggcggtttaggagagcacactcga

SEQ ID NO: 288880 - DNA, 25 bp, Mus musculus
tcctaactgctaggatcctgggcag

SEQ ID NO: 288881 - DNA, 25 bp, Mus musculus
gggccacagaagaacccacccagga

SEQ ID NO: 288882 - DNA, 25 bp, Mus musculus
ccagcttagccaaaatcggtgagtg

SEQ ID NO: 288883 - DNA, 25 bp, Mus musculus
cggtgttctgcagtagctgcgcttg

SEQ ID NO: 288884 - DNA, 25 bp, Mus musculus
tcagcttagcactgggacccgcagc

SEQ ID NO: 288885 - DNA, 25 bp, Mus musculus
ccctgcggttttctcagcttagcac

SEQ ID NO: 288886 - DNA, 25 bp, Mus musculus
gtcccaggttttggagatcgtgctg

SEQ ID NO: 288887 - DNA, 25 bp, Mus musculus
ctgcgcttgtctctgcttcccgaga

SEQ ID NO: 288888 - DNA, 25 bp, Mus musculus
ttctgggtacgttgagagcaccgtt

SEQ ID NO: 288889 - DNA, 25 bp, Mus musculus
tttccggagatgagattaacctaga

SEQ ID NO: 288890 - DNA, 25 bp, Mus musculus
ccacccagtagtggttcacggaagc

SEQ ID NO: 288891 - DNA, 25 bp, Mus musculus
gtggtgtagcctcccggcttcagag

SEQ ID NO: 288892 - DNA, 25 bp, Mus musculus
ctaagcctgtcgtgaaggtgtgccc

SEQ ID NO: 288893 - DNA, 25 bp, Mus musculus
ccaagtctccgaggcactgagagta

SEQ ID NO: 288894 - DNA, 25 bp, Mus musculus
cccactgcacgtcccaggggtgtga

SEQ ID NO: 288895 - DNA, 25 bp, Mus musculus
cttcgttagttcgacggctctggtg

SEQ ID NO: 288896 - DNA, 25 bp, Mus musculus
gctgcggtgcgtttgttcttcgtta

SEQ ID NO: 288897 - DNA, 25 bp, Mus musculus
gctgtacccatcctcgaggctgcgg

SEQ ID NO: 288898 - DNA, 25 bp, Mus musculus
ccaccagaaggtggcgcccttggaa

SEQ ID NO: 288899 - DNA, 25 bp, Mus musculus
ttgcggcccttcgagccaccagaag

SEQ ID NO: 288900 - DNA, 25 bp, Mus musculus
cgccttccggaagaacctgtgattc

SEQ ID NO: 288901 - DNA, 25 bp, Mus musculus
cagtaggcgtggtcccagctctcct

SEQ ID NO: 288902 - DNA, 25 bp, Mus musculus
cactgagagtaggaacccagcggcc

SEQ ID NO: 288903 - DNA, 25 bp, Mus musculus
tgcccgaaggtatggccacccagta

SEQ ID NO: 288904 - DNA, 25 bp, Mus musculus
acgtgctttctctgtccgccaatgg

SEQ ID NO: 288905 - DNA, 25 bp, Mus musculus
gctccaagttccgtggccaccagaa

SEQ ID NO: 288906 - DNA, 25 bp, Mus musculus
agattcgccacatcctgcccaagga

SEQ ID NO: 288907 - DNA, 25 bp, Mus musculus
gcttgctctacagcggctccaagtt

SEQ ID NO: 288908 - DNA, 25 bp, Mus musculus
gcgtggccaccagcttgctctacag

SEQ ID NO: 288909 - DNA, 25 bp, Mus musculus
gcaacacgagcgcttggtctggcct

SEQ ID NO: 288910 - DNA, 25 bp, Mus musculus
tctccgggtccaggtggcaacacga

SEQ ID NO: 288911 - DNA, 25 bp, Mus musculus
ccaccagaagagcaaggggaactcg

SEQ ID NO: 288912 - DNA, 25 bp, Mus musculus
gcgcgcccgcgccaattggaagctg

SEQ ID NO: 288913 - DNA, 25 bp, Mus musculus
agcatcataaacgtgctcgccacgc

SEQ ID NO: 288914 - DNA, 25 bp, Mus musculus
ggaaacctctcaccaagggttcata

SEQ ID NO: 288915 - DNA, 25 bp, Mus musculus
ctcgctggttctgtacggaaacctc

SEQ ID NO: 288916 - DNA, 25 bp, Mus musculus
ctgggtggacacatgcgtggaaaca

SEQ ID NO: 288917 - DNA, 25 bp, Mus musculus
caagtgggaagggagacccagctca

SEQ ID NO: 288918 - DNA, 25 bp, Mus musculus
tagtattatcccctgtttctcggtc

SEQ ID NO: 288919 - DNA, 25 bp, Mus musculus
cagcccgggcggctccgtagtatta

SEQ ID NO: 288920 - DNA, 25 bp, Mus musculus
gctccgtagtattatcccctgtttc

SEQ ID NO: 288921 - DNA, 25 bp, Mus musculus
ggtcaccatagagacagtgagtccc

SEQ ID NO: 288922 - DNA, 25 bp, Mus musculus
accatagagacagtgagtcccaccc

SEQ ID NO: 288923 - DNA, 25 bp, Mus musculus
gagacagtgagtcccaccccctagg

SEQ ID NO: 288924 - DNA, 25 bp, Mus musculus
ccctaggctgtctcggcgggagagt

SEQ ID NO: 288925 - DNA, 25 bp, Mus musculus
cgggagagtgaccaaggtcacgcta

SEQ ID NO: 288926 - DNA, 25 bp, Mus musculus
gtgaccaaggtcacgctagctcctc

SEQ ID NO: 288927 - DNA, 25 bp, Mus musculus
agaccccgccctatgtgctctgtgg

SEQ ID NO: 288928 - DNA, 25 bp, Mus musculus
ctgggcccgcagaattgcagcgaca

SEQ ID NO: 288929 - DNA, 25 bp, Mus musculus
ggcccgcagaattgcagcgacagcc

SEQ ID NO: 288930 - DNA, 25 bp, Mus musculus
agcgacagccttatcctgctcctcc

SEQ ID NO: 288931 - DNA, 25 bp, Mus musculus
gcccgggcggctccgtagtattatc

SEQ ID NO: 288932 - DNA, 25 bp, Mus musculus
tcgactctagcggttgctggctttg

SEQ ID NO: 288933 - DNA, 25 bp, Mus musculus
cctggcggccaaagagaaggtcttc

SEQ ID NO: 288934 - DNA, 25 bp, Mus musculus
cagggtgaacgttctttcttcttca

SEQ ID NO: 288935 - DNA, 25 bp, Mus musculus
aaggtcttctggaacctggcggcga

SEQ ID NO: 288936 - DNA, 25 bp, Mus musculus
tggctttgtcttctacctgggcgtc

SEQ ID NO: 288937 - DNA, 25 bp, Mus musculus
ttcgtggaagattcggtcgactcta

SEQ ID NO: 288938 - DNA, 25 bp, Mus musculus
cctggactacgcttcgtggaagatt

SEQ ID NO: 288939 - DNA, 25 bp, Mus musculus
cggagagcatttttgacctggacta

SEQ ID NO: 288940 - DNA, 25 bp, Mus musculus
tgactcctgtgagcagccacggctt

SEQ ID NO: 288941 - DNA, 25 bp, Mus musculus
tcctggcatccagattcagatcatg

SEQ ID NO: 288942 - DNA, 25 bp, Mus musculus
tttgctgaaactgaagagcggtgtc

SEQ ID NO: 288943 - DNA, 25 bp, Mus musculus
cccgaaggtcctagcgacaactttg

SEQ ID NO: 288944 - DNA, 25 bp, Mus musculus
cttcagattgaggatgggtacccga

SEQ ID NO: 288945 - DNA, 25 bp, Mus musculus
ctgggcgtctttgtagtctgccatc

SEQ ID NO: 288946 - DNA, 25 bp, Mus musculus
cacttcagaccgtccgggcaaagtc

SEQ ID NO: 288947 - DNA, 25 bp, Mus musculus
ccagatgcggcctgccaaggtcagc

SEQ ID NO: 288948 - DNA, 25 bp, Mus musculus
catcccggacggaggttgggcctca

SEQ ID NO: 288949 - DNA, 25 bp, Mus musculus
ttccgccttagcaaggacccgctgg

SEQ ID NO: 288950 - DNA, 25 bp, Mus musculus
aaccgcgctgcgtcacttcgcagga

SEQ ID NO: 288951 - DNA, 25 bp, Mus musculus
agcaggccgagacaggcccagagtc

SEQ ID NO: 288952 - DNA, 25 bp, Mus musculus
tggcaacagcgcgaactacggcgcc

SEQ ID NO: 288953 - DNA, 25 bp, Mus musculus
actgggtcggcgaaacccagcagca

SEQ ID NO: 288954 - DNA, 25 bp, Mus musculus
atgataaaaggaagtcccgcgctcc

SEQ ID NO: 288955 - DNA, 25 bp, Mus musculus
cagtgcggatctatggccctgatta

SEQ ID NO: 288956 - DNA, 25 bp, Mus musculus
atggcacattgcctggcgatcggtg

SEQ ID NO: 288957 - DNA, 25 bp, Mus musculus
tcggaggcccgacgcatggcacatt

SEQ ID NO: 288958 - DNA, 25 bp, Mus musculus
aggtgagaaacgctgcagccgctcc

SEQ ID NO: 288959 - DNA, 25 bp, Mus musculus
tcaggccaagctcggaggtgagaaa

SEQ ID NO: 288960 - DNA, 25 bp, Mus musculus
gtccttctctaaacgcaagaaagtg

SEQ ID NO: 288961 - DNA, 25 bp, Mus musculus
tctgggttaactacctgcgaccgcg

SEQ ID NO: 288962 - DNA, 25 bp, Mus musculus
ccaagtaggaagctccgggcacctc

SEQ ID NO: 288963 - DNA, 25 bp, Mus musculus
cgcagctcagacgtaagagtccttc

SEQ ID NO: 288964 - DNA, 25 bp, Mus musculus
gccatcaaggggaactccgcagctc

SEQ ID NO: 288965 - DNA, 25 bp, Mus musculus
agggtttcccttgggcgccatcaag

SEQ ID NO: 288966 - DNA, 25 bp, Mus musculus
gcattccgtgtcctagcctcgagtc

SEQ ID NO: 288967 - DNA, 25 bp, Mus musculus
cccgcaaagaaagcgagtatccctc

SEQ ID NO: 288968 - DNA, 25 bp, Mus musculus
gctttataagctgggtccgaggacc

SEQ ID NO: 288969 - DNA, 25 bp, Mus musculus
cggcttcttcgaaaacggatctaga

SEQ ID NO: 288970 - DNA, 25 bp, Mus musculus
ctcatgcaacttggggactttgttc

SEQ ID NO: 288971 - DNA, 25 bp, Mus musculus
tgacggctccgcctcatgcaacttg

SEQ ID NO: 288972 - DNA, 25 bp, Mus musculus
ccgcacacctagagggtttcccttg

SEQ ID NO: 288973 - DNA, 25 bp, Mus musculus
cgggcacctcaccaagtctgggtta

SEQ ID NO: 288974 - DNA, 25 bp, Mus musculus
ggcgcttctgtctggcttcattagg

SEQ ID NO: 288975 - DNA, 25 bp, Mus musculus
cacgcatgcgttactctggagtgcc

SEQ ID NO: 288976 - DNA, 25 bp, Mus musculus
tttacacccggtaagccgcactgcg

SEQ ID NO: 288977 - DNA, 25 bp, Mus musculus
taaatggctccagtttccgggcacc

SEQ ID NO: 288978 - DNA, 25 bp, Mus musculus
ccgcagtagggcctggctcttaaat

SEQ ID NO: 288979 - DNA, 25 bp, Mus musculus
ttgtccacgttgaaatagagctccg

SEQ ID NO: 288980 - DNA, 25 bp, Mus musculus
agcgtctcgcactgcaccaggttga

SEQ ID NO: 288981 - DNA, 25 bp, Mus musculus
aatcgaccgcgtggtggtgctaata

SEQ ID NO: 288982 - DNA, 25 bp, Mus musculus
tgcgcactaaggaaaggcggccctg

SEQ ID NO: 288983 - DNA, 25 bp, Mus musculus
cgggtgtgctattccttaggctgtc

SEQ ID NO: 288984 - DNA, 25 bp, Mus musculus
ttcccggcgtttgttgcactagttc

SEQ ID NO: 288985 - DNA, 25 bp, Mus musculus
ggtgccttaaactcgcccatatatg

SEQ ID NO: 288986 - DNA, 25 bp, Mus musculus
cccttcgacagccacgtttgaaata

SEQ ID NO: 288987 - DNA, 25 bp, Mus musculus
ttcattagggccagccgggtaaagc

SEQ ID NO: 288988 - DNA, 25 bp, Mus musculus
taccgacagcgcgaggtccttgcag

SEQ ID NO: 288989 - DNA, 25 bp, Mus musculus
acagcgcgaggtccttgcagcccag

SEQ ID NO: 288990 - DNA, 25 bp, Mus musculus
gcgaggtccttgcagcccagcgcag

SEQ ID NO: 288991 - DNA, 25 bp, Mus musculus
ccagcgcagccatgtgagtgtccgc

SEQ ID NO: 288992 - DNA, 25 bp, Mus musculus
ctccactgtgggcaggcccgagggc

SEQ ID NO: 288993 - DNA, 25 bp, Mus musculus
agccatgtgagtgtccgcgccgttt

SEQ ID NO: 288994 - DNA, 25 bp, Mus musculus
cgacccggatcgcgccgtgtctttt

SEQ ID NO: 288995 - DNA, 25 bp, Mus musculus
cgcgccgtttcctaaggccgtggcg

SEQ ID NO: 288996 - DNA, 25 bp, Mus musculus
gcgagctgtggatcccgtgcgtcct

SEQ ID NO: 288997 - DNA, 25 bp, Mus musculus
gctgtggatcccgtgcgtcctgcac

SEQ ID NO: 288998 - DNA, 25 bp, Mus musculus
agagtaccgacagcgcgaggtcctt

SEQ ID NO: 288999 - DNA, 25 bp, Mus musculus
gggcaacgccgagagtaccgacagc

SEQ ID NO: 289000 - DNA, 25 bp, Mus musculus
atcggctcccggacttgcgaccggg

SEQ ID NO: 289001 - DNA, 25 bp, Mus musculus
cccgttctcgcgacccggatcgcgc

SEQ ID NO: 289002 - DNA, 25 bp, Mus musculus
ctcaacctctcggtccacgaagggg

SEQ ID NO: 289003 - DNA, 25 bp, Mus musculus
ggtaaacaggcgcttccgcacattc

SEQ ID NO: 289004 - DNA, 25 bp, Mus musculus
ttcctgctccttcccagctggagga

SEQ ID NO: 289005 - DNA, 25 bp, Mus musculus
ccgcacctccgcaggaagtaggggc

SEQ ID NO: 289006 - DNA, 25 bp, Mus musculus
cacgctgagtccgaggccgagtctc

SEQ ID NO: 289007 - DNA, 25 bp, Mus musculus
tgccactgccctgtcattagcgcgg

SEQ ID NO: 289008 - DNA, 25 bp, Mus musculus
ctggaacccactggggcagctgtac

SEQ ID NO: 289009 - DNA, 25 bp, Mus musculus
cccagtcacgggaaaggggcttcag

SEQ ID NO: 289010 - DNA, 25 bp, Mus musculus
ggacccgattggtgctggacacaca

SEQ ID NO: 289011 - DNA, 25 bp, Mus musculus
attccatgatgtccctgtcggtgcg

SEQ ID NO: 289012 - DNA, 25 bp, Mus musculus
cccgggtcagtaggagccagtcctt

SEQ ID NO: 289013 - DNA, 25 bp, Mus musculus
ggagccagtccttcgcaggcgtcct

SEQ ID NO: 289014 - DNA, 25 bp, Mus musculus
gggccaatgaggctaagactgccga

SEQ ID NO: 289015 - DNA, 25 bp, Mus musculus
gtggtggtactcaacctctcggtcc

SEQ ID NO: 289016 - DNA, 25 bp, Mus musculus
gccattttgtgtccgagcctgtgga

SEQ ID NO: 289017 - DNA, 25 bp, Mus musculus
ggttgccgccgcttgcttcgcctag

SEQ ID NO: 289018 - DNA, 25 bp, Mus musculus
ctggaccctctgaggctcggttgcc

SEQ ID NO: 289019 - DNA, 25 bp, Mus musculus
ttaccgagtctggaccctctgaggc

SEQ ID NO: 289020 - DNA, 25 bp, Mus musculus
cttttggcccggctgatcttcgggc

SEQ ID NO: 289021 - DNA, 25 bp, Mus musculus
cccaacatggtaggcctctggcggc

SEQ ID NO: 289022 - DNA, 25 bp, Mus musculus
tcctcccaacatggtaggcctctgg

SEQ ID NO: 289023 - DNA, 25 bp, Mus musculus
ctctaggtgtcacgatggggccgct

SEQ ID NO: 289024 - DNA, 25 bp, Mus musculus
ttcgcgggccgcctctaggtgtcac

SEQ ID NO: 289025 - DNA, 25 bp, Mus musculus
cctgtggagcgattaaaccgtgcgc

SEQ ID NO: 289026 - DNA, 25 bp, Mus musculus
ttgcttcgcctaggggttctgaacc

SEQ ID NO: 289027 - DNA, 25 bp, Mus musculus
tccgagcctgtggagcgattaaacc

SEQ ID NO: 289028 - DNA, 25 bp, Mus musculus
aaaccgtgcgcggagctgcttcttt

SEQ ID NO: 289029 - DNA, 25 bp, Mus musculus
ccatcgcgccggcttttgaaagttg

SEQ ID NO: 289030 - DNA, 25 bp, Mus musculus
ctctgtgctcttctggtgcttttgc

SEQ ID NO: 289031 - DNA, 25 bp, Mus musculus
atggacctgccacccgccgggcaac

SEQ ID NO: 289032 - DNA, 25 bp, Mus musculus
ggccctctgcctcgcatggacctgc

SEQ ID NO: 289033 - DNA, 25 bp, Mus musculus
gggccgtctgcacgcggctctccaa

SEQ ID NO: 289034 - DNA, 25 bp, Mus musculus
tgctgctgaggaagcggaacgggac

SEQ ID NO: 289035 - DNA, 25 bp, Mus musculus
cttttgcctcaggtgctgctgagga

SEQ ID NO: 289036 - DNA, 25 bp, Mus musculus
gtgcttttgcctcaggtgctgctga

SEQ ID NO: 289037 - DNA, 25 bp, Mus musculus
gtgctcttctggtgcttttgcctca

SEQ ID NO: 289038 - DNA, 25 bp, Mus musculus
caacccgagcccgaccgagaccacg

SEQ ID NO: 289039 - DNA, 25 bp, Mus musculus
cgggttcgacgctctgtgctcttct

SEQ ID NO: 289040 - DNA, 25 bp, Mus musculus
tcggggccgcgctcagcaccacgga

SEQ ID NO: 289041 - DNA, 25 bp, Mus musculus
gctgcacaaagtcgcgcgcactcgg

SEQ ID NO: 289042 - DNA, 25 bp, Mus musculus
atgcttggcggctgcacaaagtcgc

SEQ ID NO: 289043 - DNA, 25 bp, Mus musculus
cttctggtgcttttgcctcaggtgc

SEQ ID NO: 289044 - DNA, 25 bp, Mus musculus
gacagtttattcttaccggggcatc

SEQ ID NO: 289045 - DNA, 25 bp, Mus musculus
gtgggttccgtctgacacaagtaac

SEQ ID NO: 289046 - DNA, 25 bp, Mus musculus
cggttcgtggacttgacagtgtttc

SEQ ID NO: 289047 - DNA, 25 bp, Mus musculus
tctgggatctgagcgacctgcttac

SEQ ID NO: 289048 - DNA, 25 bp, Mus musculus
tcctttttgggacgctcgaaccata

SEQ ID NO: 289049 - DNA, 25 bp, Mus musculus
ccctcattctgccttcggattggtc

SEQ ID NO: 289050 - DNA, 25 bp, Mus musculus
agcccgtgagctgttcctcagtaca

SEQ ID NO: 289051 - DNA, 25 bp, Mus musculus
ctagctgctggctgatgacagttta

SEQ ID NO: 289052 - DNA, 25 bp, Mus musculus
gtcctgctgactgacctagctgctg

SEQ ID NO: 289053 - DNA, 25 bp, Mus musculus
accgccaggcggatcctaagtttga

SEQ ID NO: 289054 - DNA, 25 bp, Mus musculus
aatcggacattagcagggcggcacc

SEQ ID NO: 289055 - DNA, 25 bp, Mus musculus
ggccagcaaccctgaatcggacatt

SEQ ID NO: 289056 - DNA, 25 bp, Mus musculus
tgaacctaggatcagctctcgaatc

SEQ ID NO: 289057 - DNA, 25 bp, Mus musculus
agccactttggctctgtgtaagacc

SEQ ID NO: 289058 - DNA, 25 bp, Mus musculus
gactccattcttggtgcgcttcctg

SEQ ID NO: 289059 - DNA, 25 bp, Mus musculus
aggggacaactggagccaccaccga

SEQ ID NO: 289060 - DNA, 25 bp, Mus musculus
ctaccctccttgtttttcttgtctg

SEQ ID NO: 289061 - DNA, 25 bp, Mus musculus
gagatcgctcgaacgcagaagaaca

SEQ ID NO: 289062 - DNA, 25 bp, Mus musculus
tcggagatcgagaaggagatcgctc

SEQ ID NO: 289063 - DNA, 25 bp, Mus musculus
ctatggggatcttggagaaaatctc

SEQ ID NO: 289064 - DNA, 25 bp, Mus musculus
atctccgccgaagctgcaactatgg

SEQ ID NO: 289065 - DNA, 25 bp, Mus musculus
gctataggcagcgtgaatctccgcc

SEQ ID NO: 289066 - DNA, 25 bp, Mus musculus
cgctcagcgctgtaagctataggca

SEQ ID NO: 289067 - DNA, 25 bp, Mus musculus
cgcttcctggttctgactgctttgc

SEQ ID NO: 289068 - DNA, 25 bp, Mus musculus
ccgaatctcgtagcaccgggagctc

SEQ ID NO: 289069 - DNA, 25 bp, Mus musculus
gtgtgcccggactccgaatctcgta

SEQ ID NO: 289070 - DNA, 25 bp, Mus musculus
atgctcatcgcagctggacgaggta

SEQ ID NO: 289071 - DNA, 25 bp, Mus musculus
ttccggcattagacgtgagcgctca

SEQ ID NO: 289072 - DNA, 25 bp, Mus musculus
acgggacctactcactaatggggca

SEQ ID NO: 289073 - DNA, 25 bp, Mus musculus
tcactaatggggcacatggcctttc

SEQ ID NO: 289074 - DNA, 25 bp, Mus musculus
ttgtagcgctcctgggcttggcgct

SEQ ID NO: 289075 - DNA, 25 bp, Mus musculus
ggcttggcgctgctgttcctgaacc

SEQ ID NO: 289076 - DNA, 25 bp, Mus musculus
tcctgaacctgtgcaaggacctgca

SEQ ID NO: 289077 - DNA, 25 bp, Mus musculus
gctctcttggcagctagggcgttgc

SEQ ID NO: 289078 - DNA, 25 bp, Mus musculus
ctagggcgttgcgactaatgaaatc

SEQ ID NO: 289079 - DNA, 25 bp, Mus musculus
taatgaaatccacgcctaggccggg

SEQ ID NO: 289080 - DNA, 25 bp, Mus musculus
ggtccctgcagagacatggcaagca

SEQ ID NO: 289081 - DNA, 25 bp, Mus musculus
gacatggcaagcacggtggagaccc

SEQ ID NO: 289082 - DNA, 25 bp, Mus musculus
cgtggcactacattgcacctctgta

SEQ ID NO: 289083 - DNA, 25 bp, Mus musculus
acattgcacctctgtaccgactcta

SEQ ID NO: 289084 - DNA, 25 bp, Mus musculus
cacttgacagcgcacgggacctact

SEQ ID NO: 289085 - DNA, 25 bp, Mus musculus
cacatggcctttctgcgtggcgttg

SEQ ID NO: 289086 - DNA, 25 bp, Mus musculus
gactagcccactgcccagaggggtt

SEQ ID NO: 289087 - DNA, 25 bp, Mus musculus
ccagggcctgttgcgctgcgcaact

SEQ ID NO: 289088 - DNA, 25 bp, Mus musculus
cctgcaacagtgcaccagggcctgt

SEQ ID NO: 289089 - DNA, 25 bp, Mus musculus
gggacgggccctcgcacatgatcct

SEQ ID NO: 289090 - DNA, 25 bp, Mus musculus
aagacgcggtggaaagccgtgctca

SEQ ID NO: 289091 - DNA, 25 bp, Mus musculus
ttccttccaggcgtccttgggctga

SEQ ID NO: 289092 - DNA, 25 bp, Mus musculus
ggtccagcttcaacgcgtttccttc

SEQ ID NO: 289093 - DNA, 25 bp, Mus musculus
acctgaagtcagcaggtccagcttc

SEQ ID NO: 289094 - DNA, 25 bp, Mus musculus
actggagtccaggtcccgacctgaa

SEQ ID NO: 289095 - DNA, 25 bp, Mus musculus
ttcaggcctgatgcgagggccacga

SEQ ID NO: 289096 - DNA, 25 bp, Mus musculus
atctctcgggcttcaggcctgatgc

SEQ ID NO: 289097 - DNA, 25 bp, Mus musculus
acgctctaggatctctcgggcttca

SEQ ID NO: 289098 - DNA, 25 bp, Mus musculus
ctctaatccctgtcgggtgcttcca

SEQ ID NO: 289099 - DNA, 25 bp, Mus musculus
tcgctggccacgctctaggatctct

SEQ ID NO: 289100 - DNA, 25 bp, Mus musculus
cgcaaggtaggcagcatccctccta

SEQ ID NO: 289101 - DNA, 25 bp, Mus musculus
tgatggccacgtggcctcgcaggaa

SEQ ID NO: 289102 - DNA, 25 bp, Mus musculus
cacgtggcctcgcaggaatgcgctg

SEQ ID NO: 289103 - DNA, 25 bp, Mus musculus
ctggccaatgagcacgaagcacggc

SEQ ID NO: 289104 - DNA, 25 bp, Mus musculus
caatgagcacgaagcacggccggtt

SEQ ID NO: 289105 - DNA, 25 bp, Mus musculus
atgagcacgaagcacggccggttcc

SEQ ID NO: 289106 - DNA, 25 bp, Mus musculus
gcacggccggttccggccaatcatg

SEQ ID NO: 289107 - DNA, 25 bp, Mus musculus
cggttccggccaatcatggtgaggt

SEQ ID NO: 289108 - DNA, 25 bp, Mus musculus
cgcgggacaactggcggacgcagac

SEQ ID NO: 289109 - DNA, 25 bp, Mus musculus
cgcccggtccctcggtgagtgagca

SEQ ID NO: 289110 - DNA, 25 bp, Mus musculus
cccggtccctcggtgagtgagcacg

SEQ ID NO: 289111 - DNA, 25 bp, Mus musculus
caagtcccgtcccaggccgcttgca

SEQ ID NO: 289112 - DNA, 25 bp, Mus musculus
aggtaggcagcatccctcctactca

SEQ ID NO: 289113 - DNA, 25 bp, Mus musculus
ctcctactcacggcgcggggcgtta

SEQ ID NO: 289114 - DNA, 25 bp, Mus musculus
ccgggatgaagagctgcgcatgctc

SEQ ID NO: 289115 - DNA, 25 bp, Mus musculus
agcaggtcccatctccgaggtggag

SEQ ID NO: 289116 - DNA, 25 bp, Mus musculus
gaacctcggagcgacctcgtactca

SEQ ID NO: 289117 - DNA, 25 bp, Mus musculus
gacctcgtactcaatgccgtgcaca

SEQ ID NO: 289118 - DNA, 25 bp, Mus musculus
gccgtgcacacactggcatttagca

SEQ ID NO: 289119 - DNA, 25 bp, Mus musculus
gtatactcgcttccaacctccggag

SEQ ID NO: 289120 - DNA, 25 bp, Mus musculus
cctctcacctggcatgctggcattg

SEQ ID NO: 289121 - DNA, 25 bp, Mus musculus
attgcccgcccagagctgcacgaga

SEQ ID NO: 289122 - DNA, 25 bp, Mus musculus
ctgcacgagagaccatggatccgga

SEQ ID NO: 289123 - DNA, 25 bp, Mus musculus
cgcgccggaatccaaagcaccgata

SEQ ID NO: 289124 - DNA, 25 bp, Mus musculus
cacgccgcctggtttctaaggaaca

SEQ ID NO: 289125 - DNA, 25 bp, Mus musculus
ttctaaggaacaggggtctctggta

SEQ ID NO: 289126 - DNA, 25 bp, Mus musculus
cgtccgaatgtagcaggtcccatct

SEQ ID NO: 289127 - DNA, 25 bp, Mus musculus
aggaggacagcgcatgctcagtgat

SEQ ID NO: 289128 - DNA, 25 bp, Mus musculus
cttacgtacttgatccgagtgctcc

SEQ ID NO: 289129 - DNA, 25 bp, Mus musculus
cgttcccaccgcctattttgagtca

SEQ ID NO: 289130 - DNA, 25 bp, Mus musculus
tcaagcagcagcgagcaccgcgttc

SEQ ID NO: 289131 - DNA, 25 bp, Mus musculus
ctcctaactgctcaagcagcagcga

SEQ ID NO: 289132 - DNA, 25 bp, Mus musculus
ctgaggtccgccatgttcaggaccc

SEQ ID NO: 289133 - DNA, 25 bp, Mus musculus
cagaaaagctgaggtccgccatgtt

SEQ ID NO: 289134 - DNA, 25 bp, Mus musculus
gtaggatcgccgtcagaaaagctga

SEQ ID NO: 289135 - DNA, 25 bp, Mus musculus
cgtgcgtacagtaggatcgccgtca

SEQ ID NO: 289136 - DNA, 25 bp, Mus musculus
cacgcgccgcaaaagcgtgcgtaca

SEQ ID NO: 289137 - DNA, 25 bp, Mus musculus
gagtgcgcgaatccgccgtctccag

SEQ ID NO: 289138 - DNA, 25 bp, Mus musculus
tgatccgagtgctccggcgtctcat

SEQ ID NO: 289139 - DNA, 25 bp, Mus musculus
cgcctattttgagtcaagtctcgcg

SEQ ID NO: 289140 - DNA, 25 bp, Mus musculus
cgcaacactcttacgtacttgatcc

SEQ ID NO: 289141 - DNA, 25 bp, Mus musculus
gcgtctcatcggagtgcgcgaatcc

SEQ ID NO: 289142 - DNA, 25 bp, Mus musculus
gcgtagtcctcctttccaggcggtc

SEQ ID NO: 289143 - DNA, 25 bp, Mus musculus
ctctggctcaagaacgtgtcccgtg

SEQ ID NO: 289144 - DNA, 25 bp, Mus musculus
gcttcttacgcttcaggccgccgta

SEQ ID NO: 289145 - DNA, 25 bp, Mus musculus
cctttcgcttaggacgagcttcatc

SEQ ID NO: 289146 - DNA, 25 bp, Mus musculus
cgtctctgcagcgtccactttcagg

SEQ ID NO: 289147 - DNA, 25 bp, Mus musculus
agggtagcccatgccataacgtgtc

SEQ ID NO: 289148 - DNA, 25 bp, Mus musculus
acgtttcccaaggacgctgagttgc

SEQ ID NO: 289149 - DNA, 25 bp, Mus musculus
aggcgctgcacttctacacgtttcc

SEQ ID NO: 289150 - DNA, 25 bp, Mus musculus
gcgttccgggctgctacaacaattc

SEQ ID NO: 289151 - DNA, 25 bp, Mus musculus
atgcctggctttacgtgctgcgttc

SEQ ID NO: 289152 - DNA, 25 bp, Mus musculus
gcggtccgcaaccatattctgggca

SEQ ID NO: 289153 - DNA, 25 bp, Mus musculus
actctgaacaggatatcgcggtgtc

SEQ ID NO: 289154 - DNA, 25 bp, Mus musculus
attcacaccgggacaaggcgctgca

SEQ ID NO: 289155 - DNA, 25 bp, Mus musculus
tctgcctctgcagctgtgcttctta

SEQ ID NO: 289156 - DNA, 25 bp, Mus musculus
cgatcaggatagctctcagggcccg

SEQ ID NO: 289157 - DNA, 25 bp, Mus musculus
cgcctctgcgaatggcattctggga

SEQ ID NO: 289158 - DNA, 25 bp, Mus musculus
gggaaatgtagttctagctaagctc

SEQ ID NO: 289159 - DNA, 25 bp, Mus musculus
gctaagctcactaaggcgtataagg

SEQ ID NO: 289160 - DNA, 25 bp, Mus musculus
aaggagcatactgggactacgtttc

SEQ ID NO: 289161 - DNA, 25 bp, Mus musculus
ccgggagcttctgcttcgaggccct

SEQ ID NO: 289162 - DNA, 25 bp, Mus musculus
gcctaccgcggattgtctgcggccg

SEQ ID NO: 289163 - DNA, 25 bp, Mus musculus
ctgagagcctgatggacggctgtcc

SEQ ID NO: 289164 - DNA, 25 bp, Mus musculus
caccctgtgtcttggctgatggcca

SEQ ID NO: 289165 - DNA, 25 bp, Mus musculus
ttcttttgtccggacgatcaggata

SEQ ID NO: 289166 - DNA, 25 bp, Mus musculus
ttgcctggcttgctcgaatcctgca

SEQ ID NO: 289167 - DNA, 25 bp, Mus musculus
tcctgcaacctctgcaggcaggttg

SEQ ID NO: 289168 - DNA, 25 bp, Mus musculus
aagatccggggatgggcaacgccac

SEQ ID NO: 289169 - DNA, 25 bp, Mus musculus
ctgatggccagatctttttcttttg

SEQ ID NO: 289170 - DNA, 25 bp, Mus musculus
ttcgggtgccataggctccattagc

SEQ ID NO: 289171 - DNA, 25 bp, Mus musculus
atctgaaccgttttcgggtgccata

SEQ ID NO: 289172 - DNA, 25 bp, Mus musculus
tggacgtatggcgtggatctgaacc

SEQ ID NO: 289173 - DNA, 25 bp, Mus musculus
ctcttagcgaagtggtggacgtatg

SEQ ID NO: 289174 - DNA, 25 bp, Mus musculus
gacatactcaaactggaccggcccg

SEQ ID NO: 289175 - DNA, 25 bp, Mus musculus
cagcatctgcgggacatactcaaac

SEQ ID NO: 289176 - DNA, 25 bp, Mus musculus
tcgacattgaggacgccacgcagca

SEQ ID NO: 289177 - DNA, 25 bp, Mus musculus
cctcctgcgcgagcatcgacattga

SEQ ID NO: 289178 - DNA, 25 bp, Mus musculus
ctaacgtcgggcgagcaggactctc

SEQ ID NO: 289179 - DNA, 25 bp, Mus musculus
ctgcggaggtagaggaactaacgtc

SEQ ID NO: 289180 - DNA, 25 bp, Mus musculus
tcgtggctgggcgaaattggacact

SEQ ID NO: 289181 - DNA, 25 bp, Mus musculus
gcgaactgcggctaggttttgtgta

SEQ ID NO: 289182 - DNA, 25 bp, Mus musculus
ttcttctgcggtagttgtaggttcc

SEQ ID NO: 289183 - DNA, 25 bp, Mus musculus
tccattagccagactcgggatcctc

SEQ ID NO: 289184 - DNA, 25 bp, Mus musculus
gtcaggcgcgcgcagtaatgacgcc

SEQ ID NO: 289185 - DNA, 25 bp, Mus musculus
cccgaagacgttgattggcaggcac

SEQ ID NO: 289186 - DNA, 25 bp, Mus musculus
cgttgattggcaggcactccgaacc

SEQ ID NO: 289187 - DNA, 25 bp, Mus musculus
cacacttgcgttcgcgtctggaggc

SEQ ID NO: 289188 - DNA, 25 bp, Mus musculus
gccgcccaagtttgttttggcgtca

SEQ ID NO: 289189 - DNA, 25 bp, Mus musculus
caagtttgttttggcgtcaggcgcg

SEQ ID NO: 289190 - DNA, 25 bp, Mus musculus
ccttgcgactgaacgccagggtcct

SEQ ID NO: 289191 - DNA, 25 bp, Mus musculus
tctaaccttgttgtgtgcggcgcct

SEQ ID NO: 289192 - DNA, 25 bp, Mus musculus
cgcgggtcaggttgatctaaccttg

SEQ ID NO: 289193 - DNA, 25 bp, Mus musculus
ctcctgccgcgttaggcccgatgga

SEQ ID NO: 289194 - DNA, 25 bp, Mus musculus
cgccaccacgctgacgcgggaggat

SEQ ID NO: 289195 - DNA, 25 bp, Mus musculus
agtaatgacgccaccacgctgacgc

SEQ ID NO: 289196 - DNA, 25 bp, Mus musculus
ttggtcatctgcctgtctgtggccc

SEQ ID NO: 289197 - DNA, 25 bp, Mus musculus
taggcccgatggacttggtcatctg

SEQ ID NO: 289198 - DNA, 25 bp, Mus musculus
ccagcctaagcaaggcagcccgtta

SEQ ID NO: 289199 - DNA, 25 bp, Mus musculus
agcaagaaaagtggagtcctgcatg

SEQ ID NO: 289200 - DNA, 25 bp, Mus musculus
agtcctgcatggacgtctgcgcgcg

SEQ ID NO: 289201 - DNA, 25 bp, Mus musculus
ggcgcaccctcaccgtccgagtctt

SEQ ID NO: 289202 - DNA, 25 bp, Mus musculus
gctcgccgtagtccacccaactgag

SEQ ID NO: 289203 - DNA, 25 bp, Mus musculus
ccctcgaggttgtcatagtcgccgc

SEQ ID NO: 289204 - DNA, 25 bp, Mus musculus
aggttgtcatagtcgccgcgtcgcg

SEQ ID NO: 289205 - DNA, 25 bp, Mus musculus
cggcaccacggtgaagtgaggcatc

SEQ ID NO: 289206 - DNA, 25 bp, Mus musculus
cgcgttcggcgccagcctaagcaag

SEQ ID NO: 289207 - DNA, 25 bp, Mus musculus
ctaagcaaggcagcccgttacccgg

SEQ ID NO: 289208 - DNA, 25 bp, Mus musculus
agtcccggaccaaaaagactcatcg

SEQ ID NO: 289209 - DNA, 25 bp, Mus musculus
tctgagcgcgcaaggagcaagaaaa

SEQ ID NO: 289210 - DNA, 25 bp, Mus musculus
aaagactcatcggtctgagcgcgca

SEQ ID NO: 289211 - DNA, 25 bp, Mus musculus
accacggtgaagtgaggcatcgcgc

SEQ ID NO: 289212 - DNA, 25 bp, Mus musculus
ccagtcagggtcacacagccctggg

SEQ ID NO: 289213 - DNA, 25 bp, Mus musculus
ggcggagctgcgctcttaaaggggc

SEQ ID NO: 289214 - DNA, 25 bp, Mus musculus
tggaatttggatccggccaggaagg

SEQ ID NO: 289215 - DNA, 25 bp, Mus musculus
agatcgctgcttccaggcgtccgct

SEQ ID NO: 289216 - DNA, 25 bp, Mus musculus
caggcgtcgcccgagatcgctgctt

SEQ ID NO: 289217 - DNA, 25 bp, Mus musculus
gccgcgccgccgcacacaggcgtcg

SEQ ID NO: 289218 - DNA, 25 bp, Mus musculus
caggcactctggctagggctcctgg

SEQ ID NO: 289219 - DNA, 25 bp, Mus musculus
ctgggaagcagagagcccgcaccgc

SEQ ID NO: 289220 - DNA, 25 bp, Mus musculus
cagagagggtgagtgcccagtcagg

SEQ ID NO: 289221 - DNA, 25 bp, Mus musculus
cgcagtgctcgaggcctggtccaga

SEQ ID NO: 289222 - DNA, 25 bp, Mus musculus
gagcctccgcagtgctcgaggcctg

SEQ ID NO: 289223 - DNA, 25 bp, Mus musculus
cgcccgagctggtgcctgaaaggcc

SEQ ID NO: 289224 - DNA, 25 bp, Mus musculus
aaaagccgcccgagctggtgcctga

SEQ ID NO: 289225 - DNA, 25 bp, Mus musculus
acctccaggcactctggctagggct

SEQ ID NO: 289226 - DNA, 25 bp, Mus musculus
tcttggtcacaagagcgcttgagaa

SEQ ID NO: 289227 - DNA, 25 bp, Mus musculus
aaggcgagggtcactggtcacacct

SEQ ID NO: 289228 - DNA, 25 bp, Mus musculus
ggtcacacctgacgtggccgtgtca

SEQ ID NO: 289229 - DNA, 25 bp, Mus musculus
ccgtgtcattaggaatgcctggagc

SEQ ID NO: 289230 - DNA, 25 bp, Mus musculus
aggcttccggtgttgtcggagcact

SEQ ID NO: 289231 - DNA, 25 bp, Mus musculus
tcagggtgcaggttacccacagaga

SEQ ID NO: 289232 - DNA, 25 bp, Mus musculus
ggcgacaatgggttcggaccttcga

SEQ ID NO: 289233 - DNA, 25 bp, Mus musculus
gaccttcgattcagggtccctagga

SEQ ID NO: 289234 - DNA, 25 bp, Mus musculus
ttggaagggcttccagtcaccctgc

SEQ ID NO: 289235 - DNA, 25 bp, Mus musculus
cgcaacggacgctctggaattttcc

SEQ ID NO: 289236 - DNA, 25 bp, Mus musculus
gaattttccactcctacaagcgcag

SEQ ID NO: 289237 - DNA, 25 bp, Mus musculus
caagcgcagtcgctagagggcacca

SEQ ID NO: 289238 - DNA, 25 bp, Mus musculus
gtggaccctcaagacccgcgggctg

SEQ ID NO: 289239 - DNA, 25 bp, Mus musculus
cccacagagacggaactagaagtaa

SEQ ID NO: 289240 - DNA, 25 bp, Mus musculus
gcaccactaggttccgtcgaggctc

SEQ ID NO: 289241 - DNA, 25 bp, Mus musculus
gctgcactcgctctatggagaaatg

SEQ ID NO: 289242 - DNA, 25 bp, Mus musculus
ttccagacccaggtccacgaagctg

SEQ ID NO: 289243 - DNA, 25 bp, Mus musculus
cacaacttcggggacagcctcctga

SEQ ID NO: 289244 - DNA, 25 bp, Mus musculus
gcgcactagcactggccgctgcaaa

SEQ ID NO: 289245 - DNA, 25 bp, Mus musculus
ctgcactgaggttggctgcacaact

SEQ ID NO: 289246 - DNA, 25 bp, Mus musculus
aagcacgccaccgtagtctggagta

SEQ ID NO: 289247 - DNA, 25 bp, Mus musculus
aggcgcgcgctaatgacgtcaagca

SEQ ID NO: 289248 - DNA, 25 bp, Mus musculus
ttcccttgatgcagaagaggcgcgc

SEQ ID NO: 289249 - DNA, 25 bp, Mus musculus
cgtcgaggctccagaagcaaccgta

SEQ ID NO: 289250 - DNA, 25 bp, Mus musculus
ccactggcaaggactggtcggaacc

SEQ ID NO: 289251 - DNA, 25 bp, Mus musculus
tcgccgatgcttccagccacgggaa

SEQ ID NO: 289252 - DNA, 25 bp, Mus musculus
ccggctaaagccatatttcccttga

SEQ ID NO: 289253 - DNA, 25 bp, Mus musculus
gagaaatggtcttgccgcgatcgcc

SEQ ID NO: 289254 - DNA, 25 bp, Mus musculus
cagctttctaggtcggaacggaacg

SEQ ID NO: 289255 - DNA, 25 bp, Mus musculus
ttcaaactcgtcttcggcgaggacg

SEQ ID NO: 289256 - DNA, 25 bp, Mus musculus
tagggaactcgactccgagaggcca

SEQ ID NO: 289257 - DNA, 25 bp, Mus musculus
ctgcgagcgaactagtagggaactc

SEQ ID NO: 289258 - DNA, 25 bp, Mus musculus
aagtgtcttggctgcgagcgaacta

SEQ ID NO: 289259 - DNA, 25 bp, Mus musculus
cccgatttaatttgaggaggagaag

SEQ ID NO: 289260 - DNA, 25 bp, Mus musculus
cgaggaaagcccgatttaatttgag

SEQ ID NO: 289261 - DNA, 25 bp, Mus musculus
gtgtcccaggtctcgcggcctgcag

SEQ ID NO: 289262 - DNA, 25 bp, Mus musculus
cacgacgagctcgacttcaaactcg

SEQ ID NO: 289263 - DNA, 25 bp, Mus musculus
ctactgcaaactgtggcgcccacga

SEQ ID NO: 289264 - DNA, 25 bp, Mus musculus
gggccacgccgatgactactgcaaa

SEQ ID NO: 289265 - DNA, 25 bp, Mus musculus
gtcggaacggaacgctcggcctcgc

SEQ ID NO: 289266 - DNA, 25 bp, Mus musculus
gctcggccagctttctaggtcggaa

SEQ ID NO: 289267 - DNA, 25 bp, Mus musculus
aaagtttgcagtggagccgcgacct

SEQ ID NO: 289268 - DNA, 25 bp, Mus musculus
cttcatgctgaatgacgtgctcatg

SEQ ID NO: 289269 - DNA, 25 bp, Mus musculus
gagaccgtgtcacctgtcagcctca

SEQ ID NO: 289270 - DNA, 25 bp, Mus musculus
ctcacggtaaggacgagaccgtgtc

SEQ ID NO: 289271 - DNA, 25 bp, Mus musculus
tgtgccaccgccagctcacggtaag

SEQ ID NO: 289272 - DNA, 25 bp, Mus musculus
gtacctcgtccggtccgatgacgtc

SEQ ID NO: 289273 - DNA, 25 bp, Mus musculus
ccgatgacgtcatcgagacggttta

SEQ ID NO: 289274 - DNA, 25 bp, Mus musculus
agcgacacgctgtgtacatcggaga

SEQ ID NO: 289275 - DNA, 25 bp, Mus musculus
caacgccggatcttcatgctgaatg

SEQ ID NO: 289276 - DNA, 25 bp, Mus musculus
cgtcaagaccaaacaacgccggatc

SEQ ID NO: 289277 - DNA, 25 bp, Mus musculus
gaccggggagaaatcgtcaagacca

SEQ ID NO: 289278 - DNA, 25 bp, Mus musculus
gtgctcatgtgtgccaccgccagct

SEQ ID NO: 289279 - DNA, 25 bp, Mus musculus
tcatcgagacggtttacaacgaccg

SEQ ID NO: 289280 - DNA, 25 bp, Mus musculus
tgtcagcctcacagcgacacgctgt

SEQ ID NO: 289281 - DNA, 25 bp, Mus musculus
gtgtcacctgtcagcctcacagcga

SEQ ID NO: 289282 - DNA, 25 bp, Mus musculus
gaagtagtgtccctgccactccgca

SEQ ID NO: 289283 - DNA, 25 bp, Mus musculus
tatccctgcctactccggcgagtta

SEQ ID NO: 289284 - DNA, 25 bp, Mus musculus
ccaccagcgactgaggttcgggaca

SEQ ID NO: 289285 - DNA, 25 bp, Mus musculus
accacttgccaaactaggaggatta

SEQ ID NO: 289286 - DNA, 25 bp, Mus musculus
gccgctgtgcctcaacaggctctga

SEQ ID NO: 289287 - DNA, 25 bp, Mus musculus
tcggcgcgaactagcgacttgtgca

SEQ ID NO: 289288 - DNA, 25 bp, Mus musculus
gttgcagcactttgtccagggactc

SEQ ID NO: 289289 - DNA, 25 bp, Mus musculus
gaccctatttctgacgtgtcctctg

SEQ ID NO: 289290 - DNA, 25 bp, Mus musculus
ggatggatcccttagccgctattgt

SEQ ID NO: 289291 - DNA, 25 bp, Mus musculus
gctattgtcaacttcctcggcagga

SEQ ID NO: 289292 - DNA, 25 bp, Mus musculus
agaccttgtcctactggccgtgcca

SEQ ID NO: 289293 - DNA, 25 bp, Mus musculus
cgcggtagtcgctcaaaagtttcaa

SEQ ID NO: 289294 - DNA, 25 bp, Mus musculus
tctgggaatggcctagcacgcttcc

SEQ ID NO: 289295 - DNA, 25 bp, Mus musculus
gagtccactcgcctcgcggcattgt

SEQ ID NO: 289296 - DNA, 25 bp, Mus musculus
aattgactggtatctgcgagcggtg

SEQ ID NO: 289297 - DNA, 25 bp, Mus musculus
acgctcgtggcggagagttgcaatt

SEQ ID NO: 289298 - DNA, 25 bp, Mus musculus
tggatcgccatctctgcacctgtcg

SEQ ID NO: 289299 - DNA, 25 bp, Mus musculus
cgggcctaggcacgatccctaatct

SEQ ID NO: 289300 - DNA, 25 bp, Mus musculus
cggctcccatcggttggtcgatcga

SEQ ID NO: 289301 - DNA, 25 bp, Mus musculus
atcggttggtcgatcgatgcgttcg

SEQ ID NO: 289302 - DNA, 25 bp, Mus musculus
ttcggcgcgcagcaaagtcccggag

SEQ ID NO: 289303 - DNA, 25 bp, Mus musculus
gagttgcaattggtagagccttagc

SEQ ID NO: 289304 - DNA, 25 bp, Mus musculus
agccttagcaagaggcgggtcttaa

SEQ ID NO: 289305 - DNA, 25 bp, Mus musculus
aggcgggtcttaattgactggtatc

SEQ ID NO: 289306 - DNA, 25 bp, Mus musculus
acagtctcacgccatggatcgccat

SEQ ID NO: 289307 - DNA, 25 bp, Mus musculus
ggcacgatccctaatctctaaagca

SEQ ID NO: 289308 - DNA, 25 bp, Mus musculus
ttaactagctgagctgcggcccggg

SEQ ID NO: 289309 - DNA, 25 bp, Mus musculus
ttggacctgcgaccacagtctcacg

SEQ ID NO: 289310 - DNA, 25 bp, Mus musculus
gagctgcactgcttgtatggcactg

SEQ ID NO: 289311 - DNA, 25 bp, Mus musculus
cacagaagggctggttgaagccatg

SEQ ID NO: 289312 - DNA, 25 bp, Mus musculus
cgactaactacacgctccgggacta

SEQ ID NO: 289313 - DNA, 25 bp, Mus musculus
gctccgggactatcaccggttcttc

SEQ ID NO: 289314 - DNA, 25 bp, Mus musculus
tatcaccggttcttccgggacatcg

SEQ ID NO: 289315 - DNA, 25 bp, Mus musculus
ccgggacatcggtttcgaagatggc

SEQ ID NO: 289316 - DNA, 25 bp, Mus musculus
gtgttcccacgccaaactctttcta

SEQ ID NO: 289317 - DNA, 25 bp, Mus musculus
ttcatgcggcaggacacagaagggc

SEQ ID NO: 289318 - DNA, 25 bp, Mus musculus
tggttgaagccatgacgccacccgg

SEQ ID NO: 289319 - DNA, 25 bp, Mus musculus
acgccacccggggtggagctgcact

SEQ ID NO: 289320 - DNA, 25 bp, Mus musculus
ccaaaatctgcttcggcgatggtga

SEQ ID NO: 289321 - DNA, 25 bp, Mus musculus
ttgtatggcactggtgttcccacgc

SEQ ID NO: 289322 - DNA, 25 bp, Mus musculus
tactacgagagctttcctgatcggg

SEQ ID NO: 289323 - DNA, 25 bp, Mus musculus
ttcgaagatggctggttcatgcggc

SEQ ID NO: 289324 - DNA, 25 bp, Mus musculus
aggctgctccgtaacggtacgcgga

SEQ ID NO: 289325 - DNA, 25 bp, Mus musculus
gcgcgaccgagcatcctggaagctc

SEQ ID NO: 289326 - DNA, 25 bp, Mus musculus
ctggaggctgctccgtaacggtacg

SEQ ID NO: 289327 - DNA, 25 bp, Mus musculus
gacggcgcgaccgagcatcctggaa

SEQ ID NO: 289328 - DNA, 25 bp, Mus musculus
cgctgtcgcgatccggtgcgagtga

SEQ ID NO: 289329 - DNA, 25 bp, Mus musculus
tgctccgtaacggtacgcggatcgc

SEQ ID NO: 289330 - DNA, 25 bp, Mus musculus
atcctggaagctccgggccacgagg

SEQ ID NO: 289331 - DNA, 25 bp, Mus musculus
tcgttctggtgtgcggccgaacact

SEQ ID NO: 289332 - DNA, 25 bp, Mus musculus
tgcggccgaacactcttgcgtggcc

SEQ ID NO: 289333 - DNA, 25 bp, Mus musculus
aacactcttgcgtggcctccgtggc

SEQ ID NO: 289334 - DNA, 25 bp, Mus musculus
tcttgcgtggcctccgtggccgcgt

SEQ ID NO: 289335 - DNA, 25 bp, Mus musculus
atccctggagtggaccgccgtgtga

SEQ ID NO: 289336 - DNA, 25 bp, Mus musculus
accgccgtgtgaggaagacgcaggc

SEQ ID NO: 289337 - DNA, 25 bp, Mus musculus
gtgctccagtgcccggaagcaacgc

SEQ ID NO: 289338 - DNA, 25 bp, Mus musculus
ggtgtacttatcttccgggctgctc

SEQ ID NO: 289339 - DNA, 25 bp, Mus musculus
cacgggcagcgttcaaagatcgctc

SEQ ID NO: 289340 - DNA, 25 bp, Mus musculus
ctgtagcggccctctttacggacct

SEQ ID NO: 289341 - DNA, 25 bp, Mus musculus
catacctgggatcgcacggtggcaa

SEQ ID NO: 289342 - DNA, 25 bp, Mus musculus
cggtggcaaccaactggaagacatt

SEQ ID NO: 289343 - DNA, 25 bp, Mus musculus
tccatagcggcgatcgcggagtact

SEQ ID NO: 289344 - DNA, 25 bp, Mus musculus
ttccggcctcatttttagggctctg

SEQ ID NO: 289345 - DNA, 25 bp, Mus musculus
tgggtgactgtcctttctcagactg

SEQ ID NO: 289346 - DNA, 25 bp, Mus musculus
gcgcaggacttgtgtcagaagcctc

SEQ ID NO: 289347 - DNA, 25 bp, Mus musculus
gggatggctttctcagttcgtattc

SEQ ID NO: 289348 - DNA, 25 bp, Mus musculus
attctgagcagtttgggaaccattc

SEQ ID NO: 289349 - DNA, 25 bp, Mus musculus
tcagttcacgacactcacccggaga

SEQ ID NO: 289350 - DNA, 25 bp, Mus musculus
ggatgtccatccagttcagcgggcg

SEQ ID NO: 289351 - DNA, 25 bp, Mus musculus
cacaagctgctggattggctcctcc

SEQ ID NO: 289352 - DNA, 25 bp, Mus musculus
gagcgagcgcgctttgtctctctcg

SEQ ID NO: 289353 - DNA, 25 bp, Mus musculus
ggtaccagatctcggcgtccagatc

SEQ ID NO: 289354 - DNA, 25 bp, Mus musculus
cctgctcgcagggtaccagatctcg

SEQ ID NO: 289355 - DNA, 25 bp, Mus musculus
cgaaagccgggcacctgagagcaac

SEQ ID NO: 289356 - DNA, 25 bp, Mus musculus
cagagcgcgaaagccgggcacctga

SEQ ID NO: 289357 - DNA, 25 bp, Mus musculus
accgccgctttgtcctcccgtggat

SEQ ID NO: 289358 - DNA, 25 bp, Mus musculus
tttccgtggaagctacccgtgccgc

SEQ ID NO: 289359 - DNA, 25 bp, Mus musculus
cggcgtccagatctggagcgcgctc

SEQ ID NO: 289360 - DNA, 25 bp, Mus musculus
tctcttctcctagcacgtttccgtg

SEQ ID NO: 289361 - DNA, 25 bp, Mus musculus
ggagcatccctccaggatccgcgaa

SEQ ID NO: 289362 - DNA, 25 bp, Mus musculus
tcctagcacgtttccgtggaagcta

SEQ ID NO: 289363 - DNA, 25 bp, Mus musculus
gggattttccatcccggctcgcgcg

SEQ ID NO: 289364 - DNA, 25 bp, Mus musculus
tgcagcggagcatccctccaggatc

SEQ ID NO: 289365 - DNA, 25 bp, Mus musculus
cgcgctcggcatgcagcggagcatc

SEQ ID NO: 289366 - DNA, 25 bp, Mus musculus
agttggctcacgtaagctgcccttc

SEQ ID NO: 289367 - DNA, 25 bp, Mus musculus
cattgtatgggctcgagggcttcca

SEQ ID NO: 289368 - DNA, 25 bp, Mus musculus
gtcatagcatctactcctccggaga

SEQ ID NO: 289369 - DNA, 25 bp, Mus musculus
ggcgacgactactatgaccagcagt

SEQ ID NO: 289370 - DNA, 25 bp, Mus musculus
ccaggacctgggtgaatattacgac

SEQ ID NO: 289371 - DNA, 25 bp, Mus musculus
gaccagcagtcgctataccactacg

SEQ ID NO: 289372 - DNA, 25 bp, Mus musculus
gcaggctcccgcaagtcattgtatg

SEQ ID NO: 289373 - DNA, 25 bp, Mus musculus
gggcttcctgccctttgaggacgaa

SEQ ID NO: 289374 - DNA, 25 bp, Mus musculus
ccttcccgtcgggtgctgagatcct

SEQ ID NO: 289375 - DNA, 25 bp, Mus musculus
ctggctgaccaagaagttcctcctc

SEQ ID NO: 289376 - DNA, 25 bp, Mus musculus
gcaaggcatccacagctattaactg

SEQ ID NO: 289377 - DNA, 25 bp, Mus musculus
aggcctcgtgcccagtcacttagca

SEQ ID NO: 289378 - DNA, 25 bp, Mus musculus
gccctcgttcatggtgatccgcttc

SEQ ID NO: 289379 - DNA, 25 bp, Mus musculus
actaccatcgggaaggcgacgacta

SEQ ID NO: 289380 - DNA, 25 bp, Mus musculus
gctccgcgcctcattccgctgaccc

SEQ ID NO: 289381 - DNA, 25 bp, Mus musculus
accggggcttcctagagacggctct

SEQ ID NO: 289382 - DNA, 25 bp, Mus musculus
gcgatggttacagcgaccgcggctc

SEQ ID NO: 289383 - DNA, 25 bp, Mus musculus
tccggagcctccctcggactcagca

SEQ ID NO: 289384 - DNA, 25 bp, Mus musculus
tggagcggcgaacagctccgcgcct

SEQ ID NO: 289385 - DNA, 25 bp, Mus musculus
tcctagagacggctctcgcggcggc

SEQ ID NO: 289386 - DNA, 25 bp, Mus musculus
tcccgcgagctgctctggccaatgg

SEQ ID NO: 289387 - DNA, 25 bp, Mus musculus
agctgctctggccaatggagacgca

SEQ ID NO: 289388 - DNA, 25 bp, Mus musculus
tctggccaatggagacgcaggatcc

SEQ ID NO: 289389 - DNA, 25 bp, Mus musculus
ccaatggagacgcaggatccgccca

SEQ ID NO: 289390 - DNA, 25 bp, Mus musculus
aggatccgcccaggaggttgcctat

SEQ ID NO: 289391 - DNA, 25 bp, Mus musculus
ccgcccaggaggttgcctattggga

SEQ ID NO: 289392 - DNA, 25 bp, Mus musculus
gactcagcacctggagcggcgaaca

SEQ ID NO: 289393 - DNA, 25 bp, Mus musculus
agcgaccgcggctctggcatccgga

SEQ ID NO: 289394 - DNA, 25 bp, Mus musculus
gtactgccgggaacaagaaactgca

SEQ ID NO: 289395 - DNA, 25 bp, Mus musculus
cctgaggtcgcggattccgaagccc

SEQ ID NO: 289396 - DNA, 25 bp, Mus musculus
cccggaggcagattccgagtgcagt

SEQ ID NO: 289397 - DNA, 25 bp, Mus musculus
gccgaccatcctgcggacggactgg

SEQ ID NO: 289398 - DNA, 25 bp, Mus musculus
accatcctgcggacggactgggcgt

SEQ ID NO: 289399 - DNA, 25 bp, Mus musculus
gaatcgtagtttctgcacccgtgga

SEQ ID NO: 289400 - DNA, 25 bp, Mus musculus
ttgcagagcagtactgccgggaaca

SEQ ID NO: 289401 - DNA, 25 bp, Mus musculus
cggacctgaggtcgcggattccgaa

SEQ ID NO: 289402 - DNA, 25 bp, Mus musculus
ccgaccctgttgttgcagagcagta

SEQ ID NO: 289403 - DNA, 25 bp, Mus musculus
tgtggccattgtccgaccctgttgt

SEQ ID NO: 289404 - DNA, 25 bp, Mus musculus
tgcgcagtcgcactcgtggctctgc

SEQ ID NO: 289405 - DNA, 25 bp, Mus musculus
cgcgaggatcattgtgcgcagtcgc

SEQ ID NO: 289406 - DNA, 25 bp, Mus musculus
tttctgcacccgtggatgggcaggc

SEQ ID NO: 289407 - DNA, 25 bp, Mus musculus
acaagaaactgcagcgggcgctaga

SEQ ID NO: 289408 - DNA, 25 bp, Mus musculus
ccagccgagtgtttacttaattagg

SEQ ID NO: 289409 - DNA, 25 bp, Mus musculus
cctgtatcctgaggctcgtttgtgt

SEQ ID NO: 289410 - DNA, 25 bp, Mus musculus
tgtttacttaattagggcctgtatc

SEQ ID NO: 289411 - DNA, 25 bp, Mus musculus
agctctccagccgagtgtttactta

SEQ ID NO: 289412 - DNA, 25 bp, Mus musculus
gaggcggaaatgagcgcgctccaca

SEQ ID NO: 289413 - DNA, 25 bp, Mus musculus
cgccggaatgcagagtgccctggaa

SEQ ID NO: 289414 - DNA, 25 bp, Mus musculus
agtatcgttttctccgctctgctcg

SEQ ID NO: 289415 - DNA, 25 bp, Mus musculus
ccgaagagctgagtatcgttttctc

SEQ ID NO: 289416 - DNA, 25 bp, Mus musculus
ctcgcccgaagagctgagtatcgtt

SEQ ID NO: 289417 - DNA, 25 bp, Mus musculus
gcgtcgtggtccaggctcgcccgaa

SEQ ID NO: 289418 - DNA, 25 bp, Mus musculus
gctcgtttgtgtttaactgtctgcc

SEQ ID NO: 289419 - DNA, 25 bp, Mus musculus
taactgtctgcctaatggtttcgtc

SEQ ID NO: 289420 - DNA, 25 bp, Mus musculus
gcctaatggtttcgtctggctccgg

SEQ ID NO: 289421 - DNA, 25 bp, Mus musculus
aattagggcctgtatcctgaggctc

SEQ ID NO: 289422 - DNA, 25 bp, Mus musculus
ggctgagcaacggtgcgcctactaa

SEQ ID NO: 289423 - DNA, 25 bp, Mus musculus
cttcgctttactgtggcgcatcgga

SEQ ID NO: 289424 - DNA, 25 bp, Mus musculus
gcgcatcggaaggttgtctagagca

SEQ ID NO: 289425 - DNA, 25 bp, Mus musculus
tcggaaggttgtctagagcagagct

SEQ ID NO: 289426 - DNA, 25 bp, Mus musculus
cagagctgggacgtcttggagccac

SEQ ID NO: 289427 - DNA, 25 bp, Mus musculus
cacatcctcgggaggcgtagaaagt

SEQ ID NO: 289428 - DNA, 25 bp, Mus musculus
taacgtccagctcttctgtgcctcg

SEQ ID NO: 289429 - DNA, 25 bp, Mus musculus
gcctcgctgctactgttgttgctta

SEQ ID NO: 289430 - DNA, 25 bp, Mus musculus
tgttgcttatcttgacctctcggtg

SEQ ID NO: 289431 - DNA, 25 bp, Mus musculus
tatcttgacctctcggtgcctcgcg

SEQ ID NO: 289432 - DNA, 25 bp, Mus musculus
ccgccacagtagaggaatgcgcagt

SEQ ID NO: 289433 - DNA, 25 bp, Mus musculus
gaatgcgcagtgcacattcctcccg

SEQ ID NO: 289434 - DNA, 25 bp, Mus musculus
ggaagaccacacgtgcttcgcttta

SEQ ID NO: 289435 - DNA, 25 bp, Mus musculus
gtgcgcctactaacgtccagctctt

SEQ ID NO: 289436 - DNA, 25 bp, Mus musculus
gtgggccacgcacagctacagtatt

SEQ ID NO: 289437 - DNA, 25 bp, Mus musculus
gcgctccctccaagtgcagggcata

SEQ ID NO: 289438 - DNA, 25 bp, Mus musculus
tactcagtcgctgccaacccggagg

SEQ ID NO: 289439 - DNA, 25 bp, Mus musculus
agaatcgcagcgctcgcacaggtgc

SEQ ID NO: 289440 - DNA, 25 bp, Mus musculus
gcgctcacacaggtgcgcgtgaatg

SEQ ID NO: 289441 - DNA, 25 bp, Mus musculus
ttcggaggaccggattgatccaaga

SEQ ID NO: 289442 - DNA, 25 bp, Mus musculus
tgcctgtgacactgggttctttatg

SEQ ID NO: 289443 - DNA, 25 bp, Mus musculus
cgctagctagctcggaaagtggaca

SEQ ID NO: 289444 - DNA, 25 bp, Mus musculus
cgcacactagatccacggagggcta

SEQ ID NO: 289445 - DNA, 25 bp, Mus musculus
gcagactcttgacgccacgggtagt

SEQ ID NO: 289446 - DNA, 25 bp, Mus musculus
ctacagtattcgttcggggagcctc

SEQ ID NO: 289447 - DNA, 25 bp, Mus musculus
gaaagcgcgctgcatttaaattagg

SEQ ID NO: 289448 - DNA, 25 bp, Mus musculus
gctcgtagagccagacagtgggtca

SEQ ID NO: 289449 - DNA, 25 bp, Mus musculus
aaagtggacatgatttggcggaccc

SEQ ID NO: 289450 - DNA, 25 bp, Mus musculus
ctctgcgctgctcactggtgtggga

SEQ ID NO: 289451 - DNA, 25 bp, Mus musculus
tgcgttgagaccgttcgcggtcgaa

SEQ ID NO: 289452 - DNA, 25 bp, Mus musculus
gcggcgcactactgagttcccaaga

SEQ ID NO: 289453 - DNA, 25 bp, Mus musculus
gaccgcacccgagctcagtgtttgc

SEQ ID NO: 289454 - DNA, 25 bp, Mus musculus
agctcagtgtttgctcggcgtctgc

SEQ ID NO: 289455 - DNA, 25 bp, Mus musculus
cccatgatccgcttcgctgtgtttt

SEQ ID NO: 289456 - DNA, 25 bp, Mus musculus
cttcgctgtgtttttctgccggctg

SEQ ID NO: 289457 - DNA, 25 bp, Mus musculus
gagcagggtccctgtttgagacaga

SEQ ID NO: 289458 - DNA, 25 bp, Mus musculus
gaagtagcgcggacgatccgagata

SEQ ID NO: 289459 - DNA, 25 bp, Mus musculus
cgatccgagataagggaagggattt

SEQ ID NO: 289460 - DNA, 25 bp, Mus musculus
tagtattataaaagcacctgtcctg

SEQ ID NO: 289461 - DNA, 25 bp, Mus musculus
cgcttcccttcttccaagaaagttg

SEQ ID NO: 289462 - DNA, 25 bp, Mus musculus
agaacttctgctagactcctgcccg

SEQ ID NO: 289463 - DNA, 25 bp, Mus musculus
cacctgtcctgttagggagggaccg

SEQ ID NO: 289464 - DNA, 25 bp, Mus musculus
caggttctggaagcgctgaagttgc

SEQ ID NO: 289465 - DNA, 25 bp, Mus musculus
ctgaccgctgatgccggccgaggtc

SEQ ID NO: 289466 - DNA, 25 bp, Mus musculus
gcctgcagtccgctgaccgctgatg

SEQ ID NO: 289467 - DNA, 25 bp, Mus musculus
aagctccaggaaagggcctgcagtc

SEQ ID NO: 289468 - DNA, 25 bp, Mus musculus
gtgcagtctcacttaaaacttaaac

SEQ ID NO: 289469 - DNA, 25 bp, Mus musculus
cttgggctctgtgcagtctcactta

SEQ ID NO: 289470 - DNA, 25 bp, Mus musculus
gctgctaccgcatgtttcccgcagg

SEQ ID NO: 289471 - DNA, 25 bp, Mus musculus
tcgccctggctgctaccgcatgttt

SEQ ID NO: 289472 - DNA, 25 bp, Mus musculus
ttctggtgacatgtggtctggagca

SEQ ID NO: 289473 - DNA, 25 bp, Mus musculus
tgtttgagcacgtcgcaggtcgctc

SEQ ID NO: 289474 - DNA, 25 bp, Mus musculus
gctggcccacttgggtgtttgagca

SEQ ID NO: 289475 - DNA, 25 bp, Mus musculus
tccgccacattcaaaatggcggccg

SEQ ID NO: 289476 - DNA, 25 bp, Mus musculus
gcaggtcgctccactccaatcatgg

SEQ ID NO: 289477 - DNA, 25 bp, Mus musculus
tccgttgggcgcctcgctgagcagc

SEQ ID NO: 289478 - DNA, 25 bp, Mus musculus
cccagcggcaccgtggaggcagtgc

SEQ ID NO: 289479 - DNA, 25 bp, Mus musculus
actctcgattcggaggggctaggtc

SEQ ID NO: 289480 - DNA, 25 bp, Mus musculus
caaggggccggagcctcttaccgcg

SEQ ID NO: 289481 - DNA, 25 bp, Mus musculus
tgctgagcaccggaacgccggcagc

SEQ ID NO: 289482 - DNA, 25 bp, Mus musculus
cgctcaatgcttcccggcggcagtc

SEQ ID NO: 289483 - DNA, 25 bp, Mus musculus
aaggcggtcgtcagtcggagcccca

SEQ ID NO: 289484 - DNA, 25 bp, Mus musculus
tacttaaggcggctctgctgggcaa

SEQ ID NO: 289485 - DNA, 25 bp, Mus musculus
cgcgatacttaaggcggctctgctg

SEQ ID NO: 289486 - DNA, 25 bp, Mus musculus
tcgcgcgcgatacttaaggcggctc

SEQ ID NO: 289487 - DNA, 25 bp, Mus musculus
gcctttcccagtgggtcgcgcgcga

SEQ ID NO: 289488 - DNA, 25 bp, Mus musculus
actttccctgccctggtgccggagg

SEQ ID NO: 289489 - DNA, 25 bp, Mus musculus
ggagccctcccactcttgccaactt

SEQ ID NO: 289490 - DNA, 25 bp, Mus musculus
gaggggctaggtccacgacagaccc

SEQ ID NO: 289491 - DNA, 25 bp, Mus musculus
ccggcggcacggtgagcgcacccaa

SEQ ID NO: 289492 - DNA, 25 bp, Mus musculus
tcgcgccgcggagtacttccgggac

SEQ ID NO: 289493 - DNA, 25 bp, Mus musculus
tgccattcccgctactttctgagtt

SEQ ID NO: 289494 - DNA, 25 bp, Mus musculus
cgctactttctgagttccaagtcca

SEQ ID NO: 289495 - DNA, 25 bp, Mus musculus
gagttccaagtccactcgactccag

SEQ ID NO: 289496 - DNA, 25 bp, Mus musculus
agcaagcctcccgaccggggactga

SEQ ID NO: 289497 - DNA, 25 bp, Mus musculus
gcgagcattgcctgcgcacttccgg

SEQ ID NO: 289498 - DNA, 25 bp, Mus musculus
gggcagctaaaacccactgttcgga

SEQ ID NO: 289499 - DNA, 25 bp, Mus musculus
ttagtggctcatcagaacgtgcccg

SEQ ID NO: 289500 - DNA, 25 bp, Mus musculus
cgcgcgctttagtggctcatcagaa

SEQ ID NO: 289501 - DNA, 25 bp, Mus musculus
gaagctactccgctccgtggacctg

SEQ ID NO: 289502 - DNA, 25 bp, Mus musculus
gcccgcggaccttgttggatgctca

SEQ ID NO: 289503 - DNA, 25 bp, Mus musculus
tggatgctcagttcttgaggccgag

SEQ ID NO: 289504 - DNA, 25 bp, Mus musculus
ccttttgagtctcgggctgccattc

SEQ ID NO: 289505 - DNA, 25 bp, Mus musculus
tcttgaggccgaggggaagctactc

SEQ ID NO: 289506 - DNA, 25 bp, Mus musculus
ccatcctgtcggtgaacggcaccga

SEQ ID NO: 289507 - DNA, 25 bp, Mus musculus
ttcagtgaaccaggacaacctcgcc

SEQ ID NO: 289508 - DNA, 25 bp, Mus musculus
ctccgaagagctttcagtgaaccag

SEQ ID NO: 289509 - DNA, 25 bp, Mus musculus
gggcgtggccctcatgaataatgaa

SEQ ID NO: 289510 - DNA, 25 bp, Mus musculus
catcagcatcaagggcggccgcgag

SEQ ID NO: 289511 - DNA, 25 bp, Mus musculus
cgcgagaaccggatgccgatcctca

SEQ ID NO: 289512 - DNA, 25 bp, Mus musculus
tctccaagatcttcccggggctggc

SEQ ID NO: 289513 - DNA, 25 bp, Mus musculus
cagacctcctcttgtggggctccag

SEQ ID NO: 289514 - DNA, 25 bp, Mus musculus
gggctccagagtgtggaaaaactga

SEQ ID NO: 289515 - DNA, 25 bp, Mus musculus
aaaactgaggcgtccagcgagaaga

SEQ ID NO: 289516 - DNA, 25 bp, Mus musculus
gcgagaagaaagttgggcagccacc

SEQ ID NO: 289517 - DNA, 25 bp, Mus musculus
gggcagccaccgaagtgttacttta

SEQ ID NO: 289518 - DNA, 25 bp, Mus musculus
cccttagcgagactcagctgagatt

SEQ ID NO: 289519 - DNA, 25 bp, Mus musculus
ggatgccgatcctcatctccaagat

SEQ ID NO: 289520 - DNA, 25 bp, Mus musculus
gtgacgtcgtgaggagagctttaaa

SEQ ID NO: 289521 - DNA, 25 bp, Mus musculus
agctcaagtccatgacgtcccggga

SEQ ID NO: 289522 - DNA, 25 bp, Mus musculus
tttggtcccttgagccacgcatggg

SEQ ID NO: 289523 - DNA, 25 bp, Mus musculus
ctgtagctggtgctgcatgaccgac

SEQ ID NO: 289524 - DNA, 25 bp, Mus musculus
gcctttttccctcaggacgcggaga

SEQ ID NO: 289525 - DNA, 25 bp, Mus musculus
gcacgcgcgtcgagaagcccgctaa

SEQ ID NO: 289526 - DNA, 25 bp, Mus musculus
cgcatgctcaaagtacgtggagtct

SEQ ID NO: 289527 - DNA, 25 bp, Mus musculus
ttcgggagctgttctcgaagctttc

SEQ ID NO: 289528 - DNA, 25 bp, Mus musculus
ggcgtgcaggcaaattgttgttttc

SEQ ID NO: 289529 - DNA, 25 bp, Mus musculus
ccaagcggaaataccaggaggactc

SEQ ID NO: 289530 - DNA, 25 bp, Mus musculus
cgattcccgaggatttgtgcgctgg

SEQ ID NO: 289531 - DNA, 25 bp, Mus musculus
cgggacaactacaaggcgggcagtc

SEQ ID NO: 289532 - DNA, 25 bp, Mus musculus
ctgtccagtggacaccgcgagcaca

SEQ ID NO: 289533 - DNA, 25 bp, Mus musculus
ctacaccgacctgcgggagaagctc

SEQ ID NO: 289534 - DNA, 25 bp, Mus musculus
tcattcattccctacgtcctgcagg

SEQ ID NO: 289535 - DNA, 25 bp, Mus musculus
tctcacaaggcacgcccttggtcgg

SEQ ID NO: 289536 - DNA, 25 bp, Mus musculus
ccctcttagaggagcggtgtctgca

SEQ ID NO: 289537 - DNA, 25 bp, Mus musculus
tctgcagttgcaggccatggccaca

SEQ ID NO: 289538 - DNA, 25 bp, Mus musculus
ggactcggctcccactgctagtggc

SEQ ID NO: 289539 - DNA, 25 bp, Mus musculus
gctcccactgctagtggcagctctg

SEQ ID NO: 289540 - DNA, 25 bp, Mus musculus
gagagccgacctgccgggctcctaa

SEQ ID NO: 289541 - DNA, 25 bp, Mus musculus
cggacccaggatatgaaatgacaac

SEQ ID NO: 289542 - DNA, 25 bp, Mus musculus
aatgacaacgtcaaccctccaggta

SEQ ID NO: 289543 - DNA, 25 bp, Mus musculus
accctccaggtacttgggtgcggcg

SEQ ID NO: 289544 - DNA, 25 bp, Mus musculus
ggcggtccctgtcaggctgcctcgt

SEQ ID NO: 289545 - DNA, 25 bp, Mus musculus
cggggctgaactgccgccttgcagc

SEQ ID NO: 289546 - DNA, 25 bp, Mus musculus
ccctacgtcctgcagggtgatgctg

SEQ ID NO: 289547 - DNA, 25 bp, Mus musculus
ggagcccgaaggacgtctccactga

SEQ ID NO: 289548 - DNA, 25 bp, Mus musculus
ctccggctccgaagaagccagctaa

SEQ ID NO: 289549 - DNA, 25 bp, Mus musculus
caccaccacctcaggccggggacgt

SEQ ID NO: 289550 - DNA, 25 bp, Mus musculus
gcaaacggcggtgggctcgccacca

SEQ ID NO: 289551 - DNA, 25 bp, Mus musculus
cagcaaacggcggtgggctcgccac

SEQ ID NO: 289552 - DNA, 25 bp, Mus musculus
gatttgttgctacttcctccgccac

SEQ ID NO: 289553 - DNA, 25 bp, Mus musculus
ctggtggatttgttgctacttcctc

SEQ ID NO: 289554 - DNA, 25 bp, Mus musculus
ccgctggtggatttgttgctacttc

SEQ ID NO: 289555 - DNA, 25 bp, Mus musculus
aacccgctggtggatttgttgctac

SEQ ID NO: 289556 - DNA, 25 bp, Mus musculus
tccgaagaagccagctaacccgctg

SEQ ID NO: 289557 - DNA, 25 bp, Mus musculus
gccaaatcagcgttcgagtaacccg

SEQ ID NO: 289558 - DNA, 25 bp, Mus musculus
atcagcgttcgagtaacccgctcct

SEQ ID NO: 289559 - DNA, 25 bp, Mus musculus
cgggacgccggccaaatcagcgttc

SEQ ID NO: 289560 - DNA, 25 bp, Mus musculus
gccggccaaatcagcgttcgagtaa

SEQ ID NO: 289561 - DNA, 25 bp, Mus musculus
agaagccagctaacccgctggtgga

SEQ ID NO: 289562 - DNA, 25 bp, Mus musculus
gggcaaagcaactgcacacaccttc

SEQ ID NO: 289563 - DNA, 25 bp, Mus musculus
ggcccgcgctatcctgggcaaagca

SEQ ID NO: 289564 - DNA, 25 bp, Mus musculus
cctgagatctgcacggcttggaagc

SEQ ID NO: 289565 - DNA, 25 bp, Mus musculus
gcttggaagcgaggcacacacgcca

SEQ ID NO: 289566 - DNA, 25 bp, Mus musculus
ggctgtccaacactctcagactggg

SEQ ID NO: 289567 - DNA, 25 bp, Mus musculus
ctggggttcaccagcacccgaagtg

SEQ ID NO: 289568 - DNA, 25 bp, Mus musculus
gaactcgagcgccaacacttgcagc

SEQ ID NO: 289569 - DNA, 25 bp, Mus musculus
caaggcgcctgaggtaccgccagta

SEQ ID NO: 289570 - DNA, 25 bp, Mus musculus
ccgacctggcacacgtgcgcgtatg

SEQ ID NO: 289571 - DNA, 25 bp, Mus musculus
ttccgctagcgccaaagacgccggg

SEQ ID NO: 289572 - DNA, 25 bp, Mus musculus
gtgtaacttccggacgcccatcgtc

SEQ ID NO: 289573 - DNA, 25 bp, Mus musculus
cgagtggcgacagttgtcggtttta

SEQ ID NO: 289574 - DNA, 25 bp, Mus musculus
ttaaagctgcaaataccacagggcc

SEQ ID NO: 289575 - DNA, 25 bp, Mus musculus
agggttccatctgacgcagttcgcg

SEQ ID NO: 289576 - DNA, 25 bp, Mus musculus
attaggctagagagacacgcgttcg

SEQ ID NO: 289577 - DNA, 25 bp, Mus musculus
cccgcgaatgaacgtcttgtagttg

SEQ ID NO: 289578 - DNA, 25 bp, Mus musculus
tcgggcttctcacgccactgagctt

SEQ ID NO: 289579 - DNA, 25 bp, Mus musculus
agcgacgccaggaggccctcatctt

SEQ ID NO: 289580 - DNA, 25 bp, Mus musculus
ggtaccgtcacttcctcttcagagc

SEQ ID NO: 289581 - DNA, 25 bp, Mus musculus
cgctcctgggaaacggaaacgattg

SEQ ID NO: 289582 - DNA, 25 bp, Mus musculus
gctgcgcaaagatcacggagaatta

SEQ ID NO: 289583 - DNA, 25 bp, Mus musculus
tgccctcagcatcggagagaacctt

SEQ ID NO: 289584 - DNA, 25 bp, Mus musculus
ttcaactcctagtggacagacccga

SEQ ID NO: 289585 - DNA, 25 bp, Mus musculus
cagacccgacggcacgtactgtttc

SEQ ID NO: 289586 - DNA, 25 bp, Mus musculus
ggctgcacaacgaccgagtgtacta

SEQ ID NO: 289587 - DNA, 25 bp, Mus musculus
atccatccctggtcgtcaccgggta

SEQ ID NO: 289588 - DNA, 25 bp, Mus musculus
cttccggctctccaggcacgaggat

SEQ ID NO: 289589 - DNA, 25 bp, Mus musculus
cccgtctctatggtttctcatctag

SEQ ID NO: 289590 - DNA, 25 bp, Mus musculus
agcaacgctgggaaagaagacatgg

SEQ ID NO: 289591 - DNA, 25 bp, Mus musculus
cgcagccatgataccgacggggttc

SEQ ID NO: 289592 - DNA, 25 bp, Mus musculus
tgacgccatcgggtcacgcacaacg

SEQ ID NO: 289593 - DNA, 25 bp, Mus musculus
tttccttggctgtgacgccatcggg

SEQ ID NO: 289594 - DNA, 25 bp, Mus musculus
ccgactgggccgtttccttggctgt

SEQ ID NO: 289595 - DNA, 25 bp, Mus musculus
tagaacttgagcacccagcggttga

SEQ ID NO: 289596 - DNA, 25 bp, Mus musculus
gcgcctcgtggaaatagaacttgag

SEQ ID NO: 289597 - DNA, 25 bp, Mus musculus
tctgcctgaagtcccggtaccggct

SEQ ID NO: 289598 - DNA, 25 bp, Mus musculus
tgatgtcccggatctgcctgaagtc

SEQ ID NO: 289599 - DNA, 25 bp, Mus musculus
gaagacatggttggctccgcgagcc

SEQ ID NO: 289600 - DNA, 25 bp, Mus musculus
cccaagggcctgacaagcaacgctg

SEQ ID NO: 289601 - DNA, 25 bp, Mus musculus
gcaaccgggacaccgtatgctcctt

SEQ ID NO: 289602 - DNA, 25 bp, Mus musculus
gacagacactgcataacccgcagca

SEQ ID NO: 289603 - DNA, 25 bp, Mus musculus
tctcaccctgcatgatgtcccggat

SEQ ID NO: 289604 - DNA, 25 bp, Mus musculus
cccgtcggaccaggtgtattgctac

SEQ ID NO: 289605 - DNA, 25 bp, Mus musculus
ctactgctggccgacgcatacagcg

SEQ ID NO: 289606 - DNA, 25 bp, Mus musculus
ccgactcctggagtactgtgcggcc

SEQ ID NO: 289607 - DNA, 25 bp, Mus musculus
tgcaaggcgtgagcttcactgccct

SEQ ID NO: 289608 - DNA, 25 bp, Mus musculus
ccggtcgccgactacgggcgcataa

SEQ ID NO: 289609 - DNA, 25 bp, Mus musculus
acccgacctggtcatcgaggtggcc

SEQ ID NO: 289610 - DNA, 25 bp, Mus musculus
gcttcatgagcgaccactacctgga

SEQ ID NO: 289611 - DNA, 25 bp, Mus musculus
tccggtgcagaacgcgatctgctgc

SEQ ID NO: 289612 - DNA, 25 bp, Mus musculus
gacgcggccgtttattgctaccagg

SEQ ID NO: 289613 - DNA, 25 bp, Mus musculus
ttcaactacctcttcctggcgggcg

SEQ ID NO: 289614 - DNA, 25 bp, Mus musculus
agctgagcctggacaactgctacga

SEQ ID NO: 289615 - DNA, 25 bp, Mus musculus
ctgccacctgtaacggagagattta

SEQ ID NO: 289616 - DNA, 25 bp, Mus musculus
gcggcctctgcgtgctcttcaacta

SEQ ID NO: 289617 - DNA, 25 bp, Mus musculus
tgtattgctacaacccggtcaccga

SEQ ID NO: 289618 - DNA, 25 bp, Mus musculus
cacgtttaggcgctggtccaaaatc

SEQ ID NO: 289619 - DNA, 25 bp, Mus musculus
tcggaggggctgcagtctcagcctc

SEQ ID NO: 289620 - DNA, 25 bp, Mus musculus
tatcacccgcttcctcagcgaggtg

SEQ ID NO: 289621 - DNA, 25 bp, Mus musculus
ggcgagtctacgatatcacccgctt

SEQ ID NO: 289622 - DNA, 25 bp, Mus musculus
gatccacgggcgagtctacgatatc

SEQ ID NO: 289623 - DNA, 25 bp, Mus musculus
cgaagcgaaactcggcggaagagac

SEQ ID NO: 289624 - DNA, 25 bp, Mus musculus
tctcagcctcgactgacaacgtgcg

SEQ ID NO: 289625 - DNA, 25 bp, Mus musculus
ctggtcgacgccgattggccagtcg

SEQ ID NO: 289626 - DNA, 25 bp, Mus musculus
ccgtcacctactaccggctggagga

SEQ ID NO: 289627 - DNA, 25 bp, Mus musculus
agttagcggtggaagcccagatagc

SEQ ID NO: 289628 - DNA, 25 bp, Mus musculus
ccggcaagtcaaggaagttagcggt

SEQ ID NO: 289629 - DNA, 25 bp, Mus musculus
attggccagtcggacgtcggaccag

SEQ ID NO: 289630 - DNA, 25 bp, Mus musculus
ggcgctggtccaaaatcacgatatc

SEQ ID NO: 289631 - DNA, 25 bp, Mus musculus
tcacgatatctgattggcaaggttg

SEQ ID NO: 289632 - DNA, 25 bp, Mus musculus
cgctgaggagaagcccgaaacggac

SEQ ID NO: 289633 - DNA, 25 bp, Mus musculus
gctcagattcctgtcagcggcgccg

SEQ ID NO: 289634 - DNA, 25 bp, Mus musculus
acttcatctcattgctcagcgcgga

SEQ ID NO: 289635 - DNA, 25 bp, Mus musculus
ccggaggttcgcaacctgccggtcg

SEQ ID NO: 289636 - DNA, 25 bp, Mus musculus
cagcgcggacctagacctggaatcg

SEQ ID NO: 289637 - DNA, 25 bp, Mus musculus
tggactcaccgggagtcagttctcc

SEQ ID NO: 289638 - DNA, 25 bp, Mus musculus
cttcggagctcagggtcaccatttt

SEQ ID NO: 289639 - DNA, 25 bp, Mus musculus
ccggactctcctctttggcaaagtt

SEQ ID NO: 289640 - DNA, 25 bp, Mus musculus
ccagagtcctctgcggtcccggagg

SEQ ID NO: 289641 - DNA, 25 bp, Mus musculus
cctcacgagagtcctgggctggccg

SEQ ID NO: 289642 - DNA, 25 bp, Mus musculus
ccctgtactcgcgaggtgagtcaga

SEQ ID NO: 289643 - DNA, 25 bp, Mus musculus
tggaatcgcccaagtccctgtactc

SEQ ID NO: 289644 - DNA, 25 bp, Mus musculus
agctgcgatgccctcggacttcatc

SEQ ID NO: 289645 - DNA, 25 bp, Mus musculus
gtcagttctccactccgcagagctg

SEQ ID NO: 289646 - DNA, 25 bp, Mus musculus
cctcccggatggtgtagatgttctt

SEQ ID NO: 289647 - DNA, 25 bp, Mus musculus
gaggctccttgaaccgaagctggta

SEQ ID NO: 289648 - DNA, 25 bp, Mus musculus
ccgcacgtactctgggagaggctcc

SEQ ID NO: 289649 - DNA, 25 bp, Mus musculus
ggagcgcacggctggcactattaaa

SEQ ID NO: 289650 - DNA, 25 bp, Mus musculus
agccaggctgaaccgactgtctcta

SEQ ID NO: 289651 - DNA, 25 bp, Mus musculus
ctcagaccggaggaacagctgctgc

SEQ ID NO: 289652 - DNA, 25 bp, Mus musculus
gtagatgttcttcccgatgtcctgg

SEQ ID NO: 289653 - DNA, 25 bp, Mus musculus
tccctcaagaaagctccggcatcag

SEQ ID NO: 289654 - DNA, 25 bp, Mus musculus
gcgcgtggccttgtcgcgaatctct

SEQ ID NO: 289655 - DNA, 25 bp, Mus musculus
cgccatgttggctgtcaaggacaga

SEQ ID NO: 289656 - DNA, 25 bp, Mus musculus
acagaccgcgcatgcgtatggagcc

SEQ ID NO: 289657 - DNA, 25 bp, Mus musculus
cgccgttcttgggtttgcacagtag

SEQ ID NO: 289658 - DNA, 25 bp, Mus musculus
tgcacagtagtcttcctcagaccgg

SEQ ID NO: 289659 - DNA, 25 bp, Mus musculus
acaaacgctgcctgctaccgatcgg

SEQ ID NO: 289660 - DNA, 25 bp, Mus musculus
tattttatacgtttgctcgggcaca

SEQ ID NO: 289661 - DNA, 25 bp, Mus musculus
ccgggtcctaggtggtccgcacctg

SEQ ID NO: 289662 - DNA, 25 bp, Mus musculus
gcacagcccgggtgatccttgcaat

SEQ ID NO: 289663 - DNA, 25 bp, Mus musculus
aagtggagcggagttaggcgccgct

SEQ ID NO: 289664 - DNA, 25 bp, Mus musculus
aggtgaccgcgcacgcccacgtgac

SEQ ID NO: 289665 - DNA, 25 bp, Mus musculus
agcctcttccgggtcaggtgaccgc

SEQ ID NO: 289666 - DNA, 25 bp, Mus musculus
caatcccggccctgagcgggtcaaa

SEQ ID NO: 289667 - DNA, 25 bp, Mus musculus
ggccctgagcgggtcaaacgctcgc

SEQ ID NO: 289668 - DNA, 25 bp, Mus musculus
gtcctaggtggtccgcacctgcgcg

SEQ ID NO: 289669 - DNA, 25 bp, Mus musculus
gtgagcccttattttatacgtttgc

SEQ ID NO: 289670 - DNA, 25 bp, Mus musculus
cggccagcctcttccgggtcaggtg

SEQ ID NO: 289671 - DNA, 25 bp, Mus musculus
tatacgtttgctcgggcacagcccg

SEQ ID NO: 289672 - DNA, 25 bp, Mus musculus
agcccgggtgatccttgcaatcccg

SEQ ID NO: 289673 - DNA, 25 bp, Mus musculus
gtgatccttgcaatcccggccctga

SEQ ID NO: 289674 - DNA, 25 bp, Mus musculus
aaggaggcttcgagcctggacccga

SEQ ID NO: 289675 - DNA, 25 bp, Mus musculus
gcacaggcccgacagggctgaactt

SEQ ID NO: 289676 - DNA, 25 bp, Mus musculus
acaggcccgacagggctgaactttt

SEQ ID NO: 289677 - DNA, 25 bp, Mus musculus
gccaggaggacttctcacaaggcta

SEQ ID NO: 289678 - DNA, 25 bp, Mus musculus
ggaggacttctcacaaggctacgcc

SEQ ID NO: 289679 - DNA, 25 bp, Mus musculus
ggacttctcacaaggctacgcctgg

SEQ ID NO: 289680 - DNA, 25 bp, Mus musculus
tctcacaaggctacgcctgggaaga

SEQ ID NO: 289681 - DNA, 25 bp, Mus musculus
caaggctacgcctgggaagactgga

SEQ ID NO: 289682 - DNA, 25 bp, Mus musculus
actggagcaaggaggcttcgagcct

SEQ ID NO: 289683 - DNA, 25 bp, Mus musculus
aggcttcgagcctggacccgagtgt

SEQ ID NO: 289684 - DNA, 25 bp, Mus musculus
cctggacccgagtgtggcacgactt

SEQ ID NO: 289685 - DNA, 25 bp, Mus musculus
acccgagtgtggcacgacttgcacg

SEQ ID NO: 289686 - DNA, 25 bp, Mus musculus
ccgagtgtggcacgacttgcacgcg

SEQ ID NO: 289687 - DNA, 25 bp, Mus musculus
gctacgcctgggaagactggagcaa

SEQ ID NO: 289688 - DNA, 25 bp, Mus musculus
cgttcatcggggactccgagaccgg

SEQ ID NO: 289689 - DNA, 25 bp, Mus musculus
tccgagaccggggtttcagtgacag

SEQ ID NO: 289690 - DNA, 25 bp, Mus musculus
cggggtttcagtgacagcttttaca

SEQ ID NO: 289691 - DNA, 25 bp, Mus musculus
gacagcttttacaggcacgggcaca

SEQ ID NO: 289692 - DNA, 25 bp, Mus musculus
gcacgggcacacgagactgaagctc

SEQ ID NO: 289693 - DNA, 25 bp, Mus musculus
gaagctcggtcttaaacggcgccca

SEQ ID NO: 289694 - DNA, 25 bp, Mus musculus
cggcgcccagccgttctgggaaaag

SEQ ID NO: 289695 - DNA, 25 bp, Mus musculus
ctcggcgggtagcatcgttccggct

SEQ ID NO: 289696 - DNA, 25 bp, Mus musculus
cgaggctgtcaatgggtaccgagca

SEQ ID NO: 289697 - DNA, 25 bp, Mus musculus
caatgggtaccgagcaccgcggtgt

SEQ ID NO: 289698 - DNA, 25 bp, Mus musculus
agccgctggggtcgcttgtcccaac

SEQ ID NO: 289699 - DNA, 25 bp, Mus musculus
gccacccgctcaccggttgaaatga

SEQ ID NO: 289700 - DNA, 25 bp, Mus musculus
tttgaccgccgctgcacagtcgact

SEQ ID NO: 289701 - DNA, 25 bp, Mus musculus
cggttgaaatgatccaccacactga

SEQ ID NO: 289702 - DNA, 25 bp, Mus musculus
tttgtgcaaacagcagctttccgaa

SEQ ID NO: 289703 - DNA, 25 bp, Mus musculus
gcatgccgccgtgtctctcatagcg

SEQ ID NO: 289704 - DNA, 25 bp, Mus musculus
aaataaggcgcgcacggcatgccgc

SEQ ID NO: 289705 - DNA, 25 bp, Mus musculus
cttggttgagtaaataaggcgcgca

SEQ ID NO: 289706 - DNA, 25 bp, Mus musculus
ctccaacgatgcagatccagcggtg

SEQ ID NO: 289707 - DNA, 25 bp, Mus musculus
gcttgatttataaactccaacgatg

SEQ ID NO: 289708 - DNA, 25 bp, Mus musculus
gctttccgaaagtcgagcacgcttc

SEQ ID NO: 289709 - DNA, 25 bp, Mus musculus
cgggaaacataaccagctttgtgca

SEQ ID NO: 289710 - DNA, 25 bp, Mus musculus
ttattctgaattatcgggaaacata

SEQ ID NO: 289711 - DNA, 25 bp, Mus musculus
gagggtttttcaaatattattctga

SEQ ID NO: 289712 - DNA, 25 bp, Mus musculus
gtctcactgtgaggcgtgtgcctgc

SEQ ID NO: 289713 - DNA, 25 bp, Mus musculus
tgagccgttgtctcactgtgaggcg

SEQ ID NO: 289714 - DNA, 25 bp, Mus musculus
tggcaggtgtgagccgttgtctcac

SEQ ID NO: 289715 - DNA, 25 bp, Mus musculus
gagcacgcttcctgtgcttgattta

SEQ ID NO: 289716 - DNA, 25 bp, Mus musculus
agcagcgccaggaacgcgcaatggg

SEQ ID NO: 289717 - DNA, 25 bp, Mus musculus
caccctggacactaggggctcccgg

SEQ ID NO: 289718 - DNA, 25 bp, Mus musculus
tctacctgggcggtcactgcctgac

SEQ ID NO: 289719 - DNA, 25 bp, Mus musculus
ctgggcggtcactgcctgacccggt

SEQ ID NO: 289720 - DNA, 25 bp, Mus musculus
cggtcactgcctgacccggtgagca

SEQ ID NO: 289721 - DNA, 25 bp, Mus musculus
gtcactgcctgacccggtgagcagc

SEQ ID NO: 289722 - DNA, 25 bp, Mus musculus
tgagcagcgccaggaacgcgcaatg

SEQ ID NO: 289723 - DNA, 25 bp, Mus musculus
cccacaacgactgcgccccaccccg

SEQ ID NO: 289724 - DNA, 25 bp, Mus musculus
ggccgcggagctcggtggcaatctg

SEQ ID NO: 289725 - DNA, 25 bp, Mus musculus
ctcggtggcaatctggggtccggga

SEQ ID NO: 289726 - DNA, 25 bp, Mus musculus
gtgccgcgctctacctgggcggtca

SEQ ID NO: 289727 - DNA, 25 bp, Mus musculus
cgcaatgggggctgcaccctggaca

SEQ ID NO: 289728 - DNA, 25 bp, Mus musculus
gctgcaccctggacactaggggctc

SEQ ID NO: 289729 - DNA, 25 bp, Mus musculus
tgcctgacccggtgagcagcgccag

SEQ ID NO: 289730 - DNA, 25 bp, Mus musculus
gtaagttcggggctccgctgccact

SEQ ID NO: 289731 - DNA, 25 bp, Mus musculus
ctcctgaggtgtacggaggctttgt

SEQ ID NO: 289732 - DNA, 25 bp, Mus musculus
tttgttgctgtgtaatgtggatccc

SEQ ID NO: 289733 - DNA, 25 bp, Mus musculus
attaaccttccgctttgttgctgtg

SEQ ID NO: 289734 - DNA, 25 bp, Mus musculus
tgcggggctgtgagtttcaaattaa

SEQ ID NO: 289735 - DNA, 25 bp, Mus musculus
ctgctcctgtgtgtttgtgcgtcta

SEQ ID NO: 289736 - DNA, 25 bp, Mus musculus
ttacataaagcgattccgggcgggc

SEQ ID NO: 289737 - DNA, 25 bp, Mus musculus
tgacttttgatgagcggtgcggtca

SEQ ID NO: 289738 - DNA, 25 bp, Mus musculus
cgctgccactggaatctcccgttgt

SEQ ID NO: 289739 - DNA, 25 bp, Mus musculus
gaaggcgcgtccgtttcttccaggc

SEQ ID NO: 289740 - DNA, 25 bp, Mus musculus
cgactgtagatgtcaggctttgccc

SEQ ID NO: 289741 - DNA, 25 bp, Mus musculus
caggccggcctttgacttttgatga

SEQ ID NO: 289742 - DNA, 25 bp, Mus musculus
ggcctgcgcccagcgcgactgtaga

SEQ ID NO: 289743 - DNA, 25 bp, Mus musculus
gtgcgcgctgcaaactgcgagttga

SEQ ID NO: 289744 - DNA, 25 bp, Mus musculus
ttttccagcctccagacctacatgg

SEQ ID NO: 289745 - DNA, 25 bp, Mus musculus
agatcgtctaccagccagacggctc

SEQ ID NO: 289746 - DNA, 25 bp, Mus musculus
ggaggtcagctgcaacgagtgctca

SEQ ID NO: 289747 - DNA, 25 bp, Mus musculus
gacggctccgcgtacattgttgaga

SEQ ID NO: 289748 - DNA, 25 bp, Mus musculus
acctggccggggagatcgtctacca

SEQ ID NO: 289749 - DNA, 25 bp, Mus musculus
agagcgccagcgacaccagcgagga

SEQ ID NO: 289750 - DNA, 25 bp, Mus musculus
agacctacatggagcatcactgccc

SEQ ID NO: 289751 - DNA, 25 bp, Mus musculus
aacgagtgctcagcctccttttcca

SEQ ID NO: 289752 - DNA, 25 bp, Mus musculus
ccgacaaacccagtagcatggagca

SEQ ID NO: 289753 - DNA, 25 bp, Mus musculus
caccggcaatggactgaactcaaca

SEQ ID NO: 289754 - DNA, 25 bp, Mus musculus
gggatccctcagcaccggcaatgga

SEQ ID NO: 289755 - DNA, 25 bp, Mus musculus
aaggacaatgggtgcgggatccctc

SEQ ID NO: 289756 - DNA, 25 bp, Mus musculus
catggagcagcccacaggcgagagc

SEQ ID NO: 289757 - DNA, 25 bp, Mus musculus
tacattgttgagagcctgagccagc

SEQ ID NO: 289758 - DNA, 25 bp, Mus musculus
gcacggagacttgttgggcgctcaa

SEQ ID NO: 289759 - DNA, 25 bp, Mus musculus
gtggtggctggactcaaccatccta

SEQ ID NO: 289760 - DNA, 25 bp, Mus musculus
ctgcgcaccggggaaaaaccataca

SEQ ID NO: 289761 - DNA, 25 bp, Mus musculus
aaccatacaattggccacgcgagcg

SEQ ID NO: 289762 - DNA, 25 bp, Mus musculus
gggctctaaacagagtccggtaatc

SEQ ID NO: 289763 - DNA, 25 bp, Mus musculus
ttccacacgcacacgacacggatgg

SEQ ID NO: 289764 - DNA, 25 bp, Mus musculus
tcatgtctgcagatattccacacgc

SEQ ID NO: 289765 - DNA, 25 bp, Mus musculus
tgaatttcctccacgcagtcatgtc

SEQ ID NO: 289766 - DNA, 25 bp, Mus musculus
ggcaggagcagcgacttgaatttcc

SEQ ID NO: 289767 - DNA, 25 bp, Mus musculus
ttacccttagctgcagtgaggagcc

SEQ ID NO: 289768 - DNA, 25 bp, Mus musculus
accgagctagcctgtcttaccctta

SEQ ID NO: 289769 - DNA, 25 bp, Mus musculus
cgcttggtcccttacaatcctcaga

SEQ ID NO: 289770 - DNA, 25 bp, Mus musculus
tcctccgaggaacaaccgggctcta

SEQ ID NO: 289771 - DNA, 25 bp, Mus musculus
tcctcagatcagacactcgcgttcg

SEQ ID NO: 289772 - DNA, 25 bp, Mus musculus
ttcacgacggacaacctggacatgc

SEQ ID NO: 289773 - DNA, 25 bp, Mus musculus
agctgatgaacctgggcgagagctt

SEQ ID NO: 289774 - DNA, 25 bp, Mus musculus
tgaacctgggcgagagcttcatcca

SEQ ID NO: 289775 - DNA, 25 bp, Mus musculus
gcgagagcttcatccagaccaacga

SEQ ID NO: 289776 - DNA, 25 bp, Mus musculus
agaccaacgacccatcgctgaagct

SEQ ID NO: 289777 - DNA, 25 bp, Mus musculus
tgaagctcttccaatgtgccgtctg

SEQ ID NO: 289778 - DNA, 25 bp, Mus musculus
agctcttccaatgtgccgtctgcaa

SEQ ID NO: 289779 - DNA, 25 bp, Mus musculus
atgtgccgtctgcaacaagttcacg

SEQ ID NO: 289780 - DNA, 25 bp, Mus musculus
gcagcctctcggaggacgagtggaa

SEQ ID NO: 289781 - DNA, 25 bp, Mus musculus
acatgaacgtggagcgcagcctctc

SEQ ID NO: 289782 - DNA, 25 bp, Mus musculus
ctgcacatgaacgtggagcgcagcc

SEQ ID NO: 289783 - DNA, 25 bp, Mus musculus
acctggacatgctggggctgcacat

SEQ ID NO: 289784 - DNA, 25 bp, Mus musculus
gtctgcaacaagttcacgacggaca

SEQ ID NO: 289785 - DNA, 25 bp, Mus musculus
acaacctggacatgctggggctgca

SEQ ID NO: 289786 - DNA, 25 bp, Mus musculus
tgccacccgagagcgtggtgatgcc

SEQ ID NO: 289787 - DNA, 25 bp, Mus musculus
tcaatgcgctgagccaggtgccacc

SEQ ID NO: 289788 - DNA, 25 bp, Mus musculus
atggctccaagcgtcaatgcgctga

SEQ ID NO: 289789 - DNA, 25 bp, Mus musculus
aagcagtgccgccatggctccaagc

SEQ ID NO: 289790 - DNA, 25 bp, Mus musculus
cagcaacgggactggcaacagcggc

SEQ ID NO: 289791 - DNA, 25 bp, Mus musculus
agcagcccggacaataagccgttta

SEQ ID NO: 289792 - DNA, 25 bp, Mus musculus
ctgcaagtgggaacagcaacgggac

SEQ ID NO: 289793 - DNA, 25 bp, Mus musculus
tttaccgccaccaatccaagcagtg

SEQ ID NO: 289794 - DNA, 25 bp, Mus musculus
accagaccaaggcacgggcagccaa

SEQ ID NO: 289795 - DNA, 25 bp, Mus musculus
ccacgctggagatccacatgcggtc

SEQ ID NO: 289796 - DNA, 25 bp, Mus musculus
cgtacagccagagttccacgctgga

SEQ ID NO: 289797 - DNA, 25 bp, Mus musculus
acacttgcaacgtggcgtacagcca

SEQ ID NO: 289798 - DNA, 25 bp, Mus musculus
taagccgtttaagtgtaacacttgc

SEQ ID NO: 289799 - DNA, 25 bp, Mus musculus
cacatgcggtctgtgctgcaccaga

SEQ ID NO: 289800 - DNA, 25 bp, Mus musculus
cagaagtatctgctggactccaacc

SEQ ID NO: 289801 - DNA, 25 bp, Mus musculus
cccggagcagctggaaattctctac

SEQ ID NO: 289802 - DNA, 25 bp, Mus musculus
cccgaaagatgctggatcacatcgc

SEQ ID NO: 289803 - DNA, 25 bp, Mus musculus
ccgacccgaaagatgctggatcaca

SEQ ID NO: 289804 - DNA, 25 bp, Mus musculus
agtatctgctggactccaacccgac

SEQ ID NO: 289805 - DNA, 25 bp, Mus musculus
ggaaattctctaccagaagtatctg

SEQ ID NO: 289806 - DNA, 25 bp, Mus musculus
gagcctcagagagacaagcgtttga

SEQ ID NO: 289807 - DNA, 25 bp, Mus musculus
ggagaagagcctcagagagacaagc

SEQ ID NO: 289808 - DNA, 25 bp, Mus musculus
tgcgagccccggtgagaacgacagc

SEQ ID NO: 289809 - DNA, 25 bp, Mus musculus
caagaggaagctggaggaaaaggcc

SEQ ID NO: 289810 - DNA, 25 bp, Mus musculus
acgatgaacacgctcaagaggaagc

SEQ ID NO: 289811 - DNA, 25 bp, Mus musculus
acctccacgatgaacacgctcaaga

SEQ ID NO: 289812 - DNA, 25 bp, Mus musculus
caagcgtttgaggacgaccataacc

SEQ ID NO: 289813 - DNA, 25 bp, Mus musculus
ccaacccgacccgaaagatgctgga

SEQ ID NO: 289814 - DNA, 25 bp, Mus musculus
caaggaatatgacaacgaaggtaca

SEQ ID NO: 289815 - DNA, 25 bp, Mus musculus
caagcgggtccgctggcaaatctgg

SEQ ID NO: 289816 - DNA, 25 bp, Mus musculus
gatcgacctgggcagaaacgttttc

SEQ ID NO: 289817 - DNA, 25 bp, Mus musculus
tccgctggcaaatctggtgacggcg

SEQ ID NO: 289818 - DNA, 25 bp, Mus musculus
aggtacagtggactacagtgaaacc

SEQ ID NO: 289819 - DNA, 25 bp, Mus musculus
tgacaacgaaggtacagtggactac

SEQ ID NO: 289820 - DNA, 25 bp, Mus musculus
gtcatctggtctggtcagcccagcc

SEQ ID NO: 289821 - DNA, 25 bp, Mus musculus
ccggttgtcatctggtctggtcagc

SEQ ID NO: 289822 - DNA, 25 bp, Mus musculus
tgtccgagtatgaagaccggttgtc

SEQ ID NO: 289823 - DNA, 25 bp, Mus musculus
cagccatgatggcaatgtccgagta

SEQ ID NO: 289824 - DNA, 25 bp, Mus musculus
ggggttgaccaaagcagccatgatg

SEQ ID NO: 289825 - DNA, 25 bp, Mus musculus
cgaacgaggggttgaccaaagcagc

SEQ ID NO: 289826 - DNA, 25 bp, Mus musculus
acagtgaaacctcaagcctcgcgga

SEQ ID NO: 289827 - DNA, 25 bp, Mus musculus
cccgagcttttatagcaaggaatat

SEQ ID NO: 289828 - DNA, 25 bp, Mus musculus
tgccaacagacgactattcggagga

SEQ ID NO: 289829 - DNA, 25 bp, Mus musculus
acggttacctcaagttcatgcagca

SEQ ID NO: 289830 - DNA, 25 bp, Mus musculus
cctccaggaagtcttggccgccagt

SEQ ID NO: 289831 - DNA, 25 bp, Mus musculus
agtctgccgctcactcaaacgacag

SEQ ID NO: 289832 - DNA, 25 bp, Mus musculus
gggttcagccctcgatgccaacaga

SEQ ID NO: 289833 - DNA, 25 bp, Mus musculus
tcatgcagcacctcaggggttcagc

SEQ ID NO: 289834 - DNA, 25 bp, Mus musculus
ggatctcagccaaaagtccgacgga

SEQ ID NO: 289835 - DNA, 25 bp, Mus musculus
tagtttattacctcactctgcctgc

SEQ ID NO: 289836 - DNA, 25 bp, Mus musculus
ttcggaggagtctgacacggatctc

SEQ ID NO: 289837 - DNA, 25 bp, Mus musculus
cgccaaagagcaccctagtttatta

SEQ ID NO: 289838 - DNA, 25 bp, Mus musculus
tcacgagagcagcaagaaacgccaa

SEQ ID NO: 289839 - DNA, 25 bp, Mus musculus
ggccttgcacaaacacagaacaatc

SEQ ID NO: 289840 - DNA, 25 bp, Mus musculus
cgtaccactgcctggcgtgcgagag

SEQ ID NO: 289841 - DNA, 25 bp, Mus musculus
cagcatctcgagtcggccttgcaca

SEQ ID NO: 289842 - DNA, 25 bp, Mus musculus
ctccaagtcaaatgtgcgagctttc

SEQ ID NO: 289843 - DNA, 25 bp, Mus musculus
ttctttccaccgctgtccttcgagt

SEQ ID NO: 289844 - DNA, 25 bp, Mus musculus
ttccaccgctgtccttcgagtttgc

SEQ ID NO: 289845 - DNA, 25 bp, Mus musculus
accgctgtccttcgagtttgctcga

SEQ ID NO: 289846 - DNA, 25 bp, Mus musculus
gagtttgctcgaacatggcctccaa

SEQ ID NO: 289847 - DNA, 25 bp, Mus musculus
tttgctcgaacatggcctccaagtc

SEQ ID NO: 289848 - DNA, 25 bp, Mus musculus
tctgcgcctgtcacttcgctggttc

SEQ ID NO: 289849 - DNA, 25 bp, Mus musculus
gtcaaatgtgcgagctttcttcccg

SEQ ID NO: 289850 - DNA, 25 bp, Mus musculus
aatgtgcgagctttcttcccgaatc

SEQ ID NO: 289851 - DNA, 25 bp, Mus musculus
gcgagctttcttcccgaatcctgtg

SEQ ID NO: 289852 - DNA, 25 bp, Mus musculus
agctttcttcccgaatcctgtgaag

SEQ ID NO: 289853 - DNA, 25 bp, Mus musculus
gccagtgttttccggcttctttcca

SEQ ID NO: 289854 - DNA, 25 bp, Mus musculus
catggcctccaagtcaaatgtgcga

SEQ ID NO: 289855 - DNA, 25 bp, Mus musculus
tcgaacatggcctccaagtcaaatg

SEQ ID NO: 289856 - DNA, 25 bp, Mus musculus
cacgagaccggccatgtttactaag

SEQ ID NO: 289857 - DNA, 25 bp, Mus musculus
aggccttcggttcctgatctggaga

SEQ ID NO: 289858 - DNA, 25 bp, Mus musculus
agcggccatcatcgtcccataatgc

SEQ ID NO: 289859 - DNA, 25 bp, Mus musculus
caagcacgactctcgaggccttcgg

SEQ ID NO: 289860 - DNA, 25 bp, Mus musculus
tcgttttctgcgtccgtgtttctca

SEQ ID NO: 289861 - DNA, 25 bp, Mus musculus
ccatggctgccgaaggacagatctg

SEQ ID NO: 289862 - DNA, 25 bp, Mus musculus
atcgcgcttggcgtaagagtcaaca

SEQ ID NO: 289863 - DNA, 25 bp, Mus musculus
ttcagagtctccttgcgaccaatcg

SEQ ID NO: 289864 - DNA, 25 bp, Mus musculus
ctcagtctcttcctctgggttcaga

SEQ ID NO: 289865 - DNA, 25 bp, Mus musculus
gtctcaaagaggcaaattccgctgt

SEQ ID NO: 289866 - DNA, 25 bp, Mus musculus
gcagcccacaaatccagggttccgg

SEQ ID NO: 289867 - DNA, 25 bp, Mus musculus
tccaaaaagaccatcgagagcagcc

SEQ ID NO: 289868 - DNA, 25 bp, Mus musculus
ggagccttctatccgtccaaaaaga

SEQ ID NO: 289869 - DNA, 25 bp, Mus musculus
attaccggactattgactggggcgc

SEQ ID NO: 289870 - DNA, 25 bp, Mus musculus
aggttccgcacggttgtctttatgc

SEQ ID NO: 289871 - DNA, 25 bp, Mus musculus
gtcttgtcgctgtcgcgcctcctaa

SEQ ID NO: 289872 - DNA, 25 bp, Mus musculus
ccctagacgttgattggacagccga

SEQ ID NO: 289873 - DNA, 25 bp, Mus musculus
ttggacagccgaacgcgtgcgctct

SEQ ID NO: 289874 - DNA, 25 bp, Mus musculus
gctctgcccggagtcaggctccgtg

SEQ ID NO: 289875 - DNA, 25 bp, Mus musculus
acgtgcctactttctgtcttgtcgc

SEQ ID NO: 289876 - DNA, 25 bp, Mus musculus
tcctaagggacgctgctctgaagtc

SEQ ID NO: 289877 - DNA, 25 bp, Mus musculus
ccttccttcggtgcaaccgtgagga

SEQ ID NO: 289878 - DNA, 25 bp, Mus musculus
tctcgagtggggagcagacgcttcc

SEQ ID NO: 289879 - DNA, 25 bp, Mus musculus
gacgcttccgaaatctgcagaccaa

SEQ ID NO: 289880 - DNA, 25 bp, Mus musculus
gtagtgcgcactaccctaatgcttc

SEQ ID NO: 289881 - DNA, 25 bp, Mus musculus
aagggcgatgcagcccgaaggttcc

SEQ ID NO: 289882 - DNA, 25 bp, Mus musculus
acggttgtctttatgccggtgctgc

SEQ ID NO: 289883 - DNA, 25 bp, Mus musculus
cctaatgcttccctgtccctgggaa

SEQ ID NO: 289884 - DNA, 25 bp, Mus musculus
tcctacagactaacgctggggttcc

SEQ ID NO: 289885 - DNA, 25 bp, Mus musculus
ggcggtgttagccacgccctaccta

SEQ ID NO: 289886 - DNA, 25 bp, Mus musculus
cttaggtctaaggagggcacgctca

SEQ ID NO: 289887 - DNA, 25 bp, Mus musculus
agccgctcggcatccaaaatggcga

SEQ ID NO: 289888 - DNA, 25 bp, Mus musculus
tgcccggtacccttgttccagattc

SEQ ID NO: 289889 - DNA, 25 bp, Mus musculus
agtcatttgctaagggcgcgccttg

SEQ ID NO: 289890 - DNA, 25 bp, Mus musculus
tcacgcagtgggttgagtcatttgc

SEQ ID NO: 289891 - DNA, 25 bp, Mus musculus
acggcttgtcctcacggtcctacag

SEQ ID NO: 289892 - DNA, 25 bp, Mus musculus
ggaaaaaccggctgcagactgtctc

SEQ ID NO: 289893 - DNA, 25 bp, Mus musculus
agactgtctcgcaaacgcccgcgga

SEQ ID NO: 289894 - DNA, 25 bp, Mus musculus
tccggtccgcatcctagctcaagtt

SEQ ID NO: 289895 - DNA, 25 bp, Mus musculus
tcaagttcaaggtcctgagggccac

SEQ ID NO: 289896 - DNA, 25 bp, Mus musculus
acagcgacgccagcacctgtctagg

SEQ ID NO: 289897 - DNA, 25 bp, Mus musculus
attggctgcgcacacaacaaggggc

SEQ ID NO: 289898 - DNA, 25 bp, Mus musculus
gcaacccgcgtagctcccgactgcc

SEQ ID NO: 289899 - DNA, 25 bp, Mus musculus
ccgggagtcggcaacccgcgtagct

SEQ ID NO: 289900 - DNA, 25 bp, Mus musculus
cggggcccattgtcccgcggtctgt

SEQ ID NO: 289901 - DNA, 25 bp, Mus musculus
gtctgccgttggctttgtctgtccg

SEQ ID NO: 289902 - DNA, 25 bp, Mus musculus
cgtctgtctgccgttggctttgtct

SEQ ID NO: 289903 - DNA, 25 bp, Mus musculus
tggaacgcccgcgattggatgctcc

SEQ ID NO: 289904 - DNA, 25 bp, Mus musculus
aggacacctccgaaagctctttaga

SEQ ID NO: 289905 - DNA, 25 bp, Mus musculus
ttggctttgtctgtccgccgcgccg

SEQ ID NO: 289906 - DNA, 25 bp, Mus musculus
cgctctaaaggtgcgcggaaacgtc

SEQ ID NO: 289907 - DNA, 25 bp, Mus musculus
tgcgcggaaacgtcaggacacctcc

SEQ ID NO: 289908 - DNA, 25 bp, Mus musculus
cgtcaggacacctccgaaagctctt

SEQ ID NO: 289909 - DNA, 25 bp, Mus musculus
gtcgccaggaccagatcgcgggcgg

SEQ ID NO: 289910 - DNA, 25 bp, Mus musculus
cctccgaaagctctttagatgctca

SEQ ID NO: 289911 - DNA, 25 bp, Mus musculus
actcgctgcgagagcgcgaaccgcg

SEQ ID NO: 289912 - DNA, 25 bp, Mus musculus
gtgtgtcactgagccgggcgctctc

SEQ ID NO: 289913 - DNA, 25 bp, Mus musculus
aaggcgacgaaaggatactgttatc

SEQ ID NO: 289914 - DNA, 25 bp, Mus musculus
cagcttcaagctggtcgggtcatgg

SEQ ID NO: 289915 - DNA, 25 bp, Mus musculus
cggtcccgcagcttcaagctggtcg

SEQ ID NO: 289916 - DNA, 25 bp, Mus musculus
ggatactgttatctacagaagagca

SEQ ID NO: 289917 - DNA, 25 bp, Mus musculus
gaagggaacccggagcccttgcgca

SEQ ID NO: 289918 - DNA, 25 bp, Mus musculus
ctcggctgtcgtgtgtcactgagcc

SEQ ID NO: 289919 - DNA, 25 bp, Mus musculus
cgtgagcgatcaggtctcggctgtc

SEQ ID NO: 289920 - DNA, 25 bp, Mus musculus
ggccgcccgtgagcgatcaggtctc

SEQ ID NO: 289921 - DNA, 25 bp, Mus musculus
ctgactcctgccaggtcgccggaga

SEQ ID NO: 289922 - DNA, 25 bp, Mus musculus
cgcccggcgcttaaggcgacgaaag

SEQ ID NO: 289923 - DNA, 25 bp, Mus musculus
tttgaagacccagagggcccgcgga

SEQ ID NO: 289924 - DNA, 25 bp, Mus musculus
aagagcaggcactccctggcttccg

SEQ ID NO: 289925 - DNA, 25 bp, Mus musculus
tgcgcaacgaggacgagcgaaccct

SEQ ID NO: 289926 - DNA, 25 bp, Mus musculus
ctgcaacgacttgaacgagaacgca

SEQ ID NO: 289927 - DNA, 25 bp, Mus musculus
ctgcagcgcatgcaagagacagatg

SEQ ID NO: 289928 - DNA, 25 bp, Mus musculus
tcgtgaagccaagcgcctgcagcgc

SEQ ID NO: 289929 - DNA, 25 bp, Mus musculus
agacgcatgagggatcgtgaagcca

SEQ ID NO: 289930 - DNA, 25 bp, Mus musculus
aagagccgtcgagacaatgagaccc

SEQ ID NO: 289931 - DNA, 25 bp, Mus musculus
cgacttgaacgagaacgcacagcca

SEQ ID NO: 289932 - DNA, 25 bp, Mus musculus
ctctggaagtaaggctgcaacgact

SEQ ID NO: 289933 - DNA, 25 bp, Mus musculus
gcgacagaatgagcctctggaagta

SEQ ID NO: 289934 - DNA, 25 bp, Mus musculus
caagtgggcccttcggcgacagaat

SEQ ID NO: 289935 - DNA, 25 bp, Mus musculus
gagacagatgagcagcgagctcgca

SEQ ID NO: 289936 - DNA, 25 bp, Mus musculus
ccatgaggctgaagcgggccaatga

SEQ ID NO: 289937 - DNA, 25 bp, Mus musculus
ccagagaagcggcaggcccgactca

SEQ ID NO: 289938 - DNA, 25 bp, Mus musculus
cggcaggcccgactcattcgagagc

SEQ ID NO: 289939 - DNA, 25 bp, Mus musculus
gcacagccaagaagagccgtcgaga

SEQ ID NO: 289940 - DNA, 25 bp, Mus musculus
gaacccaggcctgcttggcctcagg

SEQ ID NO: 289941 - DNA, 25 bp, Mus musculus
agatggcgttgagcgcatcccgccc

SEQ ID NO: 289942 - DNA, 25 bp, Mus musculus
cccgacgcggagagatgacgtcacc

SEQ ID NO: 289943 - DNA, 25 bp, Mus musculus
agcgccgcctacttacacaggagga

SEQ ID NO: 289944 - DNA, 25 bp, Mus musculus
cttacacaggaggaaactggccgcc

SEQ ID NO: 289945 - DNA, 25 bp, Mus musculus
ggggcccttccactagagctccgaa

SEQ ID NO: 289946 - DNA, 25 bp, Mus musculus
gagctccgaacccaggcctgcttgg

SEQ ID NO: 289947 - DNA, 25 bp, Mus musculus
ccgctggcgacgcttccttgtttgg

SEQ ID NO: 289948 - DNA, 25 bp, Mus musculus
cgccctgagaactcggacatcctga

SEQ ID NO: 289949 - DNA, 25 bp, Mus musculus
cggacatcctgacccgcggggacaa

SEQ ID NO: 289950 - DNA, 25 bp, Mus musculus
atcagggcctgaggccgccttctgg

SEQ ID NO: 289951 - DNA, 25 bp, Mus musculus
ccaggcgggaaagcagcatctagag

SEQ ID NO: 289952 - DNA, 25 bp, Mus musculus
catctagaggggctaggcacggcct

SEQ ID NO: 289953 - DNA, 25 bp, Mus musculus
ttcgctcgctctgcccgctgtttag

SEQ ID NO: 289954 - DNA, 25 bp, Mus musculus
agctcttcgccttccacaaggtgcg

SEQ ID NO: 289955 - DNA, 25 bp, Mus musculus
cgggccgcctctgccctgcgagcgc

SEQ ID NO: 289956 - DNA, 25 bp, Mus musculus
ggagctcttcgccttccacaaggtg

SEQ ID NO: 289957 - DNA, 25 bp, Mus musculus
agcaggagctcttcgccttccacaa

SEQ ID NO: 289958 - DNA, 25 bp, Mus musculus
gcttaagcaggagctcttcgccttc

SEQ ID NO: 289959 - DNA, 25 bp, Mus musculus
cgagaagcttaagcaggagctcttc

SEQ ID NO: 289960 - DNA, 25 bp, Mus musculus
gcgcgagaagcttaagcaggagctc

SEQ ID NO: 289961 - DNA, 25 bp, Mus musculus
cgcagcgcgagaagcttaagcagga

SEQ ID NO: 289962 - DNA, 25 bp, Mus musculus
acccgcagcgcgagaagcttaagca

SEQ ID NO: 289963 - DNA, 25 bp, Mus musculus
atgatgaagtttcggttccggcggc

SEQ ID NO: 289964 - DNA, 25 bp, Mus musculus
cgcaagatgatgaagtttcggttcc

SEQ ID NO: 289965 - DNA, 25 bp, Mus musculus
gcacggcgggcacgctcacgtcgtg

SEQ ID NO: 289966 - DNA, 25 bp, Mus musculus
cgcccattgtctggcgagcaagggg

SEQ ID NO: 289967 - DNA, 25 bp, Mus musculus
tcaggcgggccacatcgggccgcct

SEQ ID NO: 289968 - DNA, 25 bp, Mus musculus
agctgctggtttccttcgaggtttc

SEQ ID NO: 289969 - DNA, 25 bp, Mus musculus
ttgcttggacttcctgagggccgac

SEQ ID NO: 289970 - DNA, 25 bp, Mus musculus
caggcctccttgaacccattgactt

SEQ ID NO: 289971 - DNA, 25 bp, Mus musculus
cattgactttctcaggctgcgaggc

SEQ ID NO: 289972 - DNA, 25 bp, Mus musculus
gctcctttgaaagctcgctccgttc

SEQ ID NO: 289973 - DNA, 25 bp, Mus musculus
tgtcctctcggagccacgtatcagc

SEQ ID NO: 289974 - DNA, 25 bp, Mus musculus
tggatgttcggttcctgctgccact

SEQ ID NO: 289975 - DNA, 25 bp, Mus musculus
agtcgcctcctcctcggcaaatagt

SEQ ID NO: 289976 - DNA, 25 bp, Mus musculus
acccttgctacgctttgagtcgctc

SEQ ID NO: 289977 - DNA, 25 bp, Mus musculus
cggcgtcgagcgtcatcagtgacag

SEQ ID NO: 289978 - DNA, 25 bp, Mus musculus
tcagactcctcgcagcggtgactcg

SEQ ID NO: 289979 - DNA, 25 bp, Mus musculus
cggagcgtgctagctcagactcctc

SEQ ID NO: 289980 - DNA, 25 bp, Mus musculus
aaccaaagtgcgacggctccagggc

SEQ ID NO: 289981 - DNA, 25 bp, Mus musculus
tcctcggcaaatagtcctcggcggg

SEQ ID NO: 289982 - DNA, 25 bp, Mus musculus
ctctgtaaatccttggccgccaatg

SEQ ID NO: 289983 - DNA, 25 bp, Mus musculus
cggctctcggctccaagacgcaaca

SEQ ID NO: 289984 - DNA, 25 bp, Mus musculus
tgcgggagttccgaaccggctctcg

SEQ ID NO: 289985 - DNA, 25 bp, Mus musculus
tcggcggacacctgaagacatcacc

SEQ ID NO: 289986 - DNA, 25 bp, Mus musculus
agtacgcaggactcggcggacacct

SEQ ID NO: 289987 - DNA, 25 bp, Mus musculus
acctcagtctcctcgctgggcctag

SEQ ID NO: 289988 - DNA, 25 bp, Mus musculus
aagcaagagggctgtggccgccttc

SEQ ID NO: 289989 - DNA, 25 bp, Mus musculus
ccgggcgtctctgtaaatccttggc

SEQ ID NO: 289990 - DNA, 25 bp, Mus musculus
gacgactacgcaggtccagcgggtc

SEQ ID NO: 289991 - DNA, 25 bp, Mus musculus
ccaggctgacgactacgcaggtcca

SEQ ID NO: 289992 - DNA, 25 bp, Mus musculus
ctcgccaggctgacgactacgcagg

SEQ ID NO: 289993 - DNA, 25 bp, Mus musculus
ttcgggtcctaaaggtgagacggca

SEQ ID NO: 289994 - DNA, 25 bp, Mus musculus
aggcccacgccttcgggcagccgct

SEQ ID NO: 289995 - DNA, 25 bp, Mus musculus
gccttcgctaagctgcccgaggcgg

SEQ ID NO: 289996 - DNA, 25 bp, Mus musculus
gctggccgcgtataaaatcactaga

SEQ ID NO: 289997 - DNA, 25 bp, Mus musculus
cgctggcaaagctggcgctgaatcc

SEQ ID NO: 289998 - DNA, 25 bp, Mus musculus
tagttatttccgaagccgctgccgc

SEQ ID NO: 289999 - DNA, 25 bp, Mus musculus
gctccaactcggtgccctcaaaagg

SEQ ID NO: 290000 - DNA, 25 bp, Mus musculus
actgctggtccagctgccgaacctg

SEQ ID NO: 290001 - DNA, 25 bp, Mus musculus
cgcaggatcgtgtactgctggtcca

SEQ ID NO: 290002 - DNA, 25 bp, Mus musculus
aacgcccatagtgaggacgcccagc

SEQ ID NO: 290003 - DNA, 25 bp, Mus musculus
agctccctgcagtaaaacgcccata

SEQ ID NO: 290004 - DNA, 25 bp, Mus musculus
cctgggcagcttccttagactctta

SEQ ID NO: 290005 - DNA, 25 bp, Mus musculus
aagccaatggcgacgcagtagccca

SEQ ID NO: 290006 - DNA, 25 bp, Mus musculus
gcgcaacgccgcatacaggtaaaag

SEQ ID NO: 290007 - DNA, 25 bp, Mus musculus
gtcggtggaattgatgcgcaacgcc

SEQ ID NO: 290008 - DNA, 25 bp, Mus musculus
ctctggttttgcaagtgtcggtgga

SEQ ID NO: 290009 - DNA, 25 bp, Mus musculus
cgggcgtagactctttctctggttt

SEQ ID NO: 290010 - DNA, 25 bp, Mus musculus
tcggggctgcgtcccaactgggtcc

SEQ ID NO: 290011 - DNA, 25 bp, Mus musculus
ggcgcccgaggccatgcttctgcga

SEQ ID NO: 290012 - DNA, 25 bp, Mus musculus
ccgcgcacggctttgacgggacttc

SEQ ID NO: 290013 - DNA, 25 bp, Mus musculus
gacgggacttctccaaggctctttg

SEQ ID NO: 290014 - DNA, 25 bp, Mus musculus
caaggctctttgttcggatgcgcga

SEQ ID NO: 290015 - DNA, 25 bp, Mus musculus
gcgtccctgtgtctgtcctggcgct

SEQ ID NO: 290016 - DNA, 25 bp, Mus musculus
tggtctcggtccgttctctgttccc

SEQ ID NO: 290017 - DNA, 25 bp, Mus musculus
accgctcgacgtggtggtctcggtc

SEQ ID NO: 290018 - DNA, 25 bp, Mus musculus
gcccggaaacgatccgagggcgaca

SEQ ID NO: 290019 - DNA, 25 bp, Mus musculus
ttcccaggcaggtggccaagctcaa

SEQ ID NO: 290020 - DNA, 25 bp, Mus musculus
ccaagctcaaggacggggcggtaca

SEQ ID NO: 290021 - DNA, 25 bp, Mus musculus
gcggtacagctcacctgtgcgcacg

SEQ ID NO: 290022 - DNA, 25 bp, Mus musculus
cgaagtatttttcatggccggattc

SEQ ID NO: 290023 - DNA, 25 bp, Mus musculus
cgagggcgacaaccaaccataagtt

SEQ ID NO: 290024 - DNA, 25 bp, Mus musculus
tgacgcttgagtggcgaccattgtc

SEQ ID NO: 290025 - DNA, 25 bp, Mus musculus
cagaaaactcagcaggtggcggatc

SEQ ID NO: 290026 - DNA, 25 bp, Mus musculus
tgtcacttcacagaggggtagctgc

SEQ ID NO: 290027 - DNA, 25 bp, Mus musculus
cgaagcggctcgaggtgacatcgca

SEQ ID NO: 290028 - DNA, 25 bp, Mus musculus
ccctgcaggtgtgtactgcttgtcc

SEQ ID NO: 290029 - DNA, 25 bp, Mus musculus
ggcgaccattgtcagacccagaaaa

SEQ ID NO: 290030 - DNA, 25 bp, Mus musculus
ccaccgcagggaaagcagggccact

SEQ ID NO: 290031 - DNA, 25 bp, Mus musculus
aagcagggccacttctcagccgttg

SEQ ID NO: 290032 - DNA, 25 bp, Mus musculus
acttctcagccgttggggacagagc

SEQ ID NO: 290033 - DNA, 25 bp, Mus musculus
acagagcgagcttaaggcctggtct

SEQ ID NO: 290034 - DNA, 25 bp, Mus musculus
ttaaggcctggtctgctgcatcgac

SEQ ID NO: 290035 - DNA, 25 bp, Mus musculus
caagtctccgtgtccacagcggtga

SEQ ID NO: 290036 - DNA, 25 bp, Mus musculus
acccattgcggttcgcggtgtgtct

SEQ ID NO: 290037 - DNA, 25 bp, Mus musculus
tgacatcgcaggtctcttgacccgc

SEQ ID NO: 290038 - DNA, 25 bp, Mus musculus
ctgtcactcggtgccgcttggctct

SEQ ID NO: 290039 - DNA, 25 bp, Mus musculus
gcgcgcacactcagggaatcgcgca

SEQ ID NO: 290040 - DNA, 25 bp, Mus musculus
tgcctttatatgcagcccggagctg

SEQ ID NO: 290041 - DNA, 25 bp, Mus musculus
gcgcgccacgctgcctttatatgca

SEQ ID NO: 290042 - DNA, 25 bp, Mus musculus
acactcagggaatcgcgcagggcgc

SEQ ID NO: 290043 - DNA, 25 bp, Mus musculus
ccgcttggctctggttctcgcgctg

SEQ ID NO: 290044 - DNA, 25 bp, Mus musculus
gatcttaagcctctctctcagcgcg

SEQ ID NO: 290045 - DNA, 25 bp, Mus musculus
ccggagatcttaagcctctctctca

SEQ ID NO: 290046 - DNA, 25 bp, Mus musculus
gctccggagatcttaagcctctctc

SEQ ID NO: 290047 - DNA, 25 bp, Mus musculus
gccgctccggagatcttaagcctct

SEQ ID NO: 290048 - DNA, 25 bp, Mus musculus
cgagccgctccggagatcttaagcc

SEQ ID NO: 290049 - DNA, 25 bp, Mus musculus
cgggccagccatggcgagccgctcc

SEQ ID NO: 290050 - DNA, 25 bp, Mus musculus
ctgcgcgccacgctgcctttatatg

SEQ ID NO: 290051 - DNA, 25 bp, Mus musculus
ttaagcctctctctcagcgcgctgt

SEQ ID NO: 290052 - DNA, 25 bp, Mus musculus
cagagctcagctccaggagttgcca

SEQ ID NO: 290053 - DNA, 25 bp, Mus musculus
tgacagttcccggacggttcgctgc

SEQ ID NO: 290054 - DNA, 25 bp, Mus musculus
gcttctcggtgagtgacagttcccg

SEQ ID NO: 290055 - DNA, 25 bp, Mus musculus
aggaccgcgtgtgcggtgctactct

SEQ ID NO: 290056 - DNA, 25 bp, Mus musculus
caagtacgcagaggagacgccaccc

SEQ ID NO: 290057 - DNA, 25 bp, Mus musculus
cgacccggttgccaagtacgcagag

SEQ ID NO: 290058 - DNA, 25 bp, Mus musculus
tctttgtccgcgacccggttgccaa

SEQ ID NO: 290059 - DNA, 25 bp, Mus musculus
ctggaactccagttgcgcgtgcgca

SEQ ID NO: 290060 - DNA, 25 bp, Mus musculus
cagtgtggctgtcagagcctcgcag

SEQ ID NO: 290061 - DNA, 25 bp, Mus musculus
tgacgataggcctcccggaaggcgc

SEQ ID NO: 290062 - DNA, 25 bp, Mus musculus
gagttgccaccctcccgagtgacgt

SEQ ID NO: 290063 - DNA, 25 bp, Mus musculus
ggacaagtttctccgcaccagagct

SEQ ID NO: 290064 - DNA, 25 bp, Mus musculus
gcgacccgctgagacggacaagttt

SEQ ID NO: 290065 - DNA, 25 bp, Mus musculus
agtgacgtcgatgcgcgtgacgata

SEQ ID NO: 290066 - DNA, 25 bp, Mus musculus
ctccgagagcgcctctccatcatct

SEQ ID NO: 290067 - DNA, 25 bp, Mus musculus
catcatctcccggaccttcgagaac

SEQ ID NO: 290068 - DNA, 25 bp, Mus musculus
cttcgagaaccagaggaaactggtc

SEQ ID NO: 290069 - DNA, 25 bp, Mus musculus
cagaggaaactggtccaaggagaca

SEQ ID NO: 290070 - DNA, 25 bp, Mus musculus
aaactggtccaaggagacagcatgc

SEQ ID NO: 290071 - DNA, 25 bp, Mus musculus
gacagcatgctctttctggaccacg

SEQ ID NO: 290072 - DNA, 25 bp, Mus musculus
agcatgctctttctggaccacgttt

SEQ ID NO: 290073 - DNA, 25 bp, Mus musculus
tatctagtgaacacagtgagggtgc

SEQ ID NO: 290074 - DNA, 25 bp, Mus musculus
ttctggaccacgttttcacgatcga

SEQ ID NO: 290075 - DNA, 25 bp, Mus musculus
agcgcctgaataacatccagctatc

SEQ ID NO: 290076 - DNA, 25 bp, Mus musculus
ggaccacgttttcacgatcgagccc

SEQ ID NO: 290077 - DNA, 25 bp, Mus musculus
ccggtgagcgcctgaataacatcca

SEQ ID NO: 290078 - DNA, 25 bp, Mus musculus
atccagctatctagtgaacacagtg

SEQ ID NO: 290079 - DNA, 25 bp, Mus musculus
gctctttctggaccacgttttcacg

SEQ ID NO: 290080 - DNA, 25 bp, Mus musculus
cgcgaagacgctgcagttgtccata

SEQ ID NO: 290081 - DNA, 25 bp, Mus musculus
tcctgtgctccacgacttagtcggc

SEQ ID NO: 290082 - DNA, 25 bp, Mus musculus
tcacgcgtgtcttgcaggaagcatc

SEQ ID NO: 290083 - DNA, 25 bp, Mus musculus
gggaccgagccaatcagaacacgta

SEQ ID NO: 290084 - DNA, 25 bp, Mus musculus
acgcccataagtcggccaatcagga

SEQ ID NO: 290085 - DNA, 25 bp, Mus musculus
cttattacccgggagccttgcttca

SEQ ID NO: 290086 - DNA, 25 bp, Mus musculus
tgccctttccaaggcggcgagcaga

SEQ ID NO: 290087 - DNA, 25 bp, Mus musculus
tggtgctccacacgtactctatgcg

SEQ ID NO: 290088 - DNA, 25 bp, Mus musculus
cggctttactgcgtctaccagaaca

SEQ ID NO: 290089 - DNA, 25 bp, Mus musculus
aacatggtgctcttcttcttcgaga

SEQ ID NO: 290090 - DNA, 25 bp, Mus musculus
gttgtccataacctgcggcatcgag

SEQ ID NO: 290091 - DNA, 25 bp, Mus musculus
ttctggaacgtcctgctgaggctga

SEQ ID NO: 290092 - DNA, 25 bp, Mus musculus
tctcacttcggggttccttctggaa

SEQ ID NO: 290093 - DNA, 25 bp, Mus musculus
tcttcgagaactacaccggggtcca

SEQ ID NO: 290094 - DNA, 25 bp, Mus musculus
gctgccaccatgaacccagagaagg

SEQ ID NO: 290095 - DNA, 25 bp, Mus musculus
ggcgagggttcggtattgacctctc

SEQ ID NO: 290096 - DNA, 25 bp, Mus musculus
agcgcctagcggttctgcttgcccg

SEQ ID NO: 290097 - DNA, 25 bp, Mus musculus
cgagaagtaagagctcctgggaccc

SEQ ID NO: 290098 - DNA, 25 bp, Mus musculus
tgcagcgctggagatcgagaagtaa

SEQ ID NO: 290099 - DNA, 25 bp, Mus musculus
actctacgaaaagcggaaggttgca

SEQ ID NO: 290100 - DNA, 25 bp, Mus musculus
actcccaacatcgtaagggccctga

SEQ ID NO: 290101 - DNA, 25 bp, Mus musculus
gcaacctcgggctaaggtgtctgga

SEQ ID NO: 290102 - DNA, 25 bp, Mus musculus
gcatagcccatgagcaggctccggt

SEQ ID NO: 290103 - DNA, 25 bp, Mus musculus
ggcccagtgagcgttgccggttcct

SEQ ID NO: 290104 - DNA, 25 bp, Mus musculus
acctgagtaacatggccgcggccca

SEQ ID NO: 290105 - DNA, 25 bp, Mus musculus
gcgcagcgcgagctgccaccatgaa

SEQ ID NO: 290106 - DNA, 25 bp, Mus musculus
gggccctgaatgataaactctacga

SEQ ID NO: 290107 - DNA, 25 bp, Mus musculus
ccagagaaggattttgcgccgctca

SEQ ID NO: 290108 - DNA, 25 bp, Mus musculus
tgtcggatcccagcaaagcagcagc

SEQ ID NO: 290109 - DNA, 25 bp, Mus musculus
ctacctgctaggctcggtgtcggat

SEQ ID NO: 290110 - DNA, 25 bp, Mus musculus
ccgaacttgcagttggacgctgaga

SEQ ID NO: 290111 - DNA, 25 bp, Mus musculus
agctgccttttaacttggacgcgtc

SEQ ID NO: 290112 - DNA, 25 bp, Mus musculus
agcgcagtgactccgccaagaacca

SEQ ID NO: 290113 - DNA, 25 bp, Mus musculus
gcagtatcctgctctctgtccgcga

SEQ ID NO: 290114 - DNA, 25 bp, Mus musculus
tgtccgcgaccctcagaatgctgcg

SEQ ID NO: 290115 - DNA, 25 bp, Mus musculus
cgggagcctgtactcagacctaagt

SEQ ID NO: 290116 - DNA, 25 bp, Mus musculus
acctaagttgcaggcgaaccgcaga

SEQ ID NO: 290117 - DNA, 25 bp, Mus musculus
ccctggcagtgacagtttttccgtg

SEQ ID NO: 290118 - DNA, 25 bp, Mus musculus
tttccgtgatagtcaggggtcactt

SEQ ID NO: 290119 - DNA, 25 bp, Mus musculus
aagcaactatcccttggaggcagga

SEQ ID NO: 290120 - DNA, 25 bp, Mus musculus
tgctccgaagttgtgcgatcccagt

SEQ ID NO: 290121 - DNA, 25 bp, Mus musculus
ggagcttcgagcttacgtggcaccc

SEQ ID NO: 290122 - DNA, 25 bp, Mus musculus
ctagggcgtattccctcggtggcat

SEQ ID NO: 290123 - DNA, 25 bp, Mus musculus
aagtcgttgccgctgaggtccacgc

SEQ ID NO: 290124 - DNA, 25 bp, Mus musculus
tgacgtcccgagaccacagtgtggg

SEQ ID NO: 290125 - DNA, 25 bp, Mus musculus
ggagaagtgacgtcccgagaccaca

SEQ ID NO: 290126 - DNA, 25 bp, Mus musculus
cagctctcttacgggcagggaggac

SEQ ID NO: 290127 - DNA, 25 bp, Mus musculus
tccacgccgcgcacgaacggcagca

SEQ ID NO: 290128 - DNA, 25 bp, Mus musculus
ctaaccttgaagtcgttgccgctga

SEQ ID NO: 290129 - DNA, 25 bp, Mus musculus
cccagctaaccttgaagtcgttgcc

SEQ ID NO: 290130 - DNA, 25 bp, Mus musculus
ccggtcccggaagcgcagaggaagc

SEQ ID NO: 290131 - DNA, 25 bp, Mus musculus
gcggcctgagggctcaaatcccgcg

SEQ ID NO: 290132 - DNA, 25 bp, Mus musculus
cggttcgcggcctgagggctcaaat

SEQ ID NO: 290133 - DNA, 25 bp, Mus musculus
tattccctcggtggcatggggtccg

SEQ ID NO: 290134 - DNA, 25 bp, Mus musculus
gctggctagggcgtattccctcggt

SEQ ID NO: 290135 - DNA, 25 bp, Mus musculus
tccatggtggcgcagctctcttacg

SEQ ID NO: 290136 - DNA, 25 bp, Mus musculus
ggcagcgccagagctcggatttcaa

SEQ ID NO: 290137 - DNA, 25 bp, Mus musculus
aggctgcgccgcgaactgcccgcgc

SEQ ID NO: 290138 - DNA, 25 bp, Mus musculus
agcttcggcggctcggattaccgcc

SEQ ID NO: 290139 - DNA, 25 bp, Mus musculus
acgtgacgcccgagcttcggcggct

SEQ ID NO: 290140 - DNA, 25 bp, Mus musculus
ctccgccgcgcccacgtgacgcccg

SEQ ID NO: 290141 - DNA, 25 bp, Mus musculus
ctggccgtgaatgggtcctcgcccg

SEQ ID NO: 290142 - DNA, 25 bp, Mus musculus
ttctggccgtgaatgggtcctcgcc

SEQ ID NO: 290143 - DNA, 25 bp, Mus musculus
ggtttctggccgtgaatgggtcctc

SEQ ID NO: 290144 - DNA, 25 bp, Mus musculus
gctcggatttcaaagccctggtttc

SEQ ID NO: 290145 - DNA, 25 bp, Mus musculus
gagctcggatttcaaagccctggtt

SEQ ID NO: 290146 - DNA, 25 bp, Mus musculus
ccagagctcggatttcaaagccctg

SEQ ID NO: 290147 - DNA, 25 bp, Mus musculus
cgccagagctcggatttcaaagccc

SEQ ID NO: 290148 - DNA, 25 bp, Mus musculus
agcgccagagctcggatttcaaagc

SEQ ID NO: 290149 - DNA, 25 bp, Mus musculus
gcagcgccagagctcggatttcaaa

SEQ ID NO: 290150 - DNA, 25 bp, Mus musculus
catccgcccacccatcgtccctgtg

SEQ ID NO: 290151 - DNA, 25 bp, Mus musculus
gcctgatccagaccaagcgcccagc

SEQ ID NO: 290152 - DNA, 25 bp, Mus musculus
tgatccagaccaagcgcccagcctc

SEQ ID NO: 290153 - DNA, 25 bp, Mus musculus
tccaccgccgggctgcccacggcag

SEQ ID NO: 290154 - DNA, 25 bp, Mus musculus
tgccctccggtgcacctcccggtgt

SEQ ID NO: 290155 - DNA, 25 bp, Mus musculus
tgcacctcccggtgtggccaccatc

SEQ ID NO: 290156 - DNA, 25 bp, Mus musculus
tgtggccaccatccgccgcacaccc

SEQ ID NO: 290157 - DNA, 25 bp, Mus musculus
catccgccgcacaccctctaccaag

SEQ ID NO: 290158 - DNA, 25 bp, Mus musculus
cgcacaccctctaccaagcccactg

SEQ ID NO: 290159 - DNA, 25 bp, Mus musculus
ccaagcccactgtgcgccgcgccct

SEQ ID NO: 290160 - DNA, 25 bp, Mus musculus
cgcccacccatcgtccctgtgaaga

SEQ ID NO: 290161 - DNA, 25 bp, Mus musculus
cctgtgaagacacccaccgtgcccg

SEQ ID NO: 290162 - DNA, 25 bp, Mus musculus
cgtccctgtgaagacacccaccgtg

SEQ ID NO: 290163 - DNA, 25 bp, Mus musculus
tctaccaagcccactgtgcgccgcg

SEQ ID NO: 290164 - DNA, 25 bp, Mus musculus
gcatcttatgatggtgccgcccacc

SEQ ID NO: 290165 - DNA, 25 bp, Mus musculus
ctggccaccgaggacgaagagcagc

SEQ ID NO: 290166 - DNA, 25 bp, Mus musculus
ccaccgaggacgaagagcagcaact

SEQ ID NO: 290167 - DNA, 25 bp, Mus musculus
gcaactggctgccaacaggcacagc

SEQ ID NO: 290168 - DNA, 25 bp, Mus musculus
ctgccaacaggcacagcctagtaga

SEQ ID NO: 290169 - DNA, 25 bp, Mus musculus
caggcacagcctagtagagaagctt

SEQ ID NO: 290170 - DNA, 25 bp, Mus musculus
acagcctagtagagaagcttgggga

SEQ ID NO: 290171 - DNA, 25 bp, Mus musculus
cctgtcagccactccttcggaggaa

SEQ ID NO: 290172 - DNA, 25 bp, Mus musculus
tcagccactccttcggaggaaacgc

SEQ ID NO: 290173 - DNA, 25 bp, Mus musculus
ccggccgaagacatgctggtggcca

SEQ ID NO: 290174 - DNA, 25 bp, Mus musculus
ggctgcgcaggaccgtcaccaacga

SEQ ID NO: 290175 - DNA, 25 bp, Mus musculus
cgcaggaccgtcaccaacgacaggt

SEQ ID NO: 290176 - DNA, 25 bp, Mus musculus
ccgcatcttatgatggtgccgccca

SEQ ID NO: 290177 - DNA, 25 bp, Mus musculus
gaccgtcaccaacgacaggtcggcg

SEQ ID NO: 290178 - DNA, 25 bp, Mus musculus
ctcgcaagccttaaaggactcgttc

SEQ ID NO: 290179 - DNA, 25 bp, Mus musculus
gcaagccttaaaggactcgttccca

SEQ ID NO: 290180 - DNA, 25 bp, Mus musculus
gaagacacaagtgggcgaagagtcc

SEQ ID NO: 290181 - DNA, 25 bp, Mus musculus
ctctgaagacacaagtgggcgaaga

SEQ ID NO: 290182 - DNA, 25 bp, Mus musculus
cactctgaagacacaagtgggcgaa

SEQ ID NO: 290183 - DNA, 25 bp, Mus musculus
aaaggactcgttcccactctgaaga

SEQ ID NO: 290184 - DNA, 25 bp, Mus musculus
gtgccaccacgttaaactcgcaagc

SEQ ID NO: 290185 - DNA, 25 bp, Mus musculus
agtgtgccaccacgttaaactcgca

SEQ ID NO: 290186 - DNA, 25 bp, Mus musculus
cacgagtgtgccaccacgttaaact

SEQ ID NO: 290187 - DNA, 25 bp, Mus musculus
aatacacgagtgtgccaccacgtta

SEQ ID NO: 290188 - DNA, 25 bp, Mus musculus
ggaaatacacgagtgtgccaccacg

SEQ ID NO: 290189 - DNA, 25 bp, Mus musculus
caccacgttaaactcgcaagcctta

SEQ ID NO: 290190 - DNA, 25 bp, Mus musculus
cttaaaggactcgttcccactctga

SEQ ID NO: 290191 - DNA, 25 bp, Mus musculus
cgtggtggaaatacacgagtgtgcc

SEQ ID NO: 290192 - DNA, 25 bp, Mus musculus
gatgctgaatcgcttcaaggcctaa

SEQ ID NO: 290193 - DNA, 25 bp, Mus musculus
cacgaggccatttgcccacggcaag

SEQ ID NO: 290194 - DNA, 25 bp, Mus musculus
ttgcccacggcaagcatttccctaa

SEQ ID NO: 290195 - DNA, 25 bp, Mus musculus
tgccgggcagctctctcctatgagc

SEQ ID NO: 290196 - DNA, 25 bp, Mus musculus
ggcagctctctcctatgagcgctct

SEQ ID NO: 290197 - DNA, 25 bp, Mus musculus
attagccttcaagacgggccttcgg

SEQ ID NO: 290198 - DNA, 25 bp, Mus musculus
ttcctccgcgacagagaagctggga

SEQ ID NO: 290199 - DNA, 25 bp, Mus musculus
gagaagctgggaggccacttcttta

SEQ ID NO: 290200 - DNA, 25 bp, Mus musculus
ggccacttctttaccctgctgcaag

SEQ ID NO: 290201 - DNA, 25 bp, Mus musculus
ttcggtacccgacggatgctgaatc

SEQ ID NO: 290202 - DNA, 25 bp, Mus musculus
gaatcgcttcaaggcctaagccacc

SEQ ID NO: 290203 - DNA, 25 bp, Mus musculus
cggcgtccgccattagccttcaaga

SEQ ID NO: 290204 - DNA, 25 bp, Mus musculus
gggcgaagagtccacgaggccattt

SEQ ID NO: 290205 - DNA, 25 bp, Mus musculus
ctgcaagaaggatggcttcggtacc

SEQ ID NO: 290206 - DNA, 25 bp, Mus musculus
ttcgctctctgacagagctgcagga

SEQ ID NO: 290207 - DNA, 25 bp, Mus musculus
tgtcgatcgctttaccagggaaaac

SEQ ID NO: 290208 - DNA, 25 bp, Mus musculus
gcatcacgggtgtcgatcgctttac

SEQ ID NO: 290209 - DNA, 25 bp, Mus musculus
ctttttcctggaggatccggtggca

SEQ ID NO: 290210 - DNA, 25 bp, Mus musculus
cgccaacgcagaggggacctcgcaa

SEQ ID NO: 290211 - DNA, 25 bp, Mus musculus
agcgcccaccgggagccaagatggc

SEQ ID NO: 290212 - DNA, 25 bp, Mus musculus
gtggagtctccgctgaaattgtcag

SEQ ID NO: 290213 - DNA, 25 bp, Mus musculus
ctgaaattgtcaggagctcctccgc

SEQ ID NO: 290214 - DNA, 25 bp, Mus musculus
ggaggacactgctccgaaatctcca

SEQ ID NO: 290215 - DNA, 25 bp, Mus musculus
ggagctgaacctcctttttcctgga

SEQ ID NO: 290216 - DNA, 25 bp, Mus musculus
cgagctcattcgctctctgacagag

SEQ ID NO: 290217 - DNA, 25 bp, Mus musculus
gctggaagctgtgtacgaacgactc

SEQ ID NO: 290218 - DNA, 25 bp, Mus musculus
ctgtgtacgaacgactctgtggcga

SEQ ID NO: 290219 - DNA, 25 bp, Mus musculus
gaaatctccaccgagctcattcgct

SEQ ID NO: 290220 - DNA, 25 bp, Mus musculus
tttaacgcggctgcgcatgcagcgc

SEQ ID NO: 290221 - DNA, 25 bp, Mus musculus
cagagatctgggaaacccgcaggaa

SEQ ID NO: 290222 - DNA, 25 bp, Mus musculus
agatctgggaaacccgcaggaaggc

SEQ ID NO: 290223 - DNA, 25 bp, Mus musculus
ccaaactacagtggaactgaagacc

SEQ ID NO: 290224 - DNA, 25 bp, Mus musculus
tggaactgaagaccccgcggaccca

SEQ ID NO: 290225 - DNA, 25 bp, Mus musculus
gacccacatacctgcgtccgcccag

SEQ ID NO: 290226 - DNA, 25 bp, Mus musculus
tgcgtccgcccagcgctcgcagagc

SEQ ID NO: 290227 - DNA, 25 bp, Mus musculus
tcgcagagccggctctttaacgcgg

SEQ ID NO: 290228 - DNA, 25 bp, Mus musculus
ccggctctttaacgcggctgcgcat

SEQ ID NO: 290229 - DNA, 25 bp, Mus musculus
agttcattcggcctcccgccagagt

SEQ ID NO: 290230 - DNA, 25 bp, Mus musculus
agagtcctcagaacctactcgcagc

SEQ ID NO: 290231 - DNA, 25 bp, Mus musculus
aatggagttcattcggcctcccgcc

SEQ ID NO: 290232 - DNA, 25 bp, Mus musculus
tgggaaatggagttcattcggcctc

SEQ ID NO: 290233 - DNA, 25 bp, Mus musculus
catgcagcgcggcgcaccctgggaa

SEQ ID NO: 290234 - DNA, 25 bp, Mus musculus
gcggcagctctctgcacgggcggag

SEQ ID NO: 290235 - DNA, 25 bp, Mus musculus
caggagcggcaagcatggcccgcgc

SEQ ID NO: 290236 - DNA, 25 bp, Mus musculus
cggcgcccagcgcagactgaggtgc

SEQ ID NO: 290237 - DNA, 25 bp, Mus musculus
ccctaccgtcttctgtgcgggcagc

SEQ ID NO: 290238 - DNA, 25 bp, Mus musculus
gcccagaggcccagatccagcgggt

SEQ ID NO: 290239 - DNA, 25 bp, Mus musculus
cagaggcccagatccagcgggtcca

SEQ ID NO: 290240 - DNA, 25 bp, Mus musculus
gaggcccagatccagcgggtccagc

SEQ ID NO: 290241 - DNA, 25 bp, Mus musculus
cagcccagcaacttccctcgggtct

SEQ ID NO: 290242 - DNA, 25 bp, Mus musculus
ggtccgattgccttggcctcgatcg

SEQ ID NO: 290243 - DNA, 25 bp, Mus musculus
aagctaacgggtccaggcgcgggag

SEQ ID NO: 290244 - DNA, 25 bp, Mus musculus
tccgattgccttggcctcgatcggg

SEQ ID NO: 290245 - DNA, 25 bp, Mus musculus
cgattgccttggcctcgatcgggat

SEQ ID NO: 290246 - DNA, 25 bp, Mus musculus
gcggactggagagcggtgaagctaa

SEQ ID NO: 290247 - DNA, 25 bp, Mus musculus
agagcggtgaagctaacgggtccag

SEQ ID NO: 290248 - DNA, 25 bp, Mus musculus
tccaccaatcatggccttgggaggc

SEQ ID NO: 290249 - DNA, 25 bp, Mus musculus
tcaaggagaatttccggcgccgccg

SEQ ID NO: 290250 - DNA, 25 bp, Mus musculus
cttagccaatcacgcaactcaagga

SEQ ID NO: 290251 - DNA, 25 bp, Mus musculus
ggaggagcttctttcttagccaatc

SEQ ID NO: 290252 - DNA, 25 bp, Mus musculus
ccagtcacttctgggtccggcaagc

SEQ ID NO: 290253 - DNA, 25 bp, Mus musculus
tgagcgccttcagaaccagtcactt

SEQ ID NO: 290254 - DNA, 25 bp, Mus musculus
tctaccgagggaactgagcggccct

SEQ ID NO: 290255 - DNA, 25 bp, Mus musculus
ccaaggccagcaagatcgaggtcta

SEQ ID NO: 290256 - DNA, 25 bp, Mus musculus
atcatcgacatgctggccaaggcca

SEQ ID NO: 290257 - DNA, 25 bp, Mus musculus
tgcatgacgccgacttcgaagccca

SEQ ID NO: 290258 - DNA, 25 bp, Mus musculus
cgagttccggaagacaggcgtgcat

SEQ ID NO: 290259 - DNA, 25 bp, Mus musculus
ctactgggagaacaaccggtacgcg

SEQ ID NO: 290260 - DNA, 25 bp, Mus musculus
ggcaactggcaccactactgggaga

SEQ ID NO: 290261 - DNA, 25 bp, Mus musculus
gccgacagtcgaggcaactggcacc

SEQ ID NO: 290262 - DNA, 25 bp, Mus musculus
ccagcgcccatgagtcggtggccat

SEQ ID NO: 290263 - DNA, 25 bp, Mus musculus
cacagcaaactccagcgagcgcggg

SEQ ID NO: 290264 - DNA, 25 bp, Mus musculus
cggataagaagctcgctgcgggttt

SEQ ID NO: 290265 - DNA, 25 bp, Mus musculus
gcgggttttcttcgctgtcggagca

SEQ ID NO: 290266 - DNA, 25 bp, Mus musculus
ttcgctgtcggagcaaatccgccgc

SEQ ID NO: 290267 - DNA, 25 bp, Mus musculus
aaatccgccgcgctaagtgatcgcc

SEQ ID NO: 290268 - DNA, 25 bp, Mus musculus
gcgctaagtgatcgcccacagcaaa

SEQ ID NO: 290269 - DNA, 25 bp, Mus musculus
gcggagttgacgtcagttcctgccc

SEQ ID NO: 290270 - DNA, 25 bp, Mus musculus
cactgaccgacttgacagcggcttc

SEQ ID NO: 290271 - DNA, 25 bp, Mus musculus
ccaagtgccactcacacggagcgga

SEQ ID NO: 290272 - DNA, 25 bp, Mus musculus
gccactcacacggagcggaaaaaga

SEQ ID NO: 290273 - DNA, 25 bp, Mus musculus
aagacccgcgcggagttgacgtcag

SEQ ID NO: 290274 - DNA, 25 bp, Mus musculus
cgtgctggaaaccatgtccgcctca

SEQ ID NO: 290275 - DNA, 25 bp, Mus musculus
accaggccactgaccgacttgacag

SEQ ID NO: 290276 - DNA, 25 bp, Mus musculus
ctgaagcaggagaaccgtgaggccc

SEQ ID NO: 290277 - DNA, 25 bp, Mus musculus
gtcccgcctggaagccaagctgaag

SEQ ID NO: 290278 - DNA, 25 bp, Mus musculus
gcttcctactggaacccagtgcgca

SEQ ID NO: 290279 - DNA, 25 bp, Mus musculus
ggctctaggtggcatcagcttccta

SEQ ID NO: 290280 - DNA, 25 bp, Mus musculus
atgacaatgcatgaggcccgcctcg

SEQ ID NO: 290281 - DNA, 25 bp, Mus musculus
cggaaggcagcgataggccatgaca

SEQ ID NO: 290282 - DNA, 25 bp, Mus musculus
tcacgcatgcgcactgcggaaggca

SEQ ID NO: 290283 - DNA, 25 bp, Mus musculus
taatctgggaacagccgtaagcgtg

SEQ ID NO: 290284 - DNA, 25 bp, Mus musculus
gcgccctagagatgcacacgaagtg

SEQ ID NO: 290285 - DNA, 25 bp, Mus musculus
gcgcttaatcgcctgaaacttcacg

SEQ ID NO: 290286 - DNA, 25 bp, Mus musculus
ccgcaggaggatcgacctcaacttg

SEQ ID NO: 290287 - DNA, 25 bp, Mus musculus
agtgatttccaacagcgcttaatcg

SEQ ID NO: 290288 - DNA, 25 bp, Mus musculus
ccactctctgtgctgtcggcttgca

SEQ ID NO: 290289 - DNA, 25 bp, Mus musculus
aacttggatatcagcccacagcggc

SEQ ID NO: 290290 - DNA, 25 bp, Mus musculus
cttgcgcctttaaatccggagtatg

SEQ ID NO: 290291 - DNA, 25 bp, Mus musculus
ccggagtatgcttgtggtttccgcc

SEQ ID NO: 290292 - DNA, 25 bp, Mus musculus
gctccgttttgagcacgtgtgcgca

SEQ ID NO: 290293 - DNA, 25 bp, Mus musculus
tggagcgaaggcctgcttatccagc

SEQ ID NO: 290294 - DNA, 25 bp, Mus musculus
cttatccagcgtgcctttcgggtca

SEQ ID NO: 290295 - DNA, 25 bp, Mus musculus
gtgcctttcgggtcacttgccgcct

SEQ ID NO: 290296 - DNA, 25 bp, Mus musculus
gtttgaacgttccattcctaggcga

SEQ ID NO: 290297 - DNA, 25 bp, Mus musculus
attcctaggcgagtcctgggcctcc

SEQ ID NO: 290298 - DNA, 25 bp, Mus musculus
tactcgccctgtccttgggtccatg

SEQ ID NO: 290299 - DNA, 25 bp, Mus musculus
tccatgcgctgacgctcggacgcag

SEQ ID NO: 290300 - DNA, 25 bp, Mus musculus
acgcaggtacggctacagcgcaccg

SEQ ID NO: 290301 - DNA, 25 bp, Mus musculus
tgtctcccagcactgggcgtggcgc

SEQ ID NO: 290302 - DNA, 25 bp, Mus musculus
cccttgcgctatcaatataaccttg

SEQ ID NO: 290303 - DNA, 25 bp, Mus musculus
tgcctggcgatcattggctgagctg

SEQ ID NO: 290304 - DNA, 25 bp, Mus musculus
cgcgtgcatcttctgagctgctgct

SEQ ID NO: 290305 - DNA, 25 bp, Mus musculus
gtgccccgcacactgggttggagta

SEQ ID NO: 290306 - DNA, 25 bp, Mus musculus
agatcatcgtgcgtgcaccggcgca

SEQ ID NO: 290307 - DNA, 25 bp, Mus musculus
tgcaccggcgcagtgttcgccgctt

SEQ ID NO: 290308 - DNA, 25 bp, Mus musculus
cggcgcagtgttcgccgcttgcctg

SEQ ID NO: 290309 - DNA, 25 bp, Mus musculus
cgtgcatcttctgagctgctgctgc

SEQ ID NO: 290310 - DNA, 25 bp, Mus musculus
cccgcgtgcatcttctgagctgctg

SEQ ID NO: 290311 - DNA, 25 bp, Mus musculus
actcacgcgcgctttgctcggccgc

SEQ ID NO: 290312 - DNA, 25 bp, Mus musculus
gcgcctcactcacgcgcgctttgct

SEQ ID NO: 290313 - DNA, 25 bp, Mus musculus
cgcgggctgcgcctcactcacgcgc

SEQ ID NO: 290314 - DNA, 25 bp, Mus musculus
tagggtattggaggggtgagcactc

SEQ ID NO: 290315 - DNA, 25 bp, Mus musculus
gcacactgggttggagtagggtatt

SEQ ID NO: 290316 - DNA, 25 bp, Mus musculus
cgccgcttgcctgcctgccggagga

SEQ ID NO: 290317 - DNA, 25 bp, Mus musculus
acagcggtggtagatgtgccccgca

SEQ ID NO: 290318 - DNA, 25 bp, Mus musculus
gggaaatcattcactaaagctcaga

SEQ ID NO: 290319 - DNA, 25 bp, Mus musculus
cccgagggaaatcattcactaaagc

SEQ ID NO: 290320 - DNA, 25 bp, Mus musculus
tcactaaagctcagaccggaaacgg

SEQ ID NO: 290321 - DNA, 25 bp, Mus musculus
gcagcgctggcaggcttgcccgctt

SEQ ID NO: 290322 - DNA, 25 bp, Mus musculus
gtcctcttcgggttcccacccatca

SEQ ID NO: 290323 - DNA, 25 bp, Mus musculus
acccatcacccttcgctgcagatcg

SEQ ID NO: 290324 - DNA, 25 bp, Mus musculus
gtggcagagaagtccagcaccgccc

SEQ ID NO: 290325 - DNA, 25 bp, Mus musculus
agctcagaccggaaacggcgcgcca

SEQ ID NO: 290326 - DNA, 25 bp, Mus musculus
gtgtcgtcagagtcagcgtcagctc

SEQ ID NO: 290327 - DNA, 25 bp, Mus musculus
tcgtcagagtcagcgtcagctccgc

SEQ ID NO: 290328 - DNA, 25 bp, Mus musculus
ctaaggtccggggatccagcgccac

SEQ ID NO: 290329 - DNA, 25 bp, Mus musculus
tccggggatccagcgccactactgt

SEQ ID NO: 290330 - DNA, 25 bp, Mus musculus
gcgccactactgtcctcttcgggtt

SEQ ID NO: 290331 - DNA, 25 bp, Mus musculus
aaacggcgcgccacggtgtcgtcag

SEQ ID NO: 290332 - DNA, 25 bp, Mus musculus
aaaaaagcaagtgagccccgagagc

SEQ ID NO: 290333 - DNA, 25 bp, Mus musculus
ctctacgagaagagccggcgcttgg

SEQ ID NO: 290334 - DNA, 25 bp, Mus musculus
cctggcctgggtcaggacccggtct

SEQ ID NO: 290335 - DNA, 25 bp, Mus musculus
tcagagcgctctgattggatggtga

SEQ ID NO: 290336 - DNA, 25 bp, Mus musculus
gtcaggacccggtctccgcaggagc

SEQ ID NO: 290337 - DNA, 25 bp, Mus musculus
cgtagcgggtcacttttcatcagag

SEQ ID NO: 290338 - DNA, 25 bp, Mus musculus
ttgtggcgggtgagtatagcttctt

SEQ ID NO: 290339 - DNA, 25 bp, Mus musculus
gtgagtatagcttcttgtgcgcatc

SEQ ID NO: 290340 - DNA, 25 bp, Mus musculus
catctgagggagcaggtaactgccg

SEQ ID NO: 290341 - DNA, 25 bp, Mus musculus
ggtcacttttcatcagagcgctctg

SEQ ID NO: 290342 - DNA, 25 bp, Mus musculus
gatggtgaggtacggctctggcacc

SEQ ID NO: 290343 - DNA, 25 bp, Mus musculus
atagcttcttgtgcgcatctgaggg

SEQ ID NO: 290344 - DNA, 25 bp, Mus musculus
cccgagagctctacgagaagagccg

SEQ ID NO: 290345 - DNA, 25 bp, Mus musculus
cgcatctgagggagcaggtaactgc

SEQ ID NO: 290346 - DNA, 25 bp, Mus musculus
cgccgcagctgtacgcggccgaaga

SEQ ID NO: 290347 - DNA, 25 bp, Mus musculus
tcgaggactgctatcgcccttctct

SEQ ID NO: 290348 - DNA, 25 bp, Mus musculus
gctctcccgataggctctgcgcggg

SEQ ID NO: 290349 - DNA, 25 bp, Mus musculus
cgcgcatctttaagcgagcggaaga

SEQ ID NO: 290350 - DNA, 25 bp, Mus musculus
ggtagccgccatgccgggagaccat

SEQ ID NO: 290351 - DNA, 25 bp, Mus musculus
cgaagacgacgagacgcccgctgct

SEQ ID NO: 290352 - DNA, 25 bp, Mus musculus
gggtcgcctgctctgcgatttccgc

SEQ ID NO: 290353 - DNA, 25 bp, Mus musculus
tacccgcgtgctcagctcgaggtgt

SEQ ID NO: 290354 - DNA, 25 bp, Mus musculus
tggccctcatgcctgtgctcaatca

SEQ ID NO: 290355 - DNA, 25 bp, Mus musculus
tgctcaatcaggtggccgggttact

SEQ ID NO: 290356 - DNA, 25 bp, Mus musculus
actgagagttggaccgatgctgtgc

SEQ ID NO: 290357 - DNA, 25 bp, Mus musculus
gcctctacccagtgctgcagcagtg

SEQ ID NO: 290358 - DNA, 25 bp, Mus musculus
cgacgaggattcgaggactgctatc

SEQ ID NO: 290359 - DNA, 25 bp, Mus musculus
ctgattggaaaaaaccggagcgacg

SEQ ID NO: 290360 - DNA, 25 bp, Mus musculus
ccacgggcagagagatgtggttctg

SEQ ID NO: 290361 - DNA, 25 bp, Mus musculus
accacgggcagagagatgtggttct

SEQ ID NO: 290362 - DNA, 25 bp, Mus musculus
cggacaacggtgaccacgggcagag

SEQ ID NO: 290363 - DNA, 25 bp, Mus musculus
acggacaacggtgaccacgggcaga

SEQ ID NO: 290364 - DNA, 25 bp, Mus musculus
tgcagggacggacaacggtgaccac

SEQ ID NO: 290365 - DNA, 25 bp, Mus musculus
gagcggggacggaggacgttggcag

SEQ ID NO: 290366 - DNA, 25 bp, Mus musculus
aggacgttggcaggtccccgcacac

SEQ ID NO: 290367 - DNA, 25 bp, Mus musculus
ggacgttggcaggtccccgcacact

SEQ ID NO: 290368 - DNA, 25 bp, Mus musculus
cacgggcagagagatgtggttctgg

SEQ ID NO: 290369 - DNA, 25 bp, Mus musculus
cgcacactcgtcgtcaaccaggcgg

SEQ ID NO: 290370 - DNA, 25 bp, Mus musculus
ctgcccgcgagtcgcgggcccgtga

SEQ ID NO: 290371 - DNA, 25 bp, Mus musculus
gagtcgcgggcccgtgaggtaggaa

SEQ ID NO: 290372 - DNA, 25 bp, Mus musculus
cccgcacactcgtcgtcaaccaggc

SEQ ID NO: 290373 - DNA, 25 bp, Mus musculus
cagagagatgtggttctgggctgcg

SEQ ID NO: 290374 - DNA, 25 bp, Mus musculus
ttcacttccgccgggcgttgctgag

SEQ ID NO: 290375 - DNA, 25 bp, Mus musculus
ttgccgcgggccgtaaagcgcggaa

SEQ ID NO: 290376 - DNA, 25 bp, Mus musculus
taaagcgcggaaggtcgcaggcccc

SEQ ID NO: 290377 - DNA, 25 bp, Mus musculus
gtcccggaactctgcgctccgcgtc

SEQ ID NO: 290378 - DNA, 25 bp, Mus musculus
ggcgcagaccctcttcagcggctgg

SEQ ID NO: 290379 - DNA, 25 bp, Mus musculus
ccaaacaagcgcacgtgcgggccgg

SEQ ID NO: 290380 - DNA, 25 bp, Mus musculus
gctgggctgcccttcacttccgccg

SEQ ID NO: 290381 - DNA, 25 bp, Mus musculus
ggcggcagacgatcacccgaactgc

SEQ ID NO: 290382 - DNA, 25 bp, Mus musculus
gcggccttctggtcccgcgaactct

SEQ ID NO: 290383 - DNA, 25 bp, Mus musculus
agaccctcttcagcggctgggctgc

SEQ ID NO: 290384 - DNA, 25 bp, Mus musculus
cgagacccaaacaagcgcacgtgcg

SEQ ID NO: 290385 - DNA, 25 bp, Mus musculus
cggggcctggcgagacccaaacaag

SEQ ID NO: 290386 - DNA, 25 bp, Mus musculus
gcctggcggcagacgatcacccgaa

SEQ ID NO: 290387 - DNA, 25 bp, Mus musculus
ccctcgcgcaggatcggagctcagg

SEQ ID NO: 290388 - DNA, 25 bp, Mus musculus
ccagagcctcgacccagtgtgggca

SEQ ID NO: 290389 - DNA, 25 bp, Mus musculus
agcctcgacccagtgtgggcagtta

SEQ ID NO: 290390 - DNA, 25 bp, Mus musculus
cctcgacccagtgtgggcagttagg

SEQ ID NO: 290391 - DNA, 25 bp, Mus musculus
cccagtgtgggcagttagggtgacc

SEQ ID NO: 290392 - DNA, 25 bp, Mus musculus
cgtgtgtgcctagagcccgggcatc

SEQ ID NO: 290393 - DNA, 25 bp, Mus musculus
cccgggcatcggatccgggccagag

SEQ ID NO: 290394 - DNA, 25 bp, Mus musculus
cgggccagagcctcgacccagtgtg

SEQ ID NO: 290395 - DNA, 25 bp, Mus musculus
gcctccgtgtgtgcctagagcccgg

SEQ ID NO: 290396 - DNA, 25 bp, Mus musculus
aggccggcctccgtgtgtgcctaga

SEQ ID NO: 290397 - DNA, 25 bp, Mus musculus
tcaggccggcctccgtgtgtgccta

SEQ ID NO: 290398 - DNA, 25 bp, Mus musculus
cgacgagagtgaggagagccgccac

SEQ ID NO: 290399 - DNA, 25 bp, Mus musculus
acggcgagtgtgcagggagcggcca

SEQ ID NO: 290400 - DNA, 25 bp, Mus musculus
ccgcctggatgacggcgagtgtgca

SEQ ID NO: 290401 - DNA, 25 bp, Mus musculus
ctctgcctggatggcgacgagagtg

SEQ ID NO: 290402 - DNA, 25 bp, Mus musculus
agctccgatcctgcgcgaggggtcc

SEQ ID NO: 290403 - DNA, 25 bp, Mus musculus
gcagcccagccgctgaagagggtct

SEQ ID NO: 290404 - DNA, 25 bp, Mus musculus
agctccactggctcaatcccggcgc

SEQ ID NO: 290405 - DNA, 25 bp, Mus musculus
ccgaccggtggcaccgcctcagaga

SEQ ID NO: 290406 - DNA, 25 bp, Mus musculus
gccggagcccaaagctcggacgcca

SEQ ID NO: 290407 - DNA, 25 bp, Mus musculus
caagagttcgcgggaccagaaggcc

SEQ ID NO: 290408 - DNA, 25 bp, Mus musculus
ctcagcaacgcccggcggaagtgaa

SEQ ID NO: 290409 - DNA, 25 bp, Mus musculus
ccagccgctgaagagggtctgcgcc

SEQ ID NO: 290410 - DNA, 25 bp, Mus musculus
ggggcctgcgaccttccgcgcttta

SEQ ID NO: 290411 - DNA, 25 bp, Mus musculus
ttccgcgctttacggcccgcggcaa

SEQ ID NO: 290412 - DNA, 25 bp, Mus musculus
cccgcacgtgcgcttgtttgggtct

SEQ ID NO: 290413 - DNA, 25 bp, Mus musculus
cgcttgtttgggtctcgccaggccc

SEQ ID NO: 290414 - DNA, 25 bp, Mus musculus
ggcctgagctccgatcctgcgcgag

SEQ ID NO: 290415 - DNA, 25 bp, Mus musculus
cgggtgatcgtctgccgccaggcct

SEQ ID NO: 290416 - DNA, 25 bp, Mus musculus
caccgccatcttgggttcgcggcga

SEQ ID NO: 290417 - DNA, 25 bp, Mus musculus
tggccctgaccgtgaccattctggg

SEQ ID NO: 290418 - DNA, 25 bp, Mus musculus
ctgctgcgataactgaggctgctga

SEQ ID NO: 290419 - DNA, 25 bp, Mus musculus
ccgcgaaaagcgactgctgctgttg

SEQ ID NO: 290420 - DNA, 25 bp, Mus musculus
ccaggttgttgctccaggtgtgttt

SEQ ID NO: 290421 - DNA, 25 bp, Mus musculus
aggcactcgagcaccgccaggttgt

SEQ ID NO: 290422 - DNA, 25 bp, Mus musculus
cttgcccgaacgcacccgggagtga

SEQ ID NO: 290423 - DNA, 25 bp, Mus musculus
caccgcgacgacagggagcgaacta

SEQ ID NO: 290424 - DNA, 25 bp, Mus musculus
aggcctgcgcctactgaggccgtga

SEQ ID NO: 290425 - DNA, 25 bp, Mus musculus
gcgcaaacagaaaacacgctcctta

SEQ ID NO: 290426 - DNA, 25 bp, Mus musculus
gcatcacacaaaagacaggagcgca

SEQ ID NO: 290427 - DNA, 25 bp, Mus musculus
tttccggcgaggaaccgctctgcat

SEQ ID NO: 290428 - DNA, 25 bp, Mus musculus
ggtcgaaacggatagcaaacaaatc

SEQ ID NO: 290429 - DNA, 25 bp, Mus musculus
ccgccggcgacgtgtatttaaatga

SEQ ID NO: 290430 - DNA, 25 bp, Mus musculus
cccttgctaagctttggtttcgata

SEQ ID NO: 290431 - DNA, 25 bp, Mus musculus
tcctattggccagccactgcggacg

SEQ ID NO: 290432 - DNA, 25 bp, Mus musculus
aaggcgcctcctgcaattggtagtc

SEQ ID NO: 290433 - DNA, 25 bp, Mus musculus
tgatacatttctgggcgagaacctc

SEQ ID NO: 290434 - DNA, 25 bp, Mus musculus
gcgccctcattggtcagcctttgat

SEQ ID NO: 290435 - DNA, 25 bp, Mus musculus
ccagctgaaatagtggcgccctcat

SEQ ID NO: 290436 - DNA, 25 bp, Mus musculus
ggacggcgaccaatctcttctcttc

SEQ ID NO: 290437 - DNA, 25 bp, Mus musculus
cagcagctcttctggaccctgaggc

SEQ ID NO: 290438 - DNA, 25 bp, Mus musculus
gacaagggtcaaagagtcagtcacc

SEQ ID NO: 290439 - DNA, 25 bp, Mus musculus
gttccgctgcggtgataaaagttaa

SEQ ID NO: 290440 - DNA, 25 bp, Mus musculus
atatccttcggtcgcagttccgctg

SEQ ID NO: 290441 - DNA, 25 bp, Mus musculus
cgccctgttagtagctgcggaacca

SEQ ID NO: 290442 - DNA, 25 bp, Mus musculus
ttcgataaacacagaaggcgggagc

SEQ ID NO: 290443 - DNA, 25 bp, Mus musculus
ggttcgtatccaggctcgccctgtt

SEQ ID NO: 290444 - DNA, 25 bp, Mus musculus
tgtaggatcatcagtctcccgccgc

SEQ ID NO: 290445 - DNA, 25 bp, Mus musculus
aagctctcgcctctcggaggaactc

SEQ ID NO: 290446 - DNA, 25 bp, Mus musculus
ccgcggtcttctgcctcgttgacaa

SEQ ID NO: 290447 - DNA, 25 bp, Mus musculus
ttctgcctcgttgacaatgcacgcc

SEQ ID NO: 290448 - DNA, 25 bp, Mus musculus
cgttgacaatgcacgccaggtcgga

SEQ ID NO: 290449 - DNA, 25 bp, Mus musculus
atgcacgccaggtcggagcaggtcc

SEQ ID NO: 290450 - DNA, 25 bp, Mus musculus
gtccggtctatcctgcgctcagttc

SEQ ID NO: 290451 - DNA, 25 bp, Mus musculus
aaccttaaagctctcgcctctcgga

SEQ ID NO: 290452 - DNA, 25 bp, Mus musculus
tccgaggggcgctcgtccggtctat

SEQ ID NO: 290453 - DNA, 25 bp, Mus musculus
cgcgctacagctcactggattctac

SEQ ID NO: 290454 - DNA, 25 bp, Mus musculus
cctcccttggtgcaaccttaaagct

SEQ ID NO: 290455 - DNA, 25 bp, Mus musculus
ttctacgtgatctccgaggggcgct

SEQ ID NO: 290456 - DNA, 25 bp, Mus musculus
cctgcgctcagttcctgtaggatca

SEQ ID NO: 290457 - DNA, 25 bp, Mus musculus
cactggattctacgtgatctccgag

SEQ ID NO: 290458 - DNA, 25 bp, Mus musculus
agagcaagacgctgagcgcggcccg

SEQ ID NO: 290459 - DNA, 25 bp, Mus musculus
gtcggcactgatgtcctggccagcc

SEQ ID NO: 290460 - DNA, 25 bp, Mus musculus
tcccattggccactcggtgggacgc

SEQ ID NO: 290461 - DNA, 25 bp, Mus musculus
atttgcatgccctgctcccattggc

SEQ ID NO: 290462 - DNA, 25 bp, Mus musculus
cctctaacatctcgggagccggggc

SEQ ID NO: 290463 - DNA, 25 bp, Mus musculus
cagcgcgcctctaacatctcgggag

SEQ ID NO: 290464 - DNA, 25 bp, Mus musculus
gatctcggagcccggcagtctgctc

SEQ ID NO: 290465 - DNA, 25 bp, Mus musculus
ccggatgatgccgcacgaagctggt

SEQ ID NO: 290466 - DNA, 25 bp, Mus musculus
ggcccatccaggtcggcactgatgt

SEQ ID NO: 290467 - DNA, 25 bp, Mus musculus
gagtgtctgtgaggtggcccatcca

SEQ ID NO: 290468 - DNA, 25 bp, Mus musculus
catagtactgctccagccagcggcg

SEQ ID NO: 290469 - DNA, 25 bp, Mus musculus
gttcgcccacatagtactgctccag

SEQ ID NO: 290470 - DNA, 25 bp, Mus musculus
tcgcagttcgcccacatagtactgc

SEQ ID NO: 290471 - DNA, 25 bp, Mus musculus
cgcacgaagctggtgaggtcgtaga

SEQ ID NO: 290472 - DNA, 25 bp, Mus musculus
acccaacgcgctgtcggactttgtg

SEQ ID NO: 290473 - DNA, 25 bp, Mus musculus
atttgactgattctgcggtagcccg

SEQ ID NO: 290474 - DNA, 25 bp, Mus musculus
cccttaggtcgtggggagactcatt

SEQ ID NO: 290475 - DNA, 25 bp, Mus musculus
cggcgacagtttctgcccttaggtc

SEQ ID NO: 290476 - DNA, 25 bp, Mus musculus
tgcgccactaagcagccttgaacta

SEQ ID NO: 290477 - DNA, 25 bp, Mus musculus
ggcaactgccgcctcgatcagaaac

SEQ ID NO: 290478 - DNA, 25 bp, Mus musculus
cgaggaactgtgagagccaccttaa

SEQ ID NO: 290479 - DNA, 25 bp, Mus musculus
gcccgtgcatgctggagaacccaga

SEQ ID NO: 290480 - DNA, 25 bp, Mus musculus
tgctccagcagcaactccacgggtg

SEQ ID NO: 290481 - DNA, 25 bp, Mus musculus
cgtcggtgccactgaaacgctaaga

SEQ ID NO: 290482 - DNA, 25 bp, Mus musculus
agaacttttcgcactcctcggaagg

SEQ ID NO: 290483 - DNA, 25 bp, Mus musculus
gcgtcgtttttctccgccacgcaga

SEQ ID NO: 290484 - DNA, 25 bp, Mus musculus
tagcccgtggcgaggattaatgaca

SEQ ID NO: 290485 - DNA, 25 bp, Mus musculus
tcatacgcccgttggacagcaagtc

SEQ ID NO: 290486 - DNA, 25 bp, Mus musculus
ccctccgcctttatgttcgcccaga

SEQ ID NO: 290487 - DNA, 25 bp, Mus musculus
tgcgcagccgctcggtcagctcggt

SEQ ID NO: 290488 - DNA, 25 bp, Mus musculus
cgggcatgggcatggaccccagcac

SEQ ID NO: 290489 - DNA, 25 bp, Mus musculus
gaggggtgccctttagtctctacac

SEQ ID NO: 290490 - DNA, 25 bp, Mus musculus
ctcggggctcttttgtgactctccc

SEQ ID NO: 290491 - DNA, 25 bp, Mus musculus
tcgcccagacctccacccgcttctg

SEQ ID NO: 290492 - DNA, 25 bp, Mus musculus
ggtctctacggatgacagcgccgtg

SEQ ID NO: 290493 - DNA, 25 bp, Mus musculus
ggggaacatgcattcggcttggaca

SEQ ID NO: 290494 - DNA, 25 bp, Mus musculus
tctacggatgacagcgccgtgccgc

SEQ ID NO: 290495 - DNA, 25 bp, Mus musculus
cactttgggcactaccggacgggcg

SEQ ID NO: 290496 - DNA, 25 bp, Mus musculus
ggaccttaaggggaacatgcattcg

SEQ ID NO: 290497 - DNA, 25 bp, Mus musculus
tcttcggaccttaaggggaacatgc

SEQ ID NO: 290498 - DNA, 25 bp, Mus musculus
tggaccgcgcttcttcggaccttaa

SEQ ID NO: 290499 - DNA, 25 bp, Mus musculus
cggcttggacagtttgaaattctta

SEQ ID NO: 290500 - DNA, 25 bp, Mus musculus
agagttggacccgagtcggacccag

SEQ ID NO: 290501 - DNA, 25 bp, Mus musculus
ctgcccaaggtgaacaggtggaaga

SEQ ID NO: 290502 - DNA, 25 bp, Mus musculus
gacccaggcctcgtcgcgacggcgc

SEQ ID NO: 290503 - DNA, 25 bp, Mus musculus
aacaggtggaagaggcacgcgccgc

SEQ ID NO: 290504 - DNA, 25 bp, Mus musculus
cgcccaggcagagttggacccgagt

SEQ ID NO: 290505 - DNA, 25 bp, Mus musculus
gcccgacgcccaggcagagttggac

SEQ ID NO: 290506 - DNA, 25 bp, Mus musculus
cggccactctagtggggccgctgca

SEQ ID NO: 290507 - DNA, 25 bp, Mus musculus
ctcgcaaacggccactctagtgggg

SEQ ID NO: 290508 - DNA, 25 bp, Mus musculus
cacccgccgcggatcacatggtttg

SEQ ID NO: 290509 - DNA, 25 bp, Mus musculus
gccgcggatcacatggtttggctcc

SEQ ID NO: 290510 - DNA, 25 bp, Mus musculus
atcacatggtttggctccgctctcc

SEQ ID NO: 290511 - DNA, 25 bp, Mus musculus
cgcggctgccctcctggccatccgc

SEQ ID NO: 290512 - DNA, 25 bp, Mus musculus
gcaccgctgcccaaggtgaacaggt

SEQ ID NO: 290513 - DNA, 25 bp, Mus musculus
cgcagctcagcgtccgccagtgcgc

SEQ ID NO: 290514 - DNA, 25 bp, Mus musculus
acctgcagtcgcgagtgggtgacaa

SEQ ID NO: 290515 - DNA, 25 bp, Mus musculus
ccggagtgggagtctcaacttcgac

SEQ ID NO: 290516 - DNA, 25 bp, Mus musculus
cctcgagctcttctgagagtcggtc

SEQ ID NO: 290517 - DNA, 25 bp, Mus musculus
agagtcggtccctatgggctgttcg

SEQ ID NO: 290518 - DNA, 25 bp, Mus musculus
gcgcgcttgaccctccacgagggtg

SEQ ID NO: 290519 - DNA, 25 bp, Mus musculus
gcttgcgcaaaagcgctagcgctcg

SEQ ID NO: 290520 - DNA, 25 bp, Mus musculus
agtctcaacttcgacgccttgcggg

SEQ ID NO: 290521 - DNA, 25 bp, Mus musculus
ctcgtgacccggaaccgcgagtgga

SEQ ID NO: 290522 - DNA, 25 bp, Mus musculus
gctcgctccacaaggtgcacgcttg

SEQ ID NO: 290523 - DNA, 25 bp, Mus musculus
tttcccagagttcctagcagcgcgg

SEQ ID NO: 290524 - DNA, 25 bp, Mus musculus
cggctcagaggcattatgggaattg

SEQ ID NO: 290525 - DNA, 25 bp, Mus musculus
gtagtcctacacctcagcgtcacag

SEQ ID NO: 290526 - DNA, 25 bp, Mus musculus
cgtcacagctccgaggactctggga

SEQ ID NO: 290527 - DNA, 25 bp, Mus musculus
cctccaggtatgtctgcaaggccgg

SEQ ID NO: 290528 - DNA, 25 bp, Mus musculus
ctcggttttccagtccctctgcgta

SEQ ID NO: 290529 - DNA, 25 bp, Mus musculus
cccatgcaaatgagccgccgaggtg

SEQ ID NO: 290530 - DNA, 25 bp, Mus musculus
ggcatgcctagccacgctaccattg

SEQ ID NO: 290531 - DNA, 25 bp, Mus musculus
ctcaccaggtacttcatggtgctcc

SEQ ID NO: 290532 - DNA, 25 bp, Mus musculus
ctcggtaattctgcagccggcagga

SEQ ID NO: 290533 - DNA, 25 bp, Mus musculus
cgccgagctgctcggtaattctgca

SEQ ID NO: 290534 - DNA, 25 bp, Mus musculus
agggactcgtttacgcgccgagctg

SEQ ID NO: 290535 - DNA, 25 bp, Mus musculus
gctgcccgaggacgtcaggacccaa

SEQ ID NO: 290536 - DNA, 25 bp, Mus musculus
ggctactgccagttgtggacatccc

SEQ ID NO: 290537 - DNA, 25 bp, Mus musculus
atcctcagcaaatctcggttttcca

SEQ ID NO: 290538 - DNA, 25 bp, Mus musculus
gccgccggtaagcaatcctcagcaa

SEQ ID NO: 290539 - DNA, 25 bp, Mus musculus
ggccctgctagcgaaggtccttaga

SEQ ID NO: 290540 - DNA, 25 bp, Mus musculus
gcgacacgctagctccgtgggctgc

SEQ ID NO: 290541 - DNA, 25 bp, Mus musculus
gcgtgtcgagctggctactgccagt

SEQ ID NO: 290542 - DNA, 25 bp, Mus musculus
cgtcctagtccgctgtcctggaaga

SEQ ID NO: 290543 - DNA, 25 bp, Mus musculus
ggtcagcactcaccggcacggtcat

SEQ ID NO: 290544 - DNA, 25 bp, Mus musculus
cgggattttttctgtcggcacaact

SEQ ID NO: 290545 - DNA, 25 bp, Mus musculus
gctttccgccgccaccggacagtcc

SEQ ID NO: 290546 - DNA, 25 bp, Mus musculus
ttctccgctgtcctgccggctgctt

SEQ ID NO: 290547 - DNA, 25 bp, Mus musculus
gctagctcgggctcggtgggcccgc

SEQ ID NO: 290548 - DNA, 25 bp, Mus musculus
cggcacggtcatcttggccgccgcc

SEQ ID NO: 290549 - DNA, 25 bp, Mus musculus
aggcggtcagcactcaccggcacgg

SEQ ID NO: 290550 - DNA, 25 bp, Mus musculus
ctggaaaagccgggtctgagaagcc

SEQ ID NO: 290551 - DNA, 25 bp, Mus musculus
tgtcctggaagaggctggaaaagcc

SEQ ID NO: 290552 - DNA, 25 bp, Mus musculus
cgctgtcctggaagaggctggaaaa

SEQ ID NO: 290553 - DNA, 25 bp, Mus musculus
tcctagtccgctgtcctggaagagg

SEQ ID NO: 290554 - DNA, 25 bp, Mus musculus
gattttttctgtcggcacaactggt

SEQ ID NO: 290555 - DNA, 25 bp, Mus musculus
ctagtccgctgtcctggaagaggct

SEQ ID NO: 290556 - DNA, 25 bp, Mus musculus
tgccacgtggtcagagacgacactt

SEQ ID NO: 290557 - DNA, 25 bp, Mus musculus
acccagaggcggacaattgagtttc

SEQ ID NO: 290558 - DNA, 25 bp, Mus musculus
cggacgtgaaggaagctggcaattc

SEQ ID NO: 290559 - DNA, 25 bp, Mus musculus
aacaatctccaatgtccgggtcggc

SEQ ID NO: 290560 - DNA, 25 bp, Mus musculus
ggcttccagaaccagccggtaggta

SEQ ID NO: 290561 - DNA, 25 bp, Mus musculus
agcagctatgcagaaccgacacatg

SEQ ID NO: 290562 - DNA, 25 bp, Mus musculus
gacacatgcgtgttccaggccgcct

SEQ ID NO: 290563 - DNA, 25 bp, Mus musculus
ggtgtgaagcgtggaaaccaccctc

SEQ ID NO: 290564 - DNA, 25 bp, Mus musculus
atcgctcaccggacggcaagtagtc

SEQ ID NO: 290565 - DNA, 25 bp, Mus musculus
agtcgaattcctccatgctgctgtc

SEQ ID NO: 290566 - DNA, 25 bp, Mus musculus
tgctgcgattggtcagtctacactc

SEQ ID NO: 290567 - DNA, 25 bp, Mus musculus
agtctacactcaccgggcccttgtg

SEQ ID NO: 290568 - DNA, 25 bp, Mus musculus
cacctctcagaagcgatgcatgctg

SEQ ID NO: 290569 - DNA, 25 bp, Mus musculus
cctcgtccgatgtggagaagtcttc

SEQ ID NO: 290570 - DNA, 25 bp, Mus musculus
agtgcgattccagggctgcctcggc

SEQ ID NO: 290571 - DNA, 25 bp, Mus musculus
tggggcacagggtcccgttgcccac

SEQ ID NO: 290572 - DNA, 25 bp, Mus musculus
cgagcttcaggctgaggatctgctg

SEQ ID NO: 290573 - DNA, 25 bp, Mus musculus
gagtaccgcacctccgcagccacgg

SEQ ID NO: 290574 - DNA, 25 bp, Mus musculus
cacggcgtcacctttggccggccct

SEQ ID NO: 290575 - DNA, 25 bp, Mus musculus
ctccaacggcgctgctagagtaatc

SEQ ID NO: 290576 - DNA, 25 bp, Mus musculus
acggcgctgctagagtaatcgtttc

SEQ ID NO: 290577 - DNA, 25 bp, Mus musculus
gtaatcgtttctccttccaatcaca

SEQ ID NO: 290578 - DNA, 25 bp, Mus musculus
gtttctccttccaatcacagggcgc

SEQ ID NO: 290579 - DNA, 25 bp, Mus musculus
ctggcgctgcgttcgattagagaaa

SEQ ID NO: 290580 - DNA, 25 bp, Mus musculus
tgcgttcgattagagaaacccacgg

SEQ ID NO: 290581 - DNA, 25 bp, Mus musculus
ttagagaaacccacggcatgctgcg

SEQ ID NO: 290582 - DNA, 25 bp, Mus musculus
cccaagtgcgattccagggctgcct

SEQ ID NO: 290583 - DNA, 25 bp, Mus musculus
acccgcggcacgagcttcaggctga

SEQ ID NO: 290584 - DNA, 25 bp, Mus musculus
ccctggatgtggtcttgaaggcttc

SEQ ID NO: 290585 - DNA, 25 bp, Mus musculus
ggccagatcctcgtagcgcaccagg

SEQ ID NO: 290586 - DNA, 25 bp, Mus musculus
ccaggcggtagcgatcttgcaagaa

SEQ ID NO: 290587 - DNA, 25 bp, Mus musculus
acatggctgcggcatacctcgttga

SEQ ID NO: 290588 - DNA, 25 bp, Mus musculus
tggtacccaggacgatgccattgtc

SEQ ID NO: 290589 - DNA, 25 bp, Mus musculus
gaagcgcacctccttgagcacgacg

SEQ ID NO: 290590 - DNA, 25 bp, Mus musculus
cgtgactataggagctgcaggcttc

SEQ ID NO: 290591 - DNA, 25 bp, Mus musculus
cgttgcgcacagaggcttacacacc

SEQ ID NO: 290592 - DNA, 25 bp, Mus musculus
ggctcaccgcccactggaagagatc

SEQ ID NO: 290593 - DNA, 25 bp, Mus musculus
cgccagggcaggtaggcatcaaata

SEQ ID NO: 290594 - DNA, 25 bp, Mus musculus
cgtccatgtcgcataggaacactga

SEQ ID NO: 290595 - DNA, 25 bp, Mus musculus
caagccggctccatcaggtagaaga

SEQ ID NO: 290596 - DNA, 25 bp, Mus musculus
gcctggccctgaaccatgcgtgata

SEQ ID NO: 290597 - DNA, 25 bp, Mus musculus
cgaggacagtaccagcacgtgcaca

SEQ ID NO: 290598 - DNA, 25 bp, Mus musculus
ctgcgctgcccgctgcgcttctgcg

SEQ ID NO: 290599 - DNA, 25 bp, Mus musculus
ggcgcacacaaagagccgctcagtc

SEQ ID NO: 290600 - DNA, 25 bp, Mus musculus
cgcacacaaagagccgctcagtcgg

SEQ ID NO: 290601 - DNA, 25 bp, Mus musculus
acaaagagccgctcagtcggtggtg

SEQ ID NO: 290602 - DNA, 25 bp, Mus musculus
tcagtcggtggtggctctttgcctg

SEQ ID NO: 290603 - DNA, 25 bp, Mus musculus
agcaaggaggcagccagttggccta

SEQ ID NO: 290604 - DNA, 25 bp, Mus musculus
aggcagccagttggcctagggctcc

SEQ ID NO: 290605 - DNA, 25 bp, Mus musculus
agccagttggcctagggctcctcta

SEQ ID NO: 290606 - DNA, 25 bp, Mus musculus
ccagttggcctagggctcctctatc

SEQ ID NO: 290607 - DNA, 25 bp, Mus musculus
ttggcctagggctcctctatccttc

SEQ ID NO: 290608 - DNA, 25 bp, Mus musculus
tagggctcctctatccttcccaggc

SEQ ID NO: 290609 - DNA, 25 bp, Mus musculus
tccttcccaggcgtgaccgtggtgg

SEQ ID NO: 290610 - DNA, 25 bp, Mus musculus
tgcgcttctgcgctgcgcacccagg

SEQ ID NO: 290611 - DNA, 25 bp, Mus musculus
cagggcgcacacaaagagccgctca

SEQ ID NO: 290612 - DNA, 25 bp, Mus musculus
tgagagaagagatggtacagcgcca

SEQ ID NO: 290613 - DNA, 25 bp, Mus musculus
gggcgggaaccacgcaccgacacga

SEQ ID NO: 290614 - DNA, 25 bp, Mus musculus
gaaccacgcaccgacacgagcggga

SEQ ID NO: 290615 - DNA, 25 bp, Mus musculus
ctccaggcgaggaaggcttcaggct

SEQ ID NO: 290616 - DNA, 25 bp, Mus musculus
cgaggaaggcttcaggctccggccc

SEQ ID NO: 290617 - DNA, 25 bp, Mus musculus
cccaggagagccacgagcagcactt

SEQ ID NO: 290618 - DNA, 25 bp, Mus musculus
gagagccacgagcagcacttggtgc

SEQ ID NO: 290619 - DNA, 25 bp, Mus musculus
gcacttggtgctggaagcgcacgtt

SEQ ID NO: 290620 - DNA, 25 bp, Mus musculus
tggaagcgcacgttcggctgctcct

SEQ ID NO: 290621 - DNA, 25 bp, Mus musculus
gttcggctgctcctcgtagctgctc

SEQ ID NO: 290622 - DNA, 25 bp, Mus musculus
gcttcagccaaaaccctgcgggaga

SEQ ID NO: 290623 - DNA, 25 bp, Mus musculus
gtggctccggaaggccaccagcagc

SEQ ID NO: 290624 - DNA, 25 bp, Mus musculus
cccgcgcggtaagcgcgctcgattg

SEQ ID NO: 290625 - DNA, 25 bp, Mus musculus
agagatggtacagcgccatgagcgc

SEQ ID NO: 290626 - DNA, 25 bp, Mus musculus
cgcgcggaaagtgaccacagcaaca

SEQ ID NO: 290627 - DNA, 25 bp, Mus musculus
ggctgtcctaacagcccagcacgtg

SEQ ID NO: 290628 - DNA, 25 bp, Mus musculus
aacagcccagcacgtgctccgggaa

SEQ ID NO: 290629 - DNA, 25 bp, Mus musculus
cacgtgctccgggaaccagcctccc

SEQ ID NO: 290630 - DNA, 25 bp, Mus musculus
gggaaacccaaacttggcgcgcaga

SEQ ID NO: 290631 - DNA, 25 bp, Mus musculus
aaacccaaacttggcgcgcagaggc

SEQ ID NO: 290632 - DNA, 25 bp, Mus musculus
gcagaggccggagctccactaaact

SEQ ID NO: 290633 - DNA, 25 bp, Mus musculus
gaggccggagctccactaaactctc

SEQ ID NO: 290634 - DNA, 25 bp, Mus musculus
cctacagcggcccaatcagtgggag

SEQ ID NO: 290635 - DNA, 25 bp, Mus musculus
cccaatcagtgggagcatccaggta

SEQ ID NO: 290636 - DNA, 25 bp, Mus musculus
gggagcatccaggtagagcccgccc

SEQ ID NO: 290637 - DNA, 25 bp, Mus musculus
cccagctgcccacgcgcgattcgcc

SEQ ID NO: 290638 - DNA, 25 bp, Mus musculus
cggaaagtgaccacagcaacacctc

SEQ ID NO: 290639 - DNA, 25 bp, Mus musculus
gaccacagcaacacctccagccgga

SEQ ID NO: 290640 - DNA, 25 bp, Mus musculus
tgctgtccggcaagtgcgaatgtca

SEQ ID NO: 290641 - DNA, 25 bp, Mus musculus
tcgccctacgtggatctcgctggga

SEQ ID NO: 290642 - DNA, 25 bp, Mus musculus
accactctctgggtaagcgcggtcg

SEQ ID NO: 290643 - DNA, 25 bp, Mus musculus
tggatgtttaaggaggaccactctc

SEQ ID NO: 290644 - DNA, 25 bp, Mus musculus
cccgtcgccatgaagtggatgttta

SEQ ID NO: 290645 - DNA, 25 bp, Mus musculus
ttgttgttgtggtcgcttcgccgaa

SEQ ID NO: 290646 - DNA, 25 bp, Mus musculus
gaagctcttaccaggcccgccggaa

SEQ ID NO: 290647 - DNA, 25 bp, Mus musculus
ctctcacgtaatcgtagcctactga

SEQ ID NO: 290648 - DNA, 25 bp, Mus musculus
tccgcgaagatcagagcgaagtacc

SEQ ID NO: 290649 - DNA, 25 bp, Mus musculus
aagtcccgcctgtggagtagtcgtc

SEQ ID NO: 290650 - DNA, 25 bp, Mus musculus
accgagttccggtgagtgtggactc

SEQ ID NO: 290651 - DNA, 25 bp, Mus musculus
gctgtcacccttagcgtctaggaga

SEQ ID NO: 290652 - DNA, 25 bp, Mus musculus
cacagatgcgtggaatccgcgaaga

SEQ ID NO: 290653 - DNA, 25 bp, Mus musculus
gtgcgaatgtcagcctggttttctt

SEQ ID NO: 290654 - DNA, 25 bp, Mus musculus
tagagggccgctccggtcaagctct

SEQ ID NO: 290655 - DNA, 25 bp, Mus musculus
gaagtgacgccctagagggccgctc

SEQ ID NO: 290656 - DNA, 25 bp, Mus musculus
tttaaccaggttgcgcagcggaagt

SEQ ID NO: 290657 - DNA, 25 bp, Mus musculus
ccgccacgctcgtttaaccaggttg

SEQ ID NO: 290658 - DNA, 25 bp, Mus musculus
gcgccgcaacctccacgcgatgccc

SEQ ID NO: 290659 - DNA, 25 bp, Mus musculus
accctattatccacgcgccgcaacc

SEQ ID NO: 290660 - DNA, 25 bp, Mus musculus
ccggagtccctcacaccctattatc

SEQ ID NO: 290661 - DNA, 25 bp, Mus musculus
tcggccaactgtgtagagctaaccc

SEQ ID NO: 290662 - DNA, 25 bp, Mus musculus
ccctcggccaactgtgtagagctaa

SEQ ID NO: 290663 - DNA, 25 bp, Mus musculus
ggtcaagctctgcccgcaaagcacg

SEQ ID NO: 290664 - DNA, 25 bp, Mus musculus
aaagcacgctggtctttgtagtctg

SEQ ID NO: 290665 - DNA, 25 bp, Mus musculus
ctttgtagtctgtgggaacggtgca

SEQ ID NO: 290666 - DNA, 25 bp, Mus musculus
gcctccgcagcaaagaccgacttag

SEQ ID NO: 290667 - DNA, 25 bp, Mus musculus
ccgcagcaaagaccgacttagctcg

SEQ ID NO: 290668 - DNA, 25 bp, Mus musculus
atccgggctgtgggctcctaaacaa

SEQ ID NO: 290669 - DNA, 25 bp, Mus musculus
gatccgggctgtgggctcctaaaca

SEQ ID NO: 290670 - DNA, 25 bp, Mus musculus
tttcatcttccttcatttgttttat

SEQ ID NO: 290671 - DNA, 25 bp, Mus musculus
ccatagagagtgtaatgcttcaaaa

SEQ ID NO: 290672 - DNA, 25 bp, Mus musculus
catagagagtgtaatgcttcaaaaa

SEQ ID NO: 290673 - DNA, 25 bp, Mus musculus
tagagagtgtaatgcttcaaaaagg

SEQ ID NO: 290674 - DNA, 25 bp, Mus musculus
agagagtgtaatgcttcaaaaagga

SEQ ID NO: 290675 - DNA, 25 bp, Mus musculus
gaaagggctcgtttcgtcctggaga

SEQ ID NO: 290676 - DNA, 25 bp, Mus musculus
aagggctcgtttcgtcctggagacg

SEQ ID NO: 290677 - DNA, 25 bp, Mus musculus
ggctcgtttcgtcctggagacggct

SEQ ID NO: 290678 - DNA, 25 bp, Mus musculus
gctcgtttcgtcctggagacggctg

SEQ ID NO: 290679 - DNA, 25 bp, Mus musculus
ctcgtttcgtcctggagacggctgg

SEQ ID NO: 290680 - DNA, 25 bp, Mus musculus
tcgtttcgtcctggagacggctggc

SEQ ID NO: 290681 - DNA, 25 bp, Mus musculus
agatccgggctgtgggctcctaaac

SEQ ID NO: 290682 - DNA, 25 bp, Mus musculus
tcgcctacaccgacgcggaagatgt

SEQ ID NO: 290683 - DNA, 25 bp, Mus musculus
catgtcgttttacgtgcggcccagc

SEQ ID NO: 290684 - DNA, 25 bp, Mus musculus
tccgtcttagtggtgtcgtttctgc

SEQ ID NO: 290685 - DNA, 25 bp, Mus musculus
gctttacttgtacagcggggcgaca

SEQ ID NO: 290686 - DNA, 25 bp, Mus musculus
ctacgtgaaggagaacgcccgttcg

SEQ ID NO: 290687 - DNA, 25 bp, Mus musculus
cctccactctgttcgtgagagaaga

SEQ ID NO: 290688 - DNA, 25 bp, Mus musculus
cgggcgacttcatctccacgcagta

SEQ ID NO: 290689 - DNA, 25 bp, Mus musculus
atcgcaacgagaagctggacctgga

SEQ ID NO: 290690 - DNA, 25 bp, Mus musculus
atgtggccatcctgacctacgtgaa

SEQ ID NO: 290691 - DNA, 25 bp, Mus musculus
ccagctcggtcacaggcaatgcctt

SEQ ID NO: 290692 - DNA, 25 bp, Mus musculus
ctggcagtcgctcaaggaccgctac

SEQ ID NO: 290693 - DNA, 25 bp, Mus musculus
tacctcaagcacctacggggtcagg

SEQ ID NO: 290694 - DNA, 25 bp, Mus musculus
gtcctcccagaagctcaaacggaag

SEQ ID NO: 290695 - DNA, 25 bp, Mus musculus
aggcgatggatctgggtaaagaccc

SEQ ID NO: 290696 - DNA, 25 bp, Mus musculus
acctagtagatttccaggccgcgcc

SEQ ID NO: 290697 - DNA, 25 bp, Mus musculus
gcgcacactatctgcggaggctcca

SEQ ID NO: 290698 - DNA, 25 bp, Mus musculus
agctgtccgtcaagcatacgctccg

SEQ ID NO: 290699 - DNA, 25 bp, Mus musculus
tgtctcaatactggggacgcgagtt

SEQ ID NO: 290700 - DNA, 25 bp, Mus musculus
acgcgagttcattggttcggcattc

SEQ ID NO: 290701 - DNA, 25 bp, Mus musculus
ggttcggcattctctcattccagca

SEQ ID NO: 290702 - DNA, 25 bp, Mus musculus
tttcggttagaaacagggagatgtc

SEQ ID NO: 290703 - DNA, 25 bp, Mus musculus
agagtcccgcgctatccttacggtg

SEQ ID NO: 290704 - DNA, 25 bp, Mus musculus
ggctttcgccaattagcgcacacta

SEQ ID NO: 290705 - DNA, 25 bp, Mus musculus
ctccaccagaatggggcgggacata

SEQ ID NO: 290706 - DNA, 25 bp, Mus musculus
cgggacataagggagagcctactct

SEQ ID NO: 290707 - DNA, 25 bp, Mus musculus
acgcgcagattccacagagttccgg

SEQ ID NO: 290708 - DNA, 25 bp, Mus musculus
tcaagggatgagcagtggctttcgc

SEQ ID NO: 290709 - DNA, 25 bp, Mus musculus
gcactccggggagtcaatacggccg

SEQ ID NO: 290710 - DNA, 25 bp, Mus musculus
ggcgcttgtcggtatcagagtgatt

SEQ ID NO: 290711 - DNA, 25 bp, Mus musculus
ctgccgctgtcactggctaaggcga

SEQ ID NO: 290712 - DNA, 25 bp, Mus musculus
cggccaccgaagcacagcagaagca

SEQ ID NO: 290713 - DNA, 25 bp, Mus musculus
cagcacagctggagtgcctgcaaga

SEQ ID NO: 290714 - DNA, 25 bp, Mus musculus
tgcctgcaagaaagaaaagggtgac

SEQ ID NO: 290715 - DNA, 25 bp, Mus musculus
tgacaccgccgcgtgagcagcgtcg

SEQ ID NO: 290716 - DNA, 25 bp, Mus musculus
cgcacaagcacaggagggcgcactc

SEQ ID NO: 290717 - DNA, 25 bp, Mus musculus
gcactccatggtcaggtgcggacgc

SEQ ID NO: 290718 - DNA, 25 bp, Mus musculus
ctcacatggcagcacgagagcctgc

SEQ ID NO: 290719 - DNA, 25 bp, Mus musculus
ggagctctgccagagcccggtctgc

SEQ ID NO: 290720 - DNA, 25 bp, Mus musculus
ctccgctccgtgattggcgaccgga

SEQ ID NO: 290721 - DNA, 25 bp, Mus musculus
aaactctgttggtgatgctcgcggg

SEQ ID NO: 290722 - DNA, 25 bp, Mus musculus
atcagagtgattgtgtgcggctcgc

SEQ ID NO: 290723 - DNA, 25 bp, Mus musculus
cgcctgtggctatgaaactctgttg

SEQ ID NO: 290724 - DNA, 25 bp, Mus musculus
ctatgcgggcctggacgacacggac

SEQ ID NO: 290725 - DNA, 25 bp, Mus musculus
atctgggtcaaggtcccgtcacctg

SEQ ID NO: 290726 - DNA, 25 bp, Mus musculus
ccgttattaggggatctgggtcaag

SEQ ID NO: 290727 - DNA, 25 bp, Mus musculus
gcgggcatgcgcatccgaaatgcca

SEQ ID NO: 290728 - DNA, 25 bp, Mus musculus
tacgccaagtaagcggccttggagc

SEQ ID NO: 290729 - DNA, 25 bp, Mus musculus
cggctgggtgtactacgccaagtaa

SEQ ID NO: 290730 - DNA, 25 bp, Mus musculus
acacggacagtgaggatgagctgcc

SEQ ID NO: 290731 - DNA, 25 bp, Mus musculus
tccagcatggcagctctgcgctatg

SEQ ID NO: 290732 - DNA, 25 bp, Mus musculus
ggcggctacttctgtctccagcatg

SEQ ID NO: 290733 - DNA, 25 bp, Mus musculus
ctgaggagagcaggcggctacttct

SEQ ID NO: 290734 - DNA, 25 bp, Mus musculus
ggaaactggattacagccgcggacc

SEQ ID NO: 290735 - DNA, 25 bp, Mus musculus
cgccagtagctgcaaaacccggaaa

SEQ ID NO: 290736 - DNA, 25 bp, Mus musculus
ctgccgctcactaggtggcactgca

SEQ ID NO: 290737 - DNA, 25 bp, Mus musculus
aggagagaaccaccaaggacggctg

SEQ ID NO: 290738 - DNA, 25 bp, Mus musculus
ccatggaccgggagatccctcgtca

SEQ ID NO: 290739 - DNA, 25 bp, Mus musculus
ctcatagttaatccatggaccggga

SEQ ID NO: 290740 - DNA, 25 bp, Mus musculus
cctcggtggtgtctcatagttaatc

SEQ ID NO: 290741 - DNA, 25 bp, Mus musculus
ggcctgcccttcctcggtggtgtct

SEQ ID NO: 290742 - DNA, 25 bp, Mus musculus
ttctaaggtgaccacacggggcctg

SEQ ID NO: 290743 - DNA, 25 bp, Mus musculus
ttccaggcgcttggcttctaaggtg

SEQ ID NO: 290744 - DNA, 25 bp, Mus musculus
taccgccctgattattgctgagccc

SEQ ID NO: 290745 - DNA, 25 bp, Mus musculus
ggacttttcattaccgccctgatta

SEQ ID NO: 290746 - DNA, 25 bp, Mus musculus
cagctcgtcccggacttttcattac

SEQ ID NO: 290747 - DNA, 25 bp, Mus musculus
agatccagtggaccgcagctcgtcc

SEQ ID NO: 290748 - DNA, 25 bp, Mus musculus
ggccgtgctcagcagatccagtgga

SEQ ID NO: 290749 - DNA, 25 bp, Mus musculus
acagctagttctgtggccgtgctca

SEQ ID NO: 290750 - DNA, 25 bp, Mus musculus
gttccggtctgcatcacagcgctgc

SEQ ID NO: 290751 - DNA, 25 bp, Mus musculus
gggagatccctcgtcaacgcgcacg

SEQ ID NO: 290752 - DNA, 25 bp, Mus musculus
aacatattccatggccaggggactg

SEQ ID NO: 290753 - DNA, 25 bp, Mus musculus
gctgttgctgatgagcgcctcgacc

SEQ ID NO: 290754 - DNA, 25 bp, Mus musculus
acgccaatgtgctctctctctttct

SEQ ID NO: 290755 - DNA, 25 bp, Mus musculus
gcccgaaagctcgaacgtgcacaca

SEQ ID NO: 290756 - DNA, 25 bp, Mus musculus
ctagggcgcttctagcttgcgcggc

SEQ ID NO: 290757 - DNA, 25 bp, Mus musculus
ccgctccgccagatgggctgcagga

SEQ ID NO: 290758 - DNA, 25 bp, Mus musculus
tgccagttctgaagccatcctcctg

SEQ ID NO: 290759 - DNA, 25 bp, Mus musculus
ggtcggaattgttcattgccagttc

SEQ ID NO: 290760 - DNA, 25 bp, Mus musculus
agacggccgcactggctgatgatgc

SEQ ID NO: 290761 - DNA, 25 bp, Mus musculus
gtgcgccttctgttcgctgcccgag

SEQ ID NO: 290762 - DNA, 25 bp, Mus musculus
agccggtcatccagtagtagtcttc

SEQ ID NO: 290763 - DNA, 25 bp, Mus musculus
gcatagccatcgaagccaccctgga

SEQ ID NO: 290764 - DNA, 25 bp, Mus musculus
gtagtagtcttccaggtgcgccttc

SEQ ID NO: 290765 - DNA, 25 bp, Mus musculus
atgcggtcggtctccaccggttcct

SEQ ID NO: 290766 - DNA, 25 bp, Mus musculus
cggctgaaccgcagctctcatgctg

SEQ ID NO: 290767 - DNA, 25 bp, Mus musculus
ggggcgcagccagggagcaacaccc

SEQ ID NO: 290768 - DNA, 25 bp, Mus musculus
caccaccggccggtgcgaagtttag

SEQ ID NO: 290769 - DNA, 25 bp, Mus musculus
ccggccggtgcgaagtttagtgcac

SEQ ID NO: 290770 - DNA, 25 bp, Mus musculus
gcgaagtttagtgcaccaggggaca

SEQ ID NO: 290771 - DNA, 25 bp, Mus musculus
gtgcaccaggggacagagtttacta

SEQ ID NO: 290772 - DNA, 25 bp, Mus musculus
gcaccaggggacagagtttactaaa

SEQ ID NO: 290773 - DNA, 25 bp, Mus musculus
cagagtttactaaaagggcggctgg

SEQ ID NO: 290774 - DNA, 25 bp, Mus musculus
tttcctcggagttcgagagaggcct

SEQ ID NO: 290775 - DNA, 25 bp, Mus musculus
tgctgcagagatccgccagaactcc

SEQ ID NO: 290776 - DNA, 25 bp, Mus musculus
ccgcagctctcatgctgcagagatc

SEQ ID NO: 290777 - DNA, 25 bp, Mus musculus
ctcatgctgcagagatccgccagaa

SEQ ID NO: 290778 - DNA, 25 bp, Mus musculus
ctgccggtcccgcaccctgacaacg

SEQ ID NO: 290779 - DNA, 25 bp, Mus musculus
ggatggtttgctttcctcggagttc

SEQ ID NO: 290780 - DNA, 25 bp, Mus musculus
cgattgctcgctcacaaggcggcca

SEQ ID NO: 290781 - DNA, 25 bp, Mus musculus
tgggctcccagaacgagtggctgaa

SEQ ID NO: 290782 - DNA, 25 bp, Mus musculus
gcaaagtgcgagtcgctgcgcccac

SEQ ID NO: 290783 - DNA, 25 bp, Mus musculus
aagagtcttcaagtcgcaaagtgcg

SEQ ID NO: 290784 - DNA, 25 bp, Mus musculus
ggatccgccttaggaaagagtcttc

SEQ ID NO: 290785 - DNA, 25 bp, Mus musculus
ccggaagcctgctgtaagctgccgc

SEQ ID NO: 290786 - DNA, 25 bp, Mus musculus
tgcgagaaggactacactgcccaca

SEQ ID NO: 290787 - DNA, 25 bp, Mus musculus
atcttggagactctcggttcgtcgg

SEQ ID NO: 290788 - DNA, 25 bp, Mus musculus
gagcccagcttacctctctcgggag

SEQ ID NO: 290789 - DNA, 25 bp, Mus musculus
tggcacagaggcttcgccggctctg

SEQ ID NO: 290790 - DNA, 25 bp, Mus musculus
acacgatccggagtcgcgcgtggca

SEQ ID NO: 290791 - DNA, 25 bp, Mus musculus
cccacaggacgctcggtaggacagc

SEQ ID NO: 290792 - DNA, 25 bp, Mus musculus
aagaaagcgcctaccactcccagag

SEQ ID NO: 290793 - DNA, 25 bp, Mus musculus
cctataaagcacacggcgccgcgag

SEQ ID NO: 290794 - DNA, 25 bp, Mus musculus
ggagcccgttgaactcgtcgataaa

SEQ ID NO: 290795 - DNA, 25 bp, Mus musculus
ttccgcttgtgggaagatggtttgc

SEQ ID NO: 290796 - DNA, 25 bp, Mus musculus
tgtcctccgtgctgccgtagccttt

SEQ ID NO: 290797 - DNA, 25 bp, Mus musculus
aggtgatgctccggttcccacgtgt

SEQ ID NO: 290798 - DNA, 25 bp, Mus musculus
ctcgtcgataaactcctcacagtgc

SEQ ID NO: 290799 - DNA, 25 bp, Mus musculus
tccttggacaagtggagcccgttga

SEQ ID NO: 290800 - DNA, 25 bp, Mus musculus
caccctcttatccttggacaagtgg

SEQ ID NO: 290801 - DNA, 25 bp, Mus musculus
ctgacttcaccctcttatccttgga

SEQ ID NO: 290802 - DNA, 25 bp, Mus musculus
ctccggcctgcttccctgacttcac

SEQ ID NO: 290803 - DNA, 25 bp, Mus musculus
ctttccactggcaggccgcgggcgt

SEQ ID NO: 290804 - DNA, 25 bp, Mus musculus
gggagagtctttccactggcaggcc

SEQ ID NO: 290805 - DNA, 25 bp, Mus musculus
ttccagaggccgatgggagagtctt

SEQ ID NO: 290806 - DNA, 25 bp, Mus musculus
gatggtttgctcttcccgggttcca

SEQ ID NO: 290807 - DNA, 25 bp, Mus musculus
cctcacagtgcaggaggtgatgctc

SEQ ID NO: 290808 - DNA, 25 bp, Mus musculus
tcctcggggctgagcaagcacctcg

SEQ ID NO: 290809 - DNA, 25 bp, Mus musculus
ggatcctcggggctgagcaagcacc

SEQ ID NO: 290810 - DNA, 25 bp, Mus musculus
gatcctcggggctgagcaagcacct

SEQ ID NO: 290811 - DNA, 25 bp, Mus musculus
atcctcggggctgagcaagcacctc

SEQ ID NO: 290812 - DNA, 25 bp, Mus musculus
tcggggctgagcaagcacctcgccg

SEQ ID NO: 290813 - DNA, 25 bp, Mus musculus
gccgggagcgctagcttgcctccct

SEQ ID NO: 290814 - DNA, 25 bp, Mus musculus
cgggagcgctagcttgcctccctcc

SEQ ID NO: 290815 - DNA, 25 bp, Mus musculus
gagcgctagcttgcctccctccgcc

SEQ ID NO: 290816 - DNA, 25 bp, Mus musculus
ccctaaagtgggccgtccgcagcgc

SEQ ID NO: 290817 - DNA, 25 bp, Mus musculus
cccgcattccctcggacgcccggcg

SEQ ID NO: 290818 - DNA, 25 bp, Mus musculus
cctgtacttgttttttccacactcg

SEQ ID NO: 290819 - DNA, 25 bp, Mus musculus
gcacctcgccgggagcgctagcttg

SEQ ID NO: 290820 - DNA, 25 bp, Mus musculus
ctgtacttgttttttccacactcgg

SEQ ID NO: 290821 - DNA, 25 bp, Mus musculus
cattccctcggacgcccggcgactt

SEQ ID NO: 290822 - DNA, 25 bp, Mus musculus
ttctgcgggcgccaagggctgtggg

SEQ ID NO: 290823 - DNA, 25 bp, Mus musculus
cctgcagatggaggccaggcttcga

SEQ ID NO: 290824 - DNA, 25 bp, Mus musculus
ccctgcagatggaggccaggcttcg

SEQ ID NO: 290825 - DNA, 25 bp, Mus musculus
acccgcttgcttcctggcgggacat

SEQ ID NO: 290826 - DNA, 25 bp, Mus musculus
gtgggctccttccaacccgcttgct

SEQ ID NO: 290827 - DNA, 25 bp, Mus musculus
cctggcgggacatcccctgcagatg

SEQ ID NO: 290828 - DNA, 25 bp, Mus musculus
ccgcgcagcctgaagcggagcagaa

SEQ ID NO: 290829 - DNA, 25 bp, Mus musculus
accgcgcagcctgaagcggagcaga

SEQ ID NO: 290830 - DNA, 25 bp, Mus musculus
ctaccgcgcagcctgaagcggagca

SEQ ID NO: 290831 - DNA, 25 bp, Mus musculus
gcgctaccgcgcagcctgaagcgga

SEQ ID NO: 290832 - DNA, 25 bp, Mus musculus
agcgctaccgcgcagcctgaagcgg

SEQ ID NO: 290833 - DNA, 25 bp, Mus musculus
ggtttgcagccagcgctaccgcgca

SEQ ID NO: 290834 - DNA, 25 bp, Mus musculus
gtcgggtttgcagccagcgctaccg

SEQ ID NO: 290835 - DNA, 25 bp, Mus musculus
aacccgcttgcttcctggcgggaca

SEQ ID NO: 290836 - DNA, 25 bp, Mus musculus
cggacctgtgtctcagcgatttgta

SEQ ID NO: 290837 - DNA, 25 bp, Mus musculus
tctcagcgatttgtaggcttgtacg

SEQ ID NO: 290838 - DNA, 25 bp, Mus musculus
cacgatgagtacgtccatgttggcg

SEQ ID NO: 290839 - DNA, 25 bp, Mus musculus
gtggcgagcacgatgagtacgtcca

SEQ ID NO: 290840 - DNA, 25 bp, Mus musculus
gtacgtccatgttggcggacctgtg

SEQ ID NO: 290841 - DNA, 25 bp, Mus musculus
tgaccagggagtaggcataggcaat

SEQ ID NO: 290842 - DNA, 25 bp, Mus musculus
cataggcaatggttgtggcgagcac

SEQ ID NO: 290843 - DNA, 25 bp, Mus musculus
agccaccgtcccagggcgatgaaca

SEQ ID NO: 290844 - DNA, 25 bp, Mus musculus
cccagggcgatgaacacaaagagca

SEQ ID NO: 290845 - DNA, 25 bp, Mus musculus
cgtgtcaaagaaggtcacggggctc

SEQ ID NO: 290846 - DNA, 25 bp, Mus musculus
caaagaaggtcacggggctcttctc

SEQ ID NO: 290847 - DNA, 25 bp, Mus musculus
ttctctgccttctcggctacggcga

SEQ ID NO: 290848 - DNA, 25 bp, Mus musculus
gctacggcgaccaccaggatgacca

SEQ ID NO: 290849 - DNA, 25 bp, Mus musculus
cgaccaccaggatgaccagggagta

SEQ ID NO: 290850 - DNA, 25 bp, Mus musculus
gagcccgcagctcccttaggacttg

SEQ ID NO: 290851 - DNA, 25 bp, Mus musculus
gcagcctcagcgacaccgaattgga

SEQ ID NO: 290852 - DNA, 25 bp, Mus musculus
ttggcggcttcaaaagcacctcggc

SEQ ID NO: 290853 - DNA, 25 bp, Mus musculus
aagcgttttccatcaggcgcccaca

SEQ ID NO: 290854 - DNA, 25 bp, Mus musculus
tgggaagctaaagagccgcgtcctt

SEQ ID NO: 290855 - DNA, 25 bp, Mus musculus
gagccaggcctcagacatctacggg

SEQ ID NO: 290856 - DNA, 25 bp, Mus musculus
gactctggggatctaaagcgttttc

SEQ ID NO: 290857 - DNA, 25 bp, Mus musculus
cctgtctctgagtacagcgactctg

SEQ ID NO: 290858 - DNA, 25 bp, Mus musculus
gcggggacagcacacagagatgact

SEQ ID NO: 290859 - DNA, 25 bp, Mus musculus
ttaggacttgcaagcaccgacgctc

SEQ ID NO: 290860 - DNA, 25 bp, Mus musculus
tcagcagtgtgacagctcatgcccg

SEQ ID NO: 290861 - DNA, 25 bp, Mus musculus
ttccgccacgggatcttagcctagg

SEQ ID NO: 290862 - DNA, 25 bp, Mus musculus
ccgcggctcaccaagaagagtgttc

SEQ ID NO: 290863 - DNA, 25 bp, Mus musculus
ggaccggtccactgtcccatgctga

SEQ ID NO: 290864 - DNA, 25 bp, Mus musculus
gggctgtgcgcaccaatattctgtg

SEQ ID NO: 290865 - DNA, 25 bp, Mus musculus
accgaccggccggatgctaatgagc

SEQ ID NO: 290866 - DNA, 25 bp, Mus musculus
cccgggagctgatccagccgactgt

SEQ ID NO: 290867 - DNA, 25 bp, Mus musculus
cagccgactgtgagcgagctgtccc

SEQ ID NO: 290868 - DNA, 25 bp, Mus musculus
ggctgcggcaagatcctgcccaaca

SEQ ID NO: 290869 - DNA, 25 bp, Mus musculus
gcgctcaacatgcacctcgtcaaga

SEQ ID NO: 290870 - DNA, 25 bp, Mus musculus
gagcgcgcacaacgcaccgggcaag

SEQ ID NO: 290871 - DNA, 25 bp, Mus musculus
cagcttctcggtggcgtgcccacaa

SEQ ID NO: 290872 - DNA, 25 bp, Mus musculus
agcctgcctgtttactcaggttcca

SEQ ID NO: 290873 - DNA, 25 bp, Mus musculus
cgactgcaaggcagccggccgagac

SEQ ID NO: 290874 - DNA, 25 bp, Mus musculus
ttccaaggatgagcgacaggtgatg

SEQ ID NO: 290875 - DNA, 25 bp, Mus musculus
cgacaggtgatgtcgccaaggcacc

SEQ ID NO: 290876 - DNA, 25 bp, Mus musculus
acctggtcactcaaaagcggctgcg

SEQ ID NO: 290877 - DNA, 25 bp, Mus musculus
ggtgggtcctacctggtcactcaaa

SEQ ID NO: 290878 - DNA, 25 bp, Mus musculus
gcttacccaccctgaagattgcttc

SEQ ID NO: 290879 - DNA, 25 bp, Mus musculus
gagcttcgcaggcactggcgacgtt

SEQ ID NO: 290880 - DNA, 25 bp, Mus musculus
tgccagacgcttcgagagcttcgca

SEQ ID NO: 290881 - DNA, 25 bp, Mus musculus
ctaggtgccgcgttgccagacgctt

SEQ ID NO: 290882 - DNA, 25 bp, Mus musculus
cattcccgtcgctctgtgcgtggtt

SEQ ID NO: 290883 - DNA, 25 bp, Mus musculus
ggggctaaggagcattcccgtcgct

SEQ ID NO: 290884 - DNA, 25 bp, Mus musculus
caaaccagctcaagggcggagtccc

SEQ ID NO: 290885 - DNA, 25 bp, Mus musculus
ctgttgccctaggttacggccgcgt

SEQ ID NO: 290886 - DNA, 25 bp, Mus musculus
aagagccgggctgttgccctaggtt

SEQ ID NO: 290887 - DNA, 25 bp, Mus musculus
tcagacgctcctacggggccgcgag

SEQ ID NO: 290888 - DNA, 25 bp, Mus musculus
ggacgtggccacagccactcagacg

SEQ ID NO: 290889 - DNA, 25 bp, Mus musculus
aagattgcttccttccgcggctctg

SEQ ID NO: 290890 - DNA, 25 bp, Mus musculus
gtctcgcttacccaccctgaagatt

SEQ ID NO: 290891 - DNA, 25 bp, Mus musculus
gctctgccgcccgtgaagtgtctag

SEQ ID NO: 290892 - DNA, 25 bp, Mus musculus
atcccaagagcgagaagcgtgggta

SEQ ID NO: 290893 - DNA, 25 bp, Mus musculus
aggctgtaggccacaacccgcaagc

SEQ ID NO: 290894 - DNA, 25 bp, Mus musculus
aaagtttgctcctgtactctcccgc

SEQ ID NO: 290895 - DNA, 25 bp, Mus musculus
aggccgcagaaccaggatcccaaga

SEQ ID NO: 290896 - DNA, 25 bp, Mus musculus
acttcggataggacaacccgcgcga

SEQ ID NO: 290897 - DNA, 25 bp, Mus musculus
gcggtgaccacgtgccctgcactta

SEQ ID NO: 290898 - DNA, 25 bp, Mus musculus
tgcacttacccgacagcaaagcaga

SEQ ID NO: 290899 - DNA, 25 bp, Mus musculus
aaagcagatccggtgcgcagtgagc

SEQ ID NO: 290900 - DNA, 25 bp, Mus musculus
gcaagctcctcgacacttgcagcga

SEQ ID NO: 290901 - DNA, 25 bp, Mus musculus
cttgcagcgacatggtcagaggtcc

SEQ ID NO: 290902 - DNA, 25 bp, Mus musculus
ccagagtaagcggagcacccaggcc

SEQ ID NO: 290903 - DNA, 25 bp, Mus musculus
tctgattggacatcttgaaggttcc

SEQ ID NO: 290904 - DNA, 25 bp, Mus musculus
cttgaaggttccacttcggatagga

SEQ ID NO: 290905 - DNA, 25 bp, Mus musculus
cctacttagggagaaaggccgcaga

SEQ ID NO: 290906 - DNA, 25 bp, Mus musculus
cggccagcccgtacatcaggtgagc

SEQ ID NO: 290907 - DNA, 25 bp, Mus musculus
ttcagcgaaggcttctggcggactc

SEQ ID NO: 290908 - DNA, 25 bp, Mus musculus
ttctgcccggaactaatggacgtga

SEQ ID NO: 290909 - DNA, 25 bp, Mus musculus
cgtgaacgtagcgaggcgtaactcc

SEQ ID NO: 290910 - DNA, 25 bp, Mus musculus
cttccacactgagagcactcggttc

SEQ ID NO: 290911 - DNA, 25 bp, Mus musculus
ctgggaattggataccgcggaaccg

SEQ ID NO: 290912 - DNA, 25 bp, Mus musculus
tgacgcaacggcacagctccttaaa

SEQ ID NO: 290913 - DNA, 25 bp, Mus musculus
aggcgcgttgttgaacttccagctc

SEQ ID NO: 290914 - DNA, 25 bp, Mus musculus
gatcccggtgcagaagaacatcctg

SEQ ID NO: 290915 - DNA, 25 bp, Mus musculus
cggagtccctggaggtccgcaaaag

SEQ ID NO: 290916 - DNA, 25 bp, Mus musculus
aacacggtgtacaggccgtcctgga

SEQ ID NO: 290917 - DNA, 25 bp, Mus musculus
ccgcagaagttttacctccgagtca

SEQ ID NO: 290918 - DNA, 25 bp, Mus musculus
tacctccgagtcaccgcacagtggg

SEQ ID NO: 290919 - DNA, 25 bp, Mus musculus
tccagagcttcactcagtccgggcg

SEQ ID NO: 290920 - DNA, 25 bp, Mus musculus
tgaccgccagcacgggcaacgacag

SEQ ID NO: 290921 - DNA, 25 bp, Mus musculus
cccagcctgtgggaccatgagcatc

SEQ ID NO: 290922 - DNA, 25 bp, Mus musculus
caaccttattgactgtctgatggtc

SEQ ID NO: 290923 - DNA, 25 bp, Mus musculus
ggcaacgacagcgagcccaacctta

SEQ ID NO: 290924 - DNA, 25 bp, Mus musculus
tggcctccagcgaggtccacgtgga

SEQ ID NO: 290925 - DNA, 25 bp, Mus musculus
ctgaagtcggtggttgtggcctcca

SEQ ID NO: 290926 - DNA, 25 bp, Mus musculus
gaagccacattgtctgagccacggc

SEQ ID NO: 290927 - DNA, 25 bp, Mus musculus
tggtgtctcaggaagccacattgtc

SEQ ID NO: 290928 - DNA, 25 bp, Mus musculus
ccagcccggacctggtgtctcagga

SEQ ID NO: 290929 - DNA, 25 bp, Mus musculus
gcccaccttacctctgcgtctgctg

SEQ ID NO: 290930 - DNA, 25 bp, Mus musculus
tccgaaacggctgccagcagccatg

SEQ ID NO: 290931 - DNA, 25 bp, Mus musculus
cccagcctgaaagagatccgaaacg

SEQ ID NO: 290932 - DNA, 25 bp, Mus musculus
actgtctgatggtcagcccagcctg

SEQ ID NO: 290933 - DNA, 25 bp, Mus musculus
cgacagcgagcccaaccttattgac

SEQ ID NO: 290934 - DNA, 25 bp, Mus musculus
gccggacgtgacgagtggtctaaaa

SEQ ID NO: 290935 - DNA, 25 bp, Mus musculus
caactgctgactaatcggcgggcgg

SEQ ID NO: 290936 - DNA, 25 bp, Mus musculus
ctcggaatggttacgcccgctggct

SEQ ID NO: 290937 - DNA, 25 bp, Mus musculus
tggctctagggaccgtctctgaaga

SEQ ID NO: 290938 - DNA, 25 bp, Mus musculus
caacgcggccgccaaaaggttccag

SEQ ID NO: 290939 - DNA, 25 bp, Mus musculus
gttccagaaccagcccgcctagtgg

SEQ ID NO: 290940 - DNA, 25 bp, Mus musculus
ctttcggcgacttcactcagtcatc

SEQ ID NO: 290941 - DNA, 25 bp, Mus musculus
tcccagtctgggtgtcccagctgtc

SEQ ID NO: 290942 - DNA, 25 bp, Mus musculus
cgcttacccgtggacgccattttct

SEQ ID NO: 290943 - DNA, 25 bp, Mus musculus
atcctctcccaaagagccggacgtg

SEQ ID NO: 290944 - DNA, 25 bp, Mus musculus
acgaacccgagagctccttggcgcg

SEQ ID NO: 290945 - DNA, 25 bp, Mus musculus
gccagtgagcgagggttacccacga

SEQ ID NO: 290946 - DNA, 25 bp, Mus musculus
gccggcctgaaacaactgctgacta

SEQ ID NO: 290947 - DNA, 25 bp, Mus musculus
ctctgaagagtctgccctggaggga

SEQ ID NO: 290948 - DNA, 25 bp, Mus musculus
tggcgcggccgcctccaaagcagaa

SEQ ID NO: 290949 - DNA, 25 bp, Mus musculus
agcagctctttctccacacgcgatt

SEQ ID NO: 290950 - DNA, 25 bp, Mus musculus
ttcccagtagtacacaggtggctcc

SEQ ID NO: 290951 - DNA, 25 bp, Mus musculus
gattttgaacagtacttcccagtag

SEQ ID NO: 290952 - DNA, 25 bp, Mus musculus
gcttgcggggacttgattttgaaca

SEQ ID NO: 290953 - DNA, 25 bp, Mus musculus
tcgccaccgagagtcctacgcggga

SEQ ID NO: 290954 - DNA, 25 bp, Mus musculus
ggtggccgaagcgtctacctcgcca

SEQ ID NO: 290955 - DNA, 25 bp, Mus musculus
cagtggccaactagggtttgaatga

SEQ ID NO: 290956 - DNA, 25 bp, Mus musculus
acctctccagggtgagcagtggcca

SEQ ID NO: 290957 - DNA, 25 bp, Mus musculus
tggggaacccttgcttagggacagc

SEQ ID NO: 290958 - DNA, 25 bp, Mus musculus
agtagccaggatggatggagctccc

SEQ ID NO: 290959 - DNA, 25 bp, Mus musculus
gtaccgccaggtgagtagccaggat

SEQ ID NO: 290960 - DNA, 25 bp, Mus musculus
tgagcaagacctgcgctgccggact

SEQ ID NO: 290961 - DNA, 25 bp, Mus musculus
ccaaagcagaagtaaggagcgccgc

SEQ ID NO: 290962 - DNA, 25 bp, Mus musculus
cacacctgcgctgcgcggagttcga

SEQ ID NO: 290963 - DNA, 25 bp, Mus musculus
ggagttcgagctgcggctcacagac

SEQ ID NO: 290964 - DNA, 25 bp, Mus musculus
gcactgccggatccggtctactatg

SEQ ID NO: 290965 - DNA, 25 bp, Mus musculus
gccggatccggtctactatggagaa

SEQ ID NO: 290966 - DNA, 25 bp, Mus musculus
tcatccagcactaccgtgaggcaca

SEQ ID NO: 290967 - DNA, 25 bp, Mus musculus
gagctgcggctcacagacccggtgc

SEQ ID NO: 290968 - DNA, 25 bp, Mus musculus
ccggtctactatggagaatggggtc

SEQ ID NO: 290969 - DNA, 25 bp, Mus musculus
agcactaccgtgaggcacacctgcg

SEQ ID NO: 290970 - DNA, 25 bp, Mus musculus
tctactatggagaatggggtcatga

SEQ ID NO: 290971 - DNA, 25 bp, Mus musculus
gcatctacgccctcatccagcacta

SEQ ID NO: 290972 - DNA, 25 bp, Mus musculus
aacctcacgttcaacagcatctacg

SEQ ID NO: 290973 - DNA, 25 bp, Mus musculus
tgaccgacaacctcacgttcaacag

SEQ ID NO: 290974 - DNA, 25 bp, Mus musculus
tgaagtactacctgaccgacaacct

SEQ ID NO: 290975 - DNA, 25 bp, Mus musculus
aatggggtcatgaagtactacctga

SEQ ID NO: 290976 - DNA, 25 bp, Mus musculus
ccatgttggacgcacttgcagaggc

SEQ ID NO: 290977 - DNA, 25 bp, Mus musculus
ctcagcaccttcatgcgcagcaggt

SEQ ID NO: 290978 - DNA, 25 bp, Mus musculus
gcgcagcaggttcttggataactta

SEQ ID NO: 290979 - DNA, 25 bp, Mus musculus
ataacttagtcttgcgctccgacgc

SEQ ID NO: 290980 - DNA, 25 bp, Mus musculus
agtcccactacggaacatctcggag

SEQ ID NO: 290981 - DNA, 25 bp, Mus musculus
ttgcagaggctttcccgccgcactg

SEQ ID NO: 290982 - DNA, 25 bp, Mus musculus
gcacggtcaagagcggagctagata

SEQ ID NO: 290983 - DNA, 25 bp, Mus musculus
gataagacgacgctctagacccgcc

SEQ ID NO: 290984 - DNA, 25 bp, Mus musculus
cgccctagtgctcggagctgcttct

SEQ ID NO: 290985 - DNA, 25 bp, Mus musculus
cgtctctccgcaaagagctgtggta

SEQ ID NO: 290986 - DNA, 25 bp, Mus musculus
ctgcgattcagggtcccagggctaa

SEQ ID NO: 290987 - DNA, 25 bp, Mus musculus
cccagggctaaactcaggaaaggcg

SEQ ID NO: 290988 - DNA, 25 bp, Mus musculus
tcgcttacaggcgtggcagagcttt

SEQ ID NO: 290989 - DNA, 25 bp, Mus musculus
gaacatctcggagctcagcagcctc

SEQ ID NO: 290990 - DNA, 25 bp, Mus musculus
cactcctttcgaggcgactcctagg

SEQ ID NO: 290991 - DNA, 25 bp, Mus musculus
agctggcatcactgacttcccgggg

SEQ ID NO: 290992 - DNA, 25 bp, Mus musculus
cgtgcagatatacccggctagctca

SEQ ID NO: 290993 - DNA, 25 bp, Mus musculus
ttctgcattcagatcgccctgcttg

SEQ ID NO: 290994 - DNA, 25 bp, Mus musculus
cctcccgaggttcgtgcatcggata

SEQ ID NO: 290995 - DNA, 25 bp, Mus musculus
ttttgcaagcaaagcgacatcctgg

SEQ ID NO: 290996 - DNA, 25 bp, Mus musculus
tagctcagatgcgaggtcaccctca

SEQ ID NO: 290997 - DNA, 25 bp, Mus musculus
aggcgcttcttctagtcgggcaaga

SEQ ID NO: 290998 - DNA, 25 bp, Mus musculus
gcagccgcgtgtgtgaatgcaaacg

SEQ ID NO: 290999 - DNA, 25 bp, Mus musculus
caaaggctggctcccacggaaaata

SEQ ID NO: 291000 - DNA, 25 bp, Mus musculus
tgccgctgatctatttgggaagttg

SEQ ID NO: 291001 - DNA, 25 bp, Mus musculus
aatgctttcgcgatgctgccgctga

SEQ ID NO: 291002 - DNA, 25 bp, Mus musculus
atccgtcttgtaaagccattggtcc

SEQ ID NO: 291003 - DNA, 25 bp, Mus musculus
tgtgtgcgcgtgtaagctcattcta

SEQ ID NO: 291004 - DNA, 25 bp, Mus musculus
tgcagcgaggaccacagtctcagga

SEQ ID NO: 291005 - DNA, 25 bp, Mus musculus
ccattgggtcccaaccggctggcag

SEQ ID NO: 291006 - DNA, 25 bp, Mus musculus
agagagccggctgtccatcacaagc

SEQ ID NO: 291007 - DNA, 25 bp, Mus musculus
tcctggggaacacagggctcagatc

SEQ ID NO: 291008 - DNA, 25 bp, Mus musculus
gtttacctcggttgtttcgcatgcc

SEQ ID NO: 291009 - DNA, 25 bp, Mus musculus
agcgctttcttcgtgcctcggttta

SEQ ID NO: 291010 - DNA, 25 bp, Mus musculus
ttggaggcagtccagataaagtctg

SEQ ID NO: 291011 - DNA, 25 bp, Mus musculus
cgcttcctcaggagccaataggata

SEQ ID NO: 291012 - DNA, 25 bp, Mus musculus
gtggctaacggcacacgcttcctca

SEQ ID NO: 291013 - DNA, 25 bp, Mus musculus
tgtactggaagattagctcgtcgcc

SEQ ID NO: 291014 - DNA, 25 bp, Mus musculus
cgaagaagcgcatccgtggttcctg

SEQ ID NO: 291015 - DNA, 25 bp, Mus musculus
ggggactcgccgacacctctgaaag

SEQ ID NO: 291016 - DNA, 25 bp, Mus musculus
ctgcggactacggacagcgaggtcc

SEQ ID NO: 291017 - DNA, 25 bp, Mus musculus
ggaagcggctattaggcaacctgca

SEQ ID NO: 291018 - DNA, 25 bp, Mus musculus
ggttccgagacatcgccgccaagct

SEQ ID NO: 291019 - DNA, 25 bp, Mus musculus
ggacctgacccgcagggacaccgat

SEQ ID NO: 291020 - DNA, 25 bp, Mus musculus
gcagcctcatatgggcctggacacc

SEQ ID NO: 291021 - DNA, 25 bp, Mus musculus
taagcggcagcctcatatgggcctg

SEQ ID NO: 291022 - DNA, 25 bp, Mus musculus
catcaccttggtggtaagcggcagc

SEQ ID NO: 291023 - DNA, 25 bp, Mus musculus
ccaagaccatgcaggacatcacctt

SEQ ID NO: 291024 - DNA, 25 bp, Mus musculus
tcccgtgaccgtgtagtcgcgagaa

SEQ ID NO: 291025 - DNA, 25 bp, Mus musculus
gtgtaggtgacggttccgagacatc

SEQ ID NO: 291026 - DNA, 25 bp, Mus musculus
cgccgagaaaccgaagtgtaggtga

SEQ ID NO: 291027 - DNA, 25 bp, Mus musculus
gtctgcgccgagaaaccgaagtgta

SEQ ID NO: 291028 - DNA, 25 bp, Mus musculus
cttgtgggcgtctgcgccgagaaac

SEQ ID NO: 291029 - DNA, 25 bp, Mus musculus
tagtcgcgagaactgtcggcttgtg

SEQ ID NO: 291030 - DNA, 25 bp, Mus musculus
tgaccgtgtagtcgcgagaactgtc

SEQ ID NO: 291031 - DNA, 25 bp, Mus musculus
catgcaggacatcaccttggtggta

SEQ ID NO: 291032 - DNA, 25 bp, Mus musculus
gagaacggcggctccgccgcgaaca

SEQ ID NO: 291033 - DNA, 25 bp, Mus musculus
cggagctctcgcgacatttgcggtc

SEQ ID NO: 291034 - DNA, 25 bp, Mus musculus
agtccgagccgcgatgtgcactgag

SEQ ID NO: 291035 - DNA, 25 bp, Mus musculus
cgctccgggccaatttctggggaag

SEQ ID NO: 291036 - DNA, 25 bp, Mus musculus
ccgggccaatttctggggaagcagc

SEQ ID NO: 291037 - DNA, 25 bp, Mus musculus
aatttctggggaagcagctgcggta

SEQ ID NO: 291038 - DNA, 25 bp, Mus musculus
ggcaaacgtacctgcgtccgcctca

SEQ ID NO: 291039 - DNA, 25 bp, Mus musculus
agccgcgatgtgcactgagctgcag

SEQ ID NO: 291040 - DNA, 25 bp, Mus musculus
aacacgcctcgggtctccattcggg

SEQ ID NO: 291041 - DNA, 25 bp, Mus musculus
ggggatgtttactcgcaagtctcgc

SEQ ID NO: 291042 - DNA, 25 bp, Mus musculus
gatgtttactcgcaagtctcgcgag

SEQ ID NO: 291043 - DNA, 25 bp, Mus musculus
tctcgcgagaccacgccgctggggc

SEQ ID NO: 291044 - DNA, 25 bp, Mus musculus
gctgtgcggagctctcgcgacattt

SEQ ID NO: 291045 - DNA, 25 bp, Mus musculus
tctcgcgacatttgcggtcttgggg

SEQ ID NO: 291046 - DNA, 25 bp, Mus musculus
cgcggccattctgcatcagtcctga

SEQ ID NO: 291047 - DNA, 25 bp, Mus musculus
tcgcacccgggtgtactacacaaga

SEQ ID NO: 291048 - DNA, 25 bp, Mus musculus
acggacgcaacgacatcccaggatc

SEQ ID NO: 291049 - DNA, 25 bp, Mus musculus
atcccaggatctcagcgaaggctcg

SEQ ID NO: 291050 - DNA, 25 bp, Mus musculus
ctggtagcagaacagggactccctg

SEQ ID NO: 291051 - DNA, 25 bp, Mus musculus
gggcacggcccagcgactctgcaaa

SEQ ID NO: 291052 - DNA, 25 bp, Mus musculus
gtcctgagacttagaacctacttag

SEQ ID NO: 291053 - DNA, 25 bp, Mus musculus
agaagctgcgcgctttcttcagcag

SEQ ID NO: 291054 - DNA, 25 bp, Mus musculus
acctacttagacctagcgaccagga

SEQ ID NO: 291055 - DNA, 25 bp, Mus musculus
tgtgcgagcctcctgccgaggacca

SEQ ID NO: 291056 - DNA, 25 bp, Mus musculus
ccgggacacctgctcagggagctga

SEQ ID NO: 291057 - DNA, 25 bp, Mus musculus
cgcgggcgcaatacctgcagcgaga

SEQ ID NO: 291058 - DNA, 25 bp, Mus musculus
gaccgggaaagcgttggacagccaa

SEQ ID NO: 291059 - DNA, 25 bp, Mus musculus
caacgacgcggaccgtagagtatta

SEQ ID NO: 291060 - DNA, 25 bp, Mus musculus
gatcatctaaccgagtcctccagcg

SEQ ID NO: 291061 - DNA, 25 bp, Mus musculus
tcgcccgagaaacaggaagtcccgc

SEQ ID NO: 291062 - DNA, 25 bp, Mus musculus
tcaggccggaagttcgcccgagaaa

SEQ ID NO: 291063 - DNA, 25 bp, Mus musculus
ctaaactgttttccggatcaggccg

SEQ ID NO: 291064 - DNA, 25 bp, Mus musculus
tgttggagcagactaaactgttttc

SEQ ID NO: 291065 - DNA, 25 bp, Mus musculus
cgccacccacaactgttggagcaga

SEQ ID NO: 291066 - DNA, 25 bp, Mus musculus
caaaggagccagagtgccgaacctc

SEQ ID NO: 291067 - DNA, 25 bp, Mus musculus
cacgtggtctgccacgtgctctcag

SEQ ID NO: 291068 - DNA, 25 bp, Mus musculus
gtctctatagccacgtggtctgcca

SEQ ID NO: 291069 - DNA, 25 bp, Mus musculus
atcgaccagtctctatagccacgtg

SEQ ID NO: 291070 - DNA, 25 bp, Mus musculus
taggacgagcctcagcgctgtaatc

SEQ ID NO: 291071 - DNA, 25 bp, Mus musculus
tggccagcatctaggacgagcctca

SEQ ID NO: 291072 - DNA, 25 bp, Mus musculus
ccctcgtggccagcatctaggacga

SEQ ID NO: 291073 - DNA, 25 bp, Mus musculus
gcgctgtaatcgaccagtctctata

SEQ ID NO: 291074 - DNA, 25 bp, Mus musculus
tttctcattggctagtcgcagcatc

SEQ ID NO: 291075 - DNA, 25 bp, Mus musculus
gcgtccacgcctgagcaccgggagt

SEQ ID NO: 291076 - DNA, 25 bp, Mus musculus
cacagtctgtcattggccatctcca

SEQ ID NO: 291077 - DNA, 25 bp, Mus musculus
tcattggccatctccaggaagaggc

SEQ ID NO: 291078 - DNA, 25 bp, Mus musculus
gctagtcgcagcatccatcacagca

SEQ ID NO: 291079 - DNA, 25 bp, Mus musculus
tcacagcaccacagtctgtcattgg

SEQ ID NO: 291080 - DNA, 25 bp, Mus musculus
tggcagcgtcgctgcagatcagccc

SEQ ID NO: 291081 - DNA, 25 bp, Mus musculus
gacctcgactggcagcgtcgctgca

SEQ ID NO: 291082 - DNA, 25 bp, Mus musculus
ctccacgtgaaaaagagcgcgggga

SEQ ID NO: 291083 - DNA, 25 bp, Mus musculus
ccacgcacgtgctccacgtgaaaaa

SEQ ID NO: 291084 - DNA, 25 bp, Mus musculus
atagttagctccgtcccacgcacgt

SEQ ID NO: 291085 - DNA, 25 bp, Mus musculus
agttcatagttagctccgtcccacg

SEQ ID NO: 291086 - DNA, 25 bp, Mus musculus
cgcaggagacctcgactggcagcgt

SEQ ID NO: 291087 - DNA, 25 bp, Mus musculus
aagaggcggagttcatagttagctc

SEQ ID NO: 291088 - DNA, 25 bp, Mus musculus
aacaaaggcagctcggtaccgttga

SEQ ID NO: 291089 - DNA, 25 bp, Mus musculus
ttcgctcgcggcttcaacaatgatg

SEQ ID NO: 291090 - DNA, 25 bp, Mus musculus
tgtttggatacattcctggcgtctc

SEQ ID NO: 291091 - DNA, 25 bp, Mus musculus
ctgcgcgcactgtctgtttggatac

SEQ ID NO: 291092 - DNA, 25 bp, Mus musculus
tgtgagtcacgtgcgctgcgcgcac

SEQ ID NO: 291093 - DNA, 25 bp, Mus musculus
atcagctgtgagtcacgtgcgctgc

SEQ ID NO: 291094 - DNA, 25 bp, Mus musculus
gggccggaaatcagctgtgagtcac

SEQ ID NO: 291095 - DNA, 25 bp, Mus musculus
agcgaactgactcttcggcggcgcg

SEQ ID NO: 291096 - DNA, 25 bp, Mus musculus
cagctcggtaccgttgaggcgcacg

SEQ ID NO: 291097 - DNA, 25 bp, Mus musculus
gcgcgcaaacaaaggcagctcggta

SEQ ID NO: 291098 - DNA, 25 bp, Mus musculus
tcaacaatgatgtgctggtccatcc

SEQ ID NO: 291099 - DNA, 25 bp, Mus musculus
cgggccgcagcgaactgactcttcg

SEQ ID NO: 291100 - DNA, 25 bp, Mus musculus
acattcctggcgtctcttaaagaga

SEQ ID NO: 291101 - DNA, 25 bp, Mus musculus
ctggtccatccagggcgccgattgt

SEQ ID NO: 291102 - DNA, 25 bp, Mus musculus
tacgtagaggatgcgtagtgcccgc

SEQ ID NO: 291103 - DNA, 25 bp, Mus musculus
atgtcgatgacattcaggggcccgc

SEQ ID NO: 291104 - DNA, 25 bp, Mus musculus
gacacatagtatggggagatggcta

SEQ ID NO: 291105 - DNA, 25 bp, Mus musculus
gacactgcgagcgacacatagtatg

SEQ ID NO: 291106 - DNA, 25 bp, Mus musculus
ccggggattcgtcagacactgcgag

SEQ ID NO: 291107 - DNA, 25 bp, Mus musculus
cctgcctccggggattcgtcagaca

SEQ ID NO: 291108 - DNA, 25 bp, Mus musculus
cgagccaggcgcattacgtagagga

SEQ ID NO: 291109 - DNA, 25 bp, Mus musculus
tttgttcggggcctggacaaagcgc

SEQ ID NO: 291110 - DNA, 25 bp, Mus musculus
ctggacaaagcgcaggcaaaactcc

SEQ ID NO: 291111 - DNA, 25 bp, Mus musculus
cgcggaagaactgacatttgttcgg

SEQ ID NO: 291112 - DNA, 25 bp, Mus musculus
cgatgacattcaggggcccgcggaa

SEQ ID NO: 291113 - DNA, 25 bp, Mus musculus
cgtagtgcccgcagaacacgcagca

SEQ ID NO: 291114 - DNA, 25 bp, Mus musculus
ggagatggctagaatgtcgatgaca

SEQ ID NO: 291115 - DNA, 25 bp, Mus musculus
actgacatttgttcggggcctggac

SEQ ID NO: 291116 - DNA, 25 bp, Mus musculus
agccggagcctgctcaggcggctca

SEQ ID NO: 291117 - DNA, 25 bp, Mus musculus
atcgtgaagcctgcacctcggagtg

SEQ ID NO: 291118 - DNA, 25 bp, Mus musculus
gtgggtcctccaccatttcacgcag

SEQ ID NO: 291119 - DNA, 25 bp, Mus musculus
caccatttcacgcagctggttcatg

SEQ ID NO: 291120 - DNA, 25 bp, Mus musculus
cagctggttcatgctgcgggcccat

SEQ ID NO: 291121 - DNA, 25 bp, Mus musculus
gcaggcgaagaccttcccgggcagc

SEQ ID NO: 291122 - DNA, 25 bp, Mus musculus
gcgctccaggttggtttcctcgatg

SEQ ID NO: 291123 - DNA, 25 bp, Mus musculus
acatctctcgcagaagcaccagctt

SEQ ID NO: 291124 - DNA, 25 bp, Mus musculus
agaactcctggctgtcctcatcgta

SEQ ID NO: 291125 - DNA, 25 bp, Mus musculus
tcatcgtagtcatcgcagagctgcg

SEQ ID NO: 291126 - DNA, 25 bp, Mus musculus
tgatctcctcatggctgcggcacag

SEQ ID NO: 291127 - DNA, 25 bp, Mus musculus
ttcttcagcagcttgcgcaggcagc

SEQ ID NO: 291128 - DNA, 25 bp, Mus musculus
cgcagagctgcgtgatctcctcatg

SEQ ID NO: 291129 - DNA, 25 bp, Mus musculus
cagggcgcacatctctcgcagaagc

SEQ ID NO: 291130 - DNA, 25 bp, Mus musculus
caggtttggacaagaatcagagctc

SEQ ID NO: 291131 - DNA, 25 bp, Mus musculus
caggcgattcttatgctctggcagg

SEQ ID NO: 291132 - DNA, 25 bp, Mus musculus
ccgagctgctctatcccaggtaagg

SEQ ID NO: 291133 - DNA, 25 bp, Mus musculus
ccgctgcggctgacccttggagttt

SEQ ID NO: 291134 - DNA, 25 bp, Mus musculus
ctgagaccacacagaggcttcctga

SEQ ID NO: 291135 - DNA, 25 bp, Mus musculus
caccagttcaccatggggagacgcc

SEQ ID NO: 291136 - DNA, 25 bp, Mus musculus
agaggcttcctgatccttcctgagc

SEQ ID NO: 291137 - DNA, 25 bp, Mus musculus
tgtggagcagcctggacaccagttc

SEQ ID NO: 291138 - DNA, 25 bp, Mus musculus
gggagacgcctcaagtttctgcaga

SEQ ID NO: 291139 - DNA, 25 bp, Mus musculus
tctgcagaaactggccttcttgggc

SEQ ID NO: 291140 - DNA, 25 bp, Mus musculus
ttcttgggccagaaccaccggtaca

SEQ ID NO: 291141 - DNA, 25 bp, Mus musculus
aaccaccggtacaaggcgctggaga

SEQ ID NO: 291142 - DNA, 25 bp, Mus musculus
caggtaaggcttttaactcaggact

SEQ ID NO: 291143 - DNA, 25 bp, Mus musculus
tcaggactttctccctttcaggcga

SEQ ID NO: 291144 - DNA, 25 bp, Mus musculus
aacagcaggcgccagcgttgccgat

SEQ ID NO: 291145 - DNA, 25 bp, Mus musculus
cagcgttgccgatgctccggggcca

SEQ ID NO: 291146 - DNA, 25 bp, Mus musculus
gctgaggtagatgacggacagcaca

SEQ ID NO: 291147 - DNA, 25 bp, Mus musculus
gacggacagcacatccaggatgctc

SEQ ID NO: 291148 - DNA, 25 bp, Mus musculus
aggatgctctcgaaccggccacctt

SEQ ID NO: 291149 - DNA, 25 bp, Mus musculus
gaccagcgtggacggatcaaaggat

SEQ ID NO: 291150 - DNA, 25 bp, Mus musculus
cgtggacggatcaaaggatgaaccc

SEQ ID NO: 291151 - DNA, 25 bp, Mus musculus
tcaaaggatgaacccaggaggcaca

SEQ ID NO: 291152 - DNA, 25 bp, Mus musculus
ccactcctcgatcatggcttggtcg

SEQ ID NO: 291153 - DNA, 25 bp, Mus musculus
caggaacatgcccacgtgagggacg

SEQ ID NO: 291154 - DNA, 25 bp, Mus musculus
tggacgaccacgctcaggaacatgc

SEQ ID NO: 291155 - DNA, 25 bp, Mus musculus
ggatgaacccaggaggcacaggccc

SEQ ID NO: 291156 - DNA, 25 bp, Mus musculus
ccctgtggacgaccacgctcaggaa

SEQ ID NO: 291157 - DNA, 25 bp, Mus musculus
cgtgagggacgtggaacacccactc

SEQ ID NO: 291158 - DNA, 25 bp, Mus musculus
cttgtcgatcttcgtggccatggcc

SEQ ID NO: 291159 - DNA, 25 bp, Mus musculus
ttcgctcccattggtcaggcgaggc

SEQ ID NO: 291160 - DNA, 25 bp, Mus musculus
ggggactccactcccgtgaaagcca

SEQ ID NO: 291161 - DNA, 25 bp, Mus musculus
ccgcggttactgcagagccagagcg

SEQ ID NO: 291162 - DNA, 25 bp, Mus musculus
ccagtctgtgcggattgcgcaactc

SEQ ID NO: 291163 - DNA, 25 bp, Mus musculus
ggaaccagtgaacgcgtccctgatc

SEQ ID NO: 291164 - DNA, 25 bp, Mus musculus
gcactaagttgtacgccgcgcgaca

SEQ ID NO: 291165 - DNA, 25 bp, Mus musculus
gccgtcgtcccgcactaagttgtac

SEQ ID NO: 291166 - DNA, 25 bp, Mus musculus
cagcaagctaaggtcctcggagaga

SEQ ID NO: 291167 - DNA, 25 bp, Mus musculus
tggcgccgtcgtatctgaaagtcac

SEQ ID NO: 291168 - DNA, 25 bp, Mus musculus
agcggcacgaagcaggtcactactg

SEQ ID NO: 291169 - DNA, 25 bp, Mus musculus
ccgcgaggacactgccggaaccagt

SEQ ID NO: 291170 - DNA, 25 bp, Mus musculus
gcgttgctcaccagatgaccgccga

SEQ ID NO: 291171 - DNA, 25 bp, Mus musculus
gtccctgatccgctacgagagtcga

SEQ ID NO: 291172 - DNA, 25 bp, Mus musculus
accgaactcagcgactggggcgcac

SEQ ID NO: 291173 - DNA, 25 bp, Mus musculus
cgcgcatgcgcgcaccgaactcagc

SEQ ID NO: 291174 - DNA, 25 bp, Mus musculus
gcacgagcagtctccgacgcgcatg

SEQ ID NO: 291175 - DNA, 25 bp, Mus musculus
ccgcttcagccgcacgagcagtctc

SEQ ID NO: 291176 - DNA, 25 bp, Mus musculus
tcacccacctcccagcggcgtgcgt

SEQ ID NO: 291177 - DNA, 25 bp, Mus musculus
gcgtgcgtcgcttctccgctccttg

SEQ ID NO: 291178 - DNA, 25 bp, Mus musculus
cgacccgtacagctcccttcaccca

SEQ ID NO: 291179 - DNA, 25 bp, Mus musculus
cgggctgagtgatgcgcccacattt

SEQ ID NO: 291180 - DNA, 25 bp, Mus musculus
ggggcaagaggctccacccgctcct

SEQ ID NO: 291181 - DNA, 25 bp, Mus musculus
ctacgggctgagtgatgcgcccaca

SEQ ID NO: 291182 - DNA, 25 bp, Mus musculus
tgatgcgcccacatttggccgtcgc

SEQ ID NO: 291183 - DNA, 25 bp, Mus musculus
agtgatgcgcccacatttggccgtc

SEQ ID NO: 291184 - DNA, 25 bp, Mus musculus
aactcagcgactggggcgcacagcc

SEQ ID NO: 291185 - DNA, 25 bp, Mus musculus
gcgcacagcctacgggctgagtgat

SEQ ID NO: 291186 - DNA, 25 bp, Mus musculus
tccctcggcgcctcagcaccttcgg

SEQ ID NO: 291187 - DNA, 25 bp, Mus musculus
ccgccattgacagtgtaggctcgca

SEQ ID NO: 291188 - DNA, 25 bp, Mus musculus
agcggctcgcaagcgggcgcgatcc

SEQ ID NO: 291189 - DNA, 25 bp, Mus musculus
cgctgctctggtagcggctcgcaag

SEQ ID NO: 291190 - DNA, 25 bp, Mus musculus
cggtagccccgcagtgtgcgctgct

SEQ ID NO: 291191 - DNA, 25 bp, Mus musculus
cttccttgcagagggatggctgcgc

SEQ ID NO: 291192 - DNA, 25 bp, Mus musculus
tcgcacttccttgcagagggatggc

SEQ ID NO: 291193 - DNA, 25 bp, Mus musculus
cccagccgccattgacagtgtaggc

SEQ ID NO: 291194 - DNA, 25 bp, Mus musculus
aggctcgcacttccttgcagaggga

SEQ ID NO: 291195 - DNA, 25 bp, Mus musculus
ctccgtgctggctcccggggatccc

SEQ ID NO: 291196 - DNA, 25 bp, Mus musculus
gtgtaggctcgcacttccttgcaga

SEQ ID NO: 291197 - DNA, 25 bp, Mus musculus
gacagtgtaggctcgcacttccttg

SEQ ID NO: 291198 - DNA, 25 bp, Mus musculus
cattgacagtgtaggctcgcacttc

SEQ ID NO: 291199 - DNA, 25 bp, Mus musculus
tcgcgggtgcacaggtgcggcccac

SEQ ID NO: 291200 - DNA, 25 bp, Mus musculus
aggacatcctgctacagcgggtgaa

SEQ ID NO: 291201 - DNA, 25 bp, Mus musculus
aagctggccatgtgctctctgctgc

SEQ ID NO: 291202 - DNA, 25 bp, Mus musculus
ggaggccatgcactaccacaacagc

SEQ ID NO: 291203 - DNA, 25 bp, Mus musculus
tggcccagcctgtcctgcagacgaa

SEQ ID NO: 291204 - DNA, 25 bp, Mus musculus
tcctgcagacgaagcgaacgctgct

SEQ ID NO: 291205 - DNA, 25 bp, Mus musculus
ctgcgctccgaggagtgcttgctct

SEQ ID NO: 291206 - DNA, 25 bp, Mus musculus
gctgagcgatgacacctgctaccta

SEQ ID NO: 291207 - DNA, 25 bp, Mus musculus
cctgctacctagacaccaagaatga

SEQ ID NO: 291208 - DNA, 25 bp, Mus musculus
agtgggtgaaggagacatccctgcc

SEQ ID NO: 291209 - DNA, 25 bp, Mus musculus
agccaccactgcgtcgctgtgctgg

SEQ ID NO: 291210 - DNA, 25 bp, Mus musculus
gggcagcttctcgagagacaacgga

SEQ ID NO: 291211 - DNA, 25 bp, Mus musculus
agacaacggagggaatgccgcctcc

SEQ ID NO: 291212 - DNA, 25 bp, Mus musculus
tgccgcctccaaccttctttatagg

SEQ ID NO: 291213 - DNA, 25 bp, Mus musculus
ccgcgttctggagaacatccgcttc

SEQ ID NO: 291214 - DNA, 25 bp, Mus musculus
cacagcatgtgcagcctgggcgaca

SEQ ID NO: 291215 - DNA, 25 bp, Mus musculus
ccgtaccgcaagaacctgctgtgtt

SEQ ID NO: 291216 - DNA, 25 bp, Mus musculus
cctgctgtgttatgaccaccggaca

SEQ ID NO: 291217 - DNA, 25 bp, Mus musculus
aacagctcggggctggcacagcatg

SEQ ID NO: 291218 - DNA, 25 bp, Mus musculus
gactaccagattggcccgtaccgca

SEQ ID NO: 291219 - DNA, 25 bp, Mus musculus
tgggcgacagcatctactccatcgg

SEQ ID NO: 291220 - DNA, 25 bp, Mus musculus
ggcagtgacgaccacatggagtcca

SEQ ID NO: 291221 - DNA, 25 bp, Mus musculus
acatggagtccatggagcgcttcga

SEQ ID NO: 291222 - DNA, 25 bp, Mus musculus
tccatggagcgcttcgatgtgctgg

SEQ ID NO: 291223 - DNA, 25 bp, Mus musculus
tggaggcctacagcccacagtgcaa

SEQ ID NO: 291224 - DNA, 25 bp, Mus musculus
acagtgcaaccagtggactcgcgtg

SEQ ID NO: 291225 - DNA, 25 bp, Mus musculus
gctgctgcaggccaacagcgagtca

SEQ ID NO: 291226 - DNA, 25 bp, Mus musculus
ccaacagcgagtcaggcgtggccgt

SEQ ID NO: 291227 - DNA, 25 bp, Mus musculus
tatgaccaccggacagacgtgtggg

SEQ ID NO: 291228 - DNA, 25 bp, Mus musculus
gggcggcatactccggtttgcccga

SEQ ID NO: 291229 - DNA, 25 bp, Mus musculus
aacctcattgagacgggccgccatg

SEQ ID NO: 291230 - DNA, 25 bp, Mus musculus
agccggagcagcaccgaacctcatt

SEQ ID NO: 291231 - DNA, 25 bp, Mus musculus
gtttgcccgagactgacaccttttg

SEQ ID NO: 291232 - DNA, 25 bp, Mus musculus
tattgcaaagaaaaccgggaagcgc

SEQ ID NO: 291233 - DNA, 25 bp, Mus musculus
ggtgccgcttctccgggctgcgact

SEQ ID NO: 291234 - DNA, 25 bp, Mus musculus
agaagtcagcacgtggtgccgcttc

SEQ ID NO: 291235 - DNA, 25 bp, Mus musculus
atgcacttaggacgagtgagaagtc

SEQ ID NO: 291236 - DNA, 25 bp, Mus musculus
tgctgtgttttctgtgcccggagct

SEQ ID NO: 291237 - DNA, 25 bp, Mus musculus
aggccggattgcctgctgtgttttc

SEQ ID NO: 291238 - DNA, 25 bp, Mus musculus
accttttgcacggtgtccgagcccg

SEQ ID NO: 291239 - DNA, 25 bp, Mus musculus
gcccgagactgacaccttttgcacg

SEQ ID NO: 291240 - DNA, 25 bp, Mus musculus
atggccctccacaacccacaggtag

SEQ ID NO: 291241 - DNA, 25 bp, Mus musculus
cctggcctcgggaattctattgcaa

SEQ ID NO: 291242 - DNA, 25 bp, Mus musculus
tcagcaaggcgcagtaaactctttc

SEQ ID NO: 291243 - DNA, 25 bp, Mus musculus
gccgctctcttcaggggagcacatg

SEQ ID NO: 291244 - DNA, 25 bp, Mus musculus
catggacgctcatcctcggtatggc

SEQ ID NO: 291245 - DNA, 25 bp, Mus musculus
ttcaatttgagtccgcccgtgatcc

SEQ ID NO: 291246 - DNA, 25 bp, Mus musculus
gcggcccgtgccacattcaatttga

SEQ ID NO: 291247 - DNA, 25 bp, Mus musculus
caaaggtaggctctcccgccctgtt

SEQ ID NO: 291248 - DNA, 25 bp, Mus musculus
tctagattagtgctctccgccgcga

SEQ ID NO: 291249 - DNA, 25 bp, Mus musculus
gtgtagtctgctgtcctctagatta

SEQ ID NO: 291250 - DNA, 25 bp, Mus musculus
ggggccttttcaggcgggccaatca

SEQ ID NO: 291251 - DNA, 25 bp, Mus musculus
ggattttccagattgcgacccgcac

SEQ ID NO: 291252 - DNA, 25 bp, Mus musculus
gccagcttgcctcagaccaaaggta

SEQ ID NO: 291253 - DNA, 25 bp, Mus musculus
ctcagccatttaggagtctagtctc

SEQ ID NO: 291254 - DNA, 25 bp, Mus musculus
gatcgctcttttcctgctgccctag

SEQ ID NO: 291255 - DNA, 25 bp, Mus musculus
gtctcactcagggaacacttttaac

SEQ ID NO: 291256 - DNA, 25 bp, Mus musculus
gccgcttctgaagaaccgctggttc

SEQ ID NO: 291257 - DNA, 25 bp, Mus musculus
actacggacgtcttccagattgggc

SEQ ID NO: 291258 - DNA, 25 bp, Mus musculus
gattgggcttaatggctggctacga

SEQ ID NO: 291259 - DNA, 25 bp, Mus musculus
gctacgaatcgatgaccaaacggtc

SEQ ID NO: 291260 - DNA, 25 bp, Mus musculus
ccagtaccaggtggtgaaaccgcct

SEQ ID NO: 291261 - DNA, 25 bp, Mus musculus
tattaccgccgcgtggacctgctgt

SEQ ID NO: 291262 - DNA, 25 bp, Mus musculus
tgcctgacgctgcttcctacagttc

SEQ ID NO: 291263 - DNA, 25 bp, Mus musculus
tctgatcgcgtagtggaataagtcc

SEQ ID NO: 291264 - DNA, 25 bp, Mus musculus
ctgacttcagaagctggactgttgc

SEQ ID NO: 291265 - DNA, 25 bp, Mus musculus
acaggcggccactacactacggacg

SEQ ID NO: 291266 - DNA, 25 bp, Mus musculus
gacctgctgtaaccgtgcccgtgtg

SEQ ID NO: 291267 - DNA, 25 bp, Mus musculus
ggctcgcaccgtgtcccagtctgat

SEQ ID NO: 291268 - DNA, 25 bp, Mus musculus
gcgcagctcgtgctgactgacttca

SEQ ID NO: 291269 - DNA, 25 bp, Mus musculus
ctagtggctctgtagagagactccc

SEQ ID NO: 291270 - DNA, 25 bp, Mus musculus
gcctgccgcacgcagaaagagctca

SEQ ID NO: 291271 - DNA, 25 bp, Mus musculus
tacttttatggtcacggctaggggc

SEQ ID NO: 291272 - DNA, 25 bp, Mus musculus
ggataaatgcgcacaccccggctca

SEQ ID NO: 291273 - DNA, 25 bp, Mus musculus
tcagcacgtgcttcccggtggtctt

SEQ ID NO: 291274 - DNA, 25 bp, Mus musculus
cggtggtcttttgtcctgtccttca

SEQ ID NO: 291275 - DNA, 25 bp, Mus musculus
ggtcttttgtcctgtccttcacttg

SEQ ID NO: 291276 - DNA, 25 bp, Mus musculus
tgtcctgtccttcacttgagtagta

SEQ ID NO: 291277 - DNA, 25 bp, Mus musculus
gggtccacaggccacggactgtctg

SEQ ID NO: 291278 - DNA, 25 bp, Mus musculus
gccgcacgcagaaagagctcaatga

SEQ ID NO: 291279 - DNA, 25 bp, Mus musculus
cgcagaaagagctcaatgaaaacta

SEQ ID NO: 291280 - DNA, 25 bp, Mus musculus
tgaaaactacttttatggtcacggc

SEQ ID NO: 291281 - DNA, 25 bp, Mus musculus
tgcgcatcgtggtcctcagtgcctc

SEQ ID NO: 291282 - DNA, 25 bp, Mus musculus
gctccttgcgcatcgtggtcctcag

SEQ ID NO: 291283 - DNA, 25 bp, Mus musculus
ttcacttgagtagtagaaccgggtg

SEQ ID NO: 291284 - DNA, 25 bp, Mus musculus
tggaccaggccgaggtcaagacgct

SEQ ID NO: 291285 - DNA, 25 bp, Mus musculus
gcgacgcatcatgcggcagcgctca

SEQ ID NO: 291286 - DNA, 25 bp, Mus musculus
tgggtccaggcttgcacacctccat

SEQ ID NO: 291287 - DNA, 25 bp, Mus musculus
cccttcctgatgaccggccagagtt

SEQ ID NO: 291288 - DNA, 25 bp, Mus musculus
ggcagcagcatctacggcaagacta

SEQ ID NO: 291289 - DNA, 25 bp, Mus musculus
cggcaagactactaaacggagatcc

SEQ ID NO: 291290 - DNA, 25 bp, Mus musculus
gcccggaagagaaatcagtgcctac

SEQ ID NO: 291291 - DNA, 25 bp, Mus musculus
gagcactcgataaggcttcccgccg

SEQ ID NO: 291292 - DNA, 25 bp, Mus musculus
ttcccgccgcaccatacatagatga

SEQ ID NO: 291293 - DNA, 25 bp, Mus musculus
catagatgaagtttgtggcgactcc

SEQ ID NO: 291294 - DNA, 25 bp, Mus musculus
tgtggcgactccgattctcttttta

SEQ ID NO: 291295 - DNA, 25 bp, Mus musculus
aagcaactgagccagagggcgtttg

SEQ ID NO: 291296 - DNA, 25 bp, Mus musculus
cgttgccgttcgagagcactcgata

SEQ ID NO: 291297 - DNA, 25 bp, Mus musculus
tctctttttaaggatgtcggtgcca

SEQ ID NO: 291298 - DNA, 25 bp, Mus musculus
cagggctgtcattctgctggtctca

SEQ ID NO: 291299 - DNA, 25 bp, Mus musculus
ccggcgctcccagcaaaagtgacag

SEQ ID NO: 291300 - DNA, 25 bp, Mus musculus
ggctcccggcttgctccagagaact

SEQ ID NO: 291301 - DNA, 25 bp, Mus musculus
ccagagaactcgtacgtcacgcggg

SEQ ID NO: 291302 - DNA, 25 bp, Mus musculus
ttgactgacaactctctccgcgaca

SEQ ID NO: 291303 - DNA, 25 bp, Mus musculus
cgaggccgcttctaggatttgggaa

SEQ ID NO: 291304 - DNA, 25 bp, Mus musculus
ctcgcgcgtcacgtgcacctaaagg

SEQ ID NO: 291305 - DNA, 25 bp, Mus musculus
tggaactctgttcctgagcgaaccc

SEQ ID NO: 291306 - DNA, 25 bp, Mus musculus
gccttcaaaggcgtgtgggtccacg

SEQ ID NO: 291307 - DNA, 25 bp, Mus musculus
gcgacacatccaaagggcccgactg

SEQ ID NO: 291308 - DNA, 25 bp, Mus musculus
ttgcgcgcaaaaacgccgcgaccta

SEQ ID NO: 291309 - DNA, 25 bp, Mus musculus
gggacctacgctgggactctgctac

SEQ ID NO: 291310 - DNA, 25 bp, Mus musculus
cgcgacctagtcatcctctgctgga

SEQ ID NO: 291311 - DNA, 25 bp, Mus musculus
caggccagaccagcctcgagggtca

SEQ ID NO: 291312 - DNA, 25 bp, Mus musculus
cccaacaagcgctgcgaggttcgca

SEQ ID NO: 291313 - DNA, 25 bp, Mus musculus
cccgcgagtggaacaccgaggacgc

SEQ ID NO: 291314 - DNA, 25 bp, Mus musculus
gtgctgaggggcatccaggaaccct

SEQ ID NO: 291315 - DNA, 25 bp, Mus musculus
agccaggcccgctgttgctacgtct

SEQ ID NO: 291316 - DNA, 25 bp, Mus musculus
cagcagcagatccacgtgcagaagc

SEQ ID NO: 291317 - DNA, 25 bp, Mus musculus
cagcccatcactgaggcgggcagca

SEQ ID NO: 291318 - DNA, 25 bp, Mus musculus
ctcgtgtgtccctgctgcttctcgt

SEQ ID NO: 291319 - DNA, 25 bp, Mus musculus
acacaccagtggcagagctttgagc

SEQ ID NO: 291320 - DNA, 25 bp, Mus musculus
ttgagctagccaacgtgccggtctt

SEQ ID NO: 291321 - DNA, 25 bp, Mus musculus
tgccggtcttgcagcggctctacgt

SEQ ID NO: 291322 - DNA, 25 bp, Mus musculus
tacctctgtggggaggactgtacac

SEQ ID NO: 291323 - DNA, 25 bp, Mus musculus
gtgcttcagcgtcttggaggacgtc

SEQ ID NO: 291324 - DNA, 25 bp, Mus musculus
tgcgcacgactccagcaagtccgga

SEQ ID NO: 291325 - DNA, 25 bp, Mus musculus
tgtactggctcaagaggccgcatca

SEQ ID NO: 291326 - DNA, 25 bp, Mus musculus
gcggcaaaatcatccccacgaagtc

SEQ ID NO: 291327 - DNA, 25 bp, Mus musculus
cccgagtcgccagatgccgtggtgc

SEQ ID NO: 291328 - DNA, 25 bp, Mus musculus
catacatatggaacatcgttgctgc

SEQ ID NO: 291329 - DNA, 25 bp, Mus musculus
tttatttaaacatgtgtcagggccc

SEQ ID NO: 291330 - DNA, 25 bp, Mus musculus
aatcgctgatgtgcccacgccgagc

SEQ ID NO: 291331 - DNA, 25 bp, Mus musculus
ctgacaggcacacggcgccttgccc

SEQ ID NO: 291332 - DNA, 25 bp, Mus musculus
cggaatcgctgatgtgcccacgccg

SEQ ID NO: 291333 - DNA, 25 bp, Mus musculus
ccacaagcctgtgatgccagcacga

SEQ ID NO: 291334 - DNA, 25 bp, Mus musculus
tgtgatgccagcacgacccgcgcag

SEQ ID NO: 291335 - DNA, 25 bp, Mus musculus
agctgtcgctcgcagccatcagcgg

SEQ ID NO: 291336 - DNA, 25 bp, Mus musculus
gctcgcagccatcagcggcaaaatc

SEQ ID NO: 291337 - DNA, 25 bp, Mus musculus
cccacgaagtcatacatatggaaca

SEQ ID NO: 291338 - DNA, 25 bp, Mus musculus
tatggaacatcgttgctgcagaata

SEQ ID NO: 291339 - DNA, 25 bp, Mus musculus
tgcccacgccgagccctgacaggca

SEQ ID NO: 291340 - DNA, 25 bp, Mus musculus
ggcgagaaatttcaaaatcgaacaa

SEQ ID NO: 291341 - DNA, 25 bp, Mus musculus
ctctcagagagagttagcggccgag

SEQ ID NO: 291342 - DNA, 25 bp, Mus musculus
tcaccggcaagggattcctcgcagc

SEQ ID NO: 291343 - DNA, 25 bp, Mus musculus
tcgcagccctgccaaggaagcgttt

SEQ ID NO: 291344 - DNA, 25 bp, Mus musculus
aggaagcgtttcctggactctgcca

SEQ ID NO: 291345 - DNA, 25 bp, Mus musculus
cctggactctgccatcgcttaatga

SEQ ID NO: 291346 - DNA, 25 bp, Mus musculus
catcgcttaatgagcgcgcctcggc

SEQ ID NO: 291347 - DNA, 25 bp, Mus musculus
gccggcgtggattgaacggaccaat

SEQ ID NO: 291348 - DNA, 25 bp, Mus musculus
ctcacctcggaaggccggctggtct

SEQ ID NO: 291349 - DNA, 25 bp, Mus musculus
cagagacttggcagccggcgagaaa

SEQ ID NO: 291350 - DNA, 25 bp, Mus musculus
caactggatggatgacgccgttgga

SEQ ID NO: 291351 - DNA, 25 bp, Mus musculus
aatcgaacaaagctctcccaactgg

SEQ ID NO: 291352 - DNA, 25 bp, Mus musculus
agctctcccaactggatggatgacg

SEQ ID NO: 291353 - DNA, 25 bp, Mus musculus
gattgaacggaccaatgagcgcgga

SEQ ID NO: 291354 - DNA, 25 bp, Mus musculus
ccgcttgcacacagcagtattttta

SEQ ID NO: 291355 - DNA, 25 bp, Mus musculus
gggcctctcgccctgcctgtaatta

SEQ ID NO: 291356 - DNA, 25 bp, Mus musculus
cggagtcctgattgccgcagtccaa

SEQ ID NO: 291357 - DNA, 25 bp, Mus musculus
cccaaattatgatctgccgcttgca

SEQ ID NO: 291358 - DNA, 25 bp, Mus musculus
ttaaccttaactgtcggggctgagc

SEQ ID NO: 291359 - DNA, 25 bp, Mus musculus
gggctgagcttaaatttcctgtctg

SEQ ID NO: 291360 - DNA, 25 bp, Mus musculus
gacgttgaaccgaacctcgccgatg

SEQ ID NO: 291361 - DNA, 25 bp, Mus musculus
ctcgccgatgacagaccctgtaatt

SEQ ID NO: 291362 - DNA, 25 bp, Mus musculus
ccctgtaattagaaactgtagtgtc

SEQ ID NO: 291363 - DNA, 25 bp, Mus musculus
gagaccggtctttaaaactgtcaga

SEQ ID NO: 291364 - DNA, 25 bp, Mus musculus
actgtcagaagccaaacggcggtca

SEQ ID NO: 291365 - DNA, 25 bp, Mus musculus
acggcggtcatttgatacgaggcta

SEQ ID NO: 291366 - DNA, 25 bp, Mus musculus
ttaaacacggcagcgacccaaatta

SEQ ID NO: 291367 - DNA, 25 bp, Mus musculus
acgaggctatcattaccggagaaac

SEQ ID NO: 291368 - DNA, 25 bp, Mus musculus
aaagccgatttctccttggcaacca

SEQ ID NO: 291369 - DNA, 25 bp, Mus musculus
ctgttggaaacaggtctcttgaccc

SEQ ID NO: 291370 - DNA, 25 bp, Mus musculus
gaccctcgcccttgacattcaaatg

SEQ ID NO: 291371 - DNA, 25 bp, Mus musculus
gcgagattgctgttcgcacgtctta

SEQ ID NO: 291372 - DNA, 25 bp, Mus musculus
ccctcggtacttcttggctgtttgg

SEQ ID NO: 291373 - DNA, 25 bp, Mus musculus
gttctgaacgtgaaaccctgttgga

SEQ ID NO: 291374 - DNA, 25 bp, Mus musculus
tctcccattgacgaggcgaaatctg

SEQ ID NO: 291375 - DNA, 25 bp, Mus musculus
aagacttgtttgtcgccgctgcctc

SEQ ID NO: 291376 - DNA, 25 bp, Mus musculus
gcgtccctagcccaagacttgtttg

SEQ ID NO: 291377 - DNA, 25 bp, Mus musculus
ttggtcaattacctcactgtggatc

SEQ ID NO: 291378 - DNA, 25 bp, Mus musculus
ctggtttctacccacggtgctccgg

SEQ ID NO: 291379 - DNA, 25 bp, Mus musculus
aaaggcagcctttgatcatctcgga

SEQ ID NO: 291380 - DNA, 25 bp, Mus musculus
ggctccagcccttccttggtcaatt

SEQ ID NO: 291381 - DNA, 25 bp, Mus musculus
tttggacatttttgagcgccgtggc

SEQ ID NO: 291382 - DNA, 25 bp, Mus musculus
gaatgtcaaaggctcgcacggtttg

SEQ ID NO: 291383 - DNA, 25 bp, Mus musculus
tgccacctccgcgacctgcggctgc

SEQ ID NO: 291384 - DNA, 25 bp, Mus musculus
ccagttaattaaatccgctcggcta

SEQ ID NO: 291385 - DNA, 25 bp, Mus musculus
aatccgctcggctattgtcagaaga

SEQ ID NO: 291386 - DNA, 25 bp, Mus musculus
tcggctattgtcagaagagaaactc

SEQ ID NO: 291387 - DNA, 25 bp, Mus musculus
tcgggtgtttattgcgcctccagaa

SEQ ID NO: 291388 - DNA, 25 bp, Mus musculus
tgtttattgcgcctccagaatgtca

SEQ ID NO: 291389 - DNA, 25 bp, Mus musculus
tgcgcctccagaatgtcaaaggctc

SEQ ID NO: 291390 - DNA, 25 bp, Mus musculus
ctccagaatgtcaaaggctcgcacg

SEQ ID NO: 291391 - DNA, 25 bp, Mus musculus
aaggctcgcacggtttgaagacatg

SEQ ID NO: 291392 - DNA, 25 bp, Mus musculus
tggcagggaatagcccgagcatatg

SEQ ID NO: 291393 - DNA, 25 bp, Mus musculus
tcgcacggtttgaagacatgctggc

SEQ ID NO: 291394 - DNA, 25 bp, Mus musculus
ccgagcatatgtctacgaggccggg

SEQ ID NO: 291395 - DNA, 25 bp, Mus musculus
gaatagcccgagcatatgtctacga

SEQ ID NO: 291396 - DNA, 25 bp, Mus musculus
ttccaggggtgtatatatgtgttgc

SEQ ID NO: 291397 - DNA, 25 bp, Mus musculus
tgccctgtacgatcgaagcccgttg

SEQ ID NO: 291398 - DNA, 25 bp, Mus musculus
actgagcgacagaagccagcggcga

SEQ ID NO: 291399 - DNA, 25 bp, Mus musculus
caacggtggcaatgcagccagcgca

SEQ ID NO: 291400 - DNA, 25 bp, Mus musculus
cccggccactgaccgaggtaagagc

SEQ ID NO: 291401 - DNA, 25 bp, Mus musculus
ggcagaagagctccctccgttcctt

SEQ ID NO: 291402 - DNA, 25 bp, Mus musculus
tggtgaaccaccagatgaaatgctg

SEQ ID NO: 291403 - DNA, 25 bp, Mus musculus
cctgccatgtttcgggctacagcca

SEQ ID NO: 291404 - DNA, 25 bp, Mus musculus
tttgctccgggctaacgtctttcca

SEQ ID NO: 291405 - DNA, 25 bp, Mus musculus
taccgagaagggctactgtggcagc

SEQ ID NO: 291406 - DNA, 25 bp, Mus musculus
tctcggaaactttgaggagctcttg

SEQ ID NO: 291407 - DNA, 25 bp, Mus musculus
gcggagccacttttgcgcgcggcat

SEQ ID NO: 291408 - DNA, 25 bp, Mus musculus
cgggctacagccaccagggaacttt

SEQ ID NO: 291409 - DNA, 25 bp, Mus musculus
gccctgcccgggatcagataactgc

SEQ ID NO: 291410 - DNA, 25 bp, Mus musculus
caaaactttgggacagaggctcgtg

SEQ ID NO: 291411 - DNA, 25 bp, Mus musculus
gcagttcagacaaacccgggcgacg

SEQ ID NO: 291412 - DNA, 25 bp, Mus musculus
cccgggtgagataagcagttcagac

SEQ ID NO: 291413 - DNA, 25 bp, Mus musculus
acagcagcaggtgtttcttggccca

SEQ ID NO: 291414 - DNA, 25 bp, Mus musculus
tcctccctactcttggagatgagtg

SEQ ID NO: 291415 - DNA, 25 bp, Mus musculus
gcaggcgtgttgtaagccactcctc

SEQ ID NO: 291416 - DNA, 25 bp, Mus musculus
tgccaggcactgttccaggcgcttg

SEQ ID NO: 291417 - DNA, 25 bp, Mus musculus
tccactcagcacaaggaaaggccta

SEQ ID NO: 291418 - DNA, 25 bp, Mus musculus
ccaacggcctatattgtgtggtccc

SEQ ID NO: 291419 - DNA, 25 bp, Mus musculus
tggcccgagctcttaacattaagtc

SEQ ID NO: 291420 - DNA, 25 bp, Mus musculus
gcgagatggagactttgcaaaactt

SEQ ID NO: 291421 - DNA, 25 bp, Mus musculus
tgccgaggaatttcaggacgctccc

SEQ ID NO: 291422 - DNA, 25 bp, Mus musculus
atcttggagatcgagagaggccaac

SEQ ID NO: 291423 - DNA, 25 bp, Mus musculus
ggacttctcgaacatgggctcttta

SEQ ID NO: 291424 - DNA, 25 bp, Mus musculus
gcacaggctccgactggcagcgtgt

SEQ ID NO: 291425 - DNA, 25 bp, Mus musculus
tgccgaagccgcttgctcaacactt

SEQ ID NO: 291426 - DNA, 25 bp, Mus musculus
cgctgtgccgaagccgcttgctcaa

SEQ ID NO: 291427 - DNA, 25 bp, Mus musculus
cctcgatggggctcgctgtgccgaa

SEQ ID NO: 291428 - DNA, 25 bp, Mus musculus
agcctccctcgatggggctcgctgt

SEQ ID NO: 291429 - DNA, 25 bp, Mus musculus
agggttgctggcagcctccctcgat

SEQ ID NO: 291430 - DNA, 25 bp, Mus musculus
accggaacagggttgctggcagcct

SEQ ID NO: 291431 - DNA, 25 bp, Mus musculus
atctgctatgctgggtgtcacgccc

SEQ ID NO: 291432 - DNA, 25 bp, Mus musculus
tcatctgctatgctgggtgtcacgc

SEQ ID NO: 291433 - DNA, 25 bp, Mus musculus
cgtgtgtcatctgctatgctgggtg

SEQ ID NO: 291434 - DNA, 25 bp, Mus musculus
tggcagcgtgtgtcatctgctatgc

SEQ ID NO: 291435 - DNA, 25 bp, Mus musculus
gactggcagcgtgtgtcatctgcta

SEQ ID NO: 291436 - DNA, 25 bp, Mus musculus
gaagccgcttgctcaacacttctca

SEQ ID NO: 291437 - DNA, 25 bp, Mus musculus
ctccgactggcagcgtgtgtcatct

SEQ ID NO: 291438 - DNA, 25 bp, Mus musculus
tggccgcatcggtgtagcaaagaac

SEQ ID NO: 291439 - DNA, 25 bp, Mus musculus
gacatcgcagtttttcccagttttc

SEQ ID NO: 291440 - DNA, 25 bp, Mus musculus
catcgccacctcttgtcttttcaga

SEQ ID NO: 291441 - DNA, 25 bp, Mus musculus
cgagtgtctgtcagtctacgcggtc

SEQ ID NO: 291442 - DNA, 25 bp, Mus musculus
acgcggtcgtgtgtcgttcaccgaa

SEQ ID NO: 291443 - DNA, 25 bp, Mus musculus
tcgttcaccgaagcactctgtggta

SEQ ID NO: 291444 - DNA, 25 bp, Mus musculus
ggtagtgcctcggtgaatcagattc

SEQ ID NO: 291445 - DNA, 25 bp, Mus musculus
attcggcgaattaaggatgcttttc

SEQ ID NO: 291446 - DNA, 25 bp, Mus musculus
ggatgcttttcctgcctgcgccact

SEQ ID NO: 291447 - DNA, 25 bp, Mus musculus
ctgcctcctaagaggatgacacatc

SEQ ID NO: 291448 - DNA, 25 bp, Mus musculus
tgcgccactgacatcgcagtttttc

SEQ ID NO: 291449 - DNA, 25 bp, Mus musculus
tagcaaagaacacgctgcatggttt

SEQ ID NO: 291450 - DNA, 25 bp, Mus musculus
catggtttgaagacacgctgcctcc

SEQ ID NO: 291451 - DNA, 25 bp, Mus musculus
ttttcagagcaaaacctggagcggc

SEQ ID NO: 291452 - DNA, 25 bp, Mus musculus
cgggatgatagtcaccaactccttt

SEQ ID NO: 291453 - DNA, 25 bp, Mus musculus
acctcggccgcatccatgttgaaga

SEQ ID NO: 291454 - DNA, 25 bp, Mus musculus
gtccagactgaagttcgggatgata

SEQ ID NO: 291455 - DNA, 25 bp, Mus musculus
tttttcattggtctccgggtctgcc

SEQ ID NO: 291456 - DNA, 25 bp, Mus musculus
ctgatccagcgagttacagccctga

SEQ ID NO: 291457 - DNA, 25 bp, Mus musculus
gggctccacgcttcctgaatcctga

SEQ ID NO: 291458 - DNA, 25 bp, Mus musculus
aggcctaccgatgccctttccagta

SEQ ID NO: 291459 - DNA, 25 bp, Mus musculus
caaactcgcggattggtctgtaggc

SEQ ID NO: 291460 - DNA, 25 bp, Mus musculus
cgcagcctccaagtcacagctagta

SEQ ID NO: 291461 - DNA, 25 bp, Mus musculus
gcggccctatagagacgttgctctc

SEQ ID NO: 291462 - DNA, 25 bp, Mus musculus
cctcgaacggaagacgtcctgcggc

SEQ ID NO: 291463 - DNA, 25 bp, Mus musculus
aggcagcgcctcaggcacttctttc

SEQ ID NO: 291464 - DNA, 25 bp, Mus musculus
cccgatcaggtagatcttgtccaga

SEQ ID NO: 291465 - DNA, 25 bp, Mus musculus
tccatgttgaagagtaggcggccca

SEQ ID NO: 291466 - DNA, 25 bp, Mus musculus
cggcaccgggcaaagtttgggcatc

SEQ ID NO: 291467 - DNA, 25 bp, Mus musculus
tcgccctttgcggtcgcgaagctgc

SEQ ID NO: 291468 - DNA, 25 bp, Mus musculus
gcggtcgcgaagctgctttgatgta

SEQ ID NO: 291469 - DNA, 25 bp, Mus musculus
agctgctttgatgtactgggcgccc

SEQ ID NO: 291470 - DNA, 25 bp, Mus musculus
ccctaagcgaggcagctcatcaata

SEQ ID NO: 291471 - DNA, 25 bp, Mus musculus
gaggcagctcatcaataatacattg

SEQ ID NO: 291472 - DNA, 25 bp, Mus musculus
taatacattggaaacacttggtgga

SEQ ID NO: 291473 - DNA, 25 bp, Mus musculus
ccgatgtcagacacgcggccagagg

SEQ ID NO: 291474 - DNA, 25 bp, Mus musculus
aggccgagctgatcagcgaagtctg

SEQ ID NO: 291475 - DNA, 25 bp, Mus musculus
tgatcagcgaagtctgcaggaagtt

SEQ ID NO: 291476 - DNA, 25 bp, Mus musculus
ggacaccaggcgacgcgcttgcagc

SEQ ID NO: 291477 - DNA, 25 bp, Mus musculus
caaagtttgggcatcggccggctgt

SEQ ID NO: 291478 - DNA, 25 bp, Mus musculus
tccgcctcctgtgcagagacgcaga

SEQ ID NO: 291479 - DNA, 25 bp, Mus musculus
ggtcccagatctccacgatcctggg

SEQ ID NO: 291480 - DNA, 25 bp, Mus musculus
cgtggagcaccatcttgcagtaggc

SEQ ID NO: 291481 - DNA, 25 bp, Mus musculus
accgcgagcttaccagggtgagcgc

SEQ ID NO: 291482 - DNA, 25 bp, Mus musculus
caccaggagcccgttgacggcgcag

SEQ ID NO: 291483 - DNA, 25 bp, Mus musculus
cagtaggcctgcgtagtcagcttca

SEQ ID NO: 291484 - DNA, 25 bp, Mus musculus
tagtcagcttcacgccgggcatcgc

SEQ ID NO: 291485 - DNA, 25 bp, Mus musculus
cggaaaacgtctgccggaaagcagc

SEQ ID NO: 291486 - DNA, 25 bp, Mus musculus
cccgcgctctgaaacggacgggctt

SEQ ID NO: 291487 - DNA, 25 bp, Mus musculus
gggcttccctgattcccgcgatgct

SEQ ID NO: 291488 - DNA, 25 bp, Mus musculus
atgcttcgcggctccgtcttggtct

SEQ ID NO: 291489 - DNA, 25 bp, Mus musculus
gacagcgacctgagccctgacgtca

SEQ ID NO: 291490 - DNA, 25 bp, Mus musculus
cctgacgtcacgctacggtttctgc

SEQ ID NO: 291491 - DNA, 25 bp, Mus musculus
tcggacgttctttctcggggatcga

SEQ ID NO: 291492 - DNA, 25 bp, Mus musculus
cgaatctcaggggttgtgctacagt

SEQ ID NO: 291493 - DNA, 25 bp, Mus musculus
atgcagtccacgaagagcgtgtggc

SEQ ID NO: 291494 - DNA, 25 bp, Mus musculus
attagctcgcgcgaccgtcgctctg

SEQ ID NO: 291495 - DNA, 25 bp, Mus musculus
tcgcccaaacggagtgcacagcacg

SEQ ID NO: 291496 - DNA, 25 bp, Mus musculus
accttcgcccaaacggagtgcacag

SEQ ID NO: 291497 - DNA, 25 bp, Mus musculus
tataaaagcaggcgcgcgcgtacgg

SEQ ID NO: 291498 - DNA, 25 bp, Mus musculus
cgcttcagagaaggcggatttggca

SEQ ID NO: 291499 - DNA, 25 bp, Mus musculus
ctcggaaagagagcgcttcagagaa

SEQ ID NO: 291500 - DNA, 25 bp, Mus musculus
tgatttctcggaaagagagcgcttc

SEQ ID NO: 291501 - DNA, 25 bp, Mus musculus
ggacgtgcaaaagtgatttctcgga

SEQ ID NO: 291502 - DNA, 25 bp, Mus musculus
tcggggacgtgcaaaagtgatttct

SEQ ID NO: 291503 - DNA, 25 bp, Mus musculus
ggatgatccgtgcatcaccagcctc

SEQ ID NO: 291504 - DNA, 25 bp, Mus musculus
cccgaggatgatccgtgcatcacca

SEQ ID NO: 291505 - DNA, 25 bp, Mus musculus
gggacagaggctctccaaacctgaa

SEQ ID NO: 291506 - DNA, 25 bp, Mus musculus
tgcccgggacagaggctctccaaac

SEQ ID NO: 291507 - DNA, 25 bp, Mus musculus
ggctgtggctctcccaccttcgccc

SEQ ID NO: 291508 - DNA, 25 bp, Mus musculus
ctccagccgcacggtggacagcgga

SEQ ID NO: 291509 - DNA, 25 bp, Mus musculus
accgcttcgtgtggaccagcggcct

SEQ ID NO: 291510 - DNA, 25 bp, Mus musculus
ccagcggcctcctggagatcaacga

SEQ ID NO: 291511 - DNA, 25 bp, Mus musculus
cctcctggagatcaacgagaccctg

SEQ ID NO: 291512 - DNA, 25 bp, Mus musculus
ctggagatcaacgagaccctggtta

SEQ ID NO: 291513 - DNA, 25 bp, Mus musculus
tgatgatttgttctgggctgagccg

SEQ ID NO: 291514 - DNA, 25 bp, Mus musculus
ccggtgatgatttgttctgggctga

SEQ ID NO: 291515 - DNA, 25 bp, Mus musculus
cctgctggaccggtgatgatttgtt

SEQ ID NO: 291516 - DNA, 25 bp, Mus musculus
tcgcagcccgggacggtacagttcc

SEQ ID NO: 291517 - DNA, 25 bp, Mus musculus
ccatggaccgcttcgtgtggaccag

SEQ ID NO: 291518 - DNA, 25 bp, Mus musculus
tgcgcgtctacgacggcgaggagaa

SEQ ID NO: 291519 - DNA, 25 bp, Mus musculus
tcaacgagaccctggttatccagca

SEQ ID NO: 291520 - DNA, 25 bp, Mus musculus
ggacggtacagttccgccttgtggc

SEQ ID NO: 291521 - DNA, 25 bp, Mus musculus
cgacccgcggccctcgtgctgggca

SEQ ID NO: 291522 - DNA, 25 bp, Mus musculus
cgcacgttgtcagctcaaattcctg

SEQ ID NO: 291523 - DNA, 25 bp, Mus musculus
tgcggcacagaccagggtgcccgcc

SEQ ID NO: 291524 - DNA, 25 bp, Mus musculus
aggacgctccctgccctgcggcaca

SEQ ID NO: 291525 - DNA, 25 bp, Mus musculus
ctacctgcccgccaggacgctccct

SEQ ID NO: 291526 - DNA, 25 bp, Mus musculus
cggggctagcggacttctctctacc

SEQ ID NO: 291527 - DNA, 25 bp, Mus musculus
acacccggggctagcggacttctct

SEQ ID NO: 291528 - DNA, 25 bp, Mus musculus
gcttgctgataacacccggggctag

SEQ ID NO: 291529 - DNA, 25 bp, Mus musculus
ttaagccgcttgctgataacacccg

SEQ ID NO: 291530 - DNA, 25 bp, Mus musculus
gcccgccggcttctgtccaggcggc

SEQ ID NO: 291531 - DNA, 25 bp, Mus musculus
cggtgcgcacgttgtcagctcaaat

SEQ ID NO: 291532 - DNA, 25 bp, Mus musculus
ctcaaattcctgattaagccgcttg

SEQ ID NO: 291533 - DNA, 25 bp, Mus musculus
ctcccaccgtcaaccggctggcgga

SEQ ID NO: 291534 - DNA, 25 bp, Mus musculus
cgcacctcgggcagctttgaagtct

SEQ ID NO: 291535 - DNA, 25 bp, Mus musculus
gcagctttgaagtctgggactccag

SEQ ID NO: 291536 - DNA, 25 bp, Mus musculus
ggtcggcccttgctaacctgcagca

SEQ ID NO: 291537 - DNA, 25 bp, Mus musculus
cgcgctccctctggatgtcggggat

SEQ ID NO: 291538 - DNA, 25 bp, Mus musculus
cttaagcaattaaccagcgcagata

SEQ ID NO: 291539 - DNA, 25 bp, Mus musculus
ctcgcgtggggtcggcccttgctaa

SEQ ID NO: 291540 - DNA, 25 bp, Mus musculus
taaccagcgcagatacctggggccc

SEQ ID NO: 291541 - DNA, 25 bp, Mus musculus
tcggcccttgctaacctgcagcagg

SEQ ID NO: 291542 - DNA, 25 bp, Mus musculus
ttgctaacctgcagcagggcggccg

SEQ ID NO: 291543 - DNA, 25 bp, Mus musculus
gacggccgaagcaggatctggttcc

SEQ ID NO: 291544 - DNA, 25 bp, Mus musculus
caggatctggttccgcgctcgggtt

SEQ ID NO: 291545 - DNA, 25 bp, Mus musculus
tctggttccgcgctcgggtttcgcc

SEQ ID NO: 291546 - DNA, 25 bp, Mus musculus
cggccggcggcttcacttaagcaat

SEQ ID NO: 291547 - DNA, 25 bp, Mus musculus
gccggcggcttcacttaagcaatta

SEQ ID NO: 291548 - DNA, 25 bp, Mus musculus
ggcggcttcacttaagcaattaacc

SEQ ID NO: 291549 - DNA, 25 bp, Mus musculus
tccctctggatgtcggggatgcgca

SEQ ID NO: 291550 - DNA, 25 bp, Mus musculus
ttaccacgtgtgtggacatccgctg

SEQ ID NO: 291551 - DNA, 25 bp, Mus musculus
acctggctgacatgtttaccacgtg

SEQ ID NO: 291552 - DNA, 25 bp, Mus musculus
gagaagtcacaacgctacctggctg

SEQ ID NO: 291553 - DNA, 25 bp, Mus musculus
tcgccaacatggacgagaagtcaca

SEQ ID NO: 291554 - DNA, 25 bp, Mus musculus
acggtcagtgcaacattgaattcgc

SEQ ID NO: 291555 - DNA, 25 bp, Mus musculus
caatggcaaggtgcatacacggcgc

SEQ ID NO: 291556 - DNA, 25 bp, Mus musculus
cttcgtcaagaagaacggtcagtgc

SEQ ID NO: 291557 - DNA, 25 bp, Mus musculus
gcgccaacggttttggcaatggcaa

SEQ ID NO: 291558 - DNA, 25 bp, Mus musculus
gatgaccgcagccagtcgggccaac

SEQ ID NO: 291559 - DNA, 25 bp, Mus musculus
ccctacagcatcgtatcatcagagg

SEQ ID NO: 291560 - DNA, 25 bp, Mus musculus
tatcatcagaggaggacgggctgca

SEQ ID NO: 291561 - DNA, 25 bp, Mus musculus
acgggctgcacctggttaccatgtc

SEQ ID NO: 291562 - DNA, 25 bp, Mus musculus
tgcaacattgaattcgccaacatgg

SEQ ID NO: 291563 - DNA, 25 bp, Mus musculus
tggttaccatgtcaggcgccaacgg

SEQ ID NO: 291564 - DNA, 25 bp, Mus musculus
gcctgcgcgtctaagttggtgatta

SEQ ID NO: 291565 - DNA, 25 bp, Mus musculus
gctccgggcgcgtgttaatgcacgc

SEQ ID NO: 291566 - DNA, 25 bp, Mus musculus
cgcgtgtgcgcgctttcatgaatga

SEQ ID NO: 291567 - DNA, 25 bp, Mus musculus
tttcatgaatgagtgcacgaagccg

SEQ ID NO: 291568 - DNA, 25 bp, Mus musculus
cacgaagccgcctgctagggaacct

SEQ ID NO: 291569 - DNA, 25 bp, Mus musculus
tcgtggcactgcacgacctgaagcc

SEQ ID NO: 291570 - DNA, 25 bp, Mus musculus
gtcccgcttgcagcgcttggagaca

SEQ ID NO: 291571 - DNA, 25 bp, Mus musculus
cttggagacaaagcgcccgctaagc

SEQ ID NO: 291572 - DNA, 25 bp, Mus musculus
cgctaagccgcctgcggtttcgttt

SEQ ID NO: 291573 - DNA, 25 bp, Mus musculus
ggccgggaacccaatcgctctctct

SEQ ID NO: 291574 - DNA, 25 bp, Mus musculus
agttggtgattagaggattcgcttg

SEQ ID NO: 291575 - DNA, 25 bp, Mus musculus
ttgagcccactgaatagctacgggg

SEQ ID NO: 291576 - DNA, 25 bp, Mus musculus
ggggcttgagcccactgaatagcta

SEQ ID NO: 291577 - DNA, 25 bp, Mus musculus
cagcccggtcatccgggcctaggag

SEQ ID NO: 291578 - DNA, 25 bp, Mus musculus
cctgtgcggatttcagtgggatttc

SEQ ID NO: 291579 - DNA, 25 bp, Mus musculus
atcccgggatcgaatccgtgtcctg

SEQ ID NO: 291580 - DNA, 25 bp, Mus musculus
agctcactaccaggctcctgtgcgg

SEQ ID NO: 291581 - DNA, 25 bp, Mus musculus
tagaagggccgattccatggaaaga

SEQ ID NO: 291582 - DNA, 25 bp, Mus musculus
ctatggctcctgatcccgggatcga

SEQ ID NO: 291583 - DNA, 25 bp, Mus musculus
ggatttcccagctcccgacatcagg

SEQ ID NO: 291584 - DNA, 25 bp, Mus musculus
tttctccagggtccattttggctta

SEQ ID NO: 291585 - DNA, 25 bp, Mus musculus
ttccatggaaagatcgctagcagcg

SEQ ID NO: 291586 - DNA, 25 bp, Mus musculus
ccattttggcttagggtcgcgcatg

SEQ ID NO: 291587 - DNA, 25 bp, Mus musculus
caggcaagcctagaagggccgattc

SEQ ID NO: 291588 - DNA, 25 bp, Mus musculus
ggctgggctccaggcaagcctagaa

SEQ ID NO: 291589 - DNA, 25 bp, Mus musculus
ctctcgcctgatctgtcgccggagg

SEQ ID NO: 291590 - DNA, 25 bp, Mus musculus
ctcccgacatcagggccagctgggt

SEQ ID NO: 291591 - DNA, 25 bp, Mus musculus
atcgctagcagcgtcccgaggtctc

SEQ ID NO: 291592 - DNA, 25 bp, Mus musculus
cacgcatgcggaccacgggaacaac

SEQ ID NO: 291593 - DNA, 25 bp, Mus musculus
tgtccagccaagcaaggcgaggatg

SEQ ID NO: 291594 - DNA, 25 bp, Mus musculus
cacgcacacaacacgcatacattta

SEQ ID NO: 291595 - DNA, 25 bp, Mus musculus
ctgggtctccatggctaacacgtca

SEQ ID NO: 291596 - DNA, 25 bp, Mus musculus
ccggtgcacttgtcgagaacgcttt

SEQ ID NO: 291597 - DNA, 25 bp, Mus musculus
gcttcgtgctgcacctgcgcactga

SEQ ID NO: 291598 - DNA, 25 bp, Mus musculus
ttggggttccctgcagtagtagcac

SEQ ID NO: 291599 - DNA, 25 bp, Mus musculus
agcaccgacgcattagaggaccaga

SEQ ID NO: 291600 - DNA, 25 bp, Mus musculus
tgcccaggatttcccgagacacaca

SEQ ID NO: 291601 - DNA, 25 bp, Mus musculus
cttgcaacgcggatgcccaggattt

SEQ ID NO: 291602 - DNA, 25 bp, Mus musculus
ggaccagaggtcaccgctggaactg

SEQ ID NO: 291603 - DNA, 25 bp, Mus musculus
actgaagctagtgacccgcaaggtt

SEQ ID NO: 291604 - DNA, 25 bp, Mus musculus
agcctggctggctaaaacctgtcca

SEQ ID NO: 291605 - DNA, 25 bp, Mus musculus
ctggaactgccttgcaacgcggatg

SEQ ID NO: 291606 - DNA, 25 bp, Mus musculus
cggcgcccaaggacctggtgaagcc

SEQ ID NO: 291607 - DNA, 25 bp, Mus musculus
ccctacagctatatagcgctcatca

SEQ ID NO: 291608 - DNA, 25 bp, Mus musculus
catcaccatggcgatccagaacgcg

SEQ ID NO: 291609 - DNA, 25 bp, Mus musculus
ccagaacgcgccagagaagaagatc

SEQ ID NO: 291610 - DNA, 25 bp, Mus musculus
agtgcttcgtgaaagtgccgcgcga

SEQ ID NO: 291611 - DNA, 25 bp, Mus musculus
caagaagaaggatgtgcccaaggac

SEQ ID NO: 291612 - DNA, 25 bp, Mus musculus
ccggcttcagcgtggagaccatcat

SEQ ID NO: 291613 - DNA, 25 bp, Mus musculus
gctgccggtcatcaccaaggtggag

SEQ ID NO: 291614 - DNA, 25 bp, Mus musculus
tggtgccaccgctggcactgccata

SEQ ID NO: 291615 - DNA, 25 bp, Mus musculus
ggctaccagtgcagtatgcgggcta

SEQ ID NO: 291616 - DNA, 25 bp, Mus musculus
tatgcgggctatgagtctgtacacc

SEQ ID NO: 291617 - DNA, 25 bp, Mus musculus
acgaggctctgtcggaccacccgag

SEQ ID NO: 291618 - DNA, 25 bp, Mus musculus
cccaaggaggccgagaagaaagtcg

SEQ ID NO: 291619 - DNA, 25 bp, Mus musculus
gagaccatcatgacgctgcgcacgt

SEQ ID NO: 291620 - DNA, 25 bp, Mus musculus
cgcaaccagcccacgactaaagtgg

SEQ ID NO: 291621 - DNA, 25 bp, Mus musculus
cagatttgccttagggtttggaaga

SEQ ID NO: 291622 - DNA, 25 bp, Mus musculus
gttgagactcgagctcagatttgcc

SEQ ID NO: 291623 - DNA, 25 bp, Mus musculus
ccacgactaaagtgggcggtgctta

SEQ ID NO: 291624 - DNA, 25 bp, Mus musculus
ggtgcaagtccgctggaagtttcta

SEQ ID NO: 291625 - DNA, 25 bp, Mus musculus
tgctcctccaagctgctggtgcaag

SEQ ID NO: 291626 - DNA, 25 bp, Mus musculus
tcagactgcgcccagaacgggaccg

SEQ ID NO: 291627 - DNA, 25 bp, Mus musculus
caggcttcagactgcgcccagaacg

SEQ ID NO: 291628 - DNA, 25 bp, Mus musculus
ctcgttgtcatctgagagcccaggc

SEQ ID NO: 291629 - DNA, 25 bp, Mus musculus
ctaagtaaggctcgttgtcatctga

SEQ ID NO: 291630 - DNA, 25 bp, Mus musculus
ggccctctagggctaagtaaggctc

SEQ ID NO: 291631 - DNA, 25 bp, Mus musculus
aaggctggactgtgcctctgcgcaa

SEQ ID NO: 291632 - DNA, 25 bp, Mus musculus
gcgcatccgctcctagactcaggga

SEQ ID NO: 291633 - DNA, 25 bp, Mus musculus
ggcggtgcttattgttgagactcga

SEQ ID NO: 291634 - DNA, 25 bp, Mus musculus
agcaccggggatccctaagcccgtg

SEQ ID NO: 291635 - DNA, 25 bp, Mus musculus
cagtgagccaatgcctgtgggcgaa

SEQ ID NO: 291636 - DNA, 25 bp, Mus musculus
actaaggcggattagcggctgcttc

SEQ ID NO: 291637 - DNA, 25 bp, Mus musculus
ccgaggccacagtgcttcgtttcca

SEQ ID NO: 291638 - DNA, 25 bp, Mus musculus
tttcctctgcaggttcccgaggcca

SEQ ID NO: 291639 - DNA, 25 bp, Mus musculus
ttcaacgcttcgctggtcttcgacg

SEQ ID NO: 291640 - DNA, 25 bp, Mus musculus
ggttccaagtcaaagagtttcagca

SEQ ID NO: 291641 - DNA, 25 bp, Mus musculus
aacggcaattatcggcgcaggaaga

SEQ ID NO: 291642 - DNA, 25 bp, Mus musculus
cccgctgcttggacatgtttgagaa

SEQ ID NO: 291643 - DNA, 25 bp, Mus musculus
catcatggatcgcttcccgttctac

SEQ ID NO: 291644 - DNA, 25 bp, Mus musculus
gctcccgagcagagggtcacactga

SEQ ID NO: 291645 - DNA, 25 bp, Mus musculus
cgctcttatagccatggcgatccag

SEQ ID NO: 291646 - DNA, 25 bp, Mus musculus
tcgacagcatcttggccgtgagacc

SEQ ID NO: 291647 - DNA, 25 bp, Mus musculus
gcggcttttcccagctggggattcc

SEQ ID NO: 291648 - DNA, 25 bp, Mus musculus
cgagctccctggagccaggccgaga

SEQ ID NO: 291649 - DNA, 25 bp, Mus musculus
gctggaacgcagactggaaaatgaa

SEQ ID NO: 291650 - DNA, 25 bp, Mus musculus
ctcccgagagggaagctggaacgca

SEQ ID NO: 291651 - DNA, 25 bp, Mus musculus
tgccagaaggtcgaggctcccgaga

SEQ ID NO: 291652 - DNA, 25 bp, Mus musculus
ttcactgccagaaggtcgaggctcc

SEQ ID NO: 291653 - DNA, 25 bp, Mus musculus
acatcaccggttcactgccagaagg

SEQ ID NO: 291654 - DNA, 25 bp, Mus musculus
gagccaggccgagacgtccacatca

SEQ ID NO: 291655 - DNA, 25 bp, Mus musculus
catccacgagatggcgagctccctg

SEQ ID NO: 291656 - DNA, 25 bp, Mus musculus
ggtcagtggccacgcctggccctgt

SEQ ID NO: 291657 - DNA, 25 bp, Mus musculus
ttcacagggttcatgggtcagtggc

SEQ ID NO: 291658 - DNA, 25 bp, Mus musculus
ccggccacgtatgttcacagggttc

SEQ ID NO: 291659 - DNA, 25 bp, Mus musculus
ggcccggccacgtatgttcacaggg

SEQ ID NO: 291660 - DNA, 25 bp, Mus musculus
agtcgccccttaatgaggagccgga

SEQ ID NO: 291661 - DNA, 25 bp, Mus musculus
agacgtccacatcaccggttcactg

SEQ ID NO: 291662 - DNA, 25 bp, Mus musculus
acccacaggaagcacaaacggctgc

SEQ ID NO: 291663 - DNA, 25 bp, Mus musculus
tttcggaggttctccacgtccggca

SEQ ID NO: 291664 - DNA, 25 bp, Mus musculus
atcctggagagctcgttgaagtttc

SEQ ID NO: 291665 - DNA, 25 bp, Mus musculus
cggacctccaggacaatcctggaga

SEQ ID NO: 291666 - DNA, 25 bp, Mus musculus
catcagcggccttggctgaaggctc

SEQ ID NO: 291667 - DNA, 25 bp, Mus musculus
gccgtccttagcaggtggcccatca

SEQ ID NO: 291668 - DNA, 25 bp, Mus musculus
gaggccgactgctcagctgcctcgg

SEQ ID NO: 291669 - DNA, 25 bp, Mus musculus
ctcgagctgacacccacaggaagca

SEQ ID NO: 291670 - DNA, 25 bp, Mus musculus
gggtaatcctcgttcctcgagctga

SEQ ID NO: 291671 - DNA, 25 bp, Mus musculus
cggtccttaccataggcggcaagtg

SEQ ID NO: 291672 - DNA, 25 bp, Mus musculus
agagctgggcccacggtccttacca

SEQ ID NO: 291673 - DNA, 25 bp, Mus musculus
tcgttgaagtttcggaggttctcca

SEQ ID NO: 291674 - DNA, 25 bp, Mus musculus
ggctctttgccgtccttagcaggtg

SEQ ID NO: 291675 - DNA, 25 bp, Mus musculus
cggcgctgcaggtcaatctctacag

SEQ ID NO: 291676 - DNA, 25 bp, Mus musculus
ggggcggacctcttgcgcttgaccc

SEQ ID NO: 291677 - DNA, 25 bp, Mus musculus
gcacctggcgcaggcgtggccgaat

SEQ ID NO: 291678 - DNA, 25 bp, Mus musculus
aagctcaggtggcccaccaccaggg

SEQ ID NO: 291679 - DNA, 25 bp, Mus musculus
cgaggtaaggatccgaagctcaggt

SEQ ID NO: 291680 - DNA, 25 bp, Mus musculus
acccgaggtaaggatccgaagctca

SEQ ID NO: 291681 - DNA, 25 bp, Mus musculus
cgacccgaggtaaggatccgaagct

SEQ ID NO: 291682 - DNA, 25 bp, Mus musculus
cagacagacccgacccgaggtaagg

SEQ ID NO: 291683 - DNA, 25 bp, Mus musculus
gtgccagacagacccgacccgaggt

SEQ ID NO: 291684 - DNA, 25 bp, Mus musculus
cacttccgccgtgccagacagaccc

SEQ ID NO: 291685 - DNA, 25 bp, Mus musculus
cagtcaccctgtggccgctgaggct

SEQ ID NO: 291686 - DNA, 25 bp, Mus musculus
cggtcagtcaccctgtggccgctga

SEQ ID NO: 291687 - DNA, 25 bp, Mus musculus
agatgctcggtcagtcaccctgtgg

SEQ ID NO: 291688 - DNA, 25 bp, Mus musculus
acgggagatgctcggtcagtcaccc

SEQ ID NO: 291689 - DNA, 25 bp, Mus musculus
cccgccctctgagagcccgcctcgg

SEQ ID NO: 291690 - DNA, 25 bp, Mus musculus
ccacgagcagctcaggcgggagctc

SEQ ID NO: 291691 - DNA, 25 bp, Mus musculus
agcgccgtctccagatggtgtccgt

SEQ ID NO: 291692 - DNA, 25 bp, Mus musculus
tctccagatggtgtccgtgtgcaag

SEQ ID NO: 291693 - DNA, 25 bp, Mus musculus
ccgtgtgcaagattcggcggaacct

SEQ ID NO: 291694 - DNA, 25 bp, Mus musculus
ggcggaacctgctgcagacctgagc

SEQ ID NO: 291695 - DNA, 25 bp, Mus musculus
gacgcgaagatctccacgagcagct

SEQ ID NO: 291696 - DNA, 25 bp, Mus musculus
agctccagcagagagcaacgcgccg

SEQ ID NO: 291697 - DNA, 25 bp, Mus musculus
ggccaggcagccgtagtcccgcttg

SEQ ID NO: 291698 - DNA, 25 bp, Mus musculus
tagtcccgcttgcaggctcctcaag

SEQ ID NO: 291699 - DNA, 25 bp, Mus musculus
cctacgtgttaggtccacgcccttg

SEQ ID NO: 291700 - DNA, 25 bp, Mus musculus
gtccacgcccttgtatggagccaca

SEQ ID NO: 291701 - DNA, 25 bp, Mus musculus
cttgtatggagccacaccctatttc

SEQ ID NO: 291702 - DNA, 25 bp, Mus musculus
tggagccacaccctatttccaggct

SEQ ID NO: 291703 - DNA, 25 bp, Mus musculus
ggcagcgacgcgaagatctccacga

SEQ ID NO: 291704 - DNA, 25 bp, Mus musculus
ttcccgcactggacatggtaagcgc

SEQ ID NO: 291705 - DNA, 25 bp, Mus musculus
tctggtggaccctgagaggagacca

SEQ ID NO: 291706 - DNA, 25 bp, Mus musculus
catccagccgggctagagtcgcctg

SEQ ID NO: 291707 - DNA, 25 bp, Mus musculus
cagcgccatccagccgggctagagt

SEQ ID NO: 291708 - DNA, 25 bp, Mus musculus
tgcagcgccatccagccgggctaga

SEQ ID NO: 291709 - DNA, 25 bp, Mus musculus
gagagacgactagggctccgatgct

SEQ ID NO: 291710 - DNA, 25 bp, Mus musculus
ccctgagaggagaccaggaagtggg

SEQ ID NO: 291711 - DNA, 25 bp, Mus musculus
acatggtaagcgcaggaagtctggt

SEQ ID NO: 291712 - DNA, 25 bp, Mus musculus
cgcactggacatggtaagcgcagga

SEQ ID NO: 291713 - DNA, 25 bp, Mus musculus
ctagagtcgcctggcctcccttggg

SEQ ID NO: 291714 - DNA, 25 bp, Mus musculus
cctgcttcccgcactggacatggta

SEQ ID NO: 291715 - DNA, 25 bp, Mus musculus
gctgctctctccctcgctgccgcca

SEQ ID NO: 291716 - DNA, 25 bp, Mus musculus
ggtggcctgctgcttgcccgctgct

SEQ ID NO: 291717 - DNA, 25 bp, Mus musculus
ctggacatggtaagcgcaggaagtc

SEQ ID NO: 291718 - DNA, 25 bp, Mus musculus
ttctgcttcccggagcgcagttctc

SEQ ID NO: 291719 - DNA, 25 bp, Mus musculus
ggggacgctcgtccggcaacttgac

SEQ ID NO: 291720 - DNA, 25 bp, Mus musculus
gcgcgcatccactggggacgctcgt

SEQ ID NO: 291721 - DNA, 25 bp, Mus musculus
gcagccctgtatgcgtgcaacagta

SEQ ID NO: 291722 - DNA, 25 bp, Mus musculus
gatacacggcttcgcgggcactgcc

SEQ ID NO: 291723 - DNA, 25 bp, Mus musculus
gagcgcagttctcccactcaggaga

SEQ ID NO: 291724 - DNA, 25 bp, Mus musculus
gaaaacctgttcaggggcgctcaga

SEQ ID NO: 291725 - DNA, 25 bp, Mus musculus
gccgcgttcgctcgggatacacggc

SEQ ID NO: 291726 - DNA, 25 bp, Mus musculus
gagcccggccgtgaaaacctgttca

SEQ ID NO: 291727 - DNA, 25 bp, Mus musculus
aaacgtgtagcttctgcttcccgga

SEQ ID NO: 291728 - DNA, 25 bp, Mus musculus
tgtagaagcgctgggctcctggacc

SEQ ID NO: 291729 - DNA, 25 bp, Mus musculus
accaggcagtcctcggtgtccacag

SEQ ID NO: 291730 - DNA, 25 bp, Mus musculus
cttgcgacgaggtgaccgcgtcacc

SEQ ID NO: 291731 - DNA, 25 bp, Mus musculus
ccagcctgtggaaacgtgtagcttc

SEQ ID NO: 291732 - DNA, 25 bp, Mus musculus
gctcagatctgctctgcggccggaa

SEQ ID NO: 291733 - DNA, 25 bp, Mus musculus
ggatgcaaccgaggcgcaaccacgt

SEQ ID NO: 291734 - DNA, 25 bp, Mus musculus
tgtatgtcccggacgacgccgaagc

SEQ ID NO: 291735 - DNA, 25 bp, Mus musculus
cgtccctacgggacaagatgccctg

SEQ ID NO: 291736 - DNA, 25 bp, Mus musculus
cctcgacgatcttgagcaattcttg

SEQ ID NO: 291737 - DNA, 25 bp, Mus musculus
agcaattcttgtttacttgttcaga

SEQ ID NO: 291738 - DNA, 25 bp, Mus musculus
cttgttcagaagagcaggtgacgcg

SEQ ID NO: 291739 - DNA, 25 bp, Mus musculus
cgattgactgcatcgctggccaata

SEQ ID NO: 291740 - DNA, 25 bp, Mus musculus
ctggccaatagtttcccagacaaca

SEQ ID NO: 291741 - DNA, 25 bp, Mus musculus
ccagacaacaaagccgacgtgcggc

SEQ ID NO: 291742 - DNA, 25 bp, Mus musculus
gacgtgcggcttcctccaatgaaaa

SEQ ID NO: 291743 - DNA, 25 bp, Mus musculus
catgttgagtgtggcgctcagatct

SEQ ID NO: 291744 - DNA, 25 bp, Mus musculus
caaccacgttgctagcctgaagggc

SEQ ID NO: 291745 - DNA, 25 bp, Mus musculus
gggcctcgtgttctccatgttgagt

SEQ ID NO: 291746 - DNA, 25 bp, Mus musculus
cacacacaagggaagtgatcgtcgc

SEQ ID NO: 291747 - DNA, 25 bp, Mus musculus
gtgacgcgccgcgagtcacctgact

SEQ ID NO: 291748 - DNA, 25 bp, Mus musculus
agtcagatcgtctggctcgggaccc

SEQ ID NO: 291749 - DNA, 25 bp, Mus musculus
ctgcgcgcttggctgtgtccttcgt

SEQ ID NO: 291750 - DNA, 25 bp, Mus musculus
gtcgccttggccgtcggtcgccgat

SEQ ID NO: 291751 - DNA, 25 bp, Mus musculus
gacagttaacagatgctcgcccagc

SEQ ID NO: 291752 - DNA, 25 bp, Mus musculus
agtcacctgactcggctgcggactg

SEQ ID NO: 291753 - DNA, 25 bp, Mus musculus
ggctgcggactgagacacacacaag

SEQ ID NO: 291754 - DNA, 25 bp, Mus musculus
tgatcgtcgccggagtcagatcgtc

SEQ ID NO: 291755 - DNA, 25 bp, Mus musculus
gccatgccgtccgagaagaccttca

SEQ ID NO: 291756 - DNA, 25 bp, Mus musculus
gaccttcaagcagcgccggagcttt

SEQ ID NO: 291757 - DNA, 25 bp, Mus musculus
cgacgcagccagtgggatattggtc

SEQ ID NO: 291758 - DNA, 25 bp, Mus musculus
tagctcgggtgctcagcgtcgcctt

SEQ ID NO: 291759 - DNA, 25 bp, Mus musculus
ccgacccacgcagacagttaacaga

SEQ ID NO: 291760 - DNA, 25 bp, Mus musculus
gatcgcacacgcagacacgggttcc

SEQ ID NO: 291761 - DNA, 25 bp, Mus musculus
accctcgttgagctgcagcccgtag

SEQ ID NO: 291762 - DNA, 25 bp, Mus musculus
ccaggtcggtgcaagtggacatatc

SEQ ID NO: 291763 - DNA, 25 bp, Mus musculus
ttatgtcacctaagaaccgggattg

SEQ ID NO: 291764 - DNA, 25 bp, Mus musculus
ggccgtgacaccgaacacacaaagg

SEQ ID NO: 291765 - DNA, 25 bp, Mus musculus
tccgggtcccttagtaggtcatctc

SEQ ID NO: 291766 - DNA, 25 bp, Mus musculus
aggtcatctccaggctggccggtaa

SEQ ID NO: 291767 - DNA, 25 bp, Mus musculus
cgcgcttgcgctcaccttgtggcaa

SEQ ID NO: 291768 - DNA, 25 bp, Mus musculus
agtcgcgcagcgaatggtagtcctt

SEQ ID NO: 291769 - DNA, 25 bp, Mus musculus
tgctctggatctgtgtgagctcctg

SEQ ID NO: 291770 - DNA, 25 bp, Mus musculus
gacacgggttcctgtacatcgtacc

SEQ ID NO: 291771 - DNA, 25 bp, Mus musculus
aggaggaactcatcgcccgtgcgac

SEQ ID NO: 291772 - DNA, 25 bp, Mus musculus
accacctcgtccgtcaggttggtga

SEQ ID NO: 291773 - DNA, 25 bp, Mus musculus
ggcgcagcacctgcttctggtggaa

SEQ ID NO: 291774 - DNA, 25 bp, Mus musculus
ctcgggatggaattttaggcgcttt

SEQ ID NO: 291775 - DNA, 25 bp, Mus musculus
gctccgtaggattggtcgaagtcta

SEQ ID NO: 291776 - DNA, 25 bp, Mus musculus
tccctcagattagcccggagccttg

SEQ ID NO: 291777 - DNA, 25 bp, Mus musculus
gatgggcccagaagcaccaccggct

SEQ ID NO: 291778 - DNA, 25 bp, Mus musculus
ctcgtttcggcagctccgtaggatt

SEQ ID NO: 291779 - DNA, 25 bp, Mus musculus
taggattggtcgaagtctaggcgcc

SEQ ID NO: 291780 - DNA, 25 bp, Mus musculus
tctaggcgccgcctcagagatggac

SEQ ID NO: 291781 - DNA, 25 bp, Mus musculus
cgcctcagagatggactgtcgatca

SEQ ID NO: 291782 - DNA, 25 bp, Mus musculus
actgtcgatcacgtcgggtccgcct

SEQ ID NO: 291783 - DNA, 25 bp, Mus musculus
taggcgcttttgttccctcagatta

SEQ ID NO: 291784 - DNA, 25 bp, Mus musculus
cagattagcccggagccttgttttt

SEQ ID NO: 291785 - DNA, 25 bp, Mus musculus
ggcctcggtgctttattcatgaacg

SEQ ID NO: 291786 - DNA, 25 bp, Mus musculus
ttcatgaacgtgacggcaaggaggc

SEQ ID NO: 291787 - DNA, 25 bp, Mus musculus
ctgtcctgcgcgacggctcgtttcg

SEQ ID NO: 291788 - DNA, 25 bp, Mus musculus
ctccggcgcagctcgaaaatgaaca

SEQ ID NO: 291789 - DNA, 25 bp, Mus musculus
ttttgacgatggagggtcctactgc

SEQ ID NO: 291790 - DNA, 25 bp, Mus musculus
acgcacggatttaaggggcgctacg

SEQ ID NO: 291791 - DNA, 25 bp, Mus musculus
aagcgccacggcatcggcctggaga

SEQ ID NO: 291792 - DNA, 25 bp, Mus musculus
gcggcaacacgtaccaaggcacctg

SEQ ID NO: 291793 - DNA, 25 bp, Mus musculus
ctgggcgtctacacctggccaagcg

SEQ ID NO: 291794 - DNA, 25 bp, Mus musculus
cagggcgaatacaccggctcgtgga

SEQ ID NO: 291795 - DNA, 25 bp, Mus musculus
aaccgcgttacatgcatgtccagtg

SEQ ID NO: 291796 - DNA, 25 bp, Mus musculus
cgggattcgcaaaccgcgttacatg

SEQ ID NO: 291797 - DNA, 25 bp, Mus musculus
tttttcaccgcttgcgggattcgca

SEQ ID NO: 291798 - DNA, 25 bp, Mus musculus
tccggtttgttgatcgccttgtttc

SEQ ID NO: 291799 - DNA, 25 bp, Mus musculus
cagccaaccaagactccggtttgtt

SEQ ID NO: 291800 - DNA, 25 bp, Mus musculus
aacaatcgccgctggcggacctaga

SEQ ID NO: 291801 - DNA, 25 bp, Mus musculus
gcatcgcaacaaaaagccagccagc

SEQ ID NO: 291802 - DNA, 25 bp, Mus musculus
cccttatggcatggccgcagtcatc

SEQ ID NO: 291803 - DNA, 25 bp, Mus musculus
gcaagaatctcatcccgctgcgtgc

SEQ ID NO: 291804 - DNA, 25 bp, Mus musculus
ctcgtgagcggcaaacgcaagaatc

SEQ ID NO: 291805 - DNA, 25 bp, Mus musculus
catgggtacgggtgcatgactttcc

SEQ ID NO: 291806 - DNA, 25 bp, Mus musculus
ccagcgctcggacgggcttaagtat

SEQ ID NO: 291807 - DNA, 25 bp, Mus musculus
gtgaatggaagaacgacaaacgctc

SEQ ID NO: 291808 - DNA, 25 bp, Mus musculus
ccaccgagacctacgtgggtgaatg

SEQ ID NO: 291809 - DNA, 25 bp, Mus musculus
tgaggacgacatcgacgccactacc

SEQ ID NO: 291810 - DNA, 25 bp, Mus musculus
gccggaatgagcaccgtgagctcca

SEQ ID NO: 291811 - DNA, 25 bp, Mus musculus
caagcagagctccttccgcagcgag

SEQ ID NO: 291812 - DNA, 25 bp, Mus musculus
gcggcctgaagctacgcaagtctga

SEQ ID NO: 291813 - DNA, 25 bp, Mus musculus
ctcaagagcaagaagaagggactgt

SEQ ID NO: 291814 - DNA, 25 bp, Mus musculus
tcgccaagcagaaagccgagatcgc

SEQ ID NO: 291815 - DNA, 25 bp, Mus musculus
ggcccacagtgactcggagatcctc

SEQ ID NO: 291816 - DNA, 25 bp, Mus musculus
ctatgcccgcaacagctggggcgag

SEQ ID NO: 291817 - DNA, 25 bp, Mus musculus
aagcggggacatccagatgctcctc

SEQ ID NO: 291818 - DNA, 25 bp, Mus musculus
ggacatccagatgctcctcgagggc

SEQ ID NO: 291819 - DNA, 25 bp, Mus musculus
acatccagatgctcctcgagggccg

SEQ ID NO: 291820 - DNA, 25 bp, Mus musculus
ccgcggaggggactatgcccgcaac

SEQ ID NO: 291821 - DNA, 25 bp, Mus musculus
ggaggggactatgcccgcaacagct

SEQ ID NO: 291822 - DNA, 25 bp, Mus musculus
ggactatgcccgcaacagctggggc

SEQ ID NO: 291823 - DNA, 25 bp, Mus musculus
ctctaggggtatccgcagcggtgcc

SEQ ID NO: 291824 - DNA, 25 bp, Mus musculus
tacgcagcggccagcccactgagga

SEQ ID NO: 291825 - DNA, 25 bp, Mus musculus
tgaggacttccgcacccggggctca

SEQ ID NO: 291826 - DNA, 25 bp, Mus musculus
cggggctcaggccacaagcagcctg

SEQ ID NO: 291827 - DNA, 25 bp, Mus musculus
tcaggccacaagcagcctgggaacc

SEQ ID NO: 291828 - DNA, 25 bp, Mus musculus
agcgaagcggggacatccagatgct

SEQ ID NO: 291829 - DNA, 25 bp, Mus musculus
gcagcggtgccctacgcagcggcca

SEQ ID NO: 291830 - DNA, 25 bp, Mus musculus
cgcggaaccgaacaggacagatctg

SEQ ID NO: 291831 - DNA, 25 bp, Mus musculus
gacagatctggtcttccatggaaga

SEQ ID NO: 291832 - DNA, 25 bp, Mus musculus
ataaacgaggagtttcgggactgca

SEQ ID NO: 291833 - DNA, 25 bp, Mus musculus
ttcgggactgcaaagggacccgaga

SEQ ID NO: 291834 - DNA, 25 bp, Mus musculus
cgcgagcgcttggacaccttcttct

SEQ ID NO: 291835 - DNA, 25 bp, Mus musculus
gcccatcgcgccgattcggaagcgg

SEQ ID NO: 291836 - DNA, 25 bp, Mus musculus
cccgggagacaaccggaggcaaatg

SEQ ID NO: 291837 - DNA, 25 bp, Mus musculus
ccggaggcaaatgaatgatgatgtt

SEQ ID NO: 291838 - DNA, 25 bp, Mus musculus
tgatgatgttctgccgggccggaaa

SEQ ID NO: 291839 - DNA, 25 bp, Mus musculus
ggcgcgctataggaggctcacttcc

SEQ ID NO: 291840 - DNA, 25 bp, Mus musculus
ggctcacttcctgtcctttgctctg

SEQ ID NO: 291841 - DNA, 25 bp, Mus musculus
tggagcagccgatcccaccagtact

SEQ ID NO: 291842 - DNA, 25 bp, Mus musculus
caccagtactttgggtccgtctcgg

SEQ ID NO: 291843 - DNA, 25 bp, Mus musculus
ccagcaagctgcgtgactctaaacg

SEQ ID NO: 291844 - DNA, 25 bp, Mus musculus
cggcgtgactactgatgggtttatc

SEQ ID NO: 291845 - DNA, 25 bp, Mus musculus
ggactactgatgtgtttaacgcggc

SEQ ID NO: 291846 - DNA, 25 bp, Mus musculus
agcacgtggagcgttaagatcctga

SEQ ID NO: 291847 - DNA, 25 bp, Mus musculus
ccgctgctgttggttcagctcgcaa

SEQ ID NO: 291848 - DNA, 25 bp, Mus musculus
gcgcggccttttatctctaccgtta

SEQ ID NO: 291849 - DNA, 25 bp, Mus musculus
ctctccgcgtactgagaagtgcgtc

SEQ ID NO: 291850 - DNA, 25 bp, Mus musculus
tgatattgcgctgcagggtcacgcc

SEQ ID NO: 291851 - DNA, 25 bp, Mus musculus
ccacaccgttgagcagcgtgatatt

SEQ ID NO: 291852 - DNA, 25 bp, Mus musculus
tgcccacgatgatggccacaccgtt

SEQ ID NO: 291853 - DNA, 25 bp, Mus musculus
cgtcacgaagatgccagagccgatg

SEQ ID NO: 291854 - DNA, 25 bp, Mus musculus
acgagccgtagacctccagcatgta

SEQ ID NO: 291855 - DNA, 25 bp, Mus musculus
gggccgaatgatgagcagctcgatc

SEQ ID NO: 291856 - DNA, 25 bp, Mus musculus
tacttacgcacgcagaggcaggcca

SEQ ID NO: 291857 - DNA, 25 bp, Mus musculus
ccgagctgtaaacgcaggaaccttg

SEQ ID NO: 291858 - DNA, 25 bp, Mus musculus
aaccggggtgccaactactgccgca

SEQ ID NO: 291859 - DNA, 25 bp, Mus musculus
ctcccgaaggctggccaaggaaacg

SEQ ID NO: 291860 - DNA, 25 bp, Mus musculus
ggctggccaaggaaacggaaatctg

SEQ ID NO: 291861 - DNA, 25 bp, Mus musculus
gccaaggaaacggaaatctgctctc

SEQ ID NO: 291862 - DNA, 25 bp, Mus musculus
aacggaaatctgctctcctcgctga

SEQ ID NO: 291863 - DNA, 25 bp, Mus musculus
cgcctggctgtgtccggctcgccct

SEQ ID NO: 291864 - DNA, 25 bp, Mus musculus
cggtcgcccactcgctcgctcccgc

SEQ ID NO: 291865 - DNA, 25 bp, Mus musculus
cagcgcgcgcacactggccaccgcg

SEQ ID NO: 291866 - DNA, 25 bp, Mus musculus
gcctgacccggattctgctctgctc

SEQ ID NO: 291867 - DNA, 25 bp, Mus musculus
cggagcgcttcacccggcctgaccc

SEQ ID NO: 291868 - DNA, 25 bp, Mus musculus
ggggtgccaactactgccgcagctg

SEQ ID NO: 291869 - DNA, 25 bp, Mus musculus
ggacaaccggggtgccaactactgc

SEQ ID NO: 291870 - DNA, 25 bp, Mus musculus
gaaatctgctctcctcgctgactgc

SEQ ID NO: 291871 - DNA, 25 bp, Mus musculus
tgagggcccgccctctcgaagtccc

SEQ ID NO: 291872 - DNA, 25 bp, Mus musculus
ttccgctccacacgaagcactggta

SEQ ID NO: 291873 - DNA, 25 bp, Mus musculus
cgtttcgagtctctccttggaaggc

SEQ ID NO: 291874 - DNA, 25 bp, Mus musculus
taggctttcgaaccgcctccggaga

SEQ ID NO: 291875 - DNA, 25 bp, Mus musculus
caccattggtggtttgccggtctaa

SEQ ID NO: 291876 - DNA, 25 bp, Mus musculus
tcaggccactgaaccggtttgcacc

SEQ ID NO: 291877 - DNA, 25 bp, Mus musculus
tcgcccgctggctccagagaaaagc

SEQ ID NO: 291878 - DNA, 25 bp, Mus musculus
cacggtctgcgcctattataggctt

SEQ ID NO: 291879 - DNA, 25 bp, Mus musculus
gcgcagcaccctctgacttcgagga

SEQ ID NO: 291880 - DNA, 25 bp, Mus musculus
aactcaggcaggctacagcagcacc

SEQ ID NO: 291881 - DNA, 25 bp, Mus musculus
caaagaccgcgttgagaactcaggc

SEQ ID NO: 291882 - DNA, 25 bp, Mus musculus
cgcaggttttgcttccagttgtcca

SEQ ID NO: 291883 - DNA, 25 bp, Mus musculus
caagccttgggctcaccttgcgctt

SEQ ID NO: 291884 - DNA, 25 bp, Mus musculus
cgtgctgaggattgggtaaaactga

SEQ ID NO: 291885 - DNA, 25 bp, Mus musculus
cgccagcgatttgacgtttcgagtc

SEQ ID NO: 291886 - DNA, 25 bp, Mus musculus
ggccgcccaagtctctcaggactga

SEQ ID NO: 291887 - DNA, 25 bp, Mus musculus
agcgagagcgagatctccggccgcc

SEQ ID NO: 291888 - DNA, 25 bp, Mus musculus
acacggtaattgcagctcccgcagc

SEQ ID NO: 291889 - DNA, 25 bp, Mus musculus
ctgctctgctctctgttgacatcgg

SEQ ID NO: 291890 - DNA, 25 bp, Mus musculus
ctctgttgacatcggggccgagact

SEQ ID NO: 291891 - DNA, 25 bp, Mus musculus
cgagaattccgcagcccacacggta

SEQ ID NO: 291892 - DNA, 25 bp, Mus musculus
atctcccggccgttgttggcgctat

SEQ ID NO: 291893 - DNA, 25 bp, Mus musculus
cgacaaacaccacgagaattccgca

SEQ ID NO: 291894 - DNA, 25 bp, Mus musculus
aactgcgcatgctcgttggagtccg

SEQ ID NO: 291895 - DNA, 25 bp, Mus musculus
tgacttcgccctggttggcgcgtcc

SEQ ID NO: 291896 - DNA, 25 bp, Mus musculus
ctctcgcgaggacggacgccattat

SEQ ID NO: 291897 - DNA, 25 bp, Mus musculus
cgcagagcggctgcttctctcgcga

SEQ ID NO: 291898 - DNA, 25 bp, Mus musculus
agtccgtcggcgaaagcgcgcgcca

SEQ ID NO: 291899 - DNA, 25 bp, Mus musculus
gggaggacaactgcgcatgctcgtt

SEQ ID NO: 291900 - DNA, 25 bp, Mus musculus
agagcaagcatcaccagagcccagg

SEQ ID NO: 291901 - DNA, 25 bp, Mus musculus
gagggtatcgtagcgggattcaatc

SEQ ID NO: 291902 - DNA, 25 bp, Mus musculus
ttaagctaagccgaccgcggagaca

SEQ ID NO: 291903 - DNA, 25 bp, Mus musculus
ggagtccacggagttaagctaagcc

SEQ ID NO: 291904 - DNA, 25 bp, Mus musculus
cttgagggtcaccacgctcttgctt

SEQ ID NO: 291905 - DNA, 25 bp, Mus musculus
ccctaaggtctgattccgcgggcgg

SEQ ID NO: 291906 - DNA, 25 bp, Mus musculus
ggaaccgttcgtatgctactccacc

SEQ ID NO: 291907 - DNA, 25 bp, Mus musculus
gggattcaatcggacttccagtggc

SEQ ID NO: 291908 - DNA, 25 bp, Mus musculus
ggtgaagcggtaactcattcattgc

SEQ ID NO: 291909 - DNA, 25 bp, Mus musculus
cccgcgagttgcgaagcacagagca

SEQ ID NO: 291910 - DNA, 25 bp, Mus musculus
ctgcaggcgccgagtaccgaactcg

SEQ ID NO: 291911 - DNA, 25 bp, Mus musculus
ttccgacacacggtgagacgagctg

SEQ ID NO: 291912 - DNA, 25 bp, Mus musculus
cgcgtcccgggaactggagctacgc

SEQ ID NO: 291913 - DNA, 25 bp, Mus musculus
cattcattgcgacttggaaccgttc

SEQ ID NO: 291914 - DNA, 25 bp, Mus musculus
acgcagcccgctttgcccgaaatgg

SEQ ID NO: 291915 - DNA, 25 bp, Mus musculus
atggcgccgaaggaggcagcctatc

SEQ ID NO: 291916 - DNA, 25 bp, Mus musculus
ggaggcagcctatccgttctgacca

SEQ ID NO: 291917 - DNA, 25 bp, Mus musculus
ggaccaagcgctcgatcggcaaaga

SEQ ID NO: 291918 - DNA, 25 bp, Mus musculus
tgcttggaaggggaaagcgccctca

SEQ ID NO: 291919 - DNA, 25 bp, Mus musculus
ccttaggagacctgcccgggtgctt

SEQ ID NO: 291920 - DNA, 25 bp, Mus musculus
aagcgcaaggcacgtgcctcggtca

SEQ ID NO: 291921 - DNA, 25 bp, Mus musculus
gctttgcccgaaatggccaggcgcg

SEQ ID NO: 291922 - DNA, 25 bp, Mus musculus
cgcacttcctgaacaccattgtgga

SEQ ID NO: 291923 - DNA, 25 bp, Mus musculus
tcggcaaagacagtagggagccatc

SEQ ID NO: 291924 - DNA, 25 bp, Mus musculus
ccatcagagcaggaaggagacgctg

SEQ ID NO: 291925 - DNA, 25 bp, Mus musculus
cccaagaaggatgaagcgcaaggca

SEQ ID NO: 291926 - DNA, 25 bp, Mus musculus
tatccgttctgaccagcagttctgc

SEQ ID NO: 291927 - DNA, 25 bp, Mus musculus
cgcggcgagccttaggagacctgcc

SEQ ID NO: 291928 - DNA, 25 bp, Mus musculus
caaagctgaggattggacagacgtg

SEQ ID NO: 291929 - DNA, 25 bp, Mus musculus
gacaaagctgaggattggacagacg

SEQ ID NO: 291930 - DNA, 25 bp, Mus musculus
ccggaggaggtgaggacaaagctga

SEQ ID NO: 291931 - DNA, 25 bp, Mus musculus
attcgggacaaggccggcgcgacct

SEQ ID NO: 291932 - DNA, 25 bp, Mus musculus
gattggacagacgtgggcaaggcct

SEQ ID NO: 291933 - DNA, 25 bp, Mus musculus
acagacgtgggcaaggcctgtgttg

SEQ ID NO: 291934 - DNA, 25 bp, Mus musculus
aaggaccaggcctgtgcgaaggact

SEQ ID NO: 291935 - DNA, 25 bp, Mus musculus
ggaccaggcctgtgcgaaggactac

SEQ ID NO: 291936 - DNA, 25 bp, Mus musculus
cctgtgcgaaggactacggagcaga

SEQ ID NO: 291937 - DNA, 25 bp, Mus musculus
tgcgaaggactacggagcagaggcg

SEQ ID NO: 291938 - DNA, 25 bp, Mus musculus
gcgggcctacggaggcgtggcgaag

SEQ ID NO: 291939 - DNA, 25 bp, Mus musculus
cgaaggcaaagaaggaggagacgtg

SEQ ID NO: 291940 - DNA, 25 bp, Mus musculus
ccaggcctgtgcgaaggactacgga

SEQ ID NO: 291941 - DNA, 25 bp, Mus musculus
tgaggacaaagctgaggattggaca

SEQ ID NO: 291942 - DNA, 25 bp, Mus musculus
gtcagcacgggtgggaaggcgctac

SEQ ID NO: 291943 - DNA, 25 bp, Mus musculus
gccgccggttcgccgctcgcggctc

SEQ ID NO: 291944 - DNA, 25 bp, Mus musculus
cccgccgccagctacgcgaaggccc

SEQ ID NO: 291945 - DNA, 25 bp, Mus musculus
gcccgccgccagctacgcgaaggcc

SEQ ID NO: 291946 - DNA, 25 bp, Mus musculus
ggcccgccgccagctacgcgaaggc

SEQ ID NO: 291947 - DNA, 25 bp, Mus musculus
aggacggtccggggcgtggcgagag

SEQ ID NO: 291948 - DNA, 25 bp, Mus musculus
aggcgctaccgcggaggacggtccg

SEQ ID NO: 291949 - DNA, 25 bp, Mus musculus
tgggaaggcgctaccgcggaggacg

SEQ ID NO: 291950 - DNA, 25 bp, Mus musculus
gcctgcggggagcgccctggcggcg

SEQ ID NO: 291951 - DNA, 25 bp, Mus musculus
cagcacgggtgggaaggcgctaccg

SEQ ID NO: 291952 - DNA, 25 bp, Mus musculus
cctgagggcggggtcagcacgggtg

SEQ ID NO: 291953 - DNA, 25 bp, Mus musculus
ccagtgggaaggacggcctgagggc

SEQ ID NO: 291954 - DNA, 25 bp, Mus musculus
ggccagtgggaaggacggcctgagg

SEQ ID NO: 291955 - DNA, 25 bp, Mus musculus
agcacgggtgggaaggcgctaccgc

SEQ ID NO: 291956 - DNA, 25 bp, Mus musculus
aggttccattgagaaaagctgagcg

SEQ ID NO: 291957 - DNA, 25 bp, Mus musculus
ccattgagaaaagctgagcggcggc

SEQ ID NO: 291958 - DNA, 25 bp, Mus musculus
tccattgagaaaagctgagcggcgg

SEQ ID NO: 291959 - DNA, 25 bp, Mus musculus
gttccattgagaaaagctgagcggc

SEQ ID NO: 291960 - DNA, 25 bp, Mus musculus
caggttccattgagaaaagctgagc

SEQ ID NO: 291961 - DNA, 25 bp, Mus musculus
cgcaggttccattgagaaaagctga

SEQ ID NO: 291962 - DNA, 25 bp, Mus musculus
tcgcaggttccattgagaaaagctg

SEQ ID NO: 291963 - DNA, 25 bp, Mus musculus
ctcgcaggttccattgagaaaagct

SEQ ID NO: 291964 - DNA, 25 bp, Mus musculus
gctcgcaggttccattgagaaaagc

SEQ ID NO: 291965 - DNA, 25 bp, Mus musculus
cggctcgcaggttccattgagaaaa

SEQ ID NO: 291966 - DNA, 25 bp, Mus musculus
gcggctcgcaggttccattgagaaa

SEQ ID NO: 291967 - DNA, 25 bp, Mus musculus
tcgcggctcgcaggttccattgaga

SEQ ID NO: 291968 - DNA, 25 bp, Mus musculus
gctcgcggctcgcaggttccattga

SEQ ID NO: 291969 - DNA, 25 bp, Mus musculus
ttccattgagaaaagctgagcggcg

SEQ ID NO: 291970 - DNA, 25 bp, Mus musculus
taaaatattccattctgcaagtccc

SEQ ID NO: 291971 - DNA, 25 bp, Mus musculus
tgcaagtcccatcctgataagatcg

SEQ ID NO: 291972 - DNA, 25 bp, Mus musculus
gtcccatcctgataagatcgctctg

SEQ ID NO: 291973 - DNA, 25 bp, Mus musculus
tgataagatcgctctgtcgggacgg

SEQ ID NO: 291974 - DNA, 25 bp, Mus musculus
cgggacgggctgaaattgtgatctt

SEQ ID NO: 291975 - DNA, 25 bp, Mus musculus
cgggctgaaattgtgatcttatctg

SEQ ID NO: 291976 - DNA, 25 bp, Mus musculus
attgtgatcttatctggcgtgcttg

SEQ ID NO: 291977 - DNA, 25 bp, Mus musculus
tcttatctggcgtgcttgactctcc

SEQ ID NO: 291978 - DNA, 25 bp, Mus musculus
gtgcttgactctcccaggctttgta

SEQ ID NO: 291979 - DNA, 25 bp, Mus musculus
ctgggctcagataaagtttaaaata

SEQ ID NO: 291980 - DNA, 25 bp, Mus musculus
tcccaggctttgtatctagaggcag

SEQ ID NO: 291981 - DNA, 25 bp, Mus musculus
ctttgtatctagaggcagaaggaga

SEQ ID NO: 291982 - DNA, 25 bp, Mus musculus
gggccacctcgcagcctgcacctcc

SEQ ID NO: 291983 - DNA, 25 bp, Mus musculus
cccgatctgggctcagataaagttt

SEQ ID NO: 291984 - DNA, 25 bp, Mus musculus
tgttcgcctggtgccttggcctcac

SEQ ID NO: 291985 - DNA, 25 bp, Mus musculus
accaaagccgggttgcagctgcccg

SEQ ID NO: 291986 - DNA, 25 bp, Mus musculus
tcagagccctctgtgcaactcgtgg

SEQ ID NO: 291987 - DNA, 25 bp, Mus musculus
cctagcagatctaaacgcgttaaga

SEQ ID NO: 291988 - DNA, 25 bp, Mus musculus
aagatgcgaacgttgattgtcacca

SEQ ID NO: 291989 - DNA, 25 bp, Mus musculus
tgattgtcaccatgcggaggcgcct

SEQ ID NO: 291990 - DNA, 25 bp, Mus musculus
gctctctgctcaaggccatgcgtga

SEQ ID NO: 291991 - DNA, 25 bp, Mus musculus
tgaggccctcacagctgttcgcctg

SEQ ID NO: 291992 - DNA, 25 bp, Mus musculus
cgcttgcctctgtgcgccttttgtt

SEQ ID NO: 291993 - DNA, 25 bp, Mus musculus
gcgccttttgttctgcgcaaagata

SEQ ID NO: 291994 - DNA, 25 bp, Mus musculus
cgcaaagatagatgtgccgtgctga

SEQ ID NO: 291995 - DNA, 25 bp, Mus musculus
tgccgtgctgataaggcttgcaacc

SEQ ID NO: 291996 - DNA, 25 bp, Mus musculus
cttgcaaccgatggcagccgcgata

SEQ ID NO: 291997 - DNA, 25 bp, Mus musculus
gccgcgatagcgtttccatttatta

SEQ ID NO: 291998 - DNA, 25 bp, Mus musculus
gagcccggatgcaccaacagctctg

SEQ ID NO: 291999 - DNA, 25 bp, Mus musculus
actgtgcgcagacccaaagcggcca

SEQ ID NO: 292000 - DNA, 25 bp, Mus musculus
gctggccgactaccacgagtgtacc

SEQ ID NO: 292001 - DNA, 25 bp, Mus musculus
accgcatgtcgcgtaagcttccaca

SEQ ID NO: 292002 - DNA, 25 bp, Mus musculus
tcgcaagctgtacgagctgcccgca

SEQ ID NO: 292003 - DNA, 25 bp, Mus musculus
acactgtgcacaagcgctactactg

SEQ ID NO: 292004 - DNA, 25 bp, Mus musculus
tagccgccacgaaacctacactgtg

SEQ ID NO: 292005 - DNA, 25 bp, Mus musculus
cgaggcctgcaacatccggtttagc

SEQ ID NO: 292006 - DNA, 25 bp, Mus musculus
tggcacgactactccggaggccgag

SEQ ID NO: 292007 - DNA, 25 bp, Mus musculus
tctatgtgcacaagcgcctctactg

SEQ ID NO: 292008 - DNA, 25 bp, Mus musculus
ccgtagacgacgcagaggacgatcc

SEQ ID NO: 292009 - DNA, 25 bp, Mus musculus
acctggctcacaagaagtactcatg

SEQ ID NO: 292010 - DNA, 25 bp, Mus musculus
acagcctcgaagcttacctggctca

SEQ ID NO: 292011 - DNA, 25 bp, Mus musculus
gcgacctggttgagcatttgcgcca

SEQ ID NO: 292012 - DNA, 25 bp, Mus musculus
gaagcccgccggttcgcaagacggc

SEQ ID NO: 292013 - DNA, 25 bp, Mus musculus
catctgatctcatcccaagcaacta

SEQ ID NO: 292014 - DNA, 25 bp, Mus musculus
aactaccacgaagagccaccgactg

SEQ ID NO: 292015 - DNA, 25 bp, Mus musculus
cctgcgcagtagcagagccttggga

SEQ ID NO: 292016 - DNA, 25 bp, Mus musculus
tcgcggcctgatgacgttgcacaat

SEQ ID NO: 292017 - DNA, 25 bp, Mus musculus
cgtcgtgcccaaagccggagccagt

SEQ ID NO: 292018 - DNA, 25 bp, Mus musculus
aaggctgaggaacgtctcgtccacg

SEQ ID NO: 292019 - DNA, 25 bp, Mus musculus
tcccgtcttcgcgttgaggtaagct

SEQ ID NO: 292020 - DNA, 25 bp, Mus musculus
gtctgccgtggtgaagttgcttttc

SEQ ID NO: 292021 - DNA, 25 bp, Mus musculus
agctgtcattttcccttccgggcca

SEQ ID NO: 292022 - DNA, 25 bp, Mus musculus
ggccactcggcgtggcacatgttcg

SEQ ID NO: 292023 - DNA, 25 bp, Mus musculus
cgccgcccacaaaggggagcggatc

SEQ ID NO: 292024 - DNA, 25 bp, Mus musculus
gaggaggcccgcttggactctcgac

SEQ ID NO: 292025 - DNA, 25 bp, Mus musculus
tcgacctcggtgagcctgcgcagta

SEQ ID NO: 292026 - DNA, 25 bp, Mus musculus
acttcgcaagtcctcactgatcggc

SEQ ID NO: 292027 - DNA, 25 bp, Mus musculus
ggtcgcctctagaacaggcggccga

SEQ ID NO: 292028 - DNA, 25 bp, Mus musculus
gcctctagaacaggcggccgagcac

SEQ ID NO: 292029 - DNA, 25 bp, Mus musculus
cccggtaggtctctccgaggatccg

SEQ ID NO: 292030 - DNA, 25 bp, Mus musculus
tctctccgaggatccgcgctttgag

SEQ ID NO: 292031 - DNA, 25 bp, Mus musculus
atccgcgctttgaggtccgcagaac

SEQ ID NO: 292032 - DNA, 25 bp, Mus musculus
gcgctttgaggtccgcagaaccagc

SEQ ID NO: 292033 - DNA, 25 bp, Mus musculus
tgaggtccgcagaaccagcccgagc

SEQ ID NO: 292034 - DNA, 25 bp, Mus musculus
cccgcagcccacctcactcactcag

SEQ ID NO: 292035 - DNA, 25 bp, Mus musculus
aggccagacgccagcgcctgttcgt

SEQ ID NO: 292036 - DNA, 25 bp, Mus musculus
agacgccagcgcctgttcgttggcc

SEQ ID NO: 292037 - DNA, 25 bp, Mus musculus
gttggcccacatggcccactcgatc

SEQ ID NO: 292038 - DNA, 25 bp, Mus musculus
atgacgaggaccctgcgcacacgca

SEQ ID NO: 292039 - DNA, 25 bp, Mus musculus
cggtccaactctgcagcccacttcg

SEQ ID NO: 292040 - DNA, 25 bp, Mus musculus
agatttccttctcgcgctcttgcac

SEQ ID NO: 292041 - DNA, 25 bp, Mus musculus
agggcctcaagctgctgcaatcgga

SEQ ID NO: 292042 - DNA, 25 bp, Mus musculus
ctcagattcagaggcaaagtcgctg

SEQ ID NO: 292043 - DNA, 25 bp, Mus musculus
aagtagtctcccttcgcctgcagtg

SEQ ID NO: 292044 - DNA, 25 bp, Mus musculus
cttcagaaaagagccaagcgtcctc

SEQ ID NO: 292045 - DNA, 25 bp, Mus musculus
cgcggaagaagtccttctggcttca

SEQ ID NO: 292046 - DNA, 25 bp, Mus musculus
tgcaatttttggcacgcgaagacgc

SEQ ID NO: 292047 - DNA, 25 bp, Mus musculus
agctgctgcacgtgactatgaggcc

SEQ ID NO: 292048 - DNA, 25 bp, Mus musculus
caaagtgcgcactcattggctgagc

SEQ ID NO: 292049 - DNA, 25 bp, Mus musculus
cttccctgctaacgacaaagtgcgc

SEQ ID NO: 292050 - DNA, 25 bp, Mus musculus
ggtcctatccgcctactggcctaga

SEQ ID NO: 292051 - DNA, 25 bp, Mus musculus
gccactttccgctgctgggtcctat

SEQ ID NO: 292052 - DNA, 25 bp, Mus musculus
gcacagtaccagtaaggagctgcta

SEQ ID NO: 292053 - DNA, 25 bp, Mus musculus
tacctctaatctagccgcgggattg

SEQ ID NO: 292054 - DNA, 25 bp, Mus musculus
gcctgccctggtgcttctacgtggg

SEQ ID NO: 292055 - DNA, 25 bp, Mus musculus
tcagctttcgcctgcgtccggtatt

SEQ ID NO: 292056 - DNA, 25 bp, Mus musculus
tagcgtctcacgcttcagctttcgc

SEQ ID NO: 292057 - DNA, 25 bp, Mus musculus
tgcctcagtacagttcttgcactgc

SEQ ID NO: 292058 - DNA, 25 bp, Mus musculus
tcttgcactgccagatcagccgttg

SEQ ID NO: 292059 - DNA, 25 bp, Mus musculus
acgcccggatgctgctagcgtctca

SEQ ID NO: 292060 - DNA, 25 bp, Mus musculus
ttccggcggacagccatgtgtttgt

SEQ ID NO: 292061 - DNA, 25 bp, Mus musculus
acagccatgtgtttgtgcaggtgcg

SEQ ID NO: 292062 - DNA, 25 bp, Mus musculus
atagatggggactggtcgaccttga

SEQ ID NO: 292063 - DNA, 25 bp, Mus musculus
ccttgatggcgccttgatcctgcag

SEQ ID NO: 292064 - DNA, 25 bp, Mus musculus
ccgtccttcaccgagatggggccta

SEQ ID NO: 292065 - DNA, 25 bp, Mus musculus
tggggcctagcccttcaccgatgct

SEQ ID NO: 292066 - DNA, 25 bp, Mus musculus
ccgatgctcagtaacaccttcttca

SEQ ID NO: 292067 - DNA, 25 bp, Mus musculus
gcgtccggtattcaatgcctcagta

SEQ ID NO: 292068 - DNA, 25 bp, Mus musculus
tacttgccttgcagcgacatttttt

SEQ ID NO: 292069 - DNA, 25 bp, Mus musculus
tctcggtggctgtgctacccgcggc

SEQ ID NO: 292070 - DNA, 25 bp, Mus musculus
tcgggcctccctttgtcctgtggaa

SEQ ID NO: 292071 - DNA, 25 bp, Mus musculus
tacccgcggctcagtccggagctgt

SEQ ID NO: 292072 - DNA, 25 bp, Mus musculus
gtggcccagagctattggccgcgcc

SEQ ID NO: 292073 - DNA, 25 bp, Mus musculus
gcttccagggctcgcttgccctcta

SEQ ID NO: 292074 - DNA, 25 bp, Mus musculus
ttgccctctacttgccttgcagcga

SEQ ID NO: 292075 - DNA, 25 bp, Mus musculus
actgtaagcgtaggctcttggaagc

SEQ ID NO: 292076 - DNA, 25 bp, Mus musculus
ctcttggaagcggttgttcgaagtg

SEQ ID NO: 292077 - DNA, 25 bp, Mus musculus
ttcgaagtgtgggtagaaagaaatc

SEQ ID NO: 292078 - DNA, 25 bp, Mus musculus
aatcgtagaaggacaaggcagcttg

SEQ ID NO: 292079 - DNA, 25 bp, Mus musculus
ggacaaggcagcttgtccgatgccg

SEQ ID NO: 292080 - DNA, 25 bp, Mus musculus
tgtcctgtggaaaccgggacgtctc

SEQ ID NO: 292081 - DNA, 25 bp, Mus musculus
ggttggatactgtaagcgtaggctc

SEQ ID NO: 292082 - DNA, 25 bp, Mus musculus
tccaataggcgacaggccgagccca

SEQ ID NO: 292083 - DNA, 25 bp, Mus musculus
ctagacggtgaatccggagggatcc

SEQ ID NO: 292084 - DNA, 25 bp, Mus musculus
ctttttagcctatggacaggatcga

SEQ ID NO: 292085 - DNA, 25 bp, Mus musculus
ccgagcccatgatccactttttagc

SEQ ID NO: 292086 - DNA, 25 bp, Mus musculus
cgcatctagcctctacgctgcatga

SEQ ID NO: 292087 - DNA, 25 bp, Mus musculus
cggagctgaaaaaggatacgcatct

SEQ ID NO: 292088 - DNA, 25 bp, Mus musculus
tgcatgaaaagctcactagacggtg

SEQ ID NO: 292089 - DNA, 25 bp, Mus musculus
cttctggcacaagcaccactggata

SEQ ID NO: 292090 - DNA, 25 bp, Mus musculus
cgggcttttcccgtgctgtccaata

SEQ ID NO: 292091 - DNA, 25 bp, Mus musculus
gactcacgcgctgccatatgattgg

SEQ ID NO: 292092 - DNA, 25 bp, Mus musculus
ctcagggagtggaatctacgcatgc

SEQ ID NO: 292093 - DNA, 25 bp, Mus musculus
cgattacccggtgtctacagactca

SEQ ID NO: 292094 - DNA, 25 bp, Mus musculus
ggcgtaggaggcctccttcttacaa

SEQ ID NO: 292095 - DNA, 25 bp, Mus musculus
ccactggatagcctgagtgaccgtc

SEQ ID NO: 292096 - DNA, 25 bp, Mus musculus
tcccaaagacctgacccacttagta

SEQ ID NO: 292097 - DNA, 25 bp, Mus musculus
agaagactcccaaagacctgaccca

SEQ ID NO: 292098 - DNA, 25 bp, Mus musculus
agttactcgcactgtgcccgtgggg

SEQ ID NO: 292099 - DNA, 25 bp, Mus musculus
gcccagcgcagttactcgcactgtg

SEQ ID NO: 292100 - DNA, 25 bp, Mus musculus
ggccctactagcctggctggtgccg

SEQ ID NO: 292101 - DNA, 25 bp, Mus musculus
gcctgcgggcctttataagctcggc

SEQ ID NO: 292102 - DNA, 25 bp, Mus musculus
agacgcccagcgctatctggggctc

SEQ ID NO: 292103 - DNA, 25 bp, Mus musculus
ctcgtggttggagcaactttcgctt

SEQ ID NO: 292104 - DNA, 25 bp, Mus musculus
ttgcctgccgtgctttccactcggt

SEQ ID NO: 292105 - DNA, 25 bp, Mus musculus
cggctcggaactcacggcggctcgt

SEQ ID NO: 292106 - DNA, 25 bp, Mus musculus
gccatggcactctgggcgggtctcc

SEQ ID NO: 292107 - DNA, 25 bp, Mus musculus
gcagcaacagccagtagagcccggc

SEQ ID NO: 292108 - DNA, 25 bp, Mus musculus
agcgtgcagggcagcaacagccagt

SEQ ID NO: 292109 - DNA, 25 bp, Mus musculus
gctcacgcctctggaatgcgagcgc

SEQ ID NO: 292110 - DNA, 25 bp, Mus musculus
tggccttacgactccgcgggccaag

SEQ ID NO: 292111 - DNA, 25 bp, Mus musculus
cgcatgcgtctcttggtgcctacta

SEQ ID NO: 292112 - DNA, 25 bp, Mus musculus
cctcccagaactgtgcgtggtggta

SEQ ID NO: 292113 - DNA, 25 bp, Mus musculus
ggaactacctttttggcgccatggc

SEQ ID NO: 292114 - DNA, 25 bp, Mus musculus
cgccatggcgcaaagtcgtgttacc

SEQ ID NO: 292115 - DNA, 25 bp, Mus musculus
gttaccgatttctatgcgtgccgtc

SEQ ID NO: 292116 - DNA, 25 bp, Mus musculus
ggtcctcaatccaaagctgccgcgg

SEQ ID NO: 292117 - DNA, 25 bp, Mus musculus
gcgggccaagtcgatctgtctcacc

SEQ ID NO: 292118 - DNA, 25 bp, Mus musculus
gtggctcctgcgttcacccggagca

SEQ ID NO: 292119 - DNA, 25 bp, Mus musculus
ttacggctgcctggattggtaagga

SEQ ID NO: 292120 - DNA, 25 bp, Mus musculus
cgccagcgcacaggagtcaaatagt

SEQ ID NO: 292121 - DNA, 25 bp, Mus musculus
cggatcgcggatgtactacgctgca

SEQ ID NO: 292122 - DNA, 25 bp, Mus musculus
caccgcgcgccaagtggctttgaga

SEQ ID NO: 292123 - DNA, 25 bp, Mus musculus
ggctttgagaaccttacgcaccaca

SEQ ID NO: 292124 - DNA, 25 bp, Mus musculus
tcaactcaggttccgacatggccgc

SEQ ID NO: 292125 - DNA, 25 bp, Mus musculus
gcacctgaacagcacgcccgggatt

SEQ ID NO: 292126 - DNA, 25 bp, Mus musculus
ggaggtaggtatcagcacgctaaac

SEQ ID NO: 292127 - DNA, 25 bp, Mus musculus
cgctaaactcacgtcaatcccgggg

SEQ ID NO: 292128 - DNA, 25 bp, Mus musculus
gatgagcgtacagcgccaacgcctc

SEQ ID NO: 292129 - DNA, 25 bp, Mus musculus
gaacaaggacaggagagtgacccgc

SEQ ID NO: 292130 - DNA, 25 bp, Mus musculus
cgagatatccctgggaacaaggaca

SEQ ID NO: 292131 - DNA, 25 bp, Mus musculus
gctcggaaggagtccgggtctttca

SEQ ID NO: 292132 - DNA, 25 bp, Mus musculus
gtggacttcaggtgactggccaaga

SEQ ID NO: 292133 - DNA, 25 bp, Mus musculus
tcgatcttgccgctgtgcgtggact

SEQ ID NO: 292134 - DNA, 25 bp, Mus musculus
tcgcctgcgatgtagtcgatcttgc

SEQ ID NO: 292135 - DNA, 25 bp, Mus musculus
agcaaggccactcgcctgcgatgta

SEQ ID NO: 292136 - DNA, 25 bp, Mus musculus
ggtctttcaagaggggcgagatatc

SEQ ID NO: 292137 - DNA, 25 bp, Mus musculus
ggctcgtgaccgcacctgaacagca

SEQ ID NO: 292138 - DNA, 25 bp, Mus musculus
gctgacagccgtccgccgccagttt

SEQ ID NO: 292139 - DNA, 25 bp, Mus musculus
ccggcgctatttaaatataagcctg

SEQ ID NO: 292140 - DNA, 25 bp, Mus musculus
cctggctgcccagccggcgctattt

SEQ ID NO: 292141 - DNA, 25 bp, Mus musculus
ttttcacggcctcagctgccttccg

SEQ ID NO: 292142 - DNA, 25 bp, Mus musculus
tacgcgttcttttcacggcctcagc

SEQ ID NO: 292143 - DNA, 25 bp, Mus musculus
gtcgctctacgcgttcttttcacgg

SEQ ID NO: 292144 - DNA, 25 bp, Mus musculus
tgcagcctgccacccgtcgctctac

SEQ ID NO: 292145 - DNA, 25 bp, Mus musculus
ggaagcttagctggtcgctgcagcc

SEQ ID NO: 292146 - DNA, 25 bp, Mus musculus
ccgccagtttgcaggcctccgcctc

SEQ ID NO: 292147 - DNA, 25 bp, Mus musculus
ggctcgctttcgctgacagctgaca

SEQ ID NO: 292148 - DNA, 25 bp, Mus musculus
ggcgctatttaaatataagcctggc

SEQ ID NO: 292149 - DNA, 25 bp, Mus musculus
tgccttccgcgtccggtctttctgc

SEQ ID NO: 292150 - DNA, 25 bp, Mus musculus
cccgggaagcttagctggtcgctgc

SEQ ID NO: 292151 - DNA, 25 bp, Mus musculus
gcgttcttttcacggcctcagctgc

SEQ ID NO: 292152 - DNA, 25 bp, Mus musculus
aggtagtgggtcagccactgcagcc

SEQ ID NO: 292153 - DNA, 25 bp, Mus musculus
tcccagtctttgtgctgacagaagg

SEQ ID NO: 292154 - DNA, 25 bp, Mus musculus
ctgtccaggtagtgggtcagccact

SEQ ID NO: 292155 - DNA, 25 bp, Mus musculus
ctttgtgctgacagaaggacccgca

SEQ ID NO: 292156 - DNA, 25 bp, Mus musculus
tagcgggcggcgttacagccactgc

SEQ ID NO: 292157 - DNA, 25 bp, Mus musculus
ggtgtttctcccagtctttgtgctg

SEQ ID NO: 292158 - DNA, 25 bp, Mus musculus
cgtgatggtgtttctcccagtcttt

SEQ ID NO: 292159 - DNA, 25 bp, Mus musculus
ttacagccactgcacgtctcgctgg

SEQ ID NO: 292160 - DNA, 25 bp, Mus musculus
ggcgttacagccactgcacgtctcg

SEQ ID NO: 292161 - DNA, 25 bp, Mus musculus
cgcacacgtgatggtgtttctccca

SEQ ID NO: 292162 - DNA, 25 bp, Mus musculus
ctggccgcacacgtgatggtgtttc

SEQ ID NO: 292163 - DNA, 25 bp, Mus musculus
agactctggccgcacacgtgatggt

SEQ ID NO: 292164 - DNA, 25 bp, Mus musculus
cacagcagcgtccagcgggcctggc

SEQ ID NO: 292165 - DNA, 25 bp, Mus musculus
tgctgacagaaggacccgcagtagc

SEQ ID NO: 292166 - DNA, 25 bp, Mus musculus
acacccacctcggagcagtcgcagc

SEQ ID NO: 292167 - DNA, 25 bp, Mus musculus
cttggctatggggtccgactcagga

SEQ ID NO: 292168 - DNA, 25 bp, Mus musculus
caggacgtagggacctcaggagcgc

SEQ ID NO: 292169 - DNA, 25 bp, Mus musculus
acccccgtacggatgcaggagagcg

SEQ ID NO: 292170 - DNA, 25 bp, Mus musculus
gccgaggagtcccagcgcgtagcca

SEQ ID NO: 292171 - DNA, 25 bp, Mus musculus
tcccagcgcgtagccagtgcgtgcg

SEQ ID NO: 292172 - DNA, 25 bp, Mus musculus
ctgagcgcaccgcacacacccacct

SEQ ID NO: 292173 - DNA, 25 bp, Mus musculus
ggccacctgcgcgttctgccggcag

SEQ ID NO: 292174 - DNA, 25 bp, Mus musculus
acctgcggcaagtgggctcaggatc

SEQ ID NO: 292175 - DNA, 25 bp, Mus musculus
aagtgggctcaggatcccgctctcc

SEQ ID NO: 292176 - DNA, 25 bp, Mus musculus
ggccggcgttcgcatatgctttgca

SEQ ID NO: 292177 - DNA, 25 bp, Mus musculus
cggcgttcgcatatgctttgcattc

SEQ ID NO: 292178 - DNA, 25 bp, Mus musculus
ggacttggctatggggtccgactca

SEQ ID NO: 292179 - DNA, 25 bp, Mus musculus
cccggagccgcggtgtctactccgg

SEQ ID NO: 292180 - DNA, 25 bp, Mus musculus
tcgttcccggaacgcatttctcagg

SEQ ID NO: 292181 - DNA, 25 bp, Mus musculus
atttctcaggcgctgcatcccggga

SEQ ID NO: 292182 - DNA, 25 bp, Mus musculus
gacggacacttttcgcctgcggaca

SEQ ID NO: 292183 - DNA, 25 bp, Mus musculus
tcgcctgcggacacttttaggtgta

SEQ ID NO: 292184 - DNA, 25 bp, Mus musculus
tttaggtgtaggactcattccggcc

SEQ ID NO: 292185 - DNA, 25 bp, Mus musculus
agcgcgcagcagactacaagaaagg

SEQ ID NO: 292186 - DNA, 25 bp, Mus musculus
ctgtcacagcgtgagggacacttct

SEQ ID NO: 292187 - DNA, 25 bp, Mus musculus
tgagggacacttctgtaaggacccg

SEQ ID NO: 292188 - DNA, 25 bp, Mus musculus
ggacccgggatgacgtcacacgaaa

SEQ ID NO: 292189 - DNA, 25 bp, Mus musculus
tttgtttgcgccgagcaccgtgtgg

SEQ ID NO: 292190 - DNA, 25 bp, Mus musculus
atgcaggtcgccagggtcctggctc

SEQ ID NO: 292191 - DNA, 25 bp, Mus musculus
tcccgagagccgactagggcgtcag

SEQ ID NO: 292192 - DNA, 25 bp, Mus musculus
tgcgaatgagcaggaacgttcgttc

SEQ ID NO: 292193 - DNA, 25 bp, Mus musculus
tgcatcccgggacgtattagatcga

SEQ ID NO: 292194 - DNA, 25 bp, Mus musculus
tgagaaagatcatcagctgcgccag

SEQ ID NO: 292195 - DNA, 25 bp, Mus musculus
tagccactgcgaagtgcagggagcc

SEQ ID NO: 292196 - DNA, 25 bp, Mus musculus
ccgtgagtcgagtagccactgcgaa

SEQ ID NO: 292197 - DNA, 25 bp, Mus musculus
cgatccacacgtggagccgtgagtc

SEQ ID NO: 292198 - DNA, 25 bp, Mus musculus
ggctcagatagtggcgcgatccaca

SEQ ID NO: 292199 - DNA, 25 bp, Mus musculus
cggctccatggcacaggctcagata

SEQ ID NO: 292200 - DNA, 25 bp, Mus musculus
gcgctcctcgaaggcccagcaggat

SEQ ID NO: 292201 - DNA, 25 bp, Mus musculus
tcagctgcgccaggaactgcaagga

SEQ ID NO: 292202 - DNA, 25 bp, Mus musculus
aagatggaactgacgatgctgatga

SEQ ID NO: 292203 - DNA, 25 bp, Mus musculus
cccaggtgtccgcagaagatggaac

SEQ ID NO: 292204 - DNA, 25 bp, Mus musculus
tccaactcgactttgcccaggtgtc

SEQ ID NO: 292205 - DNA, 25 bp, Mus musculus
tgtcacggcgtccaactcgactttg

SEQ ID NO: 292206 - DNA, 25 bp, Mus musculus
gaaacagcgagtgtcacggcgtcca

SEQ ID NO: 292207 - DNA, 25 bp, Mus musculus
aaggagcagagaggcggtcactctc

SEQ ID NO: 292208 - DNA, 25 bp, Mus musculus
atggcacttgcctgcccggggctgc

SEQ ID NO: 292209 - DNA, 25 bp, Mus musculus
aacgtcaccgtgtgtcgctgtgggt

SEQ ID NO: 292210 - DNA, 25 bp, Mus musculus
caaacgctgaacgtcaccgtgtgtc

SEQ ID NO: 292211 - DNA, 25 bp, Mus musculus
cccagcagcgagagcaaacgctgaa

SEQ ID NO: 292212 - DNA, 25 bp, Mus musculus
tgagcctgctactccaggactctgg

SEQ ID NO: 292213 - DNA, 25 bp, Mus musculus
gagggcctgcatcgcctgagcctgc

SEQ ID NO: 292214 - DNA, 25 bp, Mus musculus
catcaggtctccgagggcctgcatc

SEQ ID NO: 292215 - DNA, 25 bp, Mus musculus
tgcggctccgacatcaggtctccga

SEQ ID NO: 292216 - DNA, 25 bp, Mus musculus
cacgcttgcggctccgacatcaggt

SEQ ID NO: 292217 - DNA, 25 bp, Mus musculus
acagtgagccatgcacgcttgcggc

SEQ ID NO: 292218 - DNA, 25 bp, Mus musculus
acgctgcgccttctacagtgagcca

SEQ ID NO: 292219 - DNA, 25 bp, Mus musculus
tggagcttcagctgaccacgctgcg

SEQ ID NO: 292220 - DNA, 25 bp, Mus musculus
tgggtcggatggcacttgcctgccc

SEQ ID NO: 292221 - DNA, 25 bp, Mus musculus
gcggggttaacctggagcttcagct

SEQ ID NO: 292222 - DNA, 25 bp, Mus musculus
gcctcgaaaagaggaacccttctga

SEQ ID NO: 292223 - DNA, 25 bp, Mus musculus
gctcgctgggctcgagtccacagat

SEQ ID NO: 292224 - DNA, 25 bp, Mus musculus
tccacagatggctgccaggcctggc

SEQ ID NO: 292225 - DNA, 25 bp, Mus musculus
ctgtcaagctggtcttcaggtcgtc

SEQ ID NO: 292226 - DNA, 25 bp, Mus musculus
caggtaaggttaaggctgtagcctc

SEQ ID NO: 292227 - DNA, 25 bp, Mus musculus
tcaagcgctcgctctctggctgcat

SEQ ID NO: 292228 - DNA, 25 bp, Mus musculus
tctggctgcatttccgaggttagca

SEQ ID NO: 292229 - DNA, 25 bp, Mus musculus
ccgaggttagcattctgtgggtttc

SEQ ID NO: 292230 - DNA, 25 bp, Mus musculus
ctgtgggtttctcattgattcgtta

SEQ ID NO: 292231 - DNA, 25 bp, Mus musculus
attcgttatttgtgcgcgatggacg

SEQ ID NO: 292232 - DNA, 25 bp, Mus musculus
gacgggctttgggttttcatgaaca

SEQ ID NO: 292233 - DNA, 25 bp, Mus musculus
ttcatgaacacgattgacaggtttc

SEQ ID NO: 292234 - DNA, 25 bp, Mus musculus
tcggacccaggtgtctgcggcctaa

SEQ ID NO: 292235 - DNA, 25 bp, Mus musculus
tgcggcctaagcagccagctgatgc

SEQ ID NO: 292236 - DNA, 25 bp, Mus musculus
aggcgcagaggtggcacacagatct

SEQ ID NO: 292237 - DNA, 25 bp, Mus musculus
tgggttctcggtctcctcatcttcc

SEQ ID NO: 292238 - DNA, 25 bp, Mus musculus
cctctgtgcgggatcggagcccgac

SEQ ID NO: 292239 - DNA, 25 bp, Mus musculus
ttcttccttccctctgtgcgggatc

SEQ ID NO: 292240 - DNA, 25 bp, Mus musculus
gccttcgtcacttcctgccggcccg

SEQ ID NO: 292241 - DNA, 25 bp, Mus musculus
ggaccggacgacctcgccttcgtca

SEQ ID NO: 292242 - DNA, 25 bp, Mus musculus
gtcgggatctgacccgcagcagctc

SEQ ID NO: 292243 - DNA, 25 bp, Mus musculus
cgcagagacacccaggtcgggatct

SEQ ID NO: 292244 - DNA, 25 bp, Mus musculus
acaggacagtcctcccgcgacggga

SEQ ID NO: 292245 - DNA, 25 bp, Mus musculus
tgttccaggtgacatacaggacagt

SEQ ID NO: 292246 - DNA, 25 bp, Mus musculus
tgtgcaatctgttccaggtgacata

SEQ ID NO: 292247 - DNA, 25 bp, Mus musculus
cccgagcctgtgcaatctgttccag

SEQ ID NO: 292248 - DNA, 25 bp, Mus musculus
tgtctgcgcgtgctcccgggacgaa

SEQ ID NO: 292249 - DNA, 25 bp, Mus musculus
ggtggcacacagatctgacgcccaa

SEQ ID NO: 292250 - DNA, 25 bp, Mus musculus
caaggttgttgtcgaaggagccaga

SEQ ID NO: 292251 - DNA, 25 bp, Mus musculus
aaagccgctggattggctgacctcc

SEQ ID NO: 292252 - DNA, 25 bp, Mus musculus
cccaggcggagaaagccgctggatt

SEQ ID NO: 292253 - DNA, 25 bp, Mus musculus
attggcatccgtgcgtaggagaccc

SEQ ID NO: 292254 - DNA, 25 bp, Mus musculus
agacgtccgggaatgattggcatcc

SEQ ID NO: 292255 - DNA, 25 bp, Mus musculus
ccgacggcttccgtaacaggcacgg

SEQ ID NO: 292256 - DNA, 25 bp, Mus musculus
aaagggctcagacggcccgacggct

SEQ ID NO: 292257 - DNA, 25 bp, Mus musculus
gccgcttacgtcacgtcggagagga

SEQ ID NO: 292258 - DNA, 25 bp, Mus musculus
ccgcggtctggaaacaaggttgttg

SEQ ID NO: 292259 - DNA, 25 bp, Mus musculus
ggccctactcggtgccggaagtgat

SEQ ID NO: 292260 - DNA, 25 bp, Mus musculus
gggacacgacgattggccctactcg

SEQ ID NO: 292261 - DNA, 25 bp, Mus musculus
tccctgccacgggacacgacgattg

SEQ ID NO: 292262 - DNA, 25 bp, Mus musculus
attggctgacctccctgccacggga

SEQ ID NO: 292263 - DNA, 25 bp, Mus musculus
cacgtcggagaggaaatgcgatgcc

SEQ ID NO: 292264 - DNA, 25 bp, Mus musculus
caccctgctgactctcgaggtttcg

SEQ ID NO: 292265 - DNA, 25 bp, Mus musculus
cgggtaaccgtagcctgtctctacg

SEQ ID NO: 292266 - DNA, 25 bp, Mus musculus
tgtctctacgtgaacccgcaggctg

SEQ ID NO: 292267 - DNA, 25 bp, Mus musculus
ggctgctagctttcgcgctgcgcac

SEQ ID NO: 292268 - DNA, 25 bp, Mus musculus
tgactctcgaggtttcgcagctaac

SEQ ID NO: 292269 - DNA, 25 bp, Mus musculus
cgcagctaaccttgcggataccaga

SEQ ID NO: 292270 - DNA, 25 bp, Mus musculus
ccttgcggataccagacggttcgga

SEQ ID NO: 292271 - DNA, 25 bp, Mus musculus
taccagacggttcggaccgcgcagg

SEQ ID NO: 292272 - DNA, 25 bp, Mus musculus
agcgcaaagggaggccgccctcaaa

SEQ ID NO: 292273 - DNA, 25 bp, Mus musculus
aggcgccgctttcggcaccatggcg

SEQ ID NO: 292274 - DNA, 25 bp, Mus musculus
catctgcctcgggtggttcgtctct

SEQ ID NO: 292275 - DNA, 25 bp, Mus musculus
tcgtctctccctggcgtgtgtgaga

SEQ ID NO: 292276 - DNA, 25 bp, Mus musculus
tctccctggcgtgtgtgagagagac

SEQ ID NO: 292277 - DNA, 25 bp, Mus musculus
tgaacccgcaggctgcgggctgcta

SEQ ID NO: 292278 - DNA, 25 bp, Mus musculus
acttggttcaaccagccggcgcgca

SEQ ID NO: 292279 - DNA, 25 bp, Mus musculus
cggagatacccacactgcgaagtta

SEQ ID NO: 292280 - DNA, 25 bp, Mus musculus
ggcgcgcaagatccgcaggtataga

SEQ ID NO: 292281 - DNA, 25 bp, Mus musculus
cccgacggctagaaaggcgatggtc

SEQ ID NO: 292282 - DNA, 25 bp, Mus musculus
gcagcagcgagtggacacttggttc

SEQ ID NO: 292283 - DNA, 25 bp, Mus musculus
cttccacaaggattggcagcagcga

SEQ ID NO: 292284 - DNA, 25 bp, Mus musculus
cccagccggaatggcatgatactga

SEQ ID NO: 292285 - DNA, 25 bp, Mus musculus
cctgtataggaggtgagtctctgcc

SEQ ID NO: 292286 - DNA, 25 bp, Mus musculus
tccctacaagcccagggtgctttgc

SEQ ID NO: 292287 - DNA, 25 bp, Mus musculus
tgagattggccggactccctacaag

SEQ ID NO: 292288 - DNA, 25 bp, Mus musculus
gtgacgtcacttccctttcgcctga

SEQ ID NO: 292289 - DNA, 25 bp, Mus musculus
gcgagaataaccaacccgacggcta

SEQ ID NO: 292290 - DNA, 25 bp, Mus musculus
ctccatccgctgtcatcggcgaaga

SEQ ID NO: 292291 - DNA, 25 bp, Mus musculus
gctgtgcttttcctgcaggcgcaag

SEQ ID NO: 292292 - DNA, 25 bp, Mus musculus
ccgcccgagacacgtgtgcccgcgc

SEQ ID NO: 292293 - DNA, 25 bp, Mus musculus
ggcacctgctggaccgggacccatt

SEQ ID NO: 292294 - DNA, 25 bp, Mus musculus
tgagctgccggcacctgctggaccg

SEQ ID NO: 292295 - DNA, 25 bp, Mus musculus
ccctgcgcctcgaaggtggagctgc

SEQ ID NO: 292296 - DNA, 25 bp, Mus musculus
caccctgcgcctcgaaggtggagct

SEQ ID NO: 292297 - DNA, 25 bp, Mus musculus
tgcaccctgcgcctcgaaggtggag

SEQ ID NO: 292298 - DNA, 25 bp, Mus musculus
cctgaagcatgagcggcgactcgga

SEQ ID NO: 292299 - DNA, 25 bp, Mus musculus
gagcctgaagcatgagcggcgactc

SEQ ID NO: 292300 - DNA, 25 bp, Mus musculus
tggtccggccaccatttctccggcg

SEQ ID NO: 292301 - DNA, 25 bp, Mus musculus
ctccggcgcccaccggttcgagtgc

SEQ ID NO: 292302 - DNA, 25 bp, Mus musculus
tgctggaccgggacccattgaccaa

SEQ ID NO: 292303 - DNA, 25 bp, Mus musculus
ttcgagtgcggagcctgaagcatga

SEQ ID NO: 292304 - DNA, 25 bp, Mus musculus
gcgcggccacgcctggtccggccac

SEQ ID NO: 292305 - DNA, 25 bp, Mus musculus
tggaccgggacccattgaccaagtc

SEQ ID NO: 292306 - DNA, 25 bp, Mus musculus
taatggacgtcaacactgctctaca

SEQ ID NO: 292307 - DNA, 25 bp, Mus musculus
tgcgttcaagattcggcgtcacccg

SEQ ID NO: 292308 - DNA, 25 bp, Mus musculus
tggcctagcacgtggcatacgcgaa

SEQ ID NO: 292309 - DNA, 25 bp, Mus musculus
ccacgatggcctagcacgtggcata

SEQ ID NO: 292310 - DNA, 25 bp, Mus musculus
cactgctctacaagaggtgctgaag

SEQ ID NO: 292311 - DNA, 25 bp, Mus musculus
cgtcaacactgctctacaagaggtg

SEQ ID NO: 292312 - DNA, 25 bp, Mus musculus
tggacgtcaacactgctctacaaga

SEQ ID NO: 292313 - DNA, 25 bp, Mus musculus
tagcacgtggcatacgcgaagctgc

SEQ ID NO: 292314 - DNA, 25 bp, Mus musculus
tgctggaggtgtaatggacgtcaac

SEQ ID NO: 292315 - DNA, 25 bp, Mus musculus
catagctgctggaggtgtaatggac

SEQ ID NO: 292316 - DNA, 25 bp, Mus musculus
cacccgtgattcaccgccatggccg

SEQ ID NO: 292317 - DNA, 25 bp, Mus musculus
caagattcggcgtcacccgtgattc

SEQ ID NO: 292318 - DNA, 25 bp, Mus musculus
ggtgtaatggacgtcaacactgctc

SEQ ID NO: 292319 - DNA, 25 bp, Mus musculus
gattcggcgtcacccgtgattcacc

SEQ ID NO: 292320 - DNA, 25 bp, Mus musculus
tcccggtccgaatacagggtataga

SEQ ID NO: 292321 - DNA, 25 bp, Mus musculus
tgccatggtaatgagctcccggagc

SEQ ID NO: 292322 - DNA, 25 bp, Mus musculus
cggcacgcggttgccatggtaatga

SEQ ID NO: 292323 - DNA, 25 bp, Mus musculus
cggctgtcgcgagaagatagctccg

SEQ ID NO: 292324 - DNA, 25 bp, Mus musculus
gacgcgatgttacggacccgctgtc

SEQ ID NO: 292325 - DNA, 25 bp, Mus musculus
tggccggtcgggctagcacagccct

SEQ ID NO: 292326 - DNA, 25 bp, Mus musculus
ctgaggcgagacgtccgcagactcc

SEQ ID NO: 292327 - DNA, 25 bp, Mus musculus
tacagggtatagactatgggtccca

SEQ ID NO: 292328 - DNA, 25 bp, Mus musculus
ctcccggagcctagtgtgggttttg

SEQ ID NO: 292329 - DNA, 25 bp, Mus musculus
cttaccgtccatggccggtcgggct

SEQ ID NO: 292330 - DNA, 25 bp, Mus musculus
gccagtcgaaaagcaaacccagaga

SEQ ID NO: 292331 - DNA, 25 bp, Mus musculus
ggctgtaggtctaacggcttgtccg

SEQ ID NO: 292332 - DNA, 25 bp, Mus musculus
gtcctagtcggaggtctcgagccca

SEQ ID NO: 292333 - DNA, 25 bp, Mus musculus
ggggtcacctatgggccagtcgaaa

SEQ ID NO: 292334 - DNA, 25 bp, Mus musculus
cgttcaagtttgaggttccagcgtc

SEQ ID NO: 292335 - DNA, 25 bp, Mus musculus
gaagtacgtcatgcgcctgcgccga

SEQ ID NO: 292336 - DNA, 25 bp, Mus musculus
gtggacctggagtcggatcagatcc

SEQ ID NO: 292337 - DNA, 25 bp, Mus musculus
ggatcagatccgattgaagtgtatc

SEQ ID NO: 292338 - DNA, 25 bp, Mus musculus
atccgattgaagtgtatccgtaagg

SEQ ID NO: 292339 - DNA, 25 bp, Mus musculus
tgtatccgtaaggaaggtttcttca

SEQ ID NO: 292340 - DNA, 25 bp, Mus musculus
aaggtttcttcaccgtgcctccaga

SEQ ID NO: 292341 - DNA, 25 bp, Mus musculus
tgcctccagaacacagggtgcgacg

SEQ ID NO: 292342 - DNA, 25 bp, Mus musculus
tggcagggccagactgaagcgcacc

SEQ ID NO: 292343 - DNA, 25 bp, Mus musculus
ggcagaaatcggcagcccagaggct

SEQ ID NO: 292344 - DNA, 25 bp, Mus musculus
gttccgtgtcgcgttcaagtttgag

SEQ ID NO: 292345 - DNA, 25 bp, Mus musculus
caagtttgaggttccagcgtcggag

SEQ ID NO: 292346 - DNA, 25 bp, Mus musculus
ggattccgtccccaagtccagaaca

SEQ ID NO: 292347 - DNA, 25 bp, Mus musculus
agactgaagcgcaccggggcgttcc

SEQ ID NO: 292348 - DNA, 25 bp, Mus musculus
cgcaggacccgccaggaccaagagt

SEQ ID NO: 292349 - DNA, 25 bp, Mus musculus
cgaggccacctgactcaccgcagga

SEQ ID NO: 292350 - DNA, 25 bp, Mus musculus
tccgtgcgttccatgtggcctccgt

SEQ ID NO: 292351 - DNA, 25 bp, Mus musculus
acccacaggcctggaagactccagt

SEQ ID NO: 292352 - DNA, 25 bp, Mus musculus
cgaggacccacaggcctggaagact

SEQ ID NO: 292353 - DNA, 25 bp, Mus musculus
tcggaagccgcacgaggacccacag

SEQ ID NO: 292354 - DNA, 25 bp, Mus musculus
ctccgtggtgtcagggctcggaagc

SEQ ID NO: 292355 - DNA, 25 bp, Mus musculus
tgcgttccatgtggcctccgtggtg

SEQ ID NO: 292356 - DNA, 25 bp, Mus musculus
cagcagcaggcagcgtagcccacgg

SEQ ID NO: 292357 - DNA, 25 bp, Mus musculus
gagcggactcctccgtgcgttccat

SEQ ID NO: 292358 - DNA, 25 bp, Mus musculus
cacggcgctcggacgcagcgtccgc

SEQ ID NO: 292359 - DNA, 25 bp, Mus musculus
agcaggcagcgtagcccacggcgct

SEQ ID NO: 292360 - DNA, 25 bp, Mus musculus
agtgcccgcagctcctctaggaagc

SEQ ID NO: 292361 - DNA, 25 bp, Mus musculus
aagagtgcccgcagctcctctagga

SEQ ID NO: 292362 - DNA, 25 bp, Mus musculus
ggccagatcttggagggccggtgcc

SEQ ID NO: 292363 - DNA, 25 bp, Mus musculus
atcttggagggccggtgccaggtca

SEQ ID NO: 292364 - DNA, 25 bp, Mus musculus
ttggagggccggtgccaggtcagcc

SEQ ID NO: 292365 - DNA, 25 bp, Mus musculus
cgggccagatcttggagggccggtg

SEQ ID NO: 292366 - DNA, 25 bp, Mus musculus
tcttggagggccggtgccaggtcag

SEQ ID NO: 292367 - DNA, 25 bp, Mus musculus
gcgggccagatcttggagggccggt

SEQ ID NO: 292368 - DNA, 25 bp, Mus musculus
gatcttggagggccggtgccaggtc

SEQ ID NO: 292369 - DNA, 25 bp, Mus musculus
agatcttggagggccggtgccaggt

SEQ ID NO: 292370 - DNA, 25 bp, Mus musculus
cagatcttggagggccggtgccagg

SEQ ID NO: 292371 - DNA, 25 bp, Mus musculus
ccagatcttggagggccggtgccag

SEQ ID NO: 292372 - DNA, 25 bp, Mus musculus
cgcgggccagatcttggagggccgg

SEQ ID NO: 292373 - DNA, 25 bp, Mus musculus
gccagatcttggagggccggtgcca

SEQ ID NO: 292374 - DNA, 25 bp, Mus musculus
gggccagatcttggagggccggtgc

SEQ ID NO: 292375 - DNA, 25 bp, Mus musculus
cttggagggccggtgccaggtcagc

SEQ ID NO: 292376 - DNA, 25 bp, Mus musculus
ggtcgccgcaaacgcccgcgcggcc

SEQ ID NO: 292377 - DNA, 25 bp, Mus musculus
ccgtgcaggtcaaagtcttccacca

SEQ ID NO: 292378 - DNA, 25 bp, Mus musculus
agctcgcgctccaggcactggcgat

SEQ ID NO: 292379 - DNA, 25 bp, Mus musculus
agaatctgccagagcaccgcgcgca

SEQ ID NO: 292380 - DNA, 25 bp, Mus musculus
agtcttccaccagaatctgccagag

SEQ ID NO: 292381 - DNA, 25 bp, Mus musculus
ggtcaaagtcttccaccagaatctg

SEQ ID NO: 292382 - DNA, 25 bp, Mus musculus
gtgcaggtcaaagtcttccaccaga

SEQ ID NO: 292383 - DNA, 25 bp, Mus musculus
cagggctagcgcatcgtcctgtagc

SEQ ID NO: 292384 - DNA, 25 bp, Mus musculus
tgaacagggctagcgcatcgtcctg

SEQ ID NO: 292385 - DNA, 25 bp, Mus musculus
catcagtgaacagggctagcgcatc

SEQ ID NO: 292386 - DNA, 25 bp, Mus musculus
cacaggccatcagtgaacagggcta

SEQ ID NO: 292387 - DNA, 25 bp, Mus musculus
gcgctccaggcactggcgatagtcc

SEQ ID NO: 292388 - DNA, 25 bp, Mus musculus
cccacaggccatcagtgaacagggc

SEQ ID NO: 292389 - DNA, 25 bp, Mus musculus
ggctagcgcatcgtcctgtagcgcc

SEQ ID NO: 292390 - DNA, 25 bp, Mus musculus
taggcgtggcctgggcgaagctggg

SEQ ID NO: 292391 - DNA, 25 bp, Mus musculus
aggtgtaggcgtggcctgggcgaag

SEQ ID NO: 292392 - DNA, 25 bp, Mus musculus
ggtgtaggcgtggcctgggcgaagc

SEQ ID NO: 292393 - DNA, 25 bp, Mus musculus
ggcgtggcctgggcgaagctgggcg

SEQ ID NO: 292394 - DNA, 25 bp, Mus musculus
gtgtaggcgtggcctgggcgaagct

SEQ ID NO: 292395 - DNA, 25 bp, Mus musculus
tgtaggcgtggcctgggcgaagctg

SEQ ID NO: 292396 - DNA, 25 bp, Mus musculus
agggtggaggtgtaggcgtggcctg

SEQ ID NO: 292397 - DNA, 25 bp, Mus musculus
gggtggaggtgtaggcgtggcctgg

SEQ ID NO: 292398 - DNA, 25 bp, Mus musculus
gaggtgtaggcgtggcctgggcgaa

SEQ ID NO: 292399 - DNA, 25 bp, Mus musculus
ggtggaggtgtaggcgtggcctggg

SEQ ID NO: 292400 - DNA, 25 bp, Mus musculus
gtggaggtgtaggcgtggcctgggc

SEQ ID NO: 292401 - DNA, 25 bp, Mus musculus
ggaggtgtaggcgtggcctgggcga

SEQ ID NO: 292402 - DNA, 25 bp, Mus musculus
gtaggcgtggcctgggcgaagctgg

SEQ ID NO: 292403 - DNA, 25 bp, Mus musculus
gagggtggaggtgtaggcgtggcct

SEQ ID NO: 292404 - DNA, 25 bp, Mus musculus
tattccagagagctccgcttgggcc

SEQ ID NO: 292405 - DNA, 25 bp, Mus musculus
gtgccgccctttcggctaagtagga

SEQ ID NO: 292406 - DNA, 25 bp, Mus musculus
ccttggccttggtcgtgacgttggt

SEQ ID NO: 292407 - DNA, 25 bp, Mus musculus
gcagaaagtcaagcccgccccttgg

SEQ ID NO: 292408 - DNA, 25 bp, Mus musculus
gctcttccgcagaaagtcaagcccg

SEQ ID NO: 292409 - DNA, 25 bp, Mus musculus
ctcgctcttccgcagaaagtcaagc

SEQ ID NO: 292410 - DNA, 25 bp, Mus musculus
agagctccgcttgggcctgggtctc

SEQ ID NO: 292411 - DNA, 25 bp, Mus musculus
cagctattccagagagctccgcttg

SEQ ID NO: 292412 - DNA, 25 bp, Mus musculus
agtcgccagctattccagagagctc

SEQ ID NO: 292413 - DNA, 25 bp, Mus musculus
tgctagtcgccagctattccagaga

SEQ ID NO: 292414 - DNA, 25 bp, Mus musculus
gctacctgctagtcgccagctattc

SEQ ID NO: 292415 - DNA, 25 bp, Mus musculus
ggtgctacctgctagtcgccagcta

SEQ ID NO: 292416 - DNA, 25 bp, Mus musculus
cggcggtgctacctgctagtcgcca

SEQ ID NO: 292417 - DNA, 25 bp, Mus musculus
tgggcctgggtctctcctcgctctt

SEQ ID NO: 292418 - DNA, 25 bp, Mus musculus
ggacgcctccagaccggaacgcgga

SEQ ID NO: 292419 - DNA, 25 bp, Mus musculus
atcgggagcgccgaatccctctaca

SEQ ID NO: 292420 - DNA, 25 bp, Mus musculus
aaagggcctcccagagctgcttccg

SEQ ID NO: 292421 - DNA, 25 bp, Mus musculus
tgtctagctcgatggccttgttggc

SEQ ID NO: 292422 - DNA, 25 bp, Mus musculus
ttggccagtttcatggcgctctgca

SEQ ID NO: 292423 - DNA, 25 bp, Mus musculus
ggtcagtggctcttgtcacctcctc

SEQ ID NO: 292424 - DNA, 25 bp, Mus musculus
gagctactgctctgaagggtttctg

SEQ ID NO: 292425 - DNA, 25 bp, Mus musculus
tcctttaagggcctgtcgcgagttc

SEQ ID NO: 292426 - DNA, 25 bp, Mus musculus
gacccgaagaactccgggctcctga

SEQ ID NO: 292427 - DNA, 25 bp, Mus musculus
tgtgccaagttaagtccgctctagc

SEQ ID NO: 292428 - DNA, 25 bp, Mus musculus
agcgagtgtcgcctaccaccatgaa

SEQ ID NO: 292429 - DNA, 25 bp, Mus musculus
gagccacaccgagcagcgcggagca

SEQ ID NO: 292430 - DNA, 25 bp, Mus musculus
gtccgctctagcaagaagtcagggg

SEQ ID NO: 292431 - DNA, 25 bp, Mus musculus
tcctgtctcccggaatagctcggca

SEQ ID NO: 292432 - DNA, 25 bp, Mus musculus
aggcctttgaggacctttgctgggc

SEQ ID NO: 292433 - DNA, 25 bp, Mus musculus
cgggagtgcaagacacgcctgacaa

SEQ ID NO: 292434 - DNA, 25 bp, Mus musculus
ccagcagagacccagggcgggctct

SEQ ID NO: 292435 - DNA, 25 bp, Mus musculus
ggctctcgcgagaatgtgccaaagc

SEQ ID NO: 292436 - DNA, 25 bp, Mus musculus
gtggaaatggccgaaaggcctttga

SEQ ID NO: 292437 - DNA, 25 bp, Mus musculus
ctaggccaactgtccggctgcgcgt

SEQ ID NO: 292438 - DNA, 25 bp, Mus musculus
cgcgcctcagaccagacgtgcaagg

SEQ ID NO: 292439 - DNA, 25 bp, Mus musculus
ggtcttctcgaaccaacgccgtctg

SEQ ID NO: 292440 - DNA, 25 bp, Mus musculus
ccaaggcaacgctgaaggtcttctc

SEQ ID NO: 292441 - DNA, 25 bp, Mus musculus
tcaggcgaccaacagggtccgggca

SEQ ID NO: 292442 - DNA, 25 bp, Mus musculus
ggttccgggactcgtcctctctaga

SEQ ID NO: 292443 - DNA, 25 bp, Mus musculus
tgctggacacaccagacagcggggt

SEQ ID NO: 292444 - DNA, 25 bp, Mus musculus
cgcctgacaagtgctggacacacca

SEQ ID NO: 292445 - DNA, 25 bp, Mus musculus
tgtgccaaagccgtagctactgtcc

SEQ ID NO: 292446 - DNA, 25 bp, Mus musculus
gcccaggacggctgactcgcgggca

SEQ ID NO: 292447 - DNA, 25 bp, Mus musculus
tacccagcagctcggtccaagtttt

SEQ ID NO: 292448 - DNA, 25 bp, Mus musculus
agaaatggcaagacctacccagcag

SEQ ID NO: 292449 - DNA, 25 bp, Mus musculus
gaaggcagaaatggcaagacctacc

SEQ ID NO: 292450 - DNA, 25 bp, Mus musculus
cccgaagaatggagggaccgcactg

SEQ ID NO: 292451 - DNA, 25 bp, Mus musculus
agcagctcggtccaagtttttcgga

SEQ ID NO: 292452 - DNA, 25 bp, Mus musculus
gctgggatctgaacccggaccccga

SEQ ID NO: 292453 - DNA, 25 bp, Mus musculus
cccagcagctcggtccaagtttttc

SEQ ID NO: 292454 - DNA, 25 bp, Mus musculus
agccacgctgggatctgaacccgga

SEQ ID NO: 292455 - DNA, 25 bp, Mus musculus
ccgcgctgccttccgattggccgcg

SEQ ID NO: 292456 - DNA, 25 bp, Mus musculus
ggcatagcgtctggaacaccggctc

SEQ ID NO: 292457 - DNA, 25 bp, Mus musculus
gagcccggcatagcgtctggaacac

SEQ ID NO: 292458 - DNA, 25 bp, Mus musculus
cggggcccaccacccatggcagcac

SEQ ID NO: 292459 - DNA, 25 bp, Mus musculus
cagctcggtccaagtttttcggagg

SEQ ID NO: 292460 - DNA, 25 bp, Mus musculus
tttctcacatcagcgcccagatagc

SEQ ID NO: 292461 - DNA, 25 bp, Mus musculus
aatgacaaagcacacgggcggcgcg

SEQ ID NO: 292462 - DNA, 25 bp, Mus musculus
cgctgttatggagacccgccgcgcg

SEQ ID NO: 292463 - DNA, 25 bp, Mus musculus
cggggccggaatgacaaagcacacg

SEQ ID NO: 292464 - DNA, 25 bp, Mus musculus
agcgcccagatagcgctctaccgga

SEQ ID NO: 292465 - DNA, 25 bp, Mus musculus
cggcgcagcagctcccgaacgcgcg

SEQ ID NO: 292466 - DNA, 25 bp, Mus musculus
ggggcctcgacctttctcacatcag

SEQ ID NO: 292467 - DNA, 25 bp, Mus musculus
agtgacggggcctcgacctttctca

SEQ ID NO: 292468 - DNA, 25 bp, Mus musculus
ctggagcccggtaaggcgcaccgga

SEQ ID NO: 292469 - DNA, 25 bp, Mus musculus
acatcctcctgcgtagggacggttc

SEQ ID NO: 292470 - DNA, 25 bp, Mus musculus
cagacatcctcctgcgtagggacgg

SEQ ID NO: 292471 - DNA, 25 bp, Mus musculus
gcatccgggacacggcagacatcct

SEQ ID NO: 292472 - DNA, 25 bp, Mus musculus
ggtgtacgagcagcccatcaacgag

SEQ ID NO: 292473 - DNA, 25 bp, Mus musculus
ctgaaggtgtacgagcagcccatca

SEQ ID NO: 292474 - DNA, 25 bp, Mus musculus
tcatcgacctcatggccaacagcga

SEQ ID NO: 292475 - DNA, 25 bp, Mus musculus
gctgtgtgctttgcgcctgaccgac

SEQ ID NO: 292476 - DNA, 25 bp, Mus musculus
ttagatgagaacgaggagagagagc

SEQ ID NO: 292477 - DNA, 25 bp, Mus musculus
cgcagctggaaaggctcatcgacct

SEQ ID NO: 292478 - DNA, 25 bp, Mus musculus
aggctcatcgacctcatggccaaca

SEQ ID NO: 292479 - DNA, 25 bp, Mus musculus
ctttgcccaggctatgcggctgtgt

SEQ ID NO: 292480 - DNA, 25 bp, Mus musculus
tggccaacagcgactgcgaagacag

SEQ ID NO: 292481 - DNA, 25 bp, Mus musculus
gccaacagcgactgcgaagacagca

SEQ ID NO: 292482 - DNA, 25 bp, Mus musculus
ctatgcggctgtgtgctttgcgcct

SEQ ID NO: 292483 - DNA, 25 bp, Mus musculus
caggctatgcggctgtgtgctttgc

SEQ ID NO: 292484 - DNA, 25 bp, Mus musculus
agcgactgcgaagacagcagctgcg

SEQ ID NO: 292485 - DNA, 25 bp, Mus musculus
atgagggctacgtgggtccagaaga

SEQ ID NO: 292486 - DNA, 25 bp, Mus musculus
agctgtgcgcacctttgcccaggct

SEQ ID NO: 292487 - DNA, 25 bp, Mus musculus
tggaaaggctcatcgacctcatggc

SEQ ID NO: 292488 - DNA, 25 bp, Mus musculus
tcctccttgatgacgatgacgcaga

SEQ ID NO: 292489 - DNA, 25 bp, Mus musculus
ctgtgtccagagacgtgacgtgacg

SEQ ID NO: 292490 - DNA, 25 bp, Mus musculus
cgcacagccggctttctgaaagcca

SEQ ID NO: 292491 - DNA, 25 bp, Mus musculus
gaaagccagccatctccaaagccga

SEQ ID NO: 292492 - DNA, 25 bp, Mus musculus
tagggcccgactctcgcgagagctc

SEQ ID NO: 292493 - DNA, 25 bp, Mus musculus
gcgcaaacgcgacacgccaatcttg

SEQ ID NO: 292494 - DNA, 25 bp, Mus musculus
gcccacatcaggctgtcgggtccta

SEQ ID NO: 292495 - DNA, 25 bp, Mus musculus
cgcagaggaagagggaccaaaaccg

SEQ ID NO: 292496 - DNA, 25 bp, Mus musculus
aggaaggagtccgtgtcaacaaccg

SEQ ID NO: 292497 - DNA, 25 bp, Mus musculus
tgtcaacaaccggtttgagctggtg

SEQ ID NO: 292498 - DNA, 25 bp, Mus musculus
atgacgtcatgcgaaggggcacaaa

SEQ ID NO: 292499 - DNA, 25 bp, Mus musculus
agcgaaggggctgctaaaggctaac

SEQ ID NO: 292500 - DNA, 25 bp, Mus musculus
ggctgagtgacaggactttgctgca

SEQ ID NO: 292501 - DNA, 25 bp, Mus musculus
ctttgctgcagcatagggcgtgtct

SEQ ID NO: 292502 - DNA, 25 bp, Mus musculus
tgtccgcctgccttttcgtctctag

SEQ ID NO: 292503 - DNA, 25 bp, Mus musculus
gcggccagacttgctccgcattgtg

SEQ ID NO: 292504 - DNA, 25 bp, Mus musculus
agaaaggcgactctgggagccgcta

SEQ ID NO: 292505 - DNA, 25 bp, Mus musculus
ccagataggggccaaggtgaggctg

SEQ ID NO: 292506 - DNA, 25 bp, Mus musculus
ctagccgcgtgaagtcagcatgagg

SEQ ID NO: 292507 - DNA, 25 bp, Mus musculus
gccttttcgtctctagccgcgtgaa

SEQ ID NO: 292508 - DNA, 25 bp, Mus musculus
ggctgccgatcctccgcagcctgct

SEQ ID NO: 292509 - DNA, 25 bp, Mus musculus
cagcctcttataagagggcgcggcg

SEQ ID NO: 292510 - DNA, 25 bp, Mus musculus
cagcgcttacatcagccagcgaggg

SEQ ID NO: 292511 - DNA, 25 bp, Mus musculus
agcattggcccgcagcgcttacatc

SEQ ID NO: 292512 - DNA, 25 bp, Mus musculus
attgtgcggcgctccagcattggcc

SEQ ID NO: 292513 - DNA, 25 bp, Mus musculus
cagagcctgccgcattgtgcggcgc

SEQ ID NO: 292514 - DNA, 25 bp, Mus musculus
gctccgcattgtgcgggcggatctc

SEQ ID NO: 292515 - DNA, 25 bp, Mus musculus
tctctagccgcgtgaagtcagcatg

SEQ ID NO: 292516 - DNA, 25 bp, Mus musculus
ttcgattccctggtcagctcaatgc

SEQ ID NO: 292517 - DNA, 25 bp, Mus musculus
ttcatgcccggcttcgccccactta

SEQ ID NO: 292518 - DNA, 25 bp, Mus musculus
tggtcagctcaatgccgacctccgc

SEQ ID NO: 292519 - DNA, 25 bp, Mus musculus
attccctggtcagctcaatgccgac

SEQ ID NO: 292520 - DNA, 25 bp, Mus musculus
gattccctggtcagctcaatgccga

SEQ ID NO: 292521 - DNA, 25 bp, Mus musculus
tcgattccctggtcagctcaatgcc

SEQ ID NO: 292522 - DNA, 25 bp, Mus musculus
cttcgattccctggtcagctcaatg

SEQ ID NO: 292523 - DNA, 25 bp, Mus musculus
ccttcgattccctggtcagctcaat

SEQ ID NO: 292524 - DNA, 25 bp, Mus musculus
tgtctgccaccatgagtggagtcac

SEQ ID NO: 292525 - DNA, 25 bp, Mus musculus
tgtgtctgccaccatgagtggagtc

SEQ ID NO: 292526 - DNA, 25 bp, Mus musculus
cctatggggacctcaaccaccttgt

SEQ ID NO: 292527 - DNA, 25 bp, Mus musculus
acctatggggacctcaaccaccttg

SEQ ID NO: 292528 - DNA, 25 bp, Mus musculus
tggccacacccacctatggggacct

SEQ ID NO: 292529 - DNA, 25 bp, Mus musculus
cgattccctggtcagctcaatgccg

SEQ ID NO: 292530 - DNA, 25 bp, Mus musculus
ttcggcgacagacatttggctcttc

SEQ ID NO: 292531 - DNA, 25 bp, Mus musculus
ctgtgtcgctaaaggcctcgcttca

SEQ ID NO: 292532 - DNA, 25 bp, Mus musculus
ctgaggttcggaacagagcgctgtc

SEQ ID NO: 292533 - DNA, 25 bp, Mus musculus
cgctgtcgctcgtctgagcagaaga

SEQ ID NO: 292534 - DNA, 25 bp, Mus musculus
cagaagaggagttcggaatgccgca

SEQ ID NO: 292535 - DNA, 25 bp, Mus musculus
gaatgccgcagctccgacaggaacg

SEQ ID NO: 292536 - DNA, 25 bp, Mus musculus
gtccgggaggatgccaagctgacat

SEQ ID NO: 292537 - DNA, 25 bp, Mus musculus
gtgaccctcggagcacacagtgctg

SEQ ID NO: 292538 - DNA, 25 bp, Mus musculus
ctcgagagagcgacgcccaagcgaa

SEQ ID NO: 292539 - DNA, 25 bp, Mus musculus
ccgctaggaagaaatgcggggactc

SEQ ID NO: 292540 - DNA, 25 bp, Mus musculus
gatgcttgtgaaccgggagcttccc

SEQ ID NO: 292541 - DNA, 25 bp, Mus musculus
cggggacccaattgacagccatgca

SEQ ID NO: 292542 - DNA, 25 bp, Mus musculus
gctctggttcccagtccgctaggaa

SEQ ID NO: 292543 - DNA, 25 bp, Mus musculus
cagtgctgggtgaacactcacggga

SEQ ID NO: 292544 - DNA, 25 bp, Mus musculus
tgcaatcgccactggtcggactccg

SEQ ID NO: 292545 - DNA, 25 bp, Mus musculus
gcggcggcgaactacagtgtagcca

SEQ ID NO: 292546 - DNA, 25 bp, Mus musculus
tgtagccagccggtccggtacaatg

SEQ ID NO: 292547 - DNA, 25 bp, Mus musculus
cggtacaatgtagcggcagccaggt

SEQ ID NO: 292548 - DNA, 25 bp, Mus musculus
gccaggtaagccagaaagcggtctc

SEQ ID NO: 292549 - DNA, 25 bp, Mus musculus
agggtccagatctcagcatgcaatc

SEQ ID NO: 292550 - DNA, 25 bp, Mus musculus
gtacagtgtatcagcggcggcgaac

SEQ ID NO: 292551 - DNA, 25 bp, Mus musculus
ggatcgggcttctgacccacgcact

SEQ ID NO: 292552 - DNA, 25 bp, Mus musculus
gcactcatggtgcagaactggcaga

SEQ ID NO: 292553 - DNA, 25 bp, Mus musculus
tggcagaggcctcaagcaagacgtc

SEQ ID NO: 292554 - DNA, 25 bp, Mus musculus
aagcaagacgtccagctcccggctg

SEQ ID NO: 292555 - DNA, 25 bp, Mus musculus
caaggccttggtgacctcattggtc

SEQ ID NO: 292556 - DNA, 25 bp, Mus musculus
gggcagagcttagcgtccacagatg

SEQ ID NO: 292557 - DNA, 25 bp, Mus musculus
ccagaaagcggtctctgtaggtgtc

SEQ ID NO: 292558 - DNA, 25 bp, Mus musculus
ctgatcggaacacttgagcgggtgc

SEQ ID NO: 292559 - DNA, 25 bp, Mus musculus
cgaggacccaccgaagccattgatg

SEQ ID NO: 292560 - DNA, 25 bp, Mus musculus
tctaggtcaagttggccgcggacca

SEQ ID NO: 292561 - DNA, 25 bp, Mus musculus
ggaccatccgccatcagctgtcagg

SEQ ID NO: 292562 - DNA, 25 bp, Mus musculus
gcgacactcgggttcaggatcctaa

SEQ ID NO: 292563 - DNA, 25 bp, Mus musculus
gccgcgaaccagacacccaaagaga

SEQ ID NO: 292564 - DNA, 25 bp, Mus musculus
cccaaagagaggtccgagccgatgc

SEQ ID NO: 292565 - DNA, 25 bp, Mus musculus
gtggtgcactatgatccgcctgctg

SEQ ID NO: 292566 - DNA, 25 bp, Mus musculus
tttctccaagctgtggcgatgtggc

SEQ ID NO: 292567 - DNA, 25 bp, Mus musculus
ctgtggcattgcttcttgcaggtga

SEQ ID NO: 292568 - DNA, 25 bp, Mus musculus
ggcgcagcgtcttcccgatttctgc

SEQ ID NO: 292569 - DNA, 25 bp, Mus musculus
atttctgcctccgactccactagtg

SEQ ID NO: 292570 - DNA, 25 bp, Mus musculus
tagtgtctacctacggctgatcgga

SEQ ID NO: 292571 - DNA, 25 bp, Mus musculus
ctaaaggcccttggtgtctaggtca

SEQ ID NO: 292572 - DNA, 25 bp, Mus musculus
ctggtgactactgagtccgggcttc

SEQ ID NO: 292573 - DNA, 25 bp, Mus musculus
tacgcgtgaacaagcgggtagcatc

SEQ ID NO: 292574 - DNA, 25 bp, Mus musculus
cacctccttggagggcagtccgcaa

SEQ ID NO: 292575 - DNA, 25 bp, Mus musculus
gggcagtccgcaagccttccggagc

SEQ ID NO: 292576 - DNA, 25 bp, Mus musculus
ccggagctcgcatatcagggaaaga

SEQ ID NO: 292577 - DNA, 25 bp, Mus musculus
gcatatcagggaaagagacgcagtc

SEQ ID NO: 292578 - DNA, 25 bp, Mus musculus
agacgcagtctgtgtttgccgagcc

SEQ ID NO: 292579 - DNA, 25 bp, Mus musculus
tttgccgagccggatacccgcacgt

SEQ ID NO: 292580 - DNA, 25 bp, Mus musculus
atacccgcacgtttccaaggatctg

SEQ ID NO: 292581 - DNA, 25 bp, Mus musculus
cacgtttccaaggatctggcccggc

SEQ ID NO: 292582 - DNA, 25 bp, Mus musculus
ctcagaaggcatcagcgggtctcca

SEQ ID NO: 292583 - DNA, 25 bp, Mus musculus
cctcgggagactccatgcggccaat

SEQ ID NO: 292584 - DNA, 25 bp, Mus musculus
aactgctctggtgactactgagtcc

SEQ ID NO: 292585 - DNA, 25 bp, Mus musculus
tggggcgaacaaagcctacgcgtga

SEQ ID NO: 292586 - DNA, 25 bp, Mus musculus
accagcctggtggtcagctacacca

SEQ ID NO: 292587 - DNA, 25 bp, Mus musculus
gagtacatccctacggccttcgaca

SEQ ID NO: 292588 - DNA, 25 bp, Mus musculus
ttcgacaacttctcgggtgagcgcc

SEQ ID NO: 292589 - DNA, 25 bp, Mus musculus
tccgaccggtctggctccgggattc

SEQ ID NO: 292590 - DNA, 25 bp, Mus musculus
ggattccggagcgagctgcagctca

SEQ ID NO: 292591 - DNA, 25 bp, Mus musculus
agctgcagctcaggtggccttccca

SEQ ID NO: 292592 - DNA, 25 bp, Mus musculus
gcggctcacttccagcggatcttcg

SEQ ID NO: 292593 - DNA, 25 bp, Mus musculus
atcttcgcctggagcaacccggatt

SEQ ID NO: 292594 - DNA, 25 bp, Mus musculus
aacccggattgctcccgtgtgtgag

SEQ ID NO: 292595 - DNA, 25 bp, Mus musculus
ggcttgcgagaacgttcctttcttc

SEQ ID NO: 292596 - DNA, 25 bp, Mus musculus
gaacgttcctttcttctgagcccag

SEQ ID NO: 292597 - DNA, 25 bp, Mus musculus
cgcctgcgctgtctcggtttctgac

SEQ ID NO: 292598 - DNA, 25 bp, Mus musculus
gatagaagaaggagccgccggaccc

SEQ ID NO: 292599 - DNA, 25 bp, Mus musculus
tagtccagccgcaccgtttcgaggc

SEQ ID NO: 292600 - DNA, 25 bp, Mus musculus
agcatgtccgtgatgccgccgttga

SEQ ID NO: 292601 - DNA, 25 bp, Mus musculus
ggactcacccacgagcatgtccgtg

SEQ ID NO: 292602 - DNA, 25 bp, Mus musculus
gctcgaggacacaagtacacacacc

SEQ ID NO: 292603 - DNA, 25 bp, Mus musculus
gacaacaaagggctcgaggacacaa

SEQ ID NO: 292604 - DNA, 25 bp, Mus musculus
cgccggctaacaacgtacctgtacg

SEQ ID NO: 292605 - DNA, 25 bp, Mus musculus
cggcgccttgcgtttgctcatggcg

SEQ ID NO: 292606 - DNA, 25 bp, Mus musculus
atgccgccgttgagggtctcctgcg

SEQ ID NO: 292607 - DNA, 25 bp, Mus musculus
tgggtcttaccggtggaacaatggc

SEQ ID NO: 292608 - DNA, 25 bp, Mus musculus
taccggtggaacaatggcggcgcct

SEQ ID NO: 292609 - DNA, 25 bp, Mus musculus
gtttgcgagttctgaaaagacaaca

SEQ ID NO: 292610 - DNA, 25 bp, Mus musculus
ttgtggatcgcctggctcacgttct

SEQ ID NO: 292611 - DNA, 25 bp, Mus musculus
aacgtacctgtacgcattgtacttg

SEQ ID NO: 292612 - DNA, 25 bp, Mus musculus
ctcacgttcttctcaaagtttgcga

SEQ ID NO: 292613 - DNA, 25 bp, Mus musculus
acgcattgtacttgtggatcgcctg

SEQ ID NO: 292614 - DNA, 25 bp, Mus musculus
ggcagaatggcgcagaccgccatgt

SEQ ID NO: 292615 - DNA, 25 bp, Mus musculus
tacgtgtttagaggggcaggccttg

SEQ ID NO: 292616 - DNA, 25 bp, Mus musculus
tcagggtctccagagccggtgtcta

SEQ ID NO: 292617 - DNA, 25 bp, Mus musculus
cgcagaccgccatgtccgagactta

SEQ ID NO: 292618 - DNA, 25 bp, Mus musculus
ctccagagccggtgtctagaatatc

SEQ ID NO: 292619 - DNA, 25 bp, Mus musculus
cccgttcccggctctccacgctcgg

SEQ ID NO: 292620 - DNA, 25 bp, Mus musculus
ctcggttcctctcgctctgcggaga

SEQ ID NO: 292621 - DNA, 25 bp, Mus musculus
gcgcgggtttgcgtacgtgtttaga

SEQ ID NO: 292622 - DNA, 25 bp, Mus musculus
tctcgctctgcggagactggaggac

SEQ ID NO: 292623 - DNA, 25 bp, Mus musculus
ccggtgtctagaatatcgagatatc

SEQ ID NO: 292624 - DNA, 25 bp, Mus musculus
atcgagatatcctgcaaacctcgcg

SEQ ID NO: 292625 - DNA, 25 bp, Mus musculus
ccgccatgtccgagacttacggtaa

SEQ ID NO: 292626 - DNA, 25 bp, Mus musculus
ccgagacttacggtaagacgcgcgg

SEQ ID NO: 292627 - DNA, 25 bp, Mus musculus
ttcctctcgctctgcggagactgga

SEQ ID NO: 292628 - DNA, 25 bp, Mus musculus
gcgctgtgcccgtacctggtaacac

SEQ ID NO: 292629 - DNA, 25 bp, Mus musculus
ggtaacactgtgtcctgctcctccg

SEQ ID NO: 292630 - DNA, 25 bp, Mus musculus
gcggctcccgatagcgcttcatata

SEQ ID NO: 292631 - DNA, 25 bp, Mus musculus
ccaggcgacgcgacctatctagatg

SEQ ID NO: 292632 - DNA, 25 bp, Mus musculus
ctagatggaatgataggtggtcacc

SEQ ID NO: 292633 - DNA, 25 bp, Mus musculus
ccactcggtagaggtggagaccacc

SEQ ID NO: 292634 - DNA, 25 bp, Mus musculus
ccaccggactcaaggtgacgggaca

SEQ ID NO: 292635 - DNA, 25 bp, Mus musculus
cgaacagcgtttctccttgcgcgtc

SEQ ID NO: 292636 - DNA, 25 bp, Mus musculus
tcagctgagatcgtggcgcagcagc

SEQ ID NO: 292637 - DNA, 25 bp, Mus musculus
gtcctccaccaagatgtcgccgatg

SEQ ID NO: 292638 - DNA, 25 bp, Mus musculus
gcagcagctatagcgcgaacagcgt

SEQ ID NO: 292639 - DNA, 25 bp, Mus musculus
cttagttcagcaagcggattctgtc

SEQ ID NO: 292640 - DNA, 25 bp, Mus musculus
cggtcctacagcagccggagacgaa

SEQ ID NO: 292641 - DNA, 25 bp, Mus musculus
ggggactctaggagcagcgtcctta

SEQ ID NO: 292642 - DNA, 25 bp, Mus musculus
gcagactccatacctggtgtccggg

SEQ ID NO: 292643 - DNA, 25 bp, Mus musculus
cgattgtcgattgtcgtcctgagga

SEQ ID NO: 292644 - DNA, 25 bp, Mus musculus
acgcgagtgcgcctagaagcatttg

SEQ ID NO: 292645 - DNA, 25 bp, Mus musculus
agcctcgtcgtactcctgcttggtg

SEQ ID NO: 292646 - DNA, 25 bp, Mus musculus
gccaccgatccacactgagtacttg

SEQ ID NO: 292647 - DNA, 25 bp, Mus musculus
ccttgatcttcatggtgctgggagc

SEQ ID NO: 292648 - DNA, 25 bp, Mus musculus
agctgtgatctccttctgcatgcgg

SEQ ID NO: 292649 - DNA, 25 bp, Mus musculus
catgcggtcagcgataccagggtac

SEQ ID NO: 292650 - DNA, 25 bp, Mus musculus
ccctgacatgacgttgttggcatac

SEQ ID NO: 292651 - DNA, 25 bp, Mus musculus
ggtccttcctgatgtcgatgtcgca

SEQ ID NO: 292652 - DNA, 25 bp, Mus musculus
cctgcaaccacagcacgattgtcga

SEQ ID NO: 292653 - DNA, 25 bp, Mus musculus
attgccgatggtgatgacctgcccg

SEQ ID NO: 292654 - DNA, 25 bp, Mus musculus
tccgggcaacggaaacgctcattgc

SEQ ID NO: 292655 - DNA, 25 bp, Mus musculus
tcatgatgctgttgtaggtggtctc

SEQ ID NO: 292656 - DNA, 25 bp, Mus musculus
tgctccggaccgagagcttgccaga

SEQ ID NO: 292657 - DNA, 25 bp, Mus musculus
gggccaccattaagcagcgacaata

SEQ ID NO: 292658 - DNA, 25 bp, Mus musculus
attcaccgcggtggatccagtgctc

SEQ ID NO: 292659 - DNA, 25 bp, Mus musculus
atttggagtcctgcgacccgattca

SEQ ID NO: 292660 - DNA, 25 bp, Mus musculus
gttgacgtcacatccagtaccgggg

SEQ ID NO: 292661 - DNA, 25 bp, Mus musculus
aactgggagcgctttgttgacgtca

SEQ ID NO: 292662 - DNA, 25 bp, Mus musculus
atgacgtcaaagatcggcgccgaga

SEQ ID NO: 292663 - DNA, 25 bp, Mus musculus
cccggagcttgaacacctgaggggc

SEQ ID NO: 292664 - DNA, 25 bp, Mus musculus
agagcttgccagaagcgccggtctc

SEQ ID NO: 292665 - DNA, 25 bp, Mus musculus
ctcgcgggctaatagcgagaacctc

SEQ ID NO: 292666 - DNA, 25 bp, Mus musculus
ggagacgctcggaaacatgtttgca

SEQ ID NO: 292667 - DNA, 25 bp, Mus musculus
tcctgctcgctctaggcgtggacgt

SEQ ID NO: 292668 - DNA, 25 bp, Mus musculus
acgggcgagttaaccgcagatccca

SEQ ID NO: 292669 - DNA, 25 bp, Mus musculus
cgcgagaatgaccagaagtactttc

SEQ ID NO: 292670 - DNA, 25 bp, Mus musculus
tgagacctttgggtgccttcgcctt

SEQ ID NO: 292671 - DNA, 25 bp, Mus musculus
cagaagccagccatatccgagagga

SEQ ID NO: 292672 - DNA, 25 bp, Mus musculus
tacgacctgagtctcttgcttgaga

SEQ ID NO: 292673 - DNA, 25 bp, Mus musculus
tggagcgtccgagccctttctctcg

SEQ ID NO: 292674 - DNA, 25 bp, Mus musculus
ccacgacttgtgaacctggagcgtc

SEQ ID NO: 292675 - DNA, 25 bp, Mus musculus
cggaatcagcagtagcgccctagca

SEQ ID NO: 292676 - DNA, 25 bp, Mus musculus
agccctaggagcttccatacttctg

SEQ ID NO: 292677 - DNA, 25 bp, Mus musculus
acgagcggggtccattcagaagcca

SEQ ID NO: 292678 - DNA, 25 bp, Mus musculus
atcagagaggtccacgcgcgtacga

SEQ ID NO: 292679 - DNA, 25 bp, Mus musculus
ccgaacccggcttgtggatcagaga

SEQ ID NO: 292680 - DNA, 25 bp, Mus musculus
ctgcaccctggagcctggcgaacag

SEQ ID NO: 292681 - DNA, 25 bp, Mus musculus
gttcccaaggtctcgcacaccggtg

SEQ ID NO: 292682 - DNA, 25 bp, Mus musculus
ttccatacttctgagcgcccggtcg

SEQ ID NO: 292683 - DNA, 25 bp, Mus musculus
cagccgcacgcggaagctttttcgc

SEQ ID NO: 292684 - DNA, 25 bp, Mus musculus
agggacaatgcgctctagcctggcc

SEQ ID NO: 292685 - DNA, 25 bp, Mus musculus
tgataccaatagctcagcgacagcc

SEQ ID NO: 292686 - DNA, 25 bp, Mus musculus
ccgcacggtccgtggtcaaagtggc

SEQ ID NO: 292687 - DNA, 25 bp, Mus musculus
tcctcaggcgtcttagggacaatgc

SEQ ID NO: 292688 - DNA, 25 bp, Mus musculus
tcgcctaatagcatcctcaggcgtc

SEQ ID NO: 292689 - DNA, 25 bp, Mus musculus
gaacctgtgtgcaaccctcgcctaa

SEQ ID NO: 292690 - DNA, 25 bp, Mus musculus
gcgacagcccaagcagacgaacctg

SEQ ID NO: 292691 - DNA, 25 bp, Mus musculus
acttcgcgccagtacacgtgctttg

SEQ ID NO: 292692 - DNA, 25 bp, Mus musculus
tcgcaactgtgggaacttcgcgcca

SEQ ID NO: 292693 - DNA, 25 bp, Mus musculus
gtgcttcgctcctctcgcaactgtg

SEQ ID NO: 292694 - DNA, 25 bp, Mus musculus
aaagtttggaatacgtgcttcgctc

SEQ ID NO: 292695 - DNA, 25 bp, Mus musculus
cgctcagtttggagccgtgcaaagt

SEQ ID NO: 292696 - DNA, 25 bp, Mus musculus
caaagtggccggcattttgccgggc

SEQ ID NO: 292697 - DNA, 25 bp, Mus musculus
cgtgctttgcctacagtctctgata

SEQ ID NO: 292698 - DNA, 25 bp, Mus musculus
ctctagcgatgtctgcgtgacgccc

SEQ ID NO: 292699 - DNA, 25 bp, Mus musculus
ggaaaactcacctctcgacgccgga

SEQ ID NO: 292700 - DNA, 25 bp, Mus musculus
cgagcgccctcgtgagctcgcagtt

SEQ ID NO: 292701 - DNA, 25 bp, Mus musculus
ggcaccggctgcttccgtatcggtt

SEQ ID NO: 292702 - DNA, 25 bp, Mus musculus
gcgctcggcgctcctctagcgatgt

SEQ ID NO: 292703 - DNA, 25 bp, Mus musculus
cttccgtatcggttgcccgccgtag

SEQ ID NO: 292704 - DNA, 25 bp, Mus musculus
gcgtcaacgtctgccggaagcgcct

SEQ ID NO: 292705 - DNA, 25 bp, Mus musculus
ggaagcgcctccctcacatgtggct

SEQ ID NO: 292706 - DNA, 25 bp, Mus musculus
ctcacatgtggctcgccgccgtgga

SEQ ID NO: 292707 - DNA, 25 bp, Mus musculus
ttgggtttcctctgcgccgaggcgc

SEQ ID NO: 292708 - DNA, 25 bp, Mus musculus
gccagtttggcggatgcggacacca

SEQ ID NO: 292709 - DNA, 25 bp, Mus musculus
tgcggacaccagtcctaacaggagg

SEQ ID NO: 292710 - DNA, 25 bp, Mus musculus
agtcctaacaggagggaaccggctg

SEQ ID NO: 292711 - DNA, 25 bp, Mus musculus
taggactccgtacgacgaccggcta

SEQ ID NO: 292712 - DNA, 25 bp, Mus musculus
gaggctgttatctcgctggcgacac

SEQ ID NO: 292713 - DNA, 25 bp, Mus musculus
tgggcatcgcctactacatgtactc

SEQ ID NO: 292714 - DNA, 25 bp, Mus musculus
acgcgcgcctcaagttttctccggg

SEQ ID NO: 292715 - DNA, 25 bp, Mus musculus
gggtgcagcgacttgcctcccgcat

SEQ ID NO: 292716 - DNA, 25 bp, Mus musculus
cctcagcgtcgattggtcgcccttt

SEQ ID NO: 292717 - DNA, 25 bp, Mus musculus
tgatcagaggcgtgatccctcccta

SEQ ID NO: 292718 - DNA, 25 bp, Mus musculus
cgccaggatcttggaggctgttatc

SEQ ID NO: 292719 - DNA, 25 bp, Mus musculus
tccactccctgtgccgggatcatag

SEQ ID NO: 292720 - DNA, 25 bp, Mus musculus
tgccgggatcatagggacaaccctt

SEQ ID NO: 292721 - DNA, 25 bp, Mus musculus
tcgtaccgtggttctgtcagacctc

SEQ ID NO: 292722 - DNA, 25 bp, Mus musculus
ttgcgcccagatcttggggaccttg

SEQ ID NO: 292723 - DNA, 25 bp, Mus musculus
gaaccctggtgctccagtgatcaga

SEQ ID NO: 292724 - DNA, 25 bp, Mus musculus
gtcagacctcccgttctacttgcta

SEQ ID NO: 292725 - DNA, 25 bp, Mus musculus
tcttggggatcgttgtcacccgaaa

SEQ ID NO: 292726 - DNA, 25 bp, Mus musculus
tcgccgaacacgtcgtccgagatgt

SEQ ID NO: 292727 - DNA, 25 bp, Mus musculus
tctgaaattcactctgcggacacgc

SEQ ID NO: 292728 - DNA, 25 bp, Mus musculus
gtccgcccagcggttctgaaattca

SEQ ID NO: 292729 - DNA, 25 bp, Mus musculus
cgggtcccggtgctccgtgctcttt

SEQ ID NO: 292730 - DNA, 25 bp, Mus musculus
agctcatagccgctcgccggcgtgg

SEQ ID NO: 292731 - DNA, 25 bp, Mus musculus
gggatagcaggtcgccctgcctcct

SEQ ID NO: 292732 - DNA, 25 bp, Mus musculus
ctggccaatagagagcgccggcctc

SEQ ID NO: 292733 - DNA, 25 bp, Mus musculus
gcaccttcagctgctggccaataga

SEQ ID NO: 292734 - DNA, 25 bp, Mus musculus
tcactctgcggacacgctccaggtg

SEQ ID NO: 292735 - DNA, 25 bp, Mus musculus
ctctcgtagcgtgcacgggctgcct

SEQ ID NO: 292736 - DNA, 25 bp, Mus musculus
tccgagatgtgcaggctctcgtagc

SEQ ID NO: 292737 - DNA, 25 bp, Mus musculus
ctcctcgagttccaagggatccgcg

SEQ ID NO: 292738 - DNA, 25 bp, Mus musculus
ggaagagactcagccgctgcccaga

SEQ ID NO: 292739 - DNA, 25 bp, Mus musculus
cgctcacgctcatcgtccgaggagg

SEQ ID NO: 292740 - DNA, 25 bp, Mus musculus
ctgctgccatactggcggaagcgga

SEQ ID NO: 292741 - DNA, 25 bp, Mus musculus
ttcccagaggctccggcgggtgtca

SEQ ID NO: 292742 - DNA, 25 bp, Mus musculus
gcacccggcagatcgccgctgagtt

SEQ ID NO: 292743 - DNA, 25 bp, Mus musculus
ttcatgaaggtgagggcacccggca

SEQ ID NO: 292744 - DNA, 25 bp, Mus musculus
tgcttcgataaggacgagttcatga

SEQ ID NO: 292745 - DNA, 25 bp, Mus musculus
ggccggacacgctgtgcttcgataa

SEQ ID NO: 292746 - DNA, 25 bp, Mus musculus
gtgatggagaaacgcaggatgaacc

SEQ ID NO: 292747 - DNA, 25 bp, Mus musculus
ggctgtcgctcgctgctgccatact

SEQ ID NO: 292748 - DNA, 25 bp, Mus musculus
ccgcgacgctcgtctattggctgtc

SEQ ID NO: 292749 - DNA, 25 bp, Mus musculus
tcttatcaccaacagtgcgcagccg

SEQ ID NO: 292750 - DNA, 25 bp, Mus musculus
agggcgccgctcttatcaccaacag

SEQ ID NO: 292751 - DNA, 25 bp, Mus musculus
tcgactcccggaggcagtagcgcca

SEQ ID NO: 292752 - DNA, 25 bp, Mus musculus
tgcgtgaggctgcagtaccacgctc

SEQ ID NO: 292753 - DNA, 25 bp, Mus musculus
atgaacctgcctacggggccggaca

SEQ ID NO: 292754 - DNA, 25 bp, Mus musculus
ctttccgggaccctagggcatctct

SEQ ID NO: 292755 - DNA, 25 bp, Mus musculus
gccgccgagattggagatgaccaca

SEQ ID NO: 292756 - DNA, 25 bp, Mus musculus
gagctcctcctgttatggcccttca

SEQ ID NO: 292757 - DNA, 25 bp, Mus musculus
ttaactcagggcgaagaccgccatg

SEQ ID NO: 292758 - DNA, 25 bp, Mus musculus
tccctgagcccggtcggcacttgaa

SEQ ID NO: 292759 - DNA, 25 bp, Mus musculus
ggttcccgctcatgacggccgaacg

SEQ ID NO: 292760 - DNA, 25 bp, Mus musculus
gtcgccgaagcgcaccagcttctgg

SEQ ID NO: 292761 - DNA, 25 bp, Mus musculus
caccaggcagcggtcgatgatttcg

SEQ ID NO: 292762 - DNA, 25 bp, Mus musculus
gtacttctcccggatcttctccttg

SEQ ID NO: 292763 - DNA, 25 bp, Mus musculus
ctcctccataggacgctttccggga

SEQ ID NO: 292764 - DNA, 25 bp, Mus musculus
ctccttgtcctgcatgatcttcctg

SEQ ID NO: 292765 - DNA, 25 bp, Mus musculus
ccatggggctcagcgatgagaagta

SEQ ID NO: 292766 - DNA, 25 bp, Mus musculus
agaagtaggtgaagcgcttccgctc

SEQ ID NO: 292767 - DNA, 25 bp, Mus musculus
catctggtaccggtcgggaccacta

SEQ ID NO: 292768 - DNA, 25 bp, Mus musculus
cagcccagcgccacttcctcaaaca

SEQ ID NO: 292769 - DNA, 25 bp, Mus musculus
tcaaacacttcctgccctgacgtca

SEQ ID NO: 292770 - DNA, 25 bp, Mus musculus
acagccagccaaggtgctggacctg

SEQ ID NO: 292771 - DNA, 25 bp, Mus musculus
tggctctcggagacgcagccacagc

SEQ ID NO: 292772 - DNA, 25 bp, Mus musculus
cgagccactggctctcggagacgca

SEQ ID NO: 292773 - DNA, 25 bp, Mus musculus
gacgcgcgagccactggctctcgga

SEQ ID NO: 292774 - DNA, 25 bp, Mus musculus
cacgggtactagacggctcttaaag

SEQ ID NO: 292775 - DNA, 25 bp, Mus musculus
cacccgctgaggacatgaaaactcg

SEQ ID NO: 292776 - DNA, 25 bp, Mus musculus
gccctgacgtcacgggtactagacg

SEQ ID NO: 292777 - DNA, 25 bp, Mus musculus
gcccaccggtgggtccgctcagcat

SEQ ID NO: 292778 - DNA, 25 bp, Mus musculus
tgaggacatgaaaactcggggtccc

SEQ ID NO: 292779 - DNA, 25 bp, Mus musculus
ccgccctcgcgtgggactcacctgc

SEQ ID NO: 292780 - DNA, 25 bp, Mus musculus
gcgacacccgctgaggacatgaaaa

SEQ ID NO: 292781 - DNA, 25 bp, Mus musculus
cgcacacccgggtgagccggtccac

SEQ ID NO: 292782 - DNA, 25 bp, Mus musculus
tgtatcgagtgcaaccgagaggctc

SEQ ID NO: 292783 - DNA, 25 bp, Mus musculus
gccctgttagcctcaagcactcatt

SEQ ID NO: 292784 - DNA, 25 bp, Mus musculus
gagttgtagtcctcgccctgttagc

SEQ ID NO: 292785 - DNA, 25 bp, Mus musculus
gcttcagcaaggacagcggagagta

SEQ ID NO: 292786 - DNA, 25 bp, Mus musculus
ttcccagatgcttccacgctgggca

SEQ ID NO: 292787 - DNA, 25 bp, Mus musculus
agcactcattcagcgcttggactac

SEQ ID NO: 292788 - DNA, 25 bp, Mus musculus
atccgaacttgctgtggtccggggc

SEQ ID NO: 292789 - DNA, 25 bp, Mus musculus
gctcaggagctgtaccgggactaca

SEQ ID NO: 292790 - DNA, 25 bp, Mus musculus
agataaccatctgcgtgagcgcgcc

SEQ ID NO: 292791 - DNA, 25 bp, Mus musculus
gctaggaaggcggatccgaacttgc

SEQ ID NO: 292792 - DNA, 25 bp, Mus musculus
gcgacttcttcctcttgcctgtatc

SEQ ID NO: 292793 - DNA, 25 bp, Mus musculus
aagcaggagccctagagtggccatg

SEQ ID NO: 292794 - DNA, 25 bp, Mus musculus
ctacaagtcccagtaagcccttggg

SEQ ID NO: 292795 - DNA, 25 bp, Mus musculus
ccacggcgtgctcaagataaccatc

SEQ ID NO: 292796 - DNA, 25 bp, Mus musculus
catctgttgttcacactgacccgca

SEQ ID NO: 292797 - DNA, 25 bp, Mus musculus
ctcggttcagctcgtcctggatgcg

SEQ ID NO: 292798 - DNA, 25 bp, Mus musculus
gcgcctagtccttaccatctccttg

SEQ ID NO: 292799 - DNA, 25 bp, Mus musculus
acgacgggactcacggcgcctagtc

SEQ ID NO: 292800 - DNA, 25 bp, Mus musculus
caaaagagagtgtcccacgacggga

SEQ ID NO: 292801 - DNA, 25 bp, Mus musculus
ctttcagggaccaaaagagagtgtc

SEQ ID NO: 292802 - DNA, 25 bp, Mus musculus
atgtgaagccgtgggaagccctaga

SEQ ID NO: 292803 - DNA, 25 bp, Mus musculus
ctgaagctgccctgccggaggtgat

SEQ ID NO: 292804 - DNA, 25 bp, Mus musculus
ttgttcacactgacccgcaggcgca

SEQ ID NO: 292805 - DNA, 25 bp, Mus musculus
cgcgccggtaatcggattcctggag

SEQ ID NO: 292806 - DNA, 25 bp, Mus musculus
ttccgcgccggtaatcggattcctg

SEQ ID NO: 292807 - DNA, 25 bp, Mus musculus
cgagtaccgcttccgcgccggtaat

SEQ ID NO: 292808 - DNA, 25 bp, Mus musculus
gctcgtcctggatgcgcgattatga

SEQ ID NO: 292809 - DNA, 25 bp, Mus musculus
ctgttctcctgagacccggcaggcg

SEQ ID NO: 292810 - DNA, 25 bp, Mus musculus
ggacgctgctcaataccggcctacg

SEQ ID NO: 292811 - DNA, 25 bp, Mus musculus
tgcgcccgcactatcgcggttcaga

SEQ ID NO: 292812 - DNA, 25 bp, Mus musculus
taccggcctacgaggaggcagctca

SEQ ID NO: 292813 - DNA, 25 bp, Mus musculus
gctctcacaatgtctgcttgccgtg

SEQ ID NO: 292814 - DNA, 25 bp, Mus musculus
tgcggatccctgttccgggaaccca

SEQ ID NO: 292815 - DNA, 25 bp, Mus musculus
cggcgctactgctgcctattcaaca

SEQ ID NO: 292816 - DNA, 25 bp, Mus musculus
tcttcggagccttgaccattcttgg

SEQ ID NO: 292817 - DNA, 25 bp, Mus musculus
tcctgactcaagagcgctgacatcg

SEQ ID NO: 292818 - DNA, 25 bp, Mus musculus
ccaccctcgggtgaagacagcatgc

SEQ ID NO: 292819 - DNA, 25 bp, Mus musculus
accttcagacggctgcctccggtga

SEQ ID NO: 292820 - DNA, 25 bp, Mus musculus
tcacagcagcgggtcactggtcctt

SEQ ID NO: 292821 - DNA, 25 bp, Mus musculus
ggctcagtagccttgctggctcaca

SEQ ID NO: 292822 - DNA, 25 bp, Mus musculus
cgctcgcagaaagaagactcggggc

SEQ ID NO: 292823 - DNA, 25 bp, Mus musculus
ttcaacacctggacaacctcggagg

SEQ ID NO: 292824 - DNA, 25 bp, Mus musculus
ttgcggacatggctccaggagacca

SEQ ID NO: 292825 - DNA, 25 bp, Mus musculus
aggagctacgctcacccaggtcgta

SEQ ID NO: 292826 - DNA, 25 bp, Mus musculus
aacggcgtccaggagtgcctccgaa

SEQ ID NO: 292827 - DNA, 25 bp, Mus musculus
gctcaacggagtccgaatcgtgctc

SEQ ID NO: 292828 - DNA, 25 bp, Mus musculus
cgccatgggaatcagcacggagacc

SEQ ID NO: 292829 - DNA, 25 bp, Mus musculus
tggccgtacggagtgccactgtcct

SEQ ID NO: 292830 - DNA, 25 bp, Mus musculus
tacagccgtgtagcagaccagccca

SEQ ID NO: 292831 - DNA, 25 bp, Mus musculus
cagtgtgctcctctatgcggtaggc

SEQ ID NO: 292832 - DNA, 25 bp, Mus musculus
gcccacgacccttgcttgtcttaaa

SEQ ID NO: 292833 - DNA, 25 bp, Mus musculus
tggcttggtatccacggcaaccatg

SEQ ID NO: 292834 - DNA, 25 bp, Mus musculus
caaccatgtgtctgcgcctcggtta

SEQ ID NO: 292835 - DNA, 25 bp, Mus musculus
ctcggttaacgcgtctgcttttaca

SEQ ID NO: 292836 - DNA, 25 bp, Mus musculus
acaagtttgtatcgatggcggtccc

SEQ ID NO: 292837 - DNA, 25 bp, Mus musculus
cgggatgcgtttcactgtctttggc

SEQ ID NO: 292838 - DNA, 25 bp, Mus musculus
ttgcacagagctaggggagacttac

SEQ ID NO: 292839 - DNA, 25 bp, Mus musculus
ggttcccgaaacacacaggatcttc

SEQ ID NO: 292840 - DNA, 25 bp, Mus musculus
atctttgacatctttgcggaactgg

SEQ ID NO: 292841 - DNA, 25 bp, Mus musculus
cgcctctggacgcacatctttgaca

SEQ ID NO: 292842 - DNA, 25 bp, Mus musculus
cagagcgatcgcctctggacgcaca

SEQ ID NO: 292843 - DNA, 25 bp, Mus musculus
ccgcaacgctgccaggacctgaacc

SEQ ID NO: 292844 - DNA, 25 bp, Mus musculus
acaggatcttcccatcgacctaaca

SEQ ID NO: 292845 - DNA, 25 bp, Mus musculus
aggtgcccacctgagccgcagactg

SEQ ID NO: 292846 - DNA, 25 bp, Mus musculus
tgcggaactgggttcccgaaacaca

SEQ ID NO: 292847 - DNA, 25 bp, Mus musculus
agctaggggagacttacctgcgacc

SEQ ID NO: 292848 - DNA, 25 bp, Mus musculus
cctgtcccagtctcggggttgcacg

SEQ ID NO: 292849 - DNA, 25 bp, Mus musculus
cccagtcgcgggattgtacggagct

SEQ ID NO: 292850 - DNA, 25 bp, Mus musculus
atcgacctaacacaggcttcctgcg

SEQ ID NO: 292851 - DNA, 25 bp, Mus musculus
agacttacctgcgacccgagaaccg

SEQ ID NO: 292852 - DNA, 25 bp, Mus musculus
ccggatcagctgagacacggctctc

SEQ ID NO: 292853 - DNA, 25 bp, Mus musculus
cagtgtgcacggctgcggccctgtt

SEQ ID NO: 292854 - DNA, 25 bp, Mus musculus
ctcaatcctgagctggcggatggca

SEQ ID NO: 292855 - DNA, 25 bp, Mus musculus
agctcgcaagccttcgtgcactggc

SEQ ID NO: 292856 - DNA, 25 bp, Mus musculus
gctctccgagtagccttggggccgc

SEQ ID NO: 292857 - DNA, 25 bp, Mus musculus
ttggggccgcctctcagagagcgat

SEQ ID NO: 292858 - DNA, 25 bp, Mus musculus
tgttcctcagaaacagctcgcaagc

SEQ ID NO: 292859 - DNA, 25 bp, Mus musculus
cgcctctcagagagcgatccgggga

SEQ ID NO: 292860 - DNA, 25 bp, Mus musculus
agcgatccggggagagctcaaacac

SEQ ID NO: 292861 - DNA, 25 bp, Mus musculus
gagctcaaacacaagcacctcggtg

SEQ ID NO: 292862 - DNA, 25 bp, Mus musculus
ctgagacacggctctccgagtagcc

SEQ ID NO: 292863 - DNA, 25 bp, Mus musculus
cacctcggtgagctgtcgcactcgt

SEQ ID NO: 292864 - DNA, 25 bp, Mus musculus
gctgcggccctgttcctcagaaaca

SEQ ID NO: 292865 - DNA, 25 bp, Mus musculus
gtgcactggcccagccggatcagct

SEQ ID NO: 292866 - DNA, 25 bp, Mus musculus
gcgccgtctcgatgaactgccggta

SEQ ID NO: 292867 - DNA, 25 bp, Mus musculus
tggtacatttcgctctccaggtagg

SEQ ID NO: 292868 - DNA, 25 bp, Mus musculus
tgctgcgacagttgcttcacgtaca

SEQ ID NO: 292869 - DNA, 25 bp, Mus musculus
gacatggctgccactcgtcttgctc

SEQ ID NO: 292870 - DNA, 25 bp, Mus musculus
accagacttgacgtgtgtcgccgga

SEQ ID NO: 292871 - DNA, 25 bp, Mus musculus
cctcagcggctgtcaggagacaacc

SEQ ID NO: 292872 - DNA, 25 bp, Mus musculus
cgagcccagcgttcctaagcctgtg

SEQ ID NO: 292873 - DNA, 25 bp, Mus musculus
agccaccttcggttaggcgttcgag

SEQ ID NO: 292874 - DNA, 25 bp, Mus musculus
actgccggtagttctggtagacgtt

SEQ ID NO: 292875 - DNA, 25 bp, Mus musculus
aggtaggagatctcccgcgccgtct

SEQ ID NO: 292876 - DNA, 25 bp, Mus musculus
ggatgctctccaggctgctcttctg

SEQ ID NO: 292877 - DNA, 25 bp, Mus musculus
tggcgtctccaacaggtccctgcag

SEQ ID NO: 292878 - DNA, 25 bp, Mus musculus
tagacgttgcgcttcaggttctgtg

SEQ ID NO: 292879 - DNA, 25 bp, Mus musculus
agcaggtggctcagctggtacattt

SEQ ID NO: 292880 - DNA, 25 bp, Mus musculus
acgcagatgccgtgcttgttcatgc

SEQ ID NO: 292881 - DNA, 25 bp, Mus musculus
gagaccggctaagcggaggatcctc

SEQ ID NO: 292882 - DNA, 25 bp, Mus musculus
ttgtgcttcttccagtcctggcgct

SEQ ID NO: 292883 - DNA, 25 bp, Mus musculus
cagtcctggcgctggtgctctttgc

SEQ ID NO: 292884 - DNA, 25 bp, Mus musculus
ggtgctctttgcagcagtagaagga

SEQ ID NO: 292885 - DNA, 25 bp, Mus musculus
cgcagcgcagcaggttctccatctt

SEQ ID NO: 292886 - DNA, 25 bp, Mus musculus
caacggcttggtctgcccgttgggc

SEQ ID NO: 292887 - DNA, 25 bp, Mus musculus
aggaagtcgtccaccacgcagatgc

SEQ ID NO: 292888 - DNA, 25 bp, Mus musculus
gcttgttcatgcacggcacgatgta

SEQ ID NO: 292889 - DNA, 25 bp, Mus musculus
cacgatgtactccagagccagcttc

SEQ ID NO: 292890 - DNA, 25 bp, Mus musculus
agccagcttcaacgcgggcaacggc

SEQ ID NO: 292891 - DNA, 25 bp, Mus musculus
agtactgccggtcgcgctcgctggc

SEQ ID NO: 292892 - DNA, 25 bp, Mus musculus
gctgtcactggccatggccgcggca

SEQ ID NO: 292893 - DNA, 25 bp, Mus musculus
gcacagctcgcagtactgccggtcg

SEQ ID NO: 292894 - DNA, 25 bp, Mus musculus
ccgcgacaggactacacagctcagg

SEQ ID NO: 292895 - DNA, 25 bp, Mus musculus
caccagtgcacgagtttggggacct

SEQ ID NO: 292896 - DNA, 25 bp, Mus musculus
tctcaagccgcgttttgtgcgaccc

SEQ ID NO: 292897 - DNA, 25 bp, Mus musculus
ctgtgctcggctgtcaccgtgccat

SEQ ID NO: 292898 - DNA, 25 bp, Mus musculus
cccgcggccatgaacggcaaagaag

SEQ ID NO: 292899 - DNA, 25 bp, Mus musculus
cgatccctgcgcgtgcaagccgagg

SEQ ID NO: 292900 - DNA, 25 bp, Mus musculus
ccgcctactgcgaccagggtggtgt

SEQ ID NO: 292901 - DNA, 25 bp, Mus musculus
aggctgcgtgaaggatccgcttccg

SEQ ID NO: 292902 - DNA, 25 bp, Mus musculus
acacagctcaggtaggcactcaacg

SEQ ID NO: 292903 - DNA, 25 bp, Mus musculus
ggtaggcactcaacggcttgcacca

SEQ ID NO: 292904 - DNA, 25 bp, Mus musculus
cacaacctggcacaccggaagcatg

SEQ ID NO: 292905 - DNA, 25 bp, Mus musculus
acaccggaagcatgcgcgactgaga

SEQ ID NO: 292906 - DNA, 25 bp, Mus musculus
acagaccggaagtatgtgcagcaca

SEQ ID NO: 292907 - DNA, 25 bp, Mus musculus
tgtgcgctgtcacccacgggctcag

SEQ ID NO: 292908 - DNA, 25 bp, Mus musculus
cgcctgggcttctcaccaagcgtgg

SEQ ID NO: 292909 - DNA, 25 bp, Mus musculus
ggccgcctgggcttctcaccaatcg

SEQ ID NO: 292910 - DNA, 25 bp, Mus musculus
gcctgggcttctcaccaagcgtggc

SEQ ID NO: 292911 - DNA, 25 bp, Mus musculus
gcctgggctcctcaccaatcgtggc

SEQ ID NO: 292912 - DNA, 25 bp, Mus musculus
gccgcctgggctcctcaccaatcgt

SEQ ID NO: 292913 - DNA, 25 bp, Mus musculus
tggccgcctgggctcctcaccaatc

SEQ ID NO: 292914 - DNA, 25 bp, Mus musculus
ttctcaccaagcgtggccgcctggg

SEQ ID NO: 292915 - DNA, 25 bp, Mus musculus
gccgcctgggcttctcaccaatcgt

SEQ ID NO: 292916 - DNA, 25 bp, Mus musculus
tctcaccaagcgtggccgcctgggc

SEQ ID NO: 292917 - DNA, 25 bp, Mus musculus
tgggcttctcaccaatcgtggccgc

SEQ ID NO: 292918 - DNA, 25 bp, Mus musculus
ctgggcttctcaccaatcgtggccg

SEQ ID NO: 292919 - DNA, 25 bp, Mus musculus
gcctgggcttctcaccaatcgtggc

SEQ ID NO: 292920 - DNA, 25 bp, Mus musculus
cgcctgggcttctcaccaatcgtgg

SEQ ID NO: 292921 - DNA, 25 bp, Mus musculus
ccgcctgggctcctcaccaatcgtg

SEQ ID NO: 292922 - DNA, 25 bp, Mus musculus
ctctgtcagcttgggccacgtacca

SEQ ID NO: 292923 - DNA, 25 bp, Mus musculus
gcccaagtgcagctcgatcccagga

SEQ ID NO: 292924 - DNA, 25 bp, Mus musculus
atgacatcgagttaagtgggtggcc

SEQ ID NO: 292925 - DNA, 25 bp, Mus musculus
cgctccatttcctctgtcagcttgg

SEQ ID NO: 292926 - DNA, 25 bp, Mus musculus
aggggacccgctccatttcctctgt

SEQ ID NO: 292927 - DNA, 25 bp, Mus musculus
ccgcccacttccgagtgtggactgt

SEQ ID NO: 292928 - DNA, 25 bp, Mus musculus
tcgatcccaggactccctcgggtgg

SEQ ID NO: 292929 - DNA, 25 bp, Mus musculus
tggccgcgaaggtttccgcagcgcc

SEQ ID NO: 292930 - DNA, 25 bp, Mus musculus
ctccttccttgcgaggtcccggtgg

SEQ ID NO: 292931 - DNA, 25 bp, Mus musculus
tcccactgcagctcccgtccaagcg

SEQ ID NO: 292932 - DNA, 25 bp, Mus musculus
gagatccgggcgcaccctgatgcag

SEQ ID NO: 292933 - DNA, 25 bp, Mus musculus
ggggcgctccgatccacagtccgag

SEQ ID NO: 292934 - DNA, 25 bp, Mus musculus
cccggtgatgacatcgagttaagtg

SEQ ID NO: 292935 - DNA, 25 bp, Mus musculus
cacagtccgagccacggcgcaggta

SEQ ID NO: 292936 - DNA, 25 bp, Mus musculus
tgcgcagtgctccttgcacgaaggc

SEQ ID NO: 292937 - DNA, 25 bp, Mus musculus
cctgcgctctgattgatcgccgttc

SEQ ID NO: 292938 - DNA, 25 bp, Mus musculus
ttgccatggcaacggcatttgtagc

SEQ ID NO: 292939 - DNA, 25 bp, Mus musculus
acggcatttgtagcccgggactctt

SEQ ID NO: 292940 - DNA, 25 bp, Mus musculus
cccgtacctctctcccaggcgacgc

SEQ ID NO: 292941 - DNA, 25 bp, Mus musculus
gacgcccaacgcagcccttcccatc

SEQ ID NO: 292942 - DNA, 25 bp, Mus musculus
ctaccagcttcgaccaggtctcagg

SEQ ID NO: 292943 - DNA, 25 bp, Mus musculus
cttcgaccaggtctcaggctccgtt

SEQ ID NO: 292944 - DNA, 25 bp, Mus musculus
gaccaggtctcaggctccgttccgg

SEQ ID NO: 292945 - DNA, 25 bp, Mus musculus
agcgcagtcgcgctgcgcagtgctc

SEQ ID NO: 292946 - DNA, 25 bp, Mus musculus
agtgctccttgcacgaaggctccgc

SEQ ID NO: 292947 - DNA, 25 bp, Mus musculus
tcctcaccgctctcacgttgattgg

SEQ ID NO: 292948 - DNA, 25 bp, Mus musculus
gctgccgctcctgcgctctgattga

SEQ ID NO: 292949 - DNA, 25 bp, Mus musculus
ctctcacgttgattggccagccgct

SEQ ID NO: 292950 - DNA, 25 bp, Mus musculus
tcgggattctgcgaccaggctcaaa

SEQ ID NO: 292951 - DNA, 25 bp, Mus musculus
tagccgaagatggttaatgacgaca

SEQ ID NO: 292952 - DNA, 25 bp, Mus musculus
tgacgccaagttgtcctcggctttc

SEQ ID NO: 292953 - DNA, 25 bp, Mus musculus
ccgaaattgattctcgggattctgc

SEQ ID NO: 292954 - DNA, 25 bp, Mus musculus
cgttggcccggactgaattaatgta

SEQ ID NO: 292955 - DNA, 25 bp, Mus musculus
ctcaaatgaatgtgccggcgctgcc

SEQ ID NO: 292956 - DNA, 25 bp, Mus musculus
agcgtcctcggagagcgattctcca

SEQ ID NO: 292957 - DNA, 25 bp, Mus musculus
gtgccctcggaacgaccggtgctct

SEQ ID NO: 292958 - DNA, 25 bp, Mus musculus
gtggactctcattcgtacatgctcg

SEQ ID NO: 292959 - DNA, 25 bp, Mus musculus
caccatgtccggacccttgagagtc

SEQ ID NO: 292960 - DNA, 25 bp, Mus musculus
acccttgagagtcaccacggcctgg

SEQ ID NO: 292961 - DNA, 25 bp, Mus musculus
cgagggacggacttgacgcaaaagt

SEQ ID NO: 292962 - DNA, 25 bp, Mus musculus
acgcaaaagtgcaagctgtagtcgc

SEQ ID NO: 292963 - DNA, 25 bp, Mus musculus
ctctccgggagacgagccgaaattg

SEQ ID NO: 292964 - DNA, 25 bp, Mus musculus
cctccctgggccagcgaggtgtatt

SEQ ID NO: 292965 - DNA, 25 bp, Mus musculus
cttctatcgcctgaccgaactggga

SEQ ID NO: 292966 - DNA, 25 bp, Mus musculus
gagctggcgctcttctatcgcctga

SEQ ID NO: 292967 - DNA, 25 bp, Mus musculus
cgtcgcccggggcaacagcaatggc

SEQ ID NO: 292968 - DNA, 25 bp, Mus musculus
tgtattcgccctgcgcgggccagag

SEQ ID NO: 292969 - DNA, 25 bp, Mus musculus
ccagcgaggtgtattcgccctgcgc

SEQ ID NO: 292970 - DNA, 25 bp, Mus musculus
aacagcaatggcgaccacggcggcc

SEQ ID NO: 292971 - DNA, 25 bp, Mus musculus
gcctggtgggagcttgcgacatcct

SEQ ID NO: 292972 - DNA, 25 bp, Mus musculus
tcgggcgcggcaaggcctgcctact

SEQ ID NO: 292973 - DNA, 25 bp, Mus musculus
tcttctcgctggagctgctcgtgga

SEQ ID NO: 292974 - DNA, 25 bp, Mus musculus
gctgtggcgtttcgcctgctggact

SEQ ID NO: 292975 - DNA, 25 bp, Mus musculus
tcgctcccgcttccggttggcggag

SEQ ID NO: 292976 - DNA, 25 bp, Mus musculus
gcctgaccgaactgggacgcttttc

SEQ ID NO: 292977 - DNA, 25 bp, Mus musculus
gcgccatcagcttcgggcgcggcaa

SEQ ID NO: 292978 - DNA, 25 bp, Mus musculus
tgacccagagcctgcgggacttggc

SEQ ID NO: 292979 - DNA, 25 bp, Mus musculus
gactggggagcaccggttacatgtc

SEQ ID NO: 292980 - DNA, 25 bp, Mus musculus
cttggtgtatcgcaacccggcgaga

SEQ ID NO: 292981 - DNA, 25 bp, Mus musculus
tccggcctggcttggtgtatcgcaa

SEQ ID NO: 292982 - DNA, 25 bp, Mus musculus
gaggtagagcgcctggacctctgtc

SEQ ID NO: 292983 - DNA, 25 bp, Mus musculus
gccttcagcgtaaggggtggagcct

SEQ ID NO: 292984 - DNA, 25 bp, Mus musculus
ccaggtgacccagagcctgcgggac

SEQ ID NO: 292985 - DNA, 25 bp, Mus musculus
atgtcgcggcacgtgttcctcaccg

SEQ ID NO: 292986 - DNA, 25 bp, Mus musculus
ccacgcacatgtcgcggcacgtgtt

SEQ ID NO: 292987 - DNA, 25 bp, Mus musculus
gtggagcctggccgcccattctgac

SEQ ID NO: 292988 - DNA, 25 bp, Mus musculus
cggtgctttccctgccgacaggggc

SEQ ID NO: 292989 - DNA, 25 bp, Mus musculus
gagcgcctggacctctgtccggtct

SEQ ID NO: 292990 - DNA, 25 bp, Mus musculus
ttggaaacgcatgcgcgaccacggg

SEQ ID NO: 292991 - DNA, 25 bp, Mus musculus
gagcgttggaaacgcatgcgcgacc

SEQ ID NO: 292992 - DNA, 25 bp, Mus musculus
gcggttcggccatggtctgtacgaa

SEQ ID NO: 292993 - DNA, 25 bp, Mus musculus
cgtaagcgtgagtggaaccagaatc

SEQ ID NO: 292994 - DNA, 25 bp, Mus musculus
tgtacgaagcgctgatgagaagatc

SEQ ID NO: 292995 - DNA, 25 bp, Mus musculus
gaaaaccgcgcccttgtcaatcacg

SEQ ID NO: 292996 - DNA, 25 bp, Mus musculus
agccaatcgttgagcggcctccgtg

SEQ ID NO: 292997 - DNA, 25 bp, Mus musculus
cccgggctcgctcacttaacaagaa

SEQ ID NO: 292998 - DNA, 25 bp, Mus musculus
ctgagtcttgccaacccagtgatga

SEQ ID NO: 292999 - DNA, 25 bp, Mus musculus
ctcctcgggaatttgggattcctga

SEQ ID NO: 293000 - DNA, 25 bp, Mus musculus
agtccacacatgctgagcctcagga

SEQ ID NO: 293001 - DNA, 25 bp, Mus musculus
tcaggaagccagctcacccgtgagg

SEQ ID NO: 293002 - DNA, 25 bp, Mus musculus
cattgcctatggtctcgatgatctc

SEQ ID NO: 293003 - DNA, 25 bp, Mus musculus
ttcttggccaccacagaggcagcgg

SEQ ID NO: 293004 - DNA, 25 bp, Mus musculus
agaagatcgtcctgagggcctctca

SEQ ID NO: 293005 - DNA, 25 bp, Mus musculus
ccacgtcaaaggtcacgtcgaagga

SEQ ID NO: 293006 - DNA, 25 bp, Mus musculus
aggattttcccatcatgctctgcga

SEQ ID NO: 293007 - DNA, 25 bp, Mus musculus
tttcccatcatgctctgcgatggct

SEQ ID NO: 293008 - DNA, 25 bp, Mus musculus
ggggctcagcaccctaagctcagca

SEQ ID NO: 293009 - DNA, 25 bp, Mus musculus
catgtccaagggaaggaggattttc

SEQ ID NO: 293010 - DNA, 25 bp, Mus musculus
caggtgcgcgccatgtccaagggaa

SEQ ID NO: 293011 - DNA, 25 bp, Mus musculus
ctgccaggcaggtgcgcgccatgtc

SEQ ID NO: 293012 - DNA, 25 bp, Mus musculus
gaacagtacggaccggcacagcgcg

SEQ ID NO: 293013 - DNA, 25 bp, Mus musculus
acgctgaacagtacggaccggcaca

SEQ ID NO: 293014 - DNA, 25 bp, Mus musculus
cccaaaccgcggtagacgctgaaca

SEQ ID NO: 293015 - DNA, 25 bp, Mus musculus
cctggagctcagtacgtcggcgcgt

SEQ ID NO: 293016 - DNA, 25 bp, Mus musculus
ctgctcaaggatgctccggcggctc

SEQ ID NO: 293017 - DNA, 25 bp, Mus musculus
gccatgcccgcagagtccggcagaa

SEQ ID NO: 293018 - DNA, 25 bp, Mus musculus
gtccggcagaaaccgagcgtgccct

SEQ ID NO: 293019 - DNA, 25 bp, Mus musculus
cagaaaccgagcgtgccctggggct

SEQ ID NO: 293020 - DNA, 25 bp, Mus musculus
tggtccactagcgacctctcaatcg

SEQ ID NO: 293021 - DNA, 25 bp, Mus musculus
ctgcggggaagaactagccaaactg

SEQ ID NO: 293022 - DNA, 25 bp, Mus musculus
gtggtcgtaacctctgtagtcctgc

SEQ ID NO: 293023 - DNA, 25 bp, Mus musculus
cttccctgttagctcggaccgatga

SEQ ID NO: 293024 - DNA, 25 bp, Mus musculus
tggctgtcgcacttggtccactagc

SEQ ID NO: 293025 - DNA, 25 bp, Mus musculus
tatggctctacctgtagccgagggc

SEQ ID NO: 293026 - DNA, 25 bp, Mus musculus
gcctgggcatctttccggccagcta

SEQ ID NO: 293027 - DNA, 25 bp, Mus musculus
acgtagacttcgagcgcctggagct

SEQ ID NO: 293028 - DNA, 25 bp, Mus musculus
ttcggtcaggtgtaccgcgccacct

SEQ ID NO: 293029 - DNA, 25 bp, Mus musculus
cccaacatcatccagctgcggggtg

SEQ ID NO: 293030 - DNA, 25 bp, Mus musculus
cacaggttctggtcaactgggcggt

SEQ ID NO: 293031 - DNA, 25 bp, Mus musculus
cggcatgctgtacctgcacgaggag

SEQ ID NO: 293032 - DNA, 25 bp, Mus musculus
cgcgtaagtctaagcaggtccagca

SEQ ID NO: 293033 - DNA, 25 bp, Mus musculus
gtgggccgcgctttatgattacgaa

SEQ ID NO: 293034 - DNA, 25 bp, Mus musculus
agggtctggcgccaccaaacctgca

SEQ ID NO: 293035 - DNA, 25 bp, Mus musculus
tccaccacaggtagggccgctgctg

SEQ ID NO: 293036 - DNA, 25 bp, Mus musculus
ggtgctcagcaacgcctcgggaaat

SEQ ID NO: 293037 - DNA, 25 bp, Mus musculus
caattatggagtgtcggtgctcagc

SEQ ID NO: 293038 - DNA, 25 bp, Mus musculus
ttcctggaggagcacgagtgcctgt

SEQ ID NO: 293039 - DNA, 25 bp, Mus musculus
ctgcgcaagctgaagcggcgcttcc

SEQ ID NO: 293040 - DNA, 25 bp, Mus musculus
cttatgaggacctgctgcgccagga

SEQ ID NO: 293041 - DNA, 25 bp, Mus musculus
cttctcgtccgtggagctgccttat

SEQ ID NO: 293042 - DNA, 25 bp, Mus musculus
tgggctacctgctctacctggtgtt

SEQ ID NO: 293043 - DNA, 25 bp, Mus musculus
tttgcacgaaaccaggaaagggagc

SEQ ID NO: 293044 - DNA, 25 bp, Mus musculus
tctggcctcttgtatttgcacgaaa

SEQ ID NO: 293045 - DNA, 25 bp, Mus musculus
agctcaggcctgctgactgcactgg

SEQ ID NO: 293046 - DNA, 25 bp, Mus musculus
gaattgggacttcacctcggcgctc

SEQ ID NO: 293047 - DNA, 25 bp, Mus musculus
ctgcactttccggtttcggaagcca

SEQ ID NO: 293048 - DNA, 25 bp, Mus musculus
ttcctgggagcagggcacatggcaa

SEQ ID NO: 293049 - DNA, 25 bp, Mus musculus
tcgccctagctcacgttgccagagg

SEQ ID NO: 293050 - DNA, 25 bp, Mus musculus
ccgagagactcacgtgtcgaaacca

SEQ ID NO: 293051 - DNA, 25 bp, Mus musculus
ccgcgccctaaggttgcagagcttg

SEQ ID NO: 293052 - DNA, 25 bp, Mus musculus
cctcagtggcatgaggaggtcaccg

SEQ ID NO: 293053 - DNA, 25 bp, Mus musculus
gtgggtcctcaccagtcctcactga

SEQ ID NO: 293054 - DNA, 25 bp, Mus musculus
gaagtttcagcagcatctccgggcc

SEQ ID NO: 293055 - DNA, 25 bp, Mus musculus
ccaagagcattgctgtgtgagtaga

SEQ ID NO: 293056 - DNA, 25 bp, Mus musculus
tccgtgaccgcgagtactagggcgc

SEQ ID NO: 293057 - DNA, 25 bp, Mus musculus
tcgaaaccagaacgccaggaccgtg

SEQ ID NO: 293058 - DNA, 25 bp, Mus musculus
acctacgggcgtccagacctttgtg

SEQ ID NO: 293059 - DNA, 25 bp, Mus musculus
gcccatggggatccgagagtttccc

SEQ ID NO: 293060 - DNA, 25 bp, Mus musculus
gcggcgcttccaggaccaagagcat

SEQ ID NO: 293061 - DNA, 25 bp, Mus musculus
acactccgggctgcgaggatctgaa

SEQ ID NO: 293062 - DNA, 25 bp, Mus musculus
ccgcagtgcagcctcgctgctggtg

SEQ ID NO: 293063 - DNA, 25 bp, Mus musculus
cctggaggctccagccgcttggagc

SEQ ID NO: 293064 - DNA, 25 bp, Mus musculus
ggacgctgtccgcagtgcagcctcg

SEQ ID NO: 293065 - DNA, 25 bp, Mus musculus
gggcctgaggcgtctgtccctgacc

SEQ ID NO: 293066 - DNA, 25 bp, Mus musculus
ctgaccctcaccaaagtggaaggta

SEQ ID NO: 293067 - DNA, 25 bp, Mus musculus
cggtcctgaccctcaccaaagtgga

SEQ ID NO: 293068 - DNA, 25 bp, Mus musculus
agcgcctgcaacagtccggtcctga

SEQ ID NO: 293069 - DNA, 25 bp, Mus musculus
cggctcaccatgaagaagcactcgg

SEQ ID NO: 293070 - DNA, 25 bp, Mus musculus
gcggccggctcaccatgaagaagca

SEQ ID NO: 293071 - DNA, 25 bp, Mus musculus
cccggccccaggatgtaggcgatcg

SEQ ID NO: 293072 - DNA, 25 bp, Mus musculus
gccaccgcagtgagtcgcggcgaca

SEQ ID NO: 293073 - DNA, 25 bp, Mus musculus
tacgtgacgttggagtttgcagcga

SEQ ID NO: 293074 - DNA, 25 bp, Mus musculus
gagtgcacttgtacgtgacgttgga

SEQ ID NO: 293075 - DNA, 25 bp, Mus musculus
aggctccagccgcttggagctcctg

SEQ ID NO: 293076 - DNA, 25 bp, Mus musculus
attatccgccggagaaacggactcg

SEQ ID NO: 293077 - DNA, 25 bp, Mus musculus
agtttccctgtgcagtcggtggacc

SEQ ID NO: 293078 - DNA, 25 bp, Mus musculus
caccacactctgagaacggagcttg

SEQ ID NO: 293079 - DNA, 25 bp, Mus musculus
gccaatcagggcagccgcagctaca

SEQ ID NO: 293080 - DNA, 25 bp, Mus musculus
aagtcccgcggggtgcaacacatcc

SEQ ID NO: 293081 - DNA, 25 bp, Mus musculus
gtgccagaagctgaggagctcgttc

SEQ ID NO: 293082 - DNA, 25 bp, Mus musculus
cagatattagtttccgcccataggc

SEQ ID NO: 293083 - DNA, 25 bp, Mus musculus
cgcgtgaccactgcaggcaggaatg

SEQ ID NO: 293084 - DNA, 25 bp, Mus musculus
ggcgggtactttcgcagtgagtttc

SEQ ID NO: 293085 - DNA, 25 bp, Mus musculus
tctatttgcaaacggaggccggggc

SEQ ID NO: 293086 - DNA, 25 bp, Mus musculus
agtcccgcccttctatttgcaaacg

SEQ ID NO: 293087 - DNA, 25 bp, Mus musculus
ccctggtgccggaaattatccgccg

SEQ ID NO: 293088 - DNA, 25 bp, Mus musculus
cagagggcggtaccaatcagatatt

SEQ ID NO: 293089 - DNA, 25 bp, Mus musculus
tgtactggcgctgcctggacgacaa

SEQ ID NO: 293090 - DNA, 25 bp, Mus musculus
ctccgccctgggacgcgtgcagtaa

SEQ ID NO: 293091 - DNA, 25 bp, Mus musculus
tctgcgttagaagcgcgtccgccaa

SEQ ID NO: 293092 - DNA, 25 bp, Mus musculus
gtgcgctcagcaccagcagttctgg

SEQ ID NO: 293093 - DNA, 25 bp, Mus musculus
cggttctgcgctctgtgccagcgcg

SEQ ID NO: 293094 - DNA, 25 bp, Mus musculus
tcgcgcagcgcttcttcggccagag

SEQ ID NO: 293095 - DNA, 25 bp, Mus musculus
gggctcccgactctgcgttagaagc

SEQ ID NO: 293096 - DNA, 25 bp, Mus musculus
cctggacggttctccagaagcggcc

SEQ ID NO: 293097 - DNA, 25 bp, Mus musculus
tgcagtaagggcaccaggtggtccc

SEQ ID NO: 293098 - DNA, 25 bp, Mus musculus
caggtggtccctggccacctcgtgt

SEQ ID NO: 293099 - DNA, 25 bp, Mus musculus
cgctgcagcaccaggcgcagggtct

SEQ ID NO: 293100 - DNA, 25 bp, Mus musculus
agcttctcggccagtgcgctcagca

SEQ ID NO: 293101 - DNA, 25 bp, Mus musculus
gcgctcatggttggtcagcagcttc

SEQ ID NO: 293102 - DNA, 25 bp, Mus musculus
cccgctccatttcgcggggagtaga

SEQ ID NO: 293103 - DNA, 25 bp, Mus musculus
agagtgactgccagctccggtcctg

SEQ ID NO: 293104 - DNA, 25 bp, Mus musculus
gagtcccacggagcttttgcgcagc

SEQ ID NO: 293105 - DNA, 25 bp, Mus musculus
tgcggggacaggctctctggaccca

SEQ ID NO: 293106 - DNA, 25 bp, Mus musculus
tctggacccaaccatcctggctaaa

SEQ ID NO: 293107 - DNA, 25 bp, Mus musculus
atcctggctaaaaaagaaacttgcg

SEQ ID NO: 293108 - DNA, 25 bp, Mus musculus
acttgcggcttccacagtgaattcc

SEQ ID NO: 293109 - DNA, 25 bp, Mus musculus
ctttctagtccaccgcaaaggcggg

SEQ ID NO: 293110 - DNA, 25 bp, Mus musculus
gttgccatggcgacgagccagcatc

SEQ ID NO: 293111 - DNA, 25 bp, Mus musculus
agccagcatctgaagccgctgaatg

SEQ ID NO: 293112 - DNA, 25 bp, Mus musculus
ctgaagccgctgaatggactctttg

SEQ ID NO: 293113 - DNA, 25 bp, Mus musculus
tcgccggagtcactcgggttgcgct

SEQ ID NO: 293114 - DNA, 25 bp, Mus musculus
ctgtccacatcgactccgctaagga

SEQ ID NO: 293115 - DNA, 25 bp, Mus musculus
cgccactagaaaagcgacaataggg

SEQ ID NO: 293116 - DNA, 25 bp, Mus musculus
ctctttgttttgaagccagctgacg

SEQ ID NO: 293117 - DNA, 25 bp, Mus musculus
cagtgcgctcttggccacggaaggt

SEQ ID NO: 293118 - DNA, 25 bp, Mus musculus
ggactgcctagtggggaagcggtcc

SEQ ID NO: 293119 - DNA, 25 bp, Mus musculus
taaagcagccgcgtgtgaccctcgg

SEQ ID NO: 293120 - DNA, 25 bp, Mus musculus
cgccagacaagcctttgactttatt

SEQ ID NO: 293121 - DNA, 25 bp, Mus musculus
gacaagcctttgactttatttggtg

SEQ ID NO: 293122 - DNA, 25 bp, Mus musculus
gcctttgactttatttggtgcagca

SEQ ID NO: 293123 - DNA, 25 bp, Mus musculus
ctggcgactaaagcagccgcgtgtg

SEQ ID NO: 293124 - DNA, 25 bp, Mus musculus
gcgactaaagcagccgcgtgtgacc

SEQ ID NO: 293125 - DNA, 25 bp, Mus musculus
gcgcgcattcctgcgggcgccaact

SEQ ID NO: 293126 - DNA, 25 bp, Mus musculus
tgactttatttggtgcagcacgcgc

SEQ ID NO: 293127 - DNA, 25 bp, Mus musculus
cacgggacggagaggggactgccta

SEQ ID NO: 293128 - DNA, 25 bp, Mus musculus
acgctaattttagcgccgcagctgg

SEQ ID NO: 293129 - DNA, 25 bp, Mus musculus
acgcgcgggacgctaattttagcgc

SEQ ID NO: 293130 - DNA, 25 bp, Mus musculus
tcacgcgcgggacgctaattttagc

SEQ ID NO: 293131 - DNA, 25 bp, Mus musculus
actcacgcgcgggacgctaatttta

SEQ ID NO: 293132 - DNA, 25 bp, Mus musculus
caccctggattcttccgtttctcga

SEQ ID NO: 293133 - DNA, 25 bp, Mus musculus
agcagtaggtccttggccgacagtg

SEQ ID NO: 293134 - DNA, 25 bp, Mus musculus
tcttccgtttctcgatcgcgtgcgc

SEQ ID NO: 293135 - DNA, 25 bp, Mus musculus
gacttgattcttcgacagctctgca

SEQ ID NO: 293136 - DNA, 25 bp, Mus musculus
cgtagttgacgcagccgcggcacac

SEQ ID NO: 293137 - DNA, 25 bp, Mus musculus
acgggctccgtgaagtcccagatca

SEQ ID NO: 293138 - DNA, 25 bp, Mus musculus
acagatagcacgactggcgccgaga

SEQ ID NO: 293139 - DNA, 25 bp, Mus musculus
aagcccgcgtctgcgcgactagcgg

SEQ ID NO: 293140 - DNA, 25 bp, Mus musculus
ggccgctccacttctacagacttga

SEQ ID NO: 293141 - DNA, 25 bp, Mus musculus
gtcggctccctcgtagttgacgcag

SEQ ID NO: 293142 - DNA, 25 bp, Mus musculus
atgacgaactccacgcggtcggctc

SEQ ID NO: 293143 - DNA, 25 bp, Mus musculus
gcgggccgtctcgatgacgaactcc

SEQ ID NO: 293144 - DNA, 25 bp, Mus musculus
gggaagcagccgtgagcacgcttca

SEQ ID NO: 293145 - DNA, 25 bp, Mus musculus
ggggcaggtcacacagatagcacga

SEQ ID NO: 293146 - DNA, 25 bp, Mus musculus
ttgcagcctgcgagcttcaagcatg

SEQ ID NO: 293147 - DNA, 25 bp, Mus musculus
gcgtcttcctgctcatgatcaccgg

SEQ ID NO: 293148 - DNA, 25 bp, Mus musculus
gtctcccggcccatcagtgcaatgg

SEQ ID NO: 293149 - DNA, 25 bp, Mus musculus
cgcacaggtaagcagtcgtggactc

SEQ ID NO: 293150 - DNA, 25 bp, Mus musculus
agccttccaacgatggcgtctttgc

SEQ ID NO: 293151 - DNA, 25 bp, Mus musculus
ggctgcagcaagtcccagcgtcttc

SEQ ID NO: 293152 - DNA, 25 bp, Mus musculus
gaggtaactctagcacgtgactttc

SEQ ID NO: 293153 - DNA, 25 bp, Mus musculus
tgaagtcacacagtgcgggtccgtg

SEQ ID NO: 293154 - DNA, 25 bp, Mus musculus
caagcatggccagacgagtgaagtc

SEQ ID NO: 293155 - DNA, 25 bp, Mus musculus
gacgacttaccgtctgtttccaaga

SEQ ID NO: 293156 - DNA, 25 bp, Mus musculus
tcgtcaccgcttgagaaatttgtcc

SEQ ID NO: 293157 - DNA, 25 bp, Mus musculus
gcctgcgcactcttacctttgagcg

SEQ ID NO: 293158 - DNA, 25 bp, Mus musculus
acggaggacagtgcccaaagccata

SEQ ID NO: 293159 - DNA, 25 bp, Mus musculus
tggcaacagcgacaccacctggaga

SEQ ID NO: 293160 - DNA, 25 bp, Mus musculus
cagcggttagctccgaccgatcgga

SEQ ID NO: 293161 - DNA, 25 bp, Mus musculus
gcagaaggatttgtgcgtcatcccg

SEQ ID NO: 293162 - DNA, 25 bp, Mus musculus
gcgtgcactgcagaaggatttgtgc

SEQ ID NO: 293163 - DNA, 25 bp, Mus musculus
atgaagagggcaccgcacacgcccg

SEQ ID NO: 293164 - DNA, 25 bp, Mus musculus
cgcacgcgcagatggacccagtctg

SEQ ID NO: 293165 - DNA, 25 bp, Mus musculus
accatcttcgctcgactggggcgta

SEQ ID NO: 293166 - DNA, 25 bp, Mus musculus
agtacccgatgaagagggcaccgca

SEQ ID NO: 293167 - DNA, 25 bp, Mus musculus
gcggggcccactcacgttctcgaag

SEQ ID NO: 293168 - DNA, 25 bp, Mus musculus
ctcacgttctcgaagcctgttcttg

SEQ ID NO: 293169 - DNA, 25 bp, Mus musculus
cctgttcttgaagttggggtcactc

SEQ ID NO: 293170 - DNA, 25 bp, Mus musculus
gggtcactccgccttttgcggtcga

SEQ ID NO: 293171 - DNA, 25 bp, Mus musculus
ccgccttttgcggtcgaagtagatg

SEQ ID NO: 293172 - DNA, 25 bp, Mus musculus
gtcgaagtagatgcagtacccgatg

SEQ ID NO: 293173 - DNA, 25 bp, Mus musculus
cagtctgcgcggctgagacgccaag

SEQ ID NO: 293174 - DNA, 25 bp, Mus musculus
aacacaagagcactcttcagccacg

SEQ ID NO: 293175 - DNA, 25 bp, Mus musculus
ccattcagcccgtggctgcgcagga

SEQ ID NO: 293176 - DNA, 25 bp, Mus musculus
ttctaaggctgagctcttccgctca

SEQ ID NO: 293177 - DNA, 25 bp, Mus musculus
ccgactacttccgttctaaggctga

SEQ ID NO: 293178 - DNA, 25 bp, Mus musculus
catgcgttccctctggttccgggtt

SEQ ID NO: 293179 - DNA, 25 bp, Mus musculus
tccgactagtcatgcgttccctctg

SEQ ID NO: 293180 - DNA, 25 bp, Mus musculus
ctgagcttccgggatggaagtccta

SEQ ID NO: 293181 - DNA, 25 bp, Mus musculus
tctgtctgcaaacacaagagcactc

SEQ ID NO: 293182 - DNA, 25 bp, Mus musculus
gccgtctccagagctctgtctgcaa

SEQ ID NO: 293183 - DNA, 25 bp, Mus musculus
accaggtagtcgctggccgcacagc

SEQ ID NO: 293184 - DNA, 25 bp, Mus musculus
tcggcgacctgtcccaccaggtagt

SEQ ID NO: 293185 - DNA, 25 bp, Mus musculus
catgctgaaaactgagcttccggga

SEQ ID NO: 293186 - DNA, 25 bp, Mus musculus
cgcttctgggatccgactagtcatg

SEQ ID NO: 293187 - DNA, 25 bp, Mus musculus
gatggaagtcctaggtccgcgcttc

SEQ ID NO: 293188 - DNA, 25 bp, Mus musculus
cactgcagcctacggcaagtgggct

SEQ ID NO: 293189 - DNA, 25 bp, Mus musculus
gacactgtctgggtcctccgggctt

SEQ ID NO: 293190 - DNA, 25 bp, Mus musculus
tcacggtccctggacactgtctggg

SEQ ID NO: 293191 - DNA, 25 bp, Mus musculus
gccgtaaagttctcggcgcgctccg

SEQ ID NO: 293192 - DNA, 25 bp, Mus musculus
ggaaagtgccgcagccgacggcctc

SEQ ID NO: 293193 - DNA, 25 bp, Mus musculus
tcaatatggcgcttcctggagacgg

SEQ ID NO: 293194 - DNA, 25 bp, Mus musculus
cgcggggatcaatatggcgcttcct

SEQ ID NO: 293195 - DNA, 25 bp, Mus musculus
ccgctaccggaaggccgtggccaag

SEQ ID NO: 293196 - DNA, 25 bp, Mus musculus
agcaggcggtgacccgctaccggaa

SEQ ID NO: 293197 - DNA, 25 bp, Mus musculus
atgaaagttttcagcctcatccagc

SEQ ID NO: 293198 - DNA, 25 bp, Mus musculus
cggagatggccgcatgaaagttttc

SEQ ID NO: 293199 - DNA, 25 bp, Mus musculus
ctggacatggtagccgggcagctct

SEQ ID NO: 293200 - DNA, 25 bp, Mus musculus
cctcggagtcccgactgagcgcgag

SEQ ID NO: 293201 - DNA, 25 bp, Mus musculus
acgcgcttcgccgtgcggtgaaccg

SEQ ID NO: 293202 - DNA, 25 bp, Mus musculus
gcctgtccgttggactccaggacta

SEQ ID NO: 293203 - DNA, 25 bp, Mus musculus
agcccaggagggagatccgcacaac

SEQ ID NO: 293204 - DNA, 25 bp, Mus musculus
ctggactctggagccagtgggtcct

SEQ ID NO: 293205 - DNA, 25 bp, Mus musculus
gctctctgcacgcagggttggcgct

SEQ ID NO: 293206 - DNA, 25 bp, Mus musculus
ccaaagaggaagctaggggcgacta

SEQ ID NO: 293207 - DNA, 25 bp, Mus musculus
tcaggcgtttgactcccggccttct

SEQ ID NO: 293208 - DNA, 25 bp, Mus musculus
ccttccgctcgactcaggcgtttga

SEQ ID NO: 293209 - DNA, 25 bp, Mus musculus
agaccttgcctgcagagggccaacg

SEQ ID NO: 293210 - DNA, 25 bp, Mus musculus
gacacgcgctccgtgtggcacatcg

SEQ ID NO: 293211 - DNA, 25 bp, Mus musculus
gcggctatcgcctagaccttgcctg

SEQ ID NO: 293212 - DNA, 25 bp, Mus musculus
gaattggcaaggatgcgcccgatgc

SEQ ID NO: 293213 - DNA, 25 bp, Mus musculus
ctaaggcttgcccaacatagttgga

SEQ ID NO: 293214 - DNA, 25 bp, Mus musculus
cggggtcaccctgaatctaaggctt

SEQ ID NO: 293215 - DNA, 25 bp, Mus musculus
ctagctttaccctgggcgcggctat

SEQ ID NO: 293216 - DNA, 25 bp, Mus musculus
attaggagttccgtgaagtagcagc

SEQ ID NO: 293217 - DNA, 25 bp, Mus musculus
tttagtctaagtcctactcggagcg

SEQ ID NO: 293218 - DNA, 25 bp, Mus musculus
aagtcctactcggagcgtcctggag

SEQ ID NO: 293219 - DNA, 25 bp, Mus musculus
ctcaggctgacacccaggaagtgaa

SEQ ID NO: 293220 - DNA, 25 bp, Mus musculus
aggctgacacccaggaagtgaaagc

SEQ ID NO: 293221 - DNA, 25 bp, Mus musculus
aaagcggggactgacagcgcgatcc

SEQ ID NO: 293222 - DNA, 25 bp, Mus musculus
tgtctcgcagaacaaccaaggcgtt

SEQ ID NO: 293223 - DNA, 25 bp, Mus musculus
tacctagggattaggagttccgtga

SEQ ID NO: 293224 - DNA, 25 bp, Mus musculus
agttccgtgaagtagcagctaaccc

SEQ ID NO: 293225 - DNA, 25 bp, Mus musculus
ggtctctcggaactccttgactcca

SEQ ID NO: 293226 - DNA, 25 bp, Mus musculus
ggaactccttgactccaggatcctc

SEQ ID NO: 293227 - DNA, 25 bp, Mus musculus
tcgcagaacaaccaaggcgttcttc

SEQ ID NO: 293228 - DNA, 25 bp, Mus musculus
tgactccaggatcctcgcctacacg

SEQ ID NO: 293229 - DNA, 25 bp, Mus musculus
caaggcgttcttcttttagtctaag

SEQ ID NO: 293230 - DNA, 25 bp, Mus musculus
cgcttctcgcgaattcaggcattgc

SEQ ID NO: 293231 - DNA, 25 bp, Mus musculus
gtccgcgcaatcgtgttctcctgcg

SEQ ID NO: 293232 - DNA, 25 bp, Mus musculus
tgctggtttttcgtccgcgcaatcg

SEQ ID NO: 293233 - DNA, 25 bp, Mus musculus
taagattatcgtttgctggtttttc

SEQ ID NO: 293234 - DNA, 25 bp, Mus musculus
agcgtttcggattgttaagattatc

SEQ ID NO: 293235 - DNA, 25 bp, Mus musculus
tcttaggcggacttaagagcgtttc

SEQ ID NO: 293236 - DNA, 25 bp, Mus musculus
gaggattttctggttcttaggcgga

SEQ ID NO: 293237 - DNA, 25 bp, Mus musculus
gaattcaggcattgcctcgccgcta

SEQ ID NO: 293238 - DNA, 25 bp, Mus musculus
ggctgccgttgctgtgcgccacgct

SEQ ID NO: 293239 - DNA, 25 bp, Mus musculus
cgccaagacccgctgaggattttct

SEQ ID NO: 293240 - DNA, 25 bp, Mus musculus
tgccgggcgcaggaaacttgcctgc

SEQ ID NO: 293241 - DNA, 25 bp, Mus musculus
tgacagccggagacgggagcaacca

SEQ ID NO: 293242 - DNA, 25 bp, Mus musculus
ctttccgcagcggtaagtgacagcc

SEQ ID NO: 293243 - DNA, 25 bp, Mus musculus
tgcctgcgcaaggaacggagaagtc

SEQ ID NO: 293244 - DNA, 25 bp, Mus musculus
gagctcactgtctccaagatggcgg

SEQ ID NO: 293245 - DNA, 25 bp, Mus musculus
cgggcttgcctgtcaagagctccgc

SEQ ID NO: 293246 - DNA, 25 bp, Mus musculus
cagcacgtgtggtgttgtgtctgtc

SEQ ID NO: 293247 - DNA, 25 bp, Mus musculus
cccggtcgctcccagctgccgagcc

SEQ ID NO: 293248 - DNA, 25 bp, Mus musculus
cggccgtgtcagtttggggcatctc

SEQ ID NO: 293249 - DNA, 25 bp, Mus musculus
cagtcggagctcactgtctccaaga

SEQ ID NO: 293250 - DNA, 25 bp, Mus musculus
caggcagccgttccctcgcgacgct

SEQ ID NO: 293251 - DNA, 25 bp, Mus musculus
cccgcgcaggctgttcccgctccct

SEQ ID NO: 293252 - DNA, 25 bp, Mus musculus
ccggctcttccagctaccggccgcc

SEQ ID NO: 293253 - DNA, 25 bp, Mus musculus
ccttcccggcgacgagccggctctt

SEQ ID NO: 293254 - DNA, 25 bp, Mus musculus
cagcccggccaactcccgcttccac

SEQ ID NO: 293255 - DNA, 25 bp, Mus musculus
actgtcagcccctagccgggacggg

SEQ ID NO: 293256 - DNA, 25 bp, Mus musculus
tgttgtgtctgtcggactgtcagcc

SEQ ID NO: 293257 - DNA, 25 bp, Mus musculus
ccgtgtcagtttggggcatctccgc

SEQ ID NO: 293258 - DNA, 25 bp, Mus musculus
gaagcggcggaaccgctcccgtgac

SEQ ID NO: 293259 - DNA, 25 bp, Mus musculus
gcgcagctgaaggagccggctctcc

SEQ ID NO: 293260 - DNA, 25 bp, Mus musculus
cgccatggctcaggcggccaaacag

SEQ ID NO: 293261 - DNA, 25 bp, Mus musculus
ggcggccaaacagctgaagaaaatc

SEQ ID NO: 293262 - DNA, 25 bp, Mus musculus
atcaaagacatcgaggcgcaggccc

SEQ ID NO: 293263 - DNA, 25 bp, Mus musculus
aggaatccaacaggaagcggcggaa

SEQ ID NO: 293264 - DNA, 25 bp, Mus musculus
accgctcccgtgaccgcaagaagaa

SEQ ID NO: 293265 - DNA, 25 bp, Mus musculus
cccgtgaccgcaagaagaaggtaag

SEQ ID NO: 293266 - DNA, 25 bp, Mus musculus
cccagactcatttcagcaccttgaa

SEQ ID NO: 293267 - DNA, 25 bp, Mus musculus
agcaccttgaacagaggcccgcgct

SEQ ID NO: 293268 - DNA, 25 bp, Mus musculus
ccgcgctccggaggaacttttgccg

SEQ ID NO: 293269 - DNA, 25 bp, Mus musculus
tccggaggaacttttgccgcctctg

SEQ ID NO: 293270 - DNA, 25 bp, Mus musculus
tttgccgcctctggggtggcaaagc

SEQ ID NO: 293271 - DNA, 25 bp, Mus musculus
aggcgcaggccctccaggagcagaa

SEQ ID NO: 293272 - DNA, 25 bp, Mus musculus
gggtctgctcttctgctgcctcacg

SEQ ID NO: 293273 - DNA, 25 bp, Mus musculus
ctgtgcagcttggagctcttcggtc

SEQ ID NO: 293274 - DNA, 25 bp, Mus musculus
ctcttcggtcgcattggccacatgt

SEQ ID NO: 293275 - DNA, 25 bp, Mus musculus
attggccacatgtgcccggcttcag

SEQ ID NO: 293276 - DNA, 25 bp, Mus musculus
ggagaggatcgtggctttttcccgc

SEQ ID NO: 293277 - DNA, 25 bp, Mus musculus
tttttcccgcctggcgcgataatgg

SEQ ID NO: 293278 - DNA, 25 bp, Mus musculus
cgcgataatggagtgaaaatgaccc

SEQ ID NO: 293279 - DNA, 25 bp, Mus musculus
gagtgaaaatgacccggtggcgtta

SEQ ID NO: 293280 - DNA, 25 bp, Mus musculus
gctgtatttttagccagatgcctcg

SEQ ID NO: 293281 - DNA, 25 bp, Mus musculus
cagatgcctcgtaagttgcccgcgc

SEQ ID NO: 293282 - DNA, 25 bp, Mus musculus
acaccgagggagctccggtgtcagc

SEQ ID NO: 293283 - DNA, 25 bp, Mus musculus
ctccgtggaatccagaggaaaattc

SEQ ID NO: 293284 - DNA, 25 bp, Mus musculus
aggaaaattcctcaggcctggaggc

SEQ ID NO: 293285 - DNA, 25 bp, Mus musculus
gccgcccagcagataacaccgaggg

SEQ ID NO: 293286 - DNA, 25 bp, Mus musculus
tactgagactacttcaggctcggcg

SEQ ID NO: 293287 - DNA, 25 bp, Mus musculus
cccggtctgctaacttccgcgaagt

SEQ ID NO: 293288 - DNA, 25 bp, Mus musculus
aacttccgcgaagtgctcttgcaga

SEQ ID NO: 293289 - DNA, 25 bp, Mus musculus
aagtgctcttgcagaccgcctcagc

SEQ ID NO: 293290 - DNA, 25 bp, Mus musculus
gcagtgtcccgctatgaagccaccg

SEQ ID NO: 293291 - DNA, 25 bp, Mus musculus
ccgctatgaagccaccgcagagacg

SEQ ID NO: 293292 - DNA, 25 bp, Mus musculus
atgaagccaccgcagagacggcgga

SEQ ID NO: 293293 - DNA, 25 bp, Mus musculus
actacttcaggctcggcggggccag

SEQ ID NO: 293294 - DNA, 25 bp, Mus musculus
acggcggagggtcccagcacgctac

SEQ ID NO: 293295 - DNA, 25 bp, Mus musculus
tcccagcacgctacgtaggtgaagc

SEQ ID NO: 293296 - DNA, 25 bp, Mus musculus
gctacgtaggtgaagctacgggccc

SEQ ID NO: 293297 - DNA, 25 bp, Mus musculus
cgagatgcggcatctactgagacta

SEQ ID NO: 293298 - DNA, 25 bp, Mus musculus
ggcagcagacaaacgcgagccacgc

SEQ ID NO: 293299 - DNA, 25 bp, Mus musculus
tgcggcatctactgagactacttca

SEQ ID NO: 293300 - DNA, 25 bp, Mus musculus
gccgcctctcggcacagcgggaccc

SEQ ID NO: 293301 - DNA, 25 bp, Mus musculus
agcccgcggcgtgcacgcggggaca

SEQ ID NO: 293302 - DNA, 25 bp, Mus musculus
agactcgagcctgggtctctccgac

SEQ ID NO: 293303 - DNA, 25 bp, Mus musculus
acagactcgagcctgggtctctccg

SEQ ID NO: 293304 - DNA, 25 bp, Mus musculus
gtagcctggcgccactactcagccc

SEQ ID NO: 293305 - DNA, 25 bp, Mus musculus
ccctgccggctttggcagcgctcca

SEQ ID NO: 293306 - DNA, 25 bp, Mus musculus
aaacgcagctgtttactcggcagcc

SEQ ID NO: 293307 - DNA, 25 bp, Mus musculus
aaggggaaacgcagctgtttactcg

SEQ ID NO: 293308 - DNA, 25 bp, Mus musculus
tgcaaaggggaaacgcagctgttta

SEQ ID NO: 293309 - DNA, 25 bp, Mus musculus
tctgcaaaggggaaacgcagctgtt

SEQ ID NO: 293310 - DNA, 25 bp, Mus musculus
ggcatcttcctctgcagccggctcc

SEQ ID NO: 293311 - DNA, 25 bp, Mus musculus
cggttccgggcatcttcctctgcag

SEQ ID NO: 293312 - DNA, 25 bp, Mus musculus
cggccacagactcgagcctgggtct

SEQ ID NO: 293313 - DNA, 25 bp, Mus musculus
gcagctgtttactcggcagcccggc

SEQ ID NO: 293314 - DNA, 25 bp, Mus musculus
cgtccacgcactggaagagaaggtc

SEQ ID NO: 293315 - DNA, 25 bp, Mus musculus
tcttaggggcgtccacgcactggaa

SEQ ID NO: 293316 - DNA, 25 bp, Mus musculus
aagccggtgctcttaggggcgtcca

SEQ ID NO: 293317 - DNA, 25 bp, Mus musculus
ggaggcagacgtcgcctctctctcg

SEQ ID NO: 293318 - DNA, 25 bp, Mus musculus
ccaaagccgggaggcagacgtcgcc

SEQ ID NO: 293319 - DNA, 25 bp, Mus musculus
caaactgaaggctctgtcgctgagg

SEQ ID NO: 293320 - DNA, 25 bp, Mus musculus
gggttgttccaaactgaaggctctg

SEQ ID NO: 293321 - DNA, 25 bp, Mus musculus
gactcccgagccaccaccacaccaa

SEQ ID NO: 293322 - DNA, 25 bp, Mus musculus
tctgccatcccacgcggaacaaaag

SEQ ID NO: 293323 - DNA, 25 bp, Mus musculus
ccagcgcgagtgcaaggctgcagcc

SEQ ID NO: 293324 - DNA, 25 bp, Mus musculus
cgagcctgtgcagcgtttgacaccc

SEQ ID NO: 293325 - DNA, 25 bp, Mus musculus
tgtgcagcgtttgacacccacacgc

SEQ ID NO: 293326 - DNA, 25 bp, Mus musculus
agcgacccgagcctgtgcagcgttt

SEQ ID NO: 293327 - DNA, 25 bp, Mus musculus
acaaaaggcagctggagcctggctt

SEQ ID NO: 293328 - DNA, 25 bp, Mus musculus
aatcagcacaatccggctccgccat

SEQ ID NO: 293329 - DNA, 25 bp, Mus musculus
agactggcaggctcttctcgctctc

SEQ ID NO: 293330 - DNA, 25 bp, Mus musculus
tcgctctcccagagccactggtgga

SEQ ID NO: 293331 - DNA, 25 bp, Mus musculus
agccactggtggacggcggtcacct

SEQ ID NO: 293332 - DNA, 25 bp, Mus musculus
ggtggacggcggtcaccttcctcgc

SEQ ID NO: 293333 - DNA, 25 bp, Mus musculus
tcggggtgtcgtcgggacacaataa

SEQ ID NO: 293334 - DNA, 25 bp, Mus musculus
aaaccttccaagtagcacagacgcc

SEQ ID NO: 293335 - DNA, 25 bp, Mus musculus
ccacgggcgcggctagctttcctgg

SEQ ID NO: 293336 - DNA, 25 bp, Mus musculus
accctccgcccagtagcggctctta

SEQ ID NO: 293337 - DNA, 25 bp, Mus musculus
agtagcggctcttagcgccctgcgc

SEQ ID NO: 293338 - DNA, 25 bp, Mus musculus
ccaggagagagactggcaggctctt

SEQ ID NO: 293339 - DNA, 25 bp, Mus musculus
tggcttggctgcttggcacgccgcc

SEQ ID NO: 293340 - DNA, 25 bp, Mus musculus
ctccgctcggtctggcttggctgct

SEQ ID NO: 293341 - DNA, 25 bp, Mus musculus
ggcccgactccgctttggcaccctc

SEQ ID NO: 293342 - DNA, 25 bp, Mus musculus
tacaacaagccgctggacccggact

SEQ ID NO: 293343 - DNA, 25 bp, Mus musculus
cgcggctaatgcaagtgtcaggccg

SEQ ID NO: 293344 - DNA, 25 bp, Mus musculus
taatgcaagtgtcaggccgctgctc

SEQ ID NO: 293345 - DNA, 25 bp, Mus musculus
ccgctgctctgtgcagtggcgcata

SEQ ID NO: 293346 - DNA, 25 bp, Mus musculus
gcagtggcgcatagtctgtactctg

SEQ ID NO: 293347 - DNA, 25 bp, Mus musculus
cggcaccccggttgctctttgcagg

SEQ ID NO: 293348 - DNA, 25 bp, Mus musculus
agagcgccctggagccctcatcctc

SEQ ID NO: 293349 - DNA, 25 bp, Mus musculus
ctcggagaacgaggacgatgagtac

SEQ ID NO: 293350 - DNA, 25 bp, Mus musculus
acgatgagtacaacaagccgctgga

SEQ ID NO: 293351 - DNA, 25 bp, Mus musculus
cgctggacccggactcggacgacga

SEQ ID NO: 293352 - DNA, 25 bp, Mus musculus
acgacgagaagatccgcctgctgct

SEQ ID NO: 293353 - DNA, 25 bp, Mus musculus
gggccgccttctccgtgctcagcct

SEQ ID NO: 293354 - DNA, 25 bp, Mus musculus
catagtctgtactctggggtagcga

SEQ ID NO: 293355 - DNA, 25 bp, Mus musculus
ctcggacgacgagaagatccgcctg

SEQ ID NO: 293356 - DNA, 25 bp, Mus musculus
cacgtgatctaacgccgggttctca

SEQ ID NO: 293357 - DNA, 25 bp, Mus musculus
gggcatcccggagcttctcttaacg

SEQ ID NO: 293358 - DNA, 25 bp, Mus musculus
tccggctggccacgaaacgttagcc

SEQ ID NO: 293359 - DNA, 25 bp, Mus musculus
actttgtgtgagattcggttccggc

SEQ ID NO: 293360 - DNA, 25 bp, Mus musculus
cccggcatggcgaggttcatttact

SEQ ID NO: 293361 - DNA, 25 bp, Mus musculus
agaacaggcatcgttcccggggaga

SEQ ID NO: 293362 - DNA, 25 bp, Mus musculus
ctttctgaaagccaaccggggcctg

SEQ ID NO: 293363 - DNA, 25 bp, Mus musculus
cgtgagccgaggtcgctttctgaaa

SEQ ID NO: 293364 - DNA, 25 bp, Mus musculus
actgatgctcgccagcgtgagccga

SEQ ID NO: 293365 - DNA, 25 bp, Mus musculus
gcgatgctcgctcctcgcactgatg

SEQ ID NO: 293366 - DNA, 25 bp, Mus musculus
gcccgtctttgtctacgccgctgga

SEQ ID NO: 293367 - DNA, 25 bp, Mus musculus
ccaggcgtacgtaagagcgtgcgta

SEQ ID NO: 293368 - DNA, 25 bp, Mus musculus
gcgtccggtaggaccaggtccatcc

SEQ ID NO: 293369 - DNA, 25 bp, Mus musculus
gggttctcagccacgttcctcagct

SEQ ID NO: 293370 - DNA, 25 bp, Mus musculus
gcaatgctccttgtcgtcgccagga

SEQ ID NO: 293371 - DNA, 25 bp, Mus musculus
tgcgggagcactaaccaatcaggcc

SEQ ID NO: 293372 - DNA, 25 bp, Mus musculus
caggcagcgccgtcttgtggcgaat

SEQ ID NO: 293373 - DNA, 25 bp, Mus musculus
tcggctcacagtaaggaaaccaggc

SEQ ID NO: 293374 - DNA, 25 bp, Mus musculus
cgggctcttgccgagctatagaaca

SEQ ID NO: 293375 - DNA, 25 bp, Mus musculus
tcgacaggaaaacgtctccgcgctg

SEQ ID NO: 293376 - DNA, 25 bp, Mus musculus
gctacacggctcagggatccctctt

SEQ ID NO: 293377 - DNA, 25 bp, Mus musculus
ttggcactcaaagcggctacacggc

SEQ ID NO: 293378 - DNA, 25 bp, Mus musculus
gctcacctcgcagttggcactcaaa

SEQ ID NO: 293379 - DNA, 25 bp, Mus musculus
ctcagctgcaactgacccggggtcg

SEQ ID NO: 293380 - DNA, 25 bp, Mus musculus
tgcatcgtgtcaagtgctcggcaca

SEQ ID NO: 293381 - DNA, 25 bp, Mus musculus
tcggttcaaatgagaaaagtgcatc

SEQ ID NO: 293382 - DNA, 25 bp, Mus musculus
agcgttttgcctcagtggcccagga

SEQ ID NO: 293383 - DNA, 25 bp, Mus musculus
ctatagaacatacttccggaaggcg

SEQ ID NO: 293384 - DNA, 25 bp, Mus musculus
gtcgccgcttacgtcctgtcgcaaa

SEQ ID NO: 293385 - DNA, 25 bp, Mus musculus
gccgcttacgtcctgtcgcaaaaaa

SEQ ID NO: 293386 - DNA, 25 bp, Mus musculus
ctgtcgcaaaaaaacctagcctctc

SEQ ID NO: 293387 - DNA, 25 bp, Mus musculus
cgaacaccttctgtgccgcacgttg

SEQ ID NO: 293388 - DNA, 25 bp, Mus musculus
ctccggccgtaaagcgacgcctccg

SEQ ID NO: 293389 - DNA, 25 bp, Mus musculus
tggctgggagagaagtcttcctagt

SEQ ID NO: 293390 - DNA, 25 bp, Mus musculus
agagaagtcttcctagtgtaggcga

SEQ ID NO: 293391 - DNA, 25 bp, Mus musculus
ctagtgtaggcgaatgaaacccttc

SEQ ID NO: 293392 - DNA, 25 bp, Mus musculus
cccttccgggcggaagaagatgatg

SEQ ID NO: 293393 - DNA, 25 bp, Mus musculus
acgtgatcggtggatccgggagttc

SEQ ID NO: 293394 - DNA, 25 bp, Mus musculus
ctcggccctccagcagctgtcgcgc

SEQ ID NO: 293395 - DNA, 25 bp, Mus musculus
tgtcgcgccacctccgtcgccgctt

SEQ ID NO: 293396 - DNA, 25 bp, Mus musculus
tgaatgaacaccttcccggacaccg

SEQ ID NO: 293397 - DNA, 25 bp, Mus musculus
gtagtctcgctgaatgaacaccttc

SEQ ID NO: 293398 - DNA, 25 bp, Mus musculus
tgctcaacaagaactgccacatggg

SEQ ID NO: 293399 - DNA, 25 bp, Mus musculus
gaaagctcaggagccgcgcaccgca

SEQ ID NO: 293400 - DNA, 25 bp, Mus musculus
caaggtaagggtatgccttcccacg

SEQ ID NO: 293401 - DNA, 25 bp, Mus musculus
ggcccgagatgctcaaatgtgacaa

SEQ ID NO: 293402 - DNA, 25 bp, Mus musculus
agttcttcggcttctactggcccga

SEQ ID NO: 293403 - DNA, 25 bp, Mus musculus
atctacccgtgtcgctggctctgcg

SEQ ID NO: 293404 - DNA, 25 bp, Mus musculus
tacaagaagatggtgctgcccaacc

SEQ ID NO: 293405 - DNA, 25 bp, Mus musculus
ccacaacgtgggctacaagaagatg

SEQ ID NO: 293406 - DNA, 25 bp, Mus musculus
gctcgtatcagagcgggcgcttcta

SEQ ID NO: 293407 - DNA, 25 bp, Mus musculus
gcttccagtccgacatcggctcgta

SEQ ID NO: 293408 - DNA, 25 bp, Mus musculus
tcggccagcgagtacgactacgtga

SEQ ID NO: 293409 - DNA, 25 bp, Mus musculus
gcgtcgcaagtaggtgcagcagccc

SEQ ID NO: 293410 - DNA, 25 bp, Mus musculus
gcgcattcgagctgcagcgtcgcaa

SEQ ID NO: 293411 - DNA, 25 bp, Mus musculus
gcgagccggtcatgcagttcttcgg

SEQ ID NO: 293412 - DNA, 25 bp, Mus musculus
cgtcggcgccagcagataattgcta

SEQ ID NO: 293413 - DNA, 25 bp, Mus musculus
cagataattgctaagtgcatcgcta

SEQ ID NO: 293414 - DNA, 25 bp, Mus musculus
tgcatcgctagcacagttggtccga

SEQ ID NO: 293415 - DNA, 25 bp, Mus musculus
cacagttggtccgagctgctgaaag

SEQ ID NO: 293416 - DNA, 25 bp, Mus musculus
cgagctgctgaaaggtctggtcgca

SEQ ID NO: 293417 - DNA, 25 bp, Mus musculus
tgctgaaaggtctggtcgcagagac

SEQ ID NO: 293418 - DNA, 25 bp, Mus musculus
gtcgcagagacaggaacgcagcatc

SEQ ID NO: 293419 - DNA, 25 bp, Mus musculus
aggaacgcagcatcctcagcgtgct

SEQ ID NO: 293420 - DNA, 25 bp, Mus musculus
agcgtgctccatcccggcagtgtct

SEQ ID NO: 293421 - DNA, 25 bp, Mus musculus
ccctctgcttctcggagaaggtacc

SEQ ID NO: 293422 - DNA, 25 bp, Mus musculus
gcttctcggagaaggtacctttatc

SEQ ID NO: 293423 - DNA, 25 bp, Mus musculus
gtacctttatctgtgtcccgggaga

SEQ ID NO: 293424 - DNA, 25 bp, Mus musculus
cctttatctgtgtcccgggagaggg

SEQ ID NO: 293425 - DNA, 25 bp, Mus musculus
gctgcttccgctctgttttcgctcg

SEQ ID NO: 293426 - DNA, 25 bp, Mus musculus
cccgcggcctcaagctgggaataca

SEQ ID NO: 293427 - DNA, 25 bp, Mus musculus
gaactggatctcacaccctcgggcg

SEQ ID NO: 293428 - DNA, 25 bp, Mus musculus
ctcgtttaatgctacggccgaactg

SEQ ID NO: 293429 - DNA, 25 bp, Mus musculus
tgtgtttctcggagccactcgttta

SEQ ID NO: 293430 - DNA, 25 bp, Mus musculus
ggccctgctattggggaacctgctg

SEQ ID NO: 293431 - DNA, 25 bp, Mus musculus
gttacctattgctgtgcggccaggc

SEQ ID NO: 293432 - DNA, 25 bp, Mus musculus
ggctgccctgtgagttacctattgc

SEQ ID NO: 293433 - DNA, 25 bp, Mus musculus
gctttgtttttaggccaggtctcta

SEQ ID NO: 293434 - DNA, 25 bp, Mus musculus
tacccgacgtagagagaggcctgac

SEQ ID NO: 293435 - DNA, 25 bp, Mus musculus
ccgtttctgattggccgtagtggca

SEQ ID NO: 293436 - DNA, 25 bp, Mus musculus
tccgtgcagcagtgaagggtctact

SEQ ID NO: 293437 - DNA, 25 bp, Mus musculus
gcccgctcagcggagactagagaag

SEQ ID NO: 293438 - DNA, 25 bp, Mus musculus
gccagaggctgacgtagggaaaata

SEQ ID NO: 293439 - DNA, 25 bp, Mus musculus
agcagccaccttagtcgcagagagg

SEQ ID NO: 293440 - DNA, 25 bp, Mus musculus
ctcggttctccttgcggagcgcaca

SEQ ID NO: 293441 - DNA, 25 bp, Mus musculus
tggcctcggcccacggaacaggcac

SEQ ID NO: 293442 - DNA, 25 bp, Mus musculus
cgcgagcgagcgaagttagagcact

SEQ ID NO: 293443 - DNA, 25 bp, Mus musculus
agttagagcactcacttcatctccc

SEQ ID NO: 293444 - DNA, 25 bp, Mus musculus
ttcatctccctctgaaaagtaagag

SEQ ID NO: 293445 - DNA, 25 bp, Mus musculus
ccctctgaaaagtaagagaagtgtc

SEQ ID NO: 293446 - DNA, 25 bp, Mus musculus
agaagtgtcaggagattcgcccgcg

SEQ ID NO: 293447 - DNA, 25 bp, Mus musculus
cttctgcactggcacagccgggagc

SEQ ID NO: 293448 - DNA, 25 bp, Mus musculus
gctggcgagcggctcggttctcctt

SEQ ID NO: 293449 - DNA, 25 bp, Mus musculus
tctccttgcggagcgcacataggct

SEQ ID NO: 293450 - DNA, 25 bp, Mus musculus
gcagcagccgcagcgatcgggaacc

SEQ ID NO: 293451 - DNA, 25 bp, Mus musculus
agcgatcgggaaccggcgccaagcc

SEQ ID NO: 293452 - DNA, 25 bp, Mus musculus
cgctgccgcacactaccgcatcctc

SEQ ID NO: 293453 - DNA, 25 bp, Mus musculus
agcgagactctggacctcctggcct

SEQ ID NO: 293454 - DNA, 25 bp, Mus musculus
ccggactggcgccaccaagcaaacc

SEQ ID NO: 293455 - DNA, 25 bp, Mus musculus
cccggctgcagcaggtgtccgcgat

SEQ ID NO: 293456 - DNA, 25 bp, Mus musculus
gatgtaacccggctgcagcaggtgt

SEQ ID NO: 293457 - DNA, 25 bp, Mus musculus
agtacaatgctcctcgggcctccag

SEQ ID NO: 293458 - DNA, 25 bp, Mus musculus
cccggatgtgagtacaatgctcctc

SEQ ID NO: 293459 - DNA, 25 bp, Mus musculus
gtttcacattaaagcaaaacccagc

SEQ ID NO: 293460 - DNA, 25 bp, Mus musculus
tccaaggccgtctctcgactctttt

SEQ ID NO: 293461 - DNA, 25 bp, Mus musculus
tatcctcagctgtcctccaaggccg

SEQ ID NO: 293462 - DNA, 25 bp, Mus musculus
gcggcacacttctcccttatcctca

SEQ ID NO: 293463 - DNA, 25 bp, Mus musculus
gtcgcatcgggtcccagagctctgc

SEQ ID NO: 293464 - DNA, 25 bp, Mus musculus
ctctgcgcagcaagggtcgcatcgg

SEQ ID NO: 293465 - DNA, 25 bp, Mus musculus
tcaccgcgctctgcgcagcaagggt

SEQ ID NO: 293466 - DNA, 25 bp, Mus musculus
gacccttgcgcctctctgcccgact

SEQ ID NO: 293467 - DNA, 25 bp, Mus musculus
cgatggggtgctcgaccgtcacgtc

SEQ ID NO: 293468 - DNA, 25 bp, Mus musculus
acggcgccacctgcttggtaagcaa

SEQ ID NO: 293469 - DNA, 25 bp, Mus musculus
tggccttctcccaggtgcagtgtct

SEQ ID NO: 293470 - DNA, 25 bp, Mus musculus
gcaagtccctcctccgggtttgcga

SEQ ID NO: 293471 - DNA, 25 bp, Mus musculus
ccagcttattcccaggattccgaga

SEQ ID NO: 293472 - DNA, 25 bp, Mus musculus
aacctcaggcggatcccaagacaga

SEQ ID NO: 293473 - DNA, 25 bp, Mus musculus
ctgattccctcaggtgcggttctca

SEQ ID NO: 293474 - DNA, 25 bp, Mus musculus
tctggacgacaaccacgtgaactgg

SEQ ID NO: 293475 - DNA, 25 bp, Mus musculus
atccagcgagtcgaagcccgagttc

SEQ ID NO: 293476 - DNA, 25 bp, Mus musculus
cccgagttcttctacagcgaggagc

SEQ ID NO: 293477 - DNA, 25 bp, Mus musculus
gcgacgccttctacgaggtgctgaa

SEQ ID NO: 293478 - DNA, 25 bp, Mus musculus
cgcgactttctttcggagctggagc

SEQ ID NO: 293479 - DNA, 25 bp, Mus musculus
agctttcgcgtatcgtggaggccat

SEQ ID NO: 293480 - DNA, 25 bp, Mus musculus
ggcctgacaccattgcctaccgagg

SEQ ID NO: 293481 - DNA, 25 bp, Mus musculus
cgaccgcggtcttttgctgattccc

SEQ ID NO: 293482 - DNA, 25 bp, Mus musculus
ttgtttacgggctggagtcgagccc

SEQ ID NO: 293483 - DNA, 25 bp, Mus musculus
gatgtgagacgacggctgtgccatt

SEQ ID NO: 293484 - DNA, 25 bp, Mus musculus
tcctactgctatgggcttcgggaga

SEQ ID NO: 293485 - DNA, 25 bp, Mus musculus
gggtcccagcactcctactgctatg

SEQ ID NO: 293486 - DNA, 25 bp, Mus musculus
gcgtgctctgatcgccggggtccca

SEQ ID NO: 293487 - DNA, 25 bp, Mus musculus
tccagagaccttctcacggagtatg

SEQ ID NO: 293488 - DNA, 25 bp, Mus musculus
ttgcttgcggccgaggcctctgtgc

SEQ ID NO: 293489 - DNA, 25 bp, Mus musculus
caccgcggtgagctctggactctgg

SEQ ID NO: 293490 - DNA, 25 bp, Mus musculus
gacccacccagagctgcacggaggg

SEQ ID NO: 293491 - DNA, 25 bp, Mus musculus
ccagctgacgggctgcgttgtttac

SEQ ID NO: 293492 - DNA, 25 bp, Mus musculus
agacgacggctgtgccattgctggt

SEQ ID NO: 293493 - DNA, 25 bp, Mus musculus
gagaccttctcacggagtatgtccc

SEQ ID NO: 293494 - DNA, 25 bp, Mus musculus
acccggacaggagacgcaccgcggt

SEQ ID NO: 293495 - DNA, 25 bp, Mus musculus
gcctctgtgctcttcccgggactgt

SEQ ID NO: 293496 - DNA, 25 bp, Mus musculus
aaagtggaactgctatgtcatcctt

SEQ ID NO: 293497 - DNA, 25 bp, Mus musculus
cgcccccttttggcccgagtgtgag

SEQ ID NO: 293498 - DNA, 25 bp, Mus musculus
ctctagggccctcttgcctttcctt

SEQ ID NO: 293499 - DNA, 25 bp, Mus musculus
agccctaccctctagggccctcttg

SEQ ID NO: 293500 - DNA, 25 bp, Mus musculus
gctatgtcatcctttttattccccc

SEQ ID NO: 293501 - DNA, 25 bp, Mus musculus
ctgctatgtcatcctttttattccc

SEQ ID NO: 293502 - DNA, 25 bp, Mus musculus
aactgctatgtcatcctttttattc

SEQ ID NO: 293503 - DNA, 25 bp, Mus musculus
gaactgctatgtcatcctttttatt

SEQ ID NO: 293504 - DNA, 25 bp, Mus musculus
ggaactgctatgtcatcctttttat

SEQ ID NO: 293505 - DNA, 25 bp, Mus musculus
tggaactgctatgtcatccttttta

SEQ ID NO: 293506 - DNA, 25 bp, Mus musculus
gtggaactgctatgtcatccttttt

SEQ ID NO: 293507 - DNA, 25 bp, Mus musculus
agtggaactgctatgtcatcctttt

SEQ ID NO: 293508 - DNA, 25 bp, Mus musculus
aagtggaactgctatgtcatccttt

SEQ ID NO: 293509 - DNA, 25 bp, Mus musculus
cgcccccactctcgagtgaggagga

SEQ ID NO: 293510 - DNA, 25 bp, Mus musculus
gggtcaatgcggtttccttcccatc

SEQ ID NO: 293511 - DNA, 25 bp, Mus musculus
agccttcgcaccaccaagaggatga

SEQ ID NO: 293512 - DNA, 25 bp, Mus musculus
atgagcacggcggtgaccagcaccg

SEQ ID NO: 293513 - DNA, 25 bp, Mus musculus
cagcacctgcggaacgaacggcaca

SEQ ID NO: 293514 - DNA, 25 bp, Mus musculus
acaggctgggcaacgcatatccgtc

SEQ ID NO: 293515 - DNA, 25 bp, Mus musculus
cctcctccagggtcttttgaatcac

SEQ ID NO: 293516 - DNA, 25 bp, Mus musculus
ccggaggaggttgtattcagttcgt

SEQ ID NO: 293517 - DNA, 25 bp, Mus musculus
cacatgcctggttctcggagagaga

SEQ ID NO: 293518 - DNA, 25 bp, Mus musculus
cccatctgcagaatgggtcaatgcg

SEQ ID NO: 293519 - DNA, 25 bp, Mus musculus
gaatcgcgtggtgcacggcaagacc

SEQ ID NO: 293520 - DNA, 25 bp, Mus musculus
acgtagtttcacctgcacatgcctg

SEQ ID NO: 293521 - DNA, 25 bp, Mus musculus
tattcagttcgtgactcggtgtccc

SEQ ID NO: 293522 - DNA, 25 bp, Mus musculus
gggagcaactaagccttccgagaga

SEQ ID NO: 293523 - DNA, 25 bp, Mus musculus
gagactaggtctcccgctatgcatg

SEQ ID NO: 293524 - DNA, 25 bp, Mus musculus
cgccatgcttggaaggtcgcactgc

SEQ ID NO: 293525 - DNA, 25 bp, Mus musculus
ggacacctttgctcggtcgatggaa

SEQ ID NO: 293526 - DNA, 25 bp, Mus musculus
acagtcctcgaagggacacctttgc

SEQ ID NO: 293527 - DNA, 25 bp, Mus musculus
gaagctctctaacagtcctcgaagg

SEQ ID NO: 293528 - DNA, 25 bp, Mus musculus
tccggggcaaagctgaagctctcta

SEQ ID NO: 293529 - DNA, 25 bp, Mus musculus
tcaggacaaatcgatccggggcaaa

SEQ ID NO: 293530 - DNA, 25 bp, Mus musculus
gacctacccggaatcaggacaaatc

SEQ ID NO: 293531 - DNA, 25 bp, Mus musculus
ggaaactcgtaccattcaggagctg

SEQ ID NO: 293532 - DNA, 25 bp, Mus musculus
tgctcggtcgatggaaactcgtacc

SEQ ID NO: 293533 - DNA, 25 bp, Mus musculus
gcctcccgccatgcttggaaggtcg

SEQ ID NO: 293534 - DNA, 25 bp, Mus musculus
ctcgtaccattcaggagctgcaacc

SEQ ID NO: 293535 - DNA, 25 bp, Mus musculus
caggtccacccagcttcggccaaca

SEQ ID NO: 293536 - DNA, 25 bp, Mus musculus
cctcagacgcggcacctttaaatta

SEQ ID NO: 293537 - DNA, 25 bp, Mus musculus
ctttaaattattccgctgcaggaca

SEQ ID NO: 293538 - DNA, 25 bp, Mus musculus
aatcccggtcaaagaggaggcgtgc

SEQ ID NO: 293539 - DNA, 25 bp, Mus musculus
agtgctcaattgctcgctcccgtag

SEQ ID NO: 293540 - DNA, 25 bp, Mus musculus
tgcatggcttgcgagtgctcaattg

SEQ ID NO: 293541 - DNA, 25 bp, Mus musculus
agattgcttatctgcatggcttgcg

SEQ ID NO: 293542 - DNA, 25 bp, Mus musculus
tccgcgtgcaagtgcagattgctta

SEQ ID NO: 293543 - DNA, 25 bp, Mus musculus
gttgagaccaggacgcatatccgcg

SEQ ID NO: 293544 - DNA, 25 bp, Mus musculus
acgtgcaatggacaagttgagacca

SEQ ID NO: 293545 - DNA, 25 bp, Mus musculus
gctcccgtagctcatcttgcgactg

SEQ ID NO: 293546 - DNA, 25 bp, Mus musculus
ggtggtagctctggccagccatagt

SEQ ID NO: 293547 - DNA, 25 bp, Mus musculus
acatgcttctgggaagcccaccgcg

SEQ ID NO: 293548 - DNA, 25 bp, Mus musculus
ccagccatagtcagtacgtgcaatg

SEQ ID NO: 293549 - DNA, 25 bp, Mus musculus
ggcgcatctccgatacatgcttctg

SEQ ID NO: 293550 - DNA, 25 bp, Mus musculus
tcatcttgcgactgtaacgtgggcg

SEQ ID NO: 293551 - DNA, 25 bp, Mus musculus
tggcgagaacgcacggcgcatctcc

SEQ ID NO: 293552 - DNA, 25 bp, Mus musculus
gaaggcccgccctcttcgagacaga

SEQ ID NO: 293553 - DNA, 25 bp, Mus musculus
tgaggttttgcattactggacagtc

SEQ ID NO: 293554 - DNA, 25 bp, Mus musculus
actggacagtcgactttgggcggaa

SEQ ID NO: 293555 - DNA, 25 bp, Mus musculus
ttcgggtcagtgagttctaggcgtt

SEQ ID NO: 293556 - DNA, 25 bp, Mus musculus
tcggaacgcggaactcgcgccatca

SEQ ID NO: 293557 - DNA, 25 bp, Mus musculus
cctggctctccaggtacagacgaga

SEQ ID NO: 293558 - DNA, 25 bp, Mus musculus
cgctctagtggcgtcacgcacagaa

SEQ ID NO: 293559 - DNA, 25 bp, Mus musculus
cgagacagacccgttttctattggc

SEQ ID NO: 293560 - DNA, 25 bp, Mus musculus
ctattggctgcaccgcactttgaca

SEQ ID NO: 293561 - DNA, 25 bp, Mus musculus
gcaccgcttgctctgttaaattttg

SEQ ID NO: 293562 - DNA, 25 bp, Mus musculus
tgacgtcacagacccgggttcctga

SEQ ID NO: 293563 - DNA, 25 bp, Mus musculus
actccgcttccgtattggcccttgg

SEQ ID NO: 293564 - DNA, 25 bp, Mus musculus
cttgggcagcaccaatgaggttttg

SEQ ID NO: 293565 - DNA, 25 bp, Mus musculus
tacagacgagagtcgcgctctagtg

SEQ ID NO: 293566 - DNA, 25 bp, Mus musculus
tttaagactcccgagggcgcacgca

SEQ ID NO: 293567 - DNA, 25 bp, Mus musculus
gctgtcatcgcgctaagcaaattga

SEQ ID NO: 293568 - DNA, 25 bp, Mus musculus
agggcgcacgcacaaactggcgatc

SEQ ID NO: 293569 - DNA, 25 bp, Mus musculus
caaattgatcccagtgtgtgtgagc

SEQ ID NO: 293570 - DNA, 25 bp, Mus musculus
tgagcaagggaatatttaagactcc

SEQ ID NO: 293571 - DNA, 25 bp, Mus musculus
cccacgtggatgacgcgtagagcca

SEQ ID NO: 293572 - DNA, 25 bp, Mus musculus
tgagtatttttaccgcgctgtcatc

SEQ ID NO: 293573 - DNA, 25 bp, Mus musculus
tattcctcaggggaagatggcgccc

SEQ ID NO: 293574 - DNA, 25 bp, Mus musculus
caccttgggaccgacccggaagcag

SEQ ID NO: 293575 - DNA, 25 bp, Mus musculus
ggacccagcttcctagacgtagaga

SEQ ID NO: 293576 - DNA, 25 bp, Mus musculus
ccctgaagtggagccaagtggtgct

SEQ ID NO: 293577 - DNA, 25 bp, Mus musculus
ttcgagtccctgtcattgtgccttc

SEQ ID NO: 293578 - DNA, 25 bp, Mus musculus
aactggcgatcgtccgttcgagtcc

SEQ ID NO: 293579 - DNA, 25 bp, Mus musculus
gaagcagcgctattcctcaggggaa

SEQ ID NO: 293580 - DNA, 25 bp, Mus musculus
taaccaggcgtgtctctgcggcctg

SEQ ID NO: 293581 - DNA, 25 bp, Mus musculus
ccgagaccctccgagaggcggaacg

SEQ ID NO: 293582 - DNA, 25 bp, Mus musculus
tggagtgtggctgcctaccctttct

SEQ ID NO: 293583 - DNA, 25 bp, Mus musculus
gggtcgcgagcccagtctgtcacac

SEQ ID NO: 293584 - DNA, 25 bp, Mus musculus
gctccgggcaactcgggctaaccag

SEQ ID NO: 293585 - DNA, 25 bp, Mus musculus
cgggagtctgcaatcttagggtgac

SEQ ID NO: 293586 - DNA, 25 bp, Mus musculus
cagaaagggccgaacgaccgagctc

SEQ ID NO: 293587 - DNA, 25 bp, Mus musculus
ctcagcccacagagaggtctggctc

SEQ ID NO: 293588 - DNA, 25 bp, Mus musculus
accggacacagactgcggctgggct

SEQ ID NO: 293589 - DNA, 25 bp, Mus musculus
cgccctcggtggttcagcgcggtac

SEQ ID NO: 293590 - DNA, 25 bp, Mus musculus
tccgaaaggccgaggtccgccgaca

SEQ ID NO: 293591 - DNA, 25 bp, Mus musculus
agggctgcctgcagaacacccgatc

SEQ ID NO: 293592 - DNA, 25 bp, Mus musculus
atctgggtgccgctgaccttagagg

SEQ ID NO: 293593 - DNA, 25 bp, Mus musculus
agaccaaccgagaagccgaggcccg

SEQ ID NO: 293594 - DNA, 25 bp, Mus musculus
aacgtaacacccgtccaccagcagg

SEQ ID NO: 293595 - DNA, 25 bp, Mus musculus
agacacgcacagacacgctcagaca

SEQ ID NO: 293596 - DNA, 25 bp, Mus musculus
gtaggtagcccgagagcgtcatgct

SEQ ID NO: 293597 - DNA, 25 bp, Mus musculus
agagcgtcatgctggcacgtacata

SEQ ID NO: 293598 - DNA, 25 bp, Mus musculus
gtacataccgccacagggagcctgc

SEQ ID NO: 293599 - DNA, 25 bp, Mus musculus
gctcgctgacctggaacgttgttaa

SEQ ID NO: 293600 - DNA, 25 bp, Mus musculus
gacacgctcagacacactcggaggc

SEQ ID NO: 293601 - DNA, 25 bp, Mus musculus
agcctgtgggctcgctgacctggaa

SEQ ID NO: 293602 - DNA, 25 bp, Mus musculus
gctgacctggaacgttgttaacgta

SEQ ID NO: 293603 - DNA, 25 bp, Mus musculus
cgtccaccagcaggtgcccgtcctt

SEQ ID NO: 293604 - DNA, 25 bp, Mus musculus
tagggacagtaggaggcactggccc

SEQ ID NO: 293605 - DNA, 25 bp, Mus musculus
gcactggcccggacgtaacgccaca

SEQ ID NO: 293606 - DNA, 25 bp, Mus musculus
ggtgaggtgtccgacaagcctcccg

SEQ ID NO: 293607 - DNA, 25 bp, Mus musculus
tggcacgtacataccgccacaggga

SEQ ID NO: 293608 - DNA, 25 bp, Mus musculus
gggcgcctgaactgaacacgtgaca

SEQ ID NO: 293609 - DNA, 25 bp, Mus musculus
ttaccctcagtagtgtccggcgatg

SEQ ID NO: 293610 - DNA, 25 bp, Mus musculus
cagccttgtaacttctgagtccaga

SEQ ID NO: 293611 - DNA, 25 bp, Mus musculus
gagggacccactggcttctaggtgt

SEQ ID NO: 293612 - DNA, 25 bp, Mus musculus
gctggccgcttgtggactaaaaata

SEQ ID NO: 293613 - DNA, 25 bp, Mus musculus
gtgacaagcgcgaccctttctaagg

SEQ ID NO: 293614 - DNA, 25 bp, Mus musculus
ccagtattggactgcagcggaagtc

SEQ ID NO: 293615 - DNA, 25 bp, Mus musculus
gttctagaagccgaaagcccatctt

SEQ ID NO: 293616 - DNA, 25 bp, Mus musculus
cggtagaagctctccgcctgaggta

SEQ ID NO: 293617 - DNA, 25 bp, Mus musculus
cgccgcccagattctaggatcggta

SEQ ID NO: 293618 - DNA, 25 bp, Mus musculus
tccggcgtcctaagccgaaaatatc

SEQ ID NO: 293619 - DNA, 25 bp, Mus musculus
gagaagtccgccctgaaagtcagaa

SEQ ID NO: 293620 - DNA, 25 bp, Mus musculus
ggtcctagtgccgatagcaactcta

SEQ ID NO: 293621 - DNA, 25 bp, Mus musculus
cactaagctggacgctcgatgccca

SEQ ID NO: 293622 - DNA, 25 bp, Mus musculus
ccgcacggcgtcttacagcaaaatg

SEQ ID NO: 293623 - DNA, 25 bp, Mus musculus
cacggcgtcttacagcaaaatggcg

SEQ ID NO: 293624 - DNA, 25 bp, Mus musculus
agtctttcgagactgcgaggccagg

SEQ ID NO: 293625 - DNA, 25 bp, Mus musculus
ctctaagcgcgagaaagtctttcga

SEQ ID NO: 293626 - DNA, 25 bp, Mus musculus
tggcgactctaagcgcgagaaagtc

SEQ ID NO: 293627 - DNA, 25 bp, Mus musculus
ttacagcaaaatggcgactctaagc

SEQ ID NO: 293628 - DNA, 25 bp, Mus musculus
acagagctccgcacggcgtcttaca

SEQ ID NO: 293629 - DNA, 25 bp, Mus musculus
aagagagcacagagctccgcacggc

SEQ ID NO: 293630 - DNA, 25 bp, Mus musculus
tcggctgccgaaggaagagagcaca

SEQ ID NO: 293631 - DNA, 25 bp, Mus musculus
aagggccatggctcccgcccggcac

SEQ ID NO: 293632 - DNA, 25 bp, Mus musculus
cccggagcaacaagggccatggctc

SEQ ID NO: 293633 - DNA, 25 bp, Mus musculus
caactgactagagtgggcgaggccg

SEQ ID NO: 293634 - DNA, 25 bp, Mus musculus
gcctgagggcaactgactagagtgg

SEQ ID NO: 293635 - DNA, 25 bp, Mus musculus
gcgtcttacagcaaaatggcgactc

SEQ ID NO: 293636 - DNA, 25 bp, Mus musculus
cgctgatgctggagcaacgctgagc

SEQ ID NO: 293637 - DNA, 25 bp, Mus musculus
actgtggctgcttcgatgcttgagc

SEQ ID NO: 293638 - DNA, 25 bp, Mus musculus
ggaaggctcgcccacaatcaggaca

SEQ ID NO: 293639 - DNA, 25 bp, Mus musculus
taaggcttctctccactgtgtgtgc

SEQ ID NO: 293640 - DNA, 25 bp, Mus musculus
aacgctgagctctgcccaaaggcct

SEQ ID NO: 293641 - DNA, 25 bp, Mus musculus
caggtgtttaagtagcgcagagccc

SEQ ID NO: 293642 - DNA, 25 bp, Mus musculus
caaagcctttggcacacactgggca

SEQ ID NO: 293643 - DNA, 25 bp, Mus musculus
tggatcgccagccaaaggccttgcc

SEQ ID NO: 293644 - DNA, 25 bp, Mus musculus
ccttgccgcaggcagcacactggta

SEQ ID NO: 293645 - DNA, 25 bp, Mus musculus
tgttgggccagcaacgagccatgac

SEQ ID NO: 293646 - DNA, 25 bp, Mus musculus
agcacactggtagggccgtgcacct

SEQ ID NO: 293647 - DNA, 25 bp, Mus musculus
tggcgccatggctgaatgacttgcc

SEQ ID NO: 293648 - DNA, 25 bp, Mus musculus
ccacagtcgggacagcggtaaggct

SEQ ID NO: 293649 - DNA, 25 bp, Mus musculus
cgagccatgaccgaaggccttgcca

SEQ ID NO: 293650 - DNA, 25 bp, Mus musculus
ctcttagtgttgaggggtctcctcc

SEQ ID NO: 293651 - DNA, 25 bp, Mus musculus
acccatccggatctcagattcactg

SEQ ID NO: 293652 - DNA, 25 bp, Mus musculus
tctcagattcactgtagattagggg

SEQ ID NO: 293653 - DNA, 25 bp, Mus musculus
tggccggataaacgtactaggcctg

SEQ ID NO: 293654 - DNA, 25 bp, Mus musculus
gataaacgtactaggcctgagctcc

SEQ ID NO: 293655 - DNA, 25 bp, Mus musculus
ccaagtagagcgctggcaccatgta

SEQ ID NO: 293656 - DNA, 25 bp, Mus musculus
agcgctggcaccatgtactctgcaa

SEQ ID NO: 293657 - DNA, 25 bp, Mus musculus
ccatgtactctgcaaggggtgcgta

SEQ ID NO: 293658 - DNA, 25 bp, Mus musculus
ccgcaccctgctcttagtgttgagg

SEQ ID NO: 293659 - DNA, 25 bp, Mus musculus
agcccgatccgctttcggggtcact

SEQ ID NO: 293660 - DNA, 25 bp, Mus musculus
ggacttgtagttcgctcgagccctc

SEQ ID NO: 293661 - DNA, 25 bp, Mus musculus
agctggcgcgcgtccagtctttgtt

SEQ ID NO: 293662 - DNA, 25 bp, Mus musculus
ccagtctttgtttgcgccctaccaa

SEQ ID NO: 293663 - DNA, 25 bp, Mus musculus
actctgcaaggggtgcgtagagata

SEQ ID NO: 293664 - DNA, 25 bp, Mus musculus
tccaggtcatgctggtaggcctggc

SEQ ID NO: 293665 - DNA, 25 bp, Mus musculus
ttgcgttgccgctcttgctccagca

SEQ ID NO: 293666 - DNA, 25 bp, Mus musculus
tgtcgctctagctcggtgcgctcct

SEQ ID NO: 293667 - DNA, 25 bp, Mus musculus
tcacgcagacgctccaggtcatgct

SEQ ID NO: 293668 - DNA, 25 bp, Mus musculus
aggcgctcacgttcacggtccactg

SEQ ID NO: 293669 - DNA, 25 bp, Mus musculus
tttgcagcttctccacaccggcgcg

SEQ ID NO: 293670 - DNA, 25 bp, Mus musculus
tggtccagccgctggcgcatctggc

SEQ ID NO: 293671 - DNA, 25 bp, Mus musculus
gcttctcaaagttgcgttgccgctc

SEQ ID NO: 293672 - DNA, 25 bp, Mus musculus
ttgctccagcagcaggttcccacgt

SEQ ID NO: 293673 - DNA, 25 bp, Mus musculus
aggttcccacgtgttgactgcagcc

SEQ ID NO: 293674 - DNA, 25 bp, Mus musculus
tgactgcagccggaactgcttctcg

SEQ ID NO: 293675 - DNA, 25 bp, Mus musculus
tgcttctcgcgctcctggatggccg

SEQ ID NO: 293676 - DNA, 25 bp, Mus musculus
gttcacggtccactgctcgctgggc

SEQ ID NO: 293677 - DNA, 25 bp, Mus musculus
gctcctcacgctgcttctcaaagtt

SEQ ID NO: 293678 - DNA, 25 bp, Mus musculus
tggcagcccagaccggagcgatcac

SEQ ID NO: 293679 - DNA, 25 bp, Mus musculus
cagggcggatccgagccacaacttt

SEQ ID NO: 293680 - DNA, 25 bp, Mus musculus
cggatccgagccacaactttaactt

SEQ ID NO: 293681 - DNA, 25 bp, Mus musculus
agccacaactttaacttcccaggtg

SEQ ID NO: 293682 - DNA, 25 bp, Mus musculus
ttcccaggtggtttccgtgccgaca

SEQ ID NO: 293683 - DNA, 25 bp, Mus musculus
ggtttccgtgccgacatccagcgat

SEQ ID NO: 293684 - DNA, 25 bp, Mus musculus
tccgtgccgacatccagcgatgttc

SEQ ID NO: 293685 - DNA, 25 bp, Mus musculus
tccagcgatgttcgggctgcaatga

SEQ ID NO: 293686 - DNA, 25 bp, Mus musculus
cgggctgcaatgaaagcggcccatc

SEQ ID NO: 293687 - DNA, 25 bp, Mus musculus
tgaaagcggcccatcacaaggcaat

SEQ ID NO: 293688 - DNA, 25 bp, Mus musculus
caaggcaatccaagtggcagagagg

SEQ ID NO: 293689 - DNA, 25 bp, Mus musculus
atcacaggggacgacagctctgcac

SEQ ID NO: 293690 - DNA, 25 bp, Mus musculus
accggagcgatcacaggggacgaca

SEQ ID NO: 293691 - DNA, 25 bp, Mus musculus
ggcccatcacaaggcaatccaagtg

SEQ ID NO: 293692 - DNA, 25 bp, Mus musculus
ctttggaccagtacgatttctctcg

SEQ ID NO: 293693 - DNA, 25 bp, Mus musculus
ccgcacctggttcagcggcgcctca

SEQ ID NO: 293694 - DNA, 25 bp, Mus musculus
ggcgcctcagcagctttattagtaa

SEQ ID NO: 293695 - DNA, 25 bp, Mus musculus
tttattagtaacagcagcagccgcg

SEQ ID NO: 293696 - DNA, 25 bp, Mus musculus
cagccgcggcggcaacccgattcgg

SEQ ID NO: 293697 - DNA, 25 bp, Mus musculus
cagtacgatttctctcgagccaagg

SEQ ID NO: 293698 - DNA, 25 bp, Mus musculus
gcgcacgcagcccagcccatcagag

SEQ ID NO: 293699 - DNA, 25 bp, Mus musculus
gtcgccagcgcgctcgaccgcacct

SEQ ID NO: 293700 - DNA, 25 bp, Mus musculus
ccagcccatcagagcgcgcggaccc

SEQ ID NO: 293701 - DNA, 25 bp, Mus musculus
gtccgggccactgcggaggactttc

SEQ ID NO: 293702 - DNA, 25 bp, Mus musculus
cactgcggaggactttcctggtccc

SEQ ID NO: 293703 - DNA, 25 bp, Mus musculus
gatttctctcgagccaaggcggcgg

SEQ ID NO: 293704 - DNA, 25 bp, Mus musculus
caagtctttggaccagtacgatttc

SEQ ID NO: 293705 - DNA, 25 bp, Mus musculus
cctggtccccgagatcaagtctttg

SEQ ID NO: 293706 - DNA, 25 bp, Mus musculus
cctctcctagagctcactggtcttt

SEQ ID NO: 293707 - DNA, 25 bp, Mus musculus
ccagaagtcctcaagtttcatgcga

SEQ ID NO: 293708 - DNA, 25 bp, Mus musculus
tttccagaagtcctcaagtttcatg

SEQ ID NO: 293709 - DNA, 25 bp, Mus musculus
tggtctttccagaagtcctcaagtt

SEQ ID NO: 293710 - DNA, 25 bp, Mus musculus
tcactggtctttccagaagtcctca

SEQ ID NO: 293711 - DNA, 25 bp, Mus musculus
agctcactggtctttccagaagtcc

SEQ ID NO: 293712 - DNA, 25 bp, Mus musculus
ctcctagagctcactggtctttcca

SEQ ID NO: 293713 - DNA, 25 bp, Mus musculus
cctatttctccacttccgggatctg

SEQ ID NO: 293714 - DNA, 25 bp, Mus musculus
agcctatttctccacttccgggatc

SEQ ID NO: 293715 - DNA, 25 bp, Mus musculus
tcagcctatttctccacttccggga

SEQ ID NO: 293716 - DNA, 25 bp, Mus musculus
gaagtcctcaagtttcatgcgacca

SEQ ID NO: 293717 - DNA, 25 bp, Mus musculus
gtcctcaagtttcatgcgaccagca

SEQ ID NO: 293718 - DNA, 25 bp, Mus musculus
cctcaagtttcatgcgaccagcagt

SEQ ID NO: 293719 - DNA, 25 bp, Mus musculus
tagagctcactggtctttccagaag

SEQ ID NO: 293720 - DNA, 25 bp, Mus musculus
caaggcggaggaaccttcctgcacc

SEQ ID NO: 293721 - DNA, 25 bp, Mus musculus
tgggcgagcccgaacgcaacgccaa

SEQ ID NO: 293722 - DNA, 25 bp, Mus musculus
cgcgtctgggcgagcccgaacgcaa

SEQ ID NO: 293723 - DNA, 25 bp, Mus musculus
catgagcagctgtctcgaggggctc

SEQ ID NO: 293724 - DNA, 25 bp, Mus musculus
caagttcccgccatgagcagctgtc

SEQ ID NO: 293725 - DNA, 25 bp, Mus musculus
gctgcaatccaagttcccgccatga

SEQ ID NO: 293726 - DNA, 25 bp, Mus musculus
cccaaggagccgctgcaatccaagt

SEQ ID NO: 293727 - DNA, 25 bp, Mus musculus
gaaaagacttccaatgagtatgctg

SEQ ID NO: 293728 - DNA, 25 bp, Mus musculus
ctccgcagcgagagcggtgcgcaca

SEQ ID NO: 293729 - DNA, 25 bp, Mus musculus
cgatctagacgcaaggcggaggaac

SEQ ID NO: 293730 - DNA, 25 bp, Mus musculus
atgctggggacacgtgacgcccgcc

SEQ ID NO: 293731 - DNA, 25 bp, Mus musculus
caatgagtatgctggggacacgtga

SEQ ID NO: 293732 - DNA, 25 bp, Mus musculus
cgcggcgacagaagaggaaaagact

SEQ ID NO: 293733 - DNA, 25 bp, Mus musculus
ctgaggctgcgcctgtagagcagca

SEQ ID NO: 293734 - DNA, 25 bp, Mus musculus
ggttttgcaggttctccttcggatc

SEQ ID NO: 293735 - DNA, 25 bp, Mus musculus
tgatcctcgagccactacggggacc

SEQ ID NO: 293736 - DNA, 25 bp, Mus musculus
ggttctccttcggatctagtcaccc

SEQ ID NO: 293737 - DNA, 25 bp, Mus musculus
accgatgcatagaaacgggttttgc

SEQ ID NO: 293738 - DNA, 25 bp, Mus musculus
gaccaccgatgcatagaaacgggtt

SEQ ID NO: 293739 - DNA, 25 bp, Mus musculus
gtcgccctcccgcaggaccaccgat

SEQ ID NO: 293740 - DNA, 25 bp, Mus musculus
gcgtggccaacctgtaggtcgccct

SEQ ID NO: 293741 - DNA, 25 bp, Mus musculus
ggtcagcgtggccaacctgtaggtc

SEQ ID NO: 293742 - DNA, 25 bp, Mus musculus
cagaaagtcgagctcccgcaagcgg

SEQ ID NO: 293743 - DNA, 25 bp, Mus musculus
agactcagaaagtcgagctcccgca

SEQ ID NO: 293744 - DNA, 25 bp, Mus musculus
gtcagagaccggaaaagactcagaa

SEQ ID NO: 293745 - DNA, 25 bp, Mus musculus
actcagaaagtcagagaccggaaaa

SEQ ID NO: 293746 - DNA, 25 bp, Mus musculus
ggcacctacgcctcactcagaaagt

SEQ ID NO: 293747 - DNA, 25 bp, Mus musculus
ccggtgatcctcgagccactacggg

SEQ ID NO: 293748 - DNA, 25 bp, Mus musculus
ccgcctcgagagatttactgtggga

SEQ ID NO: 293749 - DNA, 25 bp, Mus musculus
ttactgtgggaacttctggctcggc

SEQ ID NO: 293750 - DNA, 25 bp, Mus musculus
tccaagcccttgaaggagcctccgg

SEQ ID NO: 293751 - DNA, 25 bp, Mus musculus
acaccacccgtaggtggacccagag

SEQ ID NO: 293752 - DNA, 25 bp, Mus musculus
ggctccctagagtcccggaggcatc

SEQ ID NO: 293753 - DNA, 25 bp, Mus musculus
tcccggaggcatccgataggacttg

SEQ ID NO: 293754 - DNA, 25 bp, Mus musculus
ccgataggacttgactgcgagtcta

SEQ ID NO: 293755 - DNA, 25 bp, Mus musculus
agtctaagatctgcgcaacctattg

SEQ ID NO: 293756 - DNA, 25 bp, Mus musculus
acctattgcgcttcttgctgcgggc

SEQ ID NO: 293757 - DNA, 25 bp, Mus musculus
tgctgcgggcttcgattaacttctg

SEQ ID NO: 293758 - DNA, 25 bp, Mus musculus
ttcgattaacttctgggaacggagc

SEQ ID NO: 293759 - DNA, 25 bp, Mus musculus
cttctgggaacggagcttgaaggca

SEQ ID NO: 293760 - DNA, 25 bp, Mus musculus
gcaccaacccgcctcgagagattta

SEQ ID NO: 293761 - DNA, 25 bp, Mus musculus
gcctgcggtgctccctgcttgagct

SEQ ID NO: 293762 - DNA, 25 bp, Mus musculus
cggaagtgacgtatccggagcgttc

SEQ ID NO: 293763 - DNA, 25 bp, Mus musculus
ggtcccacaaagaggcccagcgaaa

SEQ ID NO: 293764 - DNA, 25 bp, Mus musculus
tcacgtgacgcctgcgtgttcgctg

SEQ ID NO: 293765 - DNA, 25 bp, Mus musculus
ttcgctggcagtggccagtaacccg

SEQ ID NO: 293766 - DNA, 25 bp, Mus musculus
agtaacccgccactcccaagatgga

SEQ ID NO: 293767 - DNA, 25 bp, Mus musculus
tcccaagatggaggcacgttacgcc

SEQ ID NO: 293768 - DNA, 25 bp, Mus musculus
cgttacgccgccattaagcgctaca

SEQ ID NO: 293769 - DNA, 25 bp, Mus musculus
agcgctacacttccgatctgttcta

SEQ ID NO: 293770 - DNA, 25 bp, Mus musculus
ttctaaggttaggtcttcatgttcc

SEQ ID NO: 293771 - DNA, 25 bp, Mus musculus
tcatgttcctactcaagatggccgc

SEQ ID NO: 293772 - DNA, 25 bp, Mus musculus
tcctaacatggcgtcccggagttgc

SEQ ID NO: 293773 - DNA, 25 bp, Mus musculus
gcgttacactccactgctcttattg

SEQ ID NO: 293774 - DNA, 25 bp, Mus musculus
ctcttattggctgactcggttcgga

SEQ ID NO: 293775 - DNA, 25 bp, Mus musculus
ccgttcgccaagagggatgagcaaa

SEQ ID NO: 293776 - DNA, 25 bp, Mus musculus
gacgtcagcgcgtcttgtaggacga

SEQ ID NO: 293777 - DNA, 25 bp, Mus musculus
cagcacactgtcagggaagaacatc

SEQ ID NO: 293778 - DNA, 25 bp, Mus musculus
aagaacatcagtggctctgcgcccg

SEQ ID NO: 293779 - DNA, 25 bp, Mus musculus
ctccaaaacaaaccctgcgacagtg

SEQ ID NO: 293780 - DNA, 25 bp, Mus musculus
ccctgcgacagtgacagcaagcaca

SEQ ID NO: 293781 - DNA, 25 bp, Mus musculus
agtttcgcaccagacaacgggccgg

SEQ ID NO: 293782 - DNA, 25 bp, Mus musculus
ggtcccgcttgcagtactcgaagtc

SEQ ID NO: 293783 - DNA, 25 bp, Mus musculus
gcccggatggacactcatgccgaga

SEQ ID NO: 293784 - DNA, 25 bp, Mus musculus
ggctctagccaagcggcctgggcac

SEQ ID NO: 293785 - DNA, 25 bp, Mus musculus
gactaccggccctgtgcgacgtcag

SEQ ID NO: 293786 - DNA, 25 bp, Mus musculus
agtctgcagtcactggagcgagttg

SEQ ID NO: 293787 - DNA, 25 bp, Mus musculus
tccctccgccgagaaaaggagtgcg

SEQ ID NO: 293788 - DNA, 25 bp, Mus musculus
agtggcttctctgagcagcaagtcc

SEQ ID NO: 293789 - DNA, 25 bp, Mus musculus
cgtcactgggcgtacccggagctac

SEQ ID NO: 293790 - DNA, 25 bp, Mus musculus
ccatggcagcctcgtcgtagttggt

SEQ ID NO: 293791 - DNA, 25 bp, Mus musculus
ccttgcacttgttggtggtgaaatc

SEQ ID NO: 293792 - DNA, 25 bp, Mus musculus
gtggtgaaatctcggatgaccttga

SEQ ID NO: 293793 - DNA, 25 bp, Mus musculus
atgaccttgacattggtgaccgccc

SEQ ID NO: 293794 - DNA, 25 bp, Mus musculus
ccaaagggtccgaaaagctgccaca

SEQ ID NO: 293795 - DNA, 25 bp, Mus musculus
gcacgctctcatcagcttctgggga

SEQ ID NO: 293796 - DNA, 25 bp, Mus musculus
tcagcttctggggacaggttgtaca

SEQ ID NO: 293797 - DNA, 25 bp, Mus musculus
gacaggttgtacacgaagatgcacc

SEQ ID NO: 293798 - DNA, 25 bp, Mus musculus
gaagatgcaccagccagcgcctgca

SEQ ID NO: 293799 - DNA, 25 bp, Mus musculus
tgccaggccactcatgccatcgatg

SEQ ID NO: 293800 - DNA, 25 bp, Mus musculus
ccatcgatggcgattggggagaacc

SEQ ID NO: 293801 - DNA, 25 bp, Mus musculus
gcgatgagcgacaggggactacttt

SEQ ID NO: 293802 - DNA, 25 bp, Mus musculus
cgtagttggtcatggtgacgaagcc

SEQ ID NO: 293803 - DNA, 25 bp, Mus musculus
gaagccgaaacccttgcacttgttg

SEQ ID NO: 293804 - DNA, 25 bp, Mus musculus
tcgaaggccgggaactgacccgagc

SEQ ID NO: 293805 - DNA, 25 bp, Mus musculus
gaaacaaagggatcacggcggccgc

SEQ ID NO: 293806 - DNA, 25 bp, Mus musculus
ttcgaggacgaagatgcccgccttt

SEQ ID NO: 293807 - DNA, 25 bp, Mus musculus
ccgagtggcattacccggaccaaca

SEQ ID NO: 293808 - DNA, 25 bp, Mus musculus
ccaacagtgggagatcgtggccctt

SEQ ID NO: 293809 - DNA, 25 bp, Mus musculus
atgctggaagcatcttccgccgccg

SEQ ID NO: 293810 - DNA, 25 bp, Mus musculus
ttccagtgaggagccacaaggacca

SEQ ID NO: 293811 - DNA, 25 bp, Mus musculus
ggcaccctgtacacagcctggcttt

SEQ ID NO: 293812 - DNA, 25 bp, Mus musculus
gctttccaaagcctctcgaaccagg

SEQ ID NO: 293813 - DNA, 25 bp, Mus musculus
aaaactccggatgcagctctggcca

SEQ ID NO: 293814 - DNA, 25 bp, Mus musculus
tcccgtgttcgtctcgcggcgacaa

SEQ ID NO: 293815 - DNA, 25 bp, Mus musculus
cggcgacaagggagtacctacagtg

SEQ ID NO: 293816 - DNA, 25 bp, Mus musculus
aggccctatggagtactgctgcagc

SEQ ID NO: 293817 - DNA, 25 bp, Mus musculus
agtgaccattcttgtgtgcccggcg

SEQ ID NO: 293818 - DNA, 25 bp, Mus musculus
cccaaaggcagttcaccgcgggctg

SEQ ID NO: 293819 - DNA, 25 bp, Mus musculus
acgtgaagttgtactgcacctcggc

SEQ ID NO: 293820 - DNA, 25 bp, Mus musculus
gcatatctcgcacctgcgtagcagg

SEQ ID NO: 293821 - DNA, 25 bp, Mus musculus
tgccgacactggtacccgcatatct

SEQ ID NO: 293822 - DNA, 25 bp, Mus musculus
tgccaattgagcgaagcacgctgcc

SEQ ID NO: 293823 - DNA, 25 bp, Mus musculus
gtgtgcttcttcatgtgccaattga

SEQ ID NO: 293824 - DNA, 25 bp, Mus musculus
cacctcggctgtgtgcttcttcatg

SEQ ID NO: 293825 - DNA, 25 bp, Mus musculus
tcccgcagcgatcgcacgtgaagtt

SEQ ID NO: 293826 - DNA, 25 bp, Mus musculus
tcacaggtgaactcgcggacgcctg

SEQ ID NO: 293827 - DNA, 25 bp, Mus musculus
ttgccgcaggtctcacaggtgaact

SEQ ID NO: 293828 - DNA, 25 bp, Mus musculus
ttcctcttgaaagacttgccgcagg

SEQ ID NO: 293829 - DNA, 25 bp, Mus musculus
cctccagatggttcttcctcttgaa

SEQ ID NO: 293830 - DNA, 25 bp, Mus musculus
ctggacactcactgcaggggcgtct

SEQ ID NO: 293831 - DNA, 25 bp, Mus musculus
tgcgccggtgcacctccagatggtt

SEQ ID NO: 293832 - DNA, 25 bp, Mus musculus
acttctggatactttggcggtgccc

SEQ ID NO: 293833 - DNA, 25 bp, Mus musculus
tgcgccgccgggagatttctcacag

SEQ ID NO: 293834 - DNA, 25 bp, Mus musculus
aagtggcgcgcctagtctgcgccgc

SEQ ID NO: 293835 - DNA, 25 bp, Mus musculus
ttgttaggagcctcgaccggaagtg

SEQ ID NO: 293836 - DNA, 25 bp, Mus musculus
gtctcaggtccacccaggggccgtg

SEQ ID NO: 293837 - DNA, 25 bp, Mus musculus
ctccagcgaaatgaggtaggcggca

SEQ ID NO: 293838 - DNA, 25 bp, Mus musculus
ccctgtaccacttctggatactttg

SEQ ID NO: 293839 - DNA, 25 bp, Mus musculus
acggcgtacttcttccaggactctg

SEQ ID NO: 293840 - DNA, 25 bp, Mus musculus
agggcaggcgcctcgatccagctcg

SEQ ID NO: 293841 - DNA, 25 bp, Mus musculus
tttgtggtttctccacccgctgcgg

SEQ ID NO: 293842 - DNA, 25 bp, Mus musculus
ggtatgcagcacagtttgtggtttc

SEQ ID NO: 293843 - DNA, 25 bp, Mus musculus
gctccaccgaaatgaggtatgcagc

SEQ ID NO: 293844 - DNA, 25 bp, Mus musculus
ctgggttgcctaagcccgagaccga

SEQ ID NO: 293845 - DNA, 25 bp, Mus musculus
caagtttggcgtcgctccagccgct

SEQ ID NO: 293846 - DNA, 25 bp, Mus musculus
ctccgcggtgtggtaaattattatt

SEQ ID NO: 293847 - DNA, 25 bp, Mus musculus
ctggacgctgtcatgttgagccacg

SEQ ID NO: 293848 - DNA, 25 bp, Mus musculus
ggtgacagcaaatcagaagagcctg

SEQ ID NO: 293849 - DNA, 25 bp, Mus musculus
ttgagccacggagcttccggttacg

SEQ ID NO: 293850 - DNA, 25 bp, Mus musculus
gaatcccagacagtcccataaacct

SEQ ID NO: 293851 - DNA, 25 bp, Mus musculus
ccggttacgagtcgaaggtgacagc

SEQ ID NO: 293852 - DNA, 25 bp, Mus musculus
agagcctgtgacgataggtcccgcc

SEQ ID NO: 293853 - DNA, 25 bp, Mus musculus
aggtcccgccctcaggaagagatcc

SEQ ID NO: 293854 - DNA, 25 bp, Mus musculus
ctcaggaagagatccaccaatagga

SEQ ID NO: 293855 - DNA, 25 bp, Mus musculus
cctcactgagctccagaagcctgga

SEQ ID NO: 293856 - DNA, 25 bp, Mus musculus
ccggtccaactttctccgcggtgtg

SEQ ID NO: 293857 - DNA, 25 bp, Mus musculus
attattgttacggactggaagcacc

SEQ ID NO: 293858 - DNA, 25 bp, Mus musculus
ggactggaagcaccacatccggttc

SEQ ID NO: 293859 - DNA, 25 bp, Mus musculus
ctttggataccagtacggaggcgct

SEQ ID NO: 293860 - DNA, 25 bp, Mus musculus
cgcccactccttaaccaattaaatg

SEQ ID NO: 293861 - DNA, 25 bp, Mus musculus
cacagtcctgctcaatcacaagcaa

SEQ ID NO: 293862 - DNA, 25 bp, Mus musculus
atctagagaagagcgccggtccgcc

SEQ ID NO: 293863 - DNA, 25 bp, Mus musculus
tccgcgcaattgttacagcgcatgc

SEQ ID NO: 293864 - DNA, 25 bp, Mus musculus
tacgccctgcgggtgatctagagaa

SEQ ID NO: 293865 - DNA, 25 bp, Mus musculus
caactacctggctccgcgcaattgt

SEQ ID NO: 293866 - DNA, 25 bp, Mus musculus
aaccaattaaatgcgcgtgtagacc

SEQ ID NO: 293867 - DNA, 25 bp, Mus musculus
tcacccaggagacgctaacttccgg

SEQ ID NO: 293868 - DNA, 25 bp, Mus musculus
agccaaggccgcttcacccaggaga

SEQ ID NO: 293869 - DNA, 25 bp, Mus musculus
cccagctgcagggatccaggggtca

SEQ ID NO: 293870 - DNA, 25 bp, Mus musculus
aacgagccatggtgtcccgaggcga

SEQ ID NO: 293871 - DNA, 25 bp, Mus musculus
accgcagcctgcgaacgagccatgg

SEQ ID NO: 293872 - DNA, 25 bp, Mus musculus
aaatcctaggggtgttcgtgatcgc

SEQ ID NO: 293873 - DNA, 25 bp, Mus musculus
cacaagcaaaatcctaggggtgttc

SEQ ID NO: 293874 - DNA, 25 bp, Mus musculus
ctcggttttcttcggctcggctcgg

SEQ ID NO: 293875 - DNA, 25 bp, Mus musculus
acggtgagttgagggtctcgaaata

SEQ ID NO: 293876 - DNA, 25 bp, Mus musculus
atggacgccgccgactccgtttgtc

SEQ ID NO: 293877 - DNA, 25 bp, Mus musculus
tgtctggctggttcgttttcggttc

SEQ ID NO: 293878 - DNA, 25 bp, Mus musculus
gtccctccgtcggtcagagactgca

SEQ ID NO: 293879 - DNA, 25 bp, Mus musculus
cccgaggcgactgcgcccaagggat

SEQ ID NO: 293880 - DNA, 25 bp, Mus musculus
cgctgtcttcggtctgtgcattgac

SEQ ID NO: 293881 - DNA, 25 bp, Mus musculus
ctcgaaatacgagcggaggagctgt

SEQ ID NO: 293882 - DNA, 25 bp, Mus musculus
gactgtcaccgccaggcgccgaagg

SEQ ID NO: 293883 - DNA, 25 bp, Mus musculus
gcgccgaagggaccggactcctaca

SEQ ID NO: 293884 - DNA, 25 bp, Mus musculus
gccagcttggcgtctgcgccatgga

SEQ ID NO: 293885 - DNA, 25 bp, Mus musculus
gagcgaaggcaaggtgaactgtcca

SEQ ID NO: 293886 - DNA, 25 bp, Mus musculus
ctacaggcctgcaaacggtgagttg

SEQ ID NO: 293887 - DNA, 25 bp, Mus musculus
tgaactgtccaatgagcacgcgcgg

SEQ ID NO: 293888 - DNA, 25 bp, Mus musculus
ctgccacgcaaagccaccaaagaga

SEQ ID NO: 293889 - DNA, 25 bp, Mus musculus
aactgtccaaggagacgcgccgcta

SEQ ID NO: 293890 - DNA, 25 bp, Mus musculus
acgctgcgtcactcgggagtctgcg

SEQ ID NO: 293891 - DNA, 25 bp, Mus musculus
ggcattcttaggacctccgggagga

SEQ ID NO: 293892 - DNA, 25 bp, Mus musculus
ggagggaggcattcttaggacctcc

SEQ ID NO: 293893 - DNA, 25 bp, Mus musculus
tcctgctgtgccctgcggggaaccg

SEQ ID NO: 293894 - DNA, 25 bp, Mus musculus
ctcggctcgcttcggtttggctccg

SEQ ID NO: 293895 - DNA, 25 bp, Mus musculus
ggtctgtctcggtagttgtcactca

SEQ ID NO: 293896 - DNA, 25 bp, Mus musculus
ctctcactcgcgaggctcgggtggt

SEQ ID NO: 293897 - DNA, 25 bp, Mus musculus
gggcgggactgcagtaactgtccaa

SEQ ID NO: 293898 - DNA, 25 bp, Mus musculus
gcaaagccaccaaagagactgagtc

SEQ ID NO: 293899 - DNA, 25 bp, Mus musculus
agtgactgctgcgtgacgctgcgtc

SEQ ID NO: 293900 - DNA, 25 bp, Mus musculus
agagactgagtctctcactcgcgag

SEQ ID NO: 293901 - DNA, 25 bp, Mus musculus
tgtctcggtagttgtcactcaggct

SEQ ID NO: 293902 - DNA, 25 bp, Mus musculus
acggtctgaggcacgttggccgtct

SEQ ID NO: 293903 - DNA, 25 bp, Mus musculus
cctgggccgcgagaacagaaaagct

SEQ ID NO: 293904 - DNA, 25 bp, Mus musculus
accagaaactcaatggaccagttca

SEQ ID NO: 293905 - DNA, 25 bp, Mus musculus
tcaccggcacgcgaaaacaagaggg

SEQ ID NO: 293906 - DNA, 25 bp, Mus musculus
aaacaagagggcagttaacacagct

SEQ ID NO: 293907 - DNA, 25 bp, Mus musculus
acagctccaccggagactgcagtgg

SEQ ID NO: 293908 - DNA, 25 bp, Mus musculus
cggcattgaagagcgcctccaagtc

SEQ ID NO: 293909 - DNA, 25 bp, Mus musculus
gcagcttgcgaagccgcatgggcac

SEQ ID NO: 293910 - DNA, 25 bp, Mus musculus
cgtcttggggttcatgacggcattg

SEQ ID NO: 293911 - DNA, 25 bp, Mus musculus
gggatacccttacctgtcgcgagtg

SEQ ID NO: 293912 - DNA, 25 bp, Mus musculus
ggcggcgtcccaactgagacagaaa

SEQ ID NO: 293913 - DNA, 25 bp, Mus musculus
cagaaactttggctccagacgccca

SEQ ID NO: 293914 - DNA, 25 bp, Mus musculus
catggctgcggcctcgttcgacgct

SEQ ID NO: 293915 - DNA, 25 bp, Mus musculus
ctaaaaagttgcgaggagcgcccgc

SEQ ID NO: 293916 - DNA, 25 bp, Mus musculus
cgaagcagcccagcccgacgcgacc

SEQ ID NO: 293917 - DNA, 25 bp, Mus musculus
cgacgcgaccagagcgggcctctcc

SEQ ID NO: 293918 - DNA, 25 bp, Mus musculus
ggaagtggcatctgtaacccgaagc

SEQ ID NO: 293919 - DNA, 25 bp, Mus musculus
tttcaggcaggttctctggggtgtc

SEQ ID NO: 293920 - DNA, 25 bp, Mus musculus
gactctatttcaggcaggttctctg

SEQ ID NO: 293921 - DNA, 25 bp, Mus musculus
cgcgctctcctgactctatttcagg

SEQ ID NO: 293922 - DNA, 25 bp, Mus musculus
tggcatctgtaacccgaagcagccc

SEQ ID NO: 293923 - DNA, 25 bp, Mus musculus
cccgcgctagctgtccaatcaggga

SEQ ID NO: 293924 - DNA, 25 bp, Mus musculus
tagctgtccaatcagggacgccgga

SEQ ID NO: 293925 - DNA, 25 bp, Mus musculus
tccaatcagggacgccggagtgtat

SEQ ID NO: 293926 - DNA, 25 bp, Mus musculus
ccggagtgtatgtttgggagcgcca

SEQ ID NO: 293927 - DNA, 25 bp, Mus musculus
cagagcgccaggagaacgcgctctc

SEQ ID NO: 293928 - DNA, 25 bp, Mus musculus
agaacgcgctctcctgactctattt

SEQ ID NO: 293929 - DNA, 25 bp, Mus musculus
ggcgtgcccgcgctagctgtccaat

SEQ ID NO: 293930 - DNA, 25 bp, Mus musculus
acaagccacccgcttagagttccgg

SEQ ID NO: 293931 - DNA, 25 bp, Mus musculus
cgccctgacaaaacccttgcaggtt

SEQ ID NO: 293932 - DNA, 25 bp, Mus musculus
caaaacccttgcaggtttgctgccc

SEQ ID NO: 293933 - DNA, 25 bp, Mus musculus
ctttccgccggaagaaggacatggc

SEQ ID NO: 293934 - DNA, 25 bp, Mus musculus
gagccgctgcactagtccgaaaaca

SEQ ID NO: 293935 - DNA, 25 bp, Mus musculus
agctgctgccgccatgttatcaaca

SEQ ID NO: 293936 - DNA, 25 bp, Mus musculus
tgacagcgtctctttgctgaacctc

SEQ ID NO: 293937 - DNA, 25 bp, Mus musculus
cctcgcttgaggaggccaccttctt

SEQ ID NO: 293938 - DNA, 25 bp, Mus musculus
cttagagttccggtccgtccgcgcg

SEQ ID NO: 293939 - DNA, 25 bp, Mus musculus
tgacctggcgtcctcgagtccgcga

SEQ ID NO: 293940 - DNA, 25 bp, Mus musculus
ccctggaggcttcggatgacagcgt

SEQ ID NO: 293941 - DNA, 25 bp, Mus musculus
ggcttcggatgacagcgtctctttg

SEQ ID NO: 293942 - DNA, 25 bp, Mus musculus
agcactgctgcgcagccttttcgcg

SEQ ID NO: 293943 - DNA, 25 bp, Mus musculus
tgccgccatgttatcaacaagccac

SEQ ID NO: 293944 - DNA, 25 bp, Mus musculus
gacaggaatgcctgaccgctgggtc

SEQ ID NO: 293945 - DNA, 25 bp, Mus musculus
aggaatgcctgaccgctgggtcgct

SEQ ID NO: 293946 - DNA, 25 bp, Mus musculus
aggcaagagacaggaatgcctgacc

SEQ ID NO: 293947 - DNA, 25 bp, Mus musculus
gccctgcacagctctgccacccaca

SEQ ID NO: 293948 - DNA, 25 bp, Mus musculus
gagctggctgcaacgccctgcacag

SEQ ID NO: 293949 - DNA, 25 bp, Mus musculus
gactcgagctggctgcaacgccctg

SEQ ID NO: 293950 - DNA, 25 bp, Mus musculus
ccgaccatgcgtggggactcgagct

SEQ ID NO: 293951 - DNA, 25 bp, Mus musculus
agtcccatcatggtgagctcggcgc

SEQ ID NO: 293952 - DNA, 25 bp, Mus musculus
tcccagtcccatcatggtgagctcg

SEQ ID NO: 293953 - DNA, 25 bp, Mus musculus
gacgctcccagtcccatcatggtga

SEQ ID NO: 293954 - DNA, 25 bp, Mus musculus
gaccgagtcacaggacgctcccagt

SEQ ID NO: 293955 - DNA, 25 bp, Mus musculus
gcggagaccgagtcacaggacgctc

SEQ ID NO: 293956 - DNA, 25 bp, Mus musculus
gtccgttgcgggaagttgtgctggt

SEQ ID NO: 293957 - DNA, 25 bp, Mus musculus
cccatcatggtgagctcggcgcggc

SEQ ID NO: 293958 - DNA, 25 bp, Mus musculus
ggacaggattcctggagcccgctca

SEQ ID NO: 293959 - DNA, 25 bp, Mus musculus
aggcccgcaagtcccaggctccggg

SEQ ID NO: 293960 - DNA, 25 bp, Mus musculus
cgatcgactgggtccaggttaccgt

SEQ ID NO: 293961 - DNA, 25 bp, Mus musculus
gacaaaggggctcggcttctggacc

SEQ ID NO: 293962 - DNA, 25 bp, Mus musculus
gccacagactcaccatctcaggatt

SEQ ID NO: 293963 - DNA, 25 bp, Mus musculus
gactcaccatctcaggattccggga

SEQ ID NO: 293964 - DNA, 25 bp, Mus musculus
gacacccagagctctcactgtggtt

SEQ ID NO: 293965 - DNA, 25 bp, Mus musculus
cactgtggttctcagtggggaaatg

SEQ ID NO: 293966 - DNA, 25 bp, Mus musculus
ttctcagtggggaaatgtgacacgc

SEQ ID NO: 293967 - DNA, 25 bp, Mus musculus
ggcaggcagaacctctccggacttc

SEQ ID NO: 293968 - DNA, 25 bp, Mus musculus
aacctctccggacttctgggcgagc

SEQ ID NO: 293969 - DNA, 25 bp, Mus musculus
caggattccgggacacccagagctc

SEQ ID NO: 293970 - DNA, 25 bp, Mus musculus
cgggacacccagagctctcactgtg

SEQ ID NO: 293971 - DNA, 25 bp, Mus musculus
taccgtttcccgtgcaggcccgcaa

SEQ ID NO: 293972 - DNA, 25 bp, Mus musculus
cgaacctgggacaccggctccagat

SEQ ID NO: 293973 - DNA, 25 bp, Mus musculus
acttcggtccaaggaccgtgacctg

SEQ ID NO: 293974 - DNA, 25 bp, Mus musculus
ggctccagatcccaagatggtggta

SEQ ID NO: 293975 - DNA, 25 bp, Mus musculus
atgcgcccgattgcgcgtttctcac

SEQ ID NO: 293976 - DNA, 25 bp, Mus musculus
agacccgtgccggtaccgacagagt

SEQ ID NO: 293977 - DNA, 25 bp, Mus musculus
tcccagccagggagagcacagcggc

SEQ ID NO: 293978 - DNA, 25 bp, Mus musculus
aggaccgtgacctgcgctccagtat

SEQ ID NO: 293979 - DNA, 25 bp, Mus musculus
gacaccggctccagatcccaagatg

SEQ ID NO: 293980 - DNA, 25 bp, Mus musculus
cccaagatggtggtatgctgtcacg

SEQ ID NO: 293981 - DNA, 25 bp, Mus musculus
tggtggtatgctgtcacgtcagaga

SEQ ID NO: 293982 - DNA, 25 bp, Mus musculus
tcacgtcagagacaaaggccggacc

SEQ ID NO: 293983 - DNA, 25 bp, Mus musculus
gtcagagacaaaggccggaccgcca

SEQ ID NO: 293984 - DNA, 25 bp, Mus musculus
ttccctttgtctatgcgcccgattg

SEQ ID NO: 293985 - DNA, 25 bp, Mus musculus
tgcgctccagtatcccagccaggga

SEQ ID NO: 293986 - DNA, 25 bp, Mus musculus
tccgcacccacggagtcggtaggct

SEQ ID NO: 293987 - DNA, 25 bp, Mus musculus
tcatggttcacagcgcccgcagagt

SEQ ID NO: 293988 - DNA, 25 bp, Mus musculus
ccgcagagtctctcacctcggtaaa

SEQ ID NO: 293989 - DNA, 25 bp, Mus musculus
tcacctcggtaaacgggtccatcgc

SEQ ID NO: 293990 - DNA, 25 bp, Mus musculus
cggttcaaactcaggaagaggaaag

SEQ ID NO: 293991 - DNA, 25 bp, Mus musculus
tcggtaggctaccacggccgttcaa

SEQ ID NO: 293992 - DNA, 25 bp, Mus musculus
gctaccacggccgttcaaaatttga

SEQ ID NO: 293993 - DNA, 25 bp, Mus musculus
ccctgagctaggtcacgtgatgcgg

SEQ ID NO: 293994 - DNA, 25 bp, Mus musculus
ctaggtcacgtgatgcggccaagtt

SEQ ID NO: 293995 - DNA, 25 bp, Mus musculus
ctctctcctccgcttgggtggagac

SEQ ID NO: 293996 - DNA, 25 bp, Mus musculus
tctgccgttgaactgcctagggaga

SEQ ID NO: 293997 - DNA, 25 bp, Mus musculus
agcgggtcccttcctgactctgtca

SEQ ID NO: 293998 - DNA, 25 bp, Mus musculus
caggcctcaccagtggacggctaga

SEQ ID NO: 293999 - DNA, 25 bp, Mus musculus
tggagacggttctgccgttgaactg

SEQ ID NO: 294000 - DNA, 25 bp, Mus musculus
gcctccagcggcgagcatgtttggt

SEQ ID NO: 294001 - DNA, 25 bp, Mus musculus
tccagcctctgggtaagacgtggtc

SEQ ID NO: 294002 - DNA, 25 bp, Mus musculus
tggaaccgccagagcgctttccagc

SEQ ID NO: 294003 - DNA, 25 bp, Mus musculus
agctctgagactaggtggaaccgcc

SEQ ID NO: 294004 - DNA, 25 bp, Mus musculus
ctcgagctgccttacgggagttttc

SEQ ID NO: 294005 - DNA, 25 bp, Mus musculus
atgctggagtctattcgcgtaacgg

SEQ ID NO: 294006 - DNA, 25 bp, Mus musculus
agacgtggtcctccaccttgcgctg

SEQ ID NO: 294007 - DNA, 25 bp, Mus musculus
tgtcagtcgcaggagcgcctccagc

SEQ ID NO: 294008 - DNA, 25 bp, Mus musculus
tctccctacgagcagggtgtcagtc

SEQ ID NO: 294009 - DNA, 25 bp, Mus musculus
tgagtgtaggcactgctggcccaag

SEQ ID NO: 294010 - DNA, 25 bp, Mus musculus
gggaagaaggcaggatcgtctccta

SEQ ID NO: 294011 - DNA, 25 bp, Mus musculus
atcgtctcctagcaacggggttgca

SEQ ID NO: 294012 - DNA, 25 bp, Mus musculus
agttgtagttcgcttcccttctctc

SEQ ID NO: 294013 - DNA, 25 bp, Mus musculus
tggcgggttcttagctctgagacta

SEQ ID NO: 294014 - DNA, 25 bp, Mus musculus
acctacatgcgactctacactacag

SEQ ID NO: 294015 - DNA, 25 bp, Mus musculus
ccgatgccgtccgtggtagtggaca

SEQ ID NO: 294016 - DNA, 25 bp, Mus musculus
tacactacagtcgtcgcaggtcatc

SEQ ID NO: 294017 - DNA, 25 bp, Mus musculus
tggacagaggctggcgtccttcgac

SEQ ID NO: 294018 - DNA, 25 bp, Mus musculus
gcttccggacgcgtcaactgccatt

SEQ ID NO: 294019 - DNA, 25 bp, Mus musculus
gtcgtcgcaggtcatcgggctccac

SEQ ID NO: 294020 - DNA, 25 bp, Mus musculus
ttccgccgccctcgagcagagggag

SEQ ID NO: 294021 - DNA, 25 bp, Mus musculus
cagccgactcacaaggactccaggt

SEQ ID NO: 294022 - DNA, 25 bp, Mus musculus
aggactccaggtgcttgagctgctg

SEQ ID NO: 294023 - DNA, 25 bp, Mus musculus
atcgcgacccgaggcgggcttagaa

SEQ ID NO: 294024 - DNA, 25 bp, Mus musculus
gaaggtggaaagtcgcctcttcctc

SEQ ID NO: 294025 - DNA, 25 bp, Mus musculus
cgacagggaacgtgcagccaggccc

SEQ ID NO: 294026 - DNA, 25 bp, Mus musculus
cgtgccgcagaacgccgacagggaa

SEQ ID NO: 294027 - DNA, 25 bp, Mus musculus
aactgccattgccacggtcgccgtg

SEQ ID NO: 294028 - DNA, 25 bp, Mus musculus
agctcgcgctcagccgctcggacta

SEQ ID NO: 294029 - DNA, 25 bp, Mus musculus
ctctactccatacgggcgacacggg

SEQ ID NO: 294030 - DNA, 25 bp, Mus musculus
tcccgcgtctgacttgcgcagtagc

SEQ ID NO: 294031 - DNA, 25 bp, Mus musculus
gtagccactctactccatacgggcg

SEQ ID NO: 294032 - DNA, 25 bp, Mus musculus
cttaggtggttctgaggcgcccagc

SEQ ID NO: 294033 - DNA, 25 bp, Mus musculus
ataccctgagggacaggcctgctta

SEQ ID NO: 294034 - DNA, 25 bp, Mus musculus
atacgggcgacacgggaaatcatcc

SEQ ID NO: 294035 - DNA, 25 bp, Mus musculus
gccgccgataccctgagggacaggc

SEQ ID NO: 294036 - DNA, 25 bp, Mus musculus
tctgacttgcgcagtagcctccgtt

SEQ ID NO: 294037 - DNA, 25 bp, Mus musculus
gcgcagtagcctccgttgtaaaatg

SEQ ID NO: 294038 - DNA, 25 bp, Mus musculus
gcctccgttgtaaaatgctatgaca

SEQ ID NO: 294039 - DNA, 25 bp, Mus musculus
aatgctatgacaacagggcgaaggc

SEQ ID NO: 294040 - DNA, 25 bp, Mus musculus
gtggtctgtggcacgagaaccccca

SEQ ID NO: 294041 - DNA, 25 bp, Mus musculus
gctcggactacaacacccagcaagc

SEQ ID NO: 294042 - DNA, 25 bp, Mus musculus
ttgagggaccctcctgcattcgatc

SEQ ID NO: 294043 - DNA, 25 bp, Mus musculus
cacagcccttttgactgcgagcagc

SEQ ID NO: 294044 - DNA, 25 bp, Mus musculus
ttgtgcgtgcattagccgacccttt

SEQ ID NO: 294045 - DNA, 25 bp, Mus musculus
gcggattccgcgcagagcctagtac

SEQ ID NO: 294046 - DNA, 25 bp, Mus musculus
cccttagaaaaaagccgccgcattg

SEQ ID NO: 294047 - DNA, 25 bp, Mus musculus
ccaggatcgtagtccctcgtgcgac

SEQ ID NO: 294048 - DNA, 25 bp, Mus musculus
tgtcgcttctgagccggcatagctc

SEQ ID NO: 294049 - DNA, 25 bp, Mus musculus
gcattcgatccgtggctccttccga

SEQ ID NO: 294050 - DNA, 25 bp, Mus musculus
ggaacctgatctccaaggtcactcg

SEQ ID NO: 294051 - DNA, 25 bp, Mus musculus
acccgctgagagcaactcccttaga

SEQ ID NO: 294052 - DNA, 25 bp, Mus musculus
aacttctgtcctccctaatgtcagg

SEQ ID NO: 294053 - DNA, 25 bp, Mus musculus
tgagccaccgatccacgctttaagg

SEQ ID NO: 294054 - DNA, 25 bp, Mus musculus
atgtcaggcccacagaggcataagc

SEQ ID NO: 294055 - DNA, 25 bp, Mus musculus
ccgcctttgcccgagggagtcaaag

SEQ ID NO: 294056 - DNA, 25 bp, Mus musculus
atcttggcatagtcgcgcccgctag

SEQ ID NO: 294057 - DNA, 25 bp, Mus musculus
agccgcgtcccggtgcttgctccgc

SEQ ID NO: 294058 - DNA, 25 bp, Mus musculus
tgcaggaccatcttggcatagtcgc

SEQ ID NO: 294059 - DNA, 25 bp, Mus musculus
gatccgcggactggcggtcgctcac

SEQ ID NO: 294060 - DNA, 25 bp, Mus musculus
actggcggtcgctcactctggccgg

SEQ ID NO: 294061 - DNA, 25 bp, Mus musculus
gccgttgccgctctcgggttgccag

SEQ ID NO: 294062 - DNA, 25 bp, Mus musculus
cgctccagcggccaagcgcgcacgc

SEQ ID NO: 294063 - DNA, 25 bp, Mus musculus
gagtagcgtggacgacctcccggaa

SEQ ID NO: 294064 - DNA, 25 bp, Mus musculus
acgacctcccggaagcggcagtgcg

SEQ ID NO: 294065 - DNA, 25 bp, Mus musculus
aagcggcagtgcgccctcgggaacc

SEQ ID NO: 294066 - DNA, 25 bp, Mus musculus
gaacctagtggccacggaacggcgc

SEQ ID NO: 294067 - DNA, 25 bp, Mus musculus
cacggaacggcgccgtgggtacact

SEQ ID NO: 294068 - DNA, 25 bp, Mus musculus
ttgccagggcgacaacggaacgccg

SEQ ID NO: 294069 - DNA, 25 bp, Mus musculus
gcgcctgcaggaccatcttggcata

SEQ ID NO: 294070 - DNA, 25 bp, Mus musculus
cggctggtgatctcccgggcgctca

SEQ ID NO: 294071 - DNA, 25 bp, Mus musculus
gccctcaccactggcggaggcggct

SEQ ID NO: 294072 - DNA, 25 bp, Mus musculus
ccctcggccctcaccactggcggag

SEQ ID NO: 294073 - DNA, 25 bp, Mus musculus
ccaccgacctgagcccgccgcatgg

SEQ ID NO: 294074 - DNA, 25 bp, Mus musculus
cccagcccaccgacctgagcccgcc

SEQ ID NO: 294075 - DNA, 25 bp, Mus musculus
cccaggacacgagcgcggtgccacg

SEQ ID NO: 294076 - DNA, 25 bp, Mus musculus
cggagcacggacacgaacacgaaca

SEQ ID NO: 294077 - DNA, 25 bp, Mus musculus
tcccggagcacggacacgaacacga

SEQ ID NO: 294078 - DNA, 25 bp, Mus musculus
agcgcagagccgagtcccggagcac

SEQ ID NO: 294079 - DNA, 25 bp, Mus musculus
ctggccggagttgagggagcgcaga

SEQ ID NO: 294080 - DNA, 25 bp, Mus musculus
ggggaagagtcagcgggccctggcc

SEQ ID NO: 294081 - DNA, 25 bp, Mus musculus
cgtctggtcgaagctgaacgcctgc

SEQ ID NO: 294082 - DNA, 25 bp, Mus musculus
gcccagcatggacctagcagagggg

SEQ ID NO: 294083 - DNA, 25 bp, Mus musculus
tgaacgcctgcgcctggattctgcc

SEQ ID NO: 294084 - DNA, 25 bp, Mus musculus
gcgccagcgggatcgccaggacctt

SEQ ID NO: 294085 - DNA, 25 bp, Mus musculus
tccgtgagctaggaaagccgcggta

SEQ ID NO: 294086 - DNA, 25 bp, Mus musculus
acgggatgctcggtcctctgtttct

SEQ ID NO: 294087 - DNA, 25 bp, Mus musculus
tcctctgtttctcagctgccttttc

SEQ ID NO: 294088 - DNA, 25 bp, Mus musculus
gctgccttttctcaagtctggcgaa

SEQ ID NO: 294089 - DNA, 25 bp, Mus musculus
tcaagtctggcgaacaagacggggt

SEQ ID NO: 294090 - DNA, 25 bp, Mus musculus
gtgcccttctggaaagacgcgctgc

SEQ ID NO: 294091 - DNA, 25 bp, Mus musculus
ctgcggtcctggatacccaggcggc

SEQ ID NO: 294092 - DNA, 25 bp, Mus musculus
gagtgccgctgagtgtttgtccaca

SEQ ID NO: 294093 - DNA, 25 bp, Mus musculus
tgtttgtccacaaagccgctgcatc

SEQ ID NO: 294094 - DNA, 25 bp, Mus musculus
tgcatccctgtcctgcccaggtggt

SEQ ID NO: 294095 - DNA, 25 bp, Mus musculus
cccagagcatccgtgagctaggaaa

SEQ ID NO: 294096 - DNA, 25 bp, Mus musculus
caggctagcgtgagcgcaacagtgc

SEQ ID NO: 294097 - DNA, 25 bp, Mus musculus
ctgcccaggtggtcgcctagagctt

SEQ ID NO: 294098 - DNA, 25 bp, Mus musculus
cctaggaggaaatgctgcagcaacg

SEQ ID NO: 294099 - DNA, 25 bp, Mus musculus
tgcgagcacccgagggcagtttcct

SEQ ID NO: 294100 - DNA, 25 bp, Mus musculus
tgctgcagcaacgaccacttcgttc

SEQ ID NO: 294101 - DNA, 25 bp, Mus musculus
gaccacttcgttctctcctggggcg

SEQ ID NO: 294102 - DNA, 25 bp, Mus musculus
ctcctgctggggctccatggtcgct

SEQ ID NO: 294103 - DNA, 25 bp, Mus musculus
attgtggcctgtcggagctcccttc

SEQ ID NO: 294104 - DNA, 25 bp, Mus musculus
ttccctgagcttactccttgtcggc

SEQ ID NO: 294105 - DNA, 25 bp, Mus musculus
ttctcatagcccgtgatcaggtgga

SEQ ID NO: 294106 - DNA, 25 bp, Mus musculus
atcaggtggatggagctggatcacc

SEQ ID NO: 294107 - DNA, 25 bp, Mus musculus
tggatcaccgctgggcaatgtccgg

SEQ ID NO: 294108 - DNA, 25 bp, Mus musculus
agcctcgtcgtcatggcgaccgtga

SEQ ID NO: 294109 - DNA, 25 bp, Mus musculus
cgaccgtgaaacaaggatggcgagc

SEQ ID NO: 294110 - DNA, 25 bp, Mus musculus
cgagcgtgcagtctaggcaatcttg

SEQ ID NO: 294111 - DNA, 25 bp, Mus musculus
ggcaatcttgcgctgtccacgtgca

SEQ ID NO: 294112 - DNA, 25 bp, Mus musculus
gctgcctcgcgccttaatttgctgg

SEQ ID NO: 294113 - DNA, 25 bp, Mus musculus
ccggagaagacgcacagtgaacagg

SEQ ID NO: 294114 - DNA, 25 bp, Mus musculus
tgcctctgcgctcccggtggagagc

SEQ ID NO: 294115 - DNA, 25 bp, Mus musculus
agagagcgcctagggcactgcgccc

SEQ ID NO: 294116 - DNA, 25 bp, Mus musculus
tcactgcttccagactgtgcggagt

SEQ ID NO: 294117 - DNA, 25 bp, Mus musculus
gtggtctcacgtcactgcttccaga

SEQ ID NO: 294118 - DNA, 25 bp, Mus musculus
ccttaatttgctggcggtggccatc

SEQ ID NO: 294119 - DNA, 25 bp, Mus musculus
tccttgggtccgctgagtggcccaa

SEQ ID NO: 294120 - DNA, 25 bp, Mus musculus
taaactgtgcctaggcgcctgctgc

SEQ ID NO: 294121 - DNA, 25 bp, Mus musculus
cagcaaggcgcgacctaaactgtgc

SEQ ID NO: 294122 - DNA, 25 bp, Mus musculus
cctctctgcagagcgcagcaaggcg

SEQ ID NO: 294123 - DNA, 25 bp, Mus musculus
gagtcggatctcctctctgcagagc

SEQ ID NO: 294124 - DNA, 25 bp, Mus musculus
cagcagccagtcagcgtggtctcac

SEQ ID NO: 294125 - DNA, 25 bp, Mus musculus
gcccaagtccgaggaggtgacgatc

SEQ ID NO: 294126 - DNA, 25 bp, Mus musculus
ggtctacacccggatcacctttggc

SEQ ID NO: 294127 - DNA, 25 bp, Mus musculus
agcctttgcggctgatgacgcgatg

SEQ ID NO: 294128 - DNA, 25 bp, Mus musculus
tgatgacgcgatggcggagctctaa

SEQ ID NO: 294129 - DNA, 25 bp, Mus musculus
cggagctctaagtggctcggctccc

SEQ ID NO: 294130 - DNA, 25 bp, Mus musculus
cgctgcggaggtccctacgattttt

SEQ ID NO: 294131 - DNA, 25 bp, Mus musculus
cgaccagcctttgcggctgatgacg

SEQ ID NO: 294132 - DNA, 25 bp, Mus musculus
cacccggatcacctttggcacatga

SEQ ID NO: 294133 - DNA, 25 bp, Mus musculus
cggatcacctttggcacatgacctt

SEQ ID NO: 294134 - DNA, 25 bp, Mus musculus
tcacctttggcacatgacctttcct

SEQ ID NO: 294135 - DNA, 25 bp, Mus musculus
ctttcctcccggaccagaggccagg

SEQ ID NO: 294136 - DNA, 25 bp, Mus musculus
gaccagaggccaggaactgcgccta

SEQ ID NO: 294137 - DNA, 25 bp, Mus musculus
agacgccgaggtggagcctcagcca

SEQ ID NO: 294138 - DNA, 25 bp, Mus musculus
ccgaggtggagcctcagccactgct

SEQ ID NO: 294139 - DNA, 25 bp, Mus musculus
caggccagcgctgcggaggtcccta

SEQ ID NO: 294140 - DNA, 25 bp, Mus musculus
acaccgcgctgtgggctccgaccac

SEQ ID NO: 294141 - DNA, 25 bp, Mus musculus
gctgtgggctccgaccaccgcagcc

SEQ ID NO: 294142 - DNA, 25 bp, Mus musculus
caccgcagccctctagattcgggtt

SEQ ID NO: 294143 - DNA, 25 bp, Mus musculus
ccgcagccctctagattcgggttga

SEQ ID NO: 294144 - DNA, 25 bp, Mus musculus
gcagccctctagattcgggttgaaa

SEQ ID NO: 294145 - DNA, 25 bp, Mus musculus
gccctctagattcgggttgaaagga

SEQ ID NO: 294146 - DNA, 25 bp, Mus musculus
ttcgggttgaaaggatggagctacc

SEQ ID NO: 294147 - DNA, 25 bp, Mus musculus
ttgaaaggatggagctacctgggcc

SEQ ID NO: 294148 - DNA, 25 bp, Mus musculus
aaggatggagctacctgggcccttt

SEQ ID NO: 294149 - DNA, 25 bp, Mus musculus
gatggagctacctgggccctttccc

SEQ ID NO: 294150 - DNA, 25 bp, Mus musculus
cgcggagagaggacccggtcccgcg

SEQ ID NO: 294151 - DNA, 25 bp, Mus musculus
ccggtgcctctgctggagggctttc

SEQ ID NO: 294152 - DNA, 25 bp, Mus musculus
tgcctctgctggagggctttctgtt

SEQ ID NO: 294153 - DNA, 25 bp, Mus musculus
ctctgtcgcacgtctgggctcggcg

SEQ ID NO: 294154 - DNA, 25 bp, Mus musculus
cgagacgaaggccattgccggtacc

SEQ ID NO: 294155 - DNA, 25 bp, Mus musculus
cgcggcactccctttcgcctggccg

SEQ ID NO: 294156 - DNA, 25 bp, Mus musculus
cgagcgcccgggattgttgatgtga

SEQ ID NO: 294157 - DNA, 25 bp, Mus musculus
ggcagacgcggcctgccctcctgaa

SEQ ID NO: 294158 - DNA, 25 bp, Mus musculus
cggcgctagccctcctggtctcgcg

SEQ ID NO: 294159 - DNA, 25 bp, Mus musculus
gccggctgctcgcttcctgctccgc

SEQ ID NO: 294160 - DNA, 25 bp, Mus musculus
agcggagcgagcctgaggaaaacaa

SEQ ID NO: 294161 - DNA, 25 bp, Mus musculus
ccgagagcgagcctgaggcaagcga

SEQ ID NO: 294162 - DNA, 25 bp, Mus musculus
ccgcgaccgagcctgaaggaaagaa

SEQ ID NO: 294163 - DNA, 25 bp, Mus musculus
ctgggacaagcaaggccgcgaccga

SEQ ID NO: 294164 - DNA, 25 bp, Mus musculus
gagcaagcctgggacaagcaaggcc

SEQ ID NO: 294165 - DNA, 25 bp, Mus musculus
cccgagctgaaacgcaacaaggccc

SEQ ID NO: 294166 - DNA, 25 bp, Mus musculus
ttgccggtaccaacgatggacggtg

SEQ ID NO: 294167 - DNA, 25 bp, Mus musculus
ggccattgccggtaccaacgatgga

SEQ ID NO: 294168 - DNA, 25 bp, Mus musculus
gcgccagggagaacacgctccgagt

SEQ ID NO: 294169 - DNA, 25 bp, Mus musculus
tggttttggagaatccgccggctgc

SEQ ID NO: 294170 - DNA, 25 bp, Mus musculus
tttgaattgaacgtgagcggagcca

SEQ ID NO: 294171 - DNA, 25 bp, Mus musculus
actgcggcaccatgggtgagcctca

SEQ ID NO: 294172 - DNA, 25 bp, Mus musculus
ggccgcggtgacagtttgaattgaa

SEQ ID NO: 294173 - DNA, 25 bp, Mus musculus
tccgagaccagtcttttcctgcgtc

SEQ ID NO: 294174 - DNA, 25 bp, Mus musculus
agaggagcgtcaactgcggcaccat

SEQ ID NO: 294175 - DNA, 25 bp, Mus musculus
cccagacgcggccaatgtaaacatg

SEQ ID NO: 294176 - DNA, 25 bp, Mus musculus
acgctccgagtgaacgaagcagggc

SEQ ID NO: 294177 - DNA, 25 bp, Mus musculus
ctgtccacgacaacggaagtgccca

SEQ ID NO: 294178 - DNA, 25 bp, Mus musculus
cgcagttgatcgtagaggtagtctc

SEQ ID NO: 294179 - DNA, 25 bp, Mus musculus
ttcattgtcaaaagtagcgcagttg

SEQ ID NO: 294180 - DNA, 25 bp, Mus musculus
gtaatctcgcgagaacgcatccgcc

SEQ ID NO: 294181 - DNA, 25 bp, Mus musculus
gatgtcggtcagtgcgagatccgct

SEQ ID NO: 294182 - DNA, 25 bp, Mus musculus
tgcctggattcaagcagctacgacg

SEQ ID NO: 294183 - DNA, 25 bp, Mus musculus
gcgggacctgacttcagctgtgaca

SEQ ID NO: 294184 - DNA, 25 bp, Mus musculus
agctgtgacacccacggcgagcggc

SEQ ID NO: 294185 - DNA, 25 bp, Mus musculus
ggctactgtcgctcaggagcaattc

SEQ ID NO: 294186 - DNA, 25 bp, Mus musculus
aacccttgctcagtgtctgcgccgg

SEQ ID NO: 294187 - DNA, 25 bp, Mus musculus
tgggtccctgaacccttgctcagtg

SEQ ID NO: 294188 - DNA, 25 bp, Mus musculus
ggcactgagagtttccctgggagaa

SEQ ID NO: 294189 - DNA, 25 bp, Mus musculus
tcgcacccgagttaggcgccgggct

SEQ ID NO: 294190 - DNA, 25 bp, Mus musculus
tcaggagcaattctgcctgctccgg

SEQ ID NO: 294191 - DNA, 25 bp, Mus musculus
acgcggctagtcctggtgcagcatc

SEQ ID NO: 294192 - DNA, 25 bp, Mus musculus
ctgctccgggaaagcggcactgaga

SEQ ID NO: 294193 - DNA, 25 bp, Mus musculus
tcaagcagctacgacgcggctagtc

SEQ ID NO: 294194 - DNA, 25 bp, Mus musculus
atttcgccgcggctactgtcgctca

SEQ ID NO: 294195 - DNA, 25 bp, Mus musculus
gccgggctttgcctggattcaagca

SEQ ID NO: 294196 - DNA, 25 bp, Mus musculus
tatggactcgctgccgcaggtcagt

SEQ ID NO: 294197 - DNA, 25 bp, Mus musculus
gcgccagggacgatatggactcgct

SEQ ID NO: 294198 - DNA, 25 bp, Mus musculus
cacccgctatggactgcgccaggga

SEQ ID NO: 294199 - DNA, 25 bp, Mus musculus
gggtataggactgccacccgctatg

SEQ ID NO: 294200 - DNA, 25 bp, Mus musculus
catcgcagggcagcagccttgggtc

SEQ ID NO: 294201 - DNA, 25 bp, Mus musculus
gcgcgtcgcctcttggggctccgat

SEQ ID NO: 294202 - DNA, 25 bp, Mus musculus
agcagggaggtgataccaagctaga

SEQ ID NO: 294203 - DNA, 25 bp, Mus musculus
agcatccaaacgaagtcccagacgc

SEQ ID NO: 294204 - DNA, 25 bp, Mus musculus
gaggccactccagcatccaaacgaa

SEQ ID NO: 294205 - DNA, 25 bp, Mus musculus
actcgagccaaagctggggtgccct

SEQ ID NO: 294206 - DNA, 25 bp, Mus musculus
gggcgcgctctcactcgagccaaag

SEQ ID NO: 294207 - DNA, 25 bp, Mus musculus
ctcagcccgcgaggttggtacggac

SEQ ID NO: 294208 - DNA, 25 bp, Mus musculus
cgcctcgagagagaagcgcgcgcat

SEQ ID NO: 294209 - DNA, 25 bp, Mus musculus
cacggaaccggagaacgcctcgaga

SEQ ID NO: 294210 - DNA, 25 bp, Mus musculus
gctgacgcgaatggccaacacacta

SEQ ID NO: 294211 - DNA, 25 bp, Mus musculus
aagtggtgcgcacagagtacgtgta

SEQ ID NO: 294212 - DNA, 25 bp, Mus musculus
aggtgatgcccgagaccctcgcatc

SEQ ID NO: 294213 - DNA, 25 bp, Mus musculus
ctataagctgcgaggtgatgcccga

SEQ ID NO: 294214 - DNA, 25 bp, Mus musculus
tgcacgtagagacaccacgcaacta

SEQ ID NO: 294215 - DNA, 25 bp, Mus musculus
tgctgcgcgacactggcctcaacta

SEQ ID NO: 294216 - DNA, 25 bp, Mus musculus
tgtgcccaaccttcactggctagtg

SEQ ID NO: 294217 - DNA, 25 bp, Mus musculus
tacagtagaccggtgcagaaggcag

SEQ ID NO: 294218 - DNA, 25 bp, Mus musculus
tgtggtgacgcccacctacagtaga

SEQ ID NO: 294219 - DNA, 25 bp, Mus musculus
agagtacgtgtacacgaggccgcca

SEQ ID NO: 294220 - DNA, 25 bp, Mus musculus
acgtggcaccatgcagcgcaacctg

SEQ ID NO: 294221 - DNA, 25 bp, Mus musculus
ggctgcgggagaccttcccacggaa

SEQ ID NO: 294222 - DNA, 25 bp, Mus musculus
acggaactctactcagccaggcgta

SEQ ID NO: 294223 - DNA, 25 bp, Mus musculus
tggaggatgctccacgcaggacgcc

SEQ ID NO: 294224 - DNA, 25 bp, Mus musculus
agccaaagcgcctgtatccggaccg

SEQ ID NO: 294225 - DNA, 25 bp, Mus musculus
ggcgggcacagatgcccaccgaaga

SEQ ID NO: 294226 - DNA, 25 bp, Mus musculus
cctcgcctagatgagccttacgatc

SEQ ID NO: 294227 - DNA, 25 bp, Mus musculus
gccttacgatcgatgcagaaggtga

SEQ ID NO: 294228 - DNA, 25 bp, Mus musculus
agtgccgcgcgcagacagccaaagc

SEQ ID NO: 294229 - DNA, 25 bp, Mus musculus
atccggaccgcaacatcgccatgta

SEQ ID NO: 294230 - DNA, 25 bp, Mus musculus
tagcccaggccagaactagccgttc

SEQ ID NO: 294231 - DNA, 25 bp, Mus musculus
gagttgtagtccattaagcccttga

SEQ ID NO: 294232 - DNA, 25 bp, Mus musculus
attaagcccttgaagcgcgggctcc

SEQ ID NO: 294233 - DNA, 25 bp, Mus musculus
agcgcgggctccaataggactactg

SEQ ID NO: 294234 - DNA, 25 bp, Mus musculus
ggactactggcgttctgaaactaca

SEQ ID NO: 294235 - DNA, 25 bp, Mus musculus
ggcgcctctgagacgcgtcttctac

SEQ ID NO: 294236 - DNA, 25 bp, Mus musculus
ttctactaagcctgtccgggcacgc

SEQ ID NO: 294237 - DNA, 25 bp, Mus musculus
tctgagccagggacttgagtgccgc

SEQ ID NO: 294238 - DNA, 25 bp, Mus musculus
gcgctcggctctttctttgactgga

SEQ ID NO: 294239 - DNA, 25 bp, Mus musculus
tcattcaggcgggatgtagataaag

SEQ ID NO: 294240 - DNA, 25 bp, Mus musculus
caaggtgaacttcccgggccgtgag

SEQ ID NO: 294241 - DNA, 25 bp, Mus musculus
ccgggaactggaaagcgctcggctc

SEQ ID NO: 294242 - DNA, 25 bp, Mus musculus
cgggccgtgagtctccgctctggaa

SEQ ID NO: 294243 - DNA, 25 bp, Mus musculus
ctctttctttgactggagtggacca

SEQ ID NO: 294244 - DNA, 25 bp, Mus musculus
actggagtggaccagtggacgctac

SEQ ID NO: 294245 - DNA, 25 bp, Mus musculus
tggaccagtggacgctaccgcctca

SEQ ID NO: 294246 - DNA, 25 bp, Mus musculus
cggccatcgggatctgccgaacatg

SEQ ID NO: 294247 - DNA, 25 bp, Mus musculus
tctgccgaacatgggcaaccactca

SEQ ID NO: 294248 - DNA, 25 bp, Mus musculus
catgggcaaccactcagcgaagctg

SEQ ID NO: 294249 - DNA, 25 bp, Mus musculus
actcagcgaagctggaggagcccga

SEQ ID NO: 294250 - DNA, 25 bp, Mus musculus
gggctcgaggcaaggtgaacttccc

SEQ ID NO: 294251 - DNA, 25 bp, Mus musculus
agcggctctctagccgccgggaact

SEQ ID NO: 294252 - DNA, 25 bp, Mus musculus
atccttcacctcagcgccgtccgca

SEQ ID NO: 294253 - DNA, 25 bp, Mus musculus
agtgcgtctcccaggtctcgcgtca

SEQ ID NO: 294254 - DNA, 25 bp, Mus musculus
cgccgtccgcatggccgctcggcct

SEQ ID NO: 294255 - DNA, 25 bp, Mus musculus
caggtctcgcgtcacgggcgtcgca

SEQ ID NO: 294256 - DNA, 25 bp, Mus musculus
tcgcaggctcggctgcggcaatcct

SEQ ID NO: 294257 - DNA, 25 bp, Mus musculus
gggcctgcccgccagcatccttcac

SEQ ID NO: 294258 - DNA, 25 bp, Mus musculus
agctgaggtaaactgcggcgagccg

SEQ ID NO: 294259 - DNA, 25 bp, Mus musculus
tcgcgacggaaactaggcggaacgc

SEQ ID NO: 294260 - DNA, 25 bp, Mus musculus
tccttcgcgacggaaactaggcgga

SEQ ID NO: 294261 - DNA, 25 bp, Mus musculus
gacgccgcgtccttcgcgacggaaa

SEQ ID NO: 294262 - DNA, 25 bp, Mus musculus
tcttgacaaccaaccgacgccgcgt

SEQ ID NO: 294263 - DNA, 25 bp, Mus musculus
cgcagccatcttgacaaccaaccga

SEQ ID NO: 294264 - DNA, 25 bp, Mus musculus
tgcggcaatcctggcttcgcagcgg

SEQ ID NO: 294265 - DNA, 25 bp, Mus musculus
ccaatgaggggccggctcgctcaaa

SEQ ID NO: 294266 - DNA, 25 bp, Mus musculus
gtgcctttcccatgcacgctcagtg

SEQ ID NO: 294267 - DNA, 25 bp, Mus musculus
agcccattggcttgggttacgaaca

SEQ ID NO: 294268 - DNA, 25 bp, Mus musculus
gtcctcgctagccttgtttaacttc

SEQ ID NO: 294269 - DNA, 25 bp, Mus musculus
aggggcaaatgtgaccgctactaca

SEQ ID NO: 294270 - DNA, 25 bp, Mus musculus
acgccaggctactcttcacatttga

SEQ ID NO: 294271 - DNA, 25 bp, Mus musculus
gtgcctccttgtaatattccggttg

SEQ ID NO: 294272 - DNA, 25 bp, Mus musculus
ggcccagatgttccgtcaagtccta

SEQ ID NO: 294273 - DNA, 25 bp, Mus musculus
ctccagtagaactcgggcccagatg

SEQ ID NO: 294274 - DNA, 25 bp, Mus musculus
cggctctggcctctctccagtagaa

SEQ ID NO: 294275 - DNA, 25 bp, Mus musculus
gctttgtttacatggcggctctggc

SEQ ID NO: 294276 - DNA, 25 bp, Mus musculus
cgcggcgtaacgcaccgaagtgcta

SEQ ID NO: 294277 - DNA, 25 bp, Mus musculus
agccgcacacacagaactgcctgga

SEQ ID NO: 294278 - DNA, 25 bp, Mus musculus
gcaccgagaggccagacacagtacc

SEQ ID NO: 294279 - DNA, 25 bp, Mus musculus
ttccctgccgtgtaagaacgatatg

SEQ ID NO: 294280 - DNA, 25 bp, Mus musculus
aggcatctgccacggtccttctaga

SEQ ID NO: 294281 - DNA, 25 bp, Mus musculus
tctgccacggtccttctagagggcc

SEQ ID NO: 294282 - DNA, 25 bp, Mus musculus
ttctagagggccgtgtccctgtacg

SEQ ID NO: 294283 - DNA, 25 bp, Mus musculus
ggccgtgtccctgtacgggaccagc

SEQ ID NO: 294284 - DNA, 25 bp, Mus musculus
gcttctcggccggacctggagtcgt

SEQ ID NO: 294285 - DNA, 25 bp, Mus musculus
tgggagccgaaaccgctattccacc

SEQ ID NO: 294286 - DNA, 25 bp, Mus musculus
acacacttcctagcggcactgaagc

SEQ ID NO: 294287 - DNA, 25 bp, Mus musculus
agcggcactgaagcgtcaactcacc

SEQ ID NO: 294288 - DNA, 25 bp, Mus musculus
aagaagtcaggcagccgcgcgtaca

SEQ ID NO: 294289 - DNA, 25 bp, Mus musculus
agtcgaagtcgcagccgccggctca

SEQ ID NO: 294290 - DNA, 25 bp, Mus musculus
ctcagcgccatgtcgaggggaatgt

SEQ ID NO: 294291 - DNA, 25 bp, Mus musculus
gagaaccggcctcgtgcgcatgcgc

SEQ ID NO: 294292 - DNA, 25 bp, Mus musculus
tccagtttccatagcgaccacgcgg

SEQ ID NO: 294293 - DNA, 25 bp, Mus musculus
agccgcgcgtacagtcgaagtcgca

SEQ ID NO: 294294 - DNA, 25 bp, Mus musculus
gcccagctgcgtctcagagtcgagt

SEQ ID NO: 294295 - DNA, 25 bp, Mus musculus
tttccacacatcttggccgcggagg

SEQ ID NO: 294296 - DNA, 25 bp, Mus musculus
atggtctttaggcaggattccgcgc

SEQ ID NO: 294297 - DNA, 25 bp, Mus musculus
ctgctggggactttgatggtcttta

SEQ ID NO: 294298 - DNA, 25 bp, Mus musculus
cctagtgctctaactctggctgctg

SEQ ID NO: 294299 - DNA, 25 bp, Mus musculus
gtcgaatctgagctttggggaaccc

SEQ ID NO: 294300 - DNA, 25 bp, Mus musculus
ggttcacaaccacacgtcgaatctg

SEQ ID NO: 294301 - DNA, 25 bp, Mus musculus
ctgcgaacgccttggaatcaaagtg

SEQ ID NO: 294302 - DNA, 25 bp, Mus musculus
ggcgttcttagacctttgctccagg

SEQ ID NO: 294303 - DNA, 25 bp, Mus musculus
caaggtgagttgaagtgcagcatcc

SEQ ID NO: 294304 - DNA, 25 bp, Mus musculus
cagcacccgaggtcttgtggctcaa

SEQ ID NO: 294305 - DNA, 25 bp, Mus musculus
cgcgcggtagtactatgatttggta

SEQ ID NO: 294306 - DNA, 25 bp, Mus musculus
agcatctgctcttcttggttctgtc

SEQ ID NO: 294307 - DNA, 25 bp, Mus musculus
actttgcgataggatgaggctcttg

SEQ ID NO: 294308 - DNA, 25 bp, Mus musculus
accagccgggatgagcgcgcagtcc

SEQ ID NO: 294309 - DNA, 25 bp, Mus musculus
agccggcttgctccgagtcgacaca

SEQ ID NO: 294310 - DNA, 25 bp, Mus musculus
tccgagtcgacacagggagaaagtg

SEQ ID NO: 294311 - DNA, 25 bp, Mus musculus
gcccgcgtgcttcagggctgctccc

SEQ ID NO: 294312 - DNA, 25 bp, Mus musculus
aggccaacaggactcgcccactggg

SEQ ID NO: 294313 - DNA, 25 bp, Mus musculus
ggactcgcccactgggctactggga

SEQ ID NO: 294314 - DNA, 25 bp, Mus musculus
tactgggaggacagcttcggagcaa

SEQ ID NO: 294315 - DNA, 25 bp, Mus musculus
gcggaggaaccaggctacacctgct

SEQ ID NO: 294316 - DNA, 25 bp, Mus musculus
caggctacacctgctgcgggtcact

SEQ ID NO: 294317 - DNA, 25 bp, Mus musculus
gcgggtcactgcgtggaacttttta

SEQ ID NO: 294318 - DNA, 25 bp, Mus musculus
tgcgtggaactttttatcgccttgg

SEQ ID NO: 294319 - DNA, 25 bp, Mus musculus
ttttatcgccttggggtccagatgc

SEQ ID NO: 294320 - DNA, 25 bp, Mus musculus
ccttggggtccagatgcgagactcg

SEQ ID NO: 294321 - DNA, 25 bp, Mus musculus
cgcgcagtccgcaccacccgccagc

SEQ ID NO: 294322 - DNA, 25 bp, Mus musculus
ttgctcagagcccagattcgcgctg

SEQ ID NO: 294323 - DNA, 25 bp, Mus musculus
ggcttcctgcaatccggactcggga

SEQ ID NO: 294324 - DNA, 25 bp, Mus musculus
acccagcgatgaactagcggcgacc

SEQ ID NO: 294325 - DNA, 25 bp, Mus musculus
gccgcagagccacggtcaacttgct

SEQ ID NO: 294326 - DNA, 25 bp, Mus musculus
cgcgcagactcctccaagtctaata

SEQ ID NO: 294327 - DNA, 25 bp, Mus musculus
aaggctcggcgccagaaacaatctg

SEQ ID NO: 294328 - DNA, 25 bp, Mus musculus
ggactttctccgtgctgcctgtagc

SEQ ID NO: 294329 - DNA, 25 bp, Mus musculus
cactttggacaggagtaagcacttt

SEQ ID NO: 294330 - DNA, 25 bp, Mus musculus
ggttgaatccagctacccagatgtg

SEQ ID NO: 294331 - DNA, 25 bp, Mus musculus
cccagatgtggtctacgattcctca

SEQ ID NO: 294332 - DNA, 25 bp, Mus musculus
tctggctcgctgcagaagacgaagc

SEQ ID NO: 294333 - DNA, 25 bp, Mus musculus
tcagtcgaacgagaggaaatccagc

SEQ ID NO: 294334 - DNA, 25 bp, Mus musculus
ccgtagcagttcaggcatggcactt

SEQ ID NO: 294335 - DNA, 25 bp, Mus musculus
agtttccacacacatccgaggcgga

SEQ ID NO: 294336 - DNA, 25 bp, Mus musculus
gtccactttggagttgcggagtgta

SEQ ID NO: 294337 - DNA, 25 bp, Mus musculus
caggctagttgatgggccctgtcga

SEQ ID NO: 294338 - DNA, 25 bp, Mus musculus
tcatctcggctggaacaggctagtt

SEQ ID NO: 294339 - DNA, 25 bp, Mus musculus
ggcaaagttttcctcatctcggctg

SEQ ID NO: 294340 - DNA, 25 bp, Mus musculus
gactctccgcctgggccatgatgga

SEQ ID NO: 294341 - DNA, 25 bp, Mus musculus
cttcggagttcgtaagtgtccgtgg

SEQ ID NO: 294342 - DNA, 25 bp, Mus musculus
atctgccggctgctgcttcggagtt

SEQ ID NO: 294343 - DNA, 25 bp, Mus musculus
acccggaagctgtcgccggctgcta

SEQ ID NO: 294344 - DNA, 25 bp, Mus musculus
ccaagagttcgttcccaggggcgca

SEQ ID NO: 294345 - DNA, 25 bp, Mus musculus
cccgctgctctgtccactttggagt

SEQ ID NO: 294346 - DNA, 25 bp, Mus musculus
gatggaggccggcaaagttttcctc

SEQ ID NO: 294347 - DNA, 25 bp, Mus musculus
atgggccctgtcgacagaagcgagc

SEQ ID NO: 294348 - DNA, 25 bp, Mus musculus
cagcgacgtgtgacccgatctgccg

SEQ ID NO: 294349 - DNA, 25 bp, Mus musculus
ggggctgcgaagagactctccgcct

SEQ ID NO: 294350 - DNA, 25 bp, Mus musculus
tcacagcagcaaaggagtctggctc

SEQ ID NO: 294351 - DNA, 25 bp, Mus musculus
tgtcaagtgcacagccgaaaatttg

SEQ ID NO: 294352 - DNA, 25 bp, Mus musculus
gcgctctgggagctttagtacggtc

SEQ ID NO: 294353 - DNA, 25 bp, Mus musculus
tgttcctccctgagcaaagcgcgct

SEQ ID NO: 294354 - DNA, 25 bp, Mus musculus
cgcccgggacaatgggcagttccca

SEQ ID NO: 294355 - DNA, 25 bp, Mus musculus
caggattgagatgcccagtagaagc

SEQ ID NO: 294356 - DNA, 25 bp, Mus musculus
ctcctgtagtagtggcggccattga

SEQ ID NO: 294357 - DNA, 25 bp, Mus musculus
gtcctgctgaaaagctgtgatctga

SEQ ID NO: 294358 - DNA, 25 bp, Mus musculus
ctggcgtcaggtgtagataaaagtc

SEQ ID NO: 294359 - DNA, 25 bp, Mus musculus
atacccggaatagaagcagcgtcgc

SEQ ID NO: 294360 - DNA, 25 bp, Mus musculus
ggctaatgacatactccgcacctcg

SEQ ID NO: 294361 - DNA, 25 bp, Mus musculus
ccgccgtggcttataagggtccaga

SEQ ID NO: 294362 - DNA, 25 bp, Mus musculus
ccgcgccgtgaaacttgaccattga

SEQ ID NO: 294363 - DNA, 25 bp, Mus musculus
cagcgggacacctagatactcagta

SEQ ID NO: 294364 - DNA, 25 bp, Mus musculus
cttcttctctggcacagtgaatgga

SEQ ID NO: 294365 - DNA, 25 bp, Mus musculus
cagcccactcggtgtttcccgagga

SEQ ID NO: 294366 - DNA, 25 bp, Mus musculus
agcctcatcgcctgcagcgctgggg

SEQ ID NO: 294367 - DNA, 25 bp, Mus musculus
tggggactccctggaccagcctcat

SEQ ID NO: 294368 - DNA, 25 bp, Mus musculus
ccatccagccacagggcgctgggga

SEQ ID NO: 294369 - DNA, 25 bp, Mus musculus
cgccagctgctcgagttctgctagg

SEQ ID NO: 294370 - DNA, 25 bp, Mus musculus
gctgagcggctcgttcttgctggca

SEQ ID NO: 294371 - DNA, 25 bp, Mus musculus
cccatccgattgatcatttttcctg

SEQ ID NO: 294372 - DNA, 25 bp, Mus musculus
gggactgcgtggctgcttcttctct

SEQ ID NO: 294373 - DNA, 25 bp, Mus musculus
cggaattcaagatcgagcgcctcgg

SEQ ID NO: 294374 - DNA, 25 bp, Mus musculus
ttcctggcgccggaattcaagatcg

SEQ ID NO: 294375 - DNA, 25 bp, Mus musculus
cctcggagctagtggtgcccacgcg

SEQ ID NO: 294376 - DNA, 25 bp, Mus musculus
catttttcctggacagagcggcccg

SEQ ID NO: 294377 - DNA, 25 bp, Mus musculus
caggcgaggagttcaccatccagcc

SEQ ID NO: 294378 - DNA, 25 bp, Mus musculus
gcctggggactgacaccacttgtca

SEQ ID NO: 294379 - DNA, 25 bp, Mus musculus
tgcacacagactgggtcaaggcccg

SEQ ID NO: 294380 - DNA, 25 bp, Mus musculus
ccctcattggcgattaatccttaga

SEQ ID NO: 294381 - DNA, 25 bp, Mus musculus
tgcttcagcgtctggcttgcaccac

SEQ ID NO: 294382 - DNA, 25 bp, Mus musculus
tgcaccaccggcgaaggacagctcg

SEQ ID NO: 294383 - DNA, 25 bp, Mus musculus
cagctcgcactacgcttgcgcaata

SEQ ID NO: 294384 - DNA, 25 bp, Mus musculus
ccaggctgcacactggcctaggagc

SEQ ID NO: 294385 - DNA, 25 bp, Mus musculus
ataacaaatgctgtgctgccgggcc

SEQ ID NO: 294386 - DNA, 25 bp, Mus musculus
aggggagcctatcggccagaaaatc

SEQ ID NO: 294387 - DNA, 25 bp, Mus musculus
tggtcccagcggacctgaagccgtc

SEQ ID NO: 294388 - DNA, 25 bp, Mus musculus
accctgattcgtgctgggaggcacc

SEQ ID NO: 294389 - DNA, 25 bp, Mus musculus
gaaacctggtttgtcaccctgattc

SEQ ID NO: 294390 - DNA, 25 bp, Mus musculus
acttgtcacccacctggacgcggga

SEQ ID NO: 294391 - DNA, 25 bp, Mus musculus
agccgtcacccagatcttccagggg

SEQ ID NO: 294392 - DNA, 25 bp, Mus musculus
aatgcagcactgagaggaagcccgg

SEQ ID NO: 294393 - DNA, 25 bp, Mus musculus
gtggtgaagcttcgaggtgtctttc

SEQ ID NO: 294394 - DNA, 25 bp, Mus musculus
ggtgtctttcctgaatgtgtccctc

SEQ ID NO: 294395 - DNA, 25 bp, Mus musculus
gcggcaccctagcagctgtcctgag

SEQ ID NO: 294396 - DNA, 25 bp, Mus musculus
cccggccatgcagctagagacgcaa

SEQ ID NO: 294397 - DNA, 25 bp, Mus musculus
agagacgcaagacgcgctgtacgtg

SEQ ID NO: 294398 - DNA, 25 bp, Mus musculus
tgggagcctcgagtgcattacagac

SEQ ID NO: 294399 - DNA, 25 bp, Mus musculus
tactttctggtatccctggcgacgg

SEQ ID NO: 294400 - DNA, 25 bp, Mus musculus
tgccatcaccatcagcttgggcttc

SEQ ID NO: 294401 - DNA, 25 bp, Mus musculus
cttgggcttctgcacggacttccac

SEQ ID NO: 294402 - DNA, 25 bp, Mus musculus
agtatggacaccttgcaggggcgtc

SEQ ID NO: 294403 - DNA, 25 bp, Mus musculus
attcgcgtcccgctcaggtgagacg

SEQ ID NO: 294404 - DNA, 25 bp, Mus musculus
gctgtcgaccgatatctggccattc

SEQ ID NO: 294405 - DNA, 25 bp, Mus musculus
tgcttcgtgctggtgctcacacaga

SEQ ID NO: 294406 - DNA, 25 bp, Mus musculus
cctcagtgcccagcgcgaggcaggt

SEQ ID NO: 294407 - DNA, 25 bp, Mus musculus
acgctgcgcgcggatcagaactgtg

SEQ ID NO: 294408 - DNA, 25 bp, Mus musculus
gatcagaactgtggacgcccgaccc

SEQ ID NO: 294409 - DNA, 25 bp, Mus musculus
cgcccacctctagccgggagttgta

SEQ ID NO: 294410 - DNA, 25 bp, Mus musculus
agttgtacttgagtcccgcgccgaa

SEQ ID NO: 294411 - DNA, 25 bp, Mus musculus
agtcccgcgccgaagtcctgagagc

SEQ ID NO: 294412 - DNA, 25 bp, Mus musculus
ccgattgctacccatggttttggcg

SEQ ID NO: 294413 - DNA, 25 bp, Mus musculus
tacccatggttttggcggtccgatc

SEQ ID NO: 294414 - DNA, 25 bp, Mus musculus
gtccgatcgccggtctcagacgcgt

SEQ ID NO: 294415 - DNA, 25 bp, Mus musculus
tcagacgcgtggtccctccgggcag

SEQ ID NO: 294416 - DNA, 25 bp, Mus musculus
agccgtctaccatggcccgcggggt

SEQ ID NO: 294417 - DNA, 25 bp, Mus musculus
cttcctcccagctcaggtagtttca

SEQ ID NO: 294418 - DNA, 25 bp, Mus musculus
tcaggtagtttcagggtgtggcctc

SEQ ID NO: 294419 - DNA, 25 bp, Mus musculus
gaacaggaaattccacctgtgcgcc

SEQ ID NO: 294420 - DNA, 25 bp, Mus musculus
ctagtgacttccactgtggcgggca

SEQ ID NO: 294421 - DNA, 25 bp, Mus musculus
agaacctagccagtcaggaatctgc

SEQ ID NO: 294422 - DNA, 25 bp, Mus musculus
gtcacggttgacatagtaactcttc

SEQ ID NO: 294423 - DNA, 25 bp, Mus musculus
agtaactcttcagcggctctcccta

SEQ ID NO: 294424 - DNA, 25 bp, Mus musculus
atgcgctcaggtcaaggttcctttc

SEQ ID NO: 294425 - DNA, 25 bp, Mus musculus
gtcaaggttcctttcgcggctgtct

SEQ ID NO: 294426 - DNA, 25 bp, Mus musculus
ttatcctctccctggcattgctttg

SEQ ID NO: 294427 - DNA, 25 bp, Mus musculus
tttgctcgggtccagctcagttggt

SEQ ID NO: 294428 - DNA, 25 bp, Mus musculus
agccagagcccgaggttcgtgaccc

SEQ ID NO: 294429 - DNA, 25 bp, Mus musculus
gcggatttctggacggtcctttcga

SEQ ID NO: 294430 - DNA, 25 bp, Mus musculus
cggcgcaacgagagccaggactatt

SEQ ID NO: 294431 - DNA, 25 bp, Mus musculus
caggactatttgctgatggacgagc

SEQ ID NO: 294432 - DNA, 25 bp, Mus musculus
gcagggaagccattggcagaaccta

SEQ ID NO: 294433 - DNA, 25 bp, Mus musculus
ttcccatccacggaagcaggggtgc

SEQ ID NO: 294434 - DNA, 25 bp, Mus musculus
gtcaaggtgcgagcccgaagcccag

SEQ ID NO: 294435 - DNA, 25 bp, Mus musculus
tctatgtagccagccagagccgcag

SEQ ID NO: 294436 - DNA, 25 bp, Mus musculus
tcgcctggtcctcacctctatgtag

SEQ ID NO: 294437 - DNA, 25 bp, Mus musculus
acgcagatcgggagctcgcctggtc

SEQ ID NO: 294438 - DNA, 25 bp, Mus musculus
ggcgctaagctctgcgcaaagctga

SEQ ID NO: 294439 - DNA, 25 bp, Mus musculus
ctctgcggcgacagaggcagcccga

SEQ ID NO: 294440 - DNA, 25 bp, Mus musculus
ccgaccgtcaaggtgcgagcccgaa

SEQ ID NO: 294441 - DNA, 25 bp, Mus musculus
tggtcaacgactgctgcgcgccgac

SEQ ID NO: 294442 - DNA, 25 bp, Mus musculus
gctgccaagtccacctggtcaacga

SEQ ID NO: 294443 - DNA, 25 bp, Mus musculus
atctcggccactcgccagggctgga

SEQ ID NO: 294444 - DNA, 25 bp, Mus musculus
cgagcagcagcaggacaagaagctt

SEQ ID NO: 294445 - DNA, 25 bp, Mus musculus
acagccaggctacagcgcttcccta

SEQ ID NO: 294446 - DNA, 25 bp, Mus musculus
gacaagaagcttgccggtggccgca

SEQ ID NO: 294447 - DNA, 25 bp, Mus musculus
agaggcagcccgacctcggcgctaa

SEQ ID NO: 294448 - DNA, 25 bp, Mus musculus
cgccctggaggatgaacgccgacat

SEQ ID NO: 294449 - DNA, 25 bp, Mus musculus
gacggtttgcagaggaccgaccctg

SEQ ID NO: 294450 - DNA, 25 bp, Mus musculus
tgctccttaggtcctttccctgccc

SEQ ID NO: 294451 - DNA, 25 bp, Mus musculus
accctgtcgccctggaggatgaacg

SEQ ID NO: 294452 - DNA, 25 bp, Mus musculus
agcccctgcggcacagagaggcctt

SEQ ID NO: 294453 - DNA, 25 bp, Mus musculus
cctggaggatgaacgccgacattct

SEQ ID NO: 294454 - DNA, 25 bp, Mus musculus
ggatgaacgccgacattctgctctc

SEQ ID NO: 294455 - DNA, 25 bp, Mus musculus
gatgaacgccgacattctgctctcc

SEQ ID NO: 294456 - DNA, 25 bp, Mus musculus
ccagacctctgcgcccttgtttcgc

SEQ ID NO: 294457 - DNA, 25 bp, Mus musculus
ttgtttcgcccctgaacccgcagtg

SEQ ID NO: 294458 - DNA, 25 bp, Mus musculus
agtgtctgcacaccgctgacctctg

SEQ ID NO: 294459 - DNA, 25 bp, Mus musculus
gctgacctctgctccttaggtcctt

SEQ ID NO: 294460 - DNA, 25 bp, Mus musculus
tgacctctgctccttaggtcctttc

SEQ ID NO: 294461 - DNA, 25 bp, Mus musculus
acggtttgcagaggaccgaccctgt

SEQ ID NO: 294462 - DNA, 25 bp, Mus musculus
ggcaccgcccgatggtacagtccag

SEQ ID NO: 294463 - DNA, 25 bp, Mus musculus
ggggtcaaaccatctgcaccttcta

SEQ ID NO: 294464 - DNA, 25 bp, Mus musculus
ctgcaccttctacgcggagagggga

SEQ ID NO: 294465 - DNA, 25 bp, Mus musculus
tcgtgcgggtatcccggcccgcgat

SEQ ID NO: 294466 - DNA, 25 bp, Mus musculus
ctgcgggtcggtctgcaaacgcgat

SEQ ID NO: 294467 - DNA, 25 bp, Mus musculus
tgcttagtcccacccaaaatggcgc

SEQ ID NO: 294468 - DNA, 25 bp, Mus musculus
agtgtttcgtctttgcttagtccca

SEQ ID NO: 294469 - DNA, 25 bp, Mus musculus
cctgggagagtgtttcgtctttgct

SEQ ID NO: 294470 - DNA, 25 bp, Mus musculus
ccagaggatcccatcgcctgggaga

SEQ ID NO: 294471 - DNA, 25 bp, Mus musculus
aatggcgcccagctctttctgcgtc

SEQ ID NO: 294472 - DNA, 25 bp, Mus musculus
aaccggggtccagaggatcccatcg

SEQ ID NO: 294473 - DNA, 25 bp, Mus musculus
gaggatccgggacccgctgatcttc

SEQ ID NO: 294474 - DNA, 25 bp, Mus musculus
tcacccaacgtcgtgtaagtaccta

SEQ ID NO: 294475 - DNA, 25 bp, Mus musculus
cgaggaccaagaaaactggcgagcg

SEQ ID NO: 294476 - DNA, 25 bp, Mus musculus
cgcacagaatggatcgtgccttctc

SEQ ID NO: 294477 - DNA, 25 bp, Mus musculus
aacacttagaaatcggcagcttccg

SEQ ID NO: 294478 - DNA, 25 bp, Mus musculus
ggccttcctggtctagcgaagcagc

SEQ ID NO: 294479 - DNA, 25 bp, Mus musculus
cccaggtgcagagaagaggccttcc

SEQ ID NO: 294480 - DNA, 25 bp, Mus musculus
gtctagcgaagcagcccgggacacc

SEQ ID NO: 294481 - DNA, 25 bp, Mus musculus
tccttgcttgctggttgctcgcgag

SEQ ID NO: 294482 - DNA, 25 bp, Mus musculus
ctgcggtccgaggtccttgcttgct

SEQ ID NO: 294483 - DNA, 25 bp, Mus musculus
agacccgcggactctgctgaggtga

SEQ ID NO: 294484 - DNA, 25 bp, Mus musculus
aacgtgcgcgtacccagacgccttg

SEQ ID NO: 294485 - DNA, 25 bp, Mus musculus
agcccggaacgtgcgcgtacccaga

SEQ ID NO: 294486 - DNA, 25 bp, Mus musculus
cggttcaggtgctgccacaggctcc

SEQ ID NO: 294487 - DNA, 25 bp, Mus musculus
accgacgtagcttgtggcaccagac

SEQ ID NO: 294488 - DNA, 25 bp, Mus musculus
cttctccgcaccgacgtagcttgtg

SEQ ID NO: 294489 - DNA, 25 bp, Mus musculus
cagcttccggggttccggctcgcta

SEQ ID NO: 294490 - DNA, 25 bp, Mus musculus
cctagcgtcctaatctcagaatctg

SEQ ID NO: 294491 - DNA, 25 bp, Mus musculus
acagccgatggtgtttgcctgacgc

SEQ ID NO: 294492 - DNA, 25 bp, Mus musculus
gctcctgctgtcagtgactcttcca

SEQ ID NO: 294493 - DNA, 25 bp, Mus musculus
aatccttgcgttagagcgtccggcc

SEQ ID NO: 294494 - DNA, 25 bp, Mus musculus
tccattccggggtataacacacttc

SEQ ID NO: 294495 - DNA, 25 bp, Mus musculus
tggcttttcctagtgcccaatcccg

SEQ ID NO: 294496 - DNA, 25 bp, Mus musculus
taggcagctatgtccacacctcttg

SEQ ID NO: 294497 - DNA, 25 bp, Mus musculus
gtggggcatttgctccaaggttgca

SEQ ID NO: 294498 - DNA, 25 bp, Mus musculus
tgggccatttccctaaaccacagtg

SEQ ID NO: 294499 - DNA, 25 bp, Mus musculus
atccagaatcgcgaagctccgggct

SEQ ID NO: 294500 - DNA, 25 bp, Mus musculus
gactcaggagtctagccgccacttt

SEQ ID NO: 294501 - DNA, 25 bp, Mus musculus
agcagtggcatcttcatccagaatc

SEQ ID NO: 294502 - DNA, 25 bp, Mus musculus
ggttgcaaacttgattgcctcacta

SEQ ID NO: 294503 - DNA, 25 bp, Mus musculus
taagcgcctaggacagctcctgctg

SEQ ID NO: 294504 - DNA, 25 bp, Mus musculus
cgtgcacatgctttcccgggacaac

SEQ ID NO: 294505 - DNA, 25 bp, Mus musculus
gcctcccggggcgacagaactgcgt

SEQ ID NO: 294506 - DNA, 25 bp, Mus musculus
gctttcccgggacaacagcaggcga

SEQ ID NO: 294507 - DNA, 25 bp, Mus musculus
aacagcaggcgaggcctcgatgcgc

SEQ ID NO: 294508 - DNA, 25 bp, Mus musculus
ccgcttgcctgaggtgcagacccaa

SEQ ID NO: 294509 - DNA, 25 bp, Mus musculus
cctgaggtgcagacccaaggccgcg

SEQ ID NO: 294510 - DNA, 25 bp, Mus musculus
tagcttggccggcaccggtgcttct

SEQ ID NO: 294511 - DNA, 25 bp, Mus musculus
tgcacgttgcgataggatgctcttg

SEQ ID NO: 294512 - DNA, 25 bp, Mus musculus
gggcgacagaactgcgtgcccgcca

SEQ ID NO: 294513 - DNA, 25 bp, Mus musculus
cgtgcccgccacctctcgctagcat

SEQ ID NO: 294514 - DNA, 25 bp, Mus musculus
tcgctagcatccctcggcgaactgg

SEQ ID NO: 294515 - DNA, 25 bp, Mus musculus
gcgaactgggcgttccgacggcctc

SEQ ID NO: 294516 - DNA, 25 bp, Mus musculus
atccctcggcgaactgggcgttccg

SEQ ID NO: 294517 - DNA, 25 bp, Mus musculus
accggtgcttctgggcgtgcacgtt

SEQ ID NO: 294518 - DNA, 25 bp, Mus musculus
tactaaggagtgcaccagaaagcca

SEQ ID NO: 294519 - DNA, 25 bp, Mus musculus
tgaagaaacacaatcccggctgccg

SEQ ID NO: 294520 - DNA, 25 bp, Mus musculus
cccgtgcctcgctcctaattgaaga

SEQ ID NO: 294521 - DNA, 25 bp, Mus musculus
aaatacaatggtgcgggcttcgagg

SEQ ID NO: 294522 - DNA, 25 bp, Mus musculus
gtgaatggacggcatccagcctggc

SEQ ID NO: 294523 - DNA, 25 bp, Mus musculus
aaacaaatacaatggtgcgggcttc

SEQ ID NO: 294524 - DNA, 25 bp, Mus musculus
gtgcaccagaaagccaaaacaaata

SEQ ID NO: 294525 - DNA, 25 bp, Mus musculus
cgacccgcgggccaacagggcaatg

SEQ ID NO: 294526 - DNA, 25 bp, Mus musculus
agaaataaatactaaggagtgcacc

SEQ ID NO: 294527 - DNA, 25 bp, Mus musculus
caacagggcaatgccgacggccaca

SEQ ID NO: 294528 - DNA, 25 bp, Mus musculus
tgcctcgctcctaattgaagaaaca

SEQ ID NO: 294529 - DNA, 25 bp, Mus musculus
cagcctggccggcaatttgaaaata

SEQ ID NO: 294530 - DNA, 25 bp, Mus musculus
agcaggctccggcagtctgcgcgcc

SEQ ID NO: 294531 - DNA, 25 bp, Mus musculus
gcctggccggcaatttgaaaataaa

SEQ ID NO: 294532 - DNA, 25 bp, Mus musculus
gacccggttacagcctgacctcgta

SEQ ID NO: 294533 - DNA, 25 bp, Mus musculus
tttggccaagtctgcagccgagccc

SEQ ID NO: 294534 - DNA, 25 bp, Mus musculus
atagtcccgtccatttggccaagtc

SEQ ID NO: 294535 - DNA, 25 bp, Mus musculus
tgcccagccgcttaccttaatagtc

SEQ ID NO: 294536 - DNA, 25 bp, Mus musculus
cctgcgggattccacagtggcgcaa

SEQ ID NO: 294537 - DNA, 25 bp, Mus musculus
caggtttcagctgccgggtctcgca

SEQ ID NO: 294538 - DNA, 25 bp, Mus musculus
aagctggccgccagactagtgcctg

SEQ ID NO: 294539 - DNA, 25 bp, Mus musculus
tcctccaactcgctcggagggtcgg

SEQ ID NO: 294540 - DNA, 25 bp, Mus musculus
tgacaagtaaacagggtcttccatc

SEQ ID NO: 294541 - DNA, 25 bp, Mus musculus
gagaaaccggtctggctgacaagta

SEQ ID NO: 294542 - DNA, 25 bp, Mus musculus
aatattccacacattgacccggtta

SEQ ID NO: 294543 - DNA, 25 bp, Mus musculus
ccggagagcaaggagattcctaacc

SEQ ID NO: 294544 - DNA, 25 bp, Mus musculus
ccctgtgcacgtttgttgttgtagc

SEQ ID NO: 294545 - DNA, 25 bp, Mus musculus
ttcctaacccgaggaactgcgaggc

SEQ ID NO: 294546 - DNA, 25 bp, Mus musculus
cgcggtggactcagagtagtctgca

SEQ ID NO: 294547 - DNA, 25 bp, Mus musculus
tgcctgacgcctgctaggattccga

SEQ ID NO: 294548 - DNA, 25 bp, Mus musculus
tgctgggacagaagcccgaacatcg

SEQ ID NO: 294549 - DNA, 25 bp, Mus musculus
agtctgcactcggtacgggcgactt

SEQ ID NO: 294550 - DNA, 25 bp, Mus musculus
gcactcggggcagagtcctggtaac

SEQ ID NO: 294551 - DNA, 25 bp, Mus musculus
tacgggcgactttagccgtcacgca

SEQ ID NO: 294552 - DNA, 25 bp, Mus musculus
ttccgtaagtcggaagcagagttcg

SEQ ID NO: 294553 - DNA, 25 bp, Mus musculus
ccaaagcgtgttctggagtcctcca

SEQ ID NO: 294554 - DNA, 25 bp, Mus musculus
tggtagcggctagccaaagcgtgtt

SEQ ID NO: 294555 - DNA, 25 bp, Mus musculus
tcttgctcttgctaggctcgtggta

SEQ ID NO: 294556 - DNA, 25 bp, Mus musculus
cgcgagttccaccactgcggtagta

SEQ ID NO: 294557 - DNA, 25 bp, Mus musculus
acccttacctaggtcgtgactcacg

SEQ ID NO: 294558 - DNA, 25 bp, Mus musculus
ggccacccgaggtgtggagtctaca

SEQ ID NO: 294559 - DNA, 25 bp, Mus musculus
ggcaaagttagaagccggcactcgg

SEQ ID NO: 294560 - DNA, 25 bp, Mus musculus
gaccactaggcgtcgtcgagaaaac

SEQ ID NO: 294561 - DNA, 25 bp, Mus musculus
gatgacaggaggtggagaccagccc

SEQ ID NO: 294562 - DNA, 25 bp, Mus musculus
accagagagcacaggatgacaggag

SEQ ID NO: 294563 - DNA, 25 bp, Mus musculus
cgccataatggggactatggaggtc

SEQ ID NO: 294564 - DNA, 25 bp, Mus musculus
gtgtcgcgaccctcatccagtggcg

SEQ ID NO: 294565 - DNA, 25 bp, Mus musculus
ccaagggagtcggagactgaccaga

SEQ ID NO: 294566 - DNA, 25 bp, Mus musculus
cccagaccactaggcgtcgtcgaga

SEQ ID NO: 294567 - DNA, 25 bp, Mus musculus
acccgagccccagacaattggaagg

SEQ ID NO: 294568 - DNA, 25 bp, Mus musculus
ccaggagggtctcagagacccgagc

SEQ ID NO: 294569 - DNA, 25 bp, Mus musculus
aaaactctacgtgggaggccgcagc

SEQ ID NO: 294570 - DNA, 25 bp, Mus musculus
cgaccctgttcaaaactctacgtgg

SEQ ID NO: 294571 - DNA, 25 bp, Mus musculus
tgccttagcaccgaccctgttcaaa

SEQ ID NO: 294572 - DNA, 25 bp, Mus musculus
acgctagttcttgccttagcaccga

SEQ ID NO: 294573 - DNA, 25 bp, Mus musculus
ctcatccagtggcggcgccataatg

SEQ ID NO: 294574 - DNA, 25 bp, Mus musculus
ccaagccttcaagaatgcgtgcaga

SEQ ID NO: 294575 - DNA, 25 bp, Mus musculus
cctgtgtgtcaagctttgtgaatga

SEQ ID NO: 294576 - DNA, 25 bp, Mus musculus
tgaatgaatgatgtacacgcacttg

SEQ ID NO: 294577 - DNA, 25 bp, Mus musculus
acacgcacttggaaaactatgctgc

SEQ ID NO: 294578 - DNA, 25 bp, Mus musculus
aactatgctgctactggagcggggc

SEQ ID NO: 294579 - DNA, 25 bp, Mus musculus
tgcgtgcagaatcagacggactttc

SEQ ID NO: 294580 - DNA, 25 bp, Mus musculus
ggacaggctcgccagccattcttag

SEQ ID NO: 294581 - DNA, 25 bp, Mus musculus
gccattcttagcagcggtgggctga

SEQ ID NO: 294582 - DNA, 25 bp, Mus musculus
cggtgattggctgcagatgctaagc

SEQ ID NO: 294583 - DNA, 25 bp, Mus musculus
tgggctcggtgaggaacgccctaaa

SEQ ID NO: 294584 - DNA, 25 bp, Mus musculus
cgccctaaagcggaggcgagctgca

SEQ ID NO: 294585 - DNA, 25 bp, Mus musculus
aggctgggacctaagcgcgctctct

SEQ ID NO: 294586 - DNA, 25 bp, Mus musculus
acgcctcacgtcctgtgtgtcaagc

SEQ ID NO: 294587 - DNA, 25 bp, Mus musculus
tttcccgagactgtggcagtagccc

SEQ ID NO: 294588 - DNA, 25 bp, Mus musculus
aggggaccagcagtcgctgtccgac

SEQ ID NO: 294589 - DNA, 25 bp, Mus musculus
gcaggttctccacacgtctggcgct

SEQ ID NO: 294590 - DNA, 25 bp, Mus musculus
ggttctccacacgtctggcgcttcg

SEQ ID NO: 294591 - DNA, 25 bp, Mus musculus
ttgcttgcacgcttggactcaggtc

SEQ ID NO: 294592 - DNA, 25 bp, Mus musculus
acgcttggactcaggtcccttccaa

SEQ ID NO: 294593 - DNA, 25 bp, Mus musculus
ccttccaagggagccagcactcgga

SEQ ID NO: 294594 - DNA, 25 bp, Mus musculus
ccagcactcggacgtgtcgtctgta

SEQ ID NO: 294595 - DNA, 25 bp, Mus musculus
cgtgtcgtctgtagtctcgcctata

SEQ ID NO: 294596 - DNA, 25 bp, Mus musculus
tgtagtctcgcctataccgatctcc

SEQ ID NO: 294597 - DNA, 25 bp, Mus musculus
taccgatctccctggacgggctgct

SEQ ID NO: 294598 - DNA, 25 bp, Mus musculus
acgggctgctttttcctcggtcctg

SEQ ID NO: 294599 - DNA, 25 bp, Mus musculus
ctgctttttcctcggtcctgccggg

SEQ ID NO: 294600 - DNA, 25 bp, Mus musculus
ccagacggaaagacaggggaccagc

SEQ ID NO: 294601 - DNA, 25 bp, Mus musculus
tcccgagctcccagacggaaagaca

SEQ ID NO: 294602 - DNA, 25 bp, Mus musculus
gcaggtatcgctcgccttctctctg

SEQ ID NO: 294603 - DNA, 25 bp, Mus musculus
tctgccccacgtggtagccgcggaa

SEQ ID NO: 294604 - DNA, 25 bp, Mus musculus
tccctcgcagcgaactgcgagcagg

SEQ ID NO: 294605 - DNA, 25 bp, Mus musculus
gcagcgaactgcgagcaggccatcc

SEQ ID NO: 294606 - DNA, 25 bp, Mus musculus
agcgaactgcgagcaggccatccta

SEQ ID NO: 294607 - DNA, 25 bp, Mus musculus
gaactgcgagcaggccatcctacag

SEQ ID NO: 294608 - DNA, 25 bp, Mus musculus
tgcgagcaggccatcctacagagcc

SEQ ID NO: 294609 - DNA, 25 bp, Mus musculus
agcaggccatcctacagagccggga

SEQ ID NO: 294610 - DNA, 25 bp, Mus musculus
gccatcctacagagccgggaggtta

SEQ ID NO: 294611 - DNA, 25 bp, Mus musculus
ccatcctacagagccgggaggttaa

SEQ ID NO: 294612 - DNA, 25 bp, Mus musculus
tacagagccgggaggttaaccgagc

SEQ ID NO: 294613 - DNA, 25 bp, Mus musculus
tgtgggtcctgcaggtatcgctcgc

SEQ ID NO: 294614 - DNA, 25 bp, Mus musculus
agccgcggaagattgccgttggttt

SEQ ID NO: 294615 - DNA, 25 bp, Mus musculus
gtcctgcaggtatcgctcgccttct

SEQ ID NO: 294616 - DNA, 25 bp, Mus musculus
gcttcccgaggcgactgaaaacaag

SEQ ID NO: 294617 - DNA, 25 bp, Mus musculus
gctgcctgcagatacccggagacac

SEQ ID NO: 294618 - DNA, 25 bp, Mus musculus
ccgaggcgactgaaaacaagcattt

SEQ ID NO: 294619 - DNA, 25 bp, Mus musculus
tgcagatacccggagacacaacgag

SEQ ID NO: 294620 - DNA, 25 bp, Mus musculus
cccggagacacaacgagacctaagc

SEQ ID NO: 294621 - DNA, 25 bp, Mus musculus
aacgagacctaagcggaccagagga

SEQ ID NO: 294622 - DNA, 25 bp, Mus musculus
accagaggagggacagaccgactga

SEQ ID NO: 294623 - DNA, 25 bp, Mus musculus
ggacagaccgactgacagatagatg

SEQ ID NO: 294624 - DNA, 25 bp, Mus musculus
acagatagatggtcggcgcgaaccc

SEQ ID NO: 294625 - DNA, 25 bp, Mus musculus
agccgccgcgcttgaagagaaacta

SEQ ID NO: 294626 - DNA, 25 bp, Mus musculus
tgaagagaaactaactgcacaccca

SEQ ID NO: 294627 - DNA, 25 bp, Mus musculus
gaaactaactgcacacccaagttgc

SEQ ID NO: 294628 - DNA, 25 bp, Mus musculus
acaagcatttggtttcggctgcctg

SEQ ID NO: 294629 - DNA, 25 bp, Mus musculus
atttggtttcggctgcctgcagata

SEQ ID NO: 294630 - DNA, 25 bp, Mus musculus
cagcgtggcgtccacgtgcggggcc

SEQ ID NO: 294631 - DNA, 25 bp, Mus musculus
cctctccgagccgtggcgggaggct

SEQ ID NO: 294632 - DNA, 25 bp, Mus musculus
acacggtcgggaagccgacagccgc

SEQ ID NO: 294633 - DNA, 25 bp, Mus musculus
gcacacggtcgggaagccgacagcc

SEQ ID NO: 294634 - DNA, 25 bp, Mus musculus
ggccggacacgcttgcgcacacggt

SEQ ID NO: 294635 - DNA, 25 bp, Mus musculus
aaggggccggacacgcttgcgcaca

SEQ ID NO: 294636 - DNA, 25 bp, Mus musculus
gggcaagtccgcctgaaggggaggc

SEQ ID NO: 294637 - DNA, 25 bp, Mus musculus
ctgggagcgggcaagtccgcctgaa

SEQ ID NO: 294638 - DNA, 25 bp, Mus musculus
agcactggcgcagtggctccgctcg

SEQ ID NO: 294639 - DNA, 25 bp, Mus musculus
agctccgatccgttaggcgccccga

SEQ ID NO: 294640 - DNA, 25 bp, Mus musculus
gggcgaggtaaatccgcgcgcagct

SEQ ID NO: 294641 - DNA, 25 bp, Mus musculus
cgtactcaccctcgcgggtggagcg

SEQ ID NO: 294642 - DNA, 25 bp, Mus musculus
cgcgtactcaccctcgcgggtggag

SEQ ID NO: 294643 - DNA, 25 bp, Mus musculus
tcgggaagccgacagccgcgaacgc

SEQ ID NO: 294644 - DNA, 25 bp, Mus musculus
ctacgcggctccacgctgcgggttg

SEQ ID NO: 294645 - DNA, 25 bp, Mus musculus
cacgctgcgggttgcagactcgtcc

SEQ ID NO: 294646 - DNA, 25 bp, Mus musculus
aagattcccagctgcctggttacga

SEQ ID NO: 294647 - DNA, 25 bp, Mus musculus
aggctgccgtgaagccctgagccgc

SEQ ID NO: 294648 - DNA, 25 bp, Mus musculus
agctccctgaggctgccgtgaagcc

SEQ ID NO: 294649 - DNA, 25 bp, Mus musculus
gaggctgaacccagacacccgagct

SEQ ID NO: 294650 - DNA, 25 bp, Mus musculus
ttgcagactcgtccgggaagtgccc

SEQ ID NO: 294651 - DNA, 25 bp, Mus musculus
ctgcctggttacgacccgaggctga

SEQ ID NO: 294652 - DNA, 25 bp, Mus musculus
agactcgtccgggaagtgcccgcgc

SEQ ID NO: 294653 - DNA, 25 bp, Mus musculus
tcgctcaagattcccagctgcctgg

SEQ ID NO: 294654 - DNA, 25 bp, Mus musculus
agtccgcgtcgctcaagattcccag

SEQ ID NO: 294655 - DNA, 25 bp, Mus musculus
tcgccagtccgcgtcgctcaagatt

SEQ ID NO: 294656 - DNA, 25 bp, Mus musculus
ctagccactctcctgcccacacccg

SEQ ID NO: 294657 - DNA, 25 bp, Mus musculus
gttacgacccgaggctgaacccaga

SEQ ID NO: 294658 - DNA, 25 bp, Mus musculus
ctgatctcctcaaactggtcggtta

SEQ ID NO: 294659 - DNA, 25 bp, Mus musculus
cgggcccgtcaacgcgttgattcgt

SEQ ID NO: 294660 - DNA, 25 bp, Mus musculus
cgacttccttgcctggatcacagta

SEQ ID NO: 294661 - DNA, 25 bp, Mus musculus
agtcactccgcactttccgttctga

SEQ ID NO: 294662 - DNA, 25 bp, Mus musculus
gattcgttccgtactgctgcaggta

SEQ ID NO: 294663 - DNA, 25 bp, Mus musculus
cgcgccacggggaatagacacgaac

SEQ ID NO: 294664 - DNA, 25 bp, Mus musculus
ccacgttctggcgtcctaatggact

SEQ ID NO: 294665 - DNA, 25 bp, Mus musculus
gcgctctgcgaaacatggccttaga

SEQ ID NO: 294666 - DNA, 25 bp, Mus musculus
gcccggcttctttcagcttgaggtg

SEQ ID NO: 294667 - DNA, 25 bp, Mus musculus
accatcttctcgaagggcgggcttg

SEQ ID NO: 294668 - DNA, 25 bp, Mus musculus
agccggcagtgctcttcaggctcca

SEQ ID NO: 294669 - DNA, 25 bp, Mus musculus
cacgctataggggagctatcgcctc

SEQ ID NO: 294670 - DNA, 25 bp, Mus musculus
tggtcaggcttgagtctacgtcatc

SEQ ID NO: 294671 - DNA, 25 bp, Mus musculus
gcttccgtcatgcttgacttcttca

SEQ ID NO: 294672 - DNA, 25 bp, Mus musculus
gaccagacaggtgccggtaaagact

SEQ ID NO: 294673 - DNA, 25 bp, Mus musculus
ttcgcgtcccgggagattgttcact

SEQ ID NO: 294674 - DNA, 25 bp, Mus musculus
cctggtgtccagcttttgagtatga

SEQ ID NO: 294675 - DNA, 25 bp, Mus musculus
cgtaggctacctgcccacgtgatca

SEQ ID NO: 294676 - DNA, 25 bp, Mus musculus
gatccgggccatgcgaaaaccgttg

SEQ ID NO: 294677 - DNA, 25 bp, Mus musculus
cagggcagtgctctccaagaatgga

SEQ ID NO: 294678 - DNA, 25 bp, Mus musculus
ccgccgaggacctggttgctaagag

SEQ ID NO: 294679 - DNA, 25 bp, Mus musculus
gaaagaacaccacacgtccctctga

SEQ ID NO: 294680 - DNA, 25 bp, Mus musculus
tccggaggacgagcggcaagaaaac

SEQ ID NO: 294681 - DNA, 25 bp, Mus musculus
tcatcttcgggaggactggctacaa

SEQ ID NO: 294682 - DNA, 25 bp, Mus musculus
tagcgctctcgaggtaggacgtatg

SEQ ID NO: 294683 - DNA, 25 bp, Mus musculus
agattgttcactcccggctcctggt

SEQ ID NO: 294684 - DNA, 25 bp, Mus musculus
gagcagccagcttcacttctaagga

SEQ ID NO: 294685 - DNA, 25 bp, Mus musculus
agcgagacacgcttgccagggcagt

SEQ ID NO: 294686 - DNA, 25 bp, Mus musculus
tgcgtcatcgcgcatgcggactggc

SEQ ID NO: 294687 - DNA, 25 bp, Mus musculus
acccgtcggcatgttccggttgctt

SEQ ID NO: 294688 - DNA, 25 bp, Mus musculus
tgttccggttgcttcgctggcgtct

SEQ ID NO: 294689 - DNA, 25 bp, Mus musculus
gctggcgtctgggtcgaaccctgct

SEQ ID NO: 294690 - DNA, 25 bp, Mus musculus
ggtgacctctgagccgcttctcgca

SEQ ID NO: 294691 - DNA, 25 bp, Mus musculus
aggccgagatcatccagctgctgaa

SEQ ID NO: 294692 - DNA, 25 bp, Mus musculus
cagctgctgaagcaagccaaggtga

SEQ ID NO: 294693 - DNA, 25 bp, Mus musculus
gccagccgtggcttagtggatctct

SEQ ID NO: 294694 - DNA, 25 bp, Mus musculus
tgacgtcagcatgcgtcatcgcgca

SEQ ID NO: 294695 - DNA, 25 bp, Mus musculus
acgagacggcgtgacgtcagcatgc

SEQ ID NO: 294696 - DNA, 25 bp, Mus musculus
gcggccatctcgctcaggagctctt

SEQ ID NO: 294697 - DNA, 25 bp, Mus musculus
gtacttctcgcgctgtctcgcacag

SEQ ID NO: 294698 - DNA, 25 bp, Mus musculus
gcaggccgtacttctcgcgctgtct

SEQ ID NO: 294699 - DNA, 25 bp, Mus musculus
cttagtggatctctgagggaggacc

SEQ ID NO: 294700 - DNA, 25 bp, Mus musculus
gtctttccactctcatatccttttt

SEQ ID NO: 294701 - DNA, 25 bp, Mus musculus
tataacatctcagccatagtttccc

SEQ ID NO: 294702 - DNA, 25 bp, Mus musculus
tatataacatctcagccatagtttc

SEQ ID NO: 294703 - DNA, 25 bp, Mus musculus
ctcatatataacatctcagccatag

SEQ ID NO: 294704 - DNA, 25 bp, Mus musculus
ttctctcatatataacatctcagcc

SEQ ID NO: 294705 - DNA, 25 bp, Mus musculus
ttttcttactcttctctcatatata

SEQ ID NO: 294706 - DNA, 25 bp, Mus musculus
atccttttttcttactcttctctca

SEQ ID NO: 294707 - DNA, 25 bp, Mus musculus
ttccactctcatatccttttttctt

SEQ ID NO: 294708 - DNA, 25 bp, Mus musculus
ctttccactctcatatccttttttc

SEQ ID NO: 294709 - DNA, 25 bp, Mus musculus
ctgtctttccactctcatatccttt

SEQ ID NO: 294710 - DNA, 25 bp, Mus musculus
tctcactcccaacagttctgtcttt

SEQ ID NO: 294711 - DNA, 25 bp, Mus musculus
ttctcactcccaacagttctgtctt

SEQ ID NO: 294712 - DNA, 25 bp, Mus musculus
atttacttctcactcccaacagttc

SEQ ID NO: 294713 - DNA, 25 bp, Mus musculus
tttatttacttctcactcccaacag

SEQ ID NO: 294714 - DNA, 25 bp, Mus musculus
ctcaccagcaatgattatagatggt

SEQ ID NO: 294715 - DNA, 25 bp, Mus musculus
tttgaggaacatccatgttgatttg

SEQ ID NO: 294716 - DNA, 25 bp, Mus musculus
ccatgttgatttgatttccactctg

SEQ ID NO: 294717 - DNA, 25 bp, Mus musculus
tctgaatgcactaatatatattctc

SEQ ID NO: 294718 - DNA, 25 bp, Mus musculus
caatgattatagatggtagtgagcc

SEQ ID NO: 294719 - DNA, 25 bp, Mus musculus
tggtagtgagccaccctatggtttc

SEQ ID NO: 294720 - DNA, 25 bp, Mus musculus
agtgagccaccctatggtttctggg

SEQ ID NO: 294721 - DNA, 25 bp, Mus musculus
cctctggaacaacaatcagtactct

SEQ ID NO: 294722 - DNA, 25 bp, Mus musculus
atcagtactcttaatcaccgagcca

SEQ ID NO: 294723 - DNA, 25 bp, Mus musculus
catcaattcttcttggccgccaact

SEQ ID NO: 294724 - DNA, 25 bp, Mus musculus
tacatgaatgtaagatattttgatc

SEQ ID NO: 294725 - DNA, 25 bp, Mus musculus
gatattttgatcatgttctcccagc

SEQ ID NO: 294726 - DNA, 25 bp, Mus musculus
attttgatcatgttctcccagcatc

SEQ ID NO: 294727 - DNA, 25 bp, Mus musculus
gatttccactctgaatgcactaata

SEQ ID NO: 294728 - DNA, 25 bp, Mus musculus
agcctcggtgtctcgctcaggcagt

SEQ ID NO: 294729 - DNA, 25 bp, Mus musculus
tgcagagagtgcaccggccaggaat

SEQ ID NO: 294730 - DNA, 25 bp, Mus musculus
acgctgaggtcttcttcggtgatct

SEQ ID NO: 294731 - DNA, 25 bp, Mus musculus
tgagtgcagatctgacgggagcctc

SEQ ID NO: 294732 - DNA, 25 bp, Mus musculus
tcttcttcggtgatctgccagggca

SEQ ID NO: 294733 - DNA, 25 bp, Mus musculus
gctcaggcagttcgtcctctccggg

SEQ ID NO: 294734 - DNA, 25 bp, Mus musculus
agcaccggagccttcggctgcactt

SEQ ID NO: 294735 - DNA, 25 bp, Mus musculus
tgcacttgcctgcagcggtgtcggt

SEQ ID NO: 294736 - DNA, 25 bp, Mus musculus
tgatctggcaggctgcgcgcgcacc

SEQ ID NO: 294737 - DNA, 25 bp, Mus musculus
aggtctcggggcttagccagccctg

SEQ ID NO: 294738 - DNA, 25 bp, Mus musculus
aggccagcttgcctgcagagcgctg

SEQ ID NO: 294739 - DNA, 25 bp, Mus musculus
cttgcctgcagagcgctggggtcta

SEQ ID NO: 294740 - DNA, 25 bp, Mus musculus
gtgtcagtgacacgctgaggtcttc

SEQ ID NO: 294741 - DNA, 25 bp, Mus musculus
caggaatgccgtctctccggggcga

SEQ ID NO: 294742 - DNA, 25 bp, Mus musculus
cctgctcagcggcagttacgtggct

SEQ ID NO: 294743 - DNA, 25 bp, Mus musculus
acgtggctgttcagccgctcgctct

SEQ ID NO: 294744 - DNA, 25 bp, Mus musculus
cccaaagtaacgacgccatagctgc

SEQ ID NO: 294745 - DNA, 25 bp, Mus musculus
aacgacgccatagctgcggtctccg

SEQ ID NO: 294746 - DNA, 25 bp, Mus musculus
gctcagtggccaatggtcaggctcc

SEQ ID NO: 294747 - DNA, 25 bp, Mus musculus
cagctgtgcgggacacccgcgagct

SEQ ID NO: 294748 - DNA, 25 bp, Mus musculus
ggacacccgcgagctttccgtttga

SEQ ID NO: 294749 - DNA, 25 bp, Mus musculus
agctttccgtttgaccagccggcca

SEQ ID NO: 294750 - DNA, 25 bp, Mus musculus
accagccggccatccgcacagcaga

SEQ ID NO: 294751 - DNA, 25 bp, Mus musculus
ggcacggaggcggtacacacaccgc

SEQ ID NO: 294752 - DNA, 25 bp, Mus musculus
gcggcagttacgtggctgttcagcc

SEQ ID NO: 294753 - DNA, 25 bp, Mus musculus
tcgtgcgggtatctctcccgacagc

SEQ ID NO: 294754 - DNA, 25 bp, Mus musculus
ctgcaggctctcgtgcgggtatctc

SEQ ID NO: 294755 - DNA, 25 bp, Mus musculus
ggcggtacacacaccgcgctgcagg

SEQ ID NO: 294756 - DNA, 25 bp, Mus musculus
gtgccctgcggtgacttcccagact

SEQ ID NO: 294757 - DNA, 25 bp, Mus musculus
ccagacgcctggcttgaagatcaag

SEQ ID NO: 294758 - DNA, 25 bp, Mus musculus
gcgacttccagacgcctggcttgaa

SEQ ID NO: 294759 - DNA, 25 bp, Mus musculus
cgcctggcttgaagatcaaggagga

SEQ ID NO: 294760 - DNA, 25 bp, Mus musculus
tacctgtcggctggagccagctcct

SEQ ID NO: 294761 - DNA, 25 bp, Mus musculus
agcgccatcctccaggcccggagaa

SEQ ID NO: 294762 - DNA, 25 bp, Mus musculus
cgcgctggagtgcatcctgtacaaa

SEQ ID NO: 294763 - DNA, 25 bp, Mus musculus
atcctgtacaaagcggagggcgcgc

SEQ ID NO: 294764 - DNA, 25 bp, Mus musculus
cacgcagggttcgttcgcgccactg

SEQ ID NO: 294765 - DNA, 25 bp, Mus musculus
ttcgttcgcgccactgccgtgcaag

SEQ ID NO: 294766 - DNA, 25 bp, Mus musculus
gcacccgccatctaccagccgctcg

SEQ ID NO: 294767 - DNA, 25 bp, Mus musculus
tgttccctctttacggcgacttcca

SEQ ID NO: 294768 - DNA, 25 bp, Mus musculus
actgcacctaccctctggaaggcga

SEQ ID NO: 294769 - DNA, 25 bp, Mus musculus
gcggtgacttcccagactgcaccta

SEQ ID NO: 294770 - DNA, 25 bp, Mus musculus
ctcgggctgcgagttaaagacgtcc

SEQ ID NO: 294771 - DNA, 25 bp, Mus musculus
tcccgagcaacgctgccgagattta

SEQ ID NO: 294772 - DNA, 25 bp, Mus musculus
gccgagatttaccttgaacgccaga

SEQ ID NO: 294773 - DNA, 25 bp, Mus musculus
ggaacgctgtttcccactcgcgcag

SEQ ID NO: 294774 - DNA, 25 bp, Mus musculus
cctccacgttcagcgtagtcgttaa

SEQ ID NO: 294775 - DNA, 25 bp, Mus musculus
tccgctgttcaagtttaaatcccga

SEQ ID NO: 294776 - DNA, 25 bp, Mus musculus
atcccgaagagagcccacgcctttg

SEQ ID NO: 294777 - DNA, 25 bp, Mus musculus
tggcgcaggcaaggtgtacattaca

SEQ ID NO: 294778 - DNA, 25 bp, Mus musculus
tggtccagaggccagacgttctcca

SEQ ID NO: 294779 - DNA, 25 bp, Mus musculus
gttctccacgtctacataacgattg

SEQ ID NO: 294780 - DNA, 25 bp, Mus musculus
tggtgcacattttctctaagccctc

SEQ ID NO: 294781 - DNA, 25 bp, Mus musculus
gaccgtggcgcggaatctgtttctt

SEQ ID NO: 294782 - DNA, 25 bp, Mus musculus
ggtctccactgcaacccgcgatagg

SEQ ID NO: 294783 - DNA, 25 bp, Mus musculus
acattacattgtgacctgcaggggc

SEQ ID NO: 294784 - DNA, 25 bp, Mus musculus
cgggcgcgcatctttttgaactcgc

SEQ ID NO: 294785 - DNA, 25 bp, Mus musculus
cagcagcgcggtacccgagcaggtc

SEQ ID NO: 294786 - DNA, 25 bp, Mus musculus
atctttttgaactcgccagggtggg

SEQ ID NO: 294787 - DNA, 25 bp, Mus musculus
catctttttgaactcgccagggtgg

SEQ ID NO: 294788 - DNA, 25 bp, Mus musculus
gcatctttttgaactcgccagggtg

SEQ ID NO: 294789 - DNA, 25 bp, Mus musculus
cgcatctttttgaactcgccagggt

SEQ ID NO: 294790 - DNA, 25 bp, Mus musculus
gcgcatctttttgaactcgccaggg

SEQ ID NO: 294791 - DNA, 25 bp, Mus musculus
acccgagcaggtccggtctgagtgc

SEQ ID NO: 294792 - DNA, 25 bp, Mus musculus
gtacccgagcaggtccggtctgagt

SEQ ID NO: 294793 - DNA, 25 bp, Mus musculus
cggtacccgagcaggtccggtctga

SEQ ID NO: 294794 - DNA, 25 bp, Mus musculus
cgcggtacccgagcaggtccggtct

SEQ ID NO: 294795 - DNA, 25 bp, Mus musculus
agcagcgcggtacccgagcaggtcc

SEQ ID NO: 294796 - DNA, 25 bp, Mus musculus
ggcgcgcatctttttgaactcgcca

SEQ ID NO: 294797 - DNA, 25 bp, Mus musculus
cgcgcatctttttgaactcgccagg

SEQ ID NO: 294798 - DNA, 25 bp, Mus musculus
cgctctggtccctttatgctggaga

SEQ ID NO: 294799 - DNA, 25 bp, Mus musculus
cctctgggtcctttgctggagttct

SEQ ID NO: 294800 - DNA, 25 bp, Mus musculus
ctggagttctttcccactgttcagg

SEQ ID NO: 294801 - DNA, 25 bp, Mus musculus
tcaccaagcagtcctttgccagctg

SEQ ID NO: 294802 - DNA, 25 bp, Mus musculus
gccagctgccacaggaatccaaatg

SEQ ID NO: 294803 - DNA, 25 bp, Mus musculus
gaatccaaatgcacagcttttcccg

SEQ ID NO: 294804 - DNA, 25 bp, Mus musculus
gccaaaacctgcttgcgtcatgctg

SEQ ID NO: 294805 - DNA, 25 bp, Mus musculus
tcatgctgtcgcaaaagcgcacacc

SEQ ID NO: 294806 - DNA, 25 bp, Mus musculus
agcgcacacctctgccgtaaagcgg

SEQ ID NO: 294807 - DNA, 25 bp, Mus musculus
gttgtcctatcccaggctctgcaga

SEQ ID NO: 294808 - DNA, 25 bp, Mus musculus
ccggagccttacaatcgctctggtc

SEQ ID NO: 294809 - DNA, 25 bp, Mus musculus
ctagagccgggaaagcatgcgaacc

SEQ ID NO: 294810 - DNA, 25 bp, Mus musculus
tgcagaggagcgacttcagtagacc

SEQ ID NO: 294811 - DNA, 25 bp, Mus musculus
gtccacactaaacaagccctctggg

SEQ ID NO: 294812 - DNA, 25 bp, Mus musculus
atgtgactgtcattcaccctgttga

SEQ ID NO: 294813 - DNA, 25 bp, Mus musculus
gctgtaccctggtcacatgagcaga

SEQ ID NO: 294814 - DNA, 25 bp, Mus musculus
agcgtgctctgaacagtttggttga

SEQ ID NO: 294815 - DNA, 25 bp, Mus musculus
agaaagcggcagtcgtaccacgtcc

SEQ ID NO: 294816 - DNA, 25 bp, Mus musculus
caccgaactgtgataggccggcgcg

SEQ ID NO: 294817 - DNA, 25 bp, Mus musculus
accctgttgagaggcgtgactatga

SEQ ID NO: 294818 - DNA, 25 bp, Mus musculus
gatcgagtctggattcctccttttg

SEQ ID NO: 294819 - DNA, 25 bp, Mus musculus
gtctgtcatttcgagggcgtggatc

SEQ ID NO: 294820 - DNA, 25 bp, Mus musculus
ggataacggttctgtctgtcatttc

SEQ ID NO: 294821 - DNA, 25 bp, Mus musculus
cgatgtatatttcaggggaccgaca

SEQ ID NO: 294822 - DNA, 25 bp, Mus musculus
attggctagcctccgtcgatgtata

SEQ ID NO: 294823 - DNA, 25 bp, Mus musculus
ggatgctcctcaggaacccactctg

SEQ ID NO: 294824 - DNA, 25 bp, Mus musculus
ccagagtttctcacctcacggatgc

SEQ ID NO: 294825 - DNA, 25 bp, Mus musculus
gtgactatgaagtcccaccgaactg

SEQ ID NO: 294826 - DNA, 25 bp, Mus musculus
ctctcccgcagcgtcggggcaattg

SEQ ID NO: 294827 - DNA, 25 bp, Mus musculus
cgcacctggggaaagcctgagtccc

SEQ ID NO: 294828 - DNA, 25 bp, Mus musculus
tgcgcccacactgggcatgcccggg

SEQ ID NO: 294829 - DNA, 25 bp, Mus musculus
gcacaaggtgcggacctcgctcact

SEQ ID NO: 294830 - DNA, 25 bp, Mus musculus
tgcggacctcgctcactgagggtca

SEQ ID NO: 294831 - DNA, 25 bp, Mus musculus
ctcactgagggtcaccggagctaaa

SEQ ID NO: 294832 - DNA, 25 bp, Mus musculus
gagggtcaccggagctaaagatagc

SEQ ID NO: 294833 - DNA, 25 bp, Mus musculus
gccactgccgcgcacaaggtgcgga

SEQ ID NO: 294834 - DNA, 25 bp, Mus musculus
cctggggaaagcctgagtcccgcgc

SEQ ID NO: 294835 - DNA, 25 bp, Mus musculus
ttccagaaccttaggaactagctcc

SEQ ID NO: 294836 - DNA, 25 bp, Mus musculus
ttaggaactagctccggcctgccag

SEQ ID NO: 294837 - DNA, 25 bp, Mus musculus
gcctgccagccctcgatgggccctg

SEQ ID NO: 294838 - DNA, 25 bp, Mus musculus
atttgcaagcggctcgagcccactg

SEQ ID NO: 294839 - DNA, 25 bp, Mus musculus
cgcccaggctgcgatttgcaagcgg

SEQ ID NO: 294840 - DNA, 25 bp, Mus musculus
cttgcagataaacaggcggcagatc

SEQ ID NO: 294841 - DNA, 25 bp, Mus musculus
ccttgcctgcgtcgcctaccactgt

SEQ ID NO: 294842 - DNA, 25 bp, Mus musculus
ggcggcagccacgattccttaagcc

SEQ ID NO: 294843 - DNA, 25 bp, Mus musculus
ttcctttggcggcagccacgattcc

SEQ ID NO: 294844 - DNA, 25 bp, Mus musculus
aatgtctttcctttggcggcagcca

SEQ ID NO: 294845 - DNA, 25 bp, Mus musculus
cgggaatgtctttcctttggcggca

SEQ ID NO: 294846 - DNA, 25 bp, Mus musculus
agatccgatgaggactccggagttc

SEQ ID NO: 294847 - DNA, 25 bp, Mus musculus
ccctggacgaagcaagcatcgcttg

SEQ ID NO: 294848 - DNA, 25 bp, Mus musculus
cattgccctggacgaagcaagcatc

SEQ ID NO: 294849 - DNA, 25 bp, Mus musculus
tgcgctcttcgacattgccctggac

SEQ ID NO: 294850 - DNA, 25 bp, Mus musculus
gtatgggccggcctgtgcgctcttc

SEQ ID NO: 294851 - DNA, 25 bp, Mus musculus
caagcatcgcttgcagataaacagg

SEQ ID NO: 294852 - DNA, 25 bp, Mus musculus
aggactccggagttcgggaatgtct

SEQ ID NO: 294853 - DNA, 25 bp, Mus musculus
acaggcggcagatccgatgaggact

SEQ ID NO: 294854 - DNA, 25 bp, Mus musculus
tcacgcgcctcggttctgcgagcga

SEQ ID NO: 294855 - DNA, 25 bp, Mus musculus
gagcgactcactcgctggccacggg

SEQ ID NO: 294856 - DNA, 25 bp, Mus musculus
ccgcctactgctgggtccgggctgt

SEQ ID NO: 294857 - DNA, 25 bp, Mus musculus
cacctcctcaggctgtggacccggc

SEQ ID NO: 294858 - DNA, 25 bp, Mus musculus
ggctgtggacccggctccttctttc

SEQ ID NO: 294859 - DNA, 25 bp, Mus musculus
ccgccgcagagattggaggtgcgcc

SEQ ID NO: 294860 - DNA, 25 bp, Mus musculus
agcccggttccctccgcgcagctcc

SEQ ID NO: 294861 - DNA, 25 bp, Mus musculus
ctcggttctgcgagcgactcactcg

SEQ ID NO: 294862 - DNA, 25 bp, Mus musculus
gaactcaggcgagagtttgtggcca

SEQ ID NO: 294863 - DNA, 25 bp, Mus musculus
agagtttgtggccagggctaagtaa

SEQ ID NO: 294864 - DNA, 25 bp, Mus musculus
tggccagggctaagtaatggcgcca

SEQ ID NO: 294865 - DNA, 25 bp, Mus musculus
ccagggttgagaggctcggcgccaa

SEQ ID NO: 294866 - DNA, 25 bp, Mus musculus
tcggcgccaaggttcggggcgccca

SEQ ID NO: 294867 - DNA, 25 bp, Mus musculus
ggatccctccagctcctctcggctc

SEQ ID NO: 294868 - DNA, 25 bp, Mus musculus
cttcccaaatggacagatacctcgg

SEQ ID NO: 294869 - DNA, 25 bp, Mus musculus
ttcacaccgagtgttcctcggcatg

SEQ ID NO: 294870 - DNA, 25 bp, Mus musculus
tggacagatacctcgggctgatgtc

SEQ ID NO: 294871 - DNA, 25 bp, Mus musculus
ggagcctccactcgtctagcctgaa

SEQ ID NO: 294872 - DNA, 25 bp, Mus musculus
ccctggcctggctgatccgaagctg

SEQ ID NO: 294873 - DNA, 25 bp, Mus musculus
ctggctgatccgaagctggcgccct

SEQ ID NO: 294874 - DNA, 25 bp, Mus musculus
cctactcaccgggagctggcggagt

SEQ ID NO: 294875 - DNA, 25 bp, Mus musculus
ttcaagttgtccctcgcactcatgc

SEQ ID NO: 294876 - DNA, 25 bp, Mus musculus
cggcgcgaggttagccttgcgaccc

SEQ ID NO: 294877 - DNA, 25 bp, Mus musculus
aaagagaaacctcagcccacgtggc

SEQ ID NO: 294878 - DNA, 25 bp, Mus musculus
ccacgtggctgggacgcacgttaat

SEQ ID NO: 294879 - DNA, 25 bp, Mus musculus
gggacgcacgttaatttcacaccga

SEQ ID NO: 294880 - DNA, 25 bp, Mus musculus
tcggcctcgcttcctgggtcgcgga

SEQ ID NO: 294881 - DNA, 25 bp, Mus musculus
tcgggctgatgtccgcccgcctaag

SEQ ID NO: 294882 - DNA, 25 bp, Mus musculus
cgcaagattcgctttagggggagaa

SEQ ID NO: 294883 - DNA, 25 bp, Mus musculus
tcaagcctcggaggtaatcggggcc

SEQ ID NO: 294884 - DNA, 25 bp, Mus musculus
ccggagtcaagcctcggaggtaatc

SEQ ID NO: 294885 - DNA, 25 bp, Mus musculus
aacgtcaccggctccggagtcaagc

SEQ ID NO: 294886 - DNA, 25 bp, Mus musculus
tcagttctaaaacaacgtcaccggc

SEQ ID NO: 294887 - DNA, 25 bp, Mus musculus
gatcccgagtgtcagttctaaaaca

SEQ ID NO: 294888 - DNA, 25 bp, Mus musculus
tttcaatatcctgatcccgagtgtc

SEQ ID NO: 294889 - DNA, 25 bp, Mus musculus
gacgcgcaattcttcctacatttca

SEQ ID NO: 294890 - DNA, 25 bp, Mus musculus
gctgtaagaacctggacgcgcaatt

SEQ ID NO: 294891 - DNA, 25 bp, Mus musculus
gcttttcctcccacacgctgtaaga

SEQ ID NO: 294892 - DNA, 25 bp, Mus musculus
ttcttgcctacataaaagcttttcc

SEQ ID NO: 294893 - DNA, 25 bp, Mus musculus
cggctggaatcaactacttttcttg

SEQ ID NO: 294894 - DNA, 25 bp, Mus musculus
gctcgctcaccacggctggaatcaa

SEQ ID NO: 294895 - DNA, 25 bp, Mus musculus
aagcagcagacgttcggggctcgct

SEQ ID NO: 294896 - DNA, 25 bp, Mus musculus
agctccagccacagggctcctggag

SEQ ID NO: 294897 - DNA, 25 bp, Mus musculus
acgcggccgccactgcttgactcca

SEQ ID NO: 294898 - DNA, 25 bp, Mus musculus
cttgactccagccacccggccgcag

SEQ ID NO: 294899 - DNA, 25 bp, Mus musculus
ttccaaccactcgaaggcagctcgg

SEQ ID NO: 294900 - DNA, 25 bp, Mus musculus
caaccactcgaaggcagctcggggc

SEQ ID NO: 294901 - DNA, 25 bp, Mus musculus
ctaggaagctccagccacagggctc

SEQ ID NO: 294902 - DNA, 25 bp, Mus musculus
gactccggccgacgcgctcgtccct

SEQ ID NO: 294903 - DNA, 25 bp, Mus musculus
aagctccgggtgcacggcttccagc

SEQ ID NO: 294904 - DNA, 25 bp, Mus musculus
cagcccgcccgctacaggctctagg

SEQ ID NO: 294905 - DNA, 25 bp, Mus musculus
tgcgctctgagtccgctgcccagct

SEQ ID NO: 294906 - DNA, 25 bp, Mus musculus
cagctgcttgcgaccgcaaacaatg

SEQ ID NO: 294907 - DNA, 25 bp, Mus musculus
gcttgcgaccgcaaacaatgcacgc

SEQ ID NO: 294908 - DNA, 25 bp, Mus musculus
gcaaacaatgcacgcccggccctgg

SEQ ID NO: 294909 - DNA, 25 bp, Mus musculus
ggctggtgacacctaggaagctcca

SEQ ID NO: 294910 - DNA, 25 bp, Mus musculus
cccaggcaggcccatggccagagcc

SEQ ID NO: 294911 - DNA, 25 bp, Mus musculus
gagcaagtctctgcgcgtcttggca

SEQ ID NO: 294912 - DNA, 25 bp, Mus musculus
aacatgaccggcctgccctctaggt

SEQ ID NO: 294913 - DNA, 25 bp, Mus musculus
agcgatttaaatgccccgccgactg

SEQ ID NO: 294914 - DNA, 25 bp, Mus musculus
cactcgaagctgagactatggaggg

SEQ ID NO: 294915 - DNA, 25 bp, Mus musculus
gccggcactcgaagctgagactatg

SEQ ID NO: 294916 - DNA, 25 bp, Mus musculus
gaccgcatcttgaggcgccggcact

SEQ ID NO: 294917 - DNA, 25 bp, Mus musculus
cgaaggaaccagacaccaggagcca

SEQ ID NO: 294918 - DNA, 25 bp, Mus musculus
gaaggcgcgaaggaaccagacacca

SEQ ID NO: 294919 - DNA, 25 bp, Mus musculus
tgtccctagagaaggcgcgaaggaa

SEQ ID NO: 294920 - DNA, 25 bp, Mus musculus
ctgctcaccagctgtccctagagaa

SEQ ID NO: 294921 - DNA, 25 bp, Mus musculus
gcccgagcaagtctctgcgcgtctt

SEQ ID NO: 294922 - DNA, 25 bp, Mus musculus
agtctctgcgcgtcttggcagcctc

SEQ ID NO: 294923 - DNA, 25 bp, Mus musculus
ccaggagccagggaggaccgcatct

SEQ ID NO: 294924 - DNA, 25 bp, Mus musculus
ggtccgtctcacacacagactcaaa

SEQ ID NO: 294925 - DNA, 25 bp, Mus musculus
cttccgcatttgtcacccgtcttgg

SEQ ID NO: 294926 - DNA, 25 bp, Mus musculus
cgagcgcggggattacgtcacttcc

SEQ ID NO: 294927 - DNA, 25 bp, Mus musculus
cgcttcctgccctttggttggggag

SEQ ID NO: 294928 - DNA, 25 bp, Mus musculus
actagagcgggttgttgaatccggc

SEQ ID NO: 294929 - DNA, 25 bp, Mus musculus
tgttgaatccggcagcgagcttaga

SEQ ID NO: 294930 - DNA, 25 bp, Mus musculus
cgagcttagactcggcctctctttg

SEQ ID NO: 294931 - DNA, 25 bp, Mus musculus
cctctctttggatactggcgctgta

SEQ ID NO: 294932 - DNA, 25 bp, Mus musculus
tggcgctgtagtcttctcaaatctc

SEQ ID NO: 294933 - DNA, 25 bp, Mus musculus
tctcgaagtgagaggtctgacatga

SEQ ID NO: 294934 - DNA, 25 bp, Mus musculus
tgacatgatgaacaggcgagtaagc

SEQ ID NO: 294935 - DNA, 25 bp, Mus musculus
agcgttcaccgctgaggaaatctcg

SEQ ID NO: 294936 - DNA, 25 bp, Mus musculus
cagactcaaactccgcgggctgcta

SEQ ID NO: 294937 - DNA, 25 bp, Mus musculus
cgggctgctacgcaaaggacaaaca

SEQ ID NO: 294938 - DNA, 25 bp, Mus musculus
tcgtgacactgcaatcgctccctaa

SEQ ID NO: 294939 - DNA, 25 bp, Mus musculus
tccgggctgtccaaatacgaatcgc

SEQ ID NO: 294940 - DNA, 25 bp, Mus musculus
tacgaatcgctgaactccagagtgg

SEQ ID NO: 294941 - DNA, 25 bp, Mus musculus
atcgtcgctcgctcgcaccgtgggg

SEQ ID NO: 294942 - DNA, 25 bp, Mus musculus
tggcgaggctacaagctgtagcgca

SEQ ID NO: 294943 - DNA, 25 bp, Mus musculus
caagctgtagcgcagaggagtcttc

SEQ ID NO: 294944 - DNA, 25 bp, Mus musculus
aggagtcttctgacagcgtcactcg

SEQ ID NO: 294945 - DNA, 25 bp, Mus musculus
gtcactcgctgaccctggggacagt

SEQ ID NO: 294946 - DNA, 25 bp, Mus musculus
cggtccctgcggtgcgcactttgct

SEQ ID NO: 294947 - DNA, 25 bp, Mus musculus
ccagcactgctgtgttgtagcctca

SEQ ID NO: 294948 - DNA, 25 bp, Mus musculus
gtgttgtagcctcacccgattccta

SEQ ID NO: 294949 - DNA, 25 bp, Mus musculus
cgtctgggcccactgagagcgccag

SEQ ID NO: 294950 - DNA, 25 bp, Mus musculus
atcgctccctaaaatccgggctgtc

SEQ ID NO: 294951 - DNA, 25 bp, Mus musculus
cactgagagcgccaggccctgtgcg

SEQ ID NO: 294952 - DNA, 25 bp, Mus musculus
agctcttcgcgctcactgcggactg

SEQ ID NO: 294953 - DNA, 25 bp, Mus musculus
ggttgcccacggtctgctgtccgcg

SEQ ID NO: 294954 - DNA, 25 bp, Mus musculus
tcagcccgccgctacccgcgctccc

SEQ ID NO: 294955 - DNA, 25 bp, Mus musculus
aggccgctcgcgcagctcttcgcgc

SEQ ID NO: 294956 - DNA, 25 bp, Mus musculus
tctccggggcttcccatccgctcag

SEQ ID NO: 294957 - DNA, 25 bp, Mus musculus
tcttcgcgctcactgcggactgcag

SEQ ID NO: 294958 - DNA, 25 bp, Mus musculus
cgctcactgcggactgcaggcgtgc

SEQ ID NO: 294959 - DNA, 25 bp, Mus musculus
caggcgtgcagagaatccgggagca

SEQ ID NO: 294960 - DNA, 25 bp, Mus musculus
agaatccgggagcaggacgagtcag

SEQ ID NO: 294961 - DNA, 25 bp, Mus musculus
aggtggagatcagtgcctgagcctc

SEQ ID NO: 294962 - DNA, 25 bp, Mus musculus
gatcagtgcctgagcctcctcgaga

SEQ ID NO: 294963 - DNA, 25 bp, Mus musculus
gcctcctcgagagccctctgcggtt

SEQ ID NO: 294964 - DNA, 25 bp, Mus musculus
tctgcggttgcccacggtctgctgt

SEQ ID NO: 294965 - DNA, 25 bp, Mus musculus
actggccggacgcacacgtcgccac

SEQ ID NO: 294966 - DNA, 25 bp, Mus musculus
cccgtatagtgactgagttctttgc

SEQ ID NO: 294967 - DNA, 25 bp, Mus musculus
accgaatgggcagtgctctccttgg

SEQ ID NO: 294968 - DNA, 25 bp, Mus musculus
cacgtaggatcccagtgcccggagg

SEQ ID NO: 294969 - DNA, 25 bp, Mus musculus
ggcgtggctctcacccgtatagtga

SEQ ID NO: 294970 - DNA, 25 bp, Mus musculus
tggctctcacccgtatagtgactga

SEQ ID NO: 294971 - DNA, 25 bp, Mus musculus
actgagttctttgcgctgcttctga

SEQ ID NO: 294972 - DNA, 25 bp, Mus musculus
ttgcgctgcttctgacgccggtaga

SEQ ID NO: 294973 - DNA, 25 bp, Mus musculus
ggcgcagaacccgagtagcagcgcc

SEQ ID NO: 294974 - DNA, 25 bp, Mus musculus
ggctgcgctgctgccagctaggaaa

SEQ ID NO: 294975 - DNA, 25 bp, Mus musculus
ctgccagctaggaaagcaggcttcc

SEQ ID NO: 294976 - DNA, 25 bp, Mus musculus
ttccgcagcaccttagccaaccgtt

SEQ ID NO: 294977 - DNA, 25 bp, Mus musculus
gcttagcgctgcgaggcaaccgaat

SEQ ID NO: 294978 - DNA, 25 bp, Mus musculus
gctaggaaagcaggcttccgcagca

SEQ ID NO: 294979 - DNA, 25 bp, Mus musculus
gtgctctccttggacccacctaagg

SEQ ID NO: 294980 - DNA, 25 bp, Mus musculus
cagcagacggtgagcacgcggatcc

SEQ ID NO: 294981 - DNA, 25 bp, Mus musculus
gagcacgcggatcctcccgtgcagt

SEQ ID NO: 294982 - DNA, 25 bp, Mus musculus
tcctcccgtgcagtcgccacacgcg

SEQ ID NO: 294983 - DNA, 25 bp, Mus musculus
cccattcttgtaccactcgatgttg

SEQ ID NO: 294984 - DNA, 25 bp, Mus musculus
taccactcgatgttgggtcgaggcc

SEQ ID NO: 294985 - DNA, 25 bp, Mus musculus
ccggccttctgcacgacagggcaga

SEQ ID NO: 294986 - DNA, 25 bp, Mus musculus
ttctgcacgacagggcagagtagcc

SEQ ID NO: 294987 - DNA, 25 bp, Mus musculus
acagggcagagtagccggctcgccc

SEQ ID NO: 294988 - DNA, 25 bp, Mus musculus
ccctggaaaccaccagatctggcgg

SEQ ID NO: 294989 - DNA, 25 bp, Mus musculus
cccgtgcacaatgcggggaaagaag

SEQ ID NO: 294990 - DNA, 25 bp, Mus musculus
aaaccaccagatctggcggctgctc

SEQ ID NO: 294991 - DNA, 25 bp, Mus musculus
agatctggcggctgctccacgatgc

SEQ ID NO: 294992 - DNA, 25 bp, Mus musculus
ggccgagagcgacgcccgtgcacaa

SEQ ID NO: 294993 - DNA, 25 bp, Mus musculus
cgacgcccgtgcacaatgcggggaa

SEQ ID NO: 294994 - DNA, 25 bp, Mus musculus
agggccgcgcgcaagttagagtccc

SEQ ID NO: 294995 - DNA, 25 bp, Mus musculus
atggccactaacagggccgcgcgca

SEQ ID NO: 294996 - DNA, 25 bp, Mus musculus
ctccaccaggatggccactaacagg

SEQ ID NO: 294997 - DNA, 25 bp, Mus musculus
taagggcttaatccgccttcctcca

SEQ ID NO: 294998 - DNA, 25 bp, Mus musculus
tcacgccgtaattaagggcttaatc

SEQ ID NO: 294999 - DNA, 25 bp, Mus musculus
tcggatcacgccgtaattaagggct

SEQ ID NO: 295000 - DNA, 25 bp, Mus musculus
tgccactcggatcacgccgtaatta

SEQ ID NO: 295001 - DNA, 25 bp, Mus musculus
cggaaagcaggtgccactcggatca

SEQ ID NO: 295002 - DNA, 25 bp, Mus musculus
gctgtcctccttcgctggttcttct

SEQ ID NO: 295003 - DNA, 25 bp, Mus musculus
tgtcctgcaggcgtgcctgggtacc

SEQ ID NO: 295004 - DNA, 25 bp, Mus musculus
gctgcggcagccacgatgccgctgt

SEQ ID NO: 295005 - DNA, 25 bp, Mus musculus
tccacagcctttgcgcgctgcggca

SEQ ID NO: 295006 - DNA, 25 bp, Mus musculus
ccagcccttgggtctgggacccgcg

SEQ ID NO: 295007 - DNA, 25 bp, Mus musculus
gcaggggcctcggagcccagccctt

SEQ ID NO: 295008 - DNA, 25 bp, Mus musculus
taatgagccgctaggcaactggccc

SEQ ID NO: 295009 - DNA, 25 bp, Mus musculus
ggcggctgagagaaagaattgcacc

SEQ ID NO: 295010 - DNA, 25 bp, Mus musculus
taaagaggccgtagagaggacaccc

SEQ ID NO: 295011 - DNA, 25 bp, Mus musculus
gcgctggctgctcacttagtgaaga

SEQ ID NO: 295012 - DNA, 25 bp, Mus musculus
aagaattgcacccacgcggcgcgag

SEQ ID NO: 295013 - DNA, 25 bp, Mus musculus
ctcaggctgacattgcgcggcaaca

SEQ ID NO: 295014 - DNA, 25 bp, Mus musculus
gcgcggcaacacacaatgggccatc

SEQ ID NO: 295015 - DNA, 25 bp, Mus musculus
cgctgtctttctagcgacccggtgg

SEQ ID NO: 295016 - DNA, 25 bp, Mus musculus
cccggcgggccaaagtaatgagccg

SEQ ID NO: 295017 - DNA, 25 bp, Mus musculus
ggcgtcgtaaatttggagcagatgc

SEQ ID NO: 295018 - DNA, 25 bp, Mus musculus
agcagatgcgtcctgacagtcagtc

SEQ ID NO: 295019 - DNA, 25 bp, Mus musculus
ccctcttctagtcagcagctgagtc

SEQ ID NO: 295020 - DNA, 25 bp, Mus musculus
cctcagctggggcagcacttggtaa

SEQ ID NO: 295021 - DNA, 25 bp, Mus musculus
cgctagacacgcgtctgtggcgctg

SEQ ID NO: 295022 - DNA, 25 bp, Mus musculus
gaccacgaatcttggtctccagccg

SEQ ID NO: 295023 - DNA, 25 bp, Mus musculus
gaagccgggcccttgtagtgatcgc

SEQ ID NO: 295024 - DNA, 25 bp, Mus musculus
cggaacgaatgaggtctccggagca

SEQ ID NO: 295025 - DNA, 25 bp, Mus musculus
ggtttggaactcagcggaacgaatg

SEQ ID NO: 295026 - DNA, 25 bp, Mus musculus
gcttcctccgggtttggaactcagc

SEQ ID NO: 295027 - DNA, 25 bp, Mus musculus
gctgtcctgacttggggcttcctcc

SEQ ID NO: 295028 - DNA, 25 bp, Mus musculus
ccggcatggaattggtgggtttctt

SEQ ID NO: 295029 - DNA, 25 bp, Mus musculus
ccacttacccggcatggaattggtg

SEQ ID NO: 295030 - DNA, 25 bp, Mus musculus
gcactctgacccacggaacgcagtt

SEQ ID NO: 295031 - DNA, 25 bp, Mus musculus
tggaagtttccacgctagaccacga

SEQ ID NO: 295032 - DNA, 25 bp, Mus musculus
tttccacgctagaccacgaatcttg

SEQ ID NO: 295033 - DNA, 25 bp, Mus musculus
ccttgtagtgatcgcgcacccggac

SEQ ID NO: 295034 - DNA, 25 bp, Mus musculus
cacggaacgcagtttcagccggttc

SEQ ID NO: 295035 - DNA, 25 bp, Mus musculus
gcagtatgggtggaagtttccacgc

SEQ ID NO: 295036 - DNA, 25 bp, Mus musculus
tgtggctcggagctgcccgccaact

SEQ ID NO: 295037 - DNA, 25 bp, Mus musculus
tcctgagtttgaagttgggcgtgtc

SEQ ID NO: 295038 - DNA, 25 bp, Mus musculus
cgccagcccgtaggtttcctgagtt

SEQ ID NO: 295039 - DNA, 25 bp, Mus musculus
gcgcttctttccagatggccgccag

SEQ ID NO: 295040 - DNA, 25 bp, Mus musculus
ggtatcccttgtgtctgctccgcct

SEQ ID NO: 295041 - DNA, 25 bp, Mus musculus
cgcatcaaggtaaccggccgctctg

SEQ ID NO: 295042 - DNA, 25 bp, Mus musculus
cggccatgtacgagcgcgtgtcccg

SEQ ID NO: 295043 - DNA, 25 bp, Mus musculus
cggcacggtattcggcagcaaggcc

SEQ ID NO: 295044 - DNA, 25 bp, Mus musculus
cgctcatcgctgtatggggcaacga

SEQ ID NO: 295045 - DNA, 25 bp, Mus musculus
cgccggcagagacgaacgcgctcat

SEQ ID NO: 295046 - DNA, 25 bp, Mus musculus
cgccgctcaaaattccgaagatgga

SEQ ID NO: 295047 - DNA, 25 bp, Mus musculus
aaaggcgaagatttgcgggctgctt

SEQ ID NO: 295048 - DNA, 25 bp, Mus musculus
ttcttgccaattgaggatgttcctg

SEQ ID NO: 295049 - DNA, 25 bp, Mus musculus
gcgacgggaacccatcgctgtccga

SEQ ID NO: 295050 - DNA, 25 bp, Mus musculus
tatcggcgggcgcaagtttcctgct

SEQ ID NO: 295051 - DNA, 25 bp, Mus musculus
tcttctgccttatcggcgggcgcaa

SEQ ID NO: 295052 - DNA, 25 bp, Mus musculus
gcgcaagtttcctgctccgactgca

SEQ ID NO: 295053 - DNA, 25 bp, Mus musculus
ccgggcttcattgtcttctgcctta

SEQ ID NO: 295054 - DNA, 25 bp, Mus musculus
taacgggccgggcttcattgtcttc

SEQ ID NO: 295055 - DNA, 25 bp, Mus musculus
tccgattggctttgctggcgcagat

SEQ ID NO: 295056 - DNA, 25 bp, Mus musculus
tttcctgctccgactgcagggatcc

SEQ ID NO: 295057 - DNA, 25 bp, Mus musculus
attggctttgctggcgcagatggtc

SEQ ID NO: 295058 - DNA, 25 bp, Mus musculus
cagccttccgattggctttgctggc

SEQ ID NO: 295059 - DNA, 25 bp, Mus musculus
tggctcggtagggttctaagtctcc

SEQ ID NO: 295060 - DNA, 25 bp, Mus musculus
catcctggctcggtagggttctaag

SEQ ID NO: 295061 - DNA, 25 bp, Mus musculus
tgccacgaaggacaaggagtagggg

SEQ ID NO: 295062 - DNA, 25 bp, Mus musculus
cagggatccgccaggaaatgtcagg

SEQ ID NO: 295063 - DNA, 25 bp, Mus musculus
cgactgcagggatccgccaggaaat

SEQ ID NO: 295064 - DNA, 25 bp, Mus musculus
ggcacttcccagtcgatttcccaag

SEQ ID NO: 295065 - DNA, 25 bp, Mus musculus
tcatcctggccttgctggacagcgg

SEQ ID NO: 295066 - DNA, 25 bp, Mus musculus
ccggtacttctcgttctggctcttc

SEQ ID NO: 295067 - DNA, 25 bp, Mus musculus
gctcttcctcgggagccttttcatc

SEQ ID NO: 295068 - DNA, 25 bp, Mus musculus
agcaccgccacgtgtaacttccggg

SEQ ID NO: 295069 - DNA, 25 bp, Mus musculus
cgggagccttttcatcctggccttg

SEQ ID NO: 295070 - DNA, 25 bp, Mus musculus
gcagccgcaggtacttcagccggta

SEQ ID NO: 295071 - DNA, 25 bp, Mus musculus
aggccgctcaacacgctcatgatca

SEQ ID NO: 295072 - DNA, 25 bp, Mus musculus
cacgctcatgatcagaccgggttct

SEQ ID NO: 295073 - DNA, 25 bp, Mus musculus
ccgcaggtacttcagccggtacttc

SEQ ID NO: 295074 - DNA, 25 bp, Mus musculus
agatggcgatcctcggcacttccca

SEQ ID NO: 295075 - DNA, 25 bp, Mus musculus
acccgccggaagttgcgcaaaagca

SEQ ID NO: 295076 - DNA, 25 bp, Mus musculus
ttgcgcaaaagcaccgccacgtgta

SEQ ID NO: 295077 - DNA, 25 bp, Mus musculus
cgcaggcagaaacagatggcgatcc

SEQ ID NO: 295078 - DNA, 25 bp, Mus musculus
ttgtaaccatgtcacctcctcgcgg

SEQ ID NO: 295079 - DNA, 25 bp, Mus musculus
ttccgggcgcagaggacccacgtgt

SEQ ID NO: 295080 - DNA, 25 bp, Mus musculus
gcgcagaggacccacgtgttccgac

SEQ ID NO: 295081 - DNA, 25 bp, Mus musculus
ggcgttgtaaccatgtcacctcctc

SEQ ID NO: 295082 - DNA, 25 bp, Mus musculus
ccagagccgggacgtccggagacaa

SEQ ID NO: 295083 - DNA, 25 bp, Mus musculus
atgtcacctcctcgcggccagagcc

SEQ ID NO: 295084 - DNA, 25 bp, Mus musculus
gtccggagacaagggtggcactcca

SEQ ID NO: 295085 - DNA, 25 bp, Mus musculus
gggtggcactccaggcttctctgcc

SEQ ID NO: 295086 - DNA, 25 bp, Mus musculus
gggcctgcggacatgcactgtgccc

SEQ ID NO: 295087 - DNA, 25 bp, Mus musculus
tgcactgtgcccctcggattgcgtc

SEQ ID NO: 295088 - DNA, 25 bp, Mus musculus
tcggattgcgtccataccaaccgct

SEQ ID NO: 295089 - DNA, 25 bp, Mus musculus
tgcgtccataccaaccgctccggtg

SEQ ID NO: 295090 - DNA, 25 bp, Mus musculus
gcctgggcgttgtaaccatgtcacc

SEQ ID NO: 295091 - DNA, 25 bp, Mus musculus
acaagggtggcactccaggcttctc

SEQ ID NO: 295092 - DNA, 25 bp, Mus musculus
ggaacacattctgtagcccagacga

SEQ ID NO: 295093 - DNA, 25 bp, Mus musculus
gtggatcgaagtcgctgtccctagg

SEQ ID NO: 295094 - DNA, 25 bp, Mus musculus
aatcaacactgactccttccacagg

SEQ ID NO: 295095 - DNA, 25 bp, Mus musculus
gcttcgcaggatccagagacgcgcc

SEQ ID NO: 295096 - DNA, 25 bp, Mus musculus
tgagatcgccagtcccaccgaagct

SEQ ID NO: 295097 - DNA, 25 bp, Mus musculus
tttccacgcctggtggacctcatgg

SEQ ID NO: 295098 - DNA, 25 bp, Mus musculus
cggggctgctgtgtacaagactgaa

SEQ ID NO: 295099 - DNA, 25 bp, Mus musculus
tacaagactgaagtggaacacattc

SEQ ID NO: 295100 - DNA, 25 bp, Mus musculus
ttctgtagcccagacgacggctgga

SEQ ID NO: 295101 - DNA, 25 bp, Mus musculus
cccgccgtagaagcccgagattctg

SEQ ID NO: 295102 - DNA, 25 bp, Mus musculus
ttctgagtctcggtggatcgaagtc

SEQ ID NO: 295103 - DNA, 25 bp, Mus musculus
gaggcgagaggtgaatcaacactga

SEQ ID NO: 295104 - DNA, 25 bp, Mus musculus
gtagaagcccgagattctgagtctc

SEQ ID NO: 295105 - DNA, 25 bp, Mus musculus
aatcgcccagcatcggggcttcgca

SEQ ID NO: 295106 - DNA, 25 bp, Mus musculus
tgctagcaacactgggccgaagatc

SEQ ID NO: 295107 - DNA, 25 bp, Mus musculus
gctgcagctcgaaggaacactcttc

SEQ ID NO: 295108 - DNA, 25 bp, Mus musculus
cggaagacctcgtctagagctatgt

SEQ ID NO: 295109 - DNA, 25 bp, Mus musculus
acctcgtctagagctatgtttgccg

SEQ ID NO: 295110 - DNA, 25 bp, Mus musculus
tctagagctatgtttgccgggccca

SEQ ID NO: 295111 - DNA, 25 bp, Mus musculus
agagctatgtttgccgggcccagaa

SEQ ID NO: 295112 - DNA, 25 bp, Mus musculus
cactgggccgaagatctagggcgca

SEQ ID NO: 295113 - DNA, 25 bp, Mus musculus
agcaagagcttgctagcaacactgg

SEQ ID NO: 295114 - DNA, 25 bp, Mus musculus
cgatgcatggaggtaagcaagagct

SEQ ID NO: 295115 - DNA, 25 bp, Mus musculus
aacgagcgatgcatggaggtaagca

SEQ ID NO: 295116 - DNA, 25 bp, Mus musculus
cacgctgatgaacgagcgatgcatg

SEQ ID NO: 295117 - DNA, 25 bp, Mus musculus
gaaacttgtccacgctgatgaacga

SEQ ID NO: 295118 - DNA, 25 bp, Mus musculus
aaggaacactcttcgcacaatcccg

SEQ ID NO: 295119 - DNA, 25 bp, Mus musculus
cgccaggctgcagctcgaaggaaca

SEQ ID NO: 295120 - DNA, 25 bp, Mus musculus
cgggcagctgcaggttctccatcat

SEQ ID NO: 295121 - DNA, 25 bp, Mus musculus
ttctccatcatgttggccgccggca

SEQ ID NO: 295122 - DNA, 25 bp, Mus musculus
cgctggagggcgtaatctcaatgga

SEQ ID NO: 295123 - DNA, 25 bp, Mus musculus
ctctcagtggtttgcgttcagccga

SEQ ID NO: 295124 - DNA, 25 bp, Mus musculus
cagggaactgcgcagcaaactctca

SEQ ID NO: 295125 - DNA, 25 bp, Mus musculus
tgtctttgccttagcgggactcggc

SEQ ID NO: 295126 - DNA, 25 bp, Mus musculus
gcttgctctctctgccggtgtcttt

SEQ ID NO: 295127 - DNA, 25 bp, Mus musculus
agtgacagtcgcctgccaagctttg

SEQ ID NO: 295128 - DNA, 25 bp, Mus musculus
aagaagcgcgcttcctcgctcagtc

SEQ ID NO: 295129 - DNA, 25 bp, Mus musculus
cctgcggtctagaactttaagaagc

SEQ ID NO: 295130 - DNA, 25 bp, Mus musculus
aggctctgctcctgcacgttcttca

SEQ ID NO: 295131 - DNA, 25 bp, Mus musculus
cgagcctgccagtagatcaagttcc

SEQ ID NO: 295132 - DNA, 25 bp, Mus musculus
caatggacggcagttgcaggaactc

SEQ ID NO: 295133 - DNA, 25 bp, Mus musculus
cacgttcttcatccggcgcatctta

SEQ ID NO: 295134 - DNA, 25 bp, Mus musculus
ccaatgcgttcgatccagtcggaga

SEQ ID NO: 295135 - DNA, 25 bp, Mus musculus
cagcgcgttggctcagtgtcgtccc

SEQ ID NO: 295136 - DNA, 25 bp, Mus musculus
tcccagagcgcagcgcgttggctca

SEQ ID NO: 295137 - DNA, 25 bp, Mus musculus
gcgcgatccctctttctatatatat

SEQ ID NO: 295138 - DNA, 25 bp, Mus musculus
gcagcgcgatccctctttctatata

SEQ ID NO: 295139 - DNA, 25 bp, Mus musculus
tggctaggtgttaccgcagcgcgat

SEQ ID NO: 295140 - DNA, 25 bp, Mus musculus
ttggactcccgaccaatgcgttcga

SEQ ID NO: 295141 - DNA, 25 bp, Mus musculus
cctgggacagctttggaagcgatga

SEQ ID NO: 295142 - DNA, 25 bp, Mus musculus
cgttcgatccagtcggagatacctc

SEQ ID NO: 295143 - DNA, 25 bp, Mus musculus
gatccagtcggagatacctccggta

SEQ ID NO: 295144 - DNA, 25 bp, Mus musculus
tcggagatacctccggtaggtgagc

SEQ ID NO: 295145 - DNA, 25 bp, Mus musculus
cctgcgccctgggacagctttggaa

SEQ ID NO: 295146 - DNA, 25 bp, Mus musculus
agctagtggagctcccctgccagcg

SEQ ID NO: 295147 - DNA, 25 bp, Mus musculus
gcagcctttggactcccgaccaatg

SEQ ID NO: 295148 - DNA, 25 bp, Mus musculus
gtcggccatcgaaatgtctcacaca

SEQ ID NO: 295149 - DNA, 25 bp, Mus musculus
ggaccgcccagtcggccatcgaaat

SEQ ID NO: 295150 - DNA, 25 bp, Mus musculus
atctggcagccgaggaccgcccagt

SEQ ID NO: 295151 - DNA, 25 bp, Mus musculus
gcagtcccggagtgcggcaaccact

SEQ ID NO: 295152 - DNA, 25 bp, Mus musculus
caccctgcgtttgggtggagacccg

SEQ ID NO: 295153 - DNA, 25 bp, Mus musculus
ctggggaaacgccaccctgcgtttg

SEQ ID NO: 295154 - DNA, 25 bp, Mus musculus
agccagggctagaagccctcggtgc

SEQ ID NO: 295155 - DNA, 25 bp, Mus musculus
agtgcggcaaccactcggtctctgc

SEQ ID NO: 295156 - DNA, 25 bp, Mus musculus
aaatgtctcacacatctgggccctc

SEQ ID NO: 295157 - DNA, 25 bp, Mus musculus
tttggatggccctggggaaacgcca

SEQ ID NO: 295158 - DNA, 25 bp, Mus musculus
ttcgtggagagggtacttttcaagc

SEQ ID NO: 295159 - DNA, 25 bp, Mus musculus
gagatcgggatgtccctcttcttcc

SEQ ID NO: 295160 - DNA, 25 bp, Mus musculus
tgctcacagaaggtccgtcggctgg

SEQ ID NO: 295161 - DNA, 25 bp, Mus musculus
cccgtgtccggagatcgggatgtcc

SEQ ID NO: 295162 - DNA, 25 bp, Mus musculus
gccgaacgctgctctcattggtccg

SEQ ID NO: 295163 - DNA, 25 bp, Mus musculus
cagctgcctggcatttgtgtggtct

SEQ ID NO: 295164 - DNA, 25 bp, Mus musculus
aggcgagcgttctggctcttcatta

SEQ ID NO: 295165 - DNA, 25 bp, Mus musculus
accggtctcattgaacgcggaggca

SEQ ID NO: 295166 - DNA, 25 bp, Mus musculus
cttcattagtgcagtcggcaagggc

SEQ ID NO: 295167 - DNA, 25 bp, Mus musculus
tctgagtgacagaggactcccgcgc

SEQ ID NO: 295168 - DNA, 25 bp, Mus musculus
ggcggcacccttctggaaggttcta

SEQ ID NO: 295169 - DNA, 25 bp, Mus musculus
tcaggccgtcaccaccagggacaga

SEQ ID NO: 295170 - DNA, 25 bp, Mus musculus
ccagggacagagactgcagcagatc

SEQ ID NO: 295171 - DNA, 25 bp, Mus musculus
ggcgccctggtctttttatcctgtc

SEQ ID NO: 295172 - DNA, 25 bp, Mus musculus
aaatataaggcttctgcccggcgcc

SEQ ID NO: 295173 - DNA, 25 bp, Mus musculus
gcagctgggcctacacacaaggtga

SEQ ID NO: 295174 - DNA, 25 bp, Mus musculus
gtgaaagttccagaacgccgcggtc

SEQ ID NO: 295175 - DNA, 25 bp, Mus musculus
gtcgtccattggctaagaagctatg

SEQ ID NO: 295176 - DNA, 25 bp, Mus musculus
cctcgaagctgagccgttgccgctt

SEQ ID NO: 295177 - DNA, 25 bp, Mus musculus
gatgtctgttttttcaccctgaggg

SEQ ID NO: 295178 - DNA, 25 bp, Mus musculus
aacggtcttggtagctggcaagccg

SEQ ID NO: 295179 - DNA, 25 bp, Mus musculus
tcgctcctcgggtcactaaattctc

SEQ ID NO: 295180 - DNA, 25 bp, Mus musculus
tgattagaacaaccggccttcgctc

SEQ ID NO: 295181 - DNA, 25 bp, Mus musculus
ctggacaacgctttgcgcgcctttc

SEQ ID NO: 295182 - DNA, 25 bp, Mus musculus
gcgcctttccctccgagatcaataa

SEQ ID NO: 295183 - DNA, 25 bp, Mus musculus
gttgccgcttctggaacgtctccca

SEQ ID NO: 295184 - DNA, 25 bp, Mus musculus
tccctccggggaactgattagaaca

SEQ ID NO: 295185 - DNA, 25 bp, Mus musculus
acccaactaagagaccctggccgtg

SEQ ID NO: 295186 - DNA, 25 bp, Mus musculus
cgagcgctgagggtctaacgagacc

SEQ ID NO: 295187 - DNA, 25 bp, Mus musculus
gcgcctgcacctgcgcttgcaggta

SEQ ID NO: 295188 - DNA, 25 bp, Mus musculus
aacacgcgagctagggacccaacta

SEQ ID NO: 295189 - DNA, 25 bp, Mus musculus
ctcacaaggtgtccagcagcagctt

SEQ ID NO: 295190 - DNA, 25 bp, Mus musculus
cgctaataggcaagggaaagacgcc

SEQ ID NO: 295191 - DNA, 25 bp, Mus musculus
gagcggagaattcggcgtctatttc

SEQ ID NO: 295192 - DNA, 25 bp, Mus musculus
ggatttctgagaaaaacgccttcca

SEQ ID NO: 295193 - DNA, 25 bp, Mus musculus
aacgccttccagtttctgtccttgg

SEQ ID NO: 295194 - DNA, 25 bp, Mus musculus
agtttctgtccttgggcagctttgc

SEQ ID NO: 295195 - DNA, 25 bp, Mus musculus
cgaggttagcctgggcgtgatcctc

SEQ ID NO: 295196 - DNA, 25 bp, Mus musculus
taggcaagggaaagacgccagcgcc

SEQ ID NO: 295197 - DNA, 25 bp, Mus musculus
gggcgtgatcctccgccgcttctgt

SEQ ID NO: 295198 - DNA, 25 bp, Mus musculus
caggatggccggatttctgagaaaa

SEQ ID NO: 295199 - DNA, 25 bp, Mus musculus
ctaaagaggcaaatgcaggatggcc

SEQ ID NO: 295200 - DNA, 25 bp, Mus musculus
ggttcctatagcgacctaaagaggc

SEQ ID NO: 295201 - DNA, 25 bp, Mus musculus
ctttacttcttaggttcctatagcg

SEQ ID NO: 295202 - DNA, 25 bp, Mus musculus
ttctgtcctggggagagccataggc

SEQ ID NO: 295203 - DNA, 25 bp, Mus musculus
ggcagctttgctcgaggttagcctg

SEQ ID NO: 295204 - DNA, 25 bp, Mus musculus
tgtctctgtagggatgccggtcccg

SEQ ID NO: 295205 - DNA, 25 bp, Mus musculus
agttgcccgggaagcactgccgccg

SEQ ID NO: 295206 - DNA, 25 bp, Mus musculus
ctctgtccgtcagactgctcttgtc

SEQ ID NO: 295207 - DNA, 25 bp, Mus musculus
gaatgcgggctctgtccgtcagact

SEQ ID NO: 295208 - DNA, 25 bp, Mus musculus
gaggatggaggatgcttcctccgaa

SEQ ID NO: 295209 - DNA, 25 bp, Mus musculus
gcgctgttcccgcacccgcagcacg

SEQ ID NO: 295210 - DNA, 25 bp, Mus musculus
cgcaaagctcgcacggtgttttctg

SEQ ID NO: 295211 - DNA, 25 bp, Mus musculus
gcctggagaaaaggttcgaaatcca

SEQ ID NO: 295212 - DNA, 25 bp, Mus musculus
tgttttctgactcgcagctctccgg

SEQ ID NO: 295213 - DNA, 25 bp, Mus musculus
ctcgcacggtgttttctgactcgca

SEQ ID NO: 295214 - DNA, 25 bp, Mus musculus
gaaatccagcgctacctgtcgacgc

SEQ ID NO: 295215 - DNA, 25 bp, Mus musculus
ggttcgaaatccagcgctacctgtc

SEQ ID NO: 295216 - DNA, 25 bp, Mus musculus
tgcttcctccgaatgcgggctctgt

SEQ ID NO: 295217 - DNA, 25 bp, Mus musculus
actgctcttgtctctgtagggatgc

SEQ ID NO: 295218 - DNA, 25 bp, Mus musculus
cgaccatggcggtaggaccgaattc

SEQ ID NO: 295219 - DNA, 25 bp, Mus musculus
tgagcccgaggacgaagtggacatt

SEQ ID NO: 295220 - DNA, 25 bp, Mus musculus
ccagacctttcagtcaccgtttgtg

SEQ ID NO: 295221 - DNA, 25 bp, Mus musculus
ggtacaattcaaccgagcgcctcca

SEQ ID NO: 295222 - DNA, 25 bp, Mus musculus
gtgccttcgtgcttactgagcccga

SEQ ID NO: 295223 - DNA, 25 bp, Mus musculus
tcgcggagactccagactgctcctg

SEQ ID NO: 295224 - DNA, 25 bp, Mus musculus
gaaaggcaagcgcagtccacttagc

SEQ ID NO: 295225 - DNA, 25 bp, Mus musculus
ttagcaacttgcagccgccagcgac

SEQ ID NO: 295226 - DNA, 25 bp, Mus musculus
tccctgtcggggatcactaatgtga

SEQ ID NO: 295227 - DNA, 25 bp, Mus musculus
cactaatgtgatcgctggttcccgc

SEQ ID NO: 295228 - DNA, 25 bp, Mus musculus
acctgccgagtgtcgctgctcaaac

SEQ ID NO: 295229 - DNA, 25 bp, Mus musculus
gctcaaactagcagctgggctcacg

SEQ ID NO: 295230 - DNA, 25 bp, Mus musculus
gctgggctcacggtggtacaattca

SEQ ID NO: 295231 - DNA, 25 bp, Mus musculus
attcaattcagtagacagcgagccc

SEQ ID NO: 295232 - DNA, 25 bp, Mus musculus
gcagccctgtctgggcgcggtcctt

SEQ ID NO: 295233 - DNA, 25 bp, Mus musculus
tcacctgccggcaccgctgggcagc

SEQ ID NO: 295234 - DNA, 25 bp, Mus musculus
gcgctcctcagctcagcggcggcgc

SEQ ID NO: 295235 - DNA, 25 bp, Mus musculus
cccagcgctcctcagctcagcggcg

SEQ ID NO: 295236 - DNA, 25 bp, Mus musculus
gcgggcccagcgctcctcagctcag

SEQ ID NO: 295237 - DNA, 25 bp, Mus musculus
cggtggccaacaccgctcgctcgct

SEQ ID NO: 295238 - DNA, 25 bp, Mus musculus
gagacggtggccaacaccgctcgct

SEQ ID NO: 295239 - DNA, 25 bp, Mus musculus
aaccgcccgtcacctgccggcaccg

SEQ ID NO: 295240 - DNA, 25 bp, Mus musculus
gggaaccgcccgtcacctgccggca

SEQ ID NO: 295241 - DNA, 25 bp, Mus musculus
agttctccgtacagcccgcccgcgc

SEQ ID NO: 295242 - DNA, 25 bp, Mus musculus
cctgagttctccgtacagcccgccc

SEQ ID NO: 295243 - DNA, 25 bp, Mus musculus
tgtgccggctccctcgcgcccaccc

SEQ ID NO: 295244 - DNA, 25 bp, Mus musculus
cctcccagaccacagactgtgccgg

SEQ ID NO: 295245 - DNA, 25 bp, Mus musculus
accacagactgtgccggctccctcg

SEQ ID NO: 295246 - DNA, 25 bp, Mus musculus
gaaagcccatggacaggagcacgtc

SEQ ID NO: 295247 - DNA, 25 bp, Mus musculus
caccactctggatggataagggatc

SEQ ID NO: 295248 - DNA, 25 bp, Mus musculus
gagtcccagcgttgcgccgctgcag

SEQ ID NO: 295249 - DNA, 25 bp, Mus musculus
gtgctcccagatctccgggcggaga

SEQ ID NO: 295250 - DNA, 25 bp, Mus musculus
acatccggagctggaagcctctgca

SEQ ID NO: 295251 - DNA, 25 bp, Mus musculus
agccgggagctcaagagcgacatcc

SEQ ID NO: 295252 - DNA, 25 bp, Mus musculus
tcccgggcttaatataagagacctc

SEQ ID NO: 295253 - DNA, 25 bp, Mus musculus
cctaagcaggtttcaggcagcgcca

SEQ ID NO: 295254 - DNA, 25 bp, Mus musculus
agactgacgcttcctggagaggcca

SEQ ID NO: 295255 - DNA, 25 bp, Mus musculus
cagcgccgacccatgcttgactgtg

SEQ ID NO: 295256 - DNA, 25 bp, Mus musculus
acccatgcttgactgtgcccgggcg

SEQ ID NO: 295257 - DNA, 25 bp, Mus musculus
cggggtgactttgctgtacagctcc

SEQ ID NO: 295258 - DNA, 25 bp, Mus musculus
taagggatccaagtcctccaaggga

SEQ ID NO: 295259 - DNA, 25 bp, Mus musculus
gagctaccagcgaaacccgggattc

SEQ ID NO: 295260 - DNA, 25 bp, Mus musculus
gcatggttttctatcctgccgggga

SEQ ID NO: 295261 - DNA, 25 bp, Mus musculus
aggtggcacctgacccgctagaact

SEQ ID NO: 295262 - DNA, 25 bp, Mus musculus
cctgtttgctccttctctgtctcga

SEQ ID NO: 295263 - DNA, 25 bp, Mus musculus
tctgtctcgagcatggttttctatc

SEQ ID NO: 295264 - DNA, 25 bp, Mus musculus
tggcgcctgtttgctccttctctgt

SEQ ID NO: 295265 - DNA, 25 bp, Mus musculus
ggcagaggtggcacctgacccgcta

SEQ ID NO: 295266 - DNA, 25 bp, Mus musculus
cgcacgcaggacggtgggtcacctc

SEQ ID NO: 295267 - DNA, 25 bp, Mus musculus
tcggcaagagtcaaggcgcacgcag

SEQ ID NO: 295268 - DNA, 25 bp, Mus musculus
ccctcggcaagagtcaaggcgcacg

SEQ ID NO: 295269 - DNA, 25 bp, Mus musculus
tcactgctgtggctgttactcccct

SEQ ID NO: 295270 - DNA, 25 bp, Mus musculus
agaactccgatgtcactgctgtggc

SEQ ID NO: 295271 - DNA, 25 bp, Mus musculus
acccgctagaactccgatgtcactg

SEQ ID NO: 295272 - DNA, 25 bp, Mus musculus
acctgacccgctagaactccgatgt

SEQ ID NO: 295273 - DNA, 25 bp, Mus musculus
ttgctccttctctgtctcgagcatg

SEQ ID NO: 295274 - DNA, 25 bp, Mus musculus
acctgggcctagagaggctggaccc

SEQ ID NO: 295275 - DNA, 25 bp, Mus musculus
catgcgcatcgctccgctttgtagc

SEQ ID NO: 295276 - DNA, 25 bp, Mus musculus
ctttgtagcgccacggggcccgact

SEQ ID NO: 295277 - DNA, 25 bp, Mus musculus
gaacatggccgcttccggtctcgga

SEQ ID NO: 295278 - DNA, 25 bp, Mus musculus
ttccggtctcggagcctgcctggcg

SEQ ID NO: 295279 - DNA, 25 bp, Mus musculus
gggcgcagcggcctccagtttctcg

SEQ ID NO: 295280 - DNA, 25 bp, Mus musculus
ttctcgcgccatggagaagagctcc

SEQ ID NO: 295281 - DNA, 25 bp, Mus musculus
cgggaagagagactgaggctgctcc

SEQ ID NO: 295282 - DNA, 25 bp, Mus musculus
caagtgtagatggagacgccagggc

SEQ ID NO: 295283 - DNA, 25 bp, Mus musculus
cccagcgaggactcactgtccaggt

SEQ ID NO: 295284 - DNA, 25 bp, Mus musculus
aagagctccagctgcgagagtctcg

SEQ ID NO: 295285 - DNA, 25 bp, Mus musculus
caaggctgcccagcgaggactcact

SEQ ID NO: 295286 - DNA, 25 bp, Mus musculus
ctccagctgcgagagtctcggcgcg

SEQ ID NO: 295287 - DNA, 25 bp, Mus musculus
ggcctccagtttctcgcgccatgga

SEQ ID NO: 295288 - DNA, 25 bp, Mus musculus
tcctaatgcaattaccgctcggtgc

SEQ ID NO: 295289 - DNA, 25 bp, Mus musculus
tcccggtgccatcctcgtgctggat

SEQ ID NO: 295290 - DNA, 25 bp, Mus musculus
atcctcgtgctggatgcgagccatc

SEQ ID NO: 295291 - DNA, 25 bp, Mus musculus
tgcgagccatcctctgggctaatga

SEQ ID NO: 295292 - DNA, 25 bp, Mus musculus
tcctctgggctaatgagctaggcgc

SEQ ID NO: 295293 - DNA, 25 bp, Mus musculus
tgacagctgtatacagtcccgggcc

SEQ ID NO: 295294 - DNA, 25 bp, Mus musculus
cgcgggagataactaatcctaatgc

SEQ ID NO: 295295 - DNA, 25 bp, Mus musculus
tggagacgttttgacagctgtatac

SEQ ID NO: 295296 - DNA, 25 bp, Mus musculus
attaccgctcggtgcagcactgata

SEQ ID NO: 295297 - DNA, 25 bp, Mus musculus
tcggtgcagcactgataggtccact

SEQ ID NO: 295298 - DNA, 25 bp, Mus musculus
ataggtccactgtgctccccgcgtg

SEQ ID NO: 295299 - DNA, 25 bp, Mus musculus
gctggagcagctgggcctcagcctc

SEQ ID NO: 295300 - DNA, 25 bp, Mus musculus
cctcagcctcctgttggagacgttt

SEQ ID NO: 295301 - DNA, 25 bp, Mus musculus
agctaggcgcgggagataactaatc

SEQ ID NO: 295302 - DNA, 25 bp, Mus musculus
gctcggcgccgtgccgtacacgtgt

SEQ ID NO: 295303 - DNA, 25 bp, Mus musculus
ccgtgcgttcctagccggagatcgc

SEQ ID NO: 295304 - DNA, 25 bp, Mus musculus
ggccaccgtgcaatctctgcgtcca

SEQ ID NO: 295305 - DNA, 25 bp, Mus musculus
gcgaataggaaagggagtctcgact

SEQ ID NO: 295306 - DNA, 25 bp, Mus musculus
agggagtctcgactccctcctgctg

SEQ ID NO: 295307 - DNA, 25 bp, Mus musculus
tcctgctgctccgtgtcgccatgtt

SEQ ID NO: 295308 - DNA, 25 bp, Mus musculus
tgttcgggcgaacgctcccgcaggt

SEQ ID NO: 295309 - DNA, 25 bp, Mus musculus
tccgccgggtcctgagtggcttcct

SEQ ID NO: 295310 - DNA, 25 bp, Mus musculus
tgccgtacacgtgtgagctcgcagc

SEQ ID NO: 295311 - DNA, 25 bp, Mus musculus
acacgtgtgagctcgcagcgcgtcc

SEQ ID NO: 295312 - DNA, 25 bp, Mus musculus
ccctccctaccgcagtgaagagttg

SEQ ID NO: 295313 - DNA, 25 bp, Mus musculus
gcgtgggcgccgtgctctatttccc

SEQ ID NO: 295314 - DNA, 25 bp, Mus musculus
tgtcgccatgttcgggcgaacgctc

SEQ ID NO: 295315 - DNA, 25 bp, Mus musculus
gggtcgccctgcaccacgaagaagc

SEQ ID NO: 295316 - DNA, 25 bp, Mus musculus
cccactcgcggctgtccagctgcca

SEQ ID NO: 295317 - DNA, 25 bp, Mus musculus
cgctttagcagggacggccacacgg

SEQ ID NO: 295318 - DNA, 25 bp, Mus musculus
agctgccagcgcacggaacctacct

SEQ ID NO: 295319 - DNA, 25 bp, Mus musculus
cctgccaggcccagcagctccgtca

SEQ ID NO: 295320 - DNA, 25 bp, Mus musculus
gtcagccgcggctttacagccagcg

SEQ ID NO: 295321 - DNA, 25 bp, Mus musculus
ttacagccagcggagagtacgagcc

SEQ ID NO: 295322 - DNA, 25 bp, Mus musculus
agcgcccgagacaccgcccgctcag

SEQ ID NO: 295323 - DNA, 25 bp, Mus musculus
cagcagccggcgcaataagctgatg

SEQ ID NO: 295324 - DNA, 25 bp, Mus musculus
gccggcgcaataagctgatgtgacg

SEQ ID NO: 295325 - DNA, 25 bp, Mus musculus
ataagctgatgtgacggcggatcgc

SEQ ID NO: 295326 - DNA, 25 bp, Mus musculus
aaccaggtccagcactctgccggga

SEQ ID NO: 295327 - DNA, 25 bp, Mus musculus
ggtccagcactctgccgggactatc

SEQ ID NO: 295328 - DNA, 25 bp, Mus musculus
cgggactatccaggcgcttcatgat

SEQ ID NO: 295329 - DNA, 25 bp, Mus musculus
ctatccaggcgcttcatgatgctgc

SEQ ID NO: 295330 - DNA, 25 bp, Mus musculus
aattcaccctgtggcgtaaagccgc

SEQ ID NO: 295331 - DNA, 25 bp, Mus musculus
tttgactcctcaccaatcagcgctg

SEQ ID NO: 295332 - DNA, 25 bp, Mus musculus
tcagcgtcggcctcatctttgactc

SEQ ID NO: 295333 - DNA, 25 bp, Mus musculus
acggacgcttaaccgatggagagtc

SEQ ID NO: 295334 - DNA, 25 bp, Mus musculus
tgtctacggcgtttgaatcatggga

SEQ ID NO: 295335 - DNA, 25 bp, Mus musculus
ctgggcggtttgtgctttcatcaca

SEQ ID NO: 295336 - DNA, 25 bp, Mus musculus
agctcagtgacgagaggctttgtcc

SEQ ID NO: 295337 - DNA, 25 bp, Mus musculus
ggcgcaggaagacaacagctacgta

SEQ ID NO: 295338 - DNA, 25 bp, Mus musculus
cggaactactttcggtggcgcagga

SEQ ID NO: 295339 - DNA, 25 bp, Mus musculus
ggagctcggcaaaaacgcctaattg

SEQ ID NO: 295340 - DNA, 25 bp, Mus musculus
cgccgggaatacagtgtctctcgtt

SEQ ID NO: 295341 - DNA, 25 bp, Mus musculus
gagggccctttaacttggattcatc

SEQ ID NO: 295342 - DNA, 25 bp, Mus musculus
tttccagagctttcgagggagggcc

SEQ ID NO: 295343 - DNA, 25 bp, Mus musculus
ccgcacatgcgcactcggttactta

SEQ ID NO: 295344 - DNA, 25 bp, Mus musculus
cccttgtcaagtcggtttgccaaat

SEQ ID NO: 295345 - DNA, 25 bp, Mus musculus
tgccaaattgcttttcgatcatgac

SEQ ID NO: 295346 - DNA, 25 bp, Mus musculus
cccgctccgcaggaatgcgggtata

SEQ ID NO: 295347 - DNA, 25 bp, Mus musculus
caggaatgcgggtataccttcctcc

SEQ ID NO: 295348 - DNA, 25 bp, Mus musculus
ccgctccgcacgaatgcgaatgcgg

SEQ ID NO: 295349 - DNA, 25 bp, Mus musculus
tgcgaatgcgggtataccttcctcc

SEQ ID NO: 295350 - DNA, 25 bp, Mus musculus
tataccttcctccatgtcgcggact

SEQ ID NO: 295351 - DNA, 25 bp, Mus musculus
cccgctccgcatggatatggctata

SEQ ID NO: 295352 - DNA, 25 bp, Mus musculus
gatatggctataccttcctaacagt

SEQ ID NO: 295353 - DNA, 25 bp, Mus musculus
tcctaacagtatgttgcacgtcaca

SEQ ID NO: 295354 - DNA, 25 bp, Mus musculus
gcacgtcacactgcgaagatgcacg

SEQ ID NO: 295355 - DNA, 25 bp, Mus musculus
cgaagatgcacggtaaacgagagcg

SEQ ID NO: 295356 - DNA, 25 bp, Mus musculus
ccacgtttaacgctgaatcattttc

SEQ ID NO: 295357 - DNA, 25 bp, Mus musculus
tcgatcatgactcttcctccacgtg

SEQ ID NO: 295358 - DNA, 25 bp, Mus musculus
ggagacgagcctctcagagcgagct

SEQ ID NO: 295359 - DNA, 25 bp, Mus musculus
agcagcggccgggctacactcaccc

SEQ ID NO: 295360 - DNA, 25 bp, Mus musculus
acgagcctctcagagcgagctgcgg

SEQ ID NO: 295361 - DNA, 25 bp, Mus musculus
tcggcttccggcctgctccaggccg

SEQ ID NO: 295362 - DNA, 25 bp, Mus musculus
agcccagtgtcctgcattgacccgg

SEQ ID NO: 295363 - DNA, 25 bp, Mus musculus
cccagtgtcctgcattgacccggaa

SEQ ID NO: 295364 - DNA, 25 bp, Mus musculus
cagtgtcctgcattgacccggaagc

SEQ ID NO: 295365 - DNA, 25 bp, Mus musculus
gtgtcctgcattgacccggaagcag

SEQ ID NO: 295366 - DNA, 25 bp, Mus musculus
tgacccggaagcagctttccgggga

SEQ ID NO: 295367 - DNA, 25 bp, Mus musculus
cgcacgtgtcacgtccgctgcgtga

SEQ ID NO: 295368 - DNA, 25 bp, Mus musculus
cacgtgtcacgtccgctgcgtgatt

SEQ ID NO: 295369 - DNA, 25 bp, Mus musculus
tgtcacgtccgctgcgtgattggga

SEQ ID NO: 295370 - DNA, 25 bp, Mus musculus
gaggggccagaggagacgagcctct

SEQ ID NO: 295371 - DNA, 25 bp, Mus musculus
agacgagcctctcagagcgagctgc

SEQ ID NO: 295372 - DNA, 25 bp, Mus musculus
ctggctccatggtccttcgctgctg

SEQ ID NO: 295373 - DNA, 25 bp, Mus musculus
gtggtcttgtcccactccaggctct

SEQ ID NO: 295374 - DNA, 25 bp, Mus musculus
ctccaggctctcctcgctgcgcgct

SEQ ID NO: 295375 - DNA, 25 bp, Mus musculus
aagcggcggcactctgggcacacgc

SEQ ID NO: 295376 - DNA, 25 bp, Mus musculus
gcacacgcggatgtgcgtgcagcct

SEQ ID NO: 295377 - DNA, 25 bp, Mus musculus
cagcctcgagctactagggcggcct

SEQ ID NO: 295378 - DNA, 25 bp, Mus musculus
tactagggcggcctcctgtgccagt

SEQ ID NO: 295379 - DNA, 25 bp, Mus musculus
ctgtgccagtctctgcgccagctgg

SEQ ID NO: 295380 - DNA, 25 bp, Mus musculus
gtctctgcgccagctggtctggctc

SEQ ID NO: 295381 - DNA, 25 bp, Mus musculus
cggcgccacatagcttgccattgct

SEQ ID NO: 295382 - DNA, 25 bp, Mus musculus
atagcttgccattgctgagcgtcgc

SEQ ID NO: 295383 - DNA, 25 bp, Mus musculus
ccattgctgagcgtcgctgtgcctc

SEQ ID NO: 295384 - DNA, 25 bp, Mus musculus
ttcgctgctgccactactcgggctc

SEQ ID NO: 295385 - DNA, 25 bp, Mus musculus
gctgctgttggtggtcttgtcccac

SEQ ID NO: 295386 - DNA, 25 bp, Mus musculus
gaccgcggcaggctcattagcattc

SEQ ID NO: 295387 - DNA, 25 bp, Mus musculus
cggcagctggtagcgacatgacaga

SEQ ID NO: 295388 - DNA, 25 bp, Mus musculus
tggtagcgacatgacagacatgccc

SEQ ID NO: 295389 - DNA, 25 bp, Mus musculus
gccctgacttgcttgcgacagactc

SEQ ID NO: 295390 - DNA, 25 bp, Mus musculus
gcgacagactcaccggcaaagggtc

SEQ ID NO: 295391 - DNA, 25 bp, Mus musculus
aggacagagaagcagtgcacagagc

SEQ ID NO: 295392 - DNA, 25 bp, Mus musculus
aagcagtgcacagagccgcccttgt

SEQ ID NO: 295393 - DNA, 25 bp, Mus musculus
agccgcccttgtgcgaagtcctgag

SEQ ID NO: 295394 - DNA, 25 bp, Mus musculus
cgaagtcctgagtcgggtccaatca

SEQ ID NO: 295395 - DNA, 25 bp, Mus musculus
tgagtcgggtccaatcagcccgctc

SEQ ID NO: 295396 - DNA, 25 bp, Mus musculus
agcccactcggggacctcgaggagc

SEQ ID NO: 295397 - DNA, 25 bp, Mus musculus
gctaattgcctcactacggcccgga

SEQ ID NO: 295398 - DNA, 25 bp, Mus musculus
actgccgccctttagagggaccgcg

SEQ ID NO: 295399 - DNA, 25 bp, Mus musculus
caggctcattagcattcccggcagc

SEQ ID NO: 295400 - DNA, 25 bp, Mus musculus
ccctgatccggacgatcgggagacg

SEQ ID NO: 295401 - DNA, 25 bp, Mus musculus
agagccaaacttgcagcttccctga

SEQ ID NO: 295402 - DNA, 25 bp, Mus musculus
cccaagtgaggagctggggtacact

SEQ ID NO: 295403 - DNA, 25 bp, Mus musculus
cgccctggtccgcaggagttattag

SEQ ID NO: 295404 - DNA, 25 bp, Mus musculus
aggagttattagcttggcctgcttc

SEQ ID NO: 295405 - DNA, 25 bp, Mus musculus
tggggtacacttcaccatccagcgc

SEQ ID NO: 295406 - DNA, 25 bp, Mus musculus
tgcagcttccctgatccggacgatc

SEQ ID NO: 295407 - DNA, 25 bp, Mus musculus
aatccggggtcgcaggcatcagagt

SEQ ID NO: 295408 - DNA, 25 bp, Mus musculus
ccaagctggggacccgacgttgctc

SEQ ID NO: 295409 - DNA, 25 bp, Mus musculus
agctcgatccgccagcagccgaagg

SEQ ID NO: 295410 - DNA, 25 bp, Mus musculus
agcagccgaaggcagagtctgtgtc

SEQ ID NO: 295411 - DNA, 25 bp, Mus musculus
gccggaacagacagagccaaacttg

SEQ ID NO: 295412 - DNA, 25 bp, Mus musculus
tattagcttggcctgcttcggtggg

SEQ ID NO: 295413 - DNA, 25 bp, Mus musculus
ccgaaggcagagtctgtgtccggct

SEQ ID NO: 295414 - DNA, 25 bp, Mus musculus
gccattccacagtctcgaggagttc

SEQ ID NO: 295415 - DNA, 25 bp, Mus musculus
cgggacagcagaggagccattccac

SEQ ID NO: 295416 - DNA, 25 bp, Mus musculus
tcgttcccggtgtcaaatgcttttg

SEQ ID NO: 295417 - DNA, 25 bp, Mus musculus
agtgtacaatccacccgggacagca

SEQ ID NO: 295418 - DNA, 25 bp, Mus musculus
gaggtgcagcccacagtgtacaatc

SEQ ID NO: 295419 - DNA, 25 bp, Mus musculus
ccctcgaatgctctcgaggtgcagc

SEQ ID NO: 295420 - DNA, 25 bp, Mus musculus
aaaaagtagttctgtgtggcgaagc

SEQ ID NO: 295421 - DNA, 25 bp, Mus musculus
agatacttccgctcagtgctgtcgc

SEQ ID NO: 295422 - DNA, 25 bp, Mus musculus
tcgaggagttcacgtttagaggttc

SEQ ID NO: 295423 - DNA, 25 bp, Mus musculus
agagaatgtattcgttcccggtgtc

SEQ ID NO: 295424 - DNA, 25 bp, Mus musculus
ttcccggactctccaaacttgagca

SEQ ID NO: 295425 - DNA, 25 bp, Mus musculus
tcgggaagccgcttcacccgggatc

SEQ ID NO: 295426 - DNA, 25 bp, Mus musculus
tctccctgggacttcgggaagccgc

SEQ ID NO: 295427 - DNA, 25 bp, Mus musculus
acttcgtcacagagggaagtcgcga

SEQ ID NO: 295428 - DNA, 25 bp, Mus musculus
cccaaagcttggcatagagaggccc

SEQ ID NO: 295429 - DNA, 25 bp, Mus musculus
actgctcgaccacgcccgacttcta

SEQ ID NO: 295430 - DNA, 25 bp, Mus musculus
tgaaccgttatctaggcatccagac

SEQ ID NO: 295431 - DNA, 25 bp, Mus musculus
agacgggtgcccaaagcttggcata

SEQ ID NO: 295432 - DNA, 25 bp, Mus musculus
ccgtctgcgccaagggcagaccggt

SEQ ID NO: 295433 - DNA, 25 bp, Mus musculus
aagggcagaccggtgtccatccctc

SEQ ID NO: 295434 - DNA, 25 bp, Mus musculus
gggagtgcccaactgctcgaccacg

SEQ ID NO: 295435 - DNA, 25 bp, Mus musculus
ctccggcgaacgctgttacctggcg

SEQ ID NO: 295436 - DNA, 25 bp, Mus musculus
acgctgttacctggcggagcgcacc

SEQ ID NO: 295437 - DNA, 25 bp, Mus musculus
gcccagggctcggatcacggcgaca

SEQ ID NO: 295438 - DNA, 25 bp, Mus musculus
gatcacggcgacaggaagctgtaga

SEQ ID NO: 295439 - DNA, 25 bp, Mus musculus
ttatctaggcatccagacgggtgcc

SEQ ID NO: 295440 - DNA, 25 bp, Mus musculus
agccagcagcaaggtcgcatcccgg

SEQ ID NO: 295441 - DNA, 25 bp, Mus musculus
acgtcccatcctgaaccgttatcta

SEQ ID NO: 295442 - DNA, 25 bp, Mus musculus
gctttgcgctgcgaaaactcctcca

SEQ ID NO: 295443 - DNA, 25 bp, Mus musculus
cgtccagccgtgctggctgctggct

SEQ ID NO: 295444 - DNA, 25 bp, Mus musculus
gctgctggctttgcgctgcgaaaac

SEQ ID NO: 295445 - DNA, 25 bp, Mus musculus
gctggctttgcgctgcgaaaactcc

SEQ ID NO: 295446 - DNA, 25 bp, Mus musculus
cttcgtcctgcactctggcggcatg

SEQ ID NO: 295447 - DNA, 25 bp, Mus musculus
gtcctgcactctggcggcatgcaca

SEQ ID NO: 295448 - DNA, 25 bp, Mus musculus
tgtgcgcgtgccaaaccatcccact

SEQ ID NO: 295449 - DNA, 25 bp, Mus musculus
tgctcgccaaatcccaggtcgctga

SEQ ID NO: 295450 - DNA, 25 bp, Mus musculus
gccaaatcccaggtcgctgaactct

SEQ ID NO: 295451 - DNA, 25 bp, Mus musculus
ccgggctgcggaaccgccacagcca

SEQ ID NO: 295452 - DNA, 25 bp, Mus musculus
gctgcgctctccacagctgggtgga

SEQ ID NO: 295453 - DNA, 25 bp, Mus musculus
cgctctccacagctgggtggaggcc

SEQ ID NO: 295454 - DNA, 25 bp, Mus musculus
tgtttgctcgccaaatcccaggtcg

SEQ ID NO: 295455 - DNA, 25 bp, Mus musculus
ggtgacacgcttctcccgccatgga

SEQ ID NO: 295456 - DNA, 25 bp, Mus musculus
tactttctctctttgtgggcgctcc

SEQ ID NO: 295457 - DNA, 25 bp, Mus musculus
aggagcctcggtctcgcaaaccaca

SEQ ID NO: 295458 - DNA, 25 bp, Mus musculus
cgccttccagtgaccaatcagaaaa

SEQ ID NO: 295459 - DNA, 25 bp, Mus musculus
ctggggcaagcggaatccaagtccc

SEQ ID NO: 295460 - DNA, 25 bp, Mus musculus
cggtgacgtcacaaggtagcgcatc

SEQ ID NO: 295461 - DNA, 25 bp, Mus musculus
cctgccgaacctaggccagggactg

SEQ ID NO: 295462 - DNA, 25 bp, Mus musculus
ggcgagctgcgaaccctataggagc

SEQ ID NO: 295463 - DNA, 25 bp, Mus musculus
gcttcctattggttggtactttctc

SEQ ID NO: 295464 - DNA, 25 bp, Mus musculus
ctggccaatgggctcaagcgcacca

SEQ ID NO: 295465 - DNA, 25 bp, Mus musculus
tcggccaatgacaaacagaagtagg

SEQ ID NO: 295466 - DNA, 25 bp, Mus musculus
tgatgtactgacctttcggccaatg

SEQ ID NO: 295467 - DNA, 25 bp, Mus musculus
gagcgttgcttctccatttgatgta

SEQ ID NO: 295468 - DNA, 25 bp, Mus musculus
ttctggaaccttcagcgcctgctga

SEQ ID NO: 295469 - DNA, 25 bp, Mus musculus
ttctagtgacgtaaggctctctgta

SEQ ID NO: 295470 - DNA, 25 bp, Mus musculus
ccaggcggggccaaagcctgcgccc

SEQ ID NO: 295471 - DNA, 25 bp, Mus musculus
atgggctccagattcaccatcctgc

SEQ ID NO: 295472 - DNA, 25 bp, Mus musculus
gtgtgcatgggctccagattcacca

SEQ ID NO: 295473 - DNA, 25 bp, Mus musculus
ctcttccccttacctgtgtgcatgg

SEQ ID NO: 295474 - DNA, 25 bp, Mus musculus
agtgacacctgtcggagctcactcc

SEQ ID NO: 295475 - DNA, 25 bp, Mus musculus
tggccgccgaggagttaacgccacc

SEQ ID NO: 295476 - DNA, 25 bp, Mus musculus
ctcctggccgccgaggagttaacgc

SEQ ID NO: 295477 - DNA, 25 bp, Mus musculus
cgctatccgcatcgccctctcctgg

SEQ ID NO: 295478 - DNA, 25 bp, Mus musculus
agcccggaaggacccgctatccgca

SEQ ID NO: 295479 - DNA, 25 bp, Mus musculus
gcgcagtgacacctgtcggagctca

SEQ ID NO: 295480 - DNA, 25 bp, Mus musculus
ccacgcgcagtgacacctgtcggag

SEQ ID NO: 295481 - DNA, 25 bp, Mus musculus
gcaatggtgtccctgtccttggtcc

SEQ ID NO: 295482 - DNA, 25 bp, Mus musculus
ccctcgcgtggtgcaatggtgtccc

SEQ ID NO: 295483 - DNA, 25 bp, Mus musculus
tgccacctcggtcgcacactccgct

SEQ ID NO: 295484 - DNA, 25 bp, Mus musculus
tggtattgcggttgcatacccttcc

SEQ ID NO: 295485 - DNA, 25 bp, Mus musculus
tgtttgtgtctgttctgtccgagaa

SEQ ID NO: 295486 - DNA, 25 bp, Mus musculus
tttgtttgtgtctgttctgtccgag

SEQ ID NO: 295487 - DNA, 25 bp, Mus musculus
ttcggtcgtgtctcacttgatcctc

SEQ ID NO: 295488 - DNA, 25 bp, Mus musculus
ggtggtattgcggttgcataccctt

SEQ ID NO: 295489 - DNA, 25 bp, Mus musculus
cacttcggtcgtgtctcacttgatc

SEQ ID NO: 295490 - DNA, 25 bp, Mus musculus
cctaggtgcccgcttctgagttggc

SEQ ID NO: 295491 - DNA, 25 bp, Mus musculus
cttctgagttggcggcggcgcttcc

SEQ ID NO: 295492 - DNA, 25 bp, Mus musculus
cattccctggcgtgcctctagtgct

SEQ ID NO: 295493 - DNA, 25 bp, Mus musculus
gtgcctctagtgctccgtccggctg

SEQ ID NO: 295494 - DNA, 25 bp, Mus musculus
tctagtgctccgtccggctgcgtgt

SEQ ID NO: 295495 - DNA, 25 bp, Mus musculus
ctccgtccggctgcgtgtttcgttt

SEQ ID NO: 295496 - DNA, 25 bp, Mus musculus
ccggctgcgtgtttcgttttgtttg

SEQ ID NO: 295497 - DNA, 25 bp, Mus musculus
gtcgtgtctcacttgatcctcttcc

SEQ ID NO: 295498 - DNA, 25 bp, Mus musculus
caggacctgccttaaagagaccgcg

SEQ ID NO: 295499 - DNA, 25 bp, Mus musculus
tagactctcctcgatcacctggctg

SEQ ID NO: 295500 - DNA, 25 bp, Mus musculus
cctacttctagaggggagactcaac

SEQ ID NO: 295501 - DNA, 25 bp, Mus musculus
agcgaattcacgtgggccgcgtaca

SEQ ID NO: 295502 - DNA, 25 bp, Mus musculus
ggactccgttcagcacttttcattc

SEQ ID NO: 295503 - DNA, 25 bp, Mus musculus
ggtttgcgcagatcaaggctgatgc

SEQ ID NO: 295504 - DNA, 25 bp, Mus musculus
cgcgcacctcttggcccttaaaggg

SEQ ID NO: 295505 - DNA, 25 bp, Mus musculus
tctaggctggctttctctggatccc

SEQ ID NO: 295506 - DNA, 25 bp, Mus musculus
tgtccagagtttgcgctccgggcaa

SEQ ID NO: 295507 - DNA, 25 bp, Mus musculus
cgattcctgagctccggactccgtt

SEQ ID NO: 295508 - DNA, 25 bp, Mus musculus
ggactcttgatggtacctcaccttc

SEQ ID NO: 295509 - DNA, 25 bp, Mus musculus
cactgcgtttctcttctgcgggctt

SEQ ID NO: 295510 - DNA, 25 bp, Mus musculus
gggagacgcgcctacaaagtttgct

SEQ ID NO: 295511 - DNA, 25 bp, Mus musculus
cctcaccttcttgaaatccgcgatg

SEQ ID NO: 295512 - DNA, 25 bp, Mus musculus
cccaaggcccggcagccacactgca

SEQ ID NO: 295513 - DNA, 25 bp, Mus musculus
ccggcagccacactgcagtgcctca

SEQ ID NO: 295514 - DNA, 25 bp, Mus musculus
tcccaccgctcccaaggcccggcag

SEQ ID NO: 295515 - DNA, 25 bp, Mus musculus
ggaaggcacaggcttcccaccgctc

SEQ ID NO: 295516 - DNA, 25 bp, Mus musculus
agccgaggcaggtcggtcagtgctg

SEQ ID NO: 295517 - DNA, 25 bp, Mus musculus
aaagcctagcgagccgaggcaggtc

SEQ ID NO: 295518 - DNA, 25 bp, Mus musculus
gggcggtcatcaaagcctagcgagc

SEQ ID NO: 295519 - DNA, 25 bp, Mus musculus
tccggcgctggccaaaacaaaacaa

SEQ ID NO: 295520 - DNA, 25 bp, Mus musculus
cattccggcgctggccaaaacaaaa

SEQ ID NO: 295521 - DNA, 25 bp, Mus musculus
cgcattccggcgctggccaaaacaa

SEQ ID NO: 295522 - DNA, 25 bp, Mus musculus
ataaaacgcattccggcgctggcca

SEQ ID NO: 295523 - DNA, 25 bp, Mus musculus
gatcataaaacgcattccggcgctg

SEQ ID NO: 295524 - DNA, 25 bp, Mus musculus
gtcatcaaagcctagcgagccgagg

SEQ ID NO: 295525 - DNA, 25 bp, Mus musculus
agtgcctcacatcaccgcacggggg

SEQ ID NO: 295526 - DNA, 25 bp, Mus musculus
gggcagctccacattgttgcggatc

SEQ ID NO: 295527 - DNA, 25 bp, Mus musculus
ccctcgtcttccagactggtttctg

SEQ ID NO: 295528 - DNA, 25 bp, Mus musculus
ctgcggctgacctggatcctccgag

SEQ ID NO: 295529 - DNA, 25 bp, Mus musculus
tactgcgggcatctgccgaggctct

SEQ ID NO: 295530 - DNA, 25 bp, Mus musculus
tcgtgcaacttactgcgggcatctg

SEQ ID NO: 295531 - DNA, 25 bp, Mus musculus
ggggcatgactcgtgcaacttactg

SEQ ID NO: 295532 - DNA, 25 bp, Mus musculus
agccggccatggacgcctgcaagtt

SEQ ID NO: 295533 - DNA, 25 bp, Mus musculus
gcctccctttgtcagcgaccgagga

SEQ ID NO: 295534 - DNA, 25 bp, Mus musculus
cattgttgcggatcgcccgcaccga

SEQ ID NO: 295535 - DNA, 25 bp, Mus musculus
cagccacagctgcttaggactggga

SEQ ID NO: 295536 - DNA, 25 bp, Mus musculus
atcttgctagcttggggccctgagc

SEQ ID NO: 295537 - DNA, 25 bp, Mus musculus
acccaaggggcatcttgctagcttg

SEQ ID NO: 295538 - DNA, 25 bp, Mus musculus
cgaacggcgacccaaggggcatctt

SEQ ID NO: 295539 - DNA, 25 bp, Mus musculus
accctcggagaacagccggccatgg

SEQ ID NO: 295540 - DNA, 25 bp, Mus musculus
gccaggtggccgcatgacccacttt

SEQ ID NO: 295541 - DNA, 25 bp, Mus musculus
actcacctgcggttccttttctgga

SEQ ID NO: 295542 - DNA, 25 bp, Mus musculus
atcggaacctgctcctgcggcacag

SEQ ID NO: 295543 - DNA, 25 bp, Mus musculus
tgcggcacaggcagcttcttactca

SEQ ID NO: 295544 - DNA, 25 bp, Mus musculus
ctagggatcgcaaactccgggcctt

SEQ ID NO: 295545 - DNA, 25 bp, Mus musculus
tgggctccgtctcggaactccactt

SEQ ID NO: 295546 - DNA, 25 bp, Mus musculus
tcccaggaggaagctccacgggctt

SEQ ID NO: 295547 - DNA, 25 bp, Mus musculus
agggtgtcccgcgtgtctttcctcg

SEQ ID NO: 295548 - DNA, 25 bp, Mus musculus
tctttcctcgaggtgtgagctgccg

SEQ ID NO: 295549 - DNA, 25 bp, Mus musculus
gcagaagaggggttaactccgcgcc

SEQ ID NO: 295550 - DNA, 25 bp, Mus musculus
cccgaccctggggtggcccatattg

SEQ ID NO: 295551 - DNA, 25 bp, Mus musculus
gcccatattggcctattctgacgga

SEQ ID NO: 295552 - DNA, 25 bp, Mus musculus
tccacttctaaagcggagggctctc

SEQ ID NO: 295553 - DNA, 25 bp, Mus musculus
tccacgggcttcatgccagccaggt

SEQ ID NO: 295554 - DNA, 25 bp, Mus musculus
tgatgaaaagaaggccggcccattg

SEQ ID NO: 295555 - DNA, 25 bp, Mus musculus
acccggatgactcggatgatgaaaa

SEQ ID NO: 295556 - DNA, 25 bp, Mus musculus
agaacctgcagtacccggatgactc

SEQ ID NO: 295557 - DNA, 25 bp, Mus musculus
cgcccatggcacagaacctgcagta

SEQ ID NO: 295558 - DNA, 25 bp, Mus musculus
gcaaggcaggcatcccgcagcatca

SEQ ID NO: 295559 - DNA, 25 bp, Mus musculus
aacggctacagcaaggcaggcatcc

SEQ ID NO: 295560 - DNA, 25 bp, Mus musculus
caccaagaagcacgtgtacggcaac

SEQ ID NO: 295561 - DNA, 25 bp, Mus musculus
tgactacagcaccaagaagcacgtg

SEQ ID NO: 295562 - DNA, 25 bp, Mus musculus
caccttcaagggtgactacagcacc

SEQ ID NO: 295563 - DNA, 25 bp, Mus musculus
caggcgccggcacaccttcaagggt

SEQ ID NO: 295564 - DNA, 25 bp, Mus musculus
agggatcatagtggccctgcgcagg

SEQ ID NO: 295565 - DNA, 25 bp, Mus musculus
gggcagatgcccacagccatcattg

SEQ ID NO: 295566 - DNA, 25 bp, Mus musculus
cacgtgtacggcaacggctacagca

SEQ ID NO: 295567 - DNA, 25 bp, Mus musculus
cccaaatatgacgaggacgccaaac

SEQ ID NO: 295568 - DNA, 25 bp, Mus musculus
ggaagctaaagggatacacgcggta

SEQ ID NO: 295569 - DNA, 25 bp, Mus musculus
ctaaagggatacacgcggtgccagc

SEQ ID NO: 295570 - DNA, 25 bp, Mus musculus
agctaaaggaaaacacgtggtgcca

SEQ ID NO: 295571 - DNA, 25 bp, Mus musculus
agagtggggctacccgagaagctaa

SEQ ID NO: 295572 - DNA, 25 bp, Mus musculus
ccgagaagctaaaggaaaacacgtg

SEQ ID NO: 295573 - DNA, 25 bp, Mus musculus
ctaaaggaaaacacgtggtgccagc

SEQ ID NO: 295574 - DNA, 25 bp, Mus musculus
ccgggaagctaaagggatacacgcg

SEQ ID NO: 295575 - DNA, 25 bp, Mus musculus
agctaaagggatacacgcggtacca

SEQ ID NO: 295576 - DNA, 25 bp, Mus musculus
agtggggctacccgagaagctaaag

SEQ ID NO: 295577 - DNA, 25 bp, Mus musculus
taccagcgcagagtggggctacccg

SEQ ID NO: 295578 - DNA, 25 bp, Mus musculus
tacacgcggtaccagcgcagagtgg

SEQ ID NO: 295579 - DNA, 25 bp, Mus musculus
aagctaaagggatacacgcggtgcc

SEQ ID NO: 295580 - DNA, 25 bp, Mus musculus
taaagggatacacgcggtgccagcg

SEQ ID NO: 295581 - DNA, 25 bp, Mus musculus
atacacgcggtaccagcgcagagtg

SEQ ID NO: 295582 - DNA, 25 bp, Mus musculus
cgggctttctccctgctaacggacg

SEQ ID NO: 295583 - DNA, 25 bp, Mus musculus
ctaacggacgctttcgaagagtggg

SEQ ID NO: 295584 - DNA, 25 bp, Mus musculus
gcagggcgaggatgcaagccttccc

SEQ ID NO: 295585 - DNA, 25 bp, Mus musculus
cgacgggagggacccgcacatgcaa

SEQ ID NO: 295586 - DNA, 25 bp, Mus musculus
ccctgctaacggacgctttcgaaga

SEQ ID NO: 295587 - DNA, 25 bp, Mus musculus
cacatgcaaggaccgccgcagggcg

SEQ ID NO: 295588 - DNA, 25 bp, Mus musculus
ttctccctgctaacggacgctttcg

SEQ ID NO: 295589 - DNA, 25 bp, Mus musculus
ccagctacagttttgggaaaggata

SEQ ID NO: 295590 - DNA, 25 bp, Mus musculus
tttgggaaaggataccagggcgctc

SEQ ID NO: 295591 - DNA, 25 bp, Mus musculus
gaaaggataccagggcgctcctata

SEQ ID NO: 295592 - DNA, 25 bp, Mus musculus
gataccagggcgctcctatatgggg

SEQ ID NO: 295593 - DNA, 25 bp, Mus musculus
aaagaaggtgctcccaggtcgaggt

SEQ ID NO: 295594 - DNA, 25 bp, Mus musculus
cagtgcggggtcacgggctttctcc

SEQ ID NO: 295595 - DNA, 25 bp, Mus musculus
agggacccgcacatgcaaggaccgc

SEQ ID NO: 295596 - DNA, 25 bp, Mus musculus
agggagccctctgcgtcagccactg

SEQ ID NO: 295597 - DNA, 25 bp, Mus musculus
tcgactcgtccatcctccgagaaga

SEQ ID NO: 295598 - DNA, 25 bp, Mus musculus
accggctccaaacaggcgtgctttt

SEQ ID NO: 295599 - DNA, 25 bp, Mus musculus
cctccgagaagaggcaggtacgtgc

SEQ ID NO: 295600 - DNA, 25 bp, Mus musculus
cttgtgcccggttcgactcgtccat

SEQ ID NO: 295601 - DNA, 25 bp, Mus musculus
agtaccagccaggactcatccgcag

SEQ ID NO: 295602 - DNA, 25 bp, Mus musculus
caagccaatagccatgacgtatatc

SEQ ID NO: 295603 - DNA, 25 bp, Mus musculus
ggcgtgctttttctccacgtggttc

SEQ ID NO: 295604 - DNA, 25 bp, Mus musculus
acgcaacaataggaacaagccaata

SEQ ID NO: 295605 - DNA, 25 bp, Mus musculus
gcggggctctactgacgcaacaata

SEQ ID NO: 295606 - DNA, 25 bp, Mus musculus
tacccggttacctgggagatgcgcg

SEQ ID NO: 295607 - DNA, 25 bp, Mus musculus
gtggttctctgtatatacccggtta

SEQ ID NO: 295608 - DNA, 25 bp, Mus musculus
cgtatatcagtgacgcaaacgcggg

SEQ ID NO: 295609 - DNA, 25 bp, Mus musculus
aggtacgtgccacctgtcgcaggtc

SEQ ID NO: 295610 - DNA, 25 bp, Mus musculus
gctgacgtcgcaaagctggaagctc

SEQ ID NO: 295611 - DNA, 25 bp, Mus musculus
acgtcgcaaagctggaagctcggcg

SEQ ID NO: 295612 - DNA, 25 bp, Mus musculus
aagctcggcgggtcagccagtccgc

SEQ ID NO: 295613 - DNA, 25 bp, Mus musculus
agtagcggttactgccccacgtcgc

SEQ ID NO: 295614 - DNA, 25 bp, Mus musculus
cccacgtcgccgacggggttctgtg

SEQ ID NO: 295615 - DNA, 25 bp, Mus musculus
tacacggtgaccctgcccgaagagc

SEQ ID NO: 295616 - DNA, 25 bp, Mus musculus
cggcgctgacgtcgcaaagctggaa

SEQ ID NO: 295617 - DNA, 25 bp, Mus musculus
gttgtagcaaggcacggggactccc

SEQ ID NO: 295618 - DNA, 25 bp, Mus musculus
ttgggtttggggcatagcccaccgc

SEQ ID NO: 295619 - DNA, 25 bp, Mus musculus
gtgttagcgcgtcctcgctttgccc

SEQ ID NO: 295620 - DNA, 25 bp, Mus musculus
cggccagtgttagcgcgtcctcgct

SEQ ID NO: 295621 - DNA, 25 bp, Mus musculus
agcatgcgtacctcctacacggtga

SEQ ID NO: 295622 - DNA, 25 bp, Mus musculus
ccagtagggttcccgcgtctctgtg

SEQ ID NO: 295623 - DNA, 25 bp, Mus musculus
cccactttcccgctctcgccaagga

SEQ ID NO: 295624 - DNA, 25 bp, Mus musculus
agcccttcgctagcggccgcggtga

SEQ ID NO: 295625 - DNA, 25 bp, Mus musculus
acgagaggcaaagtgtccccccgcg

SEQ ID NO: 295626 - DNA, 25 bp, Mus musculus
cgagcctcggagataaacttaactt

SEQ ID NO: 295627 - DNA, 25 bp, Mus musculus
ttaacttgcccggagattcgtgttg

SEQ ID NO: 295628 - DNA, 25 bp, Mus musculus
ttgcccggagattcgtgttgctctc

SEQ ID NO: 295629 - DNA, 25 bp, Mus musculus
agattcgtgttgctctcgcctcccg

SEQ ID NO: 295630 - DNA, 25 bp, Mus musculus
tggccggagccactcattggatgcg

SEQ ID NO: 295631 - DNA, 25 bp, Mus musculus
gccactcattggatgcgggtgcaga

SEQ ID NO: 295632 - DNA, 25 bp, Mus musculus
aggaacaacgggtcgctgagtgccg

SEQ ID NO: 295633 - DNA, 25 bp, Mus musculus
ttgaagcagcccttcgctagcggcc

SEQ ID NO: 295634 - DNA, 25 bp, Mus musculus
gtcggcctcggccaactacctgctc

SEQ ID NO: 295635 - DNA, 25 bp, Mus musculus
actacctgctctgcaccaactgccg

SEQ ID NO: 295636 - DNA, 25 bp, Mus musculus
ccaactgccggaaagtgctgcggaa

SEQ ID NO: 295637 - DNA, 25 bp, Mus musculus
agaagagaacgttgaagcagccctt

SEQ ID NO: 295638 - DNA, 25 bp, Mus musculus
agctccgccttgtgcgctgcacaga

SEQ ID NO: 295639 - DNA, 25 bp, Mus musculus
aaaggaagtgccgtccgatgcgaca

SEQ ID NO: 295640 - DNA, 25 bp, Mus musculus
tgcgacaactgacgacatccctagt

SEQ ID NO: 295641 - DNA, 25 bp, Mus musculus
gtcggctgcaatgatgatgaaacta

SEQ ID NO: 295642 - DNA, 25 bp, Mus musculus
agcctggtaagtcgaggtctgcatc

SEQ ID NO: 295643 - DNA, 25 bp, Mus musculus
tgcacagatctaggggagcctggta

SEQ ID NO: 295644 - DNA, 25 bp, Mus musculus
tctcgctcgttgagctggtcccttc

SEQ ID NO: 295645 - DNA, 25 bp, Mus musculus
gccatcatgggatcgtgctcttctc

SEQ ID NO: 295646 - DNA, 25 bp, Mus musculus
gccgtctttctctgcggccatcatg

SEQ ID NO: 295647 - DNA, 25 bp, Mus musculus
agtggtctattcctagcccttaaga

SEQ ID NO: 295648 - DNA, 25 bp, Mus musculus
ccgctggaagttcccgtgagccttt

SEQ ID NO: 295649 - DNA, 25 bp, Mus musculus
tgactgcagtcgtttaagcctcggc

SEQ ID NO: 295650 - DNA, 25 bp, Mus musculus
catccctagttagctgactgcagtc

SEQ ID NO: 295651 - DNA, 25 bp, Mus musculus
aaggatgtcgagtccgcgcttaacc

SEQ ID NO: 295652 - DNA, 25 bp, Mus musculus
agccgcctgagcatttttggtaatg

SEQ ID NO: 295653 - DNA, 25 bp, Mus musculus
tgtgcactagagaccctggacgctg

SEQ ID NO: 295654 - DNA, 25 bp, Mus musculus
ccctgggcaggacctcggagcttcg

SEQ ID NO: 295655 - DNA, 25 bp, Mus musculus
ctcccaactcgactgagccgcctga

SEQ ID NO: 295656 - DNA, 25 bp, Mus musculus
gatttccggagagtcctatggtccc

SEQ ID NO: 295657 - DNA, 25 bp, Mus musculus
gattcgagatttccggagagtccta

SEQ ID NO: 295658 - DNA, 25 bp, Mus musculus
ctctgagaccggattcgagatttcc

SEQ ID NO: 295659 - DNA, 25 bp, Mus musculus
tgggaaagactctgagaccggattc

SEQ ID NO: 295660 - DNA, 25 bp, Mus musculus
tcagtaccgcgctgggaaagactct

SEQ ID NO: 295661 - DNA, 25 bp, Mus musculus
tgaatcaccgctcagtaccgcgctg

SEQ ID NO: 295662 - DNA, 25 bp, Mus musculus
tgacaggaccgactgaatcaccgct

SEQ ID NO: 295663 - DNA, 25 bp, Mus musculus
ccgccctttcagaggagtgacagga

SEQ ID NO: 295664 - DNA, 25 bp, Mus musculus
taccctggaccctgaggcacagcgg

SEQ ID NO: 295665 - DNA, 25 bp, Mus musculus
ctcggctgcttctgtgcactagaga

SEQ ID NO: 295666 - DNA, 25 bp, Mus musculus
tcagagctggtagcaacgtagagtc

SEQ ID NO: 295667 - DNA, 25 bp, Mus musculus
tgccgcctgagtgtaccggagatca

SEQ ID NO: 295668 - DNA, 25 bp, Mus musculus
aaaaggcagtttccctagctggagg

SEQ ID NO: 295669 - DNA, 25 bp, Mus musculus
cgcccgcctgttgctggaaaaggca

SEQ ID NO: 295670 - DNA, 25 bp, Mus musculus
agagtattctgggaacggactagtc

SEQ ID NO: 295671 - DNA, 25 bp, Mus musculus
gtgcagcctaggttttagagtattc

SEQ ID NO: 295672 - DNA, 25 bp, Mus musculus
acttctttgcgggtgtgcagcctag

SEQ ID NO: 295673 - DNA, 25 bp, Mus musculus
cccgcgtgcgtgcaacttctttgcg

SEQ ID NO: 295674 - DNA, 25 bp, Mus musculus
agtgggcgctccttcttgccagagt

SEQ ID NO: 295675 - DNA, 25 bp, Mus musculus
cctcagagcccaggcgttgggagtt

SEQ ID NO: 295676 - DNA, 25 bp, Mus musculus
ccgcgggtgagttctttatgttgag

SEQ ID NO: 295677 - DNA, 25 bp, Mus musculus
gcgtcttcttgttcgctgcctgctg

SEQ ID NO: 295678 - DNA, 25 bp, Mus musculus
agcggcgagttcctcacttggctcg

SEQ ID NO: 295679 - DNA, 25 bp, Mus musculus
tgcccaaactggtgtgcgtcttctt

SEQ ID NO: 295680 - DNA, 25 bp, Mus musculus
ggcgtccttcatgagcccgatcagg

SEQ ID NO: 295681 - DNA, 25 bp, Mus musculus
gcgctcgcagcccagggagtgagag

SEQ ID NO: 295682 - DNA, 25 bp, Mus musculus
ctccggcaaccaccgccggcgctcg

SEQ ID NO: 295683 - DNA, 25 bp, Mus musculus
cgggcgagaaggaggggcctctccg

SEQ ID NO: 295684 - DNA, 25 bp, Mus musculus
cggccgcgagcgagggaatggagcc

SEQ ID NO: 295685 - DNA, 25 bp, Mus musculus
ttcttcacgttgccggccatggcca

SEQ ID NO: 295686 - DNA, 25 bp, Mus musculus
agctcttcttcacgttgccggccat

SEQ ID NO: 295687 - DNA, 25 bp, Mus musculus
gagctcttcttcacgttgccggcca

SEQ ID NO: 295688 - DNA, 25 bp, Mus musculus
ggcgcccgagctcttcttcacgttg

SEQ ID NO: 295689 - DNA, 25 bp, Mus musculus
gcgtccttcatgagcccgatcaggc

SEQ ID NO: 295690 - DNA, 25 bp, Mus musculus
aaggcgtccttcatgagcccgatca

SEQ ID NO: 295691 - DNA, 25 bp, Mus musculus
tggaaggcgtccttcatgagcccga

SEQ ID NO: 295692 - DNA, 25 bp, Mus musculus
cggctggaaggcgtccttcatgagc

SEQ ID NO: 295693 - DNA, 25 bp, Mus musculus
atgagcccgatcaggccgcccgctc

SEQ ID NO: 295694 - DNA, 25 bp, Mus musculus
tctggacccggagcgggtcccagct

SEQ ID NO: 295695 - DNA, 25 bp, Mus musculus
aagctgagccttgcgccagggatta

SEQ ID NO: 295696 - DNA, 25 bp, Mus musculus
cggctgtcctccagatcacggagca

SEQ ID NO: 295697 - DNA, 25 bp, Mus musculus
tccagatcacggagcagcagcttga

SEQ ID NO: 295698 - DNA, 25 bp, Mus musculus
tcacggagcagcagcttgagatgcc

SEQ ID NO: 295699 - DNA, 25 bp, Mus musculus
gcagcttgagatgcctctggacccg

SEQ ID NO: 295700 - DNA, 25 bp, Mus musculus
tggacgttgcgctggacttcactaa

SEQ ID NO: 295701 - DNA, 25 bp, Mus musculus
ggacttcactaaggatcactgacca

SEQ ID NO: 295702 - DNA, 25 bp, Mus musculus
atcactgaccagtactcagacaccg

SEQ ID NO: 295703 - DNA, 25 bp, Mus musculus
cagtactcagacaccgccgtccctt

SEQ ID NO: 295704 - DNA, 25 bp, Mus musculus
gccgtcccttctgtcagcgaggcta

SEQ ID NO: 295705 - DNA, 25 bp, Mus musculus
cttctgtcagcgaggctacgacccg

SEQ ID NO: 295706 - DNA, 25 bp, Mus musculus
ctccactcgcagaagctgagccttg

SEQ ID NO: 295707 - DNA, 25 bp, Mus musculus
tcccagctgtggacgttgcgctgga

SEQ ID NO: 295708 - DNA, 25 bp, Mus musculus
gagcgatcgacccagttaggccttt

SEQ ID NO: 295709 - DNA, 25 bp, Mus musculus
agggcactgagcaaagacccgcaga

SEQ ID NO: 295710 - DNA, 25 bp, Mus musculus
actggagggcactgagcaaagaccc

SEQ ID NO: 295711 - DNA, 25 bp, Mus musculus
gacactggagggcactgagcaaaga

SEQ ID NO: 295712 - DNA, 25 bp, Mus musculus
cgcagcccggcccactctggcaccc

SEQ ID NO: 295713 - DNA, 25 bp, Mus musculus
cacggcgcgtctaggccgcctccgc

SEQ ID NO: 295714 - DNA, 25 bp, Mus musculus
gttgcctaggccctggtgcccgtcg

SEQ ID NO: 295715 - DNA, 25 bp, Mus musculus
acccaggttgcctaggccctggtgc

SEQ ID NO: 295716 - DNA, 25 bp, Mus musculus
actgagcaaagacccgcagaagggg

SEQ ID NO: 295717 - DNA, 25 bp, Mus musculus
gcgatcgacccagttaggcctttac

SEQ ID NO: 295718 - DNA, 25 bp, Mus musculus
gccggaggagcgatcgacccagtta

SEQ ID NO: 295719 - DNA, 25 bp, Mus musculus
agctgcccggctcttgcttccgggg

SEQ ID NO: 295720 - DNA, 25 bp, Mus musculus
cggggcccagcgcagccgtccagcc

SEQ ID NO: 295721 - DNA, 25 bp, Mus musculus
ctttacccaggttgcctaggccctg

SEQ ID NO: 295722 - DNA, 25 bp, Mus musculus
tcgcctcgttccttggcagtctcag

SEQ ID NO: 295723 - DNA, 25 bp, Mus musculus
agcgcctgtcctctggacctagtcg

SEQ ID NO: 295724 - DNA, 25 bp, Mus musculus
gatcccacttggatgaacccgccgg

SEQ ID NO: 295725 - DNA, 25 bp, Mus musculus
ggctcgggtcagaaaggatgacaca

SEQ ID NO: 295726 - DNA, 25 bp, Mus musculus
gaggtggacactccggctctcttca

SEQ ID NO: 295727 - DNA, 25 bp, Mus musculus
atgttcgacccggatgctcagcgtt

SEQ ID NO: 295728 - DNA, 25 bp, Mus musculus
tccttggcagtctcagcctggcctt

SEQ ID NO: 295729 - DNA, 25 bp, Mus musculus
gtgacactcagttgcgacctcgcct

SEQ ID NO: 295730 - DNA, 25 bp, Mus musculus
gcacacacccggtggtgcagtgaca

SEQ ID NO: 295731 - DNA, 25 bp, Mus musculus
gtcttatgcactcgggcagcacaca

SEQ ID NO: 295732 - DNA, 25 bp, Mus musculus
ttttcccgccgggtcttatgcactc

SEQ ID NO: 295733 - DNA, 25 bp, Mus musculus
tgctcgcctggtcaccttgacgcgt

SEQ ID NO: 295734 - DNA, 25 bp, Mus musculus
cgctgcgacgcaaggatgctcagca

SEQ ID NO: 295735 - DNA, 25 bp, Mus musculus
gcagagatgctcaaccgggatgttc

SEQ ID NO: 295736 - DNA, 25 bp, Mus musculus
gaccagggagatcgggacacgaaaa

SEQ ID NO: 295737 - DNA, 25 bp, Mus musculus
ttgaggcttgaattcccactactgc

SEQ ID NO: 295738 - DNA, 25 bp, Mus musculus
cttcaaaagtgggttgggcctgctc

SEQ ID NO: 295739 - DNA, 25 bp, Mus musculus
gaagttcgcgtcaccttcaaaagtg

SEQ ID NO: 295740 - DNA, 25 bp, Mus musculus
acgaccggatgtggctgaagttcgc

SEQ ID NO: 295741 - DNA, 25 bp, Mus musculus
tcccggagagggctccgagtcccaa

SEQ ID NO: 295742 - DNA, 25 bp, Mus musculus
gtcagagcccgtgcgcaccaaaaca

SEQ ID NO: 295743 - DNA, 25 bp, Mus musculus
ccaatggccgctgcgtctgtcagag

SEQ ID NO: 295744 - DNA, 25 bp, Mus musculus
tcgagtcgaccgacagccaatggcc

SEQ ID NO: 295745 - DNA, 25 bp, Mus musculus
gagcgacgaccagcgacagccaatc

SEQ ID NO: 295746 - DNA, 25 bp, Mus musculus
agagccgctttagccgccaaggtac

SEQ ID NO: 295747 - DNA, 25 bp, Mus musculus
ctcagaggaagtagcccatccggga

SEQ ID NO: 295748 - DNA, 25 bp, Mus musculus
ccggaggataggtagctagaactca

SEQ ID NO: 295749 - DNA, 25 bp, Mus musculus
acccactgggcatgcgcctagtttg

SEQ ID NO: 295750 - DNA, 25 bp, Mus musculus
gctgcgtgcgcagaactgacactga

SEQ ID NO: 295751 - DNA, 25 bp, Mus musculus
tctccgtagccagagatctggatcc

SEQ ID NO: 295752 - DNA, 25 bp, Mus musculus
gaactgacactgacaacaccgccgg

SEQ ID NO: 295753 - DNA, 25 bp, Mus musculus
gacgctcgagctctgtctccgtagc

SEQ ID NO: 295754 - DNA, 25 bp, Mus musculus
ccagcctgcagagataccggggctc

SEQ ID NO: 295755 - DNA, 25 bp, Mus musculus
gctaggttccagctatcacccgatt

SEQ ID NO: 295756 - DNA, 25 bp, Mus musculus
atctggatccctaacaccggcggtg

SEQ ID NO: 295757 - DNA, 25 bp, Mus musculus
ccggaaagacttgaaggcaaagagc

SEQ ID NO: 295758 - DNA, 25 bp, Mus musculus
gcatactgcagcatccagcccaata

SEQ ID NO: 295759 - DNA, 25 bp, Mus musculus
cagcccaataccgtgatcagcgagg

SEQ ID NO: 295760 - DNA, 25 bp, Mus musculus
gcgccgccgagattccaggaccagt

SEQ ID NO: 295761 - DNA, 25 bp, Mus musculus
gccacggatggagaagaggtcctcc

SEQ ID NO: 295762 - DNA, 25 bp, Mus musculus
ttccaggaccagtgggtgccacgga

SEQ ID NO: 295763 - DNA, 25 bp, Mus musculus
cgttgccagttctcccggaaagact

SEQ ID NO: 295764 - DNA, 25 bp, Mus musculus
gtcaccatgtgggccttcccggagt

SEQ ID NO: 295765 - DNA, 25 bp, Mus musculus
aatcctctgcgggttgggagccgca

SEQ ID NO: 295766 - DNA, 25 bp, Mus musculus
ctggcgccggaatcctctgcgggtt

SEQ ID NO: 295767 - DNA, 25 bp, Mus musculus
ctgccgaggccacgggattgttcct

SEQ ID NO: 295768 - DNA, 25 bp, Mus musculus
ccacgggattgttcctggcttacca

SEQ ID NO: 295769 - DNA, 25 bp, Mus musculus
tcctggcttaccagttagctgagta

SEQ ID NO: 295770 - DNA, 25 bp, Mus musculus
ttaccagttagctgagtaggcggcg

SEQ ID NO: 295771 - DNA, 25 bp, Mus musculus
tcatccctgccttccgtagccactt

SEQ ID NO: 295772 - DNA, 25 bp, Mus musculus
attcgtggctacagtcaccctcatc

SEQ ID NO: 295773 - DNA, 25 bp, Mus musculus
ctgttgggattcgtggctacagtca

SEQ ID NO: 295774 - DNA, 25 bp, Mus musculus
gaatttgatcggctcgctgttggga

SEQ ID NO: 295775 - DNA, 25 bp, Mus musculus
cgctgctggtgaatttgatcggctc

SEQ ID NO: 295776 - DNA, 25 bp, Mus musculus
cgctgccgctgctggtgaatttgat

SEQ ID NO: 295777 - DNA, 25 bp, Mus musculus
tccgtagccactttatcgccgcgcg

SEQ ID NO: 295778 - DNA, 25 bp, Mus musculus
tggtagttcgtggtctctcagcgtt

SEQ ID NO: 295779 - DNA, 25 bp, Mus musculus
gcgtgtccagggagtttataaggcc

SEQ ID NO: 295780 - DNA, 25 bp, Mus musculus
ttgcaaccaaccagaggtgggtatt

SEQ ID NO: 295781 - DNA, 25 bp, Mus musculus
aggcgcgtcaccgaagggttaattg

SEQ ID NO: 295782 - DNA, 25 bp, Mus musculus
gcgttctctcagctaaggcgcgtca

SEQ ID NO: 295783 - DNA, 25 bp, Mus musculus
aattggaccaatcactgggcgcgtt

SEQ ID NO: 295784 - DNA, 25 bp, Mus musculus
ctcagcgttgttcgcagctcttcta

SEQ ID NO: 295785 - DNA, 25 bp, Mus musculus
ttcagttccctgtaggccgcgtaca

SEQ ID NO: 295786 - DNA, 25 bp, Mus musculus
ctgcggaaaggccactacgccgagc

SEQ ID NO: 295787 - DNA, 25 bp, Mus musculus
tcgagtacctcactgccgagatcct

SEQ ID NO: 295788 - DNA, 25 bp, Mus musculus
ctcgcaggcctctcaggagtactga

SEQ ID NO: 295789 - DNA, 25 bp, Mus musculus
aaagagctgagccacttcgggctgc

SEQ ID NO: 295790 - DNA, 25 bp, Mus musculus
agctcgtgacatcgcttcgccgttc

SEQ ID NO: 295791 - DNA, 25 bp, Mus musculus
tcgtacactatgtccggacgcggca

SEQ ID NO: 295792 - DNA, 25 bp, Mus musculus
tcctggcaaaggtcagtgagttccc

SEQ ID NO: 295793 - DNA, 25 bp, Mus musculus
cgcaccatccgcagcagctcctgga

SEQ ID NO: 295794 - DNA, 25 bp, Mus musculus
cgagggagagaaacttcggaacttg

SEQ ID NO: 295795 - DNA, 25 bp, Mus musculus
atgctttcctgactgcgcgcctagg

SEQ ID NO: 295796 - DNA, 25 bp, Mus musculus
tcggaacttggaggtcctgttcgcc

SEQ ID NO: 295797 - DNA, 25 bp, Mus musculus
gcccgcggcttcctggcaaaggtca

SEQ ID NO: 295798 - DNA, 25 bp, Mus musculus
gccctgctttgtccctggtgcagcg

SEQ ID NO: 295799 - DNA, 25 bp, Mus musculus
caactttgggggaactgttgcgcgc

SEQ ID NO: 295800 - DNA, 25 bp, Mus musculus
ttggtctgccgagtgcccatgccgc

SEQ ID NO: 295801 - DNA, 25 bp, Mus musculus
ccaggctgcccttggtctgccgagt

SEQ ID NO: 295802 - DNA, 25 bp, Mus musculus
acgcccagaagtcgggtcgttcgcg

SEQ ID NO: 295803 - DNA, 25 bp, Mus musculus
agcagcgacgcccagaagtcgggtc

SEQ ID NO: 295804 - DNA, 25 bp, Mus musculus
ggaccatgccgacgcgccggtgata

SEQ ID NO: 295805 - DNA, 25 bp, Mus musculus
tgactgcgcgcctaggtgaggccca

SEQ ID NO: 295806 - DNA, 25 bp, Mus musculus
actgtacagagtggcgaagcgctcg

SEQ ID NO: 295807 - DNA, 25 bp, Mus musculus
aagatggctgcagtgctcagccgcg

SEQ ID NO: 295808 - DNA, 25 bp, Mus musculus
cccgaagatggctgcagtgctcagc

SEQ ID NO: 295809 - DNA, 25 bp, Mus musculus
ccagccagcgcgcacagcccatggc

SEQ ID NO: 295810 - DNA, 25 bp, Mus musculus
agaaacggtcgcattcgccgaagcc

SEQ ID NO: 295811 - DNA, 25 bp, Mus musculus
ccttgtagaagaaacggtcgcattc

SEQ ID NO: 295812 - DNA, 25 bp, Mus musculus
agatcctcacgtgcgcttcggtcgc

SEQ ID NO: 295813 - DNA, 25 bp, Mus musculus
ggttctcccgagtcctgcttacctg

SEQ ID NO: 295814 - DNA, 25 bp, Mus musculus
ggagcccgcgaagcgttgacagatc

SEQ ID NO: 295815 - DNA, 25 bp, Mus musculus
cgcgcagcgcgaaacgcggagaaca

SEQ ID NO: 295816 - DNA, 25 bp, Mus musculus
ggcgctgctgtgtgccagagctccc

SEQ ID NO: 295817 - DNA, 25 bp, Mus musculus
aagtccgcggtgagcctctctggcg

SEQ ID NO: 295818 - DNA, 25 bp, Mus musculus
gttgacagatcctcacgtgcgcttc

SEQ ID NO: 295819 - DNA, 25 bp, Mus musculus
agccgggcctgcaacagccctgcca

SEQ ID NO: 295820 - DNA, 25 bp, Mus musculus
gctgagctctgcgtcacgtccgctg

SEQ ID NO: 295821 - DNA, 25 bp, Mus musculus
gaactcaccgcggttgtggccgcgc

SEQ ID NO: 295822 - DNA, 25 bp, Mus musculus
cccgcacttcactccggctgcagga

SEQ ID NO: 295823 - DNA, 25 bp, Mus musculus
actgaaggcacatggggcccgagcc

SEQ ID NO: 295824 - DNA, 25 bp, Mus musculus
tcctctgggcgggaattaggattgc

SEQ ID NO: 295825 - DNA, 25 bp, Mus musculus
ttaccggacatgactccgcccaggg

SEQ ID NO: 295826 - DNA, 25 bp, Mus musculus
gtgccttcctctgggcgggaattag

SEQ ID NO: 295827 - DNA, 25 bp, Mus musculus
ggtcatcggtcaccggctcagaact

SEQ ID NO: 295828 - DNA, 25 bp, Mus musculus
cgagaagtgcgggtcatcggtcacc

SEQ ID NO: 295829 - DNA, 25 bp, Mus musculus
gggccaatcattgcacccagaaagc

SEQ ID NO: 295830 - DNA, 25 bp, Mus musculus
agaacatggcaacccggggccaatc

SEQ ID NO: 295831 - DNA, 25 bp, Mus musculus
agacgacgagaacatggcaacccgg

SEQ ID NO: 295832 - DNA, 25 bp, Mus musculus
cgaccaatagacgacgagaacatgg

SEQ ID NO: 295833 - DNA, 25 bp, Mus musculus
tggtgtctgcagaagccggcgacct

SEQ ID NO: 295834 - DNA, 25 bp, Mus musculus
gcctccggaagcgaaatcacgtgaa

SEQ ID NO: 295835 - DNA, 25 bp, Mus musculus
gcctgagtcgcagacagtgatgcca

SEQ ID NO: 295836 - DNA, 25 bp, Mus musculus
ggaacttggaagcagcggatcccga

SEQ ID NO: 295837 - DNA, 25 bp, Mus musculus
ccactgcaggtaggccgccatcttg

SEQ ID NO: 295838 - DNA, 25 bp, Mus musculus
gctcttttgatcttgttaggactga

SEQ ID NO: 295839 - DNA, 25 bp, Mus musculus
acgtccttcaagagagtggtggcgc

SEQ ID NO: 295840 - DNA, 25 bp, Mus musculus
cgtgcgctgaggaaagaaacacctc

SEQ ID NO: 295841 - DNA, 25 bp, Mus musculus
ggcgtgctccgtagctccttaatgc

SEQ ID NO: 295842 - DNA, 25 bp, Mus musculus
acaaaaggcttgctgctcgggactg

SEQ ID NO: 295843 - DNA, 25 bp, Mus musculus
tgcgagcacgcaaaacgccactgac

SEQ ID NO: 295844 - DNA, 25 bp, Mus musculus
cgccactgacagattgcattcgctg

SEQ ID NO: 295845 - DNA, 25 bp, Mus musculus
cattcgctgtagaaactcgtccggc

SEQ ID NO: 295846 - DNA, 25 bp, Mus musculus
gaaccgaaaggcgagtcatgtgaca

SEQ ID NO: 295847 - DNA, 25 bp, Mus musculus
aaggatatctccaaagaccaggctc

SEQ ID NO: 295848 - DNA, 25 bp, Mus musculus
tcgccgcagcgaatgcagctcagta

SEQ ID NO: 295849 - DNA, 25 bp, Mus musculus
tcgccgccttgatcccggagcgaag

SEQ ID NO: 295850 - DNA, 25 bp, Mus musculus
aggttggtggccactgtaacagttt

SEQ ID NO: 295851 - DNA, 25 bp, Mus musculus
cttctacgtggaccaatggggtctc

SEQ ID NO: 295852 - DNA, 25 bp, Mus musculus
aaccggtactcaggcccagctgcgt

SEQ ID NO: 295853 - DNA, 25 bp, Mus musculus
tctggcagtttcgtcccaaccggta

SEQ ID NO: 295854 - DNA, 25 bp, Mus musculus
gccgcgaaccgtgacgtggcccaat

SEQ ID NO: 295855 - DNA, 25 bp, Mus musculus
cagaagtcccgcgaggagtaacccg

SEQ ID NO: 295856 - DNA, 25 bp, Mus musculus
cggcaccgatgctggcagaagtccc

SEQ ID NO: 295857 - DNA, 25 bp, Mus musculus
ctagggttccgcatcgaagcgtccg

SEQ ID NO: 295858 - DNA, 25 bp, Mus musculus
ttcgcaatccacgagagcacctgct

SEQ ID NO: 295859 - DNA, 25 bp, Mus musculus
ccggaagaaggccaaggacttcgca

SEQ ID NO: 295860 - DNA, 25 bp, Mus musculus
cggtcccttcggtcctgaagttcag

SEQ ID NO: 295861 - DNA, 25 bp, Mus musculus
gctcagtatgattccgtcgcgcgga

SEQ ID NO: 295862 - DNA, 25 bp, Mus musculus
gctcttgcagatgcggtgccctcgt

SEQ ID NO: 295863 - DNA, 25 bp, Mus musculus
tgacttccgactacgccggaggctg

SEQ ID NO: 295864 - DNA, 25 bp, Mus musculus
aggctgtccgggtgactgcccttcc

SEQ ID NO: 295865 - DNA, 25 bp, Mus musculus
ctgcccttccgggatggcgacagtt

SEQ ID NO: 295866 - DNA, 25 bp, Mus musculus
gcgacagttccacggcccagggaca

SEQ ID NO: 295867 - DNA, 25 bp, Mus musculus
cagggacagcgctcttgcagatgcg

SEQ ID NO: 295868 - DNA, 25 bp, Mus musculus
tggctgcagcgcacagtctccgcag

SEQ ID NO: 295869 - DNA, 25 bp, Mus musculus
tgcccatcctgactggcagagccta

SEQ ID NO: 295870 - DNA, 25 bp, Mus musculus
tcctgactggcagagcctaggctgc

SEQ ID NO: 295871 - DNA, 25 bp, Mus musculus
ggcctcccgaggctacgtgcggctt

SEQ ID NO: 295872 - DNA, 25 bp, Mus musculus
ggctacgtgcggcttctctcgccta

SEQ ID NO: 295873 - DNA, 25 bp, Mus musculus
ctacgccttgtgctccagcggctgt

SEQ ID NO: 295874 - DNA, 25 bp, Mus musculus
gcaagtctgggaccttggggctccc

SEQ ID NO: 295875 - DNA, 25 bp, Mus musculus
cagttcccagccaggagtcgggtgt

SEQ ID NO: 295876 - DNA, 25 bp, Mus musculus
ctgctgtggtctacacgactctctg

SEQ ID NO: 295877 - DNA, 25 bp, Mus musculus
aggcgaccctacacggactgcttcg

SEQ ID NO: 295878 - DNA, 25 bp, Mus musculus
cccatcccacaagaggcggagttta

SEQ ID NO: 295879 - DNA, 25 bp, Mus musculus
gtgcagcaattttacgaccagtctc

SEQ ID NO: 295880 - DNA, 25 bp, Mus musculus
catttctgggaactggcctactgta

SEQ ID NO: 295881 - DNA, 25 bp, Mus musculus
gtcccggaactggtgtcatagcctc

SEQ ID NO: 295882 - DNA, 25 bp, Mus musculus
ccatcactgtgctacggatagggta

SEQ ID NO: 295883 - DNA, 25 bp, Mus musculus
ttttccgacatcttagcgaggctgc

SEQ ID NO: 295884 - DNA, 25 bp, Mus musculus
gccggctttgttcaccacgtacacg

SEQ ID NO: 295885 - DNA, 25 bp, Mus musculus
ggcgaatagctgtcccactggtaaa

SEQ ID NO: 295886 - DNA, 25 bp, Mus musculus
gtccagcgggtaactgaaagtcttc

SEQ ID NO: 295887 - DNA, 25 bp, Mus musculus
tctcagagtttgcaggttggaagtc

SEQ ID NO: 295888 - DNA, 25 bp, Mus musculus
tggccgaaagcgaccagcacgcgtt

SEQ ID NO: 295889 - DNA, 25 bp, Mus musculus
acgcgttcgtcgtgcagtttcagca

SEQ ID NO: 295890 - DNA, 25 bp, Mus musculus
cagtaggcgctattgcaatccgttc

SEQ ID NO: 295891 - DNA, 25 bp, Mus musculus
cacctgcggtagaagccgctccaga

SEQ ID NO: 295892 - DNA, 25 bp, Mus musculus
tggctgtagacgtgaccgcgaccac

SEQ ID NO: 295893 - DNA, 25 bp, Mus musculus
ccgcgaccacagaagaaagtttgcc

SEQ ID NO: 295894 - DNA, 25 bp, Mus musculus
gcgccatagacccaggacccgggaa

SEQ ID NO: 295895 - DNA, 25 bp, Mus musculus
attgcaatccgttctgcggctgcgc

SEQ ID NO: 295896 - DNA, 25 bp, Mus musculus
gcggctgcgcggaatattcactccg

SEQ ID NO: 295897 - DNA, 25 bp, Mus musculus
acccgcagaaaacccggcagcttgt

SEQ ID NO: 295898 - DNA, 25 bp, Mus musculus
cccggcagcttgtgaaagaacgaga

SEQ ID NO: 295899 - DNA, 25 bp, Mus musculus
tgcacgccagttaggacctcagatc

SEQ ID NO: 295900 - DNA, 25 bp, Mus musculus
gatcgcacactttcaggcgttgaca

SEQ ID NO: 295901 - DNA, 25 bp, Mus musculus
ggcgttgacaaagacccagtttagc

SEQ ID NO: 295902 - DNA, 25 bp, Mus musculus
tttgccgacacagaggacatcgctg

SEQ ID NO: 295903 - DNA, 25 bp, Mus musculus
ttcaactgccgctggtgcttgtggc

SEQ ID NO: 295904 - DNA, 25 bp, Mus musculus
ggaagccagaggcagtccgcccact

SEQ ID NO: 295905 - DNA, 25 bp, Mus musculus
actcctgcgtgggtttcgagaccct

SEQ ID NO: 295906 - DNA, 25 bp, Mus musculus
ctgatcccaatgaggctggcgagcc

SEQ ID NO: 295907 - DNA, 25 bp, Mus musculus
actcacgtttctgctcggcctcgga

SEQ ID NO: 295908 - DNA, 25 bp, Mus musculus
cctcggacaagtgtgtcgtggtgaa

SEQ ID NO: 295909 - DNA, 25 bp, Mus musculus
tcgtggtgaaggtcaagaagcactc

SEQ ID NO: 295910 - DNA, 25 bp, Mus musculus
gaagcactcgttgcccatatcccaa

SEQ ID NO: 295911 - DNA, 25 bp, Mus musculus
agcaagcccggaacctggccatgga

SEQ ID NO: 295912 - DNA, 25 bp, Mus musculus
ctggcccagaagttccggtcctgga

SEQ ID NO: 295913 - DNA, 25 bp, Mus musculus
ccacttttaaggctagaggagacga

SEQ ID NO: 295914 - DNA, 25 bp, Mus musculus
tgcaagagacggagagactcgcctg

SEQ ID NO: 295915 - DNA, 25 bp, Mus musculus
gcctgcgtggaaggtgcttcctcaa

SEQ ID NO: 295916 - DNA, 25 bp, Mus musculus
tgcttcctcaaaccgcgggcaatcg

SEQ ID NO: 295917 - DNA, 25 bp, Mus musculus
ttcgagaccctcctgatcccaatga

SEQ ID NO: 295918 - DNA, 25 bp, Mus musculus
ctcggcatccgaccaacaataagcg

SEQ ID NO: 295919 - DNA, 25 bp, Mus musculus
tgacctggttatggcgtccagctcc

SEQ ID NO: 295920 - DNA, 25 bp, Mus musculus
ggcgccttaccgagtcagaccactg

SEQ ID NO: 295921 - DNA, 25 bp, Mus musculus
ctcttattttgacaggggcctctcc

SEQ ID NO: 295922 - DNA, 25 bp, Mus musculus
ggctgcgatctggaccctcggcatc

SEQ ID NO: 295923 - DNA, 25 bp, Mus musculus
gaccaacaataagcgcctagacagc

SEQ ID NO: 295924 - DNA, 25 bp, Mus musculus
tgcccaggaccatgctccgcggttg

SEQ ID NO: 295925 - DNA, 25 bp, Mus musculus
aggcaggaacccaggcaaccagcgc

SEQ ID NO: 295926 - DNA, 25 bp, Mus musculus
ccgggctggtattaagatcaaggcg

SEQ ID NO: 295927 - DNA, 25 bp, Mus musculus
tcaaggcgtccaggatcaaaaagac

SEQ ID NO: 295928 - DNA, 25 bp, Mus musculus
gatcaaaaagaccaccgcctgcctg

SEQ ID NO: 295929 - DNA, 25 bp, Mus musculus
gcgtctccaccgtcctgctggagga

SEQ ID NO: 295930 - DNA, 25 bp, Mus musculus
acccaaggaccctgacctggttatg

SEQ ID NO: 295931 - DNA, 25 bp, Mus musculus
ccgatgcttattcaggctggggaga

SEQ ID NO: 295932 - DNA, 25 bp, Mus musculus
ggctagcgcccttttagtccctgga

SEQ ID NO: 295933 - DNA, 25 bp, Mus musculus
tggtctccaaaagagcccagctgca

SEQ ID NO: 295934 - DNA, 25 bp, Mus musculus
ggaggaatctgagccagcgttactg

SEQ ID NO: 295935 - DNA, 25 bp, Mus musculus
ctcctgcattcttgcggtcggggag

SEQ ID NO: 295936 - DNA, 25 bp, Mus musculus
gctctgtctctacactcgggctttg

SEQ ID NO: 295937 - DNA, 25 bp, Mus musculus
gagatccacgctgcagtcctgtccg

SEQ ID NO: 295938 - DNA, 25 bp, Mus musculus
ggtctcttaagtcccagctctgtgc

SEQ ID NO: 295939 - DNA, 25 bp, Mus musculus
tcacagagaggtgcttgtgggtctc

SEQ ID NO: 295940 - DNA, 25 bp, Mus musculus
tgtaagtgtgcgtgtgagtcacaga

SEQ ID NO: 295941 - DNA, 25 bp, Mus musculus
ctccctgtccacgtgtgagatgtaa

SEQ ID NO: 295942 - DNA, 25 bp, Mus musculus
tccgtgcgtgtctttgtctccctgt

SEQ ID NO: 295943 - DNA, 25 bp, Mus musculus
ggccgtgagcgtctctagtttcctg

SEQ ID NO: 295944 - DNA, 25 bp, Mus musculus
tccctggaggacttgtccatgtgtc

SEQ ID NO: 295945 - DNA, 25 bp, Mus musculus
gcgccctccagtggacccgggagat

SEQ ID NO: 295946 - DNA, 25 bp, Mus musculus
cgtggttcatactgcaggggacttt

SEQ ID NO: 295947 - DNA, 25 bp, Mus musculus
gtccggattcaacccattcttcaaa

SEQ ID NO: 295948 - DNA, 25 bp, Mus musculus
ccgactgttccagcgtccggattca

SEQ ID NO: 295949 - DNA, 25 bp, Mus musculus
gtttcaccgttctggctaccgactg

SEQ ID NO: 295950 - DNA, 25 bp, Mus musculus
ttgacaccttaaggaatcgcccgtc

SEQ ID NO: 295951 - DNA, 25 bp, Mus musculus
ggatatgacatttgacaccttaagg

SEQ ID NO: 295952 - DNA, 25 bp, Mus musculus
actttagagacagggatgccacttc

SEQ ID NO: 295953 - DNA, 25 bp, Mus musculus
cgcttacctgttacggcgtggttca

SEQ ID NO: 295954 - DNA, 25 bp, Mus musculus
ctgccggcggatatagttctccaga

SEQ ID NO: 295955 - DNA, 25 bp, Mus musculus
agaaaagaagtatgagccgctgccg

SEQ ID NO: 295956 - DNA, 25 bp, Mus musculus
gctctcatgcgcgactgacagaaaa

SEQ ID NO: 295957 - DNA, 25 bp, Mus musculus
atgggcgtcggtctcttcgccctca

SEQ ID NO: 295958 - DNA, 25 bp, Mus musculus
attccttcggaaccatggtggcgtg

SEQ ID NO: 295959 - DNA, 25 bp, Mus musculus
tgccacttcggaactaaaggatatg

SEQ ID NO: 295960 - DNA, 25 bp, Mus musculus
cgagtgtgtccgaggtcagcagtca

SEQ ID NO: 295961 - DNA, 25 bp, Mus musculus
cccagctccgaagggacgaacgaag

SEQ ID NO: 295962 - DNA, 25 bp, Mus musculus
acgaacgaaggcaagggcgacagtc

SEQ ID NO: 295963 - DNA, 25 bp, Mus musculus
aggcaagggcgacagtcctcggcca

SEQ ID NO: 295964 - DNA, 25 bp, Mus musculus
acaccggccgggacacccgagtgag

SEQ ID NO: 295965 - DNA, 25 bp, Mus musculus
gcgcaggctgccctccgagtgtgtc

SEQ ID NO: 295966 - DNA, 25 bp, Mus musculus
ggtctcgtcagctctgcaggcaagc

SEQ ID NO: 295967 - DNA, 25 bp, Mus musculus
ccgagctctcgccatcttgtgtgga

SEQ ID NO: 295968 - DNA, 25 bp, Mus musculus
agctctcgccatcttgtgtggagga

SEQ ID NO: 295969 - DNA, 25 bp, Mus musculus
ccgccattttgggagcttcgagtca

SEQ ID NO: 295970 - DNA, 25 bp, Mus musculus
gggagcttcgagtcaacaataaagg

SEQ ID NO: 295971 - DNA, 25 bp, Mus musculus
tcaacaataaaggaccgagggtgcg

SEQ ID NO: 295972 - DNA, 25 bp, Mus musculus
ggtcggcaggatcctgagggtatca

SEQ ID NO: 295973 - DNA, 25 bp, Mus musculus
gtgtccgaggtcagcagtcagcaga

SEQ ID NO: 295974 - DNA, 25 bp, Mus musculus
cctaggcaacgtcattccatctttt

SEQ ID NO: 295975 - DNA, 25 bp, Mus musculus
gcgaaggttttgcttccgggtctca

SEQ ID NO: 295976 - DNA, 25 bp, Mus musculus
cgcagcccgtgacgatcgtacaggc

SEQ ID NO: 295977 - DNA, 25 bp, Mus musculus
tcgcattggttcatgagtgagtttc

SEQ ID NO: 295978 - DNA, 25 bp, Mus musculus
agatttctgggagctaagggtcgca

SEQ ID NO: 295979 - DNA, 25 bp, Mus musculus
ctctgcattttgtttccggtcttgg

SEQ ID NO: 295980 - DNA, 25 bp, Mus musculus
ccctggtgtaaaaactggaagctct

SEQ ID NO: 295981 - DNA, 25 bp, Mus musculus
cagccattggaagtgcgaaggtttt

SEQ ID NO: 295982 - DNA, 25 bp, Mus musculus
ctcgcagaaccgcagcgaacgagtc

SEQ ID NO: 295983 - DNA, 25 bp, Mus musculus
ggagttcgcatcttctccacagcca

SEQ ID NO: 295984 - DNA, 25 bp, Mus musculus
tcagcctgtgagagacggtttaaaa

SEQ ID NO: 295985 - DNA, 25 bp, Mus musculus
tttcccgtgtctttgctgattggtc

SEQ ID NO: 295986 - DNA, 25 bp, Mus musculus
ggtcgactatgaagcaccggtttca

SEQ ID NO: 295987 - DNA, 25 bp, Mus musculus
ctgattggtcactgcgtcagcctgt

SEQ ID NO: 295988 - DNA, 25 bp, Mus musculus
actgactcggggcagttatcgagct

SEQ ID NO: 295989 - DNA, 25 bp, Mus musculus
actcggggcagttatcgagctgcgt

SEQ ID NO: 295990 - DNA, 25 bp, Mus musculus
tcggggcagttatcgagctgcgtct

SEQ ID NO: 295991 - DNA, 25 bp, Mus musculus
gcagttatcgagctgcgtctggagc

SEQ ID NO: 295992 - DNA, 25 bp, Mus musculus
agttatcgagctgcgtctggagctc

SEQ ID NO: 295993 - DNA, 25 bp, Mus musculus
tatcgagctgcgtctggagctcggc

SEQ ID NO: 295994 - DNA, 25 bp, Mus musculus
ctgcgtctggagctcggcgtagagc

SEQ ID NO: 295995 - DNA, 25 bp, Mus musculus
gcgtagagcgcctggcgggcctcca

SEQ ID NO: 295996 - DNA, 25 bp, Mus musculus
gcctggcgggcctccaggtgcctcc

SEQ ID NO: 295997 - DNA, 25 bp, Mus musculus
cggggcacaggggagagagaacaca

SEQ ID NO: 295998 - DNA, 25 bp, Mus musculus
agagagaacacacactcctcaactc

SEQ ID NO: 295999 - DNA, 25 bp, Mus musculus
acactcctcaactccggcccggcgc

SEQ ID NO: 296000 - DNA, 25 bp, Mus musculus
cgagcacaggagtacaccgggagtt

SEQ ID NO: 296001 - DNA, 25 bp, Mus musculus
tgactcggggcagttatcgagctgc

SEQ ID NO: 296002 - DNA, 25 bp, Mus musculus
agcgagcagccgccaatgcccggga

SEQ ID NO: 296003 - DNA, 25 bp, Mus musculus
gaggactcaccgctgaaccaggacc

SEQ ID NO: 296004 - DNA, 25 bp, Mus musculus
tggcggaggactcaccgctgaacca

SEQ ID NO: 296005 - DNA, 25 bp, Mus musculus
gctgaaccaggacctccggactgtt

SEQ ID NO: 296006 - DNA, 25 bp, Mus musculus
acctggcggaggactcaccgctgaa

SEQ ID NO: 296007 - DNA, 25 bp, Mus musculus
tgaaccaggacctccggactgttcg

SEQ ID NO: 296008 - DNA, 25 bp, Mus musculus
aggacctccggactgttcgctccta

SEQ ID NO: 296009 - DNA, 25 bp, Mus musculus
cagctggaccgtctacgcccggttg

SEQ ID NO: 296010 - DNA, 25 bp, Mus musculus
agctggaccgtctacgcccggttgc

SEQ ID NO: 296011 - DNA, 25 bp, Mus musculus
ctgacctggcggaggactcaccgct

SEQ ID NO: 296012 - DNA, 25 bp, Mus musculus
gactgttcgctcctaccagcccggg

SEQ ID NO: 296013 - DNA, 25 bp, Mus musculus
ttcgctcctaccagcccgggccctg

SEQ ID NO: 296014 - DNA, 25 bp, Mus musculus
gcggaggactcaccgctgaaccagg

SEQ ID NO: 296015 - DNA, 25 bp, Mus musculus
cgggccctgcaggtcgcccgcccgc

SEQ ID NO: 296016 - DNA, 25 bp, Mus musculus
tgacactggactgtcggtgtgacgt

SEQ ID NO: 296017 - DNA, 25 bp, Mus musculus
gtgcacttctcggaaacccgcaggg

SEQ ID NO: 296018 - DNA, 25 bp, Mus musculus
gaccgctgagctaacgggcccagaa

SEQ ID NO: 296019 - DNA, 25 bp, Mus musculus
cccgaagtgcgatgagtcagtctcc

SEQ ID NO: 296020 - DNA, 25 bp, Mus musculus
acgcccgtgttagtggccagttctg

SEQ ID NO: 296021 - DNA, 25 bp, Mus musculus
attcacgtgtgcacccgtggggtga

SEQ ID NO: 296022 - DNA, 25 bp, Mus musculus
tcgaggcccatgtgaggattcacgt

SEQ ID NO: 296023 - DNA, 25 bp, Mus musculus
actaagtgtgtgaagtcgaggccca

SEQ ID NO: 296024 - DNA, 25 bp, Mus musculus
gtcgcttgtttgcacagcagggaaa

SEQ ID NO: 296025 - DNA, 25 bp, Mus musculus
gcagagagagaaaaagtcgcttgtt

SEQ ID NO: 296026 - DNA, 25 bp, Mus musculus
cggcctttcttcagcagggcagaga

SEQ ID NO: 296027 - DNA, 25 bp, Mus musculus
acaaggcagcagtgttgggtcgcct

SEQ ID NO: 296028 - DNA, 25 bp, Mus musculus
cgacgctggaaaggtgcacttctcg

SEQ ID NO: 296029 - DNA, 25 bp, Mus musculus
agtggccagttctgtttgtgtgacc

SEQ ID NO: 296030 - DNA, 25 bp, Mus musculus
acggcgaatggaaccccgaggcata

SEQ ID NO: 296031 - DNA, 25 bp, Mus musculus
catagtgggaggggcacgcttacct

SEQ ID NO: 296032 - DNA, 25 bp, Mus musculus
gactcagccagacggcgaatggaac

SEQ ID NO: 296033 - DNA, 25 bp, Mus musculus
cctttgcccaagtgggccgcggcgg

SEQ ID NO: 296034 - DNA, 25 bp, Mus musculus
cacgcttaccttgtggggagttggg

SEQ ID NO: 296035 - DNA, 25 bp, Mus musculus
ttctgtagactcagccagacggcga

SEQ ID NO: 296036 - DNA, 25 bp, Mus musculus
ggactttcccttctgtagactcagc

SEQ ID NO: 296037 - DNA, 25 bp, Mus musculus
ggggactttcccttctgtagactca

SEQ ID NO: 296038 - DNA, 25 bp, Mus musculus
ctggtctcgtctggtcccggggact

SEQ ID NO: 296039 - DNA, 25 bp, Mus musculus
cagactggtctcgtctggtcccggg

SEQ ID NO: 296040 - DNA, 25 bp, Mus musculus
ctgggccagactggtctcgtctggt

SEQ ID NO: 296041 - DNA, 25 bp, Mus musculus
tcccttctgtagactcagccagacg

SEQ ID NO: 296042 - DNA, 25 bp, Mus musculus
ctttcccttctgtagactcagccag

SEQ ID NO: 296043 - DNA, 25 bp, Mus musculus
tgtagactcagccagacggcgaatg

SEQ ID NO: 296044 - DNA, 25 bp, Mus musculus
aaaagcggcggacaggcccagcctc

SEQ ID NO: 296045 - DNA, 25 bp, Mus musculus
agccctgcggttccggagctcgcag

SEQ ID NO: 296046 - DNA, 25 bp, Mus musculus
ctaggactccgggaggccgtgccaa

SEQ ID NO: 296047 - DNA, 25 bp, Mus musculus
gccgcttcgcctcttgccaagatgg

SEQ ID NO: 296048 - DNA, 25 bp, Mus musculus
ctgctgcccagagacgcggagctct

SEQ ID NO: 296049 - DNA, 25 bp, Mus musculus
acaagaggacgaaaagcggcggaca

SEQ ID NO: 296050 - DNA, 25 bp, Mus musculus
gaggacggaagacccgcgcgacaac

SEQ ID NO: 296051 - DNA, 25 bp, Mus musculus
cggcgcttaccatggtgaggccgca

SEQ ID NO: 296052 - DNA, 25 bp, Mus musculus
gaagttaccatttccgcactgcctc

SEQ ID NO: 296053 - DNA, 25 bp, Mus musculus
ggcgcccgaagttaccatttccgca

SEQ ID NO: 296054 - DNA, 25 bp, Mus musculus
ctagcacagggtagctacggggaca

SEQ ID NO: 296055 - DNA, 25 bp, Mus musculus
acgtacgcgctaccctagcacaggg

SEQ ID NO: 296056 - DNA, 25 bp, Mus musculus
cgctgccaaagacacgtacgcgcta

SEQ ID NO: 296057 - DNA, 25 bp, Mus musculus
ccctttcaattaagaggtggaggag

SEQ ID NO: 296058 - DNA, 25 bp, Mus musculus
aggcggacacagagcagacgcagtc

SEQ ID NO: 296059 - DNA, 25 bp, Mus musculus
gaaatctcgccagtagcccgctctg

SEQ ID NO: 296060 - DNA, 25 bp, Mus musculus
gcttttccaatctcggctgctcagg

SEQ ID NO: 296061 - DNA, 25 bp, Mus musculus
cgatcgtccttctcttgacccggtt

SEQ ID NO: 296062 - DNA, 25 bp, Mus musculus
agcatcctgctttcgggtcagctca

SEQ ID NO: 296063 - DNA, 25 bp, Mus musculus
tcaagaaggctgagcaccgcagtcc

SEQ ID NO: 296064 - DNA, 25 bp, Mus musculus
tccaccgtgaggctggttagtaagc

SEQ ID NO: 296065 - DNA, 25 bp, Mus musculus
cgcagtccgagagtcccggaagttt

SEQ ID NO: 296066 - DNA, 25 bp, Mus musculus
atcatgtcggccagcatgcggttgc

SEQ ID NO: 296067 - DNA, 25 bp, Mus musculus
tacgggttgagcagcactagctggc

SEQ ID NO: 296068 - DNA, 25 bp, Mus musculus
agccttctcgaagtccctgcgggcg

SEQ ID NO: 296069 - DNA, 25 bp, Mus musculus
tcaggtggacttgggcctagcaaga

SEQ ID NO: 296070 - DNA, 25 bp, Mus musculus
cctagcaagagagcgtcgcggatcc

SEQ ID NO: 296071 - DNA, 25 bp, Mus musculus
aggaccaatcgctgcccgagcaagg

SEQ ID NO: 296072 - DNA, 25 bp, Mus musculus
tggaacgcttctagaatccagaaag

SEQ ID NO: 296073 - DNA, 25 bp, Mus musculus
gccaccgacagctgtgcgccatgtt

SEQ ID NO: 296074 - DNA, 25 bp, Mus musculus
tgcaatctgcatatgagcctctggc

SEQ ID NO: 296075 - DNA, 25 bp, Mus musculus
ccgcccggcaacctggataagtgca

SEQ ID NO: 296076 - DNA, 25 bp, Mus musculus
gccgagaagccgattacacacgttc

SEQ ID NO: 296077 - DNA, 25 bp, Mus musculus
cgattacacacgttcccgggacgcg

SEQ ID NO: 296078 - DNA, 25 bp, Mus musculus
gtactccatgcaaaacccaagcgtc

SEQ ID NO: 296079 - DNA, 25 bp, Mus musculus
cgggcttagcccttatggaacgctt

SEQ ID NO: 296080 - DNA, 25 bp, Mus musculus
ccagaaagctccattgtactccatg

SEQ ID NO: 296081 - DNA, 25 bp, Mus musculus
agcgtcgcccaattgattctatgca

SEQ ID NO: 296082 - DNA, 25 bp, Mus musculus
tatgcaaaatggcaaggctctcggc

SEQ ID NO: 296083 - DNA, 25 bp, Mus musculus
ggctctcggcgaacgcgccttaaaa

SEQ ID NO: 296084 - DNA, 25 bp, Mus musculus
ccatcttcacgcttggagctctttc

SEQ ID NO: 296085 - DNA, 25 bp, Mus musculus
tttccaaaatccacacaaccgtgtg

SEQ ID NO: 296086 - DNA, 25 bp, Mus musculus
ggcagagttacacgacccactcgct

SEQ ID NO: 296087 - DNA, 25 bp, Mus musculus
aggccgggcagagttacacgaccca

SEQ ID NO: 296088 - DNA, 25 bp, Mus musculus
atcgacggtgccttctccgcgaagt

SEQ ID NO: 296089 - DNA, 25 bp, Mus musculus
ttgtgagctctaagcagccgcgggc

SEQ ID NO: 296090 - DNA, 25 bp, Mus musculus
ctccgcgaagttacggatgaacttg

SEQ ID NO: 296091 - DNA, 25 bp, Mus musculus
tggtctaaggtggaaggtacgtctc

SEQ ID NO: 296092 - DNA, 25 bp, Mus musculus
atgaacttggccatggtctaaggtg

SEQ ID NO: 296093 - DNA, 25 bp, Mus musculus
tacggatgaacttggccatggtcta

SEQ ID NO: 296094 - DNA, 25 bp, Mus musculus
tgccttctccgcgaagttacggatg

SEQ ID NO: 296095 - DNA, 25 bp, Mus musculus
cgctcaccggctaccatcgacggtg

SEQ ID NO: 296096 - DNA, 25 bp, Mus musculus
ctaggaccctgcagcttgtgagctc

SEQ ID NO: 296097 - DNA, 25 bp, Mus musculus
cttggtgccgcagcacaatccctcc

SEQ ID NO: 296098 - DNA, 25 bp, Mus musculus
gctgcggccttacagtggcctcctg

SEQ ID NO: 296099 - DNA, 25 bp, Mus musculus
ccgaaccgccggctgaatgtcaccc

SEQ ID NO: 296100 - DNA, 25 bp, Mus musculus
ccaatgggaagccgaacccgagcct

SEQ ID NO: 296101 - DNA, 25 bp, Mus musculus
agcctccgtggcaggctcgactcag

SEQ ID NO: 296102 - DNA, 25 bp, Mus musculus
attcgcgctcggacatcagtacctg

SEQ ID NO: 296103 - DNA, 25 bp, Mus musculus
ctcagagctgcatcaggggctcagc

SEQ ID NO: 296104 - DNA, 25 bp, Mus musculus
aggggctcagcttcaccgcttctct

SEQ ID NO: 296105 - DNA, 25 bp, Mus musculus
cgggagccgtcagtacacgctcatt

SEQ ID NO: 296106 - DNA, 25 bp, Mus musculus
agtacacgctcattccagccgggtc

SEQ ID NO: 296107 - DNA, 25 bp, Mus musculus
cactgcgcatgtgctagtggagaac

SEQ ID NO: 296108 - DNA, 25 bp, Mus musculus
catgtgctagtggagaacgctgctc

SEQ ID NO: 296109 - DNA, 25 bp, Mus musculus
gctgctcgtccgtagagccaatggg

SEQ ID NO: 296110 - DNA, 25 bp, Mus musculus
cccgtggacattcgcgctcggacat

SEQ ID NO: 296111 - DNA, 25 bp, Mus musculus
gcaggctcgactcagagctgcatca

SEQ ID NO: 296112 - DNA, 25 bp, Mus musculus
tagtggagaacgctgctcgtccgta

SEQ ID NO: 296113 - DNA, 25 bp, Mus musculus
ggacatcagtacctgtcactcgggc

SEQ ID NO: 296114 - DNA, 25 bp, Mus musculus
atgacagagaaaacaccgaggaggc

SEQ ID NO: 296115 - DNA, 25 bp, Mus musculus
tacttccgactcagcaaggcaaccg

SEQ ID NO: 296116 - DNA, 25 bp, Mus musculus
ttataccttgcctcttaccggagcc

SEQ ID NO: 296117 - DNA, 25 bp, Mus musculus
tgcctcttaccggagcctgaaaggg

SEQ ID NO: 296118 - DNA, 25 bp, Mus musculus
cctgaaagggcagggacgacgacac

SEQ ID NO: 296119 - DNA, 25 bp, Mus musculus
gggacgacgacacctcacagctaca

SEQ ID NO: 296120 - DNA, 25 bp, Mus musculus
aaaggttcttacttccgactcagca

SEQ ID NO: 296121 - DNA, 25 bp, Mus musculus
caaggcaaccggagctgacatcatc

SEQ ID NO: 296122 - DNA, 25 bp, Mus musculus
agctgacatcatcgctgagcgccga

SEQ ID NO: 296123 - DNA, 25 bp, Mus musculus
tgtcgggcttcgctaatgacagaga

SEQ ID NO: 296124 - DNA, 25 bp, Mus musculus
aacactctcgtcctcttataccttg

SEQ ID NO: 296125 - DNA, 25 bp, Mus musculus
gaaaacaccgaggaggcgcatgcgc

SEQ ID NO: 296126 - DNA, 25 bp, Mus musculus
gcatgcgcacgtttgctggcagcta

SEQ ID NO: 296127 - DNA, 25 bp, Mus musculus
agcgccgagcctgttgggtctttac

SEQ ID NO: 296128 - DNA, 25 bp, Mus musculus
gatgcagctggcaagaggaacagta

SEQ ID NO: 296129 - DNA, 25 bp, Mus musculus
gctctttcaaaggtgactcccgaca

SEQ ID NO: 296130 - DNA, 25 bp, Mus musculus
ggtgactcccgacatgacgtcactt

SEQ ID NO: 296131 - DNA, 25 bp, Mus musculus
cgggacggctctttcaaaggtgact

SEQ ID NO: 296132 - DNA, 25 bp, Mus musculus
gtcacttccggcaccacctgcatgg

SEQ ID NO: 296133 - DNA, 25 bp, Mus musculus
taaagagggtgtgtaagtatcggaa

SEQ ID NO: 296134 - DNA, 25 bp, Mus musculus
taagtatcggaagagctgtcgggat

SEQ ID NO: 296135 - DNA, 25 bp, Mus musculus
gctgcgctctctttccactgctgag

SEQ ID NO: 296136 - DNA, 25 bp, Mus musculus
cactgctgagcatcctagtcgtcca

SEQ ID NO: 296137 - DNA, 25 bp, Mus musculus
tgagcatcctagtcgtccagggtga

SEQ ID NO: 296138 - DNA, 25 bp, Mus musculus
cctagtcgtccagggtgagtgcgcc

SEQ ID NO: 296139 - DNA, 25 bp, Mus musculus
tcaggaaagatggtcgcttttccgg

SEQ ID NO: 296140 - DNA, 25 bp, Mus musculus
gaggccgtggctgcgctctctttcc

SEQ ID NO: 296141 - DNA, 25 bp, Mus musculus
tgcgccagctggctggactccactt

SEQ ID NO: 296142 - DNA, 25 bp, Mus musculus
gaaccgaattctgctttttgtcttg

SEQ ID NO: 296143 - DNA, 25 bp, Mus musculus
ctttgccctccgcatggggcgatca

SEQ ID NO: 296144 - DNA, 25 bp, Mus musculus
ctttgtctgcgccagagcagcggca

SEQ ID NO: 296145 - DNA, 25 bp, Mus musculus
tgccagccacaggagaaatgccagt

SEQ ID NO: 296146 - DNA, 25 bp, Mus musculus
agaaatgccagtcccgcgtcagggg

SEQ ID NO: 296147 - DNA, 25 bp, Mus musculus
cgagtccttggcctcccgtgggaat

SEQ ID NO: 296148 - DNA, 25 bp, Mus musculus
ggcactcggagggtagttctgaacc

SEQ ID NO: 296149 - DNA, 25 bp, Mus musculus
tgtcttgttgaaccttctggatccc

SEQ ID NO: 296150 - DNA, 25 bp, Mus musculus
gagctgatgtcagcctgggctctcg

SEQ ID NO: 296151 - DNA, 25 bp, Mus musculus
cccggcttgagctgattacctctaa

SEQ ID NO: 296152 - DNA, 25 bp, Mus musculus
tctaagcacaggctcgcaaggtccc

SEQ ID NO: 296153 - DNA, 25 bp, Mus musculus
ctgcactcgggcagcagagagatgc

SEQ ID NO: 296154 - DNA, 25 bp, Mus musculus
gcgatcatgggacgatcctggcttg

SEQ ID NO: 296155 - DNA, 25 bp, Mus musculus
tctggatccctcacaggacaatctg

SEQ ID NO: 296156 - DNA, 25 bp, Mus musculus
cgctgcccttactcgtgttctctga

SEQ ID NO: 296157 - DNA, 25 bp, Mus musculus
tgtaccggtcgtccgcagcgggcaa

SEQ ID NO: 296158 - DNA, 25 bp, Mus musculus
tctgagcggaacaaaaacagccttc

SEQ ID NO: 296159 - DNA, 25 bp, Mus musculus
cagccttccaacaaacctaaaagct

SEQ ID NO: 296160 - DNA, 25 bp, Mus musculus
ccgtgaactcttctcctaattggca

SEQ ID NO: 296161 - DNA, 25 bp, Mus musculus
attcccgtcccgctggagaggaaga

SEQ ID NO: 296162 - DNA, 25 bp, Mus musculus
ggctggaccctacggccgtgataca

SEQ ID NO: 296163 - DNA, 25 bp, Mus musculus
tgatacacggcgcaacgggcactgt

SEQ ID NO: 296164 - DNA, 25 bp, Mus musculus
cactgtgcgaaaccgacggggacgc

SEQ ID NO: 296165 - DNA, 25 bp, Mus musculus
agcagaggcgcatcgcagtgccgct

SEQ ID NO: 296166 - DNA, 25 bp, Mus musculus
gtctcgctctctcgcggctaacttt

SEQ ID NO: 296167 - DNA, 25 bp, Mus musculus
tctctcgcggctaactttccggagc

SEQ ID NO: 296168 - DNA, 25 bp, Mus musculus
gcccacagacgacctcgggtggaga

SEQ ID NO: 296169 - DNA, 25 bp, Mus musculus
acgcgtgttggttcagggctgtacc

SEQ ID NO: 296170 - DNA, 25 bp, Mus musculus
tccacagggccagcttgacatcaac

SEQ ID NO: 296171 - DNA, 25 bp, Mus musculus
acatcaacctgaaggcggagcctcg

SEQ ID NO: 296172 - DNA, 25 bp, Mus musculus
gggagcctaccgtatgcaatgaatt

SEQ ID NO: 296173 - DNA, 25 bp, Mus musculus
tgcaatgaattctaggctcaggctg

SEQ ID NO: 296174 - DNA, 25 bp, Mus musculus
cgcgaatgtgaactttaaagcaaca

SEQ ID NO: 296175 - DNA, 25 bp, Mus musculus
ctaggctcaggctggagatcgtgac

SEQ ID NO: 296176 - DNA, 25 bp, Mus musculus
atcgtgacgaggaatgggagcaaac

SEQ ID NO: 296177 - DNA, 25 bp, Mus musculus
gggagcaaacgcgacaacatcctgg

SEQ ID NO: 296178 - DNA, 25 bp, Mus musculus
cgacaacatcctgggcgcacagcgg

SEQ ID NO: 296179 - DNA, 25 bp, Mus musculus
gcgcacagcggcatcgtccactgga

SEQ ID NO: 296180 - DNA, 25 bp, Mus musculus
atcgtccactggagccggcctttac

SEQ ID NO: 296181 - DNA, 25 bp, Mus musculus
gcggcgtcctgagaactgaagactg

SEQ ID NO: 296182 - DNA, 25 bp, Mus musculus
tcagcccacggagcttgggaacctc

SEQ ID NO: 296183 - DNA, 25 bp, Mus musculus
tgaagactgccgctggatccacagg

SEQ ID NO: 296184 - DNA, 25 bp, Mus musculus
actctgctagtccttctgggatccg

SEQ ID NO: 296185 - DNA, 25 bp, Mus musculus
tgctagtccttctgggatccgctcg

SEQ ID NO: 296186 - DNA, 25 bp, Mus musculus
cgcgcgtctcctgttgcttcttcaa

SEQ ID NO: 296187 - DNA, 25 bp, Mus musculus
cgcgtctcctgttgcttcttcaagc

SEQ ID NO: 296188 - DNA, 25 bp, Mus musculus
ctgttgcttcttcaagcctcacttc

SEQ ID NO: 296189 - DNA, 25 bp, Mus musculus
caagcctcacttccctttgcgaaga

SEQ ID NO: 296190 - DNA, 25 bp, Mus musculus
gcctcacttccctttgcgaagagct

SEQ ID NO: 296191 - DNA, 25 bp, Mus musculus
tttgcgaagagctcgcagagagaag

SEQ ID NO: 296192 - DNA, 25 bp, Mus musculus
cgggcgacatcacaggggtctgcaa

SEQ ID NO: 296193 - DNA, 25 bp, Mus musculus
ccagaagccagtggacgagggcgac

SEQ ID NO: 296194 - DNA, 25 bp, Mus musculus
gaccggggaggccaaccagtcagcc

SEQ ID NO: 296195 - DNA, 25 bp, Mus musculus
gaggcgggaaagctgcaagccgcgc

SEQ ID NO: 296196 - DNA, 25 bp, Mus musculus
tagtccttctgggatccgctcggag

SEQ ID NO: 296197 - DNA, 25 bp, Mus musculus
actcccggctgcttggactctgcta

SEQ ID NO: 296198 - DNA, 25 bp, Mus musculus
tgctcctggactctttacacaaagg

SEQ ID NO: 296199 - DNA, 25 bp, Mus musculus
tggtaactttcctcctgctcctgga

SEQ ID NO: 296200 - DNA, 25 bp, Mus musculus
gttttcccatcgcagcccagcttta

SEQ ID NO: 296201 - DNA, 25 bp, Mus musculus
tggtcctcggactgagacttcatcc

SEQ ID NO: 296202 - DNA, 25 bp, Mus musculus
cttcatccgggagccctcggtattt

SEQ ID NO: 296203 - DNA, 25 bp, Mus musculus
tccttggacctagggaagatcactc

SEQ ID NO: 296204 - DNA, 25 bp, Mus musculus
atcactcctgccgtagcttcgtgcg

SEQ ID NO: 296205 - DNA, 25 bp, Mus musculus
ttgttcttcagacccaagagtcgcc

SEQ ID NO: 296206 - DNA, 25 bp, Mus musculus
aagagtcgccatcacctatgtctca

SEQ ID NO: 296207 - DNA, 25 bp, Mus musculus
caaggtgcaagactctccgctccgg

SEQ ID NO: 296208 - DNA, 25 bp, Mus musculus
gacctggggacaagtgttcagactg

SEQ ID NO: 296209 - DNA, 25 bp, Mus musculus
ttccgtgcacctgatctgagaggca

SEQ ID NO: 296210 - DNA, 25 bp, Mus musculus
cctctttatggcatgtggctggtaa

SEQ ID NO: 296211 - DNA, 25 bp, Mus musculus
tacacaaaggtgagacccgcgctgc

SEQ ID NO: 296212 - DNA, 25 bp, Mus musculus
tgtaccggtgcacagcgcggaactc

SEQ ID NO: 296213 - DNA, 25 bp, Mus musculus
cgcatcgtctcatccttcagcgaga

SEQ ID NO: 296214 - DNA, 25 bp, Mus musculus
actcggtgggcagtgctgaatatca

SEQ ID NO: 296215 - DNA, 25 bp, Mus musculus
atcagccacatgaacgtcacgggtc

SEQ ID NO: 296216 - DNA, 25 bp, Mus musculus
tgctgaatatcaggcgcgaataaac

SEQ ID NO: 296217 - DNA, 25 bp, Mus musculus
aaccagtacaccatgtccgacggca

SEQ ID NO: 296218 - DNA, 25 bp, Mus musculus
tgcgggacggaagccaccgcaccaa

SEQ ID NO: 296219 - DNA, 25 bp, Mus musculus
cacgagtcacatgggccctggacga

SEQ ID NO: 296220 - DNA, 25 bp, Mus musculus
ctcagtaatgtgtgccgccaagggc

SEQ ID NO: 296221 - DNA, 25 bp, Mus musculus
cagttctcagtaatgtgtgccgcca

SEQ ID NO: 296222 - DNA, 25 bp, Mus musculus
ccctggggagcagttctcagtaatg

SEQ ID NO: 296223 - DNA, 25 bp, Mus musculus
gtggtcaaccctggggagcagttct

SEQ ID NO: 296224 - DNA, 25 bp, Mus musculus
tccttcagcgagaaggtggtcaacc

SEQ ID NO: 296225 - DNA, 25 bp, Mus musculus
ccctggacgacgagcccgttgtgcg

SEQ ID NO: 296226 - DNA, 25 bp, Mus musculus
tctcccagcttagttcccgcgcagc

SEQ ID NO: 296227 - DNA, 25 bp, Mus musculus
cgcttccagggacgccggggtgttg

SEQ ID NO: 296228 - DNA, 25 bp, Mus musculus
cacctcacaacgcttcagctccctg

SEQ ID NO: 296229 - DNA, 25 bp, Mus musculus
tcccgcgcagcaacacctcacaacg

SEQ ID NO: 296230 - DNA, 25 bp, Mus musculus
gcgcagcaacacctcacaacgcttc

SEQ ID NO: 296231 - DNA, 25 bp, Mus musculus
gcaacacctcacaacgcttcagctc

SEQ ID NO: 296232 - DNA, 25 bp, Mus musculus
ttagttcccgcgcagcaacacctca

SEQ ID NO: 296233 - DNA, 25 bp, Mus musculus
gcttcagctccctgcaaactcctgc

SEQ ID NO: 296234 - DNA, 25 bp, Mus musculus
agctccctgcaaactcctgccacgc

SEQ ID NO: 296235 - DNA, 25 bp, Mus musculus
tttccgggaggatggctctgcgcct

SEQ ID NO: 296236 - DNA, 25 bp, Mus musculus
gcacgccggagggctcttctctccc

SEQ ID NO: 296237 - DNA, 25 bp, Mus musculus
ggtgttgccctgcagcgaccagcaa

SEQ ID NO: 296238 - DNA, 25 bp, Mus musculus
gtgttgccctgcagcgaccagcaac

SEQ ID NO: 296239 - DNA, 25 bp, Mus musculus
tccctgcaaactcctgccacgccac

SEQ ID NO: 296240 - DNA, 25 bp, Mus musculus
ccaagctgcaaagcccgcctggaag

SEQ ID NO: 296241 - DNA, 25 bp, Mus musculus
tacgggctcggatagccatgcccgc

SEQ ID NO: 296242 - DNA, 25 bp, Mus musculus
tgcagtcctgatgccgccgaggccg

SEQ ID NO: 296243 - DNA, 25 bp, Mus musculus
aaagctacgggctcggatagccatg

SEQ ID NO: 296244 - DNA, 25 bp, Mus musculus
gactctgcagtcctgatgccgccga

SEQ ID NO: 296245 - DNA, 25 bp, Mus musculus
ccggcgtccagatgtagctgggtcc

SEQ ID NO: 296246 - DNA, 25 bp, Mus musculus
tggatcgccatcgtcgtctcctctc

SEQ ID NO: 296247 - DNA, 25 bp, Mus musculus
gtctcctctcgtgcgctacggattt

SEQ ID NO: 296248 - DNA, 25 bp, Mus musculus
tcctctcgtgcgctacggatttctc

SEQ ID NO: 296249 - DNA, 25 bp, Mus musculus
tctcgtgcgctacggatttctcctg

SEQ ID NO: 296250 - DNA, 25 bp, Mus musculus
gtgcgctacggatttctcctgccca

SEQ ID NO: 296251 - DNA, 25 bp, Mus musculus
tccgccgcctggaccgggaactgag

SEQ ID NO: 296252 - DNA, 25 bp, Mus musculus
cgaggggcctgcagactctgcagtc

SEQ ID NO: 296253 - DNA, 25 bp, Mus musculus
acgcagccgtaggagcccggagtcc

SEQ ID NO: 296254 - DNA, 25 bp, Mus musculus
gctcgggctcgactcgaacagcacc

SEQ ID NO: 296255 - DNA, 25 bp, Mus musculus
acgatctcgccctcggcgctgagca

SEQ ID NO: 296256 - DNA, 25 bp, Mus musculus
cacgaacgccgtctccttggcccgc

SEQ ID NO: 296257 - DNA, 25 bp, Mus musculus
ccgagcgtggcctcatggtcctgcg

SEQ ID NO: 296258 - DNA, 25 bp, Mus musculus
ggtcgcctcacagcaccatcgcggc

SEQ ID NO: 296259 - DNA, 25 bp, Mus musculus
ctttgtgggtcgcaggctctgctcc

SEQ ID NO: 296260 - DNA, 25 bp, Mus musculus
ttcatctgctccacgtgaggggtta

SEQ ID NO: 296261 - DNA, 25 bp, Mus musculus
tgctccgcccaggtagtctttttcg

SEQ ID NO: 296262 - DNA, 25 bp, Mus musculus
cctccgcggcagacatttctcttgg

SEQ ID NO: 296263 - DNA, 25 bp, Mus musculus
gacatttctcttggcagttgctgga

SEQ ID NO: 296264 - DNA, 25 bp, Mus musculus
tctcttggcagttgctggagtacgg

SEQ ID NO: 296265 - DNA, 25 bp, Mus musculus
tacggggagagtaagatcctcaacc

SEQ ID NO: 296266 - DNA, 25 bp, Mus musculus
ggccctttcatctgctccacgtgag

SEQ ID NO: 296267 - DNA, 25 bp, Mus musculus
gggtggctacctgcacgatctcgcc

SEQ ID NO: 296268 - DNA, 25 bp, Mus musculus
tccgggtcgtaggttccggacagca

SEQ ID NO: 296269 - DNA, 25 bp, Mus musculus
agcgaccggacaacggagccgctga

SEQ ID NO: 296270 - DNA, 25 bp, Mus musculus
cctgagacccaagcggagcccgagg

SEQ ID NO: 296271 - DNA, 25 bp, Mus musculus
ctctctgaggagtttatggggaaga

SEQ ID NO: 296272 - DNA, 25 bp, Mus musculus
aagagtcaaggctatggcagtccga

SEQ ID NO: 296273 - DNA, 25 bp, Mus musculus
tcggaaccgggatggtccttacaga

SEQ ID NO: 296274 - DNA, 25 bp, Mus musculus
acgccatgaaggacgagggccctgt

SEQ ID NO: 296275 - DNA, 25 bp, Mus musculus
acacgaggattcgaggcgccggaac

SEQ ID NO: 296276 - DNA, 25 bp, Mus musculus
tcacgggcctgtgacagaagctgtc

SEQ ID NO: 296277 - DNA, 25 bp, Mus musculus
agtggaggctggacctcggatatac

SEQ ID NO: 296278 - DNA, 25 bp, Mus musculus
ttccggacagcatcggtcctaagga

SEQ ID NO: 296279 - DNA, 25 bp, Mus musculus
tcctaaggagagagaggcacattgc

SEQ ID NO: 296280 - DNA, 25 bp, Mus musculus
cacattgcacggagcagctgagtcc

SEQ ID NO: 296281 - DNA, 25 bp, Mus musculus
aagtgatgtcgctgtcagtggcgcc

SEQ ID NO: 296282 - DNA, 25 bp, Mus musculus
cccggcctcagataggacgcgtccc

SEQ ID NO: 296283 - DNA, 25 bp, Mus musculus
tgtagatgttgaccagctcgctgtt

SEQ ID NO: 296284 - DNA, 25 bp, Mus musculus
gaccagctcgctgttgacgtcgtcc

SEQ ID NO: 296285 - DNA, 25 bp, Mus musculus
gctcgctgttgacgtcgtccgcgta

SEQ ID NO: 296286 - DNA, 25 bp, Mus musculus
tcgtccgcgtaggtgcgctcaaact

SEQ ID NO: 296287 - DNA, 25 bp, Mus musculus
ggtgcgctcaaactccgcgtctttc

SEQ ID NO: 296288 - DNA, 25 bp, Mus musculus
tcaaactccgcgtctttctgcgaga

SEQ ID NO: 296289 - DNA, 25 bp, Mus musculus
ctttctgcgagacgttcttgggccc

SEQ ID NO: 296290 - DNA, 25 bp, Mus musculus
gctctcgacggaggccaccaagagc

SEQ ID NO: 296291 - DNA, 25 bp, Mus musculus
acgcacaagggcagacgccaggcga

SEQ ID NO: 296292 - DNA, 25 bp, Mus musculus
acgccaggcgatcatggcccgggac

SEQ ID NO: 296293 - DNA, 25 bp, Mus musculus
gaggccaccaagagcacgcacaagg

SEQ ID NO: 296294 - DNA, 25 bp, Mus musculus
gcatctcaccgggaccagaacttta

SEQ ID NO: 296295 - DNA, 25 bp, Mus musculus
ttccagcatctcaccgggaccagaa

SEQ ID NO: 296296 - DNA, 25 bp, Mus musculus
actcacacaggcagagggtccgtgc

SEQ ID NO: 296297 - DNA, 25 bp, Mus musculus
ctttgcttggcgcacaggtctaccg

SEQ ID NO: 296298 - DNA, 25 bp, Mus musculus
gcgcgctctttgcttggcgcacagg

SEQ ID NO: 296299 - DNA, 25 bp, Mus musculus
tttccctcgcagtgcgcgctctttg

SEQ ID NO: 296300 - DNA, 25 bp, Mus musculus
cgggtgcgcctcactttccctcgca

SEQ ID NO: 296301 - DNA, 25 bp, Mus musculus
tcgggcaaatggcttccggaagtcc

SEQ ID NO: 296302 - DNA, 25 bp, Mus musculus
tcagtcgctcgcttgatcccgacgg

SEQ ID NO: 296303 - DNA, 25 bp, Mus musculus
ccacgatgcactcacacaggcagag

SEQ ID NO: 296304 - DNA, 25 bp, Mus musculus
cgcgtcccacccgtcacgacgaggc

SEQ ID NO: 296305 - DNA, 25 bp, Mus musculus
acaataccggctcgcccgcgcgtcc

SEQ ID NO: 296306 - DNA, 25 bp, Mus musculus
gggagccgggcctcacaataccggc

SEQ ID NO: 296307 - DNA, 25 bp, Mus musculus
ttgcgcttcagtcgctcgcttgatc

SEQ ID NO: 296308 - DNA, 25 bp, Mus musculus
ctgccactcgggcaaatggcttccg

SEQ ID NO: 296309 - DNA, 25 bp, Mus musculus
gcaccaagcagcagcgcctccactt

SEQ ID NO: 296310 - DNA, 25 bp, Mus musculus
catagggcacgaagacatccgagtc

SEQ ID NO: 296311 - DNA, 25 bp, Mus musculus
tgccgactcagctggtggtagtaac

SEQ ID NO: 296312 - DNA, 25 bp, Mus musculus
acatccgagtcggtccggtaggaca

SEQ ID NO: 296313 - DNA, 25 bp, Mus musculus
attgaagaggtccttggccaagccc

SEQ ID NO: 296314 - DNA, 25 bp, Mus musculus
gagggcgattcgaagttcatccaca

SEQ ID NO: 296315 - DNA, 25 bp, Mus musculus
agttagcgtcactgctccctcctgg

SEQ ID NO: 296316 - DNA, 25 bp, Mus musculus
gctgttcagttggatcgctcctgga

SEQ ID NO: 296317 - DNA, 25 bp, Mus musculus
tcctggtcgtcgaacacgcgtagta

SEQ ID NO: 296318 - DNA, 25 bp, Mus musculus
agcgccttatccgtgcgttctcggg

SEQ ID NO: 296319 - DNA, 25 bp, Mus musculus
ggccagtcgtggagttccttcacca

SEQ ID NO: 296320 - DNA, 25 bp, Mus musculus
ggtggaacagcactgcctgagcctc

SEQ ID NO: 296321 - DNA, 25 bp, Mus musculus
tcaacgcggtgcacagtagtcccac

SEQ ID NO: 296322 - DNA, 25 bp, Mus musculus
accggctctcatgctgtagctcttg

SEQ ID NO: 296323 - DNA, 25 bp, Mus musculus
acctacggtctccagggctttgcca

SEQ ID NO: 296324 - DNA, 25 bp, Mus musculus
ttagcagctggacatcggagaggtc

SEQ ID NO: 296325 - DNA, 25 bp, Mus musculus
cttagaagttgctgctgaccctcga

SEQ ID NO: 296326 - DNA, 25 bp, Mus musculus
tgaccctcgacgttttcaatgcctg

SEQ ID NO: 296327 - DNA, 25 bp, Mus musculus
acccacgcgggaaggtcgagctcgc

SEQ ID NO: 296328 - DNA, 25 bp, Mus musculus
cgcccggtgaggtcacggttgccat

SEQ ID NO: 296329 - DNA, 25 bp, Mus musculus
ttgccatggcttcgggcagtgacgc

SEQ ID NO: 296330 - DNA, 25 bp, Mus musculus
agtgacgcgcgtccgcacgtgacgc

SEQ ID NO: 296331 - DNA, 25 bp, Mus musculus
ccggaggtttcactgcacaacaaga

SEQ ID NO: 296332 - DNA, 25 bp, Mus musculus
tggccgctcgcatcggctactacga

SEQ ID NO: 296333 - DNA, 25 bp, Mus musculus
ggctactacgagatcgaccgcacca

SEQ ID NO: 296334 - DNA, 25 bp, Mus musculus
tcgaccgcaccatcggcaagggcaa

SEQ ID NO: 296335 - DNA, 25 bp, Mus musculus
tccgggaacttagcagctggacatc

SEQ ID NO: 296336 - DNA, 25 bp, Mus musculus
tggaaaggaggcgttggaactctct

SEQ ID NO: 296337 - DNA, 25 bp, Mus musculus
cctcgtcaccaaggccaaggtagtg

SEQ ID NO: 296338 - DNA, 25 bp, Mus musculus
gcaacctggaccagctgcgcgatga

SEQ ID NO: 296339 - DNA, 25 bp, Mus musculus
gccttcatccgcgtcagcacagatg

SEQ ID NO: 296340 - DNA, 25 bp, Mus musculus
gaggcgctgaacctgctgcaggaca

SEQ ID NO: 296341 - DNA, 25 bp, Mus musculus
ccgaccgagtcaaagagctcttcca

SEQ ID NO: 296342 - DNA, 25 bp, Mus musculus
tccacccttacgcagaacgcttggt

SEQ ID NO: 296343 - DNA, 25 bp, Mus musculus
cgcagaacgcttggtgactggaatt

SEQ ID NO: 296344 - DNA, 25 bp, Mus musculus
ctggaattgggcaccacgtgcagga

SEQ ID NO: 296345 - DNA, 25 bp, Mus musculus
gcgcgactcagtcgctgcgtgcaga

SEQ ID NO: 296346 - DNA, 25 bp, Mus musculus
ctgcgtgcagactctgtcccacaaa

SEQ ID NO: 296347 - DNA, 25 bp, Mus musculus
gtcccacaaactcacacgtaaggcg

SEQ ID NO: 296348 - DNA, 25 bp, Mus musculus
taaggcgaaggacctgcacaccagc

SEQ ID NO: 296349 - DNA, 25 bp, Mus musculus
acatgcagagtcgagtgctgcacca

SEQ ID NO: 296350 - DNA, 25 bp, Mus musculus
gcgcgatgagctcagtgccttcatc

SEQ ID NO: 296351 - DNA, 25 bp, Mus musculus
gtgctgcaccataccgaccgagtca

SEQ ID NO: 296352 - DNA, 25 bp, Mus musculus
ttctgcttccctagggcacgacgcg

SEQ ID NO: 296353 - DNA, 25 bp, Mus musculus
gtaaacaagctgaagtcattctccc

SEQ ID NO: 296354 - DNA, 25 bp, Mus musculus
cagccgtgcacccagaggcagctct

SEQ ID NO: 296355 - DNA, 25 bp, Mus musculus
gcccggggaaccacccagccgtgca

SEQ ID NO: 296356 - DNA, 25 bp, Mus musculus
gttaccggaacgtgagtctgagccc

SEQ ID NO: 296357 - DNA, 25 bp, Mus musculus
gtgcatgaactgttaccggaacgtg

SEQ ID NO: 296358 - DNA, 25 bp, Mus musculus
agtcactgtgcatgaactgttaccg

SEQ ID NO: 296359 - DNA, 25 bp, Mus musculus
accgagatcgagtcactgtgcatga

SEQ ID NO: 296360 - DNA, 25 bp, Mus musculus
agcccaccgagatcgagtcactgtg

SEQ ID NO: 296361 - DNA, 25 bp, Mus musculus
tgaggagcaacagcccaccgagatc

SEQ ID NO: 296362 - DNA, 25 bp, Mus musculus
ctcagcgccgaggatgaggagcaac

SEQ ID NO: 296363 - DNA, 25 bp, Mus musculus
cgtcaccagccaccgggcctttgtt

SEQ ID NO: 296364 - DNA, 25 bp, Mus musculus
gggtgtaaacaagctgaagtcattc

SEQ ID NO: 296365 - DNA, 25 bp, Mus musculus
gcagctctggcgtacagggtgtaaa

SEQ ID NO: 296366 - DNA, 25 bp, Mus musculus
tgaagaattttgtcccccacgccga

SEQ ID NO: 296367 - DNA, 25 bp, Mus musculus
attttgtcccccacgccgagctgtt

SEQ ID NO: 296368 - DNA, 25 bp, Mus musculus
atggcggcagctccgccactcacca

SEQ ID NO: 296369 - DNA, 25 bp, Mus musculus
gccactcaccaaagctgagtatctg

SEQ ID NO: 296370 - DNA, 25 bp, Mus musculus
ccaaagctgagtatctgaagcgtta

SEQ ID NO: 296371 - DNA, 25 bp, Mus musculus
ctgagtatctgaagcgttacttgtc

SEQ ID NO: 296372 - DNA, 25 bp, Mus musculus
tctgaagcgttacttgtctgggaca

SEQ ID NO: 296373 - DNA, 25 bp, Mus musculus
gccctcggccgcagctcttcctcgt

SEQ ID NO: 296374 - DNA, 25 bp, Mus musculus
cttgtctgggacagatgctggcttg

SEQ ID NO: 296375 - DNA, 25 bp, Mus musculus
tcgcaagcggcgcaaaaaacggccg

SEQ ID NO: 296376 - DNA, 25 bp, Mus musculus
atgctggcttggaaggaggtcccga

SEQ ID NO: 296377 - DNA, 25 bp, Mus musculus
aggccggtcgcaagcggcgcaaaaa

SEQ ID NO: 296378 - DNA, 25 bp, Mus musculus
cggcgcaaaaaacggccgaagcctg

SEQ ID NO: 296379 - DNA, 25 bp, Mus musculus
agcgttacttgtctgggacagatgc

SEQ ID NO: 296380 - DNA, 25 bp, Mus musculus
tgagaagttagttgcaccatctgcc

SEQ ID NO: 296381 - DNA, 25 bp, Mus musculus
caggtaattgctgacggctgagcca

SEQ ID NO: 296382 - DNA, 25 bp, Mus musculus
agctctccttgcatctggtcccgga

SEQ ID NO: 296383 - DNA, 25 bp, Mus musculus
ccgcagcagctaagccatgtaggtc

SEQ ID NO: 296384 - DNA, 25 bp, Mus musculus
agccatgtaggtcagggcattatcg

SEQ ID NO: 296385 - DNA, 25 bp, Mus musculus
gggcattatcggattcgctttacca

SEQ ID NO: 296386 - DNA, 25 bp, Mus musculus
cgctttaccagcgtggaaatcgaga

SEQ ID NO: 296387 - DNA, 25 bp, Mus musculus
tcgagaacaggagaggttaaatctc

SEQ ID NO: 296388 - DNA, 25 bp, Mus musculus
gccgaggtccaggaaccagtcaata

SEQ ID NO: 296389 - DNA, 25 bp, Mus musculus
ggaaccagtcaataccaggcctgaa

SEQ ID NO: 296390 - DNA, 25 bp, Mus musculus
accatctgccctctccaaagtggag

SEQ ID NO: 296391 - DNA, 25 bp, Mus musculus
taattccattttcctcgcgtgaccc

SEQ ID NO: 296392 - DNA, 25 bp, Mus musculus
ctgcgggtcactcgactcttaattc

SEQ ID NO: 296393 - DNA, 25 bp, Mus musculus
caggcctgaactagccctgcgggtc

SEQ ID NO: 296394 - DNA, 25 bp, Mus musculus
cgccgcgctgtagccgctgattaat

SEQ ID NO: 296395 - DNA, 25 bp, Mus musculus
cggccgaaactgttgccagcgcaaa

SEQ ID NO: 296396 - DNA, 25 bp, Mus musculus
gcgcaaagctcctggttacacctga

SEQ ID NO: 296397 - DNA, 25 bp, Mus musculus
ggggacagatgtgcatcaatattta

SEQ ID NO: 296398 - DNA, 25 bp, Mus musculus
gctcggattagcataacatcaagtc

SEQ ID NO: 296399 - DNA, 25 bp, Mus musculus
ttgatttcggggatcaaagcgccgc

SEQ ID NO: 296400 - DNA, 25 bp, Mus musculus
agcgccgagaagaaaagagatgccg

SEQ ID NO: 296401 - DNA, 25 bp, Mus musculus
cgagccacagctgcgccgctttgat

SEQ ID NO: 296402 - DNA, 25 bp, Mus musculus
ccgctttgatgtgccgattgtgcca

SEQ ID NO: 296403 - DNA, 25 bp, Mus musculus
tgccgattgtgccaagttaactttg

SEQ ID NO: 296404 - DNA, 25 bp, Mus musculus
aactttgcgggttgttggatgccac

SEQ ID NO: 296405 - DNA, 25 bp, Mus musculus
gtcccagcccgctgcgtcgagaaag

SEQ ID NO: 296406 - DNA, 25 bp, Mus musculus
agggcgccctttctcatcgcttgtg

SEQ ID NO: 296407 - DNA, 25 bp, Mus musculus
cccatcagacggagggtttgatttc

SEQ ID NO: 296408 - DNA, 25 bp, Mus musculus
gtactgtaggaagcaggcgctccca

SEQ ID NO: 296409 - DNA, 25 bp, Mus musculus
gtggcgatcgcaacccacgcctggt

SEQ ID NO: 296410 - DNA, 25 bp, Mus musculus
tcagggtactctgctcgtcttggtc

SEQ ID NO: 296411 - DNA, 25 bp, Mus musculus
ctagccggctgtctgcacatggaga

SEQ ID NO: 296412 - DNA, 25 bp, Mus musculus
cggccaggaagaggtcacccatccg

SEQ ID NO: 296413 - DNA, 25 bp, Mus musculus
ggcagcccagagtactgtaggaagc

SEQ ID NO: 296414 - DNA, 25 bp, Mus musculus
gcagggtagccatgcagaaaccgta

SEQ ID NO: 296415 - DNA, 25 bp, Mus musculus
ctgcctcactgagggatgctcagtg

SEQ ID NO: 296416 - DNA, 25 bp, Mus musculus
ccaggcagaagaccagcagggtagc

SEQ ID NO: 296417 - DNA, 25 bp, Mus musculus
gatgctcagtggcatcccacctggg

SEQ ID NO: 296418 - DNA, 25 bp, Mus musculus
gtggccgtgacagctttagatgttc

SEQ ID NO: 296419 - DNA, 25 bp, Mus musculus
ccgagtgcccaactttgcggggctg

SEQ ID NO: 296420 - DNA, 25 bp, Mus musculus
tactgccgcaggtcgagcaggaagc

SEQ ID NO: 296421 - DNA, 25 bp, Mus musculus
tgctgcttcttcttcatcgccggct

SEQ ID NO: 296422 - DNA, 25 bp, Mus musculus
cacccgggcagaagtacctggcggc

SEQ ID NO: 296423 - DNA, 25 bp, Mus musculus
ttggtgacgctgcagctctgaagct

SEQ ID NO: 296424 - DNA, 25 bp, Mus musculus
tgacgctgcagctctgaagctccgc

SEQ ID NO: 296425 - DNA, 25 bp, Mus musculus
tctgaagctccgctccaccagaggg

SEQ ID NO: 296426 - DNA, 25 bp, Mus musculus
tgaagctccgctccaccagagggcg

SEQ ID NO: 296427 - DNA, 25 bp, Mus musculus
gcgcaggggagacctacagcatccc

SEQ ID NO: 296428 - DNA, 25 bp, Mus musculus
aggggagacctacagcatcccgcct

SEQ ID NO: 296429 - DNA, 25 bp, Mus musculus
caggccgctctcctcagggatggga

SEQ ID NO: 296430 - DNA, 25 bp, Mus musculus
tccgataggctaggtccggatcggc

SEQ ID NO: 296431 - DNA, 25 bp, Mus musculus
tgcactcacgaagggaaagcgcacc

SEQ ID NO: 296432 - DNA, 25 bp, Mus musculus
ctgaggtcttggtgacgctgcagct

SEQ ID NO: 296433 - DNA, 25 bp, Mus musculus
tctgcacccgggcagaagtacctgg

SEQ ID NO: 296434 - DNA, 25 bp, Mus musculus
tcggccaggccgtgcactcacgaag

SEQ ID NO: 296435 - DNA, 25 bp, Mus musculus
cggtgagcacggaaccgcgccgcaa

SEQ ID NO: 296436 - DNA, 25 bp, Mus musculus
tcttggagcccgcaggttgtccgcg

SEQ ID NO: 296437 - DNA, 25 bp, Mus musculus
tctcattagctgtccgctcgggctc

SEQ ID NO: 296438 - DNA, 25 bp, Mus musculus
tgctgccgagcggatcccagtgtgc

SEQ ID NO: 296439 - DNA, 25 bp, Mus musculus
ggctcctgctgttgctcctttcggc

SEQ ID NO: 296440 - DNA, 25 bp, Mus musculus
ccacaggtaggttgtgggcacccgc

SEQ ID NO: 296441 - DNA, 25 bp, Mus musculus
tgggcacccgcggattggtcccgaa

SEQ ID NO: 296442 - DNA, 25 bp, Mus musculus
cacttcctaaatccaaagcggcggg

SEQ ID NO: 296443 - DNA, 25 bp, Mus musculus
agggatggctgcacccacacctctt

SEQ ID NO: 296444 - DNA, 25 bp, Mus musculus
acctcttcttcctggcgtagcgcgg

SEQ ID NO: 296445 - DNA, 25 bp, Mus musculus
gaaactcgctctcgtccctggaact

SEQ ID NO: 296446 - DNA, 25 bp, Mus musculus
cctggaacttgcaggtcctcctgtg

SEQ ID NO: 296447 - DNA, 25 bp, Mus musculus
tccaggcagggaaagttcccggctc

SEQ ID NO: 296448 - DNA, 25 bp, Mus musculus
ccgacatggcgagtgctgtgctgcc

SEQ ID NO: 296449 - DNA, 25 bp, Mus musculus
tcctgtgtccctgggctaagctttc

SEQ ID NO: 296450 - DNA, 25 bp, Mus musculus
agaccattcgctgagccatgctctc

SEQ ID NO: 296451 - DNA, 25 bp, Mus musculus
cgccacagtcgctaaacgtcgcaaa

SEQ ID NO: 296452 - DNA, 25 bp, Mus musculus
gcaggcgccacagtcgctaaacgtc

SEQ ID NO: 296453 - DNA, 25 bp, Mus musculus
gcgcgcaggcgccacagtcgctaaa

SEQ ID NO: 296454 - DNA, 25 bp, Mus musculus
atcacccggcacgagccgccacggc

SEQ ID NO: 296455 - DNA, 25 bp, Mus musculus
gggatacgcctagcatcacccggca

SEQ ID NO: 296456 - DNA, 25 bp, Mus musculus
gcgcccagggatacgcctagcatca

SEQ ID NO: 296457 - DNA, 25 bp, Mus musculus
acgcgcgaatctgcgctcgcctccc

SEQ ID NO: 296458 - DNA, 25 bp, Mus musculus
catggctgcgctaccttcgctgaca

SEQ ID NO: 296459 - DNA, 25 bp, Mus musculus
aggtccacccagaccattcgctgag

SEQ ID NO: 296460 - DNA, 25 bp, Mus musculus
ggtgccgggagaagactacaagccc

SEQ ID NO: 296461 - DNA, 25 bp, Mus musculus
gaggcgtcggctcgccctccacagc

SEQ ID NO: 296462 - DNA, 25 bp, Mus musculus
gctaccttcgctgacacctcgcgcc

SEQ ID NO: 296463 - DNA, 25 bp, Mus musculus
agtcgctaaacgtcgcaaacccacg

SEQ ID NO: 296464 - DNA, 25 bp, Mus musculus
tccaggttacccacgaacagagtgc

SEQ ID NO: 296465 - DNA, 25 bp, Mus musculus
gggaactgctctcgcaacccgaatc

SEQ ID NO: 296466 - DNA, 25 bp, Mus musculus
ggcgtcaagctcgacctcttaagaa

SEQ ID NO: 296467 - DNA, 25 bp, Mus musculus
tggatccgaatcagccgggacctcg

SEQ ID NO: 296468 - DNA, 25 bp, Mus musculus
agcttcctggttactaggctggatc

SEQ ID NO: 296469 - DNA, 25 bp, Mus musculus
aggagatctcaacccgtcggccatg

SEQ ID NO: 296470 - DNA, 25 bp, Mus musculus
cgccggcgatcaagccaacaggatg

SEQ ID NO: 296471 - DNA, 25 bp, Mus musculus
aagatggcccagaactcggtgtcgc

SEQ ID NO: 296472 - DNA, 25 bp, Mus musculus
cgtctagcaaacactgcaggcggtg

SEQ ID NO: 296473 - DNA, 25 bp, Mus musculus
ccgagggcccagtttgatcgacata

SEQ ID NO: 296474 - DNA, 25 bp, Mus musculus
tccttccgccgttgcgtgaaaaatg

SEQ ID NO: 296475 - DNA, 25 bp, Mus musculus
ctcccgttcagacgtcacgacgtaa

SEQ ID NO: 296476 - DNA, 25 bp, Mus musculus
gtgaatgccacagccgccctaggac

SEQ ID NO: 296477 - DNA, 25 bp, Mus musculus
cccttacctggtggaacagctcgaa

SEQ ID NO: 296478 - DNA, 25 bp, Mus musculus
tgggaggccaaatgagaagagatct

SEQ ID NO: 296479 - DNA, 25 bp, Mus musculus
cgccagggtgggaaagacatcccga

SEQ ID NO: 296480 - DNA, 25 bp, Mus musculus
tcccgaatgcatcaggtgcagagcc

SEQ ID NO: 296481 - DNA, 25 bp, Mus musculus
agcgccagagtctctccgaagcgtc

SEQ ID NO: 296482 - DNA, 25 bp, Mus musculus
gaagcgtccctctctccttaaaaga

SEQ ID NO: 296483 - DNA, 25 bp, Mus musculus
tctccttaaaagagggcatcaagtc

SEQ ID NO: 296484 - DNA, 25 bp, Mus musculus
gctcgccagcgaataaacacaaata

SEQ ID NO: 296485 - DNA, 25 bp, Mus musculus
cgcaccggtccgcatacatatgagc

SEQ ID NO: 296486 - DNA, 25 bp, Mus musculus
tatgagcacccacaggctctctgct

SEQ ID NO: 296487 - DNA, 25 bp, Mus musculus
gccagcccttgcctgtacaaagaca

SEQ ID NO: 296488 - DNA, 25 bp, Mus musculus
tgtgcccaagctgacagcctcagcg

SEQ ID NO: 296489 - DNA, 25 bp, Mus musculus
ggccgagtggccaaagctagcacca

SEQ ID NO: 296490 - DNA, 25 bp, Mus musculus
agagatctctgggtcctccaccttc

SEQ ID NO: 296491 - DNA, 25 bp, Mus musculus
ctggcaggatcgtcgcgcatttcga

SEQ ID NO: 296492 - DNA, 25 bp, Mus musculus
tcgctgctcaggattggctcctgtg

SEQ ID NO: 296493 - DNA, 25 bp, Mus musculus
gacggagccattctgtagccaatga

SEQ ID NO: 296494 - DNA, 25 bp, Mus musculus
gtcacgtcatcaatggatctcgcga

SEQ ID NO: 296495 - DNA, 25 bp, Mus musculus
atctcgcgagaagtacggatgccgc

SEQ ID NO: 296496 - DNA, 25 bp, Mus musculus
gctctcccgcgcctaattcaggttt

SEQ ID NO: 296497 - DNA, 25 bp, Mus musculus
ttttcttgtggttctggagactccc

SEQ ID NO: 296498 - DNA, 25 bp, Mus musculus
cttttcctgaggtagagatggcttg

SEQ ID NO: 296499 - DNA, 25 bp, Mus musculus
tggcctccctggtcgactctgacaa

SEQ ID NO: 296500 - DNA, 25 bp, Mus musculus
ctctgacaagtccatgttgggtaac

SEQ ID NO: 296501 - DNA, 25 bp, Mus musculus
acttaggctttgctacggtcttgta

SEQ ID NO: 296502 - DNA, 25 bp, Mus musculus
ctgccacgatgctacctgcgaggtg

SEQ ID NO: 296503 - DNA, 25 bp, Mus musculus
cagagagaacctcaccgagaacttc

SEQ ID NO: 296504 - DNA, 25 bp, Mus musculus
cgaggccttccgaatcgcaaagcga

SEQ ID NO: 296505 - DNA, 25 bp, Mus musculus
gcaaagcgaagactctgccacgatg

SEQ ID NO: 296506 - DNA, 25 bp, Mus musculus
tagggcgagagcaacccggtcttcc

SEQ ID NO: 296507 - DNA, 25 bp, Mus musculus
gtcttcccgggactttgcgaggctg

SEQ ID NO: 296508 - DNA, 25 bp, Mus musculus
gttgcctgggtgtataagccagcta

SEQ ID NO: 296509 - DNA, 25 bp, Mus musculus
ccagctaaggttccgagcgggattg

SEQ ID NO: 296510 - DNA, 25 bp, Mus musculus
gtctccggcgcaagccgcaagatgg

SEQ ID NO: 296511 - DNA, 25 bp, Mus musculus
gccaccggggctctaaattggcgtg

SEQ ID NO: 296512 - DNA, 25 bp, Mus musculus
tccggctcacgcaaaccaggggcgg

SEQ ID NO: 296513 - DNA, 25 bp, Mus musculus
cacgtgggccagagcacgcgaagac

SEQ ID NO: 296514 - DNA, 25 bp, Mus musculus
cccttagtttgtgcccggctgcggt

SEQ ID NO: 296515 - DNA, 25 bp, Mus musculus
gcgaccgcggcgaagacgacaacga

SEQ ID NO: 296516 - DNA, 25 bp, Mus musculus
cggagggacaccacggccatgactg

SEQ ID NO: 296517 - DNA, 25 bp, Mus musculus
actgcggagctgcagcaggacgact

SEQ ID NO: 296518 - DNA, 25 bp, Mus musculus
gacgacaacgagagtggggctacac

SEQ ID NO: 296519 - DNA, 25 bp, Mus musculus
ttgcacgtgagatcgtaggcagcga

SEQ ID NO: 296520 - DNA, 25 bp, Mus musculus
agtgtgaccctctcctgtgcgcgag

SEQ ID NO: 296521 - DNA, 25 bp, Mus musculus
cgtttgaaaacctgtagggagcaga

SEQ ID NO: 296522 - DNA, 25 bp, Mus musculus
tgacgcctgcgcactttggtgcttc

SEQ ID NO: 296523 - DNA, 25 bp, Mus musculus
cgcactttggtgcttctagacgcca

SEQ ID NO: 296524 - DNA, 25 bp, Mus musculus
ggtgcttctagacgccactgaaaca

SEQ ID NO: 296525 - DNA, 25 bp, Mus musculus
cgccactgaaacagcggacgcctga

SEQ ID NO: 296526 - DNA, 25 bp, Mus musculus
gcgggaacagactggcgtttgaaaa

SEQ ID NO: 296527 - DNA, 25 bp, Mus musculus
tgaaacagcggacgcctgacggcgc

SEQ ID NO: 296528 - DNA, 25 bp, Mus musculus
tgggcaccaggatcagccgcctgac

SEQ ID NO: 296529 - DNA, 25 bp, Mus musculus
gaggatctgggcaccaggatcagcc

SEQ ID NO: 296530 - DNA, 25 bp, Mus musculus
tgacagaagtcttggcccactcggg

SEQ ID NO: 296531 - DNA, 25 bp, Mus musculus
tctttcgtgacagaagtcttggccc

SEQ ID NO: 296532 - DNA, 25 bp, Mus musculus
tatcctgtttgtgtgggtacgcttc

SEQ ID NO: 296533 - DNA, 25 bp, Mus musculus
gcagcggggttgacctatcctgttt

SEQ ID NO: 296534 - DNA, 25 bp, Mus musculus
tccagcctcagtgccggagctggtc

SEQ ID NO: 296535 - DNA, 25 bp, Mus musculus
cgggcgccctatggcttgaaggtaa

SEQ ID NO: 296536 - DNA, 25 bp, Mus musculus
cttgaaggtaagaactggttggctg

SEQ ID NO: 296537 - DNA, 25 bp, Mus musculus
tggctggagccaaaagcagtctgtg

SEQ ID NO: 296538 - DNA, 25 bp, Mus musculus
agtctgtggcctctgcaccggtcga

SEQ ID NO: 296539 - DNA, 25 bp, Mus musculus
tgcaccggtcgaagcgtctagagat

SEQ ID NO: 296540 - DNA, 25 bp, Mus musculus
cgtctagagatgaccggccgggaac

SEQ ID NO: 296541 - DNA, 25 bp, Mus musculus
gccgggaacagaagtttgtccagcc

SEQ ID NO: 296542 - DNA, 25 bp, Mus musculus
agtttgtccagccactctagcgccg

SEQ ID NO: 296543 - DNA, 25 bp, Mus musculus
ctttccactgagtctccgtcgggga

SEQ ID NO: 296544 - DNA, 25 bp, Mus musculus
gtctccgtcggggagattgcgttcc

SEQ ID NO: 296545 - DNA, 25 bp, Mus musculus
tcggaaacctgaaggatggccatcc

SEQ ID NO: 296546 - DNA, 25 bp, Mus musculus
agtccttctttcttagcgttcttcg

SEQ ID NO: 296547 - DNA, 25 bp, Mus musculus
gcgttcttcgcgctttcctgtctgg

SEQ ID NO: 296548 - DNA, 25 bp, Mus musculus
gggcaggttttgcaactacccagca

SEQ ID NO: 296549 - DNA, 25 bp, Mus musculus
tgcacttcctcctgtcaaaacgcgg

SEQ ID NO: 296550 - DNA, 25 bp, Mus musculus
accctaggctctcggtgcgtgtaaa

SEQ ID NO: 296551 - DNA, 25 bp, Mus musculus
ttcgctggcaccgtgcaaccctagg

SEQ ID NO: 296552 - DNA, 25 bp, Mus musculus
caggatcaggaatatcgcccagaga

SEQ ID NO: 296553 - DNA, 25 bp, Mus musculus
ttgttcacactttgccaggatcagg

SEQ ID NO: 296554 - DNA, 25 bp, Mus musculus
cgacagcgtcgctacggtctttctc

SEQ ID NO: 296555 - DNA, 25 bp, Mus musculus
ccttcccgaatgctaaggatctctg

SEQ ID NO: 296556 - DNA, 25 bp, Mus musculus
agggtgggcacatgaggaattttcc

SEQ ID NO: 296557 - DNA, 25 bp, Mus musculus
gcctgctttcagctggtgcttggca

SEQ ID NO: 296558 - DNA, 25 bp, Mus musculus
caaggcttagagatctggaccagta

SEQ ID NO: 296559 - DNA, 25 bp, Mus musculus
ctgtgggctccacacccaaggctta

SEQ ID NO: 296560 - DNA, 25 bp, Mus musculus
cctcgctctgattggtcgccgatca

SEQ ID NO: 296561 - DNA, 25 bp, Mus musculus
taagctagaacacccggggaccatc

SEQ ID NO: 296562 - DNA, 25 bp, Mus musculus
cctctcccgggtgagtgccggtagt

SEQ ID NO: 296563 - DNA, 25 bp, Mus musculus
tataccgccctctcccgggtgagtg

SEQ ID NO: 296564 - DNA, 25 bp, Mus musculus
tgccggtagtgcagctccgcacctt

SEQ ID NO: 296565 - DNA, 25 bp, Mus musculus
cccagggacatagcgggacaagacc

SEQ ID NO: 296566 - DNA, 25 bp, Mus musculus
caagacccgcgcgtgcggtgacaca

SEQ ID NO: 296567 - DNA, 25 bp, Mus musculus
tgcggtgacacacgtgggcacaccc

SEQ ID NO: 296568 - DNA, 25 bp, Mus musculus
ctgaaggacacgaggcgcgacagtc

SEQ ID NO: 296569 - DNA, 25 bp, Mus musculus
tcggaccgaagactcacaagctagc

SEQ ID NO: 296570 - DNA, 25 bp, Mus musculus
cacaagctagcggttccggcttccg

SEQ ID NO: 296571 - DNA, 25 bp, Mus musculus
gccctccctgccgaaagcactcctg

SEQ ID NO: 296572 - DNA, 25 bp, Mus musculus
cactcctgggagtggtttcgactcg

SEQ ID NO: 296573 - DNA, 25 bp, Mus musculus
agtggtttcgactcgcggcaccctt

SEQ ID NO: 296574 - DNA, 25 bp, Mus musculus
ccgcgctcatggtcttcggaccgaa

SEQ ID NO: 296575 - DNA, 25 bp, Mus musculus
cgggatcggagctataccgccctct

SEQ ID NO: 296576 - DNA, 25 bp, Mus musculus
aaaggtgcatcgtgcgtggaatccc

SEQ ID NO: 296577 - DNA, 25 bp, Mus musculus
catgcgtgacattttgctgggcaaa

SEQ ID NO: 296578 - DNA, 25 bp, Mus musculus
cgtggaatcccgcagtaacggaagg

SEQ ID NO: 296579 - DNA, 25 bp, Mus musculus
cgaacttctccgcttagctctgagt

SEQ ID NO: 296580 - DNA, 25 bp, Mus musculus
tccgcttagctctgagtcgcgcatg

SEQ ID NO: 296581 - DNA, 25 bp, Mus musculus
tcgcgcatgcgtgacattttgctgg

SEQ ID NO: 296582 - DNA, 25 bp, Mus musculus
cgtgacattttgctgggcaaatcca

SEQ ID NO: 296583 - DNA, 25 bp, Mus musculus
ttgctgggcaaatccaggaactaca

SEQ ID NO: 296584 - DNA, 25 bp, Mus musculus
gggcaaatccaggaactacaactcc

SEQ ID NO: 296585 - DNA, 25 bp, Mus musculus
cgaccccctgtttcttggcaggttg

SEQ ID NO: 296586 - DNA, 25 bp, Mus musculus
agcgggatctctccctctcgcgaga

SEQ ID NO: 296587 - DNA, 25 bp, Mus musculus
ctctcgcgagagaaaaaggtgcatc

SEQ ID NO: 296588 - DNA, 25 bp, Mus musculus
gcatcgtgcgtggaatcccgcagta

SEQ ID NO: 296589 - DNA, 25 bp, Mus musculus
gcttagctctgagtcgcgcatgcgt

SEQ ID NO: 296590 - DNA, 25 bp, Mus musculus
gccacgttcccgtcacacgcgctca

SEQ ID NO: 296591 - DNA, 25 bp, Mus musculus
acgtgacagtctcgcggggccgatc

SEQ ID NO: 296592 - DNA, 25 bp, Mus musculus
agccacgtgacagtctcgcggggcc

SEQ ID NO: 296593 - DNA, 25 bp, Mus musculus
cagcgcgcgagccacgtgacagtct

SEQ ID NO: 296594 - DNA, 25 bp, Mus musculus
ccgagtgagcggctcccagtaggca

SEQ ID NO: 296595 - DNA, 25 bp, Mus musculus
cctcagagccgcagcacgagcgtga

SEQ ID NO: 296596 - DNA, 25 bp, Mus musculus
caagcggagattcggccacgacctg

SEQ ID NO: 296597 - DNA, 25 bp, Mus musculus
tcgcaagcggagattcggccacgac

SEQ ID NO: 296598 - DNA, 25 bp, Mus musculus
gtcacacgcgctcaccctctggccc

SEQ ID NO: 296599 - DNA, 25 bp, Mus musculus
tgctttctttcacactcgccacgtt

SEQ ID NO: 296600 - DNA, 25 bp, Mus musculus
ctcgcggggccgatcagcctatagc

SEQ ID NO: 296601 - DNA, 25 bp, Mus musculus
gagcgtgagggcttcgcgcccctct

SEQ ID NO: 296602 - DNA, 25 bp, Mus musculus
cactcgcaagcggagattcggccac

SEQ ID NO: 296603 - DNA, 25 bp, Mus musculus
cggccacgacctgccgcctcagagc

SEQ ID NO: 296604 - DNA, 25 bp, Mus musculus
gccgaacagcagaaggcgcaattca

SEQ ID NO: 296605 - DNA, 25 bp, Mus musculus
ctctacaacccggaaacagttatgt

SEQ ID NO: 296606 - DNA, 25 bp, Mus musculus
cgtaaaagaacggtgaggcaacctg

SEQ ID NO: 296607 - DNA, 25 bp, Mus musculus
caacctgaagcgtgaaccggaaggc

SEQ ID NO: 296608 - DNA, 25 bp, Mus musculus
cgccatgtcgctttcgagggctcaa

SEQ ID NO: 296609 - DNA, 25 bp, Mus musculus
cgacaatggccgagcttggtgaagc

SEQ ID NO: 296610 - DNA, 25 bp, Mus musculus
cgagggctcaaggtcactctacaac

SEQ ID NO: 296611 - DNA, 25 bp, Mus musculus
agttacaacgcctggtggccgccga

SEQ ID NO: 296612 - DNA, 25 bp, Mus musculus
cgaagcgcctgactccgacaatggc

SEQ ID NO: 296613 - DNA, 25 bp, Mus musculus
attcactgcgcaggtacgaggatga

SEQ ID NO: 296614 - DNA, 25 bp, Mus musculus
gatctacagtgctcagtgcccggga

SEQ ID NO: 296615 - DNA, 25 bp, Mus musculus
gccacaggagcatgcggttattagc

SEQ ID NO: 296616 - DNA, 25 bp, Mus musculus
aatggcactcggaatctctgggttc

SEQ ID NO: 296617 - DNA, 25 bp, Mus musculus
gaagcggacgaagcggagttacaac

SEQ ID NO: 296618 - DNA, 25 bp, Mus musculus
accggagactcccacagagcgggct

SEQ ID NO: 296619 - DNA, 25 bp, Mus musculus
agtcgtgctccggagaaacgcttcc

SEQ ID NO: 296620 - DNA, 25 bp, Mus musculus
cgctctcccgagagacaagcgggac

SEQ ID NO: 296621 - DNA, 25 bp, Mus musculus
cggagaagagaaccggaactggata

SEQ ID NO: 296622 - DNA, 25 bp, Mus musculus
cccaggaagtatctagagtgcctcg

SEQ ID NO: 296623 - DNA, 25 bp, Mus musculus
gctcgctttcactcccgggacagaa

SEQ ID NO: 296624 - DNA, 25 bp, Mus musculus
tcgctctcggggacccaggccagag

SEQ ID NO: 296625 - DNA, 25 bp, Mus musculus
ccggaactggatatagagacacagc

SEQ ID NO: 296626 - DNA, 25 bp, Mus musculus
gtccttcgtgaaaacgcagccttcc

SEQ ID NO: 296627 - DNA, 25 bp, Mus musculus
acagctctactttgcgctctccgga

SEQ ID NO: 296628 - DNA, 25 bp, Mus musculus
tctccggacccagttagatggtgta

SEQ ID NO: 296629 - DNA, 25 bp, Mus musculus
tgtaccgggactggttaccatggta

SEQ ID NO: 296630 - DNA, 25 bp, Mus musculus
ccggagtcgcagtttgtcggcaaac

SEQ ID NO: 296631 - DNA, 25 bp, Mus musculus
gtcggcaaactgagagaagacgtgc

SEQ ID NO: 296632 - DNA, 25 bp, Mus musculus
tcgcagcaagcggttacgcgggaca

SEQ ID NO: 296633 - DNA, 25 bp, Mus musculus
gccggagctccagccgcacaaggag

SEQ ID NO: 296634 - DNA, 25 bp, Mus musculus
cccaggagttgtcgcagcaagcggt

SEQ ID NO: 296635 - DNA, 25 bp, Mus musculus
agcgggggatcccactaccgcaacg

SEQ ID NO: 296636 - DNA, 25 bp, Mus musculus
acccgagagtcggaccggctgcagc

SEQ ID NO: 296637 - DNA, 25 bp, Mus musculus
cagggccgctctaagggacccgaga

SEQ ID NO: 296638 - DNA, 25 bp, Mus musculus
gaagtacggaccagggccgctctaa

SEQ ID NO: 296639 - DNA, 25 bp, Mus musculus
cagtgtcgtaaaagcggctgcttgg

SEQ ID NO: 296640 - DNA, 25 bp, Mus musculus
accgagccctgaacccatccctggg

SEQ ID NO: 296641 - DNA, 25 bp, Mus musculus
actgcggtcgcgcagtgtcgtaaaa

SEQ ID NO: 296642 - DNA, 25 bp, Mus musculus
gtgacctctccaagagcagcgcggc

SEQ ID NO: 296643 - DNA, 25 bp, Mus musculus
cgtctccggagtgacctctccaaga

SEQ ID NO: 296644 - DNA, 25 bp, Mus musculus
agacgcgccacattactgccaccga

SEQ ID NO: 296645 - DNA, 25 bp, Mus musculus
cgcaacggaccgcagcggggccaat

SEQ ID NO: 296646 - DNA, 25 bp, Mus musculus
cagcgtagacgttgctgttcctctc

SEQ ID NO: 296647 - DNA, 25 bp, Mus musculus
ggttccagagatcagccagccagcg

SEQ ID NO: 296648 - DNA, 25 bp, Mus musculus
ttcgcccaggtctccgaagaaagta

SEQ ID NO: 296649 - DNA, 25 bp, Mus musculus
cctggtccaagggaccgggatgctc

SEQ ID NO: 296650 - DNA, 25 bp, Mus musculus
tgctcccttagggtgaagcgtactg

SEQ ID NO: 296651 - DNA, 25 bp, Mus musculus
tgaagcgtactgtcccggtagctca

SEQ ID NO: 296652 - DNA, 25 bp, Mus musculus
gtagctcagacaccgcagcagcgga

SEQ ID NO: 296653 - DNA, 25 bp, Mus musculus
gcagcggcatctcggtccttgctgt

SEQ ID NO: 296654 - DNA, 25 bp, Mus musculus
cggacagccgcatctttaacctatc

SEQ ID NO: 296655 - DNA, 25 bp, Mus musculus
taacctatctccctcggggcaagag

SEQ ID NO: 296656 - DNA, 25 bp, Mus musculus
tgggcttcgacccaagcgctgccga

SEQ ID NO: 296657 - DNA, 25 bp, Mus musculus
cgcggtgcaaaacctcgtggatctg

SEQ ID NO: 296658 - DNA, 25 bp, Mus musculus
ctgacagtcctggtgcggagaagct

SEQ ID NO: 296659 - DNA, 25 bp, Mus musculus
cactggggctcgaagaacggttcca

SEQ ID NO: 296660 - DNA, 25 bp, Mus musculus
caaaactggcttggatgaatcacac

SEQ ID NO: 296661 - DNA, 25 bp, Mus musculus
gtccttcagtgttgactaccggctg

SEQ ID NO: 296662 - DNA, 25 bp, Mus musculus
ttgactaccggctgtgtcccagaca

SEQ ID NO: 296663 - DNA, 25 bp, Mus musculus
ctgtgtcccagacactgggagaata

SEQ ID NO: 296664 - DNA, 25 bp, Mus musculus
cactgggagaatagccaacaatgta

SEQ ID NO: 296665 - DNA, 25 bp, Mus musculus
gccaacaatgtaagaggccttagct

SEQ ID NO: 296666 - DNA, 25 bp, Mus musculus
gaatatataactttgtccttcagtg

SEQ ID NO: 296667 - DNA, 25 bp, Mus musculus
catcatttttaaaaggctttcctgg

SEQ ID NO: 296668 - DNA, 25 bp, Mus musculus
aggctttcctgggttcttctgaggc

SEQ ID NO: 296669 - DNA, 25 bp, Mus musculus
tcctgggttcttctgaggcgggcct

SEQ ID NO: 296670 - DNA, 25 bp, Mus musculus
agcccactaaggtgggtatatattt

SEQ ID NO: 296671 - DNA, 25 bp, Mus musculus
tttattgactaaggggaagcagatc

SEQ ID NO: 296672 - DNA, 25 bp, Mus musculus
ggggaagcagatctccaaaactggc

SEQ ID NO: 296673 - DNA, 25 bp, Mus musculus
ggccttagcttttagtctaacatca

SEQ ID NO: 296674 - DNA, 25 bp, Mus musculus
ccagcctgagcatatgcctgcaatc

SEQ ID NO: 296675 - DNA, 25 bp, Mus musculus
tgcgcacaggcaagaggcgctagca

SEQ ID NO: 296676 - DNA, 25 bp, Mus musculus
ggagtcccgcatgccacttactgga

SEQ ID NO: 296677 - DNA, 25 bp, Mus musculus
gacacaagcgggcttgccagcctga

SEQ ID NO: 296678 - DNA, 25 bp, Mus musculus
cacgggtgctcgcaacgagcattca

SEQ ID NO: 296679 - DNA, 25 bp, Mus musculus
tcactacactgcacgtttggaggcg

SEQ ID NO: 296680 - DNA, 25 bp, Mus musculus
ttcctatagaaacagcagggcgcgc

SEQ ID NO: 296681 - DNA, 25 bp, Mus musculus
ccaaactagcggcttgcactgggca

SEQ ID NO: 296682 - DNA, 25 bp, Mus musculus
ttactggaaacctagacccgagcca

SEQ ID NO: 296683 - DNA, 25 bp, Mus musculus
agcagggcagttacctcattgaagc

SEQ ID NO: 296684 - DNA, 25 bp, Mus musculus
agccctcttgcaggacgtccagtaa

SEQ ID NO: 296685 - DNA, 25 bp, Mus musculus
cgcgggtcaagcaggctagcattgt

SEQ ID NO: 296686 - DNA, 25 bp, Mus musculus
tacacaaaggcgatcagctcagctc

SEQ ID NO: 296687 - DNA, 25 bp, Mus musculus
acgagcattcacacacgcgtgagca

SEQ ID NO: 296688 - DNA, 25 bp, Mus musculus
tcagtgttaccgctaccggcttcca

SEQ ID NO: 296689 - DNA, 25 bp, Mus musculus
ggcctggatcccagcgtcagtgtta

SEQ ID NO: 296690 - DNA, 25 bp, Mus musculus
gcttctctgatcgacggcctggatc

SEQ ID NO: 296691 - DNA, 25 bp, Mus musculus
taagccggaggagaccatgcttccc

SEQ ID NO: 296692 - DNA, 25 bp, Mus musculus
gaagtgacgtaagaaatgtgcgccc

SEQ ID NO: 296693 - DNA, 25 bp, Mus musculus
caagctgttgatgcgtcatcactta

SEQ ID NO: 296694 - DNA, 25 bp, Mus musculus
cccgagcagtagctccaaatgttta

SEQ ID NO: 296695 - DNA, 25 bp, Mus musculus
aaacgagcctttggaggcgcacaaa

SEQ ID NO: 296696 - DNA, 25 bp, Mus musculus
tccggtagcgctagagaacctaaag

SEQ ID NO: 296697 - DNA, 25 bp, Mus musculus
cgaagacgctcagggccgtccgtgt

SEQ ID NO: 296698 - DNA, 25 bp, Mus musculus
gtttatcctggtaacaagctgttga

SEQ ID NO: 296699 - DNA, 25 bp, Mus musculus
tgggccgtccgagtactgaaaagaa

SEQ ID NO: 296700 - DNA, 25 bp, Mus musculus
gggcaaggccaagagctccatttta

SEQ ID NO: 296701 - DNA, 25 bp, Mus musculus
cctgcgcgaacgaggtagcaagtcc

SEQ ID NO: 296702 - DNA, 25 bp, Mus musculus
agcgtgccgagttctatcctttccc

SEQ ID NO: 296703 - DNA, 25 bp, Mus musculus
agcgtcccacttggcgtcgatcatc

SEQ ID NO: 296704 - DNA, 25 bp, Mus musculus
atttcagtttttattgcgcatgtcg

SEQ ID NO: 296705 - DNA, 25 bp, Mus musculus
tgcgcatgtcgaggcgttttgtccc

SEQ ID NO: 296706 - DNA, 25 bp, Mus musculus
gaggcgttttgtccctcggcggaca

SEQ ID NO: 296707 - DNA, 25 bp, Mus musculus
gcggacaccgttttccagccaagca

SEQ ID NO: 296708 - DNA, 25 bp, Mus musculus
gttttccagccaagcaatgtctgcg

SEQ ID NO: 296709 - DNA, 25 bp, Mus musculus
ggtccattggcacagtatttcagtt

SEQ ID NO: 296710 - DNA, 25 bp, Mus musculus
cgccgatttcgtagcgtgccgagtt

SEQ ID NO: 296711 - DNA, 25 bp, Mus musculus
gagaagctggaacagctcggcagcc

SEQ ID NO: 296712 - DNA, 25 bp, Mus musculus
tctccgttgcgagctggggctcttt

SEQ ID NO: 296713 - DNA, 25 bp, Mus musculus
ggggtctgctttccgccggcatctc

SEQ ID NO: 296714 - DNA, 25 bp, Mus musculus
ggccttcgcctcaattggtccattg

SEQ ID NO: 296715 - DNA, 25 bp, Mus musculus
aatgtctgcgccttcgccgatttcg

SEQ ID NO: 296716 - DNA, 25 bp, Mus musculus
ttcgctctacccgatcgcggtttta

SEQ ID NO: 296717 - DNA, 25 bp, Mus musculus
taatcgacgagctccgcaatgagga

SEQ ID NO: 296718 - DNA, 25 bp, Mus musculus
ccgcaatgaggacgtgcaggtacta

SEQ ID NO: 296719 - DNA, 25 bp, Mus musculus
cagagtcgtattcagccccgggacg

SEQ ID NO: 296720 - DNA, 25 bp, Mus musculus
gcggtggtccgtctcagctccgctg

SEQ ID NO: 296721 - DNA, 25 bp, Mus musculus
tggcgtccatctgctcccggcagtg

SEQ ID NO: 296722 - DNA, 25 bp, Mus musculus
ttcgcacctcgggtggaccagcgca

SEQ ID NO: 296723 - DNA, 25 bp, Mus musculus
cccgttccctttgaagtgatgcgga

SEQ ID NO: 296724 - DNA, 25 bp, Mus musculus
ccctttgaagtgatgcggagtgtcc

SEQ ID NO: 296725 - DNA, 25 bp, Mus musculus
tgaagtgatgcggagtgtccgtccc

SEQ ID NO: 296726 - DNA, 25 bp, Mus musculus
cccgggcaaactagctgggctggtt

SEQ ID NO: 296727 - DNA, 25 bp, Mus musculus
tggagatggagacgattcgctctac

SEQ ID NO: 296728 - DNA, 25 bp, Mus musculus
ttcctcggagccggctgattggatt

SEQ ID NO: 296729 - DNA, 25 bp, Mus musculus
tcgcggttttaatcgacgagctccg

SEQ ID NO: 296730 - DNA, 25 bp, Mus musculus
tggcagctttgctgtcgtggctctc

SEQ ID NO: 296731 - DNA, 25 bp, Mus musculus
agctttgctgtcgtggctctcggaa

SEQ ID NO: 296732 - DNA, 25 bp, Mus musculus
atggacccgcctatcgccttccggt

SEQ ID NO: 296733 - DNA, 25 bp, Mus musculus
ttccggtctctggagttgcgccctc

SEQ ID NO: 296734 - DNA, 25 bp, Mus musculus
accaagtggcttcctggtgcgcttg

SEQ ID NO: 296735 - DNA, 25 bp, Mus musculus
tggcttcctggtgcgcttgtgacgt

SEQ ID NO: 296736 - DNA, 25 bp, Mus musculus
agctggatcgcgtggcagctttgct

SEQ ID NO: 296737 - DNA, 25 bp, Mus musculus
ccgagcgccggtagccggtgcttga

SEQ ID NO: 296738 - DNA, 25 bp, Mus musculus
gtcttgcccagtcgcccgaggctgt

SEQ ID NO: 296739 - DNA, 25 bp, Mus musculus
ccagtcgcccgaggctgttgggtcc

SEQ ID NO: 296740 - DNA, 25 bp, Mus musculus
cgcttgtgacgtcggctgtagagct

SEQ ID NO: 296741 - DNA, 25 bp, Mus musculus
agggtcgtcatgttgtcgcaggtga

SEQ ID NO: 296742 - DNA, 25 bp, Mus musculus
cgtccgtcgcgtggaccagctcttt

SEQ ID NO: 296743 - DNA, 25 bp, Mus musculus
cccaaggtatggacccgcctatcgc

SEQ ID NO: 296744 - DNA, 25 bp, Mus musculus
agcagaagcgcaagagcgagccctg

SEQ ID NO: 296745 - DNA, 25 bp, Mus musculus
aacttgtgctcaggagccgaggcca

SEQ ID NO: 296746 - DNA, 25 bp, Mus musculus
ccagtctcctggagggtcgcctggc

SEQ ID NO: 296747 - DNA, 25 bp, Mus musculus
cactgggccagtctcctggagggtc

SEQ ID NO: 296748 - DNA, 25 bp, Mus musculus
ccggcgctgacgtgagccgacgtca

SEQ ID NO: 296749 - DNA, 25 bp, Mus musculus
aacgcgaacgaactggccggcaaga

SEQ ID NO: 296750 - DNA, 25 bp, Mus musculus
ccagcgtgccctcgatgtcgtagaa

SEQ ID NO: 296751 - DNA, 25 bp, Mus musculus
acctccgtcttggtgatccggtgcc

SEQ ID NO: 296752 - DNA, 25 bp, Mus musculus
ggggccgcacctccgtcttggtgat

SEQ ID NO: 296753 - DNA, 25 bp, Mus musculus
cgggaagacgcggaacttgtgctca

SEQ ID NO: 296754 - DNA, 25 bp, Mus musculus
gcctgtgtggcttcccggggacacc

SEQ ID NO: 296755 - DNA, 25 bp, Mus musculus
aggccacagaccaggttcccgggtg

SEQ ID NO: 296756 - DNA, 25 bp, Mus musculus
gagccgaggccacagaccaggttcc

SEQ ID NO: 296757 - DNA, 25 bp, Mus musculus
cttcaccacggcaaagttgcccttg

SEQ ID NO: 296758 - DNA, 25 bp, Mus musculus
taattacactgcctacaaaccgagc

SEQ ID NO: 296759 - DNA, 25 bp, Mus musculus
cgggtgatgctgtgccttgttttga

SEQ ID NO: 296760 - DNA, 25 bp, Mus musculus
ccttgttttgatggcagtggagtta

SEQ ID NO: 296761 - DNA, 25 bp, Mus musculus
agtgaccgtggctcagcgaccaacc

SEQ ID NO: 296762 - DNA, 25 bp, Mus musculus
ggtctccgagggttacttgcactta

SEQ ID NO: 296763 - DNA, 25 bp, Mus musculus
gcagctcctactggccgagtgaccg

SEQ ID NO: 296764 - DNA, 25 bp, Mus musculus
gtctagagccggttctgtccagccc

SEQ ID NO: 296765 - DNA, 25 bp, Mus musculus
gcaccgcactacaatcagctaatta

SEQ ID NO: 296766 - DNA, 25 bp, Mus musculus
ctttcgccacggtcgacaggcgagg

SEQ ID NO: 296767 - DNA, 25 bp, Mus musculus
ttgcacttagacctcgtgctcccgg

SEQ ID NO: 296768 - DNA, 25 bp, Mus musculus
gagttagtgattgtcagcaccgcac

SEQ ID NO: 296769 - DNA, 25 bp, Mus musculus
ttcacggcttccagacccaagtcta

SEQ ID NO: 296770 - DNA, 25 bp, Mus musculus
ggccctttgctgacgcatcctggct

SEQ ID NO: 296771 - DNA, 25 bp, Mus musculus
ggcctcggctttctgcggagtcagt

SEQ ID NO: 296772 - DNA, 25 bp, Mus musculus
gtcgcctagaggcagccctccggaa

SEQ ID NO: 296773 - DNA, 25 bp, Mus musculus
tagagtttgacttagaagcccagtg

SEQ ID NO: 296774 - DNA, 25 bp, Mus musculus
tggttgttaggccaggctagacccg

SEQ ID NO: 296775 - DNA, 25 bp, Mus musculus
ccgcttctgggctcacaaggtcggc

SEQ ID NO: 296776 - DNA, 25 bp, Mus musculus
acccggcagaggcactttccgaata

SEQ ID NO: 296777 - DNA, 25 bp, Mus musculus
cacccgaccttgaccctggagagag

SEQ ID NO: 296778 - DNA, 25 bp, Mus musculus
ctggagagagcgcttattagaatca

SEQ ID NO: 296779 - DNA, 25 bp, Mus musculus
gcctaggcgtttggagacagtgcca

SEQ ID NO: 296780 - DNA, 25 bp, Mus musculus
cgcctcgcctggttagtgtagggac

SEQ ID NO: 296781 - DNA, 25 bp, Mus musculus
cccacgagccagatcctgaaagtta

SEQ ID NO: 296782 - DNA, 25 bp, Mus musculus
cctaaggaaagttagtgcgctgttc

SEQ ID NO: 296783 - DNA, 25 bp, Mus musculus
catcggtttgtcttgctgcagtgcc

SEQ ID NO: 296784 - DNA, 25 bp, Mus musculus
gtgcgtcctgctccagtccagggct

SEQ ID NO: 296785 - DNA, 25 bp, Mus musculus
cctgggagagcccaagtagccggct

SEQ ID NO: 296786 - DNA, 25 bp, Mus musculus
tcgtcctcgtcgacaggcatgtcta

SEQ ID NO: 296787 - DNA, 25 bp, Mus musculus
ccctgagaagggacgtttgcatttg

SEQ ID NO: 296788 - DNA, 25 bp, Mus musculus
tctgcaataggtcccggagcaagtg

SEQ ID NO: 296789 - DNA, 25 bp, Mus musculus
tttcgatagaggtcaggagtctgca

SEQ ID NO: 296790 - DNA, 25 bp, Mus musculus
tttgctggtgattgactggtccacg

SEQ ID NO: 296791 - DNA, 25 bp, Mus musculus
ggactgatccgggtaactacttgta

SEQ ID NO: 296792 - DNA, 25 bp, Mus musculus
ttgttccctgacacccgaaggactg

SEQ ID NO: 296793 - DNA, 25 bp, Mus musculus
ggaggtttgactcggcctagatcta

SEQ ID NO: 296794 - DNA, 25 bp, Mus musculus
tagtcttaacccgacagcctgagga

SEQ ID NO: 296795 - DNA, 25 bp, Mus musculus
tgcgagcctcccgaggtagtcttaa

SEQ ID NO: 296796 - DNA, 25 bp, Mus musculus
tctccatctctgacccggggagtgc

SEQ ID NO: 296797 - DNA, 25 bp, Mus musculus
acggtctcggagaagcccgttgcct

SEQ ID NO: 296798 - DNA, 25 bp, Mus musculus
gcaccaagaaggtgaggacgcccga

SEQ ID NO: 296799 - DNA, 25 bp, Mus musculus
cccgctgtcttctctggtggaaacg

SEQ ID NO: 296800 - DNA, 25 bp, Mus musculus
cgcgagcgccctgcgtgtcctataa

SEQ ID NO: 296801 - DNA, 25 bp, Mus musculus
ggtccacggagagatggcagttccc

SEQ ID NO: 296802 - DNA, 25 bp, Mus musculus
gatgagggacccatcgccgctgccg

SEQ ID NO: 296803 - DNA, 25 bp, Mus musculus
gcccagaagactagggtcacgggaa

SEQ ID NO: 296804 - DNA, 25 bp, Mus musculus
tccggctgcgagagggctacactcc

SEQ ID NO: 296805 - DNA, 25 bp, Mus musculus
gagagggctacactcccgcgagcgc

SEQ ID NO: 296806 - DNA, 25 bp, Mus musculus
tgcgtgtcctataacccgcggctgc

SEQ ID NO: 296807 - DNA, 25 bp, Mus musculus
accagcagccgacagcggtcaaggc

SEQ ID NO: 296808 - DNA, 25 bp, Mus musculus
ccgacagcggtcaaggccgcggaaa

SEQ ID NO: 296809 - DNA, 25 bp, Mus musculus
cccgcggagtcctgcgcagtgctga

SEQ ID NO: 296810 - DNA, 25 bp, Mus musculus
agcggccgccataaccctgtcggaa

SEQ ID NO: 296811 - DNA, 25 bp, Mus musculus
agagatggcagttcccgctccggtc

SEQ ID NO: 296812 - DNA, 25 bp, Mus musculus
cgaagtcgacaaggacaacccaccg

SEQ ID NO: 296813 - DNA, 25 bp, Mus musculus
cgacaaggacaacccaccgaggaag

SEQ ID NO: 296814 - DNA, 25 bp, Mus musculus
ggaccgcgaggctagaacttctccc

SEQ ID NO: 296815 - DNA, 25 bp, Mus musculus
tgaaagtcggggtgttggattacta

SEQ ID NO: 296816 - DNA, 25 bp, Mus musculus
ccttacctggggctgcagtcacggc

SEQ ID NO: 296817 - DNA, 25 bp, Mus musculus
ttggattactagagagcgtgcggac

SEQ ID NO: 296818 - DNA, 25 bp, Mus musculus
ccgcatggagcgtaggtcgcacgct

SEQ ID NO: 296819 - DNA, 25 bp, Mus musculus
gttaacggctgagccacgccactta

SEQ ID NO: 296820 - DNA, 25 bp, Mus musculus
cctagaggcgccgtggtcgttaacg

SEQ ID NO: 296821 - DNA, 25 bp, Mus musculus
ctcattttcggggtaagccctgctc

SEQ ID NO: 296822 - DNA, 25 bp, Mus musculus
cagggaaggagccactcattttcgg

SEQ ID NO: 296823 - DNA, 25 bp, Mus musculus
gcgcgtcttctctcaggcggctcag

SEQ ID NO: 296824 - DNA, 25 bp, Mus musculus
ggcggccatattgccgagctgtctg

SEQ ID NO: 296825 - DNA, 25 bp, Mus musculus
tcactgcgggcttcggactcgggct

SEQ ID NO: 296826 - DNA, 25 bp, Mus musculus
tccgcttcgttcactgcgggcttcg

SEQ ID NO: 296827 - DNA, 25 bp, Mus musculus
gagcgtaggtcgcacgctctctcgc

SEQ ID NO: 296828 - DNA, 25 bp, Mus musculus
ggaggtccgggcttcctctgtgccc

SEQ ID NO: 296829 - DNA, 25 bp, Mus musculus
cagaggtataaaagtgctgcgagcc

SEQ ID NO: 296830 - DNA, 25 bp, Mus musculus
tcacgggagcgaagagacgctgcac

SEQ ID NO: 296831 - DNA, 25 bp, Mus musculus
cgaagagacgctgcacggccctata

SEQ ID NO: 296832 - DNA, 25 bp, Mus musculus
gcacggccctataggcggagacgct

SEQ ID NO: 296833 - DNA, 25 bp, Mus musculus
ctccagcgggagcagaggtataaaa

SEQ ID NO: 296834 - DNA, 25 bp, Mus musculus
agtcggcaccatcaggctcccttgg

SEQ ID NO: 296835 - DNA, 25 bp, Mus musculus
ttggcgtttcggagttttctctgtg

SEQ ID NO: 296836 - DNA, 25 bp, Mus musculus
cggtccaggttcactcggaggtccg

SEQ ID NO: 296837 - DNA, 25 bp, Mus musculus
ctggcacggtccaggttcactcgga

SEQ ID NO: 296838 - DNA, 25 bp, Mus musculus
tataggcggagacgctctggctcca

SEQ ID NO: 296839 - DNA, 25 bp, Mus musculus
tcccaagtcggaacctggcacggtc

SEQ ID NO: 296840 - DNA, 25 bp, Mus musculus
cggttgtctcccaagtcggaacctg

SEQ ID NO: 296841 - DNA, 25 bp, Mus musculus
ctctccggaggatctcggttgtctc

SEQ ID NO: 296842 - DNA, 25 bp, Mus musculus
cgaggaaagactagcgcggccatcc

SEQ ID NO: 296843 - DNA, 25 bp, Mus musculus
gttggtttccctaggactcgccaga

SEQ ID NO: 296844 - DNA, 25 bp, Mus musculus
cggagagatggctaatgaaagcgaa

SEQ ID NO: 296845 - DNA, 25 bp, Mus musculus
ctaatgaaagcgaatggctggggct

SEQ ID NO: 296846 - DNA, 25 bp, Mus musculus
tgcaatgtcttctccgcagccatca

SEQ ID NO: 296847 - DNA, 25 bp, Mus musculus
tactggaccggcgttctaggcctcc

SEQ ID NO: 296848 - DNA, 25 bp, Mus musculus
gatcacagccgtgggtccgtttccc

SEQ ID NO: 296849 - DNA, 25 bp, Mus musculus
ccgcctgggcctggagttccctgag

SEQ ID NO: 296850 - DNA, 25 bp, Mus musculus
ttccctgagcgtggccgctctggct

SEQ ID NO: 296851 - DNA, 25 bp, Mus musculus
gcggatcctgagctccgctctcggg

SEQ ID NO: 296852 - DNA, 25 bp, Mus musculus
tagagatgccgggtgatgcctcacc

SEQ ID NO: 296853 - DNA, 25 bp, Mus musculus
cagccatcacggcatgctctggaag

SEQ ID NO: 296854 - DNA, 25 bp, Mus musculus
tcggctttcccgctcagtgttcggg

SEQ ID NO: 296855 - DNA, 25 bp, Mus musculus
tcgctcgggagcacaccgcactgag

SEQ ID NO: 296856 - DNA, 25 bp, Mus musculus
gctcctcaaggcacagcacggaaga

SEQ ID NO: 296857 - DNA, 25 bp, Mus musculus
tagttttgcatgaggcggctgatcc

SEQ ID NO: 296858 - DNA, 25 bp, Mus musculus
cacctcaccttctcgtagttttgca

SEQ ID NO: 296859 - DNA, 25 bp, Mus musculus
gctccactgcttccgagagtgcttg

SEQ ID NO: 296860 - DNA, 25 bp, Mus musculus
gcgatcttaagacgccaggggaaag

SEQ ID NO: 296861 - DNA, 25 bp, Mus musculus
cgatgattggtgatttggcttccgc

SEQ ID NO: 296862 - DNA, 25 bp, Mus musculus
acgacaggcaatgcgcggacgatga

SEQ ID NO: 296863 - DNA, 25 bp, Mus musculus
tcgacctgccattccggcttcttta

SEQ ID NO: 296864 - DNA, 25 bp, Mus musculus
acagcacggaagacgcgaaaccagc

SEQ ID NO: 296865 - DNA, 25 bp, Mus musculus
aagcaaccgttttgcccatggcggg

SEQ ID NO: 296866 - DNA, 25 bp, Mus musculus
agcgattaaagctccgcaccgggtc

SEQ ID NO: 296867 - DNA, 25 bp, Mus musculus
gctgtgttttttcttccagcgatta

SEQ ID NO: 296868 - DNA, 25 bp, Mus musculus
ctccttcttttggtgctgcctgtgg

SEQ ID NO: 296869 - DNA, 25 bp, Mus musculus
tgggcacacattaatgacgacaggc

SEQ ID NO: 296870 - DNA, 25 bp, Mus musculus
ctcaggaccgttgggtgactaactc

SEQ ID NO: 296871 - DNA, 25 bp, Mus musculus
agagccggcgaccatgcaggccctg

SEQ ID NO: 296872 - DNA, 25 bp, Mus musculus
cgcagtggtgccatcacgtgatgca

SEQ ID NO: 296873 - DNA, 25 bp, Mus musculus
tcttcctgcagtcggtggactcgga

SEQ ID NO: 296874 - DNA, 25 bp, Mus musculus
acgtgatgcagatggcccttcctgg

SEQ ID NO: 296875 - DNA, 25 bp, Mus musculus
gaacttcactagctcgccgccaggt

SEQ ID NO: 296876 - DNA, 25 bp, Mus musculus
cgtgcgctacttcttcctgcagtcg

SEQ ID NO: 296877 - DNA, 25 bp, Mus musculus
gtgactaactccaaaggctgggcca

SEQ ID NO: 296878 - DNA, 25 bp, Mus musculus
aggtcccgcccggtgacagatgtaa

SEQ ID NO: 296879 - DNA, 25 bp, Mus musculus
cctgggcgcggtacacgagccagtc

SEQ ID NO: 296880 - DNA, 25 bp, Mus musculus
ccggtgacagatgtaagggtaagta

SEQ ID NO: 296881 - DNA, 25 bp, Mus musculus
gtaagtagagtaaacggcgcctgtg

SEQ ID NO: 296882 - DNA, 25 bp, Mus musculus
tcccacggagcgcagtggtgccatc

SEQ ID NO: 296883 - DNA, 25 bp, Mus musculus
ctcggacggccggaacttcactagc

SEQ ID NO: 296884 - DNA, 25 bp, Mus musculus
ctctcctcagggaggcccgccctcc

SEQ ID NO: 296885 - DNA, 25 bp, Mus musculus
ccgcacacgctgaccctgggacaca

SEQ ID NO: 296886 - DNA, 25 bp, Mus musculus
tgggacacacccttctgcagcgacg

SEQ ID NO: 296887 - DNA, 25 bp, Mus musculus
acacccttctgcagcgacgcaaata

SEQ ID NO: 296888 - DNA, 25 bp, Mus musculus
ccttctgcagcgacgcaaatagggc

SEQ ID NO: 296889 - DNA, 25 bp, Mus musculus
tctgcagcgacgcaaatagggcgta

SEQ ID NO: 296890 - DNA, 25 bp, Mus musculus
cagcgacgcaaatagggcgtagttc

SEQ ID NO: 296891 - DNA, 25 bp, Mus musculus
gcgacgcaaatagggcgtagttccc

SEQ ID NO: 296892 - DNA, 25 bp, Mus musculus
gggaacaccgggagcctcccactgc

SEQ ID NO: 296893 - DNA, 25 bp, Mus musculus
gctgacccgcagcacagctgtcttt

SEQ ID NO: 296894 - DNA, 25 bp, Mus musculus
tgacccgcagcacagctgtctttgg

SEQ ID NO: 296895 - DNA, 25 bp, Mus musculus
tgtctttggggacgccagcaaccca

SEQ ID NO: 296896 - DNA, 25 bp, Mus musculus
ctttggggacgccagcaacccagtg

SEQ ID NO: 296897 - DNA, 25 bp, Mus musculus
cgccctcccgcacacgctgaccctg

SEQ ID NO: 296898 - DNA, 25 bp, Mus musculus
tccggctctataaagcagcaagttg

SEQ ID NO: 296899 - DNA, 25 bp, Mus musculus
cacggatctagcagctggttctgta

SEQ ID NO: 296900 - DNA, 25 bp, Mus musculus
gtgcgcaccaatggcgattgccctc

SEQ ID NO: 296901 - DNA, 25 bp, Mus musculus
ccgcagacggaaatgacgacggttc

SEQ ID NO: 296902 - DNA, 25 bp, Mus musculus
cgggtttcatttcggcgcctttctg

SEQ ID NO: 296903 - DNA, 25 bp, Mus musculus
ctgtctcccgcggaagcgattggtt

SEQ ID NO: 296904 - DNA, 25 bp, Mus musculus
gagttgagtctcgtcccttcaggcc

SEQ ID NO: 296905 - DNA, 25 bp, Mus musculus
ctccctgtgcagctcggatcatgct

SEQ ID NO: 296906 - DNA, 25 bp, Mus musculus
gatcatgctgttaccctcggatgta

SEQ ID NO: 296907 - DNA, 25 bp, Mus musculus
tggtctgctcccgtccaagttcaga

SEQ ID NO: 296908 - DNA, 25 bp, Mus musculus
cttgggacagtcgaagctcctcggt

SEQ ID NO: 296909 - DNA, 25 bp, Mus musculus
ctcctcggtgtagggatgtcccttc

SEQ ID NO: 296910 - DNA, 25 bp, Mus musculus
gccttttcccgcgtgcacggatcta

SEQ ID NO: 296911 - DNA, 25 bp, Mus musculus
tcaaaacagtctcccggcctgagga

SEQ ID NO: 296912 - DNA, 25 bp, Mus musculus
aagatcgctgcgcttggcggcgatt

SEQ ID NO: 296913 - DNA, 25 bp, Mus musculus
gcactcgatccccaaggcgctggtg

SEQ ID NO: 296914 - DNA, 25 bp, Mus musculus
tgtggcccacgaggacggacctcgc

SEQ ID NO: 296915 - DNA, 25 bp, Mus musculus
ccggaatcgaccctgctcacctgca

SEQ ID NO: 296916 - DNA, 25 bp, Mus musculus
agcccgcgaagcagaggcctgcgga

SEQ ID NO: 296917 - DNA, 25 bp, Mus musculus
ggacgacgccgtgcagagccaccag

SEQ ID NO: 296918 - DNA, 25 bp, Mus musculus
cgtgcagagccaccagggcagccat

SEQ ID NO: 296919 - DNA, 25 bp, Mus musculus
accagggcagccatggagacgcgaa

SEQ ID NO: 296920 - DNA, 25 bp, Mus musculus
ccatggagacgcgaaaggctgtcaa

SEQ ID NO: 296921 - DNA, 25 bp, Mus musculus
gctgtcaagggcagagagacgcgcc

SEQ ID NO: 296922 - DNA, 25 bp, Mus musculus
ccaccgcagagcttgcgacgtcgtg

SEQ ID NO: 296923 - DNA, 25 bp, Mus musculus
ctcctccaatagcagtccaagatcg

SEQ ID NO: 296924 - DNA, 25 bp, Mus musculus
ggcgattggcccgtagccagagggc

SEQ ID NO: 296925 - DNA, 25 bp, Mus musculus
tccaatagcagtccaagatcgctgc

SEQ ID NO: 296926 - DNA, 25 bp, Mus musculus
ggttggtcccttgaaagcatcgctg

SEQ ID NO: 296927 - DNA, 25 bp, Mus musculus
gacgtcgccatgttctcaacttgga

SEQ ID NO: 296928 - DNA, 25 bp, Mus musculus
ctcaacttggactctcgcgagacgg

SEQ ID NO: 296929 - DNA, 25 bp, Mus musculus
ctcgggctttccagctacatggtca

SEQ ID NO: 296930 - DNA, 25 bp, Mus musculus
tgcccacgcgagagagcgcatgcaa

SEQ ID NO: 296931 - DNA, 25 bp, Mus musculus
cgcatgcaaacgcttgaggagacgc

SEQ ID NO: 296932 - DNA, 25 bp, Mus musculus
ccagaccgggaagaggtagtagcca

SEQ ID NO: 296933 - DNA, 25 bp, Mus musculus
aggtagtagccacttcctcgggcct

SEQ ID NO: 296934 - DNA, 25 bp, Mus musculus
ggccgccggcaacgactttatctcg

SEQ ID NO: 296935 - DNA, 25 bp, Mus musculus
tttatctcggcttagggcccgcacc

SEQ ID NO: 296936 - DNA, 25 bp, Mus musculus
tcgggagcaacccaggcgacagcaa

SEQ ID NO: 296937 - DNA, 25 bp, Mus musculus
gcgacagcaagccactgggtcccga

SEQ ID NO: 296938 - DNA, 25 bp, Mus musculus
cgagcgcatcgatggccgggcaaaa

SEQ ID NO: 296939 - DNA, 25 bp, Mus musculus
ctttaacagattagacgtcgccatg

SEQ ID NO: 296940 - DNA, 25 bp, Mus musculus
cccaaacggccaagaggagcagaca

SEQ ID NO: 296941 - DNA, 25 bp, Mus musculus
tgcctaaggaactgtcccttcagca

SEQ ID NO: 296942 - DNA, 25 bp, Mus musculus
aaatagtctccatcgcctacgtgcc

SEQ ID NO: 296943 - DNA, 25 bp, Mus musculus
gcggaactgatagatccaaatagtc

SEQ ID NO: 296944 - DNA, 25 bp, Mus musculus
tggagtctccgatcacaataaggcg

SEQ ID NO: 296945 - DNA, 25 bp, Mus musculus
agcggtgcagaaggcacgacttgcc

SEQ ID NO: 296946 - DNA, 25 bp, Mus musculus
cgagaagaagtccacgccgactgtg

SEQ ID NO: 296947 - DNA, 25 bp, Mus musculus
ggctcaatctccagcaggcgcgaga

SEQ ID NO: 296948 - DNA, 25 bp, Mus musculus
agctgcagcttgatcctcttgcccg

SEQ ID NO: 296949 - DNA, 25 bp, Mus musculus
ctagcactttcgagagcctgtggcg

SEQ ID NO: 296950 - DNA, 25 bp, Mus musculus
agcgagcaccgagcgctagcacttt

SEQ ID NO: 296951 - DNA, 25 bp, Mus musculus
gggcgcaggaaatccgcactaaaga

SEQ ID NO: 296952 - DNA, 25 bp, Mus musculus
ctcaggagcaagttctgcctaagga

SEQ ID NO: 296953 - DNA, 25 bp, Mus musculus
accggcgaccctgattcggacagga

SEQ ID NO: 296954 - DNA, 25 bp, Mus musculus
gtacggtggacagtatcggcagcca

SEQ ID NO: 296955 - DNA, 25 bp, Mus musculus
ccagctgagcaggatccgacgcaaa

SEQ ID NO: 296956 - DNA, 25 bp, Mus musculus
tttcggaggatacgcggggaattca

SEQ ID NO: 296957 - DNA, 25 bp, Mus musculus
cgacgctggcttttcggaggatacg

SEQ ID NO: 296958 - DNA, 25 bp, Mus musculus
cacgctccttcgaaacggtggcgac

SEQ ID NO: 296959 - DNA, 25 bp, Mus musculus
aggtcgcgtttcatctgggtgctcc

SEQ ID NO: 296960 - DNA, 25 bp, Mus musculus
accacccaggaggtcgcgtttcatc

SEQ ID NO: 296961 - DNA, 25 bp, Mus musculus
ttgagctcccaaaccacccaggagg

SEQ ID NO: 296962 - DNA, 25 bp, Mus musculus
gtgcctcgacttcggctccttgagc

SEQ ID NO: 296963 - DNA, 25 bp, Mus musculus
gacccgcgcgcacgtgtctggagct

SEQ ID NO: 296964 - DNA, 25 bp, Mus musculus
acacaggcagaaccggctggcgacc

SEQ ID NO: 296965 - DNA, 25 bp, Mus musculus
tcttcacctggtgagtgcagcgcgc

SEQ ID NO: 296966 - DNA, 25 bp, Mus musculus
tccgacgcaaactcttcacctggtg

SEQ ID NO: 296967 - DNA, 25 bp, Mus musculus
gcacttctcggggttccgggcacgc

SEQ ID NO: 296968 - DNA, 25 bp, Mus musculus
gctgccacctctcttttttccaagg

SEQ ID NO: 296969 - DNA, 25 bp, Mus musculus
aggtttccctgggagcaagacgctg

SEQ ID NO: 296970 - DNA, 25 bp, Mus musculus
tgctacgcactagcgaccgtgatcg

SEQ ID NO: 296971 - DNA, 25 bp, Mus musculus
atcgcaacagtgtggtctccatctc

SEQ ID NO: 296972 - DNA, 25 bp, Mus musculus
gctcagcagctctgggatcgcaaca

SEQ ID NO: 296973 - DNA, 25 bp, Mus musculus
ggcattcacccttggctcctctagg

SEQ ID NO: 296974 - DNA, 25 bp, Mus musculus
cggcacccaggtagtgcgcactttc

SEQ ID NO: 296975 - DNA, 25 bp, Mus musculus
atttagtcttgggtgactcgggcgc

SEQ ID NO: 296976 - DNA, 25 bp, Mus musculus
tcacgatgagaaagaggatttagtc

SEQ ID NO: 296977 - DNA, 25 bp, Mus musculus
gttatttcccggctcacgatgagaa

SEQ ID NO: 296978 - DNA, 25 bp, Mus musculus
cagcgccgcgggttgttatttcccg

SEQ ID NO: 296979 - DNA, 25 bp, Mus musculus
ggacgcaaacagcttccagcgctga

SEQ ID NO: 296980 - DNA, 25 bp, Mus musculus
gttcagtcgctaggcgacctgcgcc

SEQ ID NO: 296981 - DNA, 25 bp, Mus musculus
gcgactcaccggagcagagacagtg

SEQ ID NO: 296982 - DNA, 25 bp, Mus musculus
tgaatccatactgtgggctgccgcc

SEQ ID NO: 296983 - DNA, 25 bp, Mus musculus
caagcctgctccagtggcccgcccg

SEQ ID NO: 296984 - DNA, 25 bp, Mus musculus
cggctccgaagaggccaagcctgct

SEQ ID NO: 296985 - DNA, 25 bp, Mus musculus
cagtgtgtggccagacactagggcc

SEQ ID NO: 296986 - DNA, 25 bp, Mus musculus
ccgccagtgcctgcacgcgagggta

SEQ ID NO: 296987 - DNA, 25 bp, Mus musculus
acacggtatgggctgcaaagagtct

SEQ ID NO: 296988 - DNA, 25 bp, Mus musculus
cggcacacacggtatgggctgcaaa

SEQ ID NO: 296989 - DNA, 25 bp, Mus musculus
ctcgctacctgcagcagtcccgggc

SEQ ID NO: 296990 - DNA, 25 bp, Mus musculus
aatccatactgtgggctgccgcccg

SEQ ID NO: 296991 - DNA, 25 bp, Mus musculus
gaatctgaatccatactgtgggctg

SEQ ID NO: 296992 - DNA, 25 bp, Mus musculus
cccgggctcgccctcgctctgctct

SEQ ID NO: 296993 - DNA, 25 bp, Mus musculus
tatgggctgcaaagagtctggagcc

SEQ ID NO: 296994 - DNA, 25 bp, Mus musculus
tggctcgggtggacgcggcacacac

SEQ ID NO: 296995 - DNA, 25 bp, Mus musculus
cacacacggtatgggctgcaaagag

SEQ ID NO: 296996 - DNA, 25 bp, Mus musculus
actccgagcgcgcaggggcaacaac

SEQ ID NO: 296997 - DNA, 25 bp, Mus musculus
cattgtaccgccttggctgtcgctg

SEQ ID NO: 296998 - DNA, 25 bp, Mus musculus
gcgggcccagcattgtaccgccttg

SEQ ID NO: 296999 - DNA, 25 bp, Mus musculus
gcgagacgccgaatccgcgcggtca

SEQ ID NO: 297000 - DNA, 25 bp, Mus musculus
gagaacacatactccgtggccaagt

SEQ ID NO: 297001 - DNA, 25 bp, Mus musculus
cccaagcaacgcagggtgcacgagc

SEQ ID NO: 297002 - DNA, 25 bp, Mus musculus
ggtagcaatcactcccgtgctaagc

SEQ ID NO: 297003 - DNA, 25 bp, Mus musculus
caggggcaacaacgtgccgggaaca

SEQ ID NO: 297004 - DNA, 25 bp, Mus musculus
gccgggaacaaagctcttcgctaca

SEQ ID NO: 297005 - DNA, 25 bp, Mus musculus
ctgcgcgctcggctacagaaccgag

SEQ ID NO: 297006 - DNA, 25 bp, Mus musculus
tacagaaccgagctcttccggaacc

SEQ ID NO: 297007 - DNA, 25 bp, Mus musculus
tcccaggggcgagcagtttccggaa

SEQ ID NO: 297008 - DNA, 25 bp, Mus musculus
cagtttccggaagcgcgctgacgcg

SEQ ID NO: 297009 - DNA, 25 bp, Mus musculus
gagctccggcggtagcaatcactcc

SEQ ID NO: 297010 - DNA, 25 bp, Mus musculus
ggctttaaagcctctgccactgcgg

SEQ ID NO: 297011 - DNA, 25 bp, Mus musculus
cgcttcgccagacgggtctaaagac

SEQ ID NO: 297012 - DNA, 25 bp, Mus musculus
ccacggctcacgcgaggctttaaag

SEQ ID NO: 297013 - DNA, 25 bp, Mus musculus
gcccggcctgagcacgcagacatga

SEQ ID NO: 297014 - DNA, 25 bp, Mus musculus
aagcgcagccacaacggcgagcctg

SEQ ID NO: 297015 - DNA, 25 bp, Mus musculus
ggtctaaagacagcctgactcacgg

SEQ ID NO: 297016 - DNA, 25 bp, Mus musculus
ttctggccgaattgagtcgtgcgcc

SEQ ID NO: 297017 - DNA, 25 bp, Mus musculus
agacatgacccgagccgcagagcga

SEQ ID NO: 297018 - DNA, 25 bp, Mus musculus
ccctggtggccatagcgctgctgtc

SEQ ID NO: 297019 - DNA, 25 bp, Mus musculus
ctacgcgcctttctggccgaattga

SEQ ID NO: 297020 - DNA, 25 bp, Mus musculus
gagcgcagcgcgcaacaagcgcagc

SEQ ID NO: 297021 - DNA, 25 bp, Mus musculus
agcctgcgtcacacatccgtgcgga

SEQ ID NO: 297022 - DNA, 25 bp, Mus musculus
acatccgtgcggagagccaggacat

SEQ ID NO: 297023 - DNA, 25 bp, Mus musculus
ggcaccgtgttcgtgctgtgccagt

SEQ ID NO: 297024 - DNA, 25 bp, Mus musculus
gtttaaagccgcaggcagctcggga

SEQ ID NO: 297025 - DNA, 25 bp, Mus musculus
tcttcctgtgcgtcctcgggactca

SEQ ID NO: 297026 - DNA, 25 bp, Mus musculus
ctggaatgagctctgcgccagagga

SEQ ID NO: 297027 - DNA, 25 bp, Mus musculus
attccggctggaatgagctctgcgc

SEQ ID NO: 297028 - DNA, 25 bp, Mus musculus
tgcagatgcatctcgggattccggc

SEQ ID NO: 297029 - DNA, 25 bp, Mus musculus
cggtgaggacctgatgcagatgcat

SEQ ID NO: 297030 - DNA, 25 bp, Mus musculus
gctgcccaccgaatagcagttgtcc

SEQ ID NO: 297031 - DNA, 25 bp, Mus musculus
cgacgctgcccaccgaatagcagtt

SEQ ID NO: 297032 - DNA, 25 bp, Mus musculus
tctgctcaccgtgaaggggacgtcc

SEQ ID NO: 297033 - DNA, 25 bp, Mus musculus
acgagggcggtgattcctcatcctt

SEQ ID NO: 297034 - DNA, 25 bp, Mus musculus
cgttcgctgccagccaggagcaggt

SEQ ID NO: 297035 - DNA, 25 bp, Mus musculus
gagaccaagaccgttcgctgccagc

SEQ ID NO: 297036 - DNA, 25 bp, Mus musculus
tccataccctgagaccaagaccgtt

SEQ ID NO: 297037 - DNA, 25 bp, Mus musculus
gccagggagcagcaccgcctccata

SEQ ID NO: 297038 - DNA, 25 bp, Mus musculus
gggaatccaccctgtgactgggtca

SEQ ID NO: 297039 - DNA, 25 bp, Mus musculus
tggcctcggctcatcgttcaggaaa

SEQ ID NO: 297040 - DNA, 25 bp, Mus musculus
cgcaccacttgcttgttttgttcca

SEQ ID NO: 297041 - DNA, 25 bp, Mus musculus
agccaccatgctcctactcttgttg

SEQ ID NO: 297042 - DNA, 25 bp, Mus musculus
cctactcttgttggggatcctgttc

SEQ ID NO: 297043 - DNA, 25 bp, Mus musculus
gatcctgttcctgcacatcgcggtg

SEQ ID NO: 297044 - DNA, 25 bp, Mus musculus
tctccaccatcgtcagcgtgagtgc

SEQ ID NO: 297045 - DNA, 25 bp, Mus musculus
gtgttgctcttcgtctccaccatcg

SEQ ID NO: 297046 - DNA, 25 bp, Mus musculus
acatcgcggtgctagtgttgctctt

SEQ ID NO: 297047 - DNA, 25 bp, Mus musculus
tctattcgggatggggctttggaca

SEQ ID NO: 297048 - DNA, 25 bp, Mus musculus
tcagcctagctctccttggggccgt

SEQ ID NO: 297049 - DNA, 25 bp, Mus musculus
ggctgctctccgctggcaaaaacgg

SEQ ID NO: 297050 - DNA, 25 bp, Mus musculus
gacgtggcctcggtagcctcccaag

SEQ ID NO: 297051 - DNA, 25 bp, Mus musculus
acttggaggcaagtaacggaacgcg

SEQ ID NO: 297052 - DNA, 25 bp, Mus musculus
ctgtgagtccgcttttgcgaggcct

SEQ ID NO: 297053 - DNA, 25 bp, Mus musculus
gtcgccagcctagcctggcccgctc

SEQ ID NO: 297054 - DNA, 25 bp, Mus musculus
tgctgcttcccatcggcggcgtctg

SEQ ID NO: 297055 - DNA, 25 bp, Mus musculus
ctttcgagtgctgcttcccatcggc

SEQ ID NO: 297056 - DNA, 25 bp, Mus musculus
tctctcgccctttcgagtgctgctt

SEQ ID NO: 297057 - DNA, 25 bp, Mus musculus
ggcgtcgtctctcgccctttcgagt

SEQ ID NO: 297058 - DNA, 25 bp, Mus musculus
tccccatggtgaccgcgatggtatg

SEQ ID NO: 297059 - DNA, 25 bp, Mus musculus
tcagtgaagatggtctgcttgttcc

SEQ ID NO: 297060 - DNA, 25 bp, Mus musculus
ctcttcagtgaagatggtctgcttg

SEQ ID NO: 297061 - DNA, 25 bp, Mus musculus
tcacctggtagttgtccagctgctc

SEQ ID NO: 297062 - DNA, 25 bp, Mus musculus
tagcggcagggtttgaacctctgtg

SEQ ID NO: 297063 - DNA, 25 bp, Mus musculus
aacctctgtgagtccgcttttgcga

SEQ ID NO: 297064 - DNA, 25 bp, Mus musculus
gtccagctgctcttcagtgaagatg

SEQ ID NO: 297065 - DNA, 25 bp, Mus musculus
gccggcttcacctggtagttgtcca

SEQ ID NO: 297066 - DNA, 25 bp, Mus musculus
gtgagcgatcgagagacccgagcta

SEQ ID NO: 297067 - DNA, 25 bp, Mus musculus
attggtcagctagcggcagctgtgc

SEQ ID NO: 297068 - DNA, 25 bp, Mus musculus
ccgctccgcgcgtcatcaaaagatg

SEQ ID NO: 297069 - DNA, 25 bp, Mus musculus
tgtccaaggtgagcgctacagggca

SEQ ID NO: 297070 - DNA, 25 bp, Mus musculus
agcgctacagggcagcaagctcgag

SEQ ID NO: 297071 - DNA, 25 bp, Mus musculus
gtaggctgtgatcccgcctgatgga

SEQ ID NO: 297072 - DNA, 25 bp, Mus musculus
gcacgccgtgcgtggctagccctga

SEQ ID NO: 297073 - DNA, 25 bp, Mus musculus
tccaggataggtgcacaggcctccc

SEQ ID NO: 297074 - DNA, 25 bp, Mus musculus
ccggagcccttgagggtcacagaca

SEQ ID NO: 297075 - DNA, 25 bp, Mus musculus
agggtcacagacaggccacctaggc

SEQ ID NO: 297076 - DNA, 25 bp, Mus musculus
tcacctgcgggtctccgggcagcat

SEQ ID NO: 297077 - DNA, 25 bp, Mus musculus
tgatccctcagcctttgaccgggta

SEQ ID NO: 297078 - DNA, 25 bp, Mus musculus
ttgaccgggtaaacgctgggcgcaa

SEQ ID NO: 297079 - DNA, 25 bp, Mus musculus
cgtcaaggtcaaggcggccagtact

SEQ ID NO: 297080 - DNA, 25 bp, Mus musculus
ctccgcgaacgttctgggcctatgt

SEQ ID NO: 297081 - DNA, 25 bp, Mus musculus
tcctgcaggccatcggatcccagag

SEQ ID NO: 297082 - DNA, 25 bp, Mus musculus
ggagacccagtactatgacatcctg

SEQ ID NO: 297083 - DNA, 25 bp, Mus musculus
ctatcggaagctggcgctcaagtac

SEQ ID NO: 297084 - DNA, 25 bp, Mus musculus
acaagatggtgaaggagacccagta

SEQ ID NO: 297085 - DNA, 25 bp, Mus musculus
aggacccgggctgtgaattattgaa

SEQ ID NO: 297086 - DNA, 25 bp, Mus musculus
gagcgcaactgggtcccgggctcac

SEQ ID NO: 297087 - DNA, 25 bp, Mus musculus
ctatgtggcgtcacgcctcctggcg

SEQ ID NO: 297088 - DNA, 25 bp, Mus musculus
tggcggcagtcagaactggagctcc

SEQ ID NO: 297089 - DNA, 25 bp, Mus musculus
ccaacatggcccgtggcggcagtca

SEQ ID NO: 297090 - DNA, 25 bp, Mus musculus
cggcgtgacaatcggcagcgaacga

SEQ ID NO: 297091 - DNA, 25 bp, Mus musculus
tctgcccagggttcgcgcacacgag

SEQ ID NO: 297092 - DNA, 25 bp, Mus musculus
ggcagcgaacgacttccaccacgaa

SEQ ID NO: 297093 - DNA, 25 bp, Mus musculus
cagccagaggagcagacttcagaag

SEQ ID NO: 297094 - DNA, 25 bp, Mus musculus
acgagctcctcaaggcgttgggtaa

SEQ ID NO: 297095 - DNA, 25 bp, Mus musculus
ctagcgactcaaggcgcttgcggct

SEQ ID NO: 297096 - DNA, 25 bp, Mus musculus
ctgggcgcagaacgccagtctctct

SEQ ID NO: 297097 - DNA, 25 bp, Mus musculus
agaacgccagtctctctgcaacgca

SEQ ID NO: 297098 - DNA, 25 bp, Mus musculus
agtctctctgcaacgcagcgtgcga

SEQ ID NO: 297099 - DNA, 25 bp, Mus musculus
ttcgcgccgccgctacagccaacac

SEQ ID NO: 297100 - DNA, 25 bp, Mus musculus
caacttcgccggtacctggaagatg

SEQ ID NO: 297101 - DNA, 25 bp, Mus musculus
cggtacctggaagatgcgcagcagc

SEQ ID NO: 297102 - DNA, 25 bp, Mus musculus
atgcgcagcagcgagaatttcgacg

SEQ ID NO: 297103 - DNA, 25 bp, Mus musculus
tttcgacgagctcctcaaggcgttg

SEQ ID NO: 297104 - DNA, 25 bp, Mus musculus
tcaaggcgttgggtaagctggtaca

SEQ ID NO: 297105 - DNA, 25 bp, Mus musculus
ggggcgctaccctagcgactcaagg

SEQ ID NO: 297106 - DNA, 25 bp, Mus musculus
cgtgcgaccgctccgcagcagaggt

SEQ ID NO: 297107 - DNA, 25 bp, Mus musculus
cagcgagaatttcgacgagctcctc

SEQ ID NO: 297108 - DNA, 25 bp, Mus musculus
cgccaagacggggatcagttctaca

SEQ ID NO: 297109 - DNA, 25 bp, Mus musculus
cggctgcgtctaagccgcacgtgga

SEQ ID NO: 297110 - DNA, 25 bp, Mus musculus
cttgacccgctgcagggtgtgtcac

SEQ ID NO: 297111 - DNA, 25 bp, Mus musculus
ccgcacgtggagatccgccaagacg

SEQ ID NO: 297112 - DNA, 25 bp, Mus musculus
atactatctatcacccgggcgccaa

SEQ ID NO: 297113 - DNA, 25 bp, Mus musculus
tggtcctggttagtgcctcgctagc

SEQ ID NO: 297114 - DNA, 25 bp, Mus musculus
gctcaggagaaagccctacccgagg

SEQ ID NO: 297115 - DNA, 25 bp, Mus musculus
acctgatggtcctgggctcaggaga

SEQ ID NO: 297116 - DNA, 25 bp, Mus musculus
cacgggaagtttgtgtgacctgatg

SEQ ID NO: 297117 - DNA, 25 bp, Mus musculus
gacgcaaatgcagggtgaggctcca

SEQ ID NO: 297118 - DNA, 25 bp, Mus musculus
cattaaaacccttgacccgctgcag

SEQ ID NO: 297119 - DNA, 25 bp, Mus musculus
caacttcaaggtcggagagggcttc

SEQ ID NO: 297120 - DNA, 25 bp, Mus musculus
gtgcgcaccacggagatcaacttca

SEQ ID NO: 297121 - DNA, 25 bp, Mus musculus
aagacatccactactgtgcgcacca

SEQ ID NO: 297122 - DNA, 25 bp, Mus musculus
gtcccgctcttcagcggagcgctaa

SEQ ID NO: 297123 - DNA, 25 bp, Mus musculus
gctcttcagcggagcgctaattccg

SEQ ID NO: 297124 - DNA, 25 bp, Mus musculus
tttgtttcgccggtccgaggatctc

SEQ ID NO: 297125 - DNA, 25 bp, Mus musculus
cggtccgaggatctcgcgagagtta

SEQ ID NO: 297126 - DNA, 25 bp, Mus musculus
tcgcgagagttagccggcaaatccc

SEQ ID NO: 297127 - DNA, 25 bp, Mus musculus
ttagccggcaaatcccgcgagcgcg

SEQ ID NO: 297128 - DNA, 25 bp, Mus musculus
agctctgcggctctcgcggtgcctg

SEQ ID NO: 297129 - DNA, 25 bp, Mus musculus
gtgcctgcgcgagactgcttccttc

SEQ ID NO: 297130 - DNA, 25 bp, Mus musculus
gccctcagggcttggtcgttctctc

SEQ ID NO: 297131 - DNA, 25 bp, Mus musculus
tcgctgtgctctgcttacggtcacc

SEQ ID NO: 297132 - DNA, 25 bp, Mus musculus
gctgtacatccgtggccctcgctgt

SEQ ID NO: 297133 - DNA, 25 bp, Mus musculus
tggtggcgtgcgctgctgtacatcc

SEQ ID NO: 297134 - DNA, 25 bp, Mus musculus
ataatatggtctccggcgatggact

SEQ ID NO: 297135 - DNA, 25 bp, Mus musculus
cccgcagggataatatggtctccgg

SEQ ID NO: 297136 - DNA, 25 bp, Mus musculus
gactgaagcgagtcaagggtctctc

SEQ ID NO: 297137 - DNA, 25 bp, Mus musculus
cgcaaccactagctgactgagggga

SEQ ID NO: 297138 - DNA, 25 bp, Mus musculus
tgcaccgcaaccactagctgactga

SEQ ID NO: 297139 - DNA, 25 bp, Mus musculus
accgcaaccactagctgactgaggg

SEQ ID NO: 297140 - DNA, 25 bp, Mus musculus
gctcctcaaactcactgcgtgctga

SEQ ID NO: 297141 - DNA, 25 bp, Mus musculus
agagcaatcggcctcaggacgtccg

SEQ ID NO: 297142 - DNA, 25 bp, Mus musculus
aatcggcctcaggacgtccggtcgc

SEQ ID NO: 297143 - DNA, 25 bp, Mus musculus
gaggaggtggaagagactgaagcga

SEQ ID NO: 297144 - DNA, 25 bp, Mus musculus
tgaagcgagtcaagggtctctctga

SEQ ID NO: 297145 - DNA, 25 bp, Mus musculus
cgggctcctgcaacccttgcgctcc

SEQ ID NO: 297146 - DNA, 25 bp, Mus musculus
ttgcgctcctcaaactcactgcgtg

SEQ ID NO: 297147 - DNA, 25 bp, Mus musculus
accactagctgactgaggggagaga

SEQ ID NO: 297148 - DNA, 25 bp, Mus musculus
gcctcaggacgtccggtcgctgtgc

SEQ ID NO: 297149 - DNA, 25 bp, Mus musculus
ctcaaactcactgcgtgctgacgcg

SEQ ID NO: 297150 - DNA, 25 bp, Mus musculus
gtaaagaggcgctgatctgcaccct

SEQ ID NO: 297151 - DNA, 25 bp, Mus musculus
cttctccagctgagtaaagaggcgc

SEQ ID NO: 297152 - DNA, 25 bp, Mus musculus
gggttggttcttctccagctgagta

SEQ ID NO: 297153 - DNA, 25 bp, Mus musculus
attcgccgcggatgcttggccatcc

SEQ ID NO: 297154 - DNA, 25 bp, Mus musculus
gcacgcgcgggagccatattcgccg

SEQ ID NO: 297155 - DNA, 25 bp, Mus musculus
cttcctctggtgaggctcagtcctt

SEQ ID NO: 297156 - DNA, 25 bp, Mus musculus
ctcagtcctttaggggccgcggagt

SEQ ID NO: 297157 - DNA, 25 bp, Mus musculus
cgcggagtcgaggtgtctgtctccc

SEQ ID NO: 297158 - DNA, 25 bp, Mus musculus
atctgcgtggagaccacggcccagg

SEQ ID NO: 297159 - DNA, 25 bp, Mus musculus
agccgtgggcacgatgactttgcac

SEQ ID NO: 297160 - DNA, 25 bp, Mus musculus
ggccttgacggctcgcctgggctct

SEQ ID NO: 297161 - DNA, 25 bp, Mus musculus
ctgcggcccagagagtcaattcggg

SEQ ID NO: 297162 - DNA, 25 bp, Mus musculus
tgttcacagtcgaatccgaaacccg

SEQ ID NO: 297163 - DNA, 25 bp, Mus musculus
cgtggaggtagctgtgttcacagtc

SEQ ID NO: 297164 - DNA, 25 bp, Mus musculus
ttcggctcgacttggcagccaggta

SEQ ID NO: 297165 - DNA, 25 bp, Mus musculus
ccgttttagctgctcactctggaga

SEQ ID NO: 297166 - DNA, 25 bp, Mus musculus
gcttagctcgctctcctcggaaagg

SEQ ID NO: 297167 - DNA, 25 bp, Mus musculus
gcgtgacgtcttgtgagcttagctc

SEQ ID NO: 297168 - DNA, 25 bp, Mus musculus
tgtacgtctcctacggaagccggca

SEQ ID NO: 297169 - DNA, 25 bp, Mus musculus
ggacgcccggcttagaagtttcaca

SEQ ID NO: 297170 - DNA, 25 bp, Mus musculus
ccttttcaggcgtctgtgcgaagta

SEQ ID NO: 297171 - DNA, 25 bp, Mus musculus
ggcagcacctcgcaacagacgttac

SEQ ID NO: 297172 - DNA, 25 bp, Mus musculus
ggtccgctgatcctcaagccaggta

SEQ ID NO: 297173 - DNA, 25 bp, Mus musculus
tggatggcaccacgcacagcctctt

SEQ ID NO: 297174 - DNA, 25 bp, Mus musculus
agaccgcatcgccagaagccattcg

SEQ ID NO: 297175 - DNA, 25 bp, Mus musculus
tcccaaaagtcgcaggcctcaagta

SEQ ID NO: 297176 - DNA, 25 bp, Mus musculus
cacagcctcttagcggggaacacca

SEQ ID NO: 297177 - DNA, 25 bp, Mus musculus
gctccttctcctccggctggataga

SEQ ID NO: 297178 - DNA, 25 bp, Mus musculus
gcgactcgccggagactcagagtac

SEQ ID NO: 297179 - DNA, 25 bp, Mus musculus
ttgcacgtgagagccaggaacttcc

SEQ ID NO: 297180 - DNA, 25 bp, Mus musculus
gacatttcctgtaggttgcacgtga

SEQ ID NO: 297181 - DNA, 25 bp, Mus musculus
gccagctgcccggacatttcctgta

SEQ ID NO: 297182 - DNA, 25 bp, Mus musculus
cactatgagcatgcgcgaagggcca

SEQ ID NO: 297183 - DNA, 25 bp, Mus musculus
cagcgtctcgcggaacactatgagc

SEQ ID NO: 297184 - DNA, 25 bp, Mus musculus
ggaggaagcaaactacccactgctg

SEQ ID NO: 297185 - DNA, 25 bp, Mus musculus
ctcagagtacagcaccgacacggaa

SEQ ID NO: 297186 - DNA, 25 bp, Mus musculus
cgactcgatgctgatgcgcacggct

SEQ ID NO: 297187 - DNA, 25 bp, Mus musculus
ctgcttctcgcaggccgactcgatg

SEQ ID NO: 297188 - DNA, 25 bp, Mus musculus
tgcaggtacgtctcggtgccatcaa

SEQ ID NO: 297189 - DNA, 25 bp, Mus musculus
gccaggttctgcgacatggacagcg

SEQ ID NO: 297190 - DNA, 25 bp, Mus musculus
aggaacttccggctgaccgggctca

SEQ ID NO: 297191 - DNA, 25 bp, Mus musculus
cgacacggaaggctggaacaagctt

SEQ ID NO: 297192 - DNA, 25 bp, Mus musculus
cgcttgaggcccaggaaatcctgca

SEQ ID NO: 297193 - DNA, 25 bp, Mus musculus
ctcacgaagagcatctggccgagcg

SEQ ID NO: 297194 - DNA, 25 bp, Mus musculus
gtgtccttggacatggccgagatgc

SEQ ID NO: 297195 - DNA, 25 bp, Mus musculus
gtagtccgagatggccctggtcacc

SEQ ID NO: 297196 - DNA, 25 bp, Mus musculus
acagcgtctgcgtgtagtccgagat

SEQ ID NO: 297197 - DNA, 25 bp, Mus musculus
aacgtcaggctctcgaagctgggga

SEQ ID NO: 297198 - DNA, 25 bp, Mus musculus
atggcgctccaggacgtgtctatga

SEQ ID NO: 297199 - DNA, 25 bp, Mus musculus
tagaagtgcttgtcggtgatgatgc

SEQ ID NO: 297200 - DNA, 25 bp, Mus musculus
ggaagcccttggtctggttgaagta

SEQ ID NO: 297201 - DNA, 25 bp, Mus musculus
cggcccttagtcttgcccaggcagt

SEQ ID NO: 297202 - DNA, 25 bp, Mus musculus
gtaaaagtcacgcagctgccgcagc

SEQ ID NO: 297203 - DNA, 25 bp, Mus musculus
ttgaagggccggtaaaagtcacgca

SEQ ID NO: 297204 - DNA, 25 bp, Mus musculus
gtacaggccgatctggatggcgctc

SEQ ID NO: 297205 - DNA, 25 bp, Mus musculus
cggccggtcatctggtagaacttgc

SEQ ID NO: 297206 - DNA, 25 bp, Mus musculus
ttcgtgcagaagctgaagagcgagc

SEQ ID NO: 297207 - DNA, 25 bp, Mus musculus
tacgagttgatgaagctggacccgg

SEQ ID NO: 297208 - DNA, 25 bp, Mus musculus
cctcagggcccggagtaatccgcga

SEQ ID NO: 297209 - DNA, 25 bp, Mus musculus
agctcttgtgctccgtccctcaggg

SEQ ID NO: 297210 - DNA, 25 bp, Mus musculus
gatttcggcggcagctcttgtgctc

SEQ ID NO: 297211 - DNA, 25 bp, Mus musculus
cggcttccgagaaacgagcggattt

SEQ ID NO: 297212 - DNA, 25 bp, Mus musculus
gctacgagttgatgaagctggaccc

SEQ ID NO: 297213 - DNA, 25 bp, Mus musculus
tccaccgagtggtaaggtgggcttc

SEQ ID NO: 297214 - DNA, 25 bp, Mus musculus
cgcgggccttccaccgagtggtaag

SEQ ID NO: 297215 - DNA, 25 bp, Mus musculus
tccgccctcgagctccgcgggcctt

SEQ ID NO: 297216 - DNA, 25 bp, Mus musculus
cctagaaggacagggtgtgggctct

SEQ ID NO: 297217 - DNA, 25 bp, Mus musculus
gcccggagtaatccgcgaggcagcc

SEQ ID NO: 297218 - DNA, 25 bp, Mus musculus
agtaatccgcgaggcagccgtcggc

SEQ ID NO: 297219 - DNA, 25 bp, Mus musculus
aaacgagcggatttcggcggcagct

SEQ ID NO: 297220 - DNA, 25 bp, Mus musculus
gggctgcagcctcgcacaggagacc

SEQ ID NO: 297221 - DNA, 25 bp, Mus musculus
caccagcatcagcatggacagcggc

SEQ ID NO: 297222 - DNA, 25 bp, Mus musculus
ggggcagcacaacacccatgtctga

SEQ ID NO: 297223 - DNA, 25 bp, Mus musculus
acaacacccatgtctgaagaccgca

SEQ ID NO: 297224 - DNA, 25 bp, Mus musculus
tctgaagaccgcatggacaggaccg

SEQ ID NO: 297225 - DNA, 25 bp, Mus musculus
accgcatggacaggaccggagccac

SEQ ID NO: 297226 - DNA, 25 bp, Mus musculus
ggaccggagccactctggtgctgac

SEQ ID NO: 297227 - DNA, 25 bp, Mus musculus
tggtgctgaccaccaccgaagcaca

SEQ ID NO: 297228 - DNA, 25 bp, Mus musculus
ccaccgaagcacagctaagctagca

SEQ ID NO: 297229 - DNA, 25 bp, Mus musculus
cagctaagctagcacggagagcgcg

SEQ ID NO: 297230 - DNA, 25 bp, Mus musculus
caggcaagcgctgctagcagccgca

SEQ ID NO: 297231 - DNA, 25 bp, Mus musculus
gccacggtcttctgcgtcgatgcct

SEQ ID NO: 297232 - DNA, 25 bp, Mus musculus
ttctgcgtcgatgcctcgatgcctc

SEQ ID NO: 297233 - DNA, 25 bp, Mus musculus
cccgcttgtacctggcagcagcatc

SEQ ID NO: 297234 - DNA, 25 bp, Mus musculus
cttcgacaagaaccacgagcgattc

SEQ ID NO: 297235 - DNA, 25 bp, Mus musculus
cgcagtcccgggacaaagggcgcct

SEQ ID NO: 297236 - DNA, 25 bp, Mus musculus
ggaagctggacgagctgcactgcca

SEQ ID NO: 297237 - DNA, 25 bp, Mus musculus
gagcgattccgcatcgtcagctgga

SEQ ID NO: 297238 - DNA, 25 bp, Mus musculus
tttccagccgcgatcgcacgcgggt

SEQ ID NO: 297239 - DNA, 25 bp, Mus musculus
tcggttacaaaggcagcagccggcc

SEQ ID NO: 297240 - DNA, 25 bp, Mus musculus
gcgtcgctgttgcccttttaagccg

SEQ ID NO: 297241 - DNA, 25 bp, Mus musculus
aggttcatcctcgtgcggtgccgcc

SEQ ID NO: 297242 - DNA, 25 bp, Mus musculus
caggggagctcaggttcatcctcgt

SEQ ID NO: 297243 - DNA, 25 bp, Mus musculus
ataggccgcgcacgtgtctggccag

SEQ ID NO: 297244 - DNA, 25 bp, Mus musculus
cgcgcgtttcctacccgagccgacg

SEQ ID NO: 297245 - DNA, 25 bp, Mus musculus
gacaaccacgcggaggagcaacctc

SEQ ID NO: 297246 - DNA, 25 bp, Mus musculus
gccgctcacacttcactgcaacatc

SEQ ID NO: 297247 - DNA, 25 bp, Mus musculus
tccgcatcgtcagctggaagctgga

SEQ ID NO: 297248 - DNA, 25 bp, Mus musculus
gcaaccctttgtgcttttgcatccc

SEQ ID NO: 297249 - DNA, 25 bp, Mus musculus
ggcttaaacgccaggctgcctccgg

SEQ ID NO: 297250 - DNA, 25 bp, Mus musculus
gccacctggagggacattgcttggt

SEQ ID NO: 297251 - DNA, 25 bp, Mus musculus
gtacgcagagtgctgcggacccatc

SEQ ID NO: 297252 - DNA, 25 bp, Mus musculus
acattgcttggtgcgcgtggtagct

SEQ ID NO: 297253 - DNA, 25 bp, Mus musculus
tttcctagtgcttagctggcgctgc

SEQ ID NO: 297254 - DNA, 25 bp, Mus musculus
acctctgcccgggtttcctagtgct

SEQ ID NO: 297255 - DNA, 25 bp, Mus musculus
gagcgtgtgtttaccttcctgccgg

SEQ ID NO: 297256 - DNA, 25 bp, Mus musculus
cctacgtgctgagtaaccttgcgga

SEQ ID NO: 297257 - DNA, 25 bp, Mus musculus
acagatccgcgaagcacctacgtgc

SEQ ID NO: 297258 - DNA, 25 bp, Mus musculus
ccctgagactctgtagggccttcgg

SEQ ID NO: 297259 - DNA, 25 bp, Mus musculus
cagcggcgtgtccagtaccggaagc

SEQ ID NO: 297260 - DNA, 25 bp, Mus musculus
cccttccgggcggaactgtgcaggc

SEQ ID NO: 297261 - DNA, 25 bp, Mus musculus
atcgcagcgtgacctggatctccgc

SEQ ID NO: 297262 - DNA, 25 bp, Mus musculus
gcgccgctactcacagcacagtgtg

SEQ ID NO: 297263 - DNA, 25 bp, Mus musculus
cggcaggcagaaacctcggaggaca

SEQ ID NO: 297264 - DNA, 25 bp, Mus musculus
ccgctactcacagcacagtgtgtga

SEQ ID NO: 297265 - DNA, 25 bp, Mus musculus
acagcacagtgtgtgaaaacgcacc

SEQ ID NO: 297266 - DNA, 25 bp, Mus musculus
gcacagtgtgtgaaaacgcacccag

SEQ ID NO: 297267 - DNA, 25 bp, Mus musculus
cagtgtgtgaaaacgcacccagggc

SEQ ID NO: 297268 - DNA, 25 bp, Mus musculus
gccagcctccgcttcgagctcctgc

SEQ ID NO: 297269 - DNA, 25 bp, Mus musculus
gtcacccgcgccacgaggcccgctt

SEQ ID NO: 297270 - DNA, 25 bp, Mus musculus
cccgctggtcgcagtttcctagaca

SEQ ID NO: 297271 - DNA, 25 bp, Mus musculus
tggtcgcagtttcctagacagccgc

SEQ ID NO: 297272 - DNA, 25 bp, Mus musculus
tcgcagtttcctagacagccgcgcg

SEQ ID NO: 297273 - DNA, 25 bp, Mus musculus
gaaacctcggaggacactgcgcgcc

SEQ ID NO: 297274 - DNA, 25 bp, Mus musculus
caggcagaaacctcggaggacactg

SEQ ID NO: 297275 - DNA, 25 bp, Mus musculus
tcggaggacactgcgcgccgctact

SEQ ID NO: 297276 - DNA, 25 bp, Mus musculus
tgccctgttgtacgcagctttcttt

SEQ ID NO: 297277 - DNA, 25 bp, Mus musculus
gttgtctggactaactgccctgttg

SEQ ID NO: 297278 - DNA, 25 bp, Mus musculus
tgttccctgacggtctcggactttc

SEQ ID NO: 297279 - DNA, 25 bp, Mus musculus
gccctccagttgcttggctctgttc

SEQ ID NO: 297280 - DNA, 25 bp, Mus musculus
cagccaatgaggaaagcggaaagtt

SEQ ID NO: 297281 - DNA, 25 bp, Mus musculus
ttcccgggagcccattgggcagcca

SEQ ID NO: 297282 - DNA, 25 bp, Mus musculus
agctgacagcttagtcctggactgc

SEQ ID NO: 297283 - DNA, 25 bp, Mus musculus
tgcgagcacgagagctgacagctta

SEQ ID NO: 297284 - DNA, 25 bp, Mus musculus
cagagacccgaacgctcgcgagatg

SEQ ID NO: 297285 - DNA, 25 bp, Mus musculus
gccgctgctcgaaacattgtctctg

SEQ ID NO: 297286 - DNA, 25 bp, Mus musculus
cctccaggcgagagaacctagtagc

SEQ ID NO: 297287 - DNA, 25 bp, Mus musculus
aggctccagaactttgacccgcgtc

SEQ ID NO: 297288 - DNA, 25 bp, Mus musculus
agcccgtgaccttcgcctgacaggg

SEQ ID NO: 297289 - DNA, 25 bp, Mus musculus
gggcactgcaccgactgtctacgcg

SEQ ID NO: 297290 - DNA, 25 bp, Mus musculus
ggcaggagttagttagcaaagagca

SEQ ID NO: 297291 - DNA, 25 bp, Mus musculus
cgccctacaagtccgaagaaagcgc

SEQ ID NO: 297292 - DNA, 25 bp, Mus musculus
caagtccgaagaaagcgcggcgctg

SEQ ID NO: 297293 - DNA, 25 bp, Mus musculus
agagctgggtgacgctacaggtccc

SEQ ID NO: 297294 - DNA, 25 bp, Mus musculus
agatgcggcttccaagggattgcgg

SEQ ID NO: 297295 - DNA, 25 bp, Mus musculus
ggctgcgctccattgttcactccga

SEQ ID NO: 297296 - DNA, 25 bp, Mus musculus
gttcactccgaaccaatcagagctt

SEQ ID NO: 297297 - DNA, 25 bp, Mus musculus
ggaatcgctccttcaactccgcggg

SEQ ID NO: 297298 - DNA, 25 bp, Mus musculus
ttagttagcaaagagcagaggctgg

SEQ ID NO: 297299 - DNA, 25 bp, Mus musculus
gctccttcaactccgcggggcagga

SEQ ID NO: 297300 - DNA, 25 bp, Mus musculus
gaaccaatcagagctttcccacttc

SEQ ID NO: 297301 - DNA, 25 bp, Mus musculus
ggcgctcgaccctggtccttctgtc

SEQ ID NO: 297302 - DNA, 25 bp, Mus musculus
ccggtgcggaatcgctccttcaact

SEQ ID NO: 297303 - DNA, 25 bp, Mus musculus
tgggtgacgctacaggtcccgcctc

SEQ ID NO: 297304 - DNA, 25 bp, Mus musculus
tctggatcattcgaaagtggtctca

SEQ ID NO: 297305 - DNA, 25 bp, Mus musculus
ggaaaacctactgcaagcgggacta

SEQ ID NO: 297306 - DNA, 25 bp, Mus musculus
ccgcaggctgttcggcatcaagtgt

SEQ ID NO: 297307 - DNA, 25 bp, Mus musculus
cagcgtgtaccacatcgagtgcttc

SEQ ID NO: 297308 - DNA, 25 bp, Mus musculus
ctgctccctggagacgagttctcgc

SEQ ID NO: 297309 - DNA, 25 bp, Mus musculus
aaccctgctatgtgtctgcgagtgc

SEQ ID NO: 297310 - DNA, 25 bp, Mus musculus
cgccgcgtcagtaggatgtacgact

SEQ ID NO: 297311 - DNA, 25 bp, Mus musculus
accagtttatccttcgcgtgtcgcc

SEQ ID NO: 297312 - DNA, 25 bp, Mus musculus
gggagtcagatccacgaccagttta

SEQ ID NO: 297313 - DNA, 25 bp, Mus musculus
gcttcgtgagagacgggaaaaccta

SEQ ID NO: 297314 - DNA, 25 bp, Mus musculus
actgtgtagccgacagctgagcttc

SEQ ID NO: 297315 - DNA, 25 bp, Mus musculus
tccgcgttcaaagacggtgataatg

SEQ ID NO: 297316 - DNA, 25 bp, Mus musculus
tgtctctagctgaaccgatactacg

SEQ ID NO: 297317 - DNA, 25 bp, Mus musculus
tgcctcccgttagctctgtctctag

SEQ ID NO: 297318 - DNA, 25 bp, Mus musculus
tgcgcacgcacgtgcacaagcaggc

SEQ ID NO: 297319 - DNA, 25 bp, Mus musculus
acaacccgggtacggactgtgctca

SEQ ID NO: 297320 - DNA, 25 bp, Mus musculus
gtacggactgtgctcaacgagaagc

SEQ ID NO: 297321 - DNA, 25 bp, Mus musculus
gtgctcaacgagaagcaactgcata

SEQ ID NO: 297322 - DNA, 25 bp, Mus musculus
aactgcataccctgcggacgtgcta

SEQ ID NO: 297323 - DNA, 25 bp, Mus musculus
aatccgcggccagacgcgctcatga

SEQ ID NO: 297324 - DNA, 25 bp, Mus musculus
cagctagtagagatgaccggcttga

SEQ ID NO: 297325 - DNA, 25 bp, Mus musculus
tgaccggcttgagcccgcgggtcat

SEQ ID NO: 297326 - DNA, 25 bp, Mus musculus
tgggtccggacgacagccctcactg

SEQ ID NO: 297327 - DNA, 25 bp, Mus musculus
cagacgctgggtccggacgacagcc

SEQ ID NO: 297328 - DNA, 25 bp, Mus musculus
aaacgaaatcttggggagaatggct

SEQ ID NO: 297329 - DNA, 25 bp, Mus musculus
ccgaatgtcagggaaacgaaatctt

SEQ ID NO: 297330 - DNA, 25 bp, Mus musculus
cgcgctcatgaaagagcagctagta

SEQ ID NO: 297331 - DNA, 25 bp, Mus musculus
cacaagcaggcggagaagacaaccc

SEQ ID NO: 297332 - DNA, 25 bp, Mus musculus
gctcaggccattccagctctgaaaa

SEQ ID NO: 297333 - DNA, 25 bp, Mus musculus
gtttagggagcgaagcccactctgc

SEQ ID NO: 297334 - DNA, 25 bp, Mus musculus
gcccgacacttattgggtgccgatg

SEQ ID NO: 297335 - DNA, 25 bp, Mus musculus
acccgtcctcgtgctgcggttcaat

SEQ ID NO: 297336 - DNA, 25 bp, Mus musculus
aagcgcatgactgccggacagagta

SEQ ID NO: 297337 - DNA, 25 bp, Mus musculus
ctgacccgaggctttgttctggacc

SEQ ID NO: 297338 - DNA, 25 bp, Mus musculus
ttgctcgcccgggaacccatctgat

SEQ ID NO: 297339 - DNA, 25 bp, Mus musculus
tgtcactgtctctctgcgccttgct

SEQ ID NO: 297340 - DNA, 25 bp, Mus musculus
tggagactccggctccaaggacttt

SEQ ID NO: 297341 - DNA, 25 bp, Mus musculus
tctccggcccttgtaattattgttg

SEQ ID NO: 297342 - DNA, 25 bp, Mus musculus
tccttcgtgctgtccctagagtgga

SEQ ID NO: 297343 - DNA, 25 bp, Mus musculus
acagtgagagcctttgccgaacaaa

SEQ ID NO: 297344 - DNA, 25 bp, Mus musculus
cctgcaccgctgagactggagactc

SEQ ID NO: 297345 - DNA, 25 bp, Mus musculus
acctggcagcgaggacggaacaatt

SEQ ID NO: 297346 - DNA, 25 bp, Mus musculus
cgtgcctccctatggcttccgaagg

SEQ ID NO: 297347 - DNA, 25 bp, Mus musculus
ggacaggacacttgcgctactgcta

SEQ ID NO: 297348 - DNA, 25 bp, Mus musculus
ggacacttgcgctactgctactgca

SEQ ID NO: 297349 - DNA, 25 bp, Mus musculus
ttgcgctactgctactgcagctaga

SEQ ID NO: 297350 - DNA, 25 bp, Mus musculus
cgctactgctactgcagctagatca

SEQ ID NO: 297351 - DNA, 25 bp, Mus musculus
gctactgcagctagatcaccaggtc

SEQ ID NO: 297352 - DNA, 25 bp, Mus musculus
aagctcttcggctgtgctctccgtc

SEQ ID NO: 297353 - DNA, 25 bp, Mus musculus
tgcagctagatcaccaggtcaccgc

SEQ ID NO: 297354 - DNA, 25 bp, Mus musculus
tcaccgccgcgaggcccgtgcctcc

SEQ ID NO: 297355 - DNA, 25 bp, Mus musculus
gcctccctatggcttccgaaggaaa

SEQ ID NO: 297356 - DNA, 25 bp, Mus musculus
ctccctatggcttccgaaggaaaag

SEQ ID NO: 297357 - DNA, 25 bp, Mus musculus
ctgttggaacccgggtggcccgcat

SEQ ID NO: 297358 - DNA, 25 bp, Mus musculus
cgcgcggacaggacacttgcgctac

SEQ ID NO: 297359 - DNA, 25 bp, Mus musculus
tagatcaccaggtcaccgccgcgag

SEQ ID NO: 297360 - DNA, 25 bp, Mus musculus
cgcgagatttcgtccttgtcctagt

SEQ ID NO: 297361 - DNA, 25 bp, Mus musculus
tccgcgcggaaacggcgctcttgta

SEQ ID NO: 297362 - DNA, 25 bp, Mus musculus
ccaacgtgtactcacgcgagatttc

SEQ ID NO: 297363 - DNA, 25 bp, Mus musculus
tttcgtccttgtcctagtccggctg

SEQ ID NO: 297364 - DNA, 25 bp, Mus musculus
gagcgctcttttcgacgcggcggaa

SEQ ID NO: 297365 - DNA, 25 bp, Mus musculus
cggaagaggtaagcggttgttcact

SEQ ID NO: 297366 - DNA, 25 bp, Mus musculus
agcggttgttcactgtggccgctca

SEQ ID NO: 297367 - DNA, 25 bp, Mus musculus
cactgtggccgctcaggtctgctgc

SEQ ID NO: 297368 - DNA, 25 bp, Mus musculus
gtgctgcctgcgcacatctcttagg

SEQ ID NO: 297369 - DNA, 25 bp, Mus musculus
gcacatctcttaggttacgttccga

SEQ ID NO: 297370 - DNA, 25 bp, Mus musculus
ttacgttccgaaagggtcttgcagc

SEQ ID NO: 297371 - DNA, 25 bp, Mus musculus
ttgcagcgggcccacggcgcatagt

SEQ ID NO: 297372 - DNA, 25 bp, Mus musculus
acggcgctcttgtagggccagagca

SEQ ID NO: 297373 - DNA, 25 bp, Mus musculus
ggcgcatagtcgacgcagctcacca

SEQ ID NO: 297374 - DNA, 25 bp, Mus musculus
ggcttagcttactttggggcggctc

SEQ ID NO: 297375 - DNA, 25 bp, Mus musculus
ggcccggcctgaggtctgtcccagt

SEQ ID NO: 297376 - DNA, 25 bp, Mus musculus
tgtcccagtcccacgaccctcactg

SEQ ID NO: 297377 - DNA, 25 bp, Mus musculus
gcctcctcagtccacctcgcggctc

SEQ ID NO: 297378 - DNA, 25 bp, Mus musculus
cccggtcacacgcccaggtgaggga

SEQ ID NO: 297379 - DNA, 25 bp, Mus musculus
atggacggcgcaccacgtgacgcca

SEQ ID NO: 297380 - DNA, 25 bp, Mus musculus
ctcgcggacacttacccgggaggct

SEQ ID NO: 297381 - DNA, 25 bp, Mus musculus
ttagcttactttggggcggctccca

SEQ ID NO: 297382 - DNA, 25 bp, Mus musculus
caggcgcagctaggctcacttcttg

SEQ ID NO: 297383 - DNA, 25 bp, Mus musculus
tggaagggtttccgccgccatcttg

SEQ ID NO: 297384 - DNA, 25 bp, Mus musculus
agagtttcctctgtaccgacgaacg

SEQ ID NO: 297385 - DNA, 25 bp, Mus musculus
tcctgggccattcgcgcaggcgcag

SEQ ID NO: 297386 - DNA, 25 bp, Mus musculus
cgctcaagtagaaaggtaagagttt

SEQ ID NO: 297387 - DNA, 25 bp, Mus musculus
ggctcacttcttgcgcgctcaagta

SEQ ID NO: 297388 - DNA, 25 bp, Mus musculus
accgcgaagcgctgctgggtgtcca

SEQ ID NO: 297389 - DNA, 25 bp, Mus musculus
ccgcggccatataaggcagggcctg

SEQ ID NO: 297390 - DNA, 25 bp, Mus musculus
gggcctcagcaacgcagtagtcgac

SEQ ID NO: 297391 - DNA, 25 bp, Mus musculus
tagtcgacagacttcaggctggggt

SEQ ID NO: 297392 - DNA, 25 bp, Mus musculus
gctgcccgtgaagcaaggctgccaa

SEQ ID NO: 297393 - DNA, 25 bp, Mus musculus
ggctttctgcgtcctcgccgagcgg

SEQ ID NO: 297394 - DNA, 25 bp, Mus musculus
gcaccgggcggactacgaccgcgaa

SEQ ID NO: 297395 - DNA, 25 bp, Mus musculus
aggataccaggctgggtaccgcatc

SEQ ID NO: 297396 - DNA, 25 bp, Mus musculus
gtaccgcatcgccatgggctttgtc

SEQ ID NO: 297397 - DNA, 25 bp, Mus musculus
tcctgtgacaaagcgggacgaccag

SEQ ID NO: 297398 - DNA, 25 bp, Mus musculus
acgaccagagagagaggccttagca

SEQ ID NO: 297399 - DNA, 25 bp, Mus musculus
gccttagcaagagcggcctgacaat

SEQ ID NO: 297400 - DNA, 25 bp, Mus musculus
cgccatgggctttgtcctgtgacaa

SEQ ID NO: 297401 - DNA, 25 bp, Mus musculus
ggaactgcactacccgcagggcgag

SEQ ID NO: 297402 - DNA, 25 bp, Mus musculus
cggcgctcaccgagcgagaaggcaa

SEQ ID NO: 297403 - DNA, 25 bp, Mus musculus
ctggctctgcgaggactcagacaaa

SEQ ID NO: 297404 - DNA, 25 bp, Mus musculus
tcagacaaagacagcggacccgact

SEQ ID NO: 297405 - DNA, 25 bp, Mus musculus
cggacccgactcacaggggagtatc

SEQ ID NO: 297406 - DNA, 25 bp, Mus musculus
agtatcccatttcgggcctggcgtc

SEQ ID NO: 297407 - DNA, 25 bp, Mus musculus
tggaaggacctcaccaagagctccg

SEQ ID NO: 297408 - DNA, 25 bp, Mus musculus
agaacgaggtggctcgcctcttaaa

SEQ ID NO: 297409 - DNA, 25 bp, Mus musculus
ggctctgctgagaactgctgggccc

SEQ ID NO: 297410 - DNA, 25 bp, Mus musculus
aggtgatgccgcattggcccatggt

SEQ ID NO: 297411 - DNA, 25 bp, Mus musculus
accagcacggtcttagaggaggtga

SEQ ID NO: 297412 - DNA, 25 bp, Mus musculus
gtagctgctacatgacctggggaca

SEQ ID NO: 297413 - DNA, 25 bp, Mus musculus
agccctgagaacagagcgacccgca

SEQ ID NO: 297414 - DNA, 25 bp, Mus musculus
taggccgttcccaggcaactaagtc

SEQ ID NO: 297415 - DNA, 25 bp, Mus musculus
tcacccagaagatgaggttgaggaa

SEQ ID NO: 297416 - DNA, 25 bp, Mus musculus
atgcctgtgatagagacatgagagg

SEQ ID NO: 297417 - DNA, 25 bp, Mus musculus
ataagggctttagagttgatccttg

SEQ ID NO: 297418 - DNA, 25 bp, Mus musculus
gctttagagttgatccttgggaata

SEQ ID NO: 297419 - DNA, 25 bp, Mus musculus
ttgatccttgggaataagactttta

SEQ ID NO: 297420 - DNA, 25 bp, Mus musculus
cttgggaataagacttttaaggcag

SEQ ID NO: 297421 - DNA, 25 bp, Mus musculus
gacttttaaggcagttgggctgtta

SEQ ID NO: 297422 - DNA, 25 bp, Mus musculus
aggcagttgggctgttaccctttct

SEQ ID NO: 297423 - DNA, 25 bp, Mus musculus
cacatacaccaaatgcctgtgatag

SEQ ID NO: 297424 - DNA, 25 bp, Mus musculus
ccaaatgcctgtgatagagacatga

SEQ ID NO: 297425 - DNA, 25 bp, Mus musculus
gagggactgaaggtagaatcctatg

SEQ ID NO: 297426 - DNA, 25 bp, Mus musculus
ctgaaggtagaatcctatggactga

SEQ ID NO: 297427 - DNA, 25 bp, Mus musculus
aggtagaatcctatggactgaattg

SEQ ID NO: 297428 - DNA, 25 bp, Mus musculus
aatcctatggactgaattgtgtctc

SEQ ID NO: 297429 - DNA, 25 bp, Mus musculus
acaccaaatgcctgtgatagagaca

SEQ ID NO: 297430 - DNA, 25 bp, Mus musculus
tcccgggaccatcgcagccagggta

SEQ ID NO: 297431 - DNA, 25 bp, Mus musculus
cgtgcccgcaccaaacctcggcggt

SEQ ID NO: 297432 - DNA, 25 bp, Mus musculus
ttcacttcttcagaccgcgcgcgct

SEQ ID NO: 297433 - DNA, 25 bp, Mus musculus
acccttgccgcttcacttcttcaga

SEQ ID NO: 297434 - DNA, 25 bp, Mus musculus
ctaactaactactcgcggccgcgga

SEQ ID NO: 297435 - DNA, 25 bp, Mus musculus
gacacaactaactaactactcgcgg

SEQ ID NO: 297436 - DNA, 25 bp, Mus musculus
tccaccgagcaactgacacaactaa

SEQ ID NO: 297437 - DNA, 25 bp, Mus musculus
tgtcccgtcccctttctggtgatcg

SEQ ID NO: 297438 - DNA, 25 bp, Mus musculus
ttgcgatattcagcattgcctcctg

SEQ ID NO: 297439 - DNA, 25 bp, Mus musculus
ggagcacaagccgttgcgatattca

SEQ ID NO: 297440 - DNA, 25 bp, Mus musculus
cccgttacctgaggggagcacaagc

SEQ ID NO: 297441 - DNA, 25 bp, Mus musculus
ccataagccagcgcgtgtgggaaag

SEQ ID NO: 297442 - DNA, 25 bp, Mus musculus
gcgtcctcacctctcggcgaccctg

SEQ ID NO: 297443 - DNA, 25 bp, Mus musculus
atcgcagccagggtaacgaggcctg

SEQ ID NO: 297444 - DNA, 25 bp, Mus musculus
caaacacctgctgtgccttgcggtc

SEQ ID NO: 297445 - DNA, 25 bp, Mus musculus
tgctgcctgttgaagttgagccgcc

SEQ ID NO: 297446 - DNA, 25 bp, Mus musculus
tttgccctggacgaactcaggtgtg

SEQ ID NO: 297447 - DNA, 25 bp, Mus musculus
tcaggcgagtagctgcgcacatgca

SEQ ID NO: 297448 - DNA, 25 bp, Mus musculus
aagtccttgaactctttgccctgga

SEQ ID NO: 297449 - DNA, 25 bp, Mus musculus
tgggtaggagtacatccggaaagtc

SEQ ID NO: 297450 - DNA, 25 bp, Mus musculus
accgtgtggccctcatctacaaaca

SEQ ID NO: 297451 - DNA, 25 bp, Mus musculus
cggcatacaaactgcaccgtgtggc

SEQ ID NO: 297452 - DNA, 25 bp, Mus musculus
gggtcgccatctgcccggcatacaa

SEQ ID NO: 297453 - DNA, 25 bp, Mus musculus
agccgcccattgctcttggccgaga

SEQ ID NO: 297454 - DNA, 25 bp, Mus musculus
tccagcgtgccatcagggaagactg

SEQ ID NO: 297455 - DNA, 25 bp, Mus musculus
gtacgtgccgttgtcctgtacctgg

SEQ ID NO: 297456 - DNA, 25 bp, Mus musculus
cattggctgcgatgcacaggtacgt

SEQ ID NO: 297457 - DNA, 25 bp, Mus musculus
agtcgttgccgccagcattggctgc

SEQ ID NO: 297458 - DNA, 25 bp, Mus musculus
ctccagcgtcagctgttccaggctg

SEQ ID NO: 297459 - DNA, 25 bp, Mus musculus
tcaagttgctgaggccggtgaagac

SEQ ID NO: 297460 - DNA, 25 bp, Mus musculus
tcgtcctggttgagtgtcttgatgc

SEQ ID NO: 297461 - DNA, 25 bp, Mus musculus
ccacggcgctcacgatgttttcatt

SEQ ID NO: 297462 - DNA, 25 bp, Mus musculus
acgcccagcgggataagcttcaggc

SEQ ID NO: 297463 - DNA, 25 bp, Mus musculus
tgggaagctggcaaactcgtcctgg

SEQ ID NO: 297464 - DNA, 25 bp, Mus musculus
ggtcagattgcatttctccagcgtc

SEQ ID NO: 297465 - DNA, 25 bp, Mus musculus
ctgatgtccagcttggtcaagttgc

SEQ ID NO: 297466 - DNA, 25 bp, Mus musculus
ctagcaggatgacgatcttgttctc

SEQ ID NO: 297467 - DNA, 25 bp, Mus musculus
ttgagttctagctcctccaggtgtg

SEQ ID NO: 297468 - DNA, 25 bp, Mus musculus
ccagcgacttgaggttgtataggtc

SEQ ID NO: 297469 - DNA, 25 bp, Mus musculus
tcgggcaccgccacaaagcgtttgc

SEQ ID NO: 297470 - DNA, 25 bp, Mus musculus
ttgatgcggtttttgcccaggtcca

SEQ ID NO: 297471 - DNA, 25 bp, Mus musculus
aggtcttggaacatgtagtctagca

SEQ ID NO: 297472 - DNA, 25 bp, Mus musculus
ctctcaggacgagtgttgcgggctc

SEQ ID NO: 297473 - DNA, 25 bp, Mus musculus
ggtcccaggctccagcaagtcttaa

SEQ ID NO: 297474 - DNA, 25 bp, Mus musculus
gcgcagacgaagaacgctcccgggc

SEQ ID NO: 297475 - DNA, 25 bp, Mus musculus
cttctttcagagaaccggacgaaga

SEQ ID NO: 297476 - DNA, 25 bp, Mus musculus
tccagcaagtcttaagccagcccag

SEQ ID NO: 297477 - DNA, 25 bp, Mus musculus
cgggagcccagtcgactctagggca

SEQ ID NO: 297478 - DNA, 25 bp, Mus musculus
atcgcatgtctctcttgccggcgcg

SEQ ID NO: 297479 - DNA, 25 bp, Mus musculus
ggtcaccaatcgcatgtctctcttg

SEQ ID NO: 297480 - DNA, 25 bp, Mus musculus
gtccgctcggcttggtcaccaatcg

SEQ ID NO: 297481 - DNA, 25 bp, Mus musculus
gcagctgccgcgcatgctgctctga

SEQ ID NO: 297482 - DNA, 25 bp, Mus musculus
agtgcgtgcacccattcgcgtttga

SEQ ID NO: 297483 - DNA, 25 bp, Mus musculus
tcgcgtttgattgtctctggccaca

SEQ ID NO: 297484 - DNA, 25 bp, Mus musculus
gtctctggccacatgcgtgtgcatg

SEQ ID NO: 297485 - DNA, 25 bp, Mus musculus
ttcccagagtgcgtgcacccattcg

SEQ ID NO: 297486 - DNA, 25 bp, Mus musculus
tggtggcagcagcaaccaacgaagc

SEQ ID NO: 297487 - DNA, 25 bp, Mus musculus
tgcactttgggttctcgccctcctg

SEQ ID NO: 297488 - DNA, 25 bp, Mus musculus
gtcgctgctcttgtcttccacctgt

SEQ ID NO: 297489 - DNA, 25 bp, Mus musculus
ttgattctttcggtcgctgctcttg

SEQ ID NO: 297490 - DNA, 25 bp, Mus musculus
cacagccgtgtgctcttgattcttt

SEQ ID NO: 297491 - DNA, 25 bp, Mus musculus
ccctcctggggagctcatcaaggtt

SEQ ID NO: 297492 - DNA, 25 bp, Mus musculus
gctgtccctctgctcttggcctgag

SEQ ID NO: 297493 - DNA, 25 bp, Mus musculus
tacacacccgactctgcactttggg

SEQ ID NO: 297494 - DNA, 25 bp, Mus musculus
atgccagcagaatccctaacgcgcg

SEQ ID NO: 297495 - DNA, 25 bp, Mus musculus
tccacgctgcgatgccagcagaatc

SEQ ID NO: 297496 - DNA, 25 bp, Mus musculus
ccaacgaagcagaaaaggcgtgtgt

SEQ ID NO: 297497 - DNA, 25 bp, Mus musculus
tccgatcccagctccagcttgggtt

SEQ ID NO: 297498 - DNA, 25 bp, Mus musculus
ttaccatcagagctagtcgtccgcg

SEQ ID NO: 297499 - DNA, 25 bp, Mus musculus
gtgtatgtgcacaagagagcgcgca

SEQ ID NO: 297500 - DNA, 25 bp, Mus musculus
catggctcagcacatggcaggagtc

SEQ ID NO: 297501 - DNA, 25 bp, Mus musculus
acctaaatggttctagggcgcagca

SEQ ID NO: 297502 - DNA, 25 bp, Mus musculus
ggcgcagcataccagccaacggtgc

SEQ ID NO: 297503 - DNA, 25 bp, Mus musculus
aacggtgccaagctaaaagtttctg

SEQ ID NO: 297504 - DNA, 25 bp, Mus musculus
aaagtttctgtaggtggctgtctca

SEQ ID NO: 297505 - DNA, 25 bp, Mus musculus
agcctactccggagcatctgatttc

SEQ ID NO: 297506 - DNA, 25 bp, Mus musculus
aactgtccaccagcaatgtgcggtc

SEQ ID NO: 297507 - DNA, 25 bp, Mus musculus
gcgcctactgtcttatccttgcctg

SEQ ID NO: 297508 - DNA, 25 bp, Mus musculus
atccttgcctgcagccagcgaattg

SEQ ID NO: 297509 - DNA, 25 bp, Mus musculus
ggcatcttaggggatgtctcattcg

SEQ ID NO: 297510 - DNA, 25 bp, Mus musculus
tctcattcggagctgtgaccagggc

SEQ ID NO: 297511 - DNA, 25 bp, Mus musculus
gccggcgcacgagtacaaaaacatg

SEQ ID NO: 297512 - DNA, 25 bp, Mus musculus
tgcggccacagccaaaaggtaaccg

SEQ ID NO: 297513 - DNA, 25 bp, Mus musculus
aagagcagcgcgagcttcctcctca

SEQ ID NO: 297514 - DNA, 25 bp, Mus musculus
cttgcgactcggtgctgtccagatt

SEQ ID NO: 297515 - DNA, 25 bp, Mus musculus
ttgcgacttgcgacttgcgactcgg

SEQ ID NO: 297516 - DNA, 25 bp, Mus musculus
tttggacttgaattgcgacttgcga

SEQ ID NO: 297517 - DNA, 25 bp, Mus musculus
tgttccttcgccttacaagtccagg

SEQ ID NO: 297518 - DNA, 25 bp, Mus musculus
acgctctgttccttcgccttacaag

SEQ ID NO: 297519 - DNA, 25 bp, Mus musculus
tgtccagattcagcacgctctgttc

SEQ ID NO: 297520 - DNA, 25 bp, Mus musculus
cgcgatgcttctcggcccgggacac

SEQ ID NO: 297521 - DNA, 25 bp, Mus musculus
ccctcgactttggacttgaattgcg

SEQ ID NO: 297522 - DNA, 25 bp, Mus musculus
cctgctccctcgactttggacttga

SEQ ID NO: 297523 - DNA, 25 bp, Mus musculus
gaggagccctgctccctcgactttg

SEQ ID NO: 297524 - DNA, 25 bp, Mus musculus
taagtactggacagcccttgcgccc

SEQ ID NO: 297525 - DNA, 25 bp, Mus musculus
ccggagttaagtactggacagccct

SEQ ID NO: 297526 - DNA, 25 bp, Mus musculus
atctaagcgcgggtctggcgcctgc

SEQ ID NO: 297527 - DNA, 25 bp, Mus musculus
cgcccgaaatctaagcgcgggtctg

SEQ ID NO: 297528 - DNA, 25 bp, Mus musculus
cggatgcctcagaaaggccgagctc

SEQ ID NO: 297529 - DNA, 25 bp, Mus musculus
cgagctctctgtagggccggcctcg

SEQ ID NO: 297530 - DNA, 25 bp, Mus musculus
gaaggttcgccagcctgctcgcggc

SEQ ID NO: 297531 - DNA, 25 bp, Mus musculus
tcgcggccagccagaagaaccctgg

SEQ ID NO: 297532 - DNA, 25 bp, Mus musculus
cagccagaagaaccctggcgggcct

SEQ ID NO: 297533 - DNA, 25 bp, Mus musculus
cactcacctgacagcgtgtgtggtc

SEQ ID NO: 297534 - DNA, 25 bp, Mus musculus
tggtctggcctcacgacacacaggc

SEQ ID NO: 297535 - DNA, 25 bp, Mus musculus
cccagcagccgtttgggtacctgcg

SEQ ID NO: 297536 - DNA, 25 bp, Mus musculus
gtacctgcgggacagccatgacccg

SEQ ID NO: 297537 - DNA, 25 bp, Mus musculus
ggctctcgtcacttccgtcattcaa

SEQ ID NO: 297538 - DNA, 25 bp, Mus musculus
tcgtcacttccgtcattcaaacggc

SEQ ID NO: 297539 - DNA, 25 bp, Mus musculus
caaacggcccgccaatggcgggatc

SEQ ID NO: 297540 - DNA, 25 bp, Mus musculus
gcgggaaccagcttaggaccgcctc

SEQ ID NO: 297541 - DNA, 25 bp, Mus musculus
agaaaggccgagctctctgtagggc

SEQ ID NO: 297542 - DNA, 25 bp, Mus musculus
ctccgaaagtttgcggagcgcagtg

SEQ ID NO: 297543 - DNA, 25 bp, Mus musculus
agcagagctgcggactcccttttcc

SEQ ID NO: 297544 - DNA, 25 bp, Mus musculus
atccaggaaatggacccgggagtcg

SEQ ID NO: 297545 - DNA, 25 bp, Mus musculus
gttcagtcccggtggccgggatcca

SEQ ID NO: 297546 - DNA, 25 bp, Mus musculus
tggccggtcagggaccgcacagctc

SEQ ID NO: 297547 - DNA, 25 bp, Mus musculus
acttccgtgcgtcctggccggtcag

SEQ ID NO: 297548 - DNA, 25 bp, Mus musculus
tgcgagctttcagcagcccagttgc

SEQ ID NO: 297549 - DNA, 25 bp, Mus musculus
gggagctataaaggctaggagaacc

SEQ ID NO: 297550 - DNA, 25 bp, Mus musculus
ccgcttctcgctcggattggatcgc

SEQ ID NO: 297551 - DNA, 25 bp, Mus musculus
gcttcgcctcctggacttggtcatc

SEQ ID NO: 297552 - DNA, 25 bp, Mus musculus
tggtcatccatctgccttttccgtg

SEQ ID NO: 297553 - DNA, 25 bp, Mus musculus
ccttttccgtgacgcaagtgcagga

SEQ ID NO: 297554 - DNA, 25 bp, Mus musculus
aaggctaggagaaccgcctcggctg

SEQ ID NO: 297555 - DNA, 25 bp, Mus musculus
cgcaagtgcaggaaaactccgaaag

SEQ ID NO: 297556 - DNA, 25 bp, Mus musculus
gaaattacgctagattttcaacgta

SEQ ID NO: 297557 - DNA, 25 bp, Mus musculus
cgtcgaggcggaaattacgctagat

SEQ ID NO: 297558 - DNA, 25 bp, Mus musculus
cgctagattttcaacgtattccctt

SEQ ID NO: 297559 - DNA, 25 bp, Mus musculus
agcagggtcatgtccgcgtgggccc

SEQ ID NO: 297560 - DNA, 25 bp, Mus musculus
tacgtcgaggcggaaattacgctag

SEQ ID NO: 297561 - DNA, 25 bp, Mus musculus
cgaggcggaaattacgctagatttt

SEQ ID NO: 297562 - DNA, 25 bp, Mus musculus
aggcggaaattacgctagattttca

SEQ ID NO: 297563 - DNA, 25 bp, Mus musculus
gcggaaattacgctagattttcaac

SEQ ID NO: 297564 - DNA, 25 bp, Mus musculus
ttacgctagattttcaacgtattcc

SEQ ID NO: 297565 - DNA, 25 bp, Mus musculus
caacgtattccctttctcccgcatt

SEQ ID NO: 297566 - DNA, 25 bp, Mus musculus
ctttctcccgcattctccatcatgg

SEQ ID NO: 297567 - DNA, 25 bp, Mus musculus
tccacgaactgcgtgtgctgcggcg

SEQ ID NO: 297568 - DNA, 25 bp, Mus musculus
tgtgctgcggcggtaccggctgcag

SEQ ID NO: 297569 - DNA, 25 bp, Mus musculus
tctttctacgtcgaggcggaaatta

SEQ ID NO: 297570 - DNA, 25 bp, Mus musculus
agacgtggtcactgatcccgccttt

SEQ ID NO: 297571 - DNA, 25 bp, Mus musculus
gaccacaacctccacgaactgcgtg

SEQ ID NO: 297572 - DNA, 25 bp, Mus musculus
gtggtcactgatcccgcctttctcg

SEQ ID NO: 297573 - DNA, 25 bp, Mus musculus
cgcggctcactggaactctgcgact

SEQ ID NO: 297574 - DNA, 25 bp, Mus musculus
ggcgctgttggacaagctgtacgct

SEQ ID NO: 297575 - DNA, 25 bp, Mus musculus
ggagtacacgcgctacaaccagctg

SEQ ID NO: 297576 - DNA, 25 bp, Mus musculus
cggcgcgaggagtacacgcgctaca

SEQ ID NO: 297577 - DNA, 25 bp, Mus musculus
actgggaagtcaccgaccacaacct

SEQ ID NO: 297578 - DNA, 25 bp, Mus musculus
tcctaaactgggaagtcaccgacca

SEQ ID NO: 297579 - DNA, 25 bp, Mus musculus
tgaaacaggtggacttcctaaactg

SEQ ID NO: 297580 - DNA, 25 bp, Mus musculus
aagctgctgaaacaggtggacttcc

SEQ ID NO: 297581 - DNA, 25 bp, Mus musculus
taagttccacgagcagaagctgctg

SEQ ID NO: 297582 - DNA, 25 bp, Mus musculus
ttctccatcatggtgcggaagctta

SEQ ID NO: 297583 - DNA, 25 bp, Mus musculus
tcatggtgcggaagcttaagttcca

SEQ ID NO: 297584 - DNA, 25 bp, Mus musculus
tctcgctagaatcccgaaaaagcct

SEQ ID NO: 297585 - DNA, 25 bp, Mus musculus
tcagtgaaaggatccggggcaagtt

SEQ ID NO: 297586 - DNA, 25 bp, Mus musculus
ccggggcaagtttgcgatcagtact

SEQ ID NO: 297587 - DNA, 25 bp, Mus musculus
cgatcagtactgaaggctccgtatc

SEQ ID NO: 297588 - DNA, 25 bp, Mus musculus
tgaaggctccgtatcgcggacaatc

SEQ ID NO: 297589 - DNA, 25 bp, Mus musculus
tcgcggacaatctcgctagaatccc

SEQ ID NO: 297590 - DNA, 25 bp, Mus musculus
cctccctagggagaagagtcgctca

SEQ ID NO: 297591 - DNA, 25 bp, Mus musculus
cggaagtaatgtcctgcccgactca

SEQ ID NO: 297592 - DNA, 25 bp, Mus musculus
gccggaagttcgagtgcaagcttga

SEQ ID NO: 297593 - DNA, 25 bp, Mus musculus
agcggggcgtgtctagctccgctaa

SEQ ID NO: 297594 - DNA, 25 bp, Mus musculus
gctccgctaaggcacctaattggtc

SEQ ID NO: 297595 - DNA, 25 bp, Mus musculus
ctaattggtcagtcggcacaggcac

SEQ ID NO: 297596 - DNA, 25 bp, Mus musculus
cggccacgaagtcacggttttgtca

SEQ ID NO: 297597 - DNA, 25 bp, Mus musculus
cagttcagggcggaagtaatgtcct

SEQ ID NO: 297598 - DNA, 25 bp, Mus musculus
cacggagcagttcgcagggcccgca

SEQ ID NO: 297599 - DNA, 25 bp, Mus musculus
cagcggctcctgctcgcatttcagg

SEQ ID NO: 297600 - DNA, 25 bp, Mus musculus
gcaccatgcgcgagccgaccgagag

SEQ ID NO: 297601 - DNA, 25 bp, Mus musculus
aggcatttcctctccgcggggagcg

SEQ ID NO: 297602 - DNA, 25 bp, Mus musculus
tgaagcaaacaggaggcatttcctc

SEQ ID NO: 297603 - DNA, 25 bp, Mus musculus
tgctgttagttcctcgcccgcactt

SEQ ID NO: 297604 - DNA, 25 bp, Mus musculus
cgccttcgcggtggctgtaaaagtt

SEQ ID NO: 297605 - DNA, 25 bp, Mus musculus
tctccgcggcggcttttgaggaact

SEQ ID NO: 297606 - DNA, 25 bp, Mus musculus
tgctcagtttctcaatggagccgtg

SEQ ID NO: 297607 - DNA, 25 bp, Mus musculus
cccggctcctgtttgtgaatgagat

SEQ ID NO: 297608 - DNA, 25 bp, Mus musculus
ctcccgtaggggagtcgcctctcgt

SEQ ID NO: 297609 - DNA, 25 bp, Mus musculus
attcttttaactcccagtcgcgtct

SEQ ID NO: 297610 - DNA, 25 bp, Mus musculus
gctgtaaaagttgtggactcctaaa

SEQ ID NO: 297611 - DNA, 25 bp, Mus musculus
ccaagcagacctcgaactgctgtta

SEQ ID NO: 297612 - DNA, 25 bp, Mus musculus
caagcagtcggtttcgataggttta

SEQ ID NO: 297613 - DNA, 25 bp, Mus musculus
ttctgccggcaaacttggaagggtc

SEQ ID NO: 297614 - DNA, 25 bp, Mus musculus
tgggccagcagaagaccaactgctc

SEQ ID NO: 297615 - DNA, 25 bp, Mus musculus
cgaccgctggagtttaagagcaagc

SEQ ID NO: 297616 - DNA, 25 bp, Mus musculus
gtctttctccgctaaccacgctggg

SEQ ID NO: 297617 - DNA, 25 bp, Mus musculus
cctgagcgtttgcttctgccggcaa

SEQ ID NO: 297618 - DNA, 25 bp, Mus musculus
ttccagccactagcctgggagctgc

SEQ ID NO: 297619 - DNA, 25 bp, Mus musculus
cggtgtgtccgaacacggcatttta

SEQ ID NO: 297620 - DNA, 25 bp, Mus musculus
cggcattttagcaagtactcggctg

SEQ ID NO: 297621 - DNA, 25 bp, Mus musculus
tcggctgcagaaccggctagactgc

SEQ ID NO: 297622 - DNA, 25 bp, Mus musculus
aagctctaggaactcggcggattca

SEQ ID NO: 297623 - DNA, 25 bp, Mus musculus
ctccacgcttggaatagggaaaagg

SEQ ID NO: 297624 - DNA, 25 bp, Mus musculus
aagctcattggggaatgggccagca

SEQ ID NO: 297625 - DNA, 25 bp, Mus musculus
gccgcccaatttattttaccaagca

SEQ ID NO: 297626 - DNA, 25 bp, Mus musculus
ccactggctgaactgctttgggtcc

SEQ ID NO: 297627 - DNA, 25 bp, Mus musculus
cggcagagacggtttctccatcttc

SEQ ID NO: 297628 - DNA, 25 bp, Mus musculus
gctcgcgctaaaggcccgcggctgt

SEQ ID NO: 297629 - DNA, 25 bp, Mus musculus
gcgggtcctagtcccgccgatcaga

SEQ ID NO: 297630 - DNA, 25 bp, Mus musculus
tgacctcggcttcccgtgcgtggct

SEQ ID NO: 297631 - DNA, 25 bp, Mus musculus
ttttgcggtgagagcacgccgcacc

SEQ ID NO: 297632 - DNA, 25 bp, Mus musculus
cttctcccttatgggcgggaccact

SEQ ID NO: 297633 - DNA, 25 bp, Mus musculus
acccaggcctgtgaccgcttcgtgg

SEQ ID NO: 297634 - DNA, 25 bp, Mus musculus
gcggagcgaggttaagccttccctc

SEQ ID NO: 297635 - DNA, 25 bp, Mus musculus
gtaatatatcccgtggcggagcgag

SEQ ID NO: 297636 - DNA, 25 bp, Mus musculus
ccattgacggatgggtaatatatcc

SEQ ID NO: 297637 - DNA, 25 bp, Mus musculus
tgattggctaaaccattgacggatg

SEQ ID NO: 297638 - DNA, 25 bp, Mus musculus
gtctttgcggcatagtgattggcta

SEQ ID NO: 297639 - DNA, 25 bp, Mus musculus
gttgccagtccgctcttgcgggcct

SEQ ID NO: 297640 - DNA, 25 bp, Mus musculus
caggtgtggtccttggcctaccaca

SEQ ID NO: 297641 - DNA, 25 bp, Mus musculus
tcggtgacactctccagcttcctga

SEQ ID NO: 297642 - DNA, 25 bp, Mus musculus
cgcaccactttcgagcgggtggaga

SEQ ID NO: 297643 - DNA, 25 bp, Mus musculus
tgccaggcagtcctcacggccttag

SEQ ID NO: 297644 - DNA, 25 bp, Mus musculus
ccgttcttgaagcactggcgcacca

SEQ ID NO: 297645 - DNA, 25 bp, Mus musculus
acgagccggcagcaccaaggatctt

SEQ ID NO: 297646 - DNA, 25 bp, Mus musculus
gtaacgcccagtttggcgaagctcc

SEQ ID NO: 297647 - DNA, 25 bp, Mus musculus
gacagcttcggacccacgtgggtaa

SEQ ID NO: 297648 - DNA, 25 bp, Mus musculus
ttcagccctgcgcaggtcggcgaca

SEQ ID NO: 297649 - DNA, 25 bp, Mus musculus
gcggtgcagcagaacttcagccctg

SEQ ID NO: 297650 - DNA, 25 bp, Mus musculus
ggccttagccaagggagagcgtttc

SEQ ID NO: 297651 - DNA, 25 bp, Mus musculus
ttccctatgagaaggcggtgcagca

SEQ ID NO: 297652 - DNA, 25 bp, Mus musculus
tgacgcccgagaggcttccctatga

SEQ ID NO: 297653 - DNA, 25 bp, Mus musculus
ccgactgtaaccttcgcggcaggtg

SEQ ID NO: 297654 - DNA, 25 bp, Mus musculus
ggccacgcatgcaaagctgttccta

SEQ ID NO: 297655 - DNA, 25 bp, Mus musculus
gtcaagcagtggctaggaaaccgca

SEQ ID NO: 297656 - DNA, 25 bp, Mus musculus
caggctgacacacagactgccgtgg

SEQ ID NO: 297657 - DNA, 25 bp, Mus musculus
cagctagcccagagagacgttccgc

SEQ ID NO: 297658 - DNA, 25 bp, Mus musculus
ttcagagcaccaggcttctagcggc

SEQ ID NO: 297659 - DNA, 25 bp, Mus musculus
taggcgagctcctaccttcagagca

SEQ ID NO: 297660 - DNA, 25 bp, Mus musculus
caagtcctggcaaagtctgggcagc

SEQ ID NO: 297661 - DNA, 25 bp, Mus musculus
accaggcccagggagcatccaagtc

SEQ ID NO: 297662 - DNA, 25 bp, Mus musculus
aaccgcaggcggtcctgttccaaca

SEQ ID NO: 297663 - DNA, 25 bp, Mus musculus
tacacgtacatgcatggcccgaatc

SEQ ID NO: 297664 - DNA, 25 bp, Mus musculus
ggcctcaaagtctgggcagccacct

SEQ ID NO: 297665 - DNA, 25 bp, Mus musculus
cagactgcactgaggtccagaaggc

SEQ ID NO: 297666 - DNA, 25 bp, Mus musculus
ggtgcccttccttagctcacgtaaa

SEQ ID NO: 297667 - DNA, 25 bp, Mus musculus
tgttccaacagggttcgtccacggc

SEQ ID NO: 297668 - DNA, 25 bp, Mus musculus
ggcgctgatgcctggccaaatttct

SEQ ID NO: 297669 - DNA, 25 bp, Mus musculus
acaggcgccttgcacttcccggtgg

SEQ ID NO: 297670 - DNA, 25 bp, Mus musculus
gaggtgactcactctgcggccacag

SEQ ID NO: 297671 - DNA, 25 bp, Mus musculus
ggacgcaggaggtgactcactctgc

SEQ ID NO: 297672 - DNA, 25 bp, Mus musculus
gtgcggttccgggacagaattttca

SEQ ID NO: 297673 - DNA, 25 bp, Mus musculus
agaccgaaaggcctccaacgccagg

SEQ ID NO: 297674 - DNA, 25 bp, Mus musculus
ttccgcaagaccgaaaggcctccaa

SEQ ID NO: 297675 - DNA, 25 bp, Mus musculus
tgcctggaatccattttccgcaaga

SEQ ID NO: 297676 - DNA, 25 bp, Mus musculus
agagcctttcggtgcctggaatcca

SEQ ID NO: 297677 - DNA, 25 bp, Mus musculus
cccaagtggcggcttgagagccttt

SEQ ID NO: 297678 - DNA, 25 bp, Mus musculus
gacgttcacccaagtggcggcttga

SEQ ID NO: 297679 - DNA, 25 bp, Mus musculus
aatttctgcgctggcgatcggagtt

SEQ ID NO: 297680 - DNA, 25 bp, Mus musculus
tggccaaatttctgcgctggcgatc

SEQ ID NO: 297681 - DNA, 25 bp, Mus musculus
ttgcacttcccggtgggcaccggcg

SEQ ID NO: 297682 - DNA, 25 bp, Mus musculus
gtgctaaatattcggccgttcctcg

SEQ ID NO: 297683 - DNA, 25 bp, Mus musculus
gactcccacactgctcgtaaggcta

SEQ ID NO: 297684 - DNA, 25 bp, Mus musculus
acactgctcgtaaggctattccacg

SEQ ID NO: 297685 - DNA, 25 bp, Mus musculus
tcgtaaggctattccacgagcgctc

SEQ ID NO: 297686 - DNA, 25 bp, Mus musculus
aaggctattccacgagcgctcgcga

SEQ ID NO: 297687 - DNA, 25 bp, Mus musculus
gctattccacgagcgctcgcgagaa

SEQ ID NO: 297688 - DNA, 25 bp, Mus musculus
cgctcgcgagaagcaaggcaccggc

SEQ ID NO: 297689 - DNA, 25 bp, Mus musculus
cgcgagaagcaaggcaccggcgcct

SEQ ID NO: 297690 - DNA, 25 bp, Mus musculus
gtggtgctaaatattcggccgttcc

SEQ ID NO: 297691 - DNA, 25 bp, Mus musculus
gcgagactcccacactgctcgtaag

SEQ ID NO: 297692 - DNA, 25 bp, Mus musculus
tgcaaccactctcgcgagactccca

SEQ ID NO: 297693 - DNA, 25 bp, Mus musculus
tgccgccctgcctgctgcaaccact

SEQ ID NO: 297694 - DNA, 25 bp, Mus musculus
tcccacactgctcgtaaggctattc

SEQ ID NO: 297695 - DNA, 25 bp, Mus musculus
tccgcaccttgcaggagctgtccgt

SEQ ID NO: 297696 - DNA, 25 bp, Mus musculus
gggcagcaagatccgcaacctactg

SEQ ID NO: 297697 - DNA, 25 bp, Mus musculus
cgagggcgcagagtagaacatcact

SEQ ID NO: 297698 - DNA, 25 bp, Mus musculus
ctcccaggcggagcttctgctaaag

SEQ ID NO: 297699 - DNA, 25 bp, Mus musculus
gtcacgtgcgccgagattctcaagc

SEQ ID NO: 297700 - DNA, 25 bp, Mus musculus
gacgcactggatccacgacaacttg

SEQ ID NO: 297701 - DNA, 25 bp, Mus musculus
gagcctcgccatcctactttcaaag

SEQ ID NO: 297702 - DNA, 25 bp, Mus musculus
acttaagaatgtaccgagcctcgcc

SEQ ID NO: 297703 - DNA, 25 bp, Mus musculus
cggccgccagtctcagtgtacttaa

SEQ ID NO: 297704 - DNA, 25 bp, Mus musculus
cgcgcgccatcgtcttcagtggctg

SEQ ID NO: 297705 - DNA, 25 bp, Mus musculus
ccggtgctgtacacatgcgggtcaa

SEQ ID NO: 297706 - DNA, 25 bp, Mus musculus
cttttgcagatctggcacccggtgc

SEQ ID NO: 297707 - DNA, 25 bp, Mus musculus
ggcagcccgaactctggcccttttg

SEQ ID NO: 297708 - DNA, 25 bp, Mus musculus
cgacggcgcatggagaacttccgta

SEQ ID NO: 297709 - DNA, 25 bp, Mus musculus
gtctgggctgaagactgcacgttcc

SEQ ID NO: 297710 - DNA, 25 bp, Mus musculus
gaccgcacgcgtgcgtctcctcctc

SEQ ID NO: 297711 - DNA, 25 bp, Mus musculus
tctcattcccggctcagtgcgaaac

SEQ ID NO: 297712 - DNA, 25 bp, Mus musculus
tcattcccggctcagtgcgaaactc

SEQ ID NO: 297713 - DNA, 25 bp, Mus musculus
tgtttgaagagagtgggatgggacc

SEQ ID NO: 297714 - DNA, 25 bp, Mus musculus
acggtatgtgcagggtgtttgaaga

SEQ ID NO: 297715 - DNA, 25 bp, Mus musculus
tcacactgcggtgcgtttgtcctgg

SEQ ID NO: 297716 - DNA, 25 bp, Mus musculus
tccacctcacactgcggtgcgtttg

SEQ ID NO: 297717 - DNA, 25 bp, Mus musculus
ctcccggtgcctcctccacctcaca

SEQ ID NO: 297718 - DNA, 25 bp, Mus musculus
acggctctgcgctcaccgctgcgcc

SEQ ID NO: 297719 - DNA, 25 bp, Mus musculus
ccctgccacgtacccggccgtgcgc

SEQ ID NO: 297720 - DNA, 25 bp, Mus musculus
tgggaccgcatgaagcacgcacacc

SEQ ID NO: 297721 - DNA, 25 bp, Mus musculus
caggattcggcttcccggcggcaga

SEQ ID NO: 297722 - DNA, 25 bp, Mus musculus
gttagggagcaggattcggcttccc

SEQ ID NO: 297723 - DNA, 25 bp, Mus musculus
gccccctagcgtttaagagattctc

SEQ ID NO: 297724 - DNA, 25 bp, Mus musculus
agcctttgccctgcgagccggcatt

SEQ ID NO: 297725 - DNA, 25 bp, Mus musculus
tcacccgggtcatcggaccagcttt

SEQ ID NO: 297726 - DNA, 25 bp, Mus musculus
gcgccgacgtggtttgtcctccacg

SEQ ID NO: 297727 - DNA, 25 bp, Mus musculus
gagctccgcagtgggccggccttat

SEQ ID NO: 297728 - DNA, 25 bp, Mus musculus
gtgtaggagactcctccgggcctcc

SEQ ID NO: 297729 - DNA, 25 bp, Mus musculus
cccagcgtgcgtcgctgcgtgagtc

SEQ ID NO: 297730 - DNA, 25 bp, Mus musculus
gccgaggacgagctcagcacttcct

SEQ ID NO: 297731 - DNA, 25 bp, Mus musculus
tgtccttgctgtgacctgggctccc

SEQ ID NO: 297732 - DNA, 25 bp, Mus musculus
cttcctttcagtctctgggccgtga

SEQ ID NO: 297733 - DNA, 25 bp, Mus musculus
aggaatgttcactacggtcacccgg

SEQ ID NO: 297734 - DNA, 25 bp, Mus musculus
cattggagcccggtgaccgcagtgc

SEQ ID NO: 297735 - DNA, 25 bp, Mus musculus
ccgtctggagtcgtgtaggagactc

SEQ ID NO: 297736 - DNA, 25 bp, Mus musculus
cttggcgaaggtgacattgagcctc

SEQ ID NO: 297737 - DNA, 25 bp, Mus musculus
cagcctcagccagtgcgctgtggtc

SEQ ID NO: 297738 - DNA, 25 bp, Mus musculus
tagggcggaaccttgatgctctctc

SEQ ID NO: 297739 - DNA, 25 bp, Mus musculus
ggaaccttgatgctctctccgcagc

SEQ ID NO: 297740 - DNA, 25 bp, Mus musculus
cgccgccatctttctaaaggcgtgt

SEQ ID NO: 297741 - DNA, 25 bp, Mus musculus
catctttctaaaggcgtgttacgtc

SEQ ID NO: 297742 - DNA, 25 bp, Mus musculus
aaaggcgtgttacgtcttgtcattc

SEQ ID NO: 297743 - DNA, 25 bp, Mus musculus
ttacgtcttgtcattcgttcttccc

SEQ ID NO: 297744 - DNA, 25 bp, Mus musculus
ccggtcatggcgaccgaggagttcc

SEQ ID NO: 297745 - DNA, 25 bp, Mus musculus
gcatgcggtgcggatgtccacccag

SEQ ID NO: 297746 - DNA, 25 bp, Mus musculus
gatgtccacccaggggtctcagcct

SEQ ID NO: 297747 - DNA, 25 bp, Mus musculus
cggctcccgacagcgtggcaggaac

SEQ ID NO: 297748 - DNA, 25 bp, Mus musculus
tcccgacagcgtggcaggaactgcg

SEQ ID NO: 297749 - DNA, 25 bp, Mus musculus
ttgatgctctctccgcagcaggcgg

SEQ ID NO: 297750 - DNA, 25 bp, Mus musculus
agcggggaccctacttggtgacacg

SEQ ID NO: 297751 - DNA, 25 bp, Mus musculus
aagcgccaagggaaacccgcgcctg

SEQ ID NO: 297752 - DNA, 25 bp, Mus musculus
gactcgccatcccagttgcctgaaa

SEQ ID NO: 297753 - DNA, 25 bp, Mus musculus
ccagttgcctgaaacccggcttcag

SEQ ID NO: 297754 - DNA, 25 bp, Mus musculus
cggtcagtcccgaagtgattcgagt

SEQ ID NO: 297755 - DNA, 25 bp, Mus musculus
cgaagtgattcgagtgatacgaccc

SEQ ID NO: 297756 - DNA, 25 bp, Mus musculus
ccagatcctatccttgtgctcagcg

SEQ ID NO: 297757 - DNA, 25 bp, Mus musculus
ttgtgctcagcgaccacagaaatgg

SEQ ID NO: 297758 - DNA, 25 bp, Mus musculus
ccacagaaatggtcacgatccgcta

SEQ ID NO: 297759 - DNA, 25 bp, Mus musculus
cgatccgctaggtcttgccagtata

SEQ ID NO: 297760 - DNA, 25 bp, Mus musculus
gctaggtcttgccagtataggtccc

SEQ ID NO: 297761 - DNA, 25 bp, Mus musculus
aggacgcgaccaccaccaagatagc

SEQ ID NO: 297762 - DNA, 25 bp, Mus musculus
gaccaccaccaagatagctaacatg

SEQ ID NO: 297763 - DNA, 25 bp, Mus musculus
agctaacatgggtaaacggctcacc

SEQ ID NO: 297764 - DNA, 25 bp, Mus musculus
ggtaaacggctcacctcgcggactc

SEQ ID NO: 297765 - DNA, 25 bp, Mus musculus
cagcagcctccgctttttctgcgcg

SEQ ID NO: 297766 - DNA, 25 bp, Mus musculus
tcgatcaccatgtcggccttcgaca

SEQ ID NO: 297767 - DNA, 25 bp, Mus musculus
agggcgctacgcctgcgccagaacg

SEQ ID NO: 297768 - DNA, 25 bp, Mus musculus
tgctcccggaagtggagggtttaca

SEQ ID NO: 297769 - DNA, 25 bp, Mus musculus
aagtggagggtttacactgtgtgcc

SEQ ID NO: 297770 - DNA, 25 bp, Mus musculus
gtttacactgtgtgccgctgggtct

SEQ ID NO: 297771 - DNA, 25 bp, Mus musculus
gtgccgctgggtctgagtgaccaaa

SEQ ID NO: 297772 - DNA, 25 bp, Mus musculus
agtgaccaaaggcagtagcgctcgc

SEQ ID NO: 297773 - DNA, 25 bp, Mus musculus
ggcctctttcgccagagccggggac

SEQ ID NO: 297774 - DNA, 25 bp, Mus musculus
gagatcacccgctggccctcgatca

SEQ ID NO: 297775 - DNA, 25 bp, Mus musculus
ccaattctcagatttctttagggaa

SEQ ID NO: 297776 - DNA, 25 bp, Mus musculus
gacctttgtgacgtccagggccacg

SEQ ID NO: 297777 - DNA, 25 bp, Mus musculus
tagcgctcgcggagatcacccgctg

SEQ ID NO: 297778 - DNA, 25 bp, Mus musculus
gaacggctgccttgctcccggaagt

SEQ ID NO: 297779 - DNA, 25 bp, Mus musculus
cggaacggacctttgtgacgtccag

SEQ ID NO: 297780 - DNA, 25 bp, Mus musculus
gactcccgtgccagccaactccctg

SEQ ID NO: 297781 - DNA, 25 bp, Mus musculus
cagcttctctgctggccggaacctg

SEQ ID NO: 297782 - DNA, 25 bp, Mus musculus
ccaagctgagcaggaaaggcgaccg

SEQ ID NO: 297783 - DNA, 25 bp, Mus musculus
caactccctgcaagcccggctgggt

SEQ ID NO: 297784 - DNA, 25 bp, Mus musculus
ccacggtgtacaaggcctacgccaa

SEQ ID NO: 297785 - DNA, 25 bp, Mus musculus
cgtacgccacggtgtacaaggccta

SEQ ID NO: 297786 - DNA, 25 bp, Mus musculus
gcagtggcacgtacgccacggtgta

SEQ ID NO: 297787 - DNA, 25 bp, Mus musculus
cgcctgggcagtggcacgtacgcca

SEQ ID NO: 297788 - DNA, 25 bp, Mus musculus
tcatccttaccgagcgcctgggcag

SEQ ID NO: 297789 - DNA, 25 bp, Mus musculus
gtttcatccttaccgagcgcctggg

SEQ ID NO: 297790 - DNA, 25 bp, Mus musculus
ctcggctggacggtttcatccttac

SEQ ID NO: 297791 - DNA, 25 bp, Mus musculus
ccagctggggtctccctcggctgga

SEQ ID NO: 297792 - DNA, 25 bp, Mus musculus
ccgaaccaggaagcacctggcggcg

SEQ ID NO: 297793 - DNA, 25 bp, Mus musculus
gtcacgggccaagctgagcaggaaa

SEQ ID NO: 297794 - DNA, 25 bp, Mus musculus
ggcggccaacctcagctcgcccggg

SEQ ID NO: 297795 - DNA, 25 bp, Mus musculus
ccacttgctggccttcgcgaaggct

SEQ ID NO: 297796 - DNA, 25 bp, Mus musculus
acttgctggccttcgcgaaggctcc

SEQ ID NO: 297797 - DNA, 25 bp, Mus musculus
gggtgtgtccgcgtctacgccctgc

SEQ ID NO: 297798 - DNA, 25 bp, Mus musculus
tctgctggaccttggaggaaatgcg

SEQ ID NO: 297799 - DNA, 25 bp, Mus musculus
aagctcgcaggcctggtgagaggaa

SEQ ID NO: 297800 - DNA, 25 bp, Mus musculus
ggctccgatgggaggaagctcgcag

SEQ ID NO: 297801 - DNA, 25 bp, Mus musculus
tcgccgctcgcagggcttgcctaag

SEQ ID NO: 297802 - DNA, 25 bp, Mus musculus
ttcgatcgccgctcgcagggcttgc

SEQ ID NO: 297803 - DNA, 25 bp, Mus musculus
cgcttccgaacgcggccacggaggt

SEQ ID NO: 297804 - DNA, 25 bp, Mus musculus
agagttccgcttccgaacgcggcca

SEQ ID NO: 297805 - DNA, 25 bp, Mus musculus
cgcggaagcgcaaggaaggcagcag

SEQ ID NO: 297806 - DNA, 25 bp, Mus musculus
ggcagagttccgcttccgaacgcgg

SEQ ID NO: 297807 - DNA, 25 bp, Mus musculus
aggaaacaatgtagccggcgcggcc

SEQ ID NO: 297808 - DNA, 25 bp, Mus musculus
gctccgccctgtgtcaacggaagtg

SEQ ID NO: 297809 - DNA, 25 bp, Mus musculus
tttatattggcggacaggagctgcg

SEQ ID NO: 297810 - DNA, 25 bp, Mus musculus
tagatctttatattggcggacagga

SEQ ID NO: 297811 - DNA, 25 bp, Mus musculus
cccggccttgtagatctttatattg

SEQ ID NO: 297812 - DNA, 25 bp, Mus musculus
aggcttcccggccttgtagatcttt

SEQ ID NO: 297813 - DNA, 25 bp, Mus musculus
ttgcttgttaggctgcaggcttccc

SEQ ID NO: 297814 - DNA, 25 bp, Mus musculus
agctcggtttgcttgttaggctgca

SEQ ID NO: 297815 - DNA, 25 bp, Mus musculus
cgcttccgggtggtcagctcggttt

SEQ ID NO: 297816 - DNA, 25 bp, Mus musculus
tcgtcttggtgtgctgtgcagcgca

SEQ ID NO: 297817 - DNA, 25 bp, Mus musculus
tgtgtatatgcgtgcgcgctcaaga

SEQ ID NO: 297818 - DNA, 25 bp, Mus musculus
gccctgtgtcaacggaagtgacatc

SEQ ID NO: 297819 - DNA, 25 bp, Mus musculus
cgtgcgcgctcaagaaccttgtgtg

SEQ ID NO: 297820 - DNA, 25 bp, Mus musculus
ctcaagaaccttgtgtgtgcgcgcg

SEQ ID NO: 297821 - DNA, 25 bp, Mus musculus
agtgacatcactccgggtaggccga

SEQ ID NO: 297822 - DNA, 25 bp, Mus musculus
gaggaagccaacgagtggaagcaaa

SEQ ID NO: 297823 - DNA, 25 bp, Mus musculus
caccggatatatttggagtctcttt

SEQ ID NO: 297824 - DNA, 25 bp, Mus musculus
aagacgtgggcgtcggaaattgcca

SEQ ID NO: 297825 - DNA, 25 bp, Mus musculus
tgggcgtcggaaattgccaaaagtg

SEQ ID NO: 297826 - DNA, 25 bp, Mus musculus
tgccaaaagtgtggcgctgagctga

SEQ ID NO: 297827 - DNA, 25 bp, Mus musculus
gagctgagcgcctaagggctaaatc

SEQ ID NO: 297828 - DNA, 25 bp, Mus musculus
ggctaaatcgcagcctggcctacta

SEQ ID NO: 297829 - DNA, 25 bp, Mus musculus
agcctggcctactaggtccggttgc

SEQ ID NO: 297830 - DNA, 25 bp, Mus musculus
ctaggtccggttgcggagaacaata

SEQ ID NO: 297831 - DNA, 25 bp, Mus musculus
caataggggagttctctctatgccc

SEQ ID NO: 297832 - DNA, 25 bp, Mus musculus
gggtcagaatttgcagttcggagca

SEQ ID NO: 297833 - DNA, 25 bp, Mus musculus
ttgcagttcggagcaagttgcaggc

SEQ ID NO: 297834 - DNA, 25 bp, Mus musculus
gcaagttgcaggctgcgactgcacg

SEQ ID NO: 297835 - DNA, 25 bp, Mus musculus
gattacacatcgagaccaccggata

SEQ ID NO: 297836 - DNA, 25 bp, Mus musculus
gccgaagagggaaataggtccaagc

SEQ ID NO: 297837 - DNA, 25 bp, Mus musculus
gcgcgcaagaagcaaacgacacatt

SEQ ID NO: 297838 - DNA, 25 bp, Mus musculus
gcgcgactccgcttgcgcgcaagaa

SEQ ID NO: 297839 - DNA, 25 bp, Mus musculus
agaggaccggcattgttctcccggg

SEQ ID NO: 297840 - DNA, 25 bp, Mus musculus
aaggaggaacccaccggactgccag

SEQ ID NO: 297841 - DNA, 25 bp, Mus musculus
gcgaccacggtctgaggacggctct

SEQ ID NO: 297842 - DNA, 25 bp, Mus musculus
cctctccgtgtggtgctgcacgtag

SEQ ID NO: 297843 - DNA, 25 bp, Mus musculus
tcagtcttgctaggaaacccgcgcc

SEQ ID NO: 297844 - DNA, 25 bp, Mus musculus
cgacatcggtggaggtctcttcccg

SEQ ID NO: 297845 - DNA, 25 bp, Mus musculus
acgacacattctgctctcggcttgt

SEQ ID NO: 297846 - DNA, 25 bp, Mus musculus
ttttgaaagtcctggtgccacgccc

SEQ ID NO: 297847 - DNA, 25 bp, Mus musculus
tcgagcgagcagtctccgggaagat

SEQ ID NO: 297848 - DNA, 25 bp, Mus musculus
ttcccttgaacacctcagagcgtct

SEQ ID NO: 297849 - DNA, 25 bp, Mus musculus
cagagcgtcttgctgtcagtcttgc

SEQ ID NO: 297850 - DNA, 25 bp, Mus musculus
aagccgtgggcggaagccatttaag

SEQ ID NO: 297851 - DNA, 25 bp, Mus musculus
tcccgatgctctcactttttctcag

SEQ ID NO: 297852 - DNA, 25 bp, Mus musculus
ctcacctatgtgcagcgttccgggc

SEQ ID NO: 297853 - DNA, 25 bp, Mus musculus
gcccgaggccggaagcagctaaaaa

SEQ ID NO: 297854 - DNA, 25 bp, Mus musculus
tagtgcgagacggaagtgactccta

SEQ ID NO: 297855 - DNA, 25 bp, Mus musculus
gagaccgccctctggttgaagccgt

SEQ ID NO: 297856 - DNA, 25 bp, Mus musculus
agagcacggactcagaggagttccg

SEQ ID NO: 297857 - DNA, 25 bp, Mus musculus
ttcggccaatgggagagcacggact

SEQ ID NO: 297858 - DNA, 25 bp, Mus musculus
cccagcgtagcagctgagcctgcta

SEQ ID NO: 297859 - DNA, 25 bp, Mus musculus
tgctctcactttttctcagcggacc

SEQ ID NO: 297860 - DNA, 25 bp, Mus musculus
acctgcctcggctcccatttcggtc

SEQ ID NO: 297861 - DNA, 25 bp, Mus musculus
gcggcagaaagaaccacgacccgcg

SEQ ID NO: 297862 - DNA, 25 bp, Mus musculus
tgagcctgctactcctccgcagctg

SEQ ID NO: 297863 - DNA, 25 bp, Mus musculus
agtgactcctagagaccgccctctg

SEQ ID NO: 297864 - DNA, 25 bp, Mus musculus
tggggtcaggcgcttgactccgcct

SEQ ID NO: 297865 - DNA, 25 bp, Mus musculus
gcaccctgcggcgaaccgggacaag

SEQ ID NO: 297866 - DNA, 25 bp, Mus musculus
tcctccttgcaagctgcgagctctg

SEQ ID NO: 297867 - DNA, 25 bp, Mus musculus
ccgccacggggtctactatacagaa

SEQ ID NO: 297868 - DNA, 25 bp, Mus musculus
aggctctttggctttccgccacggg

SEQ ID NO: 297869 - DNA, 25 bp, Mus musculus
cctgtctcaccgaggctctttggct

SEQ ID NO: 297870 - DNA, 25 bp, Mus musculus
tccaacggcagctctgagccggagc

SEQ ID NO: 297871 - DNA, 25 bp, Mus musculus
tggcgctccaagtccaacggcagct

SEQ ID NO: 297872 - DNA, 25 bp, Mus musculus
gcccagctaagtggcgctccaagtc

SEQ ID NO: 297873 - DNA, 25 bp, Mus musculus
ttgtgagtgtgcgtactgtcacgcc

SEQ ID NO: 297874 - DNA, 25 bp, Mus musculus
cgtgtgcgcagctctgcgggtctca

SEQ ID NO: 297875 - DNA, 25 bp, Mus musculus
gctgtctcagtctcggctgcttgcc

SEQ ID NO: 297876 - DNA, 25 bp, Mus musculus
tgactccgcctcctggcgctaggtt

SEQ ID NO: 297877 - DNA, 25 bp, Mus musculus
caagctgcgagctctgctggcacgc

SEQ ID NO: 297878 - DNA, 25 bp, Mus musculus
cggcctccgcaccagtccgcttcct

SEQ ID NO: 297879 - DNA, 25 bp, Mus musculus
gaaacgcgggaggacactgcccaac

SEQ ID NO: 297880 - DNA, 25 bp, Mus musculus
cccagcgcagttggcggctggttcc

SEQ ID NO: 297881 - DNA, 25 bp, Mus musculus
gcggctggttcccagtgggttgcca

SEQ ID NO: 297882 - DNA, 25 bp, Mus musculus
ccagagaaccggtgggtcaccaaga

SEQ ID NO: 297883 - DNA, 25 bp, Mus musculus
acactgcccaaccagagaaccggtg

SEQ ID NO: 297884 - DNA, 25 bp, Mus musculus
cggtgggtcaccaagaacgccaccg

SEQ ID NO: 297885 - DNA, 25 bp, Mus musculus
agagaaacgcgggaggacactgccc

SEQ ID NO: 297886 - DNA, 25 bp, Mus musculus
aacccgcttagcctgcggcccgcgg

SEQ ID NO: 297887 - DNA, 25 bp, Mus musculus
gccaggtcagtcctcagcccgccca

SEQ ID NO: 297888 - DNA, 25 bp, Mus musculus
actggcgcggccaggtcagtcctca

SEQ ID NO: 297889 - DNA, 25 bp, Mus musculus
tctagcgggaactccccagcactgg

SEQ ID NO: 297890 - DNA, 25 bp, Mus musculus
gtccgcttccttctagcgggaactc

SEQ ID NO: 297891 - DNA, 25 bp, Mus musculus
tgcccaaccagagaaccggtgggtc

SEQ ID NO: 297892 - DNA, 25 bp, Mus musculus
agcacgctgactcgggcaagacctt

SEQ ID NO: 297893 - DNA, 25 bp, Mus musculus
cccgggatctgaagttgccattgca

SEQ ID NO: 297894 - DNA, 25 bp, Mus musculus
cgctctgctacatccagcgcgatga

SEQ ID NO: 297895 - DNA, 25 bp, Mus musculus
gtgcttctctcccatcggatctgca

SEQ ID NO: 297896 - DNA, 25 bp, Mus musculus
tggccttcggcgacgcaatgtaaca

SEQ ID NO: 297897 - DNA, 25 bp, Mus musculus
taagactacagtgccacccgggatc

SEQ ID NO: 297898 - DNA, 25 bp, Mus musculus
tccttgctgagaaccggtggcacta

SEQ ID NO: 297899 - DNA, 25 bp, Mus musculus
cttcagtctgcgtaggcaggtcctc

SEQ ID NO: 297900 - DNA, 25 bp, Mus musculus
tccttggcactcagaaggggcacca

SEQ ID NO: 297901 - DNA, 25 bp, Mus musculus
tgcccagctcattgtgtgcacgaca

SEQ ID NO: 297902 - DNA, 25 bp, Mus musculus
tcgggacctgcgcatcaggttcttc

SEQ ID NO: 297903 - DNA, 25 bp, Mus musculus
cagggatctgaccttccatctgctc

SEQ ID NO: 297904 - DNA, 25 bp, Mus musculus
gcccaactcaaaaacgtgcggcttg

SEQ ID NO: 297905 - DNA, 25 bp, Mus musculus
cacgctatagaatcgggctccggta

SEQ ID NO: 297906 - DNA, 25 bp, Mus musculus
acacacattttcacaagcacacctt

SEQ ID NO: 297907 - DNA, 25 bp, Mus musculus
gcgtcaacgcgctaagttctcccta

SEQ ID NO: 297908 - DNA, 25 bp, Mus musculus
agttctccctactttcacacacatt

SEQ ID NO: 297909 - DNA, 25 bp, Mus musculus
acatgtaataatcgcgtcaacgcgc

SEQ ID NO: 297910 - DNA, 25 bp, Mus musculus
attttcacaagcacaccttcactca

SEQ ID NO: 297911 - DNA, 25 bp, Mus musculus
aacactcaccgttctcttttgcgcg

SEQ ID NO: 297912 - DNA, 25 bp, Mus musculus
ccgttctcttttgcgcgcacacaaa

SEQ ID NO: 297913 - DNA, 25 bp, Mus musculus
gcgcgcacacaaatatccacgctca

SEQ ID NO: 297914 - DNA, 25 bp, Mus musculus
gctcactcaccctcacgcgcccgtc

SEQ ID NO: 297915 - DNA, 25 bp, Mus musculus
cgcgagcttcgcttctaattgaatg

SEQ ID NO: 297916 - DNA, 25 bp, Mus musculus
gcttctaattgaatgcgagccgttc

SEQ ID NO: 297917 - DNA, 25 bp, Mus musculus
aattgaatgcgagccgttctacgcc

SEQ ID NO: 297918 - DNA, 25 bp, Mus musculus
cgtcaacatgtaataatcgcgtcaa

SEQ ID NO: 297919 - DNA, 25 bp, Mus musculus
gcgctaagttctccctactttcaca

SEQ ID NO: 297920 - DNA, 25 bp, Mus musculus
gttcacactcgaaacaccagaagtc

SEQ ID NO: 297921 - DNA, 25 bp, Mus musculus
cgccgctgcaggctctcgaagaaca

SEQ ID NO: 297922 - DNA, 25 bp, Mus musculus
tgagcatccacgatctgccggaaca

SEQ ID NO: 297923 - DNA, 25 bp, Mus musculus
gtgcacgcagcctgagcatccacga

SEQ ID NO: 297924 - DNA, 25 bp, Mus musculus
caagcctttgcagcgggtgcacgca

SEQ ID NO: 297925 - DNA, 25 bp, Mus musculus
cagaagtcggccaagcctttgcagc

SEQ ID NO: 297926 - DNA, 25 bp, Mus musculus
tcgaaacaccagaagtcggccaagc

SEQ ID NO: 297927 - DNA, 25 bp, Mus musculus
gctgcaaatgagctgttcacactcg

SEQ ID NO: 297928 - DNA, 25 bp, Mus musculus
tgcttcgaagcacttgctgcaaatg

SEQ ID NO: 297929 - DNA, 25 bp, Mus musculus
gcctcatgcttgaggtaccactggt

SEQ ID NO: 297930 - DNA, 25 bp, Mus musculus
gccgggcctcatgcttgaggtacca

SEQ ID NO: 297931 - DNA, 25 bp, Mus musculus
tgaattgtcgcggagatcagccagg

SEQ ID NO: 297932 - DNA, 25 bp, Mus musculus
cgcgtactgtcgaggaagctgctca

SEQ ID NO: 297933 - DNA, 25 bp, Mus musculus
aagctgctcactgaattgtcgcgga

SEQ ID NO: 297934 - DNA, 25 bp, Mus musculus
agggcagtctcccagcagaggatcg

SEQ ID NO: 297935 - DNA, 25 bp, Mus musculus
ttctgggttcgcagaagggctgctt

SEQ ID NO: 297936 - DNA, 25 bp, Mus musculus
ttccagcagtcgagcttcggctttc

SEQ ID NO: 297937 - DNA, 25 bp, Mus musculus
gggattttgatcgtttccagcagtc

SEQ ID NO: 297938 - DNA, 25 bp, Mus musculus
cgggcactgcccttaggggattttg

SEQ ID NO: 297939 - DNA, 25 bp, Mus musculus
aaggtctggctaccgggcactgccc

SEQ ID NO: 297940 - DNA, 25 bp, Mus musculus
cgtgtcccggttagaagtcatgctt

SEQ ID NO: 297941 - DNA, 25 bp, Mus musculus
ttagtgacggagtaaagccggaagc

SEQ ID NO: 297942 - DNA, 25 bp, Mus musculus
agccactgttgttagtgacggagta

SEQ ID NO: 297943 - DNA, 25 bp, Mus musculus
tcctgatcctactcagccactgttg

SEQ ID NO: 297944 - DNA, 25 bp, Mus musculus
ggacccggcctgattcctgatccta

SEQ ID NO: 297945 - DNA, 25 bp, Mus musculus
agcttcggctttctgggttcgcaga

SEQ ID NO: 297946 - DNA, 25 bp, Mus musculus
gtcatgcttggaaggtctggctacc

SEQ ID NO: 297947 - DNA, 25 bp, Mus musculus
gccggtgagtggctacccagcaccg

SEQ ID NO: 297948 - DNA, 25 bp, Mus musculus
atcagggtaggcctgctcgaatccc

SEQ ID NO: 297949 - DNA, 25 bp, Mus musculus
tgcaccaggacgcacaggcaggcac

SEQ ID NO: 297950 - DNA, 25 bp, Mus musculus
tgttctcccactggatcagctgccg

SEQ ID NO: 297951 - DNA, 25 bp, Mus musculus
gagcaagctgtacacctgcccgttg

SEQ ID NO: 297952 - DNA, 25 bp, Mus musculus
ggcacgtactcagagcccgagttga

SEQ ID NO: 297953 - DNA, 25 bp, Mus musculus
gcgcgcctgccagtagaaccctgga

SEQ ID NO: 297954 - DNA, 25 bp, Mus musculus
tctctccagttgtcgggcacctggc

SEQ ID NO: 297955 - DNA, 25 bp, Mus musculus
atactggtttacgaagggcgcctgc

SEQ ID NO: 297956 - DNA, 25 bp, Mus musculus
gtgacgcgggatcgtagttctcata

SEQ ID NO: 297957 - DNA, 25 bp, Mus musculus
tagccctgttcgtaggtccgtgacg

SEQ ID NO: 297958 - DNA, 25 bp, Mus musculus
gcccgcaccacggtagtacacgtag

SEQ ID NO: 297959 - DNA, 25 bp, Mus musculus
tgtgcgagtaacgacggtcaaggcc

SEQ ID NO: 297960 - DNA, 25 bp, Mus musculus
cttcattgtacaggctgtgcgagta

SEQ ID NO: 297961 - DNA, 25 bp, Mus musculus
tcgaatcccggggtgccttcattgt

SEQ ID NO: 297962 - DNA, 25 bp, Mus musculus
gactttggcttagtcgcctggaccg

SEQ ID NO: 297963 - DNA, 25 bp, Mus musculus
cgagacgcgaaggaatccggacttt

SEQ ID NO: 297964 - DNA, 25 bp, Mus musculus
ccaccgttgatggagccgactgccg

SEQ ID NO: 297965 - DNA, 25 bp, Mus musculus
actgagcggtttctgcggccgctcc

SEQ ID NO: 297966 - DNA, 25 bp, Mus musculus
gccggagcacggacattctgggtcc

SEQ ID NO: 297967 - DNA, 25 bp, Mus musculus
gacattctgggtcccggctgagtac

SEQ ID NO: 297968 - DNA, 25 bp, Mus musculus
acctagcagtgccagctcgggaagg

SEQ ID NO: 297969 - DNA, 25 bp, Mus musculus
accggtgtcacctcggctcgggtca

SEQ ID NO: 297970 - DNA, 25 bp, Mus musculus
gagcaaggcaaaggcaggacagacc

SEQ ID NO: 297971 - DNA, 25 bp, Mus musculus
aggggctcagacctgcccatctaga

SEQ ID NO: 297972 - DNA, 25 bp, Mus musculus
tgcccatctagaatggacagagaga

SEQ ID NO: 297973 - DNA, 25 bp, Mus musculus
agagaatcgcgaaccctgtggagcc

SEQ ID NO: 297974 - DNA, 25 bp, Mus musculus
gtgcactcatctccgctgtgctcga

SEQ ID NO: 297975 - DNA, 25 bp, Mus musculus
cagccctccgactttggcttagtcg

SEQ ID NO: 297976 - DNA, 25 bp, Mus musculus
ccagatccagcacgttgggaaggtc

SEQ ID NO: 297977 - DNA, 25 bp, Mus musculus
cccaccagatccagcacgttgggaa

SEQ ID NO: 297978 - DNA, 25 bp, Mus musculus
ttccgctctgcgtcacccagccggt

SEQ ID NO: 297979 - DNA, 25 bp, Mus musculus
ggcttggcgtgtcgccgcttccgct

SEQ ID NO: 297980 - DNA, 25 bp, Mus musculus
aacctcgatgctgtagctgccgggc

SEQ ID NO: 297981 - DNA, 25 bp, Mus musculus
ccgccagcagaacctcgatgctgta

SEQ ID NO: 297982 - DNA, 25 bp, Mus musculus
caccgagtcatccaccgccagcaga

SEQ ID NO: 297983 - DNA, 25 bp, Mus musculus
tggaagcggaccaccgagtcatcca

SEQ ID NO: 297984 - DNA, 25 bp, Mus musculus
atgctccctgccgtggaagcggacc

SEQ ID NO: 297985 - DNA, 25 bp, Mus musculus
tctgcgtatgctccctgccgtggaa

SEQ ID NO: 297986 - DNA, 25 bp, Mus musculus
acgtagttctgcgtatgctccctgc

SEQ ID NO: 297987 - DNA, 25 bp, Mus musculus
cgatattcatgagcgtcagcacgta

SEQ ID NO: 297988 - DNA, 25 bp, Mus musculus
cccagggacactcacgatattcatg

SEQ ID NO: 297989 - DNA, 25 bp, Mus musculus
gagcgtcagcacgtagttctgcgta

SEQ ID NO: 297990 - DNA, 25 bp, Mus musculus
gtcctctgtaaatgctcgctctttg

SEQ ID NO: 297991 - DNA, 25 bp, Mus musculus
cgccttcacggatatcgctctagca

SEQ ID NO: 297992 - DNA, 25 bp, Mus musculus
cgtctgccgaagatccttggactcc

SEQ ID NO: 297993 - DNA, 25 bp, Mus musculus
gtaggaaccgctccagctgtcattg

SEQ ID NO: 297994 - DNA, 25 bp, Mus musculus
gcatatgacgcaacgggaatgtatc

SEQ ID NO: 297995 - DNA, 25 bp, Mus musculus
aggagctcccgacacaggcacagaa

SEQ ID NO: 297996 - DNA, 25 bp, Mus musculus
gctccgtacggtgggttagattcac

SEQ ID NO: 297997 - DNA, 25 bp, Mus musculus
aaagtgctactcttatctggccagc

SEQ ID NO: 297998 - DNA, 25 bp, Mus musculus
gcgtagacgtttcctggctatggtg

SEQ ID NO: 297999 - DNA, 25 bp, Mus musculus
taagtgatgaatatacccgcgcgtc

SEQ ID NO: 298000 - DNA, 25 bp, Mus musculus
cccgggactacaggaccaataagtg

SEQ ID NO: 298001 - DNA, 25 bp, Mus musculus
aaggcccagtttgcacggcggagaa

SEQ ID NO: 298002 - DNA, 25 bp, Mus musculus
cttggactccagcaaccagtggtcg

SEQ ID NO: 298003 - DNA, 25 bp, Mus musculus
acagcgtccggcatcccgagagttt

SEQ ID NO: 298004 - DNA, 25 bp, Mus musculus
tcatcgtggatcagggtgccggtgc

SEQ ID NO: 298005 - DNA, 25 bp, Mus musculus
taagggccgcggagttcccagctcc

SEQ ID NO: 298006 - DNA, 25 bp, Mus musculus
gggccgcggagttcccagctccttg

SEQ ID NO: 298007 - DNA, 25 bp, Mus musculus
ggagttcccagctccttgcacccgg

SEQ ID NO: 298008 - DNA, 25 bp, Mus musculus
gcgccttagcgcgtgcagtccaggc

SEQ ID NO: 298009 - DNA, 25 bp, Mus musculus
cgccttagcgcgtgcagtccaggcg

SEQ ID NO: 298010 - DNA, 25 bp, Mus musculus
gccgcacacaaaggtggacccagca

SEQ ID NO: 298011 - DNA, 25 bp, Mus musculus
cgccacgcaagcactcaccgcgccg

SEQ ID NO: 298012 - DNA, 25 bp, Mus musculus
cgaggcccggccagactggggccgg

SEQ ID NO: 298013 - DNA, 25 bp, Mus musculus
ctggattggccctgcggcgagatcc

SEQ ID NO: 298014 - DNA, 25 bp, Mus musculus
tgccggtgccctgcgggtaagggcc

SEQ ID NO: 298015 - DNA, 25 bp, Mus musculus
agggtgaagcctgagcccgcctgct

SEQ ID NO: 298016 - DNA, 25 bp, Mus musculus
atccgagggtgaagcctgagcccgc

SEQ ID NO: 298017 - DNA, 25 bp, Mus musculus
agatccgagggtgaagcctgagccc

SEQ ID NO: 298018 - DNA, 25 bp, Mus musculus
aagagggcctcttctcgcgagcctt

SEQ ID NO: 298019 - DNA, 25 bp, Mus musculus
ctctgtagacaggtccgcggcgtag

SEQ ID NO: 298020 - DNA, 25 bp, Mus musculus
agcccggggctctgtagacaggtcc

SEQ ID NO: 298021 - DNA, 25 bp, Mus musculus
ggcgctgctcagaacggtaagccga

SEQ ID NO: 298022 - DNA, 25 bp, Mus musculus
cttccagggccaggcgctgctcaga

SEQ ID NO: 298023 - DNA, 25 bp, Mus musculus
tcttgctggtctctggctcgctcct

SEQ ID NO: 298024 - DNA, 25 bp, Mus musculus
ctctcgctcttgctggtctctggct

SEQ ID NO: 298025 - DNA, 25 bp, Mus musculus
gctgcctccctcgttcactccctcg

SEQ ID NO: 298026 - DNA, 25 bp, Mus musculus
tgcttggccaatcagcctctgcagg

SEQ ID NO: 298027 - DNA, 25 bp, Mus musculus
tgaccgcccttgtgcttggccaatc

SEQ ID NO: 298028 - DNA, 25 bp, Mus musculus
agcgcccttcgcacgtgaccgccct

SEQ ID NO: 298029 - DNA, 25 bp, Mus musculus
gtcacgtggccaaaagcgcccttcg

SEQ ID NO: 298030 - DNA, 25 bp, Mus musculus
ggagacaggcgttcgagttcgagct

SEQ ID NO: 298031 - DNA, 25 bp, Mus musculus
attcgctgcgcgctctccggctagg

SEQ ID NO: 298032 - DNA, 25 bp, Mus musculus
cgctgcagcagcttccgagctaggc

SEQ ID NO: 298033 - DNA, 25 bp, Mus musculus
cccacgttgtccaagagcatgaagc

SEQ ID NO: 298034 - DNA, 25 bp, Mus musculus
cgaccatagcgcttcagagaccact

SEQ ID NO: 298035 - DNA, 25 bp, Mus musculus
agagaccactgggagacttcgcctg

SEQ ID NO: 298036 - DNA, 25 bp, Mus musculus
cttcgcctggaagtccgaggccgga

SEQ ID NO: 298037 - DNA, 25 bp, Mus musculus
cggaggccacatttcccgcttcaga

SEQ ID NO: 298038 - DNA, 25 bp, Mus musculus
tcccgcttcagacatgcctgtcaaa

SEQ ID NO: 298039 - DNA, 25 bp, Mus musculus
tcaaaggtcctggaaagcccgcctc

SEQ ID NO: 298040 - DNA, 25 bp, Mus musculus
ggaaagcccgcctccacgtgatagc

SEQ ID NO: 298041 - DNA, 25 bp, Mus musculus
tccaagagcatgaagcgaccatagc

SEQ ID NO: 298042 - DNA, 25 bp, Mus musculus
ctccacgtgatagctgacgacaatc

SEQ ID NO: 298043 - DNA, 25 bp, Mus musculus
gacgacaatcagctagccaatcagg

SEQ ID NO: 298044 - DNA, 25 bp, Mus musculus
tagccaatcaggaagcacggcgctc

SEQ ID NO: 298045 - DNA, 25 bp, Mus musculus
agcacggcgctcaaagctcacgctt

SEQ ID NO: 298046 - DNA, 25 bp, Mus musculus
cgcgcacaggagtaaggacacctcc

SEQ ID NO: 298047 - DNA, 25 bp, Mus musculus
tttaagaagcccaggtaggcaggcc

SEQ ID NO: 298048 - DNA, 25 bp, Mus musculus
tgcagaagccgctcctatggcaacc

SEQ ID NO: 298049 - DNA, 25 bp, Mus musculus
agctgcggcggcttcatgaatattc

SEQ ID NO: 298050 - DNA, 25 bp, Mus musculus
cttcatgaatattccggggcgcggg

SEQ ID NO: 298051 - DNA, 25 bp, Mus musculus
aacccgggtgaccagctgcaaagcc

SEQ ID NO: 298052 - DNA, 25 bp, Mus musculus
agcccgcgcgatcatgggctcgtga

SEQ ID NO: 298053 - DNA, 25 bp, Mus musculus
tgaggcagcgaaggacgcgtcctca

SEQ ID NO: 298054 - DNA, 25 bp, Mus musculus
tcctcactggcaggcgcacctggag

SEQ ID NO: 298055 - DNA, 25 bp, Mus musculus
atccctggcaccatggacaagctgc

SEQ ID NO: 298056 - DNA, 25 bp, Mus musculus
cgtccatgcgcaagcggctctacag

SEQ ID NO: 298057 - DNA, 25 bp, Mus musculus
gctctacagccttccgcagcaggtg

SEQ ID NO: 298058 - DNA, 25 bp, Mus musculus
cagtccctaaggtctggcgaggttc

SEQ ID NO: 298059 - DNA, 25 bp, Mus musculus
ccctctatgtctgggctgggacgcc

SEQ ID NO: 298060 - DNA, 25 bp, Mus musculus
tttcttccggcatgcgaagcccggg

SEQ ID NO: 298061 - DNA, 25 bp, Mus musculus
tctctgcgcgcgcactgagcactag

SEQ ID NO: 298062 - DNA, 25 bp, Mus musculus
cgtctcccgcgttcgcagtgagggc

SEQ ID NO: 298063 - DNA, 25 bp, Mus musculus
tctgcctgctttctgcgtggtccga

SEQ ID NO: 298064 - DNA, 25 bp, Mus musculus
tgtctgccggcctgacccaacccgg

SEQ ID NO: 298065 - DNA, 25 bp, Mus musculus
cgtgggctacggtcaaggccagccc

SEQ ID NO: 298066 - DNA, 25 bp, Mus musculus
gcagacccgcgtgggctacggtcaa

SEQ ID NO: 298067 - DNA, 25 bp, Mus musculus
tcagaggatcgctcctcagcttgta

SEQ ID NO: 298068 - DNA, 25 bp, Mus musculus
ccggggattcagaggatcgctcctc

SEQ ID NO: 298069 - DNA, 25 bp, Mus musculus
ccggcatgcgaagcccggggattca

SEQ ID NO: 298070 - DNA, 25 bp, Mus musculus
gtcgggagttgcagtctgcctgctt

SEQ ID NO: 298071 - DNA, 25 bp, Mus musculus
ctttctgcgtggtccgaggcccttt

SEQ ID NO: 298072 - DNA, 25 bp, Mus musculus
gaggccctttcttccggcatgcgaa

SEQ ID NO: 298073 - DNA, 25 bp, Mus musculus
ttgcagtctgcctgctttctgcgtg

SEQ ID NO: 298074 - DNA, 25 bp, Mus musculus
tctatatagggcctcagaggaaacc

SEQ ID NO: 298075 - DNA, 25 bp, Mus musculus
cgctcctaacccgcgggagagattt

SEQ ID NO: 298076 - DNA, 25 bp, Mus musculus
ccgggcctctatatagggcctcaga

SEQ ID NO: 298077 - DNA, 25 bp, Mus musculus
cctcagaggaaaccgaatggcctcc

SEQ ID NO: 298078 - DNA, 25 bp, Mus musculus
acctgaggcagagccgcacggactc

SEQ ID NO: 298079 - DNA, 25 bp, Mus musculus
agagccgcacggactccggagctgc

SEQ ID NO: 298080 - DNA, 25 bp, Mus musculus
tccgcggaccgcttcaaaggctacg

SEQ ID NO: 298081 - DNA, 25 bp, Mus musculus
ccggagaagcgatccgcctccttcg

SEQ ID NO: 298082 - DNA, 25 bp, Mus musculus
aatcccggcggtcgcttcgcgggca

SEQ ID NO: 298083 - DNA, 25 bp, Mus musculus
gtggctcggtctctccaggttccag

SEQ ID NO: 298084 - DNA, 25 bp, Mus musculus
aatcagtacattccggccgagagcc

SEQ ID NO: 298085 - DNA, 25 bp, Mus musculus
agagcagaggagaatcagtacattc

SEQ ID NO: 298086 - DNA, 25 bp, Mus musculus
ggcccgacttacctgcggactgcgg

SEQ ID NO: 298087 - DNA, 25 bp, Mus musculus
tcaaaggctacggagacctgaggca

SEQ ID NO: 298088 - DNA, 25 bp, Mus musculus
cgcgaggtttgctgcttcttcgtta

SEQ ID NO: 298089 - DNA, 25 bp, Mus musculus
ccgactactctaatcgcgaggtttg

SEQ ID NO: 298090 - DNA, 25 bp, Mus musculus
cagcgccagcgccaagacttaaaca

SEQ ID NO: 298091 - DNA, 25 bp, Mus musculus
ctctatctcaggctatcagtgaata

SEQ ID NO: 298092 - DNA, 25 bp, Mus musculus
ctgcatgtcttatcttactagggaa

SEQ ID NO: 298093 - DNA, 25 bp, Mus musculus
accatggaggtcaaacactggcgga

SEQ ID NO: 298094 - DNA, 25 bp, Mus musculus
cggagggacggattaagagacaaca

SEQ ID NO: 298095 - DNA, 25 bp, Mus musculus
ctcgttgtcaatgggagaccgacta

SEQ ID NO: 298096 - DNA, 25 bp, Mus musculus
tccaaggacagaatcgcacaacagc

SEQ ID NO: 298097 - DNA, 25 bp, Mus musculus
gacgcgtgagacgagcctttttccg

SEQ ID NO: 298098 - DNA, 25 bp, Mus musculus
agaaaggatcctgtagccaccggtg

SEQ ID NO: 298099 - DNA, 25 bp, Mus musculus
ttacgcacgtctacgtcagcacgcg

SEQ ID NO: 298100 - DNA, 25 bp, Mus musculus
ccacccataactggggctgcagttc

SEQ ID NO: 298101 - DNA, 25 bp, Mus musculus
attgggaaccacactactgcctttg

SEQ ID NO: 298102 - DNA, 25 bp, Mus musculus
acacaggtcagcattcgccaaacgc

SEQ ID NO: 298103 - DNA, 25 bp, Mus musculus
agcattcgccaaacgcccagccagg

SEQ ID NO: 298104 - DNA, 25 bp, Mus musculus
cgccgcctcccggagggactacttg

SEQ ID NO: 298105 - DNA, 25 bp, Mus musculus
ccgccacgacgctccgccctgaggc

SEQ ID NO: 298106 - DNA, 25 bp, Mus musculus
tgaggccgccgctaagcctccgaga

SEQ ID NO: 298107 - DNA, 25 bp, Mus musculus
aggccgccgctaagcctccgagaat

SEQ ID NO: 298108 - DNA, 25 bp, Mus musculus
cccgcttaccatcccaagcttcact

SEQ ID NO: 298109 - DNA, 25 bp, Mus musculus
caagcttcacttcagccatcttggc

SEQ ID NO: 298110 - DNA, 25 bp, Mus musculus
agcttcacttcagccatcttggctc

SEQ ID NO: 298111 - DNA, 25 bp, Mus musculus
tgcacacaggtcagcattcgccaaa

SEQ ID NO: 298112 - DNA, 25 bp, Mus musculus
cttggctccgcccaccgcttcgcga

SEQ ID NO: 298113 - DNA, 25 bp, Mus musculus
ccaccgcttcgcgaccggaagccga

SEQ ID NO: 298114 - DNA, 25 bp, Mus musculus
cgaagcgctgcacacaggtcagcat

SEQ ID NO: 298115 - DNA, 25 bp, Mus musculus
agcgctgcacacaggtcagcattcg

SEQ ID NO: 298116 - DNA, 25 bp, Mus musculus
aagctgtggctccttgacgtgagga

SEQ ID NO: 298117 - DNA, 25 bp, Mus musculus
tacgtcatcgcgtcggtccgctgca

SEQ ID NO: 298118 - DNA, 25 bp, Mus musculus
ctgagccaacaaaggggcgtgcgtc

SEQ ID NO: 298119 - DNA, 25 bp, Mus musculus
gctgctaccgctactgagccaacaa

SEQ ID NO: 298120 - DNA, 25 bp, Mus musculus
gtagttgtagccctcgtccgagtcc

SEQ ID NO: 298121 - DNA, 25 bp, Mus musculus
tcctcgtcgaactcgtagttgtagc

SEQ ID NO: 298122 - DNA, 25 bp, Mus musculus
ccaggttatcatcgtccggctcgtc

SEQ ID NO: 298123 - DNA, 25 bp, Mus musculus
tcgcccagatccaggttatcatcgt

SEQ ID NO: 298124 - DNA, 25 bp, Mus musculus
gcggtaatcctcctcctgctcgtgt

SEQ ID NO: 298125 - DNA, 25 bp, Mus musculus
cgtgagcacctcgtagcggtaatcc

SEQ ID NO: 298126 - DNA, 25 bp, Mus musculus
ccatgtgctgcaggatctgttcggc

SEQ ID NO: 298127 - DNA, 25 bp, Mus musculus
cccggatacattccaccatgtgctg

SEQ ID NO: 298128 - DNA, 25 bp, Mus musculus
tgacctcgttgacctcccggataca

SEQ ID NO: 298129 - DNA, 25 bp, Mus musculus
tcacctggatgacctcgttgacctc

SEQ ID NO: 298130 - DNA, 25 bp, Mus musculus
cctttgcttacggatctctgagatc

SEQ ID NO: 298131 - DNA, 25 bp, Mus musculus
agccgccttccgtgcgtgggtcagc

SEQ ID NO: 298132 - DNA, 25 bp, Mus musculus
caagtgagtcactgcccggttcttc

SEQ ID NO: 298133 - DNA, 25 bp, Mus musculus
gacgctaccgtaacctgctcttcgg

SEQ ID NO: 298134 - DNA, 25 bp, Mus musculus
cgacgaggcctttcgacgctaccgt

SEQ ID NO: 298135 - DNA, 25 bp, Mus musculus
ctgcgtcgtcctcgacgaggccttt

SEQ ID NO: 298136 - DNA, 25 bp, Mus musculus
gtaccatgtcagttcggccgcgcag

SEQ ID NO: 298137 - DNA, 25 bp, Mus musculus
ccagttccggtaccatgtcagttcg

SEQ ID NO: 298138 - DNA, 25 bp, Mus musculus
aacaacttccagttccggtaccatg

SEQ ID NO: 298139 - DNA, 25 bp, Mus musculus
gcttgcttggccacggcactgtggc

SEQ ID NO: 298140 - DNA, 25 bp, Mus musculus
tgaccctccgattgtcacgcgggcg

SEQ ID NO: 298141 - DNA, 25 bp, Mus musculus
atctctgagatcgagcccgccttgc

SEQ ID NO: 298142 - DNA, 25 bp, Mus musculus
cgggagctgcagaatcctttgctta

SEQ ID NO: 298143 - DNA, 25 bp, Mus musculus
ccacccggtcgggagctgcagaatc

SEQ ID NO: 298144 - DNA, 25 bp, Mus musculus
tgacccgcctcctttctgatggctt

SEQ ID NO: 298145 - DNA, 25 bp, Mus musculus
gcggaacggcagagaaggcatttcc

SEQ ID NO: 298146 - DNA, 25 bp, Mus musculus
tggcgcctcctggacgtcacaggcg

SEQ ID NO: 298147 - DNA, 25 bp, Mus musculus
ctgcattgcccgctgccagctctgc

SEQ ID NO: 298148 - DNA, 25 bp, Mus musculus
acctaaggctgctggcgcctcctgg

SEQ ID NO: 298149 - DNA, 25 bp, Mus musculus
agggagcgctccgacctgcgctact

SEQ ID NO: 298150 - DNA, 25 bp, Mus musculus
tagattcggcacctaaggctgctgg

SEQ ID NO: 298151 - DNA, 25 bp, Mus musculus
cgacctgcgctactgctggactgtt

SEQ ID NO: 298152 - DNA, 25 bp, Mus musculus
actgctggactgttggctgcggcaa

SEQ ID NO: 298153 - DNA, 25 bp, Mus musculus
ccctggaactgagcagctgcgagcc

SEQ ID NO: 298154 - DNA, 25 bp, Mus musculus
tggctgcggcaatctggtttcagca

SEQ ID NO: 298155 - DNA, 25 bp, Mus musculus
ggagaggcttcaactttggcttaga

SEQ ID NO: 298156 - DNA, 25 bp, Mus musculus
aactttggcttagattcggcaccta

SEQ ID NO: 298157 - DNA, 25 bp, Mus musculus
gaactgagcagctgcgagccggatc

SEQ ID NO: 298158 - DNA, 25 bp, Mus musculus
cgcgcttggctttcagcaccgcgga

SEQ ID NO: 298159 - DNA, 25 bp, Mus musculus
tgacgaagctacttcccatccactg

SEQ ID NO: 298160 - DNA, 25 bp, Mus musculus
tgacggtgctgaaggaccggctcac

SEQ ID NO: 298161 - DNA, 25 bp, Mus musculus
gcttggacgagcaggacctcaagcc

SEQ ID NO: 298162 - DNA, 25 bp, Mus musculus
gctcagccaactccttctctgattg

SEQ ID NO: 298163 - DNA, 25 bp, Mus musculus
catgagcgggctgaacccaggtccc

SEQ ID NO: 298164 - DNA, 25 bp, Mus musculus
tctgattggccaccgctatctcatt

SEQ ID NO: 298165 - DNA, 25 bp, Mus musculus
cctccacacacagggcagctgaggg

SEQ ID NO: 298166 - DNA, 25 bp, Mus musculus
ctgtctgacgtcactaagctcgggg

SEQ ID NO: 298167 - DNA, 25 bp, Mus musculus
gacgctccctgctagctgtctgacg

SEQ ID NO: 298168 - DNA, 25 bp, Mus musculus
tgcaaatcacttgcgtagacgctcc

SEQ ID NO: 298169 - DNA, 25 bp, Mus musculus
gacagcgccacgcatgacgaagcta

SEQ ID NO: 298170 - DNA, 25 bp, Mus musculus
ggccaccgctatctcattatgcaaa

SEQ ID NO: 298171 - DNA, 25 bp, Mus musculus
caggtcccgcggtgcccatgaagga

SEQ ID NO: 298172 - DNA, 25 bp, Mus musculus
cccagtggcagttgctagcctctga

SEQ ID NO: 298173 - DNA, 25 bp, Mus musculus
ggacccagtggcagttgctagcctc

SEQ ID NO: 298174 - DNA, 25 bp, Mus musculus
cggccttcagcttggtggctgcacc

SEQ ID NO: 298175 - DNA, 25 bp, Mus musculus
agcctctgaggcctctatcttcctt

SEQ ID NO: 298176 - DNA, 25 bp, Mus musculus
atcttccttcctcaagatcctacag

SEQ ID NO: 298177 - DNA, 25 bp, Mus musculus
gatcctacagcaccaggcagcgttg

SEQ ID NO: 298178 - DNA, 25 bp, Mus musculus
accaggcagcgttgctggccgcagc

SEQ ID NO: 298179 - DNA, 25 bp, Mus musculus
cttggtggctgcaccgctgttgccc

SEQ ID NO: 298180 - DNA, 25 bp, Mus musculus
ggcgcctataccactgcggtaggta

SEQ ID NO: 298181 - DNA, 25 bp, Mus musculus
cgcgcgctgcgaaggatgcagcaaa

SEQ ID NO: 298182 - DNA, 25 bp, Mus musculus
gatgcagcaaatggctggccagctg

SEQ ID NO: 298183 - DNA, 25 bp, Mus musculus
ggctggccagctgggtgccttccac

SEQ ID NO: 298184 - DNA, 25 bp, Mus musculus
ctgtggcgcctataccactgcggta

SEQ ID NO: 298185 - DNA, 25 bp, Mus musculus
taccactgcggtaggtagctggcca

SEQ ID NO: 298186 - DNA, 25 bp, Mus musculus
cgaggcgacaaagaaaaacattata

SEQ ID NO: 298187 - DNA, 25 bp, Mus musculus
gtcctcgcgagcgtcttggtcttct

SEQ ID NO: 298188 - DNA, 25 bp, Mus musculus
cctgcatgcgcaggtgtcctcgcga

SEQ ID NO: 298189 - DNA, 25 bp, Mus musculus
gcgagccgcagacgggtccttaacg

SEQ ID NO: 298190 - DNA, 25 bp, Mus musculus
taagggatgctgacaggcttcgctc

SEQ ID NO: 298191 - DNA, 25 bp, Mus musculus
ccgccctgcctgagggaccaagtaa

SEQ ID NO: 298192 - DNA, 25 bp, Mus musculus
cgtgagtactctctaggctggcgtg

SEQ ID NO: 298193 - DNA, 25 bp, Mus musculus
cccgagaccgcacgctgaggcgtgt

SEQ ID NO: 298194 - DNA, 25 bp, Mus musculus
cacctgatcgcggtgtcttcgcctg

SEQ ID NO: 298195 - DNA, 25 bp, Mus musculus
gttggtcggaagaggacacctgatc

SEQ ID NO: 298196 - DNA, 25 bp, Mus musculus
aggtacagcacgcaccgcggttggt

SEQ ID NO: 298197 - DNA, 25 bp, Mus musculus
ttcaactctggatcactgcgcacgc

SEQ ID NO: 298198 - DNA, 25 bp, Mus musculus
ggagaacctctttctcaagctccct

SEQ ID NO: 298199 - DNA, 25 bp, Mus musculus
tatttcggcatgtccggagaacctc

SEQ ID NO: 298200 - DNA, 25 bp, Mus musculus
cctccaaattgagggtggccggcta

SEQ ID NO: 298201 - DNA, 25 bp, Mus musculus
cgcgccagtgttcgcagctcttcgt

SEQ ID NO: 298202 - DNA, 25 bp, Mus musculus
aagggcaacctgcttgtcccgccta

SEQ ID NO: 298203 - DNA, 25 bp, Mus musculus
ggcccgcagctgtgataaccttgag

SEQ ID NO: 298204 - DNA, 25 bp, Mus musculus
gcagcgactcgtcttcacttgactg

SEQ ID NO: 298205 - DNA, 25 bp, Mus musculus
gacgtccgctctaggtatcgcagca

SEQ ID NO: 298206 - DNA, 25 bp, Mus musculus
gcggggagaacctaagccatctgtc

SEQ ID NO: 298207 - DNA, 25 bp, Mus musculus
ccgatgcccactggtgtgtaacgca

SEQ ID NO: 298208 - DNA, 25 bp, Mus musculus
ttacgaccttcctcttagctctgtg

SEQ ID NO: 298209 - DNA, 25 bp, Mus musculus
agctctgtgccctcataattcggtg

SEQ ID NO: 298210 - DNA, 25 bp, Mus musculus
ttcggtgccctcctcttaatctcta

SEQ ID NO: 298211 - DNA, 25 bp, Mus musculus
atgcagtcactagcggtccttggta

SEQ ID NO: 298212 - DNA, 25 bp, Mus musculus
gcggtccttggtaatgcagctacaa

SEQ ID NO: 298213 - DNA, 25 bp, Mus musculus
cctgttttgtgtgcccgcagatttt

SEQ ID NO: 298214 - DNA, 25 bp, Mus musculus
ctcgcggtccattcatttgtgtttc

SEQ ID NO: 298215 - DNA, 25 bp, Mus musculus
cgatgaccgccctgagccgtagcga

SEQ ID NO: 298216 - DNA, 25 bp, Mus musculus
tctggtgcgatgtatccgatgtgtc

SEQ ID NO: 298217 - DNA, 25 bp, Mus musculus
atccgatgtgtcttggtggcttcag

SEQ ID NO: 298218 - DNA, 25 bp, Mus musculus
ggcgactctgggaatgccgcgccta

SEQ ID NO: 298219 - DNA, 25 bp, Mus musculus
tctggaaatcacctcgtgtcggcca

SEQ ID NO: 298220 - DNA, 25 bp, Mus musculus
gtgtttcattcatttctcgccataa

SEQ ID NO: 298221 - DNA, 25 bp, Mus musculus
ttccctgtgggcctctgcaaaatca

SEQ ID NO: 298222 - DNA, 25 bp, Mus musculus
actcccagcgggatctactcttagg

SEQ ID NO: 298223 - DNA, 25 bp, Mus musculus
tactcttaggagcacactcggctgc

SEQ ID NO: 298224 - DNA, 25 bp, Mus musculus
gggcacttccaaccgcagaaattta

SEQ ID NO: 298225 - DNA, 25 bp, Mus musculus
acactcggctgcttctgaggcaacg

SEQ ID NO: 298226 - DNA, 25 bp, Mus musculus
acgtggagctgtcccagcacgactc

SEQ ID NO: 298227 - DNA, 25 bp, Mus musculus
aaggcacgctcccttctggaaatca

SEQ ID NO: 298228 - DNA, 25 bp, Mus musculus
tcctttcaagtctaggggcgagctg

SEQ ID NO: 298229 - DNA, 25 bp, Mus musculus
ctccgagcgccacacgaagagaagg

SEQ ID NO: 298230 - DNA, 25 bp, Mus musculus
gatgaccagagatctccgagcgcca

SEQ ID NO: 298231 - DNA, 25 bp, Mus musculus
tagcttcgctgtattctcctccctc

SEQ ID NO: 298232 - DNA, 25 bp, Mus musculus
ttgcaccgctactgctggcggtgga

SEQ ID NO: 298233 - DNA, 25 bp, Mus musculus
tctagtcagcttgcaccgctactgc

SEQ ID NO: 298234 - DNA, 25 bp, Mus musculus
tctcgcgtctgctctagtcagcttg

SEQ ID NO: 298235 - DNA, 25 bp, Mus musculus
agcggttctcgcgtctgctctagtc

SEQ ID NO: 298236 - DNA, 25 bp, Mus musculus
gcagcccagatcacagcgcagcctg

SEQ ID NO: 298237 - DNA, 25 bp, Mus musculus
gcgaggtcccaacgcgcagcccaga

SEQ ID NO: 298238 - DNA, 25 bp, Mus musculus
aagtctaggggcgagctggccaccc

SEQ ID NO: 298239 - DNA, 25 bp, Mus musculus
ctccgtggtcttcctttcaagtcta

SEQ ID NO: 298240 - DNA, 25 bp, Mus musculus
ctgcacccgacgagtcctccgtggt

SEQ ID NO: 298241 - DNA, 25 bp, Mus musculus
caggacgccgccactgctgcgggtt

SEQ ID NO: 298242 - DNA, 25 bp, Mus musculus
acctttcattgaccagacaccattc

SEQ ID NO: 298243 - DNA, 25 bp, Mus musculus
cgacgtttttatgtagtaatcgaga

SEQ ID NO: 298244 - DNA, 25 bp, Mus musculus
tctaacacggaggtctcagccctgc

SEQ ID NO: 298245 - DNA, 25 bp, Mus musculus
cagccctgccgtaaagtgaagaagg

SEQ ID NO: 298246 - DNA, 25 bp, Mus musculus
aaaataggcgtgtccgcgcaagcgc

SEQ ID NO: 298247 - DNA, 25 bp, Mus musculus
caaaagcagggaccgcggtttagct

SEQ ID NO: 298248 - DNA, 25 bp, Mus musculus
ggtttagcttccaacgcgtgctctc

SEQ ID NO: 298249 - DNA, 25 bp, Mus musculus
ctctctcggaccctgaggcgactgg

SEQ ID NO: 298250 - DNA, 25 bp, Mus musculus
cttctgaccctggaaaccgagctgg

SEQ ID NO: 298251 - DNA, 25 bp, Mus musculus
ctaaagcctagcaatcgccggagta

SEQ ID NO: 298252 - DNA, 25 bp, Mus musculus
ctccagcagcgtcacgtgcggaggc

SEQ ID NO: 298253 - DNA, 25 bp, Mus musculus
tcgactctcccgtacctttcattga

SEQ ID NO: 298254 - DNA, 25 bp, Mus musculus
caatcgccggagtaccgccgggatt

SEQ ID NO: 298255 - DNA, 25 bp, Mus musculus
agacaccattctgtccaccagtagc

SEQ ID NO: 298256 - DNA, 25 bp, Mus musculus
tgctcacctgggctagtccgaagcg

SEQ ID NO: 298257 - DNA, 25 bp, Mus musculus
cctggcggccgccaaggggagagtc

SEQ ID NO: 298258 - DNA, 25 bp, Mus musculus
ccgacgtacccacgcgcgccagtct

SEQ ID NO: 298259 - DNA, 25 bp, Mus musculus
cgggctgcgcgatctgctcacctgg

SEQ ID NO: 298260 - DNA, 25 bp, Mus musculus
ctgcgcgatctgctcacctgggcta

SEQ ID NO: 298261 - DNA, 25 bp, Mus musculus
cgcgatctgctcacctgggctagtc

SEQ ID NO: 298262 - DNA, 25 bp, Mus musculus
atctgctcacctgggctagtccgaa

SEQ ID NO: 298263 - DNA, 25 bp, Mus musculus
tcacctgggctagtccgaagcggcc

SEQ ID NO: 298264 - DNA, 25 bp, Mus musculus
ggctagtccgaagcggccgactcct

SEQ ID NO: 298265 - DNA, 25 bp, Mus musculus
tccgaagcggccgactcctcagccc

SEQ ID NO: 298266 - DNA, 25 bp, Mus musculus
ccgccgcatggacggccgcccgccc

SEQ ID NO: 298267 - DNA, 25 bp, Mus musculus
agcgagtgcccagcgcacggctcag

SEQ ID NO: 298268 - DNA, 25 bp, Mus musculus
agcgcacggctcaggcgcggtgtct

SEQ ID NO: 298269 - DNA, 25 bp, Mus musculus
gatctgctcacctgggctagtccga

SEQ ID NO: 298270 - DNA, 25 bp, Mus musculus
atcggtggctatggcaaccatgact

SEQ ID NO: 298271 - DNA, 25 bp, Mus musculus
cggtctggtcctcgccctagatctt

SEQ ID NO: 298272 - DNA, 25 bp, Mus musculus
ctggtcctcgccctagatctttggg

SEQ ID NO: 298273 - DNA, 25 bp, Mus musculus
cgccctagatctttgggccgtccgg

SEQ ID NO: 298274 - DNA, 25 bp, Mus musculus
gctagcctcggggagtatctgtggg

SEQ ID NO: 298275 - DNA, 25 bp, Mus musculus
cgtgcgtcagcacttcctcgttctg

SEQ ID NO: 298276 - DNA, 25 bp, Mus musculus
gtcagcacttcctcgttctggattt

SEQ ID NO: 298277 - DNA, 25 bp, Mus musculus
ttttccaggccgcttgaaaacagcg

SEQ ID NO: 298278 - DNA, 25 bp, Mus musculus
cgcttgaaaacagcgggaggatccg

SEQ ID NO: 298279 - DNA, 25 bp, Mus musculus
aggaggataagacgaggaagaggga

SEQ ID NO: 298280 - DNA, 25 bp, Mus musculus
cacatcggtggctatggcaaccatg

SEQ ID NO: 298281 - DNA, 25 bp, Mus musculus
ccatgacttccggtcctttcctctt

SEQ ID NO: 298282 - DNA, 25 bp, Mus musculus
ttcctctttaggacccgcctcaaca

SEQ ID NO: 298283 - DNA, 25 bp, Mus musculus
aggacacatcggtggctatggcaac

SEQ ID NO: 298284 - DNA, 25 bp, Mus musculus
ccgagccgcgggcacaggtaggctc

SEQ ID NO: 298285 - DNA, 25 bp, Mus musculus
ccacgcgcgatcgtcgctatcgagg

SEQ ID NO: 298286 - DNA, 25 bp, Mus musculus
cgatcgtcgctatcgagggctgccg

SEQ ID NO: 298287 - DNA, 25 bp, Mus musculus
ctggcctggcctcgcgacacggaga

SEQ ID NO: 298288 - DNA, 25 bp, Mus musculus
accctgccaaccatggcccagctcg

SEQ ID NO: 298289 - DNA, 25 bp, Mus musculus
cagctcggcgaacagactctgcctg

SEQ ID NO: 298290 - DNA, 25 bp, Mus musculus
tcggcgaacagactctgcctgggcc

SEQ ID NO: 298291 - DNA, 25 bp, Mus musculus
tgcctgggcccgagaccacggtgca

SEQ ID NO: 298292 - DNA, 25 bp, Mus musculus
ggcccgagaccacggtgcagatccg

SEQ ID NO: 298293 - DNA, 25 bp, Mus musculus
cgagaccacggtgcagatccgtgtc

SEQ ID NO: 298294 - DNA, 25 bp, Mus musculus
cggtgcagatccgtgtcgccatcca

SEQ ID NO: 298295 - DNA, 25 bp, Mus musculus
ggagtagtccctgagcgagtgctca

SEQ ID NO: 298296 - DNA, 25 bp, Mus musculus
aggctgaggatctggaggatctgga

SEQ ID NO: 298297 - DNA, 25 bp, Mus musculus
gcagatccgtgtcgccatccaggag

SEQ ID NO: 298298 - DNA, 25 bp, Mus musculus
cggcaacacggtaccgcacatggca

SEQ ID NO: 298299 - DNA, 25 bp, Mus musculus
gtccacgatcattcccaaccgggta

SEQ ID NO: 298300 - DNA, 25 bp, Mus musculus
caaccgggtacaatacctgtgagga

SEQ ID NO: 298301 - DNA, 25 bp, Mus musculus
gacgcggccataacgtactggtgca

SEQ ID NO: 298302 - DNA, 25 bp, Mus musculus
cataacgtactggtgcagcagtccc

SEQ ID NO: 298303 - DNA, 25 bp, Mus musculus
tgctagcccgccctctgagtgaggc

SEQ ID NO: 298304 - DNA, 25 bp, Mus musculus
ccctctgagtgaggcgggacttcct

SEQ ID NO: 298305 - DNA, 25 bp, Mus musculus
gggacttcctcttgtcacttccggc

SEQ ID NO: 298306 - DNA, 25 bp, Mus musculus
gctctctgaaagctaggctagcgga

SEQ ID NO: 298307 - DNA, 25 bp, Mus musculus
gctagcggagcttataaagatcgga

SEQ ID NO: 298308 - DNA, 25 bp, Mus musculus
atcggatggtagagctttcgctttc

SEQ ID NO: 298309 - DNA, 25 bp, Mus musculus
cctcagacgctccagatgtagacta

SEQ ID NO: 298310 - DNA, 25 bp, Mus musculus
tagactaggtgagctctctgcccgg

SEQ ID NO: 298311 - DNA, 25 bp, Mus musculus
cggtaccgcacatggcaaaaaagaa

SEQ ID NO: 298312 - DNA, 25 bp, Mus musculus
ttctcactttgacctttgcggagta

SEQ ID NO: 298313 - DNA, 25 bp, Mus musculus
ttccacccggtgcagccggtgcgga

SEQ ID NO: 298314 - DNA, 25 bp, Mus musculus
cgcagcccgcaatctggtgggaacc

SEQ ID NO: 298315 - DNA, 25 bp, Mus musculus
ccggacccttgagagccgtggccat

SEQ ID NO: 298316 - DNA, 25 bp, Mus musculus
agagccgtggccatgaagagcctca

SEQ ID NO: 298317 - DNA, 25 bp, Mus musculus
tgaagagcctcaagtcccgactgtg

SEQ ID NO: 298318 - DNA, 25 bp, Mus musculus
tggtgccatcctgctcttcgcttgt

SEQ ID NO: 298319 - DNA, 25 bp, Mus musculus
tctgtcttcccgtggtgccatcctg

SEQ ID NO: 298320 - DNA, 25 bp, Mus musculus
tcacggcagatctgagattcgcgga

SEQ ID NO: 298321 - DNA, 25 bp, Mus musculus
ttgcggagtaccctattcccacttg

SEQ ID NO: 298322 - DNA, 25 bp, Mus musculus
tcccgactgtggaagcaggacgcgc

SEQ ID NO: 298323 - DNA, 25 bp, Mus musculus
acctcggggaccctctctgttgcgt

SEQ ID NO: 298324 - DNA, 25 bp, Mus musculus
gattcgcggagaagtcctacgtccc

SEQ ID NO: 298325 - DNA, 25 bp, Mus musculus
tctctgttgcgtccctcacggcaga

SEQ ID NO: 298326 - DNA, 25 bp, Mus musculus
ctgcaagcagttcggctctgccgtg

SEQ ID NO: 298327 - DNA, 25 bp, Mus musculus
ggcgctcggcaaaaccgcatccatc

SEQ ID NO: 298328 - DNA, 25 bp, Mus musculus
atccatcacgctcatcatccgtgtg

SEQ ID NO: 298329 - DNA, 25 bp, Mus musculus
cgctcatcatccgtgtggcaggccg

SEQ ID NO: 298330 - DNA, 25 bp, Mus musculus
gcgcctgggttcacaggagaactca

SEQ ID NO: 298331 - DNA, 25 bp, Mus musculus
gaaagcccaaggcatcggcggccgc

SEQ ID NO: 298332 - DNA, 25 bp, Mus musculus
tggggtccttgggagcatcactgcc

SEQ ID NO: 298333 - DNA, 25 bp, Mus musculus
caggagaactcaatgtgaagtctgc

SEQ ID NO: 298334 - DNA, 25 bp, Mus musculus
gccttgcactagctcacgctgacta

SEQ ID NO: 298335 - DNA, 25 bp, Mus musculus
gtacacagtccgcatagacaggacc

SEQ ID NO: 298336 - DNA, 25 bp, Mus musculus
gctcacgctgactagtggggtcctt

SEQ ID NO: 298337 - DNA, 25 bp, Mus musculus
gtgaagtctgccttgcactagctca

SEQ ID NO: 298338 - DNA, 25 bp, Mus musculus
tagacaggacctgaaagcccaaggc

SEQ ID NO: 298339 - DNA, 25 bp, Mus musculus
ctgcggcgcttttctgtacacagtc

SEQ ID NO: 298340 - DNA, 25 bp, Mus musculus
taatggatgctttggccagatgctc

SEQ ID NO: 298341 - DNA, 25 bp, Mus musculus
gttgtccgcagactgccaggccctt

SEQ ID NO: 298342 - DNA, 25 bp, Mus musculus
tcgcatctgtcgagctaggcttctc

SEQ ID NO: 298343 - DNA, 25 bp, Mus musculus
gcgcgctcccagctactcattaaga

SEQ ID NO: 298344 - DNA, 25 bp, Mus musculus
tgcaaacgcgaaactcaggctccta

SEQ ID NO: 298345 - DNA, 25 bp, Mus musculus
ctgacgtgacccttgtctgcgagca

SEQ ID NO: 298346 - DNA, 25 bp, Mus musculus
agtcgaatatctacgcctccttggg

SEQ ID NO: 298347 - DNA, 25 bp, Mus musculus
ccttgggtgtctatgctggtgacca

SEQ ID NO: 298348 - DNA, 25 bp, Mus musculus
ggccatcaggccaagaaacggggtc

SEQ ID NO: 298349 - DNA, 25 bp, Mus musculus
tcggaactctgggtcgtagccagga

SEQ ID NO: 298350 - DNA, 25 bp, Mus musculus
cggtgcgcatcgtacacgatttatg

SEQ ID NO: 298351 - DNA, 25 bp, Mus musculus
tagccgcactactgagcctgttgtc

SEQ ID NO: 298352 - DNA, 25 bp, Mus musculus
ggcccgccaagccagagttctcaga

SEQ ID NO: 298353 - DNA, 25 bp, Mus musculus
tgaggaacccgccttggcaaggctg

SEQ ID NO: 298354 - DNA, 25 bp, Mus musculus
gacatccggtgagtaattgcaacta

SEQ ID NO: 298355 - DNA, 25 bp, Mus musculus
ggtcctcaagccgtcacctcggtgg

SEQ ID NO: 298356 - DNA, 25 bp, Mus musculus
gcagacggaacagcaggctctcctc

SEQ ID NO: 298357 - DNA, 25 bp, Mus musculus
atgatgtccacgcagacccggcttc

SEQ ID NO: 298358 - DNA, 25 bp, Mus musculus
tctgacactgttcacgcagccgggg

SEQ ID NO: 298359 - DNA, 25 bp, Mus musculus
gccatgtatccgcaaggcagacatc

SEQ ID NO: 298360 - DNA, 25 bp, Mus musculus
ttggccgccagagcccttttggctt

SEQ ID NO: 298361 - DNA, 25 bp, Mus musculus
tctatcatggcagggtaaacgaggc

SEQ ID NO: 298362 - DNA, 25 bp, Mus musculus
ggcagtttatctagcacctccattt

SEQ ID NO: 298363 - DNA, 25 bp, Mus musculus
ttgctacctttatggtgcgcgcgcg

SEQ ID NO: 298364 - DNA, 25 bp, Mus musculus
gcgccgtagagagccaagggtaatt

SEQ ID NO: 298365 - DNA, 25 bp, Mus musculus
taagtcttccaactcgcgctctcgg

SEQ ID NO: 298366 - DNA, 25 bp, Mus musculus
catcgtcctgattgacccgtgaggg

SEQ ID NO: 298367 - DNA, 25 bp, Mus musculus
tcagcgcttccaagctctcggaatc

SEQ ID NO: 298368 - DNA, 25 bp, Mus musculus
gcctttggggcttgcgaatattaca

SEQ ID NO: 298369 - DNA, 25 bp, Mus musculus
aacgcggccttagcttcctcggaag

SEQ ID NO: 298370 - DNA, 25 bp, Mus musculus
ttcgacttccggtgcgattggcctt

SEQ ID NO: 298371 - DNA, 25 bp, Mus musculus
gcctcaagccttgcggatcacgtgg

SEQ ID NO: 298372 - DNA, 25 bp, Mus musculus
gcagttccggatttgcgcgttcgac

SEQ ID NO: 298373 - DNA, 25 bp, Mus musculus
gggagacgtactgcttaaactgaca

SEQ ID NO: 298374 - DNA, 25 bp, Mus musculus
ccacggcttgggtacactgaaaagt

SEQ ID NO: 298375 - DNA, 25 bp, Mus musculus
gggaccgccattcacctgtctcggg

SEQ ID NO: 298376 - DNA, 25 bp, Mus musculus
tcacaggcctccaagtcaccgaatg

SEQ ID NO: 298377 - DNA, 25 bp, Mus musculus
ccgaatgcctgagaatgcgaagtcc

SEQ ID NO: 298378 - DNA, 25 bp, Mus musculus
gtcacctcgtcgtcgtgcaggatga

SEQ ID NO: 298379 - DNA, 25 bp, Mus musculus
agccatgctgtagactgccggcacg

SEQ ID NO: 298380 - DNA, 25 bp, Mus musculus
aaaagatcatatacgcctgcgcgca

SEQ ID NO: 298381 - DNA, 25 bp, Mus musculus
gatcacgtggtggacttcccaaccc

SEQ ID NO: 298382 - DNA, 25 bp, Mus musculus
ctgacttcatgaccgcaggctccgt

SEQ ID NO: 298383 - DNA, 25 bp, Mus musculus
ggcagcgctggagaaaaacctgaga

SEQ ID NO: 298384 - DNA, 25 bp, Mus musculus
ttggcaacccaagggcgccagccgg

SEQ ID NO: 298385 - DNA, 25 bp, Mus musculus
cggcgcatttcaaacaggccaatca

SEQ ID NO: 298386 - DNA, 25 bp, Mus musculus
gcgacgctgcaagcccaagtgtgcg

SEQ ID NO: 298387 - DNA, 25 bp, Mus musculus
cggggaccaggactcaatctgagga

SEQ ID NO: 298388 - DNA, 25 bp, Mus musculus
tggcgggaactaagccgagcaaacc

SEQ ID NO: 298389 - DNA, 25 bp, Mus musculus
ggcagcccaaaggatggcaacccga

SEQ ID NO: 298390 - DNA, 25 bp, Mus musculus
gcaggctccgtgctatcctgacgcg

SEQ ID NO: 298391 - DNA, 25 bp, Mus musculus
gtactacggactcagctcccgggca

SEQ ID NO: 298392 - DNA, 25 bp, Mus musculus
ggagcttcggcctacactgtactac

SEQ ID NO: 298393 - DNA, 25 bp, Mus musculus
ccagaactctgcagtgcggagcttc

SEQ ID NO: 298394 - DNA, 25 bp, Mus musculus
cccggattcggaggcagccttcgcg

SEQ ID NO: 298395 - DNA, 25 bp, Mus musculus
caccagtactcacgctgacttcatg

SEQ ID NO: 298396 - DNA, 25 bp, Mus musculus
tacctggcggaagtgcgagatcctg

SEQ ID NO: 298397 - DNA, 25 bp, Mus musculus
tgccaaggccaagtcgtgctcgtca

SEQ ID NO: 298398 - DNA, 25 bp, Mus musculus
aggccaagtcgtgctcgtcactcgc

SEQ ID NO: 298399 - DNA, 25 bp, Mus musculus
gtgctcgtcactcgcgggcctgtag

SEQ ID NO: 298400 - DNA, 25 bp, Mus musculus
tgtacctggcggaagtgcgagatcc

SEQ ID NO: 298401 - DNA, 25 bp, Mus musculus
caagtcgtgctcgtcactcgcgggc

SEQ ID NO: 298402 - DNA, 25 bp, Mus musculus
cgagatcctggagttggcaggtaac

SEQ ID NO: 298403 - DNA, 25 bp, Mus musculus
cctggagttggcaggtaacacaaca

SEQ ID NO: 298404 - DNA, 25 bp, Mus musculus
tggcaggtaacacaacaacatcctc

SEQ ID NO: 298405 - DNA, 25 bp, Mus musculus
ggtaacacaacaacatcctcatcga

SEQ ID NO: 298406 - DNA, 25 bp, Mus musculus
acacaacaacatcctcatcgacgag

SEQ ID NO: 298407 - DNA, 25 bp, Mus musculus
acatcctcatcgacgaggagctcaa

SEQ ID NO: 298408 - DNA, 25 bp, Mus musculus
gaagggcaactacatggagcgcatg

SEQ ID NO: 298409 - DNA, 25 bp, Mus musculus
ctttggaagggcaactacatggagc

SEQ ID NO: 298410 - DNA, 25 bp, Mus musculus
tgcaccaccgtccaagagcaaactt

SEQ ID NO: 298411 - DNA, 25 bp, Mus musculus
cgcgggtgcaaatgtctgcttggca

SEQ ID NO: 298412 - DNA, 25 bp, Mus musculus
ttggcagttgcctgatgcaccaccg

SEQ ID NO: 298413 - DNA, 25 bp, Mus musculus
tagacctcttctccttcaaagcttc

SEQ ID NO: 298414 - DNA, 25 bp, Mus musculus
gagcaaactttcaagatccgtcttc

SEQ ID NO: 298415 - DNA, 25 bp, Mus musculus
gtcttcaagtagcacccgggctccg

SEQ ID NO: 298416 - DNA, 25 bp, Mus musculus
gcagatccgagacgggctactcctc

SEQ ID NO: 298417 - DNA, 25 bp, Mus musculus
tccgccctcggttacctgaattctg

SEQ ID NO: 298418 - DNA, 25 bp, Mus musculus
gttacctgaattctgaggctcactg

SEQ ID NO: 298419 - DNA, 25 bp, Mus musculus
ctcactggcgtccagtggatagggc

SEQ ID NO: 298420 - DNA, 25 bp, Mus musculus
agacgcagcaagagcagatccgaga

SEQ ID NO: 298421 - DNA, 25 bp, Mus musculus
cctgggaactgcacctggagaaccc

SEQ ID NO: 298422 - DNA, 25 bp, Mus musculus
aggagccgagcgatgggctctcctc

SEQ ID NO: 298423 - DNA, 25 bp, Mus musculus
acccgggctccgtggctcagtggca

SEQ ID NO: 298424 - DNA, 25 bp, Mus musculus
agatcccagccacggtaaggggcga

SEQ ID NO: 298425 - DNA, 25 bp, Mus musculus
acggaggctcttcgaatggcagctc

SEQ ID NO: 298426 - DNA, 25 bp, Mus musculus
agagccctgaggaaaactgaagcga

SEQ ID NO: 298427 - DNA, 25 bp, Mus musculus
ctagagacccgggaccgcctgggca

SEQ ID NO: 298428 - DNA, 25 bp, Mus musculus
atggcagctccgtcagcctgttaga

SEQ ID NO: 298429 - DNA, 25 bp, Mus musculus
gatcgccagaaatggtctccaagtc

SEQ ID NO: 298430 - DNA, 25 bp, Mus musculus
gacaaggctaaactgtatcccaagc

SEQ ID NO: 298431 - DNA, 25 bp, Mus musculus
gccctccggacaaggctaaactgta

SEQ ID NO: 298432 - DNA, 25 bp, Mus musculus
catggcgaccttaaacaaacccaag

SEQ ID NO: 298433 - DNA, 25 bp, Mus musculus
tggggaccatcacgcacagttaccg

SEQ ID NO: 298434 - DNA, 25 bp, Mus musculus
ctctcaggcaggacacaggacgcgc

SEQ ID NO: 298435 - DNA, 25 bp, Mus musculus
tcagcctgttagattcggtgtagaa

SEQ ID NO: 298436 - DNA, 25 bp, Mus musculus
gagggacacgggcatcgtcttatca

SEQ ID NO: 298437 - DNA, 25 bp, Mus musculus
tcaactgcacgggatcgccagaaat

SEQ ID NO: 298438 - DNA, 25 bp, Mus musculus
atgtcagaggcctaccgtcccacgt

SEQ ID NO: 298439 - DNA, 25 bp, Mus musculus
agagcactccgccatccgacgggaa

SEQ ID NO: 298440 - DNA, 25 bp, Mus musculus
tcagactaggaagtggctcgatggc

SEQ ID NO: 298441 - DNA, 25 bp, Mus musculus
ctgctcagactaggaagtggctcga

SEQ ID NO: 298442 - DNA, 25 bp, Mus musculus
ttaggactgctcagactaggaagtg

SEQ ID NO: 298443 - DNA, 25 bp, Mus musculus
catgcgtgttaggactgctcagact

SEQ ID NO: 298444 - DNA, 25 bp, Mus musculus
gcgtgcgtgttacgcatgcgtgtta

SEQ ID NO: 298445 - DNA, 25 bp, Mus musculus
agaggcctaccgtcccacgtcaggg

SEQ ID NO: 298446 - DNA, 25 bp, Mus musculus
aggggatgtcagaggcctaccgtcc

SEQ ID NO: 298447 - DNA, 25 bp, Mus musculus
cctcagggccgaaaggaggggatgt

SEQ ID NO: 298448 - DNA, 25 bp, Mus musculus
caggcctgggtacctcagggccgaa

SEQ ID NO: 298449 - DNA, 25 bp, Mus musculus
gccaccaggcctgggtacctcaggg

SEQ ID NO: 298450 - DNA, 25 bp, Mus musculus
tccgccatccgacgggaacgtcctg

SEQ ID NO: 298451 - DNA, 25 bp, Mus musculus
cccgcaacggttgccccagtgaatg

SEQ ID NO: 298452 - DNA, 25 bp, Mus musculus
aggccagaaggcttgagtcccattc

SEQ ID NO: 298453 - DNA, 25 bp, Mus musculus
gaccatggtttcttaagcacggccc

SEQ ID NO: 298454 - DNA, 25 bp, Mus musculus
ccaaggaagcgcctcctgcagctga

SEQ ID NO: 298455 - DNA, 25 bp, Mus musculus
tacgtcttctactgcctggcggagc

SEQ ID NO: 298456 - DNA, 25 bp, Mus musculus
aagttcttgctgatgctctgctcgc

SEQ ID NO: 298457 - DNA, 25 bp, Mus musculus
gtcgcgcagcatcttcaggaagttc

SEQ ID NO: 298458 - DNA, 25 bp, Mus musculus
tagacttccggagcgctcaagaggc

SEQ ID NO: 298459 - DNA, 25 bp, Mus musculus
tcgcagtgcttggtccctagttcca

SEQ ID NO: 298460 - DNA, 25 bp, Mus musculus
ggcgcgtttcagacccaagaccatg

SEQ ID NO: 298461 - DNA, 25 bp, Mus musculus
tgttatcgctgagccaagttccgca

SEQ ID NO: 298462 - DNA, 25 bp, Mus musculus
ctaaccggagcgtacacaattcttc

SEQ ID NO: 298463 - DNA, 25 bp, Mus musculus
gctggaaaaagggtcactcgttcta

SEQ ID NO: 298464 - DNA, 25 bp, Mus musculus
gactttgcttgctcggttgctgaga

SEQ ID NO: 298465 - DNA, 25 bp, Mus musculus
cccagcacagtcgtggcctagcatg

SEQ ID NO: 298466 - DNA, 25 bp, Mus musculus
tgtcgtgttcgtgaacgcgcccttt

SEQ ID NO: 298467 - DNA, 25 bp, Mus musculus
cctttgggccagatgctgtcttttc

SEQ ID NO: 298468 - DNA, 25 bp, Mus musculus
gcgtcgctaatgtaagttgcccgga

SEQ ID NO: 298469 - DNA, 25 bp, Mus musculus
agccattcggcgcttggttaataaa

SEQ ID NO: 298470 - DNA, 25 bp, Mus musculus
cgagaaactttatcagaacccgagc

SEQ ID NO: 298471 - DNA, 25 bp, Mus musculus
tgtggggaccgacccagtctacatt

SEQ ID NO: 298472 - DNA, 25 bp, Mus musculus
agtctacattcttgcgggcacggca

SEQ ID NO: 298473 - DNA, 25 bp, Mus musculus
cgtctggccgtagccgttatggatt

SEQ ID NO: 298474 - DNA, 25 bp, Mus musculus
tgggtgactcgaaagctactgttta

SEQ ID NO: 298475 - DNA, 25 bp, Mus musculus
cgtgttgtctgcgagttgacccatt

SEQ ID NO: 298476 - DNA, 25 bp, Mus musculus
gttgacccattcgagagaccttagg

SEQ ID NO: 298477 - DNA, 25 bp, Mus musculus
aaggcaggcctcatttcctcttttc

SEQ ID NO: 298478 - DNA, 25 bp, Mus musculus
ggggagccatatttgtaactttgtc

SEQ ID NO: 298479 - DNA, 25 bp, Mus musculus
tgtgcaaatgctcagataatcctcg

SEQ ID NO: 298480 - DNA, 25 bp, Mus musculus
cgtagcagcaaaaatccgaggcccg

SEQ ID NO: 298481 - DNA, 25 bp, Mus musculus
tggtgcagtctcagcctgccctgcc

SEQ ID NO: 298482 - DNA, 25 bp, Mus musculus
ctgccctgccagctggacctatgag

SEQ ID NO: 298483 - DNA, 25 bp, Mus musculus
cctgccagctggacctatgagccag

SEQ ID NO: 298484 - DNA, 25 bp, Mus musculus
tatgagccagcctgatcttcctcgg

SEQ ID NO: 298485 - DNA, 25 bp, Mus musculus
tctaagtaatgaggatggcatcacc

SEQ ID NO: 298486 - DNA, 25 bp, Mus musculus
atgaggatggcatcaccgttgcccg

SEQ ID NO: 298487 - DNA, 25 bp, Mus musculus
aggatggcatcaccgttgcccgcgc

SEQ ID NO: 298488 - DNA, 25 bp, Mus musculus
tgcctgcagagctgctttgtacgta

SEQ ID NO: 298489 - DNA, 25 bp, Mus musculus
ctgcagagctgctttgtacgtagca

SEQ ID NO: 298490 - DNA, 25 bp, Mus musculus
tgctttgtacgtagcagcaaaaatc

SEQ ID NO: 298491 - DNA, 25 bp, Mus musculus
tgtacgtagcagcaaaaatccgagg

SEQ ID NO: 298492 - DNA, 25 bp, Mus musculus
gagccagggacaagagcgagtcgca

SEQ ID NO: 298493 - DNA, 25 bp, Mus musculus
atcacccgaccgcgcggggaagagt

SEQ ID NO: 298494 - DNA, 25 bp, Mus musculus
cccagcgtggcgacgatctgcgctg

SEQ ID NO: 298495 - DNA, 25 bp, Mus musculus
gctgcttacctttgtgacagtcata

SEQ ID NO: 298496 - DNA, 25 bp, Mus musculus
tgtgacagtcatacagaaagcgggc

SEQ ID NO: 298497 - DNA, 25 bp, Mus musculus
acagtcatacagaaagcgggcggtg

SEQ ID NO: 298498 - DNA, 25 bp, Mus musculus
tcagccgcggccgagcatctataat

SEQ ID NO: 298499 - DNA, 25 bp, Mus musculus
gccgcggccgagcatctataataga

SEQ ID NO: 298500 - DNA, 25 bp, Mus musculus
atctataatagatgaggccgccgcg

SEQ ID NO: 298501 - DNA, 25 bp, Mus musculus
ccgaccggggactcgctacaaagag

SEQ ID NO: 298502 - DNA, 25 bp, Mus musculus
accggggactcgctacaaagaggag

SEQ ID NO: 298503 - DNA, 25 bp, Mus musculus
tccgggcgcccggtgaagtcacaag

SEQ ID NO: 298504 - DNA, 25 bp, Mus musculus
cccggtgaagtcacaagctggacgg

SEQ ID NO: 298505 - DNA, 25 bp, Mus musculus
cacccgctacgggtcccgcagctgc

SEQ ID NO: 298506 - DNA, 25 bp, Mus musculus
cgacgatctgcgctgcttacctttg

SEQ ID NO: 298507 - DNA, 25 bp, Mus musculus
atctgcgctgcttacctttgtgaca

SEQ ID NO: 298508 - DNA, 25 bp, Mus musculus
ggcgggcaaacgaggctatcctaaa

SEQ ID NO: 298509 - DNA, 25 bp, Mus musculus
tgggtctgcacacggtagtgttcta

SEQ ID NO: 298510 - DNA, 25 bp, Mus musculus
gttctaacagcaagcgcaccacctt

SEQ ID NO: 298511 - DNA, 25 bp, Mus musculus
gctgtcctccctgctgactgacata

SEQ ID NO: 298512 - DNA, 25 bp, Mus musculus
catagcccagcaggtagcggatatc

SEQ ID NO: 298513 - DNA, 25 bp, Mus musculus
gcggatatcgctctctgaccggtta

SEQ ID NO: 298514 - DNA, 25 bp, Mus musculus
tgaccggttaaggagcaaggcagcc

SEQ ID NO: 298515 - DNA, 25 bp, Mus musculus
agccagagtgagcaccttgccctcg

SEQ ID NO: 298516 - DNA, 25 bp, Mus musculus
tggccgccttgtacacatagccagc

SEQ ID NO: 298517 - DNA, 25 bp, Mus musculus
acgccctggatagcgagcgatgtgc

SEQ ID NO: 298518 - DNA, 25 bp, Mus musculus
gtctggaacggcctccacttagctc

SEQ ID NO: 298519 - DNA, 25 bp, Mus musculus
gcagcaccagcaccggaacttaggg

SEQ ID NO: 298520 - DNA, 25 bp, Mus musculus
tggagttgggatgtacctacccgtc

SEQ ID NO: 298521 - DNA, 25 bp, Mus musculus
gggacgcttaagtaggtattgcttc

SEQ ID NO: 298522 - DNA, 25 bp, Mus musculus
ctcgccagggttaaggaaaccgcag

SEQ ID NO: 298523 - DNA, 25 bp, Mus musculus
agccgtctctcctcccggaaggcga

SEQ ID NO: 298524 - DNA, 25 bp, Mus musculus
cccggtgtcgcgttcgtgcaggcca

SEQ ID NO: 298525 - DNA, 25 bp, Mus musculus
agtttgagagacctcgccagggtta

SEQ ID NO: 298526 - DNA, 25 bp, Mus musculus
ggaaaccgcagggataggctactcg

SEQ ID NO: 298527 - DNA, 25 bp, Mus musculus
cggccagcctggctgagtccctgtg

SEQ ID NO: 298528 - DNA, 25 bp, Mus musculus
ggctgagtccctgtgccacttccaa

SEQ ID NO: 298529 - DNA, 25 bp, Mus musculus
gagtccctgtgccacttccaagttt

SEQ ID NO: 298530 - DNA, 25 bp, Mus musculus
ctgtgccacttccaagtttttagga

SEQ ID NO: 298531 - DNA, 25 bp, Mus musculus
agtttttaggaacctcctgctctgg

SEQ ID NO: 298532 - DNA, 25 bp, Mus musculus
acctcctgctctgggcaagactgtg

SEQ ID NO: 298533 - DNA, 25 bp, Mus musculus
ctgctctgggcaagactgtgactct

SEQ ID NO: 298534 - DNA, 25 bp, Mus musculus
ctctgggcaagactgtgactctgct

SEQ ID NO: 298535 - DNA, 25 bp, Mus musculus
ccagagtttgagagacctcgccagg

SEQ ID NO: 298536 - DNA, 25 bp, Mus musculus
cgccatcttgcgtctgtcagcgcaa

SEQ ID NO: 298537 - DNA, 25 bp, Mus musculus
tggcctcagtctcatccttcggctg

SEQ ID NO: 298538 - DNA, 25 bp, Mus musculus
ccgggctcgctaaactttccaagag

SEQ ID NO: 298539 - DNA, 25 bp, Mus musculus
agagcttctccctcgtattccctag

SEQ ID NO: 298540 - DNA, 25 bp, Mus musculus
gccagaggcgcccacaacaataaca

SEQ ID NO: 298541 - DNA, 25 bp, Mus musculus
cgcctacaactccagactcgggtgg

SEQ ID NO: 298542 - DNA, 25 bp, Mus musculus
tctccgcggccgaatattagaagtg

SEQ ID NO: 298543 - DNA, 25 bp, Mus musculus
aagtgaattcgagctgcgctttacc

SEQ ID NO: 298544 - DNA, 25 bp, Mus musculus
gcgctttacctttagttccgcactg

SEQ ID NO: 298545 - DNA, 25 bp, Mus musculus
tcagcgcaagcgcaatgaagctcgc

SEQ ID NO: 298546 - DNA, 25 bp, Mus musculus
tatttaaataatggcgccaagcggg

SEQ ID NO: 298547 - DNA, 25 bp, Mus musculus
ccaagcgggagtttgacagttacta

SEQ ID NO: 298548 - DNA, 25 bp, Mus musculus
ctgcgagacccacacgcactattta

SEQ ID NO: 298549 - DNA, 25 bp, Mus musculus
tagcgcccagggaagaggccacatc

SEQ ID NO: 298550 - DNA, 25 bp, Mus musculus
gagagagtcacaccaacctcgttgg

SEQ ID NO: 298551 - DNA, 25 bp, Mus musculus
agcttctggagagagagtcacacca

SEQ ID NO: 298552 - DNA, 25 bp, Mus musculus
tcgtgagcttctggagagagagtca

SEQ ID NO: 298553 - DNA, 25 bp, Mus musculus
ctgtatttacaacggtcaggtccta

SEQ ID NO: 298554 - DNA, 25 bp, Mus musculus
acggtcaggtcctaatggcttgttc

SEQ ID NO: 298555 - DNA, 25 bp, Mus musculus
aatggcttgttcctcgctctgggcc

SEQ ID NO: 298556 - DNA, 25 bp, Mus musculus
ccactgcagcgggtatttacagaaa

SEQ ID NO: 298557 - DNA, 25 bp, Mus musculus
cgggtatttacagaaaggagcagca

SEQ ID NO: 298558 - DNA, 25 bp, Mus musculus
ttacagaaaggagcagcatggcttg

SEQ ID NO: 298559 - DNA, 25 bp, Mus musculus
tgcagtgccggggtgtcagcatctt

SEQ ID NO: 298560 - DNA, 25 bp, Mus musculus
cgggcggctgtatttacaacggtca

SEQ ID NO: 298561 - DNA, 25 bp, Mus musculus
ggtgtcagcatcttgcaggagaagt

SEQ ID NO: 298562 - DNA, 25 bp, Mus musculus
gcttgaaggagcagttgccggtgca

SEQ ID NO: 298563 - DNA, 25 bp, Mus musculus
agcatcttgcaggagaagtggtgca

SEQ ID NO: 298564 - DNA, 25 bp, Mus musculus
taggaaatctgtccaccgcccgacg

SEQ ID NO: 298565 - DNA, 25 bp, Mus musculus
gtggaacacaaagagatcgccgctc

SEQ ID NO: 298566 - DNA, 25 bp, Mus musculus
tcaattaccctctggcaagcgaccg

SEQ ID NO: 298567 - DNA, 25 bp, Mus musculus
ttcacctggcttcacctcttgcggt

SEQ ID NO: 298568 - DNA, 25 bp, Mus musculus
cagaggccaactcggacggtaagga

SEQ ID NO: 298569 - DNA, 25 bp, Mus musculus
gccagcgtttcgacccagaggccaa

SEQ ID NO: 298570 - DNA, 25 bp, Mus musculus
acctgtggcagtccggtaggaaatc

SEQ ID NO: 298571 - DNA, 25 bp, Mus musculus
tcgggaaaattcctgaagcagtacc

SEQ ID NO: 298572 - DNA, 25 bp, Mus musculus
ctagctgcggcctgaacagtagtgc

SEQ ID NO: 298573 - DNA, 25 bp, Mus musculus
gtgattcacttctagtcccgggtgg

SEQ ID NO: 298574 - DNA, 25 bp, Mus musculus
gacggaatggcgctcttgtgttaca

SEQ ID NO: 298575 - DNA, 25 bp, Mus musculus
ccctggtgtctcatctataactgtc

SEQ ID NO: 298576 - DNA, 25 bp, Mus musculus
tcttgtgttacaaccgcggctgtgg

SEQ ID NO: 298577 - DNA, 25 bp, Mus musculus
aactgtccggatccacccgactgtg

SEQ ID NO: 298578 - DNA, 25 bp, Mus musculus
accgagtttcaaggagaggcaaaga

SEQ ID NO: 298579 - DNA, 25 bp, Mus musculus
cggctgtcgtcgagtgattgtcttc

SEQ ID NO: 298580 - DNA, 25 bp, Mus musculus
ggctctaaaaggcagaccgagtttc

SEQ ID NO: 298581 - DNA, 25 bp, Mus musculus
acccggatactgcagagcggcctcg

SEQ ID NO: 298582 - DNA, 25 bp, Mus musculus
attaaaaacgtcgtggccgcctctg

SEQ ID NO: 298583 - DNA, 25 bp, Mus musculus
ctgcacaaggtctgctccgttccgg

SEQ ID NO: 298584 - DNA, 25 bp, Mus musculus
gagcccaccagggacaagcgaccta

SEQ ID NO: 298585 - DNA, 25 bp, Mus musculus
gcgacctacattgcgtgcgcagata

SEQ ID NO: 298586 - DNA, 25 bp, Mus musculus
ttgtccgcgccactccagcagagat

SEQ ID NO: 298587 - DNA, 25 bp, Mus musculus
tccagcagagatcgtaacccaagtg

SEQ ID NO: 298588 - DNA, 25 bp, Mus musculus
ccaagtgacaaccttccgggcattg

SEQ ID NO: 298589 - DNA, 25 bp, Mus musculus
tccgggcattggtgttgtaggacac

SEQ ID NO: 298590 - DNA, 25 bp, Mus musculus
ttgtaggacactgtcccgcacccgg

SEQ ID NO: 298591 - DNA, 25 bp, Mus musculus
gattgtcttccttatccggctctaa

SEQ ID NO: 298592 - DNA, 25 bp, Mus musculus
ccagaacattgtgccgccaccaggg

SEQ ID NO: 298593 - DNA, 25 bp, Mus musculus
tgcgcgtaccgccattaaacatagc

SEQ ID NO: 298594 - DNA, 25 bp, Mus musculus
ttcaccgcagcgcagacttttgtgg

SEQ ID NO: 298595 - DNA, 25 bp, Mus musculus
tggaatcaccgggtagctgcgaacc

SEQ ID NO: 298596 - DNA, 25 bp, Mus musculus
acctttgctgggcactggaatcacc

SEQ ID NO: 298597 - DNA, 25 bp, Mus musculus
ggggcagcttttgcaagaggccaaa

SEQ ID NO: 298598 - DNA, 25 bp, Mus musculus
gccgaatgctgtggggaaaccgtaa

SEQ ID NO: 298599 - DNA, 25 bp, Mus musculus
cctttttgggacataggccgaatgc

SEQ ID NO: 298600 - DNA, 25 bp, Mus musculus
gttctccggcgaccaacactgggtc

SEQ ID NO: 298601 - DNA, 25 bp, Mus musculus
ttgacgtcctcccaagcgtggctca

SEQ ID NO: 298602 - DNA, 25 bp, Mus musculus
ctcggcaccgtccaaagactcagga

SEQ ID NO: 298603 - DNA, 25 bp, Mus musculus
ctgacacgtaggagcttttgcgagc

SEQ ID NO: 298604 - DNA, 25 bp, Mus musculus
cgctacggccttagcttggctctga

SEQ ID NO: 298605 - DNA, 25 bp, Mus musculus
tgctggccagaacatgggaaacgtc

SEQ ID NO: 298606 - DNA, 25 bp, Mus musculus
gatcggcctgtacgccaagcacctg

SEQ ID NO: 298607 - DNA, 25 bp, Mus musculus
tctcggactacacgcagacgctgtc

SEQ ID NO: 298608 - DNA, 25 bp, Mus musculus
cgcatctcggccatgtccaaggaca

SEQ ID NO: 298609 - DNA, 25 bp, Mus musculus
gtgaccagggccatctcggactaca

SEQ ID NO: 298610 - DNA, 25 bp, Mus musculus
tcaaccagaccaagggcttcccgtg

SEQ ID NO: 298611 - DNA, 25 bp, Mus musculus
aagttctaccagatgaccggccgcg

SEQ ID NO: 298612 - DNA, 25 bp, Mus musculus
tgcgtgacttttaccggcccttcaa

SEQ ID NO: 298613 - DNA, 25 bp, Mus musculus
aagccgcactgcctgggcaagacta

SEQ ID NO: 298614 - DNA, 25 bp, Mus musculus
gcttcgagagcctgacgttccgcaa

SEQ ID NO: 298615 - DNA, 25 bp, Mus musculus
gcatcatcaccgacaagcacttcta

SEQ ID NO: 298616 - DNA, 25 bp, Mus musculus
gatttcctgggcctcaagcgcatca

SEQ ID NO: 298617 - DNA, 25 bp, Mus musculus
gcgggcctcatagacacgtcctgga

SEQ ID NO: 298618 - DNA, 25 bp, Mus musculus
ggagcgccatccagatcggcctgta

SEQ ID NO: 298619 - DNA, 25 bp, Mus musculus
cgctcggccagatgctcttcgtgag

SEQ ID NO: 298620 - DNA, 25 bp, Mus musculus
ggaaacaaccgccacagagtctaaa

SEQ ID NO: 298621 - DNA, 25 bp, Mus musculus
cccgaagaagaagccgaagcctaga

SEQ ID NO: 298622 - DNA, 25 bp, Mus musculus
ggactggcccgaagaagaagccgaa

SEQ ID NO: 298623 - DNA, 25 bp, Mus musculus
gctctcaacaggcacggggcgccag

SEQ ID NO: 298624 - DNA, 25 bp, Mus musculus
atcgcaggtactcaccgtgcgggcg

SEQ ID NO: 298625 - DNA, 25 bp, Mus musculus
tcgcgatcgcaggtactcaccgtgc

SEQ ID NO: 298626 - DNA, 25 bp, Mus musculus
tgggctcgcgatcgcaggtactcac

SEQ ID NO: 298627 - DNA, 25 bp, Mus musculus
tcaacgaaagaagcgctgcggcggc

SEQ ID NO: 298628 - DNA, 25 bp, Mus musculus
ggctgtggagtcgtttgttaggata

SEQ ID NO: 298629 - DNA, 25 bp, Mus musculus
cgccacagagtctaaaggagaagtc

SEQ ID NO: 298630 - DNA, 25 bp, Mus musculus
tgttaggataggaaacaaccgccac

SEQ ID NO: 298631 - DNA, 25 bp, Mus musculus
gaagcctagagctcatgcgcgcagc

SEQ ID NO: 298632 - DNA, 25 bp, Mus musculus
ggagaagtcaacgaaagaagcgctg

SEQ ID NO: 298633 - DNA, 25 bp, Mus musculus
gcgagcctagcgaggttaagcaggc

SEQ ID NO: 298634 - DNA, 25 bp, Mus musculus
gaaggcggccgttagaccgctgtta

SEQ ID NO: 298635 - DNA, 25 bp, Mus musculus
ggagccgacatgtgggacccgcctc

SEQ ID NO: 298636 - DNA, 25 bp, Mus musculus
gaaccaaaacgcgatggcgccggaa

SEQ ID NO: 298637 - DNA, 25 bp, Mus musculus
tccggaaccaaaacgcgatggcgcc

SEQ ID NO: 298638 - DNA, 25 bp, Mus musculus
tactccggaaccaaaacgcgatggc

SEQ ID NO: 298639 - DNA, 25 bp, Mus musculus
tagaccgctgttactccggaaccaa

SEQ ID NO: 298640 - DNA, 25 bp, Mus musculus
cgacatgtgggacccgcctcctggg

SEQ ID NO: 298641 - DNA, 25 bp, Mus musculus
ggcggccgttagaccgctgttactc

SEQ ID NO: 298642 - DNA, 25 bp, Mus musculus
ggatcgtccgactgaggcccgcgtc

SEQ ID NO: 298643 - DNA, 25 bp, Mus musculus
cgtgcaggatcgtccgactgaggcc

SEQ ID NO: 298644 - DNA, 25 bp, Mus musculus
gtggcgcctgccctccaaccaggca

SEQ ID NO: 298645 - DNA, 25 bp, Mus musculus
cgtcctgagtgtctcggtgggcaag

SEQ ID NO: 298646 - DNA, 25 bp, Mus musculus
tttcggaggtgcaccggtggcgcct

SEQ ID NO: 298647 - DNA, 25 bp, Mus musculus
gccgttagaccgctgttactccgga

SEQ ID NO: 298648 - DNA, 25 bp, Mus musculus
actggtcgttgtggaccgcactgta

SEQ ID NO: 298649 - DNA, 25 bp, Mus musculus
gcagcagccgcagcgtagcctcgtg

SEQ ID NO: 298650 - DNA, 25 bp, Mus musculus
gtgctgcgtcagcacctccgaggcg

SEQ ID NO: 298651 - DNA, 25 bp, Mus musculus
acgcagaaggaagtccagtgcggca

SEQ ID NO: 298652 - DNA, 25 bp, Mus musculus
gaccgcactgtagggcacgcagaag

SEQ ID NO: 298653 - DNA, 25 bp, Mus musculus
acaggccgaactggtcgttgtggac

SEQ ID NO: 298654 - DNA, 25 bp, Mus musculus
caattgaagtgcgacaggccgaact

SEQ ID NO: 298655 - DNA, 25 bp, Mus musculus
gacgtggtagttggcgcccagcacc

SEQ ID NO: 298656 - DNA, 25 bp, Mus musculus
gccttggagcagtggtacttgatga

SEQ ID NO: 298657 - DNA, 25 bp, Mus musculus
ccaggtcctgccagggcgccttgga

SEQ ID NO: 298658 - DNA, 25 bp, Mus musculus
ttgatgaccttgagcgcggtgaaga

SEQ ID NO: 298659 - DNA, 25 bp, Mus musculus
ccactcacccaggttgatgaccttg

SEQ ID NO: 298660 - DNA, 25 bp, Mus musculus
cccagcaccggccaattgaagtgcg

SEQ ID NO: 298661 - DNA, 25 bp, Mus musculus
tagggcacgcagaaggaagtccagt

SEQ ID NO: 298662 - DNA, 25 bp, Mus musculus
ggctggtgcaacgtgagtaacccga

SEQ ID NO: 298663 - DNA, 25 bp, Mus musculus
agcgctcctagatggtgcgggcacc

SEQ ID NO: 298664 - DNA, 25 bp, Mus musculus
gtgcgggcacccgtcaccatagcaa

SEQ ID NO: 298665 - DNA, 25 bp, Mus musculus
cgtcaccatagcaacgcggcgcgcg

SEQ ID NO: 298666 - DNA, 25 bp, Mus musculus
tgcccgctgcagtggtacggcccaa

SEQ ID NO: 298667 - DNA, 25 bp, Mus musculus
ggaacccgctctgccgcagcgatgg

SEQ ID NO: 298668 - DNA, 25 bp, Mus musculus
gcagcgatggctgccggtgtaccct

SEQ ID NO: 298669 - DNA, 25 bp, Mus musculus
cttcaccggggaccggctggtgcaa

SEQ ID NO: 298670 - DNA, 25 bp, Mus musculus
cgtgagtaacccgacgtctgagccg

SEQ ID NO: 298671 - DNA, 25 bp, Mus musculus
acccgacgtctgagccgggctgcaa

SEQ ID NO: 298672 - DNA, 25 bp, Mus musculus
gcccagttcagagccatgggcgcag

SEQ ID NO: 298673 - DNA, 25 bp, Mus musculus
ctctgcccgagctgggccctaggct

SEQ ID NO: 298674 - DNA, 25 bp, Mus musculus
gccgggctgcaaggcccagttcaga

SEQ ID NO: 298675 - DNA, 25 bp, Mus musculus
gtaccctgcgcgctggttaccagct

SEQ ID NO: 298676 - DNA, 25 bp, Mus musculus
tgccgcctccgggaaggaaagtcca

SEQ ID NO: 298677 - DNA, 25 bp, Mus musculus
tcacgttctgcgtggtgatggcctt

SEQ ID NO: 298678 - DNA, 25 bp, Mus musculus
agtctacgtttcacgcagctccgcg

SEQ ID NO: 298679 - DNA, 25 bp, Mus musculus
tgatggccttctccagctcgtccaa

SEQ ID NO: 298680 - DNA, 25 bp, Mus musculus
cgtcttcttgagcttcttcaccaag

SEQ ID NO: 298681 - DNA, 25 bp, Mus musculus
acatggctggcaccgaagggtcacc

SEQ ID NO: 298682 - DNA, 25 bp, Mus musculus
cgaacttcgcttttaactctggaga

SEQ ID NO: 298683 - DNA, 25 bp, Mus musculus
ccaaactttgctggcctggatggct

SEQ ID NO: 298684 - DNA, 25 bp, Mus musculus
gcagtagaaagtttgggtttccgca

SEQ ID NO: 298685 - DNA, 25 bp, Mus musculus
gccgcgagactccaagtggcagtag

SEQ ID NO: 298686 - DNA, 25 bp, Mus musculus
aatgcacttggtgttcacgttctgc

SEQ ID NO: 298687 - DNA, 25 bp, Mus musculus
tgctccacgcggaccgacggactga

SEQ ID NO: 298688 - DNA, 25 bp, Mus musculus
cccacctggggatggtaatgcactt

SEQ ID NO: 298689 - DNA, 25 bp, Mus musculus
ggatggctttggtgcgcagatccct

SEQ ID NO: 298690 - DNA, 25 bp, Mus musculus
gccgctctgtacttatcctgatgaa

SEQ ID NO: 298691 - DNA, 25 bp, Mus musculus
acttatcctgatgaagggttccgtg

SEQ ID NO: 298692 - DNA, 25 bp, Mus musculus
ctgtacttatcctgatgaagggttc

SEQ ID NO: 298693 - DNA, 25 bp, Mus musculus
cctgatgaagggttccgtggcccta

SEQ ID NO: 298694 - DNA, 25 bp, Mus musculus
gtctggctctcagcccagcggggac

SEQ ID NO: 298695 - DNA, 25 bp, Mus musculus
ctgatgaagggttccgtggccctaa

SEQ ID NO: 298696 - DNA, 25 bp, Mus musculus
cgtggccctaatggccgggcgggct

SEQ ID NO: 298697 - DNA, 25 bp, Mus musculus
ggtcccgtgcttctctcgcaggcgg

SEQ ID NO: 298698 - DNA, 25 bp, Mus musculus
cgctctgtacttatcctgatgaagg

SEQ ID NO: 298699 - DNA, 25 bp, Mus musculus
cggggaccgcgagctgccctgaccc

SEQ ID NO: 298700 - DNA, 25 bp, Mus musculus
ttccagggccgctctgtacttatcc

SEQ ID NO: 298701 - DNA, 25 bp, Mus musculus
gggccgctctgtacttatcctgatg

SEQ ID NO: 298702 - DNA, 25 bp, Mus musculus
tatcctgatgaagggttccgtggcc

SEQ ID NO: 298703 - DNA, 25 bp, Mus musculus
ccggcccagccggtcccgtgcttct

SEQ ID NO: 298704 - DNA, 25 bp, Mus musculus
tgacagcctggtcgtacaccgcata

SEQ ID NO: 298705 - DNA, 25 bp, Mus musculus
ccctgaggtaggtcgtagaaaatgc

SEQ ID NO: 298706 - DNA, 25 bp, Mus musculus
gactcactgcgctgctccaggttga

SEQ ID NO: 298707 - DNA, 25 bp, Mus musculus
caaaaccgatcttgctgcgcgtgcg

SEQ ID NO: 298708 - DNA, 25 bp, Mus musculus
gagcagtatgccaaaaccgatcttg

SEQ ID NO: 298709 - DNA, 25 bp, Mus musculus
taacccggtggcaccttgcgcacga

SEQ ID NO: 298710 - DNA, 25 bp, Mus musculus
ttgtaggcccacacgccgtctggct

SEQ ID NO: 298711 - DNA, 25 bp, Mus musculus
tctggctccttgctgagcagtatgc

SEQ ID NO: 298712 - DNA, 25 bp, Mus musculus
cacgctgcaccagtggctcggcttg

SEQ ID NO: 298713 - DNA, 25 bp, Mus musculus
cgaacaccttgatggagtaacccgg

SEQ ID NO: 298714 - DNA, 25 bp, Mus musculus
gcccttggcgaagctgatgcgcaca

SEQ ID NO: 298715 - DNA, 25 bp, Mus musculus
tctgcgtgctgcagcagccctgagc

SEQ ID NO: 298716 - DNA, 25 bp, Mus musculus
gtacaccgcatagaggcggcccacg

SEQ ID NO: 298717 - DNA, 25 bp, Mus musculus
tgagcgctcaaagtcgaacaccttg

SEQ ID NO: 298718 - DNA, 25 bp, Mus musculus
ctttggagccttagggaagccacca

SEQ ID NO: 298719 - DNA, 25 bp, Mus musculus
gaacacgtcccattgctgagcccga

SEQ ID NO: 298720 - DNA, 25 bp, Mus musculus
ccttcaaaagttgcgcggctggtac

SEQ ID NO: 298721 - DNA, 25 bp, Mus musculus
ctggtacacgagcacaaagcgcttg

SEQ ID NO: 298722 - DNA, 25 bp, Mus musculus
tgggctttccctgcaggatccgaaa

SEQ ID NO: 298723 - DNA, 25 bp, Mus musculus
tgcttggattttgcacgcacgaaaa

SEQ ID NO: 298724 - DNA, 25 bp, Mus musculus
gaccgctcaactccagctgctttgg

SEQ ID NO: 298725 - DNA, 25 bp, Mus musculus
agtctctcctgaacgcgggtgtcaa

SEQ ID NO: 298726 - DNA, 25 bp, Mus musculus
ccagcgggctacatggatcacgatg

SEQ ID NO: 298727 - DNA, 25 bp, Mus musculus
cccaaagagctgctaggaatcctta

SEQ ID NO: 298728 - DNA, 25 bp, Mus musculus
gcggctctttctctggactcagctc

SEQ ID NO: 298729 - DNA, 25 bp, Mus musculus
gagtcattggctgcctcccatcata

SEQ ID NO: 298730 - DNA, 25 bp, Mus musculus
cgcggcgctgattgttgcgcaaaca

SEQ ID NO: 298731 - DNA, 25 bp, Mus musculus
agtctagacactttggcggctccgc

SEQ ID NO: 298732 - DNA, 25 bp, Mus musculus
ggcgctctttctcaactcgactaaa

SEQ ID NO: 298733 - DNA, 25 bp, Mus musculus
ggctggcgctctttctcaactcgac

SEQ ID NO: 298734 - DNA, 25 bp, Mus musculus
gctctttctcaactcgactaaaaac

SEQ ID NO: 298735 - DNA, 25 bp, Mus musculus
gcgctgactcctccttcagttccgc

SEQ ID NO: 298736 - DNA, 25 bp, Mus musculus
ttcccagccgccgaagacgcccacc

SEQ ID NO: 298737 - DNA, 25 bp, Mus musculus
ctcgaggttcacttccgcccaaaag

SEQ ID NO: 298738 - DNA, 25 bp, Mus musculus
tgtccgggttttagggcagattaca

SEQ ID NO: 298739 - DNA, 25 bp, Mus musculus
ttttagggcagattacacgtctgtg

SEQ ID NO: 298740 - DNA, 25 bp, Mus musculus
gggcagattacacgtctgtggtccc

SEQ ID NO: 298741 - DNA, 25 bp, Mus musculus
ctgagcgccgcctcgaggttcactt

SEQ ID NO: 298742 - DNA, 25 bp, Mus musculus
cacacaccgagtcgcccttcccagc

SEQ ID NO: 298743 - DNA, 25 bp, Mus musculus
agatcgaccacatccgctgcgctga

SEQ ID NO: 298744 - DNA, 25 bp, Mus musculus
tctgtggtccccttcgtattgtacg

SEQ ID NO: 298745 - DNA, 25 bp, Mus musculus
aaacccgtgtacacacaccgagtcg

SEQ ID NO: 298746 - DNA, 25 bp, Mus musculus
gacagtgagccagttctcccgcgca

SEQ ID NO: 298747 - DNA, 25 bp, Mus musculus
cggcgggacagtgagccagttctcc

SEQ ID NO: 298748 - DNA, 25 bp, Mus musculus
gggacagtgagccagttctcccgcg

SEQ ID NO: 298749 - DNA, 25 bp, Mus musculus
agtgagccagttctcccgcgcacag

SEQ ID NO: 298750 - DNA, 25 bp, Mus musculus
tgagccagttctcccgcgcacagcc

SEQ ID NO: 298751 - DNA, 25 bp, Mus musculus
ccgccagcgcggagccggcacagct

SEQ ID NO: 298752 - DNA, 25 bp, Mus musculus
cggcagacagtgataaggcggctcc

SEQ ID NO: 298753 - DNA, 25 bp, Mus musculus
gcagacagtgataaggcggctccga

SEQ ID NO: 298754 - DNA, 25 bp, Mus musculus
cagacagtgataaggcggctccgag

SEQ ID NO: 298755 - DNA, 25 bp, Mus musculus
gaggccaggctcagacatccggccg

SEQ ID NO: 298756 - DNA, 25 bp, Mus musculus
aggctcagacatccggccgctcggg

SEQ ID NO: 298757 - DNA, 25 bp, Mus musculus
cctggccaccccagtgttcactctg

SEQ ID NO: 298758 - DNA, 25 bp, Mus musculus
cactctgccgcctccaggggcccgc

SEQ ID NO: 298759 - DNA, 25 bp, Mus musculus
gcgggacagtgagccagttctcccg

SEQ ID NO: 298760 - DNA, 25 bp, Mus musculus
cgagctccaaggctcgttacgattg

SEQ ID NO: 298761 - DNA, 25 bp, Mus musculus
ggggcccgaacaccgtgtacctgca

SEQ ID NO: 298762 - DNA, 25 bp, Mus musculus
cactgcgacacctgcgtacgcggga

SEQ ID NO: 298763 - DNA, 25 bp, Mus musculus
caccatgtcgcagggttcggctcgt

SEQ ID NO: 298764 - DNA, 25 bp, Mus musculus
gctgccttgtcagcctggtgtggtc

SEQ ID NO: 298765 - DNA, 25 bp, Mus musculus
tcgttacgattggatgcggagcttt

SEQ ID NO: 298766 - DNA, 25 bp, Mus musculus
ccttgattgacagactccgagctcc

SEQ ID NO: 298767 - DNA, 25 bp, Mus musculus
ccggcgacgctctagctttcgctta

SEQ ID NO: 298768 - DNA, 25 bp, Mus musculus
gggctgctctctatgtcttctcgga

SEQ ID NO: 298769 - DNA, 25 bp, Mus musculus
gcttactctacgtccaccttgattg

SEQ ID NO: 298770 - DNA, 25 bp, Mus musculus
tgattggtcagttccgccatgcggt

SEQ ID NO: 298771 - DNA, 25 bp, Mus musculus
gtcttctcggaatacaacaggtcag

SEQ ID NO: 298772 - DNA, 25 bp, Mus musculus
tacaacaggtcagagtgggccgaca

SEQ ID NO: 298773 - DNA, 25 bp, Mus musculus
cgcttccgccaagtgacagtaaccg

SEQ ID NO: 298774 - DNA, 25 bp, Mus musculus
cgagatctggatactgaggtgctcc

SEQ ID NO: 298775 - DNA, 25 bp, Mus musculus
gaggtaggctcagccctcgccagct

SEQ ID NO: 298776 - DNA, 25 bp, Mus musculus
agctcggcgtccgataaggcgggag

SEQ ID NO: 298777 - DNA, 25 bp, Mus musculus
ggagcgcagataacgcccggcactc

SEQ ID NO: 298778 - DNA, 25 bp, Mus musculus
actccggcgcccgagactgcgagac

SEQ ID NO: 298779 - DNA, 25 bp, Mus musculus
gagactgcgagacgccgaggccaca

SEQ ID NO: 298780 - DNA, 25 bp, Mus musculus
cccaacgccaggtccctgagtgcca

SEQ ID NO: 298781 - DNA, 25 bp, Mus musculus
agtgccaggtcgctcaccctcgaag

SEQ ID NO: 298782 - DNA, 25 bp, Mus musculus
ccaagcctgactctgcacgagatct

SEQ ID NO: 298783 - DNA, 25 bp, Mus musculus
actctgcacgagatctggatactga

SEQ ID NO: 298784 - DNA, 25 bp, Mus musculus
ctggatactgaggtgctcccgtttc

SEQ ID NO: 298785 - DNA, 25 bp, Mus musculus
atactgaggtgctcccgtttccacg

SEQ ID NO: 298786 - DNA, 25 bp, Mus musculus
tgaggtgctcccgtttccacgggcg

SEQ ID NO: 298787 - DNA, 25 bp, Mus musculus
cctgactctgcacgagatctggata

SEQ ID NO: 298788 - DNA, 25 bp, Mus musculus
aaggcagcgccctaaggaagtggaa

SEQ ID NO: 298789 - DNA, 25 bp, Mus musculus
aaaccctgctgcgtctaaaggcggc

SEQ ID NO: 298790 - DNA, 25 bp, Mus musculus
gatgttgagtcgactgcaggagctc

SEQ ID NO: 298791 - DNA, 25 bp, Mus musculus
agcaggtttagctcctgagcccgca

SEQ ID NO: 298792 - DNA, 25 bp, Mus musculus
ctagtagaaggcagcgccctaagga

SEQ ID NO: 298793 - DNA, 25 bp, Mus musculus
ccgctaggtgttgagcaggtttagc

SEQ ID NO: 298794 - DNA, 25 bp, Mus musculus
ggtacagctccaggccgctaggtgt

SEQ ID NO: 298795 - DNA, 25 bp, Mus musculus
agcgtacagctttccagctctagcc

SEQ ID NO: 298796 - DNA, 25 bp, Mus musculus
cgaccaactgaaccgcctcaaggtg

SEQ ID NO: 298797 - DNA, 25 bp, Mus musculus
aggcggctctacacgaccaactgaa

SEQ ID NO: 298798 - DNA, 25 bp, Mus musculus
gctgcgtctaaaggcggctctacac

SEQ ID NO: 298799 - DNA, 25 bp, Mus musculus
tcatcaccgcgcgcctagtagaagg

SEQ ID NO: 298800 - DNA, 25 bp, Mus musculus
gcctcaaggtgagcgtacagctttc

SEQ ID NO: 298801 - DNA, 25 bp, Mus musculus
aggaggaaaccctgctgcgtctaaa

SEQ ID NO: 298802 - DNA, 25 bp, Mus musculus
cgagctggtcccgttaaccgccgag

SEQ ID NO: 298803 - DNA, 25 bp, Mus musculus
cagcggtatccaggtggctgctgta

SEQ ID NO: 298804 - DNA, 25 bp, Mus musculus
ggcgccctctgctgaccagcggtat

SEQ ID NO: 298805 - DNA, 25 bp, Mus musculus
ctcagaggcagatgacgcggaaata

SEQ ID NO: 298806 - DNA, 25 bp, Mus musculus
acagccaatggggactagcctcaga

SEQ ID NO: 298807 - DNA, 25 bp, Mus musculus
cgtcgcttcgccgacagccaatggg

SEQ ID NO: 298808 - DNA, 25 bp, Mus musculus
cgcgcacagacgtcccagtgaggga

SEQ ID NO: 298809 - DNA, 25 bp, Mus musculus
ccagcttggagaaagtgcggccacc

SEQ ID NO: 298810 - DNA, 25 bp, Mus musculus
cagccgggaaagagcctgcaactca

SEQ ID NO: 298811 - DNA, 25 bp, Mus musculus
ggccgtacgtgacgaagcctcgcct

SEQ ID NO: 298812 - DNA, 25 bp, Mus musculus
ggctgctgtacgaggttcttgcacg

SEQ ID NO: 298813 - DNA, 25 bp, Mus musculus
tcggcttcttcttgggcatcttgca

SEQ ID NO: 298814 - DNA, 25 bp, Mus musculus
agcacaccggttcctcgggctcgga

SEQ ID NO: 298815 - DNA, 25 bp, Mus musculus
ccggtactcactcggccgagctggt

SEQ ID NO: 298816 - DNA, 25 bp, Mus musculus
caaatttctcagcttgtctcgcgga

SEQ ID NO: 298817 - DNA, 25 bp, Mus musculus
atttctggagctaataaagcgccca

SEQ ID NO: 298818 - DNA, 25 bp, Mus musculus
cccggagacctatttctggagctaa

SEQ ID NO: 298819 - DNA, 25 bp, Mus musculus
aaagcgcccagaactcattgccgtc

SEQ ID NO: 298820 - DNA, 25 bp, Mus musculus
attgccgtcccagacattccggatg

SEQ ID NO: 298821 - DNA, 25 bp, Mus musculus
gtcccagacattccggatgggtagg

SEQ ID NO: 298822 - DNA, 25 bp, Mus musculus
tacccttggcgccaaatttctcagc

SEQ ID NO: 298823 - DNA, 25 bp, Mus musculus
gtgacatccctagggctggcgccga

SEQ ID NO: 298824 - DNA, 25 bp, Mus musculus
ctcagcttgtctcgcggagccgagt

SEQ ID NO: 298825 - DNA, 25 bp, Mus musculus
tgagaccggtttctgtgagcgcaga

SEQ ID NO: 298826 - DNA, 25 bp, Mus musculus
ccggtttctgtgagcgcagattttg

SEQ ID NO: 298827 - DNA, 25 bp, Mus musculus
cgcagattttggaagtggagcccgc

SEQ ID NO: 298828 - DNA, 25 bp, Mus musculus
gccgcgcgcacggacctagctgaga

SEQ ID NO: 298829 - DNA, 25 bp, Mus musculus
tttggaagtggagcccgcgttgcaa

SEQ ID NO: 298830 - DNA, 25 bp, Mus musculus
gtagtgttcacgcacgatccgcagc

SEQ ID NO: 298831 - DNA, 25 bp, Mus musculus
ggctgagaatcctccgggcccagtc

SEQ ID NO: 298832 - DNA, 25 bp, Mus musculus
agcgacctagccagggctgagaatc

SEQ ID NO: 298833 - DNA, 25 bp, Mus musculus
ggcagcagcgttcacgttcccgcta

SEQ ID NO: 298834 - DNA, 25 bp, Mus musculus
cttctgcagcatgctggcggcgtcg

SEQ ID NO: 298835 - DNA, 25 bp, Mus musculus
agcccagacggttatgctcgctccg

SEQ ID NO: 298836 - DNA, 25 bp, Mus musculus
gatccgcagcgtccgaccctggaag

SEQ ID NO: 298837 - DNA, 25 bp, Mus musculus
acgctgggccgcaggtagtgttcac

SEQ ID NO: 298838 - DNA, 25 bp, Mus musculus
acagcgggctgttgcaaggcacgct

SEQ ID NO: 298839 - DNA, 25 bp, Mus musculus
ctttggtcctggcttccctcgttct

SEQ ID NO: 298840 - DNA, 25 bp, Mus musculus
ttccctttgctctttgggcctctgc

SEQ ID NO: 298841 - DNA, 25 bp, Mus musculus
tgggtcccgcttccttcactagggc

SEQ ID NO: 298842 - DNA, 25 bp, Mus musculus
cctacagtccgcgagggtctggctc

SEQ ID NO: 298843 - DNA, 25 bp, Mus musculus
ccctggaaggtcctcagcagcagca

SEQ ID NO: 298844 - DNA, 25 bp, Mus musculus
tgctctcgagaaaaaccggtccaag

SEQ ID NO: 298845 - DNA, 25 bp, Mus musculus
tcccggctctagaaggcgagtttgg

SEQ ID NO: 298846 - DNA, 25 bp, Mus musculus
atcccactgtcgtcgcgtctcagaa

SEQ ID NO: 298847 - DNA, 25 bp, Mus musculus
gacggagtcacgatcggtctgtagt

SEQ ID NO: 298848 - DNA, 25 bp, Mus musculus
cggtagtgttgtagctgggcacaca

SEQ ID NO: 298849 - DNA, 25 bp, Mus musculus
agaagcgagtccctcttcctgcgct

SEQ ID NO: 298850 - DNA, 25 bp, Mus musculus
tgatcctgtctacccactttcactg

SEQ ID NO: 298851 - DNA, 25 bp, Mus musculus
cgcgcaacgtggactcactctcttt

SEQ ID NO: 298852 - DNA, 25 bp, Mus musculus
gccattctagatgtgcgggaccttc

SEQ ID NO: 298853 - DNA, 25 bp, Mus musculus
tctcccggccgagagccattctaga

SEQ ID NO: 298854 - DNA, 25 bp, Mus musculus
aacctgccagctctgcgcgaatctg

SEQ ID NO: 298855 - DNA, 25 bp, Mus musculus
ggtgtccggaagaaggaacctgcca

SEQ ID NO: 298856 - DNA, 25 bp, Mus musculus
gtctatgcgagacgtagagagcctc

SEQ ID NO: 298857 - DNA, 25 bp, Mus musculus
cccagatgctttttcctggaactgc

SEQ ID NO: 298858 - DNA, 25 bp, Mus musculus
tctgcgctcctggtactcacggcaa

SEQ ID NO: 298859 - DNA, 25 bp, Mus musculus
gcgcactggcgagtgcctctgcgct

SEQ ID NO: 298860 - DNA, 25 bp, Mus musculus
agaacggcgccctgtgcaaccctat

SEQ ID NO: 298861 - DNA, 25 bp, Mus musculus
tgtcagtgtcagaacggcgccctgt

SEQ ID NO: 298862 - DNA, 25 bp, Mus musculus
ctcctggctacacaggcgtttagtg

SEQ ID NO: 298863 - DNA, 25 bp, Mus musculus
gcgagtgcctctgcgctcctggcta

SEQ ID NO: 298864 - DNA, 25 bp, Mus musculus
tacacaggcgtttagtgagtagcga

SEQ ID NO: 298865 - DNA, 25 bp, Mus musculus
ctgtgacccgcgcactggcgagtgc

SEQ ID NO: 298866 - DNA, 25 bp, Mus musculus
tcagtgccaccatggcgccagctgt

SEQ ID NO: 298867 - DNA, 25 bp, Mus musculus
agctgctctgtcagtgccaccatgg

SEQ ID NO: 298868 - DNA, 25 bp, Mus musculus
tactcacggcaagggctgccagctg

SEQ ID NO: 298869 - DNA, 25 bp, Mus musculus
tcctggtactcacggcaagggctgc

SEQ ID NO: 298870 - DNA, 25 bp, Mus musculus
tgtgcaaccctatcaccggcgcctg

SEQ ID NO: 298871 - DNA, 25 bp, Mus musculus
gcgctcctggctacacaggcgttta

SEQ ID NO: 298872 - DNA, 25 bp, Mus musculus
cacggcctcacctttaaagaggtag

SEQ ID NO: 298873 - DNA, 25 bp, Mus musculus
taaagaggtagtcgtactcgtcgtc

SEQ ID NO: 298874 - DNA, 25 bp, Mus musculus
ctgcaggggtaacccgagcgagcga

SEQ ID NO: 298875 - DNA, 25 bp, Mus musculus
cttcagctgccggacccggtgacga

SEQ ID NO: 298876 - DNA, 25 bp, Mus musculus
cccgccctgtatgcgtcacttccgg

SEQ ID NO: 298877 - DNA, 25 bp, Mus musculus
ccctcgcagaaagtacttccggaga

SEQ ID NO: 298878 - DNA, 25 bp, Mus musculus
cccagggaaggaactgcacggccgt

SEQ ID NO: 298879 - DNA, 25 bp, Mus musculus
agtcgtactcgtcgtcgcgggtgcc

SEQ ID NO: 298880 - DNA, 25 bp, Mus musculus
caaatgggctctcgctggcccacgg

SEQ ID NO: 298881 - DNA, 25 bp, Mus musculus
gctcgagacgcccagggaaggaact

SEQ ID NO: 298882 - DNA, 25 bp, Mus musculus
gtgagacgagcagcagcatccaaga

SEQ ID NO: 298883 - DNA, 25 bp, Mus musculus
cacggccgtgagggacgcagccatc

SEQ ID NO: 298884 - DNA, 25 bp, Mus musculus
agccatcggggaggacatacagaga

SEQ ID NO: 298885 - DNA, 25 bp, Mus musculus
aagtacttccggagagatggcaccc

SEQ ID NO: 298886 - DNA, 25 bp, Mus musculus
cctgtgattggtttttgttgccata

SEQ ID NO: 298887 - DNA, 25 bp, Mus musculus
ctcgggtcagattcggcctgtgatt

SEQ ID NO: 298888 - DNA, 25 bp, Mus musculus
tttaccgtcactcccaagatggcgc

SEQ ID NO: 298889 - DNA, 25 bp, Mus musculus
atgagctaagctggctgcaagcgcc

SEQ ID NO: 298890 - DNA, 25 bp, Mus musculus
catcggtggcatagggagctgtcac

SEQ ID NO: 298891 - DNA, 25 bp, Mus musculus
gcatgaggggatcagactctgcatc

SEQ ID NO: 298892 - DNA, 25 bp, Mus musculus
tgcatctcaggctcttcccggtgct

SEQ ID NO: 298893 - DNA, 25 bp, Mus musculus
tcaggttccacgtgagcccggccag

SEQ ID NO: 298894 - DNA, 25 bp, Mus musculus
tttcccgcggctgttcagtccagat

SEQ ID NO: 298895 - DNA, 25 bp, Mus musculus
aatcccacctgctctgggtttcaaa

SEQ ID NO: 298896 - DNA, 25 bp, Mus musculus
caagctcgttacgtaaggttgcttc

SEQ ID NO: 298897 - DNA, 25 bp, Mus musculus
tccggactggccatttggtgctggc

SEQ ID NO: 298898 - DNA, 25 bp, Mus musculus
ctgtcacggccctgaggaggtgact

SEQ ID NO: 298899 - DNA, 25 bp, Mus musculus
tcctgaagctgggattttgacaagc

SEQ ID NO: 298900 - DNA, 25 bp, Mus musculus
atctctgaggaatgtgatggagcaa

SEQ ID NO: 298901 - DNA, 25 bp, Mus musculus
attagcctgctgtttgtatttttta

SEQ ID NO: 298902 - DNA, 25 bp, Mus musculus
gatgccagtctaattgaagccaacg

SEQ ID NO: 298903 - DNA, 25 bp, Mus musculus
catggcaaaagatgccagtctaatt

SEQ ID NO: 298904 - DNA, 25 bp, Mus musculus
ttggagagatgagtacggtttcttc

SEQ ID NO: 298905 - DNA, 25 bp, Mus musculus
aagtttattcacgcccggcgccgct

SEQ ID NO: 298906 - DNA, 25 bp, Mus musculus
agcccactattagcctgctgtttgt

SEQ ID NO: 298907 - DNA, 25 bp, Mus musculus
tggggtaatccagcccactattagc

SEQ ID NO: 298908 - DNA, 25 bp, Mus musculus
tcttcccatagaaactggggtaatc

SEQ ID NO: 298909 - DNA, 25 bp, Mus musculus
agttagcttcctatcttcccataga

SEQ ID NO: 298910 - DNA, 25 bp, Mus musculus
gcaaggtgttaccaaagttagcttc

SEQ ID NO: 298911 - DNA, 25 bp, Mus musculus
gaatgtgatggagcaaggtgttacc

SEQ ID NO: 298912 - DNA, 25 bp, Mus musculus
gcatttccatttggagagatgagta

SEQ ID NO: 298913 - DNA, 25 bp, Mus musculus
tctaattgaagccaacggagaacta

SEQ ID NO: 298914 - DNA, 25 bp, Mus musculus
gcccgccgcatccttctctgtgcca

SEQ ID NO: 298915 - DNA, 25 bp, Mus musculus
ggagtctccgcaggctggctagcca

SEQ ID NO: 298916 - DNA, 25 bp, Mus musculus
accgcagggttacatggctcccgcg

SEQ ID NO: 298917 - DNA, 25 bp, Mus musculus
cggagcccaccgcagggttacatgg

SEQ ID NO: 298918 - DNA, 25 bp, Mus musculus
ttaaactgcttcttcatcgtggccc

SEQ ID NO: 298919 - DNA, 25 bp, Mus musculus
ctggcgcatgcggttaaactgcttc

SEQ ID NO: 298920 - DNA, 25 bp, Mus musculus
ggccaactggcgcatgcggttaaac

SEQ ID NO: 298921 - DNA, 25 bp, Mus musculus
ggatgcgtcactctctgagcctaga

SEQ ID NO: 298922 - DNA, 25 bp, Mus musculus
atcacctgcgcctggcagatgcagc

SEQ ID NO: 298923 - DNA, 25 bp, Mus musculus
gacgcacaagctccaggccgggcag

SEQ ID NO: 298924 - DNA, 25 bp, Mus musculus
gacccaggagggacgcacaagctcc

SEQ ID NO: 298925 - DNA, 25 bp, Mus musculus
tcgggagaggaaaggtctcaccaac

SEQ ID NO: 298926 - DNA, 25 bp, Mus musculus
gcgtcactctctgagcctagaccgg

SEQ ID NO: 298927 - DNA, 25 bp, Mus musculus
tgcccaccgtctggttggccaactg

SEQ ID NO: 298928 - DNA, 25 bp, Mus musculus
tacaagttgacgaccacagagatgg

SEQ ID NO: 298929 - DNA, 25 bp, Mus musculus
cgtgcgaagaggatgccgtatttct

SEQ ID NO: 298930 - DNA, 25 bp, Mus musculus
gtatttctgacgacacacgcgtttg

SEQ ID NO: 298931 - DNA, 25 bp, Mus musculus
ggtggcaaagccctctcaacagctt

SEQ ID NO: 298932 - DNA, 25 bp, Mus musculus
cgcctctgaggaacaaaggagcttc

SEQ ID NO: 298933 - DNA, 25 bp, Mus musculus
acaccctagagctcgcgccggaaga

SEQ ID NO: 298934 - DNA, 25 bp, Mus musculus
tcggaaggtaacaccgccaacggca

SEQ ID NO: 298935 - DNA, 25 bp, Mus musculus
ggctgcaggaccagttccgaccact

SEQ ID NO: 298936 - DNA, 25 bp, Mus musculus
ttggaagacgttcagagcaagaatt

SEQ ID NO: 298937 - DNA, 25 bp, Mus musculus
tgtcgccagcgtctcatacaagttg

SEQ ID NO: 298938 - DNA, 25 bp, Mus musculus
ctctgcaaccaagggctggagcgta

SEQ ID NO: 298939 - DNA, 25 bp, Mus musculus
cggctgatgtcactgctgttttctt

SEQ ID NO: 298940 - DNA, 25 bp, Mus musculus
ttcgacttaagtgtcctccggcttc

SEQ ID NO: 298941 - DNA, 25 bp, Mus musculus
caagaatttatttagtgtcgccagc

SEQ ID NO: 298942 - DNA, 25 bp, Mus musculus
taagttccggctatggcgcgcggac

SEQ ID NO: 298943 - DNA, 25 bp, Mus musculus
ctccgggtaagtcagggaatgtgcc

SEQ ID NO: 298944 - DNA, 25 bp, Mus musculus
gcggaccttctctgaggcccgcgta

SEQ ID NO: 298945 - DNA, 25 bp, Mus musculus
tcccttatgtcgcacggcccttaag

SEQ ID NO: 298946 - DNA, 25 bp, Mus musculus
ctgccctctgtgtggcccgggtctt

SEQ ID NO: 298947 - DNA, 25 bp, Mus musculus
tccgggttcccttatgtcgcacggc

SEQ ID NO: 298948 - DNA, 25 bp, Mus musculus
tcttgtaagcagcaggattccgcgc

SEQ ID NO: 298949 - DNA, 25 bp, Mus musculus
taagcagcaggattccgcgcttggg

SEQ ID NO: 298950 - DNA, 25 bp, Mus musculus
cccgggtcttgtaagcagcaggatt

SEQ ID NO: 298951 - DNA, 25 bp, Mus musculus
cgtcccgggagagccacaacccagc

SEQ ID NO: 298952 - DNA, 25 bp, Mus musculus
ctgcgacaggcctgccctctgtgtg

SEQ ID NO: 298953 - DNA, 25 bp, Mus musculus
tattcgctgcctccgggttccctta

SEQ ID NO: 298954 - DNA, 25 bp, Mus musculus
aacccagcgcccgtgggctggaagc

SEQ ID NO: 298955 - DNA, 25 bp, Mus musculus
gcacggcccttaagttccggctatg

SEQ ID NO: 298956 - DNA, 25 bp, Mus musculus
agcccggctgtctcgagataaccca

SEQ ID NO: 298957 - DNA, 25 bp, Mus musculus
gcactttagacccacggagctcatc

SEQ ID NO: 298958 - DNA, 25 bp, Mus musculus
cagcgacgggccttgagaaggtcaa

SEQ ID NO: 298959 - DNA, 25 bp, Mus musculus
aacctcagaggccagcgctgacgtc

SEQ ID NO: 298960 - DNA, 25 bp, Mus musculus
tcgctgagcccagtagacatgcggc

SEQ ID NO: 298961 - DNA, 25 bp, Mus musculus
atgggccgcccggactaaacctcag

SEQ ID NO: 298962 - DNA, 25 bp, Mus musculus
tgcgccacgtgatcagcggctcagt

SEQ ID NO: 298963 - DNA, 25 bp, Mus musculus
ggccactgtcaagccgcactttaga

SEQ ID NO: 298964 - DNA, 25 bp, Mus musculus
cttgagtctccatggcccacgctgt

SEQ ID NO: 298965 - DNA, 25 bp, Mus musculus
atgcggcgtcagcacttgagtctcc

SEQ ID NO: 298966 - DNA, 25 bp, Mus musculus
tcccacaattcagagggccttaggc

SEQ ID NO: 298967 - DNA, 25 bp, Mus musculus
atacagctcgcggtgtcgctgagcc

SEQ ID NO: 298968 - DNA, 25 bp, Mus musculus
ccagggcgcctaccaggaacaaagg

SEQ ID NO: 298969 - DNA, 25 bp, Mus musculus
tgacgtcctgctaccgcacaacagg

SEQ ID NO: 298970 - DNA, 25 bp, Mus musculus
tgaagcggcgtaggcccgctccata

SEQ ID NO: 298971 - DNA, 25 bp, Mus musculus
gctgccattctgttccacgcattcg

SEQ ID NO: 298972 - DNA, 25 bp, Mus musculus
ctcactgtctcgctgccattctgtt

SEQ ID NO: 298973 - DNA, 25 bp, Mus musculus
attcgcctttggactcgctgctttc

SEQ ID NO: 298974 - DNA, 25 bp, Mus musculus
ccagtggcggatgggattcgccttt

SEQ ID NO: 298975 - DNA, 25 bp, Mus musculus
cgttatcttgatagagcctggcttg

SEQ ID NO: 298976 - DNA, 25 bp, Mus musculus
tcggactcccacgtccgttatcttg

SEQ ID NO: 298977 - DNA, 25 bp, Mus musculus
cacactcggattgcgaggctgccaa

SEQ ID NO: 298978 - DNA, 25 bp, Mus musculus
aagaggaagcgcacactcggattgc

SEQ ID NO: 298979 - DNA, 25 bp, Mus musculus
ggaaggtgcagtatccgcccgctct

SEQ ID NO: 298980 - DNA, 25 bp, Mus musculus
agtcatcctttcttggtccggccgc

SEQ ID NO: 298981 - DNA, 25 bp, Mus musculus
ggccgctagccttcctctgtcggag

SEQ ID NO: 298982 - DNA, 25 bp, Mus musculus
tccatagcgcatccggacggtccgg

SEQ ID NO: 298983 - DNA, 25 bp, Mus musculus
tttaagtcccttcgtccgctgcctg

SEQ ID NO: 298984 - DNA, 25 bp, Mus musculus
tctgcctgctgtccgcgcgcggtaa

SEQ ID NO: 298985 - DNA, 25 bp, Mus musculus
ccctgtggtgcagggtggccacact

SEQ ID NO: 298986 - DNA, 25 bp, Mus musculus
ccgcgtgggccgctagcccaagatg

SEQ ID NO: 298987 - DNA, 25 bp, Mus musculus
gcctcccggagccactgacgcccgg

SEQ ID NO: 298988 - DNA, 25 bp, Mus musculus
tggtgctgaccttctgcctgctgtc

SEQ ID NO: 298989 - DNA, 25 bp, Mus musculus
ctgcgcgtggcccttgtgcatgtga

SEQ ID NO: 298990 - DNA, 25 bp, Mus musculus
gaacgtgtccacagcgcgtgcctaa

SEQ ID NO: 298991 - DNA, 25 bp, Mus musculus
tgtccacagcgcgtgcctaaggcgc

SEQ ID NO: 298992 - DNA, 25 bp, Mus musculus
ctaaggcgccgggtagcatcgccag

SEQ ID NO: 298993 - DNA, 25 bp, Mus musculus
gctgcaagcgggacatgattctgcc

SEQ ID NO: 298994 - DNA, 25 bp, Mus musculus
atgattctgccctgcccgcaagcgt

SEQ ID NO: 298995 - DNA, 25 bp, Mus musculus
ccgcaagcgtctcgcggtcgcgagt

SEQ ID NO: 298996 - DNA, 25 bp, Mus musculus
ctcccgcgtgctgagtgagccgcag

SEQ ID NO: 298997 - DNA, 25 bp, Mus musculus
cccttgtgcatgtgaggtttgcatg

SEQ ID NO: 298998 - DNA, 25 bp, Mus musculus
cttggtcatcactcagatcggcctt

SEQ ID NO: 298999 - DNA, 25 bp, Mus musculus
taccagtgcgtagcagaaaacagcg

SEQ ID NO: 299000 - DNA, 25 bp, Mus musculus
aaacagcgcgggaactgcctgtgcc

SEQ ID NO: 299001 - DNA, 25 bp, Mus musculus
ccttcaggacgctggctactaccag

SEQ ID NO: 299002 - DNA, 25 bp, Mus musculus
cccgactcgggtcacagccacgccg

SEQ ID NO: 299003 - DNA, 25 bp, Mus musculus
cggcagcttggtcatcactcagatc

SEQ ID NO: 299004 - DNA, 25 bp, Mus musculus
cagcgcgggaactgcctgtgccgct

SEQ ID NO: 299005 - DNA, 25 bp, Mus musculus
ttgcgacccaatgggcgcgtcaagg

SEQ ID NO: 299006 - DNA, 25 bp, Mus musculus
cgtagcagaaaacagcgcgggaact

SEQ ID NO: 299007 - DNA, 25 bp, Mus musculus
gatcccgttgcgacccaatgggcgc

SEQ ID NO: 299008 - DNA, 25 bp, Mus musculus
cgacgggatcccgttgcgacccaat

SEQ ID NO: 299009 - DNA, 25 bp, Mus musculus
ctgcactggctgcacgacgggatcc

SEQ ID NO: 299010 - DNA, 25 bp, Mus musculus
cagcaccgcgcgcttcgtgtgccgg

SEQ ID NO: 299011 - DNA, 25 bp, Mus musculus
cgctggctactaccagtgcgtagca

SEQ ID NO: 299012 - DNA, 25 bp, Mus musculus
ccaagcctgggtgagcctcaggacc

SEQ ID NO: 299013 - DNA, 25 bp, Mus musculus
cccgctgcagttcaaagcgcagggg

SEQ ID NO: 299014 - DNA, 25 bp, Mus musculus
cgcttaaagcgctcgccggctcttt

SEQ ID NO: 299015 - DNA, 25 bp, Mus musculus
aagcggcgctctccgtgatacccga

SEQ ID NO: 299016 - DNA, 25 bp, Mus musculus
gagcccagcggaccgagagaccgat

SEQ ID NO: 299017 - DNA, 25 bp, Mus musculus
agagaccgatggctgagccgcgcac

SEQ ID NO: 299018 - DNA, 25 bp, Mus musculus
acactgcgggaacctgcgctaggag

SEQ ID NO: 299019 - DNA, 25 bp, Mus musculus
gggaaacccactccggcagggctgc

SEQ ID NO: 299020 - DNA, 25 bp, Mus musculus
gctgccggtagtttgaaggactgca

SEQ ID NO: 299021 - DNA, 25 bp, Mus musculus
ttttctacgccttcggggctcagga

SEQ ID NO: 299022 - DNA, 25 bp, Mus musculus
cagccgggaatgtccggccgcttaa

SEQ ID NO: 299023 - DNA, 25 bp, Mus musculus
gagaaagagcggaggagtcccaaca

SEQ ID NO: 299024 - DNA, 25 bp, Mus musculus
tcccaacagaggaaggcgagcccgg

SEQ ID NO: 299025 - DNA, 25 bp, Mus musculus
gatgccgattctgggcagaggaact

SEQ ID NO: 299026 - DNA, 25 bp, Mus musculus
ttactcctgccgctgagcgagcgag

SEQ ID NO: 299027 - DNA, 25 bp, Mus musculus
gtgaagcagatggtcccacttactc

SEQ ID NO: 299028 - DNA, 25 bp, Mus musculus
tgacacaaagcaatgacctcggagg

SEQ ID NO: 299029 - DNA, 25 bp, Mus musculus
tgagtcccgggagtcaaagggcaaa

SEQ ID NO: 299030 - DNA, 25 bp, Mus musculus
gtgcttctctccctttgagtcccgg

SEQ ID NO: 299031 - DNA, 25 bp, Mus musculus
ctttcatcagaacctcaagtgcttc

SEQ ID NO: 299032 - DNA, 25 bp, Mus musculus
acttgcgctctggttgcggagattc

SEQ ID NO: 299033 - DNA, 25 bp, Mus musculus
gtgccattcagcgtggacactattg

SEQ ID NO: 299034 - DNA, 25 bp, Mus musculus
gcgagcgaggtaattagccagtgcc

SEQ ID NO: 299035 - DNA, 25 bp, Mus musculus
ggattctctcattcacccgcggtgg

SEQ ID NO: 299036 - DNA, 25 bp, Mus musculus
gcgtgtgaggacaatggctgtctta

SEQ ID NO: 299037 - DNA, 25 bp, Mus musculus
caaaccctcgtttggcgtgtgagga

SEQ ID NO: 299038 - DNA, 25 bp, Mus musculus
tcgccgcgcacaatgtcggattctc

SEQ ID NO: 299039 - DNA, 25 bp, Mus musculus
gtcttattttctccattcgccgcgc

SEQ ID NO: 299040 - DNA, 25 bp, Mus musculus
cccgggctggaaaacctggcagcag

SEQ ID NO: 299041 - DNA, 25 bp, Mus musculus
tgcaatagcgacaactccataccgg

SEQ ID NO: 299042 - DNA, 25 bp, Mus musculus
ctccataccggggactccgggactg

SEQ ID NO: 299043 - DNA, 25 bp, Mus musculus
actgagcgaccgtgcccagtgtcct

SEQ ID NO: 299044 - DNA, 25 bp, Mus musculus
cggcgcgttctcaccaatgtcaatt

SEQ ID NO: 299045 - DNA, 25 bp, Mus musculus
acccacgccgggtgcaatagcgaca

SEQ ID NO: 299046 - DNA, 25 bp, Mus musculus
acctggcagcagacggtctacggtc

SEQ ID NO: 299047 - DNA, 25 bp, Mus musculus
cacgcgctacgagcccgggatgcag

SEQ ID NO: 299048 - DNA, 25 bp, Mus musculus
cgggatgcagctctccaacagggca

SEQ ID NO: 299049 - DNA, 25 bp, Mus musculus
cgctgcagagctacaagcgggactc

SEQ ID NO: 299050 - DNA, 25 bp, Mus musculus
acgcccgccacgactgtaaggactt

SEQ ID NO: 299051 - DNA, 25 bp, Mus musculus
taaggacttcgaggccctggtgagt

SEQ ID NO: 299052 - DNA, 25 bp, Mus musculus
gagtccgtcctgatccaccgttgct

SEQ ID NO: 299053 - DNA, 25 bp, Mus musculus
tgtcctgcagaggacgctcgccggc

SEQ ID NO: 299054 - DNA, 25 bp, Mus musculus
ctggctgtcggattggaaggaaacc

SEQ ID NO: 299055 - DNA, 25 bp, Mus musculus
gcagcgcaagggtgtcactgacatt

SEQ ID NO: 299056 - DNA, 25 bp, Mus musculus
cctgtcacttttggggagtctgtgc

SEQ ID NO: 299057 - DNA, 25 bp, Mus musculus
gtgcgacgcaacactcgttaaaagt

SEQ ID NO: 299058 - DNA, 25 bp, Mus musculus
aggccatctcgcctcaactcaggga

SEQ ID NO: 299059 - DNA, 25 bp, Mus musculus
cactgacattgtgcggtctcgggga

SEQ ID NO: 299060 - DNA, 25 bp, Mus musculus
cgcgcagagaggtaacgaagtagtc

SEQ ID NO: 299061 - DNA, 25 bp, Mus musculus
aacactcgcgcgacacgatcgggtc

SEQ ID NO: 299062 - DNA, 25 bp, Mus musculus
ctcctcctgggtctaggacgcaagc

SEQ ID NO: 299063 - DNA, 25 bp, Mus musculus
tccacgcatgcgcagcgtaaactca

SEQ ID NO: 299064 - DNA, 25 bp, Mus musculus
tctcggggacgacaagacgtaaaca

SEQ ID NO: 299065 - DNA, 25 bp, Mus musculus
cttcccgagaaattaggcgaccgca

SEQ ID NO: 299066 - DNA, 25 bp, Mus musculus
gcgcgtgtctctttgggtctaaaac

SEQ ID NO: 299067 - DNA, 25 bp, Mus musculus
ggaatcacgttagtctccacgcatg

SEQ ID NO: 299068 - DNA, 25 bp, Mus musculus
cgccgctcgcgaggctaattaactc

SEQ ID NO: 299069 - DNA, 25 bp, Mus musculus
ggctaattaactcccagcaggcagg

SEQ ID NO: 299070 - DNA, 25 bp, Mus musculus
cgggaacagccgcatcctaggcgtt

SEQ ID NO: 299071 - DNA, 25 bp, Mus musculus
cctaggcgttcctggctgatgtcat

SEQ ID NO: 299072 - DNA, 25 bp, Mus musculus
cctaaatcggatgcccgaaggctgc

SEQ ID NO: 299073 - DNA, 25 bp, Mus musculus
tttgcagaatagtgcgccaaggctg

SEQ ID NO: 299074 - DNA, 25 bp, Mus musculus
ccggctcttaactctttgcagaata

SEQ ID NO: 299075 - DNA, 25 bp, Mus musculus
aggagtcttaacagccggctcttaa

SEQ ID NO: 299076 - DNA, 25 bp, Mus musculus
gacaggagatcagccaatcaggagc

SEQ ID NO: 299077 - DNA, 25 bp, Mus musculus
cctctttactactgacaggagatca

SEQ ID NO: 299078 - DNA, 25 bp, Mus musculus
caagtttgctatctgatcctcttta

SEQ ID NO: 299079 - DNA, 25 bp, Mus musculus
cgcctttatgaaggtcccaagtttg

SEQ ID NO: 299080 - DNA, 25 bp, Mus musculus
gagtaccgccaccacgcctttatga

SEQ ID NO: 299081 - DNA, 25 bp, Mus musculus
atgtcataggctgccagcggtcgcg

SEQ ID NO: 299082 - DNA, 25 bp, Mus musculus
gccttccgctccattcggctgtccg

SEQ ID NO: 299083 - DNA, 25 bp, Mus musculus
agcgggtgagaaccagtatgcgctc

SEQ ID NO: 299084 - DNA, 25 bp, Mus musculus
ccactacgagcggagctagcggagc

SEQ ID NO: 299085 - DNA, 25 bp, Mus musculus
ctcaggcggcgccactacgagcgga

SEQ ID NO: 299086 - DNA, 25 bp, Mus musculus
gctacgcagcttggggcagtccctg

SEQ ID NO: 299087 - DNA, 25 bp, Mus musculus
cctgcagcgcctgcgtgatcggcag

SEQ ID NO: 299088 - DNA, 25 bp, Mus musculus
ccttttttcgcccagagccgtcagg

SEQ ID NO: 299089 - DNA, 25 bp, Mus musculus
acagacatggctctgccaccttttt

SEQ ID NO: 299090 - DNA, 25 bp, Mus musculus
ccgctgcactacagacatggctctg

SEQ ID NO: 299091 - DNA, 25 bp, Mus musculus
agattactgtcactgctcccaaccg

SEQ ID NO: 299092 - DNA, 25 bp, Mus musculus
cggataaagaagttcccagattact

SEQ ID NO: 299093 - DNA, 25 bp, Mus musculus
acgttatacacgtcacttcctcctg

SEQ ID NO: 299094 - DNA, 25 bp, Mus musculus
aaccagtatgcgctcggtggttgga

SEQ ID NO: 299095 - DNA, 25 bp, Mus musculus
cgcggttgcgttccgctttgcgttt

SEQ ID NO: 299096 - DNA, 25 bp, Mus musculus
atggggcgcgaagacagattccaac

SEQ ID NO: 299097 - DNA, 25 bp, Mus musculus
taccttaaaggcgttcgaggcagca

SEQ ID NO: 299098 - DNA, 25 bp, Mus musculus
ttcgaggcagcaagggctacattcg

SEQ ID NO: 299099 - DNA, 25 bp, Mus musculus
tacattcgaaggcacggggagctca

SEQ ID NO: 299100 - DNA, 25 bp, Mus musculus
gggagctcaaatatcgttccgatga

SEQ ID NO: 299101 - DNA, 25 bp, Mus musculus
acctgagaagtgcagggccctagcc

SEQ ID NO: 299102 - DNA, 25 bp, Mus musculus
cagggccctagcctctgagaagcaa

SEQ ID NO: 299103 - DNA, 25 bp, Mus musculus
ctctgagaagcaacggggcgagact

SEQ ID NO: 299104 - DNA, 25 bp, Mus musculus
gagtcgccatggaggccacacccag

SEQ ID NO: 299105 - DNA, 25 bp, Mus musculus
gccggcctgctactaccgagaaaaa

SEQ ID NO: 299106 - DNA, 25 bp, Mus musculus
cgcacgaagccacaccggaagagac

SEQ ID NO: 299107 - DNA, 25 bp, Mus musculus
gcgagctgcggttcacttccgttta

SEQ ID NO: 299108 - DNA, 25 bp, Mus musculus
cccggaattggatgccgattgattc

SEQ ID NO: 299109 - DNA, 25 bp, Mus musculus
caacggccgaaatccttctttctgg

SEQ ID NO: 299110 - DNA, 25 bp, Mus musculus
gcggccatcgcacactgagcctgag

SEQ ID NO: 299111 - DNA, 25 bp, Mus musculus
cgtcgctgctccctggatgtgctgc

SEQ ID NO: 299112 - DNA, 25 bp, Mus musculus
tcggagagtagactaaccgcgtgtc

SEQ ID NO: 299113 - DNA, 25 bp, Mus musculus
atgaggtctgagctggctgacgcca

SEQ ID NO: 299114 - DNA, 25 bp, Mus musculus
gtcctcgagccctcctgcaccgctt

SEQ ID NO: 299115 - DNA, 25 bp, Mus musculus
cggcggctctcggagagtagactaa

SEQ ID NO: 299116 - DNA, 25 bp, Mus musculus
atcgcacactgagcctgagcaccag

SEQ ID NO: 299117 - DNA, 25 bp, Mus musculus
cgaaacatgaggtctgagctggctg

SEQ ID NO: 299118 - DNA, 25 bp, Mus musculus
accacagctcccaaatgtctcggag

SEQ ID NO: 299119 - DNA, 25 bp, Mus musculus
aaatgtctcggagctgcctccacga

SEQ ID NO: 299120 - DNA, 25 bp, Mus musculus
accgccggcgccatgcctccattgc

SEQ ID NO: 299121 - DNA, 25 bp, Mus musculus
ctgcgaaacatgaggtctgagctgg

SEQ ID NO: 299122 - DNA, 25 bp, Mus musculus
tggatgtgctgcgaaacatgaggtc

SEQ ID NO: 299123 - DNA, 25 bp, Mus musculus
tagactaaccgcgtgtcctcgagcc

SEQ ID NO: 299124 - DNA, 25 bp, Mus musculus
agctccagcaacctgtggcgggatc

SEQ ID NO: 299125 - DNA, 25 bp, Mus musculus
tggcgggatcatagcactccacgga

SEQ ID NO: 299126 - DNA, 25 bp, Mus musculus
actccacggagctcatgggtgtcct

SEQ ID NO: 299127 - DNA, 25 bp, Mus musculus
tgtcctctggaattcgccaccaatg

SEQ ID NO: 299128 - DNA, 25 bp, Mus musculus
caccaatggcatagaggcggccttc

SEQ ID NO: 299129 - DNA, 25 bp, Mus musculus
cgccatatcatagcgcggttggtga

SEQ ID NO: 299130 - DNA, 25 bp, Mus musculus
tgggtcgtaacagaagcctagctcc

SEQ ID NO: 299131 - DNA, 25 bp, Mus musculus
cacgatgtagagcttgttgcccagg

SEQ ID NO: 299132 - DNA, 25 bp, Mus musculus
tcctcgtccaggaagcacatggtgc

SEQ ID NO: 299133 - DNA, 25 bp, Mus musculus
gtgcgcgacgcatcctctaggaagc

SEQ ID NO: 299134 - DNA, 25 bp, Mus musculus
cagttgtgccaccagctcgtgcgac

SEQ ID NO: 299135 - DNA, 25 bp, Mus musculus
aaagcgagcagttgtccgacgtgac

SEQ ID NO: 299136 - DNA, 25 bp, Mus musculus
ctgctccgcctggaagagttgaccg

SEQ ID NO: 299137 - DNA, 25 bp, Mus musculus
ccaggtgccaccctctgggtcgtaa

SEQ ID NO: 299138 - DNA, 25 bp, Mus musculus
agttaacctggctatccttgggcgc

SEQ ID NO: 299139 - DNA, 25 bp, Mus musculus
ccctggaagttaacctggctatcct

SEQ ID NO: 299140 - DNA, 25 bp, Mus musculus
catgtcgtcggtgttcggcaagccc

SEQ ID NO: 299141 - DNA, 25 bp, Mus musculus
tcgccatgtcgtcggtgttcggcaa

SEQ ID NO: 299142 - DNA, 25 bp, Mus musculus
cagcttcgccatgtcgtcggtgttc

SEQ ID NO: 299143 - DNA, 25 bp, Mus musculus
catctgcagcttcgccatgtcgtcg

SEQ ID NO: 299144 - DNA, 25 bp, Mus musculus
tggccatctgcagcttcgccatgtc

SEQ ID NO: 299145 - DNA, 25 bp, Mus musculus
gcgtggccatctgcagcttcgccat

SEQ ID NO: 299146 - DNA, 25 bp, Mus musculus
gcgtgcaactagcagcccatcgggc

SEQ ID NO: 299147 - DNA, 25 bp, Mus musculus
ggggcgtgcaactagcagcccatcg

SEQ ID NO: 299148 - DNA, 25 bp, Mus musculus
gacaccatagtctgagtgactgggg

SEQ ID NO: 299149 - DNA, 25 bp, Mus musculus
cgggcggacaccatagtctgagtga

SEQ ID NO: 299150 - DNA, 25 bp, Mus musculus
ctccagcgggcggacaccatagtct

SEQ ID NO: 299151 - DNA, 25 bp, Mus musculus
taacctggctatccttgggcgccgc

SEQ ID NO: 299152 - DNA, 25 bp, Mus musculus
ccgccttgtcgtctgcgcgtgcttg

SEQ ID NO: 299153 - DNA, 25 bp, Mus musculus
gggtgctgttcctcggcaccgacca

SEQ ID NO: 299154 - DNA, 25 bp, Mus musculus
cgagtccgcgagaagccgccttggc

SEQ ID NO: 299155 - DNA, 25 bp, Mus musculus
gccgaggttcccgagtccgcgagaa

SEQ ID NO: 299156 - DNA, 25 bp, Mus musculus
caagcacctgccgggttcgacggga

SEQ ID NO: 299157 - DNA, 25 bp, Mus musculus
gaggccacgctgttcctgtcaagca

SEQ ID NO: 299158 - DNA, 25 bp, Mus musculus
aaggaggccacgctgttcctgtcaa

SEQ ID NO: 299159 - DNA, 25 bp, Mus musculus
gtgatgctccttccgcggtgctgct

SEQ ID NO: 299160 - DNA, 25 bp, Mus musculus
gccgaggtgatgctccttccgcggt

SEQ ID NO: 299161 - DNA, 25 bp, Mus musculus
gcacgcatgcgcatggtgggccgct

SEQ ID NO: 299162 - DNA, 25 bp, Mus musculus
tgggcctttgagctctttgctccgc

SEQ ID NO: 299163 - DNA, 25 bp, Mus musculus
gcgtgcttgggcctttgagctcttt

SEQ ID NO: 299164 - DNA, 25 bp, Mus musculus
cgaccactttgcccgggaaacgctg

SEQ ID NO: 299165 - DNA, 25 bp, Mus musculus
gctgttcctgtcaagcacctgccgg

SEQ ID NO: 299166 - DNA, 25 bp, Mus musculus
ggcaggccctggaaagcaagagtgt

SEQ ID NO: 299167 - DNA, 25 bp, Mus musculus
atcctctgcgcccaaatcggggcga

SEQ ID NO: 299168 - DNA, 25 bp, Mus musculus
ccaaatcggggcgaagatccgtcta

SEQ ID NO: 299169 - DNA, 25 bp, Mus musculus
atccgtctaggctggaaagaaaggg

SEQ ID NO: 299170 - DNA, 25 bp, Mus musculus
gcgtgtatcgagcatgcgtgactta

SEQ ID NO: 299171 - DNA, 25 bp, Mus musculus
ccggggagctcgcagtaccaaagct

SEQ ID NO: 299172 - DNA, 25 bp, Mus musculus
gctcgcagtaccaaagctgggaggc

SEQ ID NO: 299173 - DNA, 25 bp, Mus musculus
catgcgtgacttacgagcagagttc

SEQ ID NO: 299174 - DNA, 25 bp, Mus musculus
ttacgagcagagttcacgagtgggc

SEQ ID NO: 299175 - DNA, 25 bp, Mus musculus
agagttcacgagtgggcaggtcctt

SEQ ID NO: 299176 - DNA, 25 bp, Mus musculus
gcaggtccttgtgaccatgcacgtg

SEQ ID NO: 299177 - DNA, 25 bp, Mus musculus
tgtgaccatgcacgtgatccatatc

SEQ ID NO: 299178 - DNA, 25 bp, Mus musculus
cgtgatccatatctctgtgtgtgcg

SEQ ID NO: 299179 - DNA, 25 bp, Mus musculus
cgaagatccgtctaggctggaaaga

SEQ ID NO: 299180 - DNA, 25 bp, Mus musculus
cggcggcttgctgtcttctgtcccg

SEQ ID NO: 299181 - DNA, 25 bp, Mus musculus
cagctccgggaatggacggaagaac

SEQ ID NO: 299182 - DNA, 25 bp, Mus musculus
cctgtcttcagctccgggaatggac

SEQ ID NO: 299183 - DNA, 25 bp, Mus musculus
cctgggcggggcctgtcttcagctc

SEQ ID NO: 299184 - DNA, 25 bp, Mus musculus
ccagggagggatacagcggcctcca

SEQ ID NO: 299185 - DNA, 25 bp, Mus musculus
ttgctgtcttctgtcccgccgggcg

SEQ ID NO: 299186 - DNA, 25 bp, Mus musculus
gcttgctccatctacgcgcagccgg

SEQ ID NO: 299187 - DNA, 25 bp, Mus musculus
ccgcttactgctgcccgcgttgcgc

SEQ ID NO: 299188 - DNA, 25 bp, Mus musculus
aggtccggcggcttcgccgcttact

SEQ ID NO: 299189 - DNA, 25 bp, Mus musculus
tcctccatggcgagtttgcaaggtc

SEQ ID NO: 299190 - DNA, 25 bp, Mus musculus
gagcccagcactcttgttccgtctg

SEQ ID NO: 299191 - DNA, 25 bp, Mus musculus
agcactcttgttccgtctggcccag

SEQ ID NO: 299192 - DNA, 25 bp, Mus musculus
aagtaggacgggcagcacccgagcc

SEQ ID NO: 299193 - DNA, 25 bp, Mus musculus
cgagtttgcaaggtccggcggcttc

SEQ ID NO: 299194 - DNA, 25 bp, Mus musculus
agccataccacctattacatctcga

SEQ ID NO: 299195 - DNA, 25 bp, Mus musculus
tctcgattttctgtgacttatgcgc

SEQ ID NO: 299196 - DNA, 25 bp, Mus musculus
tgacttatgcgctccggtctctgca

SEQ ID NO: 299197 - DNA, 25 bp, Mus musculus
tgcacgcctgcagaggcattggaga

SEQ ID NO: 299198 - DNA, 25 bp, Mus musculus
tggagatgccttctagcacagaggc

SEQ ID NO: 299199 - DNA, 25 bp, Mus musculus
cggcgaccgatgaatgtgacgatgc

SEQ ID NO: 299200 - DNA, 25 bp, Mus musculus
cagagctgagcctaggtcgaaacga

SEQ ID NO: 299201 - DNA, 25 bp, Mus musculus
aacgaacgacgtgagttaatgctgc

SEQ ID NO: 299202 - DNA, 25 bp, Mus musculus
ttaatgctgcgactgcaggcaccgg

SEQ ID NO: 299203 - DNA, 25 bp, Mus musculus
cccaccgatggagtccctggagctg

SEQ ID NO: 299204 - DNA, 25 bp, Mus musculus
tggagctggctcagtgcaactgctc

SEQ ID NO: 299205 - DNA, 25 bp, Mus musculus
agtgcaactgctcctctccgactgt

SEQ ID NO: 299206 - DNA, 25 bp, Mus musculus
cacgctgcgcctgaagctggcggtt

SEQ ID NO: 299207 - DNA, 25 bp, Mus musculus
agtcctggagggcaacctcgcaagc

SEQ ID NO: 299208 - DNA, 25 bp, Mus musculus
cagggccgctactcttccagtgcga

SEQ ID NO: 299209 - DNA, 25 bp, Mus musculus
tttgagtcggggcagtagatcccac

SEQ ID NO: 299210 - DNA, 25 bp, Mus musculus
gctactcttccagtgcgacttcagg

SEQ ID NO: 299211 - DNA, 25 bp, Mus musculus
cttaagttccgtgctttgagtcggg

SEQ ID NO: 299212 - DNA, 25 bp, Mus musculus
gcagggcagtcagggccgctactct

SEQ ID NO: 299213 - DNA, 25 bp, Mus musculus
aacccatgggcaggggcgcacgaaa

SEQ ID NO: 299214 - DNA, 25 bp, Mus musculus
gtgcacataaaggaacccatgggca

SEQ ID NO: 299215 - DNA, 25 bp, Mus musculus
gggatgtctcagtgcacataaagga

SEQ ID NO: 299216 - DNA, 25 bp, Mus musculus
ggctgggatgtctcagtgcacataa

SEQ ID NO: 299217 - DNA, 25 bp, Mus musculus
tggctgctcaaggattatcggggac

SEQ ID NO: 299218 - DNA, 25 bp, Mus musculus
tctcctctcagctatggctgctcaa

SEQ ID NO: 299219 - DNA, 25 bp, Mus musculus
ggagacacctgagccgagcccaatc

SEQ ID NO: 299220 - DNA, 25 bp, Mus musculus
agatcccaccgggagacacctgagc

SEQ ID NO: 299221 - DNA, 25 bp, Mus musculus
ctcaaggattatcggggactgcggc

SEQ ID NO: 299222 - DNA, 25 bp, Mus musculus
cattgttggaagtgaagagccgagc

SEQ ID NO: 299223 - DNA, 25 bp, Mus musculus
gctgcaatgcagcaagctcggcctc

SEQ ID NO: 299224 - DNA, 25 bp, Mus musculus
tcgaaacgcctctccggggccaatg

SEQ ID NO: 299225 - DNA, 25 bp, Mus musculus
cacgcagacaccctgcaaagttttg

SEQ ID NO: 299226 - DNA, 25 bp, Mus musculus
cagacaccctgcaaagttttgggga

SEQ ID NO: 299227 - DNA, 25 bp, Mus musculus
ggacagcgcagtggccctattccag

SEQ ID NO: 299228 - DNA, 25 bp, Mus musculus
gcagtggccctattccagcggcgca

SEQ ID NO: 299229 - DNA, 25 bp, Mus musculus
attccagcggcgcaccgtgaagcgc

SEQ ID NO: 299230 - DNA, 25 bp, Mus musculus
gcgcaccgtgaagcgcaagatggcc

SEQ ID NO: 299231 - DNA, 25 bp, Mus musculus
agagccgccacagcgttcaccgaaa

SEQ ID NO: 299232 - DNA, 25 bp, Mus musculus
ccgtccttaccctgcatgctgctga

SEQ ID NO: 299233 - DNA, 25 bp, Mus musculus
cgctcgggctcggagccgccattgt

SEQ ID NO: 299234 - DNA, 25 bp, Mus musculus
gagccgccattgttggaagtgaaga

SEQ ID NO: 299235 - DNA, 25 bp, Mus musculus
gcaatgcagcaagctcggcctctcg

SEQ ID NO: 299236 - DNA, 25 bp, Mus musculus
aagccggacgtcgagcactgcacgg

SEQ ID NO: 299237 - DNA, 25 bp, Mus musculus
ccctgcccaccacgggacagagcgt

SEQ ID NO: 299238 - DNA, 25 bp, Mus musculus
gggacagagcgtcccgcttccctct

SEQ ID NO: 299239 - DNA, 25 bp, Mus musculus
ctcaccatgagcaacctgaagccgg

SEQ ID NO: 299240 - DNA, 25 bp, Mus musculus
catgagcaacctgaagccggacgtc

SEQ ID NO: 299241 - DNA, 25 bp, Mus musculus
aacctgaagccggacgtcgagcact

SEQ ID NO: 299242 - DNA, 25 bp, Mus musculus
cgcacccgccaaacttaatgtgatc

SEQ ID NO: 299243 - DNA, 25 bp, Mus musculus
cctggggaggagcagcccatgtcca

SEQ ID NO: 299244 - DNA, 25 bp, Mus musculus
ggcagcagccgctttcctcaccagc

SEQ ID NO: 299245 - DNA, 25 bp, Mus musculus
aaacgccggagccaaggaaggcaga

SEQ ID NO: 299246 - DNA, 25 bp, Mus musculus
tctccgtagcctgacgcggcagcag

SEQ ID NO: 299247 - DNA, 25 bp, Mus musculus
tttcctttctccgtagcctgacgcg

SEQ ID NO: 299248 - DNA, 25 bp, Mus musculus
ctcaccagctcgcactctcctcggg

SEQ ID NO: 299249 - DNA, 25 bp, Mus musculus
ctctgagagagttcatcaaagttta

SEQ ID NO: 299250 - DNA, 25 bp, Mus musculus
cacccactcgtccacctacccactc

SEQ ID NO: 299251 - DNA, 25 bp, Mus musculus
ttagcccacagagaccggcccgcgc

SEQ ID NO: 299252 - DNA, 25 bp, Mus musculus
gtgcttcgccctttgttgtgggccc

SEQ ID NO: 299253 - DNA, 25 bp, Mus musculus
tggggctatgcagatgaggtacttg

SEQ ID NO: 299254 - DNA, 25 bp, Mus musculus
accctgagcagagccaccgaggatg

SEQ ID NO: 299255 - DNA, 25 bp, Mus musculus
gcctgacagggacttagcccacaga

SEQ ID NO: 299256 - DNA, 25 bp, Mus musculus
cggtgcttcgccctttgttgtgggc

SEQ ID NO: 299257 - DNA, 25 bp, Mus musculus
tgacagggacttagcccacagagac

SEQ ID NO: 299258 - DNA, 25 bp, Mus musculus
cgcggcctgacagggacttagccca

SEQ ID NO: 299259 - DNA, 25 bp, Mus musculus
ctgagcagagccaccgaggatgata

SEQ ID NO: 299260 - DNA, 25 bp, Mus musculus
gcagagccaccgaggatgataaaca

SEQ ID NO: 299261 - DNA, 25 bp, Mus musculus
accgaggatgataaacacccaggac

SEQ ID NO: 299262 - DNA, 25 bp, Mus musculus
gggacttagcccacagagaccggcc

SEQ ID NO: 299263 - DNA, 25 bp, Mus musculus
gagccaccgaggatgataaacaccc

SEQ ID NO: 299264 - DNA, 25 bp, Mus musculus
ctgtaagggcttcaccgcgggagct

SEQ ID NO: 299265 - DNA, 25 bp, Mus musculus
tcagatttctagtttctccgcagtg

SEQ ID NO: 299266 - DNA, 25 bp, Mus musculus
agtttctccgcagtgtcagggcgga

SEQ ID NO: 299267 - DNA, 25 bp, Mus musculus
tccgcaactcttcagtgcagataag

SEQ ID NO: 299268 - DNA, 25 bp, Mus musculus
ctcggttgaattcctgtcagatttc

SEQ ID NO: 299269 - DNA, 25 bp, Mus musculus
caggcccgggagtctacctcggttg

SEQ ID NO: 299270 - DNA, 25 bp, Mus musculus
cagtgcagataagagccggaagaga

SEQ ID NO: 299271 - DNA, 25 bp, Mus musculus
gaatgccaggcaactccgcaactct

SEQ ID NO: 299272 - DNA, 25 bp, Mus musculus
ttgtaccgcagaactcacgaatgcc

SEQ ID NO: 299273 - DNA, 25 bp, Mus musculus
gcctccaggtagtccttgtaccgca

SEQ ID NO: 299274 - DNA, 25 bp, Mus musculus
gagctctgcactctcgttctctatc

SEQ ID NO: 299275 - DNA, 25 bp, Mus musculus
tggcaagcggagcagagctctgcac

SEQ ID NO: 299276 - DNA, 25 bp, Mus musculus
ccagcctggcgactgacagccagag

SEQ ID NO: 299277 - DNA, 25 bp, Mus musculus
tcgcgctcggtctgctgcagagcca

SEQ ID NO: 299278 - DNA, 25 bp, Mus musculus
tctgaagcagggacttcggccaatg

SEQ ID NO: 299279 - DNA, 25 bp, Mus musculus
ggagtttcccacctggagtgccagc

SEQ ID NO: 299280 - DNA, 25 bp, Mus musculus
accagggtccctgcgtgcaaagagt

SEQ ID NO: 299281 - DNA, 25 bp, Mus musculus
tcggccaatgcagaccgggagtttc

SEQ ID NO: 299282 - DNA, 25 bp, Mus musculus
ccctaagtgggtacgcatcacgtcg

SEQ ID NO: 299283 - DNA, 25 bp, Mus musculus
gggcgccctataggagcgttgtccc

SEQ ID NO: 299284 - DNA, 25 bp, Mus musculus
cttcctttattgctctctcggcagg

SEQ ID NO: 299285 - DNA, 25 bp, Mus musculus
gagtgggtaatgagacctccctcca

SEQ ID NO: 299286 - DNA, 25 bp, Mus musculus
gtcccggactctctgttgggacaga

SEQ ID NO: 299287 - DNA, 25 bp, Mus musculus
tgcttcacattgtccgcgtcccgga

SEQ ID NO: 299288 - DNA, 25 bp, Mus musculus
agaggtgactgtggtcatcctgtgc

SEQ ID NO: 299289 - DNA, 25 bp, Mus musculus
ccagggccgaaatcaagggtataga

SEQ ID NO: 299290 - DNA, 25 bp, Mus musculus
gggagcatcatccagggccgaaatc

SEQ ID NO: 299291 - DNA, 25 bp, Mus musculus
tggagtgccagctccgaaaagaagg

SEQ ID NO: 299292 - DNA, 25 bp, Mus musculus
ccgccttgacatacccaatcagagg

SEQ ID NO: 299293 - DNA, 25 bp, Mus musculus
gtctggcccagtagttccgacctga

SEQ ID NO: 299294 - DNA, 25 bp, Mus musculus
agtcacagtcaaggtctgggctccc

SEQ ID NO: 299295 - DNA, 25 bp, Mus musculus
gaagaagggacctaaagtcacagtc

SEQ ID NO: 299296 - DNA, 25 bp, Mus musculus
ccctccgtggccaacgataagaaga

SEQ ID NO: 299297 - DNA, 25 bp, Mus musculus
cgtcgtcttccttttgctgcccgga

SEQ ID NO: 299298 - DNA, 25 bp, Mus musculus
tcatcgtgggctccgtcgtcttcct

SEQ ID NO: 299299 - DNA, 25 bp, Mus musculus
ctctcggagcgcaatatgaaggtgc

SEQ ID NO: 299300 - DNA, 25 bp, Mus musculus
ccaatcagagggctgtaacgtggca

SEQ ID NO: 299301 - DNA, 25 bp, Mus musculus
tgcctttgcgcaccgccttgacata

SEQ ID NO: 299302 - DNA, 25 bp, Mus musculus
gataccaatcccaacgctgcctttg

SEQ ID NO: 299303 - DNA, 25 bp, Mus musculus
tagtctctctttctgataccaatcc

SEQ ID NO: 299304 - DNA, 25 bp, Mus musculus
gctggggtgcgtagtctctctttct

SEQ ID NO: 299305 - DNA, 25 bp, Mus musculus
accactcggcgtcgctgcgcaggga

SEQ ID NO: 299306 - DNA, 25 bp, Mus musculus
cgcgacatctcacccgcttgtgtag

SEQ ID NO: 299307 - DNA, 25 bp, Mus musculus
gcgctgatcgcgaagataatcggta

SEQ ID NO: 299308 - DNA, 25 bp, Mus musculus
caggctccaccctctgatacgggag

SEQ ID NO: 299309 - DNA, 25 bp, Mus musculus
cccaccgagggaatgtgaacttcca

SEQ ID NO: 299310 - DNA, 25 bp, Mus musculus
caccatgtggcctttctctggactc

SEQ ID NO: 299311 - DNA, 25 bp, Mus musculus
tcttcgtccatttgctcaccatgtg

SEQ ID NO: 299312 - DNA, 25 bp, Mus musculus
attctgggtcccttttgcgctgatc

SEQ ID NO: 299313 - DNA, 25 bp, Mus musculus
gcgacgaatgtcctagccctgaatt

SEQ ID NO: 299314 - DNA, 25 bp, Mus musculus
caaaccattgtccaaggggctggca

SEQ ID NO: 299315 - DNA, 25 bp, Mus musculus
acaaagccgacttggcgtgccacca

SEQ ID NO: 299316 - DNA, 25 bp, Mus musculus
tctggtgttagaaaggcacaaagcc

SEQ ID NO: 299317 - DNA, 25 bp, Mus musculus
gagacgcgcccaatttctggtgtta

SEQ ID NO: 299318 - DNA, 25 bp, Mus musculus
cccgcttgtgtagagcgtggaactc

SEQ ID NO: 299319 - DNA, 25 bp, Mus musculus
cgctgtacagcacctccacttggaa

SEQ ID NO: 299320 - DNA, 25 bp, Mus musculus
cgctccagccgtgtgaggtgcgcga

SEQ ID NO: 299321 - DNA, 25 bp, Mus musculus
agtgccgcgagcaaagcgctccagc

SEQ ID NO: 299322 - DNA, 25 bp, Mus musculus
caactttatagacagtgccgcgagc

SEQ ID NO: 299323 - DNA, 25 bp, Mus musculus
gttatggacccagagggaccatcgg

SEQ ID NO: 299324 - DNA, 25 bp, Mus musculus
ctgccgcggcgccagtgaaaatatc

SEQ ID NO: 299325 - DNA, 25 bp, Mus musculus
ggccgttatggacccagagggacca

SEQ ID NO: 299326 - DNA, 25 bp, Mus musculus
ccgtggcggaagcagcaacaacaac

SEQ ID NO: 299327 - DNA, 25 bp, Mus musculus
ccacccgtggcggaagcagcaacaa

SEQ ID NO: 299328 - DNA, 25 bp, Mus musculus
agccaccacctcctgacgccatctt

SEQ ID NO: 299329 - DNA, 25 bp, Mus musculus
gagtcgctccgaagcgctacagcca

SEQ ID NO: 299330 - DNA, 25 bp, Mus musculus
gagggagtcgctccgaagcgctaca

SEQ ID NO: 299331 - DNA, 25 bp, Mus musculus
ctccggatccatgccagggaagggc

SEQ ID NO: 299332 - DNA, 25 bp, Mus musculus
ttccgactccggatccatgccaggg

SEQ ID NO: 299333 - DNA, 25 bp, Mus musculus
tgaaaatatcctccccctcggtgtc

SEQ ID NO: 299334 - DNA, 25 bp, Mus musculus
cgggaagggacgagcatccaagtcc

SEQ ID NO: 299335 - DNA, 25 bp, Mus musculus
agcctttcgccgtgagtagcgcccg

SEQ ID NO: 299336 - DNA, 25 bp, Mus musculus
agggacgagcatccaagtcctcacc

SEQ ID NO: 299337 - DNA, 25 bp, Mus musculus
gagcatccaagtcctcacctcgggg

SEQ ID NO: 299338 - DNA, 25 bp, Mus musculus
atccaagtcctcacctcggggcggt

SEQ ID NO: 299339 - DNA, 25 bp, Mus musculus
tagccgttctgtggtttgtgcgctg

SEQ ID NO: 299340 - DNA, 25 bp, Mus musculus
tccgcacatgcagcgcagcctttcg

SEQ ID NO: 299341 - DNA, 25 bp, Mus musculus
tttcgccgtgagtagcgcccgggcc

SEQ ID NO: 299342 - DNA, 25 bp, Mus musculus
ggccgcgggattcgacggcagcagt

SEQ ID NO: 299343 - DNA, 25 bp, Mus musculus
tcgggcattgcctgtctaggatata

SEQ ID NO: 299344 - DNA, 25 bp, Mus musculus
ttgcctgtctaggatatagccgttc

SEQ ID NO: 299345 - DNA, 25 bp, Mus musculus
ctgtctaggatatagccgttctgtg

SEQ ID NO: 299346 - DNA, 25 bp, Mus musculus
tatagccgttctgtggtttgtgcgc

SEQ ID NO: 299347 - DNA, 25 bp, Mus musculus
gtgcacgtccagctctccgcacatg

SEQ ID NO: 299348 - DNA, 25 bp, Mus musculus
gcacgacgtctatgagaaccgcacc

SEQ ID NO: 299349 - DNA, 25 bp, Mus musculus
cgtggtgctcatccttgagctgtga

SEQ ID NO: 299350 - DNA, 25 bp, Mus musculus
acatcatcacgctgcacgacgtcta

SEQ ID NO: 299351 - DNA, 25 bp, Mus musculus
atcacgctgcacgacgtctatgaga

SEQ ID NO: 299352 - DNA, 25 bp, Mus musculus
aaatcgagcgggaggtgagcatcct

SEQ ID NO: 299353 - DNA, 25 bp, Mus musculus
gctgcacgacgtctatgagaaccgc

SEQ ID NO: 299354 - DNA, 25 bp, Mus musculus
cgccaggactcatgacacggggaag

SEQ ID NO: 299355 - DNA, 25 bp, Mus musculus
caccgacgtggtgctcatccttgag

SEQ ID NO: 299356 - DNA, 25 bp, Mus musculus
ccaggactcatgacacggggaagcg

SEQ ID NO: 299357 - DNA, 25 bp, Mus musculus
ctcatccttgagctgtgagtggggt

SEQ ID NO: 299358 - DNA, 25 bp, Mus musculus
ccgggacccatgatgtggggaagcg

SEQ ID NO: 299359 - DNA, 25 bp, Mus musculus
tgtagggcgccaggactcatgacac

SEQ ID NO: 299360 - DNA, 25 bp, Mus musculus
atgagaaccgcaccgacgtggtgct

SEQ ID NO: 299361 - DNA, 25 bp, Mus musculus
agcatcctgcggcaggtgctgcacc

SEQ ID NO: 299362 - DNA, 25 bp, Mus musculus
cgtctttccctttgacaagtcgccg

SEQ ID NO: 299363 - DNA, 25 bp, Mus musculus
cctgatccttcagcgccctttgtga

SEQ ID NO: 299364 - DNA, 25 bp, Mus musculus
cagctttttctctcggtcctcggca

SEQ ID NO: 299365 - DNA, 25 bp, Mus musculus
cgatcctcttgcagactgtcccgta

SEQ ID NO: 299366 - DNA, 25 bp, Mus musculus
tgatagttccctacgggcacacgtg

SEQ ID NO: 299367 - DNA, 25 bp, Mus musculus
tgtactcatcgctttcccatcactg

SEQ ID NO: 299368 - DNA, 25 bp, Mus musculus
gagagttccctcataagtcccgcga

SEQ ID NO: 299369 - DNA, 25 bp, Mus musculus
gccgccgctgcagcaaaaatataaa

SEQ ID NO: 299370 - DNA, 25 bp, Mus musculus
ggtaacacgttctctttcgccatcg

SEQ ID NO: 299371 - DNA, 25 bp, Mus musculus
aagcctgttggaagccgagccacct

SEQ ID NO: 299372 - DNA, 25 bp, Mus musculus
cctgaataagcttgcagtctgcgcc

SEQ ID NO: 299373 - DNA, 25 bp, Mus musculus
agcgcgtctctcttagctgggactg

SEQ ID NO: 299374 - DNA, 25 bp, Mus musculus
ttcctcttgaggagagtcgcgactc

SEQ ID NO: 299375 - DNA, 25 bp, Mus musculus
aggaccagcgcttctgatctcgcga

SEQ ID NO: 299376 - DNA, 25 bp, Mus musculus
gcagccgtccagcttccggaagtgc

SEQ ID NO: 299377 - DNA, 25 bp, Mus musculus
aaagtggactcttccgggttgctcg

SEQ ID NO: 299378 - DNA, 25 bp, Mus musculus
ctcgcgcactgtcaggagcgagctg

SEQ ID NO: 299379 - DNA, 25 bp, Mus musculus
cttcagctcgcgcactgtcaggagc

SEQ ID NO: 299380 - DNA, 25 bp, Mus musculus
gcggatgcgcgcagccgtccagctt

SEQ ID NO: 299381 - DNA, 25 bp, Mus musculus
tcaaacctgaagtcgcttcagctcg

SEQ ID NO: 299382 - DNA, 25 bp, Mus musculus
gactcttccgggttgctcgtcccag

SEQ ID NO: 299383 - DNA, 25 bp, Mus musculus
ctggggtcaaacctgaagtcgcttc

SEQ ID NO: 299384 - DNA, 25 bp, Mus musculus
cgagtcctggggtcaaacctgaagt

SEQ ID NO: 299385 - DNA, 25 bp, Mus musculus
ctagccgagtcctggggtcaaacct

SEQ ID NO: 299386 - DNA, 25 bp, Mus musculus
ttccgggttgctcgtcccaggagag

SEQ ID NO: 299387 - DNA, 25 bp, Mus musculus
agccgtccagcttccggaagtgcct

SEQ ID NO: 299388 - DNA, 25 bp, Mus musculus
tcccaggagagggatcgggtctgtc

SEQ ID NO: 299389 - DNA, 25 bp, Mus musculus
ggtaagcgcgtagtttgggcggatc

SEQ ID NO: 299390 - DNA, 25 bp, Mus musculus
caggttcctcgccagcttagaaagc

SEQ ID NO: 299391 - DNA, 25 bp, Mus musculus
gaaacccagagttttacatgcatcc

SEQ ID NO: 299392 - DNA, 25 bp, Mus musculus
acatgcatcctctcctttaatagcg

SEQ ID NO: 299393 - DNA, 25 bp, Mus musculus
tctcctttaatagcgcgcgcgcgca

SEQ ID NO: 299394 - DNA, 25 bp, Mus musculus
cgcgcatcctcagtaggagcccgtg

SEQ ID NO: 299395 - DNA, 25 bp, Mus musculus
tggggtgaggcatgctttgtctccc

SEQ ID NO: 299396 - DNA, 25 bp, Mus musculus
gccgagaaagctgaggcagcgcaca

SEQ ID NO: 299397 - DNA, 25 bp, Mus musculus
atcatggccgcgctgcgttcggcgc

SEQ ID NO: 299398 - DNA, 25 bp, Mus musculus
cggcgctcacgttgcggcagaagtc

SEQ ID NO: 299399 - DNA, 25 bp, Mus musculus
cggcagaagtccacgtgcagagtct

SEQ ID NO: 299400 - DNA, 25 bp, Mus musculus
gcgcagttctcgaggcgcagcgtac

SEQ ID NO: 299401 - DNA, 25 bp, Mus musculus
cagctgagcagcaagcgcgccaggc

SEQ ID NO: 299402 - DNA, 25 bp, Mus musculus
cagcccgacagcgtgacggacgtca

SEQ ID NO: 299403 - DNA, 25 bp, Mus musculus
ccaggcagtcgtccgtgacgtggcc

SEQ ID NO: 299404 - DNA, 25 bp, Mus musculus
tgaaaatccggactcctggttctgc

SEQ ID NO: 299405 - DNA, 25 bp, Mus musculus
cagctagtgtaaagtcctacgggga

SEQ ID NO: 299406 - DNA, 25 bp, Mus musculus
ctacggggatgtgaagtgactttcc

SEQ ID NO: 299407 - DNA, 25 bp, Mus musculus
gctcacccagtgctagcagctagtg

SEQ ID NO: 299408 - DNA, 25 bp, Mus musculus
cacactagtcagtgggcggggcatt

SEQ ID NO: 299409 - DNA, 25 bp, Mus musculus
ccagggacagtaggcttccgccttc

SEQ ID NO: 299410 - DNA, 25 bp, Mus musculus
tcaaagaaagcaagggcttccgggc

SEQ ID NO: 299411 - DNA, 25 bp, Mus musculus
cttctgacccggcactgggcagacg

SEQ ID NO: 299412 - DNA, 25 bp, Mus musculus
tgcggacactccatggccacgagga

SEQ ID NO: 299413 - DNA, 25 bp, Mus musculus
gccgcgcgaaacaaaggagccgcca

SEQ ID NO: 299414 - DNA, 25 bp, Mus musculus
aacgcaacccaaaggggctcgcgcg

SEQ ID NO: 299415 - DNA, 25 bp, Mus musculus
gggtcccgagcctttgcgtcaaaga

SEQ ID NO: 299416 - DNA, 25 bp, Mus musculus
gcgcgccggcagtccagacaaagct

SEQ ID NO: 299417 - DNA, 25 bp, Mus musculus
ccgctccggagaacgtgaaaatccg

SEQ ID NO: 299418 - DNA, 25 bp, Mus musculus
ccatagcctatcagagtggacggca

SEQ ID NO: 299419 - DNA, 25 bp, Mus musculus
ccagtcaaaccggagccaggtcgga

SEQ ID NO: 299420 - DNA, 25 bp, Mus musculus
ggaggagtcccacgcccagtcaaac

SEQ ID NO: 299421 - DNA, 25 bp, Mus musculus
tggcttcggagcacagatcctgtca

SEQ ID NO: 299422 - DNA, 25 bp, Mus musculus
ctcgaggtcctctagtcacacggga

SEQ ID NO: 299423 - DNA, 25 bp, Mus musculus
ggctttgagtcgctcccagacctgt

SEQ ID NO: 299424 - DNA, 25 bp, Mus musculus
aggccaggcctggaagagttccata

SEQ ID NO: 299425 - DNA, 25 bp, Mus musculus
caaagaggcaacaggagggagcttc

SEQ ID NO: 299426 - DNA, 25 bp, Mus musculus
gccttcggtgccctagtcaaagagg

SEQ ID NO: 299427 - DNA, 25 bp, Mus musculus
agggccctgcagtgcccaatggaca

SEQ ID NO: 299428 - DNA, 25 bp, Mus musculus
cgtcatgacgacctcgggagccagt

SEQ ID NO: 299429 - DNA, 25 bp, Mus musculus
aagaacaccgcagccgtcatgacga

SEQ ID NO: 299430 - DNA, 25 bp, Mus musculus
cacccggcgatgaggaagatgactc

SEQ ID NO: 299431 - DNA, 25 bp, Mus musculus
ctgagctgctccttggcctgtaaaa

SEQ ID NO: 299432 - DNA, 25 bp, Mus musculus
cgtggagagccctcggacaaacgcc

SEQ ID NO: 299433 - DNA, 25 bp, Mus musculus
cataaggggcgttgagacaggaaaa

SEQ ID NO: 299434 - DNA, 25 bp, Mus musculus
ttctcagccacgttggagctctcca

SEQ ID NO: 299435 - DNA, 25 bp, Mus musculus
tccaagctggagagaaaaacttgtt

SEQ ID NO: 299436 - DNA, 25 bp, Mus musculus
acttgtttgttccagcgtcccgaca

SEQ ID NO: 299437 - DNA, 25 bp, Mus musculus
agcgtcccgacagttgcaccctttt

SEQ ID NO: 299438 - DNA, 25 bp, Mus musculus
tgctgctgacaaaagcttttctctc

SEQ ID NO: 299439 - DNA, 25 bp, Mus musculus
gtcgagatcagaagcgagaccttga

SEQ ID NO: 299440 - DNA, 25 bp, Mus musculus
cccggtggagatgctgctgacaaaa

SEQ ID NO: 299441 - DNA, 25 bp, Mus musculus
atttccggctcggagttctcagcca

SEQ ID NO: 299442 - DNA, 25 bp, Mus musculus
gtgacgtcacttccatttccggctc

SEQ ID NO: 299443 - DNA, 25 bp, Mus musculus
ggacaaacgccgagaaggactcaga

SEQ ID NO: 299444 - DNA, 25 bp, Mus musculus
gaatcctcaccgagcgctgcgtgga

SEQ ID NO: 299445 - DNA, 25 bp, Mus musculus
aaggactcagagctcggagaaaagg

SEQ ID NO: 299446 - DNA, 25 bp, Mus musculus
gttttataatcacaactgtatcaag

SEQ ID NO: 299447 - DNA, 25 bp, Mus musculus
tggtactgagtattgaacttaaagc

SEQ ID NO: 299448 - DNA, 25 bp, Mus musculus
gaacttaaagcttcaaacatgctag

SEQ ID NO: 299449 - DNA, 25 bp, Mus musculus
tattgttttgtggtactgagtattg

SEQ ID NO: 299450 - DNA, 25 bp, Mus musculus
tatttttctacatattgttttgtgg

SEQ ID NO: 299451 - DNA, 25 bp, Mus musculus
catcatgtgacattttatttgttac

SEQ ID NO: 299452 - DNA, 25 bp, Mus musculus
cgcggatgccgaacctttattgttt

SEQ ID NO: 299453 - DNA, 25 bp, Mus musculus
caaagttaaatagtgcatcatgtga

SEQ ID NO: 299454 - DNA, 25 bp, Mus musculus
tcaagttgacaaagttaaatagtgc

SEQ ID NO: 299455 - DNA, 25 bp, Mus musculus
tcacaactgtatcaagttgacaaag

SEQ ID NO: 299456 - DNA, 25 bp, Mus musculus
gatgccgaacctttattgttttata

SEQ ID NO: 299457 - DNA, 25 bp, Mus musculus
gacgcggatgccgaacctttattgt

SEQ ID NO: 299458 - DNA, 25 bp, Mus musculus
agtgcatcatgtgacattttatttg

SEQ ID NO: 299459 - DNA, 25 bp, Mus musculus
agcttcaaacatgctagccagcctg

SEQ ID NO: 299460 - DNA, 25 bp, Mus musculus
cagagcctgtatcgcacaacggtca

SEQ ID NO: 299461 - DNA, 25 bp, Mus musculus
cctctagtgtctctgcgtgcgtaca

SEQ ID NO: 299462 - DNA, 25 bp, Mus musculus
ctcgaggtgctccaaggcttttttg

SEQ ID NO: 299463 - DNA, 25 bp, Mus musculus
agcggcatcgagaagctgtcagaga

SEQ ID NO: 299464 - DNA, 25 bp, Mus musculus
tcacccagcgatgaggaaaatgacg

SEQ ID NO: 299465 - DNA, 25 bp, Mus musculus
aggcagcgtcatggtacccacagaa

SEQ ID NO: 299466 - DNA, 25 bp, Mus musculus
aggtactccgggctcgatcagagaa

SEQ ID NO: 299467 - DNA, 25 bp, Mus musculus
gtgcaggacacagccagtcagagca

SEQ ID NO: 299468 - DNA, 25 bp, Mus musculus
atgaagtgccttgagatgctccgcg

SEQ ID NO: 299469 - DNA, 25 bp, Mus musculus
atgctccgcggcttgtttttgcaga

SEQ ID NO: 299470 - DNA, 25 bp, Mus musculus
gctgctccacagcaaggcaggactg

SEQ ID NO: 299471 - DNA, 25 bp, Mus musculus
tactgttagaacctgtgcagcggca

SEQ ID NO: 299472 - DNA, 25 bp, Mus musculus
cggtgcaggattcgggaagctattt

SEQ ID NO: 299473 - DNA, 25 bp, Mus musculus
tccgaggtgactgggacgatttctt

SEQ ID NO: 299474 - DNA, 25 bp, Mus musculus
ctcttgaggcgacaggctcgctcct

SEQ ID NO: 299475 - DNA, 25 bp, Mus musculus
cggagtcgccgatgagcagcagctt

SEQ ID NO: 299476 - DNA, 25 bp, Mus musculus
gcgggcgtgcctcgcccaaactgtc

SEQ ID NO: 299477 - DNA, 25 bp, Mus musculus
gtcccagccaatctgcccgcgcctt

SEQ ID NO: 299478 - DNA, 25 bp, Mus musculus
atttgtagtactctgggagagccgc

SEQ ID NO: 299479 - DNA, 25 bp, Mus musculus
tccggccctctctgaccgccaagag

SEQ ID NO: 299480 - DNA, 25 bp, Mus musculus
cgtcttcgccatcttctcactccgg

SEQ ID NO: 299481 - DNA, 25 bp, Mus musculus
cctttcgtccgtccgcagttccgca

SEQ ID NO: 299482 - DNA, 25 bp, Mus musculus
acaggaggcaggtcttgccaacgcc

SEQ ID NO: 299483 - DNA, 25 bp, Mus musculus
taaaggtggtgttgaaggcgtcctc

SEQ ID NO: 299484 - DNA, 25 bp, Mus musculus
ccgctccctcaccgatggtggagat

SEQ ID NO: 299485 - DNA, 25 bp, Mus musculus
ttctccggtcgccaagccctcgcgt

SEQ ID NO: 299486 - DNA, 25 bp, Mus musculus
cccgcgaggctttatgggatttgta

SEQ ID NO: 299487 - DNA, 25 bp, Mus musculus
ttgccaacgccggagtcgccgatga

SEQ ID NO: 299488 - DNA, 25 bp, Mus musculus
tttgactttgggctcgggcttgctt

SEQ ID NO: 299489 - DNA, 25 bp, Mus musculus
cggagtttaacgcagaagccattta

SEQ ID NO: 299490 - DNA, 25 bp, Mus musculus
atgtccctcattggacttggcccgg

SEQ ID NO: 299491 - DNA, 25 bp, Mus musculus
cgtaccactgagacgggagcctaga

SEQ ID NO: 299492 - DNA, 25 bp, Mus musculus
tctatcccggaagttgctgaggggc

SEQ ID NO: 299493 - DNA, 25 bp, Mus musculus
gagccgtcaccatgcccgtaagttt

SEQ ID NO: 299494 - DNA, 25 bp, Mus musculus
tcaggctttctgttagtctggcgcc

SEQ ID NO: 299495 - DNA, 25 bp, Mus musculus
cttgttgagacttgtccgggcgaca

SEQ ID NO: 299496 - DNA, 25 bp, Mus musculus
ctcaccatgggcttcagggtcacta

SEQ ID NO: 299497 - DNA, 25 bp, Mus musculus
cagggtcactaacgggcctcgcagc

SEQ ID NO: 299498 - DNA, 25 bp, Mus musculus
cgcagccctgtgctggccattggat

SEQ ID NO: 299499 - DNA, 25 bp, Mus musculus
ggtcatcccggccttgttctgatct

SEQ ID NO: 299500 - DNA, 25 bp, Mus musculus
gccttgttctgatctgctgcgctgc

SEQ ID NO: 299501 - DNA, 25 bp, Mus musculus
aagcgagcagttcgtctcggcgacc

SEQ ID NO: 299502 - DNA, 25 bp, Mus musculus
tgcctcctagcttgctccggcttgg

SEQ ID NO: 299503 - DNA, 25 bp, Mus musculus
cgcccaccaggagggcaatggttct

SEQ ID NO: 299504 - DNA, 25 bp, Mus musculus
caatggttctgctccgattgccctg

SEQ ID NO: 299505 - DNA, 25 bp, Mus musculus
accggtgacctcagctgctacttga

SEQ ID NO: 299506 - DNA, 25 bp, Mus musculus
ttgagcagccctaagagcgtcagcc

SEQ ID NO: 299507 - DNA, 25 bp, Mus musculus
gcggccaggcagtcagaaaaacgga

SEQ ID NO: 299508 - DNA, 25 bp, Mus musculus
gcccgcaccttgatccggtgtagca

SEQ ID NO: 299509 - DNA, 25 bp, Mus musculus
ggctgctctcgatggctctggagaa

SEQ ID NO: 299510 - DNA, 25 bp, Mus musculus
gcctgctcgtgcgataactcggtag

SEQ ID NO: 299511 - DNA, 25 bp, Mus musculus
ataactcggtagtgccggacgcctc

SEQ ID NO: 299512 - DNA, 25 bp, Mus musculus
agccggtacatgttgcctccgcaga

SEQ ID NO: 299513 - DNA, 25 bp, Mus musculus
ggcggggctttacagtacctctcag

SEQ ID NO: 299514 - DNA, 25 bp, Mus musculus
gtacctctcagtcaaggccgggtgg

SEQ ID NO: 299515 - DNA, 25 bp, Mus musculus
gcagcccgagctgtcacgcttgaca

SEQ ID NO: 299516 - DNA, 25 bp, Mus musculus
agcaggccggaagtcacggctcctg

SEQ ID NO: 299517 - DNA, 25 bp, Mus musculus
caggagggcgtttgcatccactccg

SEQ ID NO: 299518 - DNA, 25 bp, Mus musculus
tgcctagagcgaggccaccgcagga

SEQ ID NO: 299519 - DNA, 25 bp, Mus musculus
ctgctttgcctagagcgaggccacc

SEQ ID NO: 299520 - DNA, 25 bp, Mus musculus
atggctggctctaggctgctttgcc

SEQ ID NO: 299521 - DNA, 25 bp, Mus musculus
tgcccatggaaccactgcgcgtgcg

SEQ ID NO: 299522 - DNA, 25 bp, Mus musculus
tcctgggccgcacagagagagccgc

SEQ ID NO: 299523 - DNA, 25 bp, Mus musculus
caggccggctttgtaacgccggcgc

SEQ ID NO: 299524 - DNA, 25 bp, Mus musculus
agcgagctgctacccgccatggcga

SEQ ID NO: 299525 - DNA, 25 bp, Mus musculus
tgcaggctccggatctttctccgca

SEQ ID NO: 299526 - DNA, 25 bp, Mus musculus
gctcctgcaggctccggatctttct

SEQ ID NO: 299527 - DNA, 25 bp, Mus musculus
ccctgcggctaagaagcaggccgga

SEQ ID NO: 299528 - DNA, 25 bp, Mus musculus
cccgggaactagctgcccatggaac

SEQ ID NO: 299529 - DNA, 25 bp, Mus musculus
agtcacggctcctgggccgcacaga

SEQ ID NO: 299530 - DNA, 25 bp, Mus musculus
ctccaggagtcagagtcccgggact

SEQ ID NO: 299531 - DNA, 25 bp, Mus musculus
gcctgatcctcttcccatagccgct

SEQ ID NO: 299532 - DNA, 25 bp, Mus musculus
agctttccggagtcacggcctgatc

SEQ ID NO: 299533 - DNA, 25 bp, Mus musculus
cagagcgcgcagtaccagggcagca

SEQ ID NO: 299534 - DNA, 25 bp, Mus musculus
acggggacctccaggagtcagagtc

SEQ ID NO: 299535 - DNA, 25 bp, Mus musculus
ccttcagacgccagagctttccgga

SEQ ID NO: 299536 - DNA, 25 bp, Mus musculus
agtcccgggactgccggatcgcaga

SEQ ID NO: 299537 - DNA, 25 bp, Mus musculus
cctcactgttggctccagcggcggt

SEQ ID NO: 299538 - DNA, 25 bp, Mus musculus
gctccagcggcggtagctcagtccg

SEQ ID NO: 299539 - DNA, 25 bp, Mus musculus
cctggcgagctaaggcatgcggccc

SEQ ID NO: 299540 - DNA, 25 bp, Mus musculus
atgcggcccggatcggaagtgccac

SEQ ID NO: 299541 - DNA, 25 bp, Mus musculus
cggcggcacagagcgcgcagtacca

SEQ ID NO: 299542 - DNA, 25 bp, Mus musculus
tacggggtgatcgtcccttcagacg

SEQ ID NO: 299543 - DNA, 25 bp, Mus musculus
tcggagccaagccatgtggctgcgc

SEQ ID NO: 299544 - DNA, 25 bp, Mus musculus
cagcgttgtgatccaggaaggcctg

SEQ ID NO: 299545 - DNA, 25 bp, Mus musculus
tgcagcgtctgtttccctagcgacg

SEQ ID NO: 299546 - DNA, 25 bp, Mus musculus
gccagctgcagcgtctgtttcccta

SEQ ID NO: 299547 - DNA, 25 bp, Mus musculus
cgggcatcgcgtgttgccagctgca

SEQ ID NO: 299548 - DNA, 25 bp, Mus musculus
agaagccgcagcctcgggtctccag

SEQ ID NO: 299549 - DNA, 25 bp, Mus musculus
cggacgcaggctccgagccacaaaa

SEQ ID NO: 299550 - DNA, 25 bp, Mus musculus
gggcccggactgaaccaccagcagt

SEQ ID NO: 299551 - DNA, 25 bp, Mus musculus
tctagaccgggtgtcaccaccaggc

SEQ ID NO: 299552 - DNA, 25 bp, Mus musculus
tgggctctggtcctgcgtctagacc

SEQ ID NO: 299553 - DNA, 25 bp, Mus musculus
acttagtgcgcaagaaaaagagccc

SEQ ID NO: 299554 - DNA, 25 bp, Mus musculus
ggctcggacttagtgcgcaagaaaa

SEQ ID NO: 299555 - DNA, 25 bp, Mus musculus
gtgatttcccggaggctcggactta

SEQ ID NO: 299556 - DNA, 25 bp, Mus musculus
caccgtgccgcggaggctgtgattt

SEQ ID NO: 299557 - DNA, 25 bp, Mus musculus
acgcaggctccgagccacaaaagtc

SEQ ID NO: 299558 - DNA, 25 bp, Mus musculus
ttcccaaccctaagagtcaagagcc

SEQ ID NO: 299559 - DNA, 25 bp, Mus musculus
gggcgaccgcattccttaggacagc

SEQ ID NO: 299560 - DNA, 25 bp, Mus musculus
ctgctgctccctgatatgtactttc

SEQ ID NO: 299561 - DNA, 25 bp, Mus musculus
caaggcgttctctttgtcgagcttc

SEQ ID NO: 299562 - DNA, 25 bp, Mus musculus
ttgctcagctcgatccaaggcgttc

SEQ ID NO: 299563 - DNA, 25 bp, Mus musculus
gtcctcggacgagacagaaaagtta

SEQ ID NO: 299564 - DNA, 25 bp, Mus musculus
gcctctctagggaagaagctcagtg

SEQ ID NO: 299565 - DNA, 25 bp, Mus musculus
agaacttcggacaccttaggacttg

SEQ ID NO: 299566 - DNA, 25 bp, Mus musculus
catcccgtgttgagggatctttctc

SEQ ID NO: 299567 - DNA, 25 bp, Mus musculus
gctagctttccgtgtgtctcccatt

SEQ ID NO: 299568 - DNA, 25 bp, Mus musculus
acatgtccttgtttggctagctttc

SEQ ID NO: 299569 - DNA, 25 bp, Mus musculus
ctcaatttgagggactgccgaaaca

SEQ ID NO: 299570 - DNA, 25 bp, Mus musculus
gacagcaagctcaggttctcaattt

SEQ ID NO: 299571 - DNA, 25 bp, Mus musculus
aagctcagtggacctcgcagaccgt

SEQ ID NO: 299572 - DNA, 25 bp, Mus musculus
ccagcagctggttgttagcgagacg

SEQ ID NO: 299573 - DNA, 25 bp, Mus musculus
actggaaatccctgcagcgcgcatg

SEQ ID NO: 299574 - DNA, 25 bp, Mus musculus
tcagagtcggggactaggaagcatc

SEQ ID NO: 299575 - DNA, 25 bp, Mus musculus
agcatcccggggtgtctttctccac

SEQ ID NO: 299576 - DNA, 25 bp, Mus musculus
tctttctccacgagccagagcggga

SEQ ID NO: 299577 - DNA, 25 bp, Mus musculus
ccagagcgggagacttgtttgcaaa

SEQ ID NO: 299578 - DNA, 25 bp, Mus musculus
tgctggaatgaagccgctctgctct

SEQ ID NO: 299579 - DNA, 25 bp, Mus musculus
cactgaaaatatggcgccctcgaac

SEQ ID NO: 299580 - DNA, 25 bp, Mus musculus
tgcttaaggctagggatcagctctc

SEQ ID NO: 299581 - DNA, 25 bp, Mus musculus
tggctcccgctgcaagactgtttgc

SEQ ID NO: 299582 - DNA, 25 bp, Mus musculus
gcggggatgcagctactgtctcatt

SEQ ID NO: 299583 - DNA, 25 bp, Mus musculus
tgcggcgaaacctacatgtgcaata

SEQ ID NO: 299584 - DNA, 25 bp, Mus musculus
gcttgacagggtttttctacattga

SEQ ID NO: 299585 - DNA, 25 bp, Mus musculus
gccggcgcgaaatctcagctcctga

SEQ ID NO: 299586 - DNA, 25 bp, Mus musculus
ccgatggtctgttgagccgcgcgct

SEQ ID NO: 299587 - DNA, 25 bp, Mus musculus
aagactgcgcgggtcgcaccgactg

SEQ ID NO: 299588 - DNA, 25 bp, Mus musculus
cacgctcgggcataagctagaagga

SEQ ID NO: 299589 - DNA, 25 bp, Mus musculus
gtccgcgccgagcatcggactctga

SEQ ID NO: 299590 - DNA, 25 bp, Mus musculus
cccaggctgggactttgccaccgtg

SEQ ID NO: 299591 - DNA, 25 bp, Mus musculus
agcatcggactctgagctcggcgcc

SEQ ID NO: 299592 - DNA, 25 bp, Mus musculus
ccgcgaagacagtgacgaagactgc

SEQ ID NO: 299593 - DNA, 25 bp, Mus musculus
gcatccctgacgaccgcgaagacag

SEQ ID NO: 299594 - DNA, 25 bp, Mus musculus
gctctcgaatcaccgcttcccgctg

SEQ ID NO: 299595 - DNA, 25 bp, Mus musculus
tcctgagcctgccttctccaacgtg

SEQ ID NO: 299596 - DNA, 25 bp, Mus musculus
aagcttctcggtcgacttcgctcct

SEQ ID NO: 299597 - DNA, 25 bp, Mus musculus
aggatgaagcttctcggtcgacttc

SEQ ID NO: 299598 - DNA, 25 bp, Mus musculus
cgggcataagctagaaggatgaagc

SEQ ID NO: 299599 - DNA, 25 bp, Mus musculus
tgggactttgccaccgtgcgcacac

SEQ ID NO: 299600 - DNA, 25 bp, Mus musculus
gtctggagtgagcacgtttgcgcac

SEQ ID NO: 299601 - DNA, 25 bp, Mus musculus
ctggccagacgtcgaggggctcgaa

SEQ ID NO: 299602 - DNA, 25 bp, Mus musculus
cagcccaggcttcgcgcagcgcagc

SEQ ID NO: 299603 - DNA, 25 bp, Mus musculus
cgctgtcgtcggctccgtgtctgca

SEQ ID NO: 299604 - DNA, 25 bp, Mus musculus
ggctccgtgtctgcagcccaggctt

SEQ ID NO: 299605 - DNA, 25 bp, Mus musculus
cgcagcgcagctcaggccgtgttag

SEQ ID NO: 299606 - DNA, 25 bp, Mus musculus
cagctcaggccgtgttaggttccag

SEQ ID NO: 299607 - DNA, 25 bp, Mus musculus
gttccagcctcggcgggatgaagaa

SEQ ID NO: 299608 - DNA, 25 bp, Mus musculus
agcacgtttgcgcacgcagcggatg

SEQ ID NO: 299609 - DNA, 25 bp, Mus musculus
aagtgcgcggctcagcagcttgccc

SEQ ID NO: 299610 - DNA, 25 bp, Mus musculus
cgcacgcagcggatgagcgagcttt

SEQ ID NO: 299611 - DNA, 25 bp, Mus musculus
gggagaaacccatctcggtcccgca

SEQ ID NO: 299612 - DNA, 25 bp, Mus musculus
agaaacccatctcggtcccgcaaga

SEQ ID NO: 299613 - DNA, 25 bp, Mus musculus
aggccgtgttaggttccagcctcgg

SEQ ID NO: 299614 - DNA, 25 bp, Mus musculus
ttgagctgagaaccttggtcccgca

SEQ ID NO: 299615 - DNA, 25 bp, Mus musculus
gagaaccttggtcccgcagcctggg

SEQ ID NO: 299616 - DNA, 25 bp, Mus musculus
tgggttcccagacccggcctctgtg

SEQ ID NO: 299617 - DNA, 25 bp, Mus musculus
ttctggtactcaaccccggctgttg

SEQ ID NO: 299618 - DNA, 25 bp, Mus musculus
cagagtaggattctggtactcaacc

SEQ ID NO: 299619 - DNA, 25 bp, Mus musculus
aagacccgctccagagtaggattct

SEQ ID NO: 299620 - DNA, 25 bp, Mus musculus
gtcgaagacccgctccagagtagga

SEQ ID NO: 299621 - DNA, 25 bp, Mus musculus
cccactcttgagctgagaaccttgg

SEQ ID NO: 299622 - DNA, 25 bp, Mus musculus
gcctctgtgcgagtagtagcgaccc

SEQ ID NO: 299623 - DNA, 25 bp, Mus musculus
cagacccggcctctgtgcgagtagt

SEQ ID NO: 299624 - DNA, 25 bp, Mus musculus
gtgcacaccacgcactcgacccggg

SEQ ID NO: 299625 - DNA, 25 bp, Mus musculus
cctccagaccgaacttggacgtgtg

SEQ ID NO: 299626 - DNA, 25 bp, Mus musculus
gaccgaacttggacgtgtgggctcc

SEQ ID NO: 299627 - DNA, 25 bp, Mus musculus
ctctgggtcgaagacccgctccaga

SEQ ID NO: 299628 - DNA, 25 bp, Mus musculus
cgggccgcagctgtcagtctctgcg

SEQ ID NO: 299629 - DNA, 25 bp, Mus musculus
tcggtggtcgctgacttgctgaacc

SEQ ID NO: 299630 - DNA, 25 bp, Mus musculus
cgctgacttgctgaaccgcttccta

SEQ ID NO: 299631 - DNA, 25 bp, Mus musculus
tgctgaaccgcttcctaggggacta

SEQ ID NO: 299632 - DNA, 25 bp, Mus musculus
cgcttcctaggggactacgtggaga

SEQ ID NO: 299633 - DNA, 25 bp, Mus musculus
ggggactacgtggagaacctgaaca

SEQ ID NO: 299634 - DNA, 25 bp, Mus musculus
ctacgtggagaacctgaacaagtcc

SEQ ID NO: 299635 - DNA, 25 bp, Mus musculus
ggagaacctgaacaagtcccagcta

SEQ ID NO: 299636 - DNA, 25 bp, Mus musculus
ctgaacaagtcccagctaaagctgg

SEQ ID NO: 299637 - DNA, 25 bp, Mus musculus
tcccagctaaagctggggatctggg

SEQ ID NO: 299638 - DNA, 25 bp, Mus musculus
cggtaagcgcgatgccacggcctac

SEQ ID NO: 299639 - DNA, 25 bp, Mus musculus
tgccacggcctaccggcgtgggaaa

SEQ ID NO: 299640 - DNA, 25 bp, Mus musculus
ccctgctgtcgatgtagccacacag

SEQ ID NO: 299641 - DNA, 25 bp, Mus musculus
cgatgtagccacacaggggcagcgc

SEQ ID NO: 299642 - DNA, 25 bp, Mus musculus
agcgcaactttgtagccgtgggttc

SEQ ID NO: 299643 - DNA, 25 bp, Mus musculus
ccgggcaaaaggaagaagcgcaact

SEQ ID NO: 299644 - DNA, 25 bp, Mus musculus
cgacgcgggcagcttctcttctgca

SEQ ID NO: 299645 - DNA, 25 bp, Mus musculus
cgagaagtgttcgaatcctccctct

SEQ ID NO: 299646 - DNA, 25 bp, Mus musculus
cccgcggtaggaatcgagaagtgtt

SEQ ID NO: 299647 - DNA, 25 bp, Mus musculus
tcggttaccttttctgcttttgaca

SEQ ID NO: 299648 - DNA, 25 bp, Mus musculus
tgtggctactcgctttctcggttac

SEQ ID NO: 299649 - DNA, 25 bp, Mus musculus
gacccgagcgttgacagccagacga

SEQ ID NO: 299650 - DNA, 25 bp, Mus musculus
gcaaacttttgcaagccagtgctgg

SEQ ID NO: 299651 - DNA, 25 bp, Mus musculus
agcctatcgtggtgccctgagcgac

SEQ ID NO: 299652 - DNA, 25 bp, Mus musculus
cgcaggcagagctatgcgagctcca

SEQ ID NO: 299653 - DNA, 25 bp, Mus musculus
ctgacccaggacacgggccgcaaga

SEQ ID NO: 299654 - DNA, 25 bp, Mus musculus
aacatggagtcagctccggcagccc

SEQ ID NO: 299655 - DNA, 25 bp, Mus musculus
ccgccgatctctacattgggaaaaa

SEQ ID NO: 299656 - DNA, 25 bp, Mus musculus
cgcgctcaggctagacacttaggtt

SEQ ID NO: 299657 - DNA, 25 bp, Mus musculus
ctgccggagctcacgtacagcttga

SEQ ID NO: 299658 - DNA, 25 bp, Mus musculus
gaagacaggatcagcccacgggatt

SEQ ID NO: 299659 - DNA, 25 bp, Mus musculus
tcggacgccgccacttcagaaagcg

SEQ ID NO: 299660 - DNA, 25 bp, Mus musculus
aagtgtggaaactcagcgctgcgtc

SEQ ID NO: 299661 - DNA, 25 bp, Mus musculus
gactggttagcgttccaggcctgcc

SEQ ID NO: 299662 - DNA, 25 bp, Mus musculus
ccgagccctgcatgcgaacgctagt

SEQ ID NO: 299663 - DNA, 25 bp, Mus musculus
aagctggggacatccacactgggtc

SEQ ID NO: 299664 - DNA, 25 bp, Mus musculus
agagtcgcagcgcttggaacgctca

SEQ ID NO: 299665 - DNA, 25 bp, Mus musculus
ttagctgctgtcactcgtctgggtg

SEQ ID NO: 299666 - DNA, 25 bp, Mus musculus
gcagccactggaacccaacggggtc

SEQ ID NO: 299667 - DNA, 25 bp, Mus musculus
atcgcagcgatgaaaggtgagctcc

SEQ ID NO: 299668 - DNA, 25 bp, Mus musculus
cccgggacaagtctggcctatgtgt

SEQ ID NO: 299669 - DNA, 25 bp, Mus musculus
cctccctggtctggggaagtaagct

SEQ ID NO: 299670 - DNA, 25 bp, Mus musculus
gcttttaaatgaggccttcgtaggc

SEQ ID NO: 299671 - DNA, 25 bp, Mus musculus
tcaccggactttgctcacaggcctt

SEQ ID NO: 299672 - DNA, 25 bp, Mus musculus
aggcagcgcctcaccggactttgct

SEQ ID NO: 299673 - DNA, 25 bp, Mus musculus
acgcgggtctgaggcagcgcctcac

SEQ ID NO: 299674 - DNA, 25 bp, Mus musculus
ggccagagccgcttgggaccctgag

SEQ ID NO: 299675 - DNA, 25 bp, Mus musculus
acaaaacgtgtgtggaagcgtcggc

SEQ ID NO: 299676 - DNA, 25 bp, Mus musculus
gtgagttcagcacaaaacgtgtgtg

SEQ ID NO: 299677 - DNA, 25 bp, Mus musculus
gcagcagtgagttcagcacaaaacg

SEQ ID NO: 299678 - DNA, 25 bp, Mus musculus
taaatgaggccttcgtaggcgggca

SEQ ID NO: 299679 - DNA, 25 bp, Mus musculus
gcggcgctcgcgtgacgtcatcacg

SEQ ID NO: 299680 - DNA, 25 bp, Mus musculus
cgactccggctcgtcgggaacgcga

SEQ ID NO: 299681 - DNA, 25 bp, Mus musculus
ggcttccctcacgtgtcttcctcgg

SEQ ID NO: 299682 - DNA, 25 bp, Mus musculus
gcgggcagcagtgagttcagcacaa

SEQ ID NO: 299683 - DNA, 25 bp, Mus musculus
tgtgtggaagcgtcggcttttctcg

SEQ ID NO: 299684 - DNA, 25 bp, Mus musculus
caacagagttgcaaagtgtcccgca

SEQ ID NO: 299685 - DNA, 25 bp, Mus musculus
aggctctcagcgatacgtgcccggc

SEQ ID NO: 299686 - DNA, 25 bp, Mus musculus
tcagcgatacgtgcccggcccaggt

SEQ ID NO: 299687 - DNA, 25 bp, Mus musculus
gaggcacggagagggacccactcca

SEQ ID NO: 299688 - DNA, 25 bp, Mus musculus
agagggacccactccacccggtgat

SEQ ID NO: 299689 - DNA, 25 bp, Mus musculus
tgcgaggccctgcaacagagttgca

SEQ ID NO: 299690 - DNA, 25 bp, Mus musculus
ctgctccgcttcaagggaggctctc

SEQ ID NO: 299691 - DNA, 25 bp, Mus musculus
tgtcccgcaagtgaccgtgctcttt

SEQ ID NO: 299692 - DNA, 25 bp, Mus musculus
aagtgaccgtgctctttgcatgcca

SEQ ID NO: 299693 - DNA, 25 bp, Mus musculus
ttgcatgccactctcctgaggggtc

SEQ ID NO: 299694 - DNA, 25 bp, Mus musculus
ggcggcattccagacgtgctagatg

SEQ ID NO: 299695 - DNA, 25 bp, Mus musculus
ccagcagtgagaagtcccacttcgc

SEQ ID NO: 299696 - DNA, 25 bp, Mus musculus
gagaagtcccacttcgctttccgca

SEQ ID NO: 299697 - DNA, 25 bp, Mus musculus
acccggtgatctgcgaggccctgca

SEQ ID NO: 299698 - DNA, 25 bp, Mus musculus
tgccatggctttccagacgaggctg

SEQ ID NO: 299699 - DNA, 25 bp, Mus musculus
tgtaccggacgaattgcaggaggtc

SEQ ID NO: 299700 - DNA, 25 bp, Mus musculus
ggagttgtggtccttaaggactaca

SEQ ID NO: 299701 - DNA, 25 bp, Mus musculus
tttgttgtgtatagagggccgctgt

SEQ ID NO: 299702 - DNA, 25 bp, Mus musculus
cacgtcgggatttgttgtgtataga

SEQ ID NO: 299703 - DNA, 25 bp, Mus musculus
gcccagagacacgtcgggatttgtt

SEQ ID NO: 299704 - DNA, 25 bp, Mus musculus
ccctccactccggaccgcccagaga

SEQ ID NO: 299705 - DNA, 25 bp, Mus musculus
tacccacgattacctgcctctgagc

SEQ ID NO: 299706 - DNA, 25 bp, Mus musculus
cttaaggactacaggcaagatggcc

SEQ ID NO: 299707 - DNA, 25 bp, Mus musculus
atggctttccagacgaggctgcgtc

SEQ ID NO: 299708 - DNA, 25 bp, Mus musculus
aggaagtccgcgctgccgctcagag

SEQ ID NO: 299709 - DNA, 25 bp, Mus musculus
caggccgaagaaccctcgagggtcg

SEQ ID NO: 299710 - DNA, 25 bp, Mus musculus
aattgcaggaggtcaggtcgccctc

SEQ ID NO: 299711 - DNA, 25 bp, Mus musculus
tggccgccaccaacgctacccacga

SEQ ID NO: 299712 - DNA, 25 bp, Mus musculus
ggactcagcccggtagagctcctct

SEQ ID NO: 299713 - DNA, 25 bp, Mus musculus
gtctgacttgagcaccttgaagcgc

SEQ ID NO: 299714 - DNA, 25 bp, Mus musculus
tgaacttgtagatctcgctgagcgg

SEQ ID NO: 299715 - DNA, 25 bp, Mus musculus
tgagcggcagcatcttctccggaga

SEQ ID NO: 299716 - DNA, 25 bp, Mus musculus
cggccgaggcatcttcttgcttggc

SEQ ID NO: 299717 - DNA, 25 bp, Mus musculus
tcttgcttggccacttgctcagggt

SEQ ID NO: 299718 - DNA, 25 bp, Mus musculus
ccggaggactggtcgaatctgagaa

SEQ ID NO: 299719 - DNA, 25 bp, Mus musculus
tgcagagacactggcgaggtcactc

SEQ ID NO: 299720 - DNA, 25 bp, Mus musculus
actcaggccgagtcacagatatagg

SEQ ID NO: 299721 - DNA, 25 bp, Mus musculus
attcgggtgccagcaactttgcgca

SEQ ID NO: 299722 - DNA, 25 bp, Mus musculus
gcaactttgcgcaccaaactgggta

SEQ ID NO: 299723 - DNA, 25 bp, Mus musculus
tcgctgccagctaggcttggactca

SEQ ID NO: 299724 - DNA, 25 bp, Mus musculus
gccgcctcgggatcttgatgaagca

SEQ ID NO: 299725 - DNA, 25 bp, Mus musculus
agttgttccaagttgccggtccgca

SEQ ID NO: 299726 - DNA, 25 bp, Mus musculus
gaaaaaagagcgtgcgcccagtagc

SEQ ID NO: 299727 - DNA, 25 bp, Mus musculus
tccgcgcaaatgtgacgcgcgctgg

SEQ ID NO: 299728 - DNA, 25 bp, Mus musculus
gagcgcttccttgcggagtggaacc

SEQ ID NO: 299729 - DNA, 25 bp, Mus musculus
ggtagtgtggccagagcgcttcctt

SEQ ID NO: 299730 - DNA, 25 bp, Mus musculus
cgtgcgcccagtagcttgtagcttt

SEQ ID NO: 299731 - DNA, 25 bp, Mus musculus
cgcatgtcatttcacttcgctagta

SEQ ID NO: 299732 - DNA, 25 bp, Mus musculus
atgtgacgcgcgctggactcaagcg

SEQ ID NO: 299733 - DNA, 25 bp, Mus musculus
cctactcggcgaggaagcaagatcc

SEQ ID NO: 299734 - DNA, 25 bp, Mus musculus
tagttatttctcctactcggcgagg

SEQ ID NO: 299735 - DNA, 25 bp, Mus musculus
gtccgcggtctagttatttctccta

SEQ ID NO: 299736 - DNA, 25 bp, Mus musculus
tgactgcgagttggagcctaaaagc

SEQ ID NO: 299737 - DNA, 25 bp, Mus musculus
cgctagtacaaatgactgcgagttg

SEQ ID NO: 299738 - DNA, 25 bp, Mus musculus
tagcttgtagctttgcgggtagtgt

SEQ ID NO: 299739 - DNA, 25 bp, Mus musculus
cgaggaagcaagatccgcgcaaatg

SEQ ID NO: 299740 - DNA, 25 bp, Mus musculus
gccgctttctgcgacctggccgtca

SEQ ID NO: 299741 - DNA, 25 bp, Mus musculus
ttccgccggggcgtacgcactgaat

SEQ ID NO: 299742 - DNA, 25 bp, Mus musculus
gacagaagggctcacggctgcgcat

SEQ ID NO: 299743 - DNA, 25 bp, Mus musculus
tagcctcgtttgttccgtgttccta

SEQ ID NO: 299744 - DNA, 25 bp, Mus musculus
ctggagcggaacctcccggttcctg

SEQ ID NO: 299745 - DNA, 25 bp, Mus musculus
gcccgaaagcctggagcggaacctc

SEQ ID NO: 299746 - DNA, 25 bp, Mus musculus
ctgcctcggacgctggtgccaggct

SEQ ID NO: 299747 - DNA, 25 bp, Mus musculus
ttcgcgttccgggtccgagcgctgc

SEQ ID NO: 299748 - DNA, 25 bp, Mus musculus
tccacagccgaccaagggcagcggg

SEQ ID NO: 299749 - DNA, 25 bp, Mus musculus
catgcgcagagaggaagcccgccga

SEQ ID NO: 299750 - DNA, 25 bp, Mus musculus
aactaagatcgtccgggaaaagctg

SEQ ID NO: 299751 - DNA, 25 bp, Mus musculus
ctgcaactaagatcgtccgggaaaa

SEQ ID NO: 299752 - DNA, 25 bp, Mus musculus
ccgcccggactgcaactaagatcgt

SEQ ID NO: 299753 - DNA, 25 bp, Mus musculus
tacgcactgaatccgggtcagctgc

SEQ ID NO: 299754 - DNA, 25 bp, Mus musculus
gctcgtttcagcagacgtcgaagtc

SEQ ID NO: 299755 - DNA, 25 bp, Mus musculus
gtaccgagcgctgtgcccgccggaa

SEQ ID NO: 299756 - DNA, 25 bp, Mus musculus
taggcgaccggcgtcccgctcggat

SEQ ID NO: 299757 - DNA, 25 bp, Mus musculus
aggggattccgaagttctgcagttg

SEQ ID NO: 299758 - DNA, 25 bp, Mus musculus
agttctgcagttgccgccaccttta

SEQ ID NO: 299759 - DNA, 25 bp, Mus musculus
tgcagttgccgccacctttaaagat

SEQ ID NO: 299760 - DNA, 25 bp, Mus musculus
aaagattggagatggccgagccagc

SEQ ID NO: 299761 - DNA, 25 bp, Mus musculus
ccgagccagctcgtttcagcagacg

SEQ ID NO: 299762 - DNA, 25 bp, Mus musculus
cgagcgccagcaggagagaccacgc

SEQ ID NO: 299763 - DNA, 25 bp, Mus musculus
agtggctcctgtggcgtcacctccg

SEQ ID NO: 299764 - DNA, 25 bp, Mus musculus
tcacctccgggtcgcgtgagcactt

SEQ ID NO: 299765 - DNA, 25 bp, Mus musculus
gtcactggcacagggctgcggtttc

SEQ ID NO: 299766 - DNA, 25 bp, Mus musculus
tgctaccgccgtggcggaagcgcct

SEQ ID NO: 299767 - DNA, 25 bp, Mus musculus
cggaagcgccttccctcaggtaggc

SEQ ID NO: 299768 - DNA, 25 bp, Mus musculus
tcagccctgcgcgtcagcattcagt

SEQ ID NO: 299769 - DNA, 25 bp, Mus musculus
atgcaatgccacttgcgctctgcgc

SEQ ID NO: 299770 - DNA, 25 bp, Mus musculus
cgcgaagatgcaatgccacttgcgc

SEQ ID NO: 299771 - DNA, 25 bp, Mus musculus
agttaaccctctcgcgtccagagtg

SEQ ID NO: 299772 - DNA, 25 bp, Mus musculus
gtccagagtgtcacgcggggcacac

SEQ ID NO: 299773 - DNA, 25 bp, Mus musculus
gcggggcacacgaggcttcatccct

SEQ ID NO: 299774 - DNA, 25 bp, Mus musculus
agcactatcccatgcctatccatgg

SEQ ID NO: 299775 - DNA, 25 bp, Mus musculus
tgcctatccatggagtggttgctcc

SEQ ID NO: 299776 - DNA, 25 bp, Mus musculus
ggggagacacctctgaagactcacc

SEQ ID NO: 299777 - DNA, 25 bp, Mus musculus
tggttgctccaaggtcacatcgacg

SEQ ID NO: 299778 - DNA, 25 bp, Mus musculus
cacatcgacggtccctgcggaagca

SEQ ID NO: 299779 - DNA, 25 bp, Mus musculus
cgccgcttgagtctagaggatgccc

SEQ ID NO: 299780 - DNA, 25 bp, Mus musculus
agtctagaggatgcccggacatgtg

SEQ ID NO: 299781 - DNA, 25 bp, Mus musculus
tgcgcgtcagcattcagttaaccct

SEQ ID NO: 299782 - DNA, 25 bp, Mus musculus
agtgacgcctgcaaaggcccgactc

SEQ ID NO: 299783 - DNA, 25 bp, Mus musculus
gttcatctttacgtctaggaagtcg

SEQ ID NO: 299784 - DNA, 25 bp, Mus musculus
gaatgctctccaagcttccatctgc

SEQ ID NO: 299785 - DNA, 25 bp, Mus musculus
cactgcacagcccagcgattgtgga

SEQ ID NO: 299786 - DNA, 25 bp, Mus musculus
ttccagcacagaagcccgccacggg

SEQ ID NO: 299787 - DNA, 25 bp, Mus musculus
tcagtgtcttcacctccggttcatc

SEQ ID NO: 299788 - DNA, 25 bp, Mus musculus
tgcagaagccgccttccagattcct

SEQ ID NO: 299789 - DNA, 25 bp, Mus musculus
aaggcccgactcttttctagtgatg

SEQ ID NO: 299790 - DNA, 25 bp, Mus musculus
ctctggcgaatgctctccaagcttc

SEQ ID NO: 299791 - DNA, 25 bp, Mus musculus
cacctccggttcatctttacgtcta

SEQ ID NO: 299792 - DNA, 25 bp, Mus musculus
cgtcctgtagttctcagtgtcttca

SEQ ID NO: 299793 - DNA, 25 bp, Mus musculus
tggctgcgtcctgtagttctcagtg

SEQ ID NO: 299794 - DNA, 25 bp, Mus musculus
cttttctagtgatggctgcgtcctg

SEQ ID NO: 299795 - DNA, 25 bp, Mus musculus
ttccagattcctcttccagcacaga

SEQ ID NO: 299796 - DNA, 25 bp, Mus musculus
gcactcaccgtcgggcgtcggagca

SEQ ID NO: 299797 - DNA, 25 bp, Mus musculus
cgccgctgacgcactattgggtaga

SEQ ID NO: 299798 - DNA, 25 bp, Mus musculus
ataccgcgccgctgacgcactattg

SEQ ID NO: 299799 - DNA, 25 bp, Mus musculus
gtccaccgcccggtccgcgattcaa

SEQ ID NO: 299800 - DNA, 25 bp, Mus musculus
tctgcgacaccgttgggagggtcag

SEQ ID NO: 299801 - DNA, 25 bp, Mus musculus
actccggtctgcgacaccgttggga

SEQ ID NO: 299802 - DNA, 25 bp, Mus musculus
gaggcacagccactccggtctgcga

SEQ ID NO: 299803 - DNA, 25 bp, Mus musculus
ggacgaggcacagccactccggtct

SEQ ID NO: 299804 - DNA, 25 bp, Mus musculus
agcgccatgagggccgccctggcaa

SEQ ID NO: 299805 - DNA, 25 bp, Mus musculus
gctgacgcactattgggtagacgca

SEQ ID NO: 299806 - DNA, 25 bp, Mus musculus
cgcgattcaaataccgcgccgctga

SEQ ID NO: 299807 - DNA, 25 bp, Mus musculus
gcaagtgcggacgaggcacagccac

SEQ ID NO: 299808 - DNA, 25 bp, Mus musculus
actattgggtagacgcacgcagggc

SEQ ID NO: 299809 - DNA, 25 bp, Mus musculus
acgcactattgggtagacgcacgca

SEQ ID NO: 299810 - DNA, 25 bp, Mus musculus
acgccctctcacagcagtatgtctg

SEQ ID NO: 299811 - DNA, 25 bp, Mus musculus
tgaacggccggcgtgccttacgccg

SEQ ID NO: 299812 - DNA, 25 bp, Mus musculus
ggagggcgtctgtcaacaccgccgc

SEQ ID NO: 299813 - DNA, 25 bp, Mus musculus
gctctcctcaggagggcgtctgtca

SEQ ID NO: 299814 - DNA, 25 bp, Mus musculus
tcttgcccggacacaatgagccact

SEQ ID NO: 299815 - DNA, 25 bp, Mus musculus
agtatgtctgcgcatgtgcgggcca

SEQ ID NO: 299816 - DNA, 25 bp, Mus musculus
ggaaagcgagcgctccggaccctca

SEQ ID NO: 299817 - DNA, 25 bp, Mus musculus
cgacagttcggaaagcgagcgctcc

SEQ ID NO: 299818 - DNA, 25 bp, Mus musculus
ttttacgacagttcggaaagcgagc

SEQ ID NO: 299819 - DNA, 25 bp, Mus musculus
ccctcccaagaggccgtgggtgtgt

SEQ ID NO: 299820 - DNA, 25 bp, Mus musculus
ggttaccttcctcactccattgtca

SEQ ID NO: 299821 - DNA, 25 bp, Mus musculus
cggggttaccttcctcactccattg

SEQ ID NO: 299822 - DNA, 25 bp, Mus musculus
cgcgcctgtcttctgctccgcggac

SEQ ID NO: 299823 - DNA, 25 bp, Mus musculus
cgggcggactcttgcccggacacaa

SEQ ID NO: 299824 - DNA, 25 bp, Mus musculus
gaagatcacggagctgcgggttatc

SEQ ID NO: 299825 - DNA, 25 bp, Mus musculus
tgcgggttatcgacctcaggtccga

SEQ ID NO: 299826 - DNA, 25 bp, Mus musculus
agacggtactggtctcccggctgaa

SEQ ID NO: 299827 - DNA, 25 bp, Mus musculus
gtccgagctgaagcgccgcaacttg

SEQ ID NO: 299828 - DNA, 25 bp, Mus musculus
ccgtttaggtgctacgcttccgcgg

SEQ ID NO: 299829 - DNA, 25 bp, Mus musculus
tcagtggctcattgtgcgcagcgta

SEQ ID NO: 299830 - DNA, 25 bp, Mus musculus
ctcaagtggcgatggctctaggtaa

SEQ ID NO: 299831 - DNA, 25 bp, Mus musculus
tctccctactatggggtgcctctca

SEQ ID NO: 299832 - DNA, 25 bp, Mus musculus
tttcggtgaagagacgcacctactc

SEQ ID NO: 299833 - DNA, 25 bp, Mus musculus
tacttcttccgggaaggctggcgca

SEQ ID NO: 299834 - DNA, 25 bp, Mus musculus
cgcaacttggacatcaacggggtca

SEQ ID NO: 299835 - DNA, 25 bp, Mus musculus
catcaacggggtcaagacggtactg

SEQ ID NO: 299836 - DNA, 25 bp, Mus musculus
accacctttccacgatgattccgta

SEQ ID NO: 299837 - DNA, 25 bp, Mus musculus
ggcagcgcgttgctttcccaaaatg

SEQ ID NO: 299838 - DNA, 25 bp, Mus musculus
cctcccgcgcgttcaggctagggaa

SEQ ID NO: 299839 - DNA, 25 bp, Mus musculus
ctcggagcgtgcctccgcgtgactg

SEQ ID NO: 299840 - DNA, 25 bp, Mus musculus
cgcgtgactgcgctcgttgaagcgc

SEQ ID NO: 299841 - DNA, 25 bp, Mus musculus
tgaagcgcccggacccactcgggga

SEQ ID NO: 299842 - DNA, 25 bp, Mus musculus
gagccgcagcgccactaggaaaata

SEQ ID NO: 299843 - DNA, 25 bp, Mus musculus
gacagccgctctgtagcagctccag

SEQ ID NO: 299844 - DNA, 25 bp, Mus musculus
gacgccatgacagccgctctgtagc

SEQ ID NO: 299845 - DNA, 25 bp, Mus musculus
ggtcctatagacaccgcggccggct

SEQ ID NO: 299846 - DNA, 25 bp, Mus musculus
aggcggtcaccttgtgctgccctct

SEQ ID NO: 299847 - DNA, 25 bp, Mus musculus
ctcggccaggcacgtcaccgtagag

SEQ ID NO: 299848 - DNA, 25 bp, Mus musculus
ggctgtcagggctgttctccatccc

SEQ ID NO: 299849 - DNA, 25 bp, Mus musculus
tgtgctgccctcttgaaggcacctc

SEQ ID NO: 299850 - DNA, 25 bp, Mus musculus
tgtgtgctgccggaagttgaactcc

SEQ ID NO: 299851 - DNA, 25 bp, Mus musculus
aaaataatcttgtgtgtgctgccgg

SEQ ID NO: 299852 - DNA, 25 bp, Mus musculus
gtaagtaacagtcgcgctggccgcc

SEQ ID NO: 299853 - DNA, 25 bp, Mus musculus
agccctcgaggagtgcgtcccgact

SEQ ID NO: 299854 - DNA, 25 bp, Mus musculus
gtgctgtttagttcgcggccgcctc

SEQ ID NO: 299855 - DNA, 25 bp, Mus musculus
cccagcacgtctcgtaagtaacagt

SEQ ID NO: 299856 - DNA, 25 bp, Mus musculus
tactggccgctcacgtcgtagtagc

SEQ ID NO: 299857 - DNA, 25 bp, Mus musculus
aactccttgtcgtactggccgctca

SEQ ID NO: 299858 - DNA, 25 bp, Mus musculus
tgttgcactcgaactccttgtcgta

SEQ ID NO: 299859 - DNA, 25 bp, Mus musculus
agccgctctcgctgttgttgcactc

SEQ ID NO: 299860 - DNA, 25 bp, Mus musculus
cgcagcagtacaggtagccgctctc

SEQ ID NO: 299861 - DNA, 25 bp, Mus musculus
caggtgccgcagcagtacaggtagc

SEQ ID NO: 299862 - DNA, 25 bp, Mus musculus
agaagcgatagtagcaggtgccgca

SEQ ID NO: 299863 - DNA, 25 bp, Mus musculus
tgcagcagaagcgatagtagcaggt

SEQ ID NO: 299864 - DNA, 25 bp, Mus musculus
cgtcccgactgggacagtggcccga

SEQ ID NO: 299865 - DNA, 25 bp, Mus musculus
agcgctcagccctcgaggagtgcgt

SEQ ID NO: 299866 - DNA, 25 bp, Mus musculus
tgtcaggtctcctcggcttctgtca

SEQ ID NO: 299867 - DNA, 25 bp, Mus musculus
cgacagtgttaattctgctcctctc

SEQ ID NO: 299868 - DNA, 25 bp, Mus musculus
ctgctctccgccagcggacaggaag

SEQ ID NO: 299869 - DNA, 25 bp, Mus musculus
cctcgcgagtgtattgggtgccgtc

SEQ ID NO: 299870 - DNA, 25 bp, Mus musculus
agtgtattgggtgccgtcgcgtcac

SEQ ID NO: 299871 - DNA, 25 bp, Mus musculus
ctcaggatcgatgcaccgcggttaa

SEQ ID NO: 299872 - DNA, 25 bp, Mus musculus
atgcaccgcggttaacccgtgagga

SEQ ID NO: 299873 - DNA, 25 bp, Mus musculus
gcagactcgcagcaacttgcgaggt

SEQ ID NO: 299874 - DNA, 25 bp, Mus musculus
atggtgttgccgacagtgttaattc

SEQ ID NO: 299875 - DNA, 25 bp, Mus musculus
ggcttctgtcagctctctcagctcg

SEQ ID NO: 299876 - DNA, 25 bp, Mus musculus
cagcaacttgcgaggttggcagcgc

SEQ ID NO: 299877 - DNA, 25 bp, Mus musculus
cgggagcattgttctgcaagcgagc

SEQ ID NO: 299878 - DNA, 25 bp, Mus musculus
gcattgttctgcaagcgagcgagcg

SEQ ID NO: 299879 - DNA, 25 bp, Mus musculus
tgtgcgtgtcccacccgagtgcctt

SEQ ID NO: 299880 - DNA, 25 bp, Mus musculus
cggccgtatgcaaatgtcctcctgg

SEQ ID NO: 299881 - DNA, 25 bp, Mus musculus
caaatggagtttggctctggggtcc

SEQ ID NO: 299882 - DNA, 25 bp, Mus musculus
ctggggtcccttagagctcagggca

SEQ ID NO: 299883 - DNA, 25 bp, Mus musculus
tccggtcctagatgtccctagggca

SEQ ID NO: 299884 - DNA, 25 bp, Mus musculus
tgactctttagagccggctagggtc

SEQ ID NO: 299885 - DNA, 25 bp, Mus musculus
aggtctcctcagagcagtccgggct

SEQ ID NO: 299886 - DNA, 25 bp, Mus musculus
ggtgggatttcccagagcagacctg

SEQ ID NO: 299887 - DNA, 25 bp, Mus musculus
gagaaccggtcccaaacagaaggca

SEQ ID NO: 299888 - DNA, 25 bp, Mus musculus
gctttctggaagcatcctctggatc

SEQ ID NO: 299889 - DNA, 25 bp, Mus musculus
tcaagtacaccaaggtaaagccgtc

SEQ ID NO: 299890 - DNA, 25 bp, Mus musculus
acgcccaacctcgagatcaagtaca

SEQ ID NO: 299891 - DNA, 25 bp, Mus musculus
tggccgcccatgacttccagcgaga

SEQ ID NO: 299892 - DNA, 25 bp, Mus musculus
acctgcctatatacagcgagcgcgc

SEQ ID NO: 299893 - DNA, 25 bp, Mus musculus
gtgggccgcacgtccaataagaagc

SEQ ID NO: 299894 - DNA, 25 bp, Mus musculus
cttctccgagccgaagggagcttta

SEQ ID NO: 299895 - DNA, 25 bp, Mus musculus
gctttggtaccggagctcgttcaaa

SEQ ID NO: 299896 - DNA, 25 bp, Mus musculus
gaagttacatcaccgccaaggcgtc

SEQ ID NO: 299897 - DNA, 25 bp, Mus musculus
ttgaaatgccggaaacggacaggcc

SEQ ID NO: 299898 - DNA, 25 bp, Mus musculus
ccgaagggagctttattgaaatgcc

SEQ ID NO: 299899 - DNA, 25 bp, Mus musculus
ttttcccggaagagcacggcttctc

SEQ ID NO: 299900 - DNA, 25 bp, Mus musculus
agcgagaacattgcgcacgggctgc

SEQ ID NO: 299901 - DNA, 25 bp, Mus musculus
gcaaaagtctctcctggcgcctcaa

SEQ ID NO: 299902 - DNA, 25 bp, Mus musculus
accgcttactcgttgcgcaaaagtc

SEQ ID NO: 299903 - DNA, 25 bp, Mus musculus
tgagagcctgttccctgatcccgat

SEQ ID NO: 299904 - DNA, 25 bp, Mus musculus
ggatcccgatccctgagagcctgtt

SEQ ID NO: 299905 - DNA, 25 bp, Mus musculus
ctcgttcaaagctgtagtgcgaaca

SEQ ID NO: 299906 - DNA, 25 bp, Mus musculus
cgttccgatcaagaggctttggtac

SEQ ID NO: 299907 - DNA, 25 bp, Mus musculus
gaacatgaaatcgagcaggcgcggc

SEQ ID NO: 299908 - DNA, 25 bp, Mus musculus
tgcgcaaagctgcaggagctcgagc

SEQ ID NO: 299909 - DNA, 25 bp, Mus musculus
tgagacctccctgcgcccataccag

SEQ ID NO: 299910 - DNA, 25 bp, Mus musculus
gtctgcagtactgggctcagcgtag

SEQ ID NO: 299911 - DNA, 25 bp, Mus musculus
cgactcgtctgcagtactgggctca

SEQ ID NO: 299912 - DNA, 25 bp, Mus musculus
ccaactgtccgactcgtctgcagta

SEQ ID NO: 299913 - DNA, 25 bp, Mus musculus
ccgcagctgtcactagagccctgta

SEQ ID NO: 299914 - DNA, 25 bp, Mus musculus
atcccacgaccgacgctgaggctga

SEQ ID NO: 299915 - DNA, 25 bp, Mus musculus
tgcaggagctcgagcctgtcgagtt

SEQ ID NO: 299916 - DNA, 25 bp, Mus musculus
agcctgtcgagttcccgggcaccgt

SEQ ID NO: 299917 - DNA, 25 bp, Mus musculus
gagttcccgggcaccgtctgggctc

SEQ ID NO: 299918 - DNA, 25 bp, Mus musculus
gctcggagctcacttaccgcctctg

SEQ ID NO: 299919 - DNA, 25 bp, Mus musculus
gacagtcccgggcgatccctgaaac

SEQ ID NO: 299920 - DNA, 25 bp, Mus musculus
ctgaggctgagcactgcgcaaagct

SEQ ID NO: 299921 - DNA, 25 bp, Mus musculus
actagagccctgtacaggctcgcca

SEQ ID NO: 299922 - DNA, 25 bp, Mus musculus
ccgtggctcccgcaagtttccaagg

SEQ ID NO: 299923 - DNA, 25 bp, Mus musculus
cgcatccaaccttcccgattaaagt

SEQ ID NO: 299924 - DNA, 25 bp, Mus musculus
caaagggacctgagttccgcacgtc

SEQ ID NO: 299925 - DNA, 25 bp, Mus musculus
ctccgcgccgtacaaagggacctga

SEQ ID NO: 299926 - DNA, 25 bp, Mus musculus
caatagagctgacaagttgcgggga

SEQ ID NO: 299927 - DNA, 25 bp, Mus musculus
cactcgctcagcaacaatagagctg

SEQ ID NO: 299928 - DNA, 25 bp, Mus musculus
gtgactcactcgctcagcaacaata

SEQ ID NO: 299929 - DNA, 25 bp, Mus musculus
tccgcgcctcaagcgcgtcggctta

SEQ ID NO: 299930 - DNA, 25 bp, Mus musculus
caagtttccaaggtggctcggcttc

SEQ ID NO: 299931 - DNA, 25 bp, Mus musculus
cgacccggagaccaagtgactcact

SEQ ID NO: 299932 - DNA, 25 bp, Mus musculus
tgggtctcctcaggcggacattttt

SEQ ID NO: 299933 - DNA, 25 bp, Mus musculus
gctgaggcggcctcagcaccgagct

SEQ ID NO: 299934 - DNA, 25 bp, Mus musculus
ttttttccgctgaggcggcctcagc

SEQ ID NO: 299935 - DNA, 25 bp, Mus musculus
cccgatagaacttgtgggtctcctc

SEQ ID NO: 299936 - DNA, 25 bp, Mus musculus
tgagcccggaatccaattacttttc

SEQ ID NO: 299937 - DNA, 25 bp, Mus musculus
cctggggcaagcgtgcttgcccttc

SEQ ID NO: 299938 - DNA, 25 bp, Mus musculus
gcgctgagcccggaatccaattact

SEQ ID NO: 299939 - DNA, 25 bp, Mus musculus
atccaattacttttccctgaggagc

SEQ ID NO: 299940 - DNA, 25 bp, Mus musculus
ttccctgaggagcttcgtacacccg

SEQ ID NO: 299941 - DNA, 25 bp, Mus musculus
gaggagcttcgtacacccgccaggc

SEQ ID NO: 299942 - DNA, 25 bp, Mus musculus
ggagcagcagccgtcgggactattt

SEQ ID NO: 299943 - DNA, 25 bp, Mus musculus
cagccgtcgggactatttgtccttc

SEQ ID NO: 299944 - DNA, 25 bp, Mus musculus
gactatttgtccttccgcgtgcggc

SEQ ID NO: 299945 - DNA, 25 bp, Mus musculus
cccaaggatgagtggcaggagatta

SEQ ID NO: 299946 - DNA, 25 bp, Mus musculus
tccgagcacggaggtcgccttgtgt

SEQ ID NO: 299947 - DNA, 25 bp, Mus musculus
tcgccttgtgtccagtggccttttc

SEQ ID NO: 299948 - DNA, 25 bp, Mus musculus
gtccagtggccttttcctgggcgca

SEQ ID NO: 299949 - DNA, 25 bp, Mus musculus
ctcagctgcggctttccgccgttcc

SEQ ID NO: 299950 - DNA, 25 bp, Mus musculus
cctcttcatagaggccctgaggtgg

SEQ ID NO: 299951 - DNA, 25 bp, Mus musculus
ggtggcaccgattcctcttcataga

SEQ ID NO: 299952 - DNA, 25 bp, Mus musculus
ccttccctaacggaggcgatcttga

SEQ ID NO: 299953 - DNA, 25 bp, Mus musculus
gctcgcctggcccagtctgagcgaa

SEQ ID NO: 299954 - DNA, 25 bp, Mus musculus
tgacgcccaggaagcaaaacaggaa

SEQ ID NO: 299955 - DNA, 25 bp, Mus musculus
tcgggagcgtcgtaaaactgtcgta

SEQ ID NO: 299956 - DNA, 25 bp, Mus musculus
cgaatctttacggttccggctgtga

SEQ ID NO: 299957 - DNA, 25 bp, Mus musculus
acaatgcctcggacttcttagggga

SEQ ID NO: 299958 - DNA, 25 bp, Mus musculus
gcctgacaaatggaggtccgccctg

SEQ ID NO: 299959 - DNA, 25 bp, Mus musculus
gcgaatgactaaactacaatgcctc

SEQ ID NO: 299960 - DNA, 25 bp, Mus musculus
aaacaggaagtagcgtcagcgtggc

SEQ ID NO: 299961 - DNA, 25 bp, Mus musculus
tggcccgctttctggctgtcagtct

SEQ ID NO: 299962 - DNA, 25 bp, Mus musculus
ggcgatcttgacctatggcgaatga

SEQ ID NO: 299963 - DNA, 25 bp, Mus musculus
gcgagcaagcgactccgaatcttta

SEQ ID NO: 299964 - DNA, 25 bp, Mus musculus
agcacggcgcatatggccgcgctcg

SEQ ID NO: 299965 - DNA, 25 bp, Mus musculus
gagccgctccgctcacggtaagcgt

SEQ ID NO: 299966 - DNA, 25 bp, Mus musculus
aggccaacccggagcctacccatga

SEQ ID NO: 299967 - DNA, 25 bp, Mus musculus
aggtccgcagcacggcgcatatggc

SEQ ID NO: 299968 - DNA, 25 bp, Mus musculus
acgcgcgaggccaacccggagccta

SEQ ID NO: 299969 - DNA, 25 bp, Mus musculus
ctcgcctcccgcgttggcgggaaga

SEQ ID NO: 299970 - DNA, 25 bp, Mus musculus
ctacccatgaggcactgcgccctgg

SEQ ID NO: 299971 - DNA, 25 bp, Mus musculus
gctccgcgatgggagccggagcggc

SEQ ID NO: 299972 - DNA, 25 bp, Mus musculus
tcctcagggctccagtcaggccgag

SEQ ID NO: 299973 - DNA, 25 bp, Mus musculus
agggctccagtcaggccgagccgct

SEQ ID NO: 299974 - DNA, 25 bp, Mus musculus
gccatgagcgccacggcctagctca

SEQ ID NO: 299975 - DNA, 25 bp, Mus musculus
cttcgaggtccgcagcacggcgcat

SEQ ID NO: 299976 - DNA, 25 bp, Mus musculus
tcgaggtccgcagcacggcgcatat

SEQ ID NO: 299977 - DNA, 25 bp, Mus musculus
tcagggctccagtcaggccgagccg

SEQ ID NO: 299978 - DNA, 25 bp, Mus musculus
cgctagggcaaagcgtccgaacttc

SEQ ID NO: 299979 - DNA, 25 bp, Mus musculus
agcgtccgaacttcgcgcttttggc

SEQ ID NO: 299980 - DNA, 25 bp, Mus musculus
tggtcctatggaaggagcgctcctg

SEQ ID NO: 299981 - DNA, 25 bp, Mus musculus
ctgcctggcaacgaagactctccgt

SEQ ID NO: 299982 - DNA, 25 bp, Mus musculus
gaagactctccgtgctgattggata

SEQ ID NO: 299983 - DNA, 25 bp, Mus musculus
ctccgtgctgattggatattgtgcc

SEQ ID NO: 299984 - DNA, 25 bp, Mus musculus
tggatattgtgccagccaatgggag

SEQ ID NO: 299985 - DNA, 25 bp, Mus musculus
gcatttttggcggttgccgggacac

SEQ ID NO: 299986 - DNA, 25 bp, Mus musculus
tgccgggacacagcttaaacttaac

SEQ ID NO: 299987 - DNA, 25 bp, Mus musculus
ttaaacttaacccagcgtgcacagg

SEQ ID NO: 299988 - DNA, 25 bp, Mus musculus
ttaacccagcgtgcacaggtatccg

SEQ ID NO: 299989 - DNA, 25 bp, Mus musculus
gtgcacaggtatccgctgccgtggc

SEQ ID NO: 299990 - DNA, 25 bp, Mus musculus
gatgtaaacggctcccgctagggca

SEQ ID NO: 299991 - DNA, 25 bp, Mus musculus
acttcgcgcttttggcttggtccta

SEQ ID NO: 299992 - DNA, 25 bp, Mus musculus
agctgcccgcgcgactgggtacctg

SEQ ID NO: 299993 - DNA, 25 bp, Mus musculus
gaggtcccgtccagctgcaagctgc

SEQ ID NO: 299994 - DNA, 25 bp, Mus musculus
cttcccgcgagagttctcaggtctc

SEQ ID NO: 299995 - DNA, 25 bp, Mus musculus
ggtgaccgtacatcttcccgcgaga

SEQ ID NO: 299996 - DNA, 25 bp, Mus musculus
ttgccgtggtgaccgtacatcttcc

SEQ ID NO: 299997 - DNA, 25 bp, Mus musculus
tgaactcaccggcactctaacactt

SEQ ID NO: 299998 - DNA, 25 bp, Mus musculus
ctggggttgaactcaccggcactct

SEQ ID NO: 299999 - DNA, 25 bp, Mus musculus
ccactggtcagtagtctggggttga

SEQ ID NO: 300000 - DNA, 25 bp, Mus musculus
cgcagcccaaccactggtcagtagt

SEQ ID NO: 300001 - DNA, 25 bp, Mus musculus
agttcaagagagtccggtgtccgtc

SEQ ID NO: 300002 - DNA, 25 bp, Mus musculus
agagttgcagagctcaagttcaaga

SEQ ID NO: 300003 - DNA, 25 bp, Mus musculus
ccgcgtctctgcagacagagttgca

SEQ ID NO: 300004 - DNA, 25 bp, Mus musculus
agttctcaggtctcgggcagcctcc

SEQ ID NO: 300005 - DNA, 25 bp, Mus musculus
cgactgggtacctgcagaaccgcgt

SEQ ID NO: 300006 - DNA, 25 bp, Mus musculus
ccgcatggagccttctgggctcggc

SEQ ID NO: 300007 - DNA, 25 bp, Mus musculus
ccgagaccggaggaagcgtgctcct

SEQ ID NO: 300008 - DNA, 25 bp, Mus musculus
tccggagcccaagggcggtcaagcc

SEQ ID NO: 300009 - DNA, 25 bp, Mus musculus
gggactcctccacaaccagagggca

SEQ ID NO: 300010 - DNA, 25 bp, Mus musculus
tcctgcctgcggagcagagccttca

SEQ ID NO: 300011 - DNA, 25 bp, Mus musculus
tgtcgccagctctggcgtctgttcc

SEQ ID NO: 300012 - DNA, 25 bp, Mus musculus
tggcagcacttgtacgcgccgcagt

SEQ ID NO: 300013 - DNA, 25 bp, Mus musculus
gcggtctcctaaactcatggcagca

SEQ ID NO: 300014 - DNA, 25 bp, Mus musculus
tggcccaaaggaggcgcggtctcct

SEQ ID NO: 300015 - DNA, 25 bp, Mus musculus
cagaagcggaagctcgagcggaaat

SEQ ID NO: 300016 - DNA, 25 bp, Mus musculus
ggcctccttcggcttccggcagaag

SEQ ID NO: 300017 - DNA, 25 bp, Mus musculus
gccaagaggaaagagcggcctcctt

SEQ ID NO: 300018 - DNA, 25 bp, Mus musculus
cagcgtcaccaacgagccaagagga

SEQ ID NO: 300019 - DNA, 25 bp, Mus musculus
tctcaccgcccgaagcctggggtga

SEQ ID NO: 300020 - DNA, 25 bp, Mus musculus
cgaccagaccgagtaggctcgctgc

SEQ ID NO: 300021 - DNA, 25 bp, Mus musculus
gctcgctgcgctagctcgtcgaaaa

SEQ ID NO: 300022 - DNA, 25 bp, Mus musculus
tcgctgcgctagctcgtcgaaaagc

SEQ ID NO: 300023 - DNA, 25 bp, Mus musculus
gctgcgctagctcgtcgaaaagctc

SEQ ID NO: 300024 - DNA, 25 bp, Mus musculus
tgcgctagctcgtcgaaaagctctc

SEQ ID NO: 300025 - DNA, 25 bp, Mus musculus
gctagctcgtcgaaaagctctcacc

SEQ ID NO: 300026 - DNA, 25 bp, Mus musculus
tagctcgtcgaaaagctctcacctg

SEQ ID NO: 300027 - DNA, 25 bp, Mus musculus
gctcgtcgaaaagctctcacctgct

SEQ ID NO: 300028 - DNA, 25 bp, Mus musculus
gtcgaaaagctctcacctgctccag

SEQ ID NO: 300029 - DNA, 25 bp, Mus musculus
tgctccagctcagtccggtggctga

SEQ ID NO: 300030 - DNA, 25 bp, Mus musculus
ctccagctcagtccggtggctgaga

SEQ ID NO: 300031 - DNA, 25 bp, Mus musculus
ctgagagaggaagcagtcctgacta

SEQ ID NO: 300032 - DNA, 25 bp, Mus musculus
ccagaccgagtaggctcgctgcgct

SEQ ID NO: 300033 - DNA, 25 bp, Mus musculus
accgagtaggctcgctgcgctagct

SEQ ID NO: 300034 - DNA, 25 bp, Mus musculus
cggccggagaaagcgactcactcga

SEQ ID NO: 300035 - DNA, 25 bp, Mus musculus
aggcctagcttatccagcttccttc

SEQ ID NO: 300036 - DNA, 25 bp, Mus musculus
gtataggcctagcttatccagcttc

SEQ ID NO: 300037 - DNA, 25 bp, Mus musculus
ggggtataggcctagcttatccagc

SEQ ID NO: 300038 - DNA, 25 bp, Mus musculus
ccctggggtataggcctagcttatc

SEQ ID NO: 300039 - DNA, 25 bp, Mus musculus
agccctggggtataggcctagctta

SEQ ID NO: 300040 - DNA, 25 bp, Mus musculus
tcactcgagccctggggtataggcc

SEQ ID NO: 300041 - DNA, 25 bp, Mus musculus
cgactcactcgagccctggggtata

SEQ ID NO: 300042 - DNA, 25 bp, Mus musculus
ccggagaaagcgactcactcgagcc

SEQ ID NO: 300043 - DNA, 25 bp, Mus musculus
tccgcgtctcttccctcacccttcc

SEQ ID NO: 300044 - DNA, 25 bp, Mus musculus
ctcaggcggccggagaaagcgactc

SEQ ID NO: 300045 - DNA, 25 bp, Mus musculus
ccgtgacgagaaccgcgaggagaac

SEQ ID NO: 300046 - DNA, 25 bp, Mus musculus
cgccatgcctctgccgcggtgacgc

SEQ ID NO: 300047 - DNA, 25 bp, Mus musculus
gaaagcgactcactcgagccctggg

SEQ ID NO: 300048 - DNA, 25 bp, Mus musculus
gttgttcgagcaaaaccgcaaggta

SEQ ID NO: 300049 - DNA, 25 bp, Mus musculus
gctcccagggagacctgttgttcga

SEQ ID NO: 300050 - DNA, 25 bp, Mus musculus
cagatttaggcctgcgcattccttc

SEQ ID NO: 300051 - DNA, 25 bp, Mus musculus
cggccaggagcacgcttttcaaatg

SEQ ID NO: 300052 - DNA, 25 bp, Mus musculus
ggggctagctaaaacgcctaatctg

SEQ ID NO: 300053 - DNA, 25 bp, Mus musculus
aatctgtaggcgacaggctcgcgtg

SEQ ID NO: 300054 - DNA, 25 bp, Mus musculus
cgctccggacgagctccttgtttct

SEQ ID NO: 300055 - DNA, 25 bp, Mus musculus
cggaagagccacgtttctcggccct

SEQ ID NO: 300056 - DNA, 25 bp, Mus musculus
tccttgtttctggagtcccgccacg

SEQ ID NO: 300057 - DNA, 25 bp, Mus musculus
gcgcttcgtccagcatgagctcgga

SEQ ID NO: 300058 - DNA, 25 bp, Mus musculus
tgagctcggacatggcagccgacga

SEQ ID NO: 300059 - DNA, 25 bp, Mus musculus
ccagtactctcggaggacgaggtgc

SEQ ID NO: 300060 - DNA, 25 bp, Mus musculus
accctctccgggagggccatggctt

SEQ ID NO: 300061 - DNA, 25 bp, Mus musculus
ggagccgacagaacttagcgacttt

SEQ ID NO: 300062 - DNA, 25 bp, Mus musculus
accactagcccagttcatgccattg

SEQ ID NO: 300063 - DNA, 25 bp, Mus musculus
caggggccagatgtagaaagtagtc

SEQ ID NO: 300064 - DNA, 25 bp, Mus musculus
cccaggtgcattgtccagcggggcc

SEQ ID NO: 300065 - DNA, 25 bp, Mus musculus
gtcgcccaggcgatctcagcgtgtc

SEQ ID NO: 300066 - DNA, 25 bp, Mus musculus
tcccatgcgagtgtgcgcgaccgtg

SEQ ID NO: 300067 - DNA, 25 bp, Mus musculus
ggttctctccggatgcgctctcgga

SEQ ID NO: 300068 - DNA, 25 bp, Mus musculus
ctgagtggcagcctctccacgcagg

SEQ ID NO: 300069 - DNA, 25 bp, Mus musculus
tcatgccattgtccgagctgcggcc

SEQ ID NO: 300070 - DNA, 25 bp, Mus musculus
gcggccgcacgtggttttatttata

SEQ ID NO: 300071 - DNA, 25 bp, Mus musculus
ttatattgtttcctgagtggcagcc

SEQ ID NO: 300072 - DNA, 25 bp, Mus musculus
ttcctccaggtctcggtggccaagc

SEQ ID NO: 300073 - DNA, 25 bp, Mus musculus
ggatccgctgaccactagcccagtt

SEQ ID NO: 300074 - DNA, 25 bp, Mus musculus
gaggccgagtctccctggatccgct

SEQ ID NO: 300075 - DNA, 25 bp, Mus musculus
tttgcagtggggttcctccaggtct

SEQ ID NO: 300076 - DNA, 25 bp, Mus musculus
tgtccttccgcctgagcactgagaa

SEQ ID NO: 300077 - DNA, 25 bp, Mus musculus
cccaaggctacgagcgtgaaaggta

SEQ ID NO: 300078 - DNA, 25 bp, Mus musculus
aattagcttgacgagtcgaagtccc

SEQ ID NO: 300079 - DNA, 25 bp, Mus musculus
agtcgaagtcccaccgacattctcg

SEQ ID NO: 300080 - DNA, 25 bp, Mus musculus
gacattctcgtctcctggctgccaa

SEQ ID NO: 300081 - DNA, 25 bp, Mus musculus
attactgcagctacccgtgtggggc

SEQ ID NO: 300082 - DNA, 25 bp, Mus musculus
aagtggtgctgtaccgcctgtcctt

SEQ ID NO: 300083 - DNA, 25 bp, Mus musculus
aaggcctgaagccagacagtgtcta

SEQ ID NO: 300084 - DNA, 25 bp, Mus musculus
tgagcactgagaacgccatccaagt

SEQ ID NO: 300085 - DNA, 25 bp, Mus musculus
gagtcgtcggtgtggacctcacaca

SEQ ID NO: 300086 - DNA, 25 bp, Mus musculus
ccatccaagttgtagaactcccggg

SEQ ID NO: 300087 - DNA, 25 bp, Mus musculus
gaccgtgcacgagtaccttctggaa

SEQ ID NO: 300088 - DNA, 25 bp, Mus musculus
acagtgtctatctggttcggattac

SEQ ID NO: 300089 - DNA, 25 bp, Mus musculus
tggacctcacacaggacgcccaagg

SEQ ID NO: 300090 - DNA, 25 bp, Mus musculus
cccactttgtgtgcagacgtgcagc

SEQ ID NO: 300091 - DNA, 25 bp, Mus musculus
agcgcggagcaggacattgcgccct

SEQ ID NO: 300092 - DNA, 25 bp, Mus musculus
gagcaggacattgcgcccttgcgcc

SEQ ID NO: 300093 - DNA, 25 bp, Mus musculus
tcggctgcctcccaaacttttcaaa

SEQ ID NO: 300094 - DNA, 25 bp, Mus musculus
ttgcgccctgcacaggttgcgcaga

SEQ ID NO: 300095 - DNA, 25 bp, Mus musculus
agccagctagtcttgggcctcggag

SEQ ID NO: 300096 - DNA, 25 bp, Mus musculus
aggggccgccgcatcaaagacaccg

SEQ ID NO: 300097 - DNA, 25 bp, Mus musculus
cgcgctgaagagagttagaggtaac

SEQ ID NO: 300098 - DNA, 25 bp, Mus musculus
gcccatcgcgctgaagagagttaga

SEQ ID NO: 300099 - DNA, 25 bp, Mus musculus
cggaacaggacaaggagcccatcgc

SEQ ID NO: 300100 - DNA, 25 bp, Mus musculus
cttttcaaagtcggcccgcggctcg

SEQ ID NO: 300101 - DNA, 25 bp, Mus musculus
tcggtaatgtcagcggaacaggaca

SEQ ID NO: 300102 - DNA, 25 bp, Mus musculus
ccatgcgcggcggtcggtaatgtca

SEQ ID NO: 300103 - DNA, 25 bp, Mus musculus
aggttgcgcagagccagctagtctt

SEQ ID NO: 300104 - DNA, 25 bp, Mus musculus
ctgacgtattctgtggggaaagtta

SEQ ID NO: 300105 - DNA, 25 bp, Mus musculus
cggagatgcagttgctgtgcgcccc

SEQ ID NO: 300106 - DNA, 25 bp, Mus musculus
tagcaacccgatcggcttcctagcg

SEQ ID NO: 300107 - DNA, 25 bp, Mus musculus
cgtgcgcgatgctgacgtattctgt

SEQ ID NO: 300108 - DNA, 25 bp, Mus musculus
ctgtcgctgcctttgcggggcgtct

SEQ ID NO: 300109 - DNA, 25 bp, Mus musculus
atcttcctgtcgctgcctttgcggg

SEQ ID NO: 300110 - DNA, 25 bp, Mus musculus
cacgatcttcctgtcgctgcctttg

SEQ ID NO: 300111 - DNA, 25 bp, Mus musculus
ttcagctggcagcagacgccggcca

SEQ ID NO: 300112 - DNA, 25 bp, Mus musculus
tgagcgagttcagctggcagcagac

SEQ ID NO: 300113 - DNA, 25 bp, Mus musculus
ccatgccagtgcgagtgagcgagtt

SEQ ID NO: 300114 - DNA, 25 bp, Mus musculus
ctggtcccgccatgccagtgcgagt

SEQ ID NO: 300115 - DNA, 25 bp, Mus musculus
aaagtggctgtgcagtccctggtcc

SEQ ID NO: 300116 - DNA, 25 bp, Mus musculus
cttcctagcgacgtaaagtggctgt

SEQ ID NO: 300117 - DNA, 25 bp, Mus musculus
ccgatcggcttcctagcgacgtaaa

SEQ ID NO: 300118 - DNA, 25 bp, Mus musculus
aggccgcgttccctggacagcgctg

SEQ ID NO: 300119 - DNA, 25 bp, Mus musculus
tagcctcttccagcggtgacagacc

SEQ ID NO: 300120 - DNA, 25 bp, Mus musculus
acagggaggtaagagaagatctcca

SEQ ID NO: 300121 - DNA, 25 bp, Mus musculus
gatctccaagagcaccaagtctggg

SEQ ID NO: 300122 - DNA, 25 bp, Mus musculus
tgggaggtcaaacagagtcgccatg

SEQ ID NO: 300123 - DNA, 25 bp, Mus musculus
tcggactggccaaaccggcgcgact

SEQ ID NO: 300124 - DNA, 25 bp, Mus musculus
gctgtcgcacgcttccgtttccggt

SEQ ID NO: 300125 - DNA, 25 bp, Mus musculus
acgtgtcgccatagccaccggtcat

SEQ ID NO: 300126 - DNA, 25 bp, Mus musculus
agcgtcaggtcgacgtgtcgccata

SEQ ID NO: 300127 - DNA, 25 bp, Mus musculus
ctacttttctaggaaagtgcccgag

SEQ ID NO: 300128 - DNA, 25 bp, Mus musculus
agaggcccgccgagaatccctactt

SEQ ID NO: 300129 - DNA, 25 bp, Mus musculus
gtcccgcataccgtgtagagcgtca

SEQ ID NO: 300130 - DNA, 25 bp, Mus musculus
aaccggcgcgactttcagaggcccg

SEQ ID NO: 300131 - DNA, 25 bp, Mus musculus
agtcgccatggtccagctgtcgcac

SEQ ID NO: 300132 - DNA, 25 bp, Mus musculus
gacgatcggagtcccgtaaactaca

SEQ ID NO: 300133 - DNA, 25 bp, Mus musculus
taccagcgtttgttaggctgacggc

SEQ ID NO: 300134 - DNA, 25 bp, Mus musculus
atccgtatgctgagatgccgcgtgc

SEQ ID NO: 300135 - DNA, 25 bp, Mus musculus
ttcaggtgcagctgcatccgtatgc

SEQ ID NO: 300136 - DNA, 25 bp, Mus musculus
ctttctcctggtggatgccttggtc

SEQ ID NO: 300137 - DNA, 25 bp, Mus musculus
tgcaactcgtaccttcgggcgcagc

SEQ ID NO: 300138 - DNA, 25 bp, Mus musculus
ttttatgaggcgtcactggcgtctg

SEQ ID NO: 300139 - DNA, 25 bp, Mus musculus
cgtagttctttttgctcgccgcgag

SEQ ID NO: 300140 - DNA, 25 bp, Mus musculus
aaaccctccgtcttccagtgtggca

SEQ ID NO: 300141 - DNA, 25 bp, Mus musculus
gcgtagggcccagtcttcttacaga

SEQ ID NO: 300142 - DNA, 25 bp, Mus musculus
aggctgacggcttgtcctaagtagc

SEQ ID NO: 300143 - DNA, 25 bp, Mus musculus
gcctgcgagcaggttgttgttttta

SEQ ID NO: 300144 - DNA, 25 bp, Mus musculus
tgttgtggagatccgcagtcgctcc

SEQ ID NO: 300145 - DNA, 25 bp, Mus musculus
gccgtacgcatcttcgggagtcgta

SEQ ID NO: 300146 - DNA, 25 bp, Mus musculus
aggcggacacatgccactaagattg

SEQ ID NO: 300147 - DNA, 25 bp, Mus musculus
ggtgggtcaggagcaaacctccctg

SEQ ID NO: 300148 - DNA, 25 bp, Mus musculus
tgctccggcactaccgcggcaggaa

SEQ ID NO: 300149 - DNA, 25 bp, Mus musculus
cctcactttcttgtaggcggacaca

SEQ ID NO: 300150 - DNA, 25 bp, Mus musculus
ttcatttctcccgagctgccgtgga

SEQ ID NO: 300151 - DNA, 25 bp, Mus musculus
gcgcgctcacgtactgcctggactt

SEQ ID NO: 300152 - DNA, 25 bp, Mus musculus
ggagagcgtttctcctgcgcgctca

SEQ ID NO: 300153 - DNA, 25 bp, Mus musculus
cgctgaggaccagctcccgggtgac

SEQ ID NO: 300154 - DNA, 25 bp, Mus musculus
gcagtgcatcgctgaggaccagctc

SEQ ID NO: 300155 - DNA, 25 bp, Mus musculus
tctggattctttactccgcctgaca

SEQ ID NO: 300156 - DNA, 25 bp, Mus musculus
ccagtgttcaatgctggaaaagaca

SEQ ID NO: 300157 - DNA, 25 bp, Mus musculus
aaacctccctgaccagtgttcaatg

SEQ ID NO: 300158 - DNA, 25 bp, Mus musculus
gggtgaccgcggtgctcatccctca

SEQ ID NO: 300159 - DNA, 25 bp, Mus musculus
acgtcctcgcgtgggaagtttcatc

SEQ ID NO: 300160 - DNA, 25 bp, Mus musculus
tggccacgctgcggaagaagcacgc

SEQ ID NO: 300161 - DNA, 25 bp, Mus musculus
tcgaactgaacaagaagcgtgaggc

SEQ ID NO: 300162 - DNA, 25 bp, Mus musculus
gcagcgactatgcacgcgagctgga

SEQ ID NO: 300163 - DNA, 25 bp, Mus musculus
actatgcacgcgagctggaggagct

SEQ ID NO: 300164 - DNA, 25 bp, Mus musculus
cgggcggtgtcacctccacccagat

SEQ ID NO: 300165 - DNA, 25 bp, Mus musculus
tccacccagatcgaactgaacaaga

SEQ ID NO: 300166 - DNA, 25 bp, Mus musculus
cccagatcgaactgaacaagaagcg

SEQ ID NO: 300167 - DNA, 25 bp, Mus musculus
aactgaacaagaagcgtgaggctga

SEQ ID NO: 300168 - DNA, 25 bp, Mus musculus
cgtgaggctgagttcttgaagctgc

SEQ ID NO: 300169 - DNA, 25 bp, Mus musculus
gaggctgagttcttgaagctgcgca

SEQ ID NO: 300170 - DNA, 25 bp, Mus musculus
tgagttcttgaagctgcgcagggac

SEQ ID NO: 300171 - DNA, 25 bp, Mus musculus
gttcttgaagctgcgcagggacctg

SEQ ID NO: 300172 - DNA, 25 bp, Mus musculus
ccacggtggccacgctgcggaagaa

SEQ ID NO: 300173 - DNA, 25 bp, Mus musculus
agcacgaggccacggtggccacgct

SEQ ID NO: 300174 - DNA, 25 bp, Mus musculus
ccaggcgaggcgagcagtcgtttct

SEQ ID NO: 300175 - DNA, 25 bp, Mus musculus
ccaaaccgggtgagcactcagcgtt

SEQ ID NO: 300176 - DNA, 25 bp, Mus musculus
ggacagcaccggacagagcaccaaa

SEQ ID NO: 300177 - DNA, 25 bp, Mus musculus
agggacgcaacaccgcagggacagc

SEQ ID NO: 300178 - DNA, 25 bp, Mus musculus
tctagcactgcagggacgcaacacc

SEQ ID NO: 300179 - DNA, 25 bp, Mus musculus
cggcacgttgggaatctagcactgc

SEQ ID NO: 300180 - DNA, 25 bp, Mus musculus
gagtacctaagggatagagcacagc

SEQ ID NO: 300181 - DNA, 25 bp, Mus musculus
cccgagctccatttggaagggagta

SEQ ID NO: 300182 - DNA, 25 bp, Mus musculus
gccagacggaaaatagcgccaagca

SEQ ID NO: 300183 - DNA, 25 bp, Mus musculus
atagagcacagcgaggacgcggcac

SEQ ID NO: 300184 - DNA, 25 bp, Mus musculus
tctcctctacgggaagtgatgtggg

SEQ ID NO: 300185 - DNA, 25 bp, Mus musculus
cactcagcgttctgggcgcgctgca

SEQ ID NO: 300186 - DNA, 25 bp, Mus musculus
gcacccaaaaaaggccagtcgcacg

SEQ ID NO: 300187 - DNA, 25 bp, Mus musculus
aggagacccgatccgtgccaggcga

SEQ ID NO: 300188 - DNA, 25 bp, Mus musculus
acgcagtcggcttcggtgcaggttc

SEQ ID NO: 300189 - DNA, 25 bp, Mus musculus
atgctgccacgcagtcggcttcggt

SEQ ID NO: 300190 - DNA, 25 bp, Mus musculus
tgcaggttcgtgaggctgccacgca

SEQ ID NO: 300191 - DNA, 25 bp, Mus musculus
gtgaggctgccacgcagctgtctcc

SEQ ID NO: 300192 - DNA, 25 bp, Mus musculus
ggaaggtcagcgatgctgccacgca

SEQ ID NO: 300193 - DNA, 25 bp, Mus musculus
ctcctgtgaaggtccgcaaggcagc

SEQ ID NO: 300194 - DNA, 25 bp, Mus musculus
agccggctccggtgcaggtttgcca

SEQ ID NO: 300195 - DNA, 25 bp, Mus musculus
cagcgaggctgccaccgagcaggct

SEQ ID NO: 300196 - DNA, 25 bp, Mus musculus
aggtcagcgaggctgccaccgagca

SEQ ID NO: 300197 - DNA, 25 bp, Mus musculus
ccctcagcaggcttccgtgcaggag

SEQ ID NO: 300198 - DNA, 25 bp, Mus musculus
gaaggtccctgagacggccacccag

SEQ ID NO: 300199 - DNA, 25 bp, Mus musculus
cccgcttccgtgaaggtccctgaga

SEQ ID NO: 300200 - DNA, 25 bp, Mus musculus
tatggcggcccataaggctgccacc

SEQ ID NO: 300201 - DNA, 25 bp, Mus musculus
gcagccacccagttggctcctgtga

SEQ ID NO: 300202 - DNA, 25 bp, Mus musculus
tcactgccggcgaggtctcctcgtt

SEQ ID NO: 300203 - DNA, 25 bp, Mus musculus
acggcatgatgttcgtccgcaacga

SEQ ID NO: 300204 - DNA, 25 bp, Mus musculus
atctacccggggcacggcatgatgt

SEQ ID NO: 300205 - DNA, 25 bp, Mus musculus
gttatttctgctccgggccgatcta

SEQ ID NO: 300206 - DNA, 25 bp, Mus musculus
catgaggatcgaaaagtgttatttc

SEQ ID NO: 300207 - DNA, 25 bp, Mus musculus
tcccacgcggggtcaacatgaggat

SEQ ID NO: 300208 - DNA, 25 bp, Mus musculus
tccgcaacgattgcaaggtgaggcg

SEQ ID NO: 300209 - DNA, 25 bp, Mus musculus
tggacccggcgtcggttcactgccg

SEQ ID NO: 300210 - DNA, 25 bp, Mus musculus
gcgaggtctcctcgttgctgtcaga

SEQ ID NO: 300211 - DNA, 25 bp, Mus musculus
tcctcgttgctgtcagacgctcatc

SEQ ID NO: 300212 - DNA, 25 bp, Mus musculus
gtcagacgctcatctcatccgcagg

SEQ ID NO: 300213 - DNA, 25 bp, Mus musculus
aagtgacgtaccacttcctctccag

SEQ ID NO: 300214 - DNA, 25 bp, Mus musculus
tccggcgactaggaagtgacgtacc

SEQ ID NO: 300215 - DNA, 25 bp, Mus musculus
gctcgcgccgggttctgaacgccgt

SEQ ID NO: 300216 - DNA, 25 bp, Mus musculus
cccgcgagtttaaagcagcaaatga

SEQ ID NO: 300217 - DNA, 25 bp, Mus musculus
cgattactttttccggttctgcaca

SEQ ID NO: 300218 - DNA, 25 bp, Mus musculus
cccttcgcggtaagacagcctttca

SEQ ID NO: 300219 - DNA, 25 bp, Mus musculus
gcgtgtcagaagcaacctgccgtga

SEQ ID NO: 300220 - DNA, 25 bp, Mus musculus
ctgccgtgaaatccgctaatgcgcc

SEQ ID NO: 300221 - DNA, 25 bp, Mus musculus
ttatgcaaattgactcgggtttccc

SEQ ID NO: 300222 - DNA, 25 bp, Mus musculus
ttctcgggcccataacaagcgcagg

SEQ ID NO: 300223 - DNA, 25 bp, Mus musculus
cctgcgacgcggcagcgattacttt

SEQ ID NO: 300224 - DNA, 25 bp, Mus musculus
cagcgaccttgcaggaatcctcagg

SEQ ID NO: 300225 - DNA, 25 bp, Mus musculus
gtgggactcagaccctaggtgctga

SEQ ID NO: 300226 - DNA, 25 bp, Mus musculus
ctccggttcctgaattagctgtttg

SEQ ID NO: 300227 - DNA, 25 bp, Mus musculus
caagttgcgtccctaaatgcgcggc

SEQ ID NO: 300228 - DNA, 25 bp, Mus musculus
caagcgcaggcagctattcaaatgc

SEQ ID NO: 300229 - DNA, 25 bp, Mus musculus
gggtttcccttgctcctaggaggca

SEQ ID NO: 300230 - DNA, 25 bp, Mus musculus
cgcaggtcagcaatggaagtaattc

SEQ ID NO: 300231 - DNA, 25 bp, Mus musculus
tgaacgcacagctgaccatggaggc

SEQ ID NO: 300232 - DNA, 25 bp, Mus musculus
caggtatgagcatgcccaccaccta

SEQ ID NO: 300233 - DNA, 25 bp, Mus musculus
acccgcgttccatgggcatggcgtc

SEQ ID NO: 300234 - DNA, 25 bp, Mus musculus
gcggaggcagcgattaccaccacca

SEQ ID NO: 300235 - DNA, 25 bp, Mus musculus
catgaccatggcctgtgaaactccc

SEQ ID NO: 300236 - DNA, 25 bp, Mus musculus
gtatcaccaccgagctcaaacgtta

SEQ ID NO: 300237 - DNA, 25 bp, Mus musculus
tttcacacttatgcgggatgagcgc

SEQ ID NO: 300238 - DNA, 25 bp, Mus musculus
cgggctggcctctatgaataacctc

SEQ ID NO: 300239 - DNA, 25 bp, Mus musculus
ctaccacaaggacgtggctggcatg

SEQ ID NO: 300240 - DNA, 25 bp, Mus musculus
ggcagcattcacaactcccagcaag

SEQ ID NO: 300241 - DNA, 25 bp, Mus musculus
ggcatggtacccatcaacggccttc

SEQ ID NO: 300242 - DNA, 25 bp, Mus musculus
cgcggctatgcccaccgacaagatg

SEQ ID NO: 300243 - DNA, 25 bp, Mus musculus
aacgtgagcggtagtttcacactta

SEQ ID NO: 300244 - DNA, 25 bp, Mus musculus
agactctgctgctgaccggctccgg

SEQ ID NO: 300245 - DNA, 25 bp, Mus musculus
actgaagcctcggaggggctagcca

SEQ ID NO: 300246 - DNA, 25 bp, Mus musculus
ggaacccggctactgaagcctcgga

SEQ ID NO: 300247 - DNA, 25 bp, Mus musculus
gctgctgaccggctccggctggaac

SEQ ID NO: 300248 - DNA, 25 bp, Mus musculus
ggctgaggacatgcccagactctgc

SEQ ID NO: 300249 - DNA, 25 bp, Mus musculus
cagggcaaacagtgagagaaagagt

SEQ ID NO: 300250 - DNA, 25 bp, Mus musculus
agtgttttgacagggcaaacagtga

SEQ ID NO: 300251 - DNA, 25 bp, Mus musculus
ttgccataacaaccggcgcgcgcag

SEQ ID NO: 300252 - DNA, 25 bp, Mus musculus
cggcggcgttgccataacaaccggc

SEQ ID NO: 300253 - DNA, 25 bp, Mus musculus
ctgagacccttatccgggaagaccg

SEQ ID NO: 300254 - DNA, 25 bp, Mus musculus
cctctgagacccttatccgggaaga

SEQ ID NO: 300255 - DNA, 25 bp, Mus musculus
gtccctgggtcctctgagaccctta

SEQ ID NO: 300256 - DNA, 25 bp, Mus musculus
ttggctgttgttgggacacgtgacc

SEQ ID NO: 300257 - DNA, 25 bp, Mus musculus
ctccggctggaacccggctactgaa

SEQ ID NO: 300258 - DNA, 25 bp, Mus musculus
gaccggcaggttccaccggactgca

SEQ ID NO: 300259 - DNA, 25 bp, Mus musculus
caaagcaggtttgggatgccagccg

SEQ ID NO: 300260 - DNA, 25 bp, Mus musculus
ggctacagagaccaggcctctaagg

SEQ ID NO: 300261 - DNA, 25 bp, Mus musculus
cgactgaagagaccgcaagggctgt

SEQ ID NO: 300262 - DNA, 25 bp, Mus musculus
aggtgatgactgtcaggctcccgcc

SEQ ID NO: 300263 - DNA, 25 bp, Mus musculus
gcgtccgagctctacaccaaggtaa

SEQ ID NO: 300264 - DNA, 25 bp, Mus musculus
ctaaccgtcgctacctcgagcggga

SEQ ID NO: 300265 - DNA, 25 bp, Mus musculus
ggctgtacctccttgcccggctgta

SEQ ID NO: 300266 - DNA, 25 bp, Mus musculus
tcccgagcccatttcggatgggatg

SEQ ID NO: 300267 - DNA, 25 bp, Mus musculus
atgggatgctcttgggcagatgctc

SEQ ID NO: 300268 - DNA, 25 bp, Mus musculus
gggccactccgccaaagcaggtttg

SEQ ID NO: 300269 - DNA, 25 bp, Mus musculus
tctcccgggactcgtgcttaaaata

SEQ ID NO: 300270 - DNA, 25 bp, Mus musculus
aataacgtcctgtgccggtatgcgc

SEQ ID NO: 300271 - DNA, 25 bp, Mus musculus
ggtctacgcgggcactctaaccgtc

SEQ ID NO: 300272 - DNA, 25 bp, Mus musculus
ttctgcacaagatggccaggcgctg

SEQ ID NO: 300273 - DNA, 25 bp, Mus musculus
ggaaaacttctgcacaagatggcca

SEQ ID NO: 300274 - DNA, 25 bp, Mus musculus
caatggcaacgcgggctgccggcaa

SEQ ID NO: 300275 - DNA, 25 bp, Mus musculus
gcgggctgccggcaagcaccaatcc

SEQ ID NO: 300276 - DNA, 25 bp, Mus musculus
caaacccaacggagggctgctgtcc

SEQ ID NO: 300277 - DNA, 25 bp, Mus musculus
acaagatggccaggcgctgagtgcc

SEQ ID NO: 300278 - DNA, 25 bp, Mus musculus
aacagcagcagagaggaggtccatg

SEQ ID NO: 300279 - DNA, 25 bp, Mus musculus
gtggccgagctctacgcgcaggtag

SEQ ID NO: 300280 - DNA, 25 bp, Mus musculus
acctgtgcacctgcccagacgggta

SEQ ID NO: 300281 - DNA, 25 bp, Mus musculus
cacctgcccagacgggtagatgagc

SEQ ID NO: 300282 - DNA, 25 bp, Mus musculus
tgggcaaacccaacggagggctgct

SEQ ID NO: 300283 - DNA, 25 bp, Mus musculus
gtagctagatcacccagacccttcg

SEQ ID NO: 300284 - DNA, 25 bp, Mus musculus
gcaccaatcccgctgctaaccctca

SEQ ID NO: 300285 - DNA, 25 bp, Mus musculus
acgccgggtagctagatcacccaga

SEQ ID NO: 300286 - DNA, 25 bp, Mus musculus
tattggaggtgagaaggctaaaatg

SEQ ID NO: 300287 - DNA, 25 bp, Mus musculus
aacagaatcgcaaatcctagcccgg

SEQ ID NO: 300288 - DNA, 25 bp, Mus musculus
atcacgggaagctgccaagacttgg

SEQ ID NO: 300289 - DNA, 25 bp, Mus musculus
gccggtggttccgttatatcacttc

SEQ ID NO: 300290 - DNA, 25 bp, Mus musculus
gaaggctaaaatgagaggcccgaga

SEQ ID NO: 300291 - DNA, 25 bp, Mus musculus
cgtcgataggttcgaggatattgga

SEQ ID NO: 300292 - DNA, 25 bp, Mus musculus
tacgagttgtgtcgtcgataggttc

SEQ ID NO: 300293 - DNA, 25 bp, Mus musculus
cctcgctcgagctacgagttgtgtc

SEQ ID NO: 300294 - DNA, 25 bp, Mus musculus
gggttcctcgctcgagctacgagtt

SEQ ID NO: 300295 - DNA, 25 bp, Mus musculus
tgtttgcaggcttaactccggccgg

SEQ ID NO: 300296 - DNA, 25 bp, Mus musculus
cttccgcttcctgtttgcaggctta

SEQ ID NO: 300297 - DNA, 25 bp, Mus musculus
ggttccgttatatcacttccgcttc

SEQ ID NO: 300298 - DNA, 25 bp, Mus musculus
cggagtcgcgactgtctgtagtccg

SEQ ID NO: 300299 - DNA, 25 bp, Mus musculus
ccgagatcacgggaagctgccaaga

SEQ ID NO: 300300 - DNA, 25 bp, Mus musculus
agaacgagacgctggcgtcgctgaa

SEQ ID NO: 300301 - DNA, 25 bp, Mus musculus
ggagccagcagagtccgtcaccgct

SEQ ID NO: 300302 - DNA, 25 bp, Mus musculus
gactcacagtctcccgctttgcgtt

SEQ ID NO: 300303 - DNA, 25 bp, Mus musculus
gctttgcgtttctctcccggctgca

SEQ ID NO: 300304 - DNA, 25 bp, Mus musculus
tcccggctgcatccggacgaagatg

SEQ ID NO: 300305 - DNA, 25 bp, Mus musculus
acgaagatggcaaccgatgggctgc

SEQ ID NO: 300306 - DNA, 25 bp, Mus musculus
ggccgagagcctcaagggcaagcta

SEQ ID NO: 300307 - DNA, 25 bp, Mus musculus
caaagctgcatgacgtggagcgtga

SEQ ID NO: 300308 - DNA, 25 bp, Mus musculus
ggaagctcccggctggagtgaacca

SEQ ID NO: 300309 - DNA, 25 bp, Mus musculus
cccggctggagtgaaccaaactctc

SEQ ID NO: 300310 - DNA, 25 bp, Mus musculus
gtgaaccaaactctccgaggggctg

SEQ ID NO: 300311 - DNA, 25 bp, Mus musculus
cgcgaaggaccggttccagcgtccg

SEQ ID NO: 300312 - DNA, 25 bp, Mus musculus
tgcacgagaacgagacgctggcgtc

SEQ ID NO: 300313 - DNA, 25 bp, Mus musculus
gcaaccgatgggctgcacgagaacg

SEQ ID NO: 300314 - DNA, 25 bp, Mus musculus
gacctctcccgggaactggaggaga

SEQ ID NO: 300315 - DNA, 25 bp, Mus musculus
gcggttgattcccaggcccgcatcg

SEQ ID NO: 300316 - DNA, 25 bp, Mus musculus
aaatcgaggcagagcgggcctccag

SEQ ID NO: 300317 - DNA, 25 bp, Mus musculus
tccagggccaaagcagagaagcagc

SEQ ID NO: 300318 - DNA, 25 bp, Mus musculus
agagaagcagcgctctgacctctcc

SEQ ID NO: 300319 - DNA, 25 bp, Mus musculus
gctctgacctctcccgggaactgga

SEQ ID NO: 300320 - DNA, 25 bp, Mus musculus
cctctgctcaggtggagatgaacaa

SEQ ID NO: 300321 - DNA, 25 bp, Mus musculus
tggagatgaacaagaagcgggaaac

SEQ ID NO: 300322 - DNA, 25 bp, Mus musculus
agcgggaaactgagtttcagaaact

SEQ ID NO: 300323 - DNA, 25 bp, Mus musculus
tgagtttcagaaacttcgccgggac

SEQ ID NO: 300324 - DNA, 25 bp, Mus musculus
acagcagccgctcttcggaagaagc

SEQ ID NO: 300325 - DNA, 25 bp, Mus musculus
agccgctcttcggaagaagcacgcg

SEQ ID NO: 300326 - DNA, 25 bp, Mus musculus
ctgagctcggggagcagatcgacaa

SEQ ID NO: 300327 - DNA, 25 bp, Mus musculus
gggccacctctgctcaggtggagat

SEQ ID NO: 300328 - DNA, 25 bp, Mus musculus
gggacttctccgactcatcgacaga

SEQ ID NO: 300329 - DNA, 25 bp, Mus musculus
gcccagagtgtcgtaccaagtgacc

SEQ ID NO: 300330 - DNA, 25 bp, Mus musculus
tcagctgaaccaccgcccagagtgt

SEQ ID NO: 300331 - DNA, 25 bp, Mus musculus
gcgccggaatttccaacgcccgtga

SEQ ID NO: 300332 - DNA, 25 bp, Mus musculus
tttccgaggctctcgctttgccgca

SEQ ID NO: 300333 - DNA, 25 bp, Mus musculus
gcggacagccctcaaggtcggctca

SEQ ID NO: 300334 - DNA, 25 bp, Mus musculus
ccggagggtcacacacaatggacgc

SEQ ID NO: 300335 - DNA, 25 bp, Mus musculus
aaaagcgtctttgttgagcggcggc

SEQ ID NO: 300336 - DNA, 25 bp, Mus musculus
cgggcacacggaacaaaagcgtctt

SEQ ID NO: 300337 - DNA, 25 bp, Mus musculus
agcgagccaggaaggcaagcctcca

SEQ ID NO: 300338 - DNA, 25 bp, Mus musculus
ctcgtggaccgccaggcacaaactt

SEQ ID NO: 300339 - DNA, 25 bp, Mus musculus
aaggtgtcaggagccctgtctcagg

SEQ ID NO: 300340 - DNA, 25 bp, Mus musculus
cgctacgcaacgtgccggagacttt

SEQ ID NO: 300341 - DNA, 25 bp, Mus musculus
ccaggcacaaacttgggcggactta

SEQ ID NO: 300342 - DNA, 25 bp, Mus musculus
tccgcacagcgtgcgagcgggctaa

SEQ ID NO: 300343 - DNA, 25 bp, Mus musculus
gtaaacaagtctgacccgcatccca

SEQ ID NO: 300344 - DNA, 25 bp, Mus musculus
tcaactgcccatcgggcgcggtaac

SEQ ID NO: 300345 - DNA, 25 bp, Mus musculus
ccgagtgctggagaaaactaggtca

SEQ ID NO: 300346 - DNA, 25 bp, Mus musculus
aagtaggtctttgtgcggctcttta

SEQ ID NO: 300347 - DNA, 25 bp, Mus musculus
gtgcggctctttacgacacgtcgtg

SEQ ID NO: 300348 - DNA, 25 bp, Mus musculus
cgacacgtcgtgtttggacgggtct

SEQ ID NO: 300349 - DNA, 25 bp, Mus musculus
cgagcaagccaaggccgcggaccaa

SEQ ID NO: 300350 - DNA, 25 bp, Mus musculus
accaagctgctatggcggacatgga

SEQ ID NO: 300351 - DNA, 25 bp, Mus musculus
gacctcttcgggagcgaagctgaga

SEQ ID NO: 300352 - DNA, 25 bp, Mus musculus
cctccgtgcatacatggccaattga

SEQ ID NO: 300353 - DNA, 25 bp, Mus musculus
tgagtggagacatgttcaactgccc

SEQ ID NO: 300354 - DNA, 25 bp, Mus musculus
tctggccgtaaagcaggctcgagcc

SEQ ID NO: 300355 - DNA, 25 bp, Mus musculus
cgcagctgacaggtcgtaaacaagt

SEQ ID NO: 300356 - DNA, 25 bp, Mus musculus
cggtctcaaatactagtggcggccc

SEQ ID NO: 300357 - DNA, 25 bp, Mus musculus
gctggccggccacaagtgactcaac

SEQ ID NO: 300358 - DNA, 25 bp, Mus musculus
caaggcgcaggaagcacagccgctc

SEQ ID NO: 300359 - DNA, 25 bp, Mus musculus
gaagcacagccgctcccttcttagt

SEQ ID NO: 300360 - DNA, 25 bp, Mus musculus
ccgccgacggacttcctggaaagca

SEQ ID NO: 300361 - DNA, 25 bp, Mus musculus
aagcactgggctgaactcacctgtc

SEQ ID NO: 300362 - DNA, 25 bp, Mus musculus
ctgcacagtccgcaaggtttgaatc

SEQ ID NO: 300363 - DNA, 25 bp, Mus musculus
aggtttgaatcgctcttcccggcgc

SEQ ID NO: 300364 - DNA, 25 bp, Mus musculus
acactccgcggtgcctcaagttcag

SEQ ID NO: 300365 - DNA, 25 bp, Mus musculus
ctcaagttcagggagttgccgaatc

SEQ ID NO: 300366 - DNA, 25 bp, Mus musculus
agggagttgccgaatcctcccgcca

SEQ ID NO: 300367 - DNA, 25 bp, Mus musculus
cgcgctgtctgtattgctggttccc

SEQ ID NO: 300368 - DNA, 25 bp, Mus musculus
tacgtagacagtcccgaactccagg

SEQ ID NO: 300369 - DNA, 25 bp, Mus musculus
tcctggaaagcactgggctgaactc

SEQ ID NO: 300370 - DNA, 25 bp, Mus musculus
ccaggctggagctgcgatcaacagg

SEQ ID NO: 300371 - DNA, 25 bp, Mus musculus
ggccactccgagacaggaccctttg

SEQ ID NO: 300372 - DNA, 25 bp, Mus musculus
tgtgcccatcccgaagcggaaggtc

SEQ ID NO: 300373 - DNA, 25 bp, Mus musculus
ggagcgactggagaccgcgccctct

SEQ ID NO: 300374 - DNA, 25 bp, Mus musculus
gaatctagagctacgtgcgccagca

SEQ ID NO: 300375 - DNA, 25 bp, Mus musculus
gtctcccaatgacgcgatggcctcg

SEQ ID NO: 300376 - DNA, 25 bp, Mus musculus
agctgcgatcaacaggcggctcccg

SEQ ID NO: 300377 - DNA, 25 bp, Mus musculus
gcggaaggtcctgcccagcagcctt

SEQ ID NO: 300378 - DNA, 25 bp, Mus musculus
tcagataggatgtcccgacagtgcc

SEQ ID NO: 300379 - DNA, 25 bp, Mus musculus
acaggggtgcttcagataggatgtc

SEQ ID NO: 300380 - DNA, 25 bp, Mus musculus
ggccgcgcgccacgctatggagcat

SEQ ID NO: 300381 - DNA, 25 bp, Mus musculus
gggcacagtgcaaccggtacccaca

SEQ ID NO: 300382 - DNA, 25 bp, Mus musculus
cctctctgcatctgcgcgtggactg

SEQ ID NO: 300383 - DNA, 25 bp, Mus musculus
cagggtcctccggtagaatctagag

SEQ ID NO: 300384 - DNA, 25 bp, Mus musculus
ttggcaggacccatggcggatctct

SEQ ID NO: 300385 - DNA, 25 bp, Mus musculus
atggcggatctctcgcctgcgccgg

SEQ ID NO: 300386 - DNA, 25 bp, Mus musculus
gagctgtcgctgagcctggcccgca

SEQ ID NO: 300387 - DNA, 25 bp, Mus musculus
aagacccgctcgtacggcagcacgg

SEQ ID NO: 300388 - DNA, 25 bp, Mus musculus
gtcatcgagcgccatgtggagcacc

SEQ ID NO: 300389 - DNA, 25 bp, Mus musculus
cacgcttcagggcatcgcgctcaag

SEQ ID NO: 300390 - DNA, 25 bp, Mus musculus
cgcgctcaagtacggagtcacggtg

SEQ ID NO: 300391 - DNA, 25 bp, Mus musculus
tgctgcaactgcagtgggcgcctaa

SEQ ID NO: 300392 - DNA, 25 bp, Mus musculus
accagctagtgcatggccttcccag

SEQ ID NO: 300393 - DNA, 25 bp, Mus musculus
agtgccctgccagtctcagctcgta

SEQ ID NO: 300394 - DNA, 25 bp, Mus musculus
agtctcagctcgtatctgtcgcgcg

SEQ ID NO: 300395 - DNA, 25 bp, Mus musculus
tgcagtccgggctcagctcccttaa

SEQ ID NO: 300396 - DNA, 25 bp, Mus musculus
ttccgcagggccttctccgacagga

SEQ ID NO: 300397 - DNA, 25 bp, Mus musculus
tctgtcgcgcgagaaacaaggaggc

SEQ ID NO: 300398 - DNA, 25 bp, Mus musculus
ctagctccaggagaggaaatgagga

SEQ ID NO: 300399 - DNA, 25 bp, Mus musculus
tcttctggcgcccagagcaggtgag

SEQ ID NO: 300400 - DNA, 25 bp, Mus musculus
gtgctgaagttcctgcgccgccagc

SEQ ID NO: 300401 - DNA, 25 bp, Mus musculus
gcctgggcgtagctttactccacta

SEQ ID NO: 300402 - DNA, 25 bp, Mus musculus
tttactccactagctccaggagagg

SEQ ID NO: 300403 - DNA, 25 bp, Mus musculus
aaatgaggaggaggcgcatgctcca

SEQ ID NO: 300404 - DNA, 25 bp, Mus musculus
catgcaaaccagaggcgtgaggatg

SEQ ID NO: 300405 - DNA, 25 bp, Mus musculus
atggcgtcagcgacccagcgctact

SEQ ID NO: 300406 - DNA, 25 bp, Mus musculus
cagcgctactccaatcccgcgggaa

SEQ ID NO: 300407 - DNA, 25 bp, Mus musculus
agacaggcttgctcgcgtattttcc

SEQ ID NO: 300408 - DNA, 25 bp, Mus musculus
cgcgtattttccttgccgcagtctt

SEQ ID NO: 300409 - DNA, 25 bp, Mus musculus
tgccgcagtcttgggtatgtttcta

SEQ ID NO: 300410 - DNA, 25 bp, Mus musculus
tatgtttctacgtcggagtcgggcc

SEQ ID NO: 300411 - DNA, 25 bp, Mus musculus
gcatgctccatgcaaaccagaggcg

SEQ ID NO: 300412 - DNA, 25 bp, Mus musculus
ccacggcacctaggctgctgctatg

SEQ ID NO: 300413 - DNA, 25 bp, Mus musculus
ctgctgcgaagcactgcctcaacta

SEQ ID NO: 300414 - DNA, 25 bp, Mus musculus
gaagcactgcctcaactaccagcag

SEQ ID NO: 300415 - DNA, 25 bp, Mus musculus
acgcgctcccggctctcacccggct

SEQ ID NO: 300416 - DNA, 25 bp, Mus musculus
gcgaacatctctggagcggagactc

SEQ ID NO: 300417 - DNA, 25 bp, Mus musculus
cagcttctccgcgaacatctctgga

SEQ ID NO: 300418 - DNA, 25 bp, Mus musculus
tctaccatctgctgcgaagcactgc

SEQ ID NO: 300419 - DNA, 25 bp, Mus musculus
gggaatctaccatctgctgcgaagc

SEQ ID NO: 300420 - DNA, 25 bp, Mus musculus
tgctatggggaatctaccatctgct

SEQ ID NO: 300421 - DNA, 25 bp, Mus musculus
cgccgccgcagtgcagctcggaccc

SEQ ID NO: 300422 - DNA, 25 bp, Mus musculus
tgcctgggcgttgcccaggaaccgc

SEQ ID NO: 300423 - DNA, 25 bp, Mus musculus
cgggactcaggtgcccgctacaccc

SEQ ID NO: 300424 - DNA, 25 bp, Mus musculus
ggccgtgggatccagcaccgcccac

SEQ ID NO: 300425 - DNA, 25 bp, Mus musculus
atctctggagcggagactcagtggc

SEQ ID NO: 300426 - DNA, 25 bp, Mus musculus
ctgagccaatgcctccagagccttg

SEQ ID NO: 300427 - DNA, 25 bp, Mus musculus
tccctccacaggtaccgcaggaatt

SEQ ID NO: 300428 - DNA, 25 bp, Mus musculus
ctcgtcgtcatagtccgtgggattt

SEQ ID NO: 300429 - DNA, 25 bp, Mus musculus
aaacggctcttgagtttcattcagc

SEQ ID NO: 300430 - DNA, 25 bp, Mus musculus
ctctgaagcagatgaccagttgcga

SEQ ID NO: 300431 - DNA, 25 bp, Mus musculus
agttgcgacgagagagggaatcctc

SEQ ID NO: 300432 - DNA, 25 bp, Mus musculus
tcctccagtttggtgctggacatca

SEQ ID NO: 300433 - DNA, 25 bp, Mus musculus
tggacatcacggactggtcccgttc

SEQ ID NO: 300434 - DNA, 25 bp, Mus musculus
cccatgagcactgaggatccgcggt

SEQ ID NO: 300435 - DNA, 25 bp, Mus musculus
gatgagagccacaacgaacacgatg

SEQ ID NO: 300436 - DNA, 25 bp, Mus musculus
gaacacgatgatataccctgcgatc

SEQ ID NO: 300437 - DNA, 25 bp, Mus musculus
ctgcgatcaggacccactcatattc

SEQ ID NO: 300438 - DNA, 25 bp, Mus musculus
ttcgggtgtaggtattccctccaca

SEQ ID NO: 300439 - DNA, 25 bp, Mus musculus
ttcggctcagtgctgcaagcttgtc

SEQ ID NO: 300440 - DNA, 25 bp, Mus musculus
ggacgctggagcaagtctggacacc

SEQ ID NO: 300441 - DNA, 25 bp, Mus musculus
ctggccgcacctcccgggcggtgcc

SEQ ID NO: 300442 - DNA, 25 bp, Mus musculus
cggcgagttgcaacaggtcccgatt

SEQ ID NO: 300443 - DNA, 25 bp, Mus musculus
agttgcaacaggtcccgattctcta

SEQ ID NO: 300444 - DNA, 25 bp, Mus musculus
gcaacaggtcccgattctctacaca

SEQ ID NO: 300445 - DNA, 25 bp, Mus musculus
aggtcccgattctctacacagagta

SEQ ID NO: 300446 - DNA, 25 bp, Mus musculus
ccgattctctacacagagtagcaca

SEQ ID NO: 300447 - DNA, 25 bp, Mus musculus
ctctacacagagtagcacacacggc

SEQ ID NO: 300448 - DNA, 25 bp, Mus musculus
acagagtagcacacacggcccagcg

SEQ ID NO: 300449 - DNA, 25 bp, Mus musculus
cagcgccctgtctgaactcaaaatc

SEQ ID NO: 300450 - DNA, 25 bp, Mus musculus
tgcacacagcactctttcttttcct

SEQ ID NO: 300451 - DNA, 25 bp, Mus musculus
ctggacacctgcgcgctgcgagcag

SEQ ID NO: 300452 - DNA, 25 bp, Mus musculus
ctggagcaagtctggacacctgcgc

SEQ ID NO: 300453 - DNA, 25 bp, Mus musculus
gccctgtctgaactcaaaatcccag

SEQ ID NO: 300454 - DNA, 25 bp, Mus musculus
gcgagtctcatcaccggcctgattc

SEQ ID NO: 300455 - DNA, 25 bp, Mus musculus
cgtgttgccgtccaattggcgtttc

SEQ ID NO: 300456 - DNA, 25 bp, Mus musculus
ctgatctgagttctcccgcagcatc

SEQ ID NO: 300457 - DNA, 25 bp, Mus musculus
ggaagagatccggactcagtgcaga

SEQ ID NO: 300458 - DNA, 25 bp, Mus musculus
cacctcggggctcccttgagaggaa

SEQ ID NO: 300459 - DNA, 25 bp, Mus musculus
gcccggaaagccagaaactgaggta

SEQ ID NO: 300460 - DNA, 25 bp, Mus musculus
ggcgtttctattggacgagccaatc

SEQ ID NO: 300461 - DNA, 25 bp, Mus musculus
agttaggctggagcttgccgagaca

SEQ ID NO: 300462 - DNA, 25 bp, Mus musculus
tgagtcgcagctcaggtacctcttg

SEQ ID NO: 300463 - DNA, 25 bp, Mus musculus
gacgagccaatcaccagcggcgctg

SEQ ID NO: 300464 - DNA, 25 bp, Mus musculus
gtccaataaaaagctcgcgtgctcg

SEQ ID NO: 300465 - DNA, 25 bp, Mus musculus
cctcgcgagctctcggaagttaggc

SEQ ID NO: 300466 - DNA, 25 bp, Mus musculus
attcgggcatggagatctggcctcc

SEQ ID NO: 300467 - DNA, 25 bp, Mus musculus
cttgccgagacaggcgagtctcatc

SEQ ID NO: 300468 - DNA, 25 bp, Mus musculus
aagcgagaacttgttgcctgtgcga

SEQ ID NO: 300469 - DNA, 25 bp, Mus musculus
gtggagcccacgaagccagctctgc

SEQ ID NO: 300470 - DNA, 25 bp, Mus musculus
ttccctgcaagcagcgcgcgtggct

SEQ ID NO: 300471 - DNA, 25 bp, Mus musculus
cttctccggggagcggcacagccag

SEQ ID NO: 300472 - DNA, 25 bp, Mus musculus
ccattccagcagctctgggtggcgg

SEQ ID NO: 300473 - DNA, 25 bp, Mus musculus
ctgcgcttctctgcgggcgagctgc

SEQ ID NO: 300474 - DNA, 25 bp, Mus musculus
cggggcagttgcacctctctgctca

SEQ ID NO: 300475 - DNA, 25 bp, Mus musculus
ccgccagctacgtgcaactactaga

SEQ ID NO: 300476 - DNA, 25 bp, Mus musculus
caactactagaggtgagaggccagg

SEQ ID NO: 300477 - DNA, 25 bp, Mus musculus
gaagttgtctcgtgagcccgccgcc

SEQ ID NO: 300478 - DNA, 25 bp, Mus musculus
ctcctgagcacgtcgtggcctctgt

SEQ ID NO: 300479 - DNA, 25 bp, Mus musculus
ttgcctgtgcgagttctggagcaag

SEQ ID NO: 300480 - DNA, 25 bp, Mus musculus
acttgttgcctgtgcgagttctgga

SEQ ID NO: 300481 - DNA, 25 bp, Mus musculus
ggcgtggacagcgttctcctcctac

SEQ ID NO: 300482 - DNA, 25 bp, Mus musculus
atggcctccacatgacggttgcacc

SEQ ID NO: 300483 - DNA, 25 bp, Mus musculus
ccgagtaccttgagcgcggggtaat

SEQ ID NO: 300484 - DNA, 25 bp, Mus musculus
ttgcaccgccacaggggaatgcagt

SEQ ID NO: 300485 - DNA, 25 bp, Mus musculus
ggagttttcattttactcaccgtgc

SEQ ID NO: 300486 - DNA, 25 bp, Mus musculus
ggagcagaacaacttcggagttttc

SEQ ID NO: 300487 - DNA, 25 bp, Mus musculus
gaatgcagtggaacatcgccgcctc

SEQ ID NO: 300488 - DNA, 25 bp, Mus musculus
ttgtgccctgtgtctgcgcacactc

SEQ ID NO: 300489 - DNA, 25 bp, Mus musculus
tggcgcttgtcgatggcctccacat

SEQ ID NO: 300490 - DNA, 25 bp, Mus musculus
tagaccagcgagcagtggcgcttgt

SEQ ID NO: 300491 - DNA, 25 bp, Mus musculus
gatctcctcggggacgtagaccagc

SEQ ID NO: 300492 - DNA, 25 bp, Mus musculus
gcgggcatagcggtagatctcctcg

SEQ ID NO: 300493 - DNA, 25 bp, Mus musculus
aggagtcggttctggctttccgaca

SEQ ID NO: 300494 - DNA, 25 bp, Mus musculus
tccaccgtcccgaacgttctgagga

SEQ ID NO: 300495 - DNA, 25 bp, Mus musculus
tccaagctcgttgctggctccaagc

SEQ ID NO: 300496 - DNA, 25 bp, Mus musculus
ccgcagcgcgccagtggagcttcgt

SEQ ID NO: 300497 - DNA, 25 bp, Mus musculus
acgcacttcagcctgagcgtgttca

SEQ ID NO: 300498 - DNA, 25 bp, Mus musculus
tgagcgtgttcaacgggctgctgta

SEQ ID NO: 300499 - DNA, 25 bp, Mus musculus
ccgtaactccgagggcagcctggct

SEQ ID NO: 300500 - DNA, 25 bp, Mus musculus
gcagcctggcttcgctggagtgcta

SEQ ID NO: 300501 - DNA, 25 bp, Mus musculus
tggagtgctacgtgccctccaccaa

SEQ ID NO: 300502 - DNA, 25 bp, Mus musculus
aatggcagcccaaagcgccgctcga

SEQ ID NO: 300503 - DNA, 25 bp, Mus musculus
gcgtgatcgtgaccggcggctacat

SEQ ID NO: 300504 - DNA, 25 bp, Mus musculus
gacgtgctcacggtggagagcttca

SEQ ID NO: 300505 - DNA, 25 bp, Mus musculus
gtacaagaaatgcatccagtgcttc

SEQ ID NO: 300506 - DNA, 25 bp, Mus musculus
gcccaacagcgtgtcccgagagtca

SEQ ID NO: 300507 - DNA, 25 bp, Mus musculus
agtcacgggccagctcggtgtcctc

SEQ ID NO: 300508 - DNA, 25 bp, Mus musculus
cctccgtgccggtcagtatctgaac

SEQ ID NO: 300509 - DNA, 25 bp, Mus musculus
ggctacatcggcagtgcgtactcgc

SEQ ID NO: 300510 - DNA, 25 bp, Mus musculus
gcagcctctgctcgggaccggaccc

SEQ ID NO: 300511 - DNA, 25 bp, Mus musculus
tgacgcccgaagaacgacgcacgca

SEQ ID NO: 300512 - DNA, 25 bp, Mus musculus
gaacgacgcacgcatccgaaacggc

SEQ ID NO: 300513 - DNA, 25 bp, Mus musculus
acgcacgcatccgaaacggctgcta

SEQ ID NO: 300514 - DNA, 25 bp, Mus musculus
atccgaaacggctgctacgacaacg

SEQ ID NO: 300515 - DNA, 25 bp, Mus musculus
aaacggctgctacgacaacggccct

SEQ ID NO: 300516 - DNA, 25 bp, Mus musculus
cccgcgcagagtgctgagtcacggt

SEQ ID NO: 300517 - DNA, 25 bp, Mus musculus
ccgatggtcacgtggccggcgctac

SEQ ID NO: 300518 - DNA, 25 bp, Mus musculus
gtggccggcgctaccacaacaacgg

SEQ ID NO: 300519 - DNA, 25 bp, Mus musculus
cgctaccacaacaacggcgggcgtg

SEQ ID NO: 300520 - DNA, 25 bp, Mus musculus
ctaccacaacaacggcgggcgtgcg

SEQ ID NO: 300521 - DNA, 25 bp, Mus musculus
acgggcgcgcggagtttgctcgcac

SEQ ID NO: 300522 - DNA, 25 bp, Mus musculus
aacgtgacgcccgaagaacgacgca

SEQ ID NO: 300523 - DNA, 25 bp, Mus musculus
ccagcccgcgcagagtgctgagtca

SEQ ID NO: 300524 - DNA, 25 bp, Mus musculus
agtgtgtacaggaccgacttgcccg

SEQ ID NO: 300525 - DNA, 25 bp, Mus musculus
tcgccactgagctgggaagagaccc

SEQ ID NO: 300526 - DNA, 25 bp, Mus musculus
gaggcacggcatcctccagttcctg

SEQ ID NO: 300527 - DNA, 25 bp, Mus musculus
agttcctgcacatctaccacgcagt

SEQ ID NO: 300528 - DNA, 25 bp, Mus musculus
taccacgcagtcaaggaccggcaca

SEQ ID NO: 300529 - DNA, 25 bp, Mus musculus
accggcacaaggacgtgctcaagtg

SEQ ID NO: 300530 - DNA, 25 bp, Mus musculus
cgggctcattcattcctgtcgggag

SEQ ID NO: 300531 - DNA, 25 bp, Mus musculus
gtgtgaatatctgcctcccggcgtc

SEQ ID NO: 300532 - DNA, 25 bp, Mus musculus
tgtcccaaggctcgccactgagctg

SEQ ID NO: 300533 - DNA, 25 bp, Mus musculus
ttcgccttggagatgagtgtgtaca

SEQ ID NO: 300534 - DNA, 25 bp, Mus musculus
cggctggcttgctatcacgtttcaa

SEQ ID NO: 300535 - DNA, 25 bp, Mus musculus
atctccagggtgtttgcttcggccc

SEQ ID NO: 300536 - DNA, 25 bp, Mus musculus
gctatcacgtttcaaatctccaggg

SEQ ID NO: 300537 - DNA, 25 bp, Mus musculus
ggcgtccggtcgcactgttcgcctt

SEQ ID NO: 300538 - DNA, 25 bp, Mus musculus
gcctcgccaggttctgctctgggct

SEQ ID NO: 300539 - DNA, 25 bp, Mus musculus
tcactgagacagagtcccgggccga

SEQ ID NO: 300540 - DNA, 25 bp, Mus musculus
cgagggcatttcaccgtcccgaccg

SEQ ID NO: 300541 - DNA, 25 bp, Mus musculus
agcgcccacccgcactggagccttg

SEQ ID NO: 300542 - DNA, 25 bp, Mus musculus
gggatgcgtcactgagacagagtcc

SEQ ID NO: 300543 - DNA, 25 bp, Mus musculus
ggctgcccagttcggcgccgtgatt

SEQ ID NO: 300544 - DNA, 25 bp, Mus musculus
tcagctcaggctgcccagttcggcg

SEQ ID NO: 300545 - DNA, 25 bp, Mus musculus
ctgtgcacggcctggcaggtcccga

SEQ ID NO: 300546 - DNA, 25 bp, Mus musculus
cacgcgggcattctccgcaggcgtg

SEQ ID NO: 300547 - DNA, 25 bp, Mus musculus
cttctccggagcacgcgggcattct

SEQ ID NO: 300548 - DNA, 25 bp, Mus musculus
aacaaggcctggcttctccggagca

SEQ ID NO: 300549 - DNA, 25 bp, Mus musculus
cctgcaccggcgttaacaaggcctg

SEQ ID NO: 300550 - DNA, 25 bp, Mus musculus
ggcccatagcctgcaccggcgttaa

SEQ ID NO: 300551 - DNA, 25 bp, Mus musculus
gggtgcgagtcccagctgcagcctc

SEQ ID NO: 300552 - DNA, 25 bp, Mus musculus
acggcctggagtctgcgaatccata

SEQ ID NO: 300553 - DNA, 25 bp, Mus musculus
ttcctcttgcatcgcggctgcagct

SEQ ID NO: 300554 - DNA, 25 bp, Mus musculus
ggctgcagcttgcttctgttcccgc

SEQ ID NO: 300555 - DNA, 25 bp, Mus musculus
gcttcaggaacttggcgggtgccaa

SEQ ID NO: 300556 - DNA, 25 bp, Mus musculus
tggatgctttcgcacctgttcgtgg

SEQ ID NO: 300557 - DNA, 25 bp, Mus musculus
tggcagccactttggcgcactgaca

SEQ ID NO: 300558 - DNA, 25 bp, Mus musculus
gcgcttggatcttcctccgagcttt

SEQ ID NO: 300559 - DNA, 25 bp, Mus musculus
ttccaaggccgcatgacatcatagc

SEQ ID NO: 300560 - DNA, 25 bp, Mus musculus
acgcggacgcatagctgcgggtaac

SEQ ID NO: 300561 - DNA, 25 bp, Mus musculus
ccgcgccattgtgacgtcacggtca

SEQ ID NO: 300562 - DNA, 25 bp, Mus musculus
tccgagctttctctgagcgaccgta

SEQ ID NO: 300563 - DNA, 25 bp, Mus musculus
gcgcagctggacctttccctgctat

SEQ ID NO: 300564 - DNA, 25 bp, Mus musculus
gcgaccactccagcgggtatctgca

SEQ ID NO: 300565 - DNA, 25 bp, Mus musculus
tcatagcgcttgatcctgcctccgg

SEQ ID NO: 300566 - DNA, 25 bp, Mus musculus
ggacaggtcacctgagacccgactc

SEQ ID NO: 300567 - DNA, 25 bp, Mus musculus
tcccaaacgtggagctcccgaaatc

SEQ ID NO: 300568 - DNA, 25 bp, Mus musculus
cgaaatcatctatgggccgggctgc

SEQ ID NO: 300569 - DNA, 25 bp, Mus musculus
ccgggctgccagaacagaagcgatc

SEQ ID NO: 300570 - DNA, 25 bp, Mus musculus
cacctcccttgtgcagaagccagga

SEQ ID NO: 300571 - DNA, 25 bp, Mus musculus
cgactcccagctcggacagtctgga

SEQ ID NO: 300572 - DNA, 25 bp, Mus musculus
ccgaagcgggcctttcctcggctat

SEQ ID NO: 300573 - DNA, 25 bp, Mus musculus
ctgcagcgcggcttagcagagttct

SEQ ID NO: 300574 - DNA, 25 bp, Mus musculus
agttctcggtcggagaagcgcacca

SEQ ID NO: 300575 - DNA, 25 bp, Mus musculus
tacggcagccattttcgcgggacag

SEQ ID NO: 300576 - DNA, 25 bp, Mus musculus
agcaccgagcgaagagctgagcgtc

SEQ ID NO: 300577 - DNA, 25 bp, Mus musculus
agctgcctgctctgctgcggaaact

SEQ ID NO: 300578 - DNA, 25 bp, Mus musculus
tggagctaagctggcccgcctcact

SEQ ID NO: 300579 - DNA, 25 bp, Mus musculus
caagtgtcaccgcttgccagggcca

SEQ ID NO: 300580 - DNA, 25 bp, Mus musculus
ttcctgctggatgccacgcgctgac

SEQ ID NO: 300581 - DNA, 25 bp, Mus musculus
tgcagggcagcttttccagggaaag

SEQ ID NO: 300582 - DNA, 25 bp, Mus musculus
tttccagggaaagcggctggtcgtc

SEQ ID NO: 300583 - DNA, 25 bp, Mus musculus
ttgtttgttttgctgccggaggccg

SEQ ID NO: 300584 - DNA, 25 bp, Mus musculus
acttgccgggttcgcccgctcggat

SEQ ID NO: 300585 - DNA, 25 bp, Mus musculus
ctggagggctgcactgcgacctgtc

SEQ ID NO: 300586 - DNA, 25 bp, Mus musculus
cactgcgacctgtcgctgggtgctg

SEQ ID NO: 300587 - DNA, 25 bp, Mus musculus
cgagcgaactcatggccgggaatga

SEQ ID NO: 300588 - DNA, 25 bp, Mus musculus
gccctctgccgagcatccgggagat

SEQ ID NO: 300589 - DNA, 25 bp, Mus musculus
ggctgtggcttctcagtggacccgc

SEQ ID NO: 300590 - DNA, 25 bp, Mus musculus
cagtggacccgccacggtcttgcgg

SEQ ID NO: 300591 - DNA, 25 bp, Mus musculus
cgccacggtcttgcgggtctccttt

SEQ ID NO: 300592 - DNA, 25 bp, Mus musculus
tgcgggtctcctttgccgagaaaac

SEQ ID NO: 300593 - DNA, 25 bp, Mus musculus
gctgacccgagcgaactcatggccg

SEQ ID NO: 300594 - DNA, 25 bp, Mus musculus
cccgacggccatgtctattctacgg

SEQ ID NO: 300595 - DNA, 25 bp, Mus musculus
tgtggccgaagtgacacaccgaagc

SEQ ID NO: 300596 - DNA, 25 bp, Mus musculus
gcgaaaggtagacccagcgcatctc

SEQ ID NO: 300597 - DNA, 25 bp, Mus musculus
agcgcatctccagcttcacgagact

SEQ ID NO: 300598 - DNA, 25 bp, Mus musculus
agcttcacgagactcacgcggcctt

SEQ ID NO: 300599 - DNA, 25 bp, Mus musculus
tcacgcggccttccgtgggccgtaa

SEQ ID NO: 300600 - DNA, 25 bp, Mus musculus
cgtgggccgtaatcgtctgtctccc

SEQ ID NO: 300601 - DNA, 25 bp, Mus musculus
taatcgtctgtctccctctgtggcc

SEQ ID NO: 300602 - DNA, 25 bp, Mus musculus
gtctccctctgtggccgaagtgaca

SEQ ID NO: 300603 - DNA, 25 bp, Mus musculus
tgtccggtgcggtcccatacgagat

SEQ ID NO: 300604 - DNA, 25 bp, Mus musculus
tctctgccttcggtgcgtgtcggcg

SEQ ID NO: 300605 - DNA, 25 bp, Mus musculus
catacgagatgggttctctgccttc

SEQ ID NO: 300606 - DNA, 25 bp, Mus musculus
atgtctattctacggcccggctctg

SEQ ID NO: 300607 - DNA, 25 bp, Mus musculus
cggcgaaaggtagacccagcgcatc

SEQ ID NO: 300608 - DNA, 25 bp, Mus musculus
tggccgctcggttgcaagcgccgat

SEQ ID NO: 300609 - DNA, 25 bp, Mus musculus
cactagccgggcaaataggggtcca

SEQ ID NO: 300610 - DNA, 25 bp, Mus musculus
gcggcatccgcggtaaaggtctttc

SEQ ID NO: 300611 - DNA, 25 bp, Mus musculus
gagaacctcctggaagactcgcgcg

SEQ ID NO: 300612 - DNA, 25 bp, Mus musculus
gccgctctgcttcggggtgaagaac

SEQ ID NO: 300613 - DNA, 25 bp, Mus musculus
cagagccatgtctaggcgggaaccc

SEQ ID NO: 300614 - DNA, 25 bp, Mus musculus
gcggctctcctcagagccatgtcta

SEQ ID NO: 300615 - DNA, 25 bp, Mus musculus
agctgagtctggaacgacgtgcgac

SEQ ID NO: 300616 - DNA, 25 bp, Mus musculus
aagcgccgattggtcaggccagcca

SEQ ID NO: 300617 - DNA, 25 bp, Mus musculus
acgcactgtcctcaagctgatgttc

SEQ ID NO: 300618 - DNA, 25 bp, Mus musculus
ttccgtggcacggagacgcactgtc

SEQ ID NO: 300619 - DNA, 25 bp, Mus musculus
atgttcccagccagacactagccgg

SEQ ID NO: 300620 - DNA, 25 bp, Mus musculus
cacggttgggatcgtttccgtggca

SEQ ID NO: 300621 - DNA, 25 bp, Mus musculus
gcggcagcggagtttttccgacgcc

SEQ ID NO: 300622 - DNA, 25 bp, Mus musculus
cgcggcaggagttcgaaagtatcta

SEQ ID NO: 300623 - DNA, 25 bp, Mus musculus
cgcatcacgcggcaggagttcgaaa

SEQ ID NO: 300624 - DNA, 25 bp, Mus musculus
ggagttcgaaagtatctattccaag

SEQ ID NO: 300625 - DNA, 25 bp, Mus musculus
aggcctacgcgcagcacgtgttccg

SEQ ID NO: 300626 - DNA, 25 bp, Mus musculus
acgtgttccgcagcttcgatgccaa

SEQ ID NO: 300627 - DNA, 25 bp, Mus musculus
cttcgatgccaacagcgatggtacg

SEQ ID NO: 300628 - DNA, 25 bp, Mus musculus
cgatggtacgctggacttcaaggag

SEQ ID NO: 300629 - DNA, 25 bp, Mus musculus
gctggacttcaaggagtacgtgatt

SEQ ID NO: 300630 - DNA, 25 bp, Mus musculus
tgattgctctgcacatgaccacggc

SEQ ID NO: 300631 - DNA, 25 bp, Mus musculus
cacgcagaagctcgagtgggccttc

SEQ ID NO: 300632 - DNA, 25 bp, Mus musculus
ggagtacgtgattgctctgcacatg

SEQ ID NO: 300633 - DNA, 25 bp, Mus musculus
gggccttctcgctctacgacgtaga

SEQ ID NO: 300634 - DNA, 25 bp, Mus musculus
cgggcaagcccacgcagaagctcga

SEQ ID NO: 300635 - DNA, 25 bp, Mus musculus
ctctgcacatgaccacggcgggcaa

SEQ ID NO: 300636 - DNA, 25 bp, Mus musculus
tttagctgctatccggacacttttg

SEQ ID NO: 300637 - DNA, 25 bp, Mus musculus
tttacttttggagcaacgcgatccc

SEQ ID NO: 300638 - DNA, 25 bp, Mus musculus
tctcctgtgcgcgaactttagctgc

SEQ ID NO: 300639 - DNA, 25 bp, Mus musculus
cgatccctaggtcgctgagcccaaa

SEQ ID NO: 300640 - DNA, 25 bp, Mus musculus
cccagctcctattgatcaagtcaga

SEQ ID NO: 300641 - DNA, 25 bp, Mus musculus
cagaagagccagacgctgtgacgcc

SEQ ID NO: 300642 - DNA, 25 bp, Mus musculus
caacctgttgtttgcccagctccta

SEQ ID NO: 300643 - DNA, 25 bp, Mus musculus
caacggctcgttttagtctccattc

SEQ ID NO: 300644 - DNA, 25 bp, Mus musculus
gggcgaatccacgtcaacctgttgt

SEQ ID NO: 300645 - DNA, 25 bp, Mus musculus
tcaagtcagagctacaaggaaatgc

SEQ ID NO: 300646 - DNA, 25 bp, Mus musculus
gaaatgcggcacacacacgcgcttg

SEQ ID NO: 300647 - DNA, 25 bp, Mus musculus
cacgcgcttggaaagtttagcttac

SEQ ID NO: 300648 - DNA, 25 bp, Mus musculus
ctgtgcagtagaaatccgccgactc

SEQ ID NO: 300649 - DNA, 25 bp, Mus musculus
ttacaggaagttttgggagagcagc

SEQ ID NO: 300650 - DNA, 25 bp, Mus musculus
gtgacctgggaagcgagatgctttc

SEQ ID NO: 300651 - DNA, 25 bp, Mus musculus
gagctccgagactcttttctcctgg

SEQ ID NO: 300652 - DNA, 25 bp, Mus musculus
cgcacggtttgactcacaacttgaa

SEQ ID NO: 300653 - DNA, 25 bp, Mus musculus
tgctcggcactcaagctgtcgctta

SEQ ID NO: 300654 - DNA, 25 bp, Mus musculus
atcccgatggcgagatgaccaggtc

SEQ ID NO: 300655 - DNA, 25 bp, Mus musculus
cctcgcgggctcagctttataaggc

SEQ ID NO: 300656 - DNA, 25 bp, Mus musculus
ccctcggtagcttagtggtgatccc

SEQ ID NO: 300657 - DNA, 25 bp, Mus musculus
ttccagaccaggaaagcccagggtg

SEQ ID NO: 300658 - DNA, 25 bp, Mus musculus
ggtgttcagtcccttttgctcggca

SEQ ID NO: 300659 - DNA, 25 bp, Mus musculus
cacccgggactgtcgtgaacccaga

SEQ ID NO: 300660 - DNA, 25 bp, Mus musculus
ccagacagttctttttgcagacagg

SEQ ID NO: 300661 - DNA, 25 bp, Mus musculus
gcagacaggtcccaacgcacggttt

SEQ ID NO: 300662 - DNA, 25 bp, Mus musculus
cccagatcattctgaaggggatccc

SEQ ID NO: 300663 - DNA, 25 bp, Mus musculus
aggggatccctctgtggattccaga

SEQ ID NO: 300664 - DNA, 25 bp, Mus musculus
ctcaacatatttccgggcggtacca

SEQ ID NO: 300665 - DNA, 25 bp, Mus musculus
ttcctgcgggtcctgcgctgtcgct

SEQ ID NO: 300666 - DNA, 25 bp, Mus musculus
gagacagttcacttcctgcgggtcc

SEQ ID NO: 300667 - DNA, 25 bp, Mus musculus
ctgtaccgaggggagacagttcact

SEQ ID NO: 300668 - DNA, 25 bp, Mus musculus
catctatctgtaccgaggggagaca

SEQ ID NO: 300669 - DNA, 25 bp, Mus musculus
acgtgaccatctatctgtaccgagg

SEQ ID NO: 300670 - DNA, 25 bp, Mus musculus
gtgagtactcaacatatttccgggc

SEQ ID NO: 300671 - DNA, 25 bp, Mus musculus
ggaggcccaatatgagtgagtactc

SEQ ID NO: 300672 - DNA, 25 bp, Mus musculus
agcgctgcctcaacgtgaccatcta

SEQ ID NO: 300673 - DNA, 25 bp, Mus musculus
cttggcattccaaggagcctggatc

SEQ ID NO: 300674 - DNA, 25 bp, Mus musculus
catgggcttggcattccaaggagcc

SEQ ID NO: 300675 - DNA, 25 bp, Mus musculus
gagttggcgactgccctggccgtcc

SEQ ID NO: 300676 - DNA, 25 bp, Mus musculus
cccacccaatggaggcccaatatga

SEQ ID NO: 300677 - DNA, 25 bp, Mus musculus
tccaaggagcctggatcgagttggc

SEQ ID NO: 300678 - DNA, 25 bp, Mus musculus
gcagcaggcgttccacaactttatt

SEQ ID NO: 300679 - DNA, 25 bp, Mus musculus
gcctccgagatatctttgcgtttca

SEQ ID NO: 300680 - DNA, 25 bp, Mus musculus
acgcgtgaagtcagcgccaggaaga

SEQ ID NO: 300681 - DNA, 25 bp, Mus musculus
ggaacgtagccggtcagtatccgcc

SEQ ID NO: 300682 - DNA, 25 bp, Mus musculus
cagtggccgctggaaatgaaactta

SEQ ID NO: 300683 - DNA, 25 bp, Mus musculus
aggccgcgaaaaggggaactctcag

SEQ ID NO: 300684 - DNA, 25 bp, Mus musculus
atctgccgctcttcggtccgggaaa

SEQ ID NO: 300685 - DNA, 25 bp, Mus musculus
gtcgtccttctacgcggatcttcca

SEQ ID NO: 300686 - DNA, 25 bp, Mus musculus
ctcagtggcccttgctggatgcact

SEQ ID NO: 300687 - DNA, 25 bp, Mus musculus
gggctgtgcatctttggtgagctca

SEQ ID NO: 300688 - DNA, 25 bp, Mus musculus
tccggatccaggatggcctgctgct

SEQ ID NO: 300689 - DNA, 25 bp, Mus musculus
acaactttattcaccgtctcggccg

SEQ ID NO: 300690 - DNA, 25 bp, Mus musculus
gactcccgtttctgcattctgcgca

SEQ ID NO: 300691 - DNA, 25 bp, Mus musculus
ttagcttgtccggttccttcctgga

SEQ ID NO: 300692 - DNA, 25 bp, Mus musculus
cccgcacttcgacgtggtagttatc

SEQ ID NO: 300693 - DNA, 25 bp, Mus musculus
cgctacgcgctgactcggccaagat

SEQ ID NO: 300694 - DNA, 25 bp, Mus musculus
cccgccaatcaaaagcgtcgctgga

SEQ ID NO: 300695 - DNA, 25 bp, Mus musculus
cgccagcgctgaaagtacctgcggg

SEQ ID NO: 300696 - DNA, 25 bp, Mus musculus
aacatgttccttctccgaggccgtg

SEQ ID NO: 300697 - DNA, 25 bp, Mus musculus
ccgcttgtcgcgttccgtatttcca

SEQ ID NO: 300698 - DNA, 25 bp, Mus musculus
gcgggaactctacgtccgaccgagc

SEQ ID NO: 300699 - DNA, 25 bp, Mus musculus
gtcatctcagagaaatcccgagtta

SEQ ID NO: 300700 - DNA, 25 bp, Mus musculus
agttaacattttcacacccgtcttg

SEQ ID NO: 300701 - DNA, 25 bp, Mus musculus
tcttgttaagcgaccgacgtggtgc

SEQ ID NO: 300702 - DNA, 25 bp, Mus musculus
cagctggcttctactccggtgacag

SEQ ID NO: 300703 - DNA, 25 bp, Mus musculus
cgtccacggagagcttgtcaagctc

SEQ ID NO: 300704 - DNA, 25 bp, Mus musculus
gtgttttgtgctgataggcgcctca

SEQ ID NO: 300705 - DNA, 25 bp, Mus musculus
gggcgtctctagctagcttccctca

SEQ ID NO: 300706 - DNA, 25 bp, Mus musculus
aatggccgcgtgcaacctcagcagt

SEQ ID NO: 300707 - DNA, 25 bp, Mus musculus
ctcggcagtcagtcagtaaaggagc

SEQ ID NO: 300708 - DNA, 25 bp, Mus musculus
agtcagtaaaggagcaatggccgcg

SEQ ID NO: 300709 - DNA, 25 bp, Mus musculus
gcaatctcagcagtcagtcagtaaa

SEQ ID NO: 300710 - DNA, 25 bp, Mus musculus
tcagtaaaggagcaatggccgcgtg

SEQ ID NO: 300711 - DNA, 25 bp, Mus musculus
agtaaaggagcaatggccgcgtgca

SEQ ID NO: 300712 - DNA, 25 bp, Mus musculus
ctcagcagtcagtcagtaaaggagc

SEQ ID NO: 300713 - DNA, 25 bp, Mus musculus
tcggcagtcagtcagtaaaggagca

SEQ ID NO: 300714 - DNA, 25 bp, Mus musculus
cagtcagtaaaggagcaatggccgc

SEQ ID NO: 300715 - DNA, 25 bp, Mus musculus
gtgcaatctcggcagtcagtcagta

SEQ ID NO: 300716 - DNA, 25 bp, Mus musculus
tcagtcagtaaaggagcaatggccg

SEQ ID NO: 300717 - DNA, 25 bp, Mus musculus
aatctcggcagtcagtcagtaaagg

SEQ ID NO: 300718 - DNA, 25 bp, Mus musculus
cgcgtgcaatctcggcagtcagtca

SEQ ID NO: 300719 - DNA, 25 bp, Mus musculus
tggccgcgtgcaatctcagcagtca

SEQ ID NO: 300720 - DNA, 25 bp, Mus musculus
gccaagccagatcgtgccgggtgct

SEQ ID NO: 300721 - DNA, 25 bp, Mus musculus
catctttccacgcacgcaactggtg

SEQ ID NO: 300722 - DNA, 25 bp, Mus musculus
aaaagaccagagtgcggccggagta

SEQ ID NO: 300723 - DNA, 25 bp, Mus musculus
tcgaaggcagcagggcaacaacaac

SEQ ID NO: 300724 - DNA, 25 bp, Mus musculus
gggccacatggcctcggcacgctaa

SEQ ID NO: 300725 - DNA, 25 bp, Mus musculus
acgctaggcctcaagccggacacga

SEQ ID NO: 300726 - DNA, 25 bp, Mus musculus
gggatggcctcaccctagttaggga

SEQ ID NO: 300727 - DNA, 25 bp, Mus musculus
gctgccgcgtcctccattttgagct

SEQ ID NO: 300728 - DNA, 25 bp, Mus musculus
accacggggtcacaggaagcagcag

SEQ ID NO: 300729 - DNA, 25 bp, Mus musculus
actattgcggccgataggaccacgg

SEQ ID NO: 300730 - DNA, 25 bp, Mus musculus
ctcaaaagcccgaggtgactattgc

SEQ ID NO: 300731 - DNA, 25 bp, Mus musculus
gcgactagccgtgctcaaaagcccg

SEQ ID NO: 300732 - DNA, 25 bp, Mus musculus
tttgagctccttgcaacagggcccg

SEQ ID NO: 300733 - DNA, 25 bp, Mus musculus
ttgctgaacggcaatcgaaggcagc

SEQ ID NO: 300734 - DNA, 25 bp, Mus musculus
ttactcttggccctagcggagggtg

SEQ ID NO: 300735 - DNA, 25 bp, Mus musculus
tatgaattactcttggccctagcgg

SEQ ID NO: 300736 - DNA, 25 bp, Mus musculus
gcggccagaatctatccctactctt

SEQ ID NO: 300737 - DNA, 25 bp, Mus musculus
ccgctatccttctgttcgcctcccg

SEQ ID NO: 300738 - DNA, 25 bp, Mus musculus
ctgtgtcaagatccgggtgtccctt

SEQ ID NO: 300739 - DNA, 25 bp, Mus musculus
cgctgccaaggctgtgtcaagatcc

SEQ ID NO: 300740 - DNA, 25 bp, Mus musculus
tccttactccgctgccaaggctgtg

SEQ ID NO: 300741 - DNA, 25 bp, Mus musculus
caagagggcggccagaatctatccc

SEQ ID NO: 300742 - DNA, 25 bp, Mus musculus
gcgatccctccttttgtatgaatta

SEQ ID NO: 300743 - DNA, 25 bp, Mus musculus
ccaggcgaaggcgatccctcctttt

SEQ ID NO: 300744 - DNA, 25 bp, Mus musculus
gagaatttagcgacggtccctggga

SEQ ID NO: 300745 - DNA, 25 bp, Mus musculus
gttatgagaatttagcgacggtccc

SEQ ID NO: 300746 - DNA, 25 bp, Mus musculus
ccgggattatgggttatgagaattt

SEQ ID NO: 300747 - DNA, 25 bp, Mus musculus
ctgagcgcatgctcctcgcactgtg

SEQ ID NO: 300748 - DNA, 25 bp, Mus musculus
aggacagcccttcgccgtgctaatt

SEQ ID NO: 300749 - DNA, 25 bp, Mus musculus
cggcataagcggaaacctggcggcc

SEQ ID NO: 300750 - DNA, 25 bp, Mus musculus
aggcgccattttagtttcgggcaat

SEQ ID NO: 300751 - DNA, 25 bp, Mus musculus
ggttgcctgttcctaaggcgccatt

SEQ ID NO: 300752 - DNA, 25 bp, Mus musculus
ggacacgcccatatctggttgcctg

SEQ ID NO: 300753 - DNA, 25 bp, Mus musculus
gccaggaacgctgccactagcaatc

SEQ ID NO: 300754 - DNA, 25 bp, Mus musculus
ccggcgtcgttgcttggccaaccta

SEQ ID NO: 300755 - DNA, 25 bp, Mus musculus
ggggcctcataacgcctggagagca

SEQ ID NO: 300756 - DNA, 25 bp, Mus musculus
gtccgagctctcctcatcgtcgttt

SEQ ID NO: 300757 - DNA, 25 bp, Mus musculus
actagcaatcactcggtggtcccgc

SEQ ID NO: 300758 - DNA, 25 bp, Mus musculus
ttcgggcaatttcccgctgtgggca

SEQ ID NO: 300759 - DNA, 25 bp, Mus musculus
tgcttattgactcggatcgggtacc

SEQ ID NO: 300760 - DNA, 25 bp, Mus musculus
tgaattgcttcagtcccgccagcgc

SEQ ID NO: 300761 - DNA, 25 bp, Mus musculus
ggccaacctagctctcggcaggaca

SEQ ID NO: 300762 - DNA, 25 bp, Mus musculus
cttttctcagcaacgggacagcgcg

SEQ ID NO: 300763 - DNA, 25 bp, Mus musculus
tcagcaacgggacagcgcgacgtta

SEQ ID NO: 300764 - DNA, 25 bp, Mus musculus
cgcgacgttagcctgggagaagcca

SEQ ID NO: 300765 - DNA, 25 bp, Mus musculus
ggagaagccagaagcgccattgtga

SEQ ID NO: 300766 - DNA, 25 bp, Mus musculus
ccgagatgcgcagtcggaggctcct

SEQ ID NO: 300767 - DNA, 25 bp, Mus musculus
cgcgtgcagagaccgcttttctcag

SEQ ID NO: 300768 - DNA, 25 bp, Mus musculus
ggtggagccatcaagtctcaattta

SEQ ID NO: 300769 - DNA, 25 bp, Mus musculus
accttctctgcttgtgcgcggtcgc

SEQ ID NO: 300770 - DNA, 25 bp, Mus musculus
cagggcaggaggtggccaaccacac

SEQ ID NO: 300771 - DNA, 25 bp, Mus musculus
ctaaaccctggtgtgaagcgggaca

SEQ ID NO: 300772 - DNA, 25 bp, Mus musculus
tttcagattgctaaaccctggtgtg

SEQ ID NO: 300773 - DNA, 25 bp, Mus musculus
ggcgcgcccatttcagattgctaaa

SEQ ID NO: 300774 - DNA, 25 bp, Mus musculus
cctctgcttttaggcgcgcccattt

SEQ ID NO: 300775 - DNA, 25 bp, Mus musculus
gtctcaatttagatccctctgcttt

SEQ ID NO: 300776 - DNA, 25 bp, Mus musculus
gctgcctaccttgaactctgcggaa

SEQ ID NO: 300777 - DNA, 25 bp, Mus musculus
actaagaaaattgaccggcgagcgg

SEQ ID NO: 300778 - DNA, 25 bp, Mus musculus
ggtcgtggaagccagatgaagacta

SEQ ID NO: 300779 - DNA, 25 bp, Mus musculus
ctctggctaagtttctggtcgtgga

SEQ ID NO: 300780 - DNA, 25 bp, Mus musculus
cgaagcaaagccctggctctggcta

SEQ ID NO: 300781 - DNA, 25 bp, Mus musculus
tggaaccttctgaagcgcccagcga

SEQ ID NO: 300782 - DNA, 25 bp, Mus musculus
aacagcgtagctaacccggggatgg

SEQ ID NO: 300783 - DNA, 25 bp, Mus musculus
ttcccgccttggaacaggcctttca

SEQ ID NO: 300784 - DNA, 25 bp, Mus musculus
ggagctgggaatgcactccctctga

SEQ ID NO: 300785 - DNA, 25 bp, Mus musculus
cttctccatcgccatcgtagggact

SEQ ID NO: 300786 - DNA, 25 bp, Mus musculus
cccgaagatatctggggttgggatc

SEQ ID NO: 300787 - DNA, 25 bp, Mus musculus
tgttgccatggttcttcaagccctg

SEQ ID NO: 300788 - DNA, 25 bp, Mus musculus
tcggtgttgctgagacactgcacca

SEQ ID NO: 300789 - DNA, 25 bp, Mus musculus
tgcaccaccgcgttcatgaaacagg

SEQ ID NO: 300790 - DNA, 25 bp, Mus musculus
agttttgaggtcagctgggtgtaca

SEQ ID NO: 300791 - DNA, 25 bp, Mus musculus
ttctgctggttctctggaagggacc

SEQ ID NO: 300792 - DNA, 25 bp, Mus musculus
gaaacagaatcaagtggatctctga

SEQ ID NO: 300793 - DNA, 25 bp, Mus musculus
ccaggaaacagaatcaagtggatct

SEQ ID NO: 300794 - DNA, 25 bp, Mus musculus
ttagtcctagcatccaggaaacaga

SEQ ID NO: 300795 - DNA, 25 bp, Mus musculus
ggcagcatatgcctttagtcctagc

SEQ ID NO: 300796 - DNA, 25 bp, Mus musculus
gtgggtggcagcatatgcctttagt

SEQ ID NO: 300797 - DNA, 25 bp, Mus musculus
agctgggtgtacagagcaagatcca

SEQ ID NO: 300798 - DNA, 25 bp, Mus musculus
aacatttgcaggtacagatgggtgg

SEQ ID NO: 300799 - DNA, 25 bp, Mus musculus
gattaaacatttgcaggtacagatg

SEQ ID NO: 300800 - DNA, 25 bp, Mus musculus
ggcctcgaagatgtgatttttaaag

SEQ ID NO: 300801 - DNA, 25 bp, Mus musculus
gccgggcctcgaagatgtgattttt

SEQ ID NO: 300802 - DNA, 25 bp, Mus musculus
ttctctggaagggaccgaaactgtc

SEQ ID NO: 300803 - DNA, 25 bp, Mus musculus
tcagctgggtgtacagagcaagatc

SEQ ID NO: 300804 - DNA, 25 bp, Mus musculus
gcagactctgcaggaacgcttccga

SEQ ID NO: 300805 - DNA, 25 bp, Mus musculus
ctgggtgccagagcgcagcacacag

SEQ ID NO: 300806 - DNA, 25 bp, Mus musculus
tccaccggatcatccgtgagtatga

SEQ ID NO: 300807 - DNA, 25 bp, Mus musculus
catggccagcgccaagagcaacagt

SEQ ID NO: 300808 - DNA, 25 bp, Mus musculus
gacggttgcgcatggccagcgccaa

SEQ ID NO: 300809 - DNA, 25 bp, Mus musculus
aacgcttccgagtgacggttgcgca

SEQ ID NO: 300810 - DNA, 25 bp, Mus musculus
tgcggttctgcaggctccaccagca

SEQ ID NO: 300811 - DNA, 25 bp, Mus musculus
cagcaagcagaagcccaggttcaca

SEQ ID NO: 300812 - DNA, 25 bp, Mus musculus
gtccgtcattgatgttgcaatcatg

SEQ ID NO: 300813 - DNA, 25 bp, Mus musculus
caggtggagaaactcatcgtccgtc

SEQ ID NO: 300814 - DNA, 25 bp, Mus musculus
cttctctttggcctcagagtgcagc

SEQ ID NO: 300815 - DNA, 25 bp, Mus musculus
catccgtgagtacgatcggcttgta

SEQ ID NO: 300816 - DNA, 25 bp, Mus musculus
tgagtatgatcacggatcatccgtg

SEQ ID NO: 300817 - DNA, 25 bp, Mus musculus
tcatgcatgcggttctgcaggctcc

SEQ ID NO: 300818 - DNA, 25 bp, Mus musculus
actgcagaggccgcgctgctgcgca

SEQ ID NO: 300819 - DNA, 25 bp, Mus musculus
cttcgggttctgcataggaggagca

SEQ ID NO: 300820 - DNA, 25 bp, Mus musculus
cgcgtgagcagacgcgtggccgcaa

SEQ ID NO: 300821 - DNA, 25 bp, Mus musculus
ccaccatggctcaggatggcgtgga

SEQ ID NO: 300822 - DNA, 25 bp, Mus musculus
cgccacggtggtccgaagacgcttc

SEQ ID NO: 300823 - DNA, 25 bp, Mus musculus
aagacgcttcgggttctgcatagga

SEQ ID NO: 300824 - DNA, 25 bp, Mus musculus
agcaccgaactgtggtgcggctccg

SEQ ID NO: 300825 - DNA, 25 bp, Mus musculus
tggggacatgtgaccgactgcagag

SEQ ID NO: 300826 - DNA, 25 bp, Mus musculus
cacccgggagcactacagggcgcgt

SEQ ID NO: 300827 - DNA, 25 bp, Mus musculus
ggtctcctcagggtccccagcttta

SEQ ID NO: 300828 - DNA, 25 bp, Mus musculus
ccagctttacgtagaaacgaaactg

SEQ ID NO: 300829 - DNA, 25 bp, Mus musculus
cgacgccacccaggcttgcgaggcc

SEQ ID NO: 300830 - DNA, 25 bp, Mus musculus
tccggccaccatggctcaggatggc

SEQ ID NO: 300831 - DNA, 25 bp, Mus musculus
ccgaagacgcttcgggttctgcata

SEQ ID NO: 300832 - DNA, 25 bp, Mus musculus
aggtctacttttgggaacgtgtgca

SEQ ID NO: 300833 - DNA, 25 bp, Mus musculus
tggcgatcgccgtagtagcaatgcc

SEQ ID NO: 300834 - DNA, 25 bp, Mus musculus
aacgtgtgcatacttcgagcattcc

SEQ ID NO: 300835 - DNA, 25 bp, Mus musculus
ctcctcggcggtgaaggaggtctac

SEQ ID NO: 300836 - DNA, 25 bp, Mus musculus
cacgggtgatgtatgctcctcggcg

SEQ ID NO: 300837 - DNA, 25 bp, Mus musculus
ctcggttacgaaacgcctgagaagg

SEQ ID NO: 300838 - DNA, 25 bp, Mus musculus
cggctctcagtttactcggttacga

SEQ ID NO: 300839 - DNA, 25 bp, Mus musculus
cttaatagagggctgttcccggctc

SEQ ID NO: 300840 - DNA, 25 bp, Mus musculus
ccgcgccgcgggctacttaatagag

SEQ ID NO: 300841 - DNA, 25 bp, Mus musculus
cctttgccgactgggaagagactcc

SEQ ID NO: 300842 - DNA, 25 bp, Mus musculus
cagcagcgcctagtgcgcagagtga

SEQ ID NO: 300843 - DNA, 25 bp, Mus musculus
aaggcgatgggagcacccagcagca

SEQ ID NO: 300844 - DNA, 25 bp, Mus musculus
cgcagccgggttccctgccaaggga

SEQ ID NO: 300845 - DNA, 25 bp, Mus musculus
ttcgagcattccttcggcgtgaggt

SEQ ID NO: 300846 - DNA, 25 bp, Mus musculus
acacgcgtttgtgagctcagaactc

SEQ ID NO: 300847 - DNA, 25 bp, Mus musculus
ggctcgaagacggattcctacacgc

SEQ ID NO: 300848 - DNA, 25 bp, Mus musculus
gaagacggattcctacacgcgtttg

SEQ ID NO: 300849 - DNA, 25 bp, Mus musculus
cggattcctacacgcgtttgtgagc

SEQ ID NO: 300850 - DNA, 25 bp, Mus musculus
cctacacgcgtttgtgagctcagaa

SEQ ID NO: 300851 - DNA, 25 bp, Mus musculus
ctcgaagacggattcctacacgcgt

SEQ ID NO: 300852 - DNA, 25 bp, Mus musculus
acgcgtttgtgagctcagaactcgc

SEQ ID NO: 300853 - DNA, 25 bp, Mus musculus
cgtttgtgagctcagaactcgctcc

SEQ ID NO: 300854 - DNA, 25 bp, Mus musculus
ttgtgagctcagaactcgctccgcg

SEQ ID NO: 300855 - DNA, 25 bp, Mus musculus
gtgagctcagaactcgctccgcgaa

SEQ ID NO: 300856 - DNA, 25 bp, Mus musculus
gagctcagaactcgctccgcgaatt

SEQ ID NO: 300857 - DNA, 25 bp, Mus musculus
gctcagaactcgctccgcgaatttc

SEQ ID NO: 300858 - DNA, 25 bp, Mus musculus
attcctacacgcgtttgtgagctca

SEQ ID NO: 300859 - DNA, 25 bp, Mus musculus
gacggattcctacacgcgtttgtga

SEQ ID NO: 300860 - DNA, 25 bp, Mus musculus
aaggccaactaggagccggatactc

SEQ ID NO: 300861 - DNA, 25 bp, Mus musculus
cgcgagctactgagaaggccaacta

SEQ ID NO: 300862 - DNA, 25 bp, Mus musculus
aggagccggatactccgccagcaca

SEQ ID NO: 300863 - DNA, 25 bp, Mus musculus
gcacacgggctcttttctgcagctc

SEQ ID NO: 300864 - DNA, 25 bp, Mus musculus
acgcagtgggagtctggcacttgaa

SEQ ID NO: 300865 - DNA, 25 bp, Mus musculus
tgggagtctggcacttgaagttgcc

SEQ ID NO: 300866 - DNA, 25 bp, Mus musculus
gcacttgaagttgccaaattgtaca

SEQ ID NO: 300867 - DNA, 25 bp, Mus musculus
caagacgcatgggatgaagtgtcca

SEQ ID NO: 300868 - DNA, 25 bp, Mus musculus
catgggatgaagtgtccagtagtca

SEQ ID NO: 300869 - DNA, 25 bp, Mus musculus
agtgtccagtagtcacacgttgtta

SEQ ID NO: 300870 - DNA, 25 bp, Mus musculus
tcacacgttgttatccggaaagggc

SEQ ID NO: 300871 - DNA, 25 bp, Mus musculus
ttgttatccggaaagggctcgaaga

SEQ ID NO: 300872 - DNA, 25 bp, Mus musculus
gttgccaaattgtacaagacgcatg

SEQ ID NO: 300873 - DNA, 25 bp, Mus musculus
caggcgcgagctactgagaaggcca

SEQ ID NO: 300874 - DNA, 25 bp, Mus musculus
ccgcgactactgaacgccaaaaatc

SEQ ID NO: 300875 - DNA, 25 bp, Mus musculus
gaaagcaaacgccacccgcaatgga

SEQ ID NO: 300876 - DNA, 25 bp, Mus musculus
tgccgccggacccagaatcacaatg

SEQ ID NO: 300877 - DNA, 25 bp, Mus musculus
tccgaagctatccttaccacttggc

SEQ ID NO: 300878 - DNA, 25 bp, Mus musculus
agccagagcgacttctcgcagcggc

SEQ ID NO: 300879 - DNA, 25 bp, Mus musculus
cgcgtcgagcaagagggctcgttcc

SEQ ID NO: 300880 - DNA, 25 bp, Mus musculus
gcagattccgcaacatcttggctcg

SEQ ID NO: 300881 - DNA, 25 bp, Mus musculus
aagctacctaccagcagattccgca

SEQ ID NO: 300882 - DNA, 25 bp, Mus musculus
cacgcctttctgtcaggatgcctga

SEQ ID NO: 300883 - DNA, 25 bp, Mus musculus
gctgctgtcttctgccacatttcca

SEQ ID NO: 300884 - DNA, 25 bp, Mus musculus
gccaaggtgactccggctgctgtct

SEQ ID NO: 300885 - DNA, 25 bp, Mus musculus
atcttggctcggttgttacccacca

SEQ ID NO: 300886 - DNA, 25 bp, Mus musculus
cgcgctcccgaccatagagagcgga

SEQ ID NO: 300887 - DNA, 25 bp, Mus musculus
atcgaaagccaccagaccggaaacg

SEQ ID NO: 300888 - DNA, 25 bp, Mus musculus
tctgccctgtgacgacaaagtgagg

SEQ ID NO: 300889 - DNA, 25 bp, Mus musculus
tgttatccggcctccgggtcttggc

SEQ ID NO: 300890 - DNA, 25 bp, Mus musculus
tcgcgctatagttcatcgccatcgg

SEQ ID NO: 300891 - DNA, 25 bp, Mus musculus
cgaccctgacaggagacgcgcagtc

SEQ ID NO: 300892 - DNA, 25 bp, Mus musculus
gcgccgggttgacttttcttatgac

SEQ ID NO: 300893 - DNA, 25 bp, Mus musculus
aagacggacgcaccctgatcatctg

SEQ ID NO: 300894 - DNA, 25 bp, Mus musculus
gcgacgtctgcgcactaggacggta

SEQ ID NO: 300895 - DNA, 25 bp, Mus musculus
taggacggtagcgtcttcgcttccc

SEQ ID NO: 300896 - DNA, 25 bp, Mus musculus
ccgttgctgtttgaaggccgtgtta

SEQ ID NO: 300897 - DNA, 25 bp, Mus musculus
ggacgcttctgttggcgcacacttc

SEQ ID NO: 300898 - DNA, 25 bp, Mus musculus
cgcacacttcctgttgtggttatca

SEQ ID NO: 300899 - DNA, 25 bp, Mus musculus
atcatggagacttctggagccgtca

SEQ ID NO: 300900 - DNA, 25 bp, Mus musculus
cctgggctacctgtaatttcggcgc

SEQ ID NO: 300901 - DNA, 25 bp, Mus musculus
ccgctgaccggaagcgggcgtcttt

SEQ ID NO: 300902 - DNA, 25 bp, Mus musculus
ggctcttttcctgaaaggtacgctc

SEQ ID NO: 300903 - DNA, 25 bp, Mus musculus
gggccgtgatactcagctctctgct

SEQ ID NO: 300904 - DNA, 25 bp, Mus musculus
cgtccacatggacagtcgccgaggc

SEQ ID NO: 300905 - DNA, 25 bp, Mus musculus
ttcctgaaaggtacgctcgggtctc

SEQ ID NO: 300906 - DNA, 25 bp, Mus musculus
cgcctcccgtcaggcccgcttttgt

SEQ ID NO: 300907 - DNA, 25 bp, Mus musculus
agaagcagcccaggccgtgggcctc

SEQ ID NO: 300908 - DNA, 25 bp, Mus musculus
taggcgcctgaggagaagcagccca

SEQ ID NO: 300909 - DNA, 25 bp, Mus musculus
gtgagcgttcgctccgttctccgtc

SEQ ID NO: 300910 - DNA, 25 bp, Mus musculus
tagaaggcgtgtgagcgttcgctcc

SEQ ID NO: 300911 - DNA, 25 bp, Mus musculus
gctgcggccattttacggcccggga

SEQ ID NO: 300912 - DNA, 25 bp, Mus musculus
ggctcaagccgctgcggccatttta

SEQ ID NO: 300913 - DNA, 25 bp, Mus musculus
cctgggctgatgctctgacgcctgg

SEQ ID NO: 300914 - DNA, 25 bp, Mus musculus
tcgccgaggcctgggctgatgctct

SEQ ID NO: 300915 - DNA, 25 bp, Mus musculus
tgaaaggtacgctcgggtctccctc

SEQ ID NO: 300916 - DNA, 25 bp, Mus musculus
accgaagcttgcaggccagtgcaga

SEQ ID NO: 300917 - DNA, 25 bp, Mus musculus
aagtcgcagaccacctggcctagtg

SEQ ID NO: 300918 - DNA, 25 bp, Mus musculus
ccagcgtccagtgaccgtgtacatg

SEQ ID NO: 300919 - DNA, 25 bp, Mus musculus
tcaccaggatggacacgagcaggtc

SEQ ID NO: 300920 - DNA, 25 bp, Mus musculus
tgccagagaggcgatcaggtagtta

SEQ ID NO: 300921 - DNA, 25 bp, Mus musculus
cgggtccgatacaccgtagcgatta

SEQ ID NO: 300922 - DNA, 25 bp, Mus musculus
ccaaggtgatgagcgccaacaaagc

SEQ ID NO: 300923 - DNA, 25 bp, Mus musculus
tcctggtaaatgtagccgtcggcgc

SEQ ID NO: 300924 - DNA, 25 bp, Mus musculus
ggggcgcactgaataccctgctcct

SEQ ID NO: 300925 - DNA, 25 bp, Mus musculus
agccagttccgtgggctcctcagta

SEQ ID NO: 300926 - DNA, 25 bp, Mus musculus
gcctgtgttctcagcccaaaggaga

SEQ ID NO: 300927 - DNA, 25 bp, Mus musculus
gcaacaggtgatatccgacgacagc

SEQ ID NO: 300928 - DNA, 25 bp, Mus musculus
ctctcaggttccctggaggcaaaca

SEQ ID NO: 300929 - DNA, 25 bp, Mus musculus
cttcgcccgggtgaataaagcactg

SEQ ID NO: 300930 - DNA, 25 bp, Mus musculus
cgcacgctctcaggtgctgtggctt

SEQ ID NO: 300931 - DNA, 25 bp, Mus musculus
tggcgcctacctgcgggctgcgctt

SEQ ID NO: 300932 - DNA, 25 bp, Mus musculus
ggctgcgcttgcatcagcgtgcatg

SEQ ID NO: 300933 - DNA, 25 bp, Mus musculus
atcagcgtgcatggccgggaatact

SEQ ID NO: 300934 - DNA, 25 bp, Mus musculus
tgagggcgtccttccttctcaggaa

SEQ ID NO: 300935 - DNA, 25 bp, Mus musculus
atctgcctgctctctgtactctcgg

SEQ ID NO: 300936 - DNA, 25 bp, Mus musculus
ccttgtcgcgccctttgcggaggta

SEQ ID NO: 300937 - DNA, 25 bp, Mus musculus
cctttgcggaggtaggtcgcctcac

SEQ ID NO: 300938 - DNA, 25 bp, Mus musculus
ggggcatttctttacctgataagta

SEQ ID NO: 300939 - DNA, 25 bp, Mus musculus
ctgataagtaggtcgcgcctggagc

SEQ ID NO: 300940 - DNA, 25 bp, Mus musculus
taggtcgcgcctggagcctcagaaa

SEQ ID NO: 300941 - DNA, 25 bp, Mus musculus
cctcagaaacttgggcgggcaaagc

SEQ ID NO: 300942 - DNA, 25 bp, Mus musculus
ctccctcttgattggcactggaaga

SEQ ID NO: 300943 - DNA, 25 bp, Mus musculus
cccaggcttgtgtagcatctgcctg

SEQ ID NO: 300944 - DNA, 25 bp, Mus musculus
ttgcccttcttctcccgttgctgga

SEQ ID NO: 300945 - DNA, 25 bp, Mus musculus
tgcccttcttctcccgttgctggaa

SEQ ID NO: 300946 - DNA, 25 bp, Mus musculus
cttcttctcccgttgctggaacttg

SEQ ID NO: 300947 - DNA, 25 bp, Mus musculus
tcttctcccgttgctggaacttgcg

SEQ ID NO: 300948 - DNA, 25 bp, Mus musculus
aggccttcttgcacttgcccttctt

SEQ ID NO: 300949 - DNA, 25 bp, Mus musculus
tcccgttgctggaacttgcgcagcc

SEQ ID NO: 300950 - DNA, 25 bp, Mus musculus
ctgacggccaagtccaaggctgcca

SEQ ID NO: 300951 - DNA, 25 bp, Mus musculus
ttgctggaacttgcgcagccgccgt

SEQ ID NO: 300952 - DNA, 25 bp, Mus musculus
cgcagccgccgtgcccatgtgtccc

SEQ ID NO: 300953 - DNA, 25 bp, Mus musculus
ttctcccgttgctggaacttgcgca

SEQ ID NO: 300954 - DNA, 25 bp, Mus musculus
gctaggccttcttgcacttgccctt

SEQ ID NO: 300955 - DNA, 25 bp, Mus musculus
tccgcgctaggccttcttgcacttg

SEQ ID NO: 300956 - DNA, 25 bp, Mus musculus
ggccaagtccaaggctgccagcctt

SEQ ID NO: 300957 - DNA, 25 bp, Mus musculus
gtccaaggctgccagcctttgccag

SEQ ID NO: 300958 - DNA, 25 bp, Mus musculus
tgaccgtgcgagtgagcagcaccaa

SEQ ID NO: 300959 - DNA, 25 bp, Mus musculus
gtgtcgccgcctggactacatcacg

SEQ ID NO: 300960 - DNA, 25 bp, Mus musculus
caggccatgaggaggtaactattta

SEQ ID NO: 300961 - DNA, 25 bp, Mus musculus
ccaagaagagtgtgtgtcgccgcct

SEQ ID NO: 300962 - DNA, 25 bp, Mus musculus
agacagctccggttcttgcaggcca

SEQ ID NO: 300963 - DNA, 25 bp, Mus musculus
ctgcatcgcgggtgttcatggaact

SEQ ID NO: 300964 - DNA, 25 bp, Mus musculus
tcaacctggcgttgctatggcaaca

SEQ ID NO: 300965 - DNA, 25 bp, Mus musculus
ggaaaacccggtctccacgctgcag

SEQ ID NO: 300966 - DNA, 25 bp, Mus musculus
aaaaccatccgatctcggccgcgga

SEQ ID NO: 300967 - DNA, 25 bp, Mus musculus
aagcgcgcggcagctaaacgtcact

SEQ ID NO: 300968 - DNA, 25 bp, Mus musculus
ggctaccgggatcacacacgttgga

SEQ ID NO: 300969 - DNA, 25 bp, Mus musculus
acgttggaaacgcagagccttcatc

SEQ ID NO: 300970 - DNA, 25 bp, Mus musculus
ccgtgatcactgaccgcgagggcag

SEQ ID NO: 300971 - DNA, 25 bp, Mus musculus
gaacgactggtcacgtggaaggccc

SEQ ID NO: 300972 - DNA, 25 bp, Mus musculus
cgccgcagaaaggagtccgcgcctt

SEQ ID NO: 300973 - DNA, 25 bp, Mus musculus
gaaaaggagtgcctcggcctaggcc

SEQ ID NO: 300974 - DNA, 25 bp, Mus musculus
aggaaacaacaactctcaggcagcg

SEQ ID NO: 300975 - DNA, 25 bp, Mus musculus
ggcgggcgctttctctaaagaggcc

SEQ ID NO: 300976 - DNA, 25 bp, Mus musculus
cctgccctgtagctgtcagtgtgtg

SEQ ID NO: 300977 - DNA, 25 bp, Mus musculus
atctgacgcacacggagccgcagca

SEQ ID NO: 300978 - DNA, 25 bp, Mus musculus
atttccagcgcgaggagatgtcgga

SEQ ID NO: 300979 - DNA, 25 bp, Mus musculus
tcagtgtgtgctcacgagccgagcc

SEQ ID NO: 300980 - DNA, 25 bp, Mus musculus
cacgagacatgtttgcgggtcactt

SEQ ID NO: 300981 - DNA, 25 bp, Mus musculus
gaggcctttcctctcacgagacatg

SEQ ID NO: 300982 - DNA, 25 bp, Mus musculus
gacttacccgatcgcagctccgaga

SEQ ID NO: 300983 - DNA, 25 bp, Mus musculus
tccatcttccaggaaccgggcgatg

SEQ ID NO: 300984 - DNA, 25 bp, Mus musculus
gccgcctgctgacagggtccatctt

SEQ ID NO: 300985 - DNA, 25 bp, Mus musculus
tccaccattcaagcaacggcggcgg

SEQ ID NO: 300986 - DNA, 25 bp, Mus musculus
taacactcagagctccgtgcggggc

SEQ ID NO: 300987 - DNA, 25 bp, Mus musculus
cgtgcccagcgcctgagttattagg

SEQ ID NO: 300988 - DNA, 25 bp, Mus musculus
gttctaaattccacgagggcacgcc

SEQ ID NO: 300989 - DNA, 25 bp, Mus musculus
cccattggctaagagaacgttctaa

SEQ ID NO: 300990 - DNA, 25 bp, Mus musculus
gctactcccgcaatgggctcggcta

SEQ ID NO: 300991 - DNA, 25 bp, Mus musculus
gtaaagcaatgttctgggccgcctg

SEQ ID NO: 300992 - DNA, 25 bp, Mus musculus
ggcttactccaaacacactcgaggg

SEQ ID NO: 300993 - DNA, 25 bp, Mus musculus
tggaaaccattccaagcaggagttg

SEQ ID NO: 300994 - DNA, 25 bp, Mus musculus
gtttgccaagaggaaactcctgcga

SEQ ID NO: 300995 - DNA, 25 bp, Mus musculus
ccaccctgagaacaacctgagtttg

SEQ ID NO: 300996 - DNA, 25 bp, Mus musculus
ccgggagactcctctcattgctttc

SEQ ID NO: 300997 - DNA, 25 bp, Mus musculus
gctcctctgagtgcttccacgtttt

SEQ ID NO: 300998 - DNA, 25 bp, Mus musculus
tctcttcggcataatgactacgttg

SEQ ID NO: 300999 - DNA, 25 bp, Mus musculus
tccctggagggaaagtaacactcag

SEQ ID NO: 301000 - DNA, 25 bp, Mus musculus
cagttcgctgtcttgggtggcttct

SEQ ID NO: 301001 - DNA, 25 bp, Mus musculus
ggctcatgagctgcgcatgctcacg

SEQ ID NO: 301002 - DNA, 25 bp, Mus musculus
gcatgctcacggagctgtgcgtcca

SEQ ID NO: 301003 - DNA, 25 bp, Mus musculus
gtccagcgcgcgctcggctagcaaa

SEQ ID NO: 301004 - DNA, 25 bp, Mus musculus
gcaaaccaagtgcagcagcaggctc

SEQ ID NO: 301005 - DNA, 25 bp, Mus musculus
cctgctgcaattgcgcgcgcagctg

SEQ ID NO: 301006 - DNA, 25 bp, Mus musculus
cagcagaagcagcagttgcagcttg

SEQ ID NO: 301007 - DNA, 25 bp, Mus musculus
ggctgctatgctggctcatgagctg

SEQ ID NO: 301008 - DNA, 25 bp, Mus musculus
catgcgcagcgtggccagttcgctg

SEQ ID NO: 301009 - DNA, 25 bp, Mus musculus
tggcttctgagctcctgcagacggc

SEQ ID NO: 301010 - DNA, 25 bp, Mus musculus
ctgcagacggcgctagttgccttct

SEQ ID NO: 301011 - DNA, 25 bp, Mus musculus
tagttgccttctgcggggacaaaac

SEQ ID NO: 301012 - DNA, 25 bp, Mus musculus
caaaactagggtgacgcggcaacgc

SEQ ID NO: 301013 - DNA, 25 bp, Mus musculus
ttcagggtgagactgtgctcgcgca

SEQ ID NO: 301014 - DNA, 25 bp, Mus musculus
ggcgaggagagaggcatcaaccatt

SEQ ID NO: 301015 - DNA, 25 bp, Mus musculus
tgctcctgcctggatcatcggccga

SEQ ID NO: 301016 - DNA, 25 bp, Mus musculus
ttcccattggttactggactccata

SEQ ID NO: 301017 - DNA, 25 bp, Mus musculus
tctattggttattgtggcatcggaa

SEQ ID NO: 301018 - DNA, 25 bp, Mus musculus
accgcgacccgcgaggacagttgca

SEQ ID NO: 301019 - DNA, 25 bp, Mus musculus
gggcaacggagcagaagcccagctt

SEQ ID NO: 301020 - DNA, 25 bp, Mus musculus
gcttcggctcctgggcaacggagca

SEQ ID NO: 301021 - DNA, 25 bp, Mus musculus
tcactcactgtagggaccacggctg

SEQ ID NO: 301022 - DNA, 25 bp, Mus musculus
ttgcggggagtttgaactcactcac

SEQ ID NO: 301023 - DNA, 25 bp, Mus musculus
tacccggacgctgcagactgcggtt

SEQ ID NO: 301024 - DNA, 25 bp, Mus musculus
agacctagagtacccggacgctgca

SEQ ID NO: 301025 - DNA, 25 bp, Mus musculus
cagctacggtccgagacctagagta

SEQ ID NO: 301026 - DNA, 25 bp, Mus musculus
gagtccgaccgacagctacggtccg

SEQ ID NO: 301027 - DNA, 25 bp, Mus musculus
ggactccatacgttcatttctattg

SEQ ID NO: 301028 - DNA, 25 bp, Mus musculus
agcactctgatctaccttctctcgg

SEQ ID NO: 301029 - DNA, 25 bp, Mus musculus
taaaggagcaactgtcgaaagtgcc

SEQ ID NO: 301030 - DNA, 25 bp, Mus musculus
cccgcggagtaagcactctgatcta

SEQ ID NO: 301031 - DNA, 25 bp, Mus musculus
gcaactgtcgaaagtgccgcccgcg

SEQ ID NO: 301032 - DNA, 25 bp, Mus musculus
ccgcccgcggagtaagcactctgat

SEQ ID NO: 301033 - DNA, 25 bp, Mus musculus
cccgagcattaaataaaggagcaac

SEQ ID NO: 301034 - DNA, 25 bp, Mus musculus
gtttacgactaaagcccgagcatta

SEQ ID NO: 301035 - DNA, 25 bp, Mus musculus
tgtgtggtttacgactaaagcccga

SEQ ID NO: 301036 - DNA, 25 bp, Mus musculus
cggtcgccctctggttctatttgtg

SEQ ID NO: 301037 - DNA, 25 bp, Mus musculus
actgagaggacgatgagtgcgatga

SEQ ID NO: 301038 - DNA, 25 bp, Mus musculus
ctggttctatttgtggctcagaagg

SEQ ID NO: 301039 - DNA, 25 bp, Mus musculus
aggtcgctacgagccagtccagcca

SEQ ID NO: 301040 - DNA, 25 bp, Mus musculus
actctgatctaccttctctcggtcg

SEQ ID NO: 301041 - DNA, 25 bp, Mus musculus
cgatgagtgcaggtcgctacgagcc

SEQ ID NO: 301042 - DNA, 25 bp, Mus musculus
acttctgtgaccgagtcagcggcga

SEQ ID NO: 301043 - DNA, 25 bp, Mus musculus
ccaattagcttgtcccgcttccggg

SEQ ID NO: 301044 - DNA, 25 bp, Mus musculus
gtccttcctaaaccacctgcgtgta

SEQ ID NO: 301045 - DNA, 25 bp, Mus musculus
cacctgcgtgtacgattaattcccg

SEQ ID NO: 301046 - DNA, 25 bp, Mus musculus
attaattcccgtgaagcaggcgccg

SEQ ID NO: 301047 - DNA, 25 bp, Mus musculus
agaaggagcgcagtgcctggtcact

SEQ ID NO: 301048 - DNA, 25 bp, Mus musculus
cctggtcactctgggcgccaaggaa

SEQ ID NO: 301049 - DNA, 25 bp, Mus musculus
agccagacgcgtcgctgcggtcttc

SEQ ID NO: 301050 - DNA, 25 bp, Mus musculus
cctcagtcgcgttaaacttctgtga

SEQ ID NO: 301051 - DNA, 25 bp, Mus musculus
cgatccctgacgcagcgagaggatg

SEQ ID NO: 301052 - DNA, 25 bp, Mus musculus
gtggtccgcgtcttcgtcgcctcat

SEQ ID NO: 301053 - DNA, 25 bp, Mus musculus
tcatgctcaggcttcgtggcggtga

SEQ ID NO: 301054 - DNA, 25 bp, Mus musculus
ggtggacacgcaggggtcacacacc

SEQ ID NO: 301055 - DNA, 25 bp, Mus musculus
tcttctccgacggtcgcacgggagt

SEQ ID NO: 301056 - DNA, 25 bp, Mus musculus
gttgaatgccgtggacatcgcgttc

SEQ ID NO: 301057 - DNA, 25 bp, Mus musculus
ggttacctctgttctgccggatgca

SEQ ID NO: 301058 - DNA, 25 bp, Mus musculus
acctgggccacaggaacgccgcagg

SEQ ID NO: 301059 - DNA, 25 bp, Mus musculus
tctgccggatgcaacgtgggaaacc

SEQ ID NO: 301060 - DNA, 25 bp, Mus musculus
aggaggaccagccacgagcgcccag

SEQ ID NO: 301061 - DNA, 25 bp, Mus musculus
acatcgcgttcaggacgctgccggg

SEQ ID NO: 301062 - DNA, 25 bp, Mus musculus
aactccacggtgtcgttgaatgccg

SEQ ID NO: 301063 - DNA, 25 bp, Mus musculus
tccagcgatagaactccacggtgtc

SEQ ID NO: 301064 - DNA, 25 bp, Mus musculus
ctgcaatggtccaggtccagcgata

SEQ ID NO: 301065 - DNA, 25 bp, Mus musculus
ctcgcctgtacctgcaatggtccag

SEQ ID NO: 301066 - DNA, 25 bp, Mus musculus
gtgggcagcccaaggaacacccaga

SEQ ID NO: 301067 - DNA, 25 bp, Mus musculus
ttgcctagcgctgaagccggggact

SEQ ID NO: 301068 - DNA, 25 bp, Mus musculus
cccaacagcctcaaggcgctgggta

SEQ ID NO: 301069 - DNA, 25 bp, Mus musculus
gcagcggcgaacagcagagacaaga

SEQ ID NO: 301070 - DNA, 25 bp, Mus musculus
gtacaggcgcaggtcagcacggcga

SEQ ID NO: 301071 - DNA, 25 bp, Mus musculus
acgtggcgagccgtaaccaatgaga

SEQ ID NO: 301072 - DNA, 25 bp, Mus musculus
agcagggcccagaagcgggtgcgcc

SEQ ID NO: 301073 - DNA, 25 bp, Mus musculus
cggtgcgacgcaaggagccaatcac

SEQ ID NO: 301074 - DNA, 25 bp, Mus musculus
gtgcgacgcaaggagccaatcacgg

SEQ ID NO: 301075 - DNA, 25 bp, Mus musculus
aatcacggcccacgcttccacgtgg

SEQ ID NO: 301076 - DNA, 25 bp, Mus musculus
tccacgtggcgagccgtaaccaatg

SEQ ID NO: 301077 - DNA, 25 bp, Mus musculus
gtccggcctcaacgcaggaggggcg

SEQ ID NO: 301078 - DNA, 25 bp, Mus musculus
cgagccgtaaccaatgagaggtagc

SEQ ID NO: 301079 - DNA, 25 bp, Mus musculus
aggcagcggggaaatttcaaacgtg

SEQ ID NO: 301080 - DNA, 25 bp, Mus musculus
gggtgctgctgtttgggctgcagct

SEQ ID NO: 301081 - DNA, 25 bp, Mus musculus
gctgcagcttggctttcagaggtgg

SEQ ID NO: 301082 - DNA, 25 bp, Mus musculus
tacggcctgtaggtcctgggctgct

SEQ ID NO: 301083 - DNA, 25 bp, Mus musculus
tttcagaggtgggtgcatcagagcg

SEQ ID NO: 301084 - DNA, 25 bp, Mus musculus
ggccgccaggtcatagcgtctccat

SEQ ID NO: 301085 - DNA, 25 bp, Mus musculus
ccgaacttccgtctccgattggtct

SEQ ID NO: 301086 - DNA, 25 bp, Mus musculus
ttccgtctccgattggtctctttca

SEQ ID NO: 301087 - DNA, 25 bp, Mus musculus
gtctccgattggtctctttcacgga

SEQ ID NO: 301088 - DNA, 25 bp, Mus musculus
gattggtctctttcacggacccgcc

SEQ ID NO: 301089 - DNA, 25 bp, Mus musculus
ctgcccaatgaggaagcctgcgtct

SEQ ID NO: 301090 - DNA, 25 bp, Mus musculus
gcccaatgaggaagcctgcgtctta

SEQ ID NO: 301091 - DNA, 25 bp, Mus musculus
atgaggaagcctgcgtcttagctcc

SEQ ID NO: 301092 - DNA, 25 bp, Mus musculus
aggaagcctgcgtcttagctcctcc

SEQ ID NO: 301093 - DNA, 25 bp, Mus musculus
ctgcgtcttagctcctccctccctg

SEQ ID NO: 301094 - DNA, 25 bp, Mus musculus
tgcctgagaactggggatggcggcg

SEQ ID NO: 301095 - DNA, 25 bp, Mus musculus
tgcgctggtgcaaggcttcctgcaa

SEQ ID NO: 301096 - DNA, 25 bp, Mus musculus
ggggcgaggacacggcccagaagcg

SEQ ID NO: 301097 - DNA, 25 bp, Mus musculus
ctggtgcaaggcttcctgcaacccg

SEQ ID NO: 301098 - DNA, 25 bp, Mus musculus
agtccactagggctgcggccgcctt

SEQ ID NO: 301099 - DNA, 25 bp, Mus musculus
gcagagctaggacctcgctgcccgg

SEQ ID NO: 301100 - DNA, 25 bp, Mus musculus
cggccagccttttttgccttcgaga

SEQ ID NO: 301101 - DNA, 25 bp, Mus musculus
gccagccttttttgccttcgagaga

SEQ ID NO: 301102 - DNA, 25 bp, Mus musculus
ccagccttttttgccttcgagagag

SEQ ID NO: 301103 - DNA, 25 bp, Mus musculus
aacgccgggacggtgcaagtccact

SEQ ID NO: 301104 - DNA, 25 bp, Mus musculus
cgccgggacggtgcaagtccactag

SEQ ID NO: 301105 - DNA, 25 bp, Mus musculus
tgcaagtccactagggctgcggccg

SEQ ID NO: 301106 - DNA, 25 bp, Mus musculus
tgcggccgcctttacctttgtacgc

SEQ ID NO: 301107 - DNA, 25 bp, Mus musculus
acctttgtacgcctaagcggtagca

SEQ ID NO: 301108 - DNA, 25 bp, Mus musculus
ttgtacgcctaagcggtagcacggc

SEQ ID NO: 301109 - DNA, 25 bp, Mus musculus
gcccgcaggggctgttccactgccc

SEQ ID NO: 301110 - DNA, 25 bp, Mus musculus
aggggctgttccactgcccccagag

SEQ ID NO: 301111 - DNA, 25 bp, Mus musculus
acggtgcaagtccactagggctgcg

SEQ ID NO: 301112 - DNA, 25 bp, Mus musculus
ttgagaaagcatggtggcgccgacc

SEQ ID NO: 301113 - DNA, 25 bp, Mus musculus
aatccagccggttccgggccagcat

SEQ ID NO: 301114 - DNA, 25 bp, Mus musculus
ctctttcaatccagccggttccggg

SEQ ID NO: 301115 - DNA, 25 bp, Mus musculus
tgcggacttaaagatacactcaccc

SEQ ID NO: 301116 - DNA, 25 bp, Mus musculus
ggggtgcggacttaaagatacactc

SEQ ID NO: 301117 - DNA, 25 bp, Mus musculus
agggcgcggtcacagcttcggcctc

SEQ ID NO: 301118 - DNA, 25 bp, Mus musculus
cgcgggctccagatgactccgccca

SEQ ID NO: 301119 - DNA, 25 bp, Mus musculus
cttcgggcactacccgcgcgggctc

SEQ ID NO: 301120 - DNA, 25 bp, Mus musculus
cagctccgggagagcgtcgcgctat

SEQ ID NO: 301121 - DNA, 25 bp, Mus musculus
cccgatcctccctcggcgcggccca

SEQ ID NO: 301122 - DNA, 25 bp, Mus musculus
ggagcagctccagctttgagaaagc

SEQ ID NO: 301123 - DNA, 25 bp, Mus musculus
gacctgcgcacaacccgggagcagc

SEQ ID NO: 301124 - DNA, 25 bp, Mus musculus
gcatcctccgtctgctcgccctacg

SEQ ID NO: 301125 - DNA, 25 bp, Mus musculus
acgcgtgcttacctggcagccgcag

SEQ ID NO: 301126 - DNA, 25 bp, Mus musculus
ccgcgttgacaaagtccgggatgca

SEQ ID NO: 301127 - DNA, 25 bp, Mus musculus
gggtgtccattctcatccgagcaag

SEQ ID NO: 301128 - DNA, 25 bp, Mus musculus
ctcctgctcgttctgtttggtgata

SEQ ID NO: 301129 - DNA, 25 bp, Mus musculus
ggtgcgctttcttgggatccgaaga

SEQ ID NO: 301130 - DNA, 25 bp, Mus musculus
ccagcacgtcaggttgtgcgggtta

SEQ ID NO: 301131 - DNA, 25 bp, Mus musculus
aggtagttctcggactgccagcacg

SEQ ID NO: 301132 - DNA, 25 bp, Mus musculus
ctcaaacttcttgccgagcgacaga

SEQ ID NO: 301133 - DNA, 25 bp, Mus musculus
ttgcaggctcacataggtcacctca

SEQ ID NO: 301134 - DNA, 25 bp, Mus musculus
tggacttgtagatggccatggactc

SEQ ID NO: 301135 - DNA, 25 bp, Mus musculus
tgcgcccgtagtccatggacttgta

SEQ ID NO: 301136 - DNA, 25 bp, Mus musculus
cggcactgcgtggaatagaactgga

SEQ ID NO: 301137 - DNA, 25 bp, Mus musculus
ccggttgtacattttgcggcactgc

SEQ ID NO: 301138 - DNA, 25 bp, Mus musculus
ccgtccagcgtgctgaaagcgatca

SEQ ID NO: 301139 - DNA, 25 bp, Mus musculus
cgcgcatcatgctgtggccagcttg

SEQ ID NO: 301140 - DNA, 25 bp, Mus musculus
gtagtgccctccgaaagccacttgg

SEQ ID NO: 301141 - DNA, 25 bp, Mus musculus
gccacttggccttggtcagtcctaa

SEQ ID NO: 301142 - DNA, 25 bp, Mus musculus
gatcgtgacgcccatagtagccctc

SEQ ID NO: 301143 - DNA, 25 bp, Mus musculus
tctggaaagcacaagcgagagtccc

SEQ ID NO: 301144 - DNA, 25 bp, Mus musculus
agagtcccgtctgtgtcacctggag

SEQ ID NO: 301145 - DNA, 25 bp, Mus musculus
gcacactcgcgtctctggagcttta

SEQ ID NO: 301146 - DNA, 25 bp, Mus musculus
ccctggctatgagcacagacagatg

SEQ ID NO: 301147 - DNA, 25 bp, Mus musculus
cctgtggctcctacgtgtagattta

SEQ ID NO: 301148 - DNA, 25 bp, Mus musculus
gcctcaaatgtgatagatggccatc

SEQ ID NO: 301149 - DNA, 25 bp, Mus musculus
tggccatcaaaaccggatcagggtt

SEQ ID NO: 301150 - DNA, 25 bp, Mus musculus
gtcattgccgcgtaactgggtctcc

SEQ ID NO: 301151 - DNA, 25 bp, Mus musculus
gggtctcctggaggttccctcaaca

SEQ ID NO: 301152 - DNA, 25 bp, Mus musculus
aacagtgtccgtttgtggctagacc

SEQ ID NO: 301153 - DNA, 25 bp, Mus musculus
gctagaccgccgattccactctgga

SEQ ID NO: 301154 - DNA, 25 bp, Mus musculus
gtcgccctcaccagtcgctagatga

SEQ ID NO: 301155 - DNA, 25 bp, Mus musculus
acggaaagcgacagccgcgactgtc

SEQ ID NO: 301156 - DNA, 25 bp, Mus musculus
gacggctgcacggaaagcgacagcc

SEQ ID NO: 301157 - DNA, 25 bp, Mus musculus
tagtgaaagctaccggggacaacga

SEQ ID NO: 301158 - DNA, 25 bp, Mus musculus
ctcatccttagtgaaagctaccggg

SEQ ID NO: 301159 - DNA, 25 bp, Mus musculus
ccgcgcagggactcatccttagtga

SEQ ID NO: 301160 - DNA, 25 bp, Mus musculus
accagtcgctagatgaaggtgcgcc

SEQ ID NO: 301161 - DNA, 25 bp, Mus musculus
ccattcattagctggcaggggcggc

SEQ ID NO: 301162 - DNA, 25 bp, Mus musculus
gcgggacaaggccattcattagctg

SEQ ID NO: 301163 - DNA, 25 bp, Mus musculus
agcacttggcgggacaaggccattc

SEQ ID NO: 301164 - DNA, 25 bp, Mus musculus
gcagcttggcgacgtagcacttggc

SEQ ID NO: 301165 - DNA, 25 bp, Mus musculus
cagaaaagcatcgtcgctggagggc

SEQ ID NO: 301166 - DNA, 25 bp, Mus musculus
cggaaccagaaaagcatcgtcgctg

SEQ ID NO: 301167 - DNA, 25 bp, Mus musculus
actcgggaataagacgggcgctgat

SEQ ID NO: 301168 - DNA, 25 bp, Mus musculus
taggcgacagctgtacggctctgct

SEQ ID NO: 301169 - DNA, 25 bp, Mus musculus
aaagtttgccgtcgacgcttgcggc

SEQ ID NO: 301170 - DNA, 25 bp, Mus musculus
tcatccgatcctgccctgagagagg

SEQ ID NO: 301171 - DNA, 25 bp, Mus musculus
cttttcacactaatccaaggaggta

SEQ ID NO: 301172 - DNA, 25 bp, Mus musculus
ctcggggttagccaagttccagctt

SEQ ID NO: 301173 - DNA, 25 bp, Mus musculus
gaaacttcgctctcatcccaaggtg

SEQ ID NO: 301174 - DNA, 25 bp, Mus musculus
ctgctcccacgcgaggaaagtttgc

SEQ ID NO: 301175 - DNA, 25 bp, Mus musculus
acaaaggagttgaggaggtgccacc

SEQ ID NO: 301176 - DNA, 25 bp, Mus musculus
gcttgtcccaggtcgctcatccgat

SEQ ID NO: 301177 - DNA, 25 bp, Mus musculus
tgtggggactacttggttcgtactc

SEQ ID NO: 301178 - DNA, 25 bp, Mus musculus
acacagaagcttgggccgggttgct

SEQ ID NO: 301179 - DNA, 25 bp, Mus musculus
tcccactagggaggaaggacgcaca

SEQ ID NO: 301180 - DNA, 25 bp, Mus musculus
gaagtttgctcgctggacaccgcgg

SEQ ID NO: 301181 - DNA, 25 bp, Mus musculus
gacccgccgtgcgtactcactggag

SEQ ID NO: 301182 - DNA, 25 bp, Mus musculus
gcacgcgcacattgtcccgcgcacg

SEQ ID NO: 301183 - DNA, 25 bp, Mus musculus
atccgcgctcctgtgccacgcacac

SEQ ID NO: 301184 - DNA, 25 bp, Mus musculus
cccaggattagcagcgcactctgca

SEQ ID NO: 301185 - DNA, 25 bp, Mus musculus
attagcagcgcactctgcagccgtc

SEQ ID NO: 301186 - DNA, 25 bp, Mus musculus
gcacttccaggaacacgcgcgtttc

SEQ ID NO: 301187 - DNA, 25 bp, Mus musculus
atggccgactcagggacccacgcgg

SEQ ID NO: 301188 - DNA, 25 bp, Mus musculus
gggaccgagcccacagttactagaa

SEQ ID NO: 301189 - DNA, 25 bp, Mus musculus
cacagttactagaacccggacaggg

SEQ ID NO: 301190 - DNA, 25 bp, Mus musculus
cggctggctcccaggccaaggtagc

SEQ ID NO: 301191 - DNA, 25 bp, Mus musculus
ctcccaggccaaggtagcgcgaagg

SEQ ID NO: 301192 - DNA, 25 bp, Mus musculus
gtctgtcggctagagcgccacctac

SEQ ID NO: 301193 - DNA, 25 bp, Mus musculus
cggctaaaatgctcgccagggcaac

SEQ ID NO: 301194 - DNA, 25 bp, Mus musculus
aaatgctcgccagggcaacccatct

SEQ ID NO: 301195 - DNA, 25 bp, Mus musculus
tctgcagccgtctccgcacttccag

SEQ ID NO: 301196 - DNA, 25 bp, Mus musculus
cggaagcgaatacagaggctgcctc

SEQ ID NO: 301197 - DNA, 25 bp, Mus musculus
cgtccggagccaaggaccgttggat

SEQ ID NO: 301198 - DNA, 25 bp, Mus musculus
gaccgttggatgacgtcactggccg

SEQ ID NO: 301199 - DNA, 25 bp, Mus musculus
gtcctctttgcgtctcctgcacgga

SEQ ID NO: 301200 - DNA, 25 bp, Mus musculus
gaagagttacgagccgcgtggcacc

SEQ ID NO: 301201 - DNA, 25 bp, Mus musculus
cgggtcatggaacctctcaccgcta

SEQ ID NO: 301202 - DNA, 25 bp, Mus musculus
ctcgttcgtgttcacgcgaggccga

SEQ ID NO: 301203 - DNA, 25 bp, Mus musculus
gctgcacagccgcactcgttcgtgt

SEQ ID NO: 301204 - DNA, 25 bp, Mus musculus
tcagaagcgcaatcgcgcccaggcg

SEQ ID NO: 301205 - DNA, 25 bp, Mus musculus
cagtcccgacatcagaagcgcaatc

SEQ ID NO: 301206 - DNA, 25 bp, Mus musculus
tctcctgcacggaagtgagcggtgt

SEQ ID NO: 301207 - DNA, 25 bp, Mus musculus
gccacgtaaagtccgtcctctttgc

SEQ ID NO: 301208 - DNA, 25 bp, Mus musculus
tggcaccggaagttggccacgtaaa

SEQ ID NO: 301209 - DNA, 25 bp, Mus musculus
cgggtcgcaatgtccggcagctcag

SEQ ID NO: 301210 - DNA, 25 bp, Mus musculus
cgcctttgttggaggcttcccggca

SEQ ID NO: 301211 - DNA, 25 bp, Mus musculus
aggcgacaccgaggcccgccgatgt

SEQ ID NO: 301212 - DNA, 25 bp, Mus musculus
cttccctccgccgtctctccggtcg

SEQ ID NO: 301213 - DNA, 25 bp, Mus musculus
ggtgcacgctggtagctgtcactag

SEQ ID NO: 301214 - DNA, 25 bp, Mus musculus
cactaggccctgggctggcggcctt

SEQ ID NO: 301215 - DNA, 25 bp, Mus musculus
cttcgtgcggctgccgcggttgcca

SEQ ID NO: 301216 - DNA, 25 bp, Mus musculus
tgcccggcgcctttgttggaggctt

SEQ ID NO: 301217 - DNA, 25 bp, Mus musculus
ccgttgcctcgccagcccggtgggt

SEQ ID NO: 301218 - DNA, 25 bp, Mus musculus
tgggtcccttttaggatcgaggcga

SEQ ID NO: 301219 - DNA, 25 bp, Mus musculus
tcccttttaggatcgaggcgacacc

SEQ ID NO: 301220 - DNA, 25 bp, Mus musculus
ttttaggatcgaggcgacaccgagg

SEQ ID NO: 301221 - DNA, 25 bp, Mus musculus
ccgcggttgccaagagagcggcgcc

SEQ ID NO: 301222 - DNA, 25 bp, Mus musculus
agagcccgcggcaggtaacagcgtc

SEQ ID NO: 301223 - DNA, 25 bp, Mus musculus
cctgtccgcccgtggccttcggcgg

SEQ ID NO: 301224 - DNA, 25 bp, Mus musculus
tattaagtggaaatggctgagaccc

SEQ ID NO: 301225 - DNA, 25 bp, Mus musculus
actctctcagacctcgcagacgtgg

SEQ ID NO: 301226 - DNA, 25 bp, Mus musculus
agctactgattgactcgcggctccg

SEQ ID NO: 301227 - DNA, 25 bp, Mus musculus
ggctccgcgcactacagcgcgagga

SEQ ID NO: 301228 - DNA, 25 bp, Mus musculus
ttggataggtaggtccggcagtcat

SEQ ID NO: 301229 - DNA, 25 bp, Mus musculus
gcaagaacgttctctccacaggcga

SEQ ID NO: 301230 - DNA, 25 bp, Mus musculus
cagacgtggcccagctttgcttccg

SEQ ID NO: 301231 - DNA, 25 bp, Mus musculus
gctgcttggcttgagtgatctgaaa

SEQ ID NO: 301232 - DNA, 25 bp, Mus musculus
gacagctgcgcctttcagcctgggc

SEQ ID NO: 301233 - DNA, 25 bp, Mus musculus
gggagcgttgacgtccctccgacca

SEQ ID NO: 301234 - DNA, 25 bp, Mus musculus
ccgcttagccctaggcgtcacttta

SEQ ID NO: 301235 - DNA, 25 bp, Mus musculus
cgtccctatgcacctgcgcgagatg

SEQ ID NO: 301236 - DNA, 25 bp, Mus musculus
ccctgccaggcgaggtcagcgtcat

SEQ ID NO: 301237 - DNA, 25 bp, Mus musculus
ctcacctagatctggagcaagaacg

SEQ ID NO: 301238 - DNA, 25 bp, Mus musculus
cacactgcccttcccgggatgggaa

SEQ ID NO: 301239 - DNA, 25 bp, Mus musculus
ggcagacaaagaagagcggaccaca

SEQ ID NO: 301240 - DNA, 25 bp, Mus musculus
agaagagcggaccacaagttacatc

SEQ ID NO: 301241 - DNA, 25 bp, Mus musculus
agcggaccacaagttacatcgctcc

SEQ ID NO: 301242 - DNA, 25 bp, Mus musculus
gccgcggggctcaccttgttgagat

SEQ ID NO: 301243 - DNA, 25 bp, Mus musculus
tcaccttgttgagatgcgggtcccg

SEQ ID NO: 301244 - DNA, 25 bp, Mus musculus
tcccgcgtcagcaggtagccgcgct

SEQ ID NO: 301245 - DNA, 25 bp, Mus musculus
agaagcgctgagtcacggcggcatc

SEQ ID NO: 301246 - DNA, 25 bp, Mus musculus
ctccggccaggctggtgaacgccaa

SEQ ID NO: 301247 - DNA, 25 bp, Mus musculus
aaaacgctcgattcccacactggtc

SEQ ID NO: 301248 - DNA, 25 bp, Mus musculus
ctggtgaacgccaagcgagagacct

SEQ ID NO: 301249 - DNA, 25 bp, Mus musculus
aacgccaagcgagagacctgggccc

SEQ ID NO: 301250 - DNA, 25 bp, Mus musculus
gcccgcctgccaccctcacggaaaa

SEQ ID NO: 301251 - DNA, 25 bp, Mus musculus
tcacggaaaacgctcgattcccaca

SEQ ID NO: 301252 - DNA, 25 bp, Mus musculus
gaacccgggccagtcctctgcagaa

SEQ ID NO: 301253 - DNA, 25 bp, Mus musculus
tcaggtgacggcagccgacgaaccc

SEQ ID NO: 301254 - DNA, 25 bp, Mus musculus
gtgcagacacgcaccgccctggtgt

SEQ ID NO: 301255 - DNA, 25 bp, Mus musculus
cgaggtagctgagtgcagacacgca

SEQ ID NO: 301256 - DNA, 25 bp, Mus musculus
gcgccctaggattatccctcgaatc

SEQ ID NO: 301257 - DNA, 25 bp, Mus musculus
ttctccagtcggatctcagagggcg

SEQ ID NO: 301258 - DNA, 25 bp, Mus musculus
tgcggcggcagcaacgactcctctt

SEQ ID NO: 301259 - DNA, 25 bp, Mus musculus
tccgcgcaacccttttcggtggtgc

SEQ ID NO: 301260 - DNA, 25 bp, Mus musculus
tgaagcggtcaccacatcccggctt

SEQ ID NO: 301261 - DNA, 25 bp, Mus musculus
tagtccttgcatcgtgccacggtcc

SEQ ID NO: 301262 - DNA, 25 bp, Mus musculus
tcagccacccgcagggtagtccttg

SEQ ID NO: 301263 - DNA, 25 bp, Mus musculus
ggtccatcgaggtccagggctgtca

SEQ ID NO: 301264 - DNA, 25 bp, Mus musculus
gcgccaagcccagttggtccatcga

SEQ ID NO: 301265 - DNA, 25 bp, Mus musculus
tggcaccgcctcttgggaccagcgg

SEQ ID NO: 301266 - DNA, 25 bp, Mus musculus
tttgggatgttgcacgcgttcacac

SEQ ID NO: 301267 - DNA, 25 bp, Mus musculus
tttatgcagagcagcgagggcgacc

SEQ ID NO: 301268 - DNA, 25 bp, Mus musculus
tgcgaaggtctgcaagggctagata

SEQ ID NO: 301269 - DNA, 25 bp, Mus musculus
ataaagccgggctgcgacaccgacg

SEQ ID NO: 301270 - DNA, 25 bp, Mus musculus
cgtcctgccatggataccaccgaga

SEQ ID NO: 301271 - DNA, 25 bp, Mus musculus
gggtacctatcagccgggatccatc

SEQ ID NO: 301272 - DNA, 25 bp, Mus musculus
ctaagtccgagttgagtccggtggc

SEQ ID NO: 301273 - DNA, 25 bp, Mus musculus
ctgggctcacgttctttgtgcgcga

SEQ ID NO: 301274 - DNA, 25 bp, Mus musculus
ttgtgcgcgacttgcgcttgccatc

SEQ ID NO: 301275 - DNA, 25 bp, Mus musculus
cacgcgctgccgttttgtttatgca

SEQ ID NO: 301276 - DNA, 25 bp, Mus musculus
cttgccatcctgcaggtccgagggc

SEQ ID NO: 301277 - DNA, 25 bp, Mus musculus
gggttcgaactcctggagagaaaga

SEQ ID NO: 301278 - DNA, 25 bp, Mus musculus
cggtgcccttactaagtccgagttg

SEQ ID NO: 301279 - DNA, 25 bp, Mus musculus
ttcccgggccatttgggatgttgca

SEQ ID NO: 301280 - DNA, 25 bp, Mus musculus
cgtcggcaagcagccgcccgctcac

SEQ ID NO: 301281 - DNA, 25 bp, Mus musculus
agccgcccgctcacgagcaaagttt

SEQ ID NO: 301282 - DNA, 25 bp, Mus musculus
gccgcccgctcacgagcaaagtttt

SEQ ID NO: 301283 - DNA, 25 bp, Mus musculus
ccgcccgctcacgagcaaagtttta

SEQ ID NO: 301284 - DNA, 25 bp, Mus musculus
cgcccgctcacgagcaaagttttaa

SEQ ID NO: 301285 - DNA, 25 bp, Mus musculus
gcccgctcacgagcaaagttttaac

SEQ ID NO: 301286 - DNA, 25 bp, Mus musculus
gccaacgggcccgggatgctccaga

SEQ ID NO: 301287 - DNA, 25 bp, Mus musculus
gaaagcaagaggagcgcccggggaa

SEQ ID NO: 301288 - DNA, 25 bp, Mus musculus
ggatgctccagagggcgagagcgag

SEQ ID NO: 301289 - DNA, 25 bp, Mus musculus
caaagagaaagcaagaggagcgccc

SEQ ID NO: 301290 - DNA, 25 bp, Mus musculus
acctgggagccggagaaagaacagc

SEQ ID NO: 301291 - DNA, 25 bp, Mus musculus
cctgggagccggagaaagaacagca

SEQ ID NO: 301292 - DNA, 25 bp, Mus musculus
aaagagaaagcaagaggagcgcccg

SEQ ID NO: 301293 - DNA, 25 bp, Mus musculus
cccgggatgctccagagggcgagag

SEQ ID NO: 301294 - DNA, 25 bp, Mus musculus
tcacagagtgagtgagcctttcctc

SEQ ID NO: 301295 - DNA, 25 bp, Mus musculus
cgccctaagtgtgtttgagctgctg

SEQ ID NO: 301296 - DNA, 25 bp, Mus musculus
tactaactcaaacgccctaagtgtg

SEQ ID NO: 301297 - DNA, 25 bp, Mus musculus
gccgttcgttcgactactaactcaa

SEQ ID NO: 301298 - DNA, 25 bp, Mus musculus
gcgacgccgttcgttcgactactaa

SEQ ID NO: 301299 - DNA, 25 bp, Mus musculus
ctcccaggggcgcagcaaggtaagt

SEQ ID NO: 301300 - DNA, 25 bp, Mus musculus
tgctgaacgtcccttcccaggcttt

SEQ ID NO: 301301 - DNA, 25 bp, Mus musculus
ggcccaggatgctgaacgtcccttc

SEQ ID NO: 301302 - DNA, 25 bp, Mus musculus
tgattgcgtcacgacgcgcctgacc

SEQ ID NO: 301303 - DNA, 25 bp, Mus musculus
gagtgagcctttcctctgactccgc

SEQ ID NO: 301304 - DNA, 25 bp, Mus musculus
aagttggccgcggtaagtccactcg

SEQ ID NO: 301305 - DNA, 25 bp, Mus musculus
agcaaggtaagtggcgacgccgttc

SEQ ID NO: 301306 - DNA, 25 bp, Mus musculus
ccgcctctcgtgagcgtgattgcgt

SEQ ID NO: 301307 - DNA, 25 bp, Mus musculus
cccagcagcgcgtctcctcccaggg

SEQ ID NO: 301308 - DNA, 25 bp, Mus musculus
ttagtccctttgtgctcgtccttcc

SEQ ID NO: 301309 - DNA, 25 bp, Mus musculus
ggtgtcacgtgatcctgcctgccac

SEQ ID NO: 301310 - DNA, 25 bp, Mus musculus
tgcctgccacgtgacccagggagca

SEQ ID NO: 301311 - DNA, 25 bp, Mus musculus
ccagggagcagccagacaagctgtc

SEQ ID NO: 301312 - DNA, 25 bp, Mus musculus
tgtcagtcttctggtgactctcaaa

SEQ ID NO: 301313 - DNA, 25 bp, Mus musculus
ctctcaaataaagattggaaccttc

SEQ ID NO: 301314 - DNA, 25 bp, Mus musculus
aaccttcacggctctgcaggatgtg

SEQ ID NO: 301315 - DNA, 25 bp, Mus musculus
ggcagcagtgtgcacatcccgcttt

SEQ ID NO: 301316 - DNA, 25 bp, Mus musculus
ttactcccggaaatcccgagctcag

SEQ ID NO: 301317 - DNA, 25 bp, Mus musculus
ccgagctcagctagccggccgggaa

SEQ ID NO: 301318 - DNA, 25 bp, Mus musculus
caggcgcaagcgcaccatctagagc

SEQ ID NO: 301319 - DNA, 25 bp, Mus musculus
catctagagccagcgcgtggctttc

SEQ ID NO: 301320 - DNA, 25 bp, Mus musculus
cgggctgttgtcagggcaacagacc

SEQ ID NO: 301321 - DNA, 25 bp, Mus musculus
gagttgtagtttagtccctttgtgc

SEQ ID NO: 301322 - DNA, 25 bp, Mus musculus
ttgccttgaggcctttagggtccca

SEQ ID NO: 301323 - DNA, 25 bp, Mus musculus
gagttcctatgtcccagagccaggc

SEQ ID NO: 301324 - DNA, 25 bp, Mus musculus
ggcgcagatctcactgcggccgctg

SEQ ID NO: 301325 - DNA, 25 bp, Mus musculus
cctcgcgcgaggcactttctgagaa

SEQ ID NO: 301326 - DNA, 25 bp, Mus musculus
tccaggcaatcctccgggctgctgg

SEQ ID NO: 301327 - DNA, 25 bp, Mus musculus
cgcagcacagcggatagaagagagc

SEQ ID NO: 301328 - DNA, 25 bp, Mus musculus
gaggagtagcgctccgcgttcagaa

SEQ ID NO: 301329 - DNA, 25 bp, Mus musculus
ttggcgcacccaacttctgggcgtc

SEQ ID NO: 301330 - DNA, 25 bp, Mus musculus
cttagagaagtgaaaagcagcggca

SEQ ID NO: 301331 - DNA, 25 bp, Mus musculus
gctgcctcaccgaagctcaggttcg

SEQ ID NO: 301332 - DNA, 25 bp, Mus musculus
tagggtcccaccgagttcctatgtc

SEQ ID NO: 301333 - DNA, 25 bp, Mus musculus
gcaggaagggatcgatcgactcacc

SEQ ID NO: 301334 - DNA, 25 bp, Mus musculus
ggccagctttctccgcttcttttga

SEQ ID NO: 301335 - DNA, 25 bp, Mus musculus
tgaagctgttgctgcttctcggcgc

SEQ ID NO: 301336 - DNA, 25 bp, Mus musculus
tgctctttccagtaagccctttttg

SEQ ID NO: 301337 - DNA, 25 bp, Mus musculus
gcgcgtcccttacgctaagaggtga

SEQ ID NO: 301338 - DNA, 25 bp, Mus musculus
ctcgtgagcctctggttcataaatc

SEQ ID NO: 301339 - DNA, 25 bp, Mus musculus
ccgcggcccaaatagggatcggaca

SEQ ID NO: 301340 - DNA, 25 bp, Mus musculus
tctcccaggtgttgtgtgtaaaacc

SEQ ID NO: 301341 - DNA, 25 bp, Mus musculus
cttgtcccgtgaaaggcaaattctt

SEQ ID NO: 301342 - DNA, 25 bp, Mus musculus
ctcccagagctggaagctgacctct

SEQ ID NO: 301343 - DNA, 25 bp, Mus musculus
tgaaccgcgcacctgttcgagagcc

SEQ ID NO: 301344 - DNA, 25 bp, Mus musculus
ctcggtgggtataggcttcctcctt

SEQ ID NO: 301345 - DNA, 25 bp, Mus musculus
gtctgtccacggagctccaaagcca

SEQ ID NO: 301346 - DNA, 25 bp, Mus musculus
agccctgcgttacacttccgaacgg

SEQ ID NO: 301347 - DNA, 25 bp, Mus musculus
ggcgcttccctagcccaatggcaag

SEQ ID NO: 301348 - DNA, 25 bp, Mus musculus
gctaacagcgcagggcaaaaccatc

SEQ ID NO: 301349 - DNA, 25 bp, Mus musculus
tcgccattaacagttctcccaggtg

SEQ ID NO: 301350 - DNA, 25 bp, Mus musculus
acctaagtagcgtctcggccggtgt

SEQ ID NO: 301351 - DNA, 25 bp, Mus musculus
ctcttctggagaaatcggtgtaata

SEQ ID NO: 301352 - DNA, 25 bp, Mus musculus
ttgcgtcctcaaacctaagtagcgt

SEQ ID NO: 301353 - DNA, 25 bp, Mus musculus
ctactccgcagtttagtagaggccc

SEQ ID NO: 301354 - DNA, 25 bp, Mus musculus
cgctaaggtacccaagtggctgctt

SEQ ID NO: 301355 - DNA, 25 bp, Mus musculus
gcttctcgcactgagcgctctacta

SEQ ID NO: 301356 - DNA, 25 bp, Mus musculus
tgagcgctctactaccacagtggcc

SEQ ID NO: 301357 - DNA, 25 bp, Mus musculus
cagccagtgcctgggagctcacgat

SEQ ID NO: 301358 - DNA, 25 bp, Mus musculus
gagctcacgatcctgcacacaaacg

SEQ ID NO: 301359 - DNA, 25 bp, Mus musculus
caaacgacgtgcacagccggctaga

SEQ ID NO: 301360 - DNA, 25 bp, Mus musculus
agaccagcgatgactccaccaagtg

SEQ ID NO: 301361 - DNA, 25 bp, Mus musculus
caagtgcctcaacgccagcctgtgt

SEQ ID NO: 301362 - DNA, 25 bp, Mus musculus
aagccgctgtacactcttctggaga

SEQ ID NO: 301363 - DNA, 25 bp, Mus musculus
tctttttcggcgaccgagccaccga

SEQ ID NO: 301364 - DNA, 25 bp, Mus musculus
agtcggcatctcgaagtcttaactc

SEQ ID NO: 301365 - DNA, 25 bp, Mus musculus
cacgctcggcactcaccgtcctctc

SEQ ID NO: 301366 - DNA, 25 bp, Mus musculus
acctggtcggcccagctgggcttcg

SEQ ID NO: 301367 - DNA, 25 bp, Mus musculus
acgcatactcaaagtcgccagtcgg

SEQ ID NO: 301368 - DNA, 25 bp, Mus musculus
acacgcggctctcgcgcaccgcaaa

SEQ ID NO: 301369 - DNA, 25 bp, Mus musculus
tcgaagtcttaactccacgcagctc

SEQ ID NO: 301370 - DNA, 25 bp, Mus musculus
cagcccgggtaaagacaggaagccg

SEQ ID NO: 301371 - DNA, 25 bp, Mus musculus
taaagacaggaagccggagtagaag

SEQ ID NO: 301372 - DNA, 25 bp, Mus musculus
gagtagaagaggcttccggtgccgc

SEQ ID NO: 301373 - DNA, 25 bp, Mus musculus
ccgcagcctagagcggccagaccgc

SEQ ID NO: 301374 - DNA, 25 bp, Mus musculus
acagcgcctccctgcggacaaaggt

SEQ ID NO: 301375 - DNA, 25 bp, Mus musculus
tccctgcggacaaaggtggacacgc

SEQ ID NO: 301376 - DNA, 25 bp, Mus musculus
cgccagtcggcatctcgaagtctta

SEQ ID NO: 301377 - DNA, 25 bp, Mus musculus
actcaaagtcgccagtcggcatctc

SEQ ID NO: 301378 - DNA, 25 bp, Mus musculus
gcggggccaacagcaggtacctgtt

SEQ ID NO: 301379 - DNA, 25 bp, Mus musculus
cagcaggtacctgttgaggagcagc

SEQ ID NO: 301380 - DNA, 25 bp, Mus musculus
gcagagcagcagaaagcagaacagc

SEQ ID NO: 301381 - DNA, 25 bp, Mus musculus
gcagaacagcggatactgacggcaa

SEQ ID NO: 301382 - DNA, 25 bp, Mus musculus
acagcggatactgacggcaaatctc

SEQ ID NO: 301383 - DNA, 25 bp, Mus musculus
gatactgacggcaaatctcgcgccc

SEQ ID NO: 301384 - DNA, 25 bp, Mus musculus
tcccgcagatcgtccgcacccaaga

SEQ ID NO: 301385 - DNA, 25 bp, Mus musculus
cccatctcattccacgcaggggagg

SEQ ID NO: 301386 - DNA, 25 bp, Mus musculus
atatccgggagcaacctgggccgcc

SEQ ID NO: 301387 - DNA, 25 bp, Mus musculus
ctcattccacgcaggggaggacgtg

SEQ ID NO: 301388 - DNA, 25 bp, Mus musculus
cccgggcccgcacccgtccgcatat

SEQ ID NO: 301389 - DNA, 25 bp, Mus musculus
ccgcccttcccgagaccgcggtgca

SEQ ID NO: 301390 - DNA, 25 bp, Mus musculus
ccgcatatccgggagcaacctgggc

SEQ ID NO: 301391 - DNA, 25 bp, Mus musculus
accgcggtgcagagtgcgctcctgc

SEQ ID NO: 301392 - DNA, 25 bp, Mus musculus
gaggaggaaaggacgccttcaagtc

SEQ ID NO: 301393 - DNA, 25 bp, Mus musculus
gaaagtcatgttagccacgtaacca

SEQ ID NO: 301394 - DNA, 25 bp, Mus musculus
taaccaacaacgagggagtcacctc

SEQ ID NO: 301395 - DNA, 25 bp, Mus musculus
tagccacgtaaccaacaacgaggga

SEQ ID NO: 301396 - DNA, 25 bp, Mus musculus
ccacctccgaaagaaagtcatgtta

SEQ ID NO: 301397 - DNA, 25 bp, Mus musculus
tggggcgtatgacaacctacccgcc

SEQ ID NO: 301398 - DNA, 25 bp, Mus musculus
tcaagctggggcgtatgacaaccta

SEQ ID NO: 301399 - DNA, 25 bp, Mus musculus
aggaaaggacgccttcaagtccgct

SEQ ID NO: 301400 - DNA, 25 bp, Mus musculus
tgccacacctaagggagaggaggaa

SEQ ID NO: 301401 - DNA, 25 bp, Mus musculus
tcgttgccacacctaagggagagga

SEQ ID NO: 301402 - DNA, 25 bp, Mus musculus
gattctcgttgccacacctaaggga

SEQ ID NO: 301403 - DNA, 25 bp, Mus musculus
tctcggattctcgttgccacaccta

SEQ ID NO: 301404 - DNA, 25 bp, Mus musculus
gcctcaacctctcggattctcgttg

SEQ ID NO: 301405 - DNA, 25 bp, Mus musculus
cgctttttaaaaggggatcaagctg

SEQ ID NO: 301406 - DNA, 25 bp, Mus musculus
cccggagcgccgcagacaaagccca

SEQ ID NO: 301407 - DNA, 25 bp, Mus musculus
aagcaccctccacaatgtcacggag

SEQ ID NO: 301408 - DNA, 25 bp, Mus musculus
agccgccctgtcctctcagccttcg

SEQ ID NO: 301409 - DNA, 25 bp, Mus musculus
ggcttcacgccctccctcgctagct

SEQ ID NO: 301410 - DNA, 25 bp, Mus musculus
cgctggcagcaaacccgatccagtt

SEQ ID NO: 301411 - DNA, 25 bp, Mus musculus
tcccgcgctgacgtgacgacgcaga

SEQ ID NO: 301412 - DNA, 25 bp, Mus musculus
gctcacacacgagtggccgcccttc

SEQ ID NO: 301413 - DNA, 25 bp, Mus musculus
gttccactcgcctccgagcgcgctc

SEQ ID NO: 301414 - DNA, 25 bp, Mus musculus
aaaatggcggccgaagctcacgccg

SEQ ID NO: 301415 - DNA, 25 bp, Mus musculus
cgcgagtggagctgttgtaaaatgg

SEQ ID NO: 301416 - DNA, 25 bp, Mus musculus
gaatcctgtccgaccgggtcggctg

SEQ ID NO: 301417 - DNA, 25 bp, Mus musculus
ctggggccgaggaatcctgtccgac

SEQ ID NO: 301418 - DNA, 25 bp, Mus musculus
gctgctccctgtgtccggcgcgagt

SEQ ID NO: 301419 - DNA, 25 bp, Mus musculus
acgtgacgacgcagacgacgccgcg

SEQ ID NO: 301420 - DNA, 25 bp, Mus musculus
aggtcaccgcctgcttcgagcctag

SEQ ID NO: 301421 - DNA, 25 bp, Mus musculus
agcgcgcgccttggacctctttttt

SEQ ID NO: 301422 - DNA, 25 bp, Mus musculus
tggccttgacttcgccgcgcaggca

SEQ ID NO: 301423 - DNA, 25 bp, Mus musculus
ccggttcaccgcagctccttttata

SEQ ID NO: 301424 - DNA, 25 bp, Mus musculus
ctgtcactgattggacgcgagagta

SEQ ID NO: 301425 - DNA, 25 bp, Mus musculus
ttttcatgaagcaacgcgtgggagc

SEQ ID NO: 301426 - DNA, 25 bp, Mus musculus
ctcctttgtgcgagatcgaggctgc

SEQ ID NO: 301427 - DNA, 25 bp, Mus musculus
tggcgccagaattcaaacgaactgc

SEQ ID NO: 301428 - DNA, 25 bp, Mus musculus
tcgagcctagtcgacacggacggtc

SEQ ID NO: 301429 - DNA, 25 bp, Mus musculus
cgcgcaggcagctttgagcgccgct

SEQ ID NO: 301430 - DNA, 25 bp, Mus musculus
agaagcttggttgctacggtggcca

SEQ ID NO: 301431 - DNA, 25 bp, Mus musculus
ccagcgctgcgcttgtgtattcagc

SEQ ID NO: 301432 - DNA, 25 bp, Mus musculus
gaggacagaattacgcgggtgaaaa

SEQ ID NO: 301433 - DNA, 25 bp, Mus musculus
ggggcgtggcttttcatgaagcaac

SEQ ID NO: 301434 - DNA, 25 bp, Mus musculus
agccagccctttcggtgtgcgatgt

SEQ ID NO: 301435 - DNA, 25 bp, Mus musculus
ctcctcgtagctcaccggcttgttc

SEQ ID NO: 301436 - DNA, 25 bp, Mus musculus
tcgcgccgcccgattctaggagcga

SEQ ID NO: 301437 - DNA, 25 bp, Mus musculus
ccgcccgattctaggagcgaaggtg

SEQ ID NO: 301438 - DNA, 25 bp, Mus musculus
attctaggagcgaaggtgcggtcac

SEQ ID NO: 301439 - DNA, 25 bp, Mus musculus
tgcggtcacggggagacccagccca

SEQ ID NO: 301440 - DNA, 25 bp, Mus musculus
tcaccttggcgcagaccgcggaggt

SEQ ID NO: 301441 - DNA, 25 bp, Mus musculus
cgcggcccactcacccgctgcccta

SEQ ID NO: 301442 - DNA, 25 bp, Mus musculus
gcaccgacgcggaccacgccatctt

SEQ ID NO: 301443 - DNA, 25 bp, Mus musculus
acgcgtcagtgcgcagccgcaggaa

SEQ ID NO: 301444 - DNA, 25 bp, Mus musculus
gccctttcggtgtgcgatgtagtgc

SEQ ID NO: 301445 - DNA, 25 bp, Mus musculus
agagcaggaactaacgggaacacgg

SEQ ID NO: 301446 - DNA, 25 bp, Mus musculus
ctcagagcaggaactaacgggaaca

SEQ ID NO: 301447 - DNA, 25 bp, Mus musculus
gcggggcctcagagcaggaactaac

SEQ ID NO: 301448 - DNA, 25 bp, Mus musculus
gaacggctgcgccagtctctcctcc

SEQ ID NO: 301449 - DNA, 25 bp, Mus musculus
tgggctcgcgagtctgcgcaggcgc

SEQ ID NO: 301450 - DNA, 25 bp, Mus musculus
cacggtaaacagtgccaagcggggc

SEQ ID NO: 301451 - DNA, 25 bp, Mus musculus
cggaggaacggctgcgccagtctct

SEQ ID NO: 301452 - DNA, 25 bp, Mus musculus
ttgagggccttgagcgcggaggaac

SEQ ID NO: 301453 - DNA, 25 bp, Mus musculus
ctgaagcagcgcttgagggccttga

SEQ ID NO: 301454 - DNA, 25 bp, Mus musculus
taaacagtgccaagcggggcctgcg

SEQ ID NO: 301455 - DNA, 25 bp, Mus musculus
ggtcacggtaaacagtgccaagcgg

SEQ ID NO: 301456 - DNA, 25 bp, Mus musculus
ggcggtcacggtaaacagtgccaag

SEQ ID NO: 301457 - DNA, 25 bp, Mus musculus
gcggcggtcacggtaaacagtgcca

SEQ ID NO: 301458 - DNA, 25 bp, Mus musculus
aatggcggcggtcacggtaaacagt

SEQ ID NO: 301459 - DNA, 25 bp, Mus musculus
cccttaagctccgagggtgatgggc

SEQ ID NO: 301460 - DNA, 25 bp, Mus musculus
cgagaagactgccgggagttaaact

SEQ ID NO: 301461 - DNA, 25 bp, Mus musculus
gcggtgcttgccaggaatggcggcg

SEQ ID NO: 301462 - DNA, 25 bp, Mus musculus
acagagtccctgtgtaatagcaacc

SEQ ID NO: 301463 - DNA, 25 bp, Mus musculus
ccgctttctgaagttacctctgggg

SEQ ID NO: 301464 - DNA, 25 bp, Mus musculus
cgtaccgagctcagcgaaaagggtc

SEQ ID NO: 301465 - DNA, 25 bp, Mus musculus
agcgaaaagggtctccgtgcccagg

SEQ ID NO: 301466 - DNA, 25 bp, Mus musculus
aggcggcctgcagtcgggaacctat

SEQ ID NO: 301467 - DNA, 25 bp, Mus musculus
cagtcgggaacctatcggagccagg

SEQ ID NO: 301468 - DNA, 25 bp, Mus musculus
ggagtgccagtagcctgggacttta

SEQ ID NO: 301469 - DNA, 25 bp, Mus musculus
gtagcctgggactttacacagagtc

SEQ ID NO: 301470 - DNA, 25 bp, Mus musculus
cctgtgtaatagcaaccggcacgta

SEQ ID NO: 301471 - DNA, 25 bp, Mus musculus
agcgatcacaccttgcacgcacata

SEQ ID NO: 301472 - DNA, 25 bp, Mus musculus
ttgcacgcacatacttgcacatgtg

SEQ ID NO: 301473 - DNA, 25 bp, Mus musculus
acttgcacatgtgcgctcgggtgcc

SEQ ID NO: 301474 - DNA, 25 bp, Mus musculus
cggcacgtagcgatcacaccttgca

SEQ ID NO: 301475 - DNA, 25 bp, Mus musculus
atgggtctcccgctttctgaagtta

SEQ ID NO: 301476 - DNA, 25 bp, Mus musculus
cttggactcgggtacttctcagtgc

SEQ ID NO: 301477 - DNA, 25 bp, Mus musculus
ctcgatggactagaaaggaaccgca

SEQ ID NO: 301478 - DNA, 25 bp, Mus musculus
agagagaacttcacgccctgctcca

SEQ ID NO: 301479 - DNA, 25 bp, Mus musculus
cacctcttcgtggaagcactgcttg

SEQ ID NO: 301480 - DNA, 25 bp, Mus musculus
agcctcgtggaccatgatgctccgg

SEQ ID NO: 301481 - DNA, 25 bp, Mus musculus
atgctccgggcctagtcctctctag

SEQ ID NO: 301482 - DNA, 25 bp, Mus musculus
gctattgtatttgatgcggctcttg

SEQ ID NO: 301483 - DNA, 25 bp, Mus musculus
cacattcagtagttaggaggactcg

SEQ ID NO: 301484 - DNA, 25 bp, Mus musculus
tcagtgcgtcccttcaactcggaaa

SEQ ID NO: 301485 - DNA, 25 bp, Mus musculus
cgttgggcttctagtctgtttctga

SEQ ID NO: 301486 - DNA, 25 bp, Mus musculus
agtgtctgccacgtctccggagaaa

SEQ ID NO: 301487 - DNA, 25 bp, Mus musculus
tcccggacgtaatgaacacattcag

SEQ ID NO: 301488 - DNA, 25 bp, Mus musculus
tagggccgcacctggtaatccagag

SEQ ID NO: 301489 - DNA, 25 bp, Mus musculus
cgcatcactgagtttaggcgctatt

SEQ ID NO: 301490 - DNA, 25 bp, Mus musculus
cctccaaggagtccggcgagaaaca

SEQ ID NO: 301491 - DNA, 25 bp, Mus musculus
ccagctttggggacagaactttgac

SEQ ID NO: 301492 - DNA, 25 bp, Mus musculus
ttcagggccttccatccagctttgg

SEQ ID NO: 301493 - DNA, 25 bp, Mus musculus
ttccagccaggaagggtccagctag

SEQ ID NO: 301494 - DNA, 25 bp, Mus musculus
ctctcctctaagaattcagggcgtc

SEQ ID NO: 301495 - DNA, 25 bp, Mus musculus
gaagtatctgtaaacgcgcgccctc

SEQ ID NO: 301496 - DNA, 25 bp, Mus musculus
gctcttcgagggattggcgtcatat

SEQ ID NO: 301497 - DNA, 25 bp, Mus musculus
tctgcggagagaagaggttccagcc

SEQ ID NO: 301498 - DNA, 25 bp, Mus musculus
acggcgcccgatctcaaagtgtaga

SEQ ID NO: 301499 - DNA, 25 bp, Mus musculus
cctctctgagatgtaagtgcgtagc

SEQ ID NO: 301500 - DNA, 25 bp, Mus musculus
gcgtagcagtctctcaggccttcta

SEQ ID NO: 301501 - DNA, 25 bp, Mus musculus
atccggcttaacgatggccacgtcg

SEQ ID NO: 301502 - DNA, 25 bp, Mus musculus
accaagtggtttgccctgctccaga

SEQ ID NO: 301503 - DNA, 25 bp, Mus musculus
gctctacctgctcgagggaagtatc

SEQ ID NO: 301504 - DNA, 25 bp, Mus musculus
gaccgggcagtgagcgccgagatgt

SEQ ID NO: 301505 - DNA, 25 bp, Mus musculus
gccgagctgaccgtgaacgccatag

SEQ ID NO: 301506 - DNA, 25 bp, Mus musculus
ccgagatgtgggctgcgctgccgct

SEQ ID NO: 301507 - DNA, 25 bp, Mus musculus
agtactggggccaccgccgagctga

SEQ ID NO: 301508 - DNA, 25 bp, Mus musculus
gggccaccgccgagctgaccgtgaa

SEQ ID NO: 301509 - DNA, 25 bp, Mus musculus
ctagtctcgggggacacgcgtcttg

SEQ ID NO: 301510 - DNA, 25 bp, Mus musculus
gctggggcctggctgctgagtactg

SEQ ID NO: 301511 - DNA, 25 bp, Mus musculus
agggagaacagggacgggctagtct

SEQ ID NO: 301512 - DNA, 25 bp, Mus musculus
gaaagtggggcgcagggctccgagg

SEQ ID NO: 301513 - DNA, 25 bp, Mus musculus
ccgtgaacgccataggtaggaggga

SEQ ID NO: 301514 - DNA, 25 bp, Mus musculus
gctgaccgtgaacgccataggtagg

SEQ ID NO: 301515 - DNA, 25 bp, Mus musculus
ccgagctgaccgtgaacgccatagg

SEQ ID NO: 301516 - DNA, 25 bp, Mus musculus
ggggacacgcgtcttgcgtgatccg

SEQ ID NO: 301517 - DNA, 25 bp, Mus musculus
gagctgaccgtgaacgccataggta

SEQ ID NO: 301518 - DNA, 25 bp, Mus musculus
agttcgacctcggatgacgccagca

SEQ ID NO: 301519 - DNA, 25 bp, Mus musculus
gaggctctgccacacgcacggagat

SEQ ID NO: 301520 - DNA, 25 bp, Mus musculus
gccgcggccatcttacaacgcagtt

SEQ ID NO: 301521 - DNA, 25 bp, Mus musculus
acagagccgctcgtttgtccaacag

SEQ ID NO: 301522 - DNA, 25 bp, Mus musculus
ttgtccaacagcctcgaaccttcgg

SEQ ID NO: 301523 - DNA, 25 bp, Mus musculus
cgggcacctcccttcaatagacttt

SEQ ID NO: 301524 - DNA, 25 bp, Mus musculus
accgagcactgtcgcggatgacgca

SEQ ID NO: 301525 - DNA, 25 bp, Mus musculus
cggatgacgcactgagattaccctc

SEQ ID NO: 301526 - DNA, 25 bp, Mus musculus
cttacaaagcaaggcctgcacggtt

SEQ ID NO: 301527 - DNA, 25 bp, Mus musculus
ctcaccctcctggaatttcggctta

SEQ ID NO: 301528 - DNA, 25 bp, Mus musculus
cttgggcgccatttataagtgattc

SEQ ID NO: 301529 - DNA, 25 bp, Mus musculus
agctctacatcctgggcgcgatttg

SEQ ID NO: 301530 - DNA, 25 bp, Mus musculus
atgccgggattggtagttcgacctc

SEQ ID NO: 301531 - DNA, 25 bp, Mus musculus
tctggcccgaagctgcgtgtaagct

SEQ ID NO: 301532 - DNA, 25 bp, Mus musculus
gagctgttcgcgctggcatcttgca

SEQ ID NO: 301533 - DNA, 25 bp, Mus musculus
gaagaccatgctatgcccgaaggga

SEQ ID NO: 301534 - DNA, 25 bp, Mus musculus
atagtgggctcgtccgtgctgcgac

SEQ ID NO: 301535 - DNA, 25 bp, Mus musculus
acctcctggctatagtgggctcgtc

SEQ ID NO: 301536 - DNA, 25 bp, Mus musculus
cccaatatatgcctcggcatcggtc

SEQ ID NO: 301537 - DNA, 25 bp, Mus musculus
atgctatgcccgaagggagtgcgca

SEQ ID NO: 301538 - DNA, 25 bp, Mus musculus
taccgcctgcggacatggtccggga

SEQ ID NO: 301539 - DNA, 25 bp, Mus musculus
cgctggcatcttgcaggttgcagac

SEQ ID NO: 301540 - DNA, 25 bp, Mus musculus
cttgcaggttgcagacgacagaaca

SEQ ID NO: 301541 - DNA, 25 bp, Mus musculus
cgacagaacagctctgaacgagacc

SEQ ID NO: 301542 - DNA, 25 bp, Mus musculus
tcgcgcgcgcggaaaccaattggga

SEQ ID NO: 301543 - DNA, 25 bp, Mus musculus
gcgcaagcggaagcagcatgtacca

SEQ ID NO: 301544 - DNA, 25 bp, Mus musculus
gcagcatgtaccacacagggcaaga

SEQ ID NO: 301545 - DNA, 25 bp, Mus musculus
ggcacctaccgcctgcggacatggt

SEQ ID NO: 301546 - DNA, 25 bp, Mus musculus
cggggtgactctcctggaaagcaaa

SEQ ID NO: 301547 - DNA, 25 bp, Mus musculus
gagcttcttcctccgccctgggtta

SEQ ID NO: 301548 - DNA, 25 bp, Mus musculus
cggctagagtcaggacccggacctt

SEQ ID NO: 301549 - DNA, 25 bp, Mus musculus
agccaggcatgtcctgagtcggacc

SEQ ID NO: 301550 - DNA, 25 bp, Mus musculus
gtccgagtctcctcctgatcctgtg

SEQ ID NO: 301551 - DNA, 25 bp, Mus musculus
gcaggaccggcttactctgagacta

SEQ ID NO: 301552 - DNA, 25 bp, Mus musculus
ctgagagaagctgcacctaccggga

SEQ ID NO: 301553 - DNA, 25 bp, Mus musculus
ccgggagccatccttcagttgtcca

SEQ ID NO: 301554 - DNA, 25 bp, Mus musculus
ttgtccactcagctggcatccggga

SEQ ID NO: 301555 - DNA, 25 bp, Mus musculus
catccgggacttgccactggagtga

SEQ ID NO: 301556 - DNA, 25 bp, Mus musculus
tgctgcgctgagtgcatctttccca

SEQ ID NO: 301557 - DNA, 25 bp, Mus musculus
attcgcgcgagacggcttcttacac

SEQ ID NO: 301558 - DNA, 25 bp, Mus musculus
gcttcttacacactccttcggggtg

SEQ ID NO: 301559 - DNA, 25 bp, Mus musculus
agcatccaggctcttgtttggccgc

SEQ ID NO: 301560 - DNA, 25 bp, Mus musculus
gggcgcgatcgtcccaccttgagca

SEQ ID NO: 301561 - DNA, 25 bp, Mus musculus
cctcatcgcggccctggtagctgaa

SEQ ID NO: 301562 - DNA, 25 bp, Mus musculus
tcccaccttgagcacggtgactgca

SEQ ID NO: 301563 - DNA, 25 bp, Mus musculus
acggtgactgcaccggcgctgtgca

SEQ ID NO: 301564 - DNA, 25 bp, Mus musculus
accggcgctgtgcacctggaagtgt

SEQ ID NO: 301565 - DNA, 25 bp, Mus musculus
agcttctgcaggtagccgcacagcc

SEQ ID NO: 301566 - DNA, 25 bp, Mus musculus
gggcccttgcccgacagcttctgca

SEQ ID NO: 301567 - DNA, 25 bp, Mus musculus
cgagtcaaacacgaaccagcggctg

SEQ ID NO: 301568 - DNA, 25 bp, Mus musculus
agcggcgcgagtcaaacacgaacca

SEQ ID NO: 301569 - DNA, 25 bp, Mus musculus
tagcagcggcgcgagtcaaacacga

SEQ ID NO: 301570 - DNA, 25 bp, Mus musculus
tcttgaagtagtagaggtagcagcg

SEQ ID NO: 301571 - DNA, 25 bp, Mus musculus
cgtcctggggactcttgaagtagta

SEQ ID NO: 301572 - DNA, 25 bp, Mus musculus
gcagagcgtcctggggactcttgaa

SEQ ID NO: 301573 - DNA, 25 bp, Mus musculus
ctgaagcaggcgtcggcgatgtcca

SEQ ID NO: 301574 - DNA, 25 bp, Mus musculus
gctcccgccactcaattcttgtagt

SEQ ID NO: 301575 - DNA, 25 bp, Mus musculus
ctcaattcttgtagtggcggccgca

SEQ ID NO: 301576 - DNA, 25 bp, Mus musculus
cctctgctggcattgtgaactcact

SEQ ID NO: 301577 - DNA, 25 bp, Mus musculus
gtgaactcacttaaaccagcgcggt

SEQ ID NO: 301578 - DNA, 25 bp, Mus musculus
ccagcgcggtttgaaaacaaacacg

SEQ ID NO: 301579 - DNA, 25 bp, Mus musculus
tgaaaacaaacacgtgcggcttccc

SEQ ID NO: 301580 - DNA, 25 bp, Mus musculus
gcactattttgggagtcaggccaga

SEQ ID NO: 301581 - DNA, 25 bp, Mus musculus
tcaggccagagactttcacaggcgg

SEQ ID NO: 301582 - DNA, 25 bp, Mus musculus
ttcacaggcgggagcttccgcgatt

SEQ ID NO: 301583 - DNA, 25 bp, Mus musculus
ggggcaccatgcatattcattagca

SEQ ID NO: 301584 - DNA, 25 bp, Mus musculus
tattcattagcacgtggagccctgg

SEQ ID NO: 301585 - DNA, 25 bp, Mus musculus
gagccctgggctgcatgccgcgcat

SEQ ID NO: 301586 - DNA, 25 bp, Mus musculus
gaaaagcgagaacccggcaccgctc

SEQ ID NO: 301587 - DNA, 25 bp, Mus musculus
gcaggttttcccgagcctctgctgg

SEQ ID NO: 301588 - DNA, 25 bp, Mus musculus
ggaggagcgccctcttttaagactc

SEQ ID NO: 301589 - DNA, 25 bp, Mus musculus
cggcccgtgacacttacctgcggtg

SEQ ID NO: 301590 - DNA, 25 bp, Mus musculus
agctatccagcgtggggcagactct

SEQ ID NO: 301591 - DNA, 25 bp, Mus musculus
agttcgtgctgaagctgccctccac

SEQ ID NO: 301592 - DNA, 25 bp, Mus musculus
ttgctgttgccagagcgcaccaagt

SEQ ID NO: 301593 - DNA, 25 bp, Mus musculus
taagcactgaatcaggcgcccgggc

SEQ ID NO: 301594 - DNA, 25 bp, Mus musculus
gctgaccattctgaaacgccaaatt

SEQ ID NO: 301595 - DNA, 25 bp, Mus musculus
ccggggtatgaatgcgcccattatc

SEQ ID NO: 301596 - DNA, 25 bp, Mus musculus
tctgttcagattagcccggggtatg

SEQ ID NO: 301597 - DNA, 25 bp, Mus musculus
gtgaaagcctttcttcccacctctg

SEQ ID NO: 301598 - DNA, 25 bp, Mus musculus
ccctttgagctctcggcgaatggca

SEQ ID NO: 301599 - DNA, 25 bp, Mus musculus
gcggcgatttattctgggagtgaca

SEQ ID NO: 301600 - DNA, 25 bp, Mus musculus
cgaaggccctcgagaagtgattccc

SEQ ID NO: 301601 - DNA, 25 bp, Mus musculus
cactgggtagatcctgctggattgc

SEQ ID NO: 301602 - DNA, 25 bp, Mus musculus
ggggtgtctcgagtttcaggattct

SEQ ID NO: 301603 - DNA, 25 bp, Mus musculus
gtctgttgtgggagacacgatggtg

SEQ ID NO: 301604 - DNA, 25 bp, Mus musculus
taaaattggaagagagcgcgctgtg

SEQ ID NO: 301605 - DNA, 25 bp, Mus musculus
ccattcgttaaaattggaagagagc

SEQ ID NO: 301606 - DNA, 25 bp, Mus musculus
ggtcggcatgttttgtttctgattt

SEQ ID NO: 301607 - DNA, 25 bp, Mus musculus
gtctcttaaatagggggtcggcatg

SEQ ID NO: 301608 - DNA, 25 bp, Mus musculus
gtgtgttcagtctcttaaatagggg

SEQ ID NO: 301609 - DNA, 25 bp, Mus musculus
atacgtgtgtgttcagtctcttaaa

SEQ ID NO: 301610 - DNA, 25 bp, Mus musculus
ataatacggcgtatatacgtgtgtg

SEQ ID NO: 301611 - DNA, 25 bp, Mus musculus
gattctttcaataatacggcgtata

SEQ ID NO: 301612 - DNA, 25 bp, Mus musculus
ttcaggattctttcaataatacggc

SEQ ID NO: 301613 - DNA, 25 bp, Mus musculus
ctcgagtttcaggattctttcaata

SEQ ID NO: 301614 - DNA, 25 bp, Mus musculus
tggacgactcataccccgagctggc

SEQ ID NO: 301615 - DNA, 25 bp, Mus musculus
tgggtggcgtggacgactcataccc

SEQ ID NO: 301616 - DNA, 25 bp, Mus musculus
tgccgccgcccagaagccgctcccg

SEQ ID NO: 301617 - DNA, 25 bp, Mus musculus
ttggcgaagcgccggtcgcagccct

SEQ ID NO: 301618 - DNA, 25 bp, Mus musculus
acgtgcatgtgcttcttgcggtcgc

SEQ ID NO: 301619 - DNA, 25 bp, Mus musculus
cttgcaaaggtagggcttgtcgctc

SEQ ID NO: 301620 - DNA, 25 bp, Mus musculus
cgcacatcttgcaaaggtagggctt

SEQ ID NO: 301621 - DNA, 25 bp, Mus musculus
tgtaggacttatcgcacatcttgca

SEQ ID NO: 301622 - DNA, 25 bp, Mus musculus
gggtgcgtgtaggacttatcgcaca

SEQ ID NO: 301623 - DNA, 25 bp, Mus musculus
ccttcatgtgtttacgcagagagct

SEQ ID NO: 301624 - DNA, 25 bp, Mus musculus
cgttaccttcatgtgtttacgcaga

SEQ ID NO: 301625 - DNA, 25 bp, Mus musculus
cggcggcgttaccttcatgtgttta

SEQ ID NO: 301626 - DNA, 25 bp, Mus musculus
ccagacggcggcgttaccttcatgt

SEQ ID NO: 301627 - DNA, 25 bp, Mus musculus
aaaaggctctcgctcgaaggcgagc

SEQ ID NO: 301628 - DNA, 25 bp, Mus musculus
gggcccagaaaaggctctcgctcga

SEQ ID NO: 301629 - DNA, 25 bp, Mus musculus
ccagaaaaggctctcgctcgaaggc

SEQ ID NO: 301630 - DNA, 25 bp, Mus musculus
cccgggtagaattgaaagcagcgct

SEQ ID NO: 301631 - DNA, 25 bp, Mus musculus
gagtcgacccacctaacgaagtctc

SEQ ID NO: 301632 - DNA, 25 bp, Mus musculus
agtctcagccagcaggcaacggcca

SEQ ID NO: 301633 - DNA, 25 bp, Mus musculus
ggttgatacccaggcccacgtctct

SEQ ID NO: 301634 - DNA, 25 bp, Mus musculus
tgcggaacagaaagtcccgggtaga

SEQ ID NO: 301635 - DNA, 25 bp, Mus musculus
ccggccgaagcagcgaagagactgt

SEQ ID NO: 301636 - DNA, 25 bp, Mus musculus
tgctccggctcgatccatttacaga

SEQ ID NO: 301637 - DNA, 25 bp, Mus musculus
tggtcacaccaatcgcgggatactg

SEQ ID NO: 301638 - DNA, 25 bp, Mus musculus
ttgcacgactttttggggttggcca

SEQ ID NO: 301639 - DNA, 25 bp, Mus musculus
ccgcctgctcgtgaagcccagaaaa

SEQ ID NO: 301640 - DNA, 25 bp, Mus musculus
ctcttgcttgatgggttggcgcata

SEQ ID NO: 301641 - DNA, 25 bp, Mus musculus
tcatgggcccatagccgtgaagctg

SEQ ID NO: 301642 - DNA, 25 bp, Mus musculus
gaaacctagccgcatctgcccgtta

SEQ ID NO: 301643 - DNA, 25 bp, Mus musculus
ctcgcccgccaaggagggaagatca

SEQ ID NO: 301644 - DNA, 25 bp, Mus musculus
gtgagcgcgagactgatagcagcaa

SEQ ID NO: 301645 - DNA, 25 bp, Mus musculus
ttggtgaggcggcaatccccccaca

SEQ ID NO: 301646 - DNA, 25 bp, Mus musculus
ggtcacgtgcgaccgacgcgggcga

SEQ ID NO: 301647 - DNA, 25 bp, Mus musculus
ccccccctgatgaatgggagcaggg

SEQ ID NO: 301648 - DNA, 25 bp, Mus musculus
ttgaaaggacgacaccgtcgtcgtc

SEQ ID NO: 301649 - DNA, 25 bp, Mus musculus
tgaattgaaaggacgacaccgtcgt

SEQ ID NO: 301650 - DNA, 25 bp, Mus musculus
aatgaattgaaaggacgacaccgtc

SEQ ID NO: 301651 - DNA, 25 bp, Mus musculus
cattcctgcagataaatgaattgaa

SEQ ID NO: 301652 - DNA, 25 bp, Mus musculus
cagcaatcattcctgcagataaatg

SEQ ID NO: 301653 - DNA, 25 bp, Mus musculus
tgatagcagcaatcattcctgcaga

SEQ ID NO: 301654 - DNA, 25 bp, Mus musculus
gactgatagcagcaatcattcctgc

SEQ ID NO: 301655 - DNA, 25 bp, Mus musculus
gcgagactgatagcagcaatcattc

SEQ ID NO: 301656 - DNA, 25 bp, Mus musculus
agcgcgagactgatagcagcaatca

SEQ ID NO: 301657 - DNA, 25 bp, Mus musculus
ccgcgccaacgaagggcgcgcggtg

SEQ ID NO: 301658 - DNA, 25 bp, Mus musculus
tcctttgaacggactcctgcgtctg

SEQ ID NO: 301659 - DNA, 25 bp, Mus musculus
ctaggggatgacagcccgatgtccc

SEQ ID NO: 301660 - DNA, 25 bp, Mus musculus
cgaaggcggaggctttttgactttg

SEQ ID NO: 301661 - DNA, 25 bp, Mus musculus
tttgcttggtctgccagcttcactg

SEQ ID NO: 301662 - DNA, 25 bp, Mus musculus
ctgctggcaccgaccggctcaagat

SEQ ID NO: 301663 - DNA, 25 bp, Mus musculus
gcaccgactgccagaaacctagatg

SEQ ID NO: 301664 - DNA, 25 bp, Mus musculus
gccaccgcttctcatgcacgttatt

SEQ ID NO: 301665 - DNA, 25 bp, Mus musculus
ttgtctcgacaacaggtagcagctg

SEQ ID NO: 301666 - DNA, 25 bp, Mus musculus
gggatccctggagacatgtatgcga

SEQ ID NO: 301667 - DNA, 25 bp, Mus musculus
atggcccgcagcgacactctggcaa

SEQ ID NO: 301668 - DNA, 25 bp, Mus musculus
ccctgcacggttatggcggcatgaa

SEQ ID NO: 301669 - DNA, 25 bp, Mus musculus
ggaaccttttgcaccagggcctatg

SEQ ID NO: 301670 - DNA, 25 bp, Mus musculus
tatgcgccagcccatcaaacaggag

SEQ ID NO: 301671 - DNA, 25 bp, Mus musculus
ggccctggagcctttttccgctata

SEQ ID NO: 301672 - DNA, 25 bp, Mus musculus
cccggtactgatgcgtctaggctcg

SEQ ID NO: 301673 - DNA, 25 bp, Mus musculus
tactgatgcgtctaggctcggtacc

SEQ ID NO: 301674 - DNA, 25 bp, Mus musculus
cgtctaggctcggtacctgttcttt

SEQ ID NO: 301675 - DNA, 25 bp, Mus musculus
tcgtctggagcgaaatactcgtcta

SEQ ID NO: 301676 - DNA, 25 bp, Mus musculus
gaaatactcgtctagtttacgcgac

SEQ ID NO: 301677 - DNA, 25 bp, Mus musculus
gcgaaaacagatccagccacaagtg

SEQ ID NO: 301678 - DNA, 25 bp, Mus musculus
agggctacgctaaggcccgcctgca

SEQ ID NO: 301679 - DNA, 25 bp, Mus musculus
cccgtttctcgtctggagcgaaata

SEQ ID NO: 301680 - DNA, 25 bp, Mus musculus
cccacctagagcgtctctcggggga

SEQ ID NO: 301681 - DNA, 25 bp, Mus musculus
tgctcgctctgaagcccgggccgag

SEQ ID NO: 301682 - DNA, 25 bp, Mus musculus
ccacaagtgccagaaaatggcgctg

SEQ ID NO: 301683 - DNA, 25 bp, Mus musculus
cccgcagtcagtcagccctcgcgga

SEQ ID NO: 301684 - DNA, 25 bp, Mus musculus
cggagtcagggcgaaaacagatcca

SEQ ID NO: 301685 - DNA, 25 bp, Mus musculus
cctgcagcagggctacgctaaggcc

SEQ ID NO: 301686 - DNA, 25 bp, Mus musculus
ctcggctataacgtctgctctcgcg

SEQ ID NO: 301687 - DNA, 25 bp, Mus musculus
tgagaggcgtttcgccaacagcagc

SEQ ID NO: 301688 - DNA, 25 bp, Mus musculus
agctgctctggtttacgccggtcta

SEQ ID NO: 301689 - DNA, 25 bp, Mus musculus
tgctgctttccagcgagctgctctg

SEQ ID NO: 301690 - DNA, 25 bp, Mus musculus
cctccagtatcagggctgctgcttt

SEQ ID NO: 301691 - DNA, 25 bp, Mus musculus
tggcacagacgtgagcgaatggtac

SEQ ID NO: 301692 - DNA, 25 bp, Mus musculus
cgcaagaaacattcgcacgtgcaca

SEQ ID NO: 301693 - DNA, 25 bp, Mus musculus
ctcgcgtcgccctcgttagaaagcg

SEQ ID NO: 301694 - DNA, 25 bp, Mus musculus
cagctctggctacgactcggctata

SEQ ID NO: 301695 - DNA, 25 bp, Mus musculus
tgaaagttcatggtcgctcaccgcc

SEQ ID NO: 301696 - DNA, 25 bp, Mus musculus
tctctgcgaaagcacatgaaagttc

SEQ ID NO: 301697 - DNA, 25 bp, Mus musculus
tgcgcgggtgtgacaagtgttacac

SEQ ID NO: 301698 - DNA, 25 bp, Mus musculus
cgagcgacaagccttatatgtgcaa

SEQ ID NO: 301699 - DNA, 25 bp, Mus musculus
tgagccctcagtggcttgctctgcg

SEQ ID NO: 301700 - DNA, 25 bp, Mus musculus
gtgcaacgcctgtacgagcgcctga

SEQ ID NO: 301701 - DNA, 25 bp, Mus musculus
ggagacacctggactttgcagttaa

SEQ ID NO: 301702 - DNA, 25 bp, Mus musculus
cggcggcgacttgcaatgaattcca

SEQ ID NO: 301703 - DNA, 25 bp, Mus musculus
ccctgagctaggaaaaggagacacc

SEQ ID NO: 301704 - DNA, 25 bp, Mus musculus
tgcagttaatgtccctttccttcga

SEQ ID NO: 301705 - DNA, 25 bp, Mus musculus
cccgcccatgaactctgaaagcttt

SEQ ID NO: 301706 - DNA, 25 bp, Mus musculus
tagcacctttcatcctagccggaga

SEQ ID NO: 301707 - DNA, 25 bp, Mus musculus
tcggattccgcctttctcttcagcg

SEQ ID NO: 301708 - DNA, 25 bp, Mus musculus
aatgaattccagatgtggcccgcca

SEQ ID NO: 301709 - DNA, 25 bp, Mus musculus
agcgccaacttcctgcccgaaggaa

SEQ ID NO: 301710 - DNA, 25 bp, Mus musculus
tccagtcttgcaaagtctccagctc

SEQ ID NO: 301711 - DNA, 25 bp, Mus musculus
ggtagatgatctgttccctcggtgc

SEQ ID NO: 301712 - DNA, 25 bp, Mus musculus
tgggatctcagggtctccgtgaacc

SEQ ID NO: 301713 - DNA, 25 bp, Mus musculus
tctccagctcaaagcgctcggattc

SEQ ID NO: 301714 - DNA, 25 bp, Mus musculus
cgctttctgcgcgttccgggacaga

SEQ ID NO: 301715 - DNA, 25 bp, Mus musculus
gccgaaagacttgggctcgtgaccc

SEQ ID NO: 301716 - DNA, 25 bp, Mus musculus
actgggagcaatggccgaaagactt

SEQ ID NO: 301717 - DNA, 25 bp, Mus musculus
tctgaagactgggagcaatggccga

SEQ ID NO: 301718 - DNA, 25 bp, Mus musculus
cggcagaggttatggtctgaagact

SEQ ID NO: 301719 - DNA, 25 bp, Mus musculus
cggatctgtgcgcacaaaggagccg

SEQ ID NO: 301720 - DNA, 25 bp, Mus musculus
gttccgggacagagctcgcggatct

SEQ ID NO: 301721 - DNA, 25 bp, Mus musculus
gctgctcggcaatccacactcgtga

SEQ ID NO: 301722 - DNA, 25 bp, Mus musculus
gagctcgcggatctgtgcgcacaaa

SEQ ID NO: 301723 - DNA, 25 bp, Mus musculus
agccagaagctctgctgtccgggcc

SEQ ID NO: 301724 - DNA, 25 bp, Mus musculus
acactcgtgacccttcttcgctagt

SEQ ID NO: 301725 - DNA, 25 bp, Mus musculus
ttcttcgctagttcccacgggatcg

SEQ ID NO: 301726 - DNA, 25 bp, Mus musculus
gggagggaactcagccagaagctct

SEQ ID NO: 301727 - DNA, 25 bp, Mus musculus
gggaactcagccagaagctctgctg

SEQ ID NO: 301728 - DNA, 25 bp, Mus musculus
cagaggagcggttcggagctcaacc

SEQ ID NO: 301729 - DNA, 25 bp, Mus musculus
aggtggttgcgcaactttcgctttg

SEQ ID NO: 301730 - DNA, 25 bp, Mus musculus
ttcgctggcgcccacaacttgttta

SEQ ID NO: 301731 - DNA, 25 bp, Mus musculus
tggcgcccacaacttgtttaccctg

SEQ ID NO: 301732 - DNA, 25 bp, Mus musculus
ccacaacttgtttaccctgcgtttg

SEQ ID NO: 301733 - DNA, 25 bp, Mus musculus
acttgtttaccctgcgtttggctag

SEQ ID NO: 301734 - DNA, 25 bp, Mus musculus
ttaccctgcgtttggctagggttca

SEQ ID NO: 301735 - DNA, 25 bp, Mus musculus
cctgcgtttggctagggttcaggac

SEQ ID NO: 301736 - DNA, 25 bp, Mus musculus
tagggttcaggacgccggcgcccca

SEQ ID NO: 301737 - DNA, 25 bp, Mus musculus
cccgcgtggatcgtcccagctcctc

SEQ ID NO: 301738 - DNA, 25 bp, Mus musculus
tggatcgtcccagctcctcggcgcc

SEQ ID NO: 301739 - DNA, 25 bp, Mus musculus
gcaggacagcgagctcagccggcga

SEQ ID NO: 301740 - DNA, 25 bp, Mus musculus
agccgcaggtggttgcgcaactttc

SEQ ID NO: 301741 - DNA, 25 bp, Mus musculus
agcggttcggagctcaaccccgcgg

SEQ ID NO: 301742 - DNA, 25 bp, Mus musculus
ggcttgacacaatcgagccaccaga

SEQ ID NO: 301743 - DNA, 25 bp, Mus musculus
caccagagggcgagagagcccggct

SEQ ID NO: 301744 - DNA, 25 bp, Mus musculus
gctgggcggctagccctggtcatac

SEQ ID NO: 301745 - DNA, 25 bp, Mus musculus
gacccggcagatgctgggacttgct

SEQ ID NO: 301746 - DNA, 25 bp, Mus musculus
ccggcagatgctgggacttgctgcc

SEQ ID NO: 301747 - DNA, 25 bp, Mus musculus
agatgctgggacttgctgcccggtt

SEQ ID NO: 301748 - DNA, 25 bp, Mus musculus
ctgggacttgctgcccggttccagc

SEQ ID NO: 301749 - DNA, 25 bp, Mus musculus
ttgctgcccggttccagccgctgag

SEQ ID NO: 301750 - DNA, 25 bp, Mus musculus
tgcccggttccagccgctgagcggt

SEQ ID NO: 301751 - DNA, 25 bp, Mus musculus
ttccagccgctgagcggtggtcggg

SEQ ID NO: 301752 - DNA, 25 bp, Mus musculus
cccaactgctgagagtcgccgcagg

SEQ ID NO: 301753 - DNA, 25 bp, Mus musculus
aactgctgagagtcgccgcaggaga

SEQ ID NO: 301754 - DNA, 25 bp, Mus musculus
tgacacaatcgagccaccagagggc

SEQ ID NO: 301755 - DNA, 25 bp, Mus musculus
ttgacacaatcgagccaccagaggg

SEQ ID NO: 301756 - DNA, 25 bp, Mus musculus
agaactgggcatgtttcctctttgc

SEQ ID NO: 301757 - DNA, 25 bp, Mus musculus
tgcaggtgagctctgcttgctggtt

SEQ ID NO: 301758 - DNA, 25 bp, Mus musculus
aaagaaggtctagccagggcgtgcc

SEQ ID NO: 301759 - DNA, 25 bp, Mus musculus
gcgtgccgaggaagcttctggaacc

SEQ ID NO: 301760 - DNA, 25 bp, Mus musculus
gggcgcacgttccacaagcaagctc

SEQ ID NO: 301761 - DNA, 25 bp, Mus musculus
ggctcacgtctggtcctgcgctctt

SEQ ID NO: 301762 - DNA, 25 bp, Mus musculus
tgctggtttccaccggcggtctaga

SEQ ID NO: 301763 - DNA, 25 bp, Mus musculus
ctttgcttgctccatccctgcggga

SEQ ID NO: 301764 - DNA, 25 bp, Mus musculus
ggggctccctgctttgagattggca

SEQ ID NO: 301765 - DNA, 25 bp, Mus musculus
ttgagattggcagggacctcctttc

SEQ ID NO: 301766 - DNA, 25 bp, Mus musculus
cgggaagcagcttgccatcctgcct

SEQ ID NO: 301767 - DNA, 25 bp, Mus musculus
tctgtctacacgcagcgctcgggac

SEQ ID NO: 301768 - DNA, 25 bp, Mus musculus
agaagtcctcgccacaggccttcgg

SEQ ID NO: 301769 - DNA, 25 bp, Mus musculus
gtctcagcgtctcgcgagaagtcct

SEQ ID NO: 301770 - DNA, 25 bp, Mus musculus
tgactgtcgggctacacaggcgccc

SEQ ID NO: 301771 - DNA, 25 bp, Mus musculus
tcagtaacggctactctggggtgac

SEQ ID NO: 301772 - DNA, 25 bp, Mus musculus
cgccaccggagaccttcagtaacgg

SEQ ID NO: 301773 - DNA, 25 bp, Mus musculus
gtctcgaagcccacctggccgttga

SEQ ID NO: 301774 - DNA, 25 bp, Mus musculus
tgaggagtcccggacgcctcacact

SEQ ID NO: 301775 - DNA, 25 bp, Mus musculus
tccttgcccgccaagttatagaggc

SEQ ID NO: 301776 - DNA, 25 bp, Mus musculus
ggctcgccgtactgcgcgaagtaca

SEQ ID NO: 301777 - DNA, 25 bp, Mus musculus
gcctcacactcgagaagctacggtg

SEQ ID NO: 301778 - DNA, 25 bp, Mus musculus
agtacacgttcttcacgttgaggaa

SEQ ID NO: 301779 - DNA, 25 bp, Mus musculus
acaggcggcccagcttcaggggcac

SEQ ID NO: 301780 - DNA, 25 bp, Mus musculus
ccgttgaggaaacggcggcaccagc

SEQ ID NO: 301781 - DNA, 25 bp, Mus musculus
cacgccgggcacttattgagctgca

SEQ ID NO: 301782 - DNA, 25 bp, Mus musculus
atcagcaccaacaggctgccgagcg

SEQ ID NO: 301783 - DNA, 25 bp, Mus musculus
gccgccagcttcagtgcacgggaca

SEQ ID NO: 301784 - DNA, 25 bp, Mus musculus
gcagcggctctttatgccacttgta

SEQ ID NO: 301785 - DNA, 25 bp, Mus musculus
tgagcccagtctccggtccagatgc

SEQ ID NO: 301786 - DNA, 25 bp, Mus musculus
tcttggcctccacgtagcgaacctt

SEQ ID NO: 301787 - DNA, 25 bp, Mus musculus
cttgtagtccaagaggttgagcatc

SEQ ID NO: 301788 - DNA, 25 bp, Mus musculus
cgaaataccttcatcccgagcgggg

SEQ ID NO: 301789 - DNA, 25 bp, Mus musculus
ttgagcatcgtgagcaccagtagca

SEQ ID NO: 301790 - DNA, 25 bp, Mus musculus
tgagtaacgcccaccctctagtctg

SEQ ID NO: 301791 - DNA, 25 bp, Mus musculus
gtccggctagcactctcctcggttt

SEQ ID NO: 301792 - DNA, 25 bp, Mus musculus
gtttctctccggttctcttctgcta

SEQ ID NO: 301793 - DNA, 25 bp, Mus musculus
ctagccctaggcagagttttccagc

SEQ ID NO: 301794 - DNA, 25 bp, Mus musculus
cgacgtctccttaggtctctcggga

SEQ ID NO: 301795 - DNA, 25 bp, Mus musculus
agcaccagcgccttcctgcgaaata

SEQ ID NO: 301796 - DNA, 25 bp, Mus musculus
ccagtagcagtgcatagcccgcgca

SEQ ID NO: 301797 - DNA, 25 bp, Mus musculus
gagctgcggctcatcacaggcacag

SEQ ID NO: 301798 - DNA, 25 bp, Mus musculus
gccttctgagatccgcctggcgttt

SEQ ID NO: 301799 - DNA, 25 bp, Mus musculus
tgaggcagttcgtcgagacactttg

SEQ ID NO: 301800 - DNA, 25 bp, Mus musculus
cagcctaatttcctggacggcaagg

SEQ ID NO: 301801 - DNA, 25 bp, Mus musculus
caggcatctaagaccgggaaccttc

SEQ ID NO: 301802 - DNA, 25 bp, Mus musculus
ggaaccactgctctgacccacaaag

SEQ ID NO: 301803 - DNA, 25 bp, Mus musculus
tgacccgactttcaaggccaactga

SEQ ID NO: 301804 - DNA, 25 bp, Mus musculus
ccgagcgtctcacctcagctgatga

SEQ ID NO: 301805 - DNA, 25 bp, Mus musculus
ccctgactgacggagatctctaaga

SEQ ID NO: 301806 - DNA, 25 bp, Mus musculus
tcccagagccaaccggcgttagatg

SEQ ID NO: 301807 - DNA, 25 bp, Mus musculus
ctacctttgaactggccttctgaga

SEQ ID NO: 301808 - DNA, 25 bp, Mus musculus
cctgcggaatttagggactctcctt

SEQ ID NO: 301809 - DNA, 25 bp, Mus musculus
gacttccgcgtcgaggcgcttttac

SEQ ID NO: 301810 - DNA, 25 bp, Mus musculus
gccagaaaggctgccaggccgaata

SEQ ID NO: 301811 - DNA, 25 bp, Mus musculus
tgtcggccatcttgagctttgctcc

SEQ ID NO: 301812 - DNA, 25 bp, Mus musculus
ggagcagcccgcttccaagccgagg

SEQ ID NO: 301813 - DNA, 25 bp, Mus musculus
cgtggcctactactactacctgctg

SEQ ID NO: 301814 - DNA, 25 bp, Mus musculus
gccttcttctacctggactacgctt

SEQ ID NO: 301815 - DNA, 25 bp, Mus musculus
ccagggtcatgacgccgtatgtgca

SEQ ID NO: 301816 - DNA, 25 bp, Mus musculus
atcagctactatggcttcggcagca

SEQ ID NO: 301817 - DNA, 25 bp, Mus musculus
gactacgcttccatcagctactatg

SEQ ID NO: 301818 - DNA, 25 bp, Mus musculus
cccgatgacttcgtggagtgcttca

SEQ ID NO: 301819 - DNA, 25 bp, Mus musculus
gcacggcgcacgtgttcagctgcct

SEQ ID NO: 301820 - DNA, 25 bp, Mus musculus
tgctgctgaccttcgccatgagctg

SEQ ID NO: 301821 - DNA, 25 bp, Mus musculus
tcagtaagttctgccgcctcttctt

SEQ ID NO: 301822 - DNA, 25 bp, Mus musculus
ctgctgctgttcctcagtaagttct

SEQ ID NO: 301823 - DNA, 25 bp, Mus musculus
gctcaacttctggacgcacttcatc

SEQ ID NO: 301824 - DNA, 25 bp, Mus musculus
agcccaccaatgagacgctcaactt

SEQ ID NO: 301825 - DNA, 25 bp, Mus musculus
tgcaccgcgcaagagtgcctggcct

SEQ ID NO: 301826 - DNA, 25 bp, Mus musculus
gcactctgtacctggctgcgggcgc

SEQ ID NO: 301827 - DNA, 25 bp, Mus musculus
atgcttgaatatgcgccctcctccg

SEQ ID NO: 301828 - DNA, 25 bp, Mus musculus
aattaggcgtggagtccgcccggat

SEQ ID NO: 301829 - DNA, 25 bp, Mus musculus
gagtccgcccggatcgccttcaaaa

SEQ ID NO: 301830 - DNA, 25 bp, Mus musculus
gcggcgcactctgtacctggctgcg

SEQ ID NO: 301831 - DNA, 25 bp, Mus musculus
cgcgagcgcctgcatcccgctctgc

SEQ ID NO: 301832 - DNA, 25 bp, Mus musculus
atggcccggccgcagacgccagaga

SEQ ID NO: 301833 - DNA, 25 bp, Mus musculus
agcgcttgaatatgcttgaatatgc

SEQ ID NO: 301834 - DNA, 25 bp, Mus musculus
ccgcgcccgggaacccgcacagcgc

SEQ ID NO: 301835 - DNA, 25 bp, Mus musculus
ttgcctcccagcggtttgggcgccg

SEQ ID NO: 301836 - DNA, 25 bp, Mus musculus
gcgccggcgctttagcgcttgaata

SEQ ID NO: 301837 - DNA, 25 bp, Mus musculus
gcgctttagcgcttgaatatgcttg

SEQ ID NO: 301838 - DNA, 25 bp, Mus musculus
gcagacgccagagaggtaacgtccc

SEQ ID NO: 301839 - DNA, 25 bp, Mus musculus
atcgccttcaaaaaccgccctcctg

SEQ ID NO: 301840 - DNA, 25 bp, Mus musculus
ccgagctggaaaacgggtgagtcgt

SEQ ID NO: 301841 - DNA, 25 bp, Mus musculus
ctcggcggtgcgcttcgcagcacgt

SEQ ID NO: 301842 - DNA, 25 bp, Mus musculus
gaaaccagcactcgccctccacgga

SEQ ID NO: 301843 - DNA, 25 bp, Mus musculus
tgagtcgttcccacggccacatcgg

SEQ ID NO: 301844 - DNA, 25 bp, Mus musculus
tcgcagcacgtctggctccggggct

SEQ ID NO: 301845 - DNA, 25 bp, Mus musculus
cccgagaggtccgtgctcgggtaca

SEQ ID NO: 301846 - DNA, 25 bp, Mus musculus
gaggcagaggttcgcggctttctcc

SEQ ID NO: 301847 - DNA, 25 bp, Mus musculus
ggctttctcctcacgtcatcctcag

SEQ ID NO: 301848 - DNA, 25 bp, Mus musculus
ctctctggtcggtcgcctagcatct

SEQ ID NO: 301849 - DNA, 25 bp, Mus musculus
tcggtcgcctagcatcttgggcgcg

SEQ ID NO: 301850 - DNA, 25 bp, Mus musculus
tgtgggaaccgctggcccagcagca

SEQ ID NO: 301851 - DNA, 25 bp, Mus musculus
atcatcgcggcccacgacgggggca

SEQ ID NO: 301852 - DNA, 25 bp, Mus musculus
tgctcgggtacagggccgccatcat

SEQ ID NO: 301853 - DNA, 25 bp, Mus musculus
gtgcgcttcgcagcacgtctggctc

SEQ ID NO: 301854 - DNA, 25 bp, Mus musculus
ccctcctgacccacgcccgcttgtg

SEQ ID NO: 301855 - DNA, 25 bp, Mus musculus
gcgcccgcaggtgtcggaggaaccc

SEQ ID NO: 301856 - DNA, 25 bp, Mus musculus
gccgagcgccgctaagccaagcttg

SEQ ID NO: 301857 - DNA, 25 bp, Mus musculus
aagcttgcctttcctgcccggcctc

SEQ ID NO: 301858 - DNA, 25 bp, Mus musculus
gaacccggagccctcgccgagcgcc

SEQ ID NO: 301859 - DNA, 25 bp, Mus musculus
ccacgcccgcttgtgcgttcaggca

SEQ ID NO: 301860 - DNA, 25 bp, Mus musculus
gcttgtgcgttcaggcacccagccc

SEQ ID NO: 301861 - DNA, 25 bp, Mus musculus
ctgcggcggccgttcggcagctcct

SEQ ID NO: 301862 - DNA, 25 bp, Mus musculus
gcccgctggtctggtccgctccgct

SEQ ID NO: 301863 - DNA, 25 bp, Mus musculus
ctccttgctcctgcgctcgcgccac

SEQ ID NO: 301864 - DNA, 25 bp, Mus musculus
cactgcgcatgctcgtcccgcaccc

SEQ ID NO: 301865 - DNA, 25 bp, Mus musculus
ccacccgcacgcttgaaatccactc

SEQ ID NO: 301866 - DNA, 25 bp, Mus musculus
gctaagccaagcttgcctttcctgc

SEQ ID NO: 301867 - DNA, 25 bp, Mus musculus
gcgccgctaagccaagcttgccttt

SEQ ID NO: 301868 - DNA, 25 bp, Mus musculus
gacgaccgggaccttgacacacaga

SEQ ID NO: 301869 - DNA, 25 bp, Mus musculus
tgagctccggatcccagtgcaccgg

SEQ ID NO: 301870 - DNA, 25 bp, Mus musculus
cctgttttgcgcaagtgtgagctcc

SEQ ID NO: 301871 - DNA, 25 bp, Mus musculus
ggtctcctagatcctgttttgcgca

SEQ ID NO: 301872 - DNA, 25 bp, Mus musculus
atcctgacccttgaccgctcatttg

SEQ ID NO: 301873 - DNA, 25 bp, Mus musculus
ttccggctgtcaagtggagctgatc

SEQ ID NO: 301874 - DNA, 25 bp, Mus musculus
tcgagtctctccgaggctttgagca

SEQ ID NO: 301875 - DNA, 25 bp, Mus musculus
aggtcatccactctctagcggaagg

SEQ ID NO: 301876 - DNA, 25 bp, Mus musculus
ttgagaacctccgagagcacctcta

SEQ ID NO: 301877 - DNA, 25 bp, Mus musculus
cctccgagatgctgcggttgttcca

SEQ ID NO: 301878 - DNA, 25 bp, Mus musculus
gtacccggcgcacatacgacgtcat

SEQ ID NO: 301879 - DNA, 25 bp, Mus musculus
gcggaatcgccttcgtgacgtaccc

SEQ ID NO: 301880 - DNA, 25 bp, Mus musculus
gagctgatccacagcctcaggcttc

SEQ ID NO: 301881 - DNA, 25 bp, Mus musculus
tactgagctttgatcctgacccttg

SEQ ID NO: 301882 - DNA, 25 bp, Mus musculus
ttggctgaggttttgtttgggaatc

SEQ ID NO: 301883 - DNA, 25 bp, Mus musculus
tttctcctccgagagaggccgagcg

SEQ ID NO: 301884 - DNA, 25 bp, Mus musculus
tcgttgttgacggaatccattggct

SEQ ID NO: 301885 - DNA, 25 bp, Mus musculus
gtcctggtcctttggtcgttgttga

SEQ ID NO: 301886 - DNA, 25 bp, Mus musculus
taccacactcgtttgcttcccgaaa

SEQ ID NO: 301887 - DNA, 25 bp, Mus musculus
agggtctcttctggccatcttacca

SEQ ID NO: 301888 - DNA, 25 bp, Mus musculus
cttggcctcgagaagggtctcttct

SEQ ID NO: 301889 - DNA, 25 bp, Mus musculus
ggagccagtccacgcgagctgcttc

SEQ ID NO: 301890 - DNA, 25 bp, Mus musculus
gttccctccctcacagtggcagttg

SEQ ID NO: 301891 - DNA, 25 bp, Mus musculus
ttttgagagccgctcggtgtcacca

SEQ ID NO: 301892 - DNA, 25 bp, Mus musculus
ccagggttccaaccgcaaccgagag

SEQ ID NO: 301893 - DNA, 25 bp, Mus musculus
acggagtccaacgtgcacagcgtcc

SEQ ID NO: 301894 - DNA, 25 bp, Mus musculus
tcacgcactcgcctgggagggaaag

SEQ ID NO: 301895 - DNA, 25 bp, Mus musculus
ggccagcccgctactctagtcggaa

SEQ ID NO: 301896 - DNA, 25 bp, Mus musculus
acagggcgtccgtcatccattaggt

SEQ ID NO: 301897 - DNA, 25 bp, Mus musculus
agtttggcttgctcggaaccctgag

SEQ ID NO: 301898 - DNA, 25 bp, Mus musculus
cagcaaaccacagggcgtccgtcat

SEQ ID NO: 301899 - DNA, 25 bp, Mus musculus
acaggtgcagcaggtacagtcaaca

SEQ ID NO: 301900 - DNA, 25 bp, Mus musculus
cgtccgtcatccattaggtggcgca

SEQ ID NO: 301901 - DNA, 25 bp, Mus musculus
tcatccattaggtggcgcaggtgag

SEQ ID NO: 301902 - DNA, 25 bp, Mus musculus
aggcgcaggtacaacaggtgcagca

SEQ ID NO: 301903 - DNA, 25 bp, Mus musculus
tacagtcaacaggtgcgtgggctcc

SEQ ID NO: 301904 - DNA, 25 bp, Mus musculus
ccttcccaggatatggagcgccgcg

SEQ ID NO: 301905 - DNA, 25 bp, Mus musculus
gtcaacaggtgcgtgggctccgccc

SEQ ID NO: 301906 - DNA, 25 bp, Mus musculus
aatagccgttggctaggtgactgga

SEQ ID NO: 301907 - DNA, 25 bp, Mus musculus
gtgacgcagtttggcttgctcggaa

SEQ ID NO: 301908 - DNA, 25 bp, Mus musculus
agcgattctcccttcccaggatatg

SEQ ID NO: 301909 - DNA, 25 bp, Mus musculus
tcggaaccctgagccagcgattctc

SEQ ID NO: 301910 - DNA, 25 bp, Mus musculus
cgctgtcaccaacgagtatggaaga

SEQ ID NO: 301911 - DNA, 25 bp, Mus musculus
ttctgcaccgactggaattagtgtc

SEQ ID NO: 301912 - DNA, 25 bp, Mus musculus
tgtcgacggtcaaaatgggagtccc

SEQ ID NO: 301913 - DNA, 25 bp, Mus musculus
ccaagttttaccgatggatctcgga

SEQ ID NO: 301914 - DNA, 25 bp, Mus musculus
accgatggatctcggagcggtaccc

SEQ ID NO: 301915 - DNA, 25 bp, Mus musculus
tcagcgaagtggtgaaggagcatca

SEQ ID NO: 301916 - DNA, 25 bp, Mus musculus
gtgtttggtttcgtttctgcaccga

SEQ ID NO: 301917 - DNA, 25 bp, Mus musculus
tgtgttgtcatcctccgagcgacgg

SEQ ID NO: 301918 - DNA, 25 bp, Mus musculus
ccctgcctcagcgaagtggtgaagg

SEQ ID NO: 301919 - DNA, 25 bp, Mus musculus
tctggcggaccttgtgttgtcatcc

SEQ ID NO: 301920 - DNA, 25 bp, Mus musculus
cggtttgctctatggtctggcggac

SEQ ID NO: 301921 - DNA, 25 bp, Mus musculus
cctctaggcccacggtttgctctat

SEQ ID NO: 301922 - DNA, 25 bp, Mus musculus
aggcagcgggatagacaggacccac

SEQ ID NO: 301923 - DNA, 25 bp, Mus musculus
ctggaattagtgtcgacggtcaaaa

SEQ ID NO: 301924 - DNA, 25 bp, Mus musculus
ggtcgctgaacggtgacatccagta

SEQ ID NO: 301925 - DNA, 25 bp, Mus musculus
gtctatgaccagacggcgcgagtgc

SEQ ID NO: 301926 - DNA, 25 bp, Mus musculus
tgatccgctgccacgtctatgacca

SEQ ID NO: 301927 - DNA, 25 bp, Mus musculus
tctggcgtttatagctccgcgctgg

SEQ ID NO: 301928 - DNA, 25 bp, Mus musculus
caaggcttcccgaaggggctgaacg

SEQ ID NO: 301929 - DNA, 25 bp, Mus musculus
ggtctcgggatctgactgcacccta

SEQ ID NO: 301930 - DNA, 25 bp, Mus musculus
ttgccaaattcccacgagctgctcg

SEQ ID NO: 301931 - DNA, 25 bp, Mus musculus
tgcggtaaacgccatctttgccaaa

SEQ ID NO: 301932 - DNA, 25 bp, Mus musculus
acatccagtacagcgctgcggtaaa

SEQ ID NO: 301933 - DNA, 25 bp, Mus musculus
ggtgtctgtctctcgcttcctgtcc

SEQ ID NO: 301934 - DNA, 25 bp, Mus musculus
cgggactcagcgctctagctttacc

SEQ ID NO: 301935 - DNA, 25 bp, Mus musculus
gcgctctagctttacctgggtggaa

SEQ ID NO: 301936 - DNA, 25 bp, Mus musculus
acctgggtggaaccgaggtgactct

SEQ ID NO: 301937 - DNA, 25 bp, Mus musculus
ggatctgactgcaccctagctcttc

SEQ ID NO: 301938 - DNA, 25 bp, Mus musculus
tcatgccagccgagggccaatcggc

SEQ ID NO: 301939 - DNA, 25 bp, Mus musculus
tacctgatgaggctccggagcccgc

SEQ ID NO: 301940 - DNA, 25 bp, Mus musculus
ccctggaatacctgatgaggctccg

SEQ ID NO: 301941 - DNA, 25 bp, Mus musculus
gcggggccaagcaaccctggaatac

SEQ ID NO: 301942 - DNA, 25 bp, Mus musculus
tcctcaggatttctctgcagcgggg

SEQ ID NO: 301943 - DNA, 25 bp, Mus musculus
agtctcagcttgtcctcaggatttc

SEQ ID NO: 301944 - DNA, 25 bp, Mus musculus
cccgggagtctcagcttgtcctcag

SEQ ID NO: 301945 - DNA, 25 bp, Mus musculus
caagctgcggtaaggtcccggaaag

SEQ ID NO: 301946 - DNA, 25 bp, Mus musculus
ctctgcaccaagctgcggtaaggtc

SEQ ID NO: 301947 - DNA, 25 bp, Mus musculus
gcaggcttccgacgcgcgcgaagac

SEQ ID NO: 301948 - DNA, 25 bp, Mus musculus
cgcgtcatgccagccgagggccaat

SEQ ID NO: 301949 - DNA, 25 bp, Mus musculus
tgtttactccctacacgcactgcgg

SEQ ID NO: 301950 - DNA, 25 bp, Mus musculus
agcttgctccgagcggacctggctc

SEQ ID NO: 301951 - DNA, 25 bp, Mus musculus
cccggccaatccgtggagagcgtcg

SEQ ID NO: 301952 - DNA, 25 bp, Mus musculus
cagtcttcgtcatgatgggcgtgtg

SEQ ID NO: 301953 - DNA, 25 bp, Mus musculus
cagcgccgccgagtcacaagatagc

SEQ ID NO: 301954 - DNA, 25 bp, Mus musculus
gaaactctccgctgctcgggttgta

SEQ ID NO: 301955 - DNA, 25 bp, Mus musculus
ctcgggttgtagatgaacagcttcc

SEQ ID NO: 301956 - DNA, 25 bp, Mus musculus
caggctctggtggaaggatttcttc

SEQ ID NO: 301957 - DNA, 25 bp, Mus musculus
gatagcgggcagtggaaatttcctc

SEQ ID NO: 301958 - DNA, 25 bp, Mus musculus
agcccagcgacaacagcggaggacg

SEQ ID NO: 301959 - DNA, 25 bp, Mus musculus
cggcacggccgggaacaactcttcg

SEQ ID NO: 301960 - DNA, 25 bp, Mus musculus
ttacgagaccactagagccgactgc

SEQ ID NO: 301961 - DNA, 25 bp, Mus musculus
aagtctgccgggcacactgaccggc

SEQ ID NO: 301962 - DNA, 25 bp, Mus musculus
taggaggctacagcgctctccactg

SEQ ID NO: 301963 - DNA, 25 bp, Mus musculus
tctccactggaagcccaggccgtgg

SEQ ID NO: 301964 - DNA, 25 bp, Mus musculus
tagtggaagcccagcctgagactta

SEQ ID NO: 301965 - DNA, 25 bp, Mus musculus
atgaacagcttccactcggccaggc

SEQ ID NO: 301966 - DNA, 25 bp, Mus musculus
tacggtggctcagcggggccacaac

SEQ ID NO: 301967 - DNA, 25 bp, Mus musculus
atcacctggaccctgcagatggcac

SEQ ID NO: 301968 - DNA, 25 bp, Mus musculus
tgcagatggcacaggtatcgcactc

SEQ ID NO: 301969 - DNA, 25 bp, Mus musculus
tggcacaggtatcgcactcaacgtc

SEQ ID NO: 301970 - DNA, 25 bp, Mus musculus
aggtatcgcactcaacgtcccagct

SEQ ID NO: 301971 - DNA, 25 bp, Mus musculus
atggctaccgcgttccacttcttga

SEQ ID NO: 301972 - DNA, 25 bp, Mus musculus
accgcgttccacttcttgagagaga

SEQ ID NO: 301973 - DNA, 25 bp, Mus musculus
tcttgagagagaacatcttgtcgcc

SEQ ID NO: 301974 - DNA, 25 bp, Mus musculus
atcttgtcgcctcccgacttggagc

SEQ ID NO: 301975 - DNA, 25 bp, Mus musculus
agaaaggacgcagggttcctcgccg

SEQ ID NO: 301976 - DNA, 25 bp, Mus musculus
cataggaaccatcccgtgtctggcg

SEQ ID NO: 301977 - DNA, 25 bp, Mus musculus
ggcttcgcctgcatcgcttacccat

SEQ ID NO: 301978 - DNA, 25 bp, Mus musculus
atccgctgggagatttgctggccgc

SEQ ID NO: 301979 - DNA, 25 bp, Mus musculus
ctcccggagtgcgaagaaaggacgc

SEQ ID NO: 301980 - DNA, 25 bp, Mus musculus
acgagcaccctttggtggcggccgc

SEQ ID NO: 301981 - DNA, 25 bp, Mus musculus
atgaattccgggacactgcaccagc

SEQ ID NO: 301982 - DNA, 25 bp, Mus musculus
ctgtgcagcaagagggatgaattcc

SEQ ID NO: 301983 - DNA, 25 bp, Mus musculus
tctaacagatggacaactgtgcagc

SEQ ID NO: 301984 - DNA, 25 bp, Mus musculus
ccgactatcctctaacagatggaca

SEQ ID NO: 301985 - DNA, 25 bp, Mus musculus
ccagaatggaaaaccgactatcctc

SEQ ID NO: 301986 - DNA, 25 bp, Mus musculus
gctctagatcataaaccagcctttg

SEQ ID NO: 301987 - DNA, 25 bp, Mus musculus
gactcctcccgcatgggagttgctc

SEQ ID NO: 301988 - DNA, 25 bp, Mus musculus
tgatgtaacttcagaggaaggggac

SEQ ID NO: 301989 - DNA, 25 bp, Mus musculus
ctgaaactctggatggaactaaaac

SEQ ID NO: 301990 - DNA, 25 bp, Mus musculus
ccttacatttggtgctgaaactctg

SEQ ID NO: 301991 - DNA, 25 bp, Mus musculus
gtggttttactgcaccttacatttg

SEQ ID NO: 301992 - DNA, 25 bp, Mus musculus
gatagtccagttcagtggttttact

SEQ ID NO: 301993 - DNA, 25 bp, Mus musculus
cgcatgggagttgctctagatcata

SEQ ID NO: 301994 - DNA, 25 bp, Mus musculus
agccgcgcctcccttgtaattacca

SEQ ID NO: 301995 - DNA, 25 bp, Mus musculus
cagtcacgccggctctcgattcaag

SEQ ID NO: 301996 - DNA, 25 bp, Mus musculus
tgcagcactcggacctcacgactgt

SEQ ID NO: 301997 - DNA, 25 bp, Mus musculus
ctcccgcgtccaggccgcgctccag

SEQ ID NO: 301998 - DNA, 25 bp, Mus musculus
ggtccgcgcgtgcaggtcctcaccc

SEQ ID NO: 301999 - DNA, 25 bp, Mus musculus
catccagtctcaccagtcccgggcg

SEQ ID NO: 302000 - DNA, 25 bp, Mus musculus
ccgcttacagatcctgccgcgcagg

SEQ ID NO: 302001 - DNA, 25 bp, Mus musculus
gactgtcctcgtctcccgtctccgg

SEQ ID NO: 302002 - DNA, 25 bp, Mus musculus
gcctcaacctcgcactggcagagga

SEQ ID NO: 302003 - DNA, 25 bp, Mus musculus
gtctccgggtctgcgctgcccgaga

SEQ ID NO: 302004 - DNA, 25 bp, Mus musculus
taccgcctgcgtagccgggcaaggc

SEQ ID NO: 302005 - DNA, 25 bp, Mus musculus
gtcacgccggctctcgattcaagtc

SEQ ID NO: 302006 - DNA, 25 bp, Mus musculus
tcaacctcgcactggcagaggagcc

SEQ ID NO: 302007 - DNA, 25 bp, Mus musculus
cgggcacaggtgtcccgcccgagct

SEQ ID NO: 302008 - DNA, 25 bp, Mus musculus
cgcagcgccgcccagaaaatggacg

SEQ ID NO: 302009 - DNA, 25 bp, Mus musculus
gcccagaaaatggacgccggcggct

SEQ ID NO: 302010 - DNA, 25 bp, Mus musculus
gggtccatggcgcttccggacctgc

SEQ ID NO: 302011 - DNA, 25 bp, Mus musculus
cgcactaggatctcatcgcgaacgg

SEQ ID NO: 302012 - DNA, 25 bp, Mus musculus
tgcggcagagccaggctcgcacaga

SEQ ID NO: 302013 - DNA, 25 bp, Mus musculus
ccggtctgcccctggtgcagtgcag

SEQ ID NO: 302014 - DNA, 25 bp, Mus musculus
cagagccaggctcgcacagatgctg

SEQ ID NO: 302015 - DNA, 25 bp, Mus musculus
atggcgcttccggacctgcgagtcc

SEQ ID NO: 302016 - DNA, 25 bp, Mus musculus
acagatgctgcgcagccaccgagca

SEQ ID NO: 302017 - DNA, 25 bp, Mus musculus
cccgcgcacttacggggctccgctc

SEQ ID NO: 302018 - DNA, 25 bp, Mus musculus
gacgctggctgctccgtaggctccg

SEQ ID NO: 302019 - DNA, 25 bp, Mus musculus
agcccgggtttgcgcttcaccggag

SEQ ID NO: 302020 - DNA, 25 bp, Mus musculus
atctcatcgcgaacgggtagggtca

SEQ ID NO: 302021 - DNA, 25 bp, Mus musculus
caggccggacggtcgctcgacctcg

SEQ ID NO: 302022 - DNA, 25 bp, Mus musculus
aaagcgcgcgcactcggagcgcaca

SEQ ID NO: 302023 - DNA, 25 bp, Mus musculus
ctgagtcgttcagcaggagcgccta

SEQ ID NO: 302024 - DNA, 25 bp, Mus musculus
aactggcatatcctagccaccgtgc

SEQ ID NO: 302025 - DNA, 25 bp, Mus musculus
ctcgtggactcaaaactggcatatc

SEQ ID NO: 302026 - DNA, 25 bp, Mus musculus
tgctttgtgactgcgtgcctaactc

SEQ ID NO: 302027 - DNA, 25 bp, Mus musculus
tgctcctccctatgccggacttagg

SEQ ID NO: 302028 - DNA, 25 bp, Mus musculus
acagtcatccagacaggctccggtc

SEQ ID NO: 302029 - DNA, 25 bp, Mus musculus
ggcctggagtgtccaaacagtcatc

SEQ ID NO: 302030 - DNA, 25 bp, Mus musculus
gccttggaggcacacatggcctgga

SEQ ID NO: 302031 - DNA, 25 bp, Mus musculus
ctgtgcgtagggatctccacccgca

SEQ ID NO: 302032 - DNA, 25 bp, Mus musculus
cgagaagcctcacaaccgctgggac

SEQ ID NO: 302033 - DNA, 25 bp, Mus musculus
tgcctccggatcttggcatcgcgga

SEQ ID NO: 302034 - DNA, 25 bp, Mus musculus
gcagggctcacacccgctgcttgga

SEQ ID NO: 302035 - DNA, 25 bp, Mus musculus
tggacccgtcccagccttggctagg

SEQ ID NO: 302036 - DNA, 25 bp, Mus musculus
gggatcctaggcatctcaggtaaga

SEQ ID NO: 302037 - DNA, 25 bp, Mus musculus
tgcctggctagctcgcctgcattaa

SEQ ID NO: 302038 - DNA, 25 bp, Mus musculus
tctcaggtaagaagagcccgccggc

SEQ ID NO: 302039 - DNA, 25 bp, Mus musculus
ctgggcctggggatcctaggcatct

SEQ ID NO: 302040 - DNA, 25 bp, Mus musculus
caatgccggggccttcgccagggct

SEQ ID NO: 302041 - DNA, 25 bp, Mus musculus
ttaaaccaatccctgggcgcaattc

SEQ ID NO: 302042 - DNA, 25 bp, Mus musculus
gcgctcgcctcctgtcagctcgccc

SEQ ID NO: 302043 - DNA, 25 bp, Mus musculus
cattaaggcctggagaagcccagtg

SEQ ID NO: 302044 - DNA, 25 bp, Mus musculus
gggaccgctcttgcctggctagctc

SEQ ID NO: 302045 - DNA, 25 bp, Mus musculus
aggccgacctccatgtagatctttc

SEQ ID NO: 302046 - DNA, 25 bp, Mus musculus
tttagatcattaggccgacctccat

SEQ ID NO: 302047 - DNA, 25 bp, Mus musculus
gtggtcgcccccagaaggctttaga

SEQ ID NO: 302048 - DNA, 25 bp, Mus musculus
tagctcgcctgcattaaggcctgga

SEQ ID NO: 302049 - DNA, 25 bp, Mus musculus
cgcctgcattaaggcctggagaagc

SEQ ID NO: 302050 - DNA, 25 bp, Mus musculus
agcccggtcaggacagagctttagc

SEQ ID NO: 302051 - DNA, 25 bp, Mus musculus
cggcccgacgcaatagagagacgtg

SEQ ID NO: 302052 - DNA, 25 bp, Mus musculus
ctggtgacttgtgctgcggtacacc

SEQ ID NO: 302053 - DNA, 25 bp, Mus musculus
aagatcggcgatctctgcctcgcgg

SEQ ID NO: 302054 - DNA, 25 bp, Mus musculus
ccaggctcctagtttcagctgtcca

SEQ ID NO: 302055 - DNA, 25 bp, Mus musculus
gcgtgagtagcagcctatgagattg

SEQ ID NO: 302056 - DNA, 25 bp, Mus musculus
gagcgggagccaatgagcatcattc

SEQ ID NO: 302057 - DNA, 25 bp, Mus musculus
gaaggtagcttcgttcgggttgcta

SEQ ID NO: 302058 - DNA, 25 bp, Mus musculus
ttgctaacgtctttcctgggagatg

SEQ ID NO: 302059 - DNA, 25 bp, Mus musculus
gcgcgcaaaccgaccagtgggtctg

SEQ ID NO: 302060 - DNA, 25 bp, Mus musculus
agctggcgattcctcggcgaaagcc

SEQ ID NO: 302061 - DNA, 25 bp, Mus musculus
ctgaaggtgagacgagcagttgccc

SEQ ID NO: 302062 - DNA, 25 bp, Mus musculus
cggcgccaccatcttcggctgaagg

SEQ ID NO: 302063 - DNA, 25 bp, Mus musculus
attgagacgctggatctgtggtcgc

SEQ ID NO: 302064 - DNA, 25 bp, Mus musculus
tgtctcagctgtactgccaaccctg

SEQ ID NO: 302065 - DNA, 25 bp, Mus musculus
gagctcccgcttagctggccgaagc

SEQ ID NO: 302066 - DNA, 25 bp, Mus musculus
agtcactgcccaccagtgcggtgta

SEQ ID NO: 302067 - DNA, 25 bp, Mus musculus
tgcggtgtaacccacagagtgcaaa

SEQ ID NO: 302068 - DNA, 25 bp, Mus musculus
gcctagcgggccaatggatctgcca

SEQ ID NO: 302069 - DNA, 25 bp, Mus musculus
atggatctgccatgcgtgcagaccc

SEQ ID NO: 302070 - DNA, 25 bp, Mus musculus
caccttgccacggatgccatctgtg

SEQ ID NO: 302071 - DNA, 25 bp, Mus musculus
atgccatctgtgctctgggctactg

SEQ ID NO: 302072 - DNA, 25 bp, Mus musculus
aggcggtcgtcatccttgacaaaga

SEQ ID NO: 302073 - DNA, 25 bp, Mus musculus
caaagacattgagggagcggtcctc

SEQ ID NO: 302074 - DNA, 25 bp, Mus musculus
tcctcggggttccacgcgtgtctca

SEQ ID NO: 302075 - DNA, 25 bp, Mus musculus
ctgccgcaggcatgtccagcagctg

SEQ ID NO: 302076 - DNA, 25 bp, Mus musculus
tccagcagctggtctagacgtgccg

SEQ ID NO: 302077 - DNA, 25 bp, Mus musculus
tgccggtcgcccaggttctaagccg

SEQ ID NO: 302078 - DNA, 25 bp, Mus musculus
taccataaaagagagggcgagcgcc

SEQ ID NO: 302079 - DNA, 25 bp, Mus musculus
ttcacagagacattcccacggaccg

SEQ ID NO: 302080 - DNA, 25 bp, Mus musculus
caggagctggagaacacttaccata

SEQ ID NO: 302081 - DNA, 25 bp, Mus musculus
cactcatctgcggactggctagcct

SEQ ID NO: 302082 - DNA, 25 bp, Mus musculus
tggcgcggacgccattcactcatct

SEQ ID NO: 302083 - DNA, 25 bp, Mus musculus
aggccactaatccaatagccgcgga

SEQ ID NO: 302084 - DNA, 25 bp, Mus musculus
ctgagctcatccctgaaggccacta

SEQ ID NO: 302085 - DNA, 25 bp, Mus musculus
gctgcagctgaaagccgatccggct

SEQ ID NO: 302086 - DNA, 25 bp, Mus musculus
ctagagcactgagcacacgccgcga

SEQ ID NO: 302087 - DNA, 25 bp, Mus musculus
agcaccgggtttcttccctagagca

SEQ ID NO: 302088 - DNA, 25 bp, Mus musculus
gccctaaagcttggcgcctgacctg

SEQ ID NO: 302089 - DNA, 25 bp, Mus musculus
atctcagcgagatgcggaagccctt

SEQ ID NO: 302090 - DNA, 25 bp, Mus musculus
tcctctcgacttgtatccggcggca

SEQ ID NO: 302091 - DNA, 25 bp, Mus musculus
tcccacggaccggaaccagagagtc

SEQ ID NO: 302092 - DNA, 25 bp, Mus musculus
gctcctattggcttaggccgcgtga

SEQ ID NO: 302093 - DNA, 25 bp, Mus musculus
ggtcggctcgcactctcatccgatg

SEQ ID NO: 302094 - DNA, 25 bp, Mus musculus
gcctctttcacgtgatcgcccaggg

SEQ ID NO: 302095 - DNA, 25 bp, Mus musculus
ggaggccgagcctgctcccattttg

SEQ ID NO: 302096 - DNA, 25 bp, Mus musculus
cattttgtcgccatggccgagcctc

SEQ ID NO: 302097 - DNA, 25 bp, Mus musculus
cgtcacgaggttcgcacgcctcttt

SEQ ID NO: 302098 - DNA, 25 bp, Mus musculus
tccgctgtcgcgcagtaccggacga

SEQ ID NO: 302099 - DNA, 25 bp, Mus musculus
accggacgagctaggccgcgactca

SEQ ID NO: 302100 - DNA, 25 bp, Mus musculus
cggcaaacagatgcaccagcgtgtc

SEQ ID NO: 302101 - DNA, 25 bp, Mus musculus
agcgtgtccctctggctcattctct

SEQ ID NO: 302102 - DNA, 25 bp, Mus musculus
ctcttctgcatgtcctccgggagta

SEQ ID NO: 302103 - DNA, 25 bp, Mus musculus
gggttcctgctccagcgagctccgt

SEQ ID NO: 302104 - DNA, 25 bp, Mus musculus
catccgatgcgctgatcagcaggtc

SEQ ID NO: 302105 - DNA, 25 bp, Mus musculus
cggaggtccctacataaacagaagc

SEQ ID NO: 302106 - DNA, 25 bp, Mus musculus
tcatcctggtcctcagcgctggtgt

SEQ ID NO: 302107 - DNA, 25 bp, Mus musculus
ctgaccgtgtcatggccattgtgga

SEQ ID NO: 302108 - DNA, 25 bp, Mus musculus
ccattgtggaaagcgatcttgcaga

SEQ ID NO: 302109 - DNA, 25 bp, Mus musculus
ttgtcgctgcggcagtactcgttga

SEQ ID NO: 302110 - DNA, 25 bp, Mus musculus
tggatggtggatgcaaatcttctca

SEQ ID NO: 302111 - DNA, 25 bp, Mus musculus
cacgaagacgtggtcctgcatggcc

SEQ ID NO: 302112 - DNA, 25 bp, Mus musculus
aaggccttgagacagtcgttgcaca

SEQ ID NO: 302113 - DNA, 25 bp, Mus musculus
acaggttgagacgacaggtgacaca

SEQ ID NO: 302114 - DNA, 25 bp, Mus musculus
ggtgacacagcgcttgtaggcaatg

SEQ ID NO: 302115 - DNA, 25 bp, Mus musculus
tcgaagcgccacttgaggtagccgt

SEQ ID NO: 302116 - DNA, 25 bp, Mus musculus
ccgtgctgctgcatgtagcgtttag

SEQ ID NO: 302117 - DNA, 25 bp, Mus musculus
tgtagcgtttagtaaggcgcccgcg

SEQ ID NO: 302118 - DNA, 25 bp, Mus musculus
caggcgtctatgaggctgaccgtgt

SEQ ID NO: 302119 - DNA, 25 bp, Mus musculus
gccacgtctgagtggaaggccttga

SEQ ID NO: 302120 - DNA, 25 bp, Mus musculus
cccagatttaggtgatgaggatcgc

SEQ ID NO: 302121 - DNA, 25 bp, Mus musculus
ccctataagtctggcagtcgccaga

SEQ ID NO: 302122 - DNA, 25 bp, Mus musculus
attcttcgggacaatgggcttctgc

SEQ ID NO: 302123 - DNA, 25 bp, Mus musculus
aatgggcttctgctaggttccagcc

SEQ ID NO: 302124 - DNA, 25 bp, Mus musculus
ctgctttgttcccttcttccctata

SEQ ID NO: 302125 - DNA, 25 bp, Mus musculus
taacagaacctatactgctttgttc

SEQ ID NO: 302126 - DNA, 25 bp, Mus musculus
atcgctgggcgtgttttgcgcttct

SEQ ID NO: 302127 - DNA, 25 bp, Mus musculus
tggaacacatctcccagatttaggt

SEQ ID NO: 302128 - DNA, 25 bp, Mus musculus
gctgtgagcagagggccaacaatca

SEQ ID NO: 302129 - DNA, 25 bp, Mus musculus
gagggccaacaatcaagcttttaaa

SEQ ID NO: 302130 - DNA, 25 bp, Mus musculus
tataggttccctttgcagcatgtca

SEQ ID NO: 302131 - DNA, 25 bp, Mus musculus
ccctttgcagcatgtcacagacatt

SEQ ID NO: 302132 - DNA, 25 bp, Mus musculus
gtcacagacattcttcgggacaatg

SEQ ID NO: 302133 - DNA, 25 bp, Mus musculus
cgtgttttgcgcttctggattaaga

SEQ ID NO: 302134 - DNA, 25 bp, Mus musculus
ttctgtaaagatgcaggcgacccta

SEQ ID NO: 302135 - DNA, 25 bp, Mus musculus
accctactgtgatgcgccctttgaa

SEQ ID NO: 302136 - DNA, 25 bp, Mus musculus
cgcgcagaagccgaagctgccacaa

SEQ ID NO: 302137 - DNA, 25 bp, Mus musculus
tgatcgcccgaggaccttctgtaaa

SEQ ID NO: 302138 - DNA, 25 bp, Mus musculus
tgcgagcgccacaaccaagtgatcg

SEQ ID NO: 302139 - DNA, 25 bp, Mus musculus
ctcgcgtgatccgactcggtcaggc

SEQ ID NO: 302140 - DNA, 25 bp, Mus musculus
atattcatgagacgcggacatcggc

SEQ ID NO: 302141 - DNA, 25 bp, Mus musculus
aggtggctcgtgcatattcatgaga

SEQ ID NO: 302142 - DNA, 25 bp, Mus musculus
caacagcagcactcactggcgcgga

SEQ ID NO: 302143 - DNA, 25 bp, Mus musculus
agcaggagcggcaccaagcacagcc

SEQ ID NO: 302144 - DNA, 25 bp, Mus musculus
gacgagtaagtccagggtctgcacc

SEQ ID NO: 302145 - DNA, 25 bp, Mus musculus
ctgccacaagaaagggcgggtgtta

SEQ ID NO: 302146 - DNA, 25 bp, Mus musculus
cgcacacttcgaggacggtgcgcgc

SEQ ID NO: 302147 - DNA, 25 bp, Mus musculus
tgatgcgccctttgaaccgacatcc

SEQ ID NO: 302148 - DNA, 25 bp, Mus musculus
caggtaagcacagccagcgaccttg

SEQ ID NO: 302149 - DNA, 25 bp, Mus musculus
tcacttttctgaccgattggctcga

SEQ ID NO: 302150 - DNA, 25 bp, Mus musculus
cgcgcgcacgacagagtcagatggc

SEQ ID NO: 302151 - DNA, 25 bp, Mus musculus
gggtgtccacgaagccttgagtccc

SEQ ID NO: 302152 - DNA, 25 bp, Mus musculus
tccctgttgactctgagcggagccc

SEQ ID NO: 302153 - DNA, 25 bp, Mus musculus
agcagatccgcggtccctgttgact

SEQ ID NO: 302154 - DNA, 25 bp, Mus musculus
acccatcctggtcgagcagcagatc

SEQ ID NO: 302155 - DNA, 25 bp, Mus musculus
actagttagtcttagggcgatctgc

SEQ ID NO: 302156 - DNA, 25 bp, Mus musculus
cccagcctgggtcaagactagttag

SEQ ID NO: 302157 - DNA, 25 bp, Mus musculus
aggtcaagttcactcgcggctccgc

SEQ ID NO: 302158 - DNA, 25 bp, Mus musculus
tgggagcgcaaggtcaagttcactc

SEQ ID NO: 302159 - DNA, 25 bp, Mus musculus
agctccgctctgtctcccgggagtt

SEQ ID NO: 302160 - DNA, 25 bp, Mus musculus
tgtggagcgcagaaccacgctagcc

SEQ ID NO: 302161 - DNA, 25 bp, Mus musculus
taccaggcccacgtgactctcgggg

SEQ ID NO: 302162 - DNA, 25 bp, Mus musculus
ttggcagcaaccgtccgggccgaac

SEQ ID NO: 302163 - DNA, 25 bp, Mus musculus
tcacccggagtgcattggcagcaac

SEQ ID NO: 302164 - DNA, 25 bp, Mus musculus
gggccgaacccacagccgctcccgc

SEQ ID NO: 302165 - DNA, 25 bp, Mus musculus
gctcccgccttcttggtgtcaggcg

SEQ ID NO: 302166 - DNA, 25 bp, Mus musculus
cgccttcttggtgtcaggcgatccc

SEQ ID NO: 302167 - DNA, 25 bp, Mus musculus
ccagtctgtcccaaaaatgcctgtg

SEQ ID NO: 302168 - DNA, 25 bp, Mus musculus
tgtcccaaaaatgcctgtggacttc

SEQ ID NO: 302169 - DNA, 25 bp, Mus musculus
aacgggtactggaagatgctgagca

SEQ ID NO: 302170 - DNA, 25 bp, Mus musculus
agatgctgagcaatgagaatttcga

SEQ ID NO: 302171 - DNA, 25 bp, Mus musculus
aatgagaatttcgaggagtacctgc

SEQ ID NO: 302172 - DNA, 25 bp, Mus musculus
aatttcgaggagtacctgcgcgcgc

SEQ ID NO: 302173 - DNA, 25 bp, Mus musculus
tacctgcgcgcgctcggtaagcgcg

SEQ ID NO: 302174 - DNA, 25 bp, Mus musculus
ctgtggacttcaacgggtactggaa

SEQ ID NO: 302175 - DNA, 25 bp, Mus musculus
ggccgtccatcacccggagtgcatt

SEQ ID NO: 302176 - DNA, 25 bp, Mus musculus
tagaagcggtctgcgctgctactgc

SEQ ID NO: 302177 - DNA, 25 bp, Mus musculus
gtcggtttcacccaagacccagaca

SEQ ID NO: 302178 - DNA, 25 bp, Mus musculus
cagaggctcacgctgttcggatagc

SEQ ID NO: 302179 - DNA, 25 bp, Mus musculus
tgctgccgacgttcagcaggaatcc

SEQ ID NO: 302180 - DNA, 25 bp, Mus musculus
gagcccgctggagtacacagtttta

SEQ ID NO: 302181 - DNA, 25 bp, Mus musculus
tttctgaaactgaccgaaggtgagc

SEQ ID NO: 302182 - DNA, 25 bp, Mus musculus
gaccatgcacggaccgccttacgga

SEQ ID NO: 302183 - DNA, 25 bp, Mus musculus
tccgagtaccgcgagagtcgcttcc

SEQ ID NO: 302184 - DNA, 25 bp, Mus musculus
gcttcccggaagttccacgtcagtg

SEQ ID NO: 302185 - DNA, 25 bp, Mus musculus
tgtaactgggtacccgcgaaggagc

SEQ ID NO: 302186 - DNA, 25 bp, Mus musculus
gcttcttggctaggagcagtagcta

SEQ ID NO: 302187 - DNA, 25 bp, Mus musculus
ctgccgtggtgacacagtagtgtaa

SEQ ID NO: 302188 - DNA, 25 bp, Mus musculus
cctgtcagtgcccttgcagtctgca

SEQ ID NO: 302189 - DNA, 25 bp, Mus musculus
cggacagtcggagccatggtaagtc

SEQ ID NO: 302190 - DNA, 25 bp, Mus musculus
tcgccgagagcccaattggaacctc

SEQ ID NO: 302191 - DNA, 25 bp, Mus musculus
ctcgagaggtttttgtgcagcattc

SEQ ID NO: 302192 - DNA, 25 bp, Mus musculus
gcgccggaatcgatagagcaacttc

SEQ ID NO: 302193 - DNA, 25 bp, Mus musculus
accagacgctctttgcgccggaatc

SEQ ID NO: 302194 - DNA, 25 bp, Mus musculus
ctgcagccatgattaccagacgctc

SEQ ID NO: 302195 - DNA, 25 bp, Mus musculus
tggaacctccacagcgacaacggtg

SEQ ID NO: 302196 - DNA, 25 bp, Mus musculus
actcacctgcctcggagctgagcag

SEQ ID NO: 302197 - DNA, 25 bp, Mus musculus
agagttctggcggtcactcacctgc

SEQ ID NO: 302198 - DNA, 25 bp, Mus musculus
tttcccgggcgctcagcagagttct

SEQ ID NO: 302199 - DNA, 25 bp, Mus musculus
agagcaagctctaagtttcccgggc

SEQ ID NO: 302200 - DNA, 25 bp, Mus musculus
caagccgccttcactcgttagagca

SEQ ID NO: 302201 - DNA, 25 bp, Mus musculus
ggaagccgcacgcagtctgacaagc

SEQ ID NO: 302202 - DNA, 25 bp, Mus musculus
gacaacggtgttctgactgcagcca

SEQ ID NO: 302203 - DNA, 25 bp, Mus musculus
tgtggcccgagtacagacccgccgt

SEQ ID NO: 302204 - DNA, 25 bp, Mus musculus
gagatctgcgacagcgtcctgcgca

SEQ ID NO: 302205 - DNA, 25 bp, Mus musculus
tggggcgctgggaaatcaagatcct

SEQ ID NO: 302206 - DNA, 25 bp, Mus musculus
gaacagttgtctcggtacgggccgc

SEQ ID NO: 302207 - DNA, 25 bp, Mus musculus
aaatcaagatcctgcccggctccta

SEQ ID NO: 302208 - DNA, 25 bp, Mus musculus
tgggccacacctccgccagtaagga

SEQ ID NO: 302209 - DNA, 25 bp, Mus musculus
tccgccagtaaggaggggacagtta

SEQ ID NO: 302210 - DNA, 25 bp, Mus musculus
ttaaagcggttggaacagttgtctc

SEQ ID NO: 302211 - DNA, 25 bp, Mus musculus
ggagctcaccgccaatgtgtcaaaa

SEQ ID NO: 302212 - DNA, 25 bp, Mus musculus
tgtcaaaagcgcatgttcgccgccg

SEQ ID NO: 302213 - DNA, 25 bp, Mus musculus
tgtcggaggccattctgtgacgcac

SEQ ID NO: 302214 - DNA, 25 bp, Mus musculus
cggagtcaagagcatgcgcagaagc

SEQ ID NO: 302215 - DNA, 25 bp, Mus musculus
ccagagtcacgtggagccgacctag

SEQ ID NO: 302216 - DNA, 25 bp, Mus musculus
gcgcgctgacgtgagatctgcgaca

SEQ ID NO: 302217 - DNA, 25 bp, Mus musculus
agccgacctaggctttgcgcgctga

SEQ ID NO: 302218 - DNA, 25 bp, Mus musculus
tccaagcgcgtggactcatccgaac

SEQ ID NO: 302219 - DNA, 25 bp, Mus musculus
tagaacctttctgggcggaccttca

SEQ ID NO: 302220 - DNA, 25 bp, Mus musculus
ctggagacctcgctacgccgaaacg

SEQ ID NO: 302221 - DNA, 25 bp, Mus musculus
ggacatccgagagcctgagacccag

SEQ ID NO: 302222 - DNA, 25 bp, Mus musculus
ccgaactttccgtgagtacagtgtg

SEQ ID NO: 302223 - DNA, 25 bp, Mus musculus
tctctggtcctccttcctaggcttg

SEQ ID NO: 302224 - DNA, 25 bp, Mus musculus
acagctcgctaaagcccaggttttg

SEQ ID NO: 302225 - DNA, 25 bp, Mus musculus
tggtcccttgcagagcgaccggatc

SEQ ID NO: 302226 - DNA, 25 bp, Mus musculus
ccagtgggcgagaacttcaccttga

SEQ ID NO: 302227 - DNA, 25 bp, Mus musculus
agcctcacattgaccctgctgcggg

SEQ ID NO: 302228 - DNA, 25 bp, Mus musculus
ccaggagctgattcgccgcagtttc

SEQ ID NO: 302229 - DNA, 25 bp, Mus musculus
gggtcaatttctcatgcctcgccga

SEQ ID NO: 302230 - DNA, 25 bp, Mus musculus
tggctcaactgcagcactaactgtc

SEQ ID NO: 302231 - DNA, 25 bp, Mus musculus
ctaggcttgtcctgagagcactaca

SEQ ID NO: 302232 - DNA, 25 bp, Mus musculus
ccgcgcatctcctgaaatataaatg

SEQ ID NO: 302233 - DNA, 25 bp, Mus musculus
gcgcatctcctgaaatataaatgta

SEQ ID NO: 302234 - DNA, 25 bp, Mus musculus
ctcctgaaatataaatgtatccggc

SEQ ID NO: 302235 - DNA, 25 bp, Mus musculus
ctgaaatataaatgtatccggcgtg

SEQ ID NO: 302236 - DNA, 25 bp, Mus musculus
gaaatataaatgtatccggcgtgag

SEQ ID NO: 302237 - DNA, 25 bp, Mus musculus
aaagcccagagctgtagagcacgag

SEQ ID NO: 302238 - DNA, 25 bp, Mus musculus
gcacgagactgaagccgctccatca

SEQ ID NO: 302239 - DNA, 25 bp, Mus musculus
tgaagccgctccatcagcgcctgaa

SEQ ID NO: 302240 - DNA, 25 bp, Mus musculus
gaagccgctccatcagcgcctgaag

SEQ ID NO: 302241 - DNA, 25 bp, Mus musculus
atcagcgcctgaagccgctccgccc

SEQ ID NO: 302242 - DNA, 25 bp, Mus musculus
ccgccgagcccgctagcagcgcgct

SEQ ID NO: 302243 - DNA, 25 bp, Mus musculus
gcagcgcgctcacctccgtggtgtt

SEQ ID NO: 302244 - DNA, 25 bp, Mus musculus
gatttcccgcgcatctcctgaaata

SEQ ID NO: 302245 - DNA, 25 bp, Mus musculus
tcccgcgcatctcctgaaatataaa

SEQ ID NO: 302246 - DNA, 25 bp, Mus musculus
cagagcatgagacagcagcagctcc

SEQ ID NO: 302247 - DNA, 25 bp, Mus musculus
cggcgtgaggaaagcgcaggactgc

SEQ ID NO: 302248 - DNA, 25 bp, Mus musculus
cgcaggactgcagagcatgagacag

SEQ ID NO: 302249 - DNA, 25 bp, Mus musculus
gcgcaggactgcagagcatgagaca

SEQ ID NO: 302250 - DNA, 25 bp, Mus musculus
caggactgcagagcatgagacagca

SEQ ID NO: 302251 - DNA, 25 bp, Mus musculus
catcgcacctgcccggcacccgcgc

SEQ ID NO: 302252 - DNA, 25 bp, Mus musculus
ccgcgcttcttcatcccgcagagcc

SEQ ID NO: 302253 - DNA, 25 bp, Mus musculus
gcgcttcttcatcccgcagagccgt

SEQ ID NO: 302254 - DNA, 25 bp, Mus musculus
cttcatcccgcagagccgtccatca

SEQ ID NO: 302255 - DNA, 25 bp, Mus musculus
ggactgcagagcatgagacagcagc

SEQ ID NO: 302256 - DNA, 25 bp, Mus musculus
actgcagagcatgagacagcagcag

SEQ ID NO: 302257 - DNA, 25 bp, Mus musculus
gaaagcgcaggactgcagagcatga

SEQ ID NO: 302258 - DNA, 25 bp, Mus musculus
agcatgagacagcagcagctccgcc

SEQ ID NO: 302259 - DNA, 25 bp, Mus musculus
aagcgcaggactgcagagcatgaga

SEQ ID NO: 302260 - DNA, 25 bp, Mus musculus
tccactaggccaagcgcagagctgc

SEQ ID NO: 302261 - DNA, 25 bp, Mus musculus
gtgcagcctaacctgaccttttccg

SEQ ID NO: 302262 - DNA, 25 bp, Mus musculus
caggactcccgcttccagaggtgca

SEQ ID NO: 302263 - DNA, 25 bp, Mus musculus
cacccattttggacagcctggattc

SEQ ID NO: 302264 - DNA, 25 bp, Mus musculus
tcccgcttccagaggtgcagcctaa

SEQ ID NO: 302265 - DNA, 25 bp, Mus musculus
ctgaccttttccgtctgaacttggg

SEQ ID NO: 302266 - DNA, 25 bp, Mus musculus
acttgggttccggttcatcttctga

SEQ ID NO: 302267 - DNA, 25 bp, Mus musculus
tcttctgaaaattgattggcatcta

SEQ ID NO: 302268 - DNA, 25 bp, Mus musculus
ggcatctagtaagtgacccaccttg

SEQ ID NO: 302269 - DNA, 25 bp, Mus musculus
ttgcgtacgcaatatccactaggcc

SEQ ID NO: 302270 - DNA, 25 bp, Mus musculus
ttggccagcctgacactcctggggc

SEQ ID NO: 302271 - DNA, 25 bp, Mus musculus
cggcgtcgacctgctgctggagcca

SEQ ID NO: 302272 - DNA, 25 bp, Mus musculus
gggctccaagactccacccattttg

SEQ ID NO: 302273 - DNA, 25 bp, Mus musculus
agtgacccaccttgcgtacgcaata

SEQ ID NO: 302274 - DNA, 25 bp, Mus musculus
aacgtccgatgccagtgagcggtac

SEQ ID NO: 302275 - DNA, 25 bp, Mus musculus
cttccgtgacacgagctctgagctg

SEQ ID NO: 302276 - DNA, 25 bp, Mus musculus
cggtactcctgggtgtctcttccca

SEQ ID NO: 302277 - DNA, 25 bp, Mus musculus
tgagcggtactcctgggtgtctctt

SEQ ID NO: 302278 - DNA, 25 bp, Mus musculus
agggacagagcaggccgaagcttct

SEQ ID NO: 302279 - DNA, 25 bp, Mus musculus
ttacctccagctgccgcaaagttcg

SEQ ID NO: 302280 - DNA, 25 bp, Mus musculus
tgggtgtctcttcccagcgatcctc

SEQ ID NO: 302281 - DNA, 25 bp, Mus musculus
cgagctctgagctggtttacctcca

SEQ ID NO: 302282 - DNA, 25 bp, Mus musculus
gaagcttctgccttccgtgacacga

SEQ ID NO: 302283 - DNA, 25 bp, Mus musculus
aggccgaagcttctgccttccgtga

SEQ ID NO: 302284 - DNA, 25 bp, Mus musculus
ccagcctcaattgggctcagagagc

SEQ ID NO: 302285 - DNA, 25 bp, Mus musculus
cctcaattgggctcagagagctcga

SEQ ID NO: 302286 - DNA, 25 bp, Mus musculus
ctcagagagctcgagggacagagca

SEQ ID NO: 302287 - DNA, 25 bp, Mus musculus
tggtttacctccagctgccgcaaag

SEQ ID NO: 302288 - DNA, 25 bp, Mus musculus
cggcctgcgaggacatgttcgagaa

SEQ ID NO: 302289 - DNA, 25 bp, Mus musculus
tcgtgaactcctacaacggcctggg

SEQ ID NO: 302290 - DNA, 25 bp, Mus musculus
gcgtgcagagcatggcgctgcctcc

SEQ ID NO: 302291 - DNA, 25 bp, Mus musculus
tacgcctcctgccagatggcggcgg

SEQ ID NO: 302292 - DNA, 25 bp, Mus musculus
tcggggttcctcaacaactcctggc

SEQ ID NO: 302293 - DNA, 25 bp, Mus musculus
caagtacctgcaatcggggttcctc

SEQ ID NO: 302294 - DNA, 25 bp, Mus musculus
cgatggctatggctacctggcgcca

SEQ ID NO: 302295 - DNA, 25 bp, Mus musculus
ttcgagaagggcaactaccggcgcc

SEQ ID NO: 302296 - DNA, 25 bp, Mus musculus
gccaagttcccgttctacgagaaga

SEQ ID NO: 302297 - DNA, 25 bp, Mus musculus
taccagtacatcatagccaagttcc

SEQ ID NO: 302298 - DNA, 25 bp, Mus musculus
actctgtccggcatctaccagtaca

SEQ ID NO: 302299 - DNA, 25 bp, Mus musculus
ccgtactcgtacgtggcgctcatcg

SEQ ID NO: 302300 - DNA, 25 bp, Mus musculus
tccagcccggcaaggggctcttcgg

SEQ ID NO: 302301 - DNA, 25 bp, Mus musculus
atcgccatggcgatccgcgagagcg

SEQ ID NO: 302302 - DNA, 25 bp, Mus musculus
atcaaagcgcctctcgcggttcctg

SEQ ID NO: 302303 - DNA, 25 bp, Mus musculus
tgtgcgtggcgacacccaggacccg

SEQ ID NO: 302304 - DNA, 25 bp, Mus musculus
agctgacccgcctgtgcgtggcgac

SEQ ID NO: 302305 - DNA, 25 bp, Mus musculus
taactggacgcagctgacccgcctg

SEQ ID NO: 302306 - DNA, 25 bp, Mus musculus
cattacgcgcccgactccgtgcgga

SEQ ID NO: 302307 - DNA, 25 bp, Mus musculus
tgcttcccattaggcccagcatggt

SEQ ID NO: 302308 - DNA, 25 bp, Mus musculus
cgcgctgcggctgcttcccattagg

SEQ ID NO: 302309 - DNA, 25 bp, Mus musculus
cctctcgcggttcctgcgttttatc

SEQ ID NO: 302310 - DNA, 25 bp, Mus musculus
tgcgttttatctcggccgctctcgg

SEQ ID NO: 302311 - DNA, 25 bp, Mus musculus
gaatgacggccgtgagattccgccc

SEQ ID NO: 302312 - DNA, 25 bp, Mus musculus
tgagattccgccctgactgattttg

SEQ ID NO: 302313 - DNA, 25 bp, Mus musculus
cctgactgattttgttccattccgg

SEQ ID NO: 302314 - DNA, 25 bp, Mus musculus
gaggaataatttgtttcgtattgga

SEQ ID NO: 302315 - DNA, 25 bp, Mus musculus
tcgtattggaatcaaagcgcctctc

SEQ ID NO: 302316 - DNA, 25 bp, Mus musculus
cctatggaggcggacaccgggaatt

SEQ ID NO: 302317 - DNA, 25 bp, Mus musculus
tcggcagacagcaagccgcagtgtg

SEQ ID NO: 302318 - DNA, 25 bp, Mus musculus
gctcaactgtgcacaagggcgcaga

SEQ ID NO: 302319 - DNA, 25 bp, Mus musculus
ctctgaaaagggctctcgcactcgc

SEQ ID NO: 302320 - DNA, 25 bp, Mus musculus
ccgcgagagctgctgactacgtcgt

SEQ ID NO: 302321 - DNA, 25 bp, Mus musculus
agctgctgactacgtcgtgggatcg

SEQ ID NO: 302322 - DNA, 25 bp, Mus musculus
gtgcccaggcctcggtcggcagaca

SEQ ID NO: 302323 - DNA, 25 bp, Mus musculus
ggcgcaccgcagagcgctcaactgt

SEQ ID NO: 302324 - DNA, 25 bp, Mus musculus
tctcgggcttcggacgtgtccgagt

SEQ ID NO: 302325 - DNA, 25 bp, Mus musculus
gtgtccgagtctcggtgccgctcct

SEQ ID NO: 302326 - DNA, 25 bp, Mus musculus
cacgtacctccaggggttgtaggag

SEQ ID NO: 302327 - DNA, 25 bp, Mus musculus
ttgtaggaggccgagctaacctcgc

SEQ ID NO: 302328 - DNA, 25 bp, Mus musculus
gccgagctaacctcgctcggtggtc

SEQ ID NO: 302329 - DNA, 25 bp, Mus musculus
tgcctcggcgcagtattcgtggcgc

SEQ ID NO: 302330 - DNA, 25 bp, Mus musculus
gtctgaaaccggagagcccggaatc

SEQ ID NO: 302331 - DNA, 25 bp, Mus musculus
ccgcaatcccgggaggtgagtattc

SEQ ID NO: 302332 - DNA, 25 bp, Mus musculus
ttagccgcagcaccgggactctgac

SEQ ID NO: 302333 - DNA, 25 bp, Mus musculus
ctcggggtatttcagccaaggccgc

SEQ ID NO: 302334 - DNA, 25 bp, Mus musculus
cgcttcacgtctcctcggggtattt

SEQ ID NO: 302335 - DNA, 25 bp, Mus musculus
gagtattcacagttcccgcttcacg

SEQ ID NO: 302336 - DNA, 25 bp, Mus musculus
gcggtgaacgctgcgccgaaacacc

SEQ ID NO: 302337 - DNA, 25 bp, Mus musculus
tcccagtctcttgctgccttcgggg

SEQ ID NO: 302338 - DNA, 25 bp, Mus musculus
agcccggaatcgtgcggtgaacgct

SEQ ID NO: 302339 - DNA, 25 bp, Mus musculus
cagagcactgcggtgtctgcagccc

SEQ ID NO: 302340 - DNA, 25 bp, Mus musculus
cgtccaccgagcacttacagcgagg

SEQ ID NO: 302341 - DNA, 25 bp, Mus musculus
cttacagcgaggttagcacggcctc

SEQ ID NO: 302342 - DNA, 25 bp, Mus musculus
cgaaacacctgagggtccgcagccg

SEQ ID NO: 302343 - DNA, 25 bp, Mus musculus
ggactctgaccggtctgaaaccgga

SEQ ID NO: 302344 - DNA, 25 bp, Mus musculus
ctagctaggaaatgcgcgtgcaggt

SEQ ID NO: 302345 - DNA, 25 bp, Mus musculus
gaggccatcgactgcgtcagttcga

SEQ ID NO: 302346 - DNA, 25 bp, Mus musculus
gactatcaggcggagcgtccaggaa

SEQ ID NO: 302347 - DNA, 25 bp, Mus musculus
cgattggtcagcctggctgcgctaa

SEQ ID NO: 302348 - DNA, 25 bp, Mus musculus
cctggctgcgctaacggtcgcgtag

SEQ ID NO: 302349 - DNA, 25 bp, Mus musculus
ccttcaggtgcacgcccaaaggtgg

SEQ ID NO: 302350 - DNA, 25 bp, Mus musculus
ccaaaggtggcttctccggaatccg

SEQ ID NO: 302351 - DNA, 25 bp, Mus musculus
ccagccagggccctcagaatggagt

SEQ ID NO: 302352 - DNA, 25 bp, Mus musculus
ggctcctacgcgctagctaggaaat

SEQ ID NO: 302353 - DNA, 25 bp, Mus musculus
gggagcccgcccgtcgctttgtgtc

SEQ ID NO: 302354 - DNA, 25 bp, Mus musculus
cggagcgtccaggaagtgtcaaagc

SEQ ID NO: 302355 - DNA, 25 bp, Mus musculus
tgcgtcagttcgattggtcagcctg

SEQ ID NO: 302356 - DNA, 25 bp, Mus musculus
gtgtcaaagcgcctgctacaaagta

SEQ ID NO: 302357 - DNA, 25 bp, Mus musculus
tgctacaaagtagccgcagcaagtc

SEQ ID NO: 302358 - DNA, 25 bp, Mus musculus
cccatggagatggagttaaataatc

SEQ ID NO: 302359 - DNA, 25 bp, Mus musculus
acctccgagggatgacgtcaggacc

SEQ ID NO: 302360 - DNA, 25 bp, Mus musculus
cctccgagccgctagatgtcgctaa

SEQ ID NO: 302361 - DNA, 25 bp, Mus musculus
gatgtcgctaaactcccattcctag

SEQ ID NO: 302362 - DNA, 25 bp, Mus musculus
ttcgctccgagactctcgcgagatc

SEQ ID NO: 302363 - DNA, 25 bp, Mus musculus
ctcgcgagatctcgcggcaacttac

SEQ ID NO: 302364 - DNA, 25 bp, Mus musculus
gcggcaacttacagaaccggaagtc

SEQ ID NO: 302365 - DNA, 25 bp, Mus musculus
ccggaagtcgcgtgtagttctcttt

SEQ ID NO: 302366 - DNA, 25 bp, Mus musculus
cgggttgtcgctggtaatccgcagc

SEQ ID NO: 302367 - DNA, 25 bp, Mus musculus
taatccgcagccatccgcggcgagg

SEQ ID NO: 302368 - DNA, 25 bp, Mus musculus
aggcgaggaggcttttctgtcccga

SEQ ID NO: 302369 - DNA, 25 bp, Mus musculus
agacggccttgctggcccggcatca

SEQ ID NO: 302370 - DNA, 25 bp, Mus musculus
gaccaggttcgtggactcgaaggcc

SEQ ID NO: 302371 - DNA, 25 bp, Mus musculus
gctcggtccgtgtctttcctagcca

SEQ ID NO: 302372 - DNA, 25 bp, Mus musculus
cccggcttacccaggctggcaaatg

SEQ ID NO: 302373 - DNA, 25 bp, Mus musculus
cagctcacggctgatgaactcgcgc

SEQ ID NO: 302374 - DNA, 25 bp, Mus musculus
ctccaggaattcgaaggcggcctcc

SEQ ID NO: 302375 - DNA, 25 bp, Mus musculus
gaactcgcgctcgtgctccaggaat

SEQ ID NO: 302376 - DNA, 25 bp, Mus musculus
tgggtgtgtcccacctccgactctt

SEQ ID NO: 302377 - DNA, 25 bp, Mus musculus
ccaggtagaaaaggacgcgcgccac

SEQ ID NO: 302378 - DNA, 25 bp, Mus musculus
tgtcgccggcttgtcctctctagaa

SEQ ID NO: 302379 - DNA, 25 bp, Mus musculus
ggcgcacatctgtcctcaaggcacg

SEQ ID NO: 302380 - DNA, 25 bp, Mus musculus
gccctgtttcctacgcgagcaactt

SEQ ID NO: 302381 - DNA, 25 bp, Mus musculus
gttcttaaatcaacaggcgggtgga

SEQ ID NO: 302382 - DNA, 25 bp, Mus musculus
caagctctgagctcgggttctacca

SEQ ID NO: 302383 - DNA, 25 bp, Mus musculus
tcctggacgcccagttttgatcctg

SEQ ID NO: 302384 - DNA, 25 bp, Mus musculus
agcaactttgcggagtcctggacgc

SEQ ID NO: 302385 - DNA, 25 bp, Mus musculus
gtgtcacgcccttcgctagttctta

SEQ ID NO: 302386 - DNA, 25 bp, Mus musculus
ctggttcccgtcgtccaagaagttg

SEQ ID NO: 302387 - DNA, 25 bp, Mus musculus
ttcacctccgggcagttgctcaacg

SEQ ID NO: 302388 - DNA, 25 bp, Mus musculus
ttgcggacatctccgaggcttcccg

SEQ ID NO: 302389 - DNA, 25 bp, Mus musculus
gccatcgccttaccgtgttggaaaa

SEQ ID NO: 302390 - DNA, 25 bp, Mus musculus
gcttcggaccgctgcacccgaagta

SEQ ID NO: 302391 - DNA, 25 bp, Mus musculus
cccgaagtagcatctggttcccgtc

SEQ ID NO: 302392 - DNA, 25 bp, Mus musculus
agcccgaagtaattctgggtggtcg

SEQ ID NO: 302393 - DNA, 25 bp, Mus musculus
accactacactcagcagttgccaag

SEQ ID NO: 302394 - DNA, 25 bp, Mus musculus
agctccgtcgctatggcgaccgctt

SEQ ID NO: 302395 - DNA, 25 bp, Mus musculus
gctccggtctcagcccgaagtaatt

SEQ ID NO: 302396 - DNA, 25 bp, Mus musculus
gaggctgatcccagagctccggtct

SEQ ID NO: 302397 - DNA, 25 bp, Mus musculus
agttgctcaacggaggctgatccca

SEQ ID NO: 302398 - DNA, 25 bp, Mus musculus
gcagttgccaagctccgtcgctatg

SEQ ID NO: 302399 - DNA, 25 bp, Mus musculus
taaaaagaaagagtttgcggacatc

SEQ ID NO: 302400 - DNA, 25 bp, Mus musculus
ggcacggctccacagtcaaaacagt

SEQ ID NO: 302401 - DNA, 25 bp, Mus musculus
tcaaaacagtcgtcgtgagcgcgga

SEQ ID NO: 302402 - DNA, 25 bp, Mus musculus
cagcgccgccacagatggatgaatc

SEQ ID NO: 302403 - DNA, 25 bp, Mus musculus
gggtgtcccaggatccttgccttcc

SEQ ID NO: 302404 - DNA, 25 bp, Mus musculus
tcccgagaggatgcggggacctacc

SEQ ID NO: 302405 - DNA, 25 bp, Mus musculus
tccctgacgtccctccttatggtgg

SEQ ID NO: 302406 - DNA, 25 bp, Mus musculus
atgcgcatggcacggattcacggac

SEQ ID NO: 302407 - DNA, 25 bp, Mus musculus
ggacctaccgctgtgtggccaccaa

SEQ ID NO: 302408 - DNA, 25 bp, Mus musculus
ctctccacgggtgcattgctccagg

SEQ ID NO: 302409 - DNA, 25 bp, Mus musculus
taccgcgctggcctgcagtgccagg

SEQ ID NO: 302410 - DNA, 25 bp, Mus musculus
cccgagtcaccagacctggctggaa

SEQ ID NO: 302411 - DNA, 25 bp, Mus musculus
tggatgaatccagttgcccgagtca

SEQ ID NO: 302412 - DNA, 25 bp, Mus musculus
ccctccttatggtggctgatctgca

SEQ ID NO: 302413 - DNA, 25 bp, Mus musculus
ctgtgtggccaccaatgcgcatggc

SEQ ID NO: 302414 - DNA, 25 bp, Mus musculus
gacttctccgctgcacaccgttaag

SEQ ID NO: 302415 - DNA, 25 bp, Mus musculus
cggctttaaaagagctgtaggttca

SEQ ID NO: 302416 - DNA, 25 bp, Mus musculus
cttgctttagctaggtgccagattc

SEQ ID NO: 302417 - DNA, 25 bp, Mus musculus
ccaagattccgagggcctgctgctt

SEQ ID NO: 302418 - DNA, 25 bp, Mus musculus
gaagagtcccgtcgcttcaaccacg

SEQ ID NO: 302419 - DNA, 25 bp, Mus musculus
atctttaactcttcgggctgccaac

SEQ ID NO: 302420 - DNA, 25 bp, Mus musculus
ccagattcaggcctcaaagttcttg

SEQ ID NO: 302421 - DNA, 25 bp, Mus musculus
gtgagccgccgataagcctaggaca

SEQ ID NO: 302422 - DNA, 25 bp, Mus musculus
actcaccacacggatctgcagtctg

SEQ ID NO: 302423 - DNA, 25 bp, Mus musculus
cggcaccactgtgggcattgggaca

SEQ ID NO: 302424 - DNA, 25 bp, Mus musculus
gctgacgccttaaagcgaccgcgca

SEQ ID NO: 302425 - DNA, 25 bp, Mus musculus
atcaaaggagtctgtctaagcggcg

SEQ ID NO: 302426 - DNA, 25 bp, Mus musculus
tcttgagaattagccagcgacctgg

SEQ ID NO: 302427 - DNA, 25 bp, Mus musculus
gagccttccgagtggctgcgacgac

SEQ ID NO: 302428 - DNA, 25 bp, Mus musculus
ctgccgtattgcagtgcctgccgta

SEQ ID NO: 302429 - DNA, 25 bp, Mus musculus
ctgccgtatccagtgcctgccgtat

SEQ ID NO: 302430 - DNA, 25 bp, Mus musculus
attgcagtgcctgccgtatccagtg

SEQ ID NO: 302431 - DNA, 25 bp, Mus musculus
tgccgtatccagtgcctgccgtatc

SEQ ID NO: 302432 - DNA, 25 bp, Mus musculus
gtatcccagtgcctgccgtatcgca

SEQ ID NO: 302433 - DNA, 25 bp, Mus musculus
atcgcagtgcctgccgtatccagtg

SEQ ID NO: 302434 - DNA, 25 bp, Mus musculus
tgccgtatcgcagtgcctgccgtat

SEQ ID NO: 302435 - DNA, 25 bp, Mus musculus
tatcgcagtgcctgccgtatccagt

SEQ ID NO: 302436 - DNA, 25 bp, Mus musculus
tatccagtgcctgccgtatcccagt

SEQ ID NO: 302437 - DNA, 25 bp, Mus musculus
ctgccgtatcgcagtgcctgccgta

SEQ ID NO: 302438 - DNA, 25 bp, Mus musculus
atcccagtgcctgccgtatcgcagt

SEQ ID NO: 302439 - DNA, 25 bp, Mus musculus
gtatccagtgcctgccgtatcccag

SEQ ID NO: 302440 - DNA, 25 bp, Mus musculus
tgccgtatcccagtgcctgccgtat

SEQ ID NO: 302441 - DNA, 25 bp, Mus musculus
tatccagtgcctgccgtatccagtg

SEQ ID NO: 302442 - DNA, 25 bp, Mus musculus
agcgagctccgtcccgagaagcaac

SEQ ID NO: 302443 - DNA, 25 bp, Mus musculus
agccggagcctctgtagaaagccca

SEQ ID NO: 302444 - DNA, 25 bp, Mus musculus
cccagctgaggccaccgcagtgggt

SEQ ID NO: 302445 - DNA, 25 bp, Mus musculus
gcccaggcaagctgcccagaacaga

SEQ ID NO: 302446 - DNA, 25 bp, Mus musculus
gtcactcaccgagaggacgctcatg

SEQ ID NO: 302447 - DNA, 25 bp, Mus musculus
ccaggcgtcgctcgagcaccgaagg

SEQ ID NO: 302448 - DNA, 25 bp, Mus musculus
ggggtctccaacaggcacgccatct

SEQ ID NO: 302449 - DNA, 25 bp, Mus musculus
ccggcttacgaatcgtcctctcaga

SEQ ID NO: 302450 - DNA, 25 bp, Mus musculus
acgctcatgcggattggggtctcca

SEQ ID NO: 302451 - DNA, 25 bp, Mus musculus
agaaggctcggccaaacccaagccg

SEQ ID NO: 302452 - DNA, 25 bp, Mus musculus
ggcactttcgacagccacctatgtg

SEQ ID NO: 302453 - DNA, 25 bp, Mus musculus
aacaggcacgccatcttgagccttc

SEQ ID NO: 302454 - DNA, 25 bp, Mus musculus
ctcgagtaggagacgcctccgactc

SEQ ID NO: 302455 - DNA, 25 bp, Mus musculus
cacctatgtgacctgcagccggagc

SEQ ID NO: 302456 - DNA, 25 bp, Mus musculus
tcgggacccgtggatctccttctgt

SEQ ID NO: 302457 - DNA, 25 bp, Mus musculus
cgcgagacttggaagccggaagtta

SEQ ID NO: 302458 - DNA, 25 bp, Mus musculus
gccggaagttacataaaggactcga

SEQ ID NO: 302459 - DNA, 25 bp, Mus musculus
aggactcgaaactcagccgcggctc

SEQ ID NO: 302460 - DNA, 25 bp, Mus musculus
cctggtgttctttgctgtgcgaccc

SEQ ID NO: 302461 - DNA, 25 bp, Mus musculus
cgttccctctctcgcgagacttgga

SEQ ID NO: 302462 - DNA, 25 bp, Mus musculus
gctgccgcagatcgcgatgtctgtt

SEQ ID NO: 302463 - DNA, 25 bp, Mus musculus
ttgctgttgagttccgcggcccaac

SEQ ID NO: 302464 - DNA, 25 bp, Mus musculus
acggcgagctggacaagatctacga

SEQ ID NO: 302465 - DNA, 25 bp, Mus musculus
atctccttctgtgctgcggcgactt

SEQ ID NO: 302466 - DNA, 25 bp, Mus musculus
gcaacgaggccgacctgcgctgcat

SEQ ID NO: 302467 - DNA, 25 bp, Mus musculus
agtaccgtcacatgcagaccttcta

SEQ ID NO: 302468 - DNA, 25 bp, Mus musculus
cagaccttctacaggtgaggggcgc

SEQ ID NO: 302469 - DNA, 25 bp, Mus musculus
ccaacgtcacgatgagggtggccgt

SEQ ID NO: 302470 - DNA, 25 bp, Mus musculus
atccctttatcccagcggcttcgga

SEQ ID NO: 302471 - DNA, 25 bp, Mus musculus
ttaaacattagtggctgcggtagcc

SEQ ID NO: 302472 - DNA, 25 bp, Mus musculus
gggatgtctgacacccaaccctcgg

SEQ ID NO: 302473 - DNA, 25 bp, Mus musculus
ggaagagctcgcatgccaggagaca

SEQ ID NO: 302474 - DNA, 25 bp, Mus musculus
atcccagcggcttcggattgtgcag

SEQ ID NO: 302475 - DNA, 25 bp, Mus musculus
cgagggtgcttcacgacgtcccgct

SEQ ID NO: 302476 - DNA, 25 bp, Mus musculus
ttccaggcggagctacttggccgct

SEQ ID NO: 302477 - DNA, 25 bp, Mus musculus
ggaaaactatgtctggaatccagcg

SEQ ID NO: 302478 - DNA, 25 bp, Mus musculus
tgccacaggcctcccaggaaaacta

SEQ ID NO: 302479 - DNA, 25 bp, Mus musculus
cagtcgccggcccttgttccgggtg

SEQ ID NO: 302480 - DNA, 25 bp, Mus musculus
gggaacctctaagacctccagtcgc

SEQ ID NO: 302481 - DNA, 25 bp, Mus musculus
agcatcctcgggctgcactgtagga

SEQ ID NO: 302482 - DNA, 25 bp, Mus musculus
tgagtcgggacgtgggaacctctaa

SEQ ID NO: 302483 - DNA, 25 bp, Mus musculus
cggattgtgcaggactgaggtaccc

SEQ ID NO: 302484 - DNA, 25 bp, Mus musculus
cttgtctagtcagaggcgcagcctc

SEQ ID NO: 302485 - DNA, 25 bp, Mus musculus
ggttctcaccgtagcgttaggacta

SEQ ID NO: 302486 - DNA, 25 bp, Mus musculus
acccggttggatgtgctaacttgtc

SEQ ID NO: 302487 - DNA, 25 bp, Mus musculus
acctcgagtgtgcaaatcccattga

SEQ ID NO: 302488 - DNA, 25 bp, Mus musculus
cccgacatatgtttcccgcagataa

SEQ ID NO: 302489 - DNA, 25 bp, Mus musculus
cggaatgtgaacttctcccgacata

SEQ ID NO: 302490 - DNA, 25 bp, Mus musculus
aggatcctcaatttacagcggcaga

SEQ ID NO: 302491 - DNA, 25 bp, Mus musculus
tgcaggctttgggaaacgatattca

SEQ ID NO: 302492 - DNA, 25 bp, Mus musculus
agcggtggaggattgtttcatttca

SEQ ID NO: 302493 - DNA, 25 bp, Mus musculus
tcagacggtgtatgggtagatttcc

SEQ ID NO: 302494 - DNA, 25 bp, Mus musculus
gcgatggattctgtcttgggcttca

SEQ ID NO: 302495 - DNA, 25 bp, Mus musculus
aaagcgtgcacaaatcccggggtca

SEQ ID NO: 302496 - DNA, 25 bp, Mus musculus
tatgccgctcaatggaggatcctca

SEQ ID NO: 302497 - DNA, 25 bp, Mus musculus
gctcgcgtctatgcgggtatctgaa

SEQ ID NO: 302498 - DNA, 25 bp, Mus musculus
agagctggctccaccgcttgccaag

SEQ ID NO: 302499 - DNA, 25 bp, Mus musculus
cgcggtcgagtcgaaagcgaccaag

SEQ ID NO: 302500 - DNA, 25 bp, Mus musculus
taaaccagccaaatgcacacgacct

SEQ ID NO: 302501 - DNA, 25 bp, Mus musculus
ctacccacccggcaaatagacttga

SEQ ID NO: 302502 - DNA, 25 bp, Mus musculus
cccggcaaatagacttgagaattct

SEQ ID NO: 302503 - DNA, 25 bp, Mus musculus
ttgagaattcttaacgcgcatcttg

SEQ ID NO: 302504 - DNA, 25 bp, Mus musculus
cgcgcatcttgtgaattacttgata

SEQ ID NO: 302505 - DNA, 25 bp, Mus musculus
cttgatatgcgaattcaaatgactc

SEQ ID NO: 302506 - DNA, 25 bp, Mus musculus
tgcgaattcaaatgactcgaaattc

SEQ ID NO: 302507 - DNA, 25 bp, Mus musculus
ctcgaaattcattgtccacttggac

SEQ ID NO: 302508 - DNA, 25 bp, Mus musculus
tggacaatggtgacgaggcctgaac

SEQ ID NO: 302509 - DNA, 25 bp, Mus musculus
gggcagaagggaacgataatccgcc

SEQ ID NO: 302510 - DNA, 25 bp, Mus musculus
gtcgaaagcgaccaaggcgcaccta

SEQ ID NO: 302511 - DNA, 25 bp, Mus musculus
cgataatccgccaagtcagagctgg

SEQ ID NO: 302512 - DNA, 25 bp, Mus musculus
gccacgcttattcttagccggaatc

SEQ ID NO: 302513 - DNA, 25 bp, Mus musculus
ggcctctgcagactacctcgggtaa

SEQ ID NO: 302514 - DNA, 25 bp, Mus musculus
tcggctgcagctcttggagagtccc

SEQ ID NO: 302515 - DNA, 25 bp, Mus musculus
ctgctgagccggctcttcgctgatt

SEQ ID NO: 302516 - DNA, 25 bp, Mus musculus
tcctggacagtgattaacaaaaaca

SEQ ID NO: 302517 - DNA, 25 bp, Mus musculus
aggacgatcgcagagagcccgccac

SEQ ID NO: 302518 - DNA, 25 bp, Mus musculus
tgacctgggattgaggacgatcgca

SEQ ID NO: 302519 - DNA, 25 bp, Mus musculus
ggactatcctggcatccgaacagcg

SEQ ID NO: 302520 - DNA, 25 bp, Mus musculus
ccgcagctactttgccacgcttatt

SEQ ID NO: 302521 - DNA, 25 bp, Mus musculus
cctcgggtaaaggtgctctagctcc

SEQ ID NO: 302522 - DNA, 25 bp, Mus musculus
agccggaatcctaacttctttcaca

SEQ ID NO: 302523 - DNA, 25 bp, Mus musculus
cgctgcgttccaaggacccgagagt

SEQ ID NO: 302524 - DNA, 25 bp, Mus musculus
tctcgctgttgtcgagccaccttcg

SEQ ID NO: 302525 - DNA, 25 bp, Mus musculus
cgggactgcagtttccggactatcc

SEQ ID NO: 302526 - DNA, 25 bp, Mus musculus
cgcgcaagacagaaaggatcagttt

SEQ ID NO: 302527 - DNA, 25 bp, Mus musculus
gcaacctgagtgtctggggactcca

SEQ ID NO: 302528 - DNA, 25 bp, Mus musculus
cggacccgcaacctgagtgtctggg

SEQ ID NO: 302529 - DNA, 25 bp, Mus musculus
acgcctctcgcagagtgcgggagtt

SEQ ID NO: 302530 - DNA, 25 bp, Mus musculus
gggtggcaatcacgcctctcgcaga

SEQ ID NO: 302531 - DNA, 25 bp, Mus musculus
tgcgggactcctctgcagcgcagag

SEQ ID NO: 302532 - DNA, 25 bp, Mus musculus
cagtgctcccgggttgcgggactcc

SEQ ID NO: 302533 - DNA, 25 bp, Mus musculus
acaggttccgaaggagcagtgctcc

SEQ ID NO: 302534 - DNA, 25 bp, Mus musculus
aaaagattcccagaagcagtggcac

SEQ ID NO: 302535 - DNA, 25 bp, Mus musculus
catggtccagccctaggaaacctta

SEQ ID NO: 302536 - DNA, 25 bp, Mus musculus
gagaagcggctgtcctgcgctccag

SEQ ID NO: 302537 - DNA, 25 bp, Mus musculus
gatcagtttggggaaaagattccca

SEQ ID NO: 302538 - DNA, 25 bp, Mus musculus
acacccgggctgcacaggttccgaa

SEQ ID NO: 302539 - DNA, 25 bp, Mus musculus
cagccctaggaaaccttagcggagg

SEQ ID NO: 302540 - DNA, 25 bp, Mus musculus
gagaagagctgaccctgcaaagttt

SEQ ID NO: 302541 - DNA, 25 bp, Mus musculus
ggggaagacatacctgtccttcttg

SEQ ID NO: 302542 - DNA, 25 bp, Mus musculus
ttcttgagcaggttcttcggcttgc

SEQ ID NO: 302543 - DNA, 25 bp, Mus musculus
tgctccttcatgtgttgggcgcgca

SEQ ID NO: 302544 - DNA, 25 bp, Mus musculus
cttcatcgatgtaaggccgcttctc

SEQ ID NO: 302545 - DNA, 25 bp, Mus musculus
ctctgcctcggacaggagcttccat

SEQ ID NO: 302546 - DNA, 25 bp, Mus musculus
attggggcccaagtaccagagtctt

SEQ ID NO: 302547 - DNA, 25 bp, Mus musculus
ccagagtcttgggattaagtggcta

SEQ ID NO: 302548 - DNA, 25 bp, Mus musculus
gctaggtaattttctggcaagggca

SEQ ID NO: 302549 - DNA, 25 bp, Mus musculus
cctagcactgcacctggccgagaat

SEQ ID NO: 302550 - DNA, 25 bp, Mus musculus
ctgcagccaaaagcggcgaagttca

SEQ ID NO: 302551 - DNA, 25 bp, Mus musculus
cgggaccgcacgcactctgacataa

SEQ ID NO: 302552 - DNA, 25 bp, Mus musculus
tctgtctttctgtccgtcctgagcc

SEQ ID NO: 302553 - DNA, 25 bp, Mus musculus
ctgaaggtttggacatggtcccggc

SEQ ID NO: 302554 - DNA, 25 bp, Mus musculus
gttcgccgtcctcacttgtttcttg

SEQ ID NO: 302555 - DNA, 25 bp, Mus musculus
ggtgtgtttcttgaatgcagcaaca

SEQ ID NO: 302556 - DNA, 25 bp, Mus musculus
tcctgcttgcatatccagtctgtta

SEQ ID NO: 302557 - DNA, 25 bp, Mus musculus
gcttttcatctacccagcgctggag

SEQ ID NO: 302558 - DNA, 25 bp, Mus musculus
gcagcaacatgctggatcctgcttg

SEQ ID NO: 302559 - DNA, 25 bp, Mus musculus
ctctgagtagtatctgtctttgtca

SEQ ID NO: 302560 - DNA, 25 bp, Mus musculus
gcttggcaaactctttttactctga

SEQ ID NO: 302561 - DNA, 25 bp, Mus musculus
gctcacggccagaccgggtacaata

SEQ ID NO: 302562 - DNA, 25 bp, Mus musculus
tcagctgttcttcatccgtggcaaa

SEQ ID NO: 302563 - DNA, 25 bp, Mus musculus
tgcatggtctcacccactcagctgt

SEQ ID NO: 302564 - DNA, 25 bp, Mus musculus
tagtacatcctctgcacctgcatgg

SEQ ID NO: 302565 - DNA, 25 bp, Mus musculus
gcctggtgaacccacttagtacatc

SEQ ID NO: 302566 - DNA, 25 bp, Mus musculus
agcgctggagacaagcctggtgaac

SEQ ID NO: 302567 - DNA, 25 bp, Mus musculus
gtggcaaaacacacccagcaacttc

SEQ ID NO: 302568 - DNA, 25 bp, Mus musculus
ctctccagcaacaatagcactctga

SEQ ID NO: 302569 - DNA, 25 bp, Mus musculus
acggcgcatcacagtgcgcgtggcc

SEQ ID NO: 302570 - DNA, 25 bp, Mus musculus
gcgagtatgagtgtgcagcgaccaa

SEQ ID NO: 302571 - DNA, 25 bp, Mus musculus
ggtaacttcactctgacctgccgcg

SEQ ID NO: 302572 - DNA, 25 bp, Mus musculus
ttcactctgacctgccgcgcagagg

SEQ ID NO: 302573 - DNA, 25 bp, Mus musculus
gacctgccgcgcagaggcttggcct

SEQ ID NO: 302574 - DNA, 25 bp, Mus musculus
aggcttggcctccagcccagatcag

SEQ ID NO: 302575 - DNA, 25 bp, Mus musculus
agcccagatcagctggcgcgcgccc

SEQ ID NO: 302576 - DNA, 25 bp, Mus musculus
gggctctcaacctcggcctctccag

SEQ ID NO: 302577 - DNA, 25 bp, Mus musculus
caatagcactctgagcgtggcggga

SEQ ID NO: 302578 - DNA, 25 bp, Mus musculus
tgtgcagcgaccaatgcgcatgggc

SEQ ID NO: 302579 - DNA, 25 bp, Mus musculus
gaccaatgcgcatgggcgccacgca

SEQ ID NO: 302580 - DNA, 25 bp, Mus musculus
acgcacggcgcatcacagtgcgcgt

SEQ ID NO: 302581 - DNA, 25 bp, Mus musculus
gccgggcggtaacttcactctgacc

SEQ ID NO: 302582 - DNA, 25 bp, Mus musculus
ggtcatgttacggtcctcaaccctg

SEQ ID NO: 302583 - DNA, 25 bp, Mus musculus
agcttccttccaacccagctgttaa

SEQ ID NO: 302584 - DNA, 25 bp, Mus musculus
gttaacactgaaccgacctagcacg

SEQ ID NO: 302585 - DNA, 25 bp, Mus musculus
acatctctcctgctccggaacggga

SEQ ID NO: 302586 - DNA, 25 bp, Mus musculus
cacagaccgccgacagggctttctg

SEQ ID NO: 302587 - DNA, 25 bp, Mus musculus
tagagactagcaggcagagcggacc

SEQ ID NO: 302588 - DNA, 25 bp, Mus musculus
agaccgaaaggactgtgcgtgtgtc

SEQ ID NO: 302589 - DNA, 25 bp, Mus musculus
gccgttaccgcacgaggcctgtgct

SEQ ID NO: 302590 - DNA, 25 bp, Mus musculus
acgcccaatctaataggctccatcg

SEQ ID NO: 302591 - DNA, 25 bp, Mus musculus
cttgtcaatcaagcgcgggccctga

SEQ ID NO: 302592 - DNA, 25 bp, Mus musculus
cctgagtggtccctgagctgagact

SEQ ID NO: 302593 - DNA, 25 bp, Mus musculus
actgcgcggcctttggacagaaggt

SEQ ID NO: 302594 - DNA, 25 bp, Mus musculus
ggctcgacgttaaccggtcatgtta

SEQ ID NO: 302595 - DNA, 25 bp, Mus musculus
gtacgaaaccaacccagaggactgc

SEQ ID NO: 302596 - DNA, 25 bp, Mus musculus
ttacctggaagtcgcggctaggccg

SEQ ID NO: 302597 - DNA, 25 bp, Mus musculus
acttgccaccgacgtggggctcggt

SEQ ID NO: 302598 - DNA, 25 bp, Mus musculus
ctacgggtcacttgccaccgacgtg

SEQ ID NO: 302599 - DNA, 25 bp, Mus musculus
gcgcttgacgggagcctaccttacc

SEQ ID NO: 302600 - DNA, 25 bp, Mus musculus
ctatcaagtaggcggggcgcttgac

SEQ ID NO: 302601 - DNA, 25 bp, Mus musculus
tccaccgaggtctatcaagtaggcg

SEQ ID NO: 302602 - DNA, 25 bp, Mus musculus
gcgcgctccaccgaggtctatcaag

SEQ ID NO: 302603 - DNA, 25 bp, Mus musculus
accggctcagttacctggaagtcgc

SEQ ID NO: 302604 - DNA, 25 bp, Mus musculus
gtctggcctccctagccagctgagg

SEQ ID NO: 302605 - DNA, 25 bp, Mus musculus
ccagacggctgagtcccgcaccgcc

SEQ ID NO: 302606 - DNA, 25 bp, Mus musculus
cgtcctgcagagacgcgcgctccac

SEQ ID NO: 302607 - DNA, 25 bp, Mus musculus
gggcactagcggactcccgcgctcc

SEQ ID NO: 302608 - DNA, 25 bp, Mus musculus
gggaccactgcagcctggactgcca

SEQ ID NO: 302609 - DNA, 25 bp, Mus musculus
ctcagttacctggaagtcgcggcta

SEQ ID NO: 302610 - DNA, 25 bp, Mus musculus
ccaggctcttggagaagctctaaaa

SEQ ID NO: 302611 - DNA, 25 bp, Mus musculus
agctctaaaaatggcgggcggcaac

SEQ ID NO: 302612 - DNA, 25 bp, Mus musculus
tgcagccacgcaaaaggccacgttt

SEQ ID NO: 302613 - DNA, 25 bp, Mus musculus
gcccgtcctgtcagcggagcagtga

SEQ ID NO: 302614 - DNA, 25 bp, Mus musculus
gcgccattggcgtgtggaaaatgcc

SEQ ID NO: 302615 - DNA, 25 bp, Mus musculus
cgtgtggaaaatgccaccagatggc

SEQ ID NO: 302616 - DNA, 25 bp, Mus musculus
aatgccaccagatggcgggttagga

SEQ ID NO: 302617 - DNA, 25 bp, Mus musculus
cgggttaggattgcagctccgttga

SEQ ID NO: 302618 - DNA, 25 bp, Mus musculus
attgcagctccgttgaaggcgcggc

SEQ ID NO: 302619 - DNA, 25 bp, Mus musculus
ccacctcgggaataacacaccggag

SEQ ID NO: 302620 - DNA, 25 bp, Mus musculus
aaactaggtcgacggccgacagcgc

SEQ ID NO: 302621 - DNA, 25 bp, Mus musculus
gctggaagcgccgatccaagatgga

SEQ ID NO: 302622 - DNA, 25 bp, Mus musculus
aagcgccgatccaagatggaggccg

SEQ ID NO: 302623 - DNA, 25 bp, Mus musculus
ttcttccaggctcttggagaagctc

SEQ ID NO: 302624 - DNA, 25 bp, Mus musculus
cgatgcgctctttaactgaaaccgg

SEQ ID NO: 302625 - DNA, 25 bp, Mus musculus
catgcgcagagagcgtagacattgc

SEQ ID NO: 302626 - DNA, 25 bp, Mus musculus
tttttgactgccagcgtgacacaca

SEQ ID NO: 302627 - DNA, 25 bp, Mus musculus
ccgaatcctaatcgccgccgccatt

SEQ ID NO: 302628 - DNA, 25 bp, Mus musculus
cgcaattcagaacgctgagcctcgc

SEQ ID NO: 302629 - DNA, 25 bp, Mus musculus
gccgaggccgcaattcagaacgctg

SEQ ID NO: 302630 - DNA, 25 bp, Mus musculus
gctctttaactgaaaccggctggct

SEQ ID NO: 302631 - DNA, 25 bp, Mus musculus
cgcttgttgtcgatgcgctctttaa

SEQ ID NO: 302632 - DNA, 25 bp, Mus musculus
gcaacgctgcatggcgcttgttgtc

SEQ ID NO: 302633 - DNA, 25 bp, Mus musculus
tcactcgcttgtgctgcgcgtcgat

SEQ ID NO: 302634 - DNA, 25 bp, Mus musculus
gcccgtgactcactcgcttgtgctg

SEQ ID NO: 302635 - DNA, 25 bp, Mus musculus
gcgtgacacacactgcacctcagga

SEQ ID NO: 302636 - DNA, 25 bp, Mus musculus
gtcgtgatgccgaggccgcaattca

SEQ ID NO: 302637 - DNA, 25 bp, Mus musculus
agacattgcgagtctgcgcctgcgc

SEQ ID NO: 302638 - DNA, 25 bp, Mus musculus
tgggctgccatcctcccactggggt

SEQ ID NO: 302639 - DNA, 25 bp, Mus musculus
cctccgcgacgtcgctgcgatggag

SEQ ID NO: 302640 - DNA, 25 bp, Mus musculus
ggaatccgacgcctgcgccgtagtc

SEQ ID NO: 302641 - DNA, 25 bp, Mus musculus
actagacccgggaatccgacgcctg

SEQ ID NO: 302642 - DNA, 25 bp, Mus musculus
ctgctggcactagacccgggaatcc

SEQ ID NO: 302643 - DNA, 25 bp, Mus musculus
caaagcgcacgcgtaagggcgaaag

SEQ ID NO: 302644 - DNA, 25 bp, Mus musculus
ctaatgtgtttatccggttttctgg

SEQ ID NO: 302645 - DNA, 25 bp, Mus musculus
cgtgagcgggctaatgtgtttatcc

SEQ ID NO: 302646 - DNA, 25 bp, Mus musculus
accgtaagtggcgagccagacatgc

SEQ ID NO: 302647 - DNA, 25 bp, Mus musculus
tgcacggaaccgtaagtggcgagcc

SEQ ID NO: 302648 - DNA, 25 bp, Mus musculus
accgagcatgctccgtgcacggaac

SEQ ID NO: 302649 - DNA, 25 bp, Mus musculus
gtccggctcgaaaccgagcatgctc

SEQ ID NO: 302650 - DNA, 25 bp, Mus musculus
cggagagcgcgtccggctcgaaacc

SEQ ID NO: 302651 - DNA, 25 bp, Mus musculus
acccacacgcctgggagaccggatt

SEQ ID NO: 302652 - DNA, 25 bp, Mus musculus
cgagccgcctagtgctcaactacga

SEQ ID NO: 302653 - DNA, 25 bp, Mus musculus
tcgtcttaaggggtggtactgtgca

SEQ ID NO: 302654 - DNA, 25 bp, Mus musculus
gcagtagtaacgtgaacggttggcc

SEQ ID NO: 302655 - DNA, 25 bp, Mus musculus
tcctttggcagtagtaacgtgaacg

SEQ ID NO: 302656 - DNA, 25 bp, Mus musculus
ttctaaagttcctttggcagtagta

SEQ ID NO: 302657 - DNA, 25 bp, Mus musculus
cggtgagacgcttctttattgttcc

SEQ ID NO: 302658 - DNA, 25 bp, Mus musculus
ctgtgtttgcggtgagacgcttctt

SEQ ID NO: 302659 - DNA, 25 bp, Mus musculus
ctctcgtgctgtgtttgcggtgaga

SEQ ID NO: 302660 - DNA, 25 bp, Mus musculus
cagtccctctcgtgctgtgtttgcg

SEQ ID NO: 302661 - DNA, 25 bp, Mus musculus
ttccgacagtccctctcgtgctgtg

SEQ ID NO: 302662 - DNA, 25 bp, Mus musculus
ggctcttgccttacttccgacagtc

SEQ ID NO: 302663 - DNA, 25 bp, Mus musculus
cagagattaacaggctcttgcctta

SEQ ID NO: 302664 - DNA, 25 bp, Mus musculus
cccaaggcgtttacagagattaaca

SEQ ID NO: 302665 - DNA, 25 bp, Mus musculus
tcttaaggggtggtactgtgcagta

SEQ ID NO: 302666 - DNA, 25 bp, Mus musculus
agcacttaagggctcacggccggga

SEQ ID NO: 302667 - DNA, 25 bp, Mus musculus
tcagcacagcgctagtggcgcgatc

SEQ ID NO: 302668 - DNA, 25 bp, Mus musculus
gatcggaatggaaccaggggccacc

SEQ ID NO: 302669 - DNA, 25 bp, Mus musculus
cagcggggactgagcatcaagaatc

SEQ ID NO: 302670 - DNA, 25 bp, Mus musculus
agcatcaagaatcgtccagagactg

SEQ ID NO: 302671 - DNA, 25 bp, Mus musculus
ccctctggcgtacatgttgagcctc

SEQ ID NO: 302672 - DNA, 25 bp, Mus musculus
tgttgagcctctaccgagacccgct

SEQ ID NO: 302673 - DNA, 25 bp, Mus musculus
tccagagactgggattaattgtttc

SEQ ID NO: 302674 - DNA, 25 bp, Mus musculus
ccgcagcctccaggcgcaaggtagg

SEQ ID NO: 302675 - DNA, 25 bp, Mus musculus
tggcctcgccagcacttaagggctc

SEQ ID NO: 302676 - DNA, 25 bp, Mus musculus
tctccgtgggcaggctcagcacagc

SEQ ID NO: 302677 - DNA, 25 bp, Mus musculus
gggattaattgtttctccgtgggca

SEQ ID NO: 302678 - DNA, 25 bp, Mus musculus
cggccgctttgcctctgtggacacg

SEQ ID NO: 302679 - DNA, 25 bp, Mus musculus
caaggtaggctgcaagcctggcctc

SEQ ID NO: 302680 - DNA, 25 bp, Mus musculus
gaaggacgcgtaggttgtactcacc

SEQ ID NO: 302681 - DNA, 25 bp, Mus musculus
accgccggagaagcgattcgcgcgg

SEQ ID NO: 302682 - DNA, 25 bp, Mus musculus
gtacgtcatcagagagcgccaccgc

SEQ ID NO: 302683 - DNA, 25 bp, Mus musculus
tcgttgtacgtcatcagagagcgcc

SEQ ID NO: 302684 - DNA, 25 bp, Mus musculus
cgcgcgctcgttgtacgtcatcaga

SEQ ID NO: 302685 - DNA, 25 bp, Mus musculus
agagacccacgagtccttggcgcgc

SEQ ID NO: 302686 - DNA, 25 bp, Mus musculus
cgtaggttgtactcacctgaagccc

SEQ ID NO: 302687 - DNA, 25 bp, Mus musculus
tcaggaagcgaactcagggaaggac

SEQ ID NO: 302688 - DNA, 25 bp, Mus musculus
tggaaccgcatcaggaagcgaactc

SEQ ID NO: 302689 - DNA, 25 bp, Mus musculus
aatgtgtgagcaatggaaccgcatc

SEQ ID NO: 302690 - DNA, 25 bp, Mus musculus
ctggattcggtttgaatgtgtgagc

SEQ ID NO: 302691 - DNA, 25 bp, Mus musculus
cgcggcctggattcggtttgaatgt

SEQ ID NO: 302692 - DNA, 25 bp, Mus musculus
ctaatggggaaaacgacgcggcctg

SEQ ID NO: 302693 - DNA, 25 bp, Mus musculus
tttgcgccagagacccacgagtcct

SEQ ID NO: 302694 - DNA, 25 bp, Mus musculus
ggaaggaaaataaagcctcagcgcc

SEQ ID NO: 302695 - DNA, 25 bp, Mus musculus
tctgggccgcttacgccgcgcgtga

SEQ ID NO: 302696 - DNA, 25 bp, Mus musculus
tgccaagctttcctgttaacgagtt

SEQ ID NO: 302697 - DNA, 25 bp, Mus musculus
tgctgccctgccaagctttcctgtt

SEQ ID NO: 302698 - DNA, 25 bp, Mus musculus
agaaccttggcatttgctgccctgc

SEQ ID NO: 302699 - DNA, 25 bp, Mus musculus
gactctcagttcttccagaaccttg

SEQ ID NO: 302700 - DNA, 25 bp, Mus musculus
aataaagcctcagcgcctaacgacg

SEQ ID NO: 302701 - DNA, 25 bp, Mus musculus
ttctttggccaagtcgggccgaggc

SEQ ID NO: 302702 - DNA, 25 bp, Mus musculus
cccgaactggtgacacatccttctt

SEQ ID NO: 302703 - DNA, 25 bp, Mus musculus
tcggtcgcccgatacctttgtttca

SEQ ID NO: 302704 - DNA, 25 bp, Mus musculus
tgaggtgctcgcagctcagccactc

SEQ ID NO: 302705 - DNA, 25 bp, Mus musculus
gcccgatacctttgtttcaggtgcc

SEQ ID NO: 302706 - DNA, 25 bp, Mus musculus
gcgcctaacgacgtgactctcagtt

SEQ ID NO: 302707 - DNA, 25 bp, Mus musculus
ggtgacacatccttctttggccaag

SEQ ID NO: 302708 - DNA, 25 bp, Mus musculus
ccctgctccaaagctcagaaggcga

SEQ ID NO: 302709 - DNA, 25 bp, Mus musculus
gatgagtttaagcaccgccagcact

SEQ ID NO: 302710 - DNA, 25 bp, Mus musculus
ttgctgtccctggaagattgcaacc

SEQ ID NO: 302711 - DNA, 25 bp, Mus musculus
cccggcagcttctagggctgatttc

SEQ ID NO: 302712 - DNA, 25 bp, Mus musculus
gcagtcacttgctggggtactagta

SEQ ID NO: 302713 - DNA, 25 bp, Mus musculus
tccggaaacctcagactgcgaaagg

SEQ ID NO: 302714 - DNA, 25 bp, Mus musculus
cttcgcccagagctaaggagcttgc

SEQ ID NO: 302715 - DNA, 25 bp, Mus musculus
ccaggctctctaagccggagatgtc

SEQ ID NO: 302716 - DNA, 25 bp, Mus musculus
actctgcgtgcgaacgaacctgctg

SEQ ID NO: 302717 - DNA, 25 bp, Mus musculus
cccaggatcggtgacattctctctc

SEQ ID NO: 302718 - DNA, 25 bp, Mus musculus
ccaccaagttgctccgcgaagggta

SEQ ID NO: 302719 - DNA, 25 bp, Mus musculus
gagcagcaagcaatccagggccatc

SEQ ID NO: 302720 - DNA, 25 bp, Mus musculus
cgaggtatcgcttcccagaccagct

SEQ ID NO: 302721 - DNA, 25 bp, Mus musculus
gcagccacgcagtctcttctaactg

SEQ ID NO: 302722 - DNA, 25 bp, Mus musculus
ttcaaaggtgacttagaggcacttc

SEQ ID NO: 302723 - DNA, 25 bp, Mus musculus
gacagcaacgctgtggccatcgaca

SEQ ID NO: 302724 - DNA, 25 bp, Mus musculus
tctaatggtgaatttggcagagtca

SEQ ID NO: 302725 - DNA, 25 bp, Mus musculus
ggcacttcaggaggatagcgccctc

SEQ ID NO: 302726 - DNA, 25 bp, Mus musculus
agagtcagcgaaactgcgcccggcg

SEQ ID NO: 302727 - DNA, 25 bp, Mus musculus
acggggccatttgcagcctaggcag

SEQ ID NO: 302728 - DNA, 25 bp, Mus musculus
ggcaccatggagctgaagaaggaca

SEQ ID NO: 302729 - DNA, 25 bp, Mus musculus
tgtggccatcgacatgctgctcatc

SEQ ID NO: 302730 - DNA, 25 bp, Mus musculus
tgctgctcatcgtgcactccgagaa

SEQ ID NO: 302731 - DNA, 25 bp, Mus musculus
cgctgctgcaaaaccgaggaggtaa

SEQ ID NO: 302732 - DNA, 25 bp, Mus musculus
gggtcctcagaatccctgggcacct

SEQ ID NO: 302733 - DNA, 25 bp, Mus musculus
cgaggctaatccgaacctctccgaa

SEQ ID NO: 302734 - DNA, 25 bp, Mus musculus
cagggcacctgcgttccttggcaac

SEQ ID NO: 302735 - DNA, 25 bp, Mus musculus
gcagcctaggcagcctcgcgagcag

SEQ ID NO: 302736 - DNA, 25 bp, Mus musculus
cggccagcccagagtcccataggga

SEQ ID NO: 302737 - DNA, 25 bp, Mus musculus
atggtggcctccgagggccatttta

SEQ ID NO: 302738 - DNA, 25 bp, Mus musculus
ctgtagtgtcccaggatggtggcct

SEQ ID NO: 302739 - DNA, 25 bp, Mus musculus
cctcgaaccggaagtcgctgcagcg

SEQ ID NO: 302740 - DNA, 25 bp, Mus musculus
tgcacttccgcatgtagtatcctcc

SEQ ID NO: 302741 - DNA, 25 bp, Mus musculus
cacttctttactgcacgctgtgcgg

SEQ ID NO: 302742 - DNA, 25 bp, Mus musculus
cggctaacgctaaggcctggtccta

SEQ ID NO: 302743 - DNA, 25 bp, Mus musculus
accgagcttcagagccacttcttta

SEQ ID NO: 302744 - DNA, 25 bp, Mus musculus
ggccggtactttcaaccgagcttca

SEQ ID NO: 302745 - DNA, 25 bp, Mus musculus
gtggccaagcgttcgccctcgaact

SEQ ID NO: 302746 - DNA, 25 bp, Mus musculus
tggactcacccacatccggggcttg

SEQ ID NO: 302747 - DNA, 25 bp, Mus musculus
ggatgcgcgcaagtcacaacaaatc

SEQ ID NO: 302748 - DNA, 25 bp, Mus musculus
gagaccgcaccacagttagccgcag

SEQ ID NO: 302749 - DNA, 25 bp, Mus musculus
ccattttagtgtaggcgccgtgctc

SEQ ID NO: 302750 - DNA, 25 bp, Mus musculus
tcaggcgaggccgtgtgtctcaatg

SEQ ID NO: 302751 - DNA, 25 bp, Mus musculus
gccggcctggccttctacgtgcaat

SEQ ID NO: 302752 - DNA, 25 bp, Mus musculus
tgcaatccaccgcttgcaagaaggg

SEQ ID NO: 302753 - DNA, 25 bp, Mus musculus
tacgtgcaatccaccgcttgcaaga

SEQ ID NO: 302754 - DNA, 25 bp, Mus musculus
caacgtccaggaggctgagagctca

SEQ ID NO: 302755 - DNA, 25 bp, Mus musculus
agggtctgcgcccacaggtccatgg

SEQ ID NO: 302756 - DNA, 25 bp, Mus musculus
tctgcgcccacaggtccatggctgt

SEQ ID NO: 302757 - DNA, 25 bp, Mus musculus
ccacaggtccatggctgtgggtcgc

SEQ ID NO: 302758 - DNA, 25 bp, Mus musculus
ggcctggccttctacgtgcaatcca

SEQ ID NO: 302759 - DNA, 25 bp, Mus musculus
ccaccgcttgcaagaagggcgagta

SEQ ID NO: 302760 - DNA, 25 bp, Mus musculus
cgcttgcaagaagggcgagtacaac

SEQ ID NO: 302761 - DNA, 25 bp, Mus musculus
tgcaagaagggcgagtacaacgtcc

SEQ ID NO: 302762 - DNA, 25 bp, Mus musculus
agaagggcgagtacaacgtccagga

SEQ ID NO: 302763 - DNA, 25 bp, Mus musculus
gcgagtacaacgtccaggaggctga

SEQ ID NO: 302764 - DNA, 25 bp, Mus musculus
gtgcacgaatgtgcccaggagccca

SEQ ID NO: 302765 - DNA, 25 bp, Mus musculus
agctagagatcttttcaccctggca

SEQ ID NO: 302766 - DNA, 25 bp, Mus musculus
cgccatctgtcgtctgaacgccatt

SEQ ID NO: 302767 - DNA, 25 bp, Mus musculus
tgaacgccattgtcagcagccacgc

SEQ ID NO: 302768 - DNA, 25 bp, Mus musculus
gcgtcctggacgacacccaagggga

SEQ ID NO: 302769 - DNA, 25 bp, Mus musculus
tcgttcgcggtggagaattatctca

SEQ ID NO: 302770 - DNA, 25 bp, Mus musculus
cgttcgttcgcggtggagaattatc

SEQ ID NO: 302771 - DNA, 25 bp, Mus musculus
tctgctggcgcgtggccgagtaccc

SEQ ID NO: 302772 - DNA, 25 bp, Mus musculus
aatcggctctcctctgctggcgcgt

SEQ ID NO: 302773 - DNA, 25 bp, Mus musculus
acagtaatcggctctcctctgctgg

SEQ ID NO: 302774 - DNA, 25 bp, Mus musculus
ggaccaatgccgcacagtaatcggc

SEQ ID NO: 302775 - DNA, 25 bp, Mus musculus
aggagcccagagctcccgtagcggg

SEQ ID NO: 302776 - DNA, 25 bp, Mus musculus
ggtggagaattatctcattgttccc

SEQ ID NO: 302777 - DNA, 25 bp, Mus musculus
tgctgagcgtgtgcacgaatgtgcc

SEQ ID NO: 302778 - DNA, 25 bp, Mus musculus
gcgcgtttcagcctggcaaacaacg

SEQ ID NO: 302779 - DNA, 25 bp, Mus musculus
gcgtttcagcctggcaaacaacgta

SEQ ID NO: 302780 - DNA, 25 bp, Mus musculus
tttcagcctggcaaacaacgtaatg

SEQ ID NO: 302781 - DNA, 25 bp, Mus musculus
ttcagcctggcaaacaacgtaatgt

SEQ ID NO: 302782 - DNA, 25 bp, Mus musculus
cagcctggcaaacaacgtaatgtta

SEQ ID NO: 302783 - DNA, 25 bp, Mus musculus
gcctggcaaacaacgtaatgttatt

SEQ ID NO: 302784 - DNA, 25 bp, Mus musculus
ggcaaacaacgtaatgttatttata

SEQ ID NO: 302785 - DNA, 25 bp, Mus musculus
aggtctgagacgctctcccgtgcac

SEQ ID NO: 302786 - DNA, 25 bp, Mus musculus
ggtctgagacgctctcccgtgcacg

SEQ ID NO: 302787 - DNA, 25 bp, Mus musculus
agacgctctcccgtgcacgcgcgcc

SEQ ID NO: 302788 - DNA, 25 bp, Mus musculus
cagaaccaggcgctctcggtcgggc

SEQ ID NO: 302789 - DNA, 25 bp, Mus musculus
aggcgctctcggtcgggcggcacat

SEQ ID NO: 302790 - DNA, 25 bp, Mus musculus
gtcgggcggcacatgcgtgcgcgcc

SEQ ID NO: 302791 - DNA, 25 bp, Mus musculus
cgcacgcgcgcgtctccgcccgcag

SEQ ID NO: 302792 - DNA, 25 bp, Mus musculus
cgggccgaccggatcccaagcatcg

SEQ ID NO: 302793 - DNA, 25 bp, Mus musculus
cctgcacaccttcgggccgaccgga

SEQ ID NO: 302794 - DNA, 25 bp, Mus musculus
tgtggcatcctgcacaccttcgggc

SEQ ID NO: 302795 - DNA, 25 bp, Mus musculus
gttgtgtggcatcctgcacaccttc

SEQ ID NO: 302796 - DNA, 25 bp, Mus musculus
cgcttgctttctggttagcgagtgg

SEQ ID NO: 302797 - DNA, 25 bp, Mus musculus
cgtgcgcttgctttctggttagcga

SEQ ID NO: 302798 - DNA, 25 bp, Mus musculus
ccgccgtgcgcttgctttctggtta

SEQ ID NO: 302799 - DNA, 25 bp, Mus musculus
gggtggccgctccttagcctgctgt

SEQ ID NO: 302800 - DNA, 25 bp, Mus musculus
agctccggagcctcggagtcggcgc

SEQ ID NO: 302801 - DNA, 25 bp, Mus musculus
cctgcgcgtgtcactctaggccgcg

SEQ ID NO: 302802 - DNA, 25 bp, Mus musculus
tgcagcctccctgcgcgtgtcactc

SEQ ID NO: 302803 - DNA, 25 bp, Mus musculus
tgagcctctacctgagcgaggacga

SEQ ID NO: 302804 - DNA, 25 bp, Mus musculus
ccagcgtgagcctctacctgagcga

SEQ ID NO: 302805 - DNA, 25 bp, Mus musculus
ggacccagcgtgagcctctacctga

SEQ ID NO: 302806 - DNA, 25 bp, Mus musculus
acttataaaaacttctgggcgctca

SEQ ID NO: 302807 - DNA, 25 bp, Mus musculus
cgctgaagcctgaagcacccaagtc

SEQ ID NO: 302808 - DNA, 25 bp, Mus musculus
aggggacgtcgcctcagtcacgatg

SEQ ID NO: 302809 - DNA, 25 bp, Mus musculus
gtcacgatggggctcctgcccaagc

SEQ ID NO: 302810 - DNA, 25 bp, Mus musculus
gttgctcccgctcggtcttcaacaa

SEQ ID NO: 302811 - DNA, 25 bp, Mus musculus
ttcaacaacattaaggtgagtagtg

SEQ ID NO: 302812 - DNA, 25 bp, Mus musculus
agtgttgtgagtagtgttcgtgttc

SEQ ID NO: 302813 - DNA, 25 bp, Mus musculus
agtgggtgacacaacctaggacgtc

SEQ ID NO: 302814 - DNA, 25 bp, Mus musculus
acctaggacgtcgatgaggccagtc

SEQ ID NO: 302815 - DNA, 25 bp, Mus musculus
ccagtccgggagctctgggttgcac

SEQ ID NO: 302816 - DNA, 25 bp, Mus musculus
agagagcgcgtttcatcatcgctgc

SEQ ID NO: 302817 - DNA, 25 bp, Mus musculus
catcgctgccacttataaaaacttc

SEQ ID NO: 302818 - DNA, 25 bp, Mus musculus
caggacccaagacacctgcctgggg

SEQ ID NO: 302819 - DNA, 25 bp, Mus musculus
gcacctctgacacccgaggaagaga

SEQ ID NO: 302820 - DNA, 25 bp, Mus musculus
agctgccagcaccatgtccgcaggg

SEQ ID NO: 302821 - DNA, 25 bp, Mus musculus
ccacgggctccgcatgacatcagag

SEQ ID NO: 302822 - DNA, 25 bp, Mus musculus
ggctccgcatgacatcagaggcttg

SEQ ID NO: 302823 - DNA, 25 bp, Mus musculus
catgacatcagaggcttgggagcgc

SEQ ID NO: 302824 - DNA, 25 bp, Mus musculus
gcccgtgcagccaacgccacccagg

SEQ ID NO: 302825 - DNA, 25 bp, Mus musculus
tgggaacccgctgcgaaaattcaag

SEQ ID NO: 302826 - DNA, 25 bp, Mus musculus
tcaagttggttttcctaggggagca

SEQ ID NO: 302827 - DNA, 25 bp, Mus musculus
agcggtgagtactcggcttattctc

SEQ ID NO: 302828 - DNA, 25 bp, Mus musculus
tcggcttattctctcggctcggagc

SEQ ID NO: 302829 - DNA, 25 bp, Mus musculus
tctcggctcggagccgagtcttttc

SEQ ID NO: 302830 - DNA, 25 bp, Mus musculus
gccctggctcgccaaggcccttcca

SEQ ID NO: 302831 - DNA, 25 bp, Mus musculus
ggctcgctgactagctcgcactgcg

SEQ ID NO: 302832 - DNA, 25 bp, Mus musculus
ctcgcactgcggcacaggctgcgga

SEQ ID NO: 302833 - DNA, 25 bp, Mus musculus
cccgctgcgaaaattcaagttggtt

SEQ ID NO: 302834 - DNA, 25 bp, Mus musculus
cggtccgtcgctgaagactaacgtg

SEQ ID NO: 302835 - DNA, 25 bp, Mus musculus
ctaacgtggagatggcgagaaaacc

SEQ ID NO: 302836 - DNA, 25 bp, Mus musculus
cgagaaaacctgtagttcacccatg

SEQ ID NO: 302837 - DNA, 25 bp, Mus musculus
ttcacccatggagttcaggacgcgg

SEQ ID NO: 302838 - DNA, 25 bp, Mus musculus
caagcggtcccgttgattaaagtca

SEQ ID NO: 302839 - DNA, 25 bp, Mus musculus
tcaaagctcagtacaggaggctggg

SEQ ID NO: 302840 - DNA, 25 bp, Mus musculus
tacggaaccgcaccggacgtagcga

SEQ ID NO: 302841 - DNA, 25 bp, Mus musculus
acgtagcgaagtcgccgtctctggt

SEQ ID NO: 302842 - DNA, 25 bp, Mus musculus
gagccgacactcttacttccaggga

SEQ ID NO: 302843 - DNA, 25 bp, Mus musculus
cgcctagcagcgcatctctagattt

SEQ ID NO: 302844 - DNA, 25 bp, Mus musculus
ctctagattttgtcccgcagcgcgc

SEQ ID NO: 302845 - DNA, 25 bp, Mus musculus
cgccttccctcaaggagtggtgtca

SEQ ID NO: 302846 - DNA, 25 bp, Mus musculus
gtggtgtcacccgaaccgtagcaaa

SEQ ID NO: 302847 - DNA, 25 bp, Mus musculus
gcaaaagtcctacgacctctatggg

SEQ ID NO: 302848 - DNA, 25 bp, Mus musculus
accgccacggagagcagcgtcggat

SEQ ID NO: 302849 - DNA, 25 bp, Mus musculus
ttacgtggctctaggctccacgccg

SEQ ID NO: 302850 - DNA, 25 bp, Mus musculus
gggccgccaaagttacgtggctcta

SEQ ID NO: 302851 - DNA, 25 bp, Mus musculus
catgaaagaggtgtgtagtcttccc

SEQ ID NO: 302852 - DNA, 25 bp, Mus musculus
ttcgccgaagccatgaaagaggtgt

SEQ ID NO: 302853 - DNA, 25 bp, Mus musculus
ccaactcgccgggtgttcgccgaag

SEQ ID NO: 302854 - DNA, 25 bp, Mus musculus
agcgtcggatccctctgctgcagct

SEQ ID NO: 302855 - DNA, 25 bp, Mus musculus
ccaggagagccaccgccacggagag

SEQ ID NO: 302856 - DNA, 25 bp, Mus musculus
tagtagaagagggaacgcagccgtc

SEQ ID NO: 302857 - DNA, 25 bp, Mus musculus
ccacactgctgggtctggaagacga

SEQ ID NO: 302858 - DNA, 25 bp, Mus musculus
gcctcatgtaagtcctgtcccaaga

SEQ ID NO: 302859 - DNA, 25 bp, Mus musculus
agggccgcctcatgtaagtcctgtc

SEQ ID NO: 302860 - DNA, 25 bp, Mus musculus
gctgcagctcctgtcgtaaggagtc

SEQ ID NO: 302861 - DNA, 25 bp, Mus musculus
tgtcccaagacccaggtcacttcag

SEQ ID NO: 302862 - DNA, 25 bp, Mus musculus
gcaccgtcaggagaactcgccactg

SEQ ID NO: 302863 - DNA, 25 bp, Mus musculus
aaatcttgcgggctgtgggtacccg

SEQ ID NO: 302864 - DNA, 25 bp, Mus musculus
tcgttaacttaggagcaaatcttgc

SEQ ID NO: 302865 - DNA, 25 bp, Mus musculus
ggctgcttgcgttcagagttcgtta

SEQ ID NO: 302866 - DNA, 25 bp, Mus musculus
tgcacgaccttgcacggtggctgct

SEQ ID NO: 302867 - DNA, 25 bp, Mus musculus
ctccacctaggtgagcgagcttcgg

SEQ ID NO: 302868 - DNA, 25 bp, Mus musculus
ttctgcagcgttagcttcgggttgg

SEQ ID NO: 302869 - DNA, 25 bp, Mus musculus
cttcctccggaagaggtgtggcgtc

SEQ ID NO: 302870 - DNA, 25 bp, Mus musculus
tctcgggaaagcgtgcccaaggacc

SEQ ID NO: 302871 - DNA, 25 bp, Mus musculus
ccgcagccgaaactgttgccgcaaa

SEQ ID NO: 302872 - DNA, 25 bp, Mus musculus
acgaacgatgagctgcgccgcagcc

SEQ ID NO: 302873 - DNA, 25 bp, Mus musculus
gcaggccctcgccacgaacgatgag

SEQ ID NO: 302874 - DNA, 25 bp, Mus musculus
acttaaggctgatcggtccggccgc

SEQ ID NO: 302875 - DNA, 25 bp, Mus musculus
tctgcacgttctggacttaaggctg

SEQ ID NO: 302876 - DNA, 25 bp, Mus musculus
aaggaaggcgcgcaccggcgagcgc

SEQ ID NO: 302877 - DNA, 25 bp, Mus musculus
taacgacggcgcgtgcgggaggaag

SEQ ID NO: 302878 - DNA, 25 bp, Mus musculus
gcgagcgctcggctaacgacggcgc

SEQ ID NO: 302879 - DNA, 25 bp, Mus musculus
cgcctgcgcgctcggttccgcccgc

SEQ ID NO: 302880 - DNA, 25 bp, Mus musculus
gtacgttcctcgctgggaaccgcga

SEQ ID NO: 302881 - DNA, 25 bp, Mus musculus
tggtggtacgttcctcgctgggaac

SEQ ID NO: 302882 - DNA, 25 bp, Mus musculus
gtgctctggtggtacgttcctcgct

SEQ ID NO: 302883 - DNA, 25 bp, Mus musculus
agctctgggtcaaggccggctgtgc

SEQ ID NO: 302884 - DNA, 25 bp, Mus musculus
tgcgaagcccgagtcacgtggcctc

SEQ ID NO: 302885 - DNA, 25 bp, Mus musculus
ccgacgtgcgaagcccgagtcacgt

SEQ ID NO: 302886 - DNA, 25 bp, Mus musculus
ggccgacgtgcgaagcccgagtcac

SEQ ID NO: 302887 - DNA, 25 bp, Mus musculus
gactcgggcacacgtcacccgggga

SEQ ID NO: 302888 - DNA, 25 bp, Mus musculus
aggactcgggcacacgtcacccggg

SEQ ID NO: 302889 - DNA, 25 bp, Mus musculus
tcccgaccctcaccttcgttatggc

SEQ ID NO: 302890 - DNA, 25 bp, Mus musculus
caccggattagttcgggtctcaagg

SEQ ID NO: 302891 - DNA, 25 bp, Mus musculus
gggttcggttgctacctagtagagc

SEQ ID NO: 302892 - DNA, 25 bp, Mus musculus
ggtcacgtggcctcacaagccaatc

SEQ ID NO: 302893 - DNA, 25 bp, Mus musculus
aaccaatcgtgtcgcgtggacagcc

SEQ ID NO: 302894 - DNA, 25 bp, Mus musculus
tcagcgtccgcgagaaccaatcgtg

SEQ ID NO: 302895 - DNA, 25 bp, Mus musculus
tgggctgcatcctccctagtgcagg

SEQ ID NO: 302896 - DNA, 25 bp, Mus musculus
ccaaggctcggagactagcgaatgc

SEQ ID NO: 302897 - DNA, 25 bp, Mus musculus
ggtcccactgcatggaagccacctt

SEQ ID NO: 302898 - DNA, 25 bp, Mus musculus
cccgcatcgaggcagaagaatcatc

SEQ ID NO: 302899 - DNA, 25 bp, Mus musculus
gtctcaagggctcgaaccaaagtga

SEQ ID NO: 302900 - DNA, 25 bp, Mus musculus
cgcttctctcgcagtcaccggatta

SEQ ID NO: 302901 - DNA, 25 bp, Mus musculus
ctgagtcccttatttccgcggatga

SEQ ID NO: 302902 - DNA, 25 bp, Mus musculus
tcgttctcctatgcgacaggtccca

SEQ ID NO: 302903 - DNA, 25 bp, Mus musculus
tcagctgcgctatgaattccgcttc

SEQ ID NO: 302904 - DNA, 25 bp, Mus musculus
ctggccacgctcctctctgattttg

SEQ ID NO: 302905 - DNA, 25 bp, Mus musculus
gaggccaagctggacacggagaaca

SEQ ID NO: 302906 - DNA, 25 bp, Mus musculus
aaccaggagttgctgtccatgggcc

SEQ ID NO: 302907 - DNA, 25 bp, Mus musculus
atcttccgggtcagcaagaaccagg

SEQ ID NO: 302908 - DNA, 25 bp, Mus musculus
ttcgagcggctcaagaaagagtatg

SEQ ID NO: 302909 - DNA, 25 bp, Mus musculus
tctgtgcccgagctagagtatgcgg

SEQ ID NO: 302910 - DNA, 25 bp, Mus musculus
gcttcaagtccaccggctcgtctgt

SEQ ID NO: 302911 - DNA, 25 bp, Mus musculus
tctagttgccacgttacgcccttct

SEQ ID NO: 302912 - DNA, 25 bp, Mus musculus
ggcatcatgggcacagcctcgtcgc

SEQ ID NO: 302913 - DNA, 25 bp, Mus musculus
acagcctcgtcgctggtgagtccca

SEQ ID NO: 302914 - DNA, 25 bp, Mus musculus
tgcgagatcccggtggaagtgaaac

SEQ ID NO: 302915 - DNA, 25 bp, Mus musculus
gaagtgaaacccaaggcccgcctgc

SEQ ID NO: 302916 - DNA, 25 bp, Mus musculus
ctgctgggcgccagcttcaagtcca

SEQ ID NO: 302917 - DNA, 25 bp, Mus musculus
aggaaactgagacccgagcgcaccg

SEQ ID NO: 302918 - DNA, 25 bp, Mus musculus
cccagggataaaacggagcatgaga

SEQ ID NO: 302919 - DNA, 25 bp, Mus musculus
ccagaagttcctgccggcgcgtcaa

SEQ ID NO: 302920 - DNA, 25 bp, Mus musculus
agcctgtgccgcctccatgcccact

SEQ ID NO: 302921 - DNA, 25 bp, Mus musculus
agagtctcgcgccacgcacctgata

SEQ ID NO: 302922 - DNA, 25 bp, Mus musculus
ataaaacggagcatgagagaggcga

SEQ ID NO: 302923 - DNA, 25 bp, Mus musculus
ggcgcgtcaagtctccagcctgtgc

SEQ ID NO: 302924 - DNA, 25 bp, Mus musculus
acaaggtggcgccagaagttcctgc

SEQ ID NO: 302925 - DNA, 25 bp, Mus musculus
tccagacaaggtggcgccagaagtt

SEQ ID NO: 302926 - DNA, 25 bp, Mus musculus
agcgactcggtgtccagacaaggtg

SEQ ID NO: 302927 - DNA, 25 bp, Mus musculus
cgactcttccggagcgactcggtgt

SEQ ID NO: 302928 - DNA, 25 bp, Mus musculus
tgaggcatctcagggctccaggctc

SEQ ID NO: 302929 - DNA, 25 bp, Mus musculus
cctgatattgggagtgaggcatctc

SEQ ID NO: 302930 - DNA, 25 bp, Mus musculus
cgccacgcacctgatattgggagtg

SEQ ID NO: 302931 - DNA, 25 bp, Mus musculus
catgcccactgtgggcccagctgtg

SEQ ID NO: 302932 - DNA, 25 bp, Mus musculus
aggctcccagtaagacacgtctccg

SEQ ID NO: 302933 - DNA, 25 bp, Mus musculus
tcatctcctggatgcgggtccggcc

SEQ ID NO: 302934 - DNA, 25 bp, Mus musculus
cggctgaatccctcgcgcggagcgt

SEQ ID NO: 302935 - DNA, 25 bp, Mus musculus
ccgtcatggatcacctgtagggatt

SEQ ID NO: 302936 - DNA, 25 bp, Mus musculus
ttggaatccaacacctcgtcgctca

SEQ ID NO: 302937 - DNA, 25 bp, Mus musculus
gctccaccgagtcggccatggctgg

SEQ ID NO: 302938 - DNA, 25 bp, Mus musculus
ctcgctgggcccacgaagcgcagga

SEQ ID NO: 302939 - DNA, 25 bp, Mus musculus
aggaacagacacagccttccaggtc

SEQ ID NO: 302940 - DNA, 25 bp, Mus musculus
ttccaggtccagacaccggcgaagc

SEQ ID NO: 302941 - DNA, 25 bp, Mus musculus
gcaggaggccggctgaatccctcgc

SEQ ID NO: 302942 - DNA, 25 bp, Mus musculus
cggctccaaggctcccagtaagaca

SEQ ID NO: 302943 - DNA, 25 bp, Mus musculus
atcacctgtagggattggaatccaa

SEQ ID NO: 302944 - DNA, 25 bp, Mus musculus
cagacaccggcgaagcggctccaag

SEQ ID NO: 302945 - DNA, 25 bp, Mus musculus
tcgtcgctcatctcctggatgcggg

SEQ ID NO: 302946 - DNA, 25 bp, Mus musculus
aggcggctttaccttcgcaggaggc

SEQ ID NO: 302947 - DNA, 25 bp, Mus musculus
ggaaggaagcaggaccgctaaccta

SEQ ID NO: 302948 - DNA, 25 bp, Mus musculus
taagaaaaccggaggcgccggcatc

SEQ ID NO: 302949 - DNA, 25 bp, Mus musculus
gccggcatccaggagggaatcccga

SEQ ID NO: 302950 - DNA, 25 bp, Mus musculus
atccctggacggaggatcgcggctt

SEQ ID NO: 302951 - DNA, 25 bp, Mus musculus
ccttggcccaagcagaaggcgaggc

SEQ ID NO: 302952 - DNA, 25 bp, Mus musculus
atcgcggcttcagcaggttcgagcc

SEQ ID NO: 302953 - DNA, 25 bp, Mus musculus
cgtgcgcttagcgaaagagagcctt

SEQ ID NO: 302954 - DNA, 25 bp, Mus musculus
aagcggcatcgcagaaacccagagc

SEQ ID NO: 302955 - DNA, 25 bp, Mus musculus
cgttccgcctctcgggaagtacgcg

SEQ ID NO: 302956 - DNA, 25 bp, Mus musculus
gccgtcacgagaccctgtcagctga

SEQ ID NO: 302957 - DNA, 25 bp, Mus musculus
ccggctccacgtcttgagtaggatg

SEQ ID NO: 302958 - DNA, 25 bp, Mus musculus
ttccaccaggcttgcgagcgctgaa

SEQ ID NO: 302959 - DNA, 25 bp, Mus musculus
ggttcgagccacacacagcagctta

SEQ ID NO: 302960 - DNA, 25 bp, Mus musculus
ccacttccatgccgggttggaggct

SEQ ID NO: 302961 - DNA, 25 bp, Mus musculus
ttttcctccgcggagggcattggcg

SEQ ID NO: 302962 - DNA, 25 bp, Mus musculus
ctggcgcaggctggcgcccgggtgc

SEQ ID NO: 302963 - DNA, 25 bp, Mus musculus
cggccacttccatgccgggttggag

SEQ ID NO: 302964 - DNA, 25 bp, Mus musculus
ggaggtgtcgcgagccgagccctgc

SEQ ID NO: 302965 - DNA, 25 bp, Mus musculus
cttgctgaaagctccgcggcggcgc

SEQ ID NO: 302966 - DNA, 25 bp, Mus musculus
gacttgctgaaagctccgcggcggc

SEQ ID NO: 302967 - DNA, 25 bp, Mus musculus
gttggggacttgctgaaagctccgc

SEQ ID NO: 302968 - DNA, 25 bp, Mus musculus
ctgctgtcccaggcctactacgaac

SEQ ID NO: 302969 - DNA, 25 bp, Mus musculus
gcattggcggacaaacggcgtgact

SEQ ID NO: 302970 - DNA, 25 bp, Mus musculus
ctgtgcttttcctccgcggagggca

SEQ ID NO: 302971 - DNA, 25 bp, Mus musculus
accggaagtggcccggctgtgcttt

SEQ ID NO: 302972 - DNA, 25 bp, Mus musculus
cgctttgagaaacggaccggaagtg

SEQ ID NO: 302973 - DNA, 25 bp, Mus musculus
ttggcggacaaacggcgtgactgct

SEQ ID NO: 302974 - DNA, 25 bp, Mus musculus
gcgcgtccacgaagccgccagggaa

SEQ ID NO: 302975 - DNA, 25 bp, Mus musculus
gttcttgcagaggccagcgcctcgg

SEQ ID NO: 302976 - DNA, 25 bp, Mus musculus
agctgcggtagtcagagcgttcaac

SEQ ID NO: 302977 - DNA, 25 bp, Mus musculus
gcgttcaacgcggaaggcagacatc

SEQ ID NO: 302978 - DNA, 25 bp, Mus musculus
gaaggcagacatcgcttcgcccagc

SEQ ID NO: 302979 - DNA, 25 bp, Mus musculus
agctcctcgcgcagttcccggttca

SEQ ID NO: 302980 - DNA, 25 bp, Mus musculus
ccggttcagcccgtcctccaggcag

SEQ ID NO: 302981 - DNA, 25 bp, Mus musculus
cctccaggcagctgtcctgcgcgtc

SEQ ID NO: 302982 - DNA, 25 bp, Mus musculus
aggcgcccgtcaaagcgcatctgca

SEQ ID NO: 302983 - DNA, 25 bp, Mus musculus
caccagcacggcgaagcgcatcggg

SEQ ID NO: 302984 - DNA, 25 bp, Mus musculus
aagcgcatcgggatgcggccgaaca

SEQ ID NO: 302985 - DNA, 25 bp, Mus musculus
ggcctcgctgagctccactttccga

SEQ ID NO: 302986 - DNA, 25 bp, Mus musculus
tccatctcgaggctcgcacttccgg

SEQ ID NO: 302987 - DNA, 25 bp, Mus musculus
agcggccgtgcatgacgcgtcctca

SEQ ID NO: 302988 - DNA, 25 bp, Mus musculus
caaatggccggactctaagcgtttc

SEQ ID NO: 302989 - DNA, 25 bp, Mus musculus
ccatgaagatagaggctggccttgc

SEQ ID NO: 302990 - DNA, 25 bp, Mus musculus
cccggaagaagagtccatgaagata

SEQ ID NO: 302991 - DNA, 25 bp, Mus musculus
agacggtaaggtcctggccacattc

SEQ ID NO: 302992 - DNA, 25 bp, Mus musculus
tggccctacggctcaaagacggtaa

SEQ ID NO: 302993 - DNA, 25 bp, Mus musculus
ctcagaaggagaacgcctacccgtg

SEQ ID NO: 302994 - DNA, 25 bp, Mus musculus
cgctctcgccctggagaatggctca

SEQ ID NO: 302995 - DNA, 25 bp, Mus musculus
tcgctgttgtttccctctctgtcca

SEQ ID NO: 302996 - DNA, 25 bp, Mus musculus
tctgcatctcttgccttcgctgttg

SEQ ID NO: 302997 - DNA, 25 bp, Mus musculus
tgcgtgctgactcgcttccttctgc

SEQ ID NO: 302998 - DNA, 25 bp, Mus musculus
ccgaccttggctgcgtgctgactcg

SEQ ID NO: 302999 - DNA, 25 bp, Mus musculus
ctatccgcctggaaggagaggtgca

SEQ ID NO: 303000 - DNA, 25 bp, Mus musculus
ttgggcggatccacgtgcccgctat

SEQ ID NO: 303001 - DNA, 25 bp, Mus musculus
taaaccggttctccgtgtgcgagcg

SEQ ID NO: 303002 - DNA, 25 bp, Mus musculus
tgacgtcgttcgcagcacttcctgt

SEQ ID NO: 303003 - DNA, 25 bp, Mus musculus
cgcggagcgcgtgaatgtatatcga

SEQ ID NO: 303004 - DNA, 25 bp, Mus musculus
agccaggcttcccagtgacgtcgtt

SEQ ID NO: 303005 - DNA, 25 bp, Mus musculus
gagagccctcagcttctcggagcca

SEQ ID NO: 303006 - DNA, 25 bp, Mus musculus
ggcccgaaagcattttctcctccag

SEQ ID NO: 303007 - DNA, 25 bp, Mus musculus
aggaatggctcaacctctcacacca

SEQ ID NO: 303008 - DNA, 25 bp, Mus musculus
cggcgtccaatccaacggaagcgcg

SEQ ID NO: 303009 - DNA, 25 bp, Mus musculus
gaagtcgacgttccggcgtccaatc

SEQ ID NO: 303010 - DNA, 25 bp, Mus musculus
ggttgtttaacatcgtcgccacgga

SEQ ID NO: 303011 - DNA, 25 bp, Mus musculus
tcagcctagagctcgctgcctcgga

SEQ ID NO: 303012 - DNA, 25 bp, Mus musculus
ctgcccgagagatccactttcatta

SEQ ID NO: 303013 - DNA, 25 bp, Mus musculus
tctcccgaaggggaatgcggtccag

SEQ ID NO: 303014 - DNA, 25 bp, Mus musculus
ggagcagggcgcttagtctcccgaa

SEQ ID NO: 303015 - DNA, 25 bp, Mus musculus
agcacttcctgtttccgctcgcggt

SEQ ID NO: 303016 - DNA, 25 bp, Mus musculus
tcacagagtcgcctgggcgctctct

SEQ ID NO: 303017 - DNA, 25 bp, Mus musculus
ggcgctctctgcacagctctggaag

SEQ ID NO: 303018 - DNA, 25 bp, Mus musculus
gcgccctacgggcaagagacgttcc

SEQ ID NO: 303019 - DNA, 25 bp, Mus musculus
ggcacagccattgccgggtcacaga

SEQ ID NO: 303020 - DNA, 25 bp, Mus musculus
tatccagccacacattctgtcgagg

SEQ ID NO: 303021 - DNA, 25 bp, Mus musculus
cgggatagcgactgcccgctttcta

SEQ ID NO: 303022 - DNA, 25 bp, Mus musculus
gcagcagcatctgcaagagaaacca

SEQ ID NO: 303023 - DNA, 25 bp, Mus musculus
tgcgagccctaatggacgtggtcct

SEQ ID NO: 303024 - DNA, 25 bp, Mus musculus
tctggaagtctctccggtctcacgg

SEQ ID NO: 303025 - DNA, 25 bp, Mus musculus
cggcgccacacgtcccgaggagaag

SEQ ID NO: 303026 - DNA, 25 bp, Mus musculus
tccaggctgcgaggactcactcgcg

SEQ ID NO: 303027 - DNA, 25 bp, Mus musculus
gcaggagtagacacccgagtcctcc

SEQ ID NO: 303028 - DNA, 25 bp, Mus musculus
ccctctggacctggaagtttctgga

SEQ ID NO: 303029 - DNA, 25 bp, Mus musculus
gctcctccagggctctcgggatagc

SEQ ID NO: 303030 - DNA, 25 bp, Mus musculus
ggcttcctactgaacgcttcctcaa

SEQ ID NO: 303031 - DNA, 25 bp, Mus musculus
agatctcggacgtgtctgcgctcct

SEQ ID NO: 303032 - DNA, 25 bp, Mus musculus
ccagctctagatctcggacgtgtct

SEQ ID NO: 303033 - DNA, 25 bp, Mus musculus
tgtttgctctcccagttgttcaccc

SEQ ID NO: 303034 - DNA, 25 bp, Mus musculus
agtcccgagtgtgtttgctctccca

SEQ ID NO: 303035 - DNA, 25 bp, Mus musculus
ttcctggacgggcactgtccctgtc

SEQ ID NO: 303036 - DNA, 25 bp, Mus musculus
gtgaagtcgtcttcctggacgggca

SEQ ID NO: 303037 - DNA, 25 bp, Mus musculus
cagcgtttgccgcaggtgaagtcgt

SEQ ID NO: 303038 - DNA, 25 bp, Mus musculus
gctttcccgggagttcagcgtttgc

SEQ ID NO: 303039 - DNA, 25 bp, Mus musculus
gcttccttcccttgtttcctagcaa

SEQ ID NO: 303040 - DNA, 25 bp, Mus musculus
tccgtcacttccgatctcaacagga

SEQ ID NO: 303041 - DNA, 25 bp, Mus musculus
ttgtttcctagcaaccggcttccta

SEQ ID NO: 303042 - DNA, 25 bp, Mus musculus
aaaacattctcctggccggcttccg

SEQ ID NO: 303043 - DNA, 25 bp, Mus musculus
tccgatctcaacaggaagtgaggtc

SEQ ID NO: 303044 - DNA, 25 bp, Mus musculus
ttcgccagttttaagcccacgtatc

SEQ ID NO: 303045 - DNA, 25 bp, Mus musculus
gttcgccaccgagttagagtacatg

SEQ ID NO: 303046 - DNA, 25 bp, Mus musculus
ccgcttgtcgacctgaatagcaatc

SEQ ID NO: 303047 - DNA, 25 bp, Mus musculus
acatagctcccgagcgcttcgttga

SEQ ID NO: 303048 - DNA, 25 bp, Mus musculus
ctcgagaaggaggacatgctacata

SEQ ID NO: 303049 - DNA, 25 bp, Mus musculus
agcccacgtatcttcccgaggacaa

SEQ ID NO: 303050 - DNA, 25 bp, Mus musculus
caccagttggaactgggtcctccta

SEQ ID NO: 303051 - DNA, 25 bp, Mus musculus
tccgccacggagacatcaagacaga

SEQ ID NO: 303052 - DNA, 25 bp, Mus musculus
gcacaaatctggagtccgccacgga

SEQ ID NO: 303053 - DNA, 25 bp, Mus musculus
ggccgtggaccaagcgcacaaatct

SEQ ID NO: 303054 - DNA, 25 bp, Mus musculus
ccttccagatcctgacggccgtgga

SEQ ID NO: 303055 - DNA, 25 bp, Mus musculus
catcgagaagcgctggatcgccttc

SEQ ID NO: 303056 - DNA, 25 bp, Mus musculus
cgcccgttcctaaacaacatcgaga

SEQ ID NO: 303057 - DNA, 25 bp, Mus musculus
caacccagcggatttcaactatttc

SEQ ID NO: 303058 - DNA, 25 bp, Mus musculus
gagcctgagcctgtgatcttctcga

SEQ ID NO: 303059 - DNA, 25 bp, Mus musculus
tcccggaaccaaagcggagctgaca

SEQ ID NO: 303060 - DNA, 25 bp, Mus musculus
agtaccatttatttgcttgagacgc

SEQ ID NO: 303061 - DNA, 25 bp, Mus musculus
acgacttccaagtaccatttatttg

SEQ ID NO: 303062 - DNA, 25 bp, Mus musculus
tgtccgggccaggaacgacttccaa

SEQ ID NO: 303063 - DNA, 25 bp, Mus musculus
ctgtcgcctggatcggtctctgtcc

SEQ ID NO: 303064 - DNA, 25 bp, Mus musculus
tgccgtgtagtgcaagatgtcgcaa

SEQ ID NO: 303065 - DNA, 25 bp, Mus musculus
aagattaaggggttgctgtcgcctg

SEQ ID NO: 303066 - DNA, 25 bp, Mus musculus
tcttctcgagggaaatgttgccgtg

SEQ ID NO: 303067 - DNA, 25 bp, Mus musculus
gaagtgacgtctcctgagcctgagc

SEQ ID NO: 303068 - DNA, 25 bp, Mus musculus
accgccaggtgaccggaagtgacgt

SEQ ID NO: 303069 - DNA, 25 bp, Mus musculus
tccggaattggccaaccgccaggtg

SEQ ID NO: 303070 - DNA, 25 bp, Mus musculus
ttgcttgagacgcaaactcaccttc

SEQ ID NO: 303071 - DNA, 25 bp, Mus musculus
ggagctgacatcaagtccggaattg

SEQ ID NO: 303072 - DNA, 25 bp, Mus musculus
actgtcagccgtccttcggttcgtc

SEQ ID NO: 303073 - DNA, 25 bp, Mus musculus
gaagaacggtcagcgaggtcccgtc

SEQ ID NO: 303074 - DNA, 25 bp, Mus musculus
gagcttccgcgtcgccaaggtgttc

SEQ ID NO: 303075 - DNA, 25 bp, Mus musculus
ggccctgaattgactccggagaaga

SEQ ID NO: 303076 - DNA, 25 bp, Mus musculus
tcccttcaagatggcggacacaatg

SEQ ID NO: 303077 - DNA, 25 bp, Mus musculus
aagctgaccgacagcgtgctccgga

SEQ ID NO: 303078 - DNA, 25 bp, Mus musculus
ctctgattttgcttctcccttcaag

SEQ ID NO: 303079 - DNA, 25 bp, Mus musculus
aagctcctcgccctctgattttgct

SEQ ID NO: 303080 - DNA, 25 bp, Mus musculus
cagctccggggcctcagcaacggga

SEQ ID NO: 303081 - DNA, 25 bp, Mus musculus
agggtttagatgctccacgcccgca

SEQ ID NO: 303082 - DNA, 25 bp, Mus musculus
tcctgccctcgagagagagggttta

SEQ ID NO: 303083 - DNA, 25 bp, Mus musculus
tgagagcacccacaaaggcactagc

SEQ ID NO: 303084 - DNA, 25 bp, Mus musculus
cccggggcttgagagcacccacaaa

SEQ ID NO: 303085 - DNA, 25 bp, Mus musculus
aggtcctgcggcctcagagacacca

SEQ ID NO: 303086 - DNA, 25 bp, Mus musculus
gccatgataggccacgtgaccggaa

SEQ ID NO: 303087 - DNA, 25 bp, Mus musculus
ggcccagccctatgtacctgtagtc

SEQ ID NO: 303088 - DNA, 25 bp, Mus musculus
tcgcctggaaacacacgagtgggtg

SEQ ID NO: 303089 - DNA, 25 bp, Mus musculus
tggcacgaggggcactcacacgtcc

SEQ ID NO: 303090 - DNA, 25 bp, Mus musculus
gaacaccacgttgaccctggggaca

SEQ ID NO: 303091 - DNA, 25 bp, Mus musculus
gagcggtccacgaacaccacgttga

SEQ ID NO: 303092 - DNA, 25 bp, Mus musculus
atccgcttgccagagcggtccacga

SEQ ID NO: 303093 - DNA, 25 bp, Mus musculus
acagtaaacgcagcgtttgggcgcc

SEQ ID NO: 303094 - DNA, 25 bp, Mus musculus
tgcgcgtcctcagcgacagtaaacg

SEQ ID NO: 303095 - DNA, 25 bp, Mus musculus
gaagacctagcatgctctgcgcgtc

SEQ ID NO: 303096 - DNA, 25 bp, Mus musculus
cgtgaccggaagacctagcatgctc

SEQ ID NO: 303097 - DNA, 25 bp, Mus musculus
gctgggccaggtatagaacattgtc

SEQ ID NO: 303098 - DNA, 25 bp, Mus musculus
acgtcctagatgttaccgccgcgtg

SEQ ID NO: 303099 - DNA, 25 bp, Mus musculus
cctgtagtcccgaacgtcctagatg

SEQ ID NO: 303100 - DNA, 25 bp, Mus musculus
gcgccggaaccagccggcggacatt

SEQ ID NO: 303101 - DNA, 25 bp, Mus musculus
ccaaggcagtgtgcggccccgtgct

SEQ ID NO: 303102 - DNA, 25 bp, Mus musculus
cccgccactgggaggaagcgagcct

SEQ ID NO: 303103 - DNA, 25 bp, Mus musculus
aaccagccggcggacattgcgtggc

SEQ ID NO: 303104 - DNA, 25 bp, Mus musculus
ccgcggctctggaagtggacccccg

SEQ ID NO: 303105 - DNA, 25 bp, Mus musculus
aagcggggccggtgatagggcaccg

SEQ ID NO: 303106 - DNA, 25 bp, Mus musculus
agccggagccgcgtagaaagcgggg

SEQ ID NO: 303107 - DNA, 25 bp, Mus musculus
cggcgcgaggcgtcagtggcgcccg

SEQ ID NO: 303108 - DNA, 25 bp, Mus musculus
cctgcgttccaaggcagtgtgcggc

SEQ ID NO: 303109 - DNA, 25 bp, Mus musculus
agcctgcgttccaaggcagtgtgcg

SEQ ID NO: 303110 - DNA, 25 bp, Mus musculus
tagcctgcgttccaaggcagtgtgc

SEQ ID NO: 303111 - DNA, 25 bp, Mus musculus
cgtagcctgcgttccaaggcagtgt

SEQ ID NO: 303112 - DNA, 25 bp, Mus musculus
gctgcccgcgcacggcgggacacca

SEQ ID NO: 303113 - DNA, 25 bp, Mus musculus
tgcgttccaaggcagtgtgcggccc

SEQ ID NO: 303114 - DNA, 25 bp, Mus musculus
gcaccagaccggcatccacggtgag

SEQ ID NO: 303115 - DNA, 25 bp, Mus musculus
caggaccaagaggagaactccgacg

SEQ ID NO: 303116 - DNA, 25 bp, Mus musculus
ccaagaggagaactccgacggcacg

SEQ ID NO: 303117 - DNA, 25 bp, Mus musculus
aactccgacggcacgggcgagccga

SEQ ID NO: 303118 - DNA, 25 bp, Mus musculus
acgggcgagccgaaagctgagccat

SEQ ID NO: 303119 - DNA, 25 bp, Mus musculus
agctctgggtccaggcgagccgagt

SEQ ID NO: 303120 - DNA, 25 bp, Mus musculus
gccgaaagctgagccatggcgcacc

SEQ ID NO: 303121 - DNA, 25 bp, Mus musculus
ccgagtcgagccgggccaggaccaa

SEQ ID NO: 303122 - DNA, 25 bp, Mus musculus
gagccatggcgcaccagaccggcat

SEQ ID NO: 303123 - DNA, 25 bp, Mus musculus
cgtcgccacatcctccggagctctg

SEQ ID NO: 303124 - DNA, 25 bp, Mus musculus
gcgaggctcggtgccgtcgccacat

SEQ ID NO: 303125 - DNA, 25 bp, Mus musculus
accaatgcccgcctctgccggcctc

SEQ ID NO: 303126 - DNA, 25 bp, Mus musculus
ccagaccggcatccacggtgagggc

SEQ ID NO: 303127 - DNA, 25 bp, Mus musculus
aagctgagccatggcgcaccagacc

SEQ ID NO: 303128 - DNA, 25 bp, Mus musculus
cccttatgatgccttcgtggtgttc

SEQ ID NO: 303129 - DNA, 25 bp, Mus musculus
cgtggtgttcgataaggcacagagc

SEQ ID NO: 303130 - DNA, 25 bp, Mus musculus
ttgccgactgggtgtataacgagct

SEQ ID NO: 303131 - DNA, 25 bp, Mus musculus
cctacgcttgtgtctggaggaccga

SEQ ID NO: 303132 - DNA, 25 bp, Mus musculus
gaccgagattggctgcctggccaga

SEQ ID NO: 303133 - DNA, 25 bp, Mus musculus
tggccagacgctcttcgagaacctc

SEQ ID NO: 303134 - DNA, 25 bp, Mus musculus
agaacctctgggcttccatctatgg

SEQ ID NO: 303135 - DNA, 25 bp, Mus musculus
ctatgggagccgcaagactctattt

SEQ ID NO: 303136 - DNA, 25 bp, Mus musculus
gactctatttgtgctggcccacacg

SEQ ID NO: 303137 - DNA, 25 bp, Mus musculus
cagcagcgcctgttggaagaccgca

SEQ ID NO: 303138 - DNA, 25 bp, Mus musculus
ggtgatcctgcgtccggatgcccac

SEQ ID NO: 303139 - DNA, 25 bp, Mus musculus
ctatgtgcgactgcgccagcgtctc

SEQ ID NO: 303140 - DNA, 25 bp, Mus musculus
agcgcccaaactctcccttatgatg

SEQ ID NO: 303141 - DNA, 25 bp, Mus musculus
aggcacagagcgcagttgccgactg

SEQ ID NO: 303142 - DNA, 25 bp, Mus musculus
agctcgtctctcttgtaggcgtcca

SEQ ID NO: 303143 - DNA, 25 bp, Mus musculus
ggagctcaaggacgcgccgtctcag

SEQ ID NO: 303144 - DNA, 25 bp, Mus musculus
aactctctttcagcttgggcggccc

SEQ ID NO: 303145 - DNA, 25 bp, Mus musculus
gtaggcgtccacatccttgatcttc

SEQ ID NO: 303146 - DNA, 25 bp, Mus musculus
ccttgatcttcctgaggattttctc

SEQ ID NO: 303147 - DNA, 25 bp, Mus musculus
gattttctccatccggtcctttgcc

SEQ ID NO: 303148 - DNA, 25 bp, Mus musculus
ttgccttctgacactcctcaaagtc

SEQ ID NO: 303149 - DNA, 25 bp, Mus musculus
ccgagcttacgtgccgcgtgtgcca

SEQ ID NO: 303150 - DNA, 25 bp, Mus musculus
gcgtgtgccatgtcctccacagaca

SEQ ID NO: 303151 - DNA, 25 bp, Mus musculus
agacaccctcctgcagggagagcga

SEQ ID NO: 303152 - DNA, 25 bp, Mus musculus
agagcgagccacactgcacatgatg

SEQ ID NO: 303153 - DNA, 25 bp, Mus musculus
cacatgatggctcggatgcgcctca

SEQ ID NO: 303154 - DNA, 25 bp, Mus musculus
ctcatcaactctgaggccgagctta

SEQ ID NO: 303155 - DNA, 25 bp, Mus musculus
acccactggagctggcagaactctc

SEQ ID NO: 303156 - DNA, 25 bp, Mus musculus
ctacgctgccggagccaagagcgca

SEQ ID NO: 303157 - DNA, 25 bp, Mus musculus
gccgcctgtcaaatgtcgaatgtca

SEQ ID NO: 303158 - DNA, 25 bp, Mus musculus
gcactcgagcggaggacgctaaacc

SEQ ID NO: 303159 - DNA, 25 bp, Mus musculus
gacgctaaaccgaccagtgcccttg

SEQ ID NO: 303160 - DNA, 25 bp, Mus musculus
agtgcccttgttcacgagcagccta

SEQ ID NO: 303161 - DNA, 25 bp, Mus musculus
tcacgagcagcctaaggccgcgatc

SEQ ID NO: 303162 - DNA, 25 bp, Mus musculus
tcgctggcggccctaaatatagagc

SEQ ID NO: 303163 - DNA, 25 bp, Mus musculus
aatatagagccggagtgaccgccgc

SEQ ID NO: 303164 - DNA, 25 bp, Mus musculus
cagggtccctctctgtttgggctcc

SEQ ID NO: 303165 - DNA, 25 bp, Mus musculus
ttgggctcctctccaactcctggga

SEQ ID NO: 303166 - DNA, 25 bp, Mus musculus
tgggactatgtctcaggcctacgct

SEQ ID NO: 303167 - DNA, 25 bp, Mus musculus
tcgaatgtcagaaggggacgcaatg

SEQ ID NO: 303168 - DNA, 25 bp, Mus musculus
gaacagccctatgcgtcagactcct

SEQ ID NO: 303169 - DNA, 25 bp, Mus musculus
gtctccttctacgaacagccctatg

SEQ ID NO: 303170 - DNA, 25 bp, Mus musculus
ccgcagcctctttcggcggcgattg

SEQ ID NO: 303171 - DNA, 25 bp, Mus musculus
gtcctgccgctttgtttgagcccta

SEQ ID NO: 303172 - DNA, 25 bp, Mus musculus
taccgcgaaacttgattggtgcctg

SEQ ID NO: 303173 - DNA, 25 bp, Mus musculus
cccgcctaccgcgaaacttgattgg

SEQ ID NO: 303174 - DNA, 25 bp, Mus musculus
tgactatctgccgagcgcgtgcccg

SEQ ID NO: 303175 - DNA, 25 bp, Mus musculus
cgattgactatctgccgagcgcgtg

SEQ ID NO: 303176 - DNA, 25 bp, Mus musculus
ctttcggcggcgattgactatctgc

SEQ ID NO: 303177 - DNA, 25 bp, Mus musculus
gaagctgattatggagcgctccctc

SEQ ID NO: 303178 - DNA, 25 bp, Mus musculus
ccacttccagctgggtggacccgcc

SEQ ID NO: 303179 - DNA, 25 bp, Mus musculus
gcccgaacagcacgctggacgaggc

SEQ ID NO: 303180 - DNA, 25 bp, Mus musculus
gcctgagagcccgaacagcacgctg

SEQ ID NO: 303181 - DNA, 25 bp, Mus musculus
tgcagagccacgtacctcctgagcc

SEQ ID NO: 303182 - DNA, 25 bp, Mus musculus
tttgtttgagccctacctgcagagc

SEQ ID NO: 303183 - DNA, 25 bp, Mus musculus
tgagccctacctgcagagccacgta

SEQ ID NO: 303184 - DNA, 25 bp, Mus musculus
aggcgcggtgcctttaagcccaggc

SEQ ID NO: 303185 - DNA, 25 bp, Mus musculus
gctgtttcctttccactcgcttggc

SEQ ID NO: 303186 - DNA, 25 bp, Mus musculus
acctccaaggtgaggacagaaccta

SEQ ID NO: 303187 - DNA, 25 bp, Mus musculus
tgccaggcctactacctccaaggtg

SEQ ID NO: 303188 - DNA, 25 bp, Mus musculus
gcctgctcctgcagaagctgcgaga

SEQ ID NO: 303189 - DNA, 25 bp, Mus musculus
accgtgctgctctacgacgaggcca

SEQ ID NO: 303190 - DNA, 25 bp, Mus musculus
tcgcacattgagacggccatcaacc

SEQ ID NO: 303191 - DNA, 25 bp, Mus musculus
tggccatcccgggtctcatgctgcg

SEQ ID NO: 303192 - DNA, 25 bp, Mus musculus
gagctcttcgaatcgtcgcacattg

SEQ ID NO: 303193 - DNA, 25 bp, Mus musculus
attgccggccgcacgagctcttcga

SEQ ID NO: 303194 - DNA, 25 bp, Mus musculus
cgtccctgctgctgctagattgccg

SEQ ID NO: 303195 - DNA, 25 bp, Mus musculus
gccatgccctgcaagagcgccgagt

SEQ ID NO: 303196 - DNA, 25 bp, Mus musculus
ccagtgcgggcgcacatgtcgactt

SEQ ID NO: 303197 - DNA, 25 bp, Mus musculus
attcccaaccatgccgacaaggagc

SEQ ID NO: 303198 - DNA, 25 bp, Mus musculus
tcgcgttttgtgagtgttgccaggc

SEQ ID NO: 303199 - DNA, 25 bp, Mus musculus
tatttcccgtgctgcactgcgggcc

SEQ ID NO: 303200 - DNA, 25 bp, Mus musculus
tgtcggccctatttcccgtgctgca

SEQ ID NO: 303201 - DNA, 25 bp, Mus musculus
ctccttgctcgcgtttgagaggtgg

SEQ ID NO: 303202 - DNA, 25 bp, Mus musculus
gaccgacctccttgctcgcgtttga

SEQ ID NO: 303203 - DNA, 25 bp, Mus musculus
gcaagctcagtctcaggaccgacct

SEQ ID NO: 303204 - DNA, 25 bp, Mus musculus
ggccggcaagctcagtctcaggacc

SEQ ID NO: 303205 - DNA, 25 bp, Mus musculus
ctgcttggctatggggcatcgagat

SEQ ID NO: 303206 - DNA, 25 bp, Mus musculus
acatccgtgactacagggcggcggc

SEQ ID NO: 303207 - DNA, 25 bp, Mus musculus
cggcatccgatgacatccgtgacta

SEQ ID NO: 303208 - DNA, 25 bp, Mus musculus
tggccttacggcatccgatgacatc

SEQ ID NO: 303209 - DNA, 25 bp, Mus musculus
ttaccgtgagtgttggccttacggc

SEQ ID NO: 303210 - DNA, 25 bp, Mus musculus
tgcactgcgggcctttctctttctc

SEQ ID NO: 303211 - DNA, 25 bp, Mus musculus
cccggtcgtcctcaaggaacggatg

SEQ ID NO: 303212 - DNA, 25 bp, Mus musculus
caaggatggctgatccggggacaac

SEQ ID NO: 303213 - DNA, 25 bp, Mus musculus
ctcaccgcgtggacaggagtgacca

SEQ ID NO: 303214 - DNA, 25 bp, Mus musculus
gggacaacctgagggcctccttctc

SEQ ID NO: 303215 - DNA, 25 bp, Mus musculus
caggaaaactgtacacgtgttgccc

SEQ ID NO: 303216 - DNA, 25 bp, Mus musculus
gggcctccttctctggggacactca

SEQ ID NO: 303217 - DNA, 25 bp, Mus musculus
gcaggccaagcctggttaccaggga

SEQ ID NO: 303218 - DNA, 25 bp, Mus musculus
caggagtgaccagaaaggctccggt

SEQ ID NO: 303219 - DNA, 25 bp, Mus musculus
cggcctaggcggaaccaactgccaa

SEQ ID NO: 303220 - DNA, 25 bp, Mus musculus
ggaaccaactgccaaacagcctagc

SEQ ID NO: 303221 - DNA, 25 bp, Mus musculus
acagcctagcggctgtggtacagcc

SEQ ID NO: 303222 - DNA, 25 bp, Mus musculus
ctgtggtacagcctccttggtaacc

SEQ ID NO: 303223 - DNA, 25 bp, Mus musculus
gcctccttggtaaccagacggctaa

SEQ ID NO: 303224 - DNA, 25 bp, Mus musculus
gacggctaaagtccagccacccagg

SEQ ID NO: 303225 - DNA, 25 bp, Mus musculus
gcttgcgcagtacgcagctgcaggc

SEQ ID NO: 303226 - DNA, 25 bp, Mus musculus
tagcgggtctaggtgggctggaccc

SEQ ID NO: 303227 - DNA, 25 bp, Mus musculus
ccggagtgaaggatggtgaagaagc

SEQ ID NO: 303228 - DNA, 25 bp, Mus musculus
tggtgaagaagcaagagccggggca

SEQ ID NO: 303229 - DNA, 25 bp, Mus musculus
gcagagggctgtgggacagaagccg

SEQ ID NO: 303230 - DNA, 25 bp, Mus musculus
cgcggccaggactgagatgaaggct

SEQ ID NO: 303231 - DNA, 25 bp, Mus musculus
cgggagagagccatacagggaggat

SEQ ID NO: 303232 - DNA, 25 bp, Mus musculus
ctgcggggagctccgcagaagcgct

SEQ ID NO: 303233 - DNA, 25 bp, Mus musculus
agccatacagggaggatccggggcc

SEQ ID NO: 303234 - DNA, 25 bp, Mus musculus
atccggggcccctggtgagccgcat

SEQ ID NO: 303235 - DNA, 25 bp, Mus musculus
agccgcatgggaagggtccatcgct

SEQ ID NO: 303236 - DNA, 25 bp, Mus musculus
cgcatgggaagggtccatcgctccc

SEQ ID NO: 303237 - DNA, 25 bp, Mus musculus
atgggaagggtccatcgctccctcc

SEQ ID NO: 303238 - DNA, 25 bp, Mus musculus
cctcccggaaacgacggatgctcgg

SEQ ID NO: 303239 - DNA, 25 bp, Mus musculus
ctgagatgaaggctgcggggagctc

SEQ ID NO: 303240 - DNA, 25 bp, Mus musculus
acaatgtgggactgagcggcccagc

SEQ ID NO: 303241 - DNA, 25 bp, Mus musculus
tttcccggggacaatgtgggactga

SEQ ID NO: 303242 - DNA, 25 bp, Mus musculus
gggcgctgcgaagaacacgttttct

SEQ ID NO: 303243 - DNA, 25 bp, Mus musculus
ctttcccggggacaatgtgggactg

SEQ ID NO: 303244 - DNA, 25 bp, Mus musculus
atgtgggactgagcggcccagccgc

SEQ ID NO: 303245 - DNA, 25 bp, Mus musculus
gcggggaatcggctccagtgtgcac

SEQ ID NO: 303246 - DNA, 25 bp, Mus musculus
cagtgtgcacccgatcgcggtcctg

SEQ ID NO: 303247 - DNA, 25 bp, Mus musculus
agtgtgcacccgatcgcggtcctgg

SEQ ID NO: 303248 - DNA, 25 bp, Mus musculus
gccgcagaacagccccagcgaggta

SEQ ID NO: 303249 - DNA, 25 bp, Mus musculus
caatgtgggactgagcggcccagcc

SEQ ID NO: 303250 - DNA, 25 bp, Mus musculus
ggcaccgcgggccattgaagtttgg

SEQ ID NO: 303251 - DNA, 25 bp, Mus musculus
tcccggggacaatgtgggactgagc

SEQ ID NO: 303252 - DNA, 25 bp, Mus musculus
caccgcgggccattgaagtttgggg

SEQ ID NO: 303253 - DNA, 25 bp, Mus musculus
gctccagtgtgcacccgatcgcggt

SEQ ID NO: 303254 - DNA, 25 bp, Mus musculus
taacggacacgtcggccgccatctt

SEQ ID NO: 303255 - DNA, 25 bp, Mus musculus
tcagcgtattggctagaaccagccc

SEQ ID NO: 303256 - DNA, 25 bp, Mus musculus
cggatcagtatcttgcggcggttac

SEQ ID NO: 303257 - DNA, 25 bp, Mus musculus
cccgggaggcctcggatcagtatct

SEQ ID NO: 303258 - DNA, 25 bp, Mus musculus
atcgagcggcggcaactcttgttcg

SEQ ID NO: 303259 - DNA, 25 bp, Mus musculus
gcaactcttgttcgggcgcccggcg

SEQ ID NO: 303260 - DNA, 25 bp, Mus musculus
tctcgggagtttccgcttcggcctc

SEQ ID NO: 303261 - DNA, 25 bp, Mus musculus
cgccttctgggaccagcgagctcag

SEQ ID NO: 303262 - DNA, 25 bp, Mus musculus
ccctttcagcgtattggctagaacc

SEQ ID NO: 303263 - DNA, 25 bp, Mus musculus
actggcgctcagtgtgttccaggcg

SEQ ID NO: 303264 - DNA, 25 bp, Mus musculus
cagtgtgttccaggcgtttccggat

SEQ ID NO: 303265 - DNA, 25 bp, Mus musculus
cgtttccggatctcttccggatcga

SEQ ID NO: 303266 - DNA, 25 bp, Mus musculus
tctcttccggatcgagcggcggcaa

SEQ ID NO: 303267 - DNA, 25 bp, Mus musculus
gcgatcgacggtctcgggagtttcc

SEQ ID NO: 303268 - DNA, 25 bp, Mus musculus
accacgagcagagtgccgttgccca

SEQ ID NO: 303269 - DNA, 25 bp, Mus musculus
aaggcatcttgaaggtccggcgtgc

SEQ ID NO: 303270 - DNA, 25 bp, Mus musculus
cgcacaagtgcgctaagtagaaggc

SEQ ID NO: 303271 - DNA, 25 bp, Mus musculus
gccagcaggtccacgacgcacaagt

SEQ ID NO: 303272 - DNA, 25 bp, Mus musculus
ccagcaggcccagaggcatgatgga

SEQ ID NO: 303273 - DNA, 25 bp, Mus musculus
cgaaggctagcatcgcccaaagcgg

SEQ ID NO: 303274 - DNA, 25 bp, Mus musculus
gatgctaccgtaggcggccaacagc

SEQ ID NO: 303275 - DNA, 25 bp, Mus musculus
gcgccaccaggaagatgctaccgta

SEQ ID NO: 303276 - DNA, 25 bp, Mus musculus
agcaggctgcaaactggcccacggc

SEQ ID NO: 303277 - DNA, 25 bp, Mus musculus
cggagtaggctacccaggtgacagt

SEQ ID NO: 303278 - DNA, 25 bp, Mus musculus
ccaggcttgcgatgtgcaggctttc

SEQ ID NO: 303279 - DNA, 25 bp, Mus musculus
ggcgctgcagcaggccatagagaaa

SEQ ID NO: 303280 - DNA, 25 bp, Mus musculus
cacctctacgagaaccgccaggata

SEQ ID NO: 303281 - DNA, 25 bp, Mus musculus
gccaagcacgcgcagccataaggca

SEQ ID NO: 303282 - DNA, 25 bp, Mus musculus
gtagcggcaccttgaacagtatgtc

SEQ ID NO: 303283 - DNA, 25 bp, Mus musculus
ttagcagagcgcaagcgccacaggc

SEQ ID NO: 303284 - DNA, 25 bp, Mus musculus
cgaaaggtgagcatggtgtactctt

SEQ ID NO: 303285 - DNA, 25 bp, Mus musculus
ctcgtaagcgggcaaagccagctcc

SEQ ID NO: 303286 - DNA, 25 bp, Mus musculus
cttgaacagtatgtcgaccgccgtg

SEQ ID NO: 303287 - DNA, 25 bp, Mus musculus
gcagccatgtgagttcttcggggta

SEQ ID NO: 303288 - DNA, 25 bp, Mus musculus
aacctatcagggctccgggtcttgc

SEQ ID NO: 303289 - DNA, 25 bp, Mus musculus
gcaggatcttctcaagggcccaatg

SEQ ID NO: 303290 - DNA, 25 bp, Mus musculus
gtccagctgcgtcggtccaatagac

SEQ ID NO: 303291 - DNA, 25 bp, Mus musculus
aggagctcttgaaggcgtgtccagc

SEQ ID NO: 303292 - DNA, 25 bp, Mus musculus
cgccggagcctataggagctcttga

SEQ ID NO: 303293 - DNA, 25 bp, Mus musculus
gagacttgcttcctactccaggctg

SEQ ID NO: 303294 - DNA, 25 bp, Mus musculus
cccaggccggaaatcgcaagagaga

SEQ ID NO: 303295 - DNA, 25 bp, Mus musculus
gtcgaccgccgtggcaactcgtaag

SEQ ID NO: 303296 - DNA, 25 bp, Mus musculus
gccttcaggacagccgcagcctgga

SEQ ID NO: 303297 - DNA, 25 bp, Mus musculus
gttctgcagttcaataacagccctc

SEQ ID NO: 303298 - DNA, 25 bp, Mus musculus
agagctcttcctgtccggaccatta

SEQ ID NO: 303299 - DNA, 25 bp, Mus musculus
gaccattatcatccggctgccaatc

SEQ ID NO: 303300 - DNA, 25 bp, Mus musculus
agctgagcaccaggccgcgactttc

SEQ ID NO: 303301 - DNA, 25 bp, Mus musculus
ctcaagatccgactgagtggcgccc

SEQ ID NO: 303302 - DNA, 25 bp, Mus musculus
acacttgggaggacaagccgagctc

SEQ ID NO: 303303 - DNA, 25 bp, Mus musculus
acggcgaccttactcactttgtggc

SEQ ID NO: 303304 - DNA, 25 bp, Mus musculus
tcgagatgaatgtggagctgccgca

SEQ ID NO: 303305 - DNA, 25 bp, Mus musculus
gtcttcatccagtggcgagaccggc

SEQ ID NO: 303306 - DNA, 25 bp, Mus musculus
acccgactggctttcacttgtgttc

SEQ ID NO: 303307 - DNA, 25 bp, Mus musculus
accctcagtatggaggccgcccagg

SEQ ID NO: 303308 - DNA, 25 bp, Mus musculus
cgaggatcagccctccgctctgagg

SEQ ID NO: 303309 - DNA, 25 bp, Mus musculus
caaagacttggagcggcagcatcgc

SEQ ID NO: 303310 - DNA, 25 bp, Mus musculus
agcagaatgtagcaaagctcccgcc

SEQ ID NO: 303311 - DNA, 25 bp, Mus musculus
agatgcgagcgatgcgattggtctt

SEQ ID NO: 303312 - DNA, 25 bp, Mus musculus
gcaggcgatggtgacaggtcccacc

SEQ ID NO: 303313 - DNA, 25 bp, Mus musculus
acacaaagagggtggccagggcacc

SEQ ID NO: 303314 - DNA, 25 bp, Mus musculus
cgcacgaagacacccaacacaaaga

SEQ ID NO: 303315 - DNA, 25 bp, Mus musculus
ggcgttatgccgcacgaagacaccc

SEQ ID NO: 303316 - DNA, 25 bp, Mus musculus
ccttgaccacgggtgtggcgttatg

SEQ ID NO: 303317 - DNA, 25 bp, Mus musculus
atggtgacaggtcccaccgcccagg

SEQ ID NO: 303318 - DNA, 25 bp, Mus musculus
gaggaagacgcctcccagcagaatg

SEQ ID NO: 303319 - DNA, 25 bp, Mus musculus
aggtcatgcagtagcagaggaagac

SEQ ID NO: 303320 - DNA, 25 bp, Mus musculus
cttggcgatgaagatgaaggtcatg

SEQ ID NO: 303321 - DNA, 25 bp, Mus musculus
agtagcagacagagaaggcggtccc

SEQ ID NO: 303322 - DNA, 25 bp, Mus musculus
cccgccaaagatgcgagcgatgcga

SEQ ID NO: 303323 - DNA, 25 bp, Mus musculus
aacccgaggcgccttaaggtgcaga

SEQ ID NO: 303324 - DNA, 25 bp, Mus musculus
gtgaagagcacagccacacgggcgc

SEQ ID NO: 303325 - DNA, 25 bp, Mus musculus
cctctgaccgggtgaagagcacagc

SEQ ID NO: 303326 - DNA, 25 bp, Mus musculus
gttgcgtgcccgagcctcgagctcg

SEQ ID NO: 303327 - DNA, 25 bp, Mus musculus
accttctccgaagtggccacgcaga

SEQ ID NO: 303328 - DNA, 25 bp, Mus musculus
acgctgggtggctgcaagcagctca

SEQ ID NO: 303329 - DNA, 25 bp, Mus musculus
tgcaagcagctcacgggcatcctct

SEQ ID NO: 303330 - DNA, 25 bp, Mus musculus
ccgaagtggccacgcagatgttgcg

SEQ ID NO: 303331 - DNA, 25 bp, Mus musculus
tcgctggctacccaggtgaagctgg

SEQ ID NO: 303332 - DNA, 25 bp, Mus musculus
accctcgaaggctgcgcggctcatg

SEQ ID NO: 303333 - DNA, 25 bp, Mus musculus
cacgcagatgttgcgtgcccgagcc

SEQ ID NO: 303334 - DNA, 25 bp, Mus musculus
ggcttctgcaacagggctcgcacca

SEQ ID NO: 303335 - DNA, 25 bp, Mus musculus
ccacacgggcgctgggcttctgcaa

SEQ ID NO: 303336 - DNA, 25 bp, Mus musculus
acgggcatcctctgaccgggtgaag

SEQ ID NO: 303337 - DNA, 25 bp, Mus musculus
acccaggtgaagctggcgttgagac

SEQ ID NO: 303338 - DNA, 25 bp, Mus musculus
gagctcccagaaagcgctgtctgga

SEQ ID NO: 303339 - DNA, 25 bp, Mus musculus
cccgggtgctccagaactctaggac

SEQ ID NO: 303340 - DNA, 25 bp, Mus musculus
cgcgatgcagggcgtgcgttctctt

SEQ ID NO: 303341 - DNA, 25 bp, Mus musculus
ccggagctcccagaaagcgctgtct

SEQ ID NO: 303342 - DNA, 25 bp, Mus musculus
tcccagaaagcgctgtctggacgtc

SEQ ID NO: 303343 - DNA, 25 bp, Mus musculus
ccagaaagcgctgtctggacgtctc

SEQ ID NO: 303344 - DNA, 25 bp, Mus musculus
tgctccagaactctaggacccgcgg

SEQ ID NO: 303345 - DNA, 25 bp, Mus musculus
tccggttcccgcttgctggctctct

SEQ ID NO: 303346 - DNA, 25 bp, Mus musculus
ctacctggcgctcccagctctggcg

SEQ ID NO: 303347 - DNA, 25 bp, Mus musculus
caagggctaaccctacctggcgctc

SEQ ID NO: 303348 - DNA, 25 bp, Mus musculus
agaaagcgctgtctggacgtctcgg

SEQ ID NO: 303349 - DNA, 25 bp, Mus musculus
aagcgctgtctggacgtctcggccc

SEQ ID NO: 303350 - DNA, 25 bp, Mus musculus
ggtgctccagaactctaggacccgc

SEQ ID NO: 303351 - DNA, 25 bp, Mus musculus
tcagggctaaaaaaggttggcagtg

SEQ ID NO: 303352 - DNA, 25 bp, Mus musculus
cggctcgcttcacggcctcctgcac

SEQ ID NO: 303353 - DNA, 25 bp, Mus musculus
cctctgcaacttcagacacgctaaa

SEQ ID NO: 303354 - DNA, 25 bp, Mus musculus
cttcagacacgctaaagtttggagc

SEQ ID NO: 303355 - DNA, 25 bp, Mus musculus
atccgcgccgagaggtcaggaccgc

SEQ ID NO: 303356 - DNA, 25 bp, Mus musculus
ctaaagtttggagcggcgacgcgac

SEQ ID NO: 303357 - DNA, 25 bp, Mus musculus
ctccagatttggagggcggaggcct

SEQ ID NO: 303358 - DNA, 25 bp, Mus musculus
gcttcgtgctgtcggcttcctgccg

SEQ ID NO: 303359 - DNA, 25 bp, Mus musculus
acctgcgccggcgaacttgggtgct

SEQ ID NO: 303360 - DNA, 25 bp, Mus musculus
ccacaggcagcgctgctgaaaggtg

SEQ ID NO: 303361 - DNA, 25 bp, Mus musculus
gtcgccgcttcgtgctgtcggcttc

SEQ ID NO: 303362 - DNA, 25 bp, Mus musculus
aggccgctcacgtgcgctctgcgga

SEQ ID NO: 303363 - DNA, 25 bp, Mus musculus
caggctgggccagcagtgagtcaga

SEQ ID NO: 303364 - DNA, 25 bp, Mus musculus
ctgtgggcgcgtgcgctccagattt

SEQ ID NO: 303365 - DNA, 25 bp, Mus musculus
gtctccttggtaacatgcacgcctc

SEQ ID NO: 303366 - DNA, 25 bp, Mus musculus
gcgctctcagcctccgctcgcggtc

SEQ ID NO: 303367 - DNA, 25 bp, Mus musculus
gctcgcggtccgcgccagaaagctt

SEQ ID NO: 303368 - DNA, 25 bp, Mus musculus
ctctggccgagggtcggtcttctcc

SEQ ID NO: 303369 - DNA, 25 bp, Mus musculus
tcccgtgccacggatccgggccgca

SEQ ID NO: 303370 - DNA, 25 bp, Mus musculus
gaacacaagccacccgcagcaaagt

SEQ ID NO: 303371 - DNA, 25 bp, Mus musculus
cctcttggacagtgtctgcggcggc

SEQ ID NO: 303372 - DNA, 25 bp, Mus musculus
caccctcttggacagtgtctgcggc

SEQ ID NO: 303373 - DNA, 25 bp, Mus musculus
gccgcaccctcttggacagtgtctg

SEQ ID NO: 303374 - DNA, 25 bp, Mus musculus
gggaacacaagccacccgcagcaaa

SEQ ID NO: 303375 - DNA, 25 bp, Mus musculus
gctgggccgtaggacctcgcgttct

SEQ ID NO: 303376 - DNA, 25 bp, Mus musculus
gaccgcaggggctctcacctcccgt

SEQ ID NO: 303377 - DNA, 25 bp, Mus musculus
gactctggccgcgtccccattgttg

SEQ ID NO: 303378 - DNA, 25 bp, Mus musculus
ggccgtaggacctcgcgttctgccg

SEQ ID NO: 303379 - DNA, 25 bp, Mus musculus
ttctgccgcaccctcttggacagtg

SEQ ID NO: 303380 - DNA, 25 bp, Mus musculus
gggatgctcgcctctacctaaagga

SEQ ID NO: 303381 - DNA, 25 bp, Mus musculus
catttcccaggagcgctttgatgtc

SEQ ID NO: 303382 - DNA, 25 bp, Mus musculus
gacgaggggcatcttctttcccatg

SEQ ID NO: 303383 - DNA, 25 bp, Mus musculus
aaaggaggtgctctttgaatctctc

SEQ ID NO: 303384 - DNA, 25 bp, Mus musculus
agagtaactcttccgccggggtgtg

SEQ ID NO: 303385 - DNA, 25 bp, Mus musculus
agaagcctctttagagtaactcttc

SEQ ID NO: 303386 - DNA, 25 bp, Mus musculus
ccgtcctgtaaagaagcctctttag

SEQ ID NO: 303387 - DNA, 25 bp, Mus musculus
ggcctgacgaggctctccttccgag

SEQ ID NO: 303388 - DNA, 25 bp, Mus musculus
accagaggcagtgtgtgagaaccgt

SEQ ID NO: 303389 - DNA, 25 bp, Mus musculus
cgcataatatgtgggccgctcagga

SEQ ID NO: 303390 - DNA, 25 bp, Mus musculus
cgtagcctgcgagtgacgcataata

SEQ ID NO: 303391 - DNA, 25 bp, Mus musculus
cgcgcgaccagtacgtagcctgcga

SEQ ID NO: 303392 - DNA, 25 bp, Mus musculus
agcgctttgatgtccctcggctcct

SEQ ID NO: 303393 - DNA, 25 bp, Mus musculus
agtctctgtccctcacgggacgagg

SEQ ID NO: 303394 - DNA, 25 bp, Mus musculus
ctacgctcaggggtgcgatctgagc

SEQ ID NO: 303395 - DNA, 25 bp, Mus musculus
gggtgcgatctgagcctcgctcaga

SEQ ID NO: 303396 - DNA, 25 bp, Mus musculus
atctgagcctcgctcagactgctgc

SEQ ID NO: 303397 - DNA, 25 bp, Mus musculus
cgatctgagcctcgctcagactgct

SEQ ID NO: 303398 - DNA, 25 bp, Mus musculus
gcgatctgagcctcgctcagactgc

SEQ ID NO: 303399 - DNA, 25 bp, Mus musculus
tgcgatctgagcctcgctcagactg

SEQ ID NO: 303400 - DNA, 25 bp, Mus musculus
ggtgcgatctgagcctcgctcagac

SEQ ID NO: 303401 - DNA, 25 bp, Mus musculus
aggggtgcgatctgagcctcgctca

SEQ ID NO: 303402 - DNA, 25 bp, Mus musculus
caggggtgcgatctgagcctcgctc

SEQ ID NO: 303403 - DNA, 25 bp, Mus musculus
gctcaggggtgcgatctgagcctcg

SEQ ID NO: 303404 - DNA, 25 bp, Mus musculus
cgctcaggggtgcgatctgagcctc

SEQ ID NO: 303405 - DNA, 25 bp, Mus musculus
acgctcaggggtgcgatctgagcct

SEQ ID NO: 303406 - DNA, 25 bp, Mus musculus
tacgctcaggggtgcgatctgagcc

SEQ ID NO: 303407 - DNA, 25 bp, Mus musculus
tctgagcctcgctcagactgctgcc

SEQ ID NO: 303408 - DNA, 25 bp, Mus musculus
cccagcgctcaccactccggctgcg

SEQ ID NO: 303409 - DNA, 25 bp, Mus musculus
caccactccggctgcgaactgagcg

SEQ ID NO: 303410 - DNA, 25 bp, Mus musculus
cagggcttggctatgctccggtccc

SEQ ID NO: 303411 - DNA, 25 bp, Mus musculus
cgcttgcgtctctcttcccagggct

SEQ ID NO: 303412 - DNA, 25 bp, Mus musculus
ggagaggctcctccgcttgcgtctc

SEQ ID NO: 303413 - DNA, 25 bp, Mus musculus
tcactggagaggctcctccgcttgc

SEQ ID NO: 303414 - DNA, 25 bp, Mus musculus
acggtcactggagaggctcctccgc

SEQ ID NO: 303415 - DNA, 25 bp, Mus musculus
gagttgtcctcccacggtcactgga

SEQ ID NO: 303416 - DNA, 25 bp, Mus musculus
gtgagttgtcctcccacggtcactg

SEQ ID NO: 303417 - DNA, 25 bp, Mus musculus
ggagtgagttgtcctcccacggtca

SEQ ID NO: 303418 - DNA, 25 bp, Mus musculus
taaggggagtgagttgtcctcccac

SEQ ID NO: 303419 - DNA, 25 bp, Mus musculus
tcgtaaggggagtgagttgtcctcc

SEQ ID NO: 303420 - DNA, 25 bp, Mus musculus
gttgtcctcccacggtcactggaga

SEQ ID NO: 303421 - DNA, 25 bp, Mus musculus
tcctcgtaaggggagtgagttgtcc

SEQ ID NO: 303422 - DNA, 25 bp, Mus musculus
cagcagcatccagggcgaaggctgc

SEQ ID NO: 303423 - DNA, 25 bp, Mus musculus
ctcaggctgctgatgaggagcgtct

SEQ ID NO: 303424 - DNA, 25 bp, Mus musculus
tggaagagccggtcctccaagtgct

SEQ ID NO: 303425 - DNA, 25 bp, Mus musculus
aaccgcttgaactggtggaagagcc

SEQ ID NO: 303426 - DNA, 25 bp, Mus musculus
tgtgacaggcgcaggctgatctccc

SEQ ID NO: 303427 - DNA, 25 bp, Mus musculus
tgccggaagttcacgtaggccacgc

SEQ ID NO: 303428 - DNA, 25 bp, Mus musculus
gctccaccttgagcgggcgatcgta

SEQ ID NO: 303429 - DNA, 25 bp, Mus musculus
tggagtctcgctcgctctgccgctt

SEQ ID NO: 303430 - DNA, 25 bp, Mus musculus
agccaccgtgcaggggcagatagcc

SEQ ID NO: 303431 - DNA, 25 bp, Mus musculus
acagcgagcgctgcttgtactggta

SEQ ID NO: 303432 - DNA, 25 bp, Mus musculus
ccgtaatagtccagggctcgctctc

SEQ ID NO: 303433 - DNA, 25 bp, Mus musculus
aggagcgtcttgtactccggagccg

SEQ ID NO: 303434 - DNA, 25 bp, Mus musculus
cgcttggcggacgatgacgagccac

SEQ ID NO: 303435 - DNA, 25 bp, Mus musculus
ctgcttgtactggtagccaccgtgc

SEQ ID NO: 303436 - DNA, 25 bp, Mus musculus
ttacggtcctacatccctattggtc

SEQ ID NO: 303437 - DNA, 25 bp, Mus musculus
ccctattggtcattgtacgagaaca

SEQ ID NO: 303438 - DNA, 25 bp, Mus musculus
agaacagcggcgttccgaatgttga

SEQ ID NO: 303439 - DNA, 25 bp, Mus musculus
tccgaatgttgatggtgagggatta

SEQ ID NO: 303440 - DNA, 25 bp, Mus musculus
ggagccgctggaagtccaccgccta

SEQ ID NO: 303441 - DNA, 25 bp, Mus musculus
aggcctctacgattggacgtcgaag

SEQ ID NO: 303442 - DNA, 25 bp, Mus musculus
ttagtcgtgatttgttggcgtggca

SEQ ID NO: 303443 - DNA, 25 bp, Mus musculus
caagcggaactgaggaggcctctac

SEQ ID NO: 303444 - DNA, 25 bp, Mus musculus
gctacctgaagtgcgcatgcctttg

SEQ ID NO: 303445 - DNA, 25 bp, Mus musculus
gcgccacttgccattggctacctga

SEQ ID NO: 303446 - DNA, 25 bp, Mus musculus
ggacctggaaccctcattgcctagg

SEQ ID NO: 303447 - DNA, 25 bp, Mus musculus
cattgcctaggcttctgcccgtcgg

SEQ ID NO: 303448 - DNA, 25 bp, Mus musculus
tgcccgtcggcctacaccagggtat

SEQ ID NO: 303449 - DNA, 25 bp, Mus musculus
tctgtaggcgaaggacctggaaccc

SEQ ID NO: 303450 - DNA, 25 bp, Mus musculus
gagcagcatttctggcgccacccta

SEQ ID NO: 303451 - DNA, 25 bp, Mus musculus
taaacgaaaggtctcggcctgccta

SEQ ID NO: 303452 - DNA, 25 bp, Mus musculus
aacctgggtcagacggcagaacctc

SEQ ID NO: 303453 - DNA, 25 bp, Mus musculus
tgccgagccaatcaaggggaacgtc

SEQ ID NO: 303454 - DNA, 25 bp, Mus musculus
cgcccggactcgtagagcagcattt

SEQ ID NO: 303455 - DNA, 25 bp, Mus musculus
ccgaatgccgagtcttggttccaca

SEQ ID NO: 303456 - DNA, 25 bp, Mus musculus
acccggaaccctctcaatctattga

SEQ ID NO: 303457 - DNA, 25 bp, Mus musculus
agctgctttggctgcttacccggaa

SEQ ID NO: 303458 - DNA, 25 bp, Mus musculus
cgcctagtgggctggaacagaaacc

SEQ ID NO: 303459 - DNA, 25 bp, Mus musculus
gctttccttgggtttagcgccgcca

SEQ ID NO: 303460 - DNA, 25 bp, Mus musculus
tcaacgtctctaggcccgggaaata

SEQ ID NO: 303461 - DNA, 25 bp, Mus musculus
gcttccggccaagttattaacgcta

SEQ ID NO: 303462 - DNA, 25 bp, Mus musculus
ggatgccttcctgtaatcgctaaag

SEQ ID NO: 303463 - DNA, 25 bp, Mus musculus
acgtccactttgattcgccggcttg

SEQ ID NO: 303464 - DNA, 25 bp, Mus musculus
cgcgcgggaaggacacttaagtaga

SEQ ID NO: 303465 - DNA, 25 bp, Mus musculus
cacgtaccgcgcctatagacgttgg

SEQ ID NO: 303466 - DNA, 25 bp, Mus musculus
cctatagacgttggtagagggagca

SEQ ID NO: 303467 - DNA, 25 bp, Mus musculus
gggagcagcactatcgcgagacttc

SEQ ID NO: 303468 - DNA, 25 bp, Mus musculus
cgagacttccgaaagcagcagcgtg

SEQ ID NO: 303469 - DNA, 25 bp, Mus musculus
acgcagttaccatggcagccgggcg

SEQ ID NO: 303470 - DNA, 25 bp, Mus musculus
cttaagtagagaggtctggcctgct

SEQ ID NO: 303471 - DNA, 25 bp, Mus musculus
ggcctgcttgctcagggagacttga

SEQ ID NO: 303472 - DNA, 25 bp, Mus musculus
ccatgggtcggatctccgggctcgt

SEQ ID NO: 303473 - DNA, 25 bp, Mus musculus
gttcctgacgctcttggctcatctg

SEQ ID NO: 303474 - DNA, 25 bp, Mus musculus
tctggtggttgtcatcacgttgttc

SEQ ID NO: 303475 - DNA, 25 bp, Mus musculus
tgtcatcacgttgttctggtcccgg

SEQ ID NO: 303476 - DNA, 25 bp, Mus musculus
tctggtcccgggtaagacgcggaca

SEQ ID NO: 303477 - DNA, 25 bp, Mus musculus
tggcgcttgcggacgcagttaccat

SEQ ID NO: 303478 - DNA, 25 bp, Mus musculus
tccacctttgccctacttggacagg

SEQ ID NO: 303479 - DNA, 25 bp, Mus musculus
agtcccggatgcacgcagtccagag

SEQ ID NO: 303480 - DNA, 25 bp, Mus musculus
acgcagtccagagagctgatcctca

SEQ ID NO: 303481 - DNA, 25 bp, Mus musculus
agctgatcctcaagcactgcgacct

SEQ ID NO: 303482 - DNA, 25 bp, Mus musculus
agcactgcgacctcattcaagagca

SEQ ID NO: 303483 - DNA, 25 bp, Mus musculus
acacaactatgctgctccacctttg

SEQ ID NO: 303484 - DNA, 25 bp, Mus musculus
aacgcgtcctctggccaaaggctca

SEQ ID NO: 303485 - DNA, 25 bp, Mus musculus
aaggctcagagattgggatcccaga

SEQ ID NO: 303486 - DNA, 25 bp, Mus musculus
tcccagaacaactcagacttggagg

SEQ ID NO: 303487 - DNA, 25 bp, Mus musculus
tcagacttggaggacgtcgagcacc

SEQ ID NO: 303488 - DNA, 25 bp, Mus musculus
tgaaccttagggaccttgtgcccga

SEQ ID NO: 303489 - DNA, 25 bp, Mus musculus
gaccttgtgcccgaactggcgcacg

SEQ ID NO: 303490 - DNA, 25 bp, Mus musculus
attgggagaacgcagcgccgagtcc

SEQ ID NO: 303491 - DNA, 25 bp, Mus musculus
gcccaggagcctcgcttcgctaggg

SEQ ID NO: 303492 - DNA, 25 bp, Mus musculus
tgcagctaccgcagaacggggtcgt

SEQ ID NO: 303493 - DNA, 25 bp, Mus musculus
agcctcacctacctacgccgtattt

SEQ ID NO: 303494 - DNA, 25 bp, Mus musculus
cagtaggcggcgcatccctcacagg

SEQ ID NO: 303495 - DNA, 25 bp, Mus musculus
ccctcacaggccgtccgggatgcca

SEQ ID NO: 303496 - DNA, 25 bp, Mus musculus
atgccacgtcctgaccgaccgcgag

SEQ ID NO: 303497 - DNA, 25 bp, Mus musculus
gggcgagggctcaccacctgtccgt

SEQ ID NO: 303498 - DNA, 25 bp, Mus musculus
tcggtccctcacagctccgtcgctg

SEQ ID NO: 303499 - DNA, 25 bp, Mus musculus
gcgaatccacgagacgccgctgcgg

SEQ ID NO: 303500 - DNA, 25 bp, Mus musculus
acgccgtatttctcctcctccgtgg

SEQ ID NO: 303501 - DNA, 25 bp, Mus musculus
cctttggctgcagctaccgcagaac

SEQ ID NO: 303502 - DNA, 25 bp, Mus musculus
cgtgaggaaggccacggtgtctcat

SEQ ID NO: 303503 - DNA, 25 bp, Mus musculus
ccacggtgtctcatgccaggcgtac

SEQ ID NO: 303504 - DNA, 25 bp, Mus musculus
tcatgccaggcgtactgagatggcc

SEQ ID NO: 303505 - DNA, 25 bp, Mus musculus
tctgcgagaagggattggatagccc

SEQ ID NO: 303506 - DNA, 25 bp, Mus musculus
gtgtttcctttctcggtccaaagca

SEQ ID NO: 303507 - DNA, 25 bp, Mus musculus
ccctgcacttcaataggtcggtcta

SEQ ID NO: 303508 - DNA, 25 bp, Mus musculus
tcggtctagatgctcgtctcacgtc

SEQ ID NO: 303509 - DNA, 25 bp, Mus musculus
tcacgtccagcgatacgattggtca

SEQ ID NO: 303510 - DNA, 25 bp, Mus musculus
attggtcaactctaggagctcccgc

SEQ ID NO: 303511 - DNA, 25 bp, Mus musculus
gagctcccgcccagttttcctggaa

SEQ ID NO: 303512 - DNA, 25 bp, Mus musculus
ccactcgggcacgtcagttcagggt

SEQ ID NO: 303513 - DNA, 25 bp, Mus musculus
cttggaaatctgtcaaaggtgtttc

SEQ ID NO: 303514 - DNA, 25 bp, Mus musculus
cggtccaaagcactagacgcctgca

SEQ ID NO: 303515 - DNA, 25 bp, Mus musculus
aaagcccgcggttctaggaagatga

SEQ ID NO: 303516 - DNA, 25 bp, Mus musculus
tgggacgcagcggacaaaagattag

SEQ ID NO: 303517 - DNA, 25 bp, Mus musculus
caaaagattaggaggcgcctggccc

SEQ ID NO: 303518 - DNA, 25 bp, Mus musculus
gctgttcgcaccacagcctttcagt

SEQ ID NO: 303519 - DNA, 25 bp, Mus musculus
cctggaaagttcttggaaatctgtc

SEQ ID NO: 303520 - DNA, 25 bp, Mus musculus
atcaacgatataagcgcgccctctc

SEQ ID NO: 303521 - DNA, 25 bp, Mus musculus
cttccgcctcggtgctgttgagaaa

SEQ ID NO: 303522 - DNA, 25 bp, Mus musculus
taacctgtagtgcactccctcggcg

SEQ ID NO: 303523 - DNA, 25 bp, Mus musculus
ccggatgtgcgtaacctgtagtgca

SEQ ID NO: 303524 - DNA, 25 bp, Mus musculus
ccagaaaattgacccagggttagcg

SEQ ID NO: 303525 - DNA, 25 bp, Mus musculus
ggcccacacacaagtaccagaaaat

SEQ ID NO: 303526 - DNA, 25 bp, Mus musculus
acctaccagagggcatgcacgctcg

SEQ ID NO: 303527 - DNA, 25 bp, Mus musculus
cctgctctggtgcatacctaccaga

SEQ ID NO: 303528 - DNA, 25 bp, Mus musculus
atgcatttcccatccggatctcctg

SEQ ID NO: 303529 - DNA, 25 bp, Mus musculus
tgcggccatgcatttcccatccgga

SEQ ID NO: 303530 - DNA, 25 bp, Mus musculus
caacgttgcggccatgcatttccca

SEQ ID NO: 303531 - DNA, 25 bp, Mus musculus
ctgtctcaaaatcaacgttgcggcc

SEQ ID NO: 303532 - DNA, 25 bp, Mus musculus
tgttgagaaagggctccggtgaacc

SEQ ID NO: 303533 - DNA, 25 bp, Mus musculus
agatccgcaaacacattatcaacga

SEQ ID NO: 303534 - DNA, 25 bp, Mus musculus
agacagtctatttccaagccggaga

SEQ ID NO: 303535 - DNA, 25 bp, Mus musculus
cggaggaatgttcacttagcgcggc

SEQ ID NO: 303536 - DNA, 25 bp, Mus musculus
caagccggagagaggttcgtaaaca

SEQ ID NO: 303537 - DNA, 25 bp, Mus musculus
ttcgtaaacagcacaggccattgcg

SEQ ID NO: 303538 - DNA, 25 bp, Mus musculus
ggaagcacggcgagccataaaactc

SEQ ID NO: 303539 - DNA, 25 bp, Mus musculus
cccgagcggaggaatgttcacttag

SEQ ID NO: 303540 - DNA, 25 bp, Mus musculus
tttctgctctattagaggcgcagga

SEQ ID NO: 303541 - DNA, 25 bp, Mus musculus
gagggcagcaccacctggaccgacg

SEQ ID NO: 303542 - DNA, 25 bp, Mus musculus
tggaccgacgcacatgcgcggagca

SEQ ID NO: 303543 - DNA, 25 bp, Mus musculus
cctgtgcacggaacgcgcgagcaaa

SEQ ID NO: 303544 - DNA, 25 bp, Mus musculus
cggaacgcgcgagcaaagcaaacaa

SEQ ID NO: 303545 - DNA, 25 bp, Mus musculus
tgggaaaagagaaaatcgttcagga

SEQ ID NO: 303546 - DNA, 25 bp, Mus musculus
atcgttcaggaaagacagtctattt

SEQ ID NO: 303547 - DNA, 25 bp, Mus musculus
caaagacgtattggtttctgctcta

SEQ ID NO: 303548 - DNA, 25 bp, Mus musculus
cttggattcggatcggtttgcgcga

SEQ ID NO: 303549 - DNA, 25 bp, Mus musculus
ttgcgcgagccagtagggcaggctc

SEQ ID NO: 303550 - DNA, 25 bp, Mus musculus
gggaccacggctggggctcaggact

SEQ ID NO: 303551 - DNA, 25 bp, Mus musculus
gccagtagggcaggctccggggtga

SEQ ID NO: 303552 - DNA, 25 bp, Mus musculus
gattcggatcggtttgcgcgagcca

SEQ ID NO: 303553 - DNA, 25 bp, Mus musculus
agcttggattcggatcggtttgcgc

SEQ ID NO: 303554 - DNA, 25 bp, Mus musculus
cgagcttggattcggatcggtttgc

SEQ ID NO: 303555 - DNA, 25 bp, Mus musculus
cgcgagcttggattcggatcggttt

SEQ ID NO: 303556 - DNA, 25 bp, Mus musculus
ctcgcgagcttggattcggatcggt

SEQ ID NO: 303557 - DNA, 25 bp, Mus musculus
actcgcgagcttggattcggatcgg

SEQ ID NO: 303558 - DNA, 25 bp, Mus musculus
ggactcgcgagcttggattcggatc

SEQ ID NO: 303559 - DNA, 25 bp, Mus musculus
caggactcgcgagcttggattcgga

SEQ ID NO: 303560 - DNA, 25 bp, Mus musculus
ctcaggactcgcgagcttggattcg

SEQ ID NO: 303561 - DNA, 25 bp, Mus musculus
tcggatcggtttgcgcgagccagta

SEQ ID NO: 303562 - DNA, 25 bp, Mus musculus
ctctggttcccatggcatgctgcaa

SEQ ID NO: 303563 - DNA, 25 bp, Mus musculus
tggctgcgtcgcgaaacttccttgc

SEQ ID NO: 303564 - DNA, 25 bp, Mus musculus
ttctggctgcgtcgcgaaacttcct

SEQ ID NO: 303565 - DNA, 25 bp, Mus musculus
ggctacaaacccccgtgggctggca

SEQ ID NO: 303566 - DNA, 25 bp, Mus musculus
caagtgagggtgtcggctacaaacc

SEQ ID NO: 303567 - DNA, 25 bp, Mus musculus
cccatggcatgctgcaagtgagggt

SEQ ID NO: 303568 - DNA, 25 bp, Mus musculus
ttcccatggcatgctgcaagtgagg

SEQ ID NO: 303569 - DNA, 25 bp, Mus musculus
ggttcccatggcatgctgcaagtga

SEQ ID NO: 303570 - DNA, 25 bp, Mus musculus
tctggttcccatggcatgctgcaag

SEQ ID NO: 303571 - DNA, 25 bp, Mus musculus
tccactctccactccgggtgtcggg

SEQ ID NO: 303572 - DNA, 25 bp, Mus musculus
gctctggttcccatggcatgctgca

SEQ ID NO: 303573 - DNA, 25 bp, Mus musculus
ggctgcgtcgcgaaacttccttgcg

SEQ ID NO: 303574 - DNA, 25 bp, Mus musculus
tggttcccatggcatgctgcaagtg

SEQ ID NO: 303575 - DNA, 25 bp, Mus musculus
cccgcgctcccttgcgcccctcagc

SEQ ID NO: 303576 - DNA, 25 bp, Mus musculus
tacgctgttcatctgcaagcgatgc

SEQ ID NO: 303577 - DNA, 25 bp, Mus musculus
tcctgcgcctgtctgtgttggcaag

SEQ ID NO: 303578 - DNA, 25 bp, Mus musculus
agaaataaaagtccgcgtgccagtc

SEQ ID NO: 303579 - DNA, 25 bp, Mus musculus
ccgcgtgccagtcgcaggcatatta

SEQ ID NO: 303580 - DNA, 25 bp, Mus musculus
cgcaggcatattactttgactcgtc

SEQ ID NO: 303581 - DNA, 25 bp, Mus musculus
ctttgactcgtcctggtggctttga

SEQ ID NO: 303582 - DNA, 25 bp, Mus musculus
ggtggctttgacgtctccctgtaaa

SEQ ID NO: 303583 - DNA, 25 bp, Mus musculus
tgacgtctccctgtaaatacattta

SEQ ID NO: 303584 - DNA, 25 bp, Mus musculus
taggacgtttctgagcttgtggccc

SEQ ID NO: 303585 - DNA, 25 bp, Mus musculus
gagcggagtgattacgctgttcatc

SEQ ID NO: 303586 - DNA, 25 bp, Mus musculus
caagcgatgcaatagaggggtactc

SEQ ID NO: 303587 - DNA, 25 bp, Mus musculus
cgcagaatgacttccgcccagagca

SEQ ID NO: 303588 - DNA, 25 bp, Mus musculus
gaggggtactcgcagaatgacttcc

SEQ ID NO: 303589 - DNA, 25 bp, Mus musculus
ccagagcatcctgcgcctgtctgtg

SEQ ID NO: 303590 - DNA, 25 bp, Mus musculus
acccggcagaagctgagggcagccc

SEQ ID NO: 303591 - DNA, 25 bp, Mus musculus
gcgcagagactgaccaacaccaatc

SEQ ID NO: 303592 - DNA, 25 bp, Mus musculus
aggctgttccatgcgcagagactga

SEQ ID NO: 303593 - DNA, 25 bp, Mus musculus
gatcatccctccaggctgttccatg

SEQ ID NO: 303594 - DNA, 25 bp, Mus musculus
ctccagggtggagcgaacctccaag

SEQ ID NO: 303595 - DNA, 25 bp, Mus musculus
actgcagcaggtacttgcagagcga

SEQ ID NO: 303596 - DNA, 25 bp, Mus musculus
ctgcggaaactgcagcaggtacttg

SEQ ID NO: 303597 - DNA, 25 bp, Mus musculus
tgccatcattgactgcggaaactgc

SEQ ID NO: 303598 - DNA, 25 bp, Mus musculus
acgcatcctataatgccatcattga

SEQ ID NO: 303599 - DNA, 25 bp, Mus musculus
cggctcggtgaacgcatcctataat

SEQ ID NO: 303600 - DNA, 25 bp, Mus musculus
cccagtactacttcggctcggtgaa

SEQ ID NO: 303601 - DNA, 25 bp, Mus musculus
gcgtcatgaaacagacccagtacta

SEQ ID NO: 303602 - DNA, 25 bp, Mus musculus
gcgcgagagcagctgcgtcatgaaa

SEQ ID NO: 303603 - DNA, 25 bp, Mus musculus
accaatctcctgttcgtggtggccg

SEQ ID NO: 303604 - DNA, 25 bp, Mus musculus
tgatcccaaacgctgtagtccacca

SEQ ID NO: 303605 - DNA, 25 bp, Mus musculus
atcgtccgacacctcgatgtgatcc

SEQ ID NO: 303606 - DNA, 25 bp, Mus musculus
ggtgcgtctcgtcctcatcgtccga

SEQ ID NO: 303607 - DNA, 25 bp, Mus musculus
cagtgtctatgttggggtgcgtctc

SEQ ID NO: 303608 - DNA, 25 bp, Mus musculus
gatgtgatcccaaacgctgtagtcc

SEQ ID NO: 303609 - DNA, 25 bp, Mus musculus
cacctcgatgtgatcccaaacgctg

SEQ ID NO: 303610 - DNA, 25 bp, Mus musculus
ccacctggtgccgccagcggaagag

SEQ ID NO: 303611 - DNA, 25 bp, Mus musculus
atcttcgcttcggaggcccggactg

SEQ ID NO: 303612 - DNA, 25 bp, Mus musculus
ccgggcgctgaacagggacccacaa

SEQ ID NO: 303613 - DNA, 25 bp, Mus musculus
gctgaacagggacccacaagggcta

SEQ ID NO: 303614 - DNA, 25 bp, Mus musculus
ggcgcgggacgttacgtccttagca

SEQ ID NO: 303615 - DNA, 25 bp, Mus musculus
tacgtccttagcaacgggagtcggc

SEQ ID NO: 303616 - DNA, 25 bp, Mus musculus
cccacaagggctagagagtccgctc

SEQ ID NO: 303617 - DNA, 25 bp, Mus musculus
tagtccaccatcttcgcttcggagg

SEQ ID NO: 303618 - DNA, 25 bp, Mus musculus
ctcttccttaggtcggctaccgctg

SEQ ID NO: 303619 - DNA, 25 bp, Mus musculus
ggtccgcttgcgacgtgtcgcctgc

SEQ ID NO: 303620 - DNA, 25 bp, Mus musculus
ggagggagcagacccagcgtccacc

SEQ ID NO: 303621 - DNA, 25 bp, Mus musculus
ccctgtcactatggccgtcagtcat

SEQ ID NO: 303622 - DNA, 25 bp, Mus musculus
gccgtcagtcatttcgggtcgaccc

SEQ ID NO: 303623 - DNA, 25 bp, Mus musculus
gcatctacgaggtcgccctcattta

SEQ ID NO: 303624 - DNA, 25 bp, Mus musculus
cctcatttaaccagaggggaaattg

SEQ ID NO: 303625 - DNA, 25 bp, Mus musculus
aattgaggcatgaggagggtctctc

SEQ ID NO: 303626 - DNA, 25 bp, Mus musculus
aggagggtctctcaaggtcacgcag

SEQ ID NO: 303627 - DNA, 25 bp, Mus musculus
acgcagctcaaccttagagtgactg

SEQ ID NO: 303628 - DNA, 25 bp, Mus musculus
tagagtgactgtctcccatcgggtg

SEQ ID NO: 303629 - DNA, 25 bp, Mus musculus
caggcctcgagtcttaatccgtttc

SEQ ID NO: 303630 - DNA, 25 bp, Mus musculus
tagccagcgccagtcggagccagcg

SEQ ID NO: 303631 - DNA, 25 bp, Mus musculus
ccttctcgcgcaagagaggactgga

SEQ ID NO: 303632 - DNA, 25 bp, Mus musculus
gaggtccgcacatctgttttgacta

SEQ ID NO: 303633 - DNA, 25 bp, Mus musculus
atacctcagactgtggccgcggagc

SEQ ID NO: 303634 - DNA, 25 bp, Mus musculus
tcctgcaggaagatacctcagactg

SEQ ID NO: 303635 - DNA, 25 bp, Mus musculus
tccttgtcttccattcctgcaggaa

SEQ ID NO: 303636 - DNA, 25 bp, Mus musculus
gagctggtgcagagaccgagatacc

SEQ ID NO: 303637 - DNA, 25 bp, Mus musculus
ccgagataccgaagaggtccgcaca

SEQ ID NO: 303638 - DNA, 25 bp, Mus musculus
ggataccgaccgcttccttgtcttc

SEQ ID NO: 303639 - DNA, 25 bp, Mus musculus
taccgaagaggtccgcacatctgtt

SEQ ID NO: 303640 - DNA, 25 bp, Mus musculus
ctgttttgactacaatgcgacggtg

SEQ ID NO: 303641 - DNA, 25 bp, Mus musculus
ggagcgacgctactgacatctgcga

SEQ ID NO: 303642 - DNA, 25 bp, Mus musculus
agcctgagccgggtggataccgacc

SEQ ID NO: 303643 - DNA, 25 bp, Mus musculus
tgactacaatgcgacggtgagttgg

SEQ ID NO: 303644 - DNA, 25 bp, Mus musculus
ggtggataccgaccgcttccttgtc

SEQ ID NO: 303645 - DNA, 25 bp, Mus musculus
ctactgacatctgcgagcctgagcc

SEQ ID NO: 303646 - DNA, 25 bp, Mus musculus
gttctatgaagaaaccggtcggcta

SEQ ID NO: 303647 - DNA, 25 bp, Mus musculus
cggatcaaaccggaaccagagcctt

SEQ ID NO: 303648 - DNA, 25 bp, Mus musculus
cgctttggaactacaaccggatcaa

SEQ ID NO: 303649 - DNA, 25 bp, Mus musculus
agaagactttctcctcgctttggaa

SEQ ID NO: 303650 - DNA, 25 bp, Mus musculus
gctacccagggcctaacgacaggtc

SEQ ID NO: 303651 - DNA, 25 bp, Mus musculus
ttgagattaacgctagcctggccgc

SEQ ID NO: 303652 - DNA, 25 bp, Mus musculus
ggaggaagcctagccttgagattaa

SEQ ID NO: 303653 - DNA, 25 bp, Mus musculus
tgggccggaacgaggcaccagttcc

SEQ ID NO: 303654 - DNA, 25 bp, Mus musculus
cgagaagccggaaggcaagcgctca

SEQ ID NO: 303655 - DNA, 25 bp, Mus musculus
ccttcccacggaacagaagccagtg

SEQ ID NO: 303656 - DNA, 25 bp, Mus musculus
tacactctacgggaccggtcggcgc

SEQ ID NO: 303657 - DNA, 25 bp, Mus musculus
tccgtatcccagcatgccgagaagc

SEQ ID NO: 303658 - DNA, 25 bp, Mus musculus
gccggagctaaacgggcttgacttg

SEQ ID NO: 303659 - DNA, 25 bp, Mus musculus
tcggcgcacagcttctgggacttgt

SEQ ID NO: 303660 - DNA, 25 bp, Mus musculus
ttgggctgctatccagttgggtgta

SEQ ID NO: 303661 - DNA, 25 bp, Mus musculus
tatgccagaagacagtgaagcgcta

SEQ ID NO: 303662 - DNA, 25 bp, Mus musculus
cctcctggtgaaagtaaagatatgc

SEQ ID NO: 303663 - DNA, 25 bp, Mus musculus
gtgcacggcctcctggtgaaagtaa

SEQ ID NO: 303664 - DNA, 25 bp, Mus musculus
gctgctagcgaacttggtgcacggc

SEQ ID NO: 303665 - DNA, 25 bp, Mus musculus
ttcttcccggagatcctgcaaccgg

SEQ ID NO: 303666 - DNA, 25 bp, Mus musculus
ccgaggggacatggctgaccatttt

SEQ ID NO: 303667 - DNA, 25 bp, Mus musculus
tcgcttctatcagcgccatagccgg

SEQ ID NO: 303668 - DNA, 25 bp, Mus musculus
atccagttgggtgtatcttcgcttc

SEQ ID NO: 303669 - DNA, 25 bp, Mus musculus
gaagacagtgaagcgctacgatgtg

SEQ ID NO: 303670 - DNA, 25 bp, Mus musculus
cccggagatcctgcaaccggtggtg

SEQ ID NO: 303671 - DNA, 25 bp, Mus musculus
tgggtgtatcttcgcttctatcagc

SEQ ID NO: 303672 - DNA, 25 bp, Mus musculus
gcttcctacggctttgggctgctat

SEQ ID NO: 303673 - DNA, 25 bp, Mus musculus
tgaccattttgcttttgccaccttc

SEQ ID NO: 303674 - DNA, 25 bp, Mus musculus
acgcacacgtggtgcgacctctgtg

SEQ ID NO: 303675 - DNA, 25 bp, Mus musculus
gtcggctcgcctagggttccagcgc

SEQ ID NO: 303676 - DNA, 25 bp, Mus musculus
cgctcggtactcactagctgctagt

SEQ ID NO: 303677 - DNA, 25 bp, Mus musculus
tcactagctgctagtccgctacagc

SEQ ID NO: 303678 - DNA, 25 bp, Mus musculus
tcggcggagccagaactcattgaac

SEQ ID NO: 303679 - DNA, 25 bp, Mus musculus
ttgaactacgcgagctggcaccgtc

SEQ ID NO: 303680 - DNA, 25 bp, Mus musculus
tcggtccaggccgtacccggctgga

SEQ ID NO: 303681 - DNA, 25 bp, Mus musculus
ctggagcgtgccaacgctctgcgca

SEQ ID NO: 303682 - DNA, 25 bp, Mus musculus
gggtacaacacgcaatccgtcacag

SEQ ID NO: 303683 - DNA, 25 bp, Mus musculus
gtggccaccgtttccagcctgcagg

SEQ ID NO: 303684 - DNA, 25 bp, Mus musculus
cgacctctgtggagacttcatctgg

SEQ ID NO: 303685 - DNA, 25 bp, Mus musculus
cacagccagcgactacggaaaggga

SEQ ID NO: 303686 - DNA, 25 bp, Mus musculus
gcagcaccatagttgcgggtcaagc

SEQ ID NO: 303687 - DNA, 25 bp, Mus musculus
gtcacagcagcacgtcccgggtcgt

SEQ ID NO: 303688 - DNA, 25 bp, Mus musculus
atgaggtcatccgtcgagctgtagc

SEQ ID NO: 303689 - DNA, 25 bp, Mus musculus
ccttcgaaatgacctggagcagcac

SEQ ID NO: 303690 - DNA, 25 bp, Mus musculus
cgtagggttctctgtcccgagtaga

SEQ ID NO: 303691 - DNA, 25 bp, Mus musculus
ggccagccctttctgcagactgcaa

SEQ ID NO: 303692 - DNA, 25 bp, Mus musculus
aaagttaggtgatgggcagcctccc

SEQ ID NO: 303693 - DNA, 25 bp, Mus musculus
ggagcagcacaaccagcagtggcta

SEQ ID NO: 303694 - DNA, 25 bp, Mus musculus
gcgaggctgaaacaccttccttcga

SEQ ID NO: 303695 - DNA, 25 bp, Mus musculus
cgggctgtctacgtttcagtcctaa

SEQ ID NO: 303696 - DNA, 25 bp, Mus musculus
accagagctaaagtcgggctgtcta

SEQ ID NO: 303697 - DNA, 25 bp, Mus musculus
agggttaatccctacgccgtgcata

SEQ ID NO: 303698 - DNA, 25 bp, Mus musculus
tcccggcatcagagatgctagtttc

SEQ ID NO: 303699 - DNA, 25 bp, Mus musculus
ctctgcactagagcgggatacgaac

SEQ ID NO: 303700 - DNA, 25 bp, Mus musculus
agttcacctgccattaccgttgtcg

SEQ ID NO: 303701 - DNA, 25 bp, Mus musculus
ctcggagctcgagcagtacttcacg

SEQ ID NO: 303702 - DNA, 25 bp, Mus musculus
gcccagaggcggcaggctccgagca

SEQ ID NO: 303703 - DNA, 25 bp, Mus musculus
aaagctcggggcctctggccctttg

SEQ ID NO: 303704 - DNA, 25 bp, Mus musculus
cctcccttcgtattcacgcgccgcg

SEQ ID NO: 303705 - DNA, 25 bp, Mus musculus
agcagtgcctcccttcgtattcacg

SEQ ID NO: 303706 - DNA, 25 bp, Mus musculus
cgagcagtgcctcccttcgtattca

SEQ ID NO: 303707 - DNA, 25 bp, Mus musculus
caggctccgagcagtctctggtgcg

SEQ ID NO: 303708 - DNA, 25 bp, Mus musculus
agacagcagagcctgcggaaggcgg

SEQ ID NO: 303709 - DNA, 25 bp, Mus musculus
tgcggtctcgagcccgagcagtgcc

SEQ ID NO: 303710 - DNA, 25 bp, Mus musculus
ggctccaaagctcggggcctctggc

SEQ ID NO: 303711 - DNA, 25 bp, Mus musculus
aggtttccgtggagacagcagagcc

SEQ ID NO: 303712 - DNA, 25 bp, Mus musculus
cacctgcgagtggaagctggggcag

SEQ ID NO: 303713 - DNA, 25 bp, Mus musculus
tgacatgggcgccagcggctccaaa

SEQ ID NO: 303714 - DNA, 25 bp, Mus musculus
acatgggcgccagcggctccaaagc

SEQ ID NO: 303715 - DNA, 25 bp, Mus musculus
agcggctccaaagctcggggcctct

SEQ ID NO: 303716 - DNA, 25 bp, Mus musculus
tcgaaacgcagcactggcaaaaagg

SEQ ID NO: 303717 - DNA, 25 bp, Mus musculus
ccctacgaggccgtaaattctgcca

SEQ ID NO: 303718 - DNA, 25 bp, Mus musculus
ccacctccgaggcaggattcttaaa

SEQ ID NO: 303719 - DNA, 25 bp, Mus musculus
gcgtcgcaagcctggtgactctctt

SEQ ID NO: 303720 - DNA, 25 bp, Mus musculus
gcctggtgactctcttcctgtgaga

SEQ ID NO: 303721 - DNA, 25 bp, Mus musculus
cttcctgtgagatgggctctgaatc

SEQ ID NO: 303722 - DNA, 25 bp, Mus musculus
ctctgaatctctaggggcgccctca

SEQ ID NO: 303723 - DNA, 25 bp, Mus musculus
ggcgccctcataagtgacccaggaa

SEQ ID NO: 303724 - DNA, 25 bp, Mus musculus
cccgcacaaagaccggagtggaata

SEQ ID NO: 303725 - DNA, 25 bp, Mus musculus
ggtcgcgaagtgctcacacagattc

SEQ ID NO: 303726 - DNA, 25 bp, Mus musculus
ggggcgcctcctcctatcctaagag

SEQ ID NO: 303727 - DNA, 25 bp, Mus musculus
ctatcctaagagtgtcggtgcccga

SEQ ID NO: 303728 - DNA, 25 bp, Mus musculus
tcggtgcccgagactaagtcctgac

SEQ ID NO: 303729 - DNA, 25 bp, Mus musculus
gaagagaaacacaccctccctacga

SEQ ID NO: 303730 - DNA, 25 bp, Mus musculus
cacatacacccgaggactcacggga

SEQ ID NO: 303731 - DNA, 25 bp, Mus musculus
gtacacagccgcaactttgtcagtt

SEQ ID NO: 303732 - DNA, 25 bp, Mus musculus
ggaggcccttcgagtggctcacacc

SEQ ID NO: 303733 - DNA, 25 bp, Mus musculus
agacactggcgtcctccgtacacag

SEQ ID NO: 303734 - DNA, 25 bp, Mus musculus
tgtacctggacgagacactggcgtc

SEQ ID NO: 303735 - DNA, 25 bp, Mus musculus
tttccctctgtgtacctggacgaga

SEQ ID NO: 303736 - DNA, 25 bp, Mus musculus
gtggcacggaacgaccagctggcct

SEQ ID NO: 303737 - DNA, 25 bp, Mus musculus
accagctggcctggctctgggctga

SEQ ID NO: 303738 - DNA, 25 bp, Mus musculus
tctgggctgagagcacggctctctt

SEQ ID NO: 303739 - DNA, 25 bp, Mus musculus
gcacggctctctttccctctgtgta

SEQ ID NO: 303740 - DNA, 25 bp, Mus musculus
aggactcacgggactgagccaggta

SEQ ID NO: 303741 - DNA, 25 bp, Mus musculus
tgagccaggtacgtgttctcccttc

SEQ ID NO: 303742 - DNA, 25 bp, Mus musculus
tgtcagtttccgtgttcgggaggcc

SEQ ID NO: 303743 - DNA, 25 bp, Mus musculus
tgtacgtcttcacgcgtcccacata

SEQ ID NO: 303744 - DNA, 25 bp, Mus musculus
ctgctgggaccagcgtaggcagacc

SEQ ID NO: 303745 - DNA, 25 bp, Mus musculus
agcgagttacccgaccgagcgcagg

SEQ ID NO: 303746 - DNA, 25 bp, Mus musculus
cctccgtactgctgggaccagcgta

SEQ ID NO: 303747 - DNA, 25 bp, Mus musculus
ttggagccagagacagcgagttacc

SEQ ID NO: 303748 - DNA, 25 bp, Mus musculus
agtgagtcctccgtactgctgggac

SEQ ID NO: 303749 - DNA, 25 bp, Mus musculus
agcgcaggcaggacgtggatcatcc

SEQ ID NO: 303750 - DNA, 25 bp, Mus musculus
agacagcgagttacccgaccgagcg

SEQ ID NO: 303751 - DNA, 25 bp, Mus musculus
gccagagacagcgagttacccgacc

SEQ ID NO: 303752 - DNA, 25 bp, Mus musculus
agactgcagtgagtcctccgtactg

SEQ ID NO: 303753 - DNA, 25 bp, Mus musculus
gttccgggcgggcactgagaactta

SEQ ID NO: 303754 - DNA, 25 bp, Mus musculus
cctgcgaagactgcagtgagtcctc

SEQ ID NO: 303755 - DNA, 25 bp, Mus musculus
aacttaggaggaggtgctctgtctc

SEQ ID NO: 303756 - DNA, 25 bp, Mus musculus
taggaggaggtgctctgtctcctgc

SEQ ID NO: 303757 - DNA, 25 bp, Mus musculus
tctgtctcctgcgaagactgcagtg

SEQ ID NO: 303758 - DNA, 25 bp, Mus musculus
cgtcggcttatgtgtctccggaatg

SEQ ID NO: 303759 - DNA, 25 bp, Mus musculus
tgagcacattgccagctgtttttcg

SEQ ID NO: 303760 - DNA, 25 bp, Mus musculus
agcgtgacctcccagaactctgcta

SEQ ID NO: 303761 - DNA, 25 bp, Mus musculus
tcgtgcactgcgcacaacttgggcg

SEQ ID NO: 303762 - DNA, 25 bp, Mus musculus
ggacctgagttgatgaatcttccca

SEQ ID NO: 303763 - DNA, 25 bp, Mus musculus
acttgggcggtgctaatctgtgtac

SEQ ID NO: 303764 - DNA, 25 bp, Mus musculus
tacatagtttagctagagcggcgtc

SEQ ID NO: 303765 - DNA, 25 bp, Mus musculus
gccgcgtgtatgtggatctgaactt

SEQ ID NO: 303766 - DNA, 25 bp, Mus musculus
ggaatggactactactcccgtcgtg

SEQ ID NO: 303767 - DNA, 25 bp, Mus musculus
ctgtttttcgaaatcccgcgccgca

SEQ ID NO: 303768 - DNA, 25 bp, Mus musculus
atcttcccagatcagcccagcgtga

SEQ ID NO: 303769 - DNA, 25 bp, Mus musculus
ccttcgatgtcattgagggacctga

SEQ ID NO: 303770 - DNA, 25 bp, Mus musculus
ggggctccagtagacttgttcagta

SEQ ID NO: 303771 - DNA, 25 bp, Mus musculus
gtgttcccaattctcggttccagga

SEQ ID NO: 303772 - DNA, 25 bp, Mus musculus
ttggcgtctctgagccaataagcta

SEQ ID NO: 303773 - DNA, 25 bp, Mus musculus
ataagctagggaggcgtgacagaac

SEQ ID NO: 303774 - DNA, 25 bp, Mus musculus
gcatgggttggcgtctctgagccaa

SEQ ID NO: 303775 - DNA, 25 bp, Mus musculus
acttgtgtttttggggaggtgcgct

SEQ ID NO: 303776 - DNA, 25 bp, Mus musculus
cgtctctgagccaataagctaggga

SEQ ID NO: 303777 - DNA, 25 bp, Mus musculus
tggagccgtcgaacttgtgtttttg

SEQ ID NO: 303778 - DNA, 25 bp, Mus musculus
cccttactctggagccgtcgaactt

SEQ ID NO: 303779 - DNA, 25 bp, Mus musculus
gtgcgctcggaactgtgagtagccc

SEQ ID NO: 303780 - DNA, 25 bp, Mus musculus
tctacgtgcgctcggaactgtgagt

SEQ ID NO: 303781 - DNA, 25 bp, Mus musculus
tgaagaaatttggagtctacgtgcg

SEQ ID NO: 303782 - DNA, 25 bp, Mus musculus
tttggagtctacgtgcgctcggaac

SEQ ID NO: 303783 - DNA, 25 bp, Mus musculus
ctctggagccgtcgaacttgtgttt

SEQ ID NO: 303784 - DNA, 25 bp, Mus musculus
gccaataagctagggaggcgtgaca

SEQ ID NO: 303785 - DNA, 25 bp, Mus musculus
cctcgaggactctgtggaggagccc

SEQ ID NO: 303786 - DNA, 25 bp, Mus musculus
gcagaaagcccgacagctcgaagga

SEQ ID NO: 303787 - DNA, 25 bp, Mus musculus
gccgacgtcacacacacctttggga

SEQ ID NO: 303788 - DNA, 25 bp, Mus musculus
acgtcacacacacctttgggagaga

SEQ ID NO: 303789 - DNA, 25 bp, Mus musculus
ccgcacaccgcagctatttcgggga

SEQ ID NO: 303790 - DNA, 25 bp, Mus musculus
tttgggtgtagcagaaagcccgaca

SEQ ID NO: 303791 - DNA, 25 bp, Mus musculus
acagctcgaaggagcgcttcctccg

SEQ ID NO: 303792 - DNA, 25 bp, Mus musculus
tctctagcgcgcgtgcgtcaccggt

SEQ ID NO: 303793 - DNA, 25 bp, Mus musculus
cgtgcgtcaccggtcatcatggtaa

SEQ ID NO: 303794 - DNA, 25 bp, Mus musculus
tcatcatggtaacgagagggcatca

SEQ ID NO: 303795 - DNA, 25 bp, Mus musculus
gagggcatcatctccgcaagctttg

SEQ ID NO: 303796 - DNA, 25 bp, Mus musculus
tccgcaagctttgcgtcagctgttt

SEQ ID NO: 303797 - DNA, 25 bp, Mus musculus
tcagctgtttgctgacgtccgccga

SEQ ID NO: 303798 - DNA, 25 bp, Mus musculus
tgtttgctgacgtccgccgacgtca

SEQ ID NO: 303799 - DNA, 25 bp, Mus musculus
tatttcggggattttgggtgtagca

SEQ ID NO: 303800 - DNA, 25 bp, Mus musculus
aagccttgttcaaccgcgacgcaaa

SEQ ID NO: 303801 - DNA, 25 bp, Mus musculus
cgtggtccacgctcagcacggagct

SEQ ID NO: 303802 - DNA, 25 bp, Mus musculus
gacatgcatccgtctgttgcgaccc

SEQ ID NO: 303803 - DNA, 25 bp, Mus musculus
tgttgcgacccttacgacgtgaatc

SEQ ID NO: 303804 - DNA, 25 bp, Mus musculus
cccttacgacgtgaatctgctgcca

SEQ ID NO: 303805 - DNA, 25 bp, Mus musculus
atctgctgccacagagtggtgcccg

SEQ ID NO: 303806 - DNA, 25 bp, Mus musculus
gcggcacattcgcagggagtttgca

SEQ ID NO: 303807 - DNA, 25 bp, Mus musculus
tcgcagggagtttgcacctccgcca

SEQ ID NO: 303808 - DNA, 25 bp, Mus musculus
gcctggctccaccaactgcagaaag

SEQ ID NO: 303809 - DNA, 25 bp, Mus musculus
ccaactgcagaaagtcccggtacca

SEQ ID NO: 303810 - DNA, 25 bp, Mus musculus
tcaacacatgcagcaccaggcgacg

SEQ ID NO: 303811 - DNA, 25 bp, Mus musculus
agcacggagctcagagacatgcatc

SEQ ID NO: 303812 - DNA, 25 bp, Mus musculus
cgacgcaaagatacacgccagagtc

SEQ ID NO: 303813 - DNA, 25 bp, Mus musculus
cgacgcagtggttgtgaaaagcctt

SEQ ID NO: 303814 - DNA, 25 bp, Mus musculus
gctgcttttgtgtcaagcgtcctcc

SEQ ID NO: 303815 - DNA, 25 bp, Mus musculus
gcggagcctccaatgccacacaaag

SEQ ID NO: 303816 - DNA, 25 bp, Mus musculus
ccaatgccacacaaagctgcttttg

SEQ ID NO: 303817 - DNA, 25 bp, Mus musculus
aacccaggcatttagcgctgcgctc

SEQ ID NO: 303818 - DNA, 25 bp, Mus musculus
tttgtgtcaagcgtcctccacggga

SEQ ID NO: 303819 - DNA, 25 bp, Mus musculus
tgtgtcaagcgtcctccacgggacc

SEQ ID NO: 303820 - DNA, 25 bp, Mus musculus
acccggtgacgtcagcctgcgtgac

SEQ ID NO: 303821 - DNA, 25 bp, Mus musculus
tgacgtcagcctgcgtgaccagctc

SEQ ID NO: 303822 - DNA, 25 bp, Mus musculus
cagctggggccggtctttcgcctag

SEQ ID NO: 303823 - DNA, 25 bp, Mus musculus
tttcgcctagccgtcccggtagcag

SEQ ID NO: 303824 - DNA, 25 bp, Mus musculus
tagccgtcccggtagcaggcgctgc

SEQ ID NO: 303825 - DNA, 25 bp, Mus musculus
cctgcagttcctggaagaaaaccca

SEQ ID NO: 303826 - DNA, 25 bp, Mus musculus
tggaagaaaacccaggcatttagcg

SEQ ID NO: 303827 - DNA, 25 bp, Mus musculus
gcctgcgtgaccagctcagcagctg

SEQ ID NO: 303828 - DNA, 25 bp, Mus musculus
ccgcaggttcttgtcgatcatttta

SEQ ID NO: 303829 - DNA, 25 bp, Mus musculus
ctcaggtccgcagttccgagcgact

SEQ ID NO: 303830 - DNA, 25 bp, Mus musculus
gaagctctcaggtccgcagttccga

SEQ ID NO: 303831 - DNA, 25 bp, Mus musculus
aggtccgcagttccgagcgactgcg

SEQ ID NO: 303832 - DNA, 25 bp, Mus musculus
ggccctctgcgggaagctctcaggt

SEQ ID NO: 303833 - DNA, 25 bp, Mus musculus
ccacacggcccacggcccggctcgg

SEQ ID NO: 303834 - DNA, 25 bp, Mus musculus
tgcagcccatcctgccgtccgccgg

SEQ ID NO: 303835 - DNA, 25 bp, Mus musculus
gatcattttagagcgctcggctgcc

SEQ ID NO: 303836 - DNA, 25 bp, Mus musculus
tcgatcattttagagcgctcggctg

SEQ ID NO: 303837 - DNA, 25 bp, Mus musculus
cgtcctcccgcaggttcttgtcgat

SEQ ID NO: 303838 - DNA, 25 bp, Mus musculus
gcaggttcttgtcgatcattttaga

SEQ ID NO: 303839 - DNA, 25 bp, Mus musculus
ctcccgcaggttcttgtcgatcatt

SEQ ID NO: 303840 - DNA, 25 bp, Mus musculus
ctctgcgggaagctctcaggtccgc

SEQ ID NO: 303841 - DNA, 25 bp, Mus musculus
tcttgtcgatcattttagagcgctc

SEQ ID NO: 303842 - DNA, 25 bp, Mus musculus
ttgggcatcaggctacgcaagcagc

SEQ ID NO: 303843 - DNA, 25 bp, Mus musculus
cggtagcgcacgtcatgtgggaata

SEQ ID NO: 303844 - DNA, 25 bp, Mus musculus
gtcgcatgttaagctccaggaactg

SEQ ID NO: 303845 - DNA, 25 bp, Mus musculus
ctgcactttgatgtagttgccggca

SEQ ID NO: 303846 - DNA, 25 bp, Mus musculus
gttgccggcatcctcgtaagtgtta

SEQ ID NO: 303847 - DNA, 25 bp, Mus musculus
tcaccatcgtagtcggggaagcaga

SEQ ID NO: 303848 - DNA, 25 bp, Mus musculus
gatctccttcacatcacgtcgcatg

SEQ ID NO: 303849 - DNA, 25 bp, Mus musculus
cttctcggagaaaacgtccttcttg

SEQ ID NO: 303850 - DNA, 25 bp, Mus musculus
acagcttctgttccgtgagtctcac

SEQ ID NO: 303851 - DNA, 25 bp, Mus musculus
caccatgtcgtaagcgctcagcgca

SEQ ID NO: 303852 - DNA, 25 bp, Mus musculus
ctcagcgcagcgatgaaaatgatgc

SEQ ID NO: 303853 - DNA, 25 bp, Mus musculus
gcacgtcacaccctcaaagcagtgg

SEQ ID NO: 303854 - DNA, 25 bp, Mus musculus
atcgaacattctgtcgggtagagcc

SEQ ID NO: 303855 - DNA, 25 bp, Mus musculus
cagatgctgaggtgtgcctttttta

SEQ ID NO: 303856 - DNA, 25 bp, Mus musculus
ctagcccgggccatggaaaggctca

SEQ ID NO: 303857 - DNA, 25 bp, Mus musculus
cccgtgggcgacatttgcatagcac

SEQ ID NO: 303858 - DNA, 25 bp, Mus musculus
gcggtttgttccctagctgctcagg

SEQ ID NO: 303859 - DNA, 25 bp, Mus musculus
ctccctggaccgctgcggtttgttc

SEQ ID NO: 303860 - DNA, 25 bp, Mus musculus
cgggacaggtatgaagcacatccta

SEQ ID NO: 303861 - DNA, 25 bp, Mus musculus
ctgcgcttgcctggctgtctgacta

SEQ ID NO: 303862 - DNA, 25 bp, Mus musculus
cacatcctagttctgtcgcctggta

SEQ ID NO: 303863 - DNA, 25 bp, Mus musculus
tggcttcgtgcacgtcagcagccga

SEQ ID NO: 303864 - DNA, 25 bp, Mus musculus
gcgccctcttgtctcttagcctgag

SEQ ID NO: 303865 - DNA, 25 bp, Mus musculus
ggaggtcgtgttctctccgtactca

SEQ ID NO: 303866 - DNA, 25 bp, Mus musculus
cttctaaggagttgcagtgccgcgg

SEQ ID NO: 303867 - DNA, 25 bp, Mus musculus
ccagacctcgcgcacttctaaggag

SEQ ID NO: 303868 - DNA, 25 bp, Mus musculus
acccgcagacagtgtgccacggttc

SEQ ID NO: 303869 - DNA, 25 bp, Mus musculus
gtcctcgaagcgtaccctggctcta

SEQ ID NO: 303870 - DNA, 25 bp, Mus musculus
ggccctcaagcgcttgcttagttta

SEQ ID NO: 303871 - DNA, 25 bp, Mus musculus
tggcttaagagactgccaggcgctc

SEQ ID NO: 303872 - DNA, 25 bp, Mus musculus
ctctccagaggcgtccaatcagcga

SEQ ID NO: 303873 - DNA, 25 bp, Mus musculus
cgcacagcgagattcagttggagac

SEQ ID NO: 303874 - DNA, 25 bp, Mus musculus
tccggcattcagtccatctttctta

SEQ ID NO: 303875 - DNA, 25 bp, Mus musculus
ggcggcgcaactgaatccggcattc

SEQ ID NO: 303876 - DNA, 25 bp, Mus musculus
ctgtcccttgttttcgcccgagatg

SEQ ID NO: 303877 - DNA, 25 bp, Mus musculus
aaatggcgtctccaccgaccgtctt

SEQ ID NO: 303878 - DNA, 25 bp, Mus musculus
aaggttcggccgctccacaaaatgg

SEQ ID NO: 303879 - DNA, 25 bp, Mus musculus
ccaattgcaaaatcactggggtgta

SEQ ID NO: 303880 - DNA, 25 bp, Mus musculus
cacagctccgcacgacaggggattc

SEQ ID NO: 303881 - DNA, 25 bp, Mus musculus
tcttcaaagactcggctgagcggtc

SEQ ID NO: 303882 - DNA, 25 bp, Mus musculus
gcaacctatgaaagccagcagagcc

SEQ ID NO: 303883 - DNA, 25 bp, Mus musculus
caggcagacttaagggacagcacca

SEQ ID NO: 303884 - DNA, 25 bp, Mus musculus
cagaagctcgggcacgccctctctc

SEQ ID NO: 303885 - DNA, 25 bp, Mus musculus
cccgcgatttccagagccgccaggc

SEQ ID NO: 303886 - DNA, 25 bp, Mus musculus
tgggcccttaccaaagcagcgtagc

SEQ ID NO: 303887 - DNA, 25 bp, Mus musculus
taccaaagcagcgtagccgccgcgg

SEQ ID NO: 303888 - DNA, 25 bp, Mus musculus
ggctccggcttccacaaaggcgtcg

SEQ ID NO: 303889 - DNA, 25 bp, Mus musculus
ccgggagatgaagtacggccgcaaa

SEQ ID NO: 303890 - DNA, 25 bp, Mus musculus
tcgaagccacggctgctaggccgcg

SEQ ID NO: 303891 - DNA, 25 bp, Mus musculus
cgtgtcttcgaagccacggctgcta

SEQ ID NO: 303892 - DNA, 25 bp, Mus musculus
ctgttttcgcaagcgagcgaggccg

SEQ ID NO: 303893 - DNA, 25 bp, Mus musculus
gacacacgactgttttcgcaagcga

SEQ ID NO: 303894 - DNA, 25 bp, Mus musculus
gaagtacggccgcaaatcccgcggc

SEQ ID NO: 303895 - DNA, 25 bp, Mus musculus
tgggaccggtaattctacagccgcc

SEQ ID NO: 303896 - DNA, 25 bp, Mus musculus
ctccgcgctgggaccggtaattcta

SEQ ID NO: 303897 - DNA, 25 bp, Mus musculus
tagcctgggcccttaccaaagcagc

SEQ ID NO: 303898 - DNA, 25 bp, Mus musculus
gctgtggccatgtctgtatcctcca

SEQ ID NO: 303899 - DNA, 25 bp, Mus musculus
agatcggttcctccgctgtggccat

SEQ ID NO: 303900 - DNA, 25 bp, Mus musculus
gtcggcaggagagatcggttcctcc

SEQ ID NO: 303901 - DNA, 25 bp, Mus musculus
gtgaaagctgtcttcctgcgccggt

SEQ ID NO: 303902 - DNA, 25 bp, Mus musculus
caccagaggccggtgaaagctgtct

SEQ ID NO: 303903 - DNA, 25 bp, Mus musculus
tttcccacaatgcacacaggggcgg

SEQ ID NO: 303904 - DNA, 25 bp, Mus musculus
tgcggagagttacggactacatttc

SEQ ID NO: 303905 - DNA, 25 bp, Mus musculus
gcctctaagacacggaagaaggcgg

SEQ ID NO: 303906 - DNA, 25 bp, Mus musculus
gaggcaacccgggtcctaggtcaga

SEQ ID NO: 303907 - DNA, 25 bp, Mus musculus
atgtctgtatcctccaggggcggta

SEQ ID NO: 303908 - DNA, 25 bp, Mus musculus
agctttaaggctgcggagagttacg

SEQ ID NO: 303909 - DNA, 25 bp, Mus musculus
gaaccgctcccgcagctttaaggct

SEQ ID NO: 303910 - DNA, 25 bp, Mus musculus
catcgccaggctcgggagcccggaa

SEQ ID NO: 303911 - DNA, 25 bp, Mus musculus
cttcctgcgccggtggccggttaag

SEQ ID NO: 303912 - DNA, 25 bp, Mus musculus
tgagccttcttaccggcgcgcagct

SEQ ID NO: 303913 - DNA, 25 bp, Mus musculus
ctggcgcaggagctactgtacatct

SEQ ID NO: 303914 - DNA, 25 bp, Mus musculus
ctgagccacatcttccagcagaagc

SEQ ID NO: 303915 - DNA, 25 bp, Mus musculus
cgggctcggagcgaatcaccgataa

SEQ ID NO: 303916 - DNA, 25 bp, Mus musculus
tgctgcagctaatggctcgagaccc

SEQ ID NO: 303917 - DNA, 25 bp, Mus musculus
gtcttttccatcctgctggcccata

SEQ ID NO: 303918 - DNA, 25 bp, Mus musculus
tcgtgcgccgcaaggaccaattcct

SEQ ID NO: 303919 - DNA, 25 bp, Mus musculus
cccagtgtgcctgccaaagttcagt

SEQ ID NO: 303920 - DNA, 25 bp, Mus musculus
tgctgctgatctccactgaccgtga

SEQ ID NO: 303921 - DNA, 25 bp, Mus musculus
cactgaccgtgaggacttctttgca

SEQ ID NO: 303922 - DNA, 25 bp, Mus musculus
cagtctctgactgccgacggcgctt

SEQ ID NO: 303923 - DNA, 25 bp, Mus musculus
gcgcttccaggaacgcctccgaaag

SEQ ID NO: 303924 - DNA, 25 bp, Mus musculus
gaggcgctgcgcacaccttactaca

SEQ ID NO: 303925 - DNA, 25 bp, Mus musculus
tgcacctgcttttcaacctcattag

SEQ ID NO: 303926 - DNA, 25 bp, Mus musculus
ggccagggagctgcagggaactggg

SEQ ID NO: 303927 - DNA, 25 bp, Mus musculus
gcggaaagccagcgcggggcgtcag

SEQ ID NO: 303928 - DNA, 25 bp, Mus musculus
cacaagtggccccagcaggtgaccg

SEQ ID NO: 303929 - DNA, 25 bp, Mus musculus
agtggccccagcaggtgaccgtgcc

SEQ ID NO: 303930 - DNA, 25 bp, Mus musculus
cagcaggtgaccgtgccgggtcccg

SEQ ID NO: 303931 - DNA, 25 bp, Mus musculus
gggatcaaagctgccggcaaggggc

SEQ ID NO: 303932 - DNA, 25 bp, Mus musculus
cgctccggaggggagcggaaagcca

SEQ ID NO: 303933 - DNA, 25 bp, Mus musculus
tgcgagcgtgggagcgcagggttgc

SEQ ID NO: 303934 - DNA, 25 bp, Mus musculus
cagggttgccggaggcgacagggac

SEQ ID NO: 303935 - DNA, 25 bp, Mus musculus
cgacagggaccaggaaagacgacga

SEQ ID NO: 303936 - DNA, 25 bp, Mus musculus
gaccaggaaagacgacgaggtagcc

SEQ ID NO: 303937 - DNA, 25 bp, Mus musculus
ccaggaaagacgacgaggtagcccg

SEQ ID NO: 303938 - DNA, 25 bp, Mus musculus
cgtgcgggatcaaagctgccggcaa

SEQ ID NO: 303939 - DNA, 25 bp, Mus musculus
agggcccccgggtcgctcacaagtg

SEQ ID NO: 303940 - DNA, 25 bp, Mus musculus
ccaagcaggggcacagcgcaccgtt

SEQ ID NO: 303941 - DNA, 25 bp, Mus musculus
ttcctgcctgtgaccgaccagcttt

SEQ ID NO: 303942 - DNA, 25 bp, Mus musculus
caccgtttctgcagatgcgaggtgg

SEQ ID NO: 303943 - DNA, 25 bp, Mus musculus
agcgggttatcgcttcctgcctgtg

SEQ ID NO: 303944 - DNA, 25 bp, Mus musculus
gcacagcgcaccgtttctgcagatg

SEQ ID NO: 303945 - DNA, 25 bp, Mus musculus
cttgggagattgtttccctggttag

SEQ ID NO: 303946 - DNA, 25 bp, Mus musculus
gagccctgctgagcgggttatcgct

SEQ ID NO: 303947 - DNA, 25 bp, Mus musculus
tgtgaccgaccagctttgcaggtgc

SEQ ID NO: 303948 - DNA, 25 bp, Mus musculus
agattgtttccctggttagagaatc

SEQ ID NO: 303949 - DNA, 25 bp, Mus musculus
cgaccagctttgcaggtgcggagca

SEQ ID NO: 303950 - DNA, 25 bp, Mus musculus
cgaatccgctgccagagagcgactg

SEQ ID NO: 303951 - DNA, 25 bp, Mus musculus
ctgccagagagcgactggcgatgct

SEQ ID NO: 303952 - DNA, 25 bp, Mus musculus
cgatgctggaggttctggagtcgaa

SEQ ID NO: 303953 - DNA, 25 bp, Mus musculus
gatgcgcgcgatcaccgcgaggact

SEQ ID NO: 303954 - DNA, 25 bp, Mus musculus
atactgttagcttgcagacaccgcg

SEQ ID NO: 303955 - DNA, 25 bp, Mus musculus
attggtcctgcgtgcaatactgtta

SEQ ID NO: 303956 - DNA, 25 bp, Mus musculus
gagccacacgctgtcattggtcctg

SEQ ID NO: 303957 - DNA, 25 bp, Mus musculus
agacaccgcgtcctggtggcacgag

SEQ ID NO: 303958 - DNA, 25 bp, Mus musculus
tggcacgaggaccactcccgcaaaa

SEQ ID NO: 303959 - DNA, 25 bp, Mus musculus
aaccagtcggatgtcttcgtcccga

SEQ ID NO: 303960 - DNA, 25 bp, Mus musculus
cctcggagaggagcctgtctctctc

SEQ ID NO: 303961 - DNA, 25 bp, Mus musculus
tcgtcccgatgccattaacccttta

SEQ ID NO: 303962 - DNA, 25 bp, Mus musculus
cctttaactcttcggtccctgtgcg

SEQ ID NO: 303963 - DNA, 25 bp, Mus musculus
ccctgtgcgttgtttgctgctccaa

SEQ ID NO: 303964 - DNA, 25 bp, Mus musculus
ccaaagggctcttggagattggcgc

SEQ ID NO: 303965 - DNA, 25 bp, Mus musculus
gctccaagcgccaggaggacaccgg

SEQ ID NO: 303966 - DNA, 25 bp, Mus musculus
cccacaagacagagcgggagccatg

SEQ ID NO: 303967 - DNA, 25 bp, Mus musculus
tctaaaaacgaggatacgacagccc

SEQ ID NO: 303968 - DNA, 25 bp, Mus musculus
gtgtcgggcctagagacaatccctc

SEQ ID NO: 303969 - DNA, 25 bp, Mus musculus
tccggttcactaccggaagtcgtgc

SEQ ID NO: 303970 - DNA, 25 bp, Mus musculus
cggttcggccaccaaactgtgtctg

SEQ ID NO: 303971 - DNA, 25 bp, Mus musculus
ccaaactgtgtctgtcgctggcagc

SEQ ID NO: 303972 - DNA, 25 bp, Mus musculus
tgcttgagtcgagccatcatgccta

SEQ ID NO: 303973 - DNA, 25 bp, Mus musculus
tatccgcgctctgtgcactatctgc

SEQ ID NO: 303974 - DNA, 25 bp, Mus musculus
gcactatctgctccgacttcttcga

SEQ ID NO: 303975 - DNA, 25 bp, Mus musculus
tcttcgatcactcccgtgacgtggc

SEQ ID NO: 303976 - DNA, 25 bp, Mus musculus
tgacgtggctgccatccactgtggc

SEQ ID NO: 303977 - DNA, 25 bp, Mus musculus
cccgtgcgtgtcctagaaccactta

SEQ ID NO: 303978 - DNA, 25 bp, Mus musculus
tccctcctccgaactaagacaagtg

SEQ ID NO: 303979 - DNA, 25 bp, Mus musculus
tcaggcgtgggtttgttattccttc

SEQ ID NO: 303980 - DNA, 25 bp, Mus musculus
tttgtccaatcagagggaagcactc

SEQ ID NO: 303981 - DNA, 25 bp, Mus musculus
gtggccacacttttcatctgcaatg

SEQ ID NO: 303982 - DNA, 25 bp, Mus musculus
ccttgccttactctaaggctccttg

SEQ ID NO: 303983 - DNA, 25 bp, Mus musculus
tcacccgccgatcacccgcgggagc

SEQ ID NO: 303984 - DNA, 25 bp, Mus musculus
cggctgtaacgcagtcccgacacga

SEQ ID NO: 303985 - DNA, 25 bp, Mus musculus
tggtggcgtcctcacccttgcctta

SEQ ID NO: 303986 - DNA, 25 bp, Mus musculus
actctaaggctccttgctctcggta

SEQ ID NO: 303987 - DNA, 25 bp, Mus musculus
aaggctccttgctctcggtagctcc

SEQ ID NO: 303988 - DNA, 25 bp, Mus musculus
cccggcgccctagccaatggaggcg

SEQ ID NO: 303989 - DNA, 25 bp, Mus musculus
ggatgaagttgtcctgcccctttca

SEQ ID NO: 303990 - DNA, 25 bp, Mus musculus
taacccggctgtaacgcagtcccga

SEQ ID NO: 303991 - DNA, 25 bp, Mus musculus
ccggctgtagtagcacgggagacca

SEQ ID NO: 303992 - DNA, 25 bp, Mus musculus
ggagaccagagtgcagctcaggacc

SEQ ID NO: 303993 - DNA, 25 bp, Mus musculus
caggacccctttatgtctcaaaaag

SEQ ID NO: 303994 - DNA, 25 bp, Mus musculus
tagttaacccggctgtaacgcagtc

SEQ ID NO: 303995 - DNA, 25 bp, Mus musculus
ccactctgctggtggagcccggctg

SEQ ID NO: 303996 - DNA, 25 bp, Mus musculus
cggccgtaacgttcctccaaatcag

SEQ ID NO: 303997 - DNA, 25 bp, Mus musculus
tccactgctagcaaacctgagaatg

SEQ ID NO: 303998 - DNA, 25 bp, Mus musculus
tgcgtcaattcctgccgtcacagtc

SEQ ID NO: 303999 - DNA, 25 bp, Mus musculus
cccaggcattctgcacgagaggcac

SEQ ID NO: 304000 - DNA, 25 bp, Mus musculus
acgccctgactgacggaacagttga

SEQ ID NO: 304001 - DNA, 25 bp, Mus musculus
ttgacgaatcaacgcgaagaactcc

SEQ ID NO: 304002 - DNA, 25 bp, Mus musculus
tcaggcgtcccaagaagaggctatt

SEQ ID NO: 304003 - DNA, 25 bp, Mus musculus
tccttggttactatgacgcccggcc

SEQ ID NO: 304004 - DNA, 25 bp, Mus musculus
gttgttgatccgtacccagtgggca

SEQ ID NO: 304005 - DNA, 25 bp, Mus musculus
gggcgagcatcactggaacatcatt

SEQ ID NO: 304006 - DNA, 25 bp, Mus musculus
gccgagcctcccagatgttgacacg

SEQ ID NO: 304007 - DNA, 25 bp, Mus musculus
gaggatgataaacgctgccagctca

SEQ ID NO: 304008 - DNA, 25 bp, Mus musculus
ggaaacctgcctttcagaccgaatc

SEQ ID NO: 304009 - DNA, 25 bp, Mus musculus
tgccagctcaaaaccgaaacgattg

SEQ ID NO: 304010 - DNA, 25 bp, Mus musculus
ctgggttccgataggaagctaagcc

SEQ ID NO: 304011 - DNA, 25 bp, Mus musculus
agcccagggcgttggaaatctaatt

SEQ ID NO: 304012 - DNA, 25 bp, Mus musculus
aaatctaattggctacgtccgccgc

SEQ ID NO: 304013 - DNA, 25 bp, Mus musculus
acgtccgccgcagcgtaaagtctga

SEQ ID NO: 304014 - DNA, 25 bp, Mus musculus
ggccctgccacgtagattggctctc

SEQ ID NO: 304015 - DNA, 25 bp, Mus musculus
ttggctctccctgttacgtcactgg

SEQ ID NO: 304016 - DNA, 25 bp, Mus musculus
aaccagttcctcgtcttctgttctg

SEQ ID NO: 304017 - DNA, 25 bp, Mus musculus
ttctgttctggctgatcctggaccc

SEQ ID NO: 304018 - DNA, 25 bp, Mus musculus
caccagagttggtcagtctagttgg

SEQ ID NO: 304019 - DNA, 25 bp, Mus musculus
tcaggcggcctgtaagtactttgga

SEQ ID NO: 304020 - DNA, 25 bp, Mus musculus
ctttggaccgatagatccacttcta

SEQ ID NO: 304021 - DNA, 25 bp, Mus musculus
tgcagacgccatgaaggcactgatc

SEQ ID NO: 304022 - DNA, 25 bp, Mus musculus
caatgggcatctgactcgcgagttc

SEQ ID NO: 304023 - DNA, 25 bp, Mus musculus
agctaagcctcctctttcggttccg

SEQ ID NO: 304024 - DNA, 25 bp, Mus musculus
cactgtcgcactggatcggccaggg

SEQ ID NO: 304025 - DNA, 25 bp, Mus musculus
gctgggactcctataccgcaggccg

SEQ ID NO: 304026 - DNA, 25 bp, Mus musculus
gggactcctataccgcaggccgcgg

SEQ ID NO: 304027 - DNA, 25 bp, Mus musculus
cggcactgtcgcactggatcggcca

SEQ ID NO: 304028 - DNA, 25 bp, Mus musculus
cactggatcggccaggggcctcgag

SEQ ID NO: 304029 - DNA, 25 bp, Mus musculus
gaacccgcccggctcatagccaggc

SEQ ID NO: 304030 - DNA, 25 bp, Mus musculus
cagcctccgcgaccggctcacaaca

SEQ ID NO: 304031 - DNA, 25 bp, Mus musculus
ggctcacaacatccgcccagctttt

SEQ ID NO: 304032 - DNA, 25 bp, Mus musculus
cgcccagcttttcggctacggcacc

SEQ ID NO: 304033 - DNA, 25 bp, Mus musculus
gctacggcacccgtccagggccaaa

SEQ ID NO: 304034 - DNA, 25 bp, Mus musculus
tccagggccaaaccgcgtgcccgct

SEQ ID NO: 304035 - DNA, 25 bp, Mus musculus
agccgcgcacgcgcatatgcacaga

SEQ ID NO: 304036 - DNA, 25 bp, Mus musculus
cgcgcacgcgcatatgcacagaccg

SEQ ID NO: 304037 - DNA, 25 bp, Mus musculus
aggccgcggcactgtcgcactggat

SEQ ID NO: 304038 - DNA, 25 bp, Mus musculus
agtgtgcacagtccgatagaggccc

SEQ ID NO: 304039 - DNA, 25 bp, Mus musculus
ctgggacccgcagggccctgtataa

SEQ ID NO: 304040 - DNA, 25 bp, Mus musculus
gccctgtataagctccggccagtcg

SEQ ID NO: 304041 - DNA, 25 bp, Mus musculus
tcggtctttcggtagcagctaagtc

SEQ ID NO: 304042 - DNA, 25 bp, Mus musculus
cagtttccgctacactcagtggcga

SEQ ID NO: 304043 - DNA, 25 bp, Mus musculus
gtcgccacccagttccctcggtcta

SEQ ID NO: 304044 - DNA, 25 bp, Mus musculus
ggtagcagctaagtcccggaagtga

SEQ ID NO: 304045 - DNA, 25 bp, Mus musculus
cccatactgcgtggtgacctccggg

SEQ ID NO: 304046 - DNA, 25 bp, Mus musculus
tggggctcactcagcagcacctgcg

SEQ ID NO: 304047 - DNA, 25 bp, Mus musculus
cctgacgctccatagtcggtctttc

SEQ ID NO: 304048 - DNA, 25 bp, Mus musculus
cagggtcaggctcagcccgggctac

SEQ ID NO: 304049 - DNA, 25 bp, Mus musculus
acactcagtggcgacctgggacccg

SEQ ID NO: 304050 - DNA, 25 bp, Mus musculus
ctcagcagcacctgcgcaggggaca

SEQ ID NO: 304051 - DNA, 25 bp, Mus musculus
ggtctacacaccagtgtgcacagtc

SEQ ID NO: 304052 - DNA, 25 bp, Mus musculus
tcctggacgtcaggcatggaatggc

SEQ ID NO: 304053 - DNA, 25 bp, Mus musculus
ccgtagtaccgctgctgttcgtaca

SEQ ID NO: 304054 - DNA, 25 bp, Mus musculus
tgctgctaccgtacatgcgctcatc

SEQ ID NO: 304055 - DNA, 25 bp, Mus musculus
cactgtatgccgacgccattcggga

SEQ ID NO: 304056 - DNA, 25 bp, Mus musculus
tagtcatggctggacagcttctccc

SEQ ID NO: 304057 - DNA, 25 bp, Mus musculus
ctcggctgctatagtcatggctgga

SEQ ID NO: 304058 - DNA, 25 bp, Mus musculus
gttcataccctttgcctcggctgct

SEQ ID NO: 304059 - DNA, 25 bp, Mus musculus
ttgaagtcgctctgcagtgtcccgt

SEQ ID NO: 304060 - DNA, 25 bp, Mus musculus
gtgcccggccatgggccatgctcag

SEQ ID NO: 304061 - DNA, 25 bp, Mus musculus
gccctaaggggctgacagggctctc

SEQ ID NO: 304062 - DNA, 25 bp, Mus musculus
ggtccgtccttgacatgttcctgga

SEQ ID NO: 304063 - DNA, 25 bp, Mus musculus
gcccgccttttgaagtcgctctgca

SEQ ID NO: 304064 - DNA, 25 bp, Mus musculus
agggctctcctcttcagaggcctgg

SEQ ID NO: 304065 - DNA, 25 bp, Mus musculus
tgcagtgtcccgttcccgttcatac

SEQ ID NO: 304066 - DNA, 25 bp, Mus musculus
ctgatggtctgtatgcccacgctgc

SEQ ID NO: 304067 - DNA, 25 bp, Mus musculus
tctgtatgcccacgctgctcatggc

SEQ ID NO: 304068 - DNA, 25 bp, Mus musculus
atgaggaagcagtggcatcgtgctt

SEQ ID NO: 304069 - DNA, 25 bp, Mus musculus
cagtggcatcgtgcttgctgtcaga

SEQ ID NO: 304070 - DNA, 25 bp, Mus musculus
gcttgctgtcagagcctgagtctga

SEQ ID NO: 304071 - DNA, 25 bp, Mus musculus
cctgagtctgagtgacgggaaagac

SEQ ID NO: 304072 - DNA, 25 bp, Mus musculus
ctgagtgacgggaaagacgagacct

SEQ ID NO: 304073 - DNA, 25 bp, Mus musculus
acgggttgctcccagtcggcattgt

SEQ ID NO: 304074 - DNA, 25 bp, Mus musculus
tcccagtcggcattgtcctcatcat

SEQ ID NO: 304075 - DNA, 25 bp, Mus musculus
atcatctgtctgcacactgcagtca

SEQ ID NO: 304076 - DNA, 25 bp, Mus musculus
tctgcacactgcagtcagcactgcg

SEQ ID NO: 304077 - DNA, 25 bp, Mus musculus
tgcgcctgcgagtcacaaggtagcg

SEQ ID NO: 304078 - DNA, 25 bp, Mus musculus
cagtcgctgatggtctgtatgccca

SEQ ID NO: 304079 - DNA, 25 bp, Mus musculus
tcctgcgcctgcgagtcacaaggta

SEQ ID NO: 304080 - DNA, 25 bp, Mus musculus
gtctctgtctgtgcgcccgtctgac

SEQ ID NO: 304081 - DNA, 25 bp, Mus musculus
gaaagcggagatactggagttcgcc

SEQ ID NO: 304082 - DNA, 25 bp, Mus musculus
ctggagttcgccgtgggctacttga

SEQ ID NO: 304083 - DNA, 25 bp, Mus musculus
taacacccgcgcgtgtctgtctctg

SEQ ID NO: 304084 - DNA, 25 bp, Mus musculus
gtgcgcccgtctgacctcggtatct

SEQ ID NO: 304085 - DNA, 25 bp, Mus musculus
aggcgctcgccagctgctacttgtc

SEQ ID NO: 304086 - DNA, 25 bp, Mus musculus
gctgctacttgtccggcttccgcga

SEQ ID NO: 304087 - DNA, 25 bp, Mus musculus
gcttccgcgagtgcctgcttcgctt

SEQ ID NO: 304088 - DNA, 25 bp, Mus musculus
aggccgtagatccagggctcccagc

SEQ ID NO: 304089 - DNA, 25 bp, Mus musculus
ccttacagacaagacggggcgccca

SEQ ID NO: 304090 - DNA, 25 bp, Mus musculus
ttttggagaccttggccctgagctt

SEQ ID NO: 304091 - DNA, 25 bp, Mus musculus
agaccttggccctgagcttttgggg

SEQ ID NO: 304092 - DNA, 25 bp, Mus musculus
cctgcttcgcttggcggcctttgcg

SEQ ID NO: 304093 - DNA, 25 bp, Mus musculus
gcaccatggcgaggttaataacacc

SEQ ID NO: 304094 - DNA, 25 bp, Mus musculus
ttcgaattcgctgctgttccacctc

SEQ ID NO: 304095 - DNA, 25 bp, Mus musculus
ttgcttcttctaggcgctgccggcg

SEQ ID NO: 304096 - DNA, 25 bp, Mus musculus
gctttgcttcttctaggcgctgccg

SEQ ID NO: 304097 - DNA, 25 bp, Mus musculus
gctgctgctttgcttcttctaggcg

SEQ ID NO: 304098 - DNA, 25 bp, Mus musculus
ctcctcggaggagtcctcgatggtg

SEQ ID NO: 304099 - DNA, 25 bp, Mus musculus
ttccacctcccgcatcttctcctgc

SEQ ID NO: 304100 - DNA, 25 bp, Mus musculus
ctgtgcttcgaattcgctgctgttc

SEQ ID NO: 304101 - DNA, 25 bp, Mus musculus
cgggctgtgcttcgaattcgctgct

SEQ ID NO: 304102 - DNA, 25 bp, Mus musculus
gtcttgcgggctgtgcttcgaattc

SEQ ID NO: 304103 - DNA, 25 bp, Mus musculus
tcttccttgtcacgccgggtcttgc

SEQ ID NO: 304104 - DNA, 25 bp, Mus musculus
aagctcttccttgtcacgccgggtc

SEQ ID NO: 304105 - DNA, 25 bp, Mus musculus
tcgaagctcttccttgtcacgccgg

SEQ ID NO: 304106 - DNA, 25 bp, Mus musculus
gccgctgagctcgaagctcttcctt

SEQ ID NO: 304107 - DNA, 25 bp, Mus musculus
tcctgctcacgcagcagctcctctt

SEQ ID NO: 304108 - DNA, 25 bp, Mus musculus
gccagctagtgctgaaggcggcttc

SEQ ID NO: 304109 - DNA, 25 bp, Mus musculus
gcccgagaagactcgtgtccacgca

SEQ ID NO: 304110 - DNA, 25 bp, Mus musculus
agaagactcgtgtccacgcaccagc

SEQ ID NO: 304111 - DNA, 25 bp, Mus musculus
gccagcccgagaagactcgtgtcca

SEQ ID NO: 304112 - DNA, 25 bp, Mus musculus
tcacgccagcccgagaagactcgtg

SEQ ID NO: 304113 - DNA, 25 bp, Mus musculus
ggcggcgctcacaatctccgctcca

SEQ ID NO: 304114 - DNA, 25 bp, Mus musculus
cctcgttgcccatggtgggcaggcg

SEQ ID NO: 304115 - DNA, 25 bp, Mus musculus
tgtccgccgccagctagtgctgaag

SEQ ID NO: 304116 - DNA, 25 bp, Mus musculus
tgctgaaggcggcttccctgctccg

SEQ ID NO: 304117 - DNA, 25 bp, Mus musculus
cgccctccaggctggcctcgttgcc

SEQ ID NO: 304118 - DNA, 25 bp, Mus musculus
gcccggacccagaccagagcctccg

SEQ ID NO: 304119 - DNA, 25 bp, Mus musculus
cgtgtccacgcaccagcctcggggt

SEQ ID NO: 304120 - DNA, 25 bp, Mus musculus
gcgcatgcgccctccgcagccaacg

SEQ ID NO: 304121 - DNA, 25 bp, Mus musculus
gtgttgaatgaaggccggcggcctc

SEQ ID NO: 304122 - DNA, 25 bp, Mus musculus
gctctgagattcgtcccactttgtt

SEQ ID NO: 304123 - DNA, 25 bp, Mus musculus
gaagacgcgggcctcaaaaagtgta

SEQ ID NO: 304124 - DNA, 25 bp, Mus musculus
gttcgctgctcctggaaaagcccga

SEQ ID NO: 304125 - DNA, 25 bp, Mus musculus
cgccctgtctaccttgccggggaag

SEQ ID NO: 304126 - DNA, 25 bp, Mus musculus
ctgctcttcgctgctactgtaggtg

SEQ ID NO: 304127 - DNA, 25 bp, Mus musculus
ggaccgaaccgcgtgttcgcctgta

SEQ ID NO: 304128 - DNA, 25 bp, Mus musculus
tcgcctgtacgtgctctctgtcgta

SEQ ID NO: 304129 - DNA, 25 bp, Mus musculus
gtgagcgcggatctgccaagattca

SEQ ID NO: 304130 - DNA, 25 bp, Mus musculus
atttcccaaccgagaagtgagcgcg

SEQ ID NO: 304131 - DNA, 25 bp, Mus musculus
ccactttgttgtctgcgtgcccaga

SEQ ID NO: 304132 - DNA, 25 bp, Mus musculus
ctctgtcgtacttggacaagctctg

SEQ ID NO: 304133 - DNA, 25 bp, Mus musculus
ttctacgtcacttccggtccagagc

SEQ ID NO: 304134 - DNA, 25 bp, Mus musculus
aggccctgcgagcttcctttctacg

SEQ ID NO: 304135 - DNA, 25 bp, Mus musculus
gacgaccgtacgtatgcattctcca

SEQ ID NO: 304136 - DNA, 25 bp, Mus musculus
agacgcctgcggctcttccgaggca

SEQ ID NO: 304137 - DNA, 25 bp, Mus musculus
aacgccaatgccctacagacgcctg

SEQ ID NO: 304138 - DNA, 25 bp, Mus musculus
ccagcaaggccgtctgtggggctcc

SEQ ID NO: 304139 - DNA, 25 bp, Mus musculus
gctctccagcaaggccgtctgtggg

SEQ ID NO: 304140 - DNA, 25 bp, Mus musculus
ggccatactgcgctctccagcaagg

SEQ ID NO: 304141 - DNA, 25 bp, Mus musculus
gttcgaggccatactgcgctctcca

SEQ ID NO: 304142 - DNA, 25 bp, Mus musculus
caggacacgggttcgaggccatact

SEQ ID NO: 304143 - DNA, 25 bp, Mus musculus
cgcacctctcaggacacgggttcga

SEQ ID NO: 304144 - DNA, 25 bp, Mus musculus
tgagtgcgcacctctcaggacacgg

SEQ ID NO: 304145 - DNA, 25 bp, Mus musculus
ctcttccgaggcagtgtacaggact

SEQ ID NO: 304146 - DNA, 25 bp, Mus musculus
gttcctcagcagcacaacgccaatg

SEQ ID NO: 304147 - DNA, 25 bp, Mus musculus
ctggggtcgtatccccgagccgtgc

SEQ ID NO: 304148 - DNA, 25 bp, Mus musculus
cttccgaggcagtgtacaggactgg

SEQ ID NO: 304149 - DNA, 25 bp, Mus musculus
tggccgaggacgacgcgttcctacc

SEQ ID NO: 304150 - DNA, 25 bp, Mus musculus
tcacccagcaccacgggcaggccgc

SEQ ID NO: 304151 - DNA, 25 bp, Mus musculus
cagccaatcccacggccgactcgga

SEQ ID NO: 304152 - DNA, 25 bp, Mus musculus
tgacacgcgagtgccgcagccaatc

SEQ ID NO: 304153 - DNA, 25 bp, Mus musculus
tcagccttcagctaccggacggaga

SEQ ID NO: 304154 - DNA, 25 bp, Mus musculus
cgcgatcacgtaccgagcggtgaga

SEQ ID NO: 304155 - DNA, 25 bp, Mus musculus
gcaaggacgtccgtggccgtgtccc

SEQ ID NO: 304156 - DNA, 25 bp, Mus musculus
caggccgcggcaggtgttcgctcct

SEQ ID NO: 304157 - DNA, 25 bp, Mus musculus
ctagcaaccgcctgacacgcgagtg

SEQ ID NO: 304158 - DNA, 25 bp, Mus musculus
gagcggcgccgactagccttcagcg

SEQ ID NO: 304159 - DNA, 25 bp, Mus musculus
gactccgcgcgaagctaccgccgct

SEQ ID NO: 304160 - DNA, 25 bp, Mus musculus
aggcgggaggcgcactcacccagca

SEQ ID NO: 304161 - DNA, 25 bp, Mus musculus
tccgcgcgatcacgtaccgagcggt

SEQ ID NO: 304162 - DNA, 25 bp, Mus musculus
cttcagctaccggacggagagccga

SEQ ID NO: 304163 - DNA, 25 bp, Mus musculus
gcgccgcctcctcacccgcaaggac

SEQ ID NO: 304164 - DNA, 25 bp, Mus musculus
ccgggagtactgtcaccgtagttct

SEQ ID NO: 304165 - DNA, 25 bp, Mus musculus
ctcgtcgcttcctctcagggttgcg

SEQ ID NO: 304166 - DNA, 25 bp, Mus musculus
tcggctgatcggcaagcacttttcc

SEQ ID NO: 304167 - DNA, 25 bp, Mus musculus
ccttgaggtgagcaggagcatttcc

SEQ ID NO: 304168 - DNA, 25 bp, Mus musculus
actcggagtcctcgccttgaggtga

SEQ ID NO: 304169 - DNA, 25 bp, Mus musculus
ttgagcaatcgtggctgaactgaga

SEQ ID NO: 304170 - DNA, 25 bp, Mus musculus
ggcgtggatgcgttcttgagcaatc

SEQ ID NO: 304171 - DNA, 25 bp, Mus musculus
ccatgattggttaagcgtctagctc

SEQ ID NO: 304172 - DNA, 25 bp, Mus musculus
atgctccacgcgtctgccatgattg

SEQ ID NO: 304173 - DNA, 25 bp, Mus musculus
ttcggtgaggataaaatagcaactc

SEQ ID NO: 304174 - DNA, 25 bp, Mus musculus
ccctgcttgcttaaaggatgagtga

SEQ ID NO: 304175 - DNA, 25 bp, Mus musculus
ggaagatctacttcgcttgcgcgaa

SEQ ID NO: 304176 - DNA, 25 bp, Mus musculus
ccgtagttcttactgcgcaagcgta

SEQ ID NO: 304177 - DNA, 25 bp, Mus musculus
cgcgtaatacaaggcaaggaagatc

SEQ ID NO: 304178 - DNA, 25 bp, Mus musculus
ccaacatctccagtatgtgtgctgc

SEQ ID NO: 304179 - DNA, 25 bp, Mus musculus
ctagtacggattccacgtttgagtc

SEQ ID NO: 304180 - DNA, 25 bp, Mus musculus
tagtacggattccacgtttgagtcc

SEQ ID NO: 304181 - DNA, 25 bp, Mus musculus
gattccacgtttgagtcccaacatc

SEQ ID NO: 304182 - DNA, 25 bp, Mus musculus
ttccacgtttgagtcccaacatctc

SEQ ID NO: 304183 - DNA, 25 bp, Mus musculus
cccaacatctccagtatgtgtgctg

SEQ ID NO: 304184 - DNA, 25 bp, Mus musculus
ccagtatgtgtgctgctcggctctc

SEQ ID NO: 304185 - DNA, 25 bp, Mus musculus
aacatctccagtatgtgtgctgctc

SEQ ID NO: 304186 - DNA, 25 bp, Mus musculus
catctccagtatgtgtgctgctcgg

SEQ ID NO: 304187 - DNA, 25 bp, Mus musculus
ctccagtatgtgtgctgctcggctc

SEQ ID NO: 304188 - DNA, 25 bp, Mus musculus
tccagtatgtgtgctgctcggctct

SEQ ID NO: 304189 - DNA, 25 bp, Mus musculus
cgctagtacggattccacgtttgag

SEQ ID NO: 304190 - DNA, 25 bp, Mus musculus
atctccagtatgtgtgctgctcggc

SEQ ID NO: 304191 - DNA, 25 bp, Mus musculus
gtcccaacatctccagtatgtgtgc

SEQ ID NO: 304192 - DNA, 25 bp, Mus musculus
cgggactacaccgagatgaacgatc

SEQ ID NO: 304193 - DNA, 25 bp, Mus musculus
cgcggcggcacagtccaccgtgtat

SEQ ID NO: 304194 - DNA, 25 bp, Mus musculus
gcacagtccaccgtgtatgccttct

SEQ ID NO: 304195 - DNA, 25 bp, Mus musculus
gggcaaggtgctgctcattgagaat

SEQ ID NO: 304196 - DNA, 25 bp, Mus musculus
ctgctcattgagaatgtcgcgtctc

SEQ ID NO: 304197 - DNA, 25 bp, Mus musculus
tgaggcaccacgatccgggactaca

SEQ ID NO: 304198 - DNA, 25 bp, Mus musculus
gatgaacgatctgcagaagcgtctg

SEQ ID NO: 304199 - DNA, 25 bp, Mus musculus
agaagcgtctgggacctcgtggact

SEQ ID NO: 304200 - DNA, 25 bp, Mus musculus
tggtgctcggtttcccgtgcaatca

SEQ ID NO: 304201 - DNA, 25 bp, Mus musculus
gtgcaatcagttcggacaccaggta

SEQ ID NO: 304202 - DNA, 25 bp, Mus musculus
ttcggacaccaggtatatggggcga

SEQ ID NO: 304203 - DNA, 25 bp, Mus musculus
gtggccttgggctctaggctcccac

SEQ ID NO: 304204 - DNA, 25 bp, Mus musculus
gctctaggctcccacgggcgggaca

SEQ ID NO: 304205 - DNA, 25 bp, Mus musculus
aatgtcgcgtctctctgaggcacca

SEQ ID NO: 304206 - DNA, 25 bp, Mus musculus
gacggtgttcccgtgcgcaggtaca

SEQ ID NO: 304207 - DNA, 25 bp, Mus musculus
tggcgggttcgagcccaattttaca

SEQ ID NO: 304208 - DNA, 25 bp, Mus musculus
cgagcccaattttacattgtttgag

SEQ ID NO: 304209 - DNA, 25 bp, Mus musculus
cattgtttgagaagtgcgaagtgaa

SEQ ID NO: 304210 - DNA, 25 bp, Mus musculus
cgaagtgaatggtgagaaggctcac

SEQ ID NO: 304211 - DNA, 25 bp, Mus musculus
tgagaaggctcacccgctctttacc

SEQ ID NO: 304212 - DNA, 25 bp, Mus musculus
ccgctctttaccttcctgcggaatg

SEQ ID NO: 304213 - DNA, 25 bp, Mus musculus
cttcctgcggaatgccttgccaaca

SEQ ID NO: 304214 - DNA, 25 bp, Mus musculus
atgccttgccaacacccagtgacga

SEQ ID NO: 304215 - DNA, 25 bp, Mus musculus
tacatcatttggtctccggtgtgcc

SEQ ID NO: 304216 - DNA, 25 bp, Mus musculus
cgacattgcctggaactttgagaag

SEQ ID NO: 304217 - DNA, 25 bp, Mus musculus
tgcgcaggtacagccgccgctttcg

SEQ ID NO: 304218 - DNA, 25 bp, Mus musculus
agccgccgctttcgtaccatcgaca

SEQ ID NO: 304219 - DNA, 25 bp, Mus musculus
ccggtgtgccgcaacgacattgcct

SEQ ID NO: 304220 - DNA, 25 bp, Mus musculus
tcgcaggagccgctcagacacgggt

SEQ ID NO: 304221 - DNA, 25 bp, Mus musculus
cacgccgtgcgctaggcggatgtcc

SEQ ID NO: 304222 - DNA, 25 bp, Mus musculus
tgatggggaccacgctccaacgtgg

SEQ ID NO: 304223 - DNA, 25 bp, Mus musculus
ggccggacctctgtcctcagtttta

SEQ ID NO: 304224 - DNA, 25 bp, Mus musculus
cccagaagacggagctcggagcctt

SEQ ID NO: 304225 - DNA, 25 bp, Mus musculus
tctgtcctcagttttaggtggaggc

SEQ ID NO: 304226 - DNA, 25 bp, Mus musculus
cctggagtctgaaagagtggcttga

SEQ ID NO: 304227 - DNA, 25 bp, Mus musculus
aaagagtggcttgacagcggccgct

SEQ ID NO: 304228 - DNA, 25 bp, Mus musculus
gtttgtcccggtccattcggattca

SEQ ID NO: 304229 - DNA, 25 bp, Mus musculus
tccattcggattcacagtagtcttg

SEQ ID NO: 304230 - DNA, 25 bp, Mus musculus
gccagcagtcagatcgcaggagccg

SEQ ID NO: 304231 - DNA, 25 bp, Mus musculus
ttcacagtagtcttggaccggcggg

SEQ ID NO: 304232 - DNA, 25 bp, Mus musculus
ctctgggcgtccagcctgcttctgt

SEQ ID NO: 304233 - DNA, 25 bp, Mus musculus
cgcagagcgtctagccggctcgctg

SEQ ID NO: 304234 - DNA, 25 bp, Mus musculus
ggactcacctgctggatctcaaatg

SEQ ID NO: 304235 - DNA, 25 bp, Mus musculus
acaacaccggtatggtgggatcgga

SEQ ID NO: 304236 - DNA, 25 bp, Mus musculus
cggcgagcaacacaacaccggtatg

SEQ ID NO: 304237 - DNA, 25 bp, Mus musculus
tagaaatgaggcagcggcgagcaac

SEQ ID NO: 304238 - DNA, 25 bp, Mus musculus
ctacctggggcgatgatagaaatga

SEQ ID NO: 304239 - DNA, 25 bp, Mus musculus
gatttagggctctacctggggcgat

SEQ ID NO: 304240 - DNA, 25 bp, Mus musculus
ccggccaggatttagggctctacct

SEQ ID NO: 304241 - DNA, 25 bp, Mus musculus
aggcatatggacatccggccggcca

SEQ ID NO: 304242 - DNA, 25 bp, Mus musculus
tgaacagacaggcatatggacatcc

SEQ ID NO: 304243 - DNA, 25 bp, Mus musculus
cccacggtcacccaaaatgaacaga

SEQ ID NO: 304244 - DNA, 25 bp, Mus musculus
gagtagggcgcaccgacccacggtc

SEQ ID NO: 304245 - DNA, 25 bp, Mus musculus
ctgcacatgccacggcaggagtagg

SEQ ID NO: 304246 - DNA, 25 bp, Mus musculus
ttaactctgcacatgccacggcagg

SEQ ID NO: 304247 - DNA, 25 bp, Mus musculus
gatctcaaatgtcgccagggcacgg

SEQ ID NO: 304248 - DNA, 25 bp, Mus musculus
gtctcggaactctcggcgcagccag

SEQ ID NO: 304249 - DNA, 25 bp, Mus musculus
agtgccacgcgccagccgtgatggc

SEQ ID NO: 304250 - DNA, 25 bp, Mus musculus
gcagcagcggcaacgatgactaccg

SEQ ID NO: 304251 - DNA, 25 bp, Mus musculus
tgcagtagtcctgaggtagctgcgc

SEQ ID NO: 304252 - DNA, 25 bp, Mus musculus
tcacctcccggcgttgtggagaaca

SEQ ID NO: 304253 - DNA, 25 bp, Mus musculus
ctgttggtcgagcatgcagtgccac

SEQ ID NO: 304254 - DNA, 25 bp, Mus musculus
cggtctgcagcacaccgtacgggca

SEQ ID NO: 304255 - DNA, 25 bp, Mus musculus
cgctgcgcagaatgcacggtctgca

SEQ ID NO: 304256 - DNA, 25 bp, Mus musculus
cgtaggacagctccagaggcaagcc

SEQ ID NO: 304257 - DNA, 25 bp, Mus musculus
ccaaagcccgtaggacagctccaga

SEQ ID NO: 304258 - DNA, 25 bp, Mus musculus
atgactaccggaagcggtcgaaggc

SEQ ID NO: 304259 - DNA, 25 bp, Mus musculus
cggcgcagccagaccagtcatctta

SEQ ID NO: 304260 - DNA, 25 bp, Mus musculus
ggacaatatggaagccggacgtgac

SEQ ID NO: 304261 - DNA, 25 bp, Mus musculus
agtcatcttaggcttccgcgccagg

SEQ ID NO: 304262 - DNA, 25 bp, Mus musculus
gtcatccagtctacaaggtccgcgg

SEQ ID NO: 304263 - DNA, 25 bp, Mus musculus
tcatactcgctacacgctgcaagtg

SEQ ID NO: 304264 - DNA, 25 bp, Mus musculus
cgtgggtgcgcaactctgagttttt

SEQ ID NO: 304265 - DNA, 25 bp, Mus musculus
ctctgagtttttggtgcacgagaac

SEQ ID NO: 304266 - DNA, 25 bp, Mus musculus
ggtgcacgagaacaacacgcatttt

SEQ ID NO: 304267 - DNA, 25 bp, Mus musculus
acgcattttctgtgcacgcatttgc

SEQ ID NO: 304268 - DNA, 25 bp, Mus musculus
catttgctatgcgaggccttctcca

SEQ ID NO: 304269 - DNA, 25 bp, Mus musculus
tgctcaacccagacggcctcgtgga

SEQ ID NO: 304270 - DNA, 25 bp, Mus musculus
ctccatggctacactgcgtcagctg

SEQ ID NO: 304271 - DNA, 25 bp, Mus musculus
gtcagctgccgctctgtcatccagt

SEQ ID NO: 304272 - DNA, 25 bp, Mus musculus
gaacaccatcgcaagagccacgctg

SEQ ID NO: 304273 - DNA, 25 bp, Mus musculus
ctacacgctgcaagtgaacaccatc

SEQ ID NO: 304274 - DNA, 25 bp, Mus musculus
agtctacaaggtccgcgggatgctg

SEQ ID NO: 304275 - DNA, 25 bp, Mus musculus
gcctcgtggacaaggtgcagcctcc

SEQ ID NO: 304276 - DNA, 25 bp, Mus musculus
aagcacggtgtacttccggcgcgca

SEQ ID NO: 304277 - DNA, 25 bp, Mus musculus
ccaccttacacatttcgccgccgcc

SEQ ID NO: 304278 - DNA, 25 bp, Mus musculus
gcgaccactgcccaccttacacatt

SEQ ID NO: 304279 - DNA, 25 bp, Mus musculus
tgaggatcctgtcgggcgaccactg

SEQ ID NO: 304280 - DNA, 25 bp, Mus musculus
ttctgaggatcctgtcgggcgacca

SEQ ID NO: 304281 - DNA, 25 bp, Mus musculus
ttttcccagggcttggccgagacac

SEQ ID NO: 304282 - DNA, 25 bp, Mus musculus
cctcattttcccagggcttggccga

SEQ ID NO: 304283 - DNA, 25 bp, Mus musculus
ggatcctcattttcccagggcttgg

SEQ ID NO: 304284 - DNA, 25 bp, Mus musculus
cttccgggatcctcattttcccagg

SEQ ID NO: 304285 - DNA, 25 bp, Mus musculus
cacggtgtacttccggcgcgcagca

SEQ ID NO: 304286 - DNA, 25 bp, Mus musculus
gaagcggaagcacggtgtacttccg

SEQ ID NO: 304287 - DNA, 25 bp, Mus musculus
ctgatcccagtccgcccgattagta

SEQ ID NO: 304288 - DNA, 25 bp, Mus musculus
ccagtccgcccgattagtatgcccg

SEQ ID NO: 304289 - DNA, 25 bp, Mus musculus
cggagtggctgcccatgaggccaca

SEQ ID NO: 304290 - DNA, 25 bp, Mus musculus
agcatgctttcagacccagggcagg

SEQ ID NO: 304291 - DNA, 25 bp, Mus musculus
gacaccgtaggtggcttcaaaaagc

SEQ ID NO: 304292 - DNA, 25 bp, Mus musculus
gcgctccttcccacaacgaggggta

SEQ ID NO: 304293 - DNA, 25 bp, Mus musculus
acgaggggtacgctctccactccaa

SEQ ID NO: 304294 - DNA, 25 bp, Mus musculus
tgtggctgcagcgttccctttaagc

SEQ ID NO: 304295 - DNA, 25 bp, Mus musculus
tccgacgctccggttctcgcgagaa

SEQ ID NO: 304296 - DNA, 25 bp, Mus musculus
gcgagaagggccttcggctcccatt

SEQ ID NO: 304297 - DNA, 25 bp, Mus musculus
ctgaatgtaagatggcgcccaggga

SEQ ID NO: 304298 - DNA, 25 bp, Mus musculus
aaaatcctgtcggtctcggagcggc

SEQ ID NO: 304299 - DNA, 25 bp, Mus musculus
acgcagcaaggctctggctcgaagg

SEQ ID NO: 304300 - DNA, 25 bp, Mus musculus
gcttcagagcggagaacgtccctcg

SEQ ID NO: 304301 - DNA, 25 bp, Mus musculus
tttctcatttttctgcgcgcgcgcg

SEQ ID NO: 304302 - DNA, 25 bp, Mus musculus
ctcccattggccgtgagggctgaat

SEQ ID NO: 304303 - DNA, 25 bp, Mus musculus
ctgtgcaactagaggaggcgctagc

SEQ ID NO: 304304 - DNA, 25 bp, Mus musculus
cacctcttacgtgccggacgacggg

SEQ ID NO: 304305 - DNA, 25 bp, Mus musculus
taagcacgtggttacccagctctgc

SEQ ID NO: 304306 - DNA, 25 bp, Mus musculus
cgggaattccttatcgccgaagact

SEQ ID NO: 304307 - DNA, 25 bp, Mus musculus
cttcattgaaactggtgggagcgga

SEQ ID NO: 304308 - DNA, 25 bp, Mus musculus
gcctcacctacaagtgcgggtctag

SEQ ID NO: 304309 - DNA, 25 bp, Mus musculus
agctcttcaactgcggggacggcct

SEQ ID NO: 304310 - DNA, 25 bp, Mus musculus
tggcgtcatcgacgcacgcaacgtg

SEQ ID NO: 304311 - DNA, 25 bp, Mus musculus
ggctcacagcgcagcagctcttcaa

SEQ ID NO: 304312 - DNA, 25 bp, Mus musculus
cagctccgcctctatacggggcgtg

SEQ ID NO: 304313 - DNA, 25 bp, Mus musculus
acctgattagcggaggcacctctta

SEQ ID NO: 304314 - DNA, 25 bp, Mus musculus
cctccgtggtcatggcggactacct

SEQ ID NO: 304315 - DNA, 25 bp, Mus musculus
acgcaacgtgtgacggaataatcta

SEQ ID NO: 304316 - DNA, 25 bp, Mus musculus
acgcgtctgtcttcctccgtggtca

SEQ ID NO: 304317 - DNA, 25 bp, Mus musculus
ctagtttatattggcgcggtccgga

SEQ ID NO: 304318 - DNA, 25 bp, Mus musculus
agccatggctgcaacggcgcttaac

SEQ ID NO: 304319 - DNA, 25 bp, Mus musculus
ctggtataactcatcgtccgccgga

SEQ ID NO: 304320 - DNA, 25 bp, Mus musculus
gccaaaccggaccagacgtgaagta

SEQ ID NO: 304321 - DNA, 25 bp, Mus musculus
ggccagatggtttctccttaaaatg

SEQ ID NO: 304322 - DNA, 25 bp, Mus musculus
tccctagctagtctcgaaatcgctg

SEQ ID NO: 304323 - DNA, 25 bp, Mus musculus
ggcggggcagatggctaaaatttcc

SEQ ID NO: 304324 - DNA, 25 bp, Mus musculus
tcccaggctttggagaatcgggctc

SEQ ID NO: 304325 - DNA, 25 bp, Mus musculus
tgcgcacctggtcctgttatgaaca

SEQ ID NO: 304326 - DNA, 25 bp, Mus musculus
ccattattcgggctcccagggacca

SEQ ID NO: 304327 - DNA, 25 bp, Mus musculus
ctgttcctgggattctcagccatta

SEQ ID NO: 304328 - DNA, 25 bp, Mus musculus
taagggtattgtttaggccactgcc

SEQ ID NO: 304329 - DNA, 25 bp, Mus musculus
cagagttgtctgtctcaaagtagcc

SEQ ID NO: 304330 - DNA, 25 bp, Mus musculus
ccggccggactatgcgggattgaaa

SEQ ID NO: 304331 - DNA, 25 bp, Mus musculus
aacacctgctagtacgggcgcccta

SEQ ID NO: 304332 - DNA, 25 bp, Mus musculus
tcaggcgctgcggacattcgcgtga

SEQ ID NO: 304333 - DNA, 25 bp, Mus musculus
tactcgagtcccgtgggggaccaca

SEQ ID NO: 304334 - DNA, 25 bp, Mus musculus
acacaggcacccgggtactcgagtc

SEQ ID NO: 304335 - DNA, 25 bp, Mus musculus
tgccagaggctaggacgcgacaagt

SEQ ID NO: 304336 - DNA, 25 bp, Mus musculus
ggctctcatgcgctccagtgcagca

SEQ ID NO: 304337 - DNA, 25 bp, Mus musculus
caggcacacggtggcgatctgagac

SEQ ID NO: 304338 - DNA, 25 bp, Mus musculus
gacggcttggctctcatgcgctcca

SEQ ID NO: 304339 - DNA, 25 bp, Mus musculus
aggtggcacagctcgacgtcaggct

SEQ ID NO: 304340 - DNA, 25 bp, Mus musculus
acattcgcgtgaggaggacacaggc

SEQ ID NO: 304341 - DNA, 25 bp, Mus musculus
tcttctgcaagagggagtcaggcgc

SEQ ID NO: 304342 - DNA, 25 bp, Mus musculus
cggtgccggcgattgctggcacctt

SEQ ID NO: 304343 - DNA, 25 bp, Mus musculus
agtttcacagggctcttctgcaaga

SEQ ID NO: 304344 - DNA, 25 bp, Mus musculus
gcgctcagtttcacagggctcttct

SEQ ID NO: 304345 - DNA, 25 bp, Mus musculus
atctgagacttggaggtggcacagc

SEQ ID NO: 304346 - DNA, 25 bp, Mus musculus
gctggaggcccttaatgcagctgta

SEQ ID NO: 304347 - DNA, 25 bp, Mus musculus
gccgtgctcgtagccgatcatctag

SEQ ID NO: 304348 - DNA, 25 bp, Mus musculus
gcgagttgtcctacactgcccagca

SEQ ID NO: 304349 - DNA, 25 bp, Mus musculus
cgatcgctctggtccattcaggaga

SEQ ID NO: 304350 - DNA, 25 bp, Mus musculus
ggacctcccggaagctctacggata

SEQ ID NO: 304351 - DNA, 25 bp, Mus musculus
actgcgctgtaattcggggacgctc

SEQ ID NO: 304352 - DNA, 25 bp, Mus musculus
acgctccgattgagccagctgcgtg

SEQ ID NO: 304353 - DNA, 25 bp, Mus musculus
tactgcgtgctcatgggtaagtgcg

SEQ ID NO: 304354 - DNA, 25 bp, Mus musculus
tcgaacatgtactcggtgccctggc

SEQ ID NO: 304355 - DNA, 25 bp, Mus musculus
cggcccgctgtcttcgaacatgtac

SEQ ID NO: 304356 - DNA, 25 bp, Mus musculus
ccgcgggtttatcgctccaactaca

SEQ ID NO: 304357 - DNA, 25 bp, Mus musculus
gatccacggaactacggcccactta

SEQ ID NO: 304358 - DNA, 25 bp, Mus musculus
tcgagacttcttggcaccgcgaagc

SEQ ID NO: 304359 - DNA, 25 bp, Mus musculus
ccggcaccttcgtgttcgagacttc

SEQ ID NO: 304360 - DNA, 25 bp, Mus musculus
tgtccggtgcgaccacccagggaga

SEQ ID NO: 304361 - DNA, 25 bp, Mus musculus
cagggagaggctagttcttcgcccg

SEQ ID NO: 304362 - DNA, 25 bp, Mus musculus
ggcatccctttgtccggtgcgacca

SEQ ID NO: 304363 - DNA, 25 bp, Mus musculus
ggagaggctagttcttcgcccgcta

SEQ ID NO: 304364 - DNA, 25 bp, Mus musculus
gttcttcgcccgctagcacgactag

SEQ ID NO: 304365 - DNA, 25 bp, Mus musculus
tcttcgcccgctagcacgactagag

SEQ ID NO: 304366 - DNA, 25 bp, Mus musculus
tagcacgactagagccgaccaagcc

SEQ ID NO: 304367 - DNA, 25 bp, Mus musculus
cgaccaagcctcacccgccagcagc

SEQ ID NO: 304368 - DNA, 25 bp, Mus musculus
ccaacacactccagacccgtaaccg

SEQ ID NO: 304369 - DNA, 25 bp, Mus musculus
cccgtaaccgggaggagtatgagct

SEQ ID NO: 304370 - DNA, 25 bp, Mus musculus
aggagtatgagctcggaagtcgccc

SEQ ID NO: 304371 - DNA, 25 bp, Mus musculus
agtatgagctcggaagtcgcccgcg

SEQ ID NO: 304372 - DNA, 25 bp, Mus musculus
cgccggcctgtgtttcccgccacct

SEQ ID NO: 304373 - DNA, 25 bp, Mus musculus
agggcatccctttgtccggtgcgac

SEQ ID NO: 304374 - DNA, 25 bp, Mus musculus
cctgattggccggatcagagtcacc

SEQ ID NO: 304375 - DNA, 25 bp, Mus musculus
gcggacgtccaatgacgaccctgtc

SEQ ID NO: 304376 - DNA, 25 bp, Mus musculus
tgggctgcggacgtccaatgacgac

SEQ ID NO: 304377 - DNA, 25 bp, Mus musculus
tacaggtagcaaagccctggcgctg

SEQ ID NO: 304378 - DNA, 25 bp, Mus musculus
ccgaagcccttagctacaggtagca

SEQ ID NO: 304379 - DNA, 25 bp, Mus musculus
cgctgcagagctccgaagcccttag

SEQ ID NO: 304380 - DNA, 25 bp, Mus musculus
aaccagccgtctggagagccgcgct

SEQ ID NO: 304381 - DNA, 25 bp, Mus musculus
ttctcgcgagaaccagccgtctgga

SEQ ID NO: 304382 - DNA, 25 bp, Mus musculus
gagagctgcgttctcgcgagaacca

SEQ ID NO: 304383 - DNA, 25 bp, Mus musculus
ctgccacggacaagaagagagctgc

SEQ ID NO: 304384 - DNA, 25 bp, Mus musculus
gagctgctgtggctgccacggacaa

SEQ ID NO: 304385 - DNA, 25 bp, Mus musculus
atgacgttcctggagctgctgtggc

SEQ ID NO: 304386 - DNA, 25 bp, Mus musculus
cccgaaagcgtccatgacgttcctg

SEQ ID NO: 304387 - DNA, 25 bp, Mus musculus
gtcgcccgcggccagacatagtccc

SEQ ID NO: 304388 - DNA, 25 bp, Mus musculus
ttgtgagtccatgccaccttcccga

SEQ ID NO: 304389 - DNA, 25 bp, Mus musculus
ccagttgttagcgatccacttggtg

SEQ ID NO: 304390 - DNA, 25 bp, Mus musculus
tcgcatcagggccttgcgtcagagc

SEQ ID NO: 304391 - DNA, 25 bp, Mus musculus
gcgtcagagctccacacgggcatca

SEQ ID NO: 304392 - DNA, 25 bp, Mus musculus
tccacacgggcatcactgtaggctc

SEQ ID NO: 304393 - DNA, 25 bp, Mus musculus
ccaaggcccactcgggttgtgagtc

SEQ ID NO: 304394 - DNA, 25 bp, Mus musculus
agacgagccatctcctgctggaaca

SEQ ID NO: 304395 - DNA, 25 bp, Mus musculus
tctcctgctggaacaaggcttgccg

SEQ ID NO: 304396 - DNA, 25 bp, Mus musculus
ggaacaaggcttgccgtgcccggct

SEQ ID NO: 304397 - DNA, 25 bp, Mus musculus
tgcccggctagggtccacattgatc

SEQ ID NO: 304398 - DNA, 25 bp, Mus musculus
agggtccacattgatccagttgtta

SEQ ID NO: 304399 - DNA, 25 bp, Mus musculus
cagcgggtgattcgcatcagggcct

SEQ ID NO: 304400 - DNA, 25 bp, Mus musculus
cgatccacttggtgccgcgggtgac

SEQ ID NO: 304401 - DNA, 25 bp, Mus musculus
tcactgtaggctcggtccaaggccc

SEQ ID NO: 304402 - DNA, 25 bp, Mus musculus
gcacccatcggtccatactgagatc

SEQ ID NO: 304403 - DNA, 25 bp, Mus musculus
tccgggatgctgtgcctacacggag

SEQ ID NO: 304404 - DNA, 25 bp, Mus musculus
accttgatgccctccagccgggtga

SEQ ID NO: 304405 - DNA, 25 bp, Mus musculus
ccactgaagatttgaggcctcctcg

SEQ ID NO: 304406 - DNA, 25 bp, Mus musculus
cgtcttcactatcgcctggtctggt

SEQ ID NO: 304407 - DNA, 25 bp, Mus musculus
ccaagaagtaggcacgggaacagat

SEQ ID NO: 304408 - DNA, 25 bp, Mus musculus
tgcacgaacaccatcagcaccaaga

SEQ ID NO: 304409 - DNA, 25 bp, Mus musculus
ttgcccaagtacaggtgcacgaaca

SEQ ID NO: 304410 - DNA, 25 bp, Mus musculus
ctcggcttggcagtgcttgaagctc

SEQ ID NO: 304411 - DNA, 25 bp, Mus musculus
gccacggttccttctggctcggctt

SEQ ID NO: 304412 - DNA, 25 bp, Mus musculus
cgcgtgacccgcacacagtgatgcg

SEQ ID NO: 304413 - DNA, 25 bp, Mus musculus
tcagggagcgacagtagcaaagtaa

SEQ ID NO: 304414 - DNA, 25 bp, Mus musculus
cgtctccgttgctgtagtgcacgaa

SEQ ID NO: 304415 - DNA, 25 bp, Mus musculus
gcagggccagcacgttgcccaagta

SEQ ID NO: 304416 - DNA, 25 bp, Mus musculus
ggttggaatcgcttcctcaccatcc

SEQ ID NO: 304417 - DNA, 25 bp, Mus musculus
gtgaccggtcgcacgtctctgcgag

SEQ ID NO: 304418 - DNA, 25 bp, Mus musculus
caggacgggcgttaacaaacagtgc

SEQ ID NO: 304419 - DNA, 25 bp, Mus musculus
aagctcccaaccaccagagaaacgg

SEQ ID NO: 304420 - DNA, 25 bp, Mus musculus
gcctccgacctctcggggagctaaa

SEQ ID NO: 304421 - DNA, 25 bp, Mus musculus
gccaacgaggaagaggaacccagga

SEQ ID NO: 304422 - DNA, 25 bp, Mus musculus
gaacccaggagagacgccaggcacc

SEQ ID NO: 304423 - DNA, 25 bp, Mus musculus
ccctgggaggaactactgagcgttc

SEQ ID NO: 304424 - DNA, 25 bp, Mus musculus
gtcgcctccgggagtgcctatcagt

SEQ ID NO: 304425 - DNA, 25 bp, Mus musculus
ccggcggccagtcaagagtaaacaa

SEQ ID NO: 304426 - DNA, 25 bp, Mus musculus
accaaaccaggctgacggaggcgta

SEQ ID NO: 304427 - DNA, 25 bp, Mus musculus
cagctccggaagtgttctgcgccgc

SEQ ID NO: 304428 - DNA, 25 bp, Mus musculus
cgcctctcttgaggctagaccagtg

SEQ ID NO: 304429 - DNA, 25 bp, Mus musculus
ccaggcttctgacgactgcgtagtc

SEQ ID NO: 304430 - DNA, 25 bp, Mus musculus
cagtagcagtagcaggagtcccggt

SEQ ID NO: 304431 - DNA, 25 bp, Mus musculus
agcttccagtaggtagcgctgctcc

SEQ ID NO: 304432 - DNA, 25 bp, Mus musculus
cccgtgcaaagatggggtcgcaagc

SEQ ID NO: 304433 - DNA, 25 bp, Mus musculus
ggggccgccgtctaaagcaaagtca

SEQ ID NO: 304434 - DNA, 25 bp, Mus musculus
gacccaccaggccagagactcgaga

SEQ ID NO: 304435 - DNA, 25 bp, Mus musculus
cgcgcccagcggaatgctctaagga

SEQ ID NO: 304436 - DNA, 25 bp, Mus musculus
tccatggaagtcactagggcaactg

SEQ ID NO: 304437 - DNA, 25 bp, Mus musculus
ccggtctgaagtctccatggaagtc

SEQ ID NO: 304438 - DNA, 25 bp, Mus musculus
ggggagcttacctctaactctaggc

SEQ ID NO: 304439 - DNA, 25 bp, Mus musculus
tgcccgcactctactggggagctta

SEQ ID NO: 304440 - DNA, 25 bp, Mus musculus
accatgatcactactgcggagcgga

SEQ ID NO: 304441 - DNA, 25 bp, Mus musculus
gggagccatcagtcagagccagttc

SEQ ID NO: 304442 - DNA, 25 bp, Mus musculus
tgttgacaaatgcagccagagcctc

SEQ ID NO: 304443 - DNA, 25 bp, Mus musculus
gctacgctgtccactctcggcagga

SEQ ID NO: 304444 - DNA, 25 bp, Mus musculus
aagccaggctagtacgactgggccc

SEQ ID NO: 304445 - DNA, 25 bp, Mus musculus
cccgcccacctgaatgtaggtgaaa

SEQ ID NO: 304446 - DNA, 25 bp, Mus musculus
acctgaatgtaggtgaaaggtcggc

SEQ ID NO: 304447 - DNA, 25 bp, Mus musculus
ctcgggcagcggagcaagaccaaga

SEQ ID NO: 304448 - DNA, 25 bp, Mus musculus
caagaccaagactgcccggagctga

SEQ ID NO: 304449 - DNA, 25 bp, Mus musculus
actgcccggagctgacagacagaca

SEQ ID NO: 304450 - DNA, 25 bp, Mus musculus
acagaagactgagcatggcagacga

SEQ ID NO: 304451 - DNA, 25 bp, Mus musculus
ggcagacgagccgaaacccatcagt

SEQ ID NO: 304452 - DNA, 25 bp, Mus musculus
gagccgaaacccatcagtccgttta

SEQ ID NO: 304453 - DNA, 25 bp, Mus musculus
tcagtccgtttaagaacctcctggc

SEQ ID NO: 304454 - DNA, 25 bp, Mus musculus
ggctagtacgactgggccctctttc

SEQ ID NO: 304455 - DNA, 25 bp, Mus musculus
tggggcaccccctggacacggtcaa

SEQ ID NO: 304456 - DNA, 25 bp, Mus musculus
cttcggcggcatgtgcctggtgttt

SEQ ID NO: 304457 - DNA, 25 bp, Mus musculus
gtttaagaacctcctggctggcggc

SEQ ID NO: 304458 - DNA, 25 bp, Mus musculus
ggacgtcgcaggcatgagccacatc

SEQ ID NO: 304459 - DNA, 25 bp, Mus musculus
ctcagacccggccagaataaggcgc

SEQ ID NO: 304460 - DNA, 25 bp, Mus musculus
gctacaccgtggaggtgcttcggca

SEQ ID NO: 304461 - DNA, 25 bp, Mus musculus
cgacttcgcggtggagtacttcaca

SEQ ID NO: 304462 - DNA, 25 bp, Mus musculus
gagtacttcacacgcctgcgcgagg

SEQ ID NO: 304463 - DNA, 25 bp, Mus musculus
aggaatcagacacgttcatcgtctc

SEQ ID NO: 304464 - DNA, 25 bp, Mus musculus
cgacgacctttcacacgcaggagtc

SEQ ID NO: 304465 - DNA, 25 bp, Mus musculus
ccggcgtgtgagcattccaaattga

SEQ ID NO: 304466 - DNA, 25 bp, Mus musculus
ttccaaattgagctccgcggttctc

SEQ ID NO: 304467 - DNA, 25 bp, Mus musculus
ttctctgagcccgagcgttcacgga

SEQ ID NO: 304468 - DNA, 25 bp, Mus musculus
tcacggagagtgatttgtcagattc

SEQ ID NO: 304469 - DNA, 25 bp, Mus musculus
tgccttgaatgaagcgtgcgcgttc

SEQ ID NO: 304470 - DNA, 25 bp, Mus musculus
ctcggactcggaagatgccgatctg

SEQ ID NO: 304471 - DNA, 25 bp, Mus musculus
gcaccttgaccatgggctgctccga

SEQ ID NO: 304472 - DNA, 25 bp, Mus musculus
aatcccggcgccctagcaacagtct

SEQ ID NO: 304473 - DNA, 25 bp, Mus musculus
cgggactgggctgtggccgcaggta

SEQ ID NO: 304474 - DNA, 25 bp, Mus musculus
aataggacggaagcgtcgcgggact

SEQ ID NO: 304475 - DNA, 25 bp, Mus musculus
gaaacaataggacggaagcgtcgcg

SEQ ID NO: 304476 - DNA, 25 bp, Mus musculus
agccattttggtggaagagaaacaa

SEQ ID NO: 304477 - DNA, 25 bp, Mus musculus
gtgcgagccaatagcgaggggccct

SEQ ID NO: 304478 - DNA, 25 bp, Mus musculus
ggcttcgggtgcgagccaatagcga

SEQ ID NO: 304479 - DNA, 25 bp, Mus musculus
ccagtccgcttgcgcggcttcgggt

SEQ ID NO: 304480 - DNA, 25 bp, Mus musculus
ccggcgccctagcaacagtcttcca

SEQ ID NO: 304481 - DNA, 25 bp, Mus musculus
cccttgcccattcaggaagccgccc

SEQ ID NO: 304482 - DNA, 25 bp, Mus musculus
agaggttttcggtgctggtagcggc

SEQ ID NO: 304483 - DNA, 25 bp, Mus musculus
agagaaacaataggacggaagcgtc

SEQ ID NO: 304484 - DNA, 25 bp, Mus musculus
ttccaggccgcccagtccgcttgcg

SEQ ID NO: 304485 - DNA, 25 bp, Mus musculus
agccaatagcgaggggccctgggag

SEQ ID NO: 304486 - DNA, 25 bp, Mus musculus
tgcaggcgagaccttcctggtgctg

SEQ ID NO: 304487 - DNA, 25 bp, Mus musculus
gcctacctgcatcgcctgcaggtga

SEQ ID NO: 304488 - DNA, 25 bp, Mus musculus
gcacgcactggtggttagcagcacg

SEQ ID NO: 304489 - DNA, 25 bp, Mus musculus
cgcggcgctccaatactggagccga

SEQ ID NO: 304490 - DNA, 25 bp, Mus musculus
atactggagccgactcgctcctggg

SEQ ID NO: 304491 - DNA, 25 bp, Mus musculus
cggcctcatgtaccgcgcgctgtat

SEQ ID NO: 304492 - DNA, 25 bp, Mus musculus
atgtaccgcgcgctgtatgcgttcc

SEQ ID NO: 304493 - DNA, 25 bp, Mus musculus
gctgtatgcgttccgctccgcggag

SEQ ID NO: 304494 - DNA, 25 bp, Mus musculus
tccgcggagccgaacgccatggcgt

SEQ ID NO: 304495 - DNA, 25 bp, Mus musculus
acgccatggcgttcgctgcaggcga

SEQ ID NO: 304496 - DNA, 25 bp, Mus musculus
ctggagcgcagcagcacgcactggt

SEQ ID NO: 304497 - DNA, 25 bp, Mus musculus
agaccgggtacgtgccgcctgccta

SEQ ID NO: 304498 - DNA, 25 bp, Mus musculus
caggtgagtgtgtccctccgtccca

SEQ ID NO: 304499 - DNA, 25 bp, Mus musculus
ggcaaacctctctcggccgcgaggg

SEQ ID NO: 304500 - DNA, 25 bp, Mus musculus
cactctaattggaatgcgccgcctt

SEQ ID NO: 304501 - DNA, 25 bp, Mus musculus
tagctattggttggttgagatgcgc

SEQ ID NO: 304502 - DNA, 25 bp, Mus musculus
ttgcgccacatctagctattggttg

SEQ ID NO: 304503 - DNA, 25 bp, Mus musculus
tgtgacgtctgttgcgccacatcta

SEQ ID NO: 304504 - DNA, 25 bp, Mus musculus
atttctgctggctagcgtggaaccc

SEQ ID NO: 304505 - DNA, 25 bp, Mus musculus
aatgcgccgcctttctctaggattc

SEQ ID NO: 304506 - DNA, 25 bp, Mus musculus
tcccgcatacaatggagtcctccga

SEQ ID NO: 304507 - DNA, 25 bp, Mus musculus
aatgacactctaattggaatgcgcc

SEQ ID NO: 304508 - DNA, 25 bp, Mus musculus
cgcgtcttttggattatttctgctg

SEQ ID NO: 304509 - DNA, 25 bp, Mus musculus
tgtgccaatagaaacaatgacactc

SEQ ID NO: 304510 - DNA, 25 bp, Mus musculus
cggggtctcccattgtgccaataga

SEQ ID NO: 304511 - DNA, 25 bp, Mus musculus
tacaatggagtcctccgagaggggc

SEQ ID NO: 304512 - DNA, 25 bp, Mus musculus
tcctacctcccgcatacaatggagt

SEQ ID NO: 304513 - DNA, 25 bp, Mus musculus
tttctctaggattctgtgacgtctg

SEQ ID NO: 304514 - DNA, 25 bp, Mus musculus
gtcggcctgcaggatctcacacttc

SEQ ID NO: 304515 - DNA, 25 bp, Mus musculus
gtgcagcgtgagctcctggaatatc

SEQ ID NO: 304516 - DNA, 25 bp, Mus musculus
ctcgcagcgtacgttcagatcatcc

SEQ ID NO: 304517 - DNA, 25 bp, Mus musculus
acgcgtggaacacctcggactcgca

SEQ ID NO: 304518 - DNA, 25 bp, Mus musculus
atttgacccagtcgatgcacgcgtg

SEQ ID NO: 304519 - DNA, 25 bp, Mus musculus
gctgcgggcagtcgtatttgaccca

SEQ ID NO: 304520 - DNA, 25 bp, Mus musculus
ctgtgtagatgaggcggcccacttt

SEQ ID NO: 304521 - DNA, 25 bp, Mus musculus
tgtcggaagtaaccgcccgctgtgt

SEQ ID NO: 304522 - DNA, 25 bp, Mus musculus
gccaggagccattgctcgggttgta

SEQ ID NO: 304523 - DNA, 25 bp, Mus musculus
tcagtgttgccatccggagagttgt

SEQ ID NO: 304524 - DNA, 25 bp, Mus musculus
accactggttggtcatggggttgta

SEQ ID NO: 304525 - DNA, 25 bp, Mus musculus
ttgcgtggcacgctcatagaggcac

SEQ ID NO: 304526 - DNA, 25 bp, Mus musculus
cccgactgcgtagatgtggccatct

SEQ ID NO: 304527 - DNA, 25 bp, Mus musculus
tctcacacttctgcagctgcgtctg

SEQ ID NO: 304528 - DNA, 25 bp, Mus musculus
ccagaactgccatgcgcgacgggct

SEQ ID NO: 304529 - DNA, 25 bp, Mus musculus
taacggcttcagtcgccagaactgc

SEQ ID NO: 304530 - DNA, 25 bp, Mus musculus
gccgtatgccaaaggggctctggcc

SEQ ID NO: 304531 - DNA, 25 bp, Mus musculus
tgtaccaccaggtttggggcatcgg

SEQ ID NO: 304532 - DNA, 25 bp, Mus musculus
cgcgacgggctgtaccaccaggttt

SEQ ID NO: 304533 - DNA, 25 bp, Mus musculus
aagatggcggtaacggcttcagtcg

SEQ ID NO: 304534 - DNA, 25 bp, Mus musculus
tctgttctcaataaagatggcggta

SEQ ID NO: 304535 - DNA, 25 bp, Mus musculus
gggcagcacttctgttctcaataaa

SEQ ID NO: 304536 - DNA, 25 bp, Mus musculus
ccgttcagcaccgtgggcagcactt

SEQ ID NO: 304537 - DNA, 25 bp, Mus musculus
gcagagtagcggagaaactcccagc

SEQ ID NO: 304538 - DNA, 25 bp, Mus musculus
gctggaatagcgcactaggatgaga

SEQ ID NO: 304539 - DNA, 25 bp, Mus musculus
gaagccacgctggaatagcgcacta

SEQ ID NO: 304540 - DNA, 25 bp, Mus musculus
ctgaagaaagactaggaagccacgc

SEQ ID NO: 304541 - DNA, 25 bp, Mus musculus
acgagattctcggtctgaagaaaga

SEQ ID NO: 304542 - DNA, 25 bp, Mus musculus
tgccgctctggatcgtgagagtatg

SEQ ID NO: 304543 - DNA, 25 bp, Mus musculus
tttccgactggtcctgaagccaagc

SEQ ID NO: 304544 - DNA, 25 bp, Mus musculus
cacatcagtactgcgcgtggtggca

SEQ ID NO: 304545 - DNA, 25 bp, Mus musculus
ttcagtattgatcctcagagtggcc

SEQ ID NO: 304546 - DNA, 25 bp, Mus musculus
tggaacgccactaccttcgagtaac

SEQ ID NO: 304547 - DNA, 25 bp, Mus musculus
ttcgagtaacagcacaggaccacgg

SEQ ID NO: 304548 - DNA, 25 bp, Mus musculus
ccgcaacgatcacgcgccagtgttt

SEQ ID NO: 304549 - DNA, 25 bp, Mus musculus
ttcagccaccgtgcgagtgcacata

SEQ ID NO: 304550 - DNA, 25 bp, Mus musculus
gcccagtatcgggaaacacttcgtg

SEQ ID NO: 304551 - DNA, 25 bp, Mus musculus
caacctgcgctaccgcttcgtggga

SEQ ID NO: 304552 - DNA, 25 bp, Mus musculus
cgccgctgctttcgagattgatcca

SEQ ID NO: 304553 - DNA, 25 bp, Mus musculus
atccacgttcgggtcttatcagcac

SEQ ID NO: 304554 - DNA, 25 bp, Mus musculus
ccagtgtttgagcaagcccagtatc

SEQ ID NO: 304555 - DNA, 25 bp, Mus musculus
cgctcgctggagcttttcagtattg

SEQ ID NO: 304556 - DNA, 25 bp, Mus musculus
ggggctgaacactgctctcggaaaa

SEQ ID NO: 304557 - DNA, 25 bp, Mus musculus
caacgtgagcttctcagcgctggca

SEQ ID NO: 304558 - DNA, 25 bp, Mus musculus
tgctgccctttgacgacaacgtgtg

SEQ ID NO: 304559 - DNA, 25 bp, Mus musculus
gcgtgtcagtgctccgctttgactc

SEQ ID NO: 304560 - DNA, 25 bp, Mus musculus
ctcctggcttcacgggagacttctg

SEQ ID NO: 304561 - DNA, 25 bp, Mus musculus
gttactcgaacccttgtcgcaatgg

SEQ ID NO: 304562 - DNA, 25 bp, Mus musculus
agtgctgaagtcctggcgaagctta

SEQ ID NO: 304563 - DNA, 25 bp, Mus musculus
gccacggaggagataagacgatatg

SEQ ID NO: 304564 - DNA, 25 bp, Mus musculus
ggcatcttttctgaggctaccggga

SEQ ID NO: 304565 - DNA, 25 bp, Mus musculus
agggcgtgcccacagacagctcaac

SEQ ID NO: 304566 - DNA, 25 bp, Mus musculus
gctcaaccattcagaggccgagtgg

SEQ ID NO: 304567 - DNA, 25 bp, Mus musculus
ctggacactgaagctggacgctgcg

SEQ ID NO: 304568 - DNA, 25 bp, Mus musculus
ccagttccttcgtcatgttccgcgg

SEQ ID NO: 304569 - DNA, 25 bp, Mus musculus
ccgagtgggatggacttagaagccc

SEQ ID NO: 304570 - DNA, 25 bp, Mus musculus
tagtagttctgtgactcccggcctg

SEQ ID NO: 304571 - DNA, 25 bp, Mus musculus
cggcagggtactgttcacatttgtc

SEQ ID NO: 304572 - DNA, 25 bp, Mus musculus
ctgggagagaaaccgctgcaagaca

SEQ ID NO: 304573 - DNA, 25 bp, Mus musculus
agttgctgcttaccgaggagtcctg

SEQ ID NO: 304574 - DNA, 25 bp, Mus musculus
cctggagtgctaataagggcgctgc

SEQ ID NO: 304575 - DNA, 25 bp, Mus musculus
gttgtactgaacgtccctggagtgc

SEQ ID NO: 304576 - DNA, 25 bp, Mus musculus
cccagctcttgagggttgtactgaa

SEQ ID NO: 304577 - DNA, 25 bp, Mus musculus
gcccgcgaagcgctagtagttctgt

SEQ ID NO: 304578 - DNA, 25 bp, Mus musculus
tcccggcctgggtcaattcaggaag

SEQ ID NO: 304579 - DNA, 25 bp, Mus musculus
ggcatttcccgtctgcggagcctta

SEQ ID NO: 304580 - DNA, 25 bp, Mus musculus
gagccttagtttaccgccttgccga

SEQ ID NO: 304581 - DNA, 25 bp, Mus musculus
tgccgattttccgaaggaggttatc

SEQ ID NO: 304582 - DNA, 25 bp, Mus musculus
ctggcgccaccttctagccggtagt

SEQ ID NO: 304583 - DNA, 25 bp, Mus musculus
ttgcagggcgctgcccaaattccgc

SEQ ID NO: 304584 - DNA, 25 bp, Mus musculus
ccctagcgcgacactagcttgcaaa

SEQ ID NO: 304585 - DNA, 25 bp, Mus musculus
gcaaccagccgcctggtattctcta

SEQ ID NO: 304586 - DNA, 25 bp, Mus musculus
tggtattctctaccgcaaccacctg

SEQ ID NO: 304587 - DNA, 25 bp, Mus musculus
actactctgagcatgtcggccctgg

SEQ ID NO: 304588 - DNA, 25 bp, Mus musculus
gtcggccctggtttcccaagatgag

SEQ ID NO: 304589 - DNA, 25 bp, Mus musculus
ctccacagagaaagaccaaaggcca

SEQ ID NO: 304590 - DNA, 25 bp, Mus musculus
gcgacactagcttgcaaaaccgttg

SEQ ID NO: 304591 - DNA, 25 bp, Mus musculus
ttgcaaaaccgttggcagcctcccg

SEQ ID NO: 304592 - DNA, 25 bp, Mus musculus
ctggtttcccaagatgaggaggact

SEQ ID NO: 304593 - DNA, 25 bp, Mus musculus
ctagtaagactatcggggcggagtt

SEQ ID NO: 304594 - DNA, 25 bp, Mus musculus
cctggctccgactactctgagcatg

SEQ ID NO: 304595 - DNA, 25 bp, Mus musculus
taagggttcttgaggttgccgctta

SEQ ID NO: 304596 - DNA, 25 bp, Mus musculus
ggaggcggagtctagtaagactatc

SEQ ID NO: 304597 - DNA, 25 bp, Mus musculus
catcggcgaccacggattggcttca

SEQ ID NO: 304598 - DNA, 25 bp, Mus musculus
tgccttgcggggtaccgcaaccttc

SEQ ID NO: 304599 - DNA, 25 bp, Mus musculus
tgcgccagtcctctaggtgaggccc

SEQ ID NO: 304600 - DNA, 25 bp, Mus musculus
tccgggacgcaagtgctacttcgca

SEQ ID NO: 304601 - DNA, 25 bp, Mus musculus
cgcggctctacactgacggaagtta

SEQ ID NO: 304602 - DNA, 25 bp, Mus musculus
ggttatctgctctggcttgggtttg

SEQ ID NO: 304603 - DNA, 25 bp, Mus musculus
ttgagagccgaggtcccagaggctt

SEQ ID NO: 304604 - DNA, 25 bp, Mus musculus
gaggcttggcgagcagttcttgcaa

SEQ ID NO: 304605 - DNA, 25 bp, Mus musculus
agttcttgcaatggtcgccttctcc

SEQ ID NO: 304606 - DNA, 25 bp, Mus musculus
cggccctgctgaggttacctgcctt

SEQ ID NO: 304607 - DNA, 25 bp, Mus musculus
tgccggagacccaggtcagcatctt

SEQ ID NO: 304608 - DNA, 25 bp, Mus musculus
agcatcttggacaacgggctgcgtg

SEQ ID NO: 304609 - DNA, 25 bp, Mus musculus
gtcctcgcatgctacctgcacggta

SEQ ID NO: 304610 - DNA, 25 bp, Mus musculus
gcccagggctttcgtacacagatga

SEQ ID NO: 304611 - DNA, 25 bp, Mus musculus
cctgcacggtaagtgtgcgccagtc

SEQ ID NO: 304612 - DNA, 25 bp, Mus musculus
gtcgagttcctctaggtcgtccgca

SEQ ID NO: 304613 - DNA, 25 bp, Mus musculus
cgcgtgctcaccgaatgggtcttcg

SEQ ID NO: 304614 - DNA, 25 bp, Mus musculus
ttgctcggagggttctcaatggatc

SEQ ID NO: 304615 - DNA, 25 bp, Mus musculus
tcaatggatcgagacagaccgggga

SEQ ID NO: 304616 - DNA, 25 bp, Mus musculus
cactctgtttcctgtggctgttcgg

SEQ ID NO: 304617 - DNA, 25 bp, Mus musculus
gggtcccggccatgactaccttcaa

SEQ ID NO: 304618 - DNA, 25 bp, Mus musculus
gcagcatccgaagacgccaagcaca

SEQ ID NO: 304619 - DNA, 25 bp, Mus musculus
tgcgggccaatcagctgccagctac

SEQ ID NO: 304620 - DNA, 25 bp, Mus musculus
agctgccagctaccgggcacagatg

SEQ ID NO: 304621 - DNA, 25 bp, Mus musculus
cacagatgggtgacgtgtacagagc

SEQ ID NO: 304622 - DNA, 25 bp, Mus musculus
atgccagggtactacagtgctgtca

SEQ ID NO: 304623 - DNA, 25 bp, Mus musculus
tacagtgctgtcaggattatcccgg

SEQ ID NO: 304624 - DNA, 25 bp, Mus musculus
gtccgcagtaaattccgcgtgctca

SEQ ID NO: 304625 - DNA, 25 bp, Mus musculus
attatcccggttgcgagatcgagga

SEQ ID NO: 304626 - DNA, 25 bp, Mus musculus
acaggacttacagccttcgcttatg

SEQ ID NO: 304627 - DNA, 25 bp, Mus musculus
tatgccggaaacaggacttacagcc

SEQ ID NO: 304628 - DNA, 25 bp, Mus musculus
ccctgatcgtatgccggaaacagga

SEQ ID NO: 304629 - DNA, 25 bp, Mus musculus
ttcccggcccgacatggcgcctcca

SEQ ID NO: 304630 - DNA, 25 bp, Mus musculus
cccgatctccaaatagccttacctt

SEQ ID NO: 304631 - DNA, 25 bp, Mus musculus
catcgatcgccctcccatggttccc

SEQ ID NO: 304632 - DNA, 25 bp, Mus musculus
catctccttggcctgcttcttgggc

SEQ ID NO: 304633 - DNA, 25 bp, Mus musculus
ggcgacacgagcatgctcggcccat

SEQ ID NO: 304634 - DNA, 25 bp, Mus musculus
acctgtgggcgacacgagcatgctc

SEQ ID NO: 304635 - DNA, 25 bp, Mus musculus
tttttgccacctgtgggcgacacga

SEQ ID NO: 304636 - DNA, 25 bp, Mus musculus
ctgtttcaggggcttctttttgcca

SEQ ID NO: 304637 - DNA, 25 bp, Mus musculus
ttcttgggctgtttcaggggcttct

SEQ ID NO: 304638 - DNA, 25 bp, Mus musculus
ttggcctgcttcttgggctgtttca

SEQ ID NO: 304639 - DNA, 25 bp, Mus musculus
agccttcgcttatgccgcacctatg

SEQ ID NO: 304640 - DNA, 25 bp, Mus musculus
cgcagatctgagctagcccggagct

SEQ ID NO: 304641 - DNA, 25 bp, Mus musculus
gcaaccatggccgtagcctcttggt

SEQ ID NO: 304642 - DNA, 25 bp, Mus musculus
agcctcttggtcctaagcggcgcgc

SEQ ID NO: 304643 - DNA, 25 bp, Mus musculus
accctacacgtctgcgttgccatga

SEQ ID NO: 304644 - DNA, 25 bp, Mus musculus
cccatttaatgagaggggttgatca

SEQ ID NO: 304645 - DNA, 25 bp, Mus musculus
ttcacaaactcggatcccgcgggac

SEQ ID NO: 304646 - DNA, 25 bp, Mus musculus
gtctccgggtaacagctgcggctcc

SEQ ID NO: 304647 - DNA, 25 bp, Mus musculus
agagccgcgcgcacccaggtggaac

SEQ ID NO: 304648 - DNA, 25 bp, Mus musculus
gtggaacggcccgaggcctcgatcc

SEQ ID NO: 304649 - DNA, 25 bp, Mus musculus
cacaggcagccggagtggtgtctcc

SEQ ID NO: 304650 - DNA, 25 bp, Mus musculus
gtcctcagagttgggaccacactcg

SEQ ID NO: 304651 - DNA, 25 bp, Mus musculus
tcgcgcgcgcgaaggcaaactctgg

SEQ ID NO: 304652 - DNA, 25 bp, Mus musculus
caccgcctgtaacgcgattgggaga

SEQ ID NO: 304653 - DNA, 25 bp, Mus musculus
tcctttgttcccagcggaggcagcg

SEQ ID NO: 304654 - DNA, 25 bp, Mus musculus
gggctatcctcagccaagagccaga

SEQ ID NO: 304655 - DNA, 25 bp, Mus musculus
ggagcggtggtctcaagactcttcc

SEQ ID NO: 304656 - DNA, 25 bp, Mus musculus
tcttcctccacggagtttgtttgga

SEQ ID NO: 304657 - DNA, 25 bp, Mus musculus
ttaatcttgaggttgcaggcgcccg

SEQ ID NO: 304658 - DNA, 25 bp, Mus musculus
tgtcaccaacctgacggtcaccatg

SEQ ID NO: 304659 - DNA, 25 bp, Mus musculus
atccagcaggaaacagagtctgtcc

SEQ ID NO: 304660 - DNA, 25 bp, Mus musculus
gcaattaacgctaaggccactttgg

SEQ ID NO: 304661 - DNA, 25 bp, Mus musculus
tgtccacttggttctgatgctccga

SEQ ID NO: 304662 - DNA, 25 bp, Mus musculus
gccgttcggatagtccagggctatc

SEQ ID NO: 304663 - DNA, 25 bp, Mus musculus
tccggctcagctgtcattcgggagc

SEQ ID NO: 304664 - DNA, 25 bp, Mus musculus
ggctatcctgagtgtgcagcaatta

SEQ ID NO: 304665 - DNA, 25 bp, Mus musculus
ggtgaattccgtttggcgccaacta

SEQ ID NO: 304666 - DNA, 25 bp, Mus musculus
gtttgcttcctgattggtgaattcc

SEQ ID NO: 304667 - DNA, 25 bp, Mus musculus
gaaggttccttctctgcgagccggc

SEQ ID NO: 304668 - DNA, 25 bp, Mus musculus
cgggcgtgaccttcggagtttctga

SEQ ID NO: 304669 - DNA, 25 bp, Mus musculus
ttctgagacgccttctgaggggacc

SEQ ID NO: 304670 - DNA, 25 bp, Mus musculus
cggagagattttgtatcagggcttc

SEQ ID NO: 304671 - DNA, 25 bp, Mus musculus
gcttgcctcaggctgggcatgtgct

SEQ ID NO: 304672 - DNA, 25 bp, Mus musculus
ccctccggctaggtctgtggcttct

SEQ ID NO: 304673 - DNA, 25 bp, Mus musculus
ccggggtcgtttctccaggcttcag

SEQ ID NO: 304674 - DNA, 25 bp, Mus musculus
aggggtggtctggagaatccaactc

SEQ ID NO: 304675 - DNA, 25 bp, Mus musculus
ggacactgagggtcgactgcagcct

SEQ ID NO: 304676 - DNA, 25 bp, Mus musculus
tcgtgccggccttcaagagggcgac

SEQ ID NO: 304677 - DNA, 25 bp, Mus musculus
tcgccattcgctgaggcatccgcgg

SEQ ID NO: 304678 - DNA, 25 bp, Mus musculus
cactttggggactgacgcgcatcta

SEQ ID NO: 304679 - DNA, 25 bp, Mus musculus
aatccaactcgagcccttgtgtgcg

SEQ ID NO: 304680 - DNA, 25 bp, Mus musculus
cgcatctagtgtctggcttcgggaa

SEQ ID NO: 304681 - DNA, 25 bp, Mus musculus
gcttcgggaatgcaaaaggggtcac

SEQ ID NO: 304682 - DNA, 25 bp, Mus musculus
tcacaataagagtcccggggcgccg

SEQ ID NO: 304683 - DNA, 25 bp, Mus musculus
ggctgtccggtacgcctccagctga

SEQ ID NO: 304684 - DNA, 25 bp, Mus musculus
ctgcctccgggttaggctgtccggt

SEQ ID NO: 304685 - DNA, 25 bp, Mus musculus
gcagttccagcccttcctgcaggtg

SEQ ID NO: 304686 - DNA, 25 bp, Mus musculus
tacgcagaggcagttccagcccttc

SEQ ID NO: 304687 - DNA, 25 bp, Mus musculus
accctacgagggctcacgggctcgg

SEQ ID NO: 304688 - DNA, 25 bp, Mus musculus
cacggtgactaagcacagcgcgcca

SEQ ID NO: 304689 - DNA, 25 bp, Mus musculus
gtcacgcgtgaccacactgccggag

SEQ ID NO: 304690 - DNA, 25 bp, Mus musculus
cccagctagtgagcgactgtcacgc

SEQ ID NO: 304691 - DNA, 25 bp, Mus musculus
ttgtctattagatcaccgtggggag

SEQ ID NO: 304692 - DNA, 25 bp, Mus musculus
gcgactccgcgtgttttgtctatta

SEQ ID NO: 304693 - DNA, 25 bp, Mus musculus
gcgccaccctgtcacaataagagtc

SEQ ID NO: 304694 - DNA, 25 bp, Mus musculus
gtctctgtaggtgccacgcgtccaa

SEQ ID NO: 304695 - DNA, 25 bp, Mus musculus
ccgcgcgggtcacggtgactaagca

SEQ ID NO: 304696 - DNA, 25 bp, Mus musculus
gcagccagcgccatgagccgcctgg

SEQ ID NO: 304697 - DNA, 25 bp, Mus musculus
ccttgtcgcccggaagcgacaaggg

SEQ ID NO: 304698 - DNA, 25 bp, Mus musculus
gaacatccttgtcgcccggaagcga

SEQ ID NO: 304699 - DNA, 25 bp, Mus musculus
agcattaccgtacgccctctgctgg

SEQ ID NO: 304700 - DNA, 25 bp, Mus musculus
agcaactggcagcattaccgtacgc

SEQ ID NO: 304701 - DNA, 25 bp, Mus musculus
gggctcagcaactggcagcattacc

SEQ ID NO: 304702 - DNA, 25 bp, Mus musculus
cgagggctcagcaactggcagcatt

SEQ ID NO: 304703 - DNA, 25 bp, Mus musculus
cgacagtaccttcgagggctcagca

SEQ ID NO: 304704 - DNA, 25 bp, Mus musculus
ccgcgacagtaccttcgagggctca

SEQ ID NO: 304705 - DNA, 25 bp, Mus musculus
ccagaccgcgacagtaccttcgagg

SEQ ID NO: 304706 - DNA, 25 bp, Mus musculus
agccgccatcgcgatcccaccagtc

SEQ ID NO: 304707 - DNA, 25 bp, Mus musculus
ccatgagccgcctggcagccgccat

SEQ ID NO: 304708 - DNA, 25 bp, Mus musculus
taccttcgagggctcagcaactggc

SEQ ID NO: 304709 - DNA, 25 bp, Mus musculus
gcgcgaacatccttgtcgcccggaa

SEQ ID NO: 304710 - DNA, 25 bp, Mus musculus
gcgaaggcgtcgtcgagccaatgaa

SEQ ID NO: 304711 - DNA, 25 bp, Mus musculus
gtcgagccaatgaagccgcctctct

SEQ ID NO: 304712 - DNA, 25 bp, Mus musculus
ccagcctggggaaaaccgagcatcc

SEQ ID NO: 304713 - DNA, 25 bp, Mus musculus
cccgaccgtgtcaggctgcttcaag

SEQ ID NO: 304714 - DNA, 25 bp, Mus musculus
aaagcccaattcacctgttgttaca

SEQ ID NO: 304715 - DNA, 25 bp, Mus musculus
tgttacagatgtgaaacaagcctcg

SEQ ID NO: 304716 - DNA, 25 bp, Mus musculus
acaagcctcggtgcacggcgcatga

SEQ ID NO: 304717 - DNA, 25 bp, Mus musculus
tcggctgcctaggttgtctctagtg

SEQ ID NO: 304718 - DNA, 25 bp, Mus musculus
gtctctagtgttcctcagcccacag

SEQ ID NO: 304719 - DNA, 25 bp, Mus musculus
gcccacagcgcgagacagtcagtct

SEQ ID NO: 304720 - DNA, 25 bp, Mus musculus
gagacagtcagtctgcgcctgcacc

SEQ ID NO: 304721 - DNA, 25 bp, Mus musculus
ggacgggtgaccatctcaggctcat

SEQ ID NO: 304722 - DNA, 25 bp, Mus musculus
agctctgtgtccgtcgcgccttttc

SEQ ID NO: 304723 - DNA, 25 bp, Mus musculus
gcttcccgggcaggcctaggatgcc

SEQ ID NO: 304724 - DNA, 25 bp, Mus musculus
cgtagtgtctaccaacagcagaggc

SEQ ID NO: 304725 - DNA, 25 bp, Mus musculus
ccggaagagtcattcgtagtgtcta

SEQ ID NO: 304726 - DNA, 25 bp, Mus musculus
tgaccgcctaacgaatagacaaacg

SEQ ID NO: 304727 - DNA, 25 bp, Mus musculus
agcaagttttgggagagcccggaca

SEQ ID NO: 304728 - DNA, 25 bp, Mus musculus
cctccttgagattgttgaccgccta

SEQ ID NO: 304729 - DNA, 25 bp, Mus musculus
ctagtagagatacagaacctccttg

SEQ ID NO: 304730 - DNA, 25 bp, Mus musculus
cctagaccgctttttctagtagaga

SEQ ID NO: 304731 - DNA, 25 bp, Mus musculus
ggcagcctcagtccgtaggggacta

SEQ ID NO: 304732 - DNA, 25 bp, Mus musculus
ctccgggactagcaggaattgctta

SEQ ID NO: 304733 - DNA, 25 bp, Mus musculus
tgaggctcagttccgagagaccaga

SEQ ID NO: 304734 - DNA, 25 bp, Mus musculus
gctctcagtgcctgttcgttgcagc

SEQ ID NO: 304735 - DNA, 25 bp, Mus musculus
tcgttgcagctttagggtccagaag

SEQ ID NO: 304736 - DNA, 25 bp, Mus musculus
gctgggcaagcactacaagaaggtg

SEQ ID NO: 304737 - DNA, 25 bp, Mus musculus
tcccagctagattcggtgcgagtct

SEQ ID NO: 304738 - DNA, 25 bp, Mus musculus
tccagctgaagtggcacccgtcttt

SEQ ID NO: 304739 - DNA, 25 bp, Mus musculus
atcgcgtgtaccgagcagaaccttc

SEQ ID NO: 304740 - DNA, 25 bp, Mus musculus
cagtgaggaccgtctctgtggaccc

SEQ ID NO: 304741 - DNA, 25 bp, Mus musculus
gtcccgcagcggttccagctgaagt

SEQ ID NO: 304742 - DNA, 25 bp, Mus musculus
gaagtggcacccgtcttttgctacc

SEQ ID NO: 304743 - DNA, 25 bp, Mus musculus
ccttgttcctgggtagctatccttg

SEQ ID NO: 304744 - DNA, 25 bp, Mus musculus
agctatccttgaagaccgtcctcga

SEQ ID NO: 304745 - DNA, 25 bp, Mus musculus
gcccgatcccgtttggcggctctag

SEQ ID NO: 304746 - DNA, 25 bp, Mus musculus
ggcggctctagctgcagccttctca

SEQ ID NO: 304747 - DNA, 25 bp, Mus musculus
cgctctccctgcgatcgcgctatta

SEQ ID NO: 304748 - DNA, 25 bp, Mus musculus
gctattaccaccacaccggtgtctg

SEQ ID NO: 304749 - DNA, 25 bp, Mus musculus
ggccatccggcatgcaggtgtctat

SEQ ID NO: 304750 - DNA, 25 bp, Mus musculus
catgcaggtgtctatcgcgtgtacc

SEQ ID NO: 304751 - DNA, 25 bp, Mus musculus
gcagaaccttcgcagccggagcagt

SEQ ID NO: 304752 - DNA, 25 bp, Mus musculus
cagcgcgctcagcactggaagcgca

SEQ ID NO: 304753 - DNA, 25 bp, Mus musculus
ctgcgcgccgcgcttgcatcgctct

SEQ ID NO: 304754 - DNA, 25 bp, Mus musculus
cgggctccgctctctccacactggg

SEQ ID NO: 304755 - DNA, 25 bp, Mus musculus
cgcgtggcgggtgggttcctcgcag

SEQ ID NO: 304756 - DNA, 25 bp, Mus musculus
gttcctcgcaggtccgcggcccagc

SEQ ID NO: 304757 - DNA, 25 bp, Mus musculus
cgctcagcactggaagcgcaagcgg

SEQ ID NO: 304758 - DNA, 25 bp, Mus musculus
tcagcactggaagcgcaagcgggcc

SEQ ID NO: 304759 - DNA, 25 bp, Mus musculus
cactggaagcgcaagcgggccccgt

SEQ ID NO: 304760 - DNA, 25 bp, Mus musculus
ctgccggcggtgcacctgtcggctt

SEQ ID NO: 304761 - DNA, 25 bp, Mus musculus
gtcggcttcccccagtggctctgct

SEQ ID NO: 304762 - DNA, 25 bp, Mus musculus
gccgcgcttgcatcgctctccacgt

SEQ ID NO: 304763 - DNA, 25 bp, Mus musculus
gcgcttgcatcgctctccacgtccc

SEQ ID NO: 304764 - DNA, 25 bp, Mus musculus
cgcgctcagcactggaagcgcaagc

SEQ ID NO: 304765 - DNA, 25 bp, Mus musculus
tgccggcggtgcacctgtcggcttc

SEQ ID NO: 304766 - DNA, 25 bp, Mus musculus
tggacccgcacctactgagagcagc

SEQ ID NO: 304767 - DNA, 25 bp, Mus musculus
agcaccagcactgtgtggacccgca

SEQ ID NO: 304768 - DNA, 25 bp, Mus musculus
gcgtctgccgtaaaccgagggcatc

SEQ ID NO: 304769 - DNA, 25 bp, Mus musculus
tgcaggattgcatccgggacgctgc

SEQ ID NO: 304770 - DNA, 25 bp, Mus musculus
ttatcccagttcacgatgtttccgg

SEQ ID NO: 304771 - DNA, 25 bp, Mus musculus
agtccggcagcgagatcacgcatgc

SEQ ID NO: 304772 - DNA, 25 bp, Mus musculus
gcatacgtgctcacgcgcttgcgca

SEQ ID NO: 304773 - DNA, 25 bp, Mus musculus
ctcgcctgctcgtgctaaatcgtga

SEQ ID NO: 304774 - DNA, 25 bp, Mus musculus
gagatcgctctaaggctcagcttta

SEQ ID NO: 304775 - DNA, 25 bp, Mus musculus
ctgagagcagcacaatggtccattg

SEQ ID NO: 304776 - DNA, 25 bp, Mus musculus
agcctgattggctgactcgagtccg

SEQ ID NO: 304777 - DNA, 25 bp, Mus musculus
gctaaatcgtgagggagcaccagca

SEQ ID NO: 304778 - DNA, 25 bp, Mus musculus
ccattgcccgaatgagagatcgctc

SEQ ID NO: 304779 - DNA, 25 bp, Mus musculus
gggtgctgttcttggaccttcattc

SEQ ID NO: 304780 - DNA, 25 bp, Mus musculus
gttggcagtgccagactacgcatgc

SEQ ID NO: 304781 - DNA, 25 bp, Mus musculus
gggcgtgggcgctgtccagcagccc

SEQ ID NO: 304782 - DNA, 25 bp, Mus musculus
acctcagcgcgcgtctgcacggtgc

SEQ ID NO: 304783 - DNA, 25 bp, Mus musculus
ctgcctcgctgccacaggtacctca

SEQ ID NO: 304784 - DNA, 25 bp, Mus musculus
agcgcgcaggccgttctccgccgct

SEQ ID NO: 304785 - DNA, 25 bp, Mus musculus
caaacaccggaccgcgggccaggag

SEQ ID NO: 304786 - DNA, 25 bp, Mus musculus
aaaggtaggagttgagaggtgaagg

SEQ ID NO: 304787 - DNA, 25 bp, Mus musculus
cgaacccgagccgttggcagtgcca

SEQ ID NO: 304788 - DNA, 25 bp, Mus musculus
ggcagtgccagactacgcatgcgca

SEQ ID NO: 304789 - DNA, 25 bp, Mus musculus
ccgagccgttggcagtgccagacta

SEQ ID NO: 304790 - DNA, 25 bp, Mus musculus
tccggagaccgcagtctggagctgg

SEQ ID NO: 304791 - DNA, 25 bp, Mus musculus
ctcgtgcccgggagttccgggatgc

SEQ ID NO: 304792 - DNA, 25 bp, Mus musculus
agtgccagactacgcatgcgcacgc

SEQ ID NO: 304793 - DNA, 25 bp, Mus musculus
acaggtacctcagcgcgcgtctgca

SEQ ID NO: 304794 - DNA, 25 bp, Mus musculus
cctcacgcaggacatcgagtgtctg

SEQ ID NO: 304795 - DNA, 25 bp, Mus musculus
tggccgctctagagactcgggttat

SEQ ID NO: 304796 - DNA, 25 bp, Mus musculus
gctagcccggaagaacctggagaca

SEQ ID NO: 304797 - DNA, 25 bp, Mus musculus
ctgtcagatggaggcaaggctagcc

SEQ ID NO: 304798 - DNA, 25 bp, Mus musculus
ctcaggagaactgggaaaggctgtc

SEQ ID NO: 304799 - DNA, 25 bp, Mus musculus
tccgcccttagctcagacttgtgtg

SEQ ID NO: 304800 - DNA, 25 bp, Mus musculus
acacggatcccacgcccagggtaag

SEQ ID NO: 304801 - DNA, 25 bp, Mus musculus
gctcagacaggggactgcctcacac

SEQ ID NO: 304802 - DNA, 25 bp, Mus musculus
tctggctagcgatgggatgctacta

SEQ ID NO: 304803 - DNA, 25 bp, Mus musculus
ctcgggttatgacttcagccgcctg

SEQ ID NO: 304804 - DNA, 25 bp, Mus musculus
ggccttggcccttgtcaacatagca

SEQ ID NO: 304805 - DNA, 25 bp, Mus musculus
aatcagcggacttcagcaggtcgtc

SEQ ID NO: 304806 - DNA, 25 bp, Mus musculus
caccgcccgagacggagatagtgcc

SEQ ID NO: 304807 - DNA, 25 bp, Mus musculus
agctgccctgcgatgactacggcta

SEQ ID NO: 304808 - DNA, 25 bp, Mus musculus
caggtccagccagatcatgggcatc

SEQ ID NO: 304809 - DNA, 25 bp, Mus musculus
ctgaacctcggtagaaacgcgggtg

SEQ ID NO: 304810 - DNA, 25 bp, Mus musculus
gcatgctcggtcttctcgcgcgaag

SEQ ID NO: 304811 - DNA, 25 bp, Mus musculus
tccaggagcgtcatcgcaaggaagc

SEQ ID NO: 304812 - DNA, 25 bp, Mus musculus
cccataatgatgcactgccagtcgg

SEQ ID NO: 304813 - DNA, 25 bp, Mus musculus
ctgccagtcggagaaaacgatgatg

SEQ ID NO: 304814 - DNA, 25 bp, Mus musculus
gccatcctaagggaaaacgcctggc

SEQ ID NO: 304815 - DNA, 25 bp, Mus musculus
gcgcggcgaaggtgtgctcaccttc

SEQ ID NO: 304816 - DNA, 25 bp, Mus musculus
cgcaaggaagcgctgaacctcggta

SEQ ID NO: 304817 - DNA, 25 bp, Mus musculus
ctggaagtgaaagtcaccggcctcc

SEQ ID NO: 304818 - DNA, 25 bp, Mus musculus
tcttgggtggagagacgacccaatc

SEQ ID NO: 304819 - DNA, 25 bp, Mus musculus
gaagctgctcgtcacgcggagtgac

SEQ ID NO: 304820 - DNA, 25 bp, Mus musculus
ccggtagtctttttgcacatgcgca

SEQ ID NO: 304821 - DNA, 25 bp, Mus musculus
cttcttcaccgcagactggaagtga

SEQ ID NO: 304822 - DNA, 25 bp, Mus musculus
agccggaatctcactggcctgcgcg

SEQ ID NO: 304823 - DNA, 25 bp, Mus musculus
aagtcctcgacaccggaagtctcgc

SEQ ID NO: 304824 - DNA, 25 bp, Mus musculus
tgcgcggccaccgtacccacaaagt

SEQ ID NO: 304825 - DNA, 25 bp, Mus musculus
tgcccagaacgcgaagccggaatct

SEQ ID NO: 304826 - DNA, 25 bp, Mus musculus
ggctcacgctgaaggctgcccagaa

SEQ ID NO: 304827 - DNA, 25 bp, Mus musculus
cttcacactaaccagggcggggcaa

SEQ ID NO: 304828 - DNA, 25 bp, Mus musculus
caggcttcacactaaccagggcggg

SEQ ID NO: 304829 - DNA, 25 bp, Mus musculus
gcctggccagcaggcttcacactaa

SEQ ID NO: 304830 - DNA, 25 bp, Mus musculus
tccgacacggagaaatgcaccaagt

SEQ ID NO: 304831 - DNA, 25 bp, Mus musculus
cgcgactaggcaactccgacacgga

SEQ ID NO: 304832 - DNA, 25 bp, Mus musculus
cgtagccgcgactaggcaactccga

SEQ ID NO: 304833 - DNA, 25 bp, Mus musculus
tccatgacgccgtagccgcgactag

SEQ ID NO: 304834 - DNA, 25 bp, Mus musculus
tcacgtcgcatagcttgccctgccg

SEQ ID NO: 304835 - DNA, 25 bp, Mus musculus
ccacaaagtcctcgacaccggaagt

SEQ ID NO: 304836 - DNA, 25 bp, Mus musculus
tcatgaagccgctgccgtcgcagca

SEQ ID NO: 304837 - DNA, 25 bp, Mus musculus
tgtcctgacggccttgggctgttcc

SEQ ID NO: 304838 - DNA, 25 bp, Mus musculus
gctctcccagggcttcgaaggatga

SEQ ID NO: 304839 - DNA, 25 bp, Mus musculus
ggacttattgttccgggaggccgca

SEQ ID NO: 304840 - DNA, 25 bp, Mus musculus
ctctttaaggggctgggcctgcaag

SEQ ID NO: 304841 - DNA, 25 bp, Mus musculus
cgccaccgaagatgggggatttcta

SEQ ID NO: 304842 - DNA, 25 bp, Mus musculus
gatttctacgatcccgagcacccga

SEQ ID NO: 304843 - DNA, 25 bp, Mus musculus
ctgagtaagtctctgctccgcggtc

SEQ ID NO: 304844 - DNA, 25 bp, Mus musculus
cggtctcccgctgtcgttggtcgct

SEQ ID NO: 304845 - DNA, 25 bp, Mus musculus
gctgtcgttggtcgctccagcccga

SEQ ID NO: 304846 - DNA, 25 bp, Mus musculus
tcctcggtcggcctgcttaggttcg

SEQ ID NO: 304847 - DNA, 25 bp, Mus musculus
cttaggttcggcgttccgcgcagct

SEQ ID NO: 304848 - DNA, 25 bp, Mus musculus
gctcctccaggacactcggtggcgt

SEQ ID NO: 304849 - DNA, 25 bp, Mus musculus
ctgccctgtgcgtgtctctttaagg

SEQ ID NO: 304850 - DNA, 25 bp, Mus musculus
aggccagcacgcagaagagcacata

SEQ ID NO: 304851 - DNA, 25 bp, Mus musculus
ccatggtaaggtggcgctctaaagc

SEQ ID NO: 304852 - DNA, 25 bp, Mus musculus
agcttgccggtgtagttgtagtgaa

SEQ ID NO: 304853 - DNA, 25 bp, Mus musculus
gccaagttctccagcacaatgaagg

SEQ ID NO: 304854 - DNA, 25 bp, Mus musculus
gttggcccgcacctgacagtaaatc

SEQ ID NO: 304855 - DNA, 25 bp, Mus musculus
aggtccgacaaagtgaggctgccaa

SEQ ID NO: 304856 - DNA, 25 bp, Mus musculus
ttcagcagcgagttagccatggcta

SEQ ID NO: 304857 - DNA, 25 bp, Mus musculus
tagcagcccgagcaatagcgacgcg

SEQ ID NO: 304858 - DNA, 25 bp, Mus musculus
tccaggcgtcctaagcagttccagc

SEQ ID NO: 304859 - DNA, 25 bp, Mus musculus
cacataggccttggcgtagagcggc

SEQ ID NO: 304860 - DNA, 25 bp, Mus musculus
tccttgcatagagcgcacagatggc

SEQ ID NO: 304861 - DNA, 25 bp, Mus musculus
ccaggagcaccacgctaagggtacg

SEQ ID NO: 304862 - DNA, 25 bp, Mus musculus
gctgggcacgcgacatccagtaata

SEQ ID NO: 304863 - DNA, 25 bp, Mus musculus
cagcaccaagagcacagccaagttc

SEQ ID NO: 304864 - DNA, 25 bp, Mus musculus
ttcctctgtttccacgcgttccgta

SEQ ID NO: 304865 - DNA, 25 bp, Mus musculus
cctgccgagcaaccaagaataggta

SEQ ID NO: 304866 - DNA, 25 bp, Mus musculus
acacaagcttctcgcgtttctcatc

SEQ ID NO: 304867 - DNA, 25 bp, Mus musculus
tcgcgtttctcatctagctcggccg

SEQ ID NO: 304868 - DNA, 25 bp, Mus musculus
gaacgccgcaggttgaaacgccgca

SEQ ID NO: 304869 - DNA, 25 bp, Mus musculus
aagtcatggccgatgcctgccgagc

SEQ ID NO: 304870 - DNA, 25 bp, Mus musculus
acgcgttccgtactgccgtcataga

SEQ ID NO: 304871 - DNA, 25 bp, Mus musculus
cgtactgccgtcatagaaatacacg

SEQ ID NO: 304872 - DNA, 25 bp, Mus musculus
acacgtgctgtgtggtgatctctaa

SEQ ID NO: 304873 - DNA, 25 bp, Mus musculus
ctgtgtggtgatctctaagagtccc

SEQ ID NO: 304874 - DNA, 25 bp, Mus musculus
accaccgtgacgagctggcactcag

SEQ ID NO: 304875 - DNA, 25 bp, Mus musculus
ggcactcagccgacaacacaagctt

SEQ ID NO: 304876 - DNA, 25 bp, Mus musculus
gcctgcactttggtcattctctgtc

SEQ ID NO: 304877 - DNA, 25 bp, Mus musculus
gaataggtataaggagtcactggtc

SEQ ID NO: 304878 - DNA, 25 bp, Mus musculus
cgcagcaggcgacgcagctccaagg

SEQ ID NO: 304879 - DNA, 25 bp, Mus musculus
cggcaccatgatgccagccatgctg

SEQ ID NO: 304880 - DNA, 25 bp, Mus musculus
atgatgccagccatgctgggcgtga

SEQ ID NO: 304881 - DNA, 25 bp, Mus musculus
ccatgctgggcgtgaggtcaaagta

SEQ ID NO: 304882 - DNA, 25 bp, Mus musculus
cgacagtgcccggatgacggcgcct

SEQ ID NO: 304883 - DNA, 25 bp, Mus musculus
atgacggcgcctgcatggcgagcct

SEQ ID NO: 304884 - DNA, 25 bp, Mus musculus
cctgcatggcgagccttctgagatt

SEQ ID NO: 304885 - DNA, 25 bp, Mus musculus
tggcgagccttctgagattcatttc

SEQ ID NO: 304886 - DNA, 25 bp, Mus musculus
gccttctgagattcatttccacttg

SEQ ID NO: 304887 - DNA, 25 bp, Mus musculus
tttccacttgactctgagtccagcc

SEQ ID NO: 304888 - DNA, 25 bp, Mus musculus
gctccaagggccgtagtgacactcg

SEQ ID NO: 304889 - DNA, 25 bp, Mus musculus
acgcagctccaagggccgtagtgac

SEQ ID NO: 304890 - DNA, 25 bp, Mus musculus
ctgcacgggcggcaccatgatgcca

SEQ ID NO: 304891 - DNA, 25 bp, Mus musculus
gagattcatttccacttgactctga

SEQ ID NO: 304892 - DNA, 25 bp, Mus musculus
ctgaccggccgctgtcctggctggt

SEQ ID NO: 304893 - DNA, 25 bp, Mus musculus
acgccagaaacacacgtcaggcctg

SEQ ID NO: 304894 - DNA, 25 bp, Mus musculus
acaggcacctggcgggacagagtca

SEQ ID NO: 304895 - DNA, 25 bp, Mus musculus
ctacctacggcagccaccggccagg

SEQ ID NO: 304896 - DNA, 25 bp, Mus musculus
gtctaaacgccagaaacacacgtca

SEQ ID NO: 304897 - DNA, 25 bp, Mus musculus
gaaacacacgtcaggcctgctaagc

SEQ ID NO: 304898 - DNA, 25 bp, Mus musculus
tcaggcctgctaagccgctctgcgg

SEQ ID NO: 304899 - DNA, 25 bp, Mus musculus
cctggcccggctacgaccgcccaag

SEQ ID NO: 304900 - DNA, 25 bp, Mus musculus
ccgggtggtggacacgcacagttcc

SEQ ID NO: 304901 - DNA, 25 bp, Mus musculus
tggtggacacgcacagttccgcccg

SEQ ID NO: 304902 - DNA, 25 bp, Mus musculus
ccgcacacccggagcgcctcactca

SEQ ID NO: 304903 - DNA, 25 bp, Mus musculus
ggcgacgccatgagcgcagcggcct

SEQ ID NO: 304904 - DNA, 25 bp, Mus musculus
tgggcccagagcactacctacggca

SEQ ID NO: 304905 - DNA, 25 bp, Mus musculus
cgcaagcaagtctaaacgccagaaa

SEQ ID NO: 304906 - DNA, 25 bp, Mus musculus
ctcacctgcgcgtagtagagcagcc

SEQ ID NO: 304907 - DNA, 25 bp, Mus musculus
ggaagtccgcggctcctgaccctgt

SEQ ID NO: 304908 - DNA, 25 bp, Mus musculus
gaggtcgcatggagctccgcctctc

SEQ ID NO: 304909 - DNA, 25 bp, Mus musculus
cgcctctcctaggactgtccaaagg

SEQ ID NO: 304910 - DNA, 25 bp, Mus musculus
cctacacttggttgtctgtggcagc

SEQ ID NO: 304911 - DNA, 25 bp, Mus musculus
ctgtcgcacttagccaccaaagtct

SEQ ID NO: 304912 - DNA, 25 bp, Mus musculus
tagagcagccacaactcgtagagcc

SEQ ID NO: 304913 - DNA, 25 bp, Mus musculus
agccggacgcaggtgcagcagacac

SEQ ID NO: 304914 - DNA, 25 bp, Mus musculus
accgcctggcttcctacacttggtt

SEQ ID NO: 304915 - DNA, 25 bp, Mus musculus
cacgtgtgcgcggagctgaagtccc

SEQ ID NO: 304916 - DNA, 25 bp, Mus musculus
cctggcacaaatgcccgaggtagcc

SEQ ID NO: 304917 - DNA, 25 bp, Mus musculus
atacagcgctcaccggcgaacactg

SEQ ID NO: 304918 - DNA, 25 bp, Mus musculus
gcggtctcgctgaggacttgcaata

SEQ ID NO: 304919 - DNA, 25 bp, Mus musculus
gcagcagacactgcgtgcgcggatc

SEQ ID NO: 304920 - DNA, 25 bp, Mus musculus
cgctgacctctgagataggctcgtt

SEQ ID NO: 304921 - DNA, 25 bp, Mus musculus
atgcgcagtgggacggcgctgacct

SEQ ID NO: 304922 - DNA, 25 bp, Mus musculus
actgaagccaaagtgcgcgtgcgcg

SEQ ID NO: 304923 - DNA, 25 bp, Mus musculus
taccagggaaccactgaagccaaag

SEQ ID NO: 304924 - DNA, 25 bp, Mus musculus
ataggctcgtttcttgagtgcaggg

SEQ ID NO: 304925 - DNA, 25 bp, Mus musculus
cgcgtgcgccttaggaagtcgtttt

SEQ ID NO: 304926 - DNA, 25 bp, Mus musculus
gcggaggattaccagggaaccactg

SEQ ID NO: 304927 - DNA, 25 bp, Mus musculus
cgtgcgccttaggaagtcgttttcg

SEQ ID NO: 304928 - DNA, 25 bp, Mus musculus
tgacctctgagataggctcgtttct

SEQ ID NO: 304929 - DNA, 25 bp, Mus musculus
aggattaccagggaaccactgaagc

SEQ ID NO: 304930 - DNA, 25 bp, Mus musculus
gaaaaccgggcgcaaggtgaggcac

SEQ ID NO: 304931 - DNA, 25 bp, Mus musculus
gcggaaagaacggctgaaggccctc

SEQ ID NO: 304932 - DNA, 25 bp, Mus musculus
tgggccgcctagaggaagaggcgct

SEQ ID NO: 304933 - DNA, 25 bp, Mus musculus
aaaagatggcggctgctcctgccgg

SEQ ID NO: 304934 - DNA, 25 bp, Mus musculus
gatatgcaactcttcctccgtgagg

SEQ ID NO: 304935 - DNA, 25 bp, Mus musculus
cggcacctgcgcgatgatatgcaac

SEQ ID NO: 304936 - DNA, 25 bp, Mus musculus
tccttcacgaagatgctcgcggcgc

SEQ ID NO: 304937 - DNA, 25 bp, Mus musculus
ggcgctcggcctcatccagcgtgaa

SEQ ID NO: 304938 - DNA, 25 bp, Mus musculus
atccagcgtgaagccagagtagagc

SEQ ID NO: 304939 - DNA, 25 bp, Mus musculus
tgcgccgtaagtggggacatcacgc

SEQ ID NO: 304940 - DNA, 25 bp, Mus musculus
atgtagttgcgcgtgcagtgcagcc

SEQ ID NO: 304941 - DNA, 25 bp, Mus musculus
gcctgcgggcgtgcgacatcacctt

SEQ ID NO: 304942 - DNA, 25 bp, Mus musculus
taaacgacaggaacatgtgcatgtg

SEQ ID NO: 304943 - DNA, 25 bp, Mus musculus
cgacatcaccttgggtgagggcacg

SEQ ID NO: 304944 - DNA, 25 bp, Mus musculus
catgtgcatgtggatgtagttgcgc

SEQ ID NO: 304945 - DNA, 25 bp, Mus musculus
tcgcggcgcgcagcataaacgacag

SEQ ID NO: 304946 - DNA, 25 bp, Mus musculus
agaaaggaggctcgcaccctggacc

SEQ ID NO: 304947 - DNA, 25 bp, Mus musculus
gagtagagcacagcgtccttcacga

SEQ ID NO: 304948 - DNA, 25 bp, Mus musculus
ccggctttggcctctgctattccaa

SEQ ID NO: 304949 - DNA, 25 bp, Mus musculus
cccgggtctttcagcagaaggataa

SEQ ID NO: 304950 - DNA, 25 bp, Mus musculus
gccactgcctctcaggcgggtgtgt

SEQ ID NO: 304951 - DNA, 25 bp, Mus musculus
gacttcatggagctctcgggatccc

SEQ ID NO: 304952 - DNA, 25 bp, Mus musculus
cgccttgccatgaatgtcggggccc

SEQ ID NO: 304953 - DNA, 25 bp, Mus musculus
tggcgactccacagggctccgagga

SEQ ID NO: 304954 - DNA, 25 bp, Mus musculus
ggacgcagtctagggagctctgaca

SEQ ID NO: 304955 - DNA, 25 bp, Mus musculus
tgcaagtttccaaaaaagccaccga

SEQ ID NO: 304956 - DNA, 25 bp, Mus musculus
gagctctgacatcgggacctgagaa

SEQ ID NO: 304957 - DNA, 25 bp, Mus musculus
ctgcttgtcagtcggtcctttgcta

SEQ ID NO: 304958 - DNA, 25 bp, Mus musculus
tgaggctgcctgtctgcttgtcagt

SEQ ID NO: 304959 - DNA, 25 bp, Mus musculus
cacactgagcccttcggcgtttctg

SEQ ID NO: 304960 - DNA, 25 bp, Mus musculus
cctgacttttgcaaccacactgagc

SEQ ID NO: 304961 - DNA, 25 bp, Mus musculus
aagccaccgaactgagcggcagcgg

SEQ ID NO: 304962 - DNA, 25 bp, Mus musculus
taaccagctccagatgcggcgagcg

SEQ ID NO: 304963 - DNA, 25 bp, Mus musculus
cgcttttcatctaggccggtcgcct

SEQ ID NO: 304964 - DNA, 25 bp, Mus musculus
tggccatgcaatccgcaccgagggc

SEQ ID NO: 304965 - DNA, 25 bp, Mus musculus
cttctgtgtggagtccgctttgcag

SEQ ID NO: 304966 - DNA, 25 bp, Mus musculus
gctagggacacaacactgcagtttc

SEQ ID NO: 304967 - DNA, 25 bp, Mus musculus
tagttccatccgctccgggtcacga

SEQ ID NO: 304968 - DNA, 25 bp, Mus musculus
ctcaaggctctcagtgtaacggggc

SEQ ID NO: 304969 - DNA, 25 bp, Mus musculus
ctggtaactggctctcaaggctctc

SEQ ID NO: 304970 - DNA, 25 bp, Mus musculus
atgactcacggtggacagcagcgac

SEQ ID NO: 304971 - DNA, 25 bp, Mus musculus
ctcggtgagacacatcccagtttca

SEQ ID NO: 304972 - DNA, 25 bp, Mus musculus
acgacccttagctgcccggctgagt

SEQ ID NO: 304973 - DNA, 25 bp, Mus musculus
ctcatgttcacaggccgtccgatcg

SEQ ID NO: 304974 - DNA, 25 bp, Mus musculus
tgaccaccgcctgtttttaataagc

SEQ ID NO: 304975 - DNA, 25 bp, Mus musculus
gccgggtggcatctccgcttttcat

SEQ ID NO: 304976 - DNA, 25 bp, Mus musculus
gctgcccttagggacaatattcatg

SEQ ID NO: 304977 - DNA, 25 bp, Mus musculus
ttgcggcgctactgttgctgcctcc

SEQ ID NO: 304978 - DNA, 25 bp, Mus musculus
atgtatggctacgtcattgcgcggc

SEQ ID NO: 304979 - DNA, 25 bp, Mus musculus
cggtcaggctcttggcgccaggtca

SEQ ID NO: 304980 - DNA, 25 bp, Mus musculus
catgtgtcgaagacgccatcgcgta

SEQ ID NO: 304981 - DNA, 25 bp, Mus musculus
ccatcgcgtactgggatgtgggcac

SEQ ID NO: 304982 - DNA, 25 bp, Mus musculus
ggcacgtgacagcacgccgcagcta

SEQ ID NO: 304983 - DNA, 25 bp, Mus musculus
cagctatctctgctgcccttaggga

SEQ ID NO: 304984 - DNA, 25 bp, Mus musculus
gggacaatattcatgtatggctacg

SEQ ID NO: 304985 - DNA, 25 bp, Mus musculus
ggctacgtcattgcgcggcctggac

SEQ ID NO: 304986 - DNA, 25 bp, Mus musculus
cttgaggcgctggatcctaatctgc

SEQ ID NO: 304987 - DNA, 25 bp, Mus musculus
ggcgctggatcctaatctgctttgc

SEQ ID NO: 304988 - DNA, 25 bp, Mus musculus
cctaatctgctttgcggcgctactg

SEQ ID NO: 304989 - DNA, 25 bp, Mus musculus
cgccaggtcagtcatgtgtcgaaga

SEQ ID NO: 304990 - DNA, 25 bp, Mus musculus
ccggcacgcccacccgcggccacct

SEQ ID NO: 304991 - DNA, 25 bp, Mus musculus
acgctgtccaccaccgtcccgaccg

SEQ ID NO: 304992 - DNA, 25 bp, Mus musculus
cacaggctacttggccgcaggagca

SEQ ID NO: 304993 - DNA, 25 bp, Mus musculus
ttccacaggctacttggccgcagga

SEQ ID NO: 304994 - DNA, 25 bp, Mus musculus
tggagaccttccacaggctacttgg

SEQ ID NO: 304995 - DNA, 25 bp, Mus musculus
ctcgctggagaccttccacaggcta

SEQ ID NO: 304996 - DNA, 25 bp, Mus musculus
tctgactcgctggagaccttccaca

SEQ ID NO: 304997 - DNA, 25 bp, Mus musculus
agcgccccagcgaatggcatctagg

SEQ ID NO: 304998 - DNA, 25 bp, Mus musculus
ctgctcctgcctcggcggccggcag

SEQ ID NO: 304999 - DNA, 25 bp, Mus musculus
ccgcgcccttctcctgctgttgctg

SEQ ID NO: 305000 - DNA, 25 bp, Mus musculus
cgccattgtggaggaacctagcggc

SEQ ID NO: 305001 - DNA, 25 bp, Mus musculus
agcgcaccatgaggcgcccgatgga

SEQ ID NO: 305002 - DNA, 25 bp, Mus musculus
tgggcaccagcgcaccatgaggcgc

SEQ ID NO: 305003 - DNA, 25 bp, Mus musculus
cctttagcgggagcgccccagcgaa

SEQ ID NO: 305004 - DNA, 25 bp, Mus musculus
agccatgctgcctcccggccatgtt

SEQ ID NO: 305005 - DNA, 25 bp, Mus musculus
ttcatcttgggtgtcaggttcccgg

SEQ ID NO: 305006 - DNA, 25 bp, Mus musculus
tcatttattcatcttgggtgtcagg

SEQ ID NO: 305007 - DNA, 25 bp, Mus musculus
gagccctccatgacgccgtgcctca

SEQ ID NO: 305008 - DNA, 25 bp, Mus musculus
cctcgacggtgccagcatcccgagc

SEQ ID NO: 305009 - DNA, 25 bp, Mus musculus
tgcgtggcgacacccgccaggcaag

SEQ ID NO: 305010 - DNA, 25 bp, Mus musculus
ggccatgttctctcgtttgccgcgc

SEQ ID NO: 305011 - DNA, 25 bp, Mus musculus
atgttctctcgtttgccgcgcgctc

SEQ ID NO: 305012 - DNA, 25 bp, Mus musculus
tccggtgcaggtcctgagagtccag

SEQ ID NO: 305013 - DNA, 25 bp, Mus musculus
gggctgatgcacagagctaccaggt

SEQ ID NO: 305014 - DNA, 25 bp, Mus musculus
cagagctaccaggtgactgtccctg

SEQ ID NO: 305015 - DNA, 25 bp, Mus musculus
gcgggaggttgagtccgcatcattt

SEQ ID NO: 305016 - DNA, 25 bp, Mus musculus
aggttgagtccgcatcatttattca

SEQ ID NO: 305017 - DNA, 25 bp, Mus musculus
gtgcctcacctctaccagctgcgtg

SEQ ID NO: 305018 - DNA, 25 bp, Mus musculus
gcaagtcctagcttctccctcgggt

SEQ ID NO: 305019 - DNA, 25 bp, Mus musculus
gcctgggaacactggacggctgcaa

SEQ ID NO: 305020 - DNA, 25 bp, Mus musculus
cgcctgggtccggtcgtgtgcccta

SEQ ID NO: 305021 - DNA, 25 bp, Mus musculus
ctgggaacactggacggctgcaatg

SEQ ID NO: 305022 - DNA, 25 bp, Mus musculus
ctggaagtggcaagcctaagggcgg

SEQ ID NO: 305023 - DNA, 25 bp, Mus musculus
gcccgcgacgccaagtgtcggcgaa

SEQ ID NO: 305024 - DNA, 25 bp, Mus musculus
agtgtcggcgaacgcccgcattttc

SEQ ID NO: 305025 - DNA, 25 bp, Mus musculus
tcccagcccggggttgccagcctgt

SEQ ID NO: 305026 - DNA, 25 bp, Mus musculus
cagcctgtgccacccgccgcggcac

SEQ ID NO: 305027 - DNA, 25 bp, Mus musculus
accggagagcgcctcagcggcgact

SEQ ID NO: 305028 - DNA, 25 bp, Mus musculus
cctcagcggcgactggtaccagcaa

SEQ ID NO: 305029 - DNA, 25 bp, Mus musculus
cagcggcgactggtaccagcaagtc

SEQ ID NO: 305030 - DNA, 25 bp, Mus musculus
cgactggtaccagcaagtcctagct

SEQ ID NO: 305031 - DNA, 25 bp, Mus musculus
cggcgactggtaccagcaagtccta

SEQ ID NO: 305032 - DNA, 25 bp, Mus musculus
gccctccatcttcggtctcagcttc

SEQ ID NO: 305033 - DNA, 25 bp, Mus musculus
atcctggggagctcgcggaccgacc

SEQ ID NO: 305034 - DNA, 25 bp, Mus musculus
ccgaccgaaggggagctttcgcagt

SEQ ID NO: 305035 - DNA, 25 bp, Mus musculus
accgaaggggagctttcgcagtctg

SEQ ID NO: 305036 - DNA, 25 bp, Mus musculus
agagttgttggcttggggacattcc

SEQ ID NO: 305037 - DNA, 25 bp, Mus musculus
cccgcgcgaacaacacctcggggcg

SEQ ID NO: 305038 - DNA, 25 bp, Mus musculus
gcaccgcggcgcaaagcgcaggtaa

SEQ ID NO: 305039 - DNA, 25 bp, Mus musculus
cgaaagacagccagggtgcgatcct

SEQ ID NO: 305040 - DNA, 25 bp, Mus musculus
tcccgctgccatggtcacgagccct

SEQ ID NO: 305041 - DNA, 25 bp, Mus musculus
ccggctccggtttaaacgcagcgcg

SEQ ID NO: 305042 - DNA, 25 bp, Mus musculus
aggtaaaaggcgaaagacagccagg

SEQ ID NO: 305043 - DNA, 25 bp, Mus musculus
cagcagtgcggagcgcgagcaccgt

SEQ ID NO: 305044 - DNA, 25 bp, Mus musculus
gggtccaacccctagcagcagtgcg

SEQ ID NO: 305045 - DNA, 25 bp, Mus musculus
tgccccacgagctcagctgcgggtg

SEQ ID NO: 305046 - DNA, 25 bp, Mus musculus
cgccgcaaacggtggtggaaataga

SEQ ID NO: 305047 - DNA, 25 bp, Mus musculus
gaaagccactttcctgcatcctgca

SEQ ID NO: 305048 - DNA, 25 bp, Mus musculus
agtcccggcttcgagtagcgattcg

SEQ ID NO: 305049 - DNA, 25 bp, Mus musculus
aacgagtcccggcttcgagtagcga

SEQ ID NO: 305050 - DNA, 25 bp, Mus musculus
gaatcagggtagctccgccctccaa

SEQ ID NO: 305051 - DNA, 25 bp, Mus musculus
cgccgcggcagaatcagggtagctc

SEQ ID NO: 305052 - DNA, 25 bp, Mus musculus
actttcctgcatcctgcaatcagct

SEQ ID NO: 305053 - DNA, 25 bp, Mus musculus
ttgtaccctctggaaagccactttc

SEQ ID NO: 305054 - DNA, 25 bp, Mus musculus
gcggagtgattgtaccctctggaaa

SEQ ID NO: 305055 - DNA, 25 bp, Mus musculus
cccaatgcggagtgattgtaccctc

SEQ ID NO: 305056 - DNA, 25 bp, Mus musculus
tcgcattccaagaagtagtccgttg

SEQ ID NO: 305057 - DNA, 25 bp, Mus musculus
cgctcttggggaacaaatcgcattc

SEQ ID NO: 305058 - DNA, 25 bp, Mus musculus
cggtggtggaaatagatgcgctctt

SEQ ID NO: 305059 - DNA, 25 bp, Mus musculus
tagatgcgctcttggggaacaaatc

SEQ ID NO: 305060 - DNA, 25 bp, Mus musculus
tggcggccacaaccgggtactgtca

SEQ ID NO: 305061 - DNA, 25 bp, Mus musculus
cactctcacagggaaggtgagtgga

SEQ ID NO: 305062 - DNA, 25 bp, Mus musculus
gttctgcgggcgtaaacagcatcga

SEQ ID NO: 305063 - DNA, 25 bp, Mus musculus
aacggattacagagtggcggccaca

SEQ ID NO: 305064 - DNA, 25 bp, Mus musculus
gagcgtctgtctgcgactgcgcaga

SEQ ID NO: 305065 - DNA, 25 bp, Mus musculus
ggccacaaccgggtactgtcagcgc

SEQ ID NO: 305066 - DNA, 25 bp, Mus musculus
tgtcagcgcccactctcacagggaa

SEQ ID NO: 305067 - DNA, 25 bp, Mus musculus
acaggcacggtagcccttccgctgg

SEQ ID NO: 305068 - DNA, 25 bp, Mus musculus
gctgcgcccgcgttgtgcgcttacg

SEQ ID NO: 305069 - DNA, 25 bp, Mus musculus
cgtaaacagcatcgaaaacggatta

SEQ ID NO: 305070 - DNA, 25 bp, Mus musculus
tgcttagagaactggtcgctgcgcc

SEQ ID NO: 305071 - DNA, 25 bp, Mus musculus
gggcgtctaggctgcttagagaact

SEQ ID NO: 305072 - DNA, 25 bp, Mus musculus
gcgcccactctcacagggaaggtga

SEQ ID NO: 305073 - DNA, 25 bp, Mus musculus
tctgcgactgcgcagaagctgagtg

SEQ ID NO: 305074 - DNA, 25 bp, Mus musculus
tgtctccaggcgctgcccagtggcg

SEQ ID NO: 305075 - DNA, 25 bp, Mus musculus
agactctgtcctcagtctgtcccgg

SEQ ID NO: 305076 - DNA, 25 bp, Mus musculus
ccttggaccgggcatcacttgggac

SEQ ID NO: 305077 - DNA, 25 bp, Mus musculus
ccgcgccacacgcaggtaagggcag

SEQ ID NO: 305078 - DNA, 25 bp, Mus musculus
gcgcgaggagcccttctttttgtct

SEQ ID NO: 305079 - DNA, 25 bp, Mus musculus
gcgctcagtgtgactccacgaccgg

SEQ ID NO: 305080 - DNA, 25 bp, Mus musculus
gctcgtcccgggtcgcgttcgctgt

SEQ ID NO: 305081 - DNA, 25 bp, Mus musculus
gcctgccacaagtacttccgggtga

SEQ ID NO: 305082 - DNA, 25 bp, Mus musculus
cagtgcgtgtcgagcgtgtctccct

SEQ ID NO: 305083 - DNA, 25 bp, Mus musculus
gaccaggcccggcttgagccagtgc

SEQ ID NO: 305084 - DNA, 25 bp, Mus musculus
agataccaacgctcgggaccaggcc

SEQ ID NO: 305085 - DNA, 25 bp, Mus musculus
ggttacgaaacgctcagataccaac

SEQ ID NO: 305086 - DNA, 25 bp, Mus musculus
cagctgggtgctccagctcccgttg

SEQ ID NO: 305087 - DNA, 25 bp, Mus musculus
catcacttgggacagctgggtgctc

SEQ ID NO: 305088 - DNA, 25 bp, Mus musculus
cgcttttacacgtcagttcctggga

SEQ ID NO: 305089 - DNA, 25 bp, Mus musculus
tcggccgtgtgcataatgggaaacc

SEQ ID NO: 305090 - DNA, 25 bp, Mus musculus
ctctttgatagcattggccggccgc

SEQ ID NO: 305091 - DNA, 25 bp, Mus musculus
gcacgaattctacgagcggtttgta

SEQ ID NO: 305092 - DNA, 25 bp, Mus musculus
catgaatgccagtcaagcgctttta

SEQ ID NO: 305093 - DNA, 25 bp, Mus musculus
cctgggatctctgtcccgctctaaa

SEQ ID NO: 305094 - DNA, 25 bp, Mus musculus
accaggctagaaggcaacgcgcttg

SEQ ID NO: 305095 - DNA, 25 bp, Mus musculus
cgcttgcgcgtcaaagttcacggtc

SEQ ID NO: 305096 - DNA, 25 bp, Mus musculus
gttcacggtccgctcttcctattgg

SEQ ID NO: 305097 - DNA, 25 bp, Mus musculus
tccagccaataggaacggaggtgcc

SEQ ID NO: 305098 - DNA, 25 bp, Mus musculus
tccgcagaatgtggatgacgcccaa

SEQ ID NO: 305099 - DNA, 25 bp, Mus musculus
gcctctactcgggaacgcgacgtga

SEQ ID NO: 305100 - DNA, 25 bp, Mus musculus
cactacgaggccgagcacgaattct

SEQ ID NO: 305101 - DNA, 25 bp, Mus musculus
cgccgaataactcctgctacaaacg

SEQ ID NO: 305102 - DNA, 25 bp, Mus musculus
tctcccgccgcgaggcgatacgtga

SEQ ID NO: 305103 - DNA, 25 bp, Mus musculus
cgcgtgacaggaactcggcaaatga

SEQ ID NO: 305104 - DNA, 25 bp, Mus musculus
ctcaggagagcttcggagccacctc

SEQ ID NO: 305105 - DNA, 25 bp, Mus musculus
ctcgccgcacagcttggctcgaggt

SEQ ID NO: 305106 - DNA, 25 bp, Mus musculus
gggcctcggtgtcacctgcgcgcat

SEQ ID NO: 305107 - DNA, 25 bp, Mus musculus
actcggcaaatgacggaggcgacga

SEQ ID NO: 305108 - DNA, 25 bp, Mus musculus
cgcccgcgtgacaggaactcggcaa

SEQ ID NO: 305109 - DNA, 25 bp, Mus musculus
cgcgaggcgatacgtgacggctctc

SEQ ID NO: 305110 - DNA, 25 bp, Mus musculus
ggagcaaaggcgacaccttcgtctc

SEQ ID NO: 305111 - DNA, 25 bp, Mus musculus
tgcgggacgcgacactctcctcgga

SEQ ID NO: 305112 - DNA, 25 bp, Mus musculus
gagccatggcttccacgaccgcggg

SEQ ID NO: 305113 - DNA, 25 bp, Mus musculus
tcggagcttcgctgcccggtctgct

SEQ ID NO: 305114 - DNA, 25 bp, Mus musculus
acgagcgtcgcgctgctcggagctt

SEQ ID NO: 305115 - DNA, 25 bp, Mus musculus
cgcgggaagcagctttccgcctggc

SEQ ID NO: 305116 - DNA, 25 bp, Mus musculus
ggctcgtgcttgatcgctcagtgcc

SEQ ID NO: 305117 - DNA, 25 bp, Mus musculus
ccggtcagtccgtctccgctgtcct

SEQ ID NO: 305118 - DNA, 25 bp, Mus musculus
cctcgcgggcgccacttggaggaat

SEQ ID NO: 305119 - DNA, 25 bp, Mus musculus
ggcgccacttggaggaatcatcgtg

SEQ ID NO: 305120 - DNA, 25 bp, Mus musculus
aaccgcaggctcgtgcttgatcgct

SEQ ID NO: 305121 - DNA, 25 bp, Mus musculus
ggcggctgctctgtgcccgttgcct

SEQ ID NO: 305122 - DNA, 25 bp, Mus musculus
ttgatcgctcagtgccgccgggtcc

SEQ ID NO: 305123 - DNA, 25 bp, Mus musculus
gcccgcagccacctcactggagatc

SEQ ID NO: 305124 - DNA, 25 bp, Mus musculus
ctcactggagatcgcgcgcctctag

SEQ ID NO: 305125 - DNA, 25 bp, Mus musculus
atcgcgcgcctctagtcgtgactgc

SEQ ID NO: 305126 - DNA, 25 bp, Mus musculus
gcgcccactccgacagtgtgggaga

SEQ ID NO: 305127 - DNA, 25 bp, Mus musculus
ctccgacagtgtgggagatccgcgc

SEQ ID NO: 305128 - DNA, 25 bp, Mus musculus
acttggaggaatcatcgtggccggc

SEQ ID NO: 305129 - DNA, 25 bp, Mus musculus
cgcgctgtaccttggattccaggct

SEQ ID NO: 305130 - DNA, 25 bp, Mus musculus
atcagaggaaactggcgcgctgccc

SEQ ID NO: 305131 - DNA, 25 bp, Mus musculus
cctgaggggacgctcagtgatgccc

SEQ ID NO: 305132 - DNA, 25 bp, Mus musculus
atgccctcccacagggctggctagg

SEQ ID NO: 305133 - DNA, 25 bp, Mus musculus
acagggctggctaggctcccaggca

SEQ ID NO: 305134 - DNA, 25 bp, Mus musculus
agccaaagacgcgtccagccgggcg

SEQ ID NO: 305135 - DNA, 25 bp, Mus musculus
gggcaccaagagcaccgaaagcatt

SEQ ID NO: 305136 - DNA, 25 bp, Mus musculus
aagagcaccgaaagcattgcacatg

SEQ ID NO: 305137 - DNA, 25 bp, Mus musculus
gtgatgcccggtctctgggccacca

SEQ ID NO: 305138 - DNA, 25 bp, Mus musculus
tgggccaccacgcaaagccgaggct

SEQ ID NO: 305139 - DNA, 25 bp, Mus musculus
cacgcaaagccgaggcttgagcgca

SEQ ID NO: 305140 - DNA, 25 bp, Mus musculus
gagcgcagccggcacctgctctgtg

SEQ ID NO: 305141 - DNA, 25 bp, Mus musculus
cctgggctggagacaaagcgcatga

SEQ ID NO: 305142 - DNA, 25 bp, Mus musculus
gcggcagcgcgagcatcattaatca

SEQ ID NO: 305143 - DNA, 25 bp, Mus musculus
aagcgcatgagccacgcgcgcggca

SEQ ID NO: 305144 - DNA, 25 bp, Mus musculus
tgcacccagatgaacgacgccatgg

SEQ ID NO: 305145 - DNA, 25 bp, Mus musculus
gactgggccgccagcgcttcgagct

SEQ ID NO: 305146 - DNA, 25 bp, Mus musculus
tggccaggtccacctccgaggtctt

SEQ ID NO: 305147 - DNA, 25 bp, Mus musculus
agggcgccctcatgcttgtccagcg

SEQ ID NO: 305148 - DNA, 25 bp, Mus musculus
gatggtgccaccaaagcgtcgctca

SEQ ID NO: 305149 - DNA, 25 bp, Mus musculus
agcgcttcgagctggccacttccgg

SEQ ID NO: 305150 - DNA, 25 bp, Mus musculus
atgaacgacgccatggtgagcgccc

SEQ ID NO: 305151 - DNA, 25 bp, Mus musculus
gaggtcttcttcagctgcacccaga

SEQ ID NO: 305152 - DNA, 25 bp, Mus musculus
ggatgaacttcaccagcggcttggc

SEQ ID NO: 305153 - DNA, 25 bp, Mus musculus
gggtacgtctgctggatgaacttca

SEQ ID NO: 305154 - DNA, 25 bp, Mus musculus
tcctcggccgcacggcagtactggg

SEQ ID NO: 305155 - DNA, 25 bp, Mus musculus
agcgccgcagtttgctgagctcctc

SEQ ID NO: 305156 - DNA, 25 bp, Mus musculus
tcatgcttgtccagcgggcgaccga

SEQ ID NO: 305157 - DNA, 25 bp, Mus musculus
ctcggtcacgtgatggtgccaccaa

SEQ ID NO: 305158 - DNA, 25 bp, Mus musculus
ttgctgtgttgcttggcgctttaca

SEQ ID NO: 305159 - DNA, 25 bp, Mus musculus
tttgagtacggcgtgaagttggacc

SEQ ID NO: 305160 - DNA, 25 bp, Mus musculus
cgatggcaacgcctgcgctgagatg

SEQ ID NO: 305161 - DNA, 25 bp, Mus musculus
taacgtttgtctacgcccgatggca

SEQ ID NO: 305162 - DNA, 25 bp, Mus musculus
ttacaaagtggtaacttgcggccca

SEQ ID NO: 305163 - DNA, 25 bp, Mus musculus
cggttcggtgacacgttgctgtgtt

SEQ ID NO: 305164 - DNA, 25 bp, Mus musculus
ctcgagcaactaccgggtgagcggc

SEQ ID NO: 305165 - DNA, 25 bp, Mus musculus
tggctaagaccgtggacgcgctcac

SEQ ID NO: 305166 - DNA, 25 bp, Mus musculus
tacttctgcgcccaagtgctgcaga

SEQ ID NO: 305167 - DNA, 25 bp, Mus musculus
cagcccaaggctcgggccatcagta

SEQ ID NO: 305168 - DNA, 25 bp, Mus musculus
gaggaagaacgcgacccgtgtattc

SEQ ID NO: 305169 - DNA, 25 bp, Mus musculus
tgcggcccaaggctttaagactttg

SEQ ID NO: 305170 - DNA, 25 bp, Mus musculus
cggagatgccggaattcccacactg

SEQ ID NO: 305171 - DNA, 25 bp, Mus musculus
tgtattccggttttaagagacggca

SEQ ID NO: 305172 - DNA, 25 bp, Mus musculus
ctcaccagctcgtggcagtggttct

SEQ ID NO: 305173 - DNA, 25 bp, Mus musculus
ttgttctctcaccttacaaagagtc

SEQ ID NO: 305174 - DNA, 25 bp, Mus musculus
ctaactgagtggatggaggaaatga

SEQ ID NO: 305175 - DNA, 25 bp, Mus musculus
gagcttcgtcctctaactgagtgga

SEQ ID NO: 305176 - DNA, 25 bp, Mus musculus
tggcagtggttctgaatgtgtttca

SEQ ID NO: 305177 - DNA, 25 bp, Mus musculus
ggccagatgccagccactttgggta

SEQ ID NO: 305178 - DNA, 25 bp, Mus musculus
caggactgcaggttgaggctcacca

SEQ ID NO: 305179 - DNA, 25 bp, Mus musculus
tccatacttactgagcaggactgca

SEQ ID NO: 305180 - DNA, 25 bp, Mus musculus
ccataaggatagaggatgtggagtc

SEQ ID NO: 305181 - DNA, 25 bp, Mus musculus
cctggcaacgggctgactgagcaca

SEQ ID NO: 305182 - DNA, 25 bp, Mus musculus
cactttgggtatatgcagcctggca

SEQ ID NO: 305183 - DNA, 25 bp, Mus musculus
agagtcacaactcccataaggatag

SEQ ID NO: 305184 - DNA, 25 bp, Mus musculus
gaatgtgtttcagagcttcgtcctc

SEQ ID NO: 305185 - DNA, 25 bp, Mus musculus
tcagggcaaggctatgtggccagat

SEQ ID NO: 305186 - DNA, 25 bp, Mus musculus
ggacacctgcgtccttcctctccgg

SEQ ID NO: 305187 - DNA, 25 bp, Mus musculus
tggcagctctcggttcatctgggac

SEQ ID NO: 305188 - DNA, 25 bp, Mus musculus
gtggcttgctcgctagccaagccca

SEQ ID NO: 305189 - DNA, 25 bp, Mus musculus
aagcccaccgtatccgggtgctctg

SEQ ID NO: 305190 - DNA, 25 bp, Mus musculus
gtatccgggtgctctgggccaccaa

SEQ ID NO: 305191 - DNA, 25 bp, Mus musculus
ctctgggccaccaagatggcgctgg

SEQ ID NO: 305192 - DNA, 25 bp, Mus musculus
ccgggagcccggctctgagtataga

SEQ ID NO: 305193 - DNA, 25 bp, Mus musculus
gcccggctctgagtatagagtaaca

SEQ ID NO: 305194 - DNA, 25 bp, Mus musculus
atagagtaacactgtgctggccgcg

SEQ ID NO: 305195 - DNA, 25 bp, Mus musculus
ggctgctcccgagcgttcgcagttc

SEQ ID NO: 305196 - DNA, 25 bp, Mus musculus
tctccggcgggtccatgaactccgt

SEQ ID NO: 305197 - DNA, 25 bp, Mus musculus
cgtatcccggatcctagcaacctgg

SEQ ID NO: 305198 - DNA, 25 bp, Mus musculus
tccatgaactccgtgtcgccggctg

SEQ ID NO: 305199 - DNA, 25 bp, Mus musculus
atcctagcaacctgggaccttcggg

SEQ ID NO: 305200 - DNA, 25 bp, Mus musculus
cctctcttcccgagctgggtgagct

SEQ ID NO: 305201 - DNA, 25 bp, Mus musculus
tgagctggactgcaacatctgtttc

SEQ ID NO: 305202 - DNA, 25 bp, Mus musculus
tcactattaaaaggggacagaggcg

SEQ ID NO: 305203 - DNA, 25 bp, Mus musculus
cacagcttgcctgcgcgagctggca

SEQ ID NO: 305204 - DNA, 25 bp, Mus musculus
cgtcacggagatcgcgctagaccct

SEQ ID NO: 305205 - DNA, 25 bp, Mus musculus
ctagaccctgtcttgtggtcacggc

SEQ ID NO: 305206 - DNA, 25 bp, Mus musculus
tggtcacggctggaggaaaaagccc

SEQ ID NO: 305207 - DNA, 25 bp, Mus musculus
tcgccgaattttggacagggtcctg

SEQ ID NO: 305208 - DNA, 25 bp, Mus musculus
cagctcttgatgagagtgccctctc

SEQ ID NO: 305209 - DNA, 25 bp, Mus musculus
ccacggtgaccacgatgcagctctt

SEQ ID NO: 305210 - DNA, 25 bp, Mus musculus
agccgcctagagatcgaagccctcg

SEQ ID NO: 305211 - DNA, 25 bp, Mus musculus
tcgttctgtatcctagccgcctaga

SEQ ID NO: 305212 - DNA, 25 bp, Mus musculus
ccaaggagggctcattcgttctgta

SEQ ID NO: 305213 - DNA, 25 bp, Mus musculus
tgcggccacacgctgtgcacagctt

SEQ ID NO: 305214 - DNA, 25 bp, Mus musculus
cctgcgactgccacgtgatccgtag

SEQ ID NO: 305215 - DNA, 25 bp, Mus musculus
ctcggagaccgctattggcctgcga

SEQ ID NO: 305216 - DNA, 25 bp, Mus musculus
cctcaaggtgggctcggagaccgct

SEQ ID NO: 305217 - DNA, 25 bp, Mus musculus
ttgtcctggtgacgccagcccgacg

SEQ ID NO: 305218 - DNA, 25 bp, Mus musculus
acgcccgttgtcctggtgacgccag

SEQ ID NO: 305219 - DNA, 25 bp, Mus musculus
ccggcgacgcccgttgtcctggtga

SEQ ID NO: 305220 - DNA, 25 bp, Mus musculus
gcctgaagtcacacggcgccggcga

SEQ ID NO: 305221 - DNA, 25 bp, Mus musculus
acagcctgaagtcacacggcgccgg

SEQ ID NO: 305222 - DNA, 25 bp, Mus musculus
cgcgagcgcgcccacagcctgaagt

SEQ ID NO: 305223 - DNA, 25 bp, Mus musculus
ctattggcctgcgactgccacgtga

SEQ ID NO: 305224 - DNA, 25 bp, Mus musculus
gtgatccgtaggcacgcccttcggc

SEQ ID NO: 305225 - DNA, 25 bp, Mus musculus
acgtgatccgtaggcacgcccttcg

SEQ ID NO: 305226 - DNA, 25 bp, Mus musculus
gcgactgccacgtgatccgtaggca

SEQ ID NO: 305227 - DNA, 25 bp, Mus musculus
ggagaccgctattggcctgcgactg

SEQ ID NO: 305228 - DNA, 25 bp, Mus musculus
ccaatcgggccggagatgttgcctg

SEQ ID NO: 305229 - DNA, 25 bp, Mus musculus
cgttcgtttaaagaagcttctgtct

SEQ ID NO: 305230 - DNA, 25 bp, Mus musculus
gttgcctgggactggccaccctgag

SEQ ID NO: 305231 - DNA, 25 bp, Mus musculus
tccggctgcgactcccgtagcatcc

SEQ ID NO: 305232 - DNA, 25 bp, Mus musculus
cgccgagggtgagtgtccgcagccc

SEQ ID NO: 305233 - DNA, 25 bp, Mus musculus
gagatgttgcctgggactggccacc

SEQ ID NO: 305234 - DNA, 25 bp, Mus musculus
agaagcttctgtctataagcctgcg

SEQ ID NO: 305235 - DNA, 25 bp, Mus musculus
ttctgtctataagcctgcgcccagc

SEQ ID NO: 305236 - DNA, 25 bp, Mus musculus
ctgcgcccagccaaccctgcgtgac

SEQ ID NO: 305237 - DNA, 25 bp, Mus musculus
caaccctgcgtgacgacggtcctcc

SEQ ID NO: 305238 - DNA, 25 bp, Mus musculus
cccttttggcaccacagctcccagg

SEQ ID NO: 305239 - DNA, 25 bp, Mus musculus
agccgcctgggtggcgccaccgaga

SEQ ID NO: 305240 - DNA, 25 bp, Mus musculus
gagttcgcaggtcccagcgctccgg

SEQ ID NO: 305241 - DNA, 25 bp, Mus musculus
agtccgcggacgccttcaccatgag

SEQ ID NO: 305242 - DNA, 25 bp, Mus musculus
agacccacagcttttccacgcggtg

SEQ ID NO: 305243 - DNA, 25 bp, Mus musculus
agagcggctgccacccgggttagac

SEQ ID NO: 305244 - DNA, 25 bp, Mus musculus
cccagagtgcacgaaggataaacgc

SEQ ID NO: 305245 - DNA, 25 bp, Mus musculus
caccggtgtagttctgtcctccaag

SEQ ID NO: 305246 - DNA, 25 bp, Mus musculus
ctccaaggtcccttcggcagagcgg

SEQ ID NO: 305247 - DNA, 25 bp, Mus musculus
tgaggtcaaggccactccaggccgc

SEQ ID NO: 305248 - DNA, 25 bp, Mus musculus
gcaggtggtacaacgcctccaactg

SEQ ID NO: 305249 - DNA, 25 bp, Mus musculus
tcccactccacgtagggctaagctg

SEQ ID NO: 305250 - DNA, 25 bp, Mus musculus
tagggctaagctgcctgccagactc

SEQ ID NO: 305251 - DNA, 25 bp, Mus musculus
cgcagcaacggacaggaacgcggca

SEQ ID NO: 305252 - DNA, 25 bp, Mus musculus
gccaaccgtctcgaagcaggtggta

SEQ ID NO: 305253 - DNA, 25 bp, Mus musculus
tttccacgcggtgcttcaggaacgg

SEQ ID NO: 305254 - DNA, 25 bp, Mus musculus
tgcctgccagactcggaagaaaccg

SEQ ID NO: 305255 - DNA, 25 bp, Mus musculus
cctttgaattttgacgccactccca

SEQ ID NO: 305256 - DNA, 25 bp, Mus musculus
ctcgtagaaggccttgaggaagtcg

SEQ ID NO: 305257 - DNA, 25 bp, Mus musculus
gccaggcactcgtagaaggccttga

SEQ ID NO: 305258 - DNA, 25 bp, Mus musculus
aagcgcgagctccatgtcggaaatg

SEQ ID NO: 305259 - DNA, 25 bp, Mus musculus
tccatgtcggaaatggacgttctcc

SEQ ID NO: 305260 - DNA, 25 bp, Mus musculus
gaaatggacgttctccagttctccc

SEQ ID NO: 305261 - DNA, 25 bp, Mus musculus
accgcacggacaaacaggctctgca

SEQ ID NO: 305262 - DNA, 25 bp, Mus musculus
ctctgcagagcaagaagatgcggtg

SEQ ID NO: 305263 - DNA, 25 bp, Mus musculus
agagcaagaagatgcggtgacgccc

SEQ ID NO: 305264 - DNA, 25 bp, Mus musculus
cctggcaaacccgagacatacttgt

SEQ ID NO: 305265 - DNA, 25 bp, Mus musculus
aaaagaagcgcgactctgcccaggc

SEQ ID NO: 305266 - DNA, 25 bp, Mus musculus
ttcctcgctcctggatgacccttaa

SEQ ID NO: 305267 - DNA, 25 bp, Mus musculus
tggatgacccttaactagccgcaaa

SEQ ID NO: 305268 - DNA, 25 bp, Mus musculus
tagccgcaaaccaagcgcggctgcg

SEQ ID NO: 305269 - DNA, 25 bp, Mus musculus
cgcaggcagccaggcactcgtagaa

SEQ ID NO: 305270 - DNA, 25 bp, Mus musculus
agtgctcgccgctgtactggtcgag

SEQ ID NO: 305271 - DNA, 25 bp, Mus musculus
acctgggctcgacagagagcggctc

SEQ ID NO: 305272 - DNA, 25 bp, Mus musculus
ggcgagtgcccttaccttgaagtag

SEQ ID NO: 305273 - DNA, 25 bp, Mus musculus
ccttaccttgaagtaggcgaactgc

SEQ ID NO: 305274 - DNA, 25 bp, Mus musculus
ggcgaactgcagaaacttgtagggc

SEQ ID NO: 305275 - DNA, 25 bp, Mus musculus
gctcgcgctgctgaaagtccgccag

SEQ ID NO: 305276 - DNA, 25 bp, Mus musculus
tgaaagtccgccagcactgagcggc

SEQ ID NO: 305277 - DNA, 25 bp, Mus musculus
caggccctgcttgcagcgcttgagg

SEQ ID NO: 305278 - DNA, 25 bp, Mus musculus
ttgcagcgcttgaggcactgcgcgc

SEQ ID NO: 305279 - DNA, 25 bp, Mus musculus
gcagacggtgcagccgcaggctcac

SEQ ID NO: 305280 - DNA, 25 bp, Mus musculus
aggccgactcgagcggcatcagctc

SEQ ID NO: 305281 - DNA, 25 bp, Mus musculus
ctgcggaagctgtagcgctcgtact

SEQ ID NO: 305282 - DNA, 25 bp, Mus musculus
aagctgtagcgctcgtactgcccgc

SEQ ID NO: 305283 - DNA, 25 bp, Mus musculus
gcacgctgccgaagaggcgtagttc

SEQ ID NO: 305284 - DNA, 25 bp, Mus musculus
agagcgcccactgcctaacggagag

SEQ ID NO: 305285 - DNA, 25 bp, Mus musculus
gatccttgcggagttcgggcttcat

SEQ ID NO: 305286 - DNA, 25 bp, Mus musculus
tttccagcttcggtttctggggaga

SEQ ID NO: 305287 - DNA, 25 bp, Mus musculus
aggtgcgcctgagtctttccagctt

SEQ ID NO: 305288 - DNA, 25 bp, Mus musculus
acctgcttcccggtttgtgcagcgc

SEQ ID NO: 305289 - DNA, 25 bp, Mus musculus
ggtcccgtgtgcacggacctgcttc

SEQ ID NO: 305290 - DNA, 25 bp, Mus musculus
ccatcgtggcgcgatcatgctccgg

SEQ ID NO: 305291 - DNA, 25 bp, Mus musculus
agttcgggcttcatggaacgctccg

SEQ ID NO: 305292 - DNA, 25 bp, Mus musculus
tcgggatccgggttaccctcgatca

SEQ ID NO: 305293 - DNA, 25 bp, Mus musculus
cgcggctctgcaaagtcgggatccg

SEQ ID NO: 305294 - DNA, 25 bp, Mus musculus
tctatgtaagtctccggtgccaccg

SEQ ID NO: 305295 - DNA, 25 bp, Mus musculus
cgctgcgcacggcatctatgtaagt

SEQ ID NO: 305296 - DNA, 25 bp, Mus musculus
cgatcacccgctcagagcaggcagg

SEQ ID NO: 305297 - DNA, 25 bp, Mus musculus
ggtcctggcatagggtcctcaacaa

SEQ ID NO: 305298 - DNA, 25 bp, Mus musculus
gcgcactcacctcatcgtcgtggtg

SEQ ID NO: 305299 - DNA, 25 bp, Mus musculus
catcgtcgtggtgctggcagaagcc

SEQ ID NO: 305300 - DNA, 25 bp, Mus musculus
gaagccgaggcgctccgggaacacc

SEQ ID NO: 305301 - DNA, 25 bp, Mus musculus
gcgctccgggaacaccgagagaatg

SEQ ID NO: 305302 - DNA, 25 bp, Mus musculus
ccgggaacaccgagagaatggagaa

SEQ ID NO: 305303 - DNA, 25 bp, Mus musculus
ccgcgctcgatgtaatggtccttgg

SEQ ID NO: 305304 - DNA, 25 bp, Mus musculus
tcgatgtaatggtccttggtgaggc

SEQ ID NO: 305305 - DNA, 25 bp, Mus musculus
tgcgcgcggacacagttgtcgcaca

SEQ ID NO: 305306 - DNA, 25 bp, Mus musculus
cgttgccctcgtcgcaggagctgca

SEQ ID NO: 305307 - DNA, 25 bp, Mus musculus
cacaggtgttcctggcagtcgaggc

SEQ ID NO: 305308 - DNA, 25 bp, Mus musculus
ttcctggcagtcgaggcagcgcgac

SEQ ID NO: 305309 - DNA, 25 bp, Mus musculus
acctcatcgtcgtggtgctggcaga

SEQ ID NO: 305310 - DNA, 25 bp, Mus musculus
ctcgtcgcaggagctgcagccgtgc

SEQ ID NO: 305311 - DNA, 25 bp, Mus musculus
cacagttgtcgcacaggtgttcctg

SEQ ID NO: 305312 - DNA, 25 bp, Mus musculus
cagatctggaagtcggtctccggga

SEQ ID NO: 305313 - DNA, 25 bp, Mus musculus
gccgtcgtgcaatgctaccgcgttc

SEQ ID NO: 305314 - DNA, 25 bp, Mus musculus
tcaaagtccgccgtggaatccggtc

SEQ ID NO: 305315 - DNA, 25 bp, Mus musculus
tgccctccggctaaatgaattgagc

SEQ ID NO: 305316 - DNA, 25 bp, Mus musculus
ttggtcccaacgagtcttgcttgtg

SEQ ID NO: 305317 - DNA, 25 bp, Mus musculus
aagatattggatgtacgggccgccc

SEQ ID NO: 305318 - DNA, 25 bp, Mus musculus
cgcggcgcaaaccaatttggtccca

SEQ ID NO: 305319 - DNA, 25 bp, Mus musculus
cccgcggaagcacgcgtgccaagta

SEQ ID NO: 305320 - DNA, 25 bp, Mus musculus
cgagcgcccgcacaagtctcaaagt

SEQ ID NO: 305321 - DNA, 25 bp, Mus musculus
gggtttgcactgctactcctcagca

SEQ ID NO: 305322 - DNA, 25 bp, Mus musculus
gtctccgggaacgaagccatttgca

SEQ ID NO: 305323 - DNA, 25 bp, Mus musculus
ctccttgcacagcaggcagatctgg

SEQ ID NO: 305324 - DNA, 25 bp, Mus musculus
gcgggccgccctgaattattcatgg

SEQ ID NO: 305325 - DNA, 25 bp, Mus musculus
ctcactcagcagagcgcatcgagga

SEQ ID NO: 305326 - DNA, 25 bp, Mus musculus
ggaagcgcgtccttctgcaaacccg

SEQ ID NO: 305327 - DNA, 25 bp, Mus musculus
tcacctgcaggcttgtctgcagcca

SEQ ID NO: 305328 - DNA, 25 bp, Mus musculus
agcggccaagggagacgctacttcc

SEQ ID NO: 305329 - DNA, 25 bp, Mus musculus
agcttccgtcccgtagcggccaagg

SEQ ID NO: 305330 - DNA, 25 bp, Mus musculus
acatccgccggtgcagggctgtttt

SEQ ID NO: 305331 - DNA, 25 bp, Mus musculus
tcgtctagcaacagcgccaacacat

SEQ ID NO: 305332 - DNA, 25 bp, Mus musculus
gctcgtcgtctagcaacagcgccaa

SEQ ID NO: 305333 - DNA, 25 bp, Mus musculus
cgaagttactgctcgtcgtctagca

SEQ ID NO: 305334 - DNA, 25 bp, Mus musculus
gctgaggaagtgacgaagttactgc

SEQ ID NO: 305335 - DNA, 25 bp, Mus musculus
agtcgcctcggctaaggtcctgggc

SEQ ID NO: 305336 - DNA, 25 bp, Mus musculus
gggacaactcttcagctcaagcccg

SEQ ID NO: 305337 - DNA, 25 bp, Mus musculus
ttcctccctgtaggtggcgtggccc

SEQ ID NO: 305338 - DNA, 25 bp, Mus musculus
gcaggcttgtctgcagccatcttcc

SEQ ID NO: 305339 - DNA, 25 bp, Mus musculus
tcggctcgagttcctccctgtaggt

SEQ ID NO: 305340 - DNA, 25 bp, Mus musculus
ttcgcttactgacatgcccggcacg

SEQ ID NO: 305341 - DNA, 25 bp, Mus musculus
ctgctgctgggtaagtgatatccga

SEQ ID NO: 305342 - DNA, 25 bp, Mus musculus
tcagcttggagacacagggaaaacc

SEQ ID NO: 305343 - DNA, 25 bp, Mus musculus
caagcagagaatcaggccgcgcatg

SEQ ID NO: 305344 - DNA, 25 bp, Mus musculus
gagcgtccatatccgggttccgtcc

SEQ ID NO: 305345 - DNA, 25 bp, Mus musculus
gcttcgttcttccagccctgtcagg

SEQ ID NO: 305346 - DNA, 25 bp, Mus musculus
ccctgtcaggagtggtgtgattccc

SEQ ID NO: 305347 - DNA, 25 bp, Mus musculus
ggtgtgattcccgaccaagatggcg

SEQ ID NO: 305348 - DNA, 25 bp, Mus musculus
gttcggttcatctccacccgggcta

SEQ ID NO: 305349 - DNA, 25 bp, Mus musculus
tagcctgcgccttgctccctgttag

SEQ ID NO: 305350 - DNA, 25 bp, Mus musculus
gctcccgaccgggaagaacgtgctg

SEQ ID NO: 305351 - DNA, 25 bp, Mus musculus
ttcgcccactgcctttgtgcggaca

SEQ ID NO: 305352 - DNA, 25 bp, Mus musculus
agcattaccacagtccaagcagaga

SEQ ID NO: 305353 - DNA, 25 bp, Mus musculus
taggtcctgcatcctcagcgaggtc

SEQ ID NO: 305354 - DNA, 25 bp, Mus musculus
cggctaggcactcggcctcggcaaa

SEQ ID NO: 305355 - DNA, 25 bp, Mus musculus
gacttacgcagcgttgtgggccctc

SEQ ID NO: 305356 - DNA, 25 bp, Mus musculus
taggcactcggcctcggcaaagcgg

SEQ ID NO: 305357 - DNA, 25 bp, Mus musculus
tgcgccggctcctgtgacaggttca

SEQ ID NO: 305358 - DNA, 25 bp, Mus musculus
cctgtgacaggttcaggtaggccgc

SEQ ID NO: 305359 - DNA, 25 bp, Mus musculus
acaggttcaggtaggccgcccgccg

SEQ ID NO: 305360 - DNA, 25 bp, Mus musculus
tgctggtggctctcggctaggcact

SEQ ID NO: 305361 - DNA, 25 bp, Mus musculus
ccagcgactccttggagaggtgctg

SEQ ID NO: 305362 - DNA, 25 bp, Mus musculus
ttccctgccagcgactccttggaga

SEQ ID NO: 305363 - DNA, 25 bp, Mus musculus
gcgttggctggcttgttccctgcca

SEQ ID NO: 305364 - DNA, 25 bp, Mus musculus
gacagcgttggctggcttgttccct

SEQ ID NO: 305365 - DNA, 25 bp, Mus musculus
ttacccttgtgcaggacagcgttgg

SEQ ID NO: 305366 - DNA, 25 bp, Mus musculus
gcggcccttacccttgtgcaggaca

SEQ ID NO: 305367 - DNA, 25 bp, Mus musculus
gccgcagctgctcctcgatcaccag

SEQ ID NO: 305368 - DNA, 25 bp, Mus musculus
gcggaagctcaccacatgctcatcg

SEQ ID NO: 305369 - DNA, 25 bp, Mus musculus
tcggaactggagtcgccaccgacgt

SEQ ID NO: 305370 - DNA, 25 bp, Mus musculus
accgacgtccggatctccatagcga

SEQ ID NO: 305371 - DNA, 25 bp, Mus musculus
catagcgatctttcactgtggaata

SEQ ID NO: 305372 - DNA, 25 bp, Mus musculus
acggggttcctcatagctaccatca

SEQ ID NO: 305373 - DNA, 25 bp, Mus musculus
ctgaagttcctcacgctcgcggtaa

SEQ ID NO: 305374 - DNA, 25 bp, Mus musculus
gtaacggctgtagcgcgcagcaaac

SEQ ID NO: 305375 - DNA, 25 bp, Mus musculus
gcagcaaacgctgcgttcaccttta

SEQ ID NO: 305376 - DNA, 25 bp, Mus musculus
ttcacctttaggcacccagaggcgc

SEQ ID NO: 305377 - DNA, 25 bp, Mus musculus
gggcttttcttaaggagcatgtcca

SEQ ID NO: 305378 - DNA, 25 bp, Mus musculus
gcatgtccactgcagacgcagtttg

SEQ ID NO: 305379 - DNA, 25 bp, Mus musculus
gatcccgtaggccttttgctcagca

SEQ ID NO: 305380 - DNA, 25 bp, Mus musculus
actcagttaccctgacgccctggga

SEQ ID NO: 305381 - DNA, 25 bp, Mus musculus
tgctcatcgctggagtcagactcgg

SEQ ID NO: 305382 - DNA, 25 bp, Mus musculus
taccgctcggccgagagtttagctg

SEQ ID NO: 305383 - DNA, 25 bp, Mus musculus
ggcgcatcctcaaaggcttgcagct

SEQ ID NO: 305384 - DNA, 25 bp, Mus musculus
ggcatcggcgcatcctcaaaggctt

SEQ ID NO: 305385 - DNA, 25 bp, Mus musculus
gcaggctcccttggcatcggcgcat

SEQ ID NO: 305386 - DNA, 25 bp, Mus musculus
gtcctgggcaggctcccttggcatc

SEQ ID NO: 305387 - DNA, 25 bp, Mus musculus
cgttcgggaagcagccgtttccaca

SEQ ID NO: 305388 - DNA, 25 bp, Mus musculus
tggccgcctacttcgtcctgggcag

SEQ ID NO: 305389 - DNA, 25 bp, Mus musculus
gaaggaggcgttgccgtccaccgcc

SEQ ID NO: 305390 - DNA, 25 bp, Mus musculus
ctcctcgttcgggaagcagccgttt

SEQ ID NO: 305391 - DNA, 25 bp, Mus musculus
gagtcccaggaagtgacgcccccta

SEQ ID NO: 305392 - DNA, 25 bp, Mus musculus
gtctacagtcccaccaccgaggcgg

SEQ ID NO: 305393 - DNA, 25 bp, Mus musculus
aacggagcggtctacagtcccacca

SEQ ID NO: 305394 - DNA, 25 bp, Mus musculus
atggagaacggagcggtctacagtc

SEQ ID NO: 305395 - DNA, 25 bp, Mus musculus
tggatgcctcgaggctgccgctcgc

SEQ ID NO: 305396 - DNA, 25 bp, Mus musculus
gtggagtttctgcaactaggaagta

SEQ ID NO: 305397 - DNA, 25 bp, Mus musculus
agaggctgctgcaggcatgcacaac

SEQ ID NO: 305398 - DNA, 25 bp, Mus musculus
cgcgctgcacgagtgggcgcaagtc

SEQ ID NO: 305399 - DNA, 25 bp, Mus musculus
caagtcggtggcctccacctaaggg

SEQ ID NO: 305400 - DNA, 25 bp, Mus musculus
cacctaagggtggagtttctgcaac

SEQ ID NO: 305401 - DNA, 25 bp, Mus musculus
tgcaactaggaagtagagcgcggtt

SEQ ID NO: 305402 - DNA, 25 bp, Mus musculus
tttctgcaactaggaagtagagcgc

SEQ ID NO: 305403 - DNA, 25 bp, Mus musculus
aggcatgcacaactgcggcagggga

SEQ ID NO: 305404 - DNA, 25 bp, Mus musculus
aggcttccgcctggcgaggccgcag

SEQ ID NO: 305405 - DNA, 25 bp, Mus musculus
gccgcagaggaaacagctggcagcc

SEQ ID NO: 305406 - DNA, 25 bp, Mus musculus
agccctgcgggcctcagcaggactt

SEQ ID NO: 305407 - DNA, 25 bp, Mus musculus
gctttaccgccaggacacgcgcggg

SEQ ID NO: 305408 - DNA, 25 bp, Mus musculus
acacgcgcggggtcacttgccagtg

SEQ ID NO: 305409 - DNA, 25 bp, Mus musculus
cagaggaaacagctggcagccctgc

SEQ ID NO: 305410 - DNA, 25 bp, Mus musculus
cctgccctctagacacgcggaagtt

SEQ ID NO: 305411 - DNA, 25 bp, Mus musculus
cgcggtgctcccaaggtccgggcca

SEQ ID NO: 305412 - DNA, 25 bp, Mus musculus
tcttcttaccatctgcgccactttg

SEQ ID NO: 305413 - DNA, 25 bp, Mus musculus
taccatctgcgccactttgaacagg

SEQ ID NO: 305414 - DNA, 25 bp, Mus musculus
ccactttgaacagggcgccgtgggt

SEQ ID NO: 305415 - DNA, 25 bp, Mus musculus
gtgagcgggtacacccggtccagca

SEQ ID NO: 305416 - DNA, 25 bp, Mus musculus
ccggtccagcagtccctccgagggc

SEQ ID NO: 305417 - DNA, 25 bp, Mus musculus
ccgctgctgcacgtggtccggacga

SEQ ID NO: 305418 - DNA, 25 bp, Mus musculus
gccctctagacacgcggaagttgga

SEQ ID NO: 305419 - DNA, 25 bp, Mus musculus
cacggctccctcttcccagctgcgg

SEQ ID NO: 305420 - DNA, 25 bp, Mus musculus
gacctctggccggtgaagctgggac

SEQ ID NO: 305421 - DNA, 25 bp, Mus musculus
gatccatgagacatcgcgcgaccca

SEQ ID NO: 305422 - DNA, 25 bp, Mus musculus
ctagacacgcggaagttggactggc

SEQ ID NO: 305423 - DNA, 25 bp, Mus musculus
ggccctggcctctcccaggagcgca

SEQ ID NO: 305424 - DNA, 25 bp, Mus musculus
cgcgctgctgctcttccatcgtcgc

SEQ ID NO: 305425 - DNA, 25 bp, Mus musculus
gcactctgggtctgctcggagaccc

SEQ ID NO: 305426 - DNA, 25 bp, Mus musculus
aacacctcggcgagcgcactctggg

SEQ ID NO: 305427 - DNA, 25 bp, Mus musculus
aagtgtcccaacacctcggcgagcg

SEQ ID NO: 305428 - DNA, 25 bp, Mus musculus
gggtcaggtccgcaagtgtcccaac

SEQ ID NO: 305429 - DNA, 25 bp, Mus musculus
ggcgggcaaacccgggtgatctcca

SEQ ID NO: 305430 - DNA, 25 bp, Mus musculus
aatgagttccctgggctcaggatcg

SEQ ID NO: 305431 - DNA, 25 bp, Mus musculus
tggtggagaagttctccgcaaagga

SEQ ID NO: 305432 - DNA, 25 bp, Mus musculus
tctcggtcgtaagcgaagctgctgc

SEQ ID NO: 305433 - DNA, 25 bp, Mus musculus
tacggaggaactctcggtcgtaagc

SEQ ID NO: 305434 - DNA, 25 bp, Mus musculus
cgatctcggctacgatcaggagccc

SEQ ID NO: 305435 - DNA, 25 bp, Mus musculus
aggcgcgcgagctagccgagtccac

SEQ ID NO: 305436 - DNA, 25 bp, Mus musculus
tccctgggctcaggatcgcgggcca

SEQ ID NO: 305437 - DNA, 25 bp, Mus musculus
ggcccgacacttacgatctcggcta

SEQ ID NO: 305438 - DNA, 25 bp, Mus musculus
gccctaaccgcagggttaccagtgc

SEQ ID NO: 305439 - DNA, 25 bp, Mus musculus
tgcacactttcagaggcgccgctgc

SEQ ID NO: 305440 - DNA, 25 bp, Mus musculus
agggccaagccggatcgctgctgca

SEQ ID NO: 305441 - DNA, 25 bp, Mus musculus
ctagggccacagctgacagcccgga

SEQ ID NO: 305442 - DNA, 25 bp, Mus musculus
acggcctagtataggcgctccgggc

SEQ ID NO: 305443 - DNA, 25 bp, Mus musculus
tcggatcgctgctgcaagtcggatc

SEQ ID NO: 305444 - DNA, 25 bp, Mus musculus
tcggatcgctgcaacacacactgtg

SEQ ID NO: 305445 - DNA, 25 bp, Mus musculus
atggccaagccggatcgctgctgca

SEQ ID NO: 305446 - DNA, 25 bp, Mus musculus
ttaccagtgcgcaaacaggtgcccg

SEQ ID NO: 305447 - DNA, 25 bp, Mus musculus
ggcctctgtccgtgcagtgtccaac

SEQ ID NO: 305448 - DNA, 25 bp, Mus musculus
tgtccaaccgggacaggcggtcgca

SEQ ID NO: 305449 - DNA, 25 bp, Mus musculus
ctgaagcagcgggagagcaaccctg

SEQ ID NO: 305450 - DNA, 25 bp, Mus musculus
cgagcccacgatgcacactttcaga

SEQ ID NO: 305451 - DNA, 25 bp, Mus musculus
tcacctccacaggaacggcctagta

SEQ ID NO: 305452 - DNA, 25 bp, Mus musculus
ctggcaaagcaggtaaggagtccgc

SEQ ID NO: 305453 - DNA, 25 bp, Mus musculus
aaagcaggtaaggagtccgccgctc

SEQ ID NO: 305454 - DNA, 25 bp, Mus musculus
ggcgtgctcagcaaatacaccaacc

SEQ ID NO: 305455 - DNA, 25 bp, Mus musculus
ctcgagggcgtgctcagcaaataca

SEQ ID NO: 305456 - DNA, 25 bp, Mus musculus
ttcccggggaatcagagcagccacg

SEQ ID NO: 305457 - DNA, 25 bp, Mus musculus
gtatgagtcaggcatttcccgggga

SEQ ID NO: 305458 - DNA, 25 bp, Mus musculus
tcttcttcctcctgtatgagtcagg

SEQ ID NO: 305459 - DNA, 25 bp, Mus musculus
cgaacttgcccgagaagtggctgga

SEQ ID NO: 305460 - DNA, 25 bp, Mus musculus
ggagcatccttagcccgggctccga

SEQ ID NO: 305461 - DNA, 25 bp, Mus musculus
tcaggatccaagtgagggggcaaca

SEQ ID NO: 305462 - DNA, 25 bp, Mus musculus
ccgacacaccgagagggagcgtgct

SEQ ID NO: 305463 - DNA, 25 bp, Mus musculus
ccgatgtagggcgtgcccactctgt

SEQ ID NO: 305464 - DNA, 25 bp, Mus musculus
gggactgcctggacacctcgtcctt

SEQ ID NO: 305465 - DNA, 25 bp, Mus musculus
tccgagcgactgcaaggttcgagga

SEQ ID NO: 305466 - DNA, 25 bp, Mus musculus
attgtcagttgaaagacgcggtttc

SEQ ID NO: 305467 - DNA, 25 bp, Mus musculus
gatccgaagtctccgcctcaacagt

SEQ ID NO: 305468 - DNA, 25 bp, Mus musculus
ggctcggagcggcaatgacattccc

SEQ ID NO: 305469 - DNA, 25 bp, Mus musculus
gcggagctcaggcaacctttgactc

SEQ ID NO: 305470 - DNA, 25 bp, Mus musculus
ctgtcacagagcgacaggtccgtta

SEQ ID NO: 305471 - DNA, 25 bp, Mus musculus
cggccgtggctacgatttcattgtc

SEQ ID NO: 305472 - DNA, 25 bp, Mus musculus
acttgtgcttgctctccggggccga

SEQ ID NO: 305473 - DNA, 25 bp, Mus musculus
acgagttgagggacgacttgtgctt

SEQ ID NO: 305474 - DNA, 25 bp, Mus musculus
ccatgaggccgctccacggggacga

SEQ ID NO: 305475 - DNA, 25 bp, Mus musculus
gacgcgctctgggttccgggcccat

SEQ ID NO: 305476 - DNA, 25 bp, Mus musculus
aggagagcaacgactgccacccggc

SEQ ID NO: 305477 - DNA, 25 bp, Mus musculus
tgatgctctcgaagcggatgacggc

SEQ ID NO: 305478 - DNA, 25 bp, Mus musculus
ggtcgaactcgtggatgatgctctc

SEQ ID NO: 305479 - DNA, 25 bp, Mus musculus
gggcttcggctgaatggccctccac

SEQ ID NO: 305480 - DNA, 25 bp, Mus musculus
agtggactgtcctgctcttttgcga

SEQ ID NO: 305481 - DNA, 25 bp, Mus musculus
acctggcctttcgtgcgcgcacaaa

SEQ ID NO: 305482 - DNA, 25 bp, Mus musculus
aacagctgggcaggacctctcgccg

SEQ ID NO: 305483 - DNA, 25 bp, Mus musculus
gggcctgaaccgactcgggccgcta

SEQ ID NO: 305484 - DNA, 25 bp, Mus musculus
ggccgactgtcaatcgctgccctgg

SEQ ID NO: 305485 - DNA, 25 bp, Mus musculus
actcactcacccgacttgggaacgt

SEQ ID NO: 305486 - DNA, 25 bp, Mus musculus
ggcgatgcgcgtccacaggacgata

SEQ ID NO: 305487 - DNA, 25 bp, Mus musculus
ggtgcgcgcgagtgactcactcatc

SEQ ID NO: 305488 - DNA, 25 bp, Mus musculus
cacaggacgatatgcagcggccaca

SEQ ID NO: 305489 - DNA, 25 bp, Mus musculus
gccctctcaggatgcgggccagatg

SEQ ID NO: 305490 - DNA, 25 bp, Mus musculus
tcatcaactttacccgggcgccgag

SEQ ID NO: 305491 - DNA, 25 bp, Mus musculus
cgagagggaaacaggaaactcctcg

SEQ ID NO: 305492 - DNA, 25 bp, Mus musculus
gaaactcctcgccaacagctgggca

SEQ ID NO: 305493 - DNA, 25 bp, Mus musculus
tttgcgagagatcttgcccggatcc

SEQ ID NO: 305494 - DNA, 25 bp, Mus musculus
tgaacaccgaaaccagagcagactt

SEQ ID NO: 305495 - DNA, 25 bp, Mus musculus
gagatcctcgatcagccggcgtctc

SEQ ID NO: 305496 - DNA, 25 bp, Mus musculus
cgccttccagttgagaaactcacta

SEQ ID NO: 305497 - DNA, 25 bp, Mus musculus
agtcctcctccgtctggttcaaaag

SEQ ID NO: 305498 - DNA, 25 bp, Mus musculus
ggttcaaaagatgtcacggcggcca

SEQ ID NO: 305499 - DNA, 25 bp, Mus musculus
gggcacttcatcctgagccagctgc

SEQ ID NO: 305500 - DNA, 25 bp, Mus musculus
gggcgcggagaaactccctccacat

SEQ ID NO: 305501 - DNA, 25 bp, Mus musculus
ccatcttcccattcactggagggca

SEQ ID NO: 305502 - DNA, 25 bp, Mus musculus
cactggagggcaagacaaaagcgga

SEQ ID NO: 305503 - DNA, 25 bp, Mus musculus
ggcagtcccgctacacggagcgcat

SEQ ID NO: 305504 - DNA, 25 bp, Mus musculus
agggacttgttctccttatcctcga

SEQ ID NO: 305505 - DNA, 25 bp, Mus musculus
tcgatcccagatccgagatcctcga

SEQ ID NO: 305506 - DNA, 25 bp, Mus musculus
ctcactaccggcgtggattccttta

SEQ ID NO: 305507 - DNA, 25 bp, Mus musculus
aaagagacggccactactagtcctc

SEQ ID NO: 305508 - DNA, 25 bp, Mus musculus
aggcgcccgggactctcctcggctc

SEQ ID NO: 305509 - DNA, 25 bp, Mus musculus
tctccgcggtccctcgctcggcctg

SEQ ID NO: 305510 - DNA, 25 bp, Mus musculus
ctggcttcgctacggccgtttcctg

SEQ ID NO: 305511 - DNA, 25 bp, Mus musculus
cctcccacgcgtgccaccgcacacc

SEQ ID NO: 305512 - DNA, 25 bp, Mus musculus
aagttggcgggcaccgaagtccctg

SEQ ID NO: 305513 - DNA, 25 bp, Mus musculus
gcaccgaagtccctgcaggtggagg

SEQ ID NO: 305514 - DNA, 25 bp, Mus musculus
gtccgcgggccactgtcccacctct

SEQ ID NO: 305515 - DNA, 25 bp, Mus musculus
tgcttgcccaagtccccagcggagg

SEQ ID NO: 305516 - DNA, 25 bp, Mus musculus
gtcgggtggcagtcagctccacacc

SEQ ID NO: 305517 - DNA, 25 bp, Mus musculus
ccaaggggcgctcacgcggccgccc

SEQ ID NO: 305518 - DNA, 25 bp, Mus musculus
tgccgggcccgtctagacccgccag

SEQ ID NO: 305519 - DNA, 25 bp, Mus musculus
ctcggctcggccgaaccgtaggtgc

SEQ ID NO: 305520 - DNA, 25 bp, Mus musculus
gagtcggacggacgcttacctggtg

SEQ ID NO: 305521 - DNA, 25 bp, Mus musculus
gaacccactcggcttcagtccgacc

SEQ ID NO: 305522 - DNA, 25 bp, Mus musculus
gaccgccctacgtagccagggttca

SEQ ID NO: 305523 - DNA, 25 bp, Mus musculus
ctatatagtcttcaggtccggcttc

SEQ ID NO: 305524 - DNA, 25 bp, Mus musculus
acggaatcccagttgccgctgagtg

SEQ ID NO: 305525 - DNA, 25 bp, Mus musculus
gcagaggctcatgggacctgtagta

SEQ ID NO: 305526 - DNA, 25 bp, Mus musculus
gagcgccacttagcggcaccctata

SEQ ID NO: 305527 - DNA, 25 bp, Mus musculus
tgctcggttcctctgtgacctccag

SEQ ID NO: 305528 - DNA, 25 bp, Mus musculus
gtgcacctgtgacggccaccttgac

SEQ ID NO: 305529 - DNA, 25 bp, Mus musculus
ttcagccggcttccaaacactgggg

SEQ ID NO: 305530 - DNA, 25 bp, Mus musculus
ctggccagacgcacttcgctttctg

SEQ ID NO: 305531 - DNA, 25 bp, Mus musculus
ctctgagctgagcagcacggaccca

SEQ ID NO: 305532 - DNA, 25 bp, Mus musculus
ctctcgggttagcaccacggtgaca

SEQ ID NO: 305533 - DNA, 25 bp, Mus musculus
cagacacgcatcagctctcgggtta

SEQ ID NO: 305534 - DNA, 25 bp, Mus musculus
ccactgggactggtagtacgtacgc

SEQ ID NO: 305535 - DNA, 25 bp, Mus musculus
tggcgtcttcgaggaaaccggaagc

SEQ ID NO: 305536 - DNA, 25 bp, Mus musculus
agaactctagggactgcggtgccac

SEQ ID NO: 305537 - DNA, 25 bp, Mus musculus
cttgccaaagcggttcagggcgtca

SEQ ID NO: 305538 - DNA, 25 bp, Mus musculus
tcttccagaagcatagtggataccg

SEQ ID NO: 305539 - DNA, 25 bp, Mus musculus
gtcccgcctgctgggaataacagcc

SEQ ID NO: 305540 - DNA, 25 bp, Mus musculus
cgcgggcccatcttggatctttagc

SEQ ID NO: 305541 - DNA, 25 bp, Mus musculus
tgcccgccacagcaggaattttggt

SEQ ID NO: 305542 - DNA, 25 bp, Mus musculus
tggataccggtggactgtgaaaccc

SEQ ID NO: 305543 - DNA, 25 bp, Mus musculus
aggtttgtctctcccgtagcagtgg

SEQ ID NO: 305544 - DNA, 25 bp, Mus musculus
cagcaagagctggatcagaactcta

SEQ ID NO: 305545 - DNA, 25 bp, Mus musculus
ccagggccaactctatgatcatttg

SEQ ID NO: 305546 - DNA, 25 bp, Mus musculus
acagagtagcgagagccactttgcc

SEQ ID NO: 305547 - DNA, 25 bp, Mus musculus
cccagagcgcccttgttttcttaca

SEQ ID NO: 305548 - DNA, 25 bp, Mus musculus
agccggcactgtactggccgccaga

SEQ ID NO: 305549 - DNA, 25 bp, Mus musculus
cctgattggtcagcgtgcagcgacc

SEQ ID NO: 305550 - DNA, 25 bp, Mus musculus
gcggagaagcagcaagccactcacg

SEQ ID NO: 305551 - DNA, 25 bp, Mus musculus
cgagcggcagatgaacggcctgtcg

SEQ ID NO: 305552 - DNA, 25 bp, Mus musculus
ggtgaggcgctagccgcgcatcctc

SEQ ID NO: 305553 - DNA, 25 bp, Mus musculus
cggcctgtcgcggagagtggaaacc

SEQ ID NO: 305554 - DNA, 25 bp, Mus musculus
gccgcgcatcctcggggcacctgac

SEQ ID NO: 305555 - DNA, 25 bp, Mus musculus
atcctcggggcacctgaccgccggc

SEQ ID NO: 305556 - DNA, 25 bp, Mus musculus
ccaggccctcacaaccacgccgacc

SEQ ID NO: 305557 - DNA, 25 bp, Mus musculus
aggtgcctgccgttgggctgcgcgc

SEQ ID NO: 305558 - DNA, 25 bp, Mus musculus
ccactcacgcgctaaggggccggga

SEQ ID NO: 305559 - DNA, 25 bp, Mus musculus
gcaagccactcacgcgctaaggggc

SEQ ID NO: 305560 - DNA, 25 bp, Mus musculus
gcagcaagccactcacgcgctaagg

SEQ ID NO: 305561 - DNA, 25 bp, Mus musculus
gaagcagcaagccactcacgcgcta

SEQ ID NO: 305562 - DNA, 25 bp, Mus musculus
gtccagcgccatctcggagggcgga

SEQ ID NO: 305563 - DNA, 25 bp, Mus musculus
ctgcggggtccagcgccatctcgga

SEQ ID NO: 305564 - DNA, 25 bp, Mus musculus
gcagagtccctacatctcgaccgga

SEQ ID NO: 305565 - DNA, 25 bp, Mus musculus
ggccacctcatctgttctcggcaaa

SEQ ID NO: 305566 - DNA, 25 bp, Mus musculus
gcgtctgagcgcttagcagatcccg

SEQ ID NO: 305567 - DNA, 25 bp, Mus musculus
aagcttcgcgcggatctgctgctgg

SEQ ID NO: 305568 - DNA, 25 bp, Mus musculus
ttcccgtgtgatcgcattgggttgg

SEQ ID NO: 305569 - DNA, 25 bp, Mus musculus
ccgtccttgactgtttgcggaaacg

SEQ ID NO: 305570 - DNA, 25 bp, Mus musculus
tctcgaccggaaaatgcgctcctgg

SEQ ID NO: 305571 - DNA, 25 bp, Mus musculus
cgctcctggagcgactactgcaggc

SEQ ID NO: 305572 - DNA, 25 bp, Mus musculus
tgcaggcgtccgtaattgcttatta

SEQ ID NO: 305573 - DNA, 25 bp, Mus musculus
tattagaggagaatgtacaggcttc

SEQ ID NO: 305574 - DNA, 25 bp, Mus musculus
ctcggcaaaagtttcccgtgtgatc

SEQ ID NO: 305575 - DNA, 25 bp, Mus musculus
tgtacaggcttctcatcgtcaacga

SEQ ID NO: 305576 - DNA, 25 bp, Mus musculus
tctcatcgtcaacgaaacgtgttcc

SEQ ID NO: 305577 - DNA, 25 bp, Mus musculus
cgtgcccacgttcgtgattcgcggg

SEQ ID NO: 305578 - DNA, 25 bp, Mus musculus
atggaacagcctgagctccgagcgc

SEQ ID NO: 305579 - DNA, 25 bp, Mus musculus
tggcctttataaccaggccgcggga

SEQ ID NO: 305580 - DNA, 25 bp, Mus musculus
cggttgccgtctgcgattcgctaaa

SEQ ID NO: 305581 - DNA, 25 bp, Mus musculus
tgcgattcgctaaagcatgcagttg

SEQ ID NO: 305582 - DNA, 25 bp, Mus musculus
ggttctccgctctacgggccatacg

SEQ ID NO: 305583 - DNA, 25 bp, Mus musculus
catgcagttgggagagcagctcctg

SEQ ID NO: 305584 - DNA, 25 bp, Mus musculus
ctcctggtgagctcggtgaacctgc

SEQ ID NO: 305585 - DNA, 25 bp, Mus musculus
ggcgcgcacttctactcgctggaga

SEQ ID NO: 305586 - DNA, 25 bp, Mus musculus
ttagacaaagcgtccaagaagtttc

SEQ ID NO: 305587 - DNA, 25 bp, Mus musculus
tccaagaagtttccgggcagtctcc

SEQ ID NO: 305588 - DNA, 25 bp, Mus musculus
cgcggccatgctcagtgacgcggac

SEQ ID NO: 305589 - DNA, 25 bp, Mus musculus
tggcgcctatccctacggccagggt

SEQ ID NO: 305590 - DNA, 25 bp, Mus musculus
gcgcgctactccatggaacagcctg

SEQ ID NO: 305591 - DNA, 25 bp, Mus musculus
acaccttcgggagcacctcggcggt

SEQ ID NO: 305592 - DNA, 25 bp, Mus musculus
ggggcaacccagatcctttgtgata

SEQ ID NO: 305593 - DNA, 25 bp, Mus musculus
cacttcgtgtaacttgggtgatggc

SEQ ID NO: 305594 - DNA, 25 bp, Mus musculus
cagcgaccaagcctgtcacgagtta

SEQ ID NO: 305595 - DNA, 25 bp, Mus musculus
gcttccaaaccctgatcgaggcaga

SEQ ID NO: 305596 - DNA, 25 bp, Mus musculus
ggtccctgtaagtctcctgcttcca

SEQ ID NO: 305597 - DNA, 25 bp, Mus musculus
cacccggaatgaccaggtccctgta

SEQ ID NO: 305598 - DNA, 25 bp, Mus musculus
accaatgtcctctgggttccctgga

SEQ ID NO: 305599 - DNA, 25 bp, Mus musculus
gcccgtcagagaccctgactctaga

SEQ ID NO: 305600 - DNA, 25 bp, Mus musculus
tcgggacatttgacttcggagtttc

SEQ ID NO: 305601 - DNA, 25 bp, Mus musculus
ccaaaactccgtccctgtgcagggt

SEQ ID NO: 305602 - DNA, 25 bp, Mus musculus
tgtaggaaccctggcctggtttctc

SEQ ID NO: 305603 - DNA, 25 bp, Mus musculus
cgccgcgccatgttcaagaagctga

SEQ ID NO: 305604 - DNA, 25 bp, Mus musculus
gccagccaggggcacccagaaagaa

SEQ ID NO: 305605 - DNA, 25 bp, Mus musculus
ttccctggacatcgcacccggaatg

SEQ ID NO: 305606 - DNA, 25 bp, Mus musculus
caagtaagtgctgtgcccatgtgcc

SEQ ID NO: 305607 - DNA, 25 bp, Mus musculus
ctcaagtaagtgctgtgcccatgtg

SEQ ID NO: 305608 - DNA, 25 bp, Mus musculus
aaagctcaagtaagtgctgtgccca

SEQ ID NO: 305609 - DNA, 25 bp, Mus musculus
ggccgaggaaaagctcaagtaagtg

SEQ ID NO: 305610 - DNA, 25 bp, Mus musculus
acatcctgaagagggagtgcgagca

SEQ ID NO: 305611 - DNA, 25 bp, Mus musculus
cagcaggagctggacatcctgaaga

SEQ ID NO: 305612 - DNA, 25 bp, Mus musculus
gagctctgcggagggagcaccagca

SEQ ID NO: 305613 - DNA, 25 bp, Mus musculus
acggcctgcgcagcgacctggagtc

SEQ ID NO: 305614 - DNA, 25 bp, Mus musculus
cctggagtccaagttgacaggagcg

SEQ ID NO: 305615 - DNA, 25 bp, Mus musculus
cgcagcgacctggagtccaagttga

SEQ ID NO: 305616 - DNA, 25 bp, Mus musculus
cagaagctgagcaaggaggtggcga

SEQ ID NO: 305617 - DNA, 25 bp, Mus musculus
agtaagtgctgtgcccatgtgcctg

SEQ ID NO: 305618 - DNA, 25 bp, Mus musculus
tgcagaaggagctgcgagctctgcg

SEQ ID NO: 305619 - DNA, 25 bp, Mus musculus
cgacctggagtccaagttgacagga

SEQ ID NO: 305620 - DNA, 25 bp, Mus musculus
ggccggcgcttacaacctggacgcg

SEQ ID NO: 305621 - DNA, 25 bp, Mus musculus
gtcctccctgggcagtcagacgcag

SEQ ID NO: 305622 - DNA, 25 bp, Mus musculus
cacgctgacatcctggcctgctctc

SEQ ID NO: 305623 - DNA, 25 bp, Mus musculus
gccgatttaaatgtccgggcggcca

SEQ ID NO: 305624 - DNA, 25 bp, Mus musculus
ggatcctcgaccctggcgtgggcac

SEQ ID NO: 305625 - DNA, 25 bp, Mus musculus
ctggtaagtgtctcccgcggatcct

SEQ ID NO: 305626 - DNA, 25 bp, Mus musculus
acaacacgcgctggtaagtgtctcc

SEQ ID NO: 305627 - DNA, 25 bp, Mus musculus
tggagcacttccacgacaacacgcg

SEQ ID NO: 305628 - DNA, 25 bp, Mus musculus
gctacgcggtgctggagcacttcca

SEQ ID NO: 305629 - DNA, 25 bp, Mus musculus
aggctctttattcggctacgcggtg

SEQ ID NO: 305630 - DNA, 25 bp, Mus musculus
ccagggcccttcaggctctttattc

SEQ ID NO: 305631 - DNA, 25 bp, Mus musculus
cggtacgcttccagggcccttcagg

SEQ ID NO: 305632 - DNA, 25 bp, Mus musculus
tgggcagtcagacgcagcttcgctc

SEQ ID NO: 305633 - DNA, 25 bp, Mus musculus
gcgcttacaacctggacgcgcagcg

SEQ ID NO: 305634 - DNA, 25 bp, Mus musculus
ccaactttgtagacgctcatcggtg

SEQ ID NO: 305635 - DNA, 25 bp, Mus musculus
tcgcaccggcgtggaaaagtaagga

SEQ ID NO: 305636 - DNA, 25 bp, Mus musculus
gatcgcaccggcgtggaaaagtaag

SEQ ID NO: 305637 - DNA, 25 bp, Mus musculus
cttgaatggtgccagcgccgggatc

SEQ ID NO: 305638 - DNA, 25 bp, Mus musculus
acacgcggcttgaatggtgccagcg

SEQ ID NO: 305639 - DNA, 25 bp, Mus musculus
tgaacacgcggcttgaatggtgcca

SEQ ID NO: 305640 - DNA, 25 bp, Mus musculus
agacgctcatcggtgaacacgcggc

SEQ ID NO: 305641 - DNA, 25 bp, Mus musculus
tgtagacgctcatcggtgaacacgc

SEQ ID NO: 305642 - DNA, 25 bp, Mus musculus
ctttgtagacgctcatcggtgaaca

SEQ ID NO: 305643 - DNA, 25 bp, Mus musculus
tttccaactttgtagacgctcatcg

SEQ ID NO: 305644 - DNA, 25 bp, Mus musculus
ctcgcgtctaccagaggcgcttctg

SEQ ID NO: 305645 - DNA, 25 bp, Mus musculus
gcgtctaccagaggcgcttctggaa

SEQ ID NO: 305646 - DNA, 25 bp, Mus musculus
gtggaaaagtaaggaagtcccagca

SEQ ID NO: 305647 - DNA, 25 bp, Mus musculus
cgtctgcgggctcgcgtctaccaga

SEQ ID NO: 305648 - DNA, 25 bp, Mus musculus
gcaatcttctcccacggtacctgga

SEQ ID NO: 305649 - DNA, 25 bp, Mus musculus
gaaccctccattcccagtttgagcg

SEQ ID NO: 305650 - DNA, 25 bp, Mus musculus
ttcccagtttgagcgtcaggacgtc

SEQ ID NO: 305651 - DNA, 25 bp, Mus musculus
tgcggaaccctccattcccagtttg

SEQ ID NO: 305652 - DNA, 25 bp, Mus musculus
ggaacccactaccgactgcaatctt

SEQ ID NO: 305653 - DNA, 25 bp, Mus musculus
cacggtacctggactcggggtgaat

SEQ ID NO: 305654 - DNA, 25 bp, Mus musculus
agtttgagcgtcaggacgtccctca

SEQ ID NO: 305655 - DNA, 25 bp, Mus musculus
gcctcagccggcgatcccgctgcac

SEQ ID NO: 305656 - DNA, 25 bp, Mus musculus
cacctcgatcgctgagcttgctcta

SEQ ID NO: 305657 - DNA, 25 bp, Mus musculus
tgagcttgctctatctcccaggctc

SEQ ID NO: 305658 - DNA, 25 bp, Mus musculus
aggctccgccgcaccctcccaccta

SEQ ID NO: 305659 - DNA, 25 bp, Mus musculus
tcgctccttctctccgtcgcctgct

SEQ ID NO: 305660 - DNA, 25 bp, Mus musculus
cgcacccatggacggtccggccatc

SEQ ID NO: 305661 - DNA, 25 bp, Mus musculus
cacctcacagcctagctctacatta

SEQ ID NO: 305662 - DNA, 25 bp, Mus musculus
acctgaagtgcgtttgtcgctgaca

SEQ ID NO: 305663 - DNA, 25 bp, Mus musculus
ccgctacttctgacggcgtgaaata

SEQ ID NO: 305664 - DNA, 25 bp, Mus musculus
tggtctacaagaggcacaggctccc

SEQ ID NO: 305665 - DNA, 25 bp, Mus musculus
ctgggccgaccatgctactacgaga

SEQ ID NO: 305666 - DNA, 25 bp, Mus musculus
ggccaccggccacagtagttagtta

SEQ ID NO: 305667 - DNA, 25 bp, Mus musculus
tccggattccggcttcgagcctact

SEQ ID NO: 305668 - DNA, 25 bp, Mus musculus
cgagcctactgtggttgaattcatt

SEQ ID NO: 305669 - DNA, 25 bp, Mus musculus
ccgatcctaggtgtctgagtgcttg

SEQ ID NO: 305670 - DNA, 25 bp, Mus musculus
gatattcttctcgtagcccagtagg

SEQ ID NO: 305671 - DNA, 25 bp, Mus musculus
gggacctggcatgaaataaaatctc

SEQ ID NO: 305672 - DNA, 25 bp, Mus musculus
ttgtgatctcacgaaagcgcttggg

SEQ ID NO: 305673 - DNA, 25 bp, Mus musculus
tgagtgcttgtcctgccctagcagg

SEQ ID NO: 305674 - DNA, 25 bp, Mus musculus
tgcaggtaaagttctcgcgatattc

SEQ ID NO: 305675 - DNA, 25 bp, Mus musculus
ttatccaagtctggcccggctacta

SEQ ID NO: 305676 - DNA, 25 bp, Mus musculus
tccttgcgcagtccggtgcagggac

SEQ ID NO: 305677 - DNA, 25 bp, Mus musculus
cgcggcgtgattcacttgagcaaaa

SEQ ID NO: 305678 - DNA, 25 bp, Mus musculus
cggccgaaggagctgttatccctgc

SEQ ID NO: 305679 - DNA, 25 bp, Mus musculus
agctgttatccctgccgcccgggtg

SEQ ID NO: 305680 - DNA, 25 bp, Mus musculus
ctacgttcgggacactcaccgtgca

SEQ ID NO: 305681 - DNA, 25 bp, Mus musculus
accgtgcaaggtcaggaagtcccga

SEQ ID NO: 305682 - DNA, 25 bp, Mus musculus
ttgagcaaaatcaccaagcggcctg

SEQ ID NO: 305683 - DNA, 25 bp, Mus musculus
cgccagggccagaaatagtcagatc

SEQ ID NO: 305684 - DNA, 25 bp, Mus musculus
tcaccaagcggcctggggtccttgc

SEQ ID NO: 305685 - DNA, 25 bp, Mus musculus
gaaatagtcagatccctcctgcttc

SEQ ID NO: 305686 - DNA, 25 bp, Mus musculus
cacaggccctgtcattacggcgagc

SEQ ID NO: 305687 - DNA, 25 bp, Mus musculus
gccgggaagactagccaaccctggc

SEQ ID NO: 305688 - DNA, 25 bp, Mus musculus
gcagggacccaactgaactgagatg

SEQ ID NO: 305689 - DNA, 25 bp, Mus musculus
tgtcattacggcgagctgccggccc

SEQ ID NO: 305690 - DNA, 25 bp, Mus musculus
ccgaaacttgtacaccgcccaggtg

SEQ ID NO: 305691 - DNA, 25 bp, Mus musculus
ttgccatttcggcttccctacgcgg

SEQ ID NO: 305692 - DNA, 25 bp, Mus musculus
cggagccgcagacgctgcgtctacg

SEQ ID NO: 305693 - DNA, 25 bp, Mus musculus
cgcctcgttgcgcacgcaggaaatc

SEQ ID NO: 305694 - DNA, 25 bp, Mus musculus
ggaaatctcacatctgcttgcccga

SEQ ID NO: 305695 - DNA, 25 bp, Mus musculus
gcttgcccgagtcttccgaaacttg

SEQ ID NO: 305696 - DNA, 25 bp, Mus musculus
ccgcccaggtgatcggagatgactt

SEQ ID NO: 305697 - DNA, 25 bp, Mus musculus
cagtttgatcaaggcccgcggcagt

SEQ ID NO: 305698 - DNA, 25 bp, Mus musculus
atgcgcgccacgaagagttccttga

SEQ ID NO: 305699 - DNA, 25 bp, Mus musculus
agagttccttgaccagctgcagcag

SEQ ID NO: 305700 - DNA, 25 bp, Mus musculus
caggtatagtgggtgcatcccggtt

SEQ ID NO: 305701 - DNA, 25 bp, Mus musculus
tcccggtttacggtccggatgcagc

SEQ ID NO: 305702 - DNA, 25 bp, Mus musculus
cgaccgtcttaatggatgattgcca

SEQ ID NO: 305703 - DNA, 25 bp, Mus musculus
gatgacttgagcgacagtttgatca

SEQ ID NO: 305704 - DNA, 25 bp, Mus musculus
gggttcccggctcctggtcctgagc

SEQ ID NO: 305705 - DNA, 25 bp, Mus musculus
gtctcaagttctccatcgatcctcg

SEQ ID NO: 305706 - DNA, 25 bp, Mus musculus
gactgctgtcctgtctcaagttctc

SEQ ID NO: 305707 - DNA, 25 bp, Mus musculus
agccgcgactgctgtcctgtctcaa

SEQ ID NO: 305708 - DNA, 25 bp, Mus musculus
ggcggcaaatgccaaggctggtcca

SEQ ID NO: 305709 - DNA, 25 bp, Mus musculus
ggccgccaggtgaatgcgtcttaaa

SEQ ID NO: 305710 - DNA, 25 bp, Mus musculus
ttccttcttcctgcggaagcgcctt

SEQ ID NO: 305711 - DNA, 25 bp, Mus musculus
ctgcggcttccttcttcctgcggaa

SEQ ID NO: 305712 - DNA, 25 bp, Mus musculus
gacatggtggcagtccgtgaagcta

SEQ ID NO: 305713 - DNA, 25 bp, Mus musculus
tgaagactgccgaggccgacatggt

SEQ ID NO: 305714 - DNA, 25 bp, Mus musculus
cttgacgtccagaatgaagactgcc

SEQ ID NO: 305715 - DNA, 25 bp, Mus musculus
accttgcccttgacgtccagaatga

SEQ ID NO: 305716 - DNA, 25 bp, Mus musculus
tggtcctgagccctaggcccgcgga

SEQ ID NO: 305717 - DNA, 25 bp, Mus musculus
gagtacctcgatccctcgccctctg

SEQ ID NO: 305718 - DNA, 25 bp, Mus musculus
ggtcccaccgatttgccagcgctct

SEQ ID NO: 305719 - DNA, 25 bp, Mus musculus
ctgcaggaagccagcggagcagggc

SEQ ID NO: 305720 - DNA, 25 bp, Mus musculus
tcccaccgatttgccagcgctctgg

SEQ ID NO: 305721 - DNA, 25 bp, Mus musculus
aggcctgcaggaagccagcggagca

SEQ ID NO: 305722 - DNA, 25 bp, Mus musculus
ctcaccccagtgaattaaggacgcg

SEQ ID NO: 305723 - DNA, 25 bp, Mus musculus
tgcaggaagccagcggagcagggcg

SEQ ID NO: 305724 - DNA, 25 bp, Mus musculus
ggaggtgggtcccaccgatttgcca

SEQ ID NO: 305725 - DNA, 25 bp, Mus musculus
gaggtgggtcccaccgatttgccag

SEQ ID NO: 305726 - DNA, 25 bp, Mus musculus
gtgggtcccaccgatttgccagcgc

SEQ ID NO: 305727 - DNA, 25 bp, Mus musculus
tgggtcccaccgatttgccagcgct

SEQ ID NO: 305728 - DNA, 25 bp, Mus musculus
gtcccaccgatttgccagcgctctg

SEQ ID NO: 305729 - DNA, 25 bp, Mus musculus
gggcgctcaccccagtgaattaagg

SEQ ID NO: 305730 - DNA, 25 bp, Mus musculus
ggcgctcaccccagtgaattaagga

SEQ ID NO: 305731 - DNA, 25 bp, Mus musculus
aggtgggtcccaccgatttgccagc

SEQ ID NO: 305732 - DNA, 25 bp, Mus musculus
tgcaccaccaccacgtcggaggccg

SEQ ID NO: 305733 - DNA, 25 bp, Mus musculus
cctgcagccgatgcatcgcggaggt

SEQ ID NO: 305734 - DNA, 25 bp, Mus musculus
ctacctgcagccgatgcatcgcgga

SEQ ID NO: 305735 - DNA, 25 bp, Mus musculus
agcactacctgcagccgatgcatcg

SEQ ID NO: 305736 - DNA, 25 bp, Mus musculus
cagcttgcagcgcggagctcgactc

SEQ ID NO: 305737 - DNA, 25 bp, Mus musculus
gggagctcacccacggagatgtctc

SEQ ID NO: 305738 - DNA, 25 bp, Mus musculus
ggagatgtctcccagctgctcaggc

SEQ ID NO: 305739 - DNA, 25 bp, Mus musculus
gtctcccagctgctcaggctttagc

SEQ ID NO: 305740 - DNA, 25 bp, Mus musculus
ggagaaccgcggtcaacacggccga

SEQ ID NO: 305741 - DNA, 25 bp, Mus musculus
accgcggtcaacacggccgacagaa

SEQ ID NO: 305742 - DNA, 25 bp, Mus musculus
ccgcccggggactctgcggtcaccg

SEQ ID NO: 305743 - DNA, 25 bp, Mus musculus
acacggccgacagaagctcgtcggg

SEQ ID NO: 305744 - DNA, 25 bp, Mus musculus
gtgcgccgtccgtgcaccaccacca

SEQ ID NO: 305745 - DNA, 25 bp, Mus musculus
tcaacacggccgacagaagctcgtc

SEQ ID NO: 305746 - DNA, 25 bp, Mus musculus
agacattcgactcgcgtcgcggccg

SEQ ID NO: 305747 - DNA, 25 bp, Mus musculus
cacttttatgttattgggcattttt

SEQ ID NO: 305748 - DNA, 25 bp, Mus musculus
ttatacacttttatgttattgggca

SEQ ID NO: 305749 - DNA, 25 bp, Mus musculus
cagatatttttgtgtgataagagac

SEQ ID NO: 305750 - DNA, 25 bp, Mus musculus
ttgtgtgataagagacattcgactc

SEQ ID NO: 305751 - DNA, 25 bp, Mus musculus
tgataagagacattcgactcgcgtc

SEQ ID NO: 305752 - DNA, 25 bp, Mus musculus
ctgttcttcttttcagatatttttg

SEQ ID NO: 305753 - DNA, 25 bp, Mus musculus
agagacattcgactcgcgtcgcggc

SEQ ID NO: 305754 - DNA, 25 bp, Mus musculus
ataagagacattcgactcgcgtcgc

SEQ ID NO: 305755 - DNA, 25 bp, Mus musculus
attcgactcgcgtcgcggccgcgga

SEQ ID NO: 305756 - DNA, 25 bp, Mus musculus
catggagaccgagctgatctagaag

SEQ ID NO: 305757 - DNA, 25 bp, Mus musculus
tggagaccgagctgatctagaaggc

SEQ ID NO: 305758 - DNA, 25 bp, Mus musculus
gctgatcaaggactaatgggggaaa

SEQ ID NO: 305759 - DNA, 25 bp, Mus musculus
ccaagctggccgacatggccacctg

SEQ ID NO: 305760 - DNA, 25 bp, Mus musculus
ctaggataaaaggtcttgcgggctc

SEQ ID NO: 305761 - DNA, 25 bp, Mus musculus
tgctaaaccgaaggagcggcgcttc

SEQ ID NO: 305762 - DNA, 25 bp, Mus musculus
catggcggccactgagtgctaaacc

SEQ ID NO: 305763 - DNA, 25 bp, Mus musculus
aactgccgcagaacgaggagccaca

SEQ ID NO: 305764 - DNA, 25 bp, Mus musculus
ttcactgagggcgtctgaaagccaa

SEQ ID NO: 305765 - DNA, 25 bp, Mus musculus
cgcggcaccgcgaaacaagcttcta

SEQ ID NO: 305766 - DNA, 25 bp, Mus musculus
tcgagtcctcggacatgacggctgc

SEQ ID NO: 305767 - DNA, 25 bp, Mus musculus
gctcgtagtcgtccctgttgatgga

SEQ ID NO: 305768 - DNA, 25 bp, Mus musculus
ctggagcgtgtggacatcagtcata

SEQ ID NO: 305769 - DNA, 25 bp, Mus musculus
cggtcacaccctcgagacgtgcaaa

SEQ ID NO: 305770 - DNA, 25 bp, Mus musculus
ctaccgagcgccaaaacctttcagg

SEQ ID NO: 305771 - DNA, 25 bp, Mus musculus
gtcatatgttagtcccgcctccggg

SEQ ID NO: 305772 - DNA, 25 bp, Mus musculus
gcggacgaaggccaactaggataaa

SEQ ID NO: 305773 - DNA, 25 bp, Mus musculus
tatcacctcctgcagctcgtagtcg

SEQ ID NO: 305774 - DNA, 25 bp, Mus musculus
cacggtctaacaaggccagcagctc

SEQ ID NO: 305775 - DNA, 25 bp, Mus musculus
agaacatgaaggagtccagggaccc

SEQ ID NO: 305776 - DNA, 25 bp, Mus musculus
ggtctcccgcagacatggcaggcaa

SEQ ID NO: 305777 - DNA, 25 bp, Mus musculus
gtttcctcaccgatgcgcgacttca

SEQ ID NO: 305778 - DNA, 25 bp, Mus musculus
gctccttcagtatatcctcacggtc

SEQ ID NO: 305779 - DNA, 25 bp, Mus musculus
gcagctctagcagcctgccgacaga

SEQ ID NO: 305780 - DNA, 25 bp, Mus musculus
tgccaggcatccaacaaactgcgag

SEQ ID NO: 305781 - DNA, 25 bp, Mus musculus
ggcgcgtttccagctctcggatctc

SEQ ID NO: 305782 - DNA, 25 bp, Mus musculus
cggatctccaagtactcgaagccca

SEQ ID NO: 305783 - DNA, 25 bp, Mus musculus
gcgtccgagggttcaagaacagcga

SEQ ID NO: 305784 - DNA, 25 bp, Mus musculus
aagaacagcgataggcggcgcctca

SEQ ID NO: 305785 - DNA, 25 bp, Mus musculus
actcccacgttaagcgcgaccaagg

SEQ ID NO: 305786 - DNA, 25 bp, Mus musculus
cgcgaccaagggtatggagaacatg

SEQ ID NO: 305787 - DNA, 25 bp, Mus musculus
cgatgcgcgacttcagctccttcag

SEQ ID NO: 305788 - DNA, 25 bp, Mus musculus
tcggccgtgttgaccgcggttctcc

SEQ ID NO: 305789 - DNA, 25 bp, Mus musculus
gagacatctccgtgggtgagctccc

SEQ ID NO: 305790 - DNA, 25 bp, Mus musculus
tgagcagctgggagacatctccgtg

SEQ ID NO: 305791 - DNA, 25 bp, Mus musculus
ctgcgggtcctgcaccggccctccc

SEQ ID NO: 305792 - DNA, 25 bp, Mus musculus
agcctgagcagctgggagacatctc

SEQ ID NO: 305793 - DNA, 25 bp, Mus musculus
ctaaagcctgagcagctgggagaca

SEQ ID NO: 305794 - DNA, 25 bp, Mus musculus
ttctgtcggccgtgttgaccgcggt

SEQ ID NO: 305795 - DNA, 25 bp, Mus musculus
acgagcttctgtcggccgtgttgac

SEQ ID NO: 305796 - DNA, 25 bp, Mus musculus
cccgacgagcttctgtcggccgtgt

SEQ ID NO: 305797 - DNA, 25 bp, Mus musculus
ggcctccgacgtggtggtggtgcac

SEQ ID NO: 305798 - DNA, 25 bp, Mus musculus
agtcgagctccgcgctgcaagctgc

SEQ ID NO: 305799 - DNA, 25 bp, Mus musculus
gcccgagtcgagctccgcgctgcaa

SEQ ID NO: 305800 - DNA, 25 bp, Mus musculus
cgatgcatcggctgcaggtagtgct

SEQ ID NO: 305801 - DNA, 25 bp, Mus musculus
aaagcctgagcagctgggagacatc

SEQ ID NO: 305802 - DNA, 25 bp, Mus musculus
tcgtgactccagtccagagtcctgc

SEQ ID NO: 305803 - DNA, 25 bp, Mus musculus
tgggacttcagcacgcagcaggtac

SEQ ID NO: 305804 - DNA, 25 bp, Mus musculus
gctagattccgagacactccgcgca

SEQ ID NO: 305805 - DNA, 25 bp, Mus musculus
cagcgacagtctcgccgctgcagta

SEQ ID NO: 305806 - DNA, 25 bp, Mus musculus
tctcgccgctgcagtacacatggac

SEQ ID NO: 305807 - DNA, 25 bp, Mus musculus
acacatggacgcacggacgcacaga

SEQ ID NO: 305808 - DNA, 25 bp, Mus musculus
ccgctgttgcctgggctgggacttc

SEQ ID NO: 305809 - DNA, 25 bp, Mus musculus
agcgacggagcgcagcgacagtctc

SEQ ID NO: 305810 - DNA, 25 bp, Mus musculus
ttcagcacgcagcaggtacgcgcgc

SEQ ID NO: 305811 - DNA, 25 bp, Mus musculus
tgacgatgctctgccagcgagaggc

SEQ ID NO: 305812 - DNA, 25 bp, Mus musculus
agcgagaggcttctcccggaaaccg

SEQ ID NO: 305813 - DNA, 25 bp, Mus musculus
cgcggaacccggagtacacgtagcg

SEQ ID NO: 305814 - DNA, 25 bp, Mus musculus
tctcggctgcagatggctagattcc

SEQ ID NO: 305815 - DNA, 25 bp, Mus musculus
tccacgcgagtctcggctgcagatg

SEQ ID NO: 305816 - DNA, 25 bp, Mus musculus
cgcttttcttgcagcgggccgcaga

SEQ ID NO: 305817 - DNA, 25 bp, Mus musculus
tcgcccttctctggggatcgctgtg

SEQ ID NO: 305818 - DNA, 25 bp, Mus musculus
gcgctctggtgcttgcgatcttaga

SEQ ID NO: 305819 - DNA, 25 bp, Mus musculus
tgcgatcttagaggcgagctcgccc

SEQ ID NO: 305820 - DNA, 25 bp, Mus musculus
ccgtgcggttcctctgcgcgattct

SEQ ID NO: 305821 - DNA, 25 bp, Mus musculus
gcgattctggctcgcagaggttcta

SEQ ID NO: 305822 - DNA, 25 bp, Mus musculus
atagagcggggaaaacctaagcgtg

SEQ ID NO: 305823 - DNA, 25 bp, Mus musculus
ccctgagagtcataggtgtcgcaaa

SEQ ID NO: 305824 - DNA, 25 bp, Mus musculus
ccgcatactgcctgggaaccgaagc

SEQ ID NO: 305825 - DNA, 25 bp, Mus musculus
gatcctcatgcgagtggctcctacc

SEQ ID NO: 305826 - DNA, 25 bp, Mus musculus
cgcttttgttttgggcaactgggag

SEQ ID NO: 305827 - DNA, 25 bp, Mus musculus
ttgaagaggcgaaccaacaggtctc

SEQ ID NO: 305828 - DNA, 25 bp, Mus musculus
aacaggtctcagatcgcttcggccg

SEQ ID NO: 305829 - DNA, 25 bp, Mus musculus
tgtcgcaaagcgaagcggacggctt

SEQ ID NO: 305830 - DNA, 25 bp, Mus musculus
gcacacctggtagcaccgagtcatg

SEQ ID NO: 305831 - DNA, 25 bp, Mus musculus
cacacaaagcggttcctcccttggt

SEQ ID NO: 305832 - DNA, 25 bp, Mus musculus
gggtcgtatcctggtgtcactattg

SEQ ID NO: 305833 - DNA, 25 bp, Mus musculus
tgtcactattggctgagcggccgtg

SEQ ID NO: 305834 - DNA, 25 bp, Mus musculus
tcgggctcagaacttgcaccgggtg

SEQ ID NO: 305835 - DNA, 25 bp, Mus musculus
ggctctaggacgcattgtcgccgta

SEQ ID NO: 305836 - DNA, 25 bp, Mus musculus
gctggctttgccgactccacacaaa

SEQ ID NO: 305837 - DNA, 25 bp, Mus musculus
cggtgcccagaggtcatggactatc

SEQ ID NO: 305838 - DNA, 25 bp, Mus musculus
aggtcatggactatcgcttgcggta

SEQ ID NO: 305839 - DNA, 25 bp, Mus musculus
tcgtggttagagctctcggacagcc

SEQ ID NO: 305840 - DNA, 25 bp, Mus musculus
acgcccttgcccatcgggagaggca

SEQ ID NO: 305841 - DNA, 25 bp, Mus musculus
catgtcacttgggagtgtgcctctc

SEQ ID NO: 305842 - DNA, 25 bp, Mus musculus
gccgcgctgaataacggtggccaga

SEQ ID NO: 305843 - DNA, 25 bp, Mus musculus
attgtcgccgtaagtgctgcctcca

SEQ ID NO: 305844 - DNA, 25 bp, Mus musculus
ccagaggcgggacctaggtccagcc

SEQ ID NO: 305845 - DNA, 25 bp, Mus musculus
ctcaccagtgtgaaggcatcgtagg

SEQ ID NO: 305846 - DNA, 25 bp, Mus musculus
cgggacctaggtccagcccaggcgt

SEQ ID NO: 305847 - DNA, 25 bp, Mus musculus
tcgcagtgcaccaggtacgtgtttc

SEQ ID NO: 305848 - DNA, 25 bp, Mus musculus
gagaaagtgggcagcttcagtggtg

SEQ ID NO: 305849 - DNA, 25 bp, Mus musculus
gcgtccggcctcatcgagacgtgct

SEQ ID NO: 305850 - DNA, 25 bp, Mus musculus
ctaggtccagcccaggcgtgtgctg

SEQ ID NO: 305851 - DNA, 25 bp, Mus musculus
agccctcgcagtgcaccaggtacgt

SEQ ID NO: 305852 - DNA, 25 bp, Mus musculus
cccgcgctgcgacggcgcgcacagc

SEQ ID NO: 305853 - DNA, 25 bp, Mus musculus
accaccacgccctgtaggcccgcgc

SEQ ID NO: 305854 - DNA, 25 bp, Mus musculus
gtgcggtactgctctagcaccacca

SEQ ID NO: 305855 - DNA, 25 bp, Mus musculus
tcctccgtgcggtactgctctagca

SEQ ID NO: 305856 - DNA, 25 bp, Mus musculus
gctcgctctcaccagtgtgaaggca

SEQ ID NO: 305857 - DNA, 25 bp, Mus musculus
ccggcctcatcgagacgtgctggcg

SEQ ID NO: 305858 - DNA, 25 bp, Mus musculus
tgctacgacaggtacacaggggagc

SEQ ID NO: 305859 - DNA, 25 bp, Mus musculus
gagactcgggagtgcatctactaca

SEQ ID NO: 305860 - DNA, 25 bp, Mus musculus
tcgggagtgcatctactacaacgcc

SEQ ID NO: 305861 - DNA, 25 bp, Mus musculus
tgcatctactacaacgccaactggg

SEQ ID NO: 305862 - DNA, 25 bp, Mus musculus
ggagcgttcccgctgccgtagcccg

SEQ ID NO: 305863 - DNA, 25 bp, Mus musculus
tacaacgccaactgggagctggagc

SEQ ID NO: 305864 - DNA, 25 bp, Mus musculus
cttcaattgctacgacaggtacaca

SEQ ID NO: 305865 - DNA, 25 bp, Mus musculus
agatgacttcaattgctacgacagg

SEQ ID NO: 305866 - DNA, 25 bp, Mus musculus
agctcgggcaccatcgagctggtga

SEQ ID NO: 305867 - DNA, 25 bp, Mus musculus
tgctacgcctcgtggcgcaacagct

SEQ ID NO: 305868 - DNA, 25 bp, Mus musculus
aagcggctgcactgctacgcctcgt

SEQ ID NO: 305869 - DNA, 25 bp, Mus musculus
ggaacaggacaagcggctgcactgc

SEQ ID NO: 305870 - DNA, 25 bp, Mus musculus
gagcgcaccaaccagagcggcctgg

SEQ ID NO: 305871 - DNA, 25 bp, Mus musculus
ggagctggagcgcaccaaccagagc

SEQ ID NO: 305872 - DNA, 25 bp, Mus musculus
accctcagcagcgaaggcctctggg

SEQ ID NO: 305873 - DNA, 25 bp, Mus musculus
cgtccggacgcggaatccgcgaagc

SEQ ID NO: 305874 - DNA, 25 bp, Mus musculus
gctgcagtttttccggcgtccggac

SEQ ID NO: 305875 - DNA, 25 bp, Mus musculus
ctgacggcgctgcagtttttccggc

SEQ ID NO: 305876 - DNA, 25 bp, Mus musculus
ttctgaatggcttcttggccggggc

SEQ ID NO: 305877 - DNA, 25 bp, Mus musculus
ctcgcggcgatttctgaatggcttc

SEQ ID NO: 305878 - DNA, 25 bp, Mus musculus
agagcttcgcttcccgtctcaggga

SEQ ID NO: 305879 - DNA, 25 bp, Mus musculus
cgcccgcgagtcatggctgcaaaga

SEQ ID NO: 305880 - DNA, 25 bp, Mus musculus
tccggagccggcgattggaccattc

SEQ ID NO: 305881 - DNA, 25 bp, Mus musculus
gcgcgagaccctcagcagcgaaggc

SEQ ID NO: 305882 - DNA, 25 bp, Mus musculus
atccgcgaagctggcgaggcagcca

SEQ ID NO: 305883 - DNA, 25 bp, Mus musculus
tcatggctgcaaagagcttcgcttc

SEQ ID NO: 305884 - DNA, 25 bp, Mus musculus
gattggaccattccggcctcggagc

SEQ ID NO: 305885 - DNA, 25 bp, Mus musculus
gcagagacaaagtgctggcgcccgc

SEQ ID NO: 305886 - DNA, 25 bp, Mus musculus
ctgcggctgtagtccgacgcacgca

SEQ ID NO: 305887 - DNA, 25 bp, Mus musculus
gtggccgacacctcctcatgttttc

SEQ ID NO: 305888 - DNA, 25 bp, Mus musculus
gcccgctggatgaccgtggccgaca

SEQ ID NO: 305889 - DNA, 25 bp, Mus musculus
gcatgcttcaccgagcgctgcagga

SEQ ID NO: 305890 - DNA, 25 bp, Mus musculus
agaggaaggaagcatgcttcaccga

SEQ ID NO: 305891 - DNA, 25 bp, Mus musculus
tcctcatcagagaggccactgctgc

SEQ ID NO: 305892 - DNA, 25 bp, Mus musculus
taggcaatgagtccctctcgctcgg

SEQ ID NO: 305893 - DNA, 25 bp, Mus musculus
tcatcatgtaggcaatgagtccctc

SEQ ID NO: 305894 - DNA, 25 bp, Mus musculus
gggagaagttctcattcatcatgta

SEQ ID NO: 305895 - DNA, 25 bp, Mus musculus
gctgcgccgggagaagttctcattc

SEQ ID NO: 305896 - DNA, 25 bp, Mus musculus
ctcgtgacgctgtcataggacggtg

SEQ ID NO: 305897 - DNA, 25 bp, Mus musculus
tggccctcgtgacgctgtcatagga

SEQ ID NO: 305898 - DNA, 25 bp, Mus musculus
ctgggaggttatcactggtggccct

SEQ ID NO: 305899 - DNA, 25 bp, Mus musculus
gacgcacgcactgggaggttatcac

SEQ ID NO: 305900 - DNA, 25 bp, Mus musculus
caggacccgaccgacgctcagggta

SEQ ID NO: 305901 - DNA, 25 bp, Mus musculus
ccctgggaacaatggcgctgtgcgc

SEQ ID NO: 305902 - DNA, 25 bp, Mus musculus
gcctatccctatttggtcactgggg

SEQ ID NO: 305903 - DNA, 25 bp, Mus musculus
ggccacctgcggagcgagactccgt

SEQ ID NO: 305904 - DNA, 25 bp, Mus musculus
agttccacgcgtccacggtagactc

SEQ ID NO: 305905 - DNA, 25 bp, Mus musculus
tggaaagttccacgcgtccacggta

SEQ ID NO: 305906 - DNA, 25 bp, Mus musculus
tcggcgtccgcgtggaaagttccac

SEQ ID NO: 305907 - DNA, 25 bp, Mus musculus
tccatgttcggcgtccgcgtggaaa

SEQ ID NO: 305908 - DNA, 25 bp, Mus musculus
gaccgacgctcagggtaagttggca

SEQ ID NO: 305909 - DNA, 25 bp, Mus musculus
gtagcacttagtccggaccacgcca

SEQ ID NO: 305910 - DNA, 25 bp, Mus musculus
aggccgcctggcctatccctatttg

SEQ ID NO: 305911 - DNA, 25 bp, Mus musculus
ctcccggctctcctcttttctcaga

SEQ ID NO: 305912 - DNA, 25 bp, Mus musculus
tcagtactgttcagagagccacgcc

SEQ ID NO: 305913 - DNA, 25 bp, Mus musculus
tcttatccgctcctcagtactgttc

SEQ ID NO: 305914 - DNA, 25 bp, Mus musculus
ctgcaggcagtacgaaggcccttct

SEQ ID NO: 305915 - DNA, 25 bp, Mus musculus
ttatggcgcatgctcctcgcctgga

SEQ ID NO: 305916 - DNA, 25 bp, Mus musculus
tgagccgggacttatggcgcatgct

SEQ ID NO: 305917 - DNA, 25 bp, Mus musculus
tcctgagcgatgagccgggacttat

SEQ ID NO: 305918 - DNA, 25 bp, Mus musculus
ttactcccttcctgagcgatgagcc

SEQ ID NO: 305919 - DNA, 25 bp, Mus musculus
ttcaagcttactcccttcctgagcg

SEQ ID NO: 305920 - DNA, 25 bp, Mus musculus
cttttcggggatcttcaagcttact

SEQ ID NO: 305921 - DNA, 25 bp, Mus musculus
cgtgtctcttttcggggatcttcaa

SEQ ID NO: 305922 - DNA, 25 bp, Mus musculus
agctcttggccctagcccaggttgt

SEQ ID NO: 305923 - DNA, 25 bp, Mus musculus
cgcgctggctcagccggagctcttg

SEQ ID NO: 305924 - DNA, 25 bp, Mus musculus
ctggaggtcccgttatctgggagaa

SEQ ID NO: 305925 - DNA, 25 bp, Mus musculus
aggcagtacgaaggcccttctgtcc

SEQ ID NO: 305926 - DNA, 25 bp, Mus musculus
agaatggggcccgacctcgccacat

SEQ ID NO: 305927 - DNA, 25 bp, Mus musculus
cctcgcctggaggtcccgttatctg

SEQ ID NO: 305928 - DNA, 25 bp, Mus musculus
gtgtctgtaaaggacaaagcccttc

SEQ ID NO: 305929 - DNA, 25 bp, Mus musculus
agacggatgacacggaagagcgttg

SEQ ID NO: 305930 - DNA, 25 bp, Mus musculus
aacaagcaagactgcagccaccact

SEQ ID NO: 305931 - DNA, 25 bp, Mus musculus
agaagtacttctggatgatgtcgga

SEQ ID NO: 305932 - DNA, 25 bp, Mus musculus
cttctggatgatgtcggagaggaca

SEQ ID NO: 305933 - DNA, 25 bp, Mus musculus
agaggacagtgcctgtgggaaacaa

SEQ ID NO: 305934 - DNA, 25 bp, Mus musculus
cctgtgggaaacaagcaagactgca

SEQ ID NO: 305935 - DNA, 25 bp, Mus musculus
ctcccacttgacgtaggcaaagttg

SEQ ID NO: 305936 - DNA, 25 bp, Mus musculus
tccttccaggccatgttcaccaagg

SEQ ID NO: 305937 - DNA, 25 bp, Mus musculus
caccaagggcaagtgtgtctgtaaa

SEQ ID NO: 305938 - DNA, 25 bp, Mus musculus
caaagcccttccaggaagaccaggt

SEQ ID NO: 305939 - DNA, 25 bp, Mus musculus
cgtaggcaaagttggccatgccgaa

SEQ ID NO: 305940 - DNA, 25 bp, Mus musculus
cagcctcccacttgacgtaggcaaa

SEQ ID NO: 305941 - DNA, 25 bp, Mus musculus
ccaggccatgttcaccaagggcaag

SEQ ID NO: 305942 - DNA, 25 bp, Mus musculus
gcgccttgtcgctgctctgaccttg

SEQ ID NO: 305943 - DNA, 25 bp, Mus musculus
tcgctgctctgaccttggggtctcc

SEQ ID NO: 305944 - DNA, 25 bp, Mus musculus
tgctctgaccttggggtctccggcc

SEQ ID NO: 305945 - DNA, 25 bp, Mus musculus
agcctgcgccagcgatggtcccgga

SEQ ID NO: 305946 - DNA, 25 bp, Mus musculus
ctcgacagcgcacggggaacccgga

SEQ ID NO: 305947 - DNA, 25 bp, Mus musculus
acccgcggcgatcagagaggaccag

SEQ ID NO: 305948 - DNA, 25 bp, Mus musculus
gggatgatcgctcacctgctagtcc

SEQ ID NO: 305949 - DNA, 25 bp, Mus musculus
tggctcgcgaggagagccaccctgc

SEQ ID NO: 305950 - DNA, 25 bp, Mus musculus
agacagacaagcggacgcacgccga

SEQ ID NO: 305951 - DNA, 25 bp, Mus musculus
acctgcggacgcctcgctacagaga

SEQ ID NO: 305952 - DNA, 25 bp, Mus musculus
gcggacgcctcgctacagagagcca

SEQ ID NO: 305953 - DNA, 25 bp, Mus musculus
tacagagagccacccacgcagacct

SEQ ID NO: 305954 - DNA, 25 bp, Mus musculus
gacctggaccggcacacacggacaa

SEQ ID NO: 305955 - DNA, 25 bp, Mus musculus
ctggaccggcacacacggacaaacg

SEQ ID NO: 305956 - DNA, 25 bp, Mus musculus
acattagcgaagctggccatgccga

SEQ ID NO: 305957 - DNA, 25 bp, Mus musculus
tgacattagcgaagctggccatgcc

SEQ ID NO: 305958 - DNA, 25 bp, Mus musculus
atgacattagcgaagctggccatgc

SEQ ID NO: 305959 - DNA, 25 bp, Mus musculus
tatgacattagcgaagctggccatg

SEQ ID NO: 305960 - DNA, 25 bp, Mus musculus
tctatgacattagcgaagctggcca

SEQ ID NO: 305961 - DNA, 25 bp, Mus musculus
catctatgacattagcgaagctggc

SEQ ID NO: 305962 - DNA, 25 bp, Mus musculus
ctcatctatgacattagcgaagctg

SEQ ID NO: 305963 - DNA, 25 bp, Mus musculus
gcctcatctatgacattagcgaagc

SEQ ID NO: 305964 - DNA, 25 bp, Mus musculus
ccagcctcatctatgacattagcga

SEQ ID NO: 305965 - DNA, 25 bp, Mus musculus
gccagcctcatctatgacattagcg

SEQ ID NO: 305966 - DNA, 25 bp, Mus musculus
tgccagcctcatctatgacattagc

SEQ ID NO: 305967 - DNA, 25 bp, Mus musculus
gatgccagcctcatctatgacatta

SEQ ID NO: 305968 - DNA, 25 bp, Mus musculus
cgatgccagcctcatctatgacatt

SEQ ID NO: 305969 - DNA, 25 bp, Mus musculus
gtcgatgccagcctcatctatgaca

SEQ ID NO: 305970 - DNA, 25 bp, Mus musculus
tggcgcttcaactctcccggaagtg

SEQ ID NO: 305971 - DNA, 25 bp, Mus musculus
cgtcggaatctccagtgatgagctc

SEQ ID NO: 305972 - DNA, 25 bp, Mus musculus
tagtcctcatctccctaacgtcgga

SEQ ID NO: 305973 - DNA, 25 bp, Mus musculus
gggcttcctttttagtcctcatctc

SEQ ID NO: 305974 - DNA, 25 bp, Mus musculus
cactatgcatcttccgggcttcctt

SEQ ID NO: 305975 - DNA, 25 bp, Mus musculus
tgacagtgtcccttccttagcgatg

SEQ ID NO: 305976 - DNA, 25 bp, Mus musculus
gcgacactgccgtcggctctggtac

SEQ ID NO: 305977 - DNA, 25 bp, Mus musculus
atggcggcccatcaccggcagaaca

SEQ ID NO: 305978 - DNA, 25 bp, Mus musculus
cggaagtgacgtcggagtgtcaaca

SEQ ID NO: 305979 - DNA, 25 bp, Mus musculus
aaccacagagtagggcgggacatcc

SEQ ID NO: 305980 - DNA, 25 bp, Mus musculus
cagtgatgagctcgctgacccgcac

SEQ ID NO: 305981 - DNA, 25 bp, Mus musculus
ttccttagcgatgggctttgcctcc

SEQ ID NO: 305982 - DNA, 25 bp, Mus musculus
tgtcaacatgcaagatggcggccca

SEQ ID NO: 305983 - DNA, 25 bp, Mus musculus
ctgtgctggaggaaatgacagtgtc

SEQ ID NO: 305984 - DNA, 25 bp, Mus musculus
ggttgccaaggacgcgcgcgcctta

SEQ ID NO: 305985 - DNA, 25 bp, Mus musculus
tgcgtgaactctgggccgcctgcgc

SEQ ID NO: 305986 - DNA, 25 bp, Mus musculus
cctctctcatggtgcgtgaactctg

SEQ ID NO: 305987 - DNA, 25 bp, Mus musculus
agcgatgactcctctctcatggtgc

SEQ ID NO: 305988 - DNA, 25 bp, Mus musculus
cagccatgagcagcgatgactcctc

SEQ ID NO: 305989 - DNA, 25 bp, Mus musculus
gggaatcccgctcagccggtcatca

SEQ ID NO: 305990 - DNA, 25 bp, Mus musculus
gcgccttagacttccggccgtgagc

SEQ ID NO: 305991 - DNA, 25 bp, Mus musculus
ccagcagccaggttgccaaggacgc

SEQ ID NO: 305992 - DNA, 25 bp, Mus musculus
aacaggccagcagccaggttgccaa

SEQ ID NO: 305993 - DNA, 25 bp, Mus musculus
ccggatgtcacagttcttagcaaca

SEQ ID NO: 305994 - DNA, 25 bp, Mus musculus
gcctagtcacgtggggccaggccac

SEQ ID NO: 305995 - DNA, 25 bp, Mus musculus
ccgctgctgcgtggcctagtcacgt

SEQ ID NO: 305996 - DNA, 25 bp, Mus musculus
gcggccagagctgggaatcccgctc

SEQ ID NO: 305997 - DNA, 25 bp, Mus musculus
gccctcccggatgtcacagttctta

SEQ ID NO: 305998 - DNA, 25 bp, Mus musculus
ccagtgctcatactaaccaagggga

SEQ ID NO: 305999 - DNA, 25 bp, Mus musculus
cgacaccatggactacagagcgctc

SEQ ID NO: 306000 - DNA, 25 bp, Mus musculus
gcggtgcccagaactctgctagtta

SEQ ID NO: 306001 - DNA, 25 bp, Mus musculus
ttcccacggggaactgactcagctt

SEQ ID NO: 306002 - DNA, 25 bp, Mus musculus
tagagagttccgtccctccagccgt

SEQ ID NO: 306003 - DNA, 25 bp, Mus musculus
cagccgtcttgatcttcagccttta

SEQ ID NO: 306004 - DNA, 25 bp, Mus musculus
atcccggctaaggaagcggtgccca

SEQ ID NO: 306005 - DNA, 25 bp, Mus musculus
gagcgctccagaacaaaacttcctg

SEQ ID NO: 306006 - DNA, 25 bp, Mus musculus
ttcctgtaccctaagcacgatctcg

SEQ ID NO: 306007 - DNA, 25 bp, Mus musculus
ccactctcgctttgaggcaggaatg

SEQ ID NO: 306008 - DNA, 25 bp, Mus musculus
cgacacacttctgaggctgacaatc

SEQ ID NO: 306009 - DNA, 25 bp, Mus musculus
gggcactcccggtaaagccaagctc

SEQ ID NO: 306010 - DNA, 25 bp, Mus musculus
cgggatctggactctaggactttaa

SEQ ID NO: 306011 - DNA, 25 bp, Mus musculus
tctcgccaactaccacgaatcggtg

SEQ ID NO: 306012 - DNA, 25 bp, Mus musculus
cgagcccggacctgctcctgtgtaa

SEQ ID NO: 306013 - DNA, 25 bp, Mus musculus
ccgaggagcccgcttcaggatggac

SEQ ID NO: 306014 - DNA, 25 bp, Mus musculus
gtgacctggacgctcccgaggagcc

SEQ ID NO: 306015 - DNA, 25 bp, Mus musculus
taaaggccacgtgacctggacgctc

SEQ ID NO: 306016 - DNA, 25 bp, Mus musculus
tgatgccgttaaaggccacgtgacc

SEQ ID NO: 306017 - DNA, 25 bp, Mus musculus
ggaaatagtagacggtgatgccgtt

SEQ ID NO: 306018 - DNA, 25 bp, Mus musculus
ccctggcaccgtgggaaatagtaga

SEQ ID NO: 306019 - DNA, 25 bp, Mus musculus
acactggtgaatccctggcaccgtg

SEQ ID NO: 306020 - DNA, 25 bp, Mus musculus
acggctgggcacactggtgaatccc

SEQ ID NO: 306021 - DNA, 25 bp, Mus musculus
agggtacagccaccacggctgggca

SEQ ID NO: 306022 - DNA, 25 bp, Mus musculus
ccgagaagccatgcccagggtacag

SEQ ID NO: 306023 - DNA, 25 bp, Mus musculus
aggtgctgtgccgagaagccatgcc

SEQ ID NO: 306024 - DNA, 25 bp, Mus musculus
actcagctaaggagaaaaggcggca

SEQ ID NO: 306025 - DNA, 25 bp, Mus musculus
cctgctcctgtgtaaactcagctaa

SEQ ID NO: 306026 - DNA, 25 bp, Mus musculus
cgtcagtggaaaactccggggctca

SEQ ID NO: 306027 - DNA, 25 bp, Mus musculus
cgcgctcggctcctaagatcgcgga

SEQ ID NO: 306028 - DNA, 25 bp, Mus musculus
ccagttcaccgaagccactcgtgtg

SEQ ID NO: 306029 - DNA, 25 bp, Mus musculus
cctaagctagcagggctcgcccagt

SEQ ID NO: 306030 - DNA, 25 bp, Mus musculus
ggaaccgtggcactcacctaagcta

SEQ ID NO: 306031 - DNA, 25 bp, Mus musculus
agctggagtgacagcgccactcacc

SEQ ID NO: 306032 - DNA, 25 bp, Mus musculus
tccggaggacccaagggagatcagc

SEQ ID NO: 306033 - DNA, 25 bp, Mus musculus
cgcctggacatctggggtaaccaca

SEQ ID NO: 306034 - DNA, 25 bp, Mus musculus
tctcaggcaactaggtcaaaaggaa

SEQ ID NO: 306035 - DNA, 25 bp, Mus musculus
cccggccacgcgagtaacttctgaa

SEQ ID NO: 306036 - DNA, 25 bp, Mus musculus
ggaggaagacgaccaatgtcacctg

SEQ ID NO: 306037 - DNA, 25 bp, Mus musculus
ggggtccgtgactcaccaagcctcg

SEQ ID NO: 306038 - DNA, 25 bp, Mus musculus
tgacggtgacaggtgaacatacgac

SEQ ID NO: 306039 - DNA, 25 bp, Mus musculus
cgccagatctccagtcgggctcgga

SEQ ID NO: 306040 - DNA, 25 bp, Mus musculus
tcaccttgacgacggccgtgggaac

SEQ ID NO: 306041 - DNA, 25 bp, Mus musculus
cagacgctggcaaggacagagcatc

SEQ ID NO: 306042 - DNA, 25 bp, Mus musculus
gcaaggacagagcatcgagggacca

SEQ ID NO: 306043 - DNA, 25 bp, Mus musculus
gagcatcgagggaccaggcgccctc

SEQ ID NO: 306044 - DNA, 25 bp, Mus musculus
accggcatccgtttggaatctggga

SEQ ID NO: 306045 - DNA, 25 bp, Mus musculus
gcgtctgctcgcagagccagccctg

SEQ ID NO: 306046 - DNA, 25 bp, Mus musculus
ctggcagcacgcctgccgggcgttt

SEQ ID NO: 306047 - DNA, 25 bp, Mus musculus
tgccgggcgtttcctggcaaccagc

SEQ ID NO: 306048 - DNA, 25 bp, Mus musculus
ggcaaccagccaccgcctgaacgtt

SEQ ID NO: 306049 - DNA, 25 bp, Mus musculus
ccgctctgcagcagcgctcacccgc

SEQ ID NO: 306050 - DNA, 25 bp, Mus musculus
gacgtcaccgtcaccttgacgacgg

SEQ ID NO: 306051 - DNA, 25 bp, Mus musculus
tgacgacggccgtgggaacacgccc

SEQ ID NO: 306052 - DNA, 25 bp, Mus musculus
cagaggacgaattccagacgctggc

SEQ ID NO: 306053 - DNA, 25 bp, Mus musculus
tgaacgttccgaactctacagcccg

SEQ ID NO: 306054 - DNA, 25 bp, Mus musculus
ctgcagtcgcaggatgtagaggaca

SEQ ID NO: 306055 - DNA, 25 bp, Mus musculus
gcggagtctcttgctgccaaccata

SEQ ID NO: 306056 - DNA, 25 bp, Mus musculus
tagctttcggggttcaccaaggcca

SEQ ID NO: 306057 - DNA, 25 bp, Mus musculus
ggcttccctgcaggcttctgcctta

SEQ ID NO: 306058 - DNA, 25 bp, Mus musculus
ttctaacggcaactgatgagagcgc

SEQ ID NO: 306059 - DNA, 25 bp, Mus musculus
tagaggacacggtggagacgctcat

SEQ ID NO: 306060 - DNA, 25 bp, Mus musculus
tgctgccaaccataaacggaggtgg

SEQ ID NO: 306061 - DNA, 25 bp, Mus musculus
gagccgcttgtctcgggtaatgaga

SEQ ID NO: 306062 - DNA, 25 bp, Mus musculus
cccggaaacatcgagccgcttgtct

SEQ ID NO: 306063 - DNA, 25 bp, Mus musculus
caccggaagcgggatctcacctttt

SEQ ID NO: 306064 - DNA, 25 bp, Mus musculus
ccggatacgctatgtcaccggaagc

SEQ ID NO: 306065 - DNA, 25 bp, Mus musculus
gatgagatctcgtcgccggatacgc

SEQ ID NO: 306066 - DNA, 25 bp, Mus musculus
cccagtgatcgagaaggcacgctcg

SEQ ID NO: 306067 - DNA, 25 bp, Mus musculus
caggggacagtgcttcgagaacatt

SEQ ID NO: 306068 - DNA, 25 bp, Mus musculus
tctgtgcagcgactgcagccgcgca

SEQ ID NO: 306069 - DNA, 25 bp, Mus musculus
tgccggccagtctcgaaatacaact

SEQ ID NO: 306070 - DNA, 25 bp, Mus musculus
ccctgtcggcaagatgctgggaaaa

SEQ ID NO: 306071 - DNA, 25 bp, Mus musculus
gcttactagcttcccgcgccatggg

SEQ ID NO: 306072 - DNA, 25 bp, Mus musculus
ttggtgagtctcacgtggagccctc

SEQ ID NO: 306073 - DNA, 25 bp, Mus musculus
ttagcctgctttgccattggctggc

SEQ ID NO: 306074 - DNA, 25 bp, Mus musculus
catacggcgttgttcttggtgagtc

SEQ ID NO: 306075 - DNA, 25 bp, Mus musculus
actcactgaatctgcgcgtgcgcca

SEQ ID NO: 306076 - DNA, 25 bp, Mus musculus
caggcgcgggccactttaacttccg

SEQ ID NO: 306077 - DNA, 25 bp, Mus musculus
aaagctacggactttccacgctcgc

SEQ ID NO: 306078 - DNA, 25 bp, Mus musculus
gtcactcagcggaccaaaagctacg

SEQ ID NO: 306079 - DNA, 25 bp, Mus musculus
gatcatggccgcctttgcgcaactc

SEQ ID NO: 306080 - DNA, 25 bp, Mus musculus
acagcgggcccactcactgaatctg

SEQ ID NO: 306081 - DNA, 25 bp, Mus musculus
gccagaggctttttccggagcggaa

SEQ ID NO: 306082 - DNA, 25 bp, Mus musculus
cctgtcacgtgatggaagcgaagcc

SEQ ID NO: 306083 - DNA, 25 bp, Mus musculus
cgaactggagtcgtcagaagggccc

SEQ ID NO: 306084 - DNA, 25 bp, Mus musculus
gtgcgcacgcactgtggtactctcc

SEQ ID NO: 306085 - DNA, 25 bp, Mus musculus
agtgacaggtctgttgccatcccgc

SEQ ID NO: 306086 - DNA, 25 bp, Mus musculus
ttctcccacttgtcagcgatggctg

SEQ ID NO: 306087 - DNA, 25 bp, Mus musculus
ttctcgccattgcagttgggactga

SEQ ID NO: 306088 - DNA, 25 bp, Mus musculus
ccagtcgctaagtcaacgtcacgtg

SEQ ID NO: 306089 - DNA, 25 bp, Mus musculus
ttgacgtcacgccaacagacccagt

SEQ ID NO: 306090 - DNA, 25 bp, Mus musculus
aagcgaagccaaccacggtcacgtg

SEQ ID NO: 306091 - DNA, 25 bp, Mus musculus
ccgtcaggtgattcgggtctaccaa

SEQ ID NO: 306092 - DNA, 25 bp, Mus musculus
caaacgaaatggatgggctcccgtc

SEQ ID NO: 306093 - DNA, 25 bp, Mus musculus
cacgtgataacggtcgctcggaaaa

SEQ ID NO: 306094 - DNA, 25 bp, Mus musculus
ccctgctccattgcgtcacgtgata

SEQ ID NO: 306095 - DNA, 25 bp, Mus musculus
gtggccgaccaaacccgtgagagaa

SEQ ID NO: 306096 - DNA, 25 bp, Mus musculus
gatctgcagcctcgggatcgcgcgc

SEQ ID NO: 306097 - DNA, 25 bp, Mus musculus
accttgctaagggatccgcgcaccg

SEQ ID NO: 306098 - DNA, 25 bp, Mus musculus
tcgacagagtcagatccgcctcttt

SEQ ID NO: 306099 - DNA, 25 bp, Mus musculus
ttagcctcgacagagtcagatccgc

SEQ ID NO: 306100 - DNA, 25 bp, Mus musculus
tggggtcttggacttagcctcgaca

SEQ ID NO: 306101 - DNA, 25 bp, Mus musculus
atccgcctctttccgtggctacggg

SEQ ID NO: 306102 - DNA, 25 bp, Mus musculus
ccgatggccacgtagcgctcgggat

SEQ ID NO: 306103 - DNA, 25 bp, Mus musculus
tgcgccgcgcaccttgctaagggat

SEQ ID NO: 306104 - DNA, 25 bp, Mus musculus
acatggccagcctgcctgtgcggag

SEQ ID NO: 306105 - DNA, 25 bp, Mus musculus
gctgcgggacatggccagcctgcct

SEQ ID NO: 306106 - DNA, 25 bp, Mus musculus
ccacgttgccgcaacttttggggtg

SEQ ID NO: 306107 - DNA, 25 bp, Mus musculus
gcccgcagctcgatgccatgcttcc

SEQ ID NO: 306108 - DNA, 25 bp, Mus musculus
caccggcgatctgcagcctcgggat

SEQ ID NO: 306109 - DNA, 25 bp, Mus musculus
ggctgtgagcctggccgccatccat

SEQ ID NO: 306110 - DNA, 25 bp, Mus musculus
cgtttctcgccgttgcacccggaag

SEQ ID NO: 306111 - DNA, 25 bp, Mus musculus
tgtcgcatgtccactatccagaacc

SEQ ID NO: 306112 - DNA, 25 bp, Mus musculus
attttgtgcgagaagccgcagcgcc

SEQ ID NO: 306113 - DNA, 25 bp, Mus musculus
gggcttccgccgcttcattgatttc

SEQ ID NO: 306114 - DNA, 25 bp, Mus musculus
attgatttccgtttctcgccgctgc

SEQ ID NO: 306115 - DNA, 25 bp, Mus musculus
cgctgcagcctcctgacacggtgat

SEQ ID NO: 306116 - DNA, 25 bp, Mus musculus
ggctaaatacgcggcgccggccatt

SEQ ID NO: 306117 - DNA, 25 bp, Mus musculus
accggcctcacactagtgtcgcatg

SEQ ID NO: 306118 - DNA, 25 bp, Mus musculus
cagaacctccaatctttcggtaagg

SEQ ID NO: 306119 - DNA, 25 bp, Mus musculus
atctttcggtaagggccagtggccg

SEQ ID NO: 306120 - DNA, 25 bp, Mus musculus
tgtctcggcgcccagaagatggcga

SEQ ID NO: 306121 - DNA, 25 bp, Mus musculus
gggaattctatcctctcaccggcct

SEQ ID NO: 306122 - DNA, 25 bp, Mus musculus
cgccggccattttgtgcgagaagcc

SEQ ID NO: 306123 - DNA, 25 bp, Mus musculus
cctcctgacacggtgatccgggcgg

SEQ ID NO: 306124 - DNA, 25 bp, Mus musculus
cccagtgagcatgcgtaaaagcacg

SEQ ID NO: 306125 - DNA, 25 bp, Mus musculus
gcatgcgtaaaagcacgcacgtttc

SEQ ID NO: 306126 - DNA, 25 bp, Mus musculus
tgtcataacccagtgagcatgcgta

SEQ ID NO: 306127 - DNA, 25 bp, Mus musculus
ccgccatgtcataacccagtgagca

SEQ ID NO: 306128 - DNA, 25 bp, Mus musculus
ggaaccgccatgtcataacccagtg

SEQ ID NO: 306129 - DNA, 25 bp, Mus musculus
agcgcggctcgcgtggaccgcacta

SEQ ID NO: 306130 - DNA, 25 bp, Mus musculus
cggccgtcgcgacgcccgtcttctg

SEQ ID NO: 306131 - DNA, 25 bp, Mus musculus
tcgaccaatcggtgggcacgctgga

SEQ ID NO: 306132 - DNA, 25 bp, Mus musculus
ggggcttctgccgacacatgcgcac

SEQ ID NO: 306133 - DNA, 25 bp, Mus musculus
tctgccgacacatgcgcacggcagg

SEQ ID NO: 306134 - DNA, 25 bp, Mus musculus
ggccctctctcttctcgctgagcgc

SEQ ID NO: 306135 - DNA, 25 bp, Mus musculus
gctgagcgccgccaacatggtgagt

SEQ ID NO: 306136 - DNA, 25 bp, Mus musculus
agtgtgtgtgccgagagctccgagt

SEQ ID NO: 306137 - DNA, 25 bp, Mus musculus
ccgtcgaccaatcggtgggcacgct

SEQ ID NO: 306138 - DNA, 25 bp, Mus musculus
gcgcacctctcagatcttcagagca

SEQ ID NO: 306139 - DNA, 25 bp, Mus musculus
gggcgcggagcatcatttctgtccc

SEQ ID NO: 306140 - DNA, 25 bp, Mus musculus
ccacgagtggacaatccgatgttgc

SEQ ID NO: 306141 - DNA, 25 bp, Mus musculus
agcgttcccagcctgccacgagtgg

SEQ ID NO: 306142 - DNA, 25 bp, Mus musculus
tgctgggtcagaagtgcaaccttcc

SEQ ID NO: 306143 - DNA, 25 bp, Mus musculus
tcggacgttgacttactgcgcccgg

SEQ ID NO: 306144 - DNA, 25 bp, Mus musculus
ccctgtagatagttcgggcgagtcg

SEQ ID NO: 306145 - DNA, 25 bp, Mus musculus
atgaggcctccggaactcctagagc

SEQ ID NO: 306146 - DNA, 25 bp, Mus musculus
tgttatcaccgagatgaggcctccg

SEQ ID NO: 306147 - DNA, 25 bp, Mus musculus
ttgtataatttctgcccggagcggg

SEQ ID NO: 306148 - DNA, 25 bp, Mus musculus
cttcagagcagatgcgcgggagtct

SEQ ID NO: 306149 - DNA, 25 bp, Mus musculus
cgccgtcagacactcgtgccttgta

SEQ ID NO: 306150 - DNA, 25 bp, Mus musculus
agcgggcaacgcttaccacctgctg

SEQ ID NO: 306151 - DNA, 25 bp, Mus musculus
tcctactccgctggaccgacaagtg

SEQ ID NO: 306152 - DNA, 25 bp, Mus musculus
ttcttctgggcttgatcccgggtta

SEQ ID NO: 306153 - DNA, 25 bp, Mus musculus
gccaagggaggtgtaaagaacgcca

SEQ ID NO: 306154 - DNA, 25 bp, Mus musculus
cctctggagaagcagaaaaggacga

SEQ ID NO: 306155 - DNA, 25 bp, Mus musculus
acacgcggagaggaagagttatata

SEQ ID NO: 306156 - DNA, 25 bp, Mus musculus
gagtctgtggagttgaaatcaggac

SEQ ID NO: 306157 - DNA, 25 bp, Mus musculus
gccagccggaatctgtctgggtccc

SEQ ID NO: 306158 - DNA, 25 bp, Mus musculus
cagctggccgccagccggaatctgt

SEQ ID NO: 306159 - DNA, 25 bp, Mus musculus
tgctatctgcaggatcccttgtgcc

SEQ ID NO: 306160 - DNA, 25 bp, Mus musculus
aagtcccgcgggactccgtctgcta

SEQ ID NO: 306161 - DNA, 25 bp, Mus musculus
ccctcggaaatactgtgccttcttt

SEQ ID NO: 306162 - DNA, 25 bp, Mus musculus
aggtgtaaagaacgccagagcgtgc

SEQ ID NO: 306163 - DNA, 25 bp, Mus musculus
agttatataaccctctggagaagca

SEQ ID NO: 306164 - DNA, 25 bp, Mus musculus
gggactccgtctgctatctgcagga

SEQ ID NO: 306165 - DNA, 25 bp, Mus musculus
ttgaaatcaggacacgcggagagga

SEQ ID NO: 306166 - DNA, 25 bp, Mus musculus
ttttctccctgcaacgacctgactg

SEQ ID NO: 306167 - DNA, 25 bp, Mus musculus
cccagcgcgtttgctttctgagcga

SEQ ID NO: 306168 - DNA, 25 bp, Mus musculus
gggaccagacttggaaccgacgctc

SEQ ID NO: 306169 - DNA, 25 bp, Mus musculus
gcctggcgacttgttctgagtgttg

SEQ ID NO: 306170 - DNA, 25 bp, Mus musculus
tggggtccgctccaagtgtttctcc

SEQ ID NO: 306171 - DNA, 25 bp, Mus musculus
gggacttgcccttagccagtaagtg

SEQ ID NO: 306172 - DNA, 25 bp, Mus musculus
gtcaccggccactcctggtgttgga

SEQ ID NO: 306173 - DNA, 25 bp, Mus musculus
cgacctgactgtgagtttgaatcca

SEQ ID NO: 306174 - DNA, 25 bp, Mus musculus
cgtggagcacgcacagacaaatttt

SEQ ID NO: 306175 - DNA, 25 bp, Mus musculus
cgtcagctcgtgtcctgtgaagccc

SEQ ID NO: 306176 - DNA, 25 bp, Mus musculus
atcttaagccctcgctcggtggcgg

SEQ ID NO: 306177 - DNA, 25 bp, Mus musculus
aaatcgctccttgtgcggcgccatc

SEQ ID NO: 306178 - DNA, 25 bp, Mus musculus
gtgccgcgccgcttataaatcgctc

SEQ ID NO: 306179 - DNA, 25 bp, Mus musculus
ttaagccgtggagtcgccaaacttg

SEQ ID NO: 306180 - DNA, 25 bp, Mus musculus
agcgtgcagtggtgatcagatccca

SEQ ID NO: 306181 - DNA, 25 bp, Mus musculus
tcccaccgggaaggcagcataatcg

SEQ ID NO: 306182 - DNA, 25 bp, Mus musculus
acggatcggcctctctagtcagagc

SEQ ID NO: 306183 - DNA, 25 bp, Mus musculus
tcaggaaacttctcggtctggagcc

SEQ ID NO: 306184 - DNA, 25 bp, Mus musculus
cggcgagcatccctcggtatttgaa

SEQ ID NO: 306185 - DNA, 25 bp, Mus musculus
agaccggaatcgtgggcagttctca

SEQ ID NO: 306186 - DNA, 25 bp, Mus musculus
ctggcctaaggggacactggaaact

SEQ ID NO: 306187 - DNA, 25 bp, Mus musculus
cttcgaacatgatctcgctggccta

SEQ ID NO: 306188 - DNA, 25 bp, Mus musculus
cgggactttgattggctgatcgcta

SEQ ID NO: 306189 - DNA, 25 bp, Mus musculus
tcaccatgacaacctgcgagacgcg

SEQ ID NO: 306190 - DNA, 25 bp, Mus musculus
ccacagcttggacagaggaaaccga

SEQ ID NO: 306191 - DNA, 25 bp, Mus musculus
cacctaagtggccttgggcactcta

SEQ ID NO: 306192 - DNA, 25 bp, Mus musculus
agccagtgcatcctttctagaaaga

SEQ ID NO: 306193 - DNA, 25 bp, Mus musculus
caggccctgcttggcgtttacacgc

SEQ ID NO: 306194 - DNA, 25 bp, Mus musculus
tcgccgcccgaacttcatgtaaatg

SEQ ID NO: 306195 - DNA, 25 bp, Mus musculus
cgcgcagcacccacattcccactcg

SEQ ID NO: 306196 - DNA, 25 bp, Mus musculus
tctggcgaccttcagagagcccggg

SEQ ID NO: 306197 - DNA, 25 bp, Mus musculus
acagtctggcgaccttcagagagcc

SEQ ID NO: 306198 - DNA, 25 bp, Mus musculus
cagcctcggtgacagtctggcgacc

SEQ ID NO: 306199 - DNA, 25 bp, Mus musculus
gcgccgcatgtactccagttctggg

SEQ ID NO: 306200 - DNA, 25 bp, Mus musculus
tgcaggatccgggacacccggaaag

SEQ ID NO: 306201 - DNA, 25 bp, Mus musculus
acaacgaatcggagcagcgacaccg

SEQ ID NO: 306202 - DNA, 25 bp, Mus musculus
gagcctcgcagtcccgggaacgtga

SEQ ID NO: 306203 - DNA, 25 bp, Mus musculus
ggcacccgcctacgctgagcctcgc

SEQ ID NO: 306204 - DNA, 25 bp, Mus musculus
cgcctcctgcgggtaagtcgctcga

SEQ ID NO: 306205 - DNA, 25 bp, Mus musculus
aacttcatgtaaatgacgtcgtgcg

SEQ ID NO: 306206 - DNA, 25 bp, Mus musculus
taagtcgctcgagctccgggcctgc

SEQ ID NO: 306207 - DNA, 25 bp, Mus musculus
gccgggccgacaacgaatcggagca

SEQ ID NO: 306208 - DNA, 25 bp, Mus musculus
ttaggcggctatccctacgccggga

SEQ ID NO: 306209 - DNA, 25 bp, Mus musculus
tgcccgagaagctgcagatcgtgaa

SEQ ID NO: 306210 - DNA, 25 bp, Mus musculus
tcctacctgcccgagaagctgcaga

SEQ ID NO: 306211 - DNA, 25 bp, Mus musculus
aagctgcagatcgtgaagccactcg

SEQ ID NO: 306212 - DNA, 25 bp, Mus musculus
tacgccgggagaactacctgtctga

SEQ ID NO: 306213 - DNA, 25 bp, Mus musculus
agtggctcgctcacgcccaccgaga

SEQ ID NO: 306214 - DNA, 25 bp, Mus musculus
cgagagcatcatgtccctgggaaca

SEQ ID NO: 306215 - DNA, 25 bp, Mus musculus
tgtccctgggaacacactcacgctt

SEQ ID NO: 306216 - DNA, 25 bp, Mus musculus
tgggaacacactcacgcttctccga

SEQ ID NO: 306217 - DNA, 25 bp, Mus musculus
acgcttctccgagttcacgggcttc

SEQ ID NO: 306218 - DNA, 25 bp, Mus musculus
ttctccgagttcacgggcttctctg

SEQ ID NO: 306219 - DNA, 25 bp, Mus musculus
ggcttctctggcatgtccttcagca

SEQ ID NO: 306220 - DNA, 25 bp, Mus musculus
ttctctggcatgtccttcagcagcc

SEQ ID NO: 306221 - DNA, 25 bp, Mus musculus
ttcacgggcttctctggcatgtcct

SEQ ID NO: 306222 - DNA, 25 bp, Mus musculus
ccgggtcagactggctcaaccgtag

SEQ ID NO: 306223 - DNA, 25 bp, Mus musculus
cacagaagtcggctgaggctgaaca

SEQ ID NO: 306224 - DNA, 25 bp, Mus musculus
gaagttcctagatgcgccctggcca

SEQ ID NO: 306225 - DNA, 25 bp, Mus musculus
taggactgccatcaccacgcacaga

SEQ ID NO: 306226 - DNA, 25 bp, Mus musculus
ccaaagtcccgcacacagaagtcgg

SEQ ID NO: 306227 - DNA, 25 bp, Mus musculus
caaagactggcctcagcgtgctcca

SEQ ID NO: 306228 - DNA, 25 bp, Mus musculus
cgaggagagtgaaccaaagactggc

SEQ ID NO: 306229 - DNA, 25 bp, Mus musculus
acgccgctcttcatggctatgggaa

SEQ ID NO: 306230 - DNA, 25 bp, Mus musculus
aagcctgacggggagcggacaccct

SEQ ID NO: 306231 - DNA, 25 bp, Mus musculus
agcttctgcagggactaccggctgc

SEQ ID NO: 306232 - DNA, 25 bp, Mus musculus
ctgctccacggggtccgtagcttct

SEQ ID NO: 306233 - DNA, 25 bp, Mus musculus
tatcgcgctagcagtgcgcccaggc

SEQ ID NO: 306234 - DNA, 25 bp, Mus musculus
tttgcggacctgctggatgtatcgc

SEQ ID NO: 306235 - DNA, 25 bp, Mus musculus
caaccgtagccaagcgaagttccta

SEQ ID NO: 306236 - DNA, 25 bp, Mus musculus
gggacactggcaccctgatcctagt

SEQ ID NO: 306237 - DNA, 25 bp, Mus musculus
ggcgctggaacattgacttctcgtc

SEQ ID NO: 306238 - DNA, 25 bp, Mus musculus
ggcttctcccttgtcgcagatggtt

SEQ ID NO: 306239 - DNA, 25 bp, Mus musculus
agatggttccaacagcgtgatccgc

SEQ ID NO: 306240 - DNA, 25 bp, Mus musculus
cagccctggaaagctgtggcccttc

SEQ ID NO: 306241 - DNA, 25 bp, Mus musculus
gtggcccttctagtccaagaatttg

SEQ ID NO: 306242 - DNA, 25 bp, Mus musculus
ctagcctggagctgtgcctcatagc

SEQ ID NO: 306243 - DNA, 25 bp, Mus musculus
cacctctagcgggactctgtgctca

SEQ ID NO: 306244 - DNA, 25 bp, Mus musculus
gcgaagggctctgagtcggtaaccc

SEQ ID NO: 306245 - DNA, 25 bp, Mus musculus
ggagccggcagctaaactccctgga

SEQ ID NO: 306246 - DNA, 25 bp, Mus musculus
ccgaagactggaggagctcactgcc

SEQ ID NO: 306247 - DNA, 25 bp, Mus musculus
cttggaaagtcatctgcacgggttc

SEQ ID NO: 306248 - DNA, 25 bp, Mus musculus
ccgagaggatgctcgctagctagca

SEQ ID NO: 306249 - DNA, 25 bp, Mus musculus
cacgggttccctaagacgtagcgcg

SEQ ID NO: 306250 - DNA, 25 bp, Mus musculus
tcttcacggcttcatgaattggccc

SEQ ID NO: 306251 - DNA, 25 bp, Mus musculus
gcccagggtcttcacggcttcatga

SEQ ID NO: 306252 - DNA, 25 bp, Mus musculus
cccacaatctgctgacggtgagttg

SEQ ID NO: 306253 - DNA, 25 bp, Mus musculus
gttgaggtgagaggtccccagtctc

SEQ ID NO: 306254 - DNA, 25 bp, Mus musculus
cagtctcaatctcctgacagcttcg

SEQ ID NO: 306255 - DNA, 25 bp, Mus musculus
tcaatctcctgacagcttcgctgcg

SEQ ID NO: 306256 - DNA, 25 bp, Mus musculus
tgacagcttcgctgcggggtctccc

SEQ ID NO: 306257 - DNA, 25 bp, Mus musculus
atagcggcggcttccagatggtgtc

SEQ ID NO: 306258 - DNA, 25 bp, Mus musculus
cggcttccagatggtgtccctcttc

SEQ ID NO: 306259 - DNA, 25 bp, Mus musculus
cagatggtgtccctcttctccctgt

SEQ ID NO: 306260 - DNA, 25 bp, Mus musculus
ctcttctccctgtccgaggtgacgg

SEQ ID NO: 306261 - DNA, 25 bp, Mus musculus
tctccctgtccgaggtgacggagga

SEQ ID NO: 306262 - DNA, 25 bp, Mus musculus
gaggagggcgtccacttccgctcgc

SEQ ID NO: 306263 - DNA, 25 bp, Mus musculus
tgcgggcaccgctaactttttctcc

SEQ ID NO: 306264 - DNA, 25 bp, Mus musculus
ggctggagctccaaatcacaacacc

SEQ ID NO: 306265 - DNA, 25 bp, Mus musculus
ttggcatctgcagggcgtcctgggc

SEQ ID NO: 306266 - DNA, 25 bp, Mus musculus
tcctgggctggagctccaaatcaca

SEQ ID NO: 306267 - DNA, 25 bp, Mus musculus
gagctccaaatcacaacacccgtgg

SEQ ID NO: 306268 - DNA, 25 bp, Mus musculus
tcacaacacccgtggggaggcagca

SEQ ID NO: 306269 - DNA, 25 bp, Mus musculus
cagcaacggcgtctcgtgcagcaca

SEQ ID NO: 306270 - DNA, 25 bp, Mus musculus
ggcgtctcgtgcagcacacaggtgt

SEQ ID NO: 306271 - DNA, 25 bp, Mus musculus
ccctggagcagaggtctgcagcgac

SEQ ID NO: 306272 - DNA, 25 bp, Mus musculus
aggtgtccatgctgacccgcgtcag

SEQ ID NO: 306273 - DNA, 25 bp, Mus musculus
gctcctccagcttccaagcggaggt

SEQ ID NO: 306274 - DNA, 25 bp, Mus musculus
ttccaagcggaggtctccctggtct

SEQ ID NO: 306275 - DNA, 25 bp, Mus musculus
gtctccctggtctgaccgccagagg

SEQ ID NO: 306276 - DNA, 25 bp, Mus musculus
tggtctgaccgccagaggccgccag

SEQ ID NO: 306277 - DNA, 25 bp, Mus musculus
gcacacaggtgtccatgctgacccg

SEQ ID NO: 306278 - DNA, 25 bp, Mus musculus
gcaggatgtggtgctcatgcgcaca

SEQ ID NO: 306279 - DNA, 25 bp, Mus musculus
ctgttctccagaggcgtctaggccc

SEQ ID NO: 306280 - DNA, 25 bp, Mus musculus
ctggagcggacagggctgttctcca

SEQ ID NO: 306281 - DNA, 25 bp, Mus musculus
tcacctcgagcggtgagaagaggct

SEQ ID NO: 306282 - DNA, 25 bp, Mus musculus
cacgtgcgagtctcacctcgagcgg

SEQ ID NO: 306283 - DNA, 25 bp, Mus musculus
ttgagtgaatctaccagggctggcc

SEQ ID NO: 306284 - DNA, 25 bp, Mus musculus
gacccgggaattgagtgaatctacc

SEQ ID NO: 306285 - DNA, 25 bp, Mus musculus
ccagttgttcagacccgggaattga

SEQ ID NO: 306286 - DNA, 25 bp, Mus musculus
gggcgtctctgctgtccagttgttc

SEQ ID NO: 306287 - DNA, 25 bp, Mus musculus
acagaccaatcgtggggcgtctctg

SEQ ID NO: 306288 - DNA, 25 bp, Mus musculus
ctaagcgacgccaaacagaccaatc

SEQ ID NO: 306289 - DNA, 25 bp, Mus musculus
gtgctcatgcgcacaccgtgagctc

SEQ ID NO: 306290 - DNA, 25 bp, Mus musculus
agcgggcagcgcatcccagccggta

SEQ ID NO: 306291 - DNA, 25 bp, Mus musculus
agctcccattcgctgctgctaagcg

SEQ ID NO: 306292 - DNA, 25 bp, Mus musculus
ctacgcggcaaagccaaggtcaatc

SEQ ID NO: 306293 - DNA, 25 bp, Mus musculus
gcagccttgggtgacaaaccgacga

SEQ ID NO: 306294 - DNA, 25 bp, Mus musculus
taggcttgcgtcagcagcgcgcgac

SEQ ID NO: 306295 - DNA, 25 bp, Mus musculus
tcgctcctgactggctacgcggcaa

SEQ ID NO: 306296 - DNA, 25 bp, Mus musculus
tgcgtccagtaagtgccactgggga

SEQ ID NO: 306297 - DNA, 25 bp, Mus musculus
tcaagagacaatccagcgggtgagc

SEQ ID NO: 306298 - DNA, 25 bp, Mus musculus
ccggagatttggtgcaggagcttcc

SEQ ID NO: 306299 - DNA, 25 bp, Mus musculus
cgcccgtctttcagctcctggagga

SEQ ID NO: 306300 - DNA, 25 bp, Mus musculus
ggaggagaatgaccagctgatccgc

SEQ ID NO: 306301 - DNA, 25 bp, Mus musculus
ctgatccgctgtatcgtggagtatc

SEQ ID NO: 306302 - DNA, 25 bp, Mus musculus
gagtatcagaataagggccgagcga

SEQ ID NO: 306303 - DNA, 25 bp, Mus musculus
gcgtcgcacccaatcagcgtcgagt

SEQ ID NO: 306304 - DNA, 25 bp, Mus musculus
ccgagcgaacgagtgcgtccagtaa

SEQ ID NO: 306305 - DNA, 25 bp, Mus musculus
gcatgtctgtcatcttcgctcctga

SEQ ID NO: 306306 - DNA, 25 bp, Mus musculus
cgcctgcatgcacgcgtcgccatgg

SEQ ID NO: 306307 - DNA, 25 bp, Mus musculus
cacgagagtctttcccgcgtggatc

SEQ ID NO: 306308 - DNA, 25 bp, Mus musculus
tactaaatctgggagccgaaggtgc

SEQ ID NO: 306309 - DNA, 25 bp, Mus musculus
acggctcccgcctggatttgaggac

SEQ ID NO: 306310 - DNA, 25 bp, Mus musculus
tcccgcctggatttgaggactatgc

SEQ ID NO: 306311 - DNA, 25 bp, Mus musculus
tttgaggactatgctggaagagctg

SEQ ID NO: 306312 - DNA, 25 bp, Mus musculus
tgctggaagagctgggactgaaaac

SEQ ID NO: 306313 - DNA, 25 bp, Mus musculus
tctcgcaggatgtggaaaagacagg

SEQ ID NO: 306314 - DNA, 25 bp, Mus musculus
actgaaaacaatgagacacggtctc

SEQ ID NO: 306315 - DNA, 25 bp, Mus musculus
acacggtctcgcaggatgtggaaaa

SEQ ID NO: 306316 - DNA, 25 bp, Mus musculus
cgcgtggatctgagactaaagggca

SEQ ID NO: 306317 - DNA, 25 bp, Mus musculus
tctttcccgcgtggatctgagacta

SEQ ID NO: 306318 - DNA, 25 bp, Mus musculus
gctgggactgaaaacaatgagacac

SEQ ID NO: 306319 - DNA, 25 bp, Mus musculus
ggtttcgagagctactaaatctggg

SEQ ID NO: 306320 - DNA, 25 bp, Mus musculus
gagacgaactctcgcgacgcttgcg

SEQ ID NO: 306321 - DNA, 25 bp, Mus musculus
gggagccttcccgagaatgtactgg

SEQ ID NO: 306322 - DNA, 25 bp, Mus musculus
tcgacatcgagatcaaccgggaacc

SEQ ID NO: 306323 - DNA, 25 bp, Mus musculus
gaccggccgcagtgtcacttcgaca

SEQ ID NO: 306324 - DNA, 25 bp, Mus musculus
ctgggaccagccaccatgaaagaga

SEQ ID NO: 306325 - DNA, 25 bp, Mus musculus
tgagccgtggttgacagctcgcaca

SEQ ID NO: 306326 - DNA, 25 bp, Mus musculus
gcgttccgttggtgacgttaggctc

SEQ ID NO: 306327 - DNA, 25 bp, Mus musculus
acgtctgcgcactcgggattggaca

SEQ ID NO: 306328 - DNA, 25 bp, Mus musculus
ctgcggccgcgatgtttggtttttt

SEQ ID NO: 306329 - DNA, 25 bp, Mus musculus
cgagaatgtactggctccgggagac

SEQ ID NO: 306330 - DNA, 25 bp, Mus musculus
aaatctcgcggtgctgcatgagtga

SEQ ID NO: 306331 - DNA, 25 bp, Mus musculus
tttttggaagtccagtgtgcagcca

SEQ ID NO: 306332 - DNA, 25 bp, Mus musculus
aaagagagaagtctcgcccggccgc

SEQ ID NO: 306333 - DNA, 25 bp, Mus musculus
tcttgcagaggagatgtattagtta

SEQ ID NO: 306334 - DNA, 25 bp, Mus musculus
ctcagagcaaaacgcgtgggaggcc

SEQ ID NO: 306335 - DNA, 25 bp, Mus musculus
cggcctggccctttaagcgtccaga

SEQ ID NO: 306336 - DNA, 25 bp, Mus musculus
accatggtacgcagggccctgcctg

SEQ ID NO: 306337 - DNA, 25 bp, Mus musculus
tctcccgagggcagctgcatcgaga

SEQ ID NO: 306338 - DNA, 25 bp, Mus musculus
tgggatcgagcggtccaaacgctcc

SEQ ID NO: 306339 - DNA, 25 bp, Mus musculus
gtccatcagagtcgcctggctcagg

SEQ ID NO: 306340 - DNA, 25 bp, Mus musculus
cccaggtaggttcgggagactcaga

SEQ ID NO: 306341 - DNA, 25 bp, Mus musculus
ttgctcggaggttctgcagccagag

SEQ ID NO: 306342 - DNA, 25 bp, Mus musculus
tctgaaaggcttccgtcgttgcggc

SEQ ID NO: 306343 - DNA, 25 bp, Mus musculus
ccaggtaggtcatctgaaaggcttc

SEQ ID NO: 306344 - DNA, 25 bp, Mus musculus
cacccggctgttccaggtaggtcat

SEQ ID NO: 306345 - DNA, 25 bp, Mus musculus
tgcgagcgcctcctttcagagcgca

SEQ ID NO: 306346 - DNA, 25 bp, Mus musculus
ctcgaccctatctgtccggtgtgca

SEQ ID NO: 306347 - DNA, 25 bp, Mus musculus
acttcccagcaaagaagggcagaga

SEQ ID NO: 306348 - DNA, 25 bp, Mus musculus
tgcagcagatcctcaacttcatcta

SEQ ID NO: 306349 - DNA, 25 bp, Mus musculus
tggccctgcacttcgcctgcttgat

SEQ ID NO: 306350 - DNA, 25 bp, Mus musculus
ttgatgggccgcctcaatgagcagc

SEQ ID NO: 306351 - DNA, 25 bp, Mus musculus
ctcttccagccagacctgtgcgatg

SEQ ID NO: 306352 - DNA, 25 bp, Mus musculus
cacacaagggtgtgctggccgccta

SEQ ID NO: 306353 - DNA, 25 bp, Mus musculus
ttcatctacacgtccaagctgctcg

SEQ ID NO: 306354 - DNA, 25 bp, Mus musculus
agctatctctggaggcactcgcgcc

SEQ ID NO: 306355 - DNA, 25 bp, Mus musculus
acctgtgcgatgtggacctagtgct

SEQ ID NO: 306356 - DNA, 25 bp, Mus musculus
ctggtgcctcagcatagcgtgttcc

SEQ ID NO: 306357 - DNA, 25 bp, Mus musculus
aggagctgctggacgctcgatcctt

SEQ ID NO: 306358 - DNA, 25 bp, Mus musculus
cagatggctgacatcgcggcctcct

SEQ ID NO: 306359 - DNA, 25 bp, Mus musculus
ggccaacgtgcacgaggtgctcagc

SEQ ID NO: 306360 - DNA, 25 bp, Mus musculus
gtccaagctgctcgtgaacgcggcc

SEQ ID NO: 306361 - DNA, 25 bp, Mus musculus
tgcagcgggtcgagctatctctgga

SEQ ID NO: 306362 - DNA, 25 bp, Mus musculus
cccacggtcttcgagagcgttcgct

SEQ ID NO: 306363 - DNA, 25 bp, Mus musculus
tccagcgacggcctcaacgtagaga

SEQ ID NO: 306364 - DNA, 25 bp, Mus musculus
tgtacacatcagagatcgcgctgga

SEQ ID NO: 306365 - DNA, 25 bp, Mus musculus
ggctgacgagctgatcgccatcatc

SEQ ID NO: 306366 - DNA, 25 bp, Mus musculus
acgacttcctgggactctcggctga

SEQ ID NO: 306367 - DNA, 25 bp, Mus musculus
aagcgcctgtgcttggccaattgcc

SEQ ID NO: 306368 - DNA, 25 bp, Mus musculus
tcaccatctgcgtgtcgtttctgca

SEQ ID NO: 306369 - DNA, 25 bp, Mus musculus
gaggcaagcgtgcaagacctgtttg

SEQ ID NO: 306370 - DNA, 25 bp, Mus musculus
tgtcgccagacgtagtgtcccaggt

SEQ ID NO: 306371 - DNA, 25 bp, Mus musculus
acggcctcaaggacatgctggacca

SEQ ID NO: 306372 - DNA, 25 bp, Mus musculus
cggaggaacagcgtctgtaccagca

SEQ ID NO: 306373 - DNA, 25 bp, Mus musculus
ctgcctcgtgctttcctggagactc

SEQ ID NO: 306374 - DNA, 25 bp, Mus musculus
agacgctcctgcaagacggcctcaa

SEQ ID NO: 306375 - DNA, 25 bp, Mus musculus
tgtcccaggtgctgcactacctgta

SEQ ID NO: 306376 - DNA, 25 bp, Mus musculus
gctcgtgcctgggagctacgtctaa

SEQ ID NO: 306377 - DNA, 25 bp, Mus musculus
agaaattgtacttgagcaggtcagc

SEQ ID NO: 306378 - DNA, 25 bp, Mus musculus
acggcaggtcaggaaaaggagactc

SEQ ID NO: 306379 - DNA, 25 bp, Mus musculus
cctgggagctacgtctaagacggca

SEQ ID NO: 306380 - DNA, 25 bp, Mus musculus
aaggagactcgactacgctctgtga

SEQ ID NO: 306381 - DNA, 25 bp, Mus musculus
cgactacgctctgtgagcccacggg

SEQ ID NO: 306382 - DNA, 25 bp, Mus musculus
ccctcacctgagcatggaagcggtc

SEQ ID NO: 306383 - DNA, 25 bp, Mus musculus
catggaagcggtcgaaggtcatgat

SEQ ID NO: 306384 - DNA, 25 bp, Mus musculus
tctaagacggcaggtcaggaaaagg

SEQ ID NO: 306385 - DNA, 25 bp, Mus musculus
gtcatgatgggtccgaagaagaaga

SEQ ID NO: 306386 - DNA, 25 bp, Mus musculus
gaagaagggcaagtagaaattgtac

SEQ ID NO: 306387 - DNA, 25 bp, Mus musculus
ctctccagggcgaagctggtgcacc

SEQ ID NO: 306388 - DNA, 25 bp, Mus musculus
acttgagcaggtcagcaagggagta

SEQ ID NO: 306389 - DNA, 25 bp, Mus musculus
tcgaaggtcatgatgggtccgaaga

SEQ ID NO: 306390 - DNA, 25 bp, Mus musculus
acgccggcatgtgctgccttggcaa

SEQ ID NO: 306391 - DNA, 25 bp, Mus musculus
tctttttcctgatccgctccggttc

SEQ ID NO: 306392 - DNA, 25 bp, Mus musculus
tgggtcgttcctctgcctcacgaac

SEQ ID NO: 306393 - DNA, 25 bp, Mus musculus
cgcgcggaaaacacgagtctgccca

SEQ ID NO: 306394 - DNA, 25 bp, Mus musculus
ccaaggagaggccattcgcagggtc

SEQ ID NO: 306395 - DNA, 25 bp, Mus musculus
attcgcagggtctatggtttggttt

SEQ ID NO: 306396 - DNA, 25 bp, Mus musculus
tggtttcccagtcttggcttctcgc

SEQ ID NO: 306397 - DNA, 25 bp, Mus musculus
ggctccactctaggcttccgattcg

SEQ ID NO: 306398 - DNA, 25 bp, Mus musculus
tcaccagggaaaccagcacggtcgc

SEQ ID NO: 306399 - DNA, 25 bp, Mus musculus
ttggtttcccgctctgtccctggct

SEQ ID NO: 306400 - DNA, 25 bp, Mus musculus
gctccggttcgatcctcgcttgact

SEQ ID NO: 306401 - DNA, 25 bp, Mus musculus
ctgcgcttcggggtctgtcttaagg

SEQ ID NO: 306402 - DNA, 25 bp, Mus musculus
gccttggcaaccgtcaccagggaaa

SEQ ID NO: 306403 - DNA, 25 bp, Mus musculus
aggcttccgattcggttcctcactc

SEQ ID NO: 306404 - DNA, 25 bp, Mus musculus
aattgcctcgaggttctcgcgaccg

SEQ ID NO: 306405 - DNA, 25 bp, Mus musculus
gcgaacgccacgcacgcaggctaga

SEQ ID NO: 306406 - DNA, 25 bp, Mus musculus
cagggtcacgtaaggtctgcgcaaa

SEQ ID NO: 306407 - DNA, 25 bp, Mus musculus
ccaccttcttgtgaccttgtccaga

SEQ ID NO: 306408 - DNA, 25 bp, Mus musculus
ttgtccagactcctagacccgtgcg

SEQ ID NO: 306409 - DNA, 25 bp, Mus musculus
ggctccacatgcactggccgacggg

SEQ ID NO: 306410 - DNA, 25 bp, Mus musculus
gcttcactcaccgagacgcggggtc

SEQ ID NO: 306411 - DNA, 25 bp, Mus musculus
gccagagactccctttacgtgcgag

SEQ ID NO: 306412 - DNA, 25 bp, Mus musculus
cacccgagtgcgagaacaccggctt

SEQ ID NO: 306413 - DNA, 25 bp, Mus musculus
aggggcattcgcattccgccacagc

SEQ ID NO: 306414 - DNA, 25 bp, Mus musculus
cccgttcccttgtcaggggcattcg

SEQ ID NO: 306415 - DNA, 25 bp, Mus musculus
ctgaaccttagtcgtgcttttgtga

SEQ ID NO: 306416 - DNA, 25 bp, Mus musculus
gacggctggcacacctgaaccttag

SEQ ID NO: 306417 - DNA, 25 bp, Mus musculus
tcctccatccggtgacacagggtca

SEQ ID NO: 306418 - DNA, 25 bp, Mus musculus
gttaacaagctgcaggacgccttca

SEQ ID NO: 306419 - DNA, 25 bp, Mus musculus
ggaagcaacggccacagacacatcg

SEQ ID NO: 306420 - DNA, 25 bp, Mus musculus
agagcaggaggaagcaacggccaca

SEQ ID NO: 306421 - DNA, 25 bp, Mus musculus
gtgtcgcctgagaaccggatgaggc

SEQ ID NO: 306422 - DNA, 25 bp, Mus musculus
acatcggaaccgagagtcttagtcg

SEQ ID NO: 306423 - DNA, 25 bp, Mus musculus
atcccgctggttaacaagctgcagg

SEQ ID NO: 306424 - DNA, 25 bp, Mus musculus
ggccacagacacatcggaaccgaga

SEQ ID NO: 306425 - DNA, 25 bp, Mus musculus
gacgccttcagctccatcggtcaga

SEQ ID NO: 306426 - DNA, 25 bp, Mus musculus
tccatcggtcagagctgccacctgg

SEQ ID NO: 306427 - DNA, 25 bp, Mus musculus
ggtcagagctgccacctggacctgc

SEQ ID NO: 306428 - DNA, 25 bp, Mus musculus
aatggcggaactgcggctcgcggac

SEQ ID NO: 306429 - DNA, 25 bp, Mus musculus
aagttcggtgctcgagaacttcgtg

SEQ ID NO: 306430 - DNA, 25 bp, Mus musculus
gcgccggcaaaagttcggtgctcga

SEQ ID NO: 306431 - DNA, 25 bp, Mus musculus
ggaggcggacaccatgggcaaccgc

SEQ ID NO: 306432 - DNA, 25 bp, Mus musculus
cgcaggtgttcctagtgtgcttgcc

SEQ ID NO: 306433 - DNA, 25 bp, Mus musculus
cttgggacccgcctctcggacctcg

SEQ ID NO: 306434 - DNA, 25 bp, Mus musculus
tggcgagctcaaactccggaacccg

SEQ ID NO: 306435 - DNA, 25 bp, Mus musculus
ctgctggcgagctcaaactccggaa

SEQ ID NO: 306436 - DNA, 25 bp, Mus musculus
gtgttcctagtgtgcttgccctgct

SEQ ID NO: 306437 - DNA, 25 bp, Mus musculus
acagggtgtcgcaggtgttcctagt

SEQ ID NO: 306438 - DNA, 25 bp, Mus musculus
ccacctgccgacagggtgtcgcagg

SEQ ID NO: 306439 - DNA, 25 bp, Mus musculus
gcccagctgcgccacagatgcccgc

SEQ ID NO: 306440 - DNA, 25 bp, Mus musculus
gcctcacctgaagccgggctctgtg

SEQ ID NO: 306441 - DNA, 25 bp, Mus musculus
ctgcagtccagggtcgggcaccaag

SEQ ID NO: 306442 - DNA, 25 bp, Mus musculus
gcgtctaccgccctgggtccggcaa

SEQ ID NO: 306443 - DNA, 25 bp, Mus musculus
aaggctccagccgaacggtccagtg

SEQ ID NO: 306444 - DNA, 25 bp, Mus musculus
gtcagaggcagtgaaggctccagcc

SEQ ID NO: 306445 - DNA, 25 bp, Mus musculus
gcttgccctgctggcgagctcaaac

SEQ ID NO: 306446 - DNA, 25 bp, Mus musculus
gccgcccgctcggtattatgattag

SEQ ID NO: 306447 - DNA, 25 bp, Mus musculus
atagctcggggacgcggttgtctac

SEQ ID NO: 306448 - DNA, 25 bp, Mus musculus
acgctgttcttttccgtagacatcg

SEQ ID NO: 306449 - DNA, 25 bp, Mus musculus
gagacgctgttcttttccgtagaca

SEQ ID NO: 306450 - DNA, 25 bp, Mus musculus
cgcgttaggagacgctgttcttttc

SEQ ID NO: 306451 - DNA, 25 bp, Mus musculus
gctcggattttttcgcgttaggaga

SEQ ID NO: 306452 - DNA, 25 bp, Mus musculus
ggactgctcggattttttcgcgtta

SEQ ID NO: 306453 - DNA, 25 bp, Mus musculus
gccgcctcacgatagctcggggacg

SEQ ID NO: 306454 - DNA, 25 bp, Mus musculus
acgcgagatccacgggcctcagttt

SEQ ID NO: 306455 - DNA, 25 bp, Mus musculus
ggaaagtaagttgcgcgctcggccc

SEQ ID NO: 306456 - DNA, 25 bp, Mus musculus
ccatcgctttcgtcacgatgacgca

SEQ ID NO: 306457 - DNA, 25 bp, Mus musculus
gtattatgattagccctgggtgcgg

SEQ ID NO: 306458 - DNA, 25 bp, Mus musculus
tcgtcacgatgacgcaaggcccgcg

SEQ ID NO: 306459 - DNA, 25 bp, Mus musculus
caggcggaaagtaagttgcgcgctc

SEQ ID NO: 306460 - DNA, 25 bp, Mus musculus
gaggaaaccagtcccgagcccagga

SEQ ID NO: 306461 - DNA, 25 bp, Mus musculus
cacgcgccgcacctcgggatttgtg

SEQ ID NO: 306462 - DNA, 25 bp, Mus musculus
cgcgccgcacctcgggatttgtgcg

SEQ ID NO: 306463 - DNA, 25 bp, Mus musculus
acctcgggatttgtgcgccccgcta

SEQ ID NO: 306464 - DNA, 25 bp, Mus musculus
ggggcaacatgaggcgccgggcaag

SEQ ID NO: 306465 - DNA, 25 bp, Mus musculus
cgccgggcaagggagcgaagaagga

SEQ ID NO: 306466 - DNA, 25 bp, Mus musculus
acctcgcacacctcccgtccgccac

SEQ ID NO: 306467 - DNA, 25 bp, Mus musculus
catggtggagggaaaaaccggagct

SEQ ID NO: 306468 - DNA, 25 bp, Mus musculus
ggagagcatggtggagggaaaaacc

SEQ ID NO: 306469 - DNA, 25 bp, Mus musculus
aagaaggagacaccgagctggagcc

SEQ ID NO: 306470 - DNA, 25 bp, Mus musculus
cccagcctcgccgggattgagggca

SEQ ID NO: 306471 - DNA, 25 bp, Mus musculus
ctggagcacagtcggagcgggcgtc

SEQ ID NO: 306472 - DNA, 25 bp, Mus musculus
tcggagcgggcgtcgcatcccgcgg

SEQ ID NO: 306473 - DNA, 25 bp, Mus musculus
cacacctccctcacctcgcacacct

SEQ ID NO: 306474 - DNA, 25 bp, Mus musculus
ctggacaaggacagcggctttgctt

SEQ ID NO: 306475 - DNA, 25 bp, Mus musculus
ggctttgcttactcgtggcaccggc

SEQ ID NO: 306476 - DNA, 25 bp, Mus musculus
accagcgatgacgactccgagagcc

SEQ ID NO: 306477 - DNA, 25 bp, Mus musculus
tgcagcagctctgagaccagcgatg

SEQ ID NO: 306478 - DNA, 25 bp, Mus musculus
agtgcacaagcgctaccaccgcagg

SEQ ID NO: 306479 - DNA, 25 bp, Mus musculus
tgcctcaccaggcacagtgcacaag

SEQ ID NO: 306480 - DNA, 25 bp, Mus musculus
ccggctgaagatgaacattgcctca

SEQ ID NO: 306481 - DNA, 25 bp, Mus musculus
tggacgagaacctgccgcccaagct

SEQ ID NO: 306482 - DNA, 25 bp, Mus musculus
acgacgagtttgacatggacgagaa

SEQ ID NO: 306483 - DNA, 25 bp, Mus musculus
accagatcttcgaggagggcgagtc

SEQ ID NO: 306484 - DNA, 25 bp, Mus musculus
ccagtgctcaaccagatcttcgagg

SEQ ID NO: 306485 - DNA, 25 bp, Mus musculus
tcgcctgacgtctcgcaagagtgcc

SEQ ID NO: 306486 - DNA, 25 bp, Mus musculus
gccggaagccatcggtcaccaatcg

SEQ ID NO: 306487 - DNA, 25 bp, Mus musculus
cgcccaagctgagccggctgaagat

SEQ ID NO: 306488 - DNA, 25 bp, Mus musculus
aaagcgcacaatgggcccggtcaga

SEQ ID NO: 306489 - DNA, 25 bp, Mus musculus
gctccaggcctgacgcaaatccaga

SEQ ID NO: 306490 - DNA, 25 bp, Mus musculus
tgttcacaaccctagagagaccgcg

SEQ ID NO: 306491 - DNA, 25 bp, Mus musculus
cgacacctatcacggaaagcgcaca

SEQ ID NO: 306492 - DNA, 25 bp, Mus musculus
ccgggatcccatggtcagtcagaga

SEQ ID NO: 306493 - DNA, 25 bp, Mus musculus
cccgaagtgtcaatcagagcagccc

SEQ ID NO: 306494 - DNA, 25 bp, Mus musculus
cagaaacctcagaccggatctgttc

SEQ ID NO: 306495 - DNA, 25 bp, Mus musculus
gtgaagcttcactggctgaccctcg

SEQ ID NO: 306496 - DNA, 25 bp, Mus musculus
tgaccagtgcttccgtggctctttc

SEQ ID NO: 306497 - DNA, 25 bp, Mus musculus
gacgcaaatccagagccggccgaca

SEQ ID NO: 306498 - DNA, 25 bp, Mus musculus
ggcggtgccttaacagttgtaagtc

SEQ ID NO: 306499 - DNA, 25 bp, Mus musculus
tgtgacacaatcaaggctaccgggc

SEQ ID NO: 306500 - DNA, 25 bp, Mus musculus
agagaccgcgaggtgtgacacaatc

SEQ ID NO: 306501 - DNA, 25 bp, Mus musculus
gctaaggcggactggatacacgacc

SEQ ID NO: 306502 - DNA, 25 bp, Mus musculus
cttcgaggtgtgtccctgcgcttgc

SEQ ID NO: 306503 - DNA, 25 bp, Mus musculus
tctctcgacccgtcggggcagacag

SEQ ID NO: 306504 - DNA, 25 bp, Mus musculus
aaagcggctgctgttgacggccgtc

SEQ ID NO: 306505 - DNA, 25 bp, Mus musculus
tgttgacggccgtcccggtgatccc

SEQ ID NO: 306506 - DNA, 25 bp, Mus musculus
ttaatggtcattattccgacggatg

SEQ ID NO: 306507 - DNA, 25 bp, Mus musculus
ttccgacggatgactacctaggctc

SEQ ID NO: 306508 - DNA, 25 bp, Mus musculus
actcggagcctcgcgggacagccga

SEQ ID NO: 306509 - DNA, 25 bp, Mus musculus
atcgtcccagcgggcggacgacgca

SEQ ID NO: 306510 - DNA, 25 bp, Mus musculus
tcgggctgaccttccttaccagtgc

SEQ ID NO: 306511 - DNA, 25 bp, Mus musculus
ggatgactacctaggctcccgcggc

SEQ ID NO: 306512 - DNA, 25 bp, Mus musculus
cagtcggcctgtcagccggcttcga

SEQ ID NO: 306513 - DNA, 25 bp, Mus musculus
tccagggcagtccacacgggcggaa

SEQ ID NO: 306514 - DNA, 25 bp, Mus musculus
cgggcggaatgacgcattaatggtc

SEQ ID NO: 306515 - DNA, 25 bp, Mus musculus
tccacacgggcggaatgacgcatta

SEQ ID NO: 306516 - DNA, 25 bp, Mus musculus
accggaaagctggaggctttgtcca

SEQ ID NO: 306517 - DNA, 25 bp, Mus musculus
ctcccgtgcacctttcaggaggtga

SEQ ID NO: 306518 - DNA, 25 bp, Mus musculus
gggcctccttgaatctcccgagtgg

SEQ ID NO: 306519 - DNA, 25 bp, Mus musculus
ttggggacactggagcttccaaacc

SEQ ID NO: 306520 - DNA, 25 bp, Mus musculus
acggggcagagacatatggacattg

SEQ ID NO: 306521 - DNA, 25 bp, Mus musculus
atggacattgacctgcctacggagc

SEQ ID NO: 306522 - DNA, 25 bp, Mus musculus
cctacggagcacattaggggtttgc

SEQ ID NO: 306523 - DNA, 25 bp, Mus musculus
ttgcggggactctacccacaactga

SEQ ID NO: 306524 - DNA, 25 bp, Mus musculus
accttggaggagtagtcaggttcca

SEQ ID NO: 306525 - DNA, 25 bp, Mus musculus
aaagcatgagaaggtagcggtccca

SEQ ID NO: 306526 - DNA, 25 bp, Mus musculus
tagcggtcccactgttgcagcaacc

SEQ ID NO: 306527 - DNA, 25 bp, Mus musculus
cgggaacgagacgacaggatcaatg

SEQ ID NO: 306528 - DNA, 25 bp, Mus musculus
aggatcaatgtggtgcctgccaggc

SEQ ID NO: 306529 - DNA, 25 bp, Mus musculus
ccgccacgcacggaaccaggtgagt

SEQ ID NO: 306530 - DNA, 25 bp, Mus musculus
gtgggccgccatcacctgaccgccc

SEQ ID NO: 306531 - DNA, 25 bp, Mus musculus
gactacctcggagggcgcgctcaga

SEQ ID NO: 306532 - DNA, 25 bp, Mus musculus
tgtgatccgaccacccgcggaggcg

SEQ ID NO: 306533 - DNA, 25 bp, Mus musculus
agtgggtaccctcggcaccctgtga

SEQ ID NO: 306534 - DNA, 25 bp, Mus musculus
agatgtccggccacctcagtgggta

SEQ ID NO: 306535 - DNA, 25 bp, Mus musculus
agcgatcagactacctcggagggcg

SEQ ID NO: 306536 - DNA, 25 bp, Mus musculus
gcgcgagcgatcagactacctcgga

SEQ ID NO: 306537 - DNA, 25 bp, Mus musculus
tcccaccgccctaccgggcgcgagc

SEQ ID NO: 306538 - DNA, 25 bp, Mus musculus
ctcctcgcagcagctgcccgggttc

SEQ ID NO: 306539 - DNA, 25 bp, Mus musculus
gcgtctgctcggttacaaatggccc

SEQ ID NO: 306540 - DNA, 25 bp, Mus musculus
gtggtagcgtctgctcggttacaaa

SEQ ID NO: 306541 - DNA, 25 bp, Mus musculus
ctactgcagcgggagttccaatcag

SEQ ID NO: 306542 - DNA, 25 bp, Mus musculus
cagcgggagttccaatcagagcgcg

SEQ ID NO: 306543 - DNA, 25 bp, Mus musculus
atgtccggccacctcagtgggtacc

SEQ ID NO: 306544 - DNA, 25 bp, Mus musculus
gtgggcagtagcctgtgtcctgcag

SEQ ID NO: 306545 - DNA, 25 bp, Mus musculus
accaaggagccagggtgcaaaggca

SEQ ID NO: 306546 - DNA, 25 bp, Mus musculus
ccgtctaggcttcccagagaggctg

SEQ ID NO: 306547 - DNA, 25 bp, Mus musculus
ctaggccgtctaggcttcccagaga

SEQ ID NO: 306548 - DNA, 25 bp, Mus musculus
aaggcaccacccgaggcctgaggaa

SEQ ID NO: 306549 - DNA, 25 bp, Mus musculus
accacccgaggcctgaggaagcgag

SEQ ID NO: 306550 - DNA, 25 bp, Mus musculus
ggtgcaaaggcaccacccgaggcct

SEQ ID NO: 306551 - DNA, 25 bp, Mus musculus
ggctctaggccgtctaggcttccca

SEQ ID NO: 306552 - DNA, 25 bp, Mus musculus
ttcctgtagtgtcgggtacagggtc

SEQ ID NO: 306553 - DNA, 25 bp, Mus musculus
ccacgtggccctcagccagttgccc

SEQ ID NO: 306554 - DNA, 25 bp, Mus musculus
tccgcttcctgtagtgtcgggtaca

SEQ ID NO: 306555 - DNA, 25 bp, Mus musculus
accgacttccgcttcctgtagtgtc

SEQ ID NO: 306556 - DNA, 25 bp, Mus musculus
cgagcccagcccaccgacttccgct

SEQ ID NO: 306557 - DNA, 25 bp, Mus musculus
ctgaggaagcgaggccttccgctga

SEQ ID NO: 306558 - DNA, 25 bp, Mus musculus
aggtcggtccgccttagccaatgag

SEQ ID NO: 306559 - DNA, 25 bp, Mus musculus
cttgccggccttgcgcaggcgttct

SEQ ID NO: 306560 - DNA, 25 bp, Mus musculus
ccttgcgcaggcgttctaggaggaa

SEQ ID NO: 306561 - DNA, 25 bp, Mus musculus
ccgccttagccaatgagcatggttc

SEQ ID NO: 306562 - DNA, 25 bp, Mus musculus
tagcggggtaaggacaccgctttga

SEQ ID NO: 306563 - DNA, 25 bp, Mus musculus
tcggaaacccgcagatagcggggta

SEQ ID NO: 306564 - DNA, 25 bp, Mus musculus
ccctcagacctagtcggccggaaga

SEQ ID NO: 306565 - DNA, 25 bp, Mus musculus
ccaatgagcatggttcgtgcggcct

SEQ ID NO: 306566 - DNA, 25 bp, Mus musculus
tcggccggaagaaccggcttgtgtc

SEQ ID NO: 306567 - DNA, 25 bp, Mus musculus
ccgacgtcctggctgggagccgctt

SEQ ID NO: 306568 - DNA, 25 bp, Mus musculus
cttgtgtctcccgaagctgccttcg

SEQ ID NO: 306569 - DNA, 25 bp, Mus musculus
aaccggcttgtgtctcccgaagctg

SEQ ID NO: 306570 - DNA, 25 bp, Mus musculus
agctgccttcggaaacccgcagata

SEQ ID NO: 306571 - DNA, 25 bp, Mus musculus
gctactcctttacctttgcttatcg

SEQ ID NO: 306572 - DNA, 25 bp, Mus musculus
cagaaccgccctgggccgtgacgcc

SEQ ID NO: 306573 - DNA, 25 bp, Mus musculus
tcctaatggctgttcgctcccaggg

SEQ ID NO: 306574 - DNA, 25 bp, Mus musculus
agcattcttcctaatggctgttcgc

SEQ ID NO: 306575 - DNA, 25 bp, Mus musculus
cacgccggagcactcagcattcttc

SEQ ID NO: 306576 - DNA, 25 bp, Mus musculus
cagccgctcaccgactcacgccgga

SEQ ID NO: 306577 - DNA, 25 bp, Mus musculus
cgggccaggtcaccgcaactgtgcc

SEQ ID NO: 306578 - DNA, 25 bp, Mus musculus
aatggctgttcgctcccagggccca

SEQ ID NO: 306579 - DNA, 25 bp, Mus musculus
tgctggacaacaccgctccgatcgt

SEQ ID NO: 306580 - DNA, 25 bp, Mus musculus
ggactgctggacaacaccgctccga

SEQ ID NO: 306581 - DNA, 25 bp, Mus musculus
ggacaccggactgctggacaacacc

SEQ ID NO: 306582 - DNA, 25 bp, Mus musculus
tcataatggcggacaccggactgct

SEQ ID NO: 306583 - DNA, 25 bp, Mus musculus
cgagagtcataatggcggacaccgg

SEQ ID NO: 306584 - DNA, 25 bp, Mus musculus
cagggcccacttcctccgcgggcct

SEQ ID NO: 306585 - DNA, 25 bp, Mus musculus
gctcctgcacccgacctcccagccg

SEQ ID NO: 306586 - DNA, 25 bp, Mus musculus
tctcaagactagcattggccggtgc

SEQ ID NO: 306587 - DNA, 25 bp, Mus musculus
gccggtgcggactgatagaaacact

SEQ ID NO: 306588 - DNA, 25 bp, Mus musculus
tagaaacactgctttctcccggcgg

SEQ ID NO: 306589 - DNA, 25 bp, Mus musculus
ttctcccggcgggaagcagaaatgt

SEQ ID NO: 306590 - DNA, 25 bp, Mus musculus
agcagaaatgtgaactcgccgtcct

SEQ ID NO: 306591 - DNA, 25 bp, Mus musculus
tgtgaactcgccgtcctggataggc

SEQ ID NO: 306592 - DNA, 25 bp, Mus musculus
cccactcctactgctggcaggagta

SEQ ID NO: 306593 - DNA, 25 bp, Mus musculus
ccacctcttatttcggcaaagctca

SEQ ID NO: 306594 - DNA, 25 bp, Mus musculus
tactgctggcaggagtagccacagg

SEQ ID NO: 306595 - DNA, 25 bp, Mus musculus
tagccacagggccagtgctacggcc

SEQ ID NO: 306596 - DNA, 25 bp, Mus musculus
tcaccctctactcacggggcgtgga

SEQ ID NO: 306597 - DNA, 25 bp, Mus musculus
tctcacctggtactcggtctcaaga

SEQ ID NO: 306598 - DNA, 25 bp, Mus musculus
cggcaaagctcattggcttcggctt

SEQ ID NO: 306599 - DNA, 25 bp, Mus musculus
tttaaggatttgtcctgcccacctc

SEQ ID NO: 306600 - DNA, 25 bp, Mus musculus
tcctcgtgttgtggtcgctcggctt

SEQ ID NO: 306601 - DNA, 25 bp, Mus musculus
gctaccgaggcaggaccgtgactct

SEQ ID NO: 306602 - DNA, 25 bp, Mus musculus
ttgttggctcccgtgcgtcagcgct

SEQ ID NO: 306603 - DNA, 25 bp, Mus musculus
gtcggctcgagttgttggctcccgt

SEQ ID NO: 306604 - DNA, 25 bp, Mus musculus
cgcagattagacgtgcagcgagacc

SEQ ID NO: 306605 - DNA, 25 bp, Mus musculus
ccgtcacgcatgacggtggcgacgc

SEQ ID NO: 306606 - DNA, 25 bp, Mus musculus
cgcgagctcgcagattagacgtgca

SEQ ID NO: 306607 - DNA, 25 bp, Mus musculus
ttagcactcggcacagtaaggaccg

SEQ ID NO: 306608 - DNA, 25 bp, Mus musculus
ggccgttgagccgtcacgcatgacg

SEQ ID NO: 306609 - DNA, 25 bp, Mus musculus
gagacctgccgcttagcactcggca

SEQ ID NO: 306610 - DNA, 25 bp, Mus musculus
tttcctagtgtcctggaggtgtgtg

SEQ ID NO: 306611 - DNA, 25 bp, Mus musculus
cgttgccatttcctagtgtcctgga

SEQ ID NO: 306612 - DNA, 25 bp, Mus musculus
cgccgtcgttgccatttcctagtgt

SEQ ID NO: 306613 - DNA, 25 bp, Mus musculus
gtgcagcgagacctgccgcttagca

SEQ ID NO: 306614 - DNA, 25 bp, Mus musculus
ttccgccgcggtcggcgcagactta

SEQ ID NO: 306615 - DNA, 25 bp, Mus musculus
tgaccgtggccgagtaactgaccgt

SEQ ID NO: 306616 - DNA, 25 bp, Mus musculus
gcggcagggcgcactgacacttgcc

SEQ ID NO: 306617 - DNA, 25 bp, Mus musculus
tgcgggctgtcgcagcgaatagaac

SEQ ID NO: 306618 - DNA, 25 bp, Mus musculus
agacccaggactgctgcgcgcacta

SEQ ID NO: 306619 - DNA, 25 bp, Mus musculus
ggctctaaaacggatccagaaggta

SEQ ID NO: 306620 - DNA, 25 bp, Mus musculus
cgggaacatggctctaaaacggatc

SEQ ID NO: 306621 - DNA, 25 bp, Mus musculus
tggccgagtaactgaccgtgcgcga

SEQ ID NO: 306622 - DNA, 25 bp, Mus musculus
cacgagcagcgggaacatggctcta

SEQ ID NO: 306623 - DNA, 25 bp, Mus musculus
cgtagagcgccgttcccggcgtgca

SEQ ID NO: 306624 - DNA, 25 bp, Mus musculus
ctagctacccacagcgcaccgcggc

SEQ ID NO: 306625 - DNA, 25 bp, Mus musculus
ctgaccgtgcgcgactccgtggtca

SEQ ID NO: 306626 - DNA, 25 bp, Mus musculus
cgcgactccgtggtcagacccagga

SEQ ID NO: 306627 - DNA, 25 bp, Mus musculus
tccagaaggtaagagtggcggaaac

SEQ ID NO: 306628 - DNA, 25 bp, Mus musculus
gtacgccctgggcattgggctccag

SEQ ID NO: 306629 - DNA, 25 bp, Mus musculus
ggggaccaggctctcccaggacgac

SEQ ID NO: 306630 - DNA, 25 bp, Mus musculus
ctgccaaggctctcggggaccaggc

SEQ ID NO: 306631 - DNA, 25 bp, Mus musculus
gacctgccaaggctctcggggacca

SEQ ID NO: 306632 - DNA, 25 bp, Mus musculus
tgtccagcatctcctgtgcggggtg

SEQ ID NO: 306633 - DNA, 25 bp, Mus musculus
tttgtccagcatctcctgtgcgggg

SEQ ID NO: 306634 - DNA, 25 bp, Mus musculus
gcctttgtccagcatctcctgtgcg

SEQ ID NO: 306635 - DNA, 25 bp, Mus musculus
tcctgggtctcaggggtgcctgcct

SEQ ID NO: 306636 - DNA, 25 bp, Mus musculus
tggctcccgtgggtggtgccgtcct

SEQ ID NO: 306637 - DNA, 25 bp, Mus musculus
ggctccaggagcgagtggctcccgt

SEQ ID NO: 306638 - DNA, 25 bp, Mus musculus
ccaggctctcccaggacgacccagc

SEQ ID NO: 306639 - DNA, 25 bp, Mus musculus
acgccctgggcattgggctccagga

SEQ ID NO: 306640 - DNA, 25 bp, Mus musculus
gcctgtgttcaagccccgctgtgtc

SEQ ID NO: 306641 - DNA, 25 bp, Mus musculus
gccggctttgttcggaggactgcgt

SEQ ID NO: 306642 - DNA, 25 bp, Mus musculus
cccgtcgattcctagagaggccggc

SEQ ID NO: 306643 - DNA, 25 bp, Mus musculus
agtctcatccgcgaagcggcaccgg

SEQ ID NO: 306644 - DNA, 25 bp, Mus musculus
ctggagtctcatccgcgaagcggca

SEQ ID NO: 306645 - DNA, 25 bp, Mus musculus
gactctggagtctcatccgcgaagc

SEQ ID NO: 306646 - DNA, 25 bp, Mus musculus
tgctgccgagagactctggagtctc

SEQ ID NO: 306647 - DNA, 25 bp, Mus musculus
tcctgtccggtcattgttctcagcc

SEQ ID NO: 306648 - DNA, 25 bp, Mus musculus
tgttctccaccgaccatcgcggggc

SEQ ID NO: 306649 - DNA, 25 bp, Mus musculus
gcaaggcacttcctgtccggtcatt

SEQ ID NO: 306650 - DNA, 25 bp, Mus musculus
tcgattcctagagaggccggcctgc

SEQ ID NO: 306651 - DNA, 25 bp, Mus musculus
gccctgggcaccgaggtgtacgacc

SEQ ID NO: 306652 - DNA, 25 bp, Mus musculus
ctgcctggcgggctaaagccctgcc

SEQ ID NO: 306653 - DNA, 25 bp, Mus musculus
ggcacttcctgtccggtcattgttc

SEQ ID NO: 306654 - DNA, 25 bp, Mus musculus
aagcccggcgcaaggcacttcctgt

SEQ ID NO: 306655 - DNA, 25 bp, Mus musculus
cccgttgctgccgagagactctgga

SEQ ID NO: 306656 - DNA, 25 bp, Mus musculus
gttggggcgccaaattcaaatctgc

SEQ ID NO: 306657 - DNA, 25 bp, Mus musculus
cacacgcagtgggaacccgagttcc

SEQ ID NO: 306658 - DNA, 25 bp, Mus musculus
ctgtcagttacgtcggcaccgagga

SEQ ID NO: 306659 - DNA, 25 bp, Mus musculus
caaatgtaagttgcgagcctgcctg

SEQ ID NO: 306660 - DNA, 25 bp, Mus musculus
caaatctgcggccatcttgaaggga

SEQ ID NO: 306661 - DNA, 25 bp, Mus musculus
agaccgtgttagtgacgccatccga

SEQ ID NO: 306662 - DNA, 25 bp, Mus musculus
cggacttctgacgtagaccgtgtta

SEQ ID NO: 306663 - DNA, 25 bp, Mus musculus
ggtacaaagtgtctgtcgcccgcgc

SEQ ID NO: 306664 - DNA, 25 bp, Mus musculus
ctcggcagacttggcagggtacaaa

SEQ ID NO: 306665 - DNA, 25 bp, Mus musculus
gctcatggtagttctggttctgacc

SEQ ID NO: 306666 - DNA, 25 bp, Mus musculus
cacttggttccgcttgctcatggta

SEQ ID NO: 306667 - DNA, 25 bp, Mus musculus
gggccgcacataggacacttggttc

SEQ ID NO: 306668 - DNA, 25 bp, Mus musculus
tgtagccgactctctctttgaagcg

SEQ ID NO: 306669 - DNA, 25 bp, Mus musculus
ggtcctggcgtaagcgaatctcgga

SEQ ID NO: 306670 - DNA, 25 bp, Mus musculus
ctttcatttgtaggctcggctcggc

SEQ ID NO: 306671 - DNA, 25 bp, Mus musculus
gcgtgttcaactgtctgtgcgccgg

SEQ ID NO: 306672 - DNA, 25 bp, Mus musculus
cgcttctggggcgtgttcaactgtc

SEQ ID NO: 306673 - DNA, 25 bp, Mus musculus
cgcctacagaaaggcgcgatgcggc

SEQ ID NO: 306674 - DNA, 25 bp, Mus musculus
tggagttacccgctcgcctacagaa

SEQ ID NO: 306675 - DNA, 25 bp, Mus musculus
agcacgcttccttcagtggcgcacg

SEQ ID NO: 306676 - DNA, 25 bp, Mus musculus
ggactccactgcagcagattcgcct

SEQ ID NO: 306677 - DNA, 25 bp, Mus musculus
gggctccagattcctttcatttgta

SEQ ID NO: 306678 - DNA, 25 bp, Mus musculus
gcagggtatgggctccagattcctt

SEQ ID NO: 306679 - DNA, 25 bp, Mus musculus
cgggtttgcacacgctgcagggtat

SEQ ID NO: 306680 - DNA, 25 bp, Mus musculus
gctctccttagtcgcgggtttgcac

SEQ ID NO: 306681 - DNA, 25 bp, Mus musculus
gccggagccgcaggctctccttagt

SEQ ID NO: 306682 - DNA, 25 bp, Mus musculus
ggcgcacggtcctcgctaccggatt

SEQ ID NO: 306683 - DNA, 25 bp, Mus musculus
ttaccctgactcacccgtggagtta

SEQ ID NO: 306684 - DNA, 25 bp, Mus musculus
tgcgaaggagaagcccatggagctc

SEQ ID NO: 306685 - DNA, 25 bp, Mus musculus
attcctagctcatcagggagcggcg

SEQ ID NO: 306686 - DNA, 25 bp, Mus musculus
cgagctgatgacacgccagcgcgcg

SEQ ID NO: 306687 - DNA, 25 bp, Mus musculus
aagcgaggccgagaaggtctacatc

SEQ ID NO: 306688 - DNA, 25 bp, Mus musculus
aggtctacatcgttcatggagtgca

SEQ ID NO: 306689 - DNA, 25 bp, Mus musculus
tcgggttgcgcgcttcccatccagt

SEQ ID NO: 306690 - DNA, 25 bp, Mus musculus
ccactgcactgaccgtcaatctgga

SEQ ID NO: 306691 - DNA, 25 bp, Mus musculus
cgcccgaggcttagtgctgcagcga

SEQ ID NO: 306692 - DNA, 25 bp, Mus musculus
tgtgcgtcctgtatgcctagatgtc

SEQ ID NO: 306693 - DNA, 25 bp, Mus musculus
gcctagatgtccacagctctcggga

SEQ ID NO: 306694 - DNA, 25 bp, Mus musculus
gctctcgggatggaggagattccta

SEQ ID NO: 306695 - DNA, 25 bp, Mus musculus
cgccttcctgaagtgtctcacgtgc

SEQ ID NO: 306696 - DNA, 25 bp, Mus musculus
gccgcgagtgcaggccatattgcgc

SEQ ID NO: 306697 - DNA, 25 bp, Mus musculus
tcaatctggaggcagctagcagtcc

SEQ ID NO: 306698 - DNA, 25 bp, Mus musculus
cgaacatctggctgggcctcaacga

SEQ ID NO: 306699 - DNA, 25 bp, Mus musculus
ggagacggagatcacgacgcaaccc

SEQ ID NO: 306700 - DNA, 25 bp, Mus musculus
caagtggttcgacaagcgatgccgc

SEQ ID NO: 306701 - DNA, 25 bp, Mus musculus
ctgtctggcgcagccaacggcaagt

SEQ ID NO: 306702 - DNA, 25 bp, Mus musculus
aaagccgagaactgcgccgccctgt

SEQ ID NO: 306703 - DNA, 25 bp, Mus musculus
acgacgcaacccgacggcggcaaag

SEQ ID NO: 306704 - DNA, 25 bp, Mus musculus
gcctacaagaactgggagacggaga

SEQ ID NO: 306705 - DNA, 25 bp, Mus musculus
cctcaacgacatggccgcggaaggc

SEQ ID NO: 306706 - DNA, 25 bp, Mus musculus
agcgtgggcaacgatgcgaacatct

SEQ ID NO: 306707 - DNA, 25 bp, Mus musculus
agtacgcgcgccacagcgtgggcaa

SEQ ID NO: 306708 - DNA, 25 bp, Mus musculus
agaacgaggcgctgttcgagtacgc

SEQ ID NO: 306709 - DNA, 25 bp, Mus musculus
cgagcgaggactgcatctcgcaagg

SEQ ID NO: 306710 - DNA, 25 bp, Mus musculus
cccgcagtcagagctagagaacgag

SEQ ID NO: 306711 - DNA, 25 bp, Mus musculus
cggcctcctggcctacaagaactgg

SEQ ID NO: 306712 - DNA, 25 bp, Mus musculus
tctccctagggcacgactgtggcct

SEQ ID NO: 306713 - DNA, 25 bp, Mus musculus
ccaccatctaggactgtgctaccag

SEQ ID NO: 306714 - DNA, 25 bp, Mus musculus
ctcagcaagagcgagggtgacccac

SEQ ID NO: 306715 - DNA, 25 bp, Mus musculus
gcctaggcaccgaaacgcagctgcg

SEQ ID NO: 306716 - DNA, 25 bp, Mus musculus
acgactgtggcctgtgtctgcgagt

SEQ ID NO: 306717 - DNA, 25 bp, Mus musculus
ctcggtctccctagggcacgactgt

SEQ ID NO: 306718 - DNA, 25 bp, Mus musculus
ccgcaggccgagtgggccatgactc

SEQ ID NO: 306719 - DNA, 25 bp, Mus musculus
gtgcgactgagaacccgcaggccga

SEQ ID NO: 306720 - DNA, 25 bp, Mus musculus
ccagcagtgcgactgagaacccgca

SEQ ID NO: 306721 - DNA, 25 bp, Mus musculus
cgcagcaggcgtgctgtgcccagca

SEQ ID NO: 306722 - DNA, 25 bp, Mus musculus
ctgtcccgcgcagcaggcgtgctgt

SEQ ID NO: 306723 - DNA, 25 bp, Mus musculus
ggccggccacaggttgctcttacct

SEQ ID NO: 306724 - DNA, 25 bp, Mus musculus
gtgctaccaggtccggatcgtgtaa

SEQ ID NO: 306725 - DNA, 25 bp, Mus musculus
cctcggtggcgcctaggcaccgaaa

SEQ ID NO: 306726 - DNA, 25 bp, Mus musculus
cttcagactccgctcgtcgaggttc

SEQ ID NO: 306727 - DNA, 25 bp, Mus musculus
tccaggctgaagtccaggcagcaga

SEQ ID NO: 306728 - DNA, 25 bp, Mus musculus
ccaggcagcagaagtgacgaggctc

SEQ ID NO: 306729 - DNA, 25 bp, Mus musculus
accagcgtagactcgatgggcttgc

SEQ ID NO: 306730 - DNA, 25 bp, Mus musculus
accagggtcatgaagcaggccacca

SEQ ID NO: 306731 - DNA, 25 bp, Mus musculus
ctccatgccgttgggcaggaagccg

SEQ ID NO: 306732 - DNA, 25 bp, Mus musculus
acgggccgcgatggcctcttcagac

SEQ ID NO: 306733 - DNA, 25 bp, Mus musculus
cagtgtattgggacgacaccggctc

SEQ ID NO: 306734 - DNA, 25 bp, Mus musculus
cgaggcggaactctgccagtgtatt

SEQ ID NO: 306735 - DNA, 25 bp, Mus musculus
ttcgttggtgaaggacgcattggcc

SEQ ID NO: 306736 - DNA, 25 bp, Mus musculus
tctgtcgttgcacgctgatgttgca

SEQ ID NO: 306737 - DNA, 25 bp, Mus musculus
agcgagctcagcatctgtcgttgca

SEQ ID NO: 306738 - DNA, 25 bp, Mus musculus
agcccacgcacaggcgcaggtcttg

SEQ ID NO: 306739 - DNA, 25 bp, Mus musculus
gcaatgatgggcaccggccagatga

SEQ ID NO: 306740 - DNA, 25 bp, Mus musculus
cccagagtgactggctgggtcttgc

SEQ ID NO: 306741 - DNA, 25 bp, Mus musculus
aagttgttgttttgccaacatggcg

SEQ ID NO: 306742 - DNA, 25 bp, Mus musculus
gctcaggaagacgagagacaagccc

SEQ ID NO: 306743 - DNA, 25 bp, Mus musculus
agacagagcctgagcgcagaaagcc

SEQ ID NO: 306744 - DNA, 25 bp, Mus musculus
tagcagctggccagacagagcctga

SEQ ID NO: 306745 - DNA, 25 bp, Mus musculus
gcagaaggtagcagctggccagaca

SEQ ID NO: 306746 - DNA, 25 bp, Mus musculus
cttgctcgtgtaatgcttggggaac

SEQ ID NO: 306747 - DNA, 25 bp, Mus musculus
cgggacaatccggtaagcagaattt

SEQ ID NO: 306748 - DNA, 25 bp, Mus musculus
tttcgataaagttgttgttttgcca

SEQ ID NO: 306749 - DNA, 25 bp, Mus musculus
cccgcatctcgcctttccctcttgg

SEQ ID NO: 306750 - DNA, 25 bp, Mus musculus
gtcagcgctgtctctcccgcatctc

SEQ ID NO: 306751 - DNA, 25 bp, Mus musculus
tttgtaccgatagcaggcgtagagg

SEQ ID NO: 306752 - DNA, 25 bp, Mus musculus
agcagaatttgtaccgatagcaggc

SEQ ID NO: 306753 - DNA, 25 bp, Mus musculus
ctgggtcttgctcgtgtaatgcttg

SEQ ID NO: 306754 - DNA, 25 bp, Mus musculus
tgccctgcccatctctccagagctg

SEQ ID NO: 306755 - DNA, 25 bp, Mus musculus
aacgtaggcgccttcacccggcctg

SEQ ID NO: 306756 - DNA, 25 bp, Mus musculus
tgtccgagcggccaagcattgcctc

SEQ ID NO: 306757 - DNA, 25 bp, Mus musculus
cggccaagcattgcctcctgaaacg

SEQ ID NO: 306758 - DNA, 25 bp, Mus musculus
tcctgaaacgccctgtggtacaaag

SEQ ID NO: 306759 - DNA, 25 bp, Mus musculus
cctgtggtacaaagggctgtggatc

SEQ ID NO: 306760 - DNA, 25 bp, Mus musculus
aagggctgtggatcaccgtggatca

SEQ ID NO: 306761 - DNA, 25 bp, Mus musculus
atcaccgtggatcaccggtcgccgg

SEQ ID NO: 306762 - DNA, 25 bp, Mus musculus
gtgccgggaaggctaagcaccgcct

SEQ ID NO: 306763 - DNA, 25 bp, Mus musculus
gggaaggctaagcaccgcctcccga

SEQ ID NO: 306764 - DNA, 25 bp, Mus musculus
cgcggtggcacaaagcgcctcggtt

SEQ ID NO: 306765 - DNA, 25 bp, Mus musculus
aagcgcctcggttcgcacaacgctg

SEQ ID NO: 306766 - DNA, 25 bp, Mus musculus
gcgtgtcatactgcggggcaccgcc

SEQ ID NO: 306767 - DNA, 25 bp, Mus musculus
ggcacaaagcgcctcggttcgcaca

SEQ ID NO: 306768 - DNA, 25 bp, Mus musculus
gcaatcaccagggaacgagtgtcca

SEQ ID NO: 306769 - DNA, 25 bp, Mus musculus
cagctgccgaggctagagtgcatta

SEQ ID NO: 306770 - DNA, 25 bp, Mus musculus
agtcgggccaccttccgataggctc

SEQ ID NO: 306771 - DNA, 25 bp, Mus musculus
agctaagagtcgctcctccgacgtc

SEQ ID NO: 306772 - DNA, 25 bp, Mus musculus
tccgacgtcttcattctgtagagta

SEQ ID NO: 306773 - DNA, 25 bp, Mus musculus
caagtctcgctgagccggctaccag

SEQ ID NO: 306774 - DNA, 25 bp, Mus musculus
gagtgcattaccgttcccagggatg

SEQ ID NO: 306775 - DNA, 25 bp, Mus musculus
ccgttcccagggatgctcagagacc

SEQ ID NO: 306776 - DNA, 25 bp, Mus musculus
gtaagccgaacctaaagcaatcacc

SEQ ID NO: 306777 - DNA, 25 bp, Mus musculus
acgagtgtccaaagccaagcgccta

SEQ ID NO: 306778 - DNA, 25 bp, Mus musculus
aaagccaagcgcctagggtcgctag

SEQ ID NO: 306779 - DNA, 25 bp, Mus musculus
tcctccgattccgagcgggaaggcg

SEQ ID NO: 306780 - DNA, 25 bp, Mus musculus
cagggcttcttgctctcgcgggagt

SEQ ID NO: 306781 - DNA, 25 bp, Mus musculus
tcagagaccggagtccgctttcctc

SEQ ID NO: 306782 - DNA, 25 bp, Mus musculus
tggcctccgggagaggcctttttca

SEQ ID NO: 306783 - DNA, 25 bp, Mus musculus
cggtttgttgaatgtcgcgactcag

SEQ ID NO: 306784 - DNA, 25 bp, Mus musculus
tgcagcgtaggccagtgtcccgcag

SEQ ID NO: 306785 - DNA, 25 bp, Mus musculus
tccagcctggctgcagcgtaggcca

SEQ ID NO: 306786 - DNA, 25 bp, Mus musculus
gcatctgaagctgtgagtcccgcgg

SEQ ID NO: 306787 - DNA, 25 bp, Mus musculus
ggccgcagcctacgagcatctgaag

SEQ ID NO: 306788 - DNA, 25 bp, Mus musculus
gggccaggccgaggctccttgacca

SEQ ID NO: 306789 - DNA, 25 bp, Mus musculus
tcgcagctcactggtttgtccgccg

SEQ ID NO: 306790 - DNA, 25 bp, Mus musculus
catcggaggcgtgcctcgcagctca

SEQ ID NO: 306791 - DNA, 25 bp, Mus musculus
ctccaatccgcgcatcggaggcgtg

SEQ ID NO: 306792 - DNA, 25 bp, Mus musculus
ctttctctgcaacgcgttacaccaa

SEQ ID NO: 306793 - DNA, 25 bp, Mus musculus
tcagtgcaaagctaccgggactccg

SEQ ID NO: 306794 - DNA, 25 bp, Mus musculus
aatgtcgcgactcagtgcaaagcta

SEQ ID NO: 306795 - DNA, 25 bp, Mus musculus
aggcctttttcaccgggcgtgctct

SEQ ID NO: 306796 - DNA, 25 bp, Mus musculus
ctcgggaccgcgagggtcaatttct

SEQ ID NO: 306797 - DNA, 25 bp, Mus musculus
gtcaatttcttagggcgacagtccc

SEQ ID NO: 306798 - DNA, 25 bp, Mus musculus
tcacgatccgtttgactggtgtttc

SEQ ID NO: 306799 - DNA, 25 bp, Mus musculus
ctggtgtttcaacttgcggtcggga

SEQ ID NO: 306800 - DNA, 25 bp, Mus musculus
ctgcaagttgcacgacaagttcctg

SEQ ID NO: 306801 - DNA, 25 bp, Mus musculus
tttcacacctctgtagacggcaccg

SEQ ID NO: 306802 - DNA, 25 bp, Mus musculus
ccttgaacttgaagcgcgtgggacc

SEQ ID NO: 306803 - DNA, 25 bp, Mus musculus
acctgctggagccacagttcggact

SEQ ID NO: 306804 - DNA, 25 bp, Mus musculus
ctaatctcattaacgcgcgcgcggg

SEQ ID NO: 306805 - DNA, 25 bp, Mus musculus
cgaacacgaactgcagcggatggcc

SEQ ID NO: 306806 - DNA, 25 bp, Mus musculus
ttgcccaaacccacggcgtaggaga

SEQ ID NO: 306807 - DNA, 25 bp, Mus musculus
ctccgccgtacatctggcacaggta

SEQ ID NO: 306808 - DNA, 25 bp, Mus musculus
gtgggaccgaacacttggccgagct

SEQ ID NO: 306809 - DNA, 25 bp, Mus musculus
cactgaggccgtgccttctccatgt

SEQ ID NO: 306810 - DNA, 25 bp, Mus musculus
ccgcgggtacattggctttgagatc

SEQ ID NO: 306811 - DNA, 25 bp, Mus musculus
ttgccaatggcaacagagaaatttc

SEQ ID NO: 306812 - DNA, 25 bp, Mus musculus
cttttcttgccacgctaacctgggg

SEQ ID NO: 306813 - DNA, 25 bp, Mus musculus
caaggccggaggaaggcttcagcaa

SEQ ID NO: 306814 - DNA, 25 bp, Mus musculus
cgaccaggacactcaccatggtggc

SEQ ID NO: 306815 - DNA, 25 bp, Mus musculus
aggttgtttagaagccgcgcgttgc

SEQ ID NO: 306816 - DNA, 25 bp, Mus musculus
ttgccaatgggaacggagacacgtg

SEQ ID NO: 306817 - DNA, 25 bp, Mus musculus
cacgctatcattggctctcagtgtc

SEQ ID NO: 306818 - DNA, 25 bp, Mus musculus
tggctttgagatccggaagtcccac

SEQ ID NO: 306819 - DNA, 25 bp, Mus musculus
gccctcgcttgcacgctatcattgg

SEQ ID NO: 306820 - DNA, 25 bp, Mus musculus
acggatgatgttgcgtaactggcta

SEQ ID NO: 306821 - DNA, 25 bp, Mus musculus
taactggctaatttccgcgggtaca

SEQ ID NO: 306822 - DNA, 25 bp, Mus musculus
aacggagacacgtgggccctcgctt

SEQ ID NO: 306823 - DNA, 25 bp, Mus musculus
tctcagtgtcacgtgacggatgatg

SEQ ID NO: 306824 - DNA, 25 bp, Mus musculus
gaacagtgttgagggtctttctacg

SEQ ID NO: 306825 - DNA, 25 bp, Mus musculus
tgcggcacttacacgctcgtgggtc

SEQ ID NO: 306826 - DNA, 25 bp, Mus musculus
agcttccgcgccgacgtccagaaag

SEQ ID NO: 306827 - DNA, 25 bp, Mus musculus
gcctgcgtattggagctaacctctc

SEQ ID NO: 306828 - DNA, 25 bp, Mus musculus
tgccggctccgatcttggaacagtg

SEQ ID NO: 306829 - DNA, 25 bp, Mus musculus
taggcgagcacagagccgactgcca

SEQ ID NO: 306830 - DNA, 25 bp, Mus musculus
gccgactgccatgaagcgcccagta

SEQ ID NO: 306831 - DNA, 25 bp, Mus musculus
atgcctcacggatggcctacaactc

SEQ ID NO: 306832 - DNA, 25 bp, Mus musculus
tacaactcccatcgggtgcaactgg

SEQ ID NO: 306833 - DNA, 25 bp, Mus musculus
caactggacggtggacgctaactac

SEQ ID NO: 306834 - DNA, 25 bp, Mus musculus
ccggcatgtctcacggcagacgtca

SEQ ID NO: 306835 - DNA, 25 bp, Mus musculus
gacgtcacttcctgaaactcgaaca

SEQ ID NO: 306836 - DNA, 25 bp, Mus musculus
ctcgaacaagcttcggatacccgga

SEQ ID NO: 306837 - DNA, 25 bp, Mus musculus
tccgctgggcagaaacgaaactttc

SEQ ID NO: 306838 - DNA, 25 bp, Mus musculus
cgactgagacgaataaatgaaataa

SEQ ID NO: 306839 - DNA, 25 bp, Mus musculus
ggagacgtcttctcaggaccccgtg

SEQ ID NO: 306840 - DNA, 25 bp, Mus musculus
tcagtcccctggtgtctggaagtgc

SEQ ID NO: 306841 - DNA, 25 bp, Mus musculus
cataatttgtgcagcagagggttga

SEQ ID NO: 306842 - DNA, 25 bp, Mus musculus
cgttcataatttgtgcagcagaggg

SEQ ID NO: 306843 - DNA, 25 bp, Mus musculus
ggtcgttcataatttgtgcagcaga

SEQ ID NO: 306844 - DNA, 25 bp, Mus musculus
cctggtcgttcataatttgtgcagc

SEQ ID NO: 306845 - DNA, 25 bp, Mus musculus
aaatgaaataaagagcgctggcggc

SEQ ID NO: 306846 - DNA, 25 bp, Mus musculus
tttcacgactgagacgaataaatga

SEQ ID NO: 306847 - DNA, 25 bp, Mus musculus
cctgatttcacgactgagacgaata

SEQ ID NO: 306848 - DNA, 25 bp, Mus musculus
cgccctgatttcacgactgagacga

SEQ ID NO: 306849 - DNA, 25 bp, Mus musculus
gtggccgccctgatttcacgactga

SEQ ID NO: 306850 - DNA, 25 bp, Mus musculus
tttcctggtcgttcataatttgtgc

SEQ ID NO: 306851 - DNA, 25 bp, Mus musculus
ggccgccctgatttcacgactgaga

SEQ ID NO: 306852 - DNA, 25 bp, Mus musculus
cccttggccgatgtgcgcgacacag

SEQ ID NO: 306853 - DNA, 25 bp, Mus musculus
atcgcgtgagctcctcgttcaaggc

SEQ ID NO: 306854 - DNA, 25 bp, Mus musculus
aggagccgcggcgactctgctgtcc

SEQ ID NO: 306855 - DNA, 25 bp, Mus musculus
gtcggcgctgcctgcgatcccttgt

SEQ ID NO: 306856 - DNA, 25 bp, Mus musculus
atcccttgtgttccagagtccagca

SEQ ID NO: 306857 - DNA, 25 bp, Mus musculus
cgggacccgagaatccacacggaca

SEQ ID NO: 306858 - DNA, 25 bp, Mus musculus
ccagagtccagcacattaacgagta

SEQ ID NO: 306859 - DNA, 25 bp, Mus musculus
agtccagcacattaacgagtatttg

SEQ ID NO: 306860 - DNA, 25 bp, Mus musculus
ttaacgagtatttgtggcacacgta

SEQ ID NO: 306861 - DNA, 25 bp, Mus musculus
agtatttgtggcacacgtagagagg

SEQ ID NO: 306862 - DNA, 25 bp, Mus musculus
ctttaaatcagggagcacaggcgcg

SEQ ID NO: 306863 - DNA, 25 bp, Mus musculus
gggtcgcgctttaaatcagggagca

SEQ ID NO: 306864 - DNA, 25 bp, Mus musculus
ccgagaatccacacggacagtctgg

SEQ ID NO: 306865 - DNA, 25 bp, Mus musculus
tgcctgcgatcccttgtgttccaga

SEQ ID NO: 306866 - DNA, 25 bp, Mus musculus
ctacttcctgtatcttgcgcttgcg

SEQ ID NO: 306867 - DNA, 25 bp, Mus musculus
gtccgtttcctattgtcttcctgtg

SEQ ID NO: 306868 - DNA, 25 bp, Mus musculus
ttgcgcttgcgcaggatctactctc

SEQ ID NO: 306869 - DNA, 25 bp, Mus musculus
aggatctactctccggcctttttca

SEQ ID NO: 306870 - DNA, 25 bp, Mus musculus
ctatgcgtttctactcggctgagga

SEQ ID NO: 306871 - DNA, 25 bp, Mus musculus
cagcggctcttaagagattctggtc

SEQ ID NO: 306872 - DNA, 25 bp, Mus musculus
ctcgagtggtcgagtccttgtcacc

SEQ ID NO: 306873 - DNA, 25 bp, Mus musculus
tccttgtcaccgcagctcttttttc

SEQ ID NO: 306874 - DNA, 25 bp, Mus musculus
actgttgctcttggcaccggccacg

SEQ ID NO: 306875 - DNA, 25 bp, Mus musculus
gtcacgtgaacctgggcttttgctc

SEQ ID NO: 306876 - DNA, 25 bp, Mus musculus
gatcctcgacgtgggtttcgttggc

SEQ ID NO: 306877 - DNA, 25 bp, Mus musculus
tggccgctggtggattctgcagaat

SEQ ID NO: 306878 - DNA, 25 bp, Mus musculus
tgcgacatcaacgacgacgagtttc

SEQ ID NO: 306879 - DNA, 25 bp, Mus musculus
tcttcctgtgggaaactacttcctg

SEQ ID NO: 306880 - DNA, 25 bp, Mus musculus
cagaagaaatcttcacgtaagcgta

SEQ ID NO: 306881 - DNA, 25 bp, Mus musculus
tcacgtaagcgtaagcgagacagcg

SEQ ID NO: 306882 - DNA, 25 bp, Mus musculus
gcgagacagcgaggccggctcctcc

SEQ ID NO: 306883 - DNA, 25 bp, Mus musculus
cctctctgtatcgacctgggtgctg

SEQ ID NO: 306884 - DNA, 25 bp, Mus musculus
gtctcggcctctctgtatcgacctg

SEQ ID NO: 306885 - DNA, 25 bp, Mus musculus
ctattgaccctgaaggctatcgagg

SEQ ID NO: 306886 - DNA, 25 bp, Mus musculus
ttttaccactattgaccctgaaggc

SEQ ID NO: 306887 - DNA, 25 bp, Mus musculus
ggctgtcctattttaccactattga

SEQ ID NO: 306888 - DNA, 25 bp, Mus musculus
aagagtacgcgtctcggcctctctg

SEQ ID NO: 306889 - DNA, 25 bp, Mus musculus
ccctgaaggctatcgaggagggcac

SEQ ID NO: 306890 - DNA, 25 bp, Mus musculus
ctggaggagatcgaagaggaggtcc

SEQ ID NO: 306891 - DNA, 25 bp, Mus musculus
gggtgctggctgtcctattttacca

SEQ ID NO: 306892 - DNA, 25 bp, Mus musculus
aggaggtccggcagaagaaatcttc

SEQ ID NO: 306893 - DNA, 25 bp, Mus musculus
ctctgtatcgacctgggtgctggct

SEQ ID NO: 306894 - DNA, 25 bp, Mus musculus
tgtgatccgagtgaggacgcaacgc

SEQ ID NO: 306895 - DNA, 25 bp, Mus musculus
ggcccgcgatccagtgtttgcagcg

SEQ ID NO: 306896 - DNA, 25 bp, Mus musculus
actcaaacagcaacgcgggcggcta

SEQ ID NO: 306897 - DNA, 25 bp, Mus musculus
tttgaggaacttcccactgctgcgg

SEQ ID NO: 306898 - DNA, 25 bp, Mus musculus
ttcaggggttaaaagagacgatgtc

SEQ ID NO: 306899 - DNA, 25 bp, Mus musculus
acgatgtcacatcggccgttccaag

SEQ ID NO: 306900 - DNA, 25 bp, Mus musculus
cccgctcagtgaggtgaagattttt

SEQ ID NO: 306901 - DNA, 25 bp, Mus musculus
cctagtactgggaatgactctgggc

SEQ ID NO: 306902 - DNA, 25 bp, Mus musculus
acaccgtgaggcttgcgagcccaga

SEQ ID NO: 306903 - DNA, 25 bp, Mus musculus
ctgccggagttgcaggtaaggcttt

SEQ ID NO: 306904 - DNA, 25 bp, Mus musculus
cgagcccagattcgcagccgagaca

SEQ ID NO: 306905 - DNA, 25 bp, Mus musculus
atgagcaccgcggatctgatgcgtc

SEQ ID NO: 306906 - DNA, 25 bp, Mus musculus
ggcagccgtcctgaactcggagagc

SEQ ID NO: 306907 - DNA, 25 bp, Mus musculus
ggtcgagaaatacaaccattcgtgc

SEQ ID NO: 306908 - DNA, 25 bp, Mus musculus
ttgtggagatcctgtgcgaaatttc

SEQ ID NO: 306909 - DNA, 25 bp, Mus musculus
cgcctctgagccatggcaattgtca

SEQ ID NO: 306910 - DNA, 25 bp, Mus musculus
atgacacttatctggacgcctctga

SEQ ID NO: 306911 - DNA, 25 bp, Mus musculus
cgcgcattgtgagctatgacactta

SEQ ID NO: 306912 - DNA, 25 bp, Mus musculus
tacgatcgtatagagtcgcgcattg

SEQ ID NO: 306913 - DNA, 25 bp, Mus musculus
gtcactcaggtgtgaggatcaatca

SEQ ID NO: 306914 - DNA, 25 bp, Mus musculus
gcgcttcggaaggagcggccatttt

SEQ ID NO: 306915 - DNA, 25 bp, Mus musculus
gtctcctgcaggactcaatcagcga

SEQ ID NO: 306916 - DNA, 25 bp, Mus musculus
ggatcgttcctacgtccgtctcctg

SEQ ID NO: 306917 - DNA, 25 bp, Mus musculus
ggctcagtagccagttgctcacctc

SEQ ID NO: 306918 - DNA, 25 bp, Mus musculus
cgtgcgtcgattgtcgggctatgaa

SEQ ID NO: 306919 - DNA, 25 bp, Mus musculus
gtcacacgtggccagtttgcgattg

SEQ ID NO: 306920 - DNA, 25 bp, Mus musculus
gcgcataagtctcattggatcgttc

SEQ ID NO: 306921 - DNA, 25 bp, Mus musculus
tgcgcatgcgtaaactggaaagctg

SEQ ID NO: 306922 - DNA, 25 bp, Mus musculus
agccattcccttgcttaacgcattc

SEQ ID NO: 306923 - DNA, 25 bp, Mus musculus
ttcttatcgcgcaccagacatcgtg

SEQ ID NO: 306924 - DNA, 25 bp, Mus musculus
ttacagtttcttatcgcgcaccaga

SEQ ID NO: 306925 - DNA, 25 bp, Mus musculus
cgataggtcgtttcttcctgccgga

SEQ ID NO: 306926 - DNA, 25 bp, Mus musculus
tcctgccggaaaagcaaattaccga

SEQ ID NO: 306927 - DNA, 25 bp, Mus musculus
tatccggttttagggtgagccattc

SEQ ID NO: 306928 - DNA, 25 bp, Mus musculus
gaacaggtcatttcattacagtttc

SEQ ID NO: 306929 - DNA, 25 bp, Mus musculus
cgcattccgcgcgtcctgaaagcgg

SEQ ID NO: 306930 - DNA, 25 bp, Mus musculus
cgcccggcggtcctaagtgcagtca

SEQ ID NO: 306931 - DNA, 25 bp, Mus musculus
cggtcctaagtgcagtcagcccgca

SEQ ID NO: 306932 - DNA, 25 bp, Mus musculus
accatccggttcttcccagcgggag

SEQ ID NO: 306933 - DNA, 25 bp, Mus musculus
ccgccacttcaatttttagaacagg

SEQ ID NO: 306934 - DNA, 25 bp, Mus musculus
gcttaacgcattccgcgcgtcctga

SEQ ID NO: 306935 - DNA, 25 bp, Mus musculus
ctctgcctgggcgtgggctatgcct

SEQ ID NO: 306936 - DNA, 25 bp, Mus musculus
ataaggctaggctttcccgagcgtc

SEQ ID NO: 306937 - DNA, 25 bp, Mus musculus
cgcctgagtaaagcggaatgcacgc

SEQ ID NO: 306938 - DNA, 25 bp, Mus musculus
gcctgattgttgatccgcagccttc

SEQ ID NO: 306939 - DNA, 25 bp, Mus musculus
tcagcagacgcgcaccgcaagttgg

SEQ ID NO: 306940 - DNA, 25 bp, Mus musculus
gctgggactcggacgaataaggcta

SEQ ID NO: 306941 - DNA, 25 bp, Mus musculus
gagctggcctcgaaacgcctgagta

SEQ ID NO: 306942 - DNA, 25 bp, Mus musculus
cgtcataggtaaggcggctcaggct

SEQ ID NO: 306943 - DNA, 25 bp, Mus musculus
gcgttccggactttgatgccatgtg

SEQ ID NO: 306944 - DNA, 25 bp, Mus musculus
gcactaaggcaaacgtggcgtcata

SEQ ID NO: 306945 - DNA, 25 bp, Mus musculus
gccatgtgttttaacctgcagtgca

SEQ ID NO: 306946 - DNA, 25 bp, Mus musculus
gcgtgctcgggctttggaagctaaa

SEQ ID NO: 306947 - DNA, 25 bp, Mus musculus
gtattttccggcctcaccctgcaag

SEQ ID NO: 306948 - DNA, 25 bp, Mus musculus
tggaagctaaacgttcgggccgctg

SEQ ID NO: 306949 - DNA, 25 bp, Mus musculus
tgcacctttaatggcggcagccctg

SEQ ID NO: 306950 - DNA, 25 bp, Mus musculus
cgcggccacagtaggagtaggccga

SEQ ID NO: 306951 - DNA, 25 bp, Mus musculus
acagagactctgtggacgtccacca

SEQ ID NO: 306952 - DNA, 25 bp, Mus musculus
actgtgggtagaagccgcggccaca

SEQ ID NO: 306953 - DNA, 25 bp, Mus musculus
gctccgtactgtgggtagaagccgc

SEQ ID NO: 306954 - DNA, 25 bp, Mus musculus
agccgattcgggtctccaaggctcc

SEQ ID NO: 306955 - DNA, 25 bp, Mus musculus
tctgtggacgtccaccaggagcccg

SEQ ID NO: 306956 - DNA, 25 bp, Mus musculus
ttgcgcagggctccagccatctgct

SEQ ID NO: 306957 - DNA, 25 bp, Mus musculus
ctccagccatctgctcgcgcacgtg

SEQ ID NO: 306958 - DNA, 25 bp, Mus musculus
ctaggtgaccagcgctgggtgccac

SEQ ID NO: 306959 - DNA, 25 bp, Mus musculus
gcgccgcgcatccagcagcgtgcgc

SEQ ID NO: 306960 - DNA, 25 bp, Mus musculus
tccacacgagggttggagccgattc

SEQ ID NO: 306961 - DNA, 25 bp, Mus musculus
tcgggtctccaaggctccgtactgt

SEQ ID NO: 306962 - DNA, 25 bp, Mus musculus
tccaaggctccgtactgtgggtaga

SEQ ID NO: 306963 - DNA, 25 bp, Mus musculus
cagcgtgcgctccacacgagggttg

SEQ ID NO: 306964 - DNA, 25 bp, Mus musculus
tcgctgcggcctgagcacgtcctag

SEQ ID NO: 306965 - DNA, 25 bp, Mus musculus
agcctccgccgtcccaggcgtcctg

SEQ ID NO: 306966 - DNA, 25 bp, Mus musculus
cccgatcagccctccgtcccactcg

SEQ ID NO: 306967 - DNA, 25 bp, Mus musculus
tcccactcgcctggcacgctcgagc

SEQ ID NO: 306968 - DNA, 25 bp, Mus musculus
cccgttggccgccagcagctggaag

SEQ ID NO: 306969 - DNA, 25 bp, Mus musculus
ccgggtgcaccatggcgtgaccgcc

SEQ ID NO: 306970 - DNA, 25 bp, Mus musculus
ctcagtcgccgcaagcttgcggagc

SEQ ID NO: 306971 - DNA, 25 bp, Mus musculus
ttggccgccagcagctggaagtctt

SEQ ID NO: 306972 - DNA, 25 bp, Mus musculus
cggtagcggcgactggaggtcaccc

SEQ ID NO: 306973 - DNA, 25 bp, Mus musculus
gccgcagcccagctcgagggcgggt

SEQ ID NO: 306974 - DNA, 25 bp, Mus musculus
tagggtctcagtcggctcctggcca

SEQ ID NO: 306975 - DNA, 25 bp, Mus musculus
ggcctgagcacgtcctagggtctca

SEQ ID NO: 306976 - DNA, 25 bp, Mus musculus
cttgcggagccagcgcggtagccac

SEQ ID NO: 306977 - DNA, 25 bp, Mus musculus
ttccagctgcaggccgggtgcacca

SEQ ID NO: 306978 - DNA, 25 bp, Mus musculus
gcggccgctctcactacctgttgat

SEQ ID NO: 306979 - DNA, 25 bp, Mus musculus
acggacccgggatgcgcttcctcct

SEQ ID NO: 306980 - DNA, 25 bp, Mus musculus
caagagggtccgaatgcagcctagc

SEQ ID NO: 306981 - DNA, 25 bp, Mus musculus
agggtccgaatgcagcctagcactc

SEQ ID NO: 306982 - DNA, 25 bp, Mus musculus
ggtccgaatgcagcctagcactctc

SEQ ID NO: 306983 - DNA, 25 bp, Mus musculus
aatgcagcctagcactctcggagcc

SEQ ID NO: 306984 - DNA, 25 bp, Mus musculus
cgccatctccagcactcgcccgtcc

SEQ ID NO: 306985 - DNA, 25 bp, Mus musculus
actacctgttgatcttgtgagcgaa

SEQ ID NO: 306986 - DNA, 25 bp, Mus musculus
gcggggcctgcacttcgacaccgct

SEQ ID NO: 306987 - DNA, 25 bp, Mus musculus
ccgctctcactacctgttgatcttg

SEQ ID NO: 306988 - DNA, 25 bp, Mus musculus
acttcgacaccgctcccagcccgcg

SEQ ID NO: 306989 - DNA, 25 bp, Mus musculus
ccagcccgcggaacgcaagacggga

SEQ ID NO: 306990 - DNA, 25 bp, Mus musculus
ccgcggaacgcaagacgggaatgac

SEQ ID NO: 306991 - DNA, 25 bp, Mus musculus
agacgggaatgacgcggggtcttct

SEQ ID NO: 306992 - DNA, 25 bp, Mus musculus
ttcaaccctgtcatagtgcacgcgc

SEQ ID NO: 306993 - DNA, 25 bp, Mus musculus
tcttacgggtgtgggcgccgccaac

SEQ ID NO: 306994 - DNA, 25 bp, Mus musculus
ccgcagaagactaggcgaggtgagc

SEQ ID NO: 306995 - DNA, 25 bp, Mus musculus
cgctgccaacactgacacccggatc

SEQ ID NO: 306996 - DNA, 25 bp, Mus musculus
gatccgcccacgaagttgctacggc

SEQ ID NO: 306997 - DNA, 25 bp, Mus musculus
caggatccgcccacgaagttgctac

SEQ ID NO: 306998 - DNA, 25 bp, Mus musculus
tggcaggtgcactcgctcctgggct

SEQ ID NO: 306999 - DNA, 25 bp, Mus musculus
tatcagcgggttggcaggtgcactc

SEQ ID NO: 307000 - DNA, 25 bp, Mus musculus
tagtgcacgcgcgtatcagcgggtt

SEQ ID NO: 307001 - DNA, 25 bp, Mus musculus
cctgtcatagtgcacgcgcgtatca

SEQ ID NO: 307002 - DNA, 25 bp, Mus musculus
ccaccgttcgcagagcttgccgggt

SEQ ID NO: 307003 - DNA, 25 bp, Mus musculus
gtgcggggaacccagaagagccagc

SEQ ID NO: 307004 - DNA, 25 bp, Mus musculus
cccagttcaaccctgtcatagtgca

SEQ ID NO: 307005 - DNA, 25 bp, Mus musculus
cgccgccaacggagccaggagatgg

SEQ ID NO: 307006 - DNA, 25 bp, Mus musculus
ccggcggtccagacttcatctcggt

SEQ ID NO: 307007 - DNA, 25 bp, Mus musculus
atcctttccctgtgggtccattgcg

SEQ ID NO: 307008 - DNA, 25 bp, Mus musculus
cagacttcatctcggtgtccgcctg

SEQ ID NO: 307009 - DNA, 25 bp, Mus musculus
gtgtccgcctgcctgaccagcgatc

SEQ ID NO: 307010 - DNA, 25 bp, Mus musculus
cgatctatctgactgttctacggcg

SEQ ID NO: 307011 - DNA, 25 bp, Mus musculus
ctatctgactgttctacggcgccgg

SEQ ID NO: 307012 - DNA, 25 bp, Mus musculus
ctgactgttctacggcgccgggacc

SEQ ID NO: 307013 - DNA, 25 bp, Mus musculus
ttttagcccggggagctgcccagcc

SEQ ID NO: 307014 - DNA, 25 bp, Mus musculus
cctggacacgcaggtccagaccatg

SEQ ID NO: 307015 - DNA, 25 bp, Mus musculus
tccagaccatggacatgggtccttc

SEQ ID NO: 307016 - DNA, 25 bp, Mus musculus
ggacatgggtccttctgatcctttc

SEQ ID NO: 307017 - DNA, 25 bp, Mus musculus
gtccttctgatcctttccctgtggg

SEQ ID NO: 307018 - DNA, 25 bp, Mus musculus
ttccctgtgggtccattgcggcgag

SEQ ID NO: 307019 - DNA, 25 bp, Mus musculus
acctcgatcacggagtctgcgcgga

SEQ ID NO: 307020 - DNA, 25 bp, Mus musculus
cagatgtacgtgaccctagtgttcc

SEQ ID NO: 307021 - DNA, 25 bp, Mus musculus
aagggctctcgcctggtgaaacctt

SEQ ID NO: 307022 - DNA, 25 bp, Mus musculus
ctagtgttccgcgtgaagggctctc

SEQ ID NO: 307023 - DNA, 25 bp, Mus musculus
acgtgaccctagtgttccgcgtgaa

SEQ ID NO: 307024 - DNA, 25 bp, Mus musculus
ccgcgtggcggagtatcgcaaccat

SEQ ID NO: 307025 - DNA, 25 bp, Mus musculus
tcgcaaccattggtcggacgtgctg

SEQ ID NO: 307026 - DNA, 25 bp, Mus musculus
cggacgtgctggctggctttctgac

SEQ ID NO: 307027 - DNA, 25 bp, Mus musculus
tcggtttgggtctcacagatgtacg

SEQ ID NO: 307028 - DNA, 25 bp, Mus musculus
tggtgaaaccttccctctgcctggc

SEQ ID NO: 307029 - DNA, 25 bp, Mus musculus
tcctctgatcggtttgggtctcaca

SEQ ID NO: 307030 - DNA, 25 bp, Mus musculus
aggcacagattaatcctctgatcgg

SEQ ID NO: 307031 - DNA, 25 bp, Mus musculus
cgcgttggctcgaaaggcacagatt

SEQ ID NO: 307032 - DNA, 25 bp, Mus musculus
agcctcccacgcgttggctcgaaag

SEQ ID NO: 307033 - DNA, 25 bp, Mus musculus
gctggctttctgacgggagcagcca

SEQ ID NO: 307034 - DNA, 25 bp, Mus musculus
tgccgctgcctcttcctgcaccgac

SEQ ID NO: 307035 - DNA, 25 bp, Mus musculus
ggtttgctaacctctcgatctccga

SEQ ID NO: 307036 - DNA, 25 bp, Mus musculus
cgccctcgactgaggtctgagccaa

SEQ ID NO: 307037 - DNA, 25 bp, Mus musculus
tcgactgaggtctgagccaacaccc

SEQ ID NO: 307038 - DNA, 25 bp, Mus musculus
gtgtgtcctccagggcgccagctat

SEQ ID NO: 307039 - DNA, 25 bp, Mus musculus
ttcctgcaccgactcccagtcaggg

SEQ ID NO: 307040 - DNA, 25 bp, Mus musculus
ttcccagctgtgtgtcctccagggc

SEQ ID NO: 307041 - DNA, 25 bp, Mus musculus
ctgattcccagctgtgtgtcctcca

SEQ ID NO: 307042 - DNA, 25 bp, Mus musculus
cacctgattcccagctgtgtgtcct

SEQ ID NO: 307043 - DNA, 25 bp, Mus musculus
cccagtcagggtccctcgccttcct

SEQ ID NO: 307044 - DNA, 25 bp, Mus musculus
agagccgcagaactgtgcccgccgt

SEQ ID NO: 307045 - DNA, 25 bp, Mus musculus
ctcgatctccgattgtcacctctag

SEQ ID NO: 307046 - DNA, 25 bp, Mus musculus
agggcgccagctatgtgctcctcgc

SEQ ID NO: 307047 - DNA, 25 bp, Mus musculus
gctaacctctcgatctccgattgtc

SEQ ID NO: 307048 - DNA, 25 bp, Mus musculus
tcagcggcactcagcaaatggcgga

SEQ ID NO: 307049 - DNA, 25 bp, Mus musculus
ctagttcgcgcctgagtgacagttc

SEQ ID NO: 307050 - DNA, 25 bp, Mus musculus
tcgtagattcacaactaaatcgtca

SEQ ID NO: 307051 - DNA, 25 bp, Mus musculus
tcgtcataaagcgtctgtggaagtg

SEQ ID NO: 307052 - DNA, 25 bp, Mus musculus
gacagtgcgggtttagttaagatga

SEQ ID NO: 307053 - DNA, 25 bp, Mus musculus
gttaagatgaagtgaaagaccgtcc

SEQ ID NO: 307054 - DNA, 25 bp, Mus musculus
tgaagtgaaagaccgtcctgtggtc

SEQ ID NO: 307055 - DNA, 25 bp, Mus musculus
taggcaaatggcagcgtgaatcgta

SEQ ID NO: 307056 - DNA, 25 bp, Mus musculus
agtgacagttcgataggcaaatggc

SEQ ID NO: 307057 - DNA, 25 bp, Mus musculus
ggacctggcaatgcgttacccaatg

SEQ ID NO: 307058 - DNA, 25 bp, Mus musculus
taaacggagggctggacctggcaat

SEQ ID NO: 307059 - DNA, 25 bp, Mus musculus
gagcattggcggctccaggtaaacg

SEQ ID NO: 307060 - DNA, 25 bp, Mus musculus
attggtcagcggcactcagcaaatg

SEQ ID NO: 307061 - DNA, 25 bp, Mus musculus
gcgttacccaatggcgggctagttc

SEQ ID NO: 307062 - DNA, 25 bp, Mus musculus
gcaggctacatgactttcgtgactc

SEQ ID NO: 307063 - DNA, 25 bp, Mus musculus
gcagcaccacgtggctgccctcttc

SEQ ID NO: 307064 - DNA, 25 bp, Mus musculus
ggcgtccaggagcactgcagaaagt

SEQ ID NO: 307065 - DNA, 25 bp, Mus musculus
ctgcagaaagtgaaatggatcctgt

SEQ ID NO: 307066 - DNA, 25 bp, Mus musculus
gcctggtgcaggctacatgactttc

SEQ ID NO: 307067 - DNA, 25 bp, Mus musculus
aatggatcctgtaggcggggaccca

SEQ ID NO: 307068 - DNA, 25 bp, Mus musculus
tgatagcgaggagaaccggacgcct

SEQ ID NO: 307069 - DNA, 25 bp, Mus musculus
ccggacgcctccgtcacctgcagct

SEQ ID NO: 307070 - DNA, 25 bp, Mus musculus
agctccagcggcacaaaactcgatg

SEQ ID NO: 307071 - DNA, 25 bp, Mus musculus
aaactcgatgtgtccgctgttggca

SEQ ID NO: 307072 - DNA, 25 bp, Mus musculus
tccgctgttggcagtgaacaccaga

SEQ ID NO: 307073 - DNA, 25 bp, Mus musculus
accagaaacgcacggagccgcggac

SEQ ID NO: 307074 - DNA, 25 bp, Mus musculus
gctacatgactttcgtgactcaccc

SEQ ID NO: 307075 - DNA, 25 bp, Mus musculus
tgaacaccagaaacgcacggagccg

SEQ ID NO: 307076 - DNA, 25 bp, Mus musculus
ccacgcactgtggtctgctggcagt

SEQ ID NO: 307077 - DNA, 25 bp, Mus musculus
cttcttctctttctggatgaccatc

SEQ ID NO: 307078 - DNA, 25 bp, Mus musculus
tgcgtccgcgggttccacacgaact

SEQ ID NO: 307079 - DNA, 25 bp, Mus musculus
aaaggcatcgccgagcggtcagcta

SEQ ID NO: 307080 - DNA, 25 bp, Mus musculus
gtggccgattaaggctcctccgaca

SEQ ID NO: 307081 - DNA, 25 bp, Mus musculus
aaagggatgccgaggcaccttcacc

SEQ ID NO: 307082 - DNA, 25 bp, Mus musculus
gggtgcaaaaccagacggctccaaa

SEQ ID NO: 307083 - DNA, 25 bp, Mus musculus
ggcagggagactccagtcagatata

SEQ ID NO: 307084 - DNA, 25 bp, Mus musculus
atgcaaagaggctgtagaacgcggc

SEQ ID NO: 307085 - DNA, 25 bp, Mus musculus
tcccgatccaaagcccgacagtggg

SEQ ID NO: 307086 - DNA, 25 bp, Mus musculus
agattagaccgctgattcggggccc

SEQ ID NO: 307087 - DNA, 25 bp, Mus musculus
agcggccagtcagagagattagacc

SEQ ID NO: 307088 - DNA, 25 bp, Mus musculus
cccgaaatccgagatgcaaagaggc

SEQ ID NO: 307089 - DNA, 25 bp, Mus musculus
ggctccaaaattcgagcgaaacgca

SEQ ID NO: 307090 - DNA, 25 bp, Mus musculus
gcccgcaccttgctggttcggtaat

SEQ ID NO: 307091 - DNA, 25 bp, Mus musculus
aatgaaggaaggtgtcggtagccgg

SEQ ID NO: 307092 - DNA, 25 bp, Mus musculus
cttgctggttcggtaatgaaggaag

SEQ ID NO: 307093 - DNA, 25 bp, Mus musculus
accttgctggttcggtaatgaagga

SEQ ID NO: 307094 - DNA, 25 bp, Mus musculus
gcaccttgctggttcggtaatgaag

SEQ ID NO: 307095 - DNA, 25 bp, Mus musculus
ccgcaccttgctggttcggtaatga

SEQ ID NO: 307096 - DNA, 25 bp, Mus musculus
agcgcccgcaccttgctggttcggt

SEQ ID NO: 307097 - DNA, 25 bp, Mus musculus
ccaactcatgcaccagccgctccag

SEQ ID NO: 307098 - DNA, 25 bp, Mus musculus
tccggacaccaactcatgcaccagc

SEQ ID NO: 307099 - DNA, 25 bp, Mus musculus
tcgcggtctccggacaccaactcat

SEQ ID NO: 307100 - DNA, 25 bp, Mus musculus
caggaaggcaggcacgaagccagga

SEQ ID NO: 307101 - DNA, 25 bp, Mus musculus
cgcgggctgtgggtacaaaggcccg

SEQ ID NO: 307102 - DNA, 25 bp, Mus musculus
caaaacgcgggctgtgggtacaaag

SEQ ID NO: 307103 - DNA, 25 bp, Mus musculus
cgcaccttgctggttcggtaatgaa

SEQ ID NO: 307104 - DNA, 25 bp, Mus musculus
ccgagcgctggccacggaatgacgt

SEQ ID NO: 307105 - DNA, 25 bp, Mus musculus
ctggccacggaatgacgtcacgctg

SEQ ID NO: 307106 - DNA, 25 bp, Mus musculus
gacggagctgccagtcagcagaaga

SEQ ID NO: 307107 - DNA, 25 bp, Mus musculus
tcacgggcgacacctgggaatcgcg

SEQ ID NO: 307108 - DNA, 25 bp, Mus musculus
ctccgcagctgagacatggtgagca

SEQ ID NO: 307109 - DNA, 25 bp, Mus musculus
ctgtgacgtgcgctcgggcagctcc

SEQ ID NO: 307110 - DNA, 25 bp, Mus musculus
cacgtgacgctgtgacgtgacgctg

SEQ ID NO: 307111 - DNA, 25 bp, Mus musculus
tctctgcgctgccacgtgacgctgt

SEQ ID NO: 307112 - DNA, 25 bp, Mus musculus
tgcctcgcggcggttccgctcggta

SEQ ID NO: 307113 - DNA, 25 bp, Mus musculus
tcttccggatgcctcgcggcggttc

SEQ ID NO: 307114 - DNA, 25 bp, Mus musculus
agaggcgggttcttccggatgcctc

SEQ ID NO: 307115 - DNA, 25 bp, Mus musculus
ccagtcagcagaagaggcgggttct

SEQ ID NO: 307116 - DNA, 25 bp, Mus musculus
aatgacgtcacgctggggctgcgtt

SEQ ID NO: 307117 - DNA, 25 bp, Mus musculus
tgagcacagggtcacgggcgacacc

SEQ ID NO: 307118 - DNA, 25 bp, Mus musculus
acgggcaagagcacaagaggacaaa

SEQ ID NO: 307119 - DNA, 25 bp, Mus musculus
acccaaggcccgcaacgggcaagag

SEQ ID NO: 307120 - DNA, 25 bp, Mus musculus
agcacaagaggacaaagaaggcgcc

SEQ ID NO: 307121 - DNA, 25 bp, Mus musculus
caagagcacaagaggacaaagaagg

SEQ ID NO: 307122 - DNA, 25 bp, Mus musculus
ggcaagagcacaagaggacaaagaa

SEQ ID NO: 307123 - DNA, 25 bp, Mus musculus
gcacaagaggacaaagaaggcgcca

SEQ ID NO: 307124 - DNA, 25 bp, Mus musculus
acatcgctcttaccgcccccgaaag

SEQ ID NO: 307125 - DNA, 25 bp, Mus musculus
ccgcaacgggcaagagcacaagagg

SEQ ID NO: 307126 - DNA, 25 bp, Mus musculus
caacgggcaagagcacaagaggaca

SEQ ID NO: 307127 - DNA, 25 bp, Mus musculus
cgcaacgggcaagagcacaagagga

SEQ ID NO: 307128 - DNA, 25 bp, Mus musculus
cccgcaacgggcaagagcacaagag

SEQ ID NO: 307129 - DNA, 25 bp, Mus musculus
gcccgcaacgggcaagagcacaaga

SEQ ID NO: 307130 - DNA, 25 bp, Mus musculus
ccaaggcccgcaacgggcaagagca

SEQ ID NO: 307131 - DNA, 25 bp, Mus musculus
cgggcaagagcacaagaggacaaag

SEQ ID NO: 307132 - DNA, 25 bp, Mus musculus
ttgaaatcctgggaacgagtcatga

SEQ ID NO: 307133 - DNA, 25 bp, Mus musculus
ctccgaccggaagtcgggcctgttg

SEQ ID NO: 307134 - DNA, 25 bp, Mus musculus
cctggccttgtcatgcatattaatg

SEQ ID NO: 307135 - DNA, 25 bp, Mus musculus
ggcttccctggccttgtcatgcata

SEQ ID NO: 307136 - DNA, 25 bp, Mus musculus
ttaatattcatgatccgcctccctc

SEQ ID NO: 307137 - DNA, 25 bp, Mus musculus
ctcggcgcgcttatgaatattaatg

SEQ ID NO: 307138 - DNA, 25 bp, Mus musculus
tgcaaatgagggctcatgaatattc

SEQ ID NO: 307139 - DNA, 25 bp, Mus musculus
tgaatattcatgactcgcccaagcc

SEQ ID NO: 307140 - DNA, 25 bp, Mus musculus
gcctgttggacgttccgcgcgtcct

SEQ ID NO: 307141 - DNA, 25 bp, Mus musculus
tagagctgagctcgcggtgactgac

SEQ ID NO: 307142 - DNA, 25 bp, Mus musculus
gccttccgccggatgtccgcggtga

SEQ ID NO: 307143 - DNA, 25 bp, Mus musculus
ggtgacggacgtcaccagggtccta

SEQ ID NO: 307144 - DNA, 25 bp, Mus musculus
gacaaaccggaagcgcggatgtctc

SEQ ID NO: 307145 - DNA, 25 bp, Mus musculus
atgaatattcacgacctcggcccga

SEQ ID NO: 307146 - DNA, 25 bp, Mus musculus
tgcgaccacggcctgtgacgtcacg

SEQ ID NO: 307147 - DNA, 25 bp, Mus musculus
gccgccgccgacagcggtgagaaac

SEQ ID NO: 307148 - DNA, 25 bp, Mus musculus
atcacgggaaatctgcggcaggagc

SEQ ID NO: 307149 - DNA, 25 bp, Mus musculus
catgactgcgagtgagcgccgcgac

SEQ ID NO: 307150 - DNA, 25 bp, Mus musculus
ctgtgtctgatgcaggggcatgacc

SEQ ID NO: 307151 - DNA, 25 bp, Mus musculus
gaccaagagcgaccttgagcatttg

SEQ ID NO: 307152 - DNA, 25 bp, Mus musculus
cagtgaccttgaccacgtggctttg

SEQ ID NO: 307153 - DNA, 25 bp, Mus musculus
atgttgttttccacaatgaggcagg

SEQ ID NO: 307154 - DNA, 25 bp, Mus musculus
ggatgaccacgaccacggcccatga

SEQ ID NO: 307155 - DNA, 25 bp, Mus musculus
cacagcctcggaccacggggaggac

SEQ ID NO: 307156 - DNA, 25 bp, Mus musculus
acatctgccgcgacgtggactgcga

SEQ ID NO: 307157 - DNA, 25 bp, Mus musculus
gtcatcctctggtacatctgccgcg

SEQ ID NO: 307158 - DNA, 25 bp, Mus musculus
ggtcgcccacagatgacgccacagg

SEQ ID NO: 307159 - DNA, 25 bp, Mus musculus
tgctggtcgcgctcttcatcttcgc

SEQ ID NO: 307160 - DNA, 25 bp, Mus musculus
gacttcttcgtgtttttttgcacca

SEQ ID NO: 307161 - DNA, 25 bp, Mus musculus
cgatttgcataaagcagcaggaacc

SEQ ID NO: 307162 - DNA, 25 bp, Mus musculus
aggcgccagggcgatttgcataaag

SEQ ID NO: 307163 - DNA, 25 bp, Mus musculus
gcgccagggcgatttgcataaagca

SEQ ID NO: 307164 - DNA, 25 bp, Mus musculus
cgtctgccaggtcgctgtccgagat

SEQ ID NO: 307165 - DNA, 25 bp, Mus musculus
ctgccaggtcgctgtccgagatgcc

SEQ ID NO: 307166 - DNA, 25 bp, Mus musculus
ccagggcgatttgcataaagcagca

SEQ ID NO: 307167 - DNA, 25 bp, Mus musculus
cggggccgggatgacttcttcgtgt

SEQ ID NO: 307168 - DNA, 25 bp, Mus musculus
tttgcaccaattagcatattttttg

SEQ ID NO: 307169 - DNA, 25 bp, Mus musculus
gcaccaattagcatattttttgggg

SEQ ID NO: 307170 - DNA, 25 bp, Mus musculus
ccacactcaccctggcccgcggcgt

SEQ ID NO: 307171 - DNA, 25 bp, Mus musculus
tgggcgtggcctcccacactcaccc

SEQ ID NO: 307172 - DNA, 25 bp, Mus musculus
cagcaggaaccagccggggccgggt

SEQ ID NO: 307173 - DNA, 25 bp, Mus musculus
tcgctgtccgagatgccgcctgtgg

SEQ ID NO: 307174 - DNA, 25 bp, Mus musculus
cggccctgtgtcacccgtgatatca

SEQ ID NO: 307175 - DNA, 25 bp, Mus musculus
tgacgctgagttccggcttccaagc

SEQ ID NO: 307176 - DNA, 25 bp, Mus musculus
atatgcagatgagcagactccgccc

SEQ ID NO: 307177 - DNA, 25 bp, Mus musculus
ggaggtgacgtcaccagccggccct

SEQ ID NO: 307178 - DNA, 25 bp, Mus musculus
cctccagggcgtcgcccaggttgaa

SEQ ID NO: 307179 - DNA, 25 bp, Mus musculus
atttgcatattctcatccggggagg

SEQ ID NO: 307180 - DNA, 25 bp, Mus musculus
cagctcgagctgatttgaatatgca

SEQ ID NO: 307181 - DNA, 25 bp, Mus musculus
atatcatttcctgtcaccgtgcgcc

SEQ ID NO: 307182 - DNA, 25 bp, Mus musculus
ccaggttgaagtcgtcactcgctga

SEQ ID NO: 307183 - DNA, 25 bp, Mus musculus
ggggcggggacaagattatcataaa

SEQ ID NO: 307184 - DNA, 25 bp, Mus musculus
atatgcaaatttagcgcctcattta

SEQ ID NO: 307185 - DNA, 25 bp, Mus musculus
gcgcctcatttacatatacagcatt

SEQ ID NO: 307186 - DNA, 25 bp, Mus musculus
tacagcatttacatccaatccgggc

SEQ ID NO: 307187 - DNA, 25 bp, Mus musculus
cccgggtatgtaaatgactcgattt

SEQ ID NO: 307188 - DNA, 25 bp, Mus musculus
gctcgcatactaaaccaggaggctg

SEQ ID NO: 307189 - DNA, 25 bp, Mus musculus
ggggcctcttcctgagcaccgcaaa

SEQ ID NO: 307190 - DNA, 25 bp, Mus musculus
gggcctcttcctgagcaccgcaaac

SEQ ID NO: 307191 - DNA, 25 bp, Mus musculus
ggcctcttcctgagcaccgcaaacc

SEQ ID NO: 307192 - DNA, 25 bp, Mus musculus
gcctcttcctgagcaccgcaaaccc

SEQ ID NO: 307193 - DNA, 25 bp, Mus musculus
cccgagctcgcatactaaaccagga

SEQ ID NO: 307194 - DNA, 25 bp, Mus musculus
ccgagctcgcatactaaaccaggag

SEQ ID NO: 307195 - DNA, 25 bp, Mus musculus
cgagctcgcatactaaaccaggagg

SEQ ID NO: 307196 - DNA, 25 bp, Mus musculus
tcgcatactaaaccaggaggctgac

SEQ ID NO: 307197 - DNA, 25 bp, Mus musculus
gagctcgcatactaaaccaggaggc

SEQ ID NO: 307198 - DNA, 25 bp, Mus musculus
agctcgcatactaaaccaggaggct

SEQ ID NO: 307199 - DNA, 25 bp, Mus musculus
ctcgcatactaaaccaggaggctga

SEQ ID NO: 307200 - DNA, 25 bp, Mus musculus
cgcatactaaaccaggaggctgacg

SEQ ID NO: 307201 - DNA, 25 bp, Mus musculus
gcatactaaaccaggaggctgacgc

SEQ ID NO: 307202 - DNA, 25 bp, Mus musculus
agctgggtcgctagcctagacgcct

SEQ ID NO: 307203 - DNA, 25 bp, Mus musculus
tgtttcagctgctgccgggccagtc

SEQ ID NO: 307204 - DNA, 25 bp, Mus musculus
tcagggctctgtttcagctgctgcc

SEQ ID NO: 307205 - DNA, 25 bp, Mus musculus
gggtcgctagcctagacgcctgcgc

SEQ ID NO: 307206 - DNA, 25 bp, Mus musculus
aatgtggaagccctgacgcgctggc

SEQ ID NO: 307207 - DNA, 25 bp, Mus musculus
caagagaatgtggaagccctgacgc

SEQ ID NO: 307208 - DNA, 25 bp, Mus musculus
tttccctcacggtggcggagaccaa

SEQ ID NO: 307209 - DNA, 25 bp, Mus musculus
cgaaaccctcccgtggcgatcgtgg

SEQ ID NO: 307210 - DNA, 25 bp, Mus musculus
agagtgcaagagaatgtggaagccc

SEQ ID NO: 307211 - DNA, 25 bp, Mus musculus
cgtggcgatcgtgggagttaaccct

SEQ ID NO: 307212 - DNA, 25 bp, Mus musculus
tggtcttgacccttagaaccttcga

SEQ ID NO: 307213 - DNA, 25 bp, Mus musculus
ttctggagcttggtcttgaccctta

SEQ ID NO: 307214 - DNA, 25 bp, Mus musculus
ctacaaggtgagacggcgcgtcgac

SEQ ID NO: 307215 - DNA, 25 bp, Mus musculus
tccaacggggccttctacaaggtga

SEQ ID NO: 307216 - DNA, 25 bp, Mus musculus
ttctgagccgactcctcaacgcgtg

SEQ ID NO: 307217 - DNA, 25 bp, Mus musculus
ttcgggttggaaaaagcgcagagcc

SEQ ID NO: 307218 - DNA, 25 bp, Mus musculus
taaactgcacaggaggcctcagctc

SEQ ID NO: 307219 - DNA, 25 bp, Mus musculus
caacgcgtgctgttctgaggtccgt

SEQ ID NO: 307220 - DNA, 25 bp, Mus musculus
gcgtttccacgtgtttctgttctga

SEQ ID NO: 307221 - DNA, 25 bp, Mus musculus
cccgtgacggcgacagatacaatgg

SEQ ID NO: 307222 - DNA, 25 bp, Mus musculus
atccggtctctctccgcgtgtgaaa

SEQ ID NO: 307223 - DNA, 25 bp, Mus musculus
cgtcagcgtgactctgaggccatcc

SEQ ID NO: 307224 - DNA, 25 bp, Mus musculus
gcaaacctcttttcacgtcagcgtg

SEQ ID NO: 307225 - DNA, 25 bp, Mus musculus
atgtcggatctggtgctgataatca

SEQ ID NO: 307226 - DNA, 25 bp, Mus musculus
gtcgggagccaaactatcaaacgca

SEQ ID NO: 307227 - DNA, 25 bp, Mus musculus
gttgccgtgtcagtcaacgcgttta

SEQ ID NO: 307228 - DNA, 25 bp, Mus musculus
ttacaaaccggtcctcacactatgg

SEQ ID NO: 307229 - DNA, 25 bp, Mus musculus
tccgtgggatcgagtaagttttaga

SEQ ID NO: 307230 - DNA, 25 bp, Mus musculus
ggagacatccgcaaccgccaacacg

SEQ ID NO: 307231 - DNA, 25 bp, Mus musculus
actaccaggcgtccatggaggccgc

SEQ ID NO: 307232 - DNA, 25 bp, Mus musculus
agcaagccctcctgctggagcagca

SEQ ID NO: 307233 - DNA, 25 bp, Mus musculus
ctggagcagcagcggatccaccagc

SEQ ID NO: 307234 - DNA, 25 bp, Mus musculus
ccaccagctgaggaactaccaggcg

SEQ ID NO: 307235 - DNA, 25 bp, Mus musculus
tgcaacgcgggccacagtgggcaca

SEQ ID NO: 307236 - DNA, 25 bp, Mus musculus
acaggtaacacgtggcctttgtgca

SEQ ID NO: 307237 - DNA, 25 bp, Mus musculus
tcacgacaggtaacacgtggccttt

SEQ ID NO: 307238 - DNA, 25 bp, Mus musculus
aagccgaggttcacgacaggtaaca

SEQ ID NO: 307239 - DNA, 25 bp, Mus musculus
gctgaggaactaccaggcgtccatg

SEQ ID NO: 307240 - DNA, 25 bp, Mus musculus
ccaccaagccgaggttcacgacagg

SEQ ID NO: 307241 - DNA, 25 bp, Mus musculus
gcgcagtcctcacccgcgtctgcca

SEQ ID NO: 307242 - DNA, 25 bp, Mus musculus
accttccccgtgtctgtgcaggagc

SEQ ID NO: 307243 - DNA, 25 bp, Mus musculus
cgcaaccgccaacacggccgtttct

SEQ ID NO: 307244 - DNA, 25 bp, Mus musculus
ttgaaggggccggaattgcaatacc

SEQ ID NO: 307245 - DNA, 25 bp, Mus musculus
tctgggcggaacatcagcgtaaaca

SEQ ID NO: 307246 - DNA, 25 bp, Mus musculus
tgcgccgacttttgcagctcaaagc

SEQ ID NO: 307247 - DNA, 25 bp, Mus musculus
ccgcctctggaactacccgaagtga

SEQ ID NO: 307248 - DNA, 25 bp, Mus musculus
cccgaagtgaaacccatagcagtgc

SEQ ID NO: 307249 - DNA, 25 bp, Mus musculus
ggacacaggcaacctctctgctaga

SEQ ID NO: 307250 - DNA, 25 bp, Mus musculus
accgctattgcgacgacttcctgga

SEQ ID NO: 307251 - DNA, 25 bp, Mus musculus
gcagttaacgatgcctacgcccagg

SEQ ID NO: 307252 - DNA, 25 bp, Mus musculus
acgtcctgttagtgttgtaccagca

SEQ ID NO: 307253 - DNA, 25 bp, Mus musculus
ctaccgggaacagattgagcgcttg

SEQ ID NO: 307254 - DNA, 25 bp, Mus musculus
ctccgtgctgaaaaaggtgcccgct

SEQ ID NO: 307255 - DNA, 25 bp, Mus musculus
tttctgaagctgcacgacaagtcca

SEQ ID NO: 307256 - DNA, 25 bp, Mus musculus
ggtattgtaacaccgcagcacctga

SEQ ID NO: 307257 - DNA, 25 bp, Mus musculus
gtcgcctccacgtaccaagtttctg

SEQ ID NO: 307258 - DNA, 25 bp, Mus musculus
ggaatgtcatataacgcggccacac

SEQ ID NO: 307259 - DNA, 25 bp, Mus musculus
gcacaccggaatgtcacataacatg

SEQ ID NO: 307260 - DNA, 25 bp, Mus musculus
tggaatgtcatataacgcggccaca

SEQ ID NO: 307261 - DNA, 25 bp, Mus musculus
cgccagcacaccagaatgtcacata

SEQ ID NO: 307262 - DNA, 25 bp, Mus musculus
tggaatgtcatataacgcagccaca

SEQ ID NO: 307263 - DNA, 25 bp, Mus musculus
gccagcacaccggaatgtcacataa

SEQ ID NO: 307264 - DNA, 25 bp, Mus musculus
gaatgtcatataacgcggccacacg

SEQ ID NO: 307265 - DNA, 25 bp, Mus musculus
gccagcacaccagaatgtcacataa

SEQ ID NO: 307266 - DNA, 25 bp, Mus musculus
gcacaccagaatgtcacataacatg

SEQ ID NO: 307267 - DNA, 25 bp, Mus musculus
cataacgtggaatgtcatataacgc

SEQ ID NO: 307268 - DNA, 25 bp, Mus musculus
cggaatgtcatataacgtggaatga

SEQ ID NO: 307269 - DNA, 25 bp, Mus musculus
gccggcacgccggaatgtcatataa

SEQ ID NO: 307270 - DNA, 25 bp, Mus musculus
ccggaatgtcatataacgtggaatg

SEQ ID NO: 307271 - DNA, 25 bp, Mus musculus
gtcatataacgcagccacacgccag

SEQ ID NO: 307272 - DNA, 25 bp, Mus musculus
atccgcgtgatctcccattattacg

SEQ ID NO: 307273 - DNA, 25 bp, Mus musculus
cccaccacctggacaaagccgcgtc

SEQ ID NO: 307274 - DNA, 25 bp, Mus musculus
gtcatatatcactttcgctacggta

SEQ ID NO: 307275 - DNA, 25 bp, Mus musculus
gcggtgtgatcacgcgtcatatatc

SEQ ID NO: 307276 - DNA, 25 bp, Mus musculus
acacgcgccacacgcggtgtgatca

SEQ ID NO: 307277 - DNA, 25 bp, Mus musculus
gtcaccacgcgggtcacacgcgcca

SEQ ID NO: 307278 - DNA, 25 bp, Mus musculus
cacgtcacatacaatccgcgtgatc

SEQ ID NO: 307279 - DNA, 25 bp, Mus musculus
gacgacgcgccgtgtcacgtgacac

SEQ ID NO: 307280 - DNA, 25 bp, Mus musculus
tgatctcccattattacgtcgcgtg

SEQ ID NO: 307281 - DNA, 25 bp, Mus musculus
attacgtcgcgtgtcatttcggtga

SEQ ID NO: 307282 - DNA, 25 bp, Mus musculus
cgcgtgtcatttcggtgatagaaga

SEQ ID NO: 307283 - DNA, 25 bp, Mus musculus
ttcggtgatagaagaaaaccgtcgc

SEQ ID NO: 307284 - DNA, 25 bp, Mus musculus
aaaaccgtcgcgacgacgcgccgtg

SEQ ID NO: 307285 - DNA, 25 bp, Mus musculus
acggttaccgcgtggccgcgcgtca

SEQ ID NO: 307286 - DNA, 25 bp, Mus musculus
ttgttgggcaagctgttaactctca

SEQ ID NO: 307287 - DNA, 25 bp, Mus musculus
tctgagattgttgggcaagctgtta

SEQ ID NO: 307288 - DNA, 25 bp, Mus musculus
cacctgtcgtgttctgagattgttg

SEQ ID NO: 307289 - DNA, 25 bp, Mus musculus
atccaacacctgtcgtgttctgaga

SEQ ID NO: 307290 - DNA, 25 bp, Mus musculus
atattcttatccaacacctgtcgtg

SEQ ID NO: 307291 - DNA, 25 bp, Mus musculus
gttcagcacatattcttatccaaca

SEQ ID NO: 307292 - DNA, 25 bp, Mus musculus
agtggctaaggcattttattagttc

SEQ ID NO: 307293 - DNA, 25 bp, Mus musculus
gcgtatataagtggctaaggcattt

SEQ ID NO: 307294 - DNA, 25 bp, Mus musculus
cttggcgtatataagtggctaaggc

SEQ ID NO: 307295 - DNA, 25 bp, Mus musculus
cccgaggaacttggcgtatataagt

SEQ ID NO: 307296 - DNA, 25 bp, Mus musculus
gttcccgaggaacttggcgtatata

SEQ ID NO: 307297 - DNA, 25 bp, Mus musculus
gcaggttcccgaggaacttggcgta

SEQ ID NO: 307298 - DNA, 25 bp, Mus musculus
aggcattttattagttcagcacata

SEQ ID NO: 307299 - DNA, 25 bp, Mus musculus
cgtgttctgagattgttgggcaagc

SEQ ID NO: 307300 - DNA, 25 bp, Mus musculus
aacgtttggaaaacagcgcttctcg

SEQ ID NO: 307301 - DNA, 25 bp, Mus musculus
ctcatctggagtcgatctcgggcgt

SEQ ID NO: 307302 - DNA, 25 bp, Mus musculus
ttatagttttcttagactgtcattg

SEQ ID NO: 307303 - DNA, 25 bp, Mus musculus
tcattgactgctcgtcgctgtttgc

SEQ ID NO: 307304 - DNA, 25 bp, Mus musculus
gtcgctgtttgcgtatgtgtgaacc

SEQ ID NO: 307305 - DNA, 25 bp, Mus musculus
cgtgaccggcgacacggaaattctt

SEQ ID NO: 307306 - DNA, 25 bp, Mus musculus
tggagtcgatctcgggcgtctgtcc

SEQ ID NO: 307307 - DNA, 25 bp, Mus musculus
tctggcctcatctggagtcgatctc

SEQ ID NO: 307308 - DNA, 25 bp, Mus musculus
cccggaagacatctggcctcatctg

SEQ ID NO: 307309 - DNA, 25 bp, Mus musculus
gactgtcattgactgctcgtcgctg

SEQ ID NO: 307310 - DNA, 25 bp, Mus musculus
acagcgcttctcgtcacgttctcga

SEQ ID NO: 307311 - DNA, 25 bp, Mus musculus
cgccagcaagagaaacgtttggaaa

SEQ ID NO: 307312 - DNA, 25 bp, Mus musculus
gacgacgccagcaagagaaacgttt

SEQ ID NO: 307313 - DNA, 25 bp, Mus musculus
tctcgtcacgttctcgattctgcca

SEQ ID NO: 307314 - DNA, 25 bp, Mus musculus
cgcccacagccacggcgacgccgcc

SEQ ID NO: 307315 - DNA, 25 bp, Mus musculus
gacgccgcccacctgcctatcagga

SEQ ID NO: 307316 - DNA, 25 bp, Mus musculus
acctgcctatcaggacgcccaggcc

SEQ ID NO: 307317 - DNA, 25 bp, Mus musculus
ccactggcctgacgcctcatgaata

SEQ ID NO: 307318 - DNA, 25 bp, Mus musculus
gcctgacgcctcatgaatatccatc

SEQ ID NO: 307319 - DNA, 25 bp, Mus musculus
cctcatgaatatccatcgcttttta

SEQ ID NO: 307320 - DNA, 25 bp, Mus musculus
tcgctttttatgaatatgcaggaca

SEQ ID NO: 307321 - DNA, 25 bp, Mus musculus
tcaccggccgcggagcgggactaac

SEQ ID NO: 307322 - DNA, 25 bp, Mus musculus
gggcgctgggactcatgaatattta

SEQ ID NO: 307323 - DNA, 25 bp, Mus musculus
ttaatattcataaccgcgcttccgc

SEQ ID NO: 307324 - DNA, 25 bp, Mus musculus
gggactcatgaatatttatctcggc

SEQ ID NO: 307325 - DNA, 25 bp, Mus musculus
gaatatttatctcggcttcattaat

SEQ ID NO: 307326 - DNA, 25 bp, Mus musculus
cttccgccggcctcgttaatattca

SEQ ID NO: 307327 - DNA, 25 bp, Mus musculus
aatatgcaggacaagagcggggcgc

SEQ ID NO: 307328 - DNA, 25 bp, Mus musculus
tgcatgcagacaagccaaagatttg

SEQ ID NO: 307329 - DNA, 25 bp, Mus musculus
gtggcgtaatgtccctgtgacgtca

SEQ ID NO: 307330 - DNA, 25 bp, Mus musculus
gtcctccgctgtttgtcagtcatta

SEQ ID NO: 307331 - DNA, 25 bp, Mus musculus
atcaccgctttcttcctgccagggt

SEQ ID NO: 307332 - DNA, 25 bp, Mus musculus
aggggcgcgaccacattgacatcac

SEQ ID NO: 307333 - DNA, 25 bp, Mus musculus
caatcacccggattggggcgccgta

SEQ ID NO: 307334 - DNA, 25 bp, Mus musculus
gtgacgtcaccaacacgggcgtgtc

SEQ ID NO: 307335 - DNA, 25 bp, Mus musculus
tagggcagggccaacgcaataaatg

SEQ ID NO: 307336 - DNA, 25 bp, Mus musculus
tgtgacgtcacacacgactccgctg

SEQ ID NO: 307337 - DNA, 25 bp, Mus musculus
ggccgctcggagctgaaaaccggaa

SEQ ID NO: 307338 - DNA, 25 bp, Mus musculus
tgtaattattgcttcggccggtccg

SEQ ID NO: 307339 - DNA, 25 bp, Mus musculus
atgcctccgcctcccggttaatttg

SEQ ID NO: 307340 - DNA, 25 bp, Mus musculus
gaggctgtagcccaccatgaacttg

SEQ ID NO: 307341 - DNA, 25 bp, Mus musculus
ccaccacgagttctagacaggaagt

SEQ ID NO: 307342 - DNA, 25 bp, Mus musculus
gaaacgcgcggcctggaaatagcga

SEQ ID NO: 307343 - DNA, 25 bp, Mus musculus
cgggcgtaggctcgcaatgattgac

SEQ ID NO: 307344 - DNA, 25 bp, Mus musculus
ctcgcaatgattgacaccggaagcg

SEQ ID NO: 307345 - DNA, 25 bp, Mus musculus
caatgattgacaccggaagcggcgg

SEQ ID NO: 307346 - DNA, 25 bp, Mus musculus
gacttccggtttccaccgctgccgc

SEQ ID NO: 307347 - DNA, 25 bp, Mus musculus
cgccgacgcgaggaacgcgcgaccc

SEQ ID NO: 307348 - DNA, 25 bp, Mus musculus
gctgacgtcacggaccgtcccggct

SEQ ID NO: 307349 - DNA, 25 bp, Mus musculus
gcgtcgccgctgactgacgtcatca

SEQ ID NO: 307350 - DNA, 25 bp, Mus musculus
tgactgacgtcatcagccgcgcgtc

SEQ ID NO: 307351 - DNA, 25 bp, Mus musculus
ccgagctcccgtcgtcgaggcgtga

SEQ ID NO: 307352 - DNA, 25 bp, Mus musculus
aacgcgcggcctggaaatagcgacg

SEQ ID NO: 307353 - DNA, 25 bp, Mus musculus
cccgccggcgacgtcacccggatgt

SEQ ID NO: 307354 - DNA, 25 bp, Mus musculus
gcggcgacctcggttccggtcctga

SEQ ID NO: 307355 - DNA, 25 bp, Mus musculus
gtcgtcgaggcgtgacgtcacagcc

SEQ ID NO: 307356 - DNA, 25 bp, Mus musculus
cggttcacgtgactccgcccatggt

SEQ ID NO: 307357 - DNA, 25 bp, Mus musculus
tgtcagtcagttgcagagccacacc

SEQ ID NO: 307358 - DNA, 25 bp, Mus musculus
gggctgggacacgtccctcatctca

SEQ ID NO: 307359 - DNA, 25 bp, Mus musculus
gagccactcttaccgacctctgaaa

SEQ ID NO: 307360 - DNA, 25 bp, Mus musculus
acgcccaccagaggcttaggctttg

SEQ ID NO: 307361 - DNA, 25 bp, Mus musculus
taggctttgcctgtcactctcatcc

SEQ ID NO: 307362 - DNA, 25 bp, Mus musculus
tcgaacgcgcactccacgagggcga

SEQ ID NO: 307363 - DNA, 25 bp, Mus musculus
tggccgactcttgcatgaacctgtg

SEQ ID NO: 307364 - DNA, 25 bp, Mus musculus
aagtcccgcagccacttctggaagc

SEQ ID NO: 307365 - DNA, 25 bp, Mus musculus
ttctggaagcgcgacggaaacacca

SEQ ID NO: 307366 - DNA, 25 bp, Mus musculus
tcctccttcctgtgggcatggacct

SEQ ID NO: 307367 - DNA, 25 bp, Mus musculus
cgcggtcatgacgtcacctgggtca

SEQ ID NO: 307368 - DNA, 25 bp, Mus musculus
tcgggtctgtgcttttccttttctc

SEQ ID NO: 307369 - DNA, 25 bp, Mus musculus
ttaactctcacagacaggaggcgtg

SEQ ID NO: 307370 - DNA, 25 bp, Mus musculus
tccaccaaggatgcccgagccaatt

SEQ ID NO: 307371 - DNA, 25 bp, Mus musculus
acacctagactctttcgggtccatc

SEQ ID NO: 307372 - DNA, 25 bp, Mus musculus
catggttccaacacttcagtcttta

SEQ ID NO: 307373 - DNA, 25 bp, Mus musculus
aattgttttgctccacgccgcagcg

SEQ ID NO: 307374 - DNA, 25 bp, Mus musculus
gcagccaatcttcactgtcagcttg

SEQ ID NO: 307375 - DNA, 25 bp, Mus musculus
ccatcgaggacgctggacctttatc

SEQ ID NO: 307376 - DNA, 25 bp, Mus musculus
tgtcagcttgtctggatttggaatc

SEQ ID NO: 307377 - DNA, 25 bp, Mus musculus
atttggaatcatctagacacaccta

SEQ ID NO: 307378 - DNA, 25 bp, Mus musculus
tcttatatcacatctgcagcagcca

SEQ ID NO: 307379 - DNA, 25 bp, Mus musculus
ccgcagcaccatttcttatatcaca

SEQ ID NO: 307380 - DNA, 25 bp, Mus musculus
gggtccatctttgagggtgtttcca

SEQ ID NO: 307381 - DNA, 25 bp, Mus musculus
tatagatcaggagggaaagccaacc

SEQ ID NO: 307382 - DNA, 25 bp, Mus musculus
acacgaacctagctcctgggagcca

SEQ ID NO: 307383 - DNA, 25 bp, Mus musculus
ctgggttccgaagcctccaacacga

SEQ ID NO: 307384 - DNA, 25 bp, Mus musculus
cagtatggagggtaagtgacactag

SEQ ID NO: 307385 - DNA, 25 bp, Mus musculus
agagttgtcccggagcagacagtat

SEQ ID NO: 307386 - DNA, 25 bp, Mus musculus
gcctcctttggagagttgtcccgga

SEQ ID NO: 307387 - DNA, 25 bp, Mus musculus
catccattggaaggtgcctgcctcc

SEQ ID NO: 307388 - DNA, 25 bp, Mus musculus
ttcctggacccaacacatccattgg

SEQ ID NO: 307389 - DNA, 25 bp, Mus musculus
caccgcccgcactttggagggtgcg

SEQ ID NO: 307390 - DNA, 25 bp, Mus musculus
aggggtcccgcctatgtagcgacag

SEQ ID NO: 307391 - DNA, 25 bp, Mus musculus
agcgacttcttggtctcttcagaga

SEQ ID NO: 307392 - DNA, 25 bp, Mus musculus
ttggtctcttcagagagacaagtcc

SEQ ID NO: 307393 - DNA, 25 bp, Mus musculus
aagtcctggctatcattgtgggcga

SEQ ID NO: 307394 - DNA, 25 bp, Mus musculus
tgcccgcctgcgagcgtccggtgaa

SEQ ID NO: 307395 - DNA, 25 bp, Mus musculus
gacagaggctggtgtgtgtccacca

SEQ ID NO: 307396 - DNA, 25 bp, Mus musculus
gcctatgtagcgacagcgacttctt

SEQ ID NO: 307397 - DNA, 25 bp, Mus musculus
ctgggctcgtgccatgtaaagagtg

SEQ ID NO: 307398 - DNA, 25 bp, Mus musculus
gggcgatgaagagaagcgacccttc

SEQ ID NO: 307399 - DNA, 25 bp, Mus musculus
cgatgaagagaagcgacccttcgtg

SEQ ID NO: 307400 - DNA, 25 bp, Mus musculus
ttccgctggagaaggtgaagcggcc

SEQ ID NO: 307401 - DNA, 25 bp, Mus musculus
ccttcatggtgtggagctctgttca

SEQ ID NO: 307402 - DNA, 25 bp, Mus musculus
ctgggcgatgaagagaagcgaccct

SEQ ID NO: 307403 - DNA, 25 bp, Mus musculus
ggagctctgttcagcgccgccagat

SEQ ID NO: 307404 - DNA, 25 bp, Mus musculus
cttcgtggaggaggctaagcgtctt

SEQ ID NO: 307405 - DNA, 25 bp, Mus musculus
aggaggctaagcgtcttcgtgcccg

SEQ ID NO: 307406 - DNA, 25 bp, Mus musculus
aggctaagcgtcttcgtgcccgcca

SEQ ID NO: 307407 - DNA, 25 bp, Mus musculus
tcgtgcccgccacctccgcgactat

SEQ ID NO: 307408 - DNA, 25 bp, Mus musculus
cctccgcgactatcccgactacaag

SEQ ID NO: 307409 - DNA, 25 bp, Mus musculus
caagatgcacaactctgagatctcc

SEQ ID NO: 307410 - DNA, 25 bp, Mus musculus
tgaagagaagcgacccttcgtggag

SEQ ID NO: 307411 - DNA, 25 bp, Mus musculus
tctccaagcgcttgggcgctcagtg

SEQ ID NO: 307412 - DNA, 25 bp, Mus musculus
cagaccccattttgtagatcaggct

SEQ ID NO: 307413 - DNA, 25 bp, Mus musculus
ggcttccaagacaactcttataaag

SEQ ID NO: 307414 - DNA, 25 bp, Mus musculus
tggcttccaagacaactcttataaa

SEQ ID NO: 307415 - DNA, 25 bp, Mus musculus
cctggcttccaagacaactcttata

SEQ ID NO: 307416 - DNA, 25 bp, Mus musculus
tcagaccccattttgtagatcaggc

SEQ ID NO: 307417 - DNA, 25 bp, Mus musculus
atcagaccccattttgtagatcagg

SEQ ID NO: 307418 - DNA, 25 bp, Mus musculus
catcagaccccattttgtagatcag

SEQ ID NO: 307419 - DNA, 25 bp, Mus musculus
tcatcagaccccattttgtagatca

SEQ ID NO: 307420 - DNA, 25 bp, Mus musculus
ctcatcagaccccattttgtagatc

SEQ ID NO: 307421 - DNA, 25 bp, Mus musculus
gctcatcagaccccattttgtagat

SEQ ID NO: 307422 - DNA, 25 bp, Mus musculus
ctggcttccaagacaactcttataa

SEQ ID NO: 307423 - DNA, 25 bp, Mus musculus
gaaggaagaggtaaagcagcccaca

SEQ ID NO: 307424 - DNA, 25 bp, Mus musculus
ggtaaagcagcccacagccgctgac

SEQ ID NO: 307425 - DNA, 25 bp, Mus musculus
tgactgttcgctcccgggtctggtt

SEQ ID NO: 307426 - DNA, 25 bp, Mus musculus
cctgactgttcgctcccgggtctgg

SEQ ID NO: 307427 - DNA, 25 bp, Mus musculus
taaagcagcccacagccgctgacag

SEQ ID NO: 307428 - DNA, 25 bp, Mus musculus
tcgctcccgggtctggtttcatttg

SEQ ID NO: 307429 - DNA, 25 bp, Mus musculus
ggaaggaagaggtaaagcagcccac

SEQ ID NO: 307430 - DNA, 25 bp, Mus musculus
cggaaggaagaggtaaagcagccca

SEQ ID NO: 307431 - DNA, 25 bp, Mus musculus
gtaaagcagcccacagccgctgaca

SEQ ID NO: 307432 - DNA, 25 bp, Mus musculus
gagtactggtcgacctccgaagttg

SEQ ID NO: 307433 - DNA, 25 bp, Mus musculus
gccaaggccggagggcaaggggctg

SEQ ID NO: 307434 - DNA, 25 bp, Mus musculus
tcccacacccaaggagagcgacgga

SEQ ID NO: 307435 - DNA, 25 bp, Mus musculus
gacggcacgaggctcccacacccaa

SEQ ID NO: 307436 - DNA, 25 bp, Mus musculus
ccacacccaaggagagcgacggaag

SEQ ID NO: 307437 - DNA, 25 bp, Mus musculus
gccgcggtcgcgacggcacgaggct

SEQ ID NO: 307438 - DNA, 25 bp, Mus musculus
cccacacccaaggagagcgacggaa

SEQ ID NO: 307439 - DNA, 25 bp, Mus musculus
ccgccagaggcctggcgccgaacgc

SEQ ID NO: 307440 - DNA, 25 bp, Mus musculus
atgctcgggcggagagagcgccccc

SEQ ID NO: 307441 - DNA, 25 bp, Mus musculus
gggagacggaggagaagacgatccc

SEQ ID NO: 307442 - DNA, 25 bp, Mus musculus
ccctcgtacgcacgtcgccgccgcg

SEQ ID NO: 307443 - DNA, 25 bp, Mus musculus
agtactggtcgacctccgaagttgg

SEQ ID NO: 307444 - DNA, 25 bp, Mus musculus
cacacccaaggagagcgacggaagg

SEQ ID NO: 307445 - DNA, 25 bp, Mus musculus
aagaggcgccgcgccggaccctctc

SEQ ID NO: 307446 - DNA, 25 bp, Mus musculus
ggttgcgcgcagttcccacgactgt

SEQ ID NO: 307447 - DNA, 25 bp, Mus musculus
tggttgcgcgcagttcccacgactg

SEQ ID NO: 307448 - DNA, 25 bp, Mus musculus
gttgcgcgcagttcccacgactgtg

SEQ ID NO: 307449 - DNA, 25 bp, Mus musculus
gcgtcccggacggaggcttggttgc

SEQ ID NO: 307450 - DNA, 25 bp, Mus musculus
cttggttgcgcgcagttcccacgac

SEQ ID NO: 307451 - DNA, 25 bp, Mus musculus
ttggttgcgcgcagttcccacgact

SEQ ID NO: 307452 - DNA, 25 bp, Mus musculus
agaacacggaggttcgcgcgcagcc

SEQ ID NO: 307453 - DNA, 25 bp, Mus musculus
tcccagcgtcgcgtggggagaacac

SEQ ID NO: 307454 - DNA, 25 bp, Mus musculus
atggaaatttcctccacgaagccca

SEQ ID NO: 307455 - DNA, 25 bp, Mus musculus
cccaaaactgagcaataaattaatt

SEQ ID NO: 307456 - DNA, 25 bp, Mus musculus
ggggtcagcagggacctcacttccc

SEQ ID NO: 307457 - DNA, 25 bp, Mus musculus
ccctgcctcagatcaggggtcagca

SEQ ID NO: 307458 - DNA, 25 bp, Mus musculus
gtcgtcgccgttgtttcccaaggca

SEQ ID NO: 307459 - DNA, 25 bp, Mus musculus
gtcaccgcgccgtacatcattttta

SEQ ID NO: 307460 - DNA, 25 bp, Mus musculus
tatcctaaaatctgccgtcaccgcg

SEQ ID NO: 307461 - DNA, 25 bp, Mus musculus
cacgctatctgtcatttttatccta

SEQ ID NO: 307462 - DNA, 25 bp, Mus musculus
tgacgtcacgttatcacacgctatc

SEQ ID NO: 307463 - DNA, 25 bp, Mus musculus
tatgcgctcgatacgtgacgtcacg

SEQ ID NO: 307464 - DNA, 25 bp, Mus musculus
tcgcgtgtcatatgcgctcgatacg

SEQ ID NO: 307465 - DNA, 25 bp, Mus musculus
gcgtcgttacgcatcgcgtgtcata

SEQ ID NO: 307466 - DNA, 25 bp, Mus musculus
cgctgattcgccagcgacgtacttt

SEQ ID NO: 307467 - DNA, 25 bp, Mus musculus
gctgattcgccagcgacgtactttg

SEQ ID NO: 307468 - DNA, 25 bp, Mus musculus
tgattcgccagcgacgtactttgac

SEQ ID NO: 307469 - DNA, 25 bp, Mus musculus
ttcgccagcgacgtactttgacttc

SEQ ID NO: 307470 - DNA, 25 bp, Mus musculus
cgccagcgacgtactttgacttcaa

SEQ ID NO: 307471 - DNA, 25 bp, Mus musculus
ccagcgacgtactttgacttcaaga

SEQ ID NO: 307472 - DNA, 25 bp, Mus musculus
cagcgacgtactttgacttcaagaa

SEQ ID NO: 307473 - DNA, 25 bp, Mus musculus
cgacgtactttgacttcaagaacga

SEQ ID NO: 307474 - DNA, 25 bp, Mus musculus
cgtactttgacttcaagaacgattt

SEQ ID NO: 307475 - DNA, 25 bp, Mus musculus
ctttgacttcaagaacgattttgcc

SEQ ID NO: 307476 - DNA, 25 bp, Mus musculus
ttgacttcaagaacgattttgcctg

SEQ ID NO: 307477 - DNA, 25 bp, Mus musculus
gacttcaagaacgattttgcctgtt

SEQ ID NO: 307478 - DNA, 25 bp, Mus musculus
ttcaagaacgattttgcctgttttc

SEQ ID NO: 307479 - DNA, 25 bp, Mus musculus
caagaacgattttgcctgttttcac

SEQ ID NO: 307480 - DNA, 25 bp, Mus musculus
cagtgcgtccctcttgggctagcct

SEQ ID NO: 307481 - DNA, 25 bp, Mus musculus
cgcaagctgcagtgccctgacatgt

SEQ ID NO: 307482 - DNA, 25 bp, Mus musculus
agctgcagtgccctgacatgtgtgt

SEQ ID NO: 307483 - DNA, 25 bp, Mus musculus
cagtgccctgacatgtgtgtgtttc

SEQ ID NO: 307484 - DNA, 25 bp, Mus musculus
gccctgacatgtgtgtgtttccgtg

SEQ ID NO: 307485 - DNA, 25 bp, Mus musculus
ctgacatgtgtgtgtttccgtgggt

SEQ ID NO: 307486 - DNA, 25 bp, Mus musculus
agtgcagtgcgtccctcttgggcta

SEQ ID NO: 307487 - DNA, 25 bp, Mus musculus
gtgcgtccctcttgggctagcctgt

SEQ ID NO: 307488 - DNA, 25 bp, Mus musculus
tgggctagcctgtgccgatgggtgt

SEQ ID NO: 307489 - DNA, 25 bp, Mus musculus
tttttgtccgggtgcgcaagctgca

SEQ ID NO: 307490 - DNA, 25 bp, Mus musculus
gagtttgtgtgcctgtccgggtgtg

SEQ ID NO: 307491 - DNA, 25 bp, Mus musculus
ctccttttttgtccgggtgcgcaag

SEQ ID NO: 307492 - DNA, 25 bp, Mus musculus
tgcgcaagctgcagtgccctgacat

SEQ ID NO: 307493 - DNA, 25 bp, Mus musculus
tcctccttttttgtccgggtgcgca

SEQ ID NO: 307494 - DNA, 25 bp, Mus musculus
ggcctgtttctctgacactgccaaa

SEQ ID NO: 307495 - DNA, 25 bp, Mus musculus
attctccagagaaatacagcagctg

SEQ ID NO: 307496 - DNA, 25 bp, Mus musculus
tggacaccttcattctccagagaaa

SEQ ID NO: 307497 - DNA, 25 bp, Mus musculus
agctgagaactggacaccttcattc

SEQ ID NO: 307498 - DNA, 25 bp, Mus musculus
gtatccattttccagctgagaactg

SEQ ID NO: 307499 - DNA, 25 bp, Mus musculus
ctgccaaagtgaaagtatccatttt

SEQ ID NO: 307500 - DNA, 25 bp, Mus musculus
cagagaaatacagcagctggccatc

SEQ ID NO: 307501 - DNA, 25 bp, Mus musculus
agtgggcctgtttctctgacactgc

SEQ ID NO: 307502 - DNA, 25 bp, Mus musculus
tcacaagagagtgggcctgtttctc

SEQ ID NO: 307503 - DNA, 25 bp, Mus musculus
cttaaagaatcacaagagagtgggc

SEQ ID NO: 307504 - DNA, 25 bp, Mus musculus
ccctcagaacctgtcttaaagaatc

SEQ ID NO: 307505 - DNA, 25 bp, Mus musculus
ccagccctcagaacctgtcttaaag

SEQ ID NO: 307506 - DNA, 25 bp, Mus musculus
ctgacactgccaaagtgaaagtatc

SEQ ID NO: 307507 - DNA, 25 bp, Mus musculus
tgtttctctgacactgccaaagtga

SEQ ID NO: 307508 - DNA, 25 bp, Mus musculus
tgttcacatggaacccttctccact

SEQ ID NO: 307509 - DNA, 25 bp, Mus musculus
ttctccacttcggccttcaaagttc

SEQ ID NO: 307510 - DNA, 25 bp, Mus musculus
gttcacatggaacccttctccactt

SEQ ID NO: 307511 - DNA, 25 bp, Mus musculus
gctgttcacatggaacccttctcca

SEQ ID NO: 307512 - DNA, 25 bp, Mus musculus
tgctgttcacatggaacccttctcc

SEQ ID NO: 307513 - DNA, 25 bp, Mus musculus
ctgctgttcacatggaacccttctc

SEQ ID NO: 307514 - DNA, 25 bp, Mus musculus
actgctgttcacatggaacccttct

SEQ ID NO: 307515 - DNA, 25 bp, Mus musculus
aactgctgttcacatggaacccttc

SEQ ID NO: 307516 - DNA, 25 bp, Mus musculus
cttctccacttcggccttcaaagtt

SEQ ID NO: 307517 - DNA, 25 bp, Mus musculus
aggtctccttcccaggcaggctttt

SEQ ID NO: 307518 - DNA, 25 bp, Mus musculus
gccatgttggaaagctaagcttccg

SEQ ID NO: 307519 - DNA, 25 bp, Mus musculus
tggaaagctaagcttccgccaggcg

SEQ ID NO: 307520 - DNA, 25 bp, Mus musculus
aagcgtgtccgcgtttggcgcctgc

SEQ ID NO: 307521 - DNA, 25 bp, Mus musculus
tttaaagcgtgtccgcgtttggcgc

SEQ ID NO: 307522 - DNA, 25 bp, Mus musculus
tgacgttcgaattttaaagcgtgtc

SEQ ID NO: 307523 - DNA, 25 bp, Mus musculus
gcgcgccttgacgttcgaattttaa

SEQ ID NO: 307524 - DNA, 25 bp, Mus musculus
tgtgcgcgccttgacgttcgaattt

SEQ ID NO: 307525 - DNA, 25 bp, Mus musculus
cccaggcaggcttttgtgcgcgcct

SEQ ID NO: 307526 - DNA, 25 bp, Mus musculus
tccttcccaggcaggcttttgtgcg

SEQ ID NO: 307527 - DNA, 25 bp, Mus musculus
cccgccatttatccgcgccgcgcat

SEQ ID NO: 307528 - DNA, 25 bp, Mus musculus
gacacaggtctccttcccaggcagg

SEQ ID NO: 307529 - DNA, 25 bp, Mus musculus
ctcctctaggggacacaggtctcct

SEQ ID NO: 307530 - DNA, 25 bp, Mus musculus
agggctgctcttccctctccgtgat

SEQ ID NO: 307531 - DNA, 25 bp, Mus musculus
agcccatagagaaccattgactgcg

SEQ ID NO: 307532 - DNA, 25 bp, Mus musculus
gagctgcgagcacatggcggtccct

SEQ ID NO: 307533 - DNA, 25 bp, Mus musculus
cacggaaagcccatagagaaccatt

SEQ ID NO: 307534 - DNA, 25 bp, Mus musculus
ccatagagaaccattgactgcggac

SEQ ID NO: 307535 - DNA, 25 bp, Mus musculus
aagtcccagcattcccggctccgac

SEQ ID NO: 307536 - DNA, 25 bp, Mus musculus
ttcccggctccgaccgagccttctc

SEQ ID NO: 307537 - DNA, 25 bp, Mus musculus
gagccttctcttcccgccgcagaca

SEQ ID NO: 307538 - DNA, 25 bp, Mus musculus
ctccatcttaagtccgcacggtcgg

SEQ ID NO: 307539 - DNA, 25 bp, Mus musculus
tccgcacggtcggatcgagtttaaa

SEQ ID NO: 307540 - DNA, 25 bp, Mus musculus
cccaattgtacgtcacggttctgca

SEQ ID NO: 307541 - DNA, 25 bp, Mus musculus
ttgtacgtcacggttctgcagcggg

SEQ ID NO: 307542 - DNA, 25 bp, Mus musculus
cgcgcactcacctctcatggcggca

SEQ ID NO: 307543 - DNA, 25 bp, Mus musculus
aggaagtgcctccatcttaagtccg

SEQ ID NO: 307544 - DNA, 25 bp, Mus musculus
gccactcacacggaaagcccataga

SEQ ID NO: 307545 - DNA, 25 bp, Mus musculus
ttagagtgaggtcagaataaggcgc

SEQ ID NO: 307546 - DNA, 25 bp, Mus musculus
tctctgacttctggaggtgctgtgg

SEQ ID NO: 307547 - DNA, 25 bp, Mus musculus
ggccaccgcattgttctctgacttc

SEQ ID NO: 307548 - DNA, 25 bp, Mus musculus
tgggccaccgcattgttctctgact

SEQ ID NO: 307549 - DNA, 25 bp, Mus musculus
cactcccggcctgtcagcgcctgtg

SEQ ID NO: 307550 - DNA, 25 bp, Mus musculus
ccacaggaaggagggcgacgtgcac

SEQ ID NO: 307551 - DNA, 25 bp, Mus musculus
ccacagcgttgccaggaagctgagg

SEQ ID NO: 307552 - DNA, 25 bp, Mus musculus
tgccacagcgttgccaggaagctga

SEQ ID NO: 307553 - DNA, 25 bp, Mus musculus
gcgcgctgccacagcgttgccagga

SEQ ID NO: 307554 - DNA, 25 bp, Mus musculus
gcatcgccgggtcgcggactacggc

SEQ ID NO: 307555 - DNA, 25 bp, Mus musculus
cgcctgtgggccaccgcattgttct

SEQ ID NO: 307556 - DNA, 25 bp, Mus musculus
gacttctggaggtgctgtggttcca

SEQ ID NO: 307557 - DNA, 25 bp, Mus musculus
gctgccacagcgttgccaggaagct

SEQ ID NO: 307558 - DNA, 25 bp, Mus musculus
agggcgacgtgcactcccggcctgt

SEQ ID NO: 307559 - DNA, 25 bp, Mus musculus
gcctcagaaacgctctcagggtcaa

SEQ ID NO: 307560 - DNA, 25 bp, Mus musculus
cctcagaaacgctctcagggtcaat

SEQ ID NO: 307561 - DNA, 25 bp, Mus musculus
ctgcctcagaaacgctctcagggtc

SEQ ID NO: 307562 - DNA, 25 bp, Mus musculus
ctcagaaacgctctcagggtcaatc

SEQ ID NO: 307563 - DNA, 25 bp, Mus musculus
cctgcctcagaaacgctctcagggt

SEQ ID NO: 307564 - DNA, 25 bp, Mus musculus
tgcctcagaaacgctctcagggtca

SEQ ID NO: 307565 - DNA, 25 bp, Mus musculus
aggaagtgcctccattttggacagg

SEQ ID NO: 307566 - DNA, 25 bp, Mus musculus
agcgccgatctccggggccacccgg

SEQ ID NO: 307567 - DNA, 25 bp, Mus musculus
cccaggcgctcatgggagctgtagt

SEQ ID NO: 307568 - DNA, 25 bp, Mus musculus
tggacaggaagtcgggcccaggcgc

SEQ ID NO: 307569 - DNA, 25 bp, Mus musculus
attttggacaggaagtcgggcccag

SEQ ID NO: 307570 - DNA, 25 bp, Mus musculus
cattttggacaggaagtcgggccca

SEQ ID NO: 307571 - DNA, 25 bp, Mus musculus
tccattttggacaggaagtcgggcc

SEQ ID NO: 307572 - DNA, 25 bp, Mus musculus
ctccattttggacaggaagtcgggc

SEQ ID NO: 307573 - DNA, 25 bp, Mus musculus
cctccattttggacaggaagtcggg

SEQ ID NO: 307574 - DNA, 25 bp, Mus musculus
gcctccattttggacaggaagtcgg

SEQ ID NO: 307575 - DNA, 25 bp, Mus musculus
tgcctccattttggacaggaagtcg

SEQ ID NO: 307576 - DNA, 25 bp, Mus musculus
agtgcctccattttggacaggaagt

SEQ ID NO: 307577 - DNA, 25 bp, Mus musculus
gaagtgcctccattttggacaggaa

SEQ ID NO: 307578 - DNA, 25 bp, Mus musculus
ggaagtgcctccattttggacagga

SEQ ID NO: 307579 - DNA, 25 bp, Mus musculus
gctaccggatacctcctcgatggcc

SEQ ID NO: 307580 - DNA, 25 bp, Mus musculus
gcaggcaaggggcactgggtatcag

SEQ ID NO: 307581 - DNA, 25 bp, Mus musculus
caggcaaggggcactgggtatcagg

SEQ ID NO: 307582 - DNA, 25 bp, Mus musculus
aggcaaggggcactgggtatcaggc

SEQ ID NO: 307583 - DNA, 25 bp, Mus musculus
ggcaaggggcactgggtatcaggca

SEQ ID NO: 307584 - DNA, 25 bp, Mus musculus
gcgcgggcgtcgctaccggatacct

SEQ ID NO: 307585 - DNA, 25 bp, Mus musculus
cgcgggcgtcgctaccggatacctc

SEQ ID NO: 307586 - DNA, 25 bp, Mus musculus
gcgggcgtcgctaccggatacctcc

SEQ ID NO: 307587 - DNA, 25 bp, Mus musculus
cgggcgtcgctaccggatacctcct

SEQ ID NO: 307588 - DNA, 25 bp, Mus musculus
gggcgtcgctaccggatacctcctc

SEQ ID NO: 307589 - DNA, 25 bp, Mus musculus
ggcgtcgctaccggatacctcctcg

SEQ ID NO: 307590 - DNA, 25 bp, Mus musculus
gcgtcgctaccggatacctcctcga

SEQ ID NO: 307591 - DNA, 25 bp, Mus musculus
tgggcgcaggcaaggggcactgggt

SEQ ID NO: 307592 - DNA, 25 bp, Mus musculus
cgtcgctaccggatacctcctcgat

SEQ ID NO: 307593 - DNA, 25 bp, Mus musculus
gctggcactcactggctgggcccgt

SEQ ID NO: 307594 - DNA, 25 bp, Mus musculus
gctcgtgtgagctcgtcgtcgtcgt

SEQ ID NO: 307595 - DNA, 25 bp, Mus musculus
tgggctctggtctcggggctcgtgt

SEQ ID NO: 307596 - DNA, 25 bp, Mus musculus
ggcgtgtcgctgtgtggtgtgtgtc

SEQ ID NO: 307597 - DNA, 25 bp, Mus musculus
cagcgcgaagaagcgaggaggcacg

SEQ ID NO: 307598 - DNA, 25 bp, Mus musculus
ttgtaggcagcgtgaggcaggcagc

SEQ ID NO: 307599 - DNA, 25 bp, Mus musculus
cactcactggctgggcccgtggtgc

SEQ ID NO: 307600 - DNA, 25 bp, Mus musculus
gccaaggctggcactcactggctgg

SEQ ID NO: 307601 - DNA, 25 bp, Mus musculus
gcggccaaggctggcactcactggc

SEQ ID NO: 307602 - DNA, 25 bp, Mus musculus
gtgcggccaaggctggcactcactg

SEQ ID NO: 307603 - DNA, 25 bp, Mus musculus
gtgtgcggccaaggctggcactcac

SEQ ID NO: 307604 - DNA, 25 bp, Mus musculus
aagcgaggaggggagatgtgtgtgc

SEQ ID NO: 307605 - DNA, 25 bp, Mus musculus
aaggctggcactcactggctgggcc

SEQ ID NO: 307606 - DNA, 25 bp, Mus musculus
gcccgtggtgcgtccagggcaggca

SEQ ID NO: 307607 - DNA, 25 bp, Mus musculus
atccgctgcggacgggcccttgact

SEQ ID NO: 307608 - DNA, 25 bp, Mus musculus
tgcagctccgcaagtctgtatccgc

SEQ ID NO: 307609 - DNA, 25 bp, Mus musculus
ctctaccgtgtggagaatgcagctc

SEQ ID NO: 307610 - DNA, 25 bp, Mus musculus
gagaatgcagctccgcaagtctgta

SEQ ID NO: 307611 - DNA, 25 bp, Mus musculus
gcagtttcagctgggtgccaggctc

SEQ ID NO: 307612 - DNA, 25 bp, Mus musculus
tgccaggctctgattaagacccata

SEQ ID NO: 307613 - DNA, 25 bp, Mus musculus
taagacccataagcgccatccagag

SEQ ID NO: 307614 - DNA, 25 bp, Mus musculus
ccatccagaggcaaggggtgagtaa

SEQ ID NO: 307615 - DNA, 25 bp, Mus musculus
aggggtgagtaatttatggccatcc

SEQ ID NO: 307616 - DNA, 25 bp, Mus musculus
tggccatcccaacacaaatgacatg

SEQ ID NO: 307617 - DNA, 25 bp, Mus musculus
caaatgacatgttaggaggagtcta

SEQ ID NO: 307618 - DNA, 25 bp, Mus musculus
gagtctaacagtgcagaatcctcta

SEQ ID NO: 307619 - DNA, 25 bp, Mus musculus
agtgcagaatcctctaccgtgtgga

SEQ ID NO: 307620 - DNA, 25 bp, Mus musculus
cgcaagtctgtatccgctgcggacg

SEQ ID NO: 307621 - DNA, 25 bp, Mus musculus
tcaagtgtgtgcatctgggaccagg

SEQ ID NO: 307622 - DNA, 25 bp, Mus musculus
cttcttccgagctcagctctgggga

SEQ ID NO: 307623 - DNA, 25 bp, Mus musculus
ggtggaataaccagcgcctcaagtg

SEQ ID NO: 307624 - DNA, 25 bp, Mus musculus
aataaccagcgcctcaagtgtgtgc

SEQ ID NO: 307625 - DNA, 25 bp, Mus musculus
cctcaagtgtgtgcatctgggacca

SEQ ID NO: 307626 - DNA, 25 bp, Mus musculus
ggcgctcaggctcgccaggctgcaa

SEQ ID NO: 307627 - DNA, 25 bp, Mus musculus
tcaggctcgccaggctgcaaagaga

SEQ ID NO: 307628 - DNA, 25 bp, Mus musculus
ctcgccaggctgcaaagagagctga

SEQ ID NO: 307629 - DNA, 25 bp, Mus musculus
ccaggctgcaaagagagctgagagc

SEQ ID NO: 307630 - DNA, 25 bp, Mus musculus
tgcaaagagagctgagagctgcctc

SEQ ID NO: 307631 - DNA, 25 bp, Mus musculus
cagaaccggcggtggaataaccagc

SEQ ID NO: 307632 - DNA, 25 bp, Mus musculus
gagagctgagagctgcctcgcgccc

SEQ ID NO: 307633 - DNA, 25 bp, Mus musculus
ttccgagctcagctctggggagccg

SEQ ID NO: 307634 - DNA, 25 bp, Mus musculus
aaccagcgcctcaagtgtgtgcatc

SEQ ID NO: 307635 - DNA, 25 bp, Mus musculus
cttggcactgtttaccgtgaccgcc

SEQ ID NO: 307636 - DNA, 25 bp, Mus musculus
cgcagactcgcgagcccacccttcc

SEQ ID NO: 307637 - DNA, 25 bp, Mus musculus
agtttaactcccggcagtcttctcg

SEQ ID NO: 307638 - DNA, 25 bp, Mus musculus
agagactggcgcagccgttcctccg

SEQ ID NO: 307639 - DNA, 25 bp, Mus musculus
gttcctccgcgctcaaggccctcaa

SEQ ID NO: 307640 - DNA, 25 bp, Mus musculus
tcaaggccctcaagcgctgcttcag

SEQ ID NO: 307641 - DNA, 25 bp, Mus musculus
cccgcttggcactgtttaccgtgac

SEQ ID NO: 307642 - DNA, 25 bp, Mus musculus
catcaccctcggagcttaaggggcg

SEQ ID NO: 307643 - DNA, 25 bp, Mus musculus
actgtttaccgtgaccgccgccatt

SEQ ID NO: 307644 - DNA, 25 bp, Mus musculus
tgaccgccgccattcctggcaagca

SEQ ID NO: 307645 - DNA, 25 bp, Mus musculus
gccgccattcctggcaagcaccgcc

SEQ ID NO: 307646 - DNA, 25 bp, Mus musculus
tggcactgtttaccgtgaccgccgc

SEQ ID NO: 307647 - DNA, 25 bp, Mus musculus
gcccatcaccctcggagcttaaggg

SEQ ID NO: 307648 - DNA, 25 bp, Mus musculus
cgcctgcgcagactcgcgagcccac

SEQ ID NO: 307649 - DNA, 25 bp, Mus musculus
tgcctttcagtatccgagcttcgcg

SEQ ID NO: 307650 - DNA, 25 bp, Mus musculus
atcgcattggcttggccacctctgc

SEQ ID NO: 307651 - DNA, 25 bp, Mus musculus
ggagtgcccgcctatcgacaactta

SEQ ID NO: 307652 - DNA, 25 bp, Mus musculus
tccttagaatctagggcggagtgcc

SEQ ID NO: 307653 - DNA, 25 bp, Mus musculus
gggtaagtagccataaccttttgca

SEQ ID NO: 307654 - DNA, 25 bp, Mus musculus
gtcgcgacctcatcttgcctttcag

SEQ ID NO: 307655 - DNA, 25 bp, Mus musculus
gcctctttcccacgttatgtcgcga

SEQ ID NO: 307656 - DNA, 25 bp, Mus musculus
tcgcgagtggtaccgccagaactct

SEQ ID NO: 307657 - DNA, 25 bp, Mus musculus
ttaggctctttcctggccgtcaaga

SEQ ID NO: 307658 - DNA, 25 bp, Mus musculus
cgcagtttgccaattgcccggcttg

SEQ ID NO: 307659 - DNA, 25 bp, Mus musculus
agtggacctgcccatccgcagtttg

SEQ ID NO: 307660 - DNA, 25 bp, Mus musculus
cgagaaatggcgtcgccctcccata

SEQ ID NO: 307661 - DNA, 25 bp, Mus musculus
ctctcaagcggccatgtgctcattc

SEQ ID NO: 307662 - DNA, 25 bp, Mus musculus
ctgactcgcagacatgatccttaga

SEQ ID NO: 307663 - DNA, 25 bp, Mus musculus
ccagctatggagacgatggcgtaca

SEQ ID NO: 307664 - DNA, 25 bp, Mus musculus
agccatggcgatcgcagagcccata

SEQ ID NO: 307665 - DNA, 25 bp, Mus musculus
acggctcagagagaagatgaccttg

SEQ ID NO: 307666 - DNA, 25 bp, Mus musculus
tgaccttgccttctcggtcgggatc

SEQ ID NO: 307667 - DNA, 25 bp, Mus musculus
atctggagccaagcggtacgccacc

SEQ ID NO: 307668 - DNA, 25 bp, Mus musculus
tgacggactccagcacgttcagctc

SEQ ID NO: 307669 - DNA, 25 bp, Mus musculus
aacgtgcccagctgcgtgtaagcca

SEQ ID NO: 307670 - DNA, 25 bp, Mus musculus
cagggacccgactgtgacaaatatg

SEQ ID NO: 307671 - DNA, 25 bp, Mus musculus
ggcgtacaggcttatgatgatattc

SEQ ID NO: 307672 - DNA, 25 bp, Mus musculus
atgatattccacgtggtcagcagca

SEQ ID NO: 307673 - DNA, 25 bp, Mus musculus
agcatcacgctgaaggcaacggcca

SEQ ID NO: 307674 - DNA, 25 bp, Mus musculus
gaaaggctgtcctgcaggtcgtaga

SEQ ID NO: 307675 - DNA, 25 bp, Mus musculus
aggtcgtagaactccaggttgctga

SEQ ID NO: 307676 - DNA, 25 bp, Mus musculus
gttgctgacaaaccagccgcggctg

SEQ ID NO: 307677 - DNA, 25 bp, Mus musculus
tctgagacggcaaagagcaccctgc

SEQ ID NO: 307678 - DNA, 25 bp, Mus musculus
tgcacggcagcaccttttcaaagaa

SEQ ID NO: 307679 - DNA, 25 bp, Mus musculus
ctcggcatcatagcgctcgaaagga

SEQ ID NO: 307680 - DNA, 25 bp, Mus musculus
tccagcgacggcagtttcatctttg

SEQ ID NO: 307681 - DNA, 25 bp, Mus musculus
tgggtttacgcacacgatgtaggcc

SEQ ID NO: 307682 - DNA, 25 bp, Mus musculus
cgaaacttgatgactatgcacggca

SEQ ID NO: 307683 - DNA, 25 bp, Mus musculus
actgcccagcagctcttgtcgtagg

SEQ ID NO: 307684 - DNA, 25 bp, Mus musculus
aggtaccgctcgtgcagaacaatca

SEQ ID NO: 307685 - DNA, 25 bp, Mus musculus
ccaggtgaccatcaagacgtaattc

SEQ ID NO: 307686 - DNA, 25 bp, Mus musculus
acctgatggccgtgatgttgctgac

SEQ ID NO: 307687 - DNA, 25 bp, Mus musculus
aagtttccgcgcgaggcttgtcgaa

SEQ ID NO: 307688 - DNA, 25 bp, Mus musculus
ttggtgtagttccagacgtcgcaca

SEQ ID NO: 307689 - DNA, 25 bp, Mus musculus
tcccgaccaggatgatgagcgccgt

SEQ ID NO: 307690 - DNA, 25 bp, Mus musculus
agcaccctgcggcacttctgacaga

SEQ ID NO: 307691 - DNA, 25 bp, Mus musculus
ctgcgtcccgcgaatatgtcgtatg

SEQ ID NO: 307692 - DNA, 25 bp, Mus musculus
cgagtcgtgtttctggaagttggac

SEQ ID NO: 307693 - DNA, 25 bp, Mus musculus
ctggaagttggacgcaaacgcgatc

SEQ ID NO: 307694 - DNA, 25 bp, Mus musculus
cgcaaacgcgatcaggacagggtcc

SEQ ID NO: 307695 - DNA, 25 bp, Mus musculus
cccacggatggtgtgtgtctaaagg

SEQ ID NO: 307696 - DNA, 25 bp, Mus musculus
gcggagtcccttcaggttccactgg

SEQ ID NO: 307697 - DNA, 25 bp, Mus musculus
tttagggcttccgacttcagggcga

SEQ ID NO: 307698 - DNA, 25 bp, Mus musculus
gcatgcatatgaggctgcgcgcaga

SEQ ID NO: 307699 - DNA, 25 bp, Mus musculus
tgaggtgcgtatgatctccctgaga

SEQ ID NO: 307700 - DNA, 25 bp, Mus musculus
tctccctgagagacgataagacagc

SEQ ID NO: 307701 - DNA, 25 bp, Mus musculus
cagcgacctgtctggagggcatgat

SEQ ID NO: 307702 - DNA, 25 bp, Mus musculus
cgcggtgaccgtatgtttgaagtga

SEQ ID NO: 307703 - DNA, 25 bp, Mus musculus
tggccctgcacaatgggcggagtct

SEQ ID NO: 307704 - DNA, 25 bp, Mus musculus
cgtatgtagtcttatgaggtgcgta

SEQ ID NO: 307705 - DNA, 25 bp, Mus musculus
agccctccacacctctgtcacgatg

SEQ ID NO: 307706 - DNA, 25 bp, Mus musculus
cgcactcctttcaaacgcacggtcg

SEQ ID NO: 307707 - DNA, 25 bp, Mus musculus
cgccacgccctcacgccctcaagcc

SEQ ID NO: 307708 - DNA, 25 bp, Mus musculus
gtcacgatgctcctctctcacgaaa

SEQ ID NO: 307709 - DNA, 25 bp, Mus musculus
ctctcacgaaaatcacacgtgtgtc

SEQ ID NO: 307710 - DNA, 25 bp, Mus musculus
aatcacacgtgtgtcacgcaacaca

SEQ ID NO: 307711 - DNA, 25 bp, Mus musculus
gtcacgcaacacactccacctgaga

SEQ ID NO: 307712 - DNA, 25 bp, Mus musculus
tccacctgagacacggcccttcggg

SEQ ID NO: 307713 - DNA, 25 bp, Mus musculus
ctgcgcgcctctcatctgcatacgc

SEQ ID NO: 307714 - DNA, 25 bp, Mus musculus
acgcgccgcttgctcttgctcttgc

SEQ ID NO: 307715 - DNA, 25 bp, Mus musculus
tgctcttgctctagctctcgctcta

SEQ ID NO: 307716 - DNA, 25 bp, Mus musculus
gctctcgctctagatttcgcgctcg

SEQ ID NO: 307717 - DNA, 25 bp, Mus musculus
tcgggctccgcacgaccggcagccc

SEQ ID NO: 307718 - DNA, 25 bp, Mus musculus
cacggtcgcctcctccgcgtcaccg

SEQ ID NO: 307719 - DNA, 25 bp, Mus musculus
ctctcagggtcaatctcctgtgtca

SEQ ID NO: 307720 - DNA, 25 bp, Mus musculus
agcctctcagggtcaatctcctgtg

SEQ ID NO: 307721 - DNA, 25 bp, Mus musculus
ctcagggtcaatctcctgtgtcaca

SEQ ID NO: 307722 - DNA, 25 bp, Mus musculus
tctcagggtcaatctcctgtgtcac

SEQ ID NO: 307723 - DNA, 25 bp, Mus musculus
cagggtcaatctcctgtgtcacaca

SEQ ID NO: 307724 - DNA, 25 bp, Mus musculus
cctctcagggtcaatctcctgtgtc

SEQ ID NO: 307725 - DNA, 25 bp, Mus musculus
cacagcctctcagggtcaatctcct

SEQ ID NO: 307726 - DNA, 25 bp, Mus musculus
acacagcctctcagggtcaatctcc

SEQ ID NO: 307727 - DNA, 25 bp, Mus musculus
cacacagcctctcagggtcaatctc

SEQ ID NO: 307728 - DNA, 25 bp, Mus musculus
gcctctcagggtcaatctcctgtgt

SEQ ID NO: 307729 - DNA, 25 bp, Mus musculus
agggtcaatctcctgtgtcacacag

SEQ ID NO: 307730 - DNA, 25 bp, Mus musculus
tcagggtcaatctcctgtgtcacac

SEQ ID NO: 307731 - DNA, 25 bp, Mus musculus
cagcctctcagggtcaatctcctgt

SEQ ID NO: 307732 - DNA, 25 bp, Mus musculus
gggtcaatctcctgtgtcacacagc

SEQ ID NO: 307733 - DNA, 25 bp, Mus musculus
actgactcctgtgggcagcgtggac

SEQ ID NO: 307734 - DNA, 25 bp, Mus musculus
gacgcggcacaggggctgtttccct

SEQ ID NO: 307735 - DNA, 25 bp, Mus musculus
gcggcacaggggctgtttccctccc

SEQ ID NO: 307736 - DNA, 25 bp, Mus musculus
gggcagcgtggactttacaacccgc

SEQ ID NO: 307737 - DNA, 25 bp, Mus musculus
gtcgactgactcctgtgggcagcgt

SEQ ID NO: 307738 - DNA, 25 bp, Mus musculus
tcgactgactcctgtgggcagcgtg

SEQ ID NO: 307739 - DNA, 25 bp, Mus musculus
gcagcgtggactttacaacccgctc

SEQ ID NO: 307740 - DNA, 25 bp, Mus musculus
tgggcagcgtggactttacaacccg

SEQ ID NO: 307741 - DNA, 25 bp, Mus musculus
gtgggcagcgtggactttacaaccc

SEQ ID NO: 307742 - DNA, 25 bp, Mus musculus
ctgtgggcagcgtggactttacaac

SEQ ID NO: 307743 - DNA, 25 bp, Mus musculus
cctgtgggcagcgtggactttacaa

SEQ ID NO: 307744 - DNA, 25 bp, Mus musculus
ctcctgtgggcagcgtggactttac

SEQ ID NO: 307745 - DNA, 25 bp, Mus musculus
actcctgtgggcagcgtggacttta

SEQ ID NO: 307746 - DNA, 25 bp, Mus musculus
tggactttacaacccgctcccgcgc

SEQ ID NO: 307747 - DNA, 25 bp, Mus musculus
agggtctcacctggccggaggagtc

SEQ ID NO: 307748 - DNA, 25 bp, Mus musculus
accagcggatcccttcccgaccgct

SEQ ID NO: 307749 - DNA, 25 bp, Mus musculus
atcccttcccgaccgctcgctccgt

SEQ ID NO: 307750 - DNA, 25 bp, Mus musculus
accgctcgctccgtctcttcaccgg

SEQ ID NO: 307751 - DNA, 25 bp, Mus musculus
gtctcttcaccggtcgccttcgcag

SEQ ID NO: 307752 - DNA, 25 bp, Mus musculus
tcaccggtcgccttcgcagccctca

SEQ ID NO: 307753 - DNA, 25 bp, Mus musculus
gcagccctcaggctacagaaccttg

SEQ ID NO: 307754 - DNA, 25 bp, Mus musculus
ctcaggctacagaaccttgccctgg

SEQ ID NO: 307755 - DNA, 25 bp, Mus musculus
tcaggctacagaaccttgccctggc

SEQ ID NO: 307756 - DNA, 25 bp, Mus musculus
ggctacagaaccttgccctggcggc

SEQ ID NO: 307757 - DNA, 25 bp, Mus musculus
acaaactgcgaaacgtacagaagcg

SEQ ID NO: 307758 - DNA, 25 bp, Mus musculus
cagaaccttgccctggcggcccgcg

SEQ ID NO: 307759 - DNA, 25 bp, Mus musculus
aggctacagaaccttgccctggcgg

SEQ ID NO: 307760 - DNA, 25 bp, Mus musculus
gcgaagacaaactgcgaaacgtaca

SEQ ID NO: 307761 - DNA, 25 bp, Mus musculus
gcccagttaggtgcgagcgaagacc

SEQ ID NO: 307762 - DNA, 25 bp, Mus musculus
cggctgtctccgacttaggctttcc

SEQ ID NO: 307763 - DNA, 25 bp, Mus musculus
ccgaattaaggagatgggacagaac

SEQ ID NO: 307764 - DNA, 25 bp, Mus musculus
cttctcccaggagacctgatcgctt

SEQ ID NO: 307765 - DNA, 25 bp, Mus musculus
ccagtatagtttgaaagctcgggcg

SEQ ID NO: 307766 - DNA, 25 bp, Mus musculus
gaaccgaatcggtgcttagcgaccg

SEQ ID NO: 307767 - DNA, 25 bp, Mus musculus
gcacacaacagtcttaagtccttta

SEQ ID NO: 307768 - DNA, 25 bp, Mus musculus
cgtcctcaccaggagcggggaagcc

SEQ ID NO: 307769 - DNA, 25 bp, Mus musculus
aattagtgcgtcacacccggcgagc

SEQ ID NO: 307770 - DNA, 25 bp, Mus musculus
agctcgggcgactcggcacacaaca

SEQ ID NO: 307771 - DNA, 25 bp, Mus musculus
taggctttccggctcatctttcgga

SEQ ID NO: 307772 - DNA, 25 bp, Mus musculus
tcaggcggagccgtctcaattcacg

SEQ ID NO: 307773 - DNA, 25 bp, Mus musculus
tctcaattcacgaagccaatgctcg

SEQ ID NO: 307774 - DNA, 25 bp, Mus musculus
cggctcgctcttttacgcctgcgtg

SEQ ID NO: 307775 - DNA, 25 bp, Mus musculus
agaatgaatggagaagtcgggcggc

SEQ ID NO: 307776 - DNA, 25 bp, Mus musculus
cctgtccctctcaggcgcgcccata

SEQ ID NO: 307777 - DNA, 25 bp, Mus musculus
ctctcaggcgcgcccatagtggcgg

SEQ ID NO: 307778 - DNA, 25 bp, Mus musculus
atagtggcggcggaaaggtgcacac

SEQ ID NO: 307779 - DNA, 25 bp, Mus musculus
cagcgacttcctccctctggcgcca

SEQ ID NO: 307780 - DNA, 25 bp, Mus musculus
ggcgccatctttagctgagcgcttg

SEQ ID NO: 307781 - DNA, 25 bp, Mus musculus
gccatctttagctgagcgcttgccg

SEQ ID NO: 307782 - DNA, 25 bp, Mus musculus
ttctcatctcgccacctgtccctct

SEQ ID NO: 307783 - DNA, 25 bp, Mus musculus
acacagacggtcttgacccagagct

SEQ ID NO: 307784 - DNA, 25 bp, Mus musculus
agcacacagacggtcttgacccaga

SEQ ID NO: 307785 - DNA, 25 bp, Mus musculus
cgtgagcacacagacggtcttgacc

SEQ ID NO: 307786 - DNA, 25 bp, Mus musculus
gcagcgtgagcacacagacggtctt

SEQ ID NO: 307787 - DNA, 25 bp, Mus musculus
gcacccggcagcgtgagcacacaga

SEQ ID NO: 307788 - DNA, 25 bp, Mus musculus
atctttagctgagcgcttgccgggg

SEQ ID NO: 307789 - DNA, 25 bp, Mus musculus
atccgcgagtaagcccgagctgagt

SEQ ID NO: 307790 - DNA, 25 bp, Mus musculus
gctcgtcccggagcccgtgcacccg

SEQ ID NO: 307791 - DNA, 25 bp, Mus musculus
cggagcccgtgcacccgcgcaccat

SEQ ID NO: 307792 - DNA, 25 bp, Mus musculus
cgtgcacccgcgcaccatccgcgag

SEQ ID NO: 307793 - DNA, 25 bp, Mus musculus
gaacacagacacacctcaccccaga

SEQ ID NO: 307794 - DNA, 25 bp, Mus musculus
accatccgcgagtaagcccgagctg

SEQ ID NO: 307795 - DNA, 25 bp, Mus musculus
catccgcgagtaagcccgagctgag

SEQ ID NO: 307796 - DNA, 25 bp, Mus musculus
gcgagtaagcccgagctgagtctga

SEQ ID NO: 307797 - DNA, 25 bp, Mus musculus
cgagtaagcccgagctgagtctgag

SEQ ID NO: 307798 - DNA, 25 bp, Mus musculus
agtaagcccgagctgagtctgagtg

SEQ ID NO: 307799 - DNA, 25 bp, Mus musculus
gtaagcccgagctgagtctgagtgc

SEQ ID NO: 307800 - DNA, 25 bp, Mus musculus
taagcccgagctgagtctgagtgcg

SEQ ID NO: 307801 - DNA, 25 bp, Mus musculus
agctgagtctgagtgcggatgtgcc

SEQ ID NO: 307802 - DNA, 25 bp, Mus musculus
ccatccgcgagtaagcccgagctga

SEQ ID NO: 307803 - DNA, 25 bp, Mus musculus
acccggcccagtgtgtgtgtcacaa

SEQ ID NO: 307804 - DNA, 25 bp, Mus musculus
cacctgtgttcctcgtattctgagc

SEQ ID NO: 307805 - DNA, 25 bp, Mus musculus
tctggagccacctgtgttcctcgta

SEQ ID NO: 307806 - DNA, 25 bp, Mus musculus
gctgtctgtgccgtcgcggcgtctc

SEQ ID NO: 307807 - DNA, 25 bp, Mus musculus
gttccacgtggaaactgtcgcccgc

SEQ ID NO: 307808 - DNA, 25 bp, Mus musculus
ggagacccggcgtcaaacgcacgcg

SEQ ID NO: 307809 - DNA, 25 bp, Mus musculus
tctcacgcgggagcacgcggagacc

SEQ ID NO: 307810 - DNA, 25 bp, Mus musculus
gactgtgtggccgtctcgggcctcc

SEQ ID NO: 307811 - DNA, 25 bp, Mus musculus
ctcagcgcgactgtgtggccgtctc

SEQ ID NO: 307812 - DNA, 25 bp, Mus musculus
gagaacacggcgctcagcgcgactg

SEQ ID NO: 307813 - DNA, 25 bp, Mus musculus
gacagacagtcacggcgtcaggacg

SEQ ID NO: 307814 - DNA, 25 bp, Mus musculus
agcgtcccacagacagcgtccagag

SEQ ID NO: 307815 - DNA, 25 bp, Mus musculus
gatggaggcgcagcgtcccacagac

SEQ ID NO: 307816 - DNA, 25 bp, Mus musculus
acgtccgcgcgtgtgcgggttccac

SEQ ID NO: 307817 - DNA, 25 bp, Mus musculus
tgtgccgggttatcaaggctgccac

SEQ ID NO: 307818 - DNA, 25 bp, Mus musculus
cgtgcggctcgcagtgccttcctga

SEQ ID NO: 307819 - DNA, 25 bp, Mus musculus
gggttatcaaggctgccaccggctt

SEQ ID NO: 307820 - DNA, 25 bp, Mus musculus
caaacgggagcaaccgttatgaggg

SEQ ID NO: 307821 - DNA, 25 bp, Mus musculus
agcccaaacgggagcaaccgttatg

SEQ ID NO: 307822 - DNA, 25 bp, Mus musculus
ttgtgaagaaatagactcagggcgg

SEQ ID NO: 307823 - DNA, 25 bp, Mus musculus
tgccgggttatcaaggctgccaccg

SEQ ID NO: 307824 - DNA, 25 bp, Mus musculus
agcccggttgtgaagaaatagactc

SEQ ID NO: 307825 - DNA, 25 bp, Mus musculus
gcgaagctcaaaggcccagagggca

SEQ ID NO: 307826 - DNA, 25 bp, Mus musculus
gttatcaaggctgccaccggcttcc

SEQ ID NO: 307827 - DNA, 25 bp, Mus musculus
tgagggcgaagctcaaaggcccaga

SEQ ID NO: 307828 - DNA, 25 bp, Mus musculus
gctgagggcgaagctcaaaggccca

SEQ ID NO: 307829 - DNA, 25 bp, Mus musculus
tgcgaagccagaggctgagggcgaa

SEQ ID NO: 307830 - DNA, 25 bp, Mus musculus
cccggttgtgaagaaatagactcag

SEQ ID NO: 307831 - DNA, 25 bp, Mus musculus
ttctcgccctgtggtggattcgatt

SEQ ID NO: 307832 - DNA, 25 bp, Mus musculus
tcgattccacccgtgtccgaattcg

SEQ ID NO: 307833 - DNA, 25 bp, Mus musculus
ctgattctcgccctgtggtggattc

SEQ ID NO: 307834 - DNA, 25 bp, Mus musculus
gattctcgccctgtggtggattcga

SEQ ID NO: 307835 - DNA, 25 bp, Mus musculus
tctcgccctgtggtggattcgattc

SEQ ID NO: 307836 - DNA, 25 bp, Mus musculus
tcgccctgtggtggattcgattcca

SEQ ID NO: 307837 - DNA, 25 bp, Mus musculus
ccctgtggtggattcgattccaccc

SEQ ID NO: 307838 - DNA, 25 bp, Mus musculus
tgtggtggattcgattccacccgtg

SEQ ID NO: 307839 - DNA, 25 bp, Mus musculus
tggtggattcgattccacccgtgtc

SEQ ID NO: 307840 - DNA, 25 bp, Mus musculus
gtggattcgattccacccgtgtccg

SEQ ID NO: 307841 - DNA, 25 bp, Mus musculus
tggattcgattccacccgtgtccga

SEQ ID NO: 307842 - DNA, 25 bp, Mus musculus
ggattcgattccacccgtgtccgaa

SEQ ID NO: 307843 - DNA, 25 bp, Mus musculus
cgccctgtggtggattcgattccac

SEQ ID NO: 307844 - DNA, 25 bp, Mus musculus
tgattctcgccctgtggtggattcg

SEQ ID NO: 307845 - DNA, 25 bp, Mus musculus
agcttgtcttcttgcctctccagcg

SEQ ID NO: 307846 - DNA, 25 bp, Mus musculus
gctgccaattctccaacacagagac

SEQ ID NO: 307847 - DNA, 25 bp, Mus musculus
gagacccaacctacccaggagcttg

SEQ ID NO: 307848 - DNA, 25 bp, Mus musculus
acctacccaggagcttgtcttcttg

SEQ ID NO: 307849 - DNA, 25 bp, Mus musculus
gcctctggcagcctcgtcattggct

SEQ ID NO: 307850 - DNA, 25 bp, Mus musculus
aggagcttgtcttcttgcctctcca

SEQ ID NO: 307851 - DNA, 25 bp, Mus musculus
tggttgccggctttcgagcaggctt

SEQ ID NO: 307852 - DNA, 25 bp, Mus musculus
tgcctgcgtcctccacttcgtcccg

SEQ ID NO: 307853 - DNA, 25 bp, Mus musculus
caagctgccaattctccaacacaga

SEQ ID NO: 307854 - DNA, 25 bp, Mus musculus
gcttggagactctgcctgcgtcctc

SEQ ID NO: 307855 - DNA, 25 bp, Mus musculus
ctttcgagcaggcttggagactctg

SEQ ID NO: 307856 - DNA, 25 bp, Mus musculus
ctctggcagcctcgtcattggctct

SEQ ID NO: 307857 - DNA, 25 bp, Mus musculus
agagagcagcggagattcgagcctc

SEQ ID NO: 307858 - DNA, 25 bp, Mus musculus
attcgagcctcggagggtggttgcc

SEQ ID NO: 307859 - DNA, 25 bp, Mus musculus
aagtcgtggttgagggcatcgtcac

SEQ ID NO: 307860 - DNA, 25 bp, Mus musculus
ggtgatctggctgcccttccgccgt

SEQ ID NO: 307861 - DNA, 25 bp, Mus musculus
ggatttctgctctggttggtggact

SEQ ID NO: 307862 - DNA, 25 bp, Mus musculus
tggcggtgccaggtactcaaacata

SEQ ID NO: 307863 - DNA, 25 bp, Mus musculus
tgccaggtactcaaacatagacgtc

SEQ ID NO: 307864 - DNA, 25 bp, Mus musculus
ggtactcaaacatagacgtcaagtg

SEQ ID NO: 307865 - DNA, 25 bp, Mus musculus
cgtcaagtgagtagacagcatgccc

SEQ ID NO: 307866 - DNA, 25 bp, Mus musculus
gcatggggtccgaccagaagaagtc

SEQ ID NO: 307867 - DNA, 25 bp, Mus musculus
tccgaccagaagaagtcgtggttga

SEQ ID NO: 307868 - DNA, 25 bp, Mus musculus
ttgagggcatcgtcactgtcaatcc

SEQ ID NO: 307869 - DNA, 25 bp, Mus musculus
ttccggcctcagaagacacgttcaa

SEQ ID NO: 307870 - DNA, 25 bp, Mus musculus
tccgccgtggcggtgccaggtactc

SEQ ID NO: 307871 - DNA, 25 bp, Mus musculus
gttccggcctcagaagacacgttca

SEQ ID NO: 307872 - DNA, 25 bp, Mus musculus
tttctgctctggttggtggactgct

SEQ ID NO: 307873 - DNA, 25 bp, Mus musculus
gagattcgtcggctcccaaaaagga

SEQ ID NO: 307874 - DNA, 25 bp, Mus musculus
caccgcctgtgctctaatagcttta

SEQ ID NO: 307875 - DNA, 25 bp, Mus musculus
ttcaccgctgaatatgcataaggca

SEQ ID NO: 307876 - DNA, 25 bp, Mus musculus
ggacgggcctcgttcatgaatattc

SEQ ID NO: 307877 - DNA, 25 bp, Mus musculus
tggtttgtcctacgcatcggtaatg

SEQ ID NO: 307878 - DNA, 25 bp, Mus musculus
tcagcttcggagttcaggctcattt

SEQ ID NO: 307879 - DNA, 25 bp, Mus musculus
ttaggccatttttactcagcttcgg

SEQ ID NO: 307880 - DNA, 25 bp, Mus musculus
cccgtgcactcaaaccgaggactta

SEQ ID NO: 307881 - DNA, 25 bp, Mus musculus
gaatgttcctggtcctgtcgtcctc

SEQ ID NO: 307882 - DNA, 25 bp, Mus musculus
cgccctttatagattcgcccttgtg

SEQ ID NO: 307883 - DNA, 25 bp, Mus musculus
gcgcaggcgcaaacctcgctacaaa

SEQ ID NO: 307884 - DNA, 25 bp, Mus musculus
gcctaagtgctcagaacccgtccgg

SEQ ID NO: 307885 - DNA, 25 bp, Mus musculus
gggtgttctttctgacgcgacagga

SEQ ID NO: 307886 - DNA, 25 bp, Mus musculus
aactggctgagtgacgccctttata

SEQ ID NO: 307887 - DNA, 25 bp, Mus musculus
gacccatcccggcttccacgagtcc

SEQ ID NO: 307888 - DNA, 25 bp, Mus musculus
cgagggacccatcccggcttccacg

SEQ ID NO: 307889 - DNA, 25 bp, Mus musculus
agggacccatcccggcttccacgag

SEQ ID NO: 307890 - DNA, 25 bp, Mus musculus
cccatcccggcttccacgagtcccg

SEQ ID NO: 307891 - DNA, 25 bp, Mus musculus
gagggacccatcccggcttccacga

SEQ ID NO: 307892 - DNA, 25 bp, Mus musculus
ccatcccggcttccacgagtcccgc

SEQ ID NO: 307893 - DNA, 25 bp, Mus musculus
ctctgtctgtcaatctcccttctcc

SEQ ID NO: 307894 - DNA, 25 bp, Mus musculus
tctgtctgtcaatctcccttctcct

SEQ ID NO: 307895 - DNA, 25 bp, Mus musculus
ctgtctgtcaatctcccttctcctt

SEQ ID NO: 307896 - DNA, 25 bp, Mus musculus
gtctctgtctgtcaatctcccttct

SEQ ID NO: 307897 - DNA, 25 bp, Mus musculus
ggtctctgtctgtcaatctcccttc

SEQ ID NO: 307898 - DNA, 25 bp, Mus musculus
gggtctctgtctgtcaatctccctt

SEQ ID NO: 307899 - DNA, 25 bp, Mus musculus
tctctgtctgtcaatctcccttctc

SEQ ID NO: 307900 - DNA, 25 bp, Mus musculus
acagagacacccagactgcgcggga

SEQ ID NO: 307901 - DNA, 25 bp, Mus musculus
agagacacccagactgcgcgggaca

SEQ ID NO: 307902 - DNA, 25 bp, Mus musculus
gagacacccagactgcgcgggacac

SEQ ID NO: 307903 - DNA, 25 bp, Mus musculus
agacacccagactgcgcgggacacg

SEQ ID NO: 307904 - DNA, 25 bp, Mus musculus
gacacccagactgcgcgggacacgg

SEQ ID NO: 307905 - DNA, 25 bp, Mus musculus
aagggagattgacagacagagaccc

SEQ ID NO: 307906 - DNA, 25 bp, Mus musculus
cagagacacccagactgcgcgggac

SEQ ID NO: 307907 - DNA, 25 bp, Mus musculus
ggcagccagaggagctgcccgagtt

SEQ ID NO: 307908 - DNA, 25 bp, Mus musculus
aggagctcgaaagttcggacgagcg

SEQ ID NO: 307909 - DNA, 25 bp, Mus musculus
cggaggagctcgaaagttcggacga

SEQ ID NO: 307910 - DNA, 25 bp, Mus musculus
cacggaggagctcgaaagttcggac

SEQ ID NO: 307911 - DNA, 25 bp, Mus musculus
cgcgcacggaggagctcgaaagttc

SEQ ID NO: 307912 - DNA, 25 bp, Mus musculus
ccgcgcacggaggagctcgaaagtt

SEQ ID NO: 307913 - DNA, 25 bp, Mus musculus
cccgcgcacggaggagctcgaaagt

SEQ ID NO: 307914 - DNA, 25 bp, Mus musculus
agccagaggagctgcccgagttggc

SEQ ID NO: 307915 - DNA, 25 bp, Mus musculus
cacgcaggcttctgcggcagccaga

SEQ ID NO: 307916 - DNA, 25 bp, Mus musculus
gagggcagcccacgcaggcttctgc

SEQ ID NO: 307917 - DNA, 25 bp, Mus musculus
cagcagcagtagaaggggggaggcg

SEQ ID NO: 307918 - DNA, 25 bp, Mus musculus
cgccgcggactgtaggcgccgggcg

SEQ ID NO: 307919 - DNA, 25 bp, Mus musculus
tgcccgcgcacggaggagctcgaaa

SEQ ID NO: 307920 - DNA, 25 bp, Mus musculus
gccgggcgcgctgaacgggttcggc

SEQ ID NO: 307921 - DNA, 25 bp, Mus musculus
gacttggacctgaaccgccgtcagc

SEQ ID NO: 307922 - DNA, 25 bp, Mus musculus
gagaagaatgcagttgtcacgacca

SEQ ID NO: 307923 - DNA, 25 bp, Mus musculus
taatttttgtttctgtgagcatgga

SEQ ID NO: 307924 - DNA, 25 bp, Mus musculus
agttgtcacgaccattcaatttttt

SEQ ID NO: 307925 - DNA, 25 bp, Mus musculus
tgcagttgtcacgaccattcaattt

SEQ ID NO: 307926 - DNA, 25 bp, Mus musculus
gaagaatgcagttgtcacgaccatt

SEQ ID NO: 307927 - DNA, 25 bp, Mus musculus
cagagaagaatgcagttgtcacgac

SEQ ID NO: 307928 - DNA, 25 bp, Mus musculus
tggtgacagagaagaatgcagttgt

SEQ ID NO: 307929 - DNA, 25 bp, Mus musculus
tcaccctggccgggcacatccgacc

SEQ ID NO: 307930 - DNA, 25 bp, Mus musculus
gcacttcctgtatctatccagggac

SEQ ID NO: 307931 - DNA, 25 bp, Mus musculus
tgtttctgtgagcatggaaattaac

SEQ ID NO: 307932 - DNA, 25 bp, Mus musculus
cggacttggacctgaaccgccgtca

SEQ ID NO: 307933 - DNA, 25 bp, Mus musculus
agcggcggacttggacctgaaccgc

SEQ ID NO: 307934 - DNA, 25 bp, Mus musculus
cacttcctgtatctatccagggaca

SEQ ID NO: 307935 - DNA, 25 bp, Mus musculus
ctgtcctggtcctcgctttaattct

SEQ ID NO: 307936 - DNA, 25 bp, Mus musculus
tggcgctgcccatggcctgtgcagc

SEQ ID NO: 307937 - DNA, 25 bp, Mus musculus
ctgcccatggcctgtgcagcctggg

SEQ ID NO: 307938 - DNA, 25 bp, Mus musculus
tgcccatggcctgtgcagcctgggt

SEQ ID NO: 307939 - DNA, 25 bp, Mus musculus
gcccatggcctgtgcagcctgggtc

SEQ ID NO: 307940 - DNA, 25 bp, Mus musculus
cccatggcctgtgcagcctgggtct

SEQ ID NO: 307941 - DNA, 25 bp, Mus musculus
ccatggcctgtgcagcctgggtctg

SEQ ID NO: 307942 - DNA, 25 bp, Mus musculus
catggcctgtgcagcctgggtctgt

SEQ ID NO: 307943 - DNA, 25 bp, Mus musculus
atggcctgtgcagcctgggtctgtg

SEQ ID NO: 307944 - DNA, 25 bp, Mus musculus
ggcctgtgcagcctgggtctgtgtg

SEQ ID NO: 307945 - DNA, 25 bp, Mus musculus
cctgtcctggtcctcgctttaattc

SEQ ID NO: 307946 - DNA, 25 bp, Mus musculus
gcctccccccgctgcctctgtctcc

SEQ ID NO: 307947 - DNA, 25 bp, Mus musculus
ctggcgctgcccatggcctgtgcag

SEQ ID NO: 307948 - DNA, 25 bp, Mus musculus
gtgtgtccgtcctcctgtcctggtc

SEQ ID NO: 307949 - DNA, 25 bp, Mus musculus
ctagtaattcctgccttcgtgggtc

SEQ ID NO: 307950 - DNA, 25 bp, Mus musculus
ttctttatcactcaaggaccccacg

SEQ ID NO: 307951 - DNA, 25 bp, Mus musculus
tttatcactcaaggaccccacgctg

SEQ ID NO: 307952 - DNA, 25 bp, Mus musculus
cttacaccaactccagtgaacctgg

SEQ ID NO: 307953 - DNA, 25 bp, Mus musculus
ttacaccaactccagtgaacctggc

SEQ ID NO: 307954 - DNA, 25 bp, Mus musculus
agtgaacctggcctctagtaattcc

SEQ ID NO: 307955 - DNA, 25 bp, Mus musculus
gtgaacctggcctctagtaattcct

SEQ ID NO: 307956 - DNA, 25 bp, Mus musculus
tgaacctggcctctagtaattcctg

SEQ ID NO: 307957 - DNA, 25 bp, Mus musculus
gaacctggcctctagtaattcctgc

SEQ ID NO: 307958 - DNA, 25 bp, Mus musculus
tctagtaattcctgccttcgtgggt

SEQ ID NO: 307959 - DNA, 25 bp, Mus musculus
agtaattcctgccttcgtgggtcca

SEQ ID NO: 307960 - DNA, 25 bp, Mus musculus
gtaattcctgccttcgtgggtccag

SEQ ID NO: 307961 - DNA, 25 bp, Mus musculus
ctacttctttatcactcaaggaccc

SEQ ID NO: 307962 - DNA, 25 bp, Mus musculus
aacctggcctctagtaattcctgcc

SEQ ID NO: 307963 - DNA, 25 bp, Mus musculus
tgaaacctttggaggaccagccacg

SEQ ID NO: 307964 - DNA, 25 bp, Mus musculus
ctttgggacacagctttaagggact

SEQ ID NO: 307965 - DNA, 25 bp, Mus musculus
gaagtaaggcgggccagccaccgcc

SEQ ID NO: 307966 - DNA, 25 bp, Mus musculus
agccaccgcctcgagccaaagtttc

SEQ ID NO: 307967 - DNA, 25 bp, Mus musculus
cccgcgcgtttctgctcaggagccc

SEQ ID NO: 307968 - DNA, 25 bp, Mus musculus
acacctcagagaaacttcccggcgt

SEQ ID NO: 307969 - DNA, 25 bp, Mus musculus
ctaggctttgggacacagctttaag

SEQ ID NO: 307970 - DNA, 25 bp, Mus musculus
cggacgggatctgaaacctttggag

SEQ ID NO: 307971 - DNA, 25 bp, Mus musculus
acctttggaggaccagccacgttcg

SEQ ID NO: 307972 - DNA, 25 bp, Mus musculus
tggaggaccagccacgttcgcacag

SEQ ID NO: 307973 - DNA, 25 bp, Mus musculus
cacgttcgcacagcccgcccatgcg

SEQ ID NO: 307974 - DNA, 25 bp, Mus musculus
cgcccatgcgcgctggcaccaggac

SEQ ID NO: 307975 - DNA, 25 bp, Mus musculus
ctggcaccaggacccgcaggctgcc

SEQ ID NO: 307976 - DNA, 25 bp, Mus musculus
acagctttaagggactgagcggccc

SEQ ID NO: 307977 - DNA, 25 bp, Mus musculus
tatggtgtccaacgagccgtgactg

SEQ ID NO: 307978 - DNA, 25 bp, Mus musculus
gagggtcgcaatcactccacctatg

SEQ ID NO: 307979 - DNA, 25 bp, Mus musculus
tcgcaatcactccacctatgaaggg

SEQ ID NO: 307980 - DNA, 25 bp, Mus musculus
tccacctatgaagggttaaattctg

SEQ ID NO: 307981 - DNA, 25 bp, Mus musculus
ggttaaattctgcagcccaatgccc

SEQ ID NO: 307982 - DNA, 25 bp, Mus musculus
agacgcggcgccatcgcagtcaggt

SEQ ID NO: 307983 - DNA, 25 bp, Mus musculus
ccttccaggttgatctaggggcgca

SEQ ID NO: 307984 - DNA, 25 bp, Mus musculus
cgctggggagcaacttaagagcgcc

SEQ ID NO: 307985 - DNA, 25 bp, Mus musculus
gccgtgaagagggtcgcaatcactc

SEQ ID NO: 307986 - DNA, 25 bp, Mus musculus
cgccctggtatggtgtccaacgagc

SEQ ID NO: 307987 - DNA, 25 bp, Mus musculus
actcggtctcctggggccgtgaaga

SEQ ID NO: 307988 - DNA, 25 bp, Mus musculus
tgatcccgggcaagcgctgcaagct

SEQ ID NO: 307989 - DNA, 25 bp, Mus musculus
gtggccctctgagcgccccagagtt

SEQ ID NO: 307990 - DNA, 25 bp, Mus musculus
agcaacttaagagcgccctggtatg

SEQ ID NO: 307991 - DNA, 25 bp, Mus musculus
gatgactgccaagccactgttccgc

SEQ ID NO: 307992 - DNA, 25 bp, Mus musculus
ctcggccgatctggctgctaatatc

SEQ ID NO: 307993 - DNA, 25 bp, Mus musculus
gccgacttcgactcttggggccagc

SEQ ID NO: 307994 - DNA, 25 bp, Mus musculus
cagtcttaggagaggcgccgacttc

SEQ ID NO: 307995 - DNA, 25 bp, Mus musculus
ttcctcctggccctgttaatgtcag

SEQ ID NO: 307996 - DNA, 25 bp, Mus musculus
cctcaacctaactggggcgtggctt

SEQ ID NO: 307997 - DNA, 25 bp, Mus musculus
ccaaggccgaatgccactgtagcta

SEQ ID NO: 307998 - DNA, 25 bp, Mus musculus
ctgtctgggccctagagatgtagcc

SEQ ID NO: 307999 - DNA, 25 bp, Mus musculus
cgtcacgtgactggagaccgcacca

SEQ ID NO: 308000 - DNA, 25 bp, Mus musculus
gtaaggccactcttcctgctgaagg

SEQ ID NO: 308001 - DNA, 25 bp, Mus musculus
tcctgacaagcttaccggggacctc

SEQ ID NO: 308002 - DNA, 25 bp, Mus musculus
tcccactgactaccatccaggggtg

SEQ ID NO: 308003 - DNA, 25 bp, Mus musculus
tgttccgcatggaataagccctcta

SEQ ID NO: 308004 - DNA, 25 bp, Mus musculus
ctcggaaggccaagcagatgactgc

SEQ ID NO: 308005 - DNA, 25 bp, Mus musculus
aaagttcttccctcgcgtgagcggc

SEQ ID NO: 308006 - DNA, 25 bp, Mus musculus
ggcaggatccgcgtcctcggctttc

SEQ ID NO: 308007 - DNA, 25 bp, Mus musculus
cccaagcatggggtcgcccaggcag

SEQ ID NO: 308008 - DNA, 25 bp, Mus musculus
agggccgccaagtctcctcctcctg

SEQ ID NO: 308009 - DNA, 25 bp, Mus musculus
ttccggacgtccgaactgctgctct

SEQ ID NO: 308010 - DNA, 25 bp, Mus musculus
cctcctggccctgccggcattccac

SEQ ID NO: 308011 - DNA, 25 bp, Mus musculus
cgccatggtgaccacgttgggtccc

SEQ ID NO: 308012 - DNA, 25 bp, Mus musculus
ggcactcgccatggtgaccacgttg

SEQ ID NO: 308013 - DNA, 25 bp, Mus musculus
ctgggattccggacgtccgaactgc

SEQ ID NO: 308014 - DNA, 25 bp, Mus musculus
gcgagtaccctgtcgcgatgacctc

SEQ ID NO: 308015 - DNA, 25 bp, Mus musculus
tcgcgtgagcggctccgagaccgca

SEQ ID NO: 308016 - DNA, 25 bp, Mus musculus
gctgcaaagttcttccctcgcgtga

SEQ ID NO: 308017 - DNA, 25 bp, Mus musculus
ggctcctgtccctcgctgcaaagtt

SEQ ID NO: 308018 - DNA, 25 bp, Mus musculus
tccgagaccgcagcgagtaccctgt

SEQ ID NO: 308019 - DNA, 25 bp, Mus musculus
taccttcgctatcagccgcttcatt

SEQ ID NO: 308020 - DNA, 25 bp, Mus musculus
agtatttacgcaaccgatcctgccc

SEQ ID NO: 308021 - DNA, 25 bp, Mus musculus
ttcaaaagtatttacgcaaccgatc

SEQ ID NO: 308022 - DNA, 25 bp, Mus musculus
gcgctaatagggtctttcaaaagta

SEQ ID NO: 308023 - DNA, 25 bp, Mus musculus
cccgcgcgctaatagggtctttcaa

SEQ ID NO: 308024 - DNA, 25 bp, Mus musculus
tgccgacccatagactccatggcgt

SEQ ID NO: 308025 - DNA, 25 bp, Mus musculus
atcagccgcttcattaacgtctgga

SEQ ID NO: 308026 - DNA, 25 bp, Mus musculus
gaacatgcgcattacttcatgcggc

SEQ ID NO: 308027 - DNA, 25 bp, Mus musculus
cctcaaagggctggttgtactgcgg

SEQ ID NO: 308028 - DNA, 25 bp, Mus musculus
ggtcgtcctcaaagggctggttgta

SEQ ID NO: 308029 - DNA, 25 bp, Mus musculus
ccaacgggtcgtcctcaaagggctg

SEQ ID NO: 308030 - DNA, 25 bp, Mus musculus
gcttcattaacgtctggaagcggct

SEQ ID NO: 308031 - DNA, 25 bp, Mus musculus
gagcacttccggtggaaacgagaag

SEQ ID NO: 308032 - DNA, 25 bp, Mus musculus
cgggtggaacatgcgcattacttca

SEQ ID NO: 308033 - DNA, 25 bp, Mus musculus
gtttcagctggctgttcccgctagc

SEQ ID NO: 308034 - DNA, 25 bp, Mus musculus
agtttcagctggctgttcccgctag

SEQ ID NO: 308035 - DNA, 25 bp, Mus musculus
tattggtggccgcttctaggctacc

SEQ ID NO: 308036 - DNA, 25 bp, Mus musculus
aggtctattggtggccgcttctagg

SEQ ID NO: 308037 - DNA, 25 bp, Mus musculus
aaggtctattggtggccgcttctag

SEQ ID NO: 308038 - DNA, 25 bp, Mus musculus
ttcaggtccaaaaggtctattggtg

SEQ ID NO: 308039 - DNA, 25 bp, Mus musculus
attggtggccgcttctaggctacca

SEQ ID NO: 308040 - DNA, 25 bp, Mus musculus
tctttcaggtccaaaaggtctattg

SEQ ID NO: 308041 - DNA, 25 bp, Mus musculus
gcccagtttcagctggctgttcccg

SEQ ID NO: 308042 - DNA, 25 bp, Mus musculus
ccagtttcagctggctgttcccgct

SEQ ID NO: 308043 - DNA, 25 bp, Mus musculus
ctttcaggtccaaaaggtctattgg

SEQ ID NO: 308044 - DNA, 25 bp, Mus musculus
tccgcgtgttagagcagagtctcct

SEQ ID NO: 308045 - DNA, 25 bp, Mus musculus
cgcgtgttagagcagagtctccttc

SEQ ID NO: 308046 - DNA, 25 bp, Mus musculus
gcagagtctccttcgtgtacaggga

SEQ ID NO: 308047 - DNA, 25 bp, Mus musculus
tgtacgtgcgagatagtcagatccg

SEQ ID NO: 308048 - DNA, 25 bp, Mus musculus
gagagatagtcagatccgcgtgtta

SEQ ID NO: 308049 - DNA, 25 bp, Mus musculus
ctgtacgtgagagatagtcagatcc

SEQ ID NO: 308050 - DNA, 25 bp, Mus musculus
cgagatagtcagatccgcgtgttag

SEQ ID NO: 308051 - DNA, 25 bp, Mus musculus
cagagtctccttcgtgtacagggaa

SEQ ID NO: 308052 - DNA, 25 bp, Mus musculus
ctgtacgtgcgagatagtcagatcc

SEQ ID NO: 308053 - DNA, 25 bp, Mus musculus
agcagagtctccttcgtgtacaggg

SEQ ID NO: 308054 - DNA, 25 bp, Mus musculus
gatccgcgtgttagagcagagtctc

SEQ ID NO: 308055 - DNA, 25 bp, Mus musculus
cgtgagagatagtcagatccgcgtg

SEQ ID NO: 308056 - DNA, 25 bp, Mus musculus
ctacgtgcgagatagtcagatccgc

SEQ ID NO: 308057 - DNA, 25 bp, Mus musculus
cagatccgcgtgttagagcagagtc

SEQ ID NO: 308058 - DNA, 25 bp, Mus musculus
ctcctctcggggattcaggtcgact

SEQ ID NO: 308059 - DNA, 25 bp, Mus musculus
ctgcgggacccagtggtcagtccct

SEQ ID NO: 308060 - DNA, 25 bp, Mus musculus
tgcgggacccagtggtcagtccctc

SEQ ID NO: 308061 - DNA, 25 bp, Mus musculus
gacccagtggtcagtccctcctccg

SEQ ID NO: 308062 - DNA, 25 bp, Mus musculus
ccagtggtcagtccctcctccgccc

SEQ ID NO: 308063 - DNA, 25 bp, Mus musculus
gccattgctcctctcggggattcag

SEQ ID NO: 308064 - DNA, 25 bp, Mus musculus
ccattgctcctctcggggattcagg

SEQ ID NO: 308065 - DNA, 25 bp, Mus musculus
gctcctctcggggattcaggtcgac

SEQ ID NO: 308066 - DNA, 25 bp, Mus musculus
gcctgcgggacccagtggtcagtcc

SEQ ID NO: 308067 - DNA, 25 bp, Mus musculus
tcctctcggggattcaggtcgactg

SEQ ID NO: 308068 - DNA, 25 bp, Mus musculus
cctctcggggattcaggtcgactga

SEQ ID NO: 308069 - DNA, 25 bp, Mus musculus
ctctcggggattcaggtcgactgac

SEQ ID NO: 308070 - DNA, 25 bp, Mus musculus
tctctctctgcaataccagcctgct

SEQ ID NO: 308071 - DNA, 25 bp, Mus musculus
cattgctcctctcggggattcaggt

SEQ ID NO: 308072 - DNA, 25 bp, Mus musculus
ctgcggacggcaccgagccggcttt

SEQ ID NO: 308073 - DNA, 25 bp, Mus musculus
cgcactaggcctccggtgaaacacg

SEQ ID NO: 308074 - DNA, 25 bp, Mus musculus
aggcctccggtgaaacacgtcatca

SEQ ID NO: 308075 - DNA, 25 bp, Mus musculus
cacgtcatcagacacggccgaggaa

SEQ ID NO: 308076 - DNA, 25 bp, Mus musculus
ggccgaggaacgacgtcagcgcacc

SEQ ID NO: 308077 - DNA, 25 bp, Mus musculus
agacgacgcttcctgcggacggcac

SEQ ID NO: 308078 - DNA, 25 bp, Mus musculus
cagctgcgcggagacgacgcttcct

SEQ ID NO: 308079 - DNA, 25 bp, Mus musculus
gtggcaggcagtgagtccatcgtat

SEQ ID NO: 308080 - DNA, 25 bp, Mus musculus
gagacactcgctctgcccagcactg

SEQ ID NO: 308081 - DNA, 25 bp, Mus musculus
ctgcgtagagcaccgagagaggccc

SEQ ID NO: 308082 - DNA, 25 bp, Mus musculus
gtcacctctaggagcttggctatga

SEQ ID NO: 308083 - DNA, 25 bp, Mus musculus
ctctaggagcttggctatgagggct

SEQ ID NO: 308084 - DNA, 25 bp, Mus musculus
cggggactgtcacctctaggagctt

SEQ ID NO: 308085 - DNA, 25 bp, Mus musculus
gacacggggaatgaacttcgccttc

SEQ ID NO: 308086 - DNA, 25 bp, Mus musculus
gtcatcctggacgtgagtacgcgcg

SEQ ID NO: 308087 - DNA, 25 bp, Mus musculus
cccaactctcactgccgctgagacg

SEQ ID NO: 308088 - DNA, 25 bp, Mus musculus
tgagaccctccttggcgcggggacc

SEQ ID NO: 308089 - DNA, 25 bp, Mus musculus
attgctgagaccctccttggcgcgg

SEQ ID NO: 308090 - DNA, 25 bp, Mus musculus
ttcgctccctgcctgttcccgcatc

SEQ ID NO: 308091 - DNA, 25 bp, Mus musculus
taaggaccctctccaccattcgctc

SEQ ID NO: 308092 - DNA, 25 bp, Mus musculus
tgccagtccacacccgggacctaag

SEQ ID NO: 308093 - DNA, 25 bp, Mus musculus
gctgggtgccagtccacacccggga

SEQ ID NO: 308094 - DNA, 25 bp, Mus musculus
ccgtcatcctggacgtgagtacgcg

SEQ ID NO: 308095 - DNA, 25 bp, Mus musculus
agccgtcatcctggacgtgagtacg

SEQ ID NO: 308096 - DNA, 25 bp, Mus musculus
cagccgtcatcctggacgtgagtac

SEQ ID NO: 308097 - DNA, 25 bp, Mus musculus
atcgcgagggggcacagccgtcatc

SEQ ID NO: 308098 - DNA, 25 bp, Mus musculus
tcatcctggacgtgagtacgcgcgg

SEQ ID NO: 308099 - DNA, 25 bp, Mus musculus
agtacgcgcgggaccctccgcccag

SEQ ID NO: 308100 - DNA, 25 bp, Mus musculus
cttccatcgtggctggggcaccggt

SEQ ID NO: 308101 - DNA, 25 bp, Mus musculus
gcacgaccctctacatctcctcctt

SEQ ID NO: 308102 - DNA, 25 bp, Mus musculus
cgtggggatctccagagcgagccct

SEQ ID NO: 308103 - DNA, 25 bp, Mus musculus
tctccagagcgagccctcccaccac

SEQ ID NO: 308104 - DNA, 25 bp, Mus musculus
cggctgaggcttgggtccgcaccca

SEQ ID NO: 308105 - DNA, 25 bp, Mus musculus
tgaggcttgggtccgcacccaccga

SEQ ID NO: 308106 - DNA, 25 bp, Mus musculus
ggcttgggtccgcacccaccgagga

SEQ ID NO: 308107 - DNA, 25 bp, Mus musculus
tccgcacccaccgaggaccctctcc

SEQ ID NO: 308108 - DNA, 25 bp, Mus musculus
cgttcccgcttccactaattacata

SEQ ID NO: 308109 - DNA, 25 bp, Mus musculus
cgcttccactaattacatagcacgg

SEQ ID NO: 308110 - DNA, 25 bp, Mus musculus
ctaattacatagcacggacccacgc

SEQ ID NO: 308111 - DNA, 25 bp, Mus musculus
ttacatagcacggacccacgctact

SEQ ID NO: 308112 - DNA, 25 bp, Mus musculus
cactggaaccgcacgaccctctaca

SEQ ID NO: 308113 - DNA, 25 bp, Mus musculus
atctcctccttcacattcccgcatc

SEQ ID NO: 308114 - DNA, 25 bp, Mus musculus
agcacggcggcacacaccatacact

SEQ ID NO: 308115 - DNA, 25 bp, Mus musculus
tacactacacaaggccagcacggcg

SEQ ID NO: 308116 - DNA, 25 bp, Mus musculus
catacactacacaaggccagcacgg

SEQ ID NO: 308117 - DNA, 25 bp, Mus musculus
ccagcacggcggcacacaccataca

SEQ ID NO: 308118 - DNA, 25 bp, Mus musculus
caccatacactacacaaggccagca

SEQ ID NO: 308119 - DNA, 25 bp, Mus musculus
cagcacggcggcacacaccatacac

SEQ ID NO: 308120 - DNA, 25 bp, Mus musculus
cacacaccatacactacacaaggcc

SEQ ID NO: 308121 - DNA, 25 bp, Mus musculus
cggcggcacacaccatacactacac

SEQ ID NO: 308122 - DNA, 25 bp, Mus musculus
acacaccatacactacacaaggcca

SEQ ID NO: 308123 - DNA, 25 bp, Mus musculus
acactacacaaggccagcacggcgg

SEQ ID NO: 308124 - DNA, 25 bp, Mus musculus
ggcggcacacaccatacactacaca

SEQ ID NO: 308125 - DNA, 25 bp, Mus musculus
gcacggcggcacacaccatacacta

SEQ ID NO: 308126 - DNA, 25 bp, Mus musculus
ccatacactacacaaggccagcacg

SEQ ID NO: 308127 - DNA, 25 bp, Mus musculus
cacggcggcacacaccatacactac

SEQ ID NO: 308128 - DNA, 25 bp, Mus musculus
tcttctgtagaagtgcaggagatgc

SEQ ID NO: 308129 - DNA, 25 bp, Mus musculus
accacctctgtctagcgtctgctga

SEQ ID NO: 308130 - DNA, 25 bp, Mus musculus
tgtctagcgtctgctgaggagtcac

SEQ ID NO: 308131 - DNA, 25 bp, Mus musculus
gaggagtcacctccctcaggtacga

SEQ ID NO: 308132 - DNA, 25 bp, Mus musculus
gagtcacctccctcaggtacgaggc

SEQ ID NO: 308133 - DNA, 25 bp, Mus musculus
ccagcttttgactggctcgcccttg

SEQ ID NO: 308134 - DNA, 25 bp, Mus musculus
actttgtcctggaacggcttggtcg

SEQ ID NO: 308135 - DNA, 25 bp, Mus musculus
aggagatgctgcctacccacaaggc

SEQ ID NO: 308136 - DNA, 25 bp, Mus musculus
tacccacaaggctctggtccatgcg

SEQ ID NO: 308137 - DNA, 25 bp, Mus musculus
taaggtcgctcgcagtcacggctgc

SEQ ID NO: 308138 - DNA, 25 bp, Mus musculus
cgtgcgtaaggtcgctcgcagtcac

SEQ ID NO: 308139 - DNA, 25 bp, Mus musculus
aaggctctggtccatgcgtggaagt

SEQ ID NO: 308140 - DNA, 25 bp, Mus musculus
tggggccctttgctaccacctctgt

SEQ ID NO: 308141 - DNA, 25 bp, Mus musculus
gcgttcctaggaactttgtcctgga

SEQ ID NO: 308142 - DNA, 25 bp, Mus musculus
gaaggggaatccactccatctcctg

SEQ ID NO: 308143 - DNA, 25 bp, Mus musculus
ctgcaggaactgaagggcaatatcc

SEQ ID NO: 308144 - DNA, 25 bp, Mus musculus
actgaagggcaatatccgggtgttc

SEQ ID NO: 308145 - DNA, 25 bp, Mus musculus
caatatccgggtgttctgccgcgtg

SEQ ID NO: 308146 - DNA, 25 bp, Mus musculus
cctgtcctcgaaggggaatccactc

SEQ ID NO: 308147 - DNA, 25 bp, Mus musculus
tccatctcctggcttcctcgtgttt

SEQ ID NO: 308148 - DNA, 25 bp, Mus musculus
acgggccttagcctctcacgatctg

SEQ ID NO: 308149 - DNA, 25 bp, Mus musculus
cttagcctctcacgatctgatgatc

SEQ ID NO: 308150 - DNA, 25 bp, Mus musculus
acgatctgatgatcggcgctccacc

SEQ ID NO: 308151 - DNA, 25 bp, Mus musculus
actgtccgccatgatttctcctttg

SEQ ID NO: 308152 - DNA, 25 bp, Mus musculus
ccatgatttctcctttgatcgggtg

SEQ ID NO: 308153 - DNA, 25 bp, Mus musculus
ttctcctttgatcgggtgttcccgc

SEQ ID NO: 308154 - DNA, 25 bp, Mus musculus
ctccacaaccagctgcaggaactga

SEQ ID NO: 308155 - DNA, 25 bp, Mus musculus
tggcttcctcgtgtttcctcctggc

SEQ ID NO: 308156 - DNA, 25 bp, Mus musculus
ctggaagcatcccaccgaatcagtg

SEQ ID NO: 308157 - DNA, 25 bp, Mus musculus
ttgatgcactgcagcatctccacct

SEQ ID NO: 308158 - DNA, 25 bp, Mus musculus
gcaccttgatgcactgcagcatctc

SEQ ID NO: 308159 - DNA, 25 bp, Mus musculus
ttgtgcaccttgatgcactgcagca

SEQ ID NO: 308160 - DNA, 25 bp, Mus musculus
cccacgcaagcgctcgcagctccgc

SEQ ID NO: 308161 - DNA, 25 bp, Mus musculus
tggcaaggcacagctcctccttact

SEQ ID NO: 308162 - DNA, 25 bp, Mus musculus
cttgcatggcaaggcacagctcctc

SEQ ID NO: 308163 - DNA, 25 bp, Mus musculus
ggccacttgcatggcaaggcacagc

SEQ ID NO: 308164 - DNA, 25 bp, Mus musculus
ggaagcatcccaccgaatcagtgga

SEQ ID NO: 308165 - DNA, 25 bp, Mus musculus
tcctggaagcatcccaccgaatcag

SEQ ID NO: 308166 - DNA, 25 bp, Mus musculus
tgcactgcagcatctccacctcctc

SEQ ID NO: 308167 - DNA, 25 bp, Mus musculus
gttgtcccacgcaagcgctcgcagc

SEQ ID NO: 308168 - DNA, 25 bp, Mus musculus
atcccaccgaatcagtggaaacctt

SEQ ID NO: 308169 - DNA, 25 bp, Mus musculus
catggcaaggcacagctcctcctta

SEQ ID NO: 308170 - DNA, 25 bp, Mus musculus
ggagccaccaagccgctaaacagga

SEQ ID NO: 308171 - DNA, 25 bp, Mus musculus
caagccgctaaacaggacgcctccc

SEQ ID NO: 308172 - DNA, 25 bp, Mus musculus
agccgctaaacaggacgcctcccgc

SEQ ID NO: 308173 - DNA, 25 bp, Mus musculus
gagccaccaagccgctaaacaggac

SEQ ID NO: 308174 - DNA, 25 bp, Mus musculus
gcgagaactgggagccaccaagccg

SEQ ID NO: 308175 - DNA, 25 bp, Mus musculus
agaactgggagccaccaagccgcta

SEQ ID NO: 308176 - DNA, 25 bp, Mus musculus
gaactgggagccaccaagccgctaa

SEQ ID NO: 308177 - DNA, 25 bp, Mus musculus
cgagaactgggagccaccaagccgc

SEQ ID NO: 308178 - DNA, 25 bp, Mus musculus
aactgggagccaccaagccgctaaa

SEQ ID NO: 308179 - DNA, 25 bp, Mus musculus
actgggagccaccaagccgctaaac

SEQ ID NO: 308180 - DNA, 25 bp, Mus musculus
ctgggagccaccaagccgctaaaca

SEQ ID NO: 308181 - DNA, 25 bp, Mus musculus
tgggagccaccaagccgctaaacag

SEQ ID NO: 308182 - DNA, 25 bp, Mus musculus
agccaccaagccgctaaacaggacg

SEQ ID NO: 308183 - DNA, 25 bp, Mus musculus
gggagccaccaagccgctaaacagg

SEQ ID NO: 308184 - DNA, 25 bp, Mus musculus
cccgccctaagttctgcgtgaacga

SEQ ID NO: 308185 - DNA, 25 bp, Mus musculus
ggcagacgcataccataaggctccg

SEQ ID NO: 308186 - DNA, 25 bp, Mus musculus
gactcggggagaatcatccggcaga

SEQ ID NO: 308187 - DNA, 25 bp, Mus musculus
ggggctcaccggacaccagtaccaa

SEQ ID NO: 308188 - DNA, 25 bp, Mus musculus
ggctcaccggacaccagtaccaagg

SEQ ID NO: 308189 - DNA, 25 bp, Mus musculus
ctcaccggacaccagtaccaagggg

SEQ ID NO: 308190 - DNA, 25 bp, Mus musculus
acacccgccctaagttctgcgtgaa

SEQ ID NO: 308191 - DNA, 25 bp, Mus musculus
taagttctgcgtgaacgaagccatc

SEQ ID NO: 308192 - DNA, 25 bp, Mus musculus
agttctgcgtgaacgaagccatccc

SEQ ID NO: 308193 - DNA, 25 bp, Mus musculus
ccctgcctccgctcttggccggcgg

SEQ ID NO: 308194 - DNA, 25 bp, Mus musculus
tggcggtggcagacgcataccataa

SEQ ID NO: 308195 - DNA, 25 bp, Mus musculus
gtggcagacgcataccataaggctc

SEQ ID NO: 308196 - DNA, 25 bp, Mus musculus
gccctaagttctgcgtgaacgaagc

SEQ ID NO: 308197 - DNA, 25 bp, Mus musculus
cggtggcagacgcataccataaggc

SEQ ID NO: 308198 - DNA, 25 bp, Mus musculus
ggcccacagtcgctgactggccctg

SEQ ID NO: 308199 - DNA, 25 bp, Mus musculus
gactgaggcagcgtcagtcccggcc

SEQ ID NO: 308200 - DNA, 25 bp, Mus musculus
cctttgtccgagttcccgagcggtg

SEQ ID NO: 308201 - DNA, 25 bp, Mus musculus
cagccagcagagctgagggctgcgc

SEQ ID NO: 308202 - DNA, 25 bp, Mus musculus
gctggtacgcagagtaggcgacggc

SEQ ID NO: 308203 - DNA, 25 bp, Mus musculus
tggtcgcagtgttcccgctggccgt

SEQ ID NO: 308204 - DNA, 25 bp, Mus musculus
gccaccggcttggtcgcagtgttcc

SEQ ID NO: 308205 - DNA, 25 bp, Mus musculus
ttccctctcctaagtcggatccgcc

SEQ ID NO: 308206 - DNA, 25 bp, Mus musculus
ttctacttccctctcctaagtcgga

SEQ ID NO: 308207 - DNA, 25 bp, Mus musculus
cgagtacggattggcagccaggctt

SEQ ID NO: 308208 - DNA, 25 bp, Mus musculus
aaaggggcggcccacagtcgctgac

SEQ ID NO: 308209 - DNA, 25 bp, Mus musculus
tcccaaaggcagacgcaaaggggcg

SEQ ID NO: 308210 - DNA, 25 bp, Mus musculus
agcatgtcccaaaggcagacgcaaa

SEQ ID NO: 308211 - DNA, 25 bp, Mus musculus
cggattggcagccaggcttgtgccc

SEQ ID NO: 308212 - DNA, 25 bp, Mus musculus
ggaccgcgcttctcctctgagcggc

SEQ ID NO: 308213 - DNA, 25 bp, Mus musculus
ctccgcgacgctgcggaccgcgctt

SEQ ID NO: 308214 - DNA, 25 bp, Mus musculus
cgcttctcctctgagcggcggcgcg

SEQ ID NO: 308215 - DNA, 25 bp, Mus musculus
ggggccagcccgtccatgaccatgg

SEQ ID NO: 308216 - DNA, 25 bp, Mus musculus
gggccagcccgtccatgaccatggg

SEQ ID NO: 308217 - DNA, 25 bp, Mus musculus
agcccgtccatgaccatgggcgaca

SEQ ID NO: 308218 - DNA, 25 bp, Mus musculus
gcccgtccatgaccatgggcgacaa

SEQ ID NO: 308219 - DNA, 25 bp, Mus musculus
ccgtccatgaccatgggcgacaaga

SEQ ID NO: 308220 - DNA, 25 bp, Mus musculus
cgtccatgaccatgggcgacaagaa

SEQ ID NO: 308221 - DNA, 25 bp, Mus musculus
caagaagagcccgaccaggccaaaa

SEQ ID NO: 308222 - DNA, 25 bp, Mus musculus
agaagagcccgaccaggccaaaaag

SEQ ID NO: 308223 - DNA, 25 bp, Mus musculus
gaagagcccgaccaggccaaaaaga

SEQ ID NO: 308224 - DNA, 25 bp, Mus musculus
agagcccgaccaggccaaaaagaca

SEQ ID NO: 308225 - DNA, 25 bp, Mus musculus
cgacgctgcggaccgcgcttctcct

SEQ ID NO: 308226 - DNA, 25 bp, Mus musculus
tgtcatttacatacgggattagccc

SEQ ID NO: 308227 - DNA, 25 bp, Mus musculus
gttctgtaatcccagtaagattgcc

SEQ ID NO: 308228 - DNA, 25 bp, Mus musculus
gctctgggaggttctctctttgttc

SEQ ID NO: 308229 - DNA, 25 bp, Mus musculus
gggaggttctctctttgttctgtaa

SEQ ID NO: 308230 - DNA, 25 bp, Mus musculus
ggggaggactcacaacctcggagcc

SEQ ID NO: 308231 - DNA, 25 bp, Mus musculus
gttctctctttgttctgtaatccca

SEQ ID NO: 308232 - DNA, 25 bp, Mus musculus
gactcacaacctcggagcctcgaga

SEQ ID NO: 308233 - DNA, 25 bp, Mus musculus
atcccagtaagattgccagccattc

SEQ ID NO: 308234 - DNA, 25 bp, Mus musculus
cagtaagattgccagccattcgccc

SEQ ID NO: 308235 - DNA, 25 bp, Mus musculus
ggccctaatcccagcaccgcgcaac

SEQ ID NO: 308236 - DNA, 25 bp, Mus musculus
tggctgtcatttacatacgggatta

SEQ ID NO: 308237 - DNA, 25 bp, Mus musculus
ccctccattggctgtcatttacata

SEQ ID NO: 308238 - DNA, 25 bp, Mus musculus
accgcgcaacaccaaccctccattg

SEQ ID NO: 308239 - DNA, 25 bp, Mus musculus
acatacgggattagcccgcacggcc

SEQ ID NO: 308240 - DNA, 25 bp, Mus musculus
agtcccgagcttccgactgcgcaga

SEQ ID NO: 308241 - DNA, 25 bp, Mus musculus
ctgcgggctctggaaaagggcacca

SEQ ID NO: 308242 - DNA, 25 bp, Mus musculus
aagggcaccagagtcggtttgcaaa

SEQ ID NO: 308243 - DNA, 25 bp, Mus musculus
tggacggctctgctatgagcgattc

SEQ ID NO: 308244 - DNA, 25 bp, Mus musculus
tcggcaagtcccgagcttccgactg

SEQ ID NO: 308245 - DNA, 25 bp, Mus musculus
gcgtctctgagatgcactcaccatg

SEQ ID NO: 308246 - DNA, 25 bp, Mus musculus
ctcaccatggtgcactctcgtcttg

SEQ ID NO: 308247 - DNA, 25 bp, Mus musculus
tctcgtcttgcctgagctgcgctgt

SEQ ID NO: 308248 - DNA, 25 bp, Mus musculus
gtcactgccgcgtaccttgcgcatt

SEQ ID NO: 308249 - DNA, 25 bp, Mus musculus
gccgcgtaccttgcgcattgctaag

SEQ ID NO: 308250 - DNA, 25 bp, Mus musculus
ccgccaaggacagcgccgaaaatgg

SEQ ID NO: 308251 - DNA, 25 bp, Mus musculus
tcggtttgcaaactctcggcaagtc

SEQ ID NO: 308252 - DNA, 25 bp, Mus musculus
ttgcgcattgctaagccgccaagga

SEQ ID NO: 308253 - DNA, 25 bp, Mus musculus
ttcccgctgctgattggacggctct

SEQ ID NO: 308254 - DNA, 25 bp, Mus musculus
gtcgccgcagtctctaaattcaaag

SEQ ID NO: 308255 - DNA, 25 bp, Mus musculus
ccaggctctcacacatacggggagg

SEQ ID NO: 308256 - DNA, 25 bp, Mus musculus
ctctctagcgcatcccttacagggg

SEQ ID NO: 308257 - DNA, 25 bp, Mus musculus
tcccttacaggggtcggatcagcag

SEQ ID NO: 308258 - DNA, 25 bp, Mus musculus
ctggtcgctctcctctgcaggaatc

SEQ ID NO: 308259 - DNA, 25 bp, Mus musculus
aggaatcgcagacatcctggcagtc

SEQ ID NO: 308260 - DNA, 25 bp, Mus musculus
tggaccacgaactcgtcgccgcagt

SEQ ID NO: 308261 - DNA, 25 bp, Mus musculus
cacagctactgcaaaccaaagaaga

SEQ ID NO: 308262 - DNA, 25 bp, Mus musculus
gttcccggagctagattcggccctc

SEQ ID NO: 308263 - DNA, 25 bp, Mus musculus
ctccaacttccggttcgagaacgag

SEQ ID NO: 308264 - DNA, 25 bp, Mus musculus
cccagcggaccagggcaggaaaact

SEQ ID NO: 308265 - DNA, 25 bp, Mus musculus
cggagctggaatacgaactggaata

SEQ ID NO: 308266 - DNA, 25 bp, Mus musculus
gttcccgtgacaggtctaccgcctg

SEQ ID NO: 308267 - DNA, 25 bp, Mus musculus
cagtctcaggagcagcgtggaccac

SEQ ID NO: 308268 - DNA, 25 bp, Mus musculus
gccggcctcaccgagctatcatagt

SEQ ID NO: 308269 - DNA, 25 bp, Mus musculus
tcttaatcagttggccttcggcttc

SEQ ID NO: 308270 - DNA, 25 bp, Mus musculus
agtgccgctctcaccaggctgatga

SEQ ID NO: 308271 - DNA, 25 bp, Mus musculus
tctgggcagcgtctaaagccacgcc

SEQ ID NO: 308272 - DNA, 25 bp, Mus musculus
ccaggctgtcgatcttctgggcagc

SEQ ID NO: 308273 - DNA, 25 bp, Mus musculus
aaagcactaagtgacgctcccgggg

SEQ ID NO: 308274 - DNA, 25 bp, Mus musculus
tggccgtgaccattgctcatcactg

SEQ ID NO: 308275 - DNA, 25 bp, Mus musculus
tcatcactgcctcttggagacccaa

SEQ ID NO: 308276 - DNA, 25 bp, Mus musculus
ggccctgcctctttcgctcagtgaa

SEQ ID NO: 308277 - DNA, 25 bp, Mus musculus
ggcgcctgacgaaggaaagcactaa

SEQ ID NO: 308278 - DNA, 25 bp, Mus musculus
tcgctcagtgaagtttgtccggata

SEQ ID NO: 308279 - DNA, 25 bp, Mus musculus
cgcccaggaatgtgcacctgttgtc

SEQ ID NO: 308280 - DNA, 25 bp, Mus musculus
tggtcccgcccggagcaactgcagt

SEQ ID NO: 308281 - DNA, 25 bp, Mus musculus
ttggagacccaaactgacttacctg

SEQ ID NO: 308282 - DNA, 25 bp, Mus musculus
caaaggagaaatcatggcggacagt

SEQ ID NO: 308283 - DNA, 25 bp, Mus musculus
ttcagttcctgcagctggttgtgga

SEQ ID NO: 308284 - DNA, 25 bp, Mus musculus
cggatattgcccttcagttcctgca

SEQ ID NO: 308285 - DNA, 25 bp, Mus musculus
gaacacccggatattgcccttcagt

SEQ ID NO: 308286 - DNA, 25 bp, Mus musculus
gtggagcgccgatcatcagatcgtg

SEQ ID NO: 308287 - DNA, 25 bp, Mus musculus
gcacgcggcagaacacccggatatt

SEQ ID NO: 308288 - DNA, 25 bp, Mus musculus
gagtggattccccttcgaggacagg

SEQ ID NO: 308289 - DNA, 25 bp, Mus musculus
aagccaggagatggagtggattccc

SEQ ID NO: 308290 - DNA, 25 bp, Mus musculus
aaacacgaggaagccaggagatgga

SEQ ID NO: 308291 - DNA, 25 bp, Mus musculus
gccaggaggaaacacgaggaagcca

SEQ ID NO: 308292 - DNA, 25 bp, Mus musculus
atcagatcgtgagaggctaaggccc

SEQ ID NO: 308293 - DNA, 25 bp, Mus musculus
gcgggaacacccgatcaaaggagaa

SEQ ID NO: 308294 - DNA, 25 bp, Mus musculus
cacccgatcaaaggagaaatcatgg

SEQ ID NO: 308295 - DNA, 25 bp, Mus musculus
agttcctgcagctggttgtggagtc

SEQ ID NO: 308296 - DNA, 25 bp, Mus musculus
ttgtgctggcgcccagccgctggac

SEQ ID NO: 308297 - DNA, 25 bp, Mus musculus
cactgaggaggtcaggaccctttct

SEQ ID NO: 308298 - DNA, 25 bp, Mus musculus
ccgctttgggcggagcctttgtgct

SEQ ID NO: 308299 - DNA, 25 bp, Mus musculus
cggagcctttgtgctggcgcccagc

SEQ ID NO: 308300 - DNA, 25 bp, Mus musculus
actgaggaggtcaggaccctttctt

SEQ ID NO: 308301 - DNA, 25 bp, Mus musculus
cagaacgcagatctggggttggggc

SEQ ID NO: 308302 - DNA, 25 bp, Mus musculus
cagacagaacgcagatctggggttg

SEQ ID NO: 308303 - DNA, 25 bp, Mus musculus
gcagacagaacgcagatctggggtt

SEQ ID NO: 308304 - DNA, 25 bp, Mus musculus
agaagggcagacagaacgcagatct

SEQ ID NO: 308305 - DNA, 25 bp, Mus musculus
tagaagggcagacagaacgcagatc

SEQ ID NO: 308306 - DNA, 25 bp, Mus musculus
ctggacgcggtagaagggcagacag

SEQ ID NO: 308307 - DNA, 25 bp, Mus musculus
gagcctttgtgctggcgcccagccg

SEQ ID NO: 308308 - DNA, 25 bp, Mus musculus
ggagcctttgtgctggcgcccagcc

SEQ ID NO: 308309 - DNA, 25 bp, Mus musculus
ctgaggaggtcaggaccctttcttc

SEQ ID NO: 308310 - DNA, 25 bp, Mus musculus
ttcaagacccataatcccactaatg

SEQ ID NO: 308311 - DNA, 25 bp, Mus musculus
gacagcagcaggacatatcaccact

SEQ ID NO: 308312 - DNA, 25 bp, Mus musculus
tccagtgaaggaacagcctggcaca

SEQ ID NO: 308313 - DNA, 25 bp, Mus musculus
gacccataatcccactaatgaactt

SEQ ID NO: 308314 - DNA, 25 bp, Mus musculus
aggacatatcaccactacagcagca

SEQ ID NO: 308315 - DNA, 25 bp, Mus musculus
cgtgcggaattcaagacccataatc

SEQ ID NO: 308316 - DNA, 25 bp, Mus musculus
ccacgtgcggaattcaagacccata

SEQ ID NO: 308317 - DNA, 25 bp, Mus musculus
ctgcaaccacgtgcggaattcaaga

SEQ ID NO: 308318 - DNA, 25 bp, Mus musculus
ctaaacctgcaaccacgtgcggaat

SEQ ID NO: 308319 - DNA, 25 bp, Mus musculus
ccgcctccagtgaaggaacagcctg

SEQ ID NO: 308320 - DNA, 25 bp, Mus musculus
agctccgcctccagtgaaggaacag

SEQ ID NO: 308321 - DNA, 25 bp, Mus musculus
agcacctgctccatgcgctggccct

SEQ ID NO: 308322 - DNA, 25 bp, Mus musculus
gcagcaggacatatcaccactacag

SEQ ID NO: 308323 - DNA, 25 bp, Mus musculus
gaaggaacagcctggcacagcatga

SEQ ID NO: 308324 - DNA, 25 bp, Mus musculus
aggaagacacggagctgcgcgacct

SEQ ID NO: 308325 - DNA, 25 bp, Mus musculus
gtcatgaaacccaaacaccggcctg

SEQ ID NO: 308326 - DNA, 25 bp, Mus musculus
tccgcccataaacgacacgctgaga

SEQ ID NO: 308327 - DNA, 25 bp, Mus musculus
atatgccacagagcgcgtcaccaga

SEQ ID NO: 308328 - DNA, 25 bp, Mus musculus
tgctgctcacgcttagaaacaaccc

SEQ ID NO: 308329 - DNA, 25 bp, Mus musculus
ctctcgcacaggaatggggaaatta

SEQ ID NO: 308330 - DNA, 25 bp, Mus musculus
agccaaagtggactcttctctcgca

SEQ ID NO: 308331 - DNA, 25 bp, Mus musculus
cgagccagtaagttcagccaaagtg

SEQ ID NO: 308332 - DNA, 25 bp, Mus musculus
ccatctaagcgggtcgagccagtaa

SEQ ID NO: 308333 - DNA, 25 bp, Mus musculus
ttggagtctccgctccgcagttcct

SEQ ID NO: 308334 - DNA, 25 bp, Mus musculus
ccggcttaagctgagcgagtataca

SEQ ID NO: 308335 - DNA, 25 bp, Mus musculus
cgagtatacacgcacagaggcgaga

SEQ ID NO: 308336 - DNA, 25 bp, Mus musculus
atagaatgcctacttgctgctcacg

SEQ ID NO: 308337 - DNA, 25 bp, Mus musculus
aacagcggcgtgctgaaccgcatca

SEQ ID NO: 308338 - DNA, 25 bp, Mus musculus
cgggcactcgaagtagcgcacgcca

SEQ ID NO: 308339 - DNA, 25 bp, Mus musculus
gagtgcgtatcactgcccgagccct

SEQ ID NO: 308340 - DNA, 25 bp, Mus musculus
gttctgggccgtgagggattccacc

SEQ ID NO: 308341 - DNA, 25 bp, Mus musculus
tgagggattccaccgagtgcgtatc

SEQ ID NO: 308342 - DNA, 25 bp, Mus musculus
agctccatcgttcttgcccaccggg

SEQ ID NO: 308343 - DNA, 25 bp, Mus musculus
accgagtgcgtatcactgcccgagc

SEQ ID NO: 308344 - DNA, 25 bp, Mus musculus
cgtgccagaatgcagggacaggttc

SEQ ID NO: 308345 - DNA, 25 bp, Mus musculus
ccgcgtgaagatgccctgtagagcc

SEQ ID NO: 308346 - DNA, 25 bp, Mus musculus
atgccctgtagagccgggcactcga

SEQ ID NO: 308347 - DNA, 25 bp, Mus musculus
tgtagagccgggcactcgaagtagc

SEQ ID NO: 308348 - DNA, 25 bp, Mus musculus
cgtccaagaccacgccggcccactg

SEQ ID NO: 308349 - DNA, 25 bp, Mus musculus
gtagcgcacgccacccacagctcca

SEQ ID NO: 308350 - DNA, 25 bp, Mus musculus
ttgcccaccgggtcgtccaagacca

SEQ ID NO: 308351 - DNA, 25 bp, Mus musculus
ggattccaccgagtgcgtatcactg

SEQ ID NO: 308352 - DNA, 25 bp, Mus musculus
tcaaacgccagctcctgagatcact

SEQ ID NO: 308353 - DNA, 25 bp, Mus musculus
gcctctagcggccagggatggctac

SEQ ID NO: 308354 - DNA, 25 bp, Mus musculus
caggaagagattcaccgcctctata

SEQ ID NO: 308355 - DNA, 25 bp, Mus musculus
accaggacccagacttccgtcaaag

SEQ ID NO: 308356 - DNA, 25 bp, Mus musculus
acttccgtcaaagcggcatggggcg

SEQ ID NO: 308357 - DNA, 25 bp, Mus musculus
gagcagccaccggaatggaggttca

SEQ ID NO: 308358 - DNA, 25 bp, Mus musculus
tgcgcaggcgcaggaagagattcac

SEQ ID NO: 308359 - DNA, 25 bp, Mus musculus
tcaggagagtggctgtgacccatcc

SEQ ID NO: 308360 - DNA, 25 bp, Mus musculus
cggccactacgagctgccgtggtga

SEQ ID NO: 308361 - DNA, 25 bp, Mus musculus
tgagcctgcagccatagtaacgcgc

SEQ ID NO: 308362 - DNA, 25 bp, Mus musculus
atggctacgcggtgctctctgcgca

SEQ ID NO: 308363 - DNA, 25 bp, Mus musculus
gcagccatagtaacgcgcgcgtaga

SEQ ID NO: 308364 - DNA, 25 bp, Mus musculus
gattcaccgcctctataacgcactt

SEQ ID NO: 308365 - DNA, 25 bp, Mus musculus
tcctgagatcactgcggcctctagc

SEQ ID NO: 308366 - DNA, 25 bp, Mus musculus
taggtatcgaagtccgccatttgcc

SEQ ID NO: 308367 - DNA, 25 bp, Mus musculus
cgtagtatctgtcaataaggcattc

SEQ ID NO: 308368 - DNA, 25 bp, Mus musculus
tcagaacgaagcgaaagcgattccc

SEQ ID NO: 308369 - DNA, 25 bp, Mus musculus
tgggaagaaatcaacaatctccgcc

SEQ ID NO: 308370 - DNA, 25 bp, Mus musculus
tctccgccagcagacacgtagtatc

SEQ ID NO: 308371 - DNA, 25 bp, Mus musculus
aggcattcgaaacgccagggaggca

SEQ ID NO: 308372 - DNA, 25 bp, Mus musculus
ggtcccagcatccagactcgaatcg

SEQ ID NO: 308373 - DNA, 25 bp, Mus musculus
gactcgaatcggaagggaaatcgcc

SEQ ID NO: 308374 - DNA, 25 bp, Mus musculus
accctccggcgtcgctgtgatctaa

SEQ ID NO: 308375 - DNA, 25 bp, Mus musculus
tgtgatctaactttccgaccgaggc

SEQ ID NO: 308376 - DNA, 25 bp, Mus musculus
taggcccgatcgtcgtaggtatcga

SEQ ID NO: 308377 - DNA, 25 bp, Mus musculus
ttgccgtctccgctccttgaggaac

SEQ ID NO: 308378 - DNA, 25 bp, Mus musculus
gctgcctgatcgcaagtcgcacgca

SEQ ID NO: 308379 - DNA, 25 bp, Mus musculus
gcaagcgagagacccgcagcctaac

SEQ ID NO: 308380 - DNA, 25 bp, Mus musculus
cgaagtaaacggtgccgggcttcag

SEQ ID NO: 308381 - DNA, 25 bp, Mus musculus
ttttcgacccatagatcccgaatgg

SEQ ID NO: 308382 - DNA, 25 bp, Mus musculus
tcccgaatgggttacaacgcacttg

SEQ ID NO: 308383 - DNA, 25 bp, Mus musculus
cacttggacgaagtaaacggtgccg

SEQ ID NO: 308384 - DNA, 25 bp, Mus musculus
gaggtctggttgctgacgtcatcca

SEQ ID NO: 308385 - DNA, 25 bp, Mus musculus
ggttgctgacgtcatccaccacctg

SEQ ID NO: 308386 - DNA, 25 bp, Mus musculus
ggcgggacgggcaccttccagtcca

SEQ ID NO: 308387 - DNA, 25 bp, Mus musculus
tcctccacgcggtagcggatctggt

SEQ ID NO: 308388 - DNA, 25 bp, Mus musculus
cggatctggtacttggcttggaaga

SEQ ID NO: 308389 - DNA, 25 bp, Mus musculus
gtacttggcttggaagaggaaatcc

SEQ ID NO: 308390 - DNA, 25 bp, Mus musculus
tgagacccagcgcacactcagctgg

SEQ ID NO: 308391 - DNA, 25 bp, Mus musculus
aacgcggctcacgtgcacgtcgggt

SEQ ID NO: 308392 - DNA, 25 bp, Mus musculus
ggttacaacgcacttggacgaagta

SEQ ID NO: 308393 - DNA, 25 bp, Mus musculus
atccttgagagctggtggtgagacc

SEQ ID NO: 308394 - DNA, 25 bp, Mus musculus
ccgcgatggtgtgcgaatacgcatc

SEQ ID NO: 308395 - DNA, 25 bp, Mus musculus
ttcgaggataccaaagcatggagtc

SEQ ID NO: 308396 - DNA, 25 bp, Mus musculus
cccaccagtggagaggacttcgagg

SEQ ID NO: 308397 - DNA, 25 bp, Mus musculus
cagcgcagcctgaatgagaccggtt

SEQ ID NO: 308398 - DNA, 25 bp, Mus musculus
ccgaaatttcagtcgctagaggctc

SEQ ID NO: 308399 - DNA, 25 bp, Mus musculus
ttgctctcgctcctcaccgaaattt

SEQ ID NO: 308400 - DNA, 25 bp, Mus musculus
ccttagacaatgaagtctgggctcg

SEQ ID NO: 308401 - DNA, 25 bp, Mus musculus
gtgggattctctcggcagctgaccc

SEQ ID NO: 308402 - DNA, 25 bp, Mus musculus
ttcctcctgggacagtgggattctc

SEQ ID NO: 308403 - DNA, 25 bp, Mus musculus
gggctcaaggccaggagttcctcct

SEQ ID NO: 308404 - DNA, 25 bp, Mus musculus
tcttttgtgtgtctttgggtgtgtc

SEQ ID NO: 308405 - DNA, 25 bp, Mus musculus
atatccaagacacaggcgtgcgccc

SEQ ID NO: 308406 - DNA, 25 bp, Mus musculus
ttcccttccgctctgatatccaaga

SEQ ID NO: 308407 - DNA, 25 bp, Mus musculus
cgggacataagccagtggggctctt

SEQ ID NO: 308408 - DNA, 25 bp, Mus musculus
tgacgaggtagcctgcaaggacacc

SEQ ID NO: 308409 - DNA, 25 bp, Mus musculus
ggcgagctcgaccaggaagaacaga

SEQ ID NO: 308410 - DNA, 25 bp, Mus musculus
tgcagaaaccctcggggtgacccaa

SEQ ID NO: 308411 - DNA, 25 bp, Mus musculus
cccgccacttcggatggaaagaatc

SEQ ID NO: 308412 - DNA, 25 bp, Mus musculus
cctgccctcgaaagcaaggagactc

SEQ ID NO: 308413 - DNA, 25 bp, Mus musculus
ggagactcggcattacaggcaaaga

SEQ ID NO: 308414 - DNA, 25 bp, Mus musculus
cctgaaggatagtcccgtaaattct

SEQ ID NO: 308415 - DNA, 25 bp, Mus musculus
aaattctgtcgttctggcccacctc

SEQ ID NO: 308416 - DNA, 25 bp, Mus musculus
tcatcgggcttcaatcgtcagggtc

SEQ ID NO: 308417 - DNA, 25 bp, Mus musculus
cacagtcgcaccttggacagcagga

SEQ ID NO: 308418 - DNA, 25 bp, Mus musculus
ctgtttctggcaaagtgacttggta

SEQ ID NO: 308419 - DNA, 25 bp, Mus musculus
ctcccgcttctgtcggatcaggcta

SEQ ID NO: 308420 - DNA, 25 bp, Mus musculus
tcggatcaggctactggccaacgcc

SEQ ID NO: 308421 - DNA, 25 bp, Mus musculus
gcgagaacccgcacgtaggcgaaga

SEQ ID NO: 308422 - DNA, 25 bp, Mus musculus
gaccctcagtaacctcaggtgaacg

SEQ ID NO: 308423 - DNA, 25 bp, Mus musculus
gggcgccgcgtccaacagacggttc

SEQ ID NO: 308424 - DNA, 25 bp, Mus musculus
atgcgcgcgccctgcagaatgacgc

SEQ ID NO: 308425 - DNA, 25 bp, Mus musculus
ccctgcagaatgacgcgaagagttt

SEQ ID NO: 308426 - DNA, 25 bp, Mus musculus
acgcgaagagtttccaagcaatttc

SEQ ID NO: 308427 - DNA, 25 bp, Mus musculus
ttccaagcaatttctcaggctgtgc

SEQ ID NO: 308428 - DNA, 25 bp, Mus musculus
aatttctcaggctgtgcgcaggcgc

SEQ ID NO: 308429 - DNA, 25 bp, Mus musculus
acctgtgccagggagaggtccggtt

SEQ ID NO: 308430 - DNA, 25 bp, Mus musculus
tccggtttccgcctgcgaggggcaa

SEQ ID NO: 308431 - DNA, 25 bp, Mus musculus
ttccgcctgcgaggggcaaagaccc

SEQ ID NO: 308432 - DNA, 25 bp, Mus musculus
gcaaagaccctcagtaacctcaggt

SEQ ID NO: 308433 - DNA, 25 bp, Mus musculus
taacctcaggtgaacgaacggaatc

SEQ ID NO: 308434 - DNA, 25 bp, Mus musculus
tgaacgaacggaatcacaccgggcg

SEQ ID NO: 308435 - DNA, 25 bp, Mus musculus
gaacggaatcacaccgggcgccgcg

SEQ ID NO: 308436 - DNA, 25 bp, Mus musculus
ccggatacgctccagaactcgggcg

SEQ ID NO: 308437 - DNA, 25 bp, Mus musculus
gggcgcgacgaggacccacatcacg

SEQ ID NO: 308438 - DNA, 25 bp, Mus musculus
aactcgggcgcgacgaggacccaca

SEQ ID NO: 308439 - DNA, 25 bp, Mus musculus
gatacgctccagaactcgggcgcga

SEQ ID NO: 308440 - DNA, 25 bp, Mus musculus
caccggatacgctccagaactcggg

SEQ ID NO: 308441 - DNA, 25 bp, Mus musculus
agtccctacaatctcgccggcctcc

SEQ ID NO: 308442 - DNA, 25 bp, Mus musculus
tccagccgcgttcagtccctacaat

SEQ ID NO: 308443 - DNA, 25 bp, Mus musculus
attcccagaaccctggcgtccagcc

SEQ ID NO: 308444 - DNA, 25 bp, Mus musculus
cgtacattcccagaaccctggcgtc

SEQ ID NO: 308445 - DNA, 25 bp, Mus musculus
gtgtgcagccccgtacattcccaga

SEQ ID NO: 308446 - DNA, 25 bp, Mus musculus
tggtacccgagcaagtgtgcagccc

SEQ ID NO: 308447 - DNA, 25 bp, Mus musculus
tttggtacccgagcaagtgtgcagc

SEQ ID NO: 308448 - DNA, 25 bp, Mus musculus
cttttggtacccgagcaagtgtgca

SEQ ID NO: 308449 - DNA, 25 bp, Mus musculus
acgctccagaactcgggcgcgacga

SEQ ID NO: 308450 - DNA, 25 bp, Mus musculus
gatccaaagctccagctgaccgggc

SEQ ID NO: 308451 - DNA, 25 bp, Mus musculus
agccgggcccatcgcgtcctctcgg

SEQ ID NO: 308452 - DNA, 25 bp, Mus musculus
atccaaagctccagctgaccgggcc

SEQ ID NO: 308453 - DNA, 25 bp, Mus musculus
tccaaagctccagctgaccgggcca

SEQ ID NO: 308454 - DNA, 25 bp, Mus musculus
aaagctccagctgaccgggccacat

SEQ ID NO: 308455 - DNA, 25 bp, Mus musculus
aagctccagctgaccgggccacatc

SEQ ID NO: 308456 - DNA, 25 bp, Mus musculus
tggaagccgggcccatcgcgtcctc

SEQ ID NO: 308457 - DNA, 25 bp, Mus musculus
ggtgacagcgacagacaaggcttct

SEQ ID NO: 308458 - DNA, 25 bp, Mus musculus
tgacagcgacagacaaggcttctgg

SEQ ID NO: 308459 - DNA, 25 bp, Mus musculus
ggaagccgggcccatcgcgtcctct

SEQ ID NO: 308460 - DNA, 25 bp, Mus musculus
aagccgggcccatcgcgtcctctcg

SEQ ID NO: 308461 - DNA, 25 bp, Mus musculus
ccgggcccatcgcgtcctctcggcc

SEQ ID NO: 308462 - DNA, 25 bp, Mus musculus
gtgacagcgacagacaaggcttctg

SEQ ID NO: 308463 - DNA, 25 bp, Mus musculus
gaagccgggcccatcgcgtcctctc

SEQ ID NO: 308464 - DNA, 25 bp, Mus musculus
agccgatgtggcggttcccgctgga

SEQ ID NO: 308465 - DNA, 25 bp, Mus musculus
cttccagccgatgtggcggttcccg

SEQ ID NO: 308466 - DNA, 25 bp, Mus musculus
ttccagccgatgtggcggttcccgc

SEQ ID NO: 308467 - DNA, 25 bp, Mus musculus
tccagccgatgtggcggttcccgct

SEQ ID NO: 308468 - DNA, 25 bp, Mus musculus
cagccgatgtggcggttcccgctgg

SEQ ID NO: 308469 - DNA, 25 bp, Mus musculus
gccgatgtggcggttcccgctggag

SEQ ID NO: 308470 - DNA, 25 bp, Mus musculus
cgatgtggcggttcccgctggagct

SEQ ID NO: 308471 - DNA, 25 bp, Mus musculus
gatgtggcggttcccgctggagctt

SEQ ID NO: 308472 - DNA, 25 bp, Mus musculus
ccagccgatgtggcggttcccgctg

SEQ ID NO: 308473 - DNA, 25 bp, Mus musculus
ctttcattgacctgtcggtcttatc

SEQ ID NO: 308474 - DNA, 25 bp, Mus musculus
gtcttatcagttctcccggttgtca

SEQ ID NO: 308475 - DNA, 25 bp, Mus musculus
tcagttctcccggttgtcaggtcga

SEQ ID NO: 308476 - DNA, 25 bp, Mus musculus
tcttatcagttctcccggttgtcag

SEQ ID NO: 308477 - DNA, 25 bp, Mus musculus
gctatgggcgcggttttctttcatt

SEQ ID NO: 308478 - DNA, 25 bp, Mus musculus
ctatgggcgcggttttctttcattg

SEQ ID NO: 308479 - DNA, 25 bp, Mus musculus
ttgacctgtcggtcttatcagttct

SEQ ID NO: 308480 - DNA, 25 bp, Mus musculus
ttctttcattgacctgtcggtctta

SEQ ID NO: 308481 - DNA, 25 bp, Mus musculus
tttcattgacctgtcggtcttatca

SEQ ID NO: 308482 - DNA, 25 bp, Mus musculus
ttcattgacctgtcggtcttatcag

SEQ ID NO: 308483 - DNA, 25 bp, Mus musculus
tcattgacctgtcggtcttatcagt

SEQ ID NO: 308484 - DNA, 25 bp, Mus musculus
attgacctgtcggtcttatcagttc

SEQ ID NO: 308485 - DNA, 25 bp, Mus musculus
tatgggcgcggttttctttcattga

SEQ ID NO: 308486 - DNA, 25 bp, Mus musculus
cttatcagttctcccggttgtcagg

SEQ ID NO: 308487 - DNA, 25 bp, Mus musculus
ccaatccgatgggcccggtcagctg

SEQ ID NO: 308488 - DNA, 25 bp, Mus musculus
cttccaatccgatgggcccggtcag

SEQ ID NO: 308489 - DNA, 25 bp, Mus musculus
gcttccaatccgatgggcccggtca

SEQ ID NO: 308490 - DNA, 25 bp, Mus musculus
ggcttccaatccgatgggcccggtc

SEQ ID NO: 308491 - DNA, 25 bp, Mus musculus
cggcttccaatccgatgggcccggt

SEQ ID NO: 308492 - DNA, 25 bp, Mus musculus
ccggcttccaatccgatgggcccgg

SEQ ID NO: 308493 - DNA, 25 bp, Mus musculus
cccggcttccaatccgatgggcccg

SEQ ID NO: 308494 - DNA, 25 bp, Mus musculus
gcccggcttccaatccgatgggccc

SEQ ID NO: 308495 - DNA, 25 bp, Mus musculus
ggcccggcttccaatccgatgggcc

SEQ ID NO: 308496 - DNA, 25 bp, Mus musculus
gggcccggcttccaatccgatgggc

SEQ ID NO: 308497 - DNA, 25 bp, Mus musculus
ttccaatccgatgggcccggtcagc

SEQ ID NO: 308498 - DNA, 25 bp, Mus musculus
tccaatccgatgggcccggtcagct

SEQ ID NO: 308499 - DNA, 25 bp, Mus musculus
caatccgatgggcccggtcagctgg

SEQ ID NO: 308500 - DNA, 25 bp, Mus musculus
gctctgccctgttaccctggcatga

SEQ ID NO: 308501 - DNA, 25 bp, Mus musculus
accctggcatgagaggccttaccgc

SEQ ID NO: 308502 - DNA, 25 bp, Mus musculus
gcaaaaggtagagacccgcggctgc

SEQ ID NO: 308503 - DNA, 25 bp, Mus musculus
ttagaggcaaaaggtagagacccgc

SEQ ID NO: 308504 - DNA, 25 bp, Mus musculus
gcgcgcacgcctaaccatcccactc

SEQ ID NO: 308505 - DNA, 25 bp, Mus musculus
gcatgagaggccttaccgccacaga

SEQ ID NO: 308506 - DNA, 25 bp, Mus musculus
tgttaccctggcatgagaggcctta

SEQ ID NO: 308507 - DNA, 25 bp, Mus musculus
tgccctgttaccctggcatgagagg

SEQ ID NO: 308508 - DNA, 25 bp, Mus musculus
tcccacggcgcgacctctcacccat

SEQ ID NO: 308509 - DNA, 25 bp, Mus musculus
tgtctccgcgcgcacgcctaaccat

SEQ ID NO: 308510 - DNA, 25 bp, Mus musculus
ctggaaaggcctggtggaaaaggtg

SEQ ID NO: 308511 - DNA, 25 bp, Mus musculus
ctcctggacggctggaaaggcctgg

SEQ ID NO: 308512 - DNA, 25 bp, Mus musculus
agcgcacatccagccgtgctggcag

SEQ ID NO: 308513 - DNA, 25 bp, Mus musculus
tgagaggccttaccgccacagactt

SEQ ID NO: 308514 - DNA, 25 bp, Mus musculus
cgggtccaactctcgtagtagcggg

SEQ ID NO: 308515 - DNA, 25 bp, Mus musculus
tctcccgggtccaactctcgtagta

SEQ ID NO: 308516 - DNA, 25 bp, Mus musculus
ggtgagccaggtggactccgtctcc

SEQ ID NO: 308517 - DNA, 25 bp, Mus musculus
tccaactctcgtagtagcggggctc

SEQ ID NO: 308518 - DNA, 25 bp, Mus musculus
actctcgtagtagcggggctcgatg

SEQ ID NO: 308519 - DNA, 25 bp, Mus musculus
ggctcgatggcatcggctcggctcc

SEQ ID NO: 308520 - DNA, 25 bp, Mus musculus
ccatcctcccgtgttgcgggcgcgc

SEQ ID NO: 308521 - DNA, 25 bp, Mus musculus
ggccgctcggcttgcggctgtggct

SEQ ID NO: 308522 - DNA, 25 bp, Mus musculus
ggcggcagcgacattggtcccctaa

SEQ ID NO: 308523 - DNA, 25 bp, Mus musculus
gacattggtcccctaaccgccagag

SEQ ID NO: 308524 - DNA, 25 bp, Mus musculus
cgtccgagtcggtgtaggtgagcca

SEQ ID NO: 308525 - DNA, 25 bp, Mus musculus
tcccgggtccaactctcgtagtagc

SEQ ID NO: 308526 - DNA, 25 bp, Mus musculus
cggggctcactcacccgcgtgcagg

SEQ ID NO: 308527 - DNA, 25 bp, Mus musculus
taggtgagccaggtggactccgtct

SEQ ID NO: 308528 - DNA, 25 bp, Mus musculus
agcagtggtcattgtcccgacggtg

SEQ ID NO: 308529 - DNA, 25 bp, Mus musculus
attgtcccgacggtgtggtggtctg

SEQ ID NO: 308530 - DNA, 25 bp, Mus musculus
tcattgtcccgacggtgtggtggtc

SEQ ID NO: 308531 - DNA, 25 bp, Mus musculus
aaagaggctagcagtggtcattgtc

SEQ ID NO: 308532 - DNA, 25 bp, Mus musculus
gcagtggtcattgtcccgacggtgt

SEQ ID NO: 308533 - DNA, 25 bp, Mus musculus
agaggctagcagtggtcattgtccc

SEQ ID NO: 308534 - DNA, 25 bp, Mus musculus
tagcagtggtcattgtcccgacggt

SEQ ID NO: 308535 - DNA, 25 bp, Mus musculus
ctagcagtggtcattgtcccgacgg

SEQ ID NO: 308536 - DNA, 25 bp, Mus musculus
gctagcagtggtcattgtcccgacg

SEQ ID NO: 308537 - DNA, 25 bp, Mus musculus
ggctagcagtggtcattgtcccgac

SEQ ID NO: 308538 - DNA, 25 bp, Mus musculus
aggctagcagtggtcattgtcccga

SEQ ID NO: 308539 - DNA, 25 bp, Mus musculus
gaggctagcagtggtcattgtcccg

SEQ ID NO: 308540 - DNA, 25 bp, Mus musculus
aagaggctagcagtggtcattgtcc

SEQ ID NO: 308541 - DNA, 25 bp, Mus musculus
cagtggtcattgtcccgacggtgtg

SEQ ID NO: 308542 - DNA, 25 bp, Mus musculus
agggagatggccaaagcagaccgag

SEQ ID NO: 308543 - DNA, 25 bp, Mus musculus
ggagatggtgtcgtgtttaaggacg

SEQ ID NO: 308544 - DNA, 25 bp, Mus musculus
gagatggtgtcgtgtttaaggacgg

SEQ ID NO: 308545 - DNA, 25 bp, Mus musculus
cagggagatggccaaagcagaccga

SEQ ID NO: 308546 - DNA, 25 bp, Mus musculus
aaatgctagggttggtggcaacgtt

SEQ ID NO: 308547 - DNA, 25 bp, Mus musculus
ggagatggccaaagcagaccgagtt

SEQ ID NO: 308548 - DNA, 25 bp, Mus musculus
gagatggccaaagcagaccgagttg

SEQ ID NO: 308549 - DNA, 25 bp, Mus musculus
agatggccaaagcagaccgagttgc

SEQ ID NO: 308550 - DNA, 25 bp, Mus musculus
gatggccaaagcagaccgagttgct

SEQ ID NO: 308551 - DNA, 25 bp, Mus musculus
atggccaaagcagaccgagttgctg

SEQ ID NO: 308552 - DNA, 25 bp, Mus musculus
tggccaaagcagaccgagttgctgt

SEQ ID NO: 308553 - DNA, 25 bp, Mus musculus
aaaaatgctagggttggtggcaacg

SEQ ID NO: 308554 - DNA, 25 bp, Mus musculus
aaaatgctagggttggtggcaacgt

SEQ ID NO: 308555 - DNA, 25 bp, Mus musculus
agatggtgtcgtgtttaaggacggt

SEQ ID NO: 308556 - DNA, 25 bp, Mus musculus
tcagccaacttaacgaagaaccagg

SEQ ID NO: 308557 - DNA, 25 bp, Mus musculus
gctcagctcatccagtagcccaagg

SEQ ID NO: 308558 - DNA, 25 bp, Mus musculus
cccaaggcaacaagcgccggcattt

SEQ ID NO: 308559 - DNA, 25 bp, Mus musculus
cacgcccagtagagcaaggtccgca

SEQ ID NO: 308560 - DNA, 25 bp, Mus musculus
cgaagcacagctgccatccagaggt

SEQ ID NO: 308561 - DNA, 25 bp, Mus musculus
cactaggtagaaagaggccgattca

SEQ ID NO: 308562 - DNA, 25 bp, Mus musculus
ggccgattcagagaccagtggaccc

SEQ ID NO: 308563 - DNA, 25 bp, Mus musculus
gtcaccaccgggatcaagtcgaaga

SEQ ID NO: 308564 - DNA, 25 bp, Mus musculus
cgggatcagggactcagcaacctca

SEQ ID NO: 308565 - DNA, 25 bp, Mus musculus
ggacttggctttcgtcggcgtccaa

SEQ ID NO: 308566 - DNA, 25 bp, Mus musculus
caggaagttacttgggtcgggcata

SEQ ID NO: 308567 - DNA, 25 bp, Mus musculus
taatgtgggccatgcctttggagcc

SEQ ID NO: 308568 - DNA, 25 bp, Mus musculus
acacggagctttcggccgctcaaaa

SEQ ID NO: 308569 - DNA, 25 bp, Mus musculus
cctgcgtgacgagctgcatgaacta

SEQ ID NO: 308570 - DNA, 25 bp, Mus musculus
gcccggtcagctggagctttggatc

SEQ ID NO: 308571 - DNA, 25 bp, Mus musculus
cagaagccttgtctgtcgctgtcac

SEQ ID NO: 308572 - DNA, 25 bp, Mus musculus
ggccagctggagcttcgggtctttt

SEQ ID NO: 308573 - DNA, 25 bp, Mus musculus
gccagctggagcttcgggtcttttt

SEQ ID NO: 308574 - DNA, 25 bp, Mus musculus
cggccagctggagcttcgggtcttt

SEQ ID NO: 308575 - DNA, 25 bp, Mus musculus
ccagctggagcttcgggtctttttt

SEQ ID NO: 308576 - DNA, 25 bp, Mus musculus
agaggacgcgatgggcccggcttcc

SEQ ID NO: 308577 - DNA, 25 bp, Mus musculus
agccctctcttgtccccgtcaccgg

SEQ ID NO: 308578 - DNA, 25 bp, Mus musculus
cgagaggacgcgatgggcccggctt

SEQ ID NO: 308579 - DNA, 25 bp, Mus musculus
ccagaagccttgtctgtcgctgtca

SEQ ID NO: 308580 - DNA, 25 bp, Mus musculus
agaagccttgtctgtcgctgtcacc

SEQ ID NO: 308581 - DNA, 25 bp, Mus musculus
aggccgagaggacgcgatgggcccg

SEQ ID NO: 308582 - DNA, 25 bp, Mus musculus
cagctggagcttcgggtcttttttt

SEQ ID NO: 308583 - DNA, 25 bp, Mus musculus
aagccctctcttgtccccgtcaccg

SEQ ID NO: 308584 - DNA, 25 bp, Mus musculus
acagcacacggcagaaagcaacacc

SEQ ID NO: 308585 - DNA, 25 bp, Mus musculus
ggaggactccgcagactctgagata

SEQ ID NO: 308586 - DNA, 25 bp, Mus musculus
tggggcatcaaggagccgcaggcac

SEQ ID NO: 308587 - DNA, 25 bp, Mus musculus
cggtgcacagcacacggcagaaagc

SEQ ID NO: 308588 - DNA, 25 bp, Mus musculus
ggcacctaacggtgcacagcacacg

SEQ ID NO: 308589 - DNA, 25 bp, Mus musculus
acaggggcaaggcacctaacggtgc

SEQ ID NO: 308590 - DNA, 25 bp, Mus musculus
cagactctgagataggaaggacagg

SEQ ID NO: 308591 - DNA, 25 bp, Mus musculus
ggactccgcagactctgagatagga

SEQ ID NO: 308592 - DNA, 25 bp, Mus musculus
gcggtaggaggactccgcagactct

SEQ ID NO: 308593 - DNA, 25 bp, Mus musculus
cacgagctggccctttttccgagga

SEQ ID NO: 308594 - DNA, 25 bp, Mus musculus
aacgcagaagggatcacgagctggc

SEQ ID NO: 308595 - DNA, 25 bp, Mus musculus
cccaggaacgcagaagggatcacga

SEQ ID NO: 308596 - DNA, 25 bp, Mus musculus
gggcagcaccgaccggggagaaagc

SEQ ID NO: 308597 - DNA, 25 bp, Mus musculus
ccgcagactctgagataggaaggac

SEQ ID NO: 308598 - DNA, 25 bp, Mus musculus
ccggatagtttctctgccgcttcga

SEQ ID NO: 308599 - DNA, 25 bp, Mus musculus
gcttctctaaccagctgggatctcc

SEQ ID NO: 308600 - DNA, 25 bp, Mus musculus
agtaactctgcgcagcttctctaac

SEQ ID NO: 308601 - DNA, 25 bp, Mus musculus
cgttggtctgcgttcagtaactctg

SEQ ID NO: 308602 - DNA, 25 bp, Mus musculus
tttttaagaggattagcggcgagcg

SEQ ID NO: 308603 - DNA, 25 bp, Mus musculus
gtggccggcctctctgtttttaaga

SEQ ID NO: 308604 - DNA, 25 bp, Mus musculus
gatgccgaccgagccgttatgctac

SEQ ID NO: 308605 - DNA, 25 bp, Mus musculus
gaagtcgaaacaaaacaagcggctg

SEQ ID NO: 308606 - DNA, 25 bp, Mus musculus
cctcccgtagccgtagctagaagtc

SEQ ID NO: 308607 - DNA, 25 bp, Mus musculus
ctgttcaaggtcacgggccgtgcca

SEQ ID NO: 308608 - DNA, 25 bp, Mus musculus
ctcaagtcgccggtttggccgcagc

SEQ ID NO: 308609 - DNA, 25 bp, Mus musculus
aaccggaatcgagagcgtgttgcca

SEQ ID NO: 308610 - DNA, 25 bp, Mus musculus
ggattccggctgtgaatcgggcctc

SEQ ID NO: 308611 - DNA, 25 bp, Mus musculus
ccgcttcgacggctttcagagcatg

SEQ ID NO: 308612 - DNA, 25 bp, Mus musculus
gcggctcatcctgccggcctgcgcc

SEQ ID NO: 308613 - DNA, 25 bp, Mus musculus
agccagggacacaacgctctctggc

SEQ ID NO: 308614 - DNA, 25 bp, Mus musculus
gagccagggacacaacgctctctgg

SEQ ID NO: 308615 - DNA, 25 bp, Mus musculus
tgagccagggacacaacgctctctg

SEQ ID NO: 308616 - DNA, 25 bp, Mus musculus
ctgagccagggacacaacgctctct

SEQ ID NO: 308617 - DNA, 25 bp, Mus musculus
gactgagccagggacacaacgctct

SEQ ID NO: 308618 - DNA, 25 bp, Mus musculus
acgactgagccagggacacaacgct

SEQ ID NO: 308619 - DNA, 25 bp, Mus musculus
gaacgactgagccagggacacaacg

SEQ ID NO: 308620 - DNA, 25 bp, Mus musculus
ctgaacgactgagccagggacacaa

SEQ ID NO: 308621 - DNA, 25 bp, Mus musculus
gctgaacgactgagccagggacaca

SEQ ID NO: 308622 - DNA, 25 bp, Mus musculus
ccgctgaacgactgagccagggaca

SEQ ID NO: 308623 - DNA, 25 bp, Mus musculus
gcccgctgaacgactgagccaggga

SEQ ID NO: 308624 - DNA, 25 bp, Mus musculus
tgcgcccgctgaacgactgagccag

SEQ ID NO: 308625 - DNA, 25 bp, Mus musculus
ggcctgcgcccgctgaacgactgag

SEQ ID NO: 308626 - DNA, 25 bp, Mus musculus
tccgagcccaaaaaacccgtgctga

SEQ ID NO: 308627 - DNA, 25 bp, Mus musculus
gggcaacaggaactgcctccgactg

SEQ ID NO: 308628 - DNA, 25 bp, Mus musculus
gtttagcaagggcaacaggaactgc

SEQ ID NO: 308629 - DNA, 25 bp, Mus musculus
gccatgtttagcaagggcaacagga

SEQ ID NO: 308630 - DNA, 25 bp, Mus musculus
gattcaccggcatcggccgctgcaa

SEQ ID NO: 308631 - DNA, 25 bp, Mus musculus
cgtgctgattcaccggcatcggccg

SEQ ID NO: 308632 - DNA, 25 bp, Mus musculus
gagcccaaaaaacccgtgctgattc

SEQ ID NO: 308633 - DNA, 25 bp, Mus musculus
agcagatctgcaccacctccgagcc

SEQ ID NO: 308634 - DNA, 25 bp, Mus musculus
cggacccaagtccagcagatctgca

SEQ ID NO: 308635 - DNA, 25 bp, Mus musculus
agcatttcgattcgcggctcctccg

SEQ ID NO: 308636 - DNA, 25 bp, Mus musculus
cgtgaagcatttcgattcgcggctc

SEQ ID NO: 308637 - DNA, 25 bp, Mus musculus
tagcaagggcaacaggaactgcctc

SEQ ID NO: 308638 - DNA, 25 bp, Mus musculus
aacccgtgctgattcaccggcatcg

SEQ ID NO: 308639 - DNA, 25 bp, Mus musculus
caggaactgcctccgactggcaacg

SEQ ID NO: 308640 - DNA, 25 bp, Mus musculus
agacagcaggctcattttgccgtgg

SEQ ID NO: 308641 - DNA, 25 bp, Mus musculus
atggcagacagcaggctcattttgc

SEQ ID NO: 308642 - DNA, 25 bp, Mus musculus
caggctcattttgccgtggcggtgc

SEQ ID NO: 308643 - DNA, 25 bp, Mus musculus
ggcgggcaccttttgagcctgtgcc

SEQ ID NO: 308644 - DNA, 25 bp, Mus musculus
ttttgagcctgtgcccactgccagc

SEQ ID NO: 308645 - DNA, 25 bp, Mus musculus
cggggatccgctatctgcctctgcg

SEQ ID NO: 308646 - DNA, 25 bp, Mus musculus
gatccgctatctgcctctgcgctga

SEQ ID NO: 308647 - DNA, 25 bp, Mus musculus
cccattggttgtcttattgaatatg

SEQ ID NO: 308648 - DNA, 25 bp, Mus musculus
tgtcttattgaatatgaatgtgggg

SEQ ID NO: 308649 - DNA, 25 bp, Mus musculus
gcaagacaagaaagaaggcgggtcc

SEQ ID NO: 308650 - DNA, 25 bp, Mus musculus
gaaagaaggcgggtccgcacatgta

SEQ ID NO: 308651 - DNA, 25 bp, Mus musculus
gcgggtccgcacatgtagcacgccg

SEQ ID NO: 308652 - DNA, 25 bp, Mus musculus
cggccagttcggtcctatcctcgct

SEQ ID NO: 308653 - DNA, 25 bp, Mus musculus
gtcgatggcagacagcaggctcatt

SEQ ID NO: 308654 - DNA, 25 bp, Mus musculus
cctagcagccgactaagaacttttt

SEQ ID NO: 308655 - DNA, 25 bp, Mus musculus
gactggtgaattgaaacaaagcatc

SEQ ID NO: 308656 - DNA, 25 bp, Mus musculus
ccgactggtgaattgaaacaaagca

SEQ ID NO: 308657 - DNA, 25 bp, Mus musculus
tccgactggtgaattgaaacaaagc

SEQ ID NO: 308658 - DNA, 25 bp, Mus musculus
atccgactggtgaattgaaacaaag

SEQ ID NO: 308659 - DNA, 25 bp, Mus musculus
gaatccgactggtgaattgaaacaa

SEQ ID NO: 308660 - DNA, 25 bp, Mus musculus
ggaatccgactggtgaattgaaaca

SEQ ID NO: 308661 - DNA, 25 bp, Mus musculus
gggaatccgactggtgaattgaaac

SEQ ID NO: 308662 - DNA, 25 bp, Mus musculus
ggggaatccgactggtgaattgaaa

SEQ ID NO: 308663 - DNA, 25 bp, Mus musculus
tggtgaattgaaacaaagcatcgcg

SEQ ID NO: 308664 - DNA, 25 bp, Mus musculus
ctagcagccgactaagaactttttt

SEQ ID NO: 308665 - DNA, 25 bp, Mus musculus
gcctagcagccgactaagaactttt

SEQ ID NO: 308666 - DNA, 25 bp, Mus musculus
ctggtgaattgaaacaaagcatcgc

SEQ ID NO: 308667 - DNA, 25 bp, Mus musculus
aggggaatccgactggtgaattgaa

SEQ ID NO: 308668 - DNA, 25 bp, Mus musculus
cgcgcaaattgtgcatccagcgttg

SEQ ID NO: 308669 - DNA, 25 bp, Mus musculus
tcgcgcctcgtccaggtctatcaga

SEQ ID NO: 308670 - DNA, 25 bp, Mus musculus
cctctactacctcgatgttgttgtg

SEQ ID NO: 308671 - DNA, 25 bp, Mus musculus
gtccagtgcatccagcatcccgggg

SEQ ID NO: 308672 - DNA, 25 bp, Mus musculus
ccacagctcagtgggttgtccgcca

SEQ ID NO: 308673 - DNA, 25 bp, Mus musculus
tatcagaggccggtccaacagtacg

SEQ ID NO: 308674 - DNA, 25 bp, Mus musculus
cgagccagcgcgtgattgagctgta

SEQ ID NO: 308675 - DNA, 25 bp, Mus musculus
atctctgcaggcctcgcgcaaattg

SEQ ID NO: 308676 - DNA, 25 bp, Mus musculus
gcatcgccgtcggagcaacctagtc

SEQ ID NO: 308677 - DNA, 25 bp, Mus musculus
agacgtaagaggcttccaactccgg

SEQ ID NO: 308678 - DNA, 25 bp, Mus musculus
gcaccagcccgaagaagacgtaaga

SEQ ID NO: 308679 - DNA, 25 bp, Mus musculus
atgaggccgatgagtgccagcacca

SEQ ID NO: 308680 - DNA, 25 bp, Mus musculus
cggcggtttaggtagagcaccatga

SEQ ID NO: 308681 - DNA, 25 bp, Mus musculus
gacgcgcagcgcaacattaaccggg

SEQ ID NO: 308682 - DNA, 25 bp, Mus musculus
cagctggagcttcgggtcttttttt

SEQ ID NO: 308683 - DNA, 25 bp, Mus musculus
gcccggtcagctggagctttggatc

SEQ ID NO: 308684 - DNA, 25 bp, Mus musculus
tgtggcccggtcagctggagctttg

SEQ ID NO: 308685 - DNA, 25 bp, Mus musculus
atgtggcccggtcagctggagcttt

SEQ ID NO: 308686 - DNA, 25 bp, Mus musculus
agaagccttgtctgtcgctgtcacc

SEQ ID NO: 308687 - DNA, 25 bp, Mus musculus
ccagctggagcttcgggtctttttt

SEQ ID NO: 308688 - DNA, 25 bp, Mus musculus
ggccagctggagcttcgggtctttt

SEQ ID NO: 308689 - DNA, 25 bp, Mus musculus
cagaagccttgtctgtcgctgtcac

SEQ ID NO: 308690 - DNA, 25 bp, Mus musculus
ccagaagccttgtctgtcgctgtca

SEQ ID NO: 308691 - DNA, 25 bp, Mus musculus
tctcttgtccccgtcaccgggggca

SEQ ID NO: 308692 - DNA, 25 bp, Mus musculus
gccagctggagcttcgggtcttttt

SEQ ID NO: 308693 - DNA, 25 bp, Mus musculus
cggccagctggagcttcgggtcttt

SEQ ID NO: 308694 - DNA, 25 bp, Mus musculus
agccctctcttgtccccgtcaccgg

SEQ ID NO: 308695 - DNA, 25 bp, Mus musculus
aagccctctcttgtccccgtcaccg

SEQ ID NO: 308696 - DNA, 25 bp, Mus musculus
tgctcatcatgtgtccctcggcggt

SEQ ID NO: 308697 - DNA, 25 bp, Mus musculus
atgcgcaaggtctacaccgccgtgc

SEQ ID NO: 308698 - DNA, 25 bp, Mus musculus
ctcatcgtggtgatgtacgcgcgca

SEQ ID NO: 308699 - DNA, 25 bp, Mus musculus
cccgcgtggtgcatatgctggtcat

SEQ ID NO: 308700 - DNA, 25 bp, Mus musculus
ggcgctcttcttcaccttgtcctgg

SEQ ID NO: 308701 - DNA, 25 bp, Mus musculus
tgcacttgctgtccgtctacgcctt

SEQ ID NO: 308702 - DNA, 25 bp, Mus musculus
tcaacgagaacttccgccgcggctt

SEQ ID NO: 308703 - DNA, 25 bp, Mus musculus
gtggacgtgcaacccagcgactcag

SEQ ID NO: 308704 - DNA, 25 bp, Mus musculus
tgctcttcgcgcacatctatctggc

SEQ ID NO: 308705 - DNA, 25 bp, Mus musculus
cacgcgagaggagcatcacttcatg

SEQ ID NO: 308706 - DNA, 25 bp, Mus musculus
ggcgctgctcaccatagcggtgatc

SEQ ID NO: 308707 - DNA, 25 bp, Mus musculus
cgtacaccctttccgtgagaagctg

SEQ ID NO: 308708 - DNA, 25 bp, Mus musculus
cgcctgcaggttccgctgcatcgta

SEQ ID NO: 308709 - DNA, 25 bp, Mus musculus
tcatgctggatgctcgcaaccgctc

SEQ ID NO: 308710 - DNA, 25 bp, Mus musculus
ttcaccacggggaagcgctcctccc

SEQ ID NO: 308711 - DNA, 25 bp, Mus musculus
ccgtaggctgtgttcaccacgggga

SEQ ID NO: 308712 - DNA, 25 bp, Mus musculus
gcactcgcccgtaggctgtgttcac

SEQ ID NO: 308713 - DNA, 25 bp, Mus musculus
gatctcgttgttgagctcgcgccgc

SEQ ID NO: 308714 - DNA, 25 bp, Mus musculus
cccaggatctcgttgttgagctcgc

SEQ ID NO: 308715 - DNA, 25 bp, Mus musculus
agaactgcacgaccgggcccaggat

SEQ ID NO: 308716 - DNA, 25 bp, Mus musculus
caagaactgcacgaccgggcccagg

SEQ ID NO: 308717 - DNA, 25 bp, Mus musculus
gccgggccacgaggcaggtgcctca

SEQ ID NO: 308718 - DNA, 25 bp, Mus musculus
cacaggcagcatgatggccggcagg

SEQ ID NO: 308719 - DNA, 25 bp, Mus musculus
tcggtgaaccacacaggcagcatga

SEQ ID NO: 308720 - DNA, 25 bp, Mus musculus
caagttgtcggtgaaccacacaggc

SEQ ID NO: 308721 - DNA, 25 bp, Mus musculus
gcctccaagttgtcggtgaaccaca

SEQ ID NO: 308722 - DNA, 25 bp, Mus musculus
cgctctggttctgcacgtaggtggc

SEQ ID NO: 308723 - DNA, 25 bp, Mus musculus
cggccgcctccaagttgtcggtgaa

SEQ ID NO: 308724 - DNA, 25 bp, Mus musculus
aaggatcattaacgggagactgtgg

SEQ ID NO: 308725 - DNA, 25 bp, Mus musculus
tcggggattgcaattattccccatg

SEQ ID NO: 308726 - DNA, 25 bp, Mus musculus
tgcggaaggatcattaacgggagac

SEQ ID NO: 308727 - DNA, 25 bp, Mus musculus
cataagcttgcgttgattaagtccc

SEQ ID NO: 308728 - DNA, 25 bp, Mus musculus
agcttgcgttgattaagtccctgcc

SEQ ID NO: 308729 - DNA, 25 bp, Mus musculus
ccgattggatggtttagtgaggccc

SEQ ID NO: 308730 - DNA, 25 bp, Mus musculus
agcgctgagaagacggtcgaacttg

SEQ ID NO: 308731 - DNA, 25 bp, Mus musculus
gagaagacggtcgaacttgactatc

SEQ ID NO: 308732 - DNA, 25 bp, Mus musculus
cggtcgaacttgactatctagagga

SEQ ID NO: 308733 - DNA, 25 bp, Mus musculus
cgaacttgactatctagaggaagta

SEQ ID NO: 308734 - DNA, 25 bp, Mus musculus
tctagaggaagtaaaagtcgtaaca

SEQ ID NO: 308735 - DNA, 25 bp, Mus musculus
ccgtaggtgaacctgcggaaggatc

SEQ ID NO: 308736 - DNA, 25 bp, Mus musculus
tgaacctgcggaaggatcattaacg

SEQ ID NO: 308737 - DNA, 25 bp, Mus musculus
caaggtttccgtaggtgaacctgcg

SEQ ID NO: 308738 - DNA, 25 bp, Mus musculus
ggaatcgaaccctgattccccgtca

SEQ ID NO: 308739 - DNA, 25 bp, Mus musculus
tgctgccttccttggatgtggtagc

SEQ ID NO: 308740 - DNA, 25 bp, Mus musculus
ccttccttggatgtggtagccgttt

SEQ ID NO: 308741 - DNA, 25 bp, Mus musculus
cttccttggatgtggtagccgtttc

SEQ ID NO: 308742 - DNA, 25 bp, Mus musculus
ttccttggatgtggtagccgtttct

SEQ ID NO: 308743 - DNA, 25 bp, Mus musculus
gctccctctccggaatcgaaccctg

SEQ ID NO: 308744 - DNA, 25 bp, Mus musculus
cttggatgtggtagccgtttctcag

SEQ ID NO: 308745 - DNA, 25 bp, Mus musculus
tctcaggctccctctccggaatcga

SEQ ID NO: 308746 - DNA, 25 bp, Mus musculus
ttggatgtggtagccgtttctcagg

SEQ ID NO: 308747 - DNA, 25 bp, Mus musculus
cctctccggaatcgaaccctgattc

SEQ ID NO: 308748 - DNA, 25 bp, Mus musculus
atgtggtagccgtttctcaggctcc

SEQ ID NO: 308749 - DNA, 25 bp, Mus musculus
tgtggtagccgtttctcaggctccc

SEQ ID NO: 308750 - DNA, 25 bp, Mus musculus
ggtaatttgcgcgcctgctgccttc

SEQ ID NO: 308751 - DNA, 25 bp, Mus musculus
ccttggatgtggtagccgtttctca

SEQ ID NO: 308752 - DNA, 25 bp, Mus musculus
cgtctcccgacgaagccgagcgcac

SEQ ID NO: 308753 - DNA, 25 bp, Mus musculus
cgatgtcggctacccacccgacccg

SEQ ID NO: 308754 - DNA, 25 bp, Mus musculus
gtcggtcacgcgtctcccgacgaag

SEQ ID NO: 308755 - DNA, 25 bp, Mus musculus
tcggtcacgcgtctcccgacgaagc

SEQ ID NO: 308756 - DNA, 25 bp, Mus musculus
ggtcacgcgtctcccgacgaagccg

SEQ ID NO: 308757 - DNA, 25 bp, Mus musculus
cacgcgtctcccgacgaagccgagc

SEQ ID NO: 308758 - DNA, 25 bp, Mus musculus
cgcgtctcccgacgaagccgagcgc

SEQ ID NO: 308759 - DNA, 25 bp, Mus musculus
tctcccgacgaagccgagcgcacgg

SEQ ID NO: 308760 - DNA, 25 bp, Mus musculus
cccgacgaagccgagcgcacggggt

SEQ ID NO: 308761 - DNA, 25 bp, Mus musculus
cgacgaagccgagcgcacggggtcg

SEQ ID NO: 308762 - DNA, 25 bp, Mus musculus
aagccgagcgcacggggtcggcggc

SEQ ID NO: 308763 - DNA, 25 bp, Mus musculus
gtcggcggcgatgtcggctacccac

SEQ ID NO: 308764 - DNA, 25 bp, Mus musculus
cggcggcgatgtcggctacccaccc

SEQ ID NO: 308765 - DNA, 25 bp, Mus musculus
ggcgatgtcggctacccacccgacc

SEQ ID NO: 308766 - DNA, 25 bp, Mus musculus
ccgcagcaacggcaggacgacagac

SEQ ID NO: 308767 - DNA, 25 bp, Mus musculus
agagaaggaaactttctcactgagg

SEQ ID NO: 308768 - DNA, 25 bp, Mus musculus
gcagcaacggcaggacgacagacag

SEQ ID NO: 308769 - DNA, 25 bp, Mus musculus
gagacccctcgagaccgtaagaagc

SEQ ID NO: 308770 - DNA, 25 bp, Mus musculus
cgagaccgtaagaagcccgcaccct

SEQ ID NO: 308771 - DNA, 25 bp, Mus musculus
gcaccctttccggaagatagctaga

SEQ ID NO: 308772 - DNA, 25 bp, Mus musculus
ccctttccggaagatagctagagaa

SEQ ID NO: 308773 - DNA, 25 bp, Mus musculus
ctttccggaagatagctagagaagg

SEQ ID NO: 308774 - DNA, 25 bp, Mus musculus
aggacgacagacaggctctgccccg

SEQ ID NO: 308775 - DNA, 25 bp, Mus musculus
gatagctagagaaggaaactttctc

SEQ ID NO: 308776 - DNA, 25 bp, Mus musculus
cggcaacaggaaggttctcttccaa

SEQ ID NO: 308777 - DNA, 25 bp, Mus musculus
acaggaaggttctcttccaagggca

SEQ ID NO: 308778 - DNA, 25 bp, Mus musculus
ggaaggttctcttccaagggcattc

SEQ ID NO: 308779 - DNA, 25 bp, Mus musculus
ccggaagatagctagagaaggaaac

SEQ ID NO: 308780 - DNA, 25 bp, Mus musculus
ccttatataactacaagtcaccttg

SEQ ID NO: 308781 - DNA, 25 bp, Mus musculus
ggaaaccacaatgcgtggttcatcc

SEQ ID NO: 308782 - DNA, 25 bp, Mus musculus
aaatgacaggaaaccacaatgcgtg

SEQ ID NO: 308783 - DNA, 25 bp, Mus musculus
ctcagtgcaaaaatgacaggaaacc

SEQ ID NO: 308784 - DNA, 25 bp, Mus musculus
ctccacctcctcagtgcaaaaatga

SEQ ID NO: 308785 - DNA, 25 bp, Mus musculus
ccttgtctttgtggttctctcctcc

SEQ ID NO: 308786 - DNA, 25 bp, Mus musculus
acaagtcaccttgtctttgtggttc

SEQ ID NO: 308787 - DNA, 25 bp, Mus musculus
tccgactccttatataactacaagt

SEQ ID NO: 308788 - DNA, 25 bp, Mus musculus
tggcctccgactccttatataacta

SEQ ID NO: 308789 - DNA, 25 bp, Mus musculus
gctggcctccgactccttatataac

SEQ ID NO: 308790 - DNA, 25 bp, Mus musculus
tttaagaccgtctcatgtatcccag

SEQ ID NO: 308791 - DNA, 25 bp, Mus musculus
gtttgatttttaagaccgtctcatg

SEQ ID NO: 308792 - DNA, 25 bp, Mus musculus
tggcacttgtttgatttttaagacc

SEQ ID NO: 308793 - DNA, 25 bp, Mus musculus
gtcaccttgtctttgtggttctctc

SEQ ID NO: 308794 - DNA, 25 bp, Mus musculus
aggttcgtcactccgcatctcagcg

SEQ ID NO: 308795 - DNA, 25 bp, Mus musculus
cgaactgctaccttgacgaccgtca

SEQ ID NO: 308796 - DNA, 25 bp, Mus musculus
tcagcaagggctcagcaagggatgc

SEQ ID NO: 308797 - DNA, 25 bp, Mus musculus
cccagcacgaacagccagaagagca

SEQ ID NO: 308798 - DNA, 25 bp, Mus musculus
gagaaacgccgtccgtggctgagat

SEQ ID NO: 308799 - DNA, 25 bp, Mus musculus
cacactttgaggtccgagaaacgcc

SEQ ID NO: 308800 - DNA, 25 bp, Mus musculus
cgatagccgagtaaagcgtaccagc

SEQ ID NO: 308801 - DNA, 25 bp, Mus musculus
caacaagtggtaggcacggcctcta

SEQ ID NO: 308802 - DNA, 25 bp, Mus musculus
cagagagcaaatccggcaacaagtg

SEQ ID NO: 308803 - DNA, 25 bp, Mus musculus
cagcaccctggaaacccggctgggt

SEQ ID NO: 308804 - DNA, 25 bp, Mus musculus
ttaaaacgctcttggctgcagcatg

SEQ ID NO: 308805 - DNA, 25 bp, Mus musculus
tctcggtcttgagtggacccaggtc

SEQ ID NO: 308806 - DNA, 25 bp, Mus musculus
tctctaagcgcgtggatctcggtct

SEQ ID NO: 308807 - DNA, 25 bp, Mus musculus
tcaatcggccgctaggattgcgccc

SEQ ID NO: 308808 - DNA, 25 bp, Mus musculus
agccctctcttgtccccgtcaccgg

SEQ ID NO: 308809 - DNA, 25 bp, Mus musculus
gtggcccggtcagctggagctttgg

SEQ ID NO: 308810 - DNA, 25 bp, Mus musculus
gcccggtcagctggagctttggatc

SEQ ID NO: 308811 - DNA, 25 bp, Mus musculus
atgtggcccggtcagctggagcttt

SEQ ID NO: 308812 - DNA, 25 bp, Mus musculus
cagaagccttgtctgtcgctgtcac

SEQ ID NO: 308813 - DNA, 25 bp, Mus musculus
cagctggagcttcgggtcttttttt

SEQ ID NO: 308814 - DNA, 25 bp, Mus musculus
ccagaagccttgtctgtcgctgtca

SEQ ID NO: 308815 - DNA, 25 bp, Mus musculus
ccagctggagcttcgggtctttttt

SEQ ID NO: 308816 - DNA, 25 bp, Mus musculus
gccagctggagcttcgggtcttttt

SEQ ID NO: 308817 - DNA, 25 bp, Mus musculus
agaagccttgtctgtcgctgtcacc

SEQ ID NO: 308818 - DNA, 25 bp, Mus musculus
cggccagctggagcttcgggtcttt

SEQ ID NO: 308819 - DNA, 25 bp, Mus musculus
aagccctctcttgtccccgtcaccg

SEQ ID NO: 308820 - DNA, 25 bp, Mus musculus
ggcccggtcagctggagctttggat

SEQ ID NO: 308821 - DNA, 25 bp, Mus musculus
ggccagctggagcttcgggtctttt

SEQ ID NO: 308822 - DNA, 25 bp, Mus musculus
ggcagggatccagccggaatcctcg

SEQ ID NO: 308823 - DNA, 25 bp, Mus musculus
cccagctcgagagtgatgatccgcc

SEQ ID NO: 308824 - DNA, 25 bp, Mus musculus
gcgtccatcccagctcgagagtgat

SEQ ID NO: 308825 - DNA, 25 bp, Mus musculus
ctttgggaaatgctcagtagccagg

SEQ ID NO: 308826 - DNA, 25 bp, Mus musculus
agtcccgagcctcgaggcagaggtc

SEQ ID NO: 308827 - DNA, 25 bp, Mus musculus
ctcctaggaaggaaggcaagggcta

SEQ ID NO: 308828 - DNA, 25 bp, Mus musculus
cccggagcgcagaatccgcggtgca

SEQ ID NO: 308829 - DNA, 25 bp, Mus musculus
gagagagctcaagaacagggaaccc

SEQ ID NO: 308830 - DNA, 25 bp, Mus musculus
atgggacaggactagattggagatc

SEQ ID NO: 308831 - DNA, 25 bp, Mus musculus
ctagattggagatccactggttctc

SEQ ID NO: 308832 - DNA, 25 bp, Mus musculus
tctctgggatggcttcgagggacca

SEQ ID NO: 308833 - DNA, 25 bp, Mus musculus
ttcaggcgacagatcctaagggatc

SEQ ID NO: 308834 - DNA, 25 bp, Mus musculus
aggagtccacggcaatccctagggg

SEQ ID NO: 308835 - DNA, 25 bp, Mus musculus
gcggggccggaatccagtcgatccc

SEQ ID NO: 308836 - DNA, 25 bp, Mus musculus
gaggtagacatcgaccggagccccc

SEQ ID NO: 308837 - DNA, 25 bp, Mus musculus
ggaggtagacatcgaccggagcccc

SEQ ID NO: 308838 - DNA, 25 bp, Mus musculus
gggaggtagacatcgaccggagccc

SEQ ID NO: 308839 - DNA, 25 bp, Mus musculus
agggaggtagacatcgaccggagcc

SEQ ID NO: 308840 - DNA, 25 bp, Mus musculus
ggagggccgagagcccgcgcggaga

SEQ ID NO: 308841 - DNA, 25 bp, Mus musculus
aggtagacatcgaccggagccccca

SEQ ID NO: 308842 - DNA, 25 bp, Mus musculus
acatcgaccggagcccccaccgcca

SEQ ID NO: 308843 - DNA, 25 bp, Mus musculus
gcgcgcggggttaatcccaccgcca

SEQ ID NO: 308844 - DNA, 25 bp, Mus musculus
cacaccgggacacgcgcgcggggtt

SEQ ID NO: 308845 - DNA, 25 bp, Mus musculus
cacgcgcgcggggttaatcccaccg

SEQ ID NO: 308846 - DNA, 25 bp, Mus musculus
gacacgcgcgcggggttaatcccac

SEQ ID NO: 308847 - DNA, 25 bp, Mus musculus
cccaccgccacaccgggacacgcgc

SEQ ID NO: 308848 - DNA, 25 bp, Mus musculus
ggacacgcgcgcggggttaatccca

SEQ ID NO: 308849 - DNA, 25 bp, Mus musculus
cgcgcggggttaatcccaccgccag

SEQ ID NO: 308850 - DNA, 25 bp, Mus musculus
aagaagcgggacactggcgagacag

SEQ ID NO: 308851 - DNA, 25 bp, Mus musculus
aaaagaagcgggacactggcgagac

SEQ ID NO: 308852 - DNA, 25 bp, Mus musculus
aaaaagaagcgggacactggcgaga

SEQ ID NO: 308853 - DNA, 25 bp, Mus musculus
tgccggaaaaagaagcgggacactg

SEQ ID NO: 308854 - DNA, 25 bp, Mus musculus
aaagaagcgggacactggcgagaca

SEQ ID NO: 308855 - DNA, 25 bp, Mus musculus
actctgggaacatggtcaagcgaga

SEQ ID NO: 308856 - DNA, 25 bp, Mus musculus
gcttacaagaaacagcgcgtgcaca

SEQ ID NO: 308857 - DNA, 25 bp, Mus musculus
ttacaagaaacagcgcgtgcacaca

SEQ ID NO: 308858 - DNA, 25 bp, Mus musculus
gaagggtatgcaacgccaccggcca

SEQ ID NO: 308859 - DNA, 25 bp, Mus musculus
cacatccaccgactctgggaacatg

SEQ ID NO: 308860 - DNA, 25 bp, Mus musculus
accgactctgggaacatggtcaagc

SEQ ID NO: 308861 - DNA, 25 bp, Mus musculus
ctgggaacatggtcaagcgagacac

SEQ ID NO: 308862 - DNA, 25 bp, Mus musculus
gaacatggtcaagcgagacacgacc

SEQ ID NO: 308863 - DNA, 25 bp, Mus musculus
tggtcaagcgagacacgaccaaagt

SEQ ID NO: 308864 - DNA, 25 bp, Mus musculus
gacacgaccaaagtgaaacacgtga

SEQ ID NO: 308865 - DNA, 25 bp, Mus musculus
ccaaagtgaaacacgtgagggcaca

SEQ ID NO: 308866 - DNA, 25 bp, Mus musculus
cgggcgcctcacacatccacaagga

SEQ ID NO: 308867 - DNA, 25 bp, Mus musculus
ctcacacatccacaaggaccacgcg

SEQ ID NO: 308868 - DNA, 25 bp, Mus musculus
tccaccgactctgggaacatggtca

SEQ ID NO: 308869 - DNA, 25 bp, Mus musculus
tgcccttggaagagaaccttcctgt

SEQ ID NO: 308870 - DNA, 25 bp, Mus musculus
gtctgtcgtcctgccgttgctgcgg

SEQ ID NO: 308871 - DNA, 25 bp, Mus musculus
ctgtctgtcgtcctgccgttgctgc

SEQ ID NO: 308872 - DNA, 25 bp, Mus musculus
cggggcagagcctgtctgtcgtcct

SEQ ID NO: 308873 - DNA, 25 bp, Mus musculus
ttggaagagaaccttcctgttgccg

SEQ ID NO: 308874 - DNA, 25 bp, Mus musculus
gcttcttacggtctcgaggggtctc

SEQ ID NO: 308875 - DNA, 25 bp, Mus musculus
tctagctatcttccggaaagggtgc

SEQ ID NO: 308876 - DNA, 25 bp, Mus musculus
cttggaagagaaccttcctgttgcc

SEQ ID NO: 308877 - DNA, 25 bp, Mus musculus
tccttctctagctatcttccggaaa

SEQ ID NO: 308878 - DNA, 25 bp, Mus musculus
gaatgcccttggaagagaaccttcc

SEQ ID NO: 308879 - DNA, 25 bp, Mus musculus
gaaagtttccttctctagctatctt

SEQ ID NO: 308880 - DNA, 25 bp, Mus musculus
cagtgagaaagtttccttctctagc

SEQ ID NO: 308881 - DNA, 25 bp, Mus musculus
cctcagtgagaaagtttccttctct

SEQ ID NO: 308882 - DNA, 25 bp, Mus musculus
ttctctagctatcttccggaaaggg

SEQ ID NO: 308883 - DNA, 25 bp, Mus musculus
ccgccgcagccgctatgacggggaa

SEQ ID NO: 308884 - DNA, 25 bp, Mus musculus
cgctatgacggggaaaagaaattga

SEQ ID NO: 308885 - DNA, 25 bp, Mus musculus
tgccggggacatcgtcggccatttt

SEQ ID NO: 308886 - DNA, 25 bp, Mus musculus
cgccgcagccgctatgacggggaaa

SEQ ID NO: 308887 - DNA, 25 bp, Mus musculus
gccgcagccgctatgacggggaaaa

SEQ ID NO: 308888 - DNA, 25 bp, Mus musculus
ccgcagccgctatgacggggaaaag

SEQ ID NO: 308889 - DNA, 25 bp, Mus musculus
cgcagccgctatgacggggaaaaga

SEQ ID NO: 308890 - DNA, 25 bp, Mus musculus
cagccgctatgacggggaaaagaaa

SEQ ID NO: 308891 - DNA, 25 bp, Mus musculus
gctatgacggggaaaagaaattgaa

SEQ ID NO: 308892 - DNA, 25 bp, Mus musculus
cgttgccggggacatcgtcggccat

SEQ ID NO: 308893 - DNA, 25 bp, Mus musculus
cctttagacgcaggacggacggacg

SEQ ID NO: 308894 - DNA, 25 bp, Mus musculus
ttgccggggacatcgtcggccattt

SEQ ID NO: 308895 - DNA, 25 bp, Mus musculus
tcgttgccggggacatcgtcggcca

SEQ ID NO: 308896 - DNA, 25 bp, Mus musculus
gcagccgctatgacggggaaaagaa

SEQ ID NO: 308897 - DNA, 25 bp, Mus musculus
attgatctcgctctcggggacggga

SEQ ID NO: 308898 - DNA, 25 bp, Mus musculus
tggcgttgattgatctcgctctcgg

SEQ ID NO: 308899 - DNA, 25 bp, Mus musculus
tgatctcgctctcggggacgggacc

SEQ ID NO: 308900 - DNA, 25 bp, Mus musculus
tgattgatctcgctctcggggacgg

SEQ ID NO: 308901 - DNA, 25 bp, Mus musculus
gttgattgatctcgctctcggggac

SEQ ID NO: 308902 - DNA, 25 bp, Mus musculus
cgttgattgatctcgctctcgggga

SEQ ID NO: 308903 - DNA, 25 bp, Mus musculus
ggcgttgattgatctcgctctcggg

SEQ ID NO: 308904 - DNA, 25 bp, Mus musculus
tctggcgttgattgatctcgctctc

SEQ ID NO: 308905 - DNA, 25 bp, Mus musculus
tgtctggcgttgattgatctcgctc

SEQ ID NO: 308906 - DNA, 25 bp, Mus musculus
cgtgtctggcgttgattgatctcgc

SEQ ID NO: 308907 - DNA, 25 bp, Mus musculus
ccgtgtctggcgttgattgatctcg

SEQ ID NO: 308908 - DNA, 25 bp, Mus musculus
tccgtgtctggcgttgattgatctc

SEQ ID NO: 308909 - DNA, 25 bp, Mus musculus
atctcgctctcggggacgggaccgt

SEQ ID NO: 308910 - DNA, 25 bp, Mus musculus
ctggcgttgattgatctcgctctcg

SEQ ID NO: 308911 - DNA, 25 bp, Mus musculus
ggggtcagatctgggcccgcctcca

SEQ ID NO: 308912 - DNA, 25 bp, Mus musculus
cccgcctccaccagcgcctgtgagc

SEQ ID NO: 308913 - DNA, 25 bp, Mus musculus
gcgcacaaggtccaaggtccgcggc

SEQ ID NO: 308914 - DNA, 25 bp, Mus musculus
acaaagcgcacaaggtccaaggtcc

SEQ ID NO: 308915 - DNA, 25 bp, Mus musculus
cacggtgaacaaagcgcacaaggtc

SEQ ID NO: 308916 - DNA, 25 bp, Mus musculus
gcggaaccacggtgaacaaagcgca

SEQ ID NO: 308917 - DNA, 25 bp, Mus musculus
caagcctctgcagtcggagcggaag

SEQ ID NO: 308918 - DNA, 25 bp, Mus musculus
ggccaggtctccaagcctctgcagt

SEQ ID NO: 308919 - DNA, 25 bp, Mus musculus
gcaatcaccctccaacaggccaggt

SEQ ID NO: 308920 - DNA, 25 bp, Mus musculus
gggatagggccgcaatcaccctcca

SEQ ID NO: 308921 - DNA, 25 bp, Mus musculus
ctgctggggatagggccgcaatcac

SEQ ID NO: 308922 - DNA, 25 bp, Mus musculus
cggaaaaggcgagggtcttgctgct

SEQ ID NO: 308923 - DNA, 25 bp, Mus musculus
gcagagcagcaacccgcggaaaagg

SEQ ID NO: 308924 - DNA, 25 bp, Mus musculus
aggtctccaagcctctgcagtcgga

SEQ ID NO: 308925 - DNA, 25 bp, Mus musculus
ggccggtggcgttgcatacccttcc

SEQ ID NO: 308926 - DNA, 25 bp, Mus musculus
catgttcccagagtcggtggatgtg

SEQ ID NO: 308927 - DNA, 25 bp, Mus musculus
tgaccatgttcccagagtcggtgga

SEQ ID NO: 308928 - DNA, 25 bp, Mus musculus
ctcgcttgaccatgttcccagagtc

SEQ ID NO: 308929 - DNA, 25 bp, Mus musculus
tgtctcgcttgaccatgttcccaga

SEQ ID NO: 308930 - DNA, 25 bp, Mus musculus
gtcgtgtctcgcttgaccatgttcc

SEQ ID NO: 308931 - DNA, 25 bp, Mus musculus
actttggtcgtgtctcgcttgacca

SEQ ID NO: 308932 - DNA, 25 bp, Mus musculus
tcacgtgtttcactttggtcgtgtc

SEQ ID NO: 308933 - DNA, 25 bp, Mus musculus
gccctcacgtgtttcactttggtcg

SEQ ID NO: 308934 - DNA, 25 bp, Mus musculus
tgtgccctcacgtgtttcactttgg

SEQ ID NO: 308935 - DNA, 25 bp, Mus musculus
gtccttgtggatgtgtgaggcgccc

SEQ ID NO: 308936 - DNA, 25 bp, Mus musculus
tgtgtgcacgcgctgtttcttgtaa

SEQ ID NO: 308937 - DNA, 25 bp, Mus musculus
ggtttgtctcctaggtgcctgcttc

SEQ ID NO: 308938 - DNA, 25 bp, Mus musculus
tgtgcacgcgctgtttcttgtaagc

SEQ ID NO: 308939 - DNA, 25 bp, Mus musculus
cacgatccttctgaccttttgggtt

SEQ ID NO: 308940 - DNA, 25 bp, Mus musculus
ggggcctcacgatccttctgacctt

SEQ ID NO: 308941 - DNA, 25 bp, Mus musculus
agcaggaggtgtcagaaaagttacc

SEQ ID NO: 308942 - DNA, 25 bp, Mus musculus
tgtcagaaaagttaccacagggata

SEQ ID NO: 308943 - DNA, 25 bp, Mus musculus
ttaccacagggataactggcttgtg

SEQ ID NO: 308944 - DNA, 25 bp, Mus musculus
gataactggcttgtggcggccaagc

SEQ ID NO: 308945 - DNA, 25 bp, Mus musculus
gcggccaagcgttcatagcgacgtc

SEQ ID NO: 308946 - DNA, 25 bp, Mus musculus
tagcgacgtcgctttttgatccttc

SEQ ID NO: 308947 - DNA, 25 bp, Mus musculus
gacgtcgctttttgatccttcgatg

SEQ ID NO: 308948 - DNA, 25 bp, Mus musculus
cgctttttgatccttcgatgtcggc

SEQ ID NO: 308949 - DNA, 25 bp, Mus musculus
gatccttcgatgtcggctcttccta

SEQ ID NO: 308950 - DNA, 25 bp, Mus musculus
tgtcggctcttcctatcattgtgaa

SEQ ID NO: 308951 - DNA, 25 bp, Mus musculus
tcctatcattgtgaagcagaattca

SEQ ID NO: 308952 - DNA, 25 bp, Mus musculus
ttgtgaagcagaattcaccaagcgt

SEQ ID NO: 308953 - DNA, 25 bp, Mus musculus
cgcaaaaggcgccactaaagccgtg

SEQ ID NO: 308954 - DNA, 25 bp, Mus musculus
cagctccagaaactaggggcccagc

SEQ ID NO: 308955 - DNA, 25 bp, Mus musculus
cgccgaaggaaacccaggaacgctg

SEQ ID NO: 308956 - DNA, 25 bp, Mus musculus
ctcaccgcaaaaggcgccactaaag

SEQ ID NO: 308957 - DNA, 25 bp, Mus musculus
cggcgctctaactaggggttcccag

SEQ ID NO: 308958 - DNA, 25 bp, Mus musculus
cagaagcggcgctctaactaggggt

SEQ ID NO: 308959 - DNA, 25 bp, Mus musculus
agcgcccaacacagtgaagccaact

SEQ ID NO: 308960 - DNA, 25 bp, Mus musculus
agcccttcgtgaaaacacacttccg

SEQ ID NO: 308961 - DNA, 25 bp, Mus musculus
ttccgcccaatgaggagacgtcatc

SEQ ID NO: 308962 - DNA, 25 bp, Mus musculus
agacgtcatcactcggcggagttca

SEQ ID NO: 308963 - DNA, 25 bp, Mus musculus
atcactcggcggagttcagcccttc

SEQ ID NO: 308964 - DNA, 25 bp, Mus musculus
cggagttcagcccttcgtgaaaaca

SEQ ID NO: 308965 - DNA, 25 bp, Mus musculus
tggaacaccgacgactgccaccgaa

SEQ ID NO: 308966 - DNA, 25 bp, Mus musculus
acccaggaacgctggaagctgaagg

SEQ ID NO: 308967 - DNA, 25 bp, Mus musculus
gagatcaatcaacgccagacacgga

SEQ ID NO: 308968 - DNA, 25 bp, Mus musculus
ggtcccgtccccgagagcgagatca

SEQ ID NO: 308969 - DNA, 25 bp, Mus musculus
tcccgtccccgagagcgagatcaat

SEQ ID NO: 308970 - DNA, 25 bp, Mus musculus
cgagagcgagatcaatcaacgccag

SEQ ID NO: 308971 - DNA, 25 bp, Mus musculus
cccgagagcgagatcaatcaacgcc

SEQ ID NO: 308972 - DNA, 25 bp, Mus musculus
gatcaatcaacgccagacacggacc

SEQ ID NO: 308973 - DNA, 25 bp, Mus musculus
cgagatcaatcaacgccagacacgg

SEQ ID NO: 308974 - DNA, 25 bp, Mus musculus
gcgagatcaatcaacgccagacacg

SEQ ID NO: 308975 - DNA, 25 bp, Mus musculus
agcgagatcaatcaacgccagacac

SEQ ID NO: 308976 - DNA, 25 bp, Mus musculus
gagcgagatcaatcaacgccagaca

SEQ ID NO: 308977 - DNA, 25 bp, Mus musculus
ccgagagcgagatcaatcaacgcca

SEQ ID NO: 308978 - DNA, 25 bp, Mus musculus
agagcgagatcaatcaacgccagac

SEQ ID NO: 308979 - DNA, 25 bp, Mus musculus
gagagcgagatcaatcaacgccaga

SEQ ID NO: 308980 - DNA, 25 bp, Mus musculus
atcaatcaacgccagacacggaccc

SEQ ID NO: 308981 - DNA, 25 bp, Mus musculus
tgatccttccgcaggttcacctacg

SEQ ID NO: 308982 - DNA, 25 bp, Mus musculus
cgcaggttcacctacggaaaccttg

SEQ ID NO: 308983 - DNA, 25 bp, Mus musculus
ccgttaatgatccttccgcaggttc

SEQ ID NO: 308984 - DNA, 25 bp, Mus musculus
tgttacgacttttacttcctctaga

SEQ ID NO: 308985 - DNA, 25 bp, Mus musculus
tacttcctctagatagtcaagttcg

SEQ ID NO: 308986 - DNA, 25 bp, Mus musculus
ctctagatagtcaagttcgaccgtc

SEQ ID NO: 308987 - DNA, 25 bp, Mus musculus
agtcaagttcgaccgtcttctcagc

SEQ ID NO: 308988 - DNA, 25 bp, Mus musculus
aagttcgaccgtcttctcagcgctc

SEQ ID NO: 308989 - DNA, 25 bp, Mus musculus
gggcctcactaaaccatccaatcgg

SEQ ID NO: 308990 - DNA, 25 bp, Mus musculus
ggcagggacttaatcaacgcaagct

SEQ ID NO: 308991 - DNA, 25 bp, Mus musculus
gggacttaatcaacgcaagcttatg

SEQ ID NO: 308992 - DNA, 25 bp, Mus musculus
ggggaataattgcaatccccgatcc

SEQ ID NO: 308993 - DNA, 25 bp, Mus musculus
ccacagtctcccgttaatgatcctt

SEQ ID NO: 308994 - DNA, 25 bp, Mus musculus
gtctcccgttaatgatccttccgca

SEQ ID NO: 308995 - DNA, 25 bp, Mus musculus
acctcgcgcccacgtcatcgctccg

SEQ ID NO: 308996 - DNA, 25 bp, Mus musculus
tgcccgcgagtgacccgtgtgtgat

SEQ ID NO: 308997 - DNA, 25 bp, Mus musculus
agtgacccgtgtgtgatgctgaggg

SEQ ID NO: 308998 - DNA, 25 bp, Mus musculus
atgctgagggatgcccacgagtgaa

SEQ ID NO: 308999 - DNA, 25 bp, Mus musculus
ctgagggatgcccacgagtgaaccg

SEQ ID NO: 309000 - DNA, 25 bp, Mus musculus
agggatgcccacgagtgaaccgtgt

SEQ ID NO: 309001 - DNA, 25 bp, Mus musculus
cccacgagtgaaccgtgtgtgaggc

SEQ ID NO: 309002 - DNA, 25 bp, Mus musculus
gaggccgcaggcaggtacggagcgg

SEQ ID NO: 309003 - DNA, 25 bp, Mus musculus
cgcgcggtggattctgggagaatcc

SEQ ID NO: 309004 - DNA, 25 bp, Mus musculus
tccgccattttctgcggcgcgcggt

SEQ ID NO: 309005 - DNA, 25 bp, Mus musculus
cgggtccgccattttctgcggcgcg

SEQ ID NO: 309006 - DNA, 25 bp, Mus musculus
tgcgcttgcgtcactcgcagccccg

SEQ ID NO: 309007 - DNA, 25 bp, Mus musculus
caccgctgtttgtccccgcgtccga

SEQ ID NO: 309008 - DNA, 25 bp, Mus musculus
tgcccacgagtgaaccgtgtgtgag

SEQ ID NO: 309009 - DNA, 25 bp, Mus musculus
atcggcccgaggttatctagagtca

SEQ ID NO: 309010 - DNA, 25 bp, Mus musculus
atctagagtcaccaaagccgccggc

SEQ ID NO: 309011 - DNA, 25 bp, Mus musculus
ccgggttggttttgatctgataaat

SEQ ID NO: 309012 - DNA, 25 bp, Mus musculus
ttggttttgatctgataaatgcacg

SEQ ID NO: 309013 - DNA, 25 bp, Mus musculus
cgggttggttttgatctgataaatg

SEQ ID NO: 309014 - DNA, 25 bp, Mus musculus
caccgggttggttttgatctgataa

SEQ ID NO: 309015 - DNA, 25 bp, Mus musculus
tctagagtcaccaaagccgccggcg

SEQ ID NO: 309016 - DNA, 25 bp, Mus musculus
ttatctagagtcaccaaagccgccg

SEQ ID NO: 309017 - DNA, 25 bp, Mus musculus
ggttatctagagtcaccaaagccgc

SEQ ID NO: 309018 - DNA, 25 bp, Mus musculus
cgaggttatctagagtcaccaaagc

SEQ ID NO: 309019 - DNA, 25 bp, Mus musculus
cccgaggttatctagagtcaccaaa

SEQ ID NO: 309020 - DNA, 25 bp, Mus musculus
tcggcccgaggttatctagagtcac

SEQ ID NO: 309021 - DNA, 25 bp, Mus musculus
gatcggcccgaggttatctagagtc

SEQ ID NO: 309022 - DNA, 25 bp, Mus musculus
ggcccgaggttatctagagtcacca

SEQ ID NO: 309023 - DNA, 25 bp, Mus musculus
ctagtacaacttagtcgaggatgga

SEQ ID NO: 309024 - DNA, 25 bp, Mus musculus
agcccaggttcccacgcggtggctt

SEQ ID NO: 309025 - DNA, 25 bp, Mus musculus
gcattcccgggatgccttcgggcca

SEQ ID NO: 309026 - DNA, 25 bp, Mus musculus
gctgagccatcgcattcccgggatg

SEQ ID NO: 309027 - DNA, 25 bp, Mus musculus
agagaatccacgtctccgggttgga

SEQ ID NO: 309028 - DNA, 25 bp, Mus musculus
cttctagtctgagagaatccacgtc

SEQ ID NO: 309029 - DNA, 25 bp, Mus musculus
cagtccatccttctagtctgagaga

SEQ ID NO: 309030 - DNA, 25 bp, Mus musculus
ttagtcgaggatggagtctccagtc

SEQ ID NO: 309031 - DNA, 25 bp, Mus musculus
tgcatgacctcactagtacaactta

SEQ ID NO: 309032 - DNA, 25 bp, Mus musculus
cctgcagatgtgcatgacctcacta

SEQ ID NO: 309033 - DNA, 25 bp, Mus musculus
tcacaggcttcgttgcggatgtggc

SEQ ID NO: 309034 - DNA, 25 bp, Mus musculus
gtggaatgattcacaggcttcgttg

SEQ ID NO: 309035 - DNA, 25 bp, Mus musculus
agccggccttgccagtgcgagagat

SEQ ID NO: 309036 - DNA, 25 bp, Mus musculus
ggagtctccagtccatccttctagt

SEQ ID NO: 309037 - DNA, 25 bp, Mus musculus
gcgtccagtgcggtaacgcgaccga

SEQ ID NO: 309038 - DNA, 25 bp, Mus musculus
gggcgatggcctccgttgccctcgg

SEQ ID NO: 309039 - DNA, 25 bp, Mus musculus
atggcctccgttgccctcggccgat

SEQ ID NO: 309040 - DNA, 25 bp, Mus musculus
cgccgcgaggcgtccagtgcggtaa

SEQ ID NO: 309041 - DNA, 25 bp, Mus musculus
cgtccagtgcggtaacgcgaccgat

SEQ ID NO: 309042 - DNA, 25 bp, Mus musculus
gtccagtgcggtaacgcgaccgatc

SEQ ID NO: 309043 - DNA, 25 bp, Mus musculus
tccagtgcggtaacgcgaccgatcc

SEQ ID NO: 309044 - DNA, 25 bp, Mus musculus
gtgcggtaacgcgaccgatcccgga

SEQ ID NO: 309045 - DNA, 25 bp, Mus musculus
tgcggtaacgcgaccgatcccggag

SEQ ID NO: 309046 - DNA, 25 bp, Mus musculus
gcggtaacgcgaccgatcccggaga

SEQ ID NO: 309047 - DNA, 25 bp, Mus musculus
gtaacgcgaccgatcccggagaagc

SEQ ID NO: 309048 - DNA, 25 bp, Mus musculus
taacgcgaccgatcccggagaagcc

SEQ ID NO: 309049 - DNA, 25 bp, Mus musculus
gagttctcttttctttgtgaagggc

SEQ ID NO: 309050 - DNA, 25 bp, Mus musculus
gagtggcggagatgggcgccgcgag

SEQ ID NO: 309051 - DNA, 25 bp, Mus musculus
tctgagggaagctctagtgtgtccc

SEQ ID NO: 309052 - DNA, 25 bp, Mus musculus
ctggctgaacctgcgcagagcatgg

SEQ ID NO: 309053 - DNA, 25 bp, Mus musculus
ccctggctgaacctgcgcagagcat

SEQ ID NO: 309054 - DNA, 25 bp, Mus musculus
gctgaacctgcgcagagcatgggac

SEQ ID NO: 309055 - DNA, 25 bp, Mus musculus
gtccggtgtgatcgcgttggttccc

SEQ ID NO: 309056 - DNA, 25 bp, Mus musculus
agtctgagggaagctctagtgtgtc

SEQ ID NO: 309057 - DNA, 25 bp, Mus musculus
agggaagctctagtgtgtcccgtgc

SEQ ID NO: 309058 - DNA, 25 bp, Mus musculus
ctcaggtttgactgcgagtctgagg

SEQ ID NO: 309059 - DNA, 25 bp, Mus musculus
ttctcaggtttgactgcgagtctga

SEQ ID NO: 309060 - DNA, 25 bp, Mus musculus
ccattctcaggtttgactgcgagtc

SEQ ID NO: 309061 - DNA, 25 bp, Mus musculus
aagctctagtgtgtcccgtgctttg

SEQ ID NO: 309062 - DNA, 25 bp, Mus musculus
ggaagctctagtgtgtcccgtgctt

SEQ ID NO: 309063 - DNA, 25 bp, Mus musculus
gctgtgaccggctactaggagctgt

SEQ ID NO: 309064 - DNA, 25 bp, Mus musculus
tgtgaccggctactaggagctgtga

SEQ ID NO: 309065 - DNA, 25 bp, Mus musculus
cgaccggaacgtgacgcaaggtgga

SEQ ID NO: 309066 - DNA, 25 bp, Mus musculus
ccaccgaggcagtgctgccaggcgc

SEQ ID NO: 309067 - DNA, 25 bp, Mus musculus
ccaccggcaacctgctgggtgggaa

SEQ ID NO: 309068 - DNA, 25 bp, Mus musculus
tcctcctccgttgaccctgcggtga

SEQ ID NO: 309069 - DNA, 25 bp, Mus musculus
tgcggcctgcgttgtgtctcctcct

SEQ ID NO: 309070 - DNA, 25 bp, Mus musculus
gaatcggacgtctctgttgcggcct

SEQ ID NO: 309071 - DNA, 25 bp, Mus musculus
gagccggaatcggacgtctctgttg

SEQ ID NO: 309072 - DNA, 25 bp, Mus musculus
ctgctggagccggaatcggacgtct

SEQ ID NO: 309073 - DNA, 25 bp, Mus musculus
tttgaccataaagcccaaggcggcg

SEQ ID NO: 309074 - DNA, 25 bp, Mus musculus
gccggagctttgaccataaagccca

SEQ ID NO: 309075 - DNA, 25 bp, Mus musculus
gcaaggccggagctttgaccataaa

SEQ ID NO: 309076 - DNA, 25 bp, Mus musculus
tcgtgacagacacttccgctcgggg

SEQ ID NO: 309077 - DNA, 25 bp, Mus musculus
caaccctggcgtcgggcgtctcgtg

SEQ ID NO: 309078 - DNA, 25 bp, Mus musculus
cgggcgtctcgtgacagacacttcc

SEQ ID NO: 309079 - DNA, 25 bp, Mus musculus
aaaacatgtttttgccatgtgtggc

SEQ ID NO: 309080 - DNA, 25 bp, Mus musculus
tatggaaattttactcaggtgtctg

SEQ ID NO: 309081 - DNA, 25 bp, Mus musculus
gtcgtcgtagcgctctcggccagct

SEQ ID NO: 309082 - DNA, 25 bp, Mus musculus
ccgcgaagcgagtccctgctgctgt

SEQ ID NO: 309083 - DNA, 25 bp, Mus musculus
cgaagcgagtccctgctgctgtctt

SEQ ID NO: 309084 - DNA, 25 bp, Mus musculus
gctgctgtctttcaattaaatgttt

SEQ ID NO: 309085 - DNA, 25 bp, Mus musculus
aaacaatcccttatttgcctttatg

SEQ ID NO: 309086 - DNA, 25 bp, Mus musculus
atttgcctttatggaaaaacatgtt

SEQ ID NO: 309087 - DNA, 25 bp, Mus musculus
ttttgccatgtgtggcttatccttg

SEQ ID NO: 309088 - DNA, 25 bp, Mus musculus
tgtggcttatccttgtgattgtata

SEQ ID NO: 309089 - DNA, 25 bp, Mus musculus
ccttgtgattgtatagagcttgaac

SEQ ID NO: 309090 - DNA, 25 bp, Mus musculus
ttactcaggtgtctgttcttaaccc

SEQ ID NO: 309091 - DNA, 25 bp, Mus musculus
catgtgtggcttatccttgtgattg

SEQ ID NO: 309092 - DNA, 25 bp, Mus musculus
gagcttgaacttatggaaattttac

SEQ ID NO: 309093 - DNA, 25 bp, Mus musculus
gctgtcgtccgacctggcaccagag

SEQ ID NO: 309094 - DNA, 25 bp, Mus musculus
cgttctcccgctgtctaaggaccta

SEQ ID NO: 309095 - DNA, 25 bp, Mus musculus
cccgctgtcgtccgacctggcacca

SEQ ID NO: 309096 - DNA, 25 bp, Mus musculus
cgctgtcgtccgacctggcaccaga

SEQ ID NO: 309097 - DNA, 25 bp, Mus musculus
ctgtcgtccgacctggcaccagagc

SEQ ID NO: 309098 - DNA, 25 bp, Mus musculus
tgtcgtccgacctggcaccagagcc

SEQ ID NO: 309099 - DNA, 25 bp, Mus musculus
gtcgtccgacctggcaccagagccg

SEQ ID NO: 309100 - DNA, 25 bp, Mus musculus
tcgtccgacctggcaccagagccgg

SEQ ID NO: 309101 - DNA, 25 bp, Mus musculus
cgtccgacctggcaccagagccgga

SEQ ID NO: 309102 - DNA, 25 bp, Mus musculus
gtccgacctggcaccagagccggag

SEQ ID NO: 309103 - DNA, 25 bp, Mus musculus
cctggcaccagagccggagctccag

SEQ ID NO: 309104 - DNA, 25 bp, Mus musculus
ccgctgtcgtccgacctggcaccag

SEQ ID NO: 309105 - DNA, 25 bp, Mus musculus
tgctcaaattctttccactcatttt

SEQ ID NO: 309106 - DNA, 25 bp, Mus musculus
taactgttactggagcaggaggcgc

SEQ ID NO: 309107 - DNA, 25 bp, Mus musculus
tctgtaactgttactggagcaggag

SEQ ID NO: 309108 - DNA, 25 bp, Mus musculus
ttccactcattttcatccttcgtta

SEQ ID NO: 309109 - DNA, 25 bp, Mus musculus
tttccactcattttcatccttcgtt

SEQ ID NO: 309110 - DNA, 25 bp, Mus musculus
ctttccactcattttcatccttcgt

SEQ ID NO: 309111 - DNA, 25 bp, Mus musculus
tctttccactcattttcatccttcg

SEQ ID NO: 309112 - DNA, 25 bp, Mus musculus
ttctttccactcattttcatccttc

SEQ ID NO: 309113 - DNA, 25 bp, Mus musculus
ctcaaattctttccactcattttca

SEQ ID NO: 309114 - DNA, 25 bp, Mus musculus
gctcaaattctttccactcattttc

SEQ ID NO: 309115 - DNA, 25 bp, Mus musculus
aactgttactggagcaggaggcgct

SEQ ID NO: 309116 - DNA, 25 bp, Mus musculus
tgtaactgttactggagcaggaggc

SEQ ID NO: 309117 - DNA, 25 bp, Mus musculus
ctgtaactgttactggagcaggagg

SEQ ID NO: 309118 - DNA, 25 bp, Mus musculus
caaattctttccactcattttcatc

SEQ ID NO: 309119 - DNA, 25 bp, Mus musculus
gctcactcggttgtttacttctgtc

SEQ ID NO: 309120 - DNA, 25 bp, Mus musculus
cggttgtttacttctgtcaaaatgc

SEQ ID NO: 309121 - DNA, 25 bp, Mus musculus
gtttacttctgtcaaaatgctcttc

SEQ ID NO: 309122 - DNA, 25 bp, Mus musculus
tcactcggttgtttacttctgtcaa

SEQ ID NO: 309123 - DNA, 25 bp, Mus musculus
tacttctgtcaaaatgctcttcccg

SEQ ID NO: 309124 - DNA, 25 bp, Mus musculus
acttctgtcaaaatgctcttcccgc

SEQ ID NO: 309125 - DNA, 25 bp, Mus musculus
cttctgtcaaaatgctcttcccgcg

SEQ ID NO: 309126 - DNA, 25 bp, Mus musculus
tctgtcaaaatgctcttcccgcgcg

SEQ ID NO: 309127 - DNA, 25 bp, Mus musculus
ctcggttgtttacttctgtcaaaat

SEQ ID NO: 309128 - DNA, 25 bp, Mus musculus
tgctcactcggttgtttacttctgt

SEQ ID NO: 309129 - DNA, 25 bp, Mus musculus
ctcactcggttgtttacttctgtca

SEQ ID NO: 309130 - DNA, 25 bp, Mus musculus
cgtcgcgcctgctcactcggttgtt

SEQ ID NO: 309131 - DNA, 25 bp, Mus musculus
cactcggttgtttacttctgtcaaa

SEQ ID NO: 309132 - DNA, 25 bp, Mus musculus
gttgtttacttctgtcaaaatgctc

SEQ ID NO: 309133 - DNA, 25 bp, Mus musculus
gacagagtggaaccggcccagactc

SEQ ID NO: 309134 - DNA, 25 bp, Mus musculus
tgacaggccacgtcctttttaagcg

SEQ ID NO: 309135 - DNA, 25 bp, Mus musculus
cgcgaccatagtccgtgcgtccgga

SEQ ID NO: 309136 - DNA, 25 bp, Mus musculus
tccgagtcggactcccaagtgattc

SEQ ID NO: 309137 - DNA, 25 bp, Mus musculus
cccaagtgattctcagcaaaacaag

SEQ ID NO: 309138 - DNA, 25 bp, Mus musculus
gaaaatccttttctcagatcaggtc

SEQ ID NO: 309139 - DNA, 25 bp, Mus musculus
aggggcctttcctacgcgacagagt

SEQ ID NO: 309140 - DNA, 25 bp, Mus musculus
gctcgtctcactccaggctttggcg

SEQ ID NO: 309141 - DNA, 25 bp, Mus musculus
atccgcatcgcttccatcgtggttc

SEQ ID NO: 309142 - DNA, 25 bp, Mus musculus
ggcgcggagccatgtacatcaagca

SEQ ID NO: 309143 - DNA, 25 bp, Mus musculus
tacatcaagcaggtaagggccgtga

SEQ ID NO: 309144 - DNA, 25 bp, Mus musculus
gccgcgtcgttctgcaggcaggcat

SEQ ID NO: 309145 - DNA, 25 bp, Mus musculus
cagatcaggtccgtctaagagggcc

SEQ ID NO: 309146 - DNA, 25 bp, Mus musculus
gaggtagttcctgccggcctctgga

SEQ ID NO: 309147 - DNA, 25 bp, Mus musculus
aaactgcgacagagcgccagctatc

SEQ ID NO: 309148 - DNA, 25 bp, Mus musculus
atgcccggctccaaacgagcgagtc

SEQ ID NO: 309149 - DNA, 25 bp, Mus musculus
acgtcagaatcgctacggtcctcca

SEQ ID NO: 309150 - DNA, 25 bp, Mus musculus
tctggcttcaacctcctcaggcata

SEQ ID NO: 309151 - DNA, 25 bp, Mus musculus
ccctatacccaaatttgacgatcga

SEQ ID NO: 309152 - DNA, 25 bp, Mus musculus
tcgacctcgccgacagggcggagaa

SEQ ID NO: 309153 - DNA, 25 bp, Mus musculus
gagcgagtcgggcttcttaccaatt

SEQ ID NO: 309154 - DNA, 25 bp, Mus musculus
ctagcgcaccaactcgatgctcgta

SEQ ID NO: 309155 - DNA, 25 bp, Mus musculus
gccttcgcctatcccttagggtcga

SEQ ID NO: 309156 - DNA, 25 bp, Mus musculus
tccgcgtcgaggttcgggaatatta

SEQ ID NO: 309157 - DNA, 25 bp, Mus musculus
gagcgccaatctccgcgtcgaggtt

SEQ ID NO: 309158 - DNA, 25 bp, Mus musculus
tttccgagttcgtttgcgttgccgc

SEQ ID NO: 309159 - DNA, 25 bp, Mus musculus
gacgatcgatttgcacgtcagaatc

SEQ ID NO: 309160 - DNA, 25 bp, Mus musculus
gcatcgccagtcctgcttaccaaga

SEQ ID NO: 309161 - DNA, 25 bp, Mus musculus
ttccaaaccggatatcggagttaga

SEQ ID NO: 309162 - DNA, 25 bp, Mus musculus
tcgagacgcgcacgttccaaaccgg

SEQ ID NO: 309163 - DNA, 25 bp, Mus musculus
ccggatatcggagttagagcgacta

SEQ ID NO: 309164 - DNA, 25 bp, Mus musculus
tacgtcactcgagacgcgcacgttc

SEQ ID NO: 309165 - DNA, 25 bp, Mus musculus
acaggaagtgcgtcatattacgtca

SEQ ID NO: 309166 - DNA, 25 bp, Mus musculus
tcaagatggtcgcaaacaggaagtg

SEQ ID NO: 309167 - DNA, 25 bp, Mus musculus
cgctttatcaagatggtcgcaaaca

SEQ ID NO: 309168 - DNA, 25 bp, Mus musculus
cggagttagagcgactaagctcttc

SEQ ID NO: 309169 - DNA, 25 bp, Mus musculus
ttagagcgactaagctcttccttta

SEQ ID NO: 309170 - DNA, 25 bp, Mus musculus
tacaggagcgcacgaccgggtacgt

SEQ ID NO: 309171 - DNA, 25 bp, Mus musculus
tgcgctttgcgacctggtgctagac

SEQ ID NO: 309172 - DNA, 25 bp, Mus musculus
ctttgcgacctggtgctagacggac

SEQ ID NO: 309173 - DNA, 25 bp, Mus musculus
tggtgctagacggaccgggcatccc

SEQ ID NO: 309174 - DNA, 25 bp, Mus musculus
gtgcgtcatattacgtcactcgaga

SEQ ID NO: 309175 - DNA, 25 bp, Mus musculus
gagacctcggttccttagctgcgga

SEQ ID NO: 309176 - DNA, 25 bp, Mus musculus
catcgccttaaagcgtgcggtgtta

SEQ ID NO: 309177 - DNA, 25 bp, Mus musculus
ctctgtcccgaagatagcgtttact

SEQ ID NO: 309178 - DNA, 25 bp, Mus musculus
gattgcgacatttccggcctcggca

SEQ ID NO: 309179 - DNA, 25 bp, Mus musculus
cccttgcgttaaggcgaatgctcta

SEQ ID NO: 309180 - DNA, 25 bp, Mus musculus
ccgagcctccaggtaccgatagcga

SEQ ID NO: 309181 - DNA, 25 bp, Mus musculus
atatgtcgcttttccctaacaaggg

SEQ ID NO: 309182 - DNA, 25 bp, Mus musculus
gggaagccaccagcccttgcgttaa

SEQ ID NO: 309183 - DNA, 25 bp, Mus musculus
cgggcgacgtcgcaaagtgtatctg

SEQ ID NO: 309184 - DNA, 25 bp, Mus musculus
tgcggacgcttcagtgccgtaaagc

SEQ ID NO: 309185 - DNA, 25 bp, Mus musculus
agcagccgggccaagagtttaacca

SEQ ID NO: 309186 - DNA, 25 bp, Mus musculus
agccgagaacccttgcgcgatggac

SEQ ID NO: 309187 - DNA, 25 bp, Mus musculus
cgtccgcatcgaccgcaaggtgcaa

SEQ ID NO: 309188 - DNA, 25 bp, Mus musculus
agaaggtctgcatctccaaccgagc

SEQ ID NO: 309189 - DNA, 25 bp, Mus musculus
tttgggtcattgtcccttcagggtg

SEQ ID NO: 309190 - DNA, 25 bp, Mus musculus
tttgtattaaagtcacaagtttagc

SEQ ID NO: 309191 - DNA, 25 bp, Mus musculus
cttaggtccttttcagcagatgtcc

SEQ ID NO: 309192 - DNA, 25 bp, Mus musculus
cgccttctcccgacctagcatcaga

SEQ ID NO: 309193 - DNA, 25 bp, Mus musculus
ttagccagagcatcttaggtccttt

SEQ ID NO: 309194 - DNA, 25 bp, Mus musculus
gccagagcatcttaggtccttttca

SEQ ID NO: 309195 - DNA, 25 bp, Mus musculus
agagcatcttaggtccttttcagca

SEQ ID NO: 309196 - DNA, 25 bp, Mus musculus
cacagccctctttgtattaaagtca

SEQ ID NO: 309197 - DNA, 25 bp, Mus musculus
gtccacagccctctttgtattaaag

SEQ ID NO: 309198 - DNA, 25 bp, Mus musculus
gcagatgtccacagccctctttgta

SEQ ID NO: 309199 - DNA, 25 bp, Mus musculus
gccctctttgtattaaagtcacaag

SEQ ID NO: 309200 - DNA, 25 bp, Mus musculus
ttttcagcagatgtccacagccctc

SEQ ID NO: 309201 - DNA, 25 bp, Mus musculus
gtccttttcagcagatgtccacagc

SEQ ID NO: 309202 - DNA, 25 bp, Mus musculus
aggtccttttcagcagatgtccaca

SEQ ID NO: 309203 - DNA, 25 bp, Mus musculus
gcagcgaccctgtccgctgtccttg

SEQ ID NO: 309204 - DNA, 25 bp, Mus musculus
gggcctcgcacaggatctacgtcca

SEQ ID NO: 309205 - DNA, 25 bp, Mus musculus
ccagagcggcgcctaccttggagct

SEQ ID NO: 309206 - DNA, 25 bp, Mus musculus
ggcgcctaccttggagctccagcag

SEQ ID NO: 309207 - DNA, 25 bp, Mus musculus
cagcagcgaccaggacccgacaccc

SEQ ID NO: 309208 - DNA, 25 bp, Mus musculus
tcacgccgatacactaaccgggtct

SEQ ID NO: 309209 - DNA, 25 bp, Mus musculus
gccgatccagtaagcccggccgctg

SEQ ID NO: 309210 - DNA, 25 bp, Mus musculus
caggatctacgtccagaaggggata

SEQ ID NO: 309211 - DNA, 25 bp, Mus musculus
ctaaccgggtctccgcgctcggagt

SEQ ID NO: 309212 - DNA, 25 bp, Mus musculus
aacgaggatgctgcgccggtctcct

SEQ ID NO: 309213 - DNA, 25 bp, Mus musculus
gcgactctgcgtcctttgttgcccg

SEQ ID NO: 309214 - DNA, 25 bp, Mus musculus
tttctttccaggatagggtgccgcc

SEQ ID NO: 309215 - DNA, 25 bp, Mus musculus
cgacaatggcttggtgatagcaccc

SEQ ID NO: 309216 - DNA, 25 bp, Mus musculus
acgcgacgacaatggcttggtgata

SEQ ID NO: 309217 - DNA, 25 bp, Mus musculus
taacttttctgacacctcctgctta

SEQ ID NO: 309218 - DNA, 25 bp, Mus musculus
tatccctgtggtaacttttctgaca

SEQ ID NO: 309219 - DNA, 25 bp, Mus musculus
aacccaaaaggtcagaaggatcgtg

SEQ ID NO: 309220 - DNA, 25 bp, Mus musculus
gtggtaacttttctgacacctcctg

SEQ ID NO: 309221 - DNA, 25 bp, Mus musculus
cacaagccagttatccctgtggtaa

SEQ ID NO: 309222 - DNA, 25 bp, Mus musculus
gcttggccgccacaagccagttatc

SEQ ID NO: 309223 - DNA, 25 bp, Mus musculus
cgctatgaacgcttggccgccacaa

SEQ ID NO: 309224 - DNA, 25 bp, Mus musculus
gcgacgtcgctatgaacgcttggcc

SEQ ID NO: 309225 - DNA, 25 bp, Mus musculus
acgcttggtgaattctgcttcacaa

SEQ ID NO: 309226 - DNA, 25 bp, Mus musculus
tgaattctgcttcacaatgatagga

SEQ ID NO: 309227 - DNA, 25 bp, Mus musculus
cacaatgataggaagagccgacatc

SEQ ID NO: 309228 - DNA, 25 bp, Mus musculus
taggaagagccgacatcgaaggatc

SEQ ID NO: 309229 - DNA, 25 bp, Mus musculus
tcgaaggatcaaaaagcgacgtcgc

SEQ ID NO: 309230 - DNA, 25 bp, Mus musculus
aaaggtcagaaggatcgtgaggccc

SEQ ID NO: 309231 - DNA, 25 bp, Mus musculus
acggtttgaatgaagcggaggcgcc

SEQ ID NO: 309232 - DNA, 25 bp, Mus musculus
acggcttctttgtttcctgaggaga

SEQ ID NO: 309233 - DNA, 25 bp, Mus musculus
cggcttctttgtttcctgaggagaa

SEQ ID NO: 309234 - DNA, 25 bp, Mus musculus
tcctgaggagaagcgagacgcccac

SEQ ID NO: 309235 - DNA, 25 bp, Mus musculus
tgaggagaagcgagacgcccactct

SEQ ID NO: 309236 - DNA, 25 bp, Mus musculus
ggagaagcgagacgcccactctgtc

SEQ ID NO: 309237 - DNA, 25 bp, Mus musculus
cgccgttacctccaggtaaggaatg

SEQ ID NO: 309238 - DNA, 25 bp, Mus musculus
ttacctccaggtaaggaatggaggc

SEQ ID NO: 309239 - DNA, 25 bp, Mus musculus
tccaggtaaggaatggaggctcccg

SEQ ID NO: 309240 - DNA, 25 bp, Mus musculus
agctgggcgaccaaagcggggtcgc

SEQ ID NO: 309241 - DNA, 25 bp, Mus musculus
ttgggcaagacggtttgaatgaagc

SEQ ID NO: 309242 - DNA, 25 bp, Mus musculus
agacggcttctttgtttcctgagga

SEQ ID NO: 309243 - DNA, 25 bp, Mus musculus
gcggagacggcttctttgtttcctg

SEQ ID NO: 309244 - DNA, 25 bp, Mus musculus
gcttgggcaagacggtttgaatgaa

SEQ ID NO: 309245 - DNA, 25 bp, Mus musculus
gtcgggagacgcgtgaccgacggtc

SEQ ID NO: 309246 - DNA, 25 bp, Mus musculus
tgggtagccgacatcgccgccgacc

SEQ ID NO: 309247 - DNA, 25 bp, Mus musculus
gggtagccgacatcgccgccgaccc

SEQ ID NO: 309248 - DNA, 25 bp, Mus musculus
ggtagccgacatcgccgccgacccc

SEQ ID NO: 309249 - DNA, 25 bp, Mus musculus
ccgtgcgctcggcttcgtcgggaga

SEQ ID NO: 309250 - DNA, 25 bp, Mus musculus
cgtgcgctcggcttcgtcgggagac

SEQ ID NO: 309251 - DNA, 25 bp, Mus musculus
gtgcgctcggcttcgtcgggagacg

SEQ ID NO: 309252 - DNA, 25 bp, Mus musculus
tgcgctcggcttcgtcgggagacgc

SEQ ID NO: 309253 - DNA, 25 bp, Mus musculus
tcgggagacgcgtgaccgacggtcc

SEQ ID NO: 309254 - DNA, 25 bp, Mus musculus
ttcgtcgggagacgcgtgaccgacg

SEQ ID NO: 309255 - DNA, 25 bp, Mus musculus
gtgggtagccgacatcgccgccgac

SEQ ID NO: 309256 - DNA, 25 bp, Mus musculus
gcgctcggcttcgtcgggagacgcg

SEQ ID NO: 309257 - DNA, 25 bp, Mus musculus
cgctcggcttcgtcgggagacgcgt

SEQ ID NO: 309258 - DNA, 25 bp, Mus musculus
cttcgtcgggagacgcgtgaccgac

SEQ ID NO: 309259 - DNA, 25 bp, Mus musculus
tggggccgagtactccatggcgact

SEQ ID NO: 309260 - DNA, 25 bp, Mus musculus
aggcgcagtggtacagcctcccggt

SEQ ID NO: 309261 - DNA, 25 bp, Mus musculus
atacaggtgaccttccggagacgcc

SEQ ID NO: 309262 - DNA, 25 bp, Mus musculus
tgcgaacaaaggctctacgggcgcg

SEQ ID NO: 309263 - DNA, 25 bp, Mus musculus
taccggcagagtggcttgaaagcga

SEQ ID NO: 309264 - DNA, 25 bp, Mus musculus
gagccaccggcgctatacaggtgac

SEQ ID NO: 309265 - DNA, 25 bp, Mus musculus
ggcgactgcgaacaaaggctctacg

SEQ ID NO: 309266 - DNA, 25 bp, Mus musculus
ctccgctctagggagacccaccctc

SEQ ID NO: 309267 - DNA, 25 bp, Mus musculus
ccgagtactccatggcgactgcgaa

SEQ ID NO: 309268 - DNA, 25 bp, Mus musculus
aaagcagccgctctgtaccggcaga

SEQ ID NO: 309269 - DNA, 25 bp, Mus musculus
accggcgctatacaggtgaccttcc

SEQ ID NO: 309270 - DNA, 25 bp, Mus musculus
agcagccgccgcagatcacttccgg

SEQ ID NO: 309271 - DNA, 25 bp, Mus musculus
gtggtacagcctcccggtggaccca

SEQ ID NO: 309272 - DNA, 25 bp, Mus musculus
ctccatggcgactgcgaacaaaggc

SEQ ID NO: 309273 - DNA, 25 bp, Mus musculus
agacttccaggcctccgaggaggta

SEQ ID NO: 309274 - DNA, 25 bp, Mus musculus
gacgcgttaaagatggaagacttcc

SEQ ID NO: 309275 - DNA, 25 bp, Mus musculus
agtccactctactcggcgggcgaag

SEQ ID NO: 309276 - DNA, 25 bp, Mus musculus
tggtcggtctattttcccaacacac

SEQ ID NO: 309277 - DNA, 25 bp, Mus musculus
tgtttgaacgttggcggttccctgc

SEQ ID NO: 309278 - DNA, 25 bp, Mus musculus
gtcgggaggatgacgtcactccacc

SEQ ID NO: 309279 - DNA, 25 bp, Mus musculus
gaggcatcctgctgtggcatgtata

SEQ ID NO: 309280 - DNA, 25 bp, Mus musculus
gcatgtatagtgacacaggcgcgca

SEQ ID NO: 309281 - DNA, 25 bp, Mus musculus
ggtctgctgcccagtctgtctgtct

SEQ ID NO: 309282 - DNA, 25 bp, Mus musculus
tgtctgccaaggaccgacgtgcgaa

SEQ ID NO: 309283 - DNA, 25 bp, Mus musculus
gacgtgcgaacagaacctgcctttg

SEQ ID NO: 309284 - DNA, 25 bp, Mus musculus
aacctgcctttgtctcggtgccgca

SEQ ID NO: 309285 - DNA, 25 bp, Mus musculus
ggtgccgcaccttgtccttcagtgc

SEQ ID NO: 309286 - DNA, 25 bp, Mus musculus
ggctgatgagcctacacacaatttg

SEQ ID NO: 309287 - DNA, 25 bp, Mus musculus
tcgcctcactctccgctcaactacc

SEQ ID NO: 309288 - DNA, 25 bp, Mus musculus
ttcgcctcactctccgctcaactac

SEQ ID NO: 309289 - DNA, 25 bp, Mus musculus
gttcgcctcactctccgctcaacta

SEQ ID NO: 309290 - DNA, 25 bp, Mus musculus
agttcgcctcactctccgctcaact

SEQ ID NO: 309291 - DNA, 25 bp, Mus musculus
aagttcgcctcactctccgctcaac

SEQ ID NO: 309292 - DNA, 25 bp, Mus musculus
caagttcgcctcactctccgctcaa

SEQ ID NO: 309293 - DNA, 25 bp, Mus musculus
cggcgacttcgggtgacaaacgcaa

SEQ ID NO: 309294 - DNA, 25 bp, Mus musculus
gaggataagggaactcggcgacttc

SEQ ID NO: 309295 - DNA, 25 bp, Mus musculus
aggataagggaactcggcgacttcg

SEQ ID NO: 309296 - DNA, 25 bp, Mus musculus
ggcgacttcgggtgacaaacgcaat

SEQ ID NO: 309297 - DNA, 25 bp, Mus musculus
ctcggcgacttcgggtgacaaacgc

SEQ ID NO: 309298 - DNA, 25 bp, Mus musculus
actcggcgacttcgggtgacaaacg

SEQ ID NO: 309299 - DNA, 25 bp, Mus musculus
gaactcggcgacttcgggtgacaaa

SEQ ID NO: 309300 - DNA, 25 bp, Mus musculus
ggaactcggcgacttcgggtgacaa

SEQ ID NO: 309301 - DNA, 25 bp, Mus musculus
tgaaggatgcccgtgtccaagcatc

SEQ ID NO: 309302 - DNA, 25 bp, Mus musculus
aggtcgccacatctcgctgccggtg

SEQ ID NO: 309303 - DNA, 25 bp, Mus musculus
aattacgaaggtcgccacatctcgc

SEQ ID NO: 309304 - DNA, 25 bp, Mus musculus
acgcaattacgaaggtcgccacatc

SEQ ID NO: 309305 - DNA, 25 bp, Mus musculus
acaaacgcaattacgaaggtcgcca

SEQ ID NO: 309306 - DNA, 25 bp, Mus musculus
ggtgacaaacgcaattacgaaggtc

SEQ ID NO: 309307 - DNA, 25 bp, Mus musculus
agcttcctatgctgtgcgccggcgc

SEQ ID NO: 309308 - DNA, 25 bp, Mus musculus
aagcatcatctctagcttcctatgc

SEQ ID NO: 309309 - DNA, 25 bp, Mus musculus
gtgtccaagcatcatctctagcttc

SEQ ID NO: 309310 - DNA, 25 bp, Mus musculus
aggatgcccgtgtccaagcatcatc

SEQ ID NO: 309311 - DNA, 25 bp, Mus musculus
catgcgtgcccgctgaaggatgccc

SEQ ID NO: 309312 - DNA, 25 bp, Mus musculus
cccgctgaaggatgcccgtgtccaa

SEQ ID NO: 309313 - DNA, 25 bp, Mus musculus
tacgaaggtcgccacatctcgctgc

SEQ ID NO: 309314 - DNA, 25 bp, Mus musculus
gcccgtgtccaagcatcatctctag

SEQ ID NO: 309315 - DNA, 25 bp, Mus musculus
catggagtttggacatcccggcacc

SEQ ID NO: 309316 - DNA, 25 bp, Mus musculus
aggcctcggagaaagcgccgacaag

SEQ ID NO: 309317 - DNA, 25 bp, Mus musculus
cggcctcgcgagtgaagagttctag

SEQ ID NO: 309318 - DNA, 25 bp, Mus musculus
acatcatgatggagcgggagcgcaa

SEQ ID NO: 309319 - DNA, 25 bp, Mus musculus
agtcagtgagagtcgggtgcccact

SEQ ID NO: 309320 - DNA, 25 bp, Mus musculus
ggtggccctgctacccacgaacttg

SEQ ID NO: 309321 - DNA, 25 bp, Mus musculus
ggcgcgtcgcagtctctctaagctc

SEQ ID NO: 309322 - DNA, 25 bp, Mus musculus
ttccaacgctatggccagggctctg

SEQ ID NO: 309323 - DNA, 25 bp, Mus musculus
ccgccggatatgacgtagaggccaa

SEQ ID NO: 309324 - DNA, 25 bp, Mus musculus
aaggatttatcctggccgccggata

SEQ ID NO: 309325 - DNA, 25 bp, Mus musculus
ctttcctccaatcggctgtgccgtt

SEQ ID NO: 309326 - DNA, 25 bp, Mus musculus
aggccgctctgtaaatccacatgga

SEQ ID NO: 309327 - DNA, 25 bp, Mus musculus
taggggctttatcatcccaggccgc

SEQ ID NO: 309328 - DNA, 25 bp, Mus musculus
gccgtcgtgactccggaaggattta

SEQ ID NO: 309329 - DNA, 25 bp, Mus musculus
gttgagtcaaattaagccgcaggct

SEQ ID NO: 309330 - DNA, 25 bp, Mus musculus
aggctccactcctggtggtgccctt

SEQ ID NO: 309331 - DNA, 25 bp, Mus musculus
aattaagccgcaggctccactcctg

SEQ ID NO: 309332 - DNA, 25 bp, Mus musculus
gagtcaaattaagccgcaggctcca

SEQ ID NO: 309333 - DNA, 25 bp, Mus musculus
tgagtcaaattaagccgcaggctcc

SEQ ID NO: 309334 - DNA, 25 bp, Mus musculus
ttgagtcaaattaagccgcaggctc

SEQ ID NO: 309335 - DNA, 25 bp, Mus musculus
gtgttgagtcaaattaagccgcagg

SEQ ID NO: 309336 - DNA, 25 bp, Mus musculus
cgtgttgagtcaaattaagccgcag

SEQ ID NO: 309337 - DNA, 25 bp, Mus musculus
ccgtgttgagtcaaattaagccgca

SEQ ID NO: 309338 - DNA, 25 bp, Mus musculus
cccgtgttgagtcaaattaagccgc

SEQ ID NO: 309339 - DNA, 25 bp, Mus musculus
tcccgtgttgagtcaaattaagccg

SEQ ID NO: 309340 - DNA, 25 bp, Mus musculus
tgttgagtcaaattaagccgcaggc

SEQ ID NO: 309341 - DNA, 25 bp, Mus musculus
ttcccgtgttgagtcaaattaagcc

SEQ ID NO: 309342 - DNA, 25 bp, Mus musculus
tttcccgtgttgagtcaaattaagc

SEQ ID NO: 309343 - DNA, 25 bp, Mus musculus
tccacgactacaaggctacagccac

SEQ ID NO: 309344 - DNA, 25 bp, Mus musculus
ctccacgactacaaggctacagcca

SEQ ID NO: 309345 - DNA, 25 bp, Mus musculus
cccccagactggagcggcggtgact

SEQ ID NO: 309346 - DNA, 25 bp, Mus musculus
tcctccacgactacaaggctacagc

SEQ ID NO: 309347 - DNA, 25 bp, Mus musculus
acactcctccacgactacaaggcta

SEQ ID NO: 309348 - DNA, 25 bp, Mus musculus
ccccagactggagcggcggtgacta

SEQ ID NO: 309349 - DNA, 25 bp, Mus musculus
ttccacactcctccacgactacaag

SEQ ID NO: 309350 - DNA, 25 bp, Mus musculus
cctccacgactacaaggctacagcc

SEQ ID NO: 309351 - DNA, 25 bp, Mus musculus
ccacgactacaaggctacagccacc

SEQ ID NO: 309352 - DNA, 25 bp, Mus musculus
tccacactcctccacgactacaagg

SEQ ID NO: 309353 - DNA, 25 bp, Mus musculus
cgactacaaggctacagccacctcc

SEQ ID NO: 309354 - DNA, 25 bp, Mus musculus
acaggacgaatgcgcgcgaagcccc

SEQ ID NO: 309355 - DNA, 25 bp, Mus musculus
actcctccacgactacaaggctaca

SEQ ID NO: 309356 - DNA, 25 bp, Mus musculus
acgactacaaggctacagccacctc

SEQ ID NO: 309357 - DNA, 25 bp, Mus musculus
cgttcaattttaaatgtgactgtcc

SEQ ID NO: 309358 - DNA, 25 bp, Mus musculus
gtgactgtccaagtagagtcagttt

SEQ ID NO: 309359 - DNA, 25 bp, Mus musculus
tgtgactgtccaagtagagtcagtt

SEQ ID NO: 309360 - DNA, 25 bp, Mus musculus
aatgtgactgtccaagtagagtcag

SEQ ID NO: 309361 - DNA, 25 bp, Mus musculus
aaatgtgactgtccaagtagagtca

SEQ ID NO: 309362 - DNA, 25 bp, Mus musculus
taaatgtgactgtccaagtagagtc

SEQ ID NO: 309363 - DNA, 25 bp, Mus musculus
tttaaatgtgactgtccaagtagag

SEQ ID NO: 309364 - DNA, 25 bp, Mus musculus
ttttaaatgtgactgtccaagtaga

SEQ ID NO: 309365 - DNA, 25 bp, Mus musculus
caattttaaatgtgactgtccaagt

SEQ ID NO: 309366 - DNA, 25 bp, Mus musculus
tgactgtccaagtagagtcagtttg

SEQ ID NO: 309367 - DNA, 25 bp, Mus musculus
gttcaattttaaatgtgactgtcca

SEQ ID NO: 309368 - DNA, 25 bp, Mus musculus
gcacgttcaattttaaatgtgactg

SEQ ID NO: 309369 - DNA, 25 bp, Mus musculus
gtgcacgttcaattttaaatgtgac

SEQ ID NO: 309370 - DNA, 25 bp, Mus musculus
tcaattttaaatgtgactgtccaag

SEQ ID NO: 309371 - DNA, 25 bp, Mus musculus
ctctccgatggacggccgggacaag

SEQ ID NO: 309372 - DNA, 25 bp, Mus musculus
tctccgatggacggccgggacaaga

SEQ ID NO: 309373 - DNA, 25 bp, Mus musculus
ctccgatggacggccgggacaagaa

SEQ ID NO: 309374 - DNA, 25 bp, Mus musculus
atggacggccgggacaagaagcttc

SEQ ID NO: 309375 - DNA, 25 bp, Mus musculus
tggacggccgggacaagaagcttca

SEQ ID NO: 309376 - DNA, 25 bp, Mus musculus
ggacggccgggacaagaagcttcat

SEQ ID NO: 309377 - DNA, 25 bp, Mus musculus
aagcgtccagctttgctcgcctcta

SEQ ID NO: 309378 - DNA, 25 bp, Mus musculus
gacccgtaaataacactcgcacctg

SEQ ID NO: 309379 - DNA, 25 bp, Mus musculus
aggctcgacccgtaaataacactcg

SEQ ID NO: 309380 - DNA, 25 bp, Mus musculus
tttcaggctcgacccgtaaataaca

SEQ ID NO: 309381 - DNA, 25 bp, Mus musculus
ccggctatttcaggctcgacccgta

SEQ ID NO: 309382 - DNA, 25 bp, Mus musculus
ataacactcgcacctgtcgcaagcg

SEQ ID NO: 309383 - DNA, 25 bp, Mus musculus
gcctctacccagtcagctctccgga

SEQ ID NO: 309384 - DNA, 25 bp, Mus musculus
gggcacgggtcccttgagctctcct

SEQ ID NO: 309385 - DNA, 25 bp, Mus musculus
atcgctccaaactcagctcagggtc

SEQ ID NO: 309386 - DNA, 25 bp, Mus musculus
aggatcgctccaaactcagctcagg

SEQ ID NO: 309387 - DNA, 25 bp, Mus musculus
ggccaggatcgctccaaactcagct

SEQ ID NO: 309388 - DNA, 25 bp, Mus musculus
ggctcccaagtcctgctcggccagg

SEQ ID NO: 309389 - DNA, 25 bp, Mus musculus
gatgcctccgaagcgtccagctttg

SEQ ID NO: 309390 - DNA, 25 bp, Mus musculus
tcagctctccggacctgctgcgctc

SEQ ID NO: 309391 - DNA, 25 bp, Mus musculus
cccagtggaacctgaagggactccg

SEQ ID NO: 309392 - DNA, 25 bp, Mus musculus
cgcgtttgcgtccaacttccagaaa

SEQ ID NO: 309393 - DNA, 25 bp, Mus musculus
tcacttcaaacatacggtcaccgcg

SEQ ID NO: 309394 - DNA, 25 bp, Mus musculus
atcatgccctccagacaggtcgctg

SEQ ID NO: 309395 - DNA, 25 bp, Mus musculus
caggtcgctgtcttatcgtctctca

SEQ ID NO: 309396 - DNA, 25 bp, Mus musculus
ctctcagggagatcatacgcacctc

SEQ ID NO: 309397 - DNA, 25 bp, Mus musculus
tacgcacctcataagactacatacg

SEQ ID NO: 309398 - DNA, 25 bp, Mus musculus
atacgacatattcgcgggacgcagc

SEQ ID NO: 309399 - DNA, 25 bp, Mus musculus
tctgcgcgcagcctcatatgcatgc

SEQ ID NO: 309400 - DNA, 25 bp, Mus musculus
tcgccctgaagtcggaagccctaaa

SEQ ID NO: 309401 - DNA, 25 bp, Mus musculus
agactccgcccattgtgcagggcca

SEQ ID NO: 309402 - DNA, 25 bp, Mus musculus
aacctgaagggactccgcggacaga

SEQ ID NO: 309403 - DNA, 25 bp, Mus musculus
tttagacacacaccatccgtgggga

SEQ ID NO: 309404 - DNA, 25 bp, Mus musculus
gaccctgtcctgatcgcgtttgcgt

SEQ ID NO: 309405 - DNA, 25 bp, Mus musculus
cgcagacatgcaccggcgcttcgtg

SEQ ID NO: 309406 - DNA, 25 bp, Mus musculus
ctggaagcccggactactcctaggg

SEQ ID NO: 309407 - DNA, 25 bp, Mus musculus
aagatgctggaagcccggactactc

SEQ ID NO: 309408 - DNA, 25 bp, Mus musculus
ggaaagatgctggaagcccggacta

SEQ ID NO: 309409 - DNA, 25 bp, Mus musculus
cgctcaggataggaaagatgctgga

SEQ ID NO: 309410 - DNA, 25 bp, Mus musculus
cagcagcaggatggcgctcaggata

SEQ ID NO: 309411 - DNA, 25 bp, Mus musculus
agacgcgggaggcagctacgcacac

SEQ ID NO: 309412 - DNA, 25 bp, Mus musculus
ctttttggacttgtagacgcgggag

SEQ ID NO: 309413 - DNA, 25 bp, Mus musculus
cccaggatgatgttcctttttggac

SEQ ID NO: 309414 - DNA, 25 bp, Mus musculus
cctgcgcccaggatgatgttccttt

SEQ ID NO: 309415 - DNA, 25 bp, Mus musculus
gaacaggatccctgcgcccaggatg

SEQ ID NO: 309416 - DNA, 25 bp, Mus musculus
tggctgccacgaacaggatccctgc

SEQ ID NO: 309417 - DNA, 25 bp, Mus musculus
tctcacctggctgccacgaacagga

SEQ ID NO: 309418 - DNA, 25 bp, Mus musculus
gaaaagagagggacgagaggaaagc

SEQ ID NO: 309419 - DNA, 25 bp, Mus musculus
ggaaccaacgcgatcacaccggacg

SEQ ID NO: 309420 - DNA, 25 bp, Mus musculus
gaccacttcccaagcaccgactccc

SEQ ID NO: 309421 - DNA, 25 bp, Mus musculus
gtcccatgctctgcgcaggttcagc

SEQ ID NO: 309422 - DNA, 25 bp, Mus musculus
tctgcgcaggttcagccaggggaac

SEQ ID NO: 309423 - DNA, 25 bp, Mus musculus
aacgcgatcacaccggacgccgccg

SEQ ID NO: 309424 - DNA, 25 bp, Mus musculus
tcacagctcctagtagccggtcaca

SEQ ID NO: 309425 - DNA, 25 bp, Mus musculus
acagctcctagtagccggtcacagc

SEQ ID NO: 309426 - DNA, 25 bp, Mus musculus
aaagcacgggacacactagagcttc

SEQ ID NO: 309427 - DNA, 25 bp, Mus musculus
agcacgggacacactagagcttccc

SEQ ID NO: 309428 - DNA, 25 bp, Mus musculus
gggacacactagagcttccctcaga

SEQ ID NO: 309429 - DNA, 25 bp, Mus musculus
gacacactagagcttccctcagact

SEQ ID NO: 309430 - DNA, 25 bp, Mus musculus
tcagactcgcagtcaaacctgagaa

SEQ ID NO: 309431 - DNA, 25 bp, Mus musculus
gactcgcagtcaaacctgagaatgg

SEQ ID NO: 309432 - DNA, 25 bp, Mus musculus
ccatgctctgcgcaggttcagccag

SEQ ID NO: 309433 - DNA, 25 bp, Mus musculus
cgcaatggggacctgaatttacagg

SEQ ID NO: 309434 - DNA, 25 bp, Mus musculus
ggacctgaatttacaggtggcgccc

SEQ ID NO: 309435 - DNA, 25 bp, Mus musculus
ccagcctgcgcaaaaggaaggcatc

SEQ ID NO: 309436 - DNA, 25 bp, Mus musculus
tccagactcagctgaaagcgcactg

SEQ ID NO: 309437 - DNA, 25 bp, Mus musculus
aaagcgcactgaagctcggtgagga

SEQ ID NO: 309438 - DNA, 25 bp, Mus musculus
aggcagcagtggatggcaaaccaga

SEQ ID NO: 309439 - DNA, 25 bp, Mus musculus
tgggacctcattccaatcggaccac

SEQ ID NO: 309440 - DNA, 25 bp, Mus musculus
ccatggctgccctcatgtcggtagc

SEQ ID NO: 309441 - DNA, 25 bp, Mus musculus
gctgccctcatgtcggtagcagaca

SEQ ID NO: 309442 - DNA, 25 bp, Mus musculus
ttgggcacagctcattcgcccaagg

SEQ ID NO: 309443 - DNA, 25 bp, Mus musculus
ccatttgccacgaacgtttggagga

SEQ ID NO: 309444 - DNA, 25 bp, Mus musculus
catctgctaggcgaaacagcagcag

SEQ ID NO: 309445 - DNA, 25 bp, Mus musculus
gaggacacgcatttcgttcagtgtc

SEQ ID NO: 309446 - DNA, 25 bp, Mus musculus
cgtttggaggacacgcatttcgttc

SEQ ID NO: 309447 - DNA, 25 bp, Mus musculus
agcctttgccctgtctgggccgatc

SEQ ID NO: 309448 - DNA, 25 bp, Mus musculus
cccatcggatgacgcacacacgtga

SEQ ID NO: 309449 - DNA, 25 bp, Mus musculus
cgcgcaagcgtgctaggtagctcca

SEQ ID NO: 309450 - DNA, 25 bp, Mus musculus
tcgttcgtagctcaaaccgaggtta

SEQ ID NO: 309451 - DNA, 25 bp, Mus musculus
ccaatggggaacacttccggtgcta

SEQ ID NO: 309452 - DNA, 25 bp, Mus musculus
ttccagtccgtagtgcttccaacca

SEQ ID NO: 309453 - DNA, 25 bp, Mus musculus
ccgctgctgcacacgggtcttagta

SEQ ID NO: 309454 - DNA, 25 bp, Mus musculus
acctcgcgcgaacgcactgacttga

SEQ ID NO: 309455 - DNA, 25 bp, Mus musculus
agcagccctatgacagccgcgcaag

SEQ ID NO: 309456 - DNA, 25 bp, Mus musculus
cgtagttccgtctctcgttcgtagc

SEQ ID NO: 309457 - DNA, 25 bp, Mus musculus
gtcctcaaccgcacaggagcctttg

SEQ ID NO: 309458 - DNA, 25 bp, Mus musculus
ctccgaaggaaacgcctgggtctca

SEQ ID NO: 309459 - DNA, 25 bp, Mus musculus
tgcggctgcgcaatacagaaccctg

SEQ ID NO: 309460 - DNA, 25 bp, Mus musculus
gcttccaaccagtcggcaatgcgca

SEQ ID NO: 309461 - DNA, 25 bp, Mus musculus
gccttcggtcctggaggtcctgccc

SEQ ID NO: 309462 - DNA, 25 bp, Mus musculus
cgcgcgtggtgttcttttcagccgc

SEQ ID NO: 309463 - DNA, 25 bp, Mus musculus
tcttttcttagatttctcctggggc

SEQ ID NO: 309464 - DNA, 25 bp, Mus musculus
ttagatttctcctggggccccggca

SEQ ID NO: 309465 - DNA, 25 bp, Mus musculus
tttcagccgcggagctttgtttccc

SEQ ID NO: 309466 - DNA, 25 bp, Mus musculus
agccgcggagctttgtttcccgtgt

SEQ ID NO: 309467 - DNA, 25 bp, Mus musculus
ggagctttgtttcccgtgtcgctga

SEQ ID NO: 309468 - DNA, 25 bp, Mus musculus
tcccgtgtcgctgaaaggaaagaga

SEQ ID NO: 309469 - DNA, 25 bp, Mus musculus
ccttcctgaagcgatgccatttcct

SEQ ID NO: 309470 - DNA, 25 bp, Mus musculus
ttcctgaagcgatgccatttcctcc

SEQ ID NO: 309471 - DNA, 25 bp, Mus musculus
gcgatgccatttcctccctccatct

SEQ ID NO: 309472 - DNA, 25 bp, Mus musculus
gtgttcttttcagccgcggagcttt

SEQ ID NO: 309473 - DNA, 25 bp, Mus musculus
gcgtggtgttcttttcagccgcgga

SEQ ID NO: 309474 - DNA, 25 bp, Mus musculus
tttgtttcccgtgtcgctgaaagga

SEQ ID NO: 309475 - DNA, 25 bp, Mus musculus
cagcagcaatgaaactccgcctagc

SEQ ID NO: 309476 - DNA, 25 bp, Mus musculus
catgctagcttcaggctgccggcgt

SEQ ID NO: 309477 - DNA, 25 bp, Mus musculus
agaaggatggacctcaagcacagca

SEQ ID NO: 309478 - DNA, 25 bp, Mus musculus
cgccaggctagaaggatggacctca

SEQ ID NO: 309479 - DNA, 25 bp, Mus musculus
ctcgcggccgccaggctagaaggat

SEQ ID NO: 309480 - DNA, 25 bp, Mus musculus
tgccttactggcctcggggaggcac

SEQ ID NO: 309481 - DNA, 25 bp, Mus musculus
tgacacagtggaacaggggtgcgca

SEQ ID NO: 309482 - DNA, 25 bp, Mus musculus
tagccaagtcgccacgccgcgccgc

SEQ ID NO: 309483 - DNA, 25 bp, Mus musculus
ggtgatcagagcgactcaggctgtc

SEQ ID NO: 309484 - DNA, 25 bp, Mus musculus
ctcatactggtgatcagagcgactc

SEQ ID NO: 309485 - DNA, 25 bp, Mus musculus
cgtcacgcactcatactggtgatca

SEQ ID NO: 309486 - DNA, 25 bp, Mus musculus
ctcaagcacagcagcaatgaaactc

SEQ ID NO: 309487 - DNA, 25 bp, Mus musculus
tagcttcaggctgccggcgtgacac

SEQ ID NO: 309488 - DNA, 25 bp, Mus musculus
ctgccggcgtgacacagtggaacag

SEQ ID NO: 309489 - DNA, 25 bp, Mus musculus
ggctgcccgcatcactcgccgacgg

SEQ ID NO: 309490 - DNA, 25 bp, Mus musculus
agagtctccacgtcgacgcgctggc

SEQ ID NO: 309491 - DNA, 25 bp, Mus musculus
tagcagagtctccacgtcgacgcgc

SEQ ID NO: 309492 - DNA, 25 bp, Mus musculus
gctctggcgcctagcagagtctcca

SEQ ID NO: 309493 - DNA, 25 bp, Mus musculus
ggctgcgggcatccggaccgggacc

SEQ ID NO: 309494 - DNA, 25 bp, Mus musculus
tggcgccacacacctggacctgcgg

SEQ ID NO: 309495 - DNA, 25 bp, Mus musculus
ggcatcaccagaggctggcgccaca

SEQ ID NO: 309496 - DNA, 25 bp, Mus musculus
tcgccgacggcatcaccagaggctg

SEQ ID NO: 309497 - DNA, 25 bp, Mus musculus
agcgctgacgactggctgcccgcat

SEQ ID NO: 309498 - DNA, 25 bp, Mus musculus
ggcctctgagcgctgacgactggct

SEQ ID NO: 309499 - DNA, 25 bp, Mus musculus
cgggctaggcacgcagcttgagcac

SEQ ID NO: 309500 - DNA, 25 bp, Mus musculus
tgcgcgtcaagtccgcatccgggcg

SEQ ID NO: 309501 - DNA, 25 bp, Mus musculus
acggcatcaccagaggctggcgcca

SEQ ID NO: 309502 - DNA, 25 bp, Mus musculus
agcaggcatgagttgggcgggctag

SEQ ID NO: 309503 - DNA, 25 bp, Mus musculus
gagccctttcctcctcagtgcccgt

SEQ ID NO: 309504 - DNA, 25 bp, Mus musculus
ccagccgtctccaggacgaaacgag

SEQ ID NO: 309505 - DNA, 25 bp, Mus musculus
cagccgtctccaggacgaaacgagc

SEQ ID NO: 309506 - DNA, 25 bp, Mus musculus
agccgtctccaggacgaaacgagcc

SEQ ID NO: 309507 - DNA, 25 bp, Mus musculus
tctccaggacgaaacgagccctttc

SEQ ID NO: 309508 - DNA, 25 bp, Mus musculus
tcctttttgaagcattacactctct

SEQ ID NO: 309509 - DNA, 25 bp, Mus musculus
cctttttgaagcattacactctcta

SEQ ID NO: 309510 - DNA, 25 bp, Mus musculus
tttttgaagcattacactctctatg

SEQ ID NO: 309511 - DNA, 25 bp, Mus musculus
ttttgaagcattacactctctatgg

SEQ ID NO: 309512 - DNA, 25 bp, Mus musculus
ataaaacaaatgaaggaagatgaaa

SEQ ID NO: 309513 - DNA, 25 bp, Mus musculus
tgtttaggagcccacagcccggatc

SEQ ID NO: 309514 - DNA, 25 bp, Mus musculus
gtttaggagcccacagcccggatct

SEQ ID NO: 309515 - DNA, 25 bp, Mus musculus
gccagccgtctccaggacgaaacga

SEQ ID NO: 309516 - DNA, 25 bp, Mus musculus
cgtctccaggacgaaacgagccctt

SEQ ID NO: 309517 - DNA, 25 bp, Mus musculus
tcagacattgcaggcgatcgcatcc

SEQ ID NO: 309518 - DNA, 25 bp, Mus musculus
catccctggccagcgttatcaagca

SEQ ID NO: 309519 - DNA, 25 bp, Mus musculus
gctcagacattgcaggcgatcgcat

SEQ ID NO: 309520 - DNA, 25 bp, Mus musculus
acattgcaggcgatcgcatccctgg

SEQ ID NO: 309521 - DNA, 25 bp, Mus musculus
gttatcgagcagacaacacagtagg

SEQ ID NO: 309522 - DNA, 25 bp, Mus musculus
ctcagacattgcaggcgatcgcatc

SEQ ID NO: 309523 - DNA, 25 bp, Mus musculus
tggccagcgttatcgagcagacaac

SEQ ID NO: 309524 - DNA, 25 bp, Mus musculus
tatcgagcagacaacacagtaggtg

SEQ ID NO: 309525 - DNA, 25 bp, Mus musculus
ctggccagcgttatcgagcagacaa

SEQ ID NO: 309526 - DNA, 25 bp, Mus musculus
tatcaagcagacaacacagtaggtg

SEQ ID NO: 309527 - DNA, 25 bp, Mus musculus
taggtgcccacgatggctgtgaatg

SEQ ID NO: 309528 - DNA, 25 bp, Mus musculus
ggctcagacattgcaggcgatcgca

SEQ ID NO: 309529 - DNA, 25 bp, Mus musculus
cctggccagcgttatcgagcagaca

SEQ ID NO: 309530 - DNA, 25 bp, Mus musculus
tccctggccagcgttatcgagcaga

SEQ ID NO: 309531 - DNA, 25 bp, Mus musculus
gatgctcttagctgagtgtcccgcg

SEQ ID NO: 309532 - DNA, 25 bp, Mus musculus
tcgatgctcttagctgagtgtcccg

SEQ ID NO: 309533 - DNA, 25 bp, Mus musculus
cctcgatgctcttagctgagtgtcc

SEQ ID NO: 309534 - DNA, 25 bp, Mus musculus
ccctcgatgctcttagctgagtgtc

SEQ ID NO: 309535 - DNA, 25 bp, Mus musculus
taaagttgctgcagttaaaaagctc

SEQ ID NO: 309536 - DNA, 25 bp, Mus musculus
cgtatattaaagttgctgcagttaa

SEQ ID NO: 309537 - DNA, 25 bp, Mus musculus
atagcgtatattaaagttgctgcag

SEQ ID NO: 309538 - DNA, 25 bp, Mus musculus
atgctcttagctgagtgtcccgcgg

SEQ ID NO: 309539 - DNA, 25 bp, Mus musculus
cgatgctcttagctgagtgtcccgc

SEQ ID NO: 309540 - DNA, 25 bp, Mus musculus
gcgtatattaaagttgctgcagtta

SEQ ID NO: 309541 - DNA, 25 bp, Mus musculus
gtgttcaaagcaggcccgagccgcc

SEQ ID NO: 309542 - DNA, 25 bp, Mus musculus
gttcaaagcaggcccgagccgcctg

SEQ ID NO: 309543 - DNA, 25 bp, Mus musculus
ctcgatgctcttagctgagtgtccc

SEQ ID NO: 309544 - DNA, 25 bp, Mus musculus
tgctcttagctgagtgtcccgcggg

SEQ ID NO: 309545 - DNA, 25 bp, Mus musculus
ccgttccgaacgcacggagcctggg

SEQ ID NO: 309546 - DNA, 25 bp, Mus musculus
tctcgctgcctaagggaagggacca

SEQ ID NO: 309547 - DNA, 25 bp, Mus musculus
gctgcaaaaggcgtctcgctgccta

SEQ ID NO: 309548 - DNA, 25 bp, Mus musculus
agtggtccgctgcaaaaggcgtctc

SEQ ID NO: 309549 - DNA, 25 bp, Mus musculus
gagtactaccgagccctgggccgca

SEQ ID NO: 309550 - DNA, 25 bp, Mus musculus
ggcgcacctgagagtactaccgagc

SEQ ID NO: 309551 - DNA, 25 bp, Mus musculus
gggtctagccctttttattagagca

SEQ ID NO: 309552 - DNA, 25 bp, Mus musculus
gggaaagggcccaccctgctactgc

SEQ ID NO: 309553 - DNA, 25 bp, Mus musculus
tgaaagtgcaagaggaagtgcagcc

SEQ ID NO: 309554 - DNA, 25 bp, Mus musculus
cccaagctagggagccggatgcgca

SEQ ID NO: 309555 - DNA, 25 bp, Mus musculus
tttgcagcgctaggcggcccaagct

SEQ ID NO: 309556 - DNA, 25 bp, Mus musculus
aagtggaaagtttgcagcgctaggc

SEQ ID NO: 309557 - DNA, 25 bp, Mus musculus
ggggcgcacctcttcgctcgtttac

SEQ ID NO: 309558 - DNA, 25 bp, Mus musculus
ggcgttcggcacaaagaaagtggaa

SEQ ID NO: 309559 - DNA, 25 bp, Mus musculus
gcgtgacttcttcgcttgggcattt

SEQ ID NO: 309560 - DNA, 25 bp, Mus musculus
acgatgtaatagacgcagcggtatc

SEQ ID NO: 309561 - DNA, 25 bp, Mus musculus
gcgccacaggttacgggactccatt

SEQ ID NO: 309562 - DNA, 25 bp, Mus musculus
cgcagctcaccaagccggatttcta

SEQ ID NO: 309563 - DNA, 25 bp, Mus musculus
cttcttacggaggtgtcgcagctca

SEQ ID NO: 309564 - DNA, 25 bp, Mus musculus
cggcgatcacgctagcatggacgaa

SEQ ID NO: 309565 - DNA, 25 bp, Mus musculus
atgctgtagctattccggatacggc

SEQ ID NO: 309566 - DNA, 25 bp, Mus musculus
cgccaagacaggtggaagttaatta

SEQ ID NO: 309567 - DNA, 25 bp, Mus musculus
tgcagtttgttaagagctccaccca

SEQ ID NO: 309568 - DNA, 25 bp, Mus musculus
tcagaggaccctacatttgcagttt

SEQ ID NO: 309569 - DNA, 25 bp, Mus musculus
ccatggttgactcccgctcagagga

SEQ ID NO: 309570 - DNA, 25 bp, Mus musculus
gcacgtctttccagtccatggttga

SEQ ID NO: 309571 - DNA, 25 bp, Mus musculus
ctaaccgccggcgaagcacgtcttt

SEQ ID NO: 309572 - DNA, 25 bp, Mus musculus
ggactccattgccatttccgaattg

SEQ ID NO: 309573 - DNA, 25 bp, Mus musculus
accaagcgcagaagctaaccgggtg

SEQ ID NO: 309574 - DNA, 25 bp, Mus musculus
ccaagcgcagaagctaaccgggtgc

SEQ ID NO: 309575 - DNA, 25 bp, Mus musculus
caagcgcagaagctaaccgggtgcc

SEQ ID NO: 309576 - DNA, 25 bp, Mus musculus
aagcgcagaagctaaccgggtgccc

SEQ ID NO: 309577 - DNA, 25 bp, Mus musculus
agcgcagaagctaaccgggtgccca

SEQ ID NO: 309578 - DNA, 25 bp, Mus musculus
gcgcagaagctaaccgggtgcccag

SEQ ID NO: 309579 - DNA, 25 bp, Mus musculus
cgcagaagctaaccgggtgcccagg

SEQ ID NO: 309580 - DNA, 25 bp, Mus musculus
gcaccaagcgcagaagctaaccggg

SEQ ID NO: 309581 - DNA, 25 bp, Mus musculus
caccaagcgcagaagctaaccgggt

SEQ ID NO: 309582 - DNA, 25 bp, Mus musculus
gaagatgtcacctcggcctcctcag

SEQ ID NO: 309583 - DNA, 25 bp, Mus musculus
agctcgcggatcctggcccggagcc

SEQ ID NO: 309584 - DNA, 25 bp, Mus musculus
ggctccgaactctgctccagccgga

SEQ ID NO: 309585 - DNA, 25 bp, Mus musculus
actgaggctccgaactctgctccag

SEQ ID NO: 309586 - DNA, 25 bp, Mus musculus
gggacactgaggctccgaactctgc

SEQ ID NO: 309587 - DNA, 25 bp, Mus musculus
tccgggacactgaggctccgaactc

SEQ ID NO: 309588 - DNA, 25 bp, Mus musculus
gcgtccgggacactgaggctccgaa

SEQ ID NO: 309589 - DNA, 25 bp, Mus musculus
gccgactcccgcgtgcctcctcggc

SEQ ID NO: 309590 - DNA, 25 bp, Mus musculus
tggaagatgtcacctcggcctcctc

SEQ ID NO: 309591 - DNA, 25 bp, Mus musculus
ccatggaagatgtcacctcggcctc

SEQ ID NO: 309592 - DNA, 25 bp, Mus musculus
ttccctacgagcctggggacgcgga

SEQ ID NO: 309593 - DNA, 25 bp, Mus musculus
gacgcagcgccgagaagcatccaca

SEQ ID NO: 309594 - DNA, 25 bp, Mus musculus
gagaagcatccacaccgaccacggg

SEQ ID NO: 309595 - DNA, 25 bp, Mus musculus
atccacaccgaccacgggcgtccgg

SEQ ID NO: 309596 - DNA, 25 bp, Mus musculus
cctttatccgaagggagggagcaga

SEQ ID NO: 309597 - DNA, 25 bp, Mus musculus
cagaggaggcgtggtctatagctct

SEQ ID NO: 309598 - DNA, 25 bp, Mus musculus
cagttccacaaacctttatccgaag

SEQ ID NO: 309599 - DNA, 25 bp, Mus musculus
gcagatggttccacccagttccaca

SEQ ID NO: 309600 - DNA, 25 bp, Mus musculus
ctgagctgcagatggttccacccag

SEQ ID NO: 309601 - DNA, 25 bp, Mus musculus
tcctctgatggtacagcccgtactc

SEQ ID NO: 309602 - DNA, 25 bp, Mus musculus
ggaggcccagaatcgcgaaggtcct

SEQ ID NO: 309603 - DNA, 25 bp, Mus musculus
agaaccttgattgcgaggcgccgct

SEQ ID NO: 309604 - DNA, 25 bp, Mus musculus
cccagctccagaaccttgattgcga

SEQ ID NO: 309605 - DNA, 25 bp, Mus musculus
aaagatgaacgcctacctcctcgcg

SEQ ID NO: 309606 - DNA, 25 bp, Mus musculus
gtctttaaagatgaacgcctacctc

SEQ ID NO: 309607 - DNA, 25 bp, Mus musculus
cgctcagtccttcggtctttaaaga

SEQ ID NO: 309608 - DNA, 25 bp, Mus musculus
atcgcgaaggtcctctgatggtaca

SEQ ID NO: 309609 - DNA, 25 bp, Mus musculus
ggtctatagctctctgggccacgcc

SEQ ID NO: 309610 - DNA, 25 bp, Mus musculus
tttacatcgcgcgcctcaatcatcg

SEQ ID NO: 309611 - DNA, 25 bp, Mus musculus
cggcgcggccacaaatgcgaggctg

SEQ ID NO: 309612 - DNA, 25 bp, Mus musculus
ctcttgcggccgtgattgacagcga

SEQ ID NO: 309613 - DNA, 25 bp, Mus musculus
tgaaaacgaggctcttgcggccgtg

SEQ ID NO: 309614 - DNA, 25 bp, Mus musculus
ccgcgcgggatgaaaacgaggctct

SEQ ID NO: 309615 - DNA, 25 bp, Mus musculus
gccttgtttacatcgcgcgcctcaa

SEQ ID NO: 309616 - DNA, 25 bp, Mus musculus
gcggggccggccttgtttacatcgc

SEQ ID NO: 309617 - DNA, 25 bp, Mus musculus
ttataccgcgggtcacggggtcaca

SEQ ID NO: 309618 - DNA, 25 bp, Mus musculus
cggctgtttataccgcgggtcacgg

SEQ ID NO: 309619 - DNA, 25 bp, Mus musculus
ctggcccgcggctgtttataccgcg

SEQ ID NO: 309620 - DNA, 25 bp, Mus musculus
cgcgggttctgttagccgccggcct

SEQ ID NO: 309621 - DNA, 25 bp, Mus musculus
tccatgacaccagccggcactcccg

SEQ ID NO: 309622 - DNA, 25 bp, Mus musculus
tgccgtcgctccctccatgacacca

SEQ ID NO: 309623 - DNA, 25 bp, Mus musculus
ggtcagcgcggtcctcaccgcggtc

SEQ ID NO: 309624 - DNA, 25 bp, Mus musculus
atgcggcatgccctgtttgtttccg

SEQ ID NO: 309625 - DNA, 25 bp, Mus musculus
agcgttggagtgacaacttgtcgcc

SEQ ID NO: 309626 - DNA, 25 bp, Mus musculus
cctttgacaccgaccggagcggagc

SEQ ID NO: 309627 - DNA, 25 bp, Mus musculus
ccagatacaatctcccggtaaccta

SEQ ID NO: 309628 - DNA, 25 bp, Mus musculus
ggtcccacctgtgtagctccagata

SEQ ID NO: 309629 - DNA, 25 bp, Mus musculus
tcgggtgttacttcctgtttgctac

SEQ ID NO: 309630 - DNA, 25 bp, Mus musculus
ttgtagtcatttcctgcctcgggtg

SEQ ID NO: 309631 - DNA, 25 bp, Mus musculus
tctggcgcaggaagttagtgtttaa

SEQ ID NO: 309632 - DNA, 25 bp, Mus musculus
tgacgctccgagttcttccctagaa

SEQ ID NO: 309633 - DNA, 25 bp, Mus musculus
ttgtttccgggcagcgaactcaaaa

SEQ ID NO: 309634 - DNA, 25 bp, Mus musculus
caaggagaggaactacgcatgcggc

SEQ ID NO: 309635 - DNA, 25 bp, Mus musculus
gaaaccggagatcaggtcgcgctgc

SEQ ID NO: 309636 - DNA, 25 bp, Mus musculus
cccaaggctcttcggtcaggacctg

SEQ ID NO: 309637 - DNA, 25 bp, Mus musculus
aaccggaaatcctcgtcgtcgctga

SEQ ID NO: 309638 - DNA, 25 bp, Mus musculus
gtcgccatcgtcacctggggcggct

SEQ ID NO: 309639 - DNA, 25 bp, Mus musculus
gggtcacaacccgtagggcgacatc

SEQ ID NO: 309640 - DNA, 25 bp, Mus musculus
gggacttcttgtctgatggccatga

SEQ ID NO: 309641 - DNA, 25 bp, Mus musculus
taaggggcgggacttcttgtctgat

SEQ ID NO: 309642 - DNA, 25 bp, Mus musculus
ccctttcagaggagctgatccgcga

SEQ ID NO: 309643 - DNA, 25 bp, Mus musculus
tgatggccatgaccggaaatcccgc

SEQ ID NO: 309644 - DNA, 25 bp, Mus musculus
ccgtagggcgacatcctttgtgcgc

SEQ ID NO: 309645 - DNA, 25 bp, Mus musculus
atccgcgagtacacggcagcggtga

SEQ ID NO: 309646 - DNA, 25 bp, Mus musculus
aggagacgcgcttgacgttctcgcc

SEQ ID NO: 309647 - DNA, 25 bp, Mus musculus
ccttccacgaggagacgcgcttgac

SEQ ID NO: 309648 - DNA, 25 bp, Mus musculus
cccaggaagtgacggccttccacga

SEQ ID NO: 309649 - DNA, 25 bp, Mus musculus
actgctgacccagggccgattggca

SEQ ID NO: 309650 - DNA, 25 bp, Mus musculus
gcgttatgcccgacccgagttgaac

SEQ ID NO: 309651 - DNA, 25 bp, Mus musculus
agcgggaagcagcaccgcgtcatca

SEQ ID NO: 309652 - DNA, 25 bp, Mus musculus
cgagcgggccggacttcccgacacg

SEQ ID NO: 309653 - DNA, 25 bp, Mus musculus
ctgaggcagcgattgagcatgaact

SEQ ID NO: 309654 - DNA, 25 bp, Mus musculus
cgatgggtgataggcggggcctgca

SEQ ID NO: 309655 - DNA, 25 bp, Mus musculus
tgaggcagcgattgagcatgaactg

SEQ ID NO: 309656 - DNA, 25 bp, Mus musculus
aggcagcgattgagcatgaactgtg

SEQ ID NO: 309657 - DNA, 25 bp, Mus musculus
gcagcgattgagcatgaactgtgtg

SEQ ID NO: 309658 - DNA, 25 bp, Mus musculus
gcgattgagcatgaactgtgtgtga

SEQ ID NO: 309659 - DNA, 25 bp, Mus musculus
atctgaggcagcgattgagcatgaa

SEQ ID NO: 309660 - DNA, 25 bp, Mus musculus
ttcccgcgcaacgtggacctaaagc

SEQ ID NO: 309661 - DNA, 25 bp, Mus musculus
gccgtcaatcatagccgagcgggcc

SEQ ID NO: 309662 - DNA, 25 bp, Mus musculus
ccgtcaatcatagccgagcgggccg

SEQ ID NO: 309663 - DNA, 25 bp, Mus musculus
tcaatcatagccgagcgggccggac

SEQ ID NO: 309664 - DNA, 25 bp, Mus musculus
aatcatagccgagcgggccggactt

SEQ ID NO: 309665 - DNA, 25 bp, Mus musculus
gcttcccgcgcaacgtggacctaaa

SEQ ID NO: 309666 - DNA, 25 bp, Mus musculus
cggcctttgcgcacgccggctccgc

SEQ ID NO: 309667 - DNA, 25 bp, Mus musculus
tgccagcgccgcaccacagggtaac

SEQ ID NO: 309668 - DNA, 25 bp, Mus musculus
actcctcagcgcaggcttcctcctg

SEQ ID NO: 309669 - DNA, 25 bp, Mus musculus
caccgactcctcagcgcaggcttcc

SEQ ID NO: 309670 - DNA, 25 bp, Mus musculus
cacgcccgcagacacgcccacagcc

SEQ ID NO: 309671 - DNA, 25 bp, Mus musculus
cccaggctccagttccggcgggcac

SEQ ID NO: 309672 - DNA, 25 bp, Mus musculus
gctccgcagccggaccgacctccac

SEQ ID NO: 309673 - DNA, 25 bp, Mus musculus
gaaggctcccagcggcctttgcgca

SEQ ID NO: 309674 - DNA, 25 bp, Mus musculus
cccagcccagcacggagatccagcc

SEQ ID NO: 309675 - DNA, 25 bp, Mus musculus
cccgcacagagagcacagcgccaga

SEQ ID NO: 309676 - DNA, 25 bp, Mus musculus
cggcgctcacctccacagtgggccc

SEQ ID NO: 309677 - DNA, 25 bp, Mus musculus
gcccacagccgcgcgcggacacgcc

SEQ ID NO: 309678 - DNA, 25 bp, Mus musculus
agccacgcccgcagacacgcccaca

SEQ ID NO: 309679 - DNA, 25 bp, Mus musculus
cggaccgacctccaccgactcctca

SEQ ID NO: 309680 - DNA, 25 bp, Mus musculus
gcgtagccgtagtattgcaggatca

SEQ ID NO: 309681 - DNA, 25 bp, Mus musculus
cttctgcacgtcagaggcgaggctt

SEQ ID NO: 309682 - DNA, 25 bp, Mus musculus
tcctgaagcctagcgagatgctacc

SEQ ID NO: 309683 - DNA, 25 bp, Mus musculus
cctgcgcgcatacagcttgctctta

SEQ ID NO: 309684 - DNA, 25 bp, Mus musculus
ttaactaatgagagacgaaccagcg

SEQ ID NO: 309685 - DNA, 25 bp, Mus musculus
aggatcacctgtccaccttcctgaa

SEQ ID NO: 309686 - DNA, 25 bp, Mus musculus
cgaaccagcgtgaagctctaaatcg

SEQ ID NO: 309687 - DNA, 25 bp, Mus musculus
cagatgcggacgaacgaggacctac

SEQ ID NO: 309688 - DNA, 25 bp, Mus musculus
aggcccgcctctcgtggatcttcat

SEQ ID NO: 309689 - DNA, 25 bp, Mus musculus
tcgtggatcttcattcaccagcacc

SEQ ID NO: 309690 - DNA, 25 bp, Mus musculus
cgtgcgcgtagtcaccgagaaatcc

SEQ ID NO: 309691 - DNA, 25 bp, Mus musculus
cgtgccatggcggtgaacctgagcc

SEQ ID NO: 309692 - DNA, 25 bp, Mus musculus
aaagctgaagctgctgcatcgcggg

SEQ ID NO: 309693 - DNA, 25 bp, Mus musculus
cccgaccgactggtaggcagcaagg

SEQ ID NO: 309694 - DNA, 25 bp, Mus musculus
ctgaccggaccatgggcgctccggc

SEQ ID NO: 309695 - DNA, 25 bp, Mus musculus
accatgggcgctccggcccctcgcc

SEQ ID NO: 309696 - DNA, 25 bp, Mus musculus
ggaccatgggcgctccggcccctcg

SEQ ID NO: 309697 - DNA, 25 bp, Mus musculus
tgaccggaccatgggcgctccggcc

SEQ ID NO: 309698 - DNA, 25 bp, Mus musculus
gctgaccggaccatgggcgctccgg

SEQ ID NO: 309699 - DNA, 25 bp, Mus musculus
ccccccctatactgcgctgaccgga

SEQ ID NO: 309700 - DNA, 25 bp, Mus musculus
gctgtgacgcttttggcccccgctc

SEQ ID NO: 309701 - DNA, 25 bp, Mus musculus
ggctgtgacgcttttggcccccgct

SEQ ID NO: 309702 - DNA, 25 bp, Mus musculus
ggccggctgtgacgcttttggcccc

SEQ ID NO: 309703 - DNA, 25 bp, Mus musculus
ctcctgtcacggagtcgcagcggcc

SEQ ID NO: 309704 - DNA, 25 bp, Mus musculus
cctcctgtcacggagtcgcagcggc

SEQ ID NO: 309705 - DNA, 25 bp, Mus musculus
cccgtagccccctcctgtcacggag

SEQ ID NO: 309706 - DNA, 25 bp, Mus musculus
tgacgcttttggcccccgctcgctc

SEQ ID NO: 309707 - DNA, 25 bp, Mus musculus
gaccggaccatgggcgctccggccc

SEQ ID NO: 309708 - DNA, 25 bp, Mus musculus
cccggcgtctcccatggtgctcggc

SEQ ID NO: 309709 - DNA, 25 bp, Mus musculus
gagtcgcagcggccggctgtgacgc

SEQ ID NO: 309710 - DNA, 25 bp, Mus musculus
ggcgctgtcccgtgcggcggcgctg

SEQ ID NO: 309711 - DNA, 25 bp, Mus musculus
ccagccacggcgctgtcccgtgcgg

SEQ ID NO: 309712 - DNA, 25 bp, Mus musculus
cgagccggggagatctggcggcctt

SEQ ID NO: 309713 - DNA, 25 bp, Mus musculus
cgggccgcaccactcggcctgcgga

SEQ ID NO: 309714 - DNA, 25 bp, Mus musculus
agccgggattccaggcgggtcagct

SEQ ID NO: 309715 - DNA, 25 bp, Mus musculus
ctccgagccgggattccaggcgggt

SEQ ID NO: 309716 - DNA, 25 bp, Mus musculus
cgggcgcgagtccggagctccgagc

SEQ ID NO: 309717 - DNA, 25 bp, Mus musculus
gcgtctcccatggtgctcggcggcg

SEQ ID NO: 309718 - DNA, 25 bp, Mus musculus
caggctgggcgctttgctgcgctcg

SEQ ID NO: 309719 - DNA, 25 bp, Mus musculus
cagggacagcgaggcggcaggctgg

SEQ ID NO: 309720 - DNA, 25 bp, Mus musculus
ttacccccagaagccgcagggacag

SEQ ID NO: 309721 - DNA, 25 bp, Mus musculus
ctgagcccccctcggaggaagcgga

SEQ ID NO: 309722 - DNA, 25 bp, Mus musculus
acgtcacggcaacggcacacggtgt

SEQ ID NO: 309723 - DNA, 25 bp, Mus musculus
gtgggaggtttatgccagcgcaaca

SEQ ID NO: 309724 - DNA, 25 bp, Mus musculus
ccagcgcaacaattggtggtttttt

SEQ ID NO: 309725 - DNA, 25 bp, Mus musculus
tttatgccagcgcaacaattggtgg

SEQ ID NO: 309726 - DNA, 25 bp, Mus musculus
gaggtttatgccagcgcaacaattg

SEQ ID NO: 309727 - DNA, 25 bp, Mus musculus
tttctgccgtgggaggtttatgcca

SEQ ID NO: 309728 - DNA, 25 bp, Mus musculus
gctttcatttctgccgtgggaggtt

SEQ ID NO: 309729 - DNA, 25 bp, Mus musculus
ttagctttcatttctgccgtgggag

SEQ ID NO: 309730 - DNA, 25 bp, Mus musculus
tgtttagctttcatttctgccgtgg

SEQ ID NO: 309731 - DNA, 25 bp, Mus musculus
cggtgtgtttagctttcatttctgc

SEQ ID NO: 309732 - DNA, 25 bp, Mus musculus
acacggtgtgtttagctttcatttc

SEQ ID NO: 309733 - DNA, 25 bp, Mus musculus
cacggcaacggcacacggtgtgttt

SEQ ID NO: 309734 - DNA, 25 bp, Mus musculus
ttttgagagtttgtgctggacgcgg

SEQ ID NO: 309735 - DNA, 25 bp, Mus musculus
cggcacacggtgtgtttagctttca

SEQ ID NO: 309736 - DNA, 25 bp, Mus musculus
gagtagtcggagcagtcgctgagac

SEQ ID NO: 309737 - DNA, 25 bp, Mus musculus
gggtaattttgcgtcatctgaatgg

SEQ ID NO: 309738 - DNA, 25 bp, Mus musculus
cgtcatctgaatggagacgtcgcta

SEQ ID NO: 309739 - DNA, 25 bp, Mus musculus
ctgaatggagacgtcgctagagatg

SEQ ID NO: 309740 - DNA, 25 bp, Mus musculus
tcgctagagatgtcggaagggctgc

SEQ ID NO: 309741 - DNA, 25 bp, Mus musculus
gctgcagaaactggccggagtagtc

SEQ ID NO: 309742 - DNA, 25 bp, Mus musculus
ggtgcgggcgatacatctcttcctc

SEQ ID NO: 309743 - DNA, 25 bp, Mus musculus
gatacatctcttcctccgcgtagcg

SEQ ID NO: 309744 - DNA, 25 bp, Mus musculus
cttcctccgcgtagcgcttggtgaa

SEQ ID NO: 309745 - DNA, 25 bp, Mus musculus
ccgcgtagcgcttggtgaacaagta

SEQ ID NO: 309746 - DNA, 25 bp, Mus musculus
cgcttggtgaacaagtacacggaca

SEQ ID NO: 309747 - DNA, 25 bp, Mus musculus
tgaacaagtacacggacatgactcc

SEQ ID NO: 309748 - DNA, 25 bp, Mus musculus
agatggtccgggtacttgatggccg

SEQ ID NO: 309749 - DNA, 25 bp, Mus musculus
cctcgggctgcagaaactggccgga

SEQ ID NO: 309750 - DNA, 25 bp, Mus musculus
cccaaggtgcaaggagaaggccttg

SEQ ID NO: 309751 - DNA, 25 bp, Mus musculus
gctctgctgccatgacaggctctgc

SEQ ID NO: 309752 - DNA, 25 bp, Mus musculus
taactgtgaccgttcaccgcagccg

SEQ ID NO: 309753 - DNA, 25 bp, Mus musculus
tcaccgcagccgcagagtgaggtca

SEQ ID NO: 309754 - DNA, 25 bp, Mus musculus
ccgcagagtgaggtcactgccaccg

SEQ ID NO: 309755 - DNA, 25 bp, Mus musculus
ccacagccacggagcgaggtcacag

SEQ ID NO: 309756 - DNA, 25 bp, Mus musculus
gagcgaggtcacagccgccaacgca

SEQ ID NO: 309757 - DNA, 25 bp, Mus musculus
cccgctgcataactgtgaccgttca

SEQ ID NO: 309758 - DNA, 25 bp, Mus musculus
cggtggtcaaggtgtctctgcgacc

SEQ ID NO: 309759 - DNA, 25 bp, Mus musculus
catgtgaccgcgaagatggaaccgc

SEQ ID NO: 309760 - DNA, 25 bp, Mus musculus
agatggaaccgccatccctgtagtc

SEQ ID NO: 309761 - DNA, 25 bp, Mus musculus
cgtatgtattcatgaatgcgtatgc

SEQ ID NO: 309762 - DNA, 25 bp, Mus musculus
cccgttcatatatacgtatgtattc

SEQ ID NO: 309763 - DNA, 25 bp, Mus musculus
cacacagatgtggatgcggtggtca

SEQ ID NO: 309764 - DNA, 25 bp, Mus musculus
tcagggccgcacgtgtctcgagccg

SEQ ID NO: 309765 - DNA, 25 bp, Mus musculus
tcccttcgtgctgaccgagccagag

SEQ ID NO: 309766 - DNA, 25 bp, Mus musculus
gctcagggccgcacgtgtctcgagc

SEQ ID NO: 309767 - DNA, 25 bp, Mus musculus
acgaggtggacattggagacgaggg

SEQ ID NO: 309768 - DNA, 25 bp, Mus musculus
aagacgaacccaaagcaccagacgg

SEQ ID NO: 309769 - DNA, 25 bp, Mus musculus
ccttcgtgctgaccgagccagagga

SEQ ID NO: 309770 - DNA, 25 bp, Mus musculus
agccaagacgaacccaaagcaccag

SEQ ID NO: 309771 - DNA, 25 bp, Mus musculus
ggtcccttcgtgctgaccgagccag

SEQ ID NO: 309772 - DNA, 25 bp, Mus musculus
aagcaccagacgggccagaaagccc

SEQ ID NO: 309773 - DNA, 25 bp, Mus musculus
caaagcaccagacgggccagaaagc

SEQ ID NO: 309774 - DNA, 25 bp, Mus musculus
cccaaagcaccagacgggccagaaa

SEQ ID NO: 309775 - DNA, 25 bp, Mus musculus
aacccaaagcaccagacgggccaga

SEQ ID NO: 309776 - DNA, 25 bp, Mus musculus
gacgaacccaaagcaccagacgggc

SEQ ID NO: 309777 - DNA, 25 bp, Mus musculus
agaggacgaggtggacattggagac

SEQ ID NO: 309778 - DNA, 25 bp, Mus musculus
cgcccgggtgaaggagaagcggaga

SEQ ID NO: 309779 - DNA, 25 bp, Mus musculus
gtgactcgcatcggcgcacggacgc

SEQ ID NO: 309780 - DNA, 25 bp, Mus musculus
acacccgggggtgactcgcatcggc

SEQ ID NO: 309781 - DNA, 25 bp, Mus musculus
acgcacagcccacagacgccgggtc

SEQ ID NO: 309782 - DNA, 25 bp, Mus musculus
aggacgagccggcgaaccgtctcag

SEQ ID NO: 309783 - DNA, 25 bp, Mus musculus
tctgatctgaggtcgcggtcagaaa

SEQ ID NO: 309784 - DNA, 25 bp, Mus musculus
gccacgtctgatctgaggtcgcggt

SEQ ID NO: 309785 - DNA, 25 bp, Mus musculus
ctgagggaatcctggttagtttctt

SEQ ID NO: 309786 - DNA, 25 bp, Mus musculus
cgccgttactgagggaatcctggtt

SEQ ID NO: 309787 - DNA, 25 bp, Mus musculus
actcgccgttactgagggaatcctg

SEQ ID NO: 309788 - DNA, 25 bp, Mus musculus
ttcactcgccgttactgagggaatc

SEQ ID NO: 309789 - DNA, 25 bp, Mus musculus
ttccctgttcactcgccgttactga

SEQ ID NO: 309790 - DNA, 25 bp, Mus musculus
gcgctgggctcttccctgttcactc

SEQ ID NO: 309791 - DNA, 25 bp, Mus musculus
gccacatttcccacgccgcgacgcg

SEQ ID NO: 309792 - DNA, 25 bp, Mus musculus
ccttcgctccttgttggggattcgg

SEQ ID NO: 309793 - DNA, 25 bp, Mus musculus
cccagcgcggaagcgaacagtgtgg

SEQ ID NO: 309794 - DNA, 25 bp, Mus musculus
cgcccagcgcggaagcgaacagtgt

SEQ ID NO: 309795 - DNA, 25 bp, Mus musculus
atttggcgcccagcgcggaagcgaa

SEQ ID NO: 309796 - DNA, 25 bp, Mus musculus
ttatttggcgcccagcgcggaagcg

SEQ ID NO: 309797 - DNA, 25 bp, Mus musculus
ttcgctccttgttggggattcggcg

SEQ ID NO: 309798 - DNA, 25 bp, Mus musculus
gccttcgctccttgttggggattcg

SEQ ID NO: 309799 - DNA, 25 bp, Mus musculus
agccttcgctccttgttggggattc

SEQ ID NO: 309800 - DNA, 25 bp, Mus musculus
cagccttcgctccttgttggggatt

SEQ ID NO: 309801 - DNA, 25 bp, Mus musculus
gcagccttcgctccttgttggggat

SEQ ID NO: 309802 - DNA, 25 bp, Mus musculus
tccggcgcccggctgtgacgggtgc

SEQ ID NO: 309803 - DNA, 25 bp, Mus musculus
gcccacacgggcctgctccggcgcc

SEQ ID NO: 309804 - DNA, 25 bp, Mus musculus
ttacctgggcccacacgggcctgct

SEQ ID NO: 309805 - DNA, 25 bp, Mus musculus
ggagacttatttggcgcccagcgcg

SEQ ID NO: 309806 - DNA, 25 bp, Mus musculus
ggcctggcccgaaggactaatcata

SEQ ID NO: 309807 - DNA, 25 bp, Mus musculus
ttcgggcaccgaccgtctgaagagt

SEQ ID NO: 309808 - DNA, 25 bp, Mus musculus
caggggcaaccttggaggctcgccc

SEQ ID NO: 309809 - DNA, 25 bp, Mus musculus
ccgccttgcgcacagaaaccaggtg

SEQ ID NO: 309810 - DNA, 25 bp, Mus musculus
acagaaaccaggtggccgttgaggc

SEQ ID NO: 309811 - DNA, 25 bp, Mus musculus
ttgaggcgccaccagccggtttgat

SEQ ID NO: 309812 - DNA, 25 bp, Mus musculus
cagccggtttgatttcccgcggccg

SEQ ID NO: 309813 - DNA, 25 bp, Mus musculus
ggaggggaaatgagccattagccaa

SEQ ID NO: 309814 - DNA, 25 bp, Mus musculus
ccattagccaatgggctgggccgag

SEQ ID NO: 309815 - DNA, 25 bp, Mus musculus
gcttcagccgactgcgattggcctc

SEQ ID NO: 309816 - DNA, 25 bp, Mus musculus
taatcataactagtcccggagctgc

SEQ ID NO: 309817 - DNA, 25 bp, Mus musculus
cccggagctgccgaataaactatta

SEQ ID NO: 309818 - DNA, 25 bp, Mus musculus
ccgaccgtctgaagagtggaggtca

SEQ ID NO: 309819 - DNA, 25 bp, Mus musculus
ggctcaggtgtacttacggagttgc

SEQ ID NO: 309820 - DNA, 25 bp, Mus musculus
tcgcacccggaacaatggggacttc

SEQ ID NO: 309821 - DNA, 25 bp, Mus musculus
gtgattgccgcattacaagatgtta

SEQ ID NO: 309822 - DNA, 25 bp, Mus musculus
agaacgcagacagcctccagacaga

SEQ ID NO: 309823 - DNA, 25 bp, Mus musculus
ttcccgagagaagcgccgcccaagt

SEQ ID NO: 309824 - DNA, 25 bp, Mus musculus
tctggcctcggcttcttaaagtcgc

SEQ ID NO: 309825 - DNA, 25 bp, Mus musculus
aagatgttacattccgccctgcggc

SEQ ID NO: 309826 - DNA, 25 bp, Mus musculus
acacccgggaggtgaaatcatcgca

SEQ ID NO: 309827 - DNA, 25 bp, Mus musculus
tctccgtcccgattgtggtccagga

SEQ ID NO: 309828 - DNA, 25 bp, Mus musculus
ccgcccaagtgggaagtgaatgttt

SEQ ID NO: 309829 - DNA, 25 bp, Mus musculus
aaaggactggacttggagcacgctc

SEQ ID NO: 309830 - DNA, 25 bp, Mus musculus
gtgctgggcagaggattacaacttc

SEQ ID NO: 309831 - DNA, 25 bp, Mus musculus
gcagcgctccgaaagaggccctttt

SEQ ID NO: 309832 - DNA, 25 bp, Mus musculus
ccagagcgcacaagctgcagtgtcc

SEQ ID NO: 309833 - DNA, 25 bp, Mus musculus
gcttcttaaagtcgcagggtgtctc

SEQ ID NO: 309834 - DNA, 25 bp, Mus musculus
cggatgaagagttagggttccagcc

SEQ ID NO: 309835 - DNA, 25 bp, Mus musculus
cgctgaagggtaccacgatgtgtag

SEQ ID NO: 309836 - DNA, 25 bp, Mus musculus
agccagcagacagggcccgaccgtt

SEQ ID NO: 309837 - DNA, 25 bp, Mus musculus
tcccggatgaagagttagggttcca

SEQ ID NO: 309838 - DNA, 25 bp, Mus musculus
taggagcccgcgtttcctcctgagc

SEQ ID NO: 309839 - DNA, 25 bp, Mus musculus
ctggggatataggagcccgcgtttc

SEQ ID NO: 309840 - DNA, 25 bp, Mus musculus
accacgatgtgtagctggggatata

SEQ ID NO: 309841 - DNA, 25 bp, Mus musculus
cttcttggtgcgctgaagggtacca

SEQ ID NO: 309842 - DNA, 25 bp, Mus musculus
ctgcatagcttcttggtgcgctgaa

SEQ ID NO: 309843 - DNA, 25 bp, Mus musculus
cataagttggggttgctgcatagct

SEQ ID NO: 309844 - DNA, 25 bp, Mus musculus
cctcacataagttggggttgctgca

SEQ ID NO: 309845 - DNA, 25 bp, Mus musculus
ccttcttttccggacgggatggatg

SEQ ID NO: 309846 - DNA, 25 bp, Mus musculus
cagacagggcccgaccgttggccaa

SEQ ID NO: 309847 - DNA, 25 bp, Mus musculus
ggcgggcaacctcacataagttggg

SEQ ID NO: 309848 - DNA, 25 bp, Mus musculus
ctgagtcccagcgagcaacaaatga

SEQ ID NO: 309849 - DNA, 25 bp, Mus musculus
acctccggttcaaagcctgcaactg

SEQ ID NO: 309850 - DNA, 25 bp, Mus musculus
ctgagtttgctggaacctccggttc

SEQ ID NO: 309851 - DNA, 25 bp, Mus musculus
tccggcagagctaggtactgagttt

SEQ ID NO: 309852 - DNA, 25 bp, Mus musculus
acagcagaagtagggcccgttgtta

SEQ ID NO: 309853 - DNA, 25 bp, Mus musculus
ggccgcctttagtgcgaacagccga

SEQ ID NO: 309854 - DNA, 25 bp, Mus musculus
cggatcttttttcccttgccattga

SEQ ID NO: 309855 - DNA, 25 bp, Mus musculus
tacctgagtctgtgtgagtcccaaa

SEQ ID NO: 309856 - DNA, 25 bp, Mus musculus
agccaggggtggacacaaacacata

SEQ ID NO: 309857 - DNA, 25 bp, Mus musculus
ggaaatccttcctgcgccctaatca

SEQ ID NO: 309858 - DNA, 25 bp, Mus musculus
tctgagttcccaaacaaatcgtctg

SEQ ID NO: 309859 - DNA, 25 bp, Mus musculus
taggcacgtgtgacctctgagttcc

SEQ ID NO: 309860 - DNA, 25 bp, Mus musculus
agcccggagtctattgttccagttg

SEQ ID NO: 309861 - DNA, 25 bp, Mus musculus
cccgagtgattagtcacacaattta

SEQ ID NO: 309862 - DNA, 25 bp, Mus musculus
ttgtgcctagcgcagcgcctatccg

SEQ ID NO: 309863 - DNA, 25 bp, Mus musculus
taagagccttgtgcctagcgcagcg

SEQ ID NO: 309864 - DNA, 25 bp, Mus musculus
ggttctcctaagagccttgtgccta

SEQ ID NO: 309865 - DNA, 25 bp, Mus musculus
ggagagacgcatccacacttcccgg

SEQ ID NO: 309866 - DNA, 25 bp, Mus musculus
ggccctccctgcgaactcactcact

SEQ ID NO: 309867 - DNA, 25 bp, Mus musculus
aggcggccaacagacagaggttctc

SEQ ID NO: 309868 - DNA, 25 bp, Mus musculus
cctcgggagagacgcatccacactt

SEQ ID NO: 309869 - DNA, 25 bp, Mus musculus
cggccaacagacagaggttctccta

SEQ ID NO: 309870 - DNA, 25 bp, Mus musculus
atctgctggagccaccgacgccagg

SEQ ID NO: 309871 - DNA, 25 bp, Mus musculus
ccgcatccctggagtcggggcttag

SEQ ID NO: 309872 - DNA, 25 bp, Mus musculus
gctctgccgcatccctggagtcggg

SEQ ID NO: 309873 - DNA, 25 bp, Mus musculus
agccaccgacgccaggtggtcattt

SEQ ID NO: 309874 - DNA, 25 bp, Mus musculus
gaggagactgacctctgcctctgga

SEQ ID NO: 309875 - DNA, 25 bp, Mus musculus
tgccactcagttcggcgcagagcta

SEQ ID NO: 309876 - DNA, 25 bp, Mus musculus
ggccgcctagggacagtgtattcca

SEQ ID NO: 309877 - DNA, 25 bp, Mus musculus
cctgttttagggtatggagtgccac

SEQ ID NO: 309878 - DNA, 25 bp, Mus musculus
tatggagtgccacgccgtgtgccca

SEQ ID NO: 309879 - DNA, 25 bp, Mus musculus
tgtgcccagcacagtcgctcggata

SEQ ID NO: 309880 - DNA, 25 bp, Mus musculus
cacagtcgctcggatactgccgggc

SEQ ID NO: 309881 - DNA, 25 bp, Mus musculus
tgccctgagggccttgcccaagtaa

SEQ ID NO: 309882 - DNA, 25 bp, Mus musculus
ttgcccaagtaagtgatcgccgcgg

SEQ ID NO: 309883 - DNA, 25 bp, Mus musculus
gaattggtaattcccggagctcagg

SEQ ID NO: 309884 - DNA, 25 bp, Mus musculus
tgctccttcctagtgcctgttttag

SEQ ID NO: 309885 - DNA, 25 bp, Mus musculus
ggttttaattgctccttcctagtgc

SEQ ID NO: 309886 - DNA, 25 bp, Mus musculus
cgtcctgatttctgtgtcgcacttg

SEQ ID NO: 309887 - DNA, 25 bp, Mus musculus
ggagccgctcggctcgtcctgattt

SEQ ID NO: 309888 - DNA, 25 bp, Mus musculus
gtgtattccagagacttgcaaggtg

SEQ ID NO: 309889 - DNA, 25 bp, Mus musculus
ctgtgtcgcacttgtggttttaatt

SEQ ID NO: 309890 - DNA, 25 bp, Mus musculus
tcgcaagcttcagtcccggccaagt

SEQ ID NO: 309891 - DNA, 25 bp, Mus musculus
tggggcccaagctcgaattcctagt

SEQ ID NO: 309892 - DNA, 25 bp, Mus musculus
tcacacctgggcgagtggggcccaa

SEQ ID NO: 309893 - DNA, 25 bp, Mus musculus
taatcagccactgttcacacctggg

SEQ ID NO: 309894 - DNA, 25 bp, Mus musculus
gtcattttagagactagaccgccca

SEQ ID NO: 309895 - DNA, 25 bp, Mus musculus
gtcccgatgcgagaagggccagtct

SEQ ID NO: 309896 - DNA, 25 bp, Mus musculus
tttgcggctcctgcagcgtgcaagc

SEQ ID NO: 309897 - DNA, 25 bp, Mus musculus
ccagaacagctgacgtttgcggctc

SEQ ID NO: 309898 - DNA, 25 bp, Mus musculus
ggaccctctcggtttccagaacagc

SEQ ID NO: 309899 - DNA, 25 bp, Mus musculus
aagtaggcccttgctctcaaatgcg

SEQ ID NO: 309900 - DNA, 25 bp, Mus musculus
cggccgaactggagctcaactcgca

SEQ ID NO: 309901 - DNA, 25 bp, Mus musculus
cgaattcctagtgcagcaaacggtc

SEQ ID NO: 309902 - DNA, 25 bp, Mus musculus
cagcaaacggtctagcgtgcgtgcg

SEQ ID NO: 309903 - DNA, 25 bp, Mus musculus
ttgctctcaaatgcgcccgtatctc

SEQ ID NO: 309904 - DNA, 25 bp, Mus musculus
gaactgcgccgacctgtaacacagc

SEQ ID NO: 309905 - DNA, 25 bp, Mus musculus
gttgaccgcgctgggaaaccgagtc

SEQ ID NO: 309906 - DNA, 25 bp, Mus musculus
cgagtccagggccaggatttgtttt

SEQ ID NO: 309907 - DNA, 25 bp, Mus musculus
gatttgtttttccaaagccgcgcga

SEQ ID NO: 309908 - DNA, 25 bp, Mus musculus
ggcttcagatccgagttcccagttg

SEQ ID NO: 309909 - DNA, 25 bp, Mus musculus
agttcccagttgctcttcagtctcc

SEQ ID NO: 309910 - DNA, 25 bp, Mus musculus
ttccaaacgctatcaggagccacgc

SEQ ID NO: 309911 - DNA, 25 bp, Mus musculus
caggttaccgcaccaccggtcattt

SEQ ID NO: 309912 - DNA, 25 bp, Mus musculus
tgtttcttctaaaagttctccagcc

SEQ ID NO: 309913 - DNA, 25 bp, Mus musculus
gttctccagccaaatttcagcaatt

SEQ ID NO: 309914 - DNA, 25 bp, Mus musculus
ctcctcaggcctcatggggtagttt

SEQ ID NO: 309915 - DNA, 25 bp, Mus musculus
gtagtttggtcaggatctgcgcgcc

SEQ ID NO: 309916 - DNA, 25 bp, Mus musculus
ccctcgacgtgatcagaaccgtgtg

SEQ ID NO: 309917 - DNA, 25 bp, Mus musculus
cagaaccgtgtgctcgaactgcgcc

SEQ ID NO: 309918 - DNA, 25 bp, Mus musculus
gcgcacatcgcccttttttctgtgg

SEQ ID NO: 309919 - DNA, 25 bp, Mus musculus
acgcgctcggcccagtgccaggata

SEQ ID NO: 309920 - DNA, 25 bp, Mus musculus
gcatcggcgtctccgggagcacagc

SEQ ID NO: 309921 - DNA, 25 bp, Mus musculus
cagagaacggggcatcggcgtctcc

SEQ ID NO: 309922 - DNA, 25 bp, Mus musculus
agtttaccctggctgtgcgcgcccg

SEQ ID NO: 309923 - DNA, 25 bp, Mus musculus
cgcagtttaccctggctgtgcgcgc

SEQ ID NO: 309924 - DNA, 25 bp, Mus musculus
atcgcccttttttctgtggcctccg

SEQ ID NO: 309925 - DNA, 25 bp, Mus musculus
tcccacaggcactgacaggtccgga

SEQ ID NO: 309926 - DNA, 25 bp, Mus musculus
cggcgtcccacaggcactgacaggt

SEQ ID NO: 309927 - DNA, 25 bp, Mus musculus
aggcagactcaaggcggcgtcccac

SEQ ID NO: 309928 - DNA, 25 bp, Mus musculus
ctcccgaaggcagactcaaggcggc

SEQ ID NO: 309929 - DNA, 25 bp, Mus musculus
gtccgaatccccgagcggcggctga

SEQ ID NO: 309930 - DNA, 25 bp, Mus musculus
cctccctggcggacaccgctcttcc

SEQ ID NO: 309931 - DNA, 25 bp, Mus musculus
tcggcccagtgccaggataccgtgg

SEQ ID NO: 309932 - DNA, 25 bp, Mus musculus
tagcatatcttgtaagcagggtacc

SEQ ID NO: 309933 - DNA, 25 bp, Mus musculus
tgtgtcaccattccactagcatatc

SEQ ID NO: 309934 - DNA, 25 bp, Mus musculus
caagttttgtgtcaccattccacta

SEQ ID NO: 309935 - DNA, 25 bp, Mus musculus
gttttgtgtcaccattccactagca

SEQ ID NO: 309936 - DNA, 25 bp, Mus musculus
tggtaattcctacaagttttgtgtc

SEQ ID NO: 309937 - DNA, 25 bp, Mus musculus
tccactagcatatcttgtaagcagg

SEQ ID NO: 309938 - DNA, 25 bp, Mus musculus
tgcttggtaattcctacaagttttg

SEQ ID NO: 309939 - DNA, 25 bp, Mus musculus
gcatatcttgtaagcagggtacctt

SEQ ID NO: 309940 - DNA, 25 bp, Mus musculus
atcttgtaagcagggtacctttgta

SEQ ID NO: 309941 - DNA, 25 bp, Mus musculus
gtcaccattccactagcatatcttg

SEQ ID NO: 309942 - DNA, 25 bp, Mus musculus
aagatattgcttggtaattcctaca

SEQ ID NO: 309943 - DNA, 25 bp, Mus musculus
ggtttcctagtggactgtcagtcaa

SEQ ID NO: 309944 - DNA, 25 bp, Mus musculus
ccctctgtttcttaaactctttctg

SEQ ID NO: 309945 - DNA, 25 bp, Mus musculus
tcctacaagttttgtgtcaccattc

SEQ ID NO: 309946 - DNA, 25 bp, Mus musculus
ttcggtgccgaacaggatcgagtcc

SEQ ID NO: 309947 - DNA, 25 bp, Mus musculus
ccacgcattaaaggcacggcgccgg

SEQ ID NO: 309948 - DNA, 25 bp, Mus musculus
cacacattcgaacttgggccacatg

SEQ ID NO: 309949 - DNA, 25 bp, Mus musculus
tcgagtaccgcgtcttcctcagtga

SEQ ID NO: 309950 - DNA, 25 bp, Mus musculus
cccttagaaggtgcccggaggtgat

SEQ ID NO: 309951 - DNA, 25 bp, Mus musculus
tcctcaagaccttaattcggtgccg

SEQ ID NO: 309952 - DNA, 25 bp, Mus musculus
caccatgagcggcttcagcagcgag

SEQ ID NO: 309953 - DNA, 25 bp, Mus musculus
cccgcaagcctcaggagagtaacca

SEQ ID NO: 309954 - DNA, 25 bp, Mus musculus
cgggtcgcccattcattccagaacg

SEQ ID NO: 309955 - DNA, 25 bp, Mus musculus
gtaaccagcgttctgtcccagcgga

SEQ ID NO: 309956 - DNA, 25 bp, Mus musculus
ggaaaccactgagtcacccttagaa

SEQ ID NO: 309957 - DNA, 25 bp, Mus musculus
ccgaccgcctaagaggattgtcctc

SEQ ID NO: 309958 - DNA, 25 bp, Mus musculus
cggcggtgcatctccgacaccatga

SEQ ID NO: 309959 - DNA, 25 bp, Mus musculus
gccggctggaggacagagatttcct

SEQ ID NO: 309960 - DNA, 25 bp, Mus musculus
atgcggagagctgaagccacctccc

SEQ ID NO: 309961 - DNA, 25 bp, Mus musculus
gcaccaaggctctccgggatctagt

SEQ ID NO: 309962 - DNA, 25 bp, Mus musculus
ccgggatctagtgagacccgcttga

SEQ ID NO: 309963 - DNA, 25 bp, Mus musculus
aaagatgcggagagctgaagccacc

SEQ ID NO: 309964 - DNA, 25 bp, Mus musculus
tggtgggactcactgccacaaccca

SEQ ID NO: 309965 - DNA, 25 bp, Mus musculus
ccacggaaccggagagcaccaaggc

SEQ ID NO: 309966 - DNA, 25 bp, Mus musculus
tgccacaacccacggaaccggagag

SEQ ID NO: 309967 - DNA, 25 bp, Mus musculus
tgaaccttacgtcagagccgatctg

SEQ ID NO: 309968 - DNA, 25 bp, Mus musculus
agagccgatctgctggaaacccgac

SEQ ID NO: 309969 - DNA, 25 bp, Mus musculus
ctggaaacccgacggcatcttgttt

SEQ ID NO: 309970 - DNA, 25 bp, Mus musculus
aagaagaaaagactcaggcgctgca

SEQ ID NO: 309971 - DNA, 25 bp, Mus musculus
cccggcgttcggaagccgtgtgcaa

SEQ ID NO: 309972 - DNA, 25 bp, Mus musculus
ggtctggtgggactcactgccacaa

SEQ ID NO: 309973 - DNA, 25 bp, Mus musculus
ccggtatgctgaaccttacgtcaga

SEQ ID NO: 309974 - DNA, 25 bp, Mus musculus
cgtttccatggtgagacaagcgccc

SEQ ID NO: 309975 - DNA, 25 bp, Mus musculus
cgaagtcaccgtgccgctgtgagag

SEQ ID NO: 309976 - DNA, 25 bp, Mus musculus
caccgtgccgctgtgagagccacaa

SEQ ID NO: 309977 - DNA, 25 bp, Mus musculus
tgtgagagccacaagagcgtgtgcc

SEQ ID NO: 309978 - DNA, 25 bp, Mus musculus
ccagaagtggtccagacagacgctc

SEQ ID NO: 309979 - DNA, 25 bp, Mus musculus
tcgagacccggagcccgtttccatg

SEQ ID NO: 309980 - DNA, 25 bp, Mus musculus
ccttggaaaacatgtttaccagaca

SEQ ID NO: 309981 - DNA, 25 bp, Mus musculus
acatgtttaccagacacagccaacg

SEQ ID NO: 309982 - DNA, 25 bp, Mus musculus
acacagccaacgagacgtgctcctg

SEQ ID NO: 309983 - DNA, 25 bp, Mus musculus
agacgtgctcctggctcttggcaca

SEQ ID NO: 309984 - DNA, 25 bp, Mus musculus
cctggctcttggcacaagtgcgttc

SEQ ID NO: 309985 - DNA, 25 bp, Mus musculus
gcacaagtgcgttcctctgggcatg

SEQ ID NO: 309986 - DNA, 25 bp, Mus musculus
gttcctctgggcatgcgtttctgca

SEQ ID NO: 309987 - DNA, 25 bp, Mus musculus
tccagacagacgctcgagacccgga

SEQ ID NO: 309988 - DNA, 25 bp, Mus musculus
cctgcctgacgtcgccgtcccttcc

SEQ ID NO: 309989 - DNA, 25 bp, Mus musculus
acttcctgcctgacgtcgccgtccc

SEQ ID NO: 309990 - DNA, 25 bp, Mus musculus
accggccctgtgtgtgacctcactt

SEQ ID NO: 309991 - DNA, 25 bp, Mus musculus
ggaccggccctgtgtgtgacctcac

SEQ ID NO: 309992 - DNA, 25 bp, Mus musculus
gcccgtcaatcaccctgcggggcgg

SEQ ID NO: 309993 - DNA, 25 bp, Mus musculus
aggtcgcgcccgtcaatcaccctgc

SEQ ID NO: 309994 - DNA, 25 bp, Mus musculus
gcggcgtcaggtcgcgcccgtcaat

SEQ ID NO: 309995 - DNA, 25 bp, Mus musculus
agcggcgtcaggtcgcgcccgtcaa

SEQ ID NO: 309996 - DNA, 25 bp, Mus musculus
agcaggacctcgtgggccgcgtgct

SEQ ID NO: 309997 - DNA, 25 bp, Mus musculus
gaaaacctcgcagtagtggagcagg

SEQ ID NO: 309998 - DNA, 25 bp, Mus musculus
aggaaaacctcgcagtagtggagca

SEQ ID NO: 309999 - DNA, 25 bp, Mus musculus
tgcaggaaaacctcgcagtagtgga

SEQ ID NO: 310000 - DNA, 25 bp, Mus musculus
tcgcgctgcaccagccgggccgcgt

SEQ ID NO: 310001 - DNA, 25 bp, Mus musculus
cgtgcaggaaaacctcgcagtagtg

SEQ ID NO: 310002 - DNA, 25 bp, Mus musculus
cgtttacccgcgcttcattgaattt

SEQ ID NO: 310003 - DNA, 25 bp, Mus musculus
agggacagtgggaatctcgttcatc

SEQ ID NO: 310004 - DNA, 25 bp, Mus musculus
tttcgctggatagtaggtagggaca

SEQ ID NO: 310005 - DNA, 25 bp, Mus musculus
ctgtggtttcgctggatagtaggta

SEQ ID NO: 310006 - DNA, 25 bp, Mus musculus
cttggctgtggtttcgctggatagt

SEQ ID NO: 310007 - DNA, 25 bp, Mus musculus
gttcatccattcatgcgcgtcacta

SEQ ID NO: 310008 - DNA, 25 bp, Mus musculus
attcatgcgcgtcactaattagatg

SEQ ID NO: 310009 - DNA, 25 bp, Mus musculus
tgggaatctcgttcatccattcatg

SEQ ID NO: 310010 - DNA, 25 bp, Mus musculus
ttacccgcgcttcattgaatttctt

SEQ ID NO: 310011 - DNA, 25 bp, Mus musculus
gccaagcccgttcccttggctgtgg

SEQ ID NO: 310012 - DNA, 25 bp, Mus musculus
ggcatttggctaccttaagagagtc

SEQ ID NO: 310013 - DNA, 25 bp, Mus musculus
cgaggcatttggctaccttaagaga

SEQ ID NO: 310014 - DNA, 25 bp, Mus musculus
ctaattagatgacgaggcatttggc

SEQ ID NO: 310015 - DNA, 25 bp, Mus musculus
gatgacgaggcatttggctacctta

SEQ ID NO: 310016 - DNA, 25 bp, Mus musculus
tttctgaccgcgacctcagatcaga

SEQ ID NO: 310017 - DNA, 25 bp, Mus musculus
gagtgaacagggaagagcccagcgc

SEQ ID NO: 310018 - DNA, 25 bp, Mus musculus
ctcagtaacggcgagtgaacaggga

SEQ ID NO: 310019 - DNA, 25 bp, Mus musculus
ttccctcagtaacggcgagtgaaca

SEQ ID NO: 310020 - DNA, 25 bp, Mus musculus
aggattccctcagtaacggcgagtg

SEQ ID NO: 310021 - DNA, 25 bp, Mus musculus
accaggattccctcagtaacggcga

SEQ ID NO: 310022 - DNA, 25 bp, Mus musculus
gaaactaaccaggattccctcagta

SEQ ID NO: 310023 - DNA, 25 bp, Mus musculus
tgaccgcgacctcagatcagacgtg

SEQ ID NO: 310024 - DNA, 25 bp, Mus musculus
tcgtcctcccgtgccgccgggtgcc

SEQ ID NO: 310025 - DNA, 25 bp, Mus musculus
tctccgcttctccttcacccgggcg

SEQ ID NO: 310026 - DNA, 25 bp, Mus musculus
gtccgtgcgccgatgcgagtcaccc

SEQ ID NO: 310027 - DNA, 25 bp, Mus musculus
acccggcgtctgtgggctgtgcgtc

SEQ ID NO: 310028 - DNA, 25 bp, Mus musculus
ctgagacggttcgccggctcgtcct

SEQ ID NO: 310029 - DNA, 25 bp, Mus musculus
accgcgacctcagatcagacgtggc

SEQ ID NO: 310030 - DNA, 25 bp, Mus musculus
gcccacgccagctcacagaagaggt

SEQ ID NO: 310031 - DNA, 25 bp, Mus musculus
tctatggtgctgctgcgcagaaggc

SEQ ID NO: 310032 - DNA, 25 bp, Mus musculus
agctgcatgcggagctaagcccacg

SEQ ID NO: 310033 - DNA, 25 bp, Mus musculus
cgcacgttttggacccagctgcatg

SEQ ID NO: 310034 - DNA, 25 bp, Mus musculus
accagcatttcaatcgcacgttttg

SEQ ID NO: 310035 - DNA, 25 bp, Mus musculus
tggactggcagctctaccagcattt

SEQ ID NO: 310036 - DNA, 25 bp, Mus musculus
ccaggagcgtgtccagcactggtgt

SEQ ID NO: 310037 - DNA, 25 bp, Mus musculus
acctgacgcctgagagccaggagcg

SEQ ID NO: 310038 - DNA, 25 bp, Mus musculus
ttcaagctgaacgtgcgcagccaga

SEQ ID NO: 310039 - DNA, 25 bp, Mus musculus
gtgctcattgcagactacttcgatg

SEQ ID NO: 310040 - DNA, 25 bp, Mus musculus
tacttcgatgagtctatggtgctgc

SEQ ID NO: 310041 - DNA, 25 bp, Mus musculus
cagcgattccatctggtgctcattg

SEQ ID NO: 310042 - DNA, 25 bp, Mus musculus
gctgcgctggcagctagatgacgtc

SEQ ID NO: 310043 - DNA, 25 bp, Mus musculus
gatgacgtcgtgtccttcaagctga

SEQ ID NO: 310044 - DNA, 25 bp, Mus musculus
tcgcaaggcgtgtactggacgtcct

SEQ ID NO: 310045 - DNA, 25 bp, Mus musculus
agataccgtcctagttctgactata

SEQ ID NO: 310046 - DNA, 25 bp, Mus musculus
tcggagcgcgaggtaatgattaaga

SEQ ID NO: 310047 - DNA, 25 bp, Mus musculus
ttctccgccggtgctcttgactgag

SEQ ID NO: 310048 - DNA, 25 bp, Mus musculus
tgcctaccgaggttcttacgggtga

SEQ ID NO: 310049 - DNA, 25 bp, Mus musculus
gctctcgagcctggataatggtgca

SEQ ID NO: 310050 - DNA, 25 bp, Mus musculus
cgccttggtgactctggataacttt

SEQ ID NO: 310051 - DNA, 25 bp, Mus musculus
aactttgcggatcgcacggtctagc

SEQ ID NO: 310052 - DNA, 25 bp, Mus musculus
tctagcaccggcgacggatcattca

SEQ ID NO: 310053 - DNA, 25 bp, Mus musculus
ggatcattcaagtgtctgccctatc

SEQ ID NO: 310054 - DNA, 25 bp, Mus musculus
acgaacgactgcgaaagcatttgcc

SEQ ID NO: 310055 - DNA, 25 bp, Mus musculus
ttggatcggcgcaagacgaacgact

SEQ ID NO: 310056 - DNA, 25 bp, Mus musculus
tactgtgccgttagaggtgaaattc

SEQ ID NO: 310057 - DNA, 25 bp, Mus musculus
ctgactataaacgatgccaactagc

SEQ ID NO: 310058 - DNA, 25 bp, Mus musculus
cgtgcaacagacaccccgacaaccc

SEQ ID NO: 310059 - DNA, 25 bp, Mus musculus
ttttcctcccccagcgctttatgtg

SEQ ID NO: 310060 - DNA, 25 bp, Mus musculus
ccagcgctttatgtggcacacacag

SEQ ID NO: 310061 - DNA, 25 bp, Mus musculus
cagcgctttatgtggcacacacaga

SEQ ID NO: 310062 - DNA, 25 bp, Mus musculus
agcgctttatgtggcacacacagac

SEQ ID NO: 310063 - DNA, 25 bp, Mus musculus
ccgaccggccctcgtgcaacagaca

SEQ ID NO: 310064 - DNA, 25 bp, Mus musculus
cgaccggccctcgtgcaacagacac

SEQ ID NO: 310065 - DNA, 25 bp, Mus musculus
gaccggccctcgtgcaacagacacc

SEQ ID NO: 310066 - DNA, 25 bp, Mus musculus
accggccctcgtgcaacagacaccc

SEQ ID NO: 310067 - DNA, 25 bp, Mus musculus
ggccctcgtgcaacagacaccccga

SEQ ID NO: 310068 - DNA, 25 bp, Mus musculus
ccctcgtgcaacagacaccccgaca

SEQ ID NO: 310069 - DNA, 25 bp, Mus musculus
ctcgtgcaacagacaccccgacaac

SEQ ID NO: 310070 - DNA, 25 bp, Mus musculus
cccagcgctttatgtggcacacaca

SEQ ID NO: 310071 - DNA, 25 bp, Mus musculus
cctcgtgcaacagacaccccgacaa

SEQ ID NO: 310072 - DNA, 25 bp, Mus musculus
tttgctttactgtagggtcgccctc

SEQ ID NO: 310073 - DNA, 25 bp, Mus musculus
tgccctcgttagacgtgggaccgta

SEQ ID NO: 310074 - DNA, 25 bp, Mus musculus
ccctggcagtcagtggtctctctct

SEQ ID NO: 310075 - DNA, 25 bp, Mus musculus
ccggcatgatgagctgcaaaatgta

SEQ ID NO: 310076 - DNA, 25 bp, Mus musculus
atgagctcctatgcgggcgacaaca

SEQ ID NO: 310077 - DNA, 25 bp, Mus musculus
tcggccgattagctgaagccacaaa

SEQ ID NO: 310078 - DNA, 25 bp, Mus musculus
tccctcagtggcagatgagctccta

SEQ ID NO: 310079 - DNA, 25 bp, Mus musculus
ggcctgatagcgagcactgccatcc

SEQ ID NO: 310080 - DNA, 25 bp, Mus musculus
ggcgcgtcccgtcttttctgagaca

SEQ ID NO: 310081 - DNA, 25 bp, Mus musculus
ctcctttgggtgacttaaatctcta

SEQ ID NO: 310082 - DNA, 25 bp, Mus musculus
cctctgctgtgagagtgtcgcttca

SEQ ID NO: 310083 - DNA, 25 bp, Mus musculus
ggaccgcttttgtctggaaccagtc

SEQ ID NO: 310084 - DNA, 25 bp, Mus musculus
gggaccgtacttgtggcctctaatc

SEQ ID NO: 310085 - DNA, 25 bp, Mus musculus
cctgcaactgctgggcttttcaatg

SEQ ID NO: 310086 - DNA, 25 bp, Mus musculus
ggggtttgcgcctttcatgcttggc

SEQ ID NO: 310087 - DNA, 25 bp, Mus musculus
cgcgctacagccctacgaggtcagg

SEQ ID NO: 310088 - DNA, 25 bp, Mus musculus
tcctggtgctaagtgcgcgccagca

SEQ ID NO: 310089 - DNA, 25 bp, Mus musculus
tgctaagtgcgcgccagcaggaccc

SEQ ID NO: 310090 - DNA, 25 bp, Mus musculus
gtcctcctaacgcagagccttccta

SEQ ID NO: 310091 - DNA, 25 bp, Mus musculus
ttgcgcctttcatgcttggccagcc

SEQ ID NO: 310092 - DNA, 25 bp, Mus musculus
cgtccagcctgtcggccgtccctgt

SEQ ID NO: 310093 - DNA, 25 bp, Mus musculus
tccctgtgcagtcgcgcaggggtcc

SEQ ID NO: 310094 - DNA, 25 bp, Mus musculus
caggggtcccgatgcctgggcctca

SEQ ID NO: 310095 - DNA, 25 bp, Mus musculus
cgaagcgcgctcgagagggccatct

SEQ ID NO: 310096 - DNA, 25 bp, Mus musculus
gcgcgctcgagagggccatctgcct

SEQ ID NO: 310097 - DNA, 25 bp, Mus musculus
ccatctgcctgggtgtggagaactg

SEQ ID NO: 310098 - DNA, 25 bp, Mus musculus
atctgcctgggtgtggagaactgca

SEQ ID NO: 310099 - DNA, 25 bp, Mus musculus
catgcttggccagcccgtccagcct

SEQ ID NO: 310100 - DNA, 25 bp, Mus musculus
tttgccgcgtgcgtgtgctcgcgga

SEQ ID NO: 310101 - DNA, 25 bp, Mus musculus
cgtgtgctcgcggacgggttttgtc

SEQ ID NO: 310102 - DNA, 25 bp, Mus musculus
cggctctcccgatgccgaggggttc

SEQ ID NO: 310103 - DNA, 25 bp, Mus musculus
tctcccgatgccgaggggttcggga

SEQ ID NO: 310104 - DNA, 25 bp, Mus musculus
tctcgccggtgtcgcgcttctcttt

SEQ ID NO: 310105 - DNA, 25 bp, Mus musculus
tgccgaggggttcgggatttgtgcc

SEQ ID NO: 310106 - DNA, 25 bp, Mus musculus
cgctcgggttggctttgccgcgtgc

SEQ ID NO: 310107 - DNA, 25 bp, Mus musculus
tccggctctcccgatgccgaggggt

SEQ ID NO: 310108 - DNA, 25 bp, Mus musculus
ggtgcggtcgacgttccggctctcc

SEQ ID NO: 310109 - DNA, 25 bp, Mus musculus
ccggtgcggtcgacgttccggctct

SEQ ID NO: 310110 - DNA, 25 bp, Mus musculus
gtcgcgcttctctttccgccaaccc

SEQ ID NO: 310111 - DNA, 25 bp, Mus musculus
ggtgtcgcgcttctctttccgccaa

SEQ ID NO: 310112 - DNA, 25 bp, Mus musculus
tgtctcgccggtgtcgcgcttctct

SEQ ID NO: 310113 - DNA, 25 bp, Mus musculus
taagagaggtgtcggagagctgtcc

SEQ ID NO: 310114 - DNA, 25 bp, Mus musculus
ggccttcagtcagcgcccggcaggt

SEQ ID NO: 310115 - DNA, 25 bp, Mus musculus
gggtgatgtcagcttccgggagccg

SEQ ID NO: 310116 - DNA, 25 bp, Mus musculus
gacatgtggtcgtttggcacgaacg

SEQ ID NO: 310117 - DNA, 25 bp, Mus musculus
cgacatgtggtcgtttggcacgaac

SEQ ID NO: 310118 - DNA, 25 bp, Mus musculus
tggtcgtttggcacgaacggttctg

SEQ ID NO: 310119 - DNA, 25 bp, Mus musculus
ggtcgtttggcacgaacggttctga

SEQ ID NO: 310120 - DNA, 25 bp, Mus musculus
cgtttggcacgaacggttctgagcc

SEQ ID NO: 310121 - DNA, 25 bp, Mus musculus
ttggcacgaacggttctgagccatg

SEQ ID NO: 310122 - DNA, 25 bp, Mus musculus
ggcacgaacggttctgagccatgtc

SEQ ID NO: 310123 - DNA, 25 bp, Mus musculus
cacgaacggttctgagccatgtccc

SEQ ID NO: 310124 - DNA, 25 bp, Mus musculus
gccatgtccccagagtagtcgcacg

SEQ ID NO: 310125 - DNA, 25 bp, Mus musculus
agagtagtcgcacggcgacccccaa

SEQ ID NO: 310126 - DNA, 25 bp, Mus musculus
catgtggtcgtttggcacgaacggt

SEQ ID NO: 310127 - DNA, 25 bp, Mus musculus
caatacccgggccttcagtcagcgc

SEQ ID NO: 310128 - DNA, 25 bp, Mus musculus
acaggcggaagtcatggccacgatg

SEQ ID NO: 310129 - DNA, 25 bp, Mus musculus
tggtgagcggcgtgggtgatgtcat

SEQ ID NO: 310130 - DNA, 25 bp, Mus musculus
cccaccctgcgacgttacttcctgt

SEQ ID NO: 310131 - DNA, 25 bp, Mus musculus
ggcctgtgacggatgggcggggcag

SEQ ID NO: 310132 - DNA, 25 bp, Mus musculus
cacgatggcgggacaggtagtgggt

SEQ ID NO: 310133 - DNA, 25 bp, Mus musculus
catggccacgatggcgggacaggta

SEQ ID NO: 310134 - DNA, 25 bp, Mus musculus
acgcccatggtgaggacagtgggga

SEQ ID NO: 310135 - DNA, 25 bp, Mus musculus
tgcgacgttacttcctgtctctcct

SEQ ID NO: 310136 - DNA, 25 bp, Mus musculus
aagtcatggccacgatggcgggaca

SEQ ID NO: 310137 - DNA, 25 bp, Mus musculus
cacaggcggaagtcatggccacgat

SEQ ID NO: 310138 - DNA, 25 bp, Mus musculus
ccacaggcggaagtcatggccacga

SEQ ID NO: 310139 - DNA, 25 bp, Mus musculus
cccacaggcggaagtcatggccacg

SEQ ID NO: 310140 - DNA, 25 bp, Mus musculus
cgacgttacttcctgtctctcctcc

SEQ ID NO: 310141 - DNA, 25 bp, Mus musculus
cggcgacgcccatggtgaggacagt

SEQ ID NO: 310142 - DNA, 25 bp, Mus musculus
ttcgagacgcccgacgtcgtcgctg

SEQ ID NO: 310143 - DNA, 25 bp, Mus musculus
gggcttggcgagtgacatcatcccg

SEQ ID NO: 310144 - DNA, 25 bp, Mus musculus
gagcctcgtgtgtgcttcctgtcag

SEQ ID NO: 310145 - DNA, 25 bp, Mus musculus
ccgtgttcgagacgcccgacgtcgt

SEQ ID NO: 310146 - DNA, 25 bp, Mus musculus
tcaccgtgttcgagacgcccgacgt

SEQ ID NO: 310147 - DNA, 25 bp, Mus musculus
cgaggtcaccgtgttcgagacgccc

SEQ ID NO: 310148 - DNA, 25 bp, Mus musculus
gcagcgaggtcaccgtgttcgagac

SEQ ID NO: 310149 - DNA, 25 bp, Mus musculus
cgctggcccgcatggccgcccggct

SEQ ID NO: 310150 - DNA, 25 bp, Mus musculus
tgacctcaccggagacaggaagtga

SEQ ID NO: 310151 - DNA, 25 bp, Mus musculus
ggaagtgacctcaccggagacagga

SEQ ID NO: 310152 - DNA, 25 bp, Mus musculus
caggcctgcggaacaggaagtgacc

SEQ ID NO: 310153 - DNA, 25 bp, Mus musculus
cacacgccaggcctgcggaacagga

SEQ ID NO: 310154 - DNA, 25 bp, Mus musculus
tacccgggcagcgaggtcaccgtgt

SEQ ID NO: 310155 - DNA, 25 bp, Mus musculus
cttcctgtcaggtgggcgcggtgca

SEQ ID NO: 310156 - DNA, 25 bp, Mus musculus
tctcccgcagcgagcatctagacgt

SEQ ID NO: 310157 - DNA, 25 bp, Mus musculus
gccgggaagaatgcagcagccgcca

SEQ ID NO: 310158 - DNA, 25 bp, Mus musculus
aagaatgcagcagccgccaaaccct

SEQ ID NO: 310159 - DNA, 25 bp, Mus musculus
gcgcgtcgcagtgactcagccgcta

SEQ ID NO: 310160 - DNA, 25 bp, Mus musculus
gtgactcagccgctaccaggaagga

SEQ ID NO: 310161 - DNA, 25 bp, Mus musculus
atctagacgtccagggcgggactcc

SEQ ID NO: 310162 - DNA, 25 bp, Mus musculus
cgctaccaggaaggaggagtgctcc

SEQ ID NO: 310163 - DNA, 25 bp, Mus musculus
aggaggagtgctcccaaactctgcg

SEQ ID NO: 310164 - DNA, 25 bp, Mus musculus
ggagtgctcccaaactctgcgacgc

SEQ ID NO: 310165 - DNA, 25 bp, Mus musculus
tagggcgccaagtctcccgcagcga

SEQ ID NO: 310166 - DNA, 25 bp, Mus musculus
gcctaccggctcaggtaagccggga

SEQ ID NO: 310167 - DNA, 25 bp, Mus musculus
cagcgagcatctagacgtccagggc

SEQ ID NO: 310168 - DNA, 25 bp, Mus musculus
caggtaagccgggaagaatgcagca

SEQ ID NO: 310169 - DNA, 25 bp, Mus musculus
agcctgacctccgaggctctagggc

SEQ ID NO: 310170 - DNA, 25 bp, Mus musculus
tcggtgccacttcccgctcatgtgg

SEQ ID NO: 310171 - DNA, 25 bp, Mus musculus
gaagtcgtcggtgccacttcccgct

SEQ ID NO: 310172 - DNA, 25 bp, Mus musculus
gggtggctttctaagccacccactc

SEQ ID NO: 310173 - DNA, 25 bp, Mus musculus
actccgtgctcatctctgcagcctc

SEQ ID NO: 310174 - DNA, 25 bp, Mus musculus
ctgcagcctctcctgccgctcgggg

SEQ ID NO: 310175 - DNA, 25 bp, Mus musculus
gtcatcgggatgatgcggacgcagt

SEQ ID NO: 310176 - DNA, 25 bp, Mus musculus
ggctgcgcacgttcgtggccttcgc

SEQ ID NO: 310177 - DNA, 25 bp, Mus musculus
gtggccttcgccgccaagctctgga

SEQ ID NO: 310178 - DNA, 25 bp, Mus musculus
aagctctggagcttctttatttacc

SEQ ID NO: 310179 - DNA, 25 bp, Mus musculus
tttatttaccttttgcggaggcaga

SEQ ID NO: 310180 - DNA, 25 bp, Mus musculus
ttaccttttgcggaggcagatccgc

SEQ ID NO: 310181 - DNA, 25 bp, Mus musculus
aggcagatccgcacggtgagtttgc

SEQ ID NO: 310182 - DNA, 25 bp, Mus musculus
atccgcacggtgagtttgcttgggt

SEQ ID NO: 310183 - DNA, 25 bp, Mus musculus
tgcagcccacgcgaagtcgtcggtg

SEQ ID NO: 310184 - DNA, 25 bp, Mus musculus
tcaaacatggagagagcgccgtcac

SEQ ID NO: 310185 - DNA, 25 bp, Mus musculus
gccaggtacttgtccacgttgaaga

SEQ ID NO: 310186 - DNA, 25 bp, Mus musculus
tagaagaactcgagctcaaacatgg

SEQ ID NO: 310187 - DNA, 25 bp, Mus musculus
acgaggtcgagcacctggcgtgcaa

SEQ ID NO: 310188 - DNA, 25 bp, Mus musculus
ccaggtccatgcaacggaaccagta

SEQ ID NO: 310189 - DNA, 25 bp, Mus musculus
tcagaggtcaccctggaggtcacag

SEQ ID NO: 310190 - DNA, 25 bp, Mus musculus
ctcacattggggaggtaggatcaga

SEQ ID NO: 310191 - DNA, 25 bp, Mus musculus
cccaaggcaacctgagctcacattg

SEQ ID NO: 310192 - DNA, 25 bp, Mus musculus
aggggtcacacccaaggcaacctga

SEQ ID NO: 310193 - DNA, 25 bp, Mus musculus
cctaccagggttgcccgtgatgtca

SEQ ID NO: 310194 - DNA, 25 bp, Mus musculus
tcacatggggtcacgcacagggcca

SEQ ID NO: 310195 - DNA, 25 bp, Mus musculus
aggccgcactgcttcaggtcgcgca

SEQ ID NO: 310196 - DNA, 25 bp, Mus musculus
tgaagaaggcgtcgaagaactcacc

SEQ ID NO: 310197 - DNA, 25 bp, Mus musculus
cccacagggtcagaggttgcccatg

SEQ ID NO: 310198 - DNA, 25 bp, Mus musculus
gccgccatggccgtcagaccacgcc

SEQ ID NO: 310199 - DNA, 25 bp, Mus musculus
cgcagttcaggccaaggtgccactt

SEQ ID NO: 310200 - DNA, 25 bp, Mus musculus
ttcaggccaaggtgccacttccctg

SEQ ID NO: 310201 - DNA, 25 bp, Mus musculus
cgcgcccaacgccagggccggccac

SEQ ID NO: 310202 - DNA, 25 bp, Mus musculus
gccgcgccacggtcacgcccaccgt

SEQ ID NO: 310203 - DNA, 25 bp, Mus musculus
ctgccgttgcgcatcaggaagcagt

SEQ ID NO: 310204 - DNA, 25 bp, Mus musculus
tgacgctgccgttgcgcatcaggaa

SEQ ID NO: 310205 - DNA, 25 bp, Mus musculus
agcagctcggtgacgcccgcgagac

SEQ ID NO: 310206 - DNA, 25 bp, Mus musculus
gcgcagtctcccatgaggccgagcg

SEQ ID NO: 310207 - DNA, 25 bp, Mus musculus
aggtcggacgccgtctcgcagttca

SEQ ID NO: 310208 - DNA, 25 bp, Mus musculus
agtctcccatgaggccgagcggcag

SEQ ID NO: 310209 - DNA, 25 bp, Mus musculus
cgtctcgcagttcaggccaaggtgc

SEQ ID NO: 310210 - DNA, 25 bp, Mus musculus
cccacccgcttctgggagggcgacg

SEQ ID NO: 310211 - DNA, 25 bp, Mus musculus
tgcaggaagtcctcggcctcgcgca

SEQ ID NO: 310212 - DNA, 25 bp, Mus musculus
aggtcgaccaactcaccactcggtg

SEQ ID NO: 310213 - DNA, 25 bp, Mus musculus
atactgacgctgcaattcggggccc

SEQ ID NO: 310214 - DNA, 25 bp, Mus musculus
gcggtctggacattgcccattgatt

SEQ ID NO: 310215 - DNA, 25 bp, Mus musculus
atcggggccagacacttatctctta

SEQ ID NO: 310216 - DNA, 25 bp, Mus musculus
cccagccgcggtttttcaatgcttt

SEQ ID NO: 310217 - DNA, 25 bp, Mus musculus
aggtatcgatcagtgcgggtttccc

SEQ ID NO: 310218 - DNA, 25 bp, Mus musculus
gggtttcccgcgcataaagcgagca

SEQ ID NO: 310219 - DNA, 25 bp, Mus musculus
gggtgcaacactcgctccggcaata

SEQ ID NO: 310220 - DNA, 25 bp, Mus musculus
tgctgaggctgtcgacccaatacaa

SEQ ID NO: 310221 - DNA, 25 bp, Mus musculus
cgcttcggagtcttttgcaaacgca

SEQ ID NO: 310222 - DNA, 25 bp, Mus musculus
agcccgctggtgacttccagtcgaa

SEQ ID NO: 310223 - DNA, 25 bp, Mus musculus
atgtcattgcgatacaggccgccta

SEQ ID NO: 310224 - DNA, 25 bp, Mus musculus
gcgtgggcttctgacttacccaata

SEQ ID NO: 310225 - DNA, 25 bp, Mus musculus
gcaaaatcccttcacggcggctgga

SEQ ID NO: 310226 - DNA, 25 bp, Mus musculus
gcgcgagttcgtttttgacatgcaa

SEQ ID NO: 310227 - DNA, 25 bp, Mus musculus
ggagaaccgacctagtgccaccttc

SEQ ID NO: 310228 - DNA, 25 bp, Mus musculus
agagtcgctccaccctcagaacgga

SEQ ID NO: 310229 - DNA, 25 bp, Mus musculus
atcgaattttcacctcggcgccgcg

SEQ ID NO: 310230 - DNA, 25 bp, Mus musculus
gcgactttggcaaataggccttttc

SEQ ID NO: 310231 - DNA, 25 bp, Mus musculus
gcagccatttctgccggggcaccga

SEQ ID NO: 310232 - DNA, 25 bp, Mus musculus
tcgtgacgcgcgctgaaattttctc

SEQ ID NO: 310233 - DNA, 25 bp, Mus musculus
cgagccgtttttgccggcagaccga

SEQ ID NO: 310234 - DNA, 25 bp, Mus musculus
ctagaggtacctcgcgttaagcgtc

SEQ ID NO: 310235 - DNA, 25 bp, Mus musculus
acgcgcctctcccacatagtaagga

SEQ ID NO: 310236 - DNA, 25 bp, Mus musculus
gactttcgccttttgcgctcttaca

SEQ ID NO: 310237 - DNA, 25 bp, Mus musculus
cgggcccgatcttcgaccgaagcta

SEQ ID NO: 310238 - DNA, 25 bp, Mus musculus
agttggaagagtcgcgctacgctaa

SEQ ID NO: 310239 - DNA, 25 bp, Mus musculus
gcgcctccctcatagtaaggaccga

SEQ ID NO: 310240 - DNA, 25 bp, Mus musculus
agctggtggctggtatcctaaacta

SEQ ID NO: 310241 - DNA, 25 bp, Mus musculus
ctccggcacaaacaaacgactgggt

SEQ ID NO: 310242 - DNA, 25 bp, Mus musculus
acaagccactttggaggaatgtccc

SEQ ID NO: 310243 - DNA, 25 bp, Mus musculus
aaactcgcgtatgtcccgtgccata

SEQ ID NO: 310244 - DNA, 25 bp, Mus musculus
gaccagggtctcgaaggcactgaca

SEQ ID NO: 310245 - DNA, 25 bp, Mus musculus
tctagcgaaatgtgcgaccagggtc

SEQ ID NO: 310246 - DNA, 25 bp, Mus musculus
ggcgggagaccagtgacaaaatcta

SEQ ID NO: 310247 - DNA, 25 bp, Mus musculus
gtagccttcgagaaccggtccacta

SEQ ID NO: 310248 - DNA, 25 bp, Mus musculus
ggcttacagtcgctcccaataaatg

SEQ ID NO: 310249 - DNA, 25 bp, Mus musculus
attggccctctctgtttgtccgtta

SEQ ID NO: 310250 - DNA, 25 bp, Mus musculus
acatacgctcgagatcttgattggc

SEQ ID NO: 310251 - DNA, 25 bp, Mus musculus
ctgctgactccaagaggcgggattt

SEQ ID NO: 310252 - DNA, 25 bp, Mus musculus
ccgtagccgacactggtaatgaatt

SEQ ID NO: 310253 - DNA, 25 bp, Mus musculus
ttgtgtgcgtactccacccatggga

SEQ ID NO: 310254 - DNA, 25 bp, Mus musculus
cgtcagcctccaggctttgtacgcg

SEQ ID NO: 310255 - DNA, 25 bp, Mus musculus
ccgccaagtcttggagcctggaggg

SEQ ID NO: 310256 - DNA, 25 bp, Mus musculus
ccaggctttgtacgcgagctccggg

SEQ ID NO: 310257 - DNA, 25 bp, Mus musculus
gtccgcgtcagcctccaggctttgt

SEQ ID NO: 310258 - DNA, 25 bp, Mus musculus
cgcgtcagcctccaggctttgtacg

SEQ ID NO: 310259 - DNA, 25 bp, Mus musculus
tcagcctccaggctttgtacgcgag

SEQ ID NO: 310260 - DNA, 25 bp, Mus musculus
cagcctccaggctttgtacgcgagc

SEQ ID NO: 310261 - DNA, 25 bp, Mus musculus
agcctccaggctttgtacgcgagct

SEQ ID NO: 310262 - DNA, 25 bp, Mus musculus
gcctccaggctttgtacgcgagctc

SEQ ID NO: 310263 - DNA, 25 bp, Mus musculus
ctccaggctttgtacgcgagctccg

SEQ ID NO: 310264 - DNA, 25 bp, Mus musculus
tccaggctttgtacgcgagctccgg

SEQ ID NO: 310265 - DNA, 25 bp, Mus musculus
gctttgtacgcgagctccgggatct

SEQ ID NO: 310266 - DNA, 25 bp, Mus musculus
ccagcccgccaagtcttggagcctg

SEQ ID NO: 310267 - DNA, 25 bp, Mus musculus
tccgcgtcagcctccaggctttgta

SEQ ID NO: 310268 - DNA, 25 bp, Mus musculus
ggaggccggacacgggcccgagcac

SEQ ID NO: 310269 - DNA, 25 bp, Mus musculus
ccaggaggccggacacgggcccgag

SEQ ID NO: 310270 - DNA, 25 bp, Mus musculus
aggaggccggacacgggcccgagca

SEQ ID NO: 310271 - DNA, 25 bp, Mus musculus
caggaggccggacacgggcccgagc

SEQ ID NO: 310272 - DNA, 25 bp, Mus musculus
gccaggaggccggacacgggcccga

SEQ ID NO: 310273 - DNA, 25 bp, Mus musculus
gagagccggaacgtcgaccgcaccg

SEQ ID NO: 310274 - DNA, 25 bp, Mus musculus
ggagagccggaacgtcgaccgcacc

SEQ ID NO: 310275 - DNA, 25 bp, Mus musculus
ccgacaaaacccgtccgcgagcaca

SEQ ID NO: 310276 - DNA, 25 bp, Mus musculus
cgacaaaacccgtccgcgagcacac

SEQ ID NO: 310277 - DNA, 25 bp, Mus musculus
gacaaaacccgtccgcgagcacacg

SEQ ID NO: 310278 - DNA, 25 bp, Mus musculus
cgcacgcggcaaagccaacccgagc

SEQ ID NO: 310279 - DNA, 25 bp, Mus musculus
gcacgcggcaaagccaacccgagcg

SEQ ID NO: 310280 - DNA, 25 bp, Mus musculus
ggacagctctccgacacctctctta

SEQ ID NO: 310281 - DNA, 25 bp, Mus musculus
aaagagaagcgcgacaccggcgaga

SEQ ID NO: 310282 - DNA, 25 bp, Mus musculus
ccctcggcatcgggagagccggaac

SEQ ID NO: 310283 - DNA, 25 bp, Mus musculus
agagccggaacgtcgaccgcaccgg

SEQ ID NO: 310284 - DNA, 25 bp, Mus musculus
aagagaagcgcgacaccggcgagac

SEQ ID NO: 310285 - DNA, 25 bp, Mus musculus
agagaagcgcgacaccggcgagaca

SEQ ID NO: 310286 - DNA, 25 bp, Mus musculus
ggcacaaatcccgaacccctcggca

SEQ ID NO: 310287 - DNA, 25 bp, Mus musculus
atgaatagggaagtggcgcaaattc

SEQ ID NO: 310288 - DNA, 25 bp, Mus musculus
cgctccgccaagtctgttcgtcgaa

SEQ ID NO: 310289 - DNA, 25 bp, Mus musculus
agtctgttcgtcgaagccgcctccg

SEQ ID NO: 310290 - DNA, 25 bp, Mus musculus
ccagcccggttctcgggagaatgaa

SEQ ID NO: 310291 - DNA, 25 bp, Mus musculus
ctcgggagaatgaagttcgtgtaca

SEQ ID NO: 310292 - DNA, 25 bp, Mus musculus
tcgtgtacaaagaggagcatccgtt

SEQ ID NO: 310293 - DNA, 25 bp, Mus musculus
agcatccgttcgagaagcgccgctc

SEQ ID NO: 310294 - DNA, 25 bp, Mus musculus
cgctctgagggcgagaaaatccgaa

SEQ ID NO: 310295 - DNA, 25 bp, Mus musculus
tcccggtaaggacagtagccagggc

SEQ ID NO: 310296 - DNA, 25 bp, Mus musculus
cgcaaattcgtggatcgctccgcca

SEQ ID NO: 310297 - DNA, 25 bp, Mus musculus
caagctgagctagtggcgtatgtta

SEQ ID NO: 310298 - DNA, 25 bp, Mus musculus
accaggctacgggttgcgctagcaa

SEQ ID NO: 310299 - DNA, 25 bp, Mus musculus
tgaaggcgtaagaggaccaggctac

SEQ ID NO: 310300 - DNA, 25 bp, Mus musculus
ccaggctagcgtcgctgacgctgtc

SEQ ID NO: 310301 - DNA, 25 bp, Mus musculus
tttgttttgtctctggtgctccacc

SEQ ID NO: 310302 - DNA, 25 bp, Mus musculus
caggggaaatcagctcgggtctctg

SEQ ID NO: 310303 - DNA, 25 bp, Mus musculus
aaattaggatgcaggggaaatcagc

SEQ ID NO: 310304 - DNA, 25 bp, Mus musculus
cccagggaactttttgcataatgag

SEQ ID NO: 310305 - DNA, 25 bp, Mus musculus
ggtgtggcttcctcagtggcgtccc

SEQ ID NO: 310306 - DNA, 25 bp, Mus musculus
tctctgactctttgaattgattttt

SEQ ID NO: 310307 - DNA, 25 bp, Mus musculus
ctctggtgctccaccatttaaatga

SEQ ID NO: 310308 - DNA, 25 bp, Mus musculus
taaactcgtgcaggattaaattagg

SEQ ID NO: 310309 - DNA, 25 bp, Mus musculus
ctcgtgcaggattaaattaggatgc

SEQ ID NO: 310310 - DNA, 25 bp, Mus musculus
aaatgaggcgctcaggtaactcaga

SEQ ID NO: 310311 - DNA, 25 bp, Mus musculus
tcagagattttaactaggacccagg

SEQ ID NO: 310312 - DNA, 25 bp, Mus musculus
taggacccagggaactttttgcata

SEQ ID NO: 310313 - DNA, 25 bp, Mus musculus
actttttgcataatgaggcacacag

SEQ ID NO: 310314 - DNA, 25 bp, Mus musculus
cctctctctgactctttgaattgat

SEQ ID NO: 310315 - DNA, 25 bp, Mus musculus
ccgcttctacgtgtgtgctttcgtg

SEQ ID NO: 310316 - DNA, 25 bp, Mus musculus
tgtgtgctttcgtgggtgacatcac

SEQ ID NO: 310317 - DNA, 25 bp, Mus musculus
acgtgtgtgctttcgtgggtgacat

SEQ ID NO: 310318 - DNA, 25 bp, Mus musculus
cgcttctacgtgtgtgctttcgtgg

SEQ ID NO: 310319 - DNA, 25 bp, Mus musculus
gtgctttcgtgggtgacatcactgt

SEQ ID NO: 310320 - DNA, 25 bp, Mus musculus
gtccgcttctacgtgtgtgctttcg

SEQ ID NO: 310321 - DNA, 25 bp, Mus musculus
cgtccgcttctacgtgtgtgctttc

SEQ ID NO: 310322 - DNA, 25 bp, Mus musculus
ggcgtccgcttctacgtgtgtgctt

SEQ ID NO: 310323 - DNA, 25 bp, Mus musculus
gtcttgggactgagtcacactggga

SEQ ID NO: 310324 - DNA, 25 bp, Mus musculus
gcgtcttgggactgagtcacactgg

SEQ ID NO: 310325 - DNA, 25 bp, Mus musculus
cggcgtcttgggactgagtcacact

SEQ ID NO: 310326 - DNA, 25 bp, Mus musculus
tgctttcgtgggtgacatcactgtg

SEQ ID NO: 310327 - DNA, 25 bp, Mus musculus
tttcgtgggtgacatcactgtgggc

SEQ ID NO: 310328 - DNA, 25 bp, Mus musculus
ttctacgtgtgtgctttcgtgggtg

SEQ ID NO: 310329 - DNA, 25 bp, Mus musculus
gcccagagcgcacaacgccctcctt

SEQ ID NO: 310330 - DNA, 25 bp, Mus musculus
cccgtgtggaagtaagacacaacgt

SEQ ID NO: 310331 - DNA, 25 bp, Mus musculus
gagggtgcgcccttgaaccacagcc

SEQ ID NO: 310332 - DNA, 25 bp, Mus musculus
ccctggagagggtgcgcccttgaac

SEQ ID NO: 310333 - DNA, 25 bp, Mus musculus
gcgcgcaccctgattggcggccaga

SEQ ID NO: 310334 - DNA, 25 bp, Mus musculus
gcgctgggccagaagctagggcctt

SEQ ID NO: 310335 - DNA, 25 bp, Mus musculus
aagacacaacgtggcggcccgcaga

SEQ ID NO: 310336 - DNA, 25 bp, Mus musculus
gcgcctgcttctgacctcacgctaa

SEQ ID NO: 310337 - DNA, 25 bp, Mus musculus
agtaagacacaacgtggcggcccgc

SEQ ID NO: 310338 - DNA, 25 bp, Mus musculus
ttagcttcctggcaatgcggtggcg

SEQ ID NO: 310339 - DNA, 25 bp, Mus musculus
tgcagctttagcttcctggcaatgc

SEQ ID NO: 310340 - DNA, 25 bp, Mus musculus
tccttcctgcagctttagcttcctg

SEQ ID NO: 310341 - DNA, 25 bp, Mus musculus
cgcagacgctgacaggcccagagcg

SEQ ID NO: 310342 - DNA, 25 bp, Mus musculus
ccgccctagagcgacttccgcgccc

SEQ ID NO: 310343 - DNA, 25 bp, Mus musculus
atacattgaggtgatgccgcgcacc

SEQ ID NO: 310344 - DNA, 25 bp, Mus musculus
aagccggagtaggacagccaagccc

SEQ ID NO: 310345 - DNA, 25 bp, Mus musculus
gagcaagccggagtaggacagccaa

SEQ ID NO: 310346 - DNA, 25 bp, Mus musculus
agcctctgtggcacggtgtggcctc

SEQ ID NO: 310347 - DNA, 25 bp, Mus musculus
tctgcagcctctgtggcacggtgtg

SEQ ID NO: 310348 - DNA, 25 bp, Mus musculus
tcgggccgtgtagtaacagggcaga

SEQ ID NO: 310349 - DNA, 25 bp, Mus musculus
tacccgatacattgaggtgatgccg

SEQ ID NO: 310350 - DNA, 25 bp, Mus musculus
tgcggaggcgactacccgatacatt

SEQ ID NO: 310351 - DNA, 25 bp, Mus musculus
atagcaacacaccagaggctgctca

SEQ ID NO: 310352 - DNA, 25 bp, Mus musculus
gccgatagcaacacaccagaggctg

SEQ ID NO: 310353 - DNA, 25 bp, Mus musculus
tccagccgatagcaacacaccagag

SEQ ID NO: 310354 - DNA, 25 bp, Mus musculus
ctggctcatgccctccagccgatag

SEQ ID NO: 310355 - DNA, 25 bp, Mus musculus
tggcagtagctgtggctgtgacggt

SEQ ID NO: 310356 - DNA, 25 bp, Mus musculus
cattgaggtgatgccgcgcaccctg

SEQ ID NO: 310357 - DNA, 25 bp, Mus musculus
ccaagagccctcacatggtgacata

SEQ ID NO: 310358 - DNA, 25 bp, Mus musculus
ctgatcccacctgacgtctacttga

SEQ ID NO: 310359 - DNA, 25 bp, Mus musculus
atagagcccagtgtgacccatgacc

SEQ ID NO: 310360 - DNA, 25 bp, Mus musculus
ccttgacctctgatgaccctatgta

SEQ ID NO: 310361 - DNA, 25 bp, Mus musculus
tgaccttgtgtgacctccattgacc

SEQ ID NO: 310362 - DNA, 25 bp, Mus musculus
tgtgtgacctcagacccatgtgacc

SEQ ID NO: 310363 - DNA, 25 bp, Mus musculus
cctaacgccatgtgacctcacgtga

SEQ ID NO: 310364 - DNA, 25 bp, Mus musculus
tggtcgacaccgagctgtaccggca

SEQ ID NO: 310365 - DNA, 25 bp, Mus musculus
cggtgaccctgtgacctccaacatg

SEQ ID NO: 310366 - DNA, 25 bp, Mus musculus
tgctggacaggaaatgaccctcggg

SEQ ID NO: 310367 - DNA, 25 bp, Mus musculus
acccgggaggacaggaagtgactct

SEQ ID NO: 310368 - DNA, 25 bp, Mus musculus
ggtgtgaacttcctgggccacttcc

SEQ ID NO: 310369 - DNA, 25 bp, Mus musculus
tcgagcgccacctgggtgtgaactt

SEQ ID NO: 310370 - DNA, 25 bp, Mus musculus
ttcaaggtgagcatgagcgtgaccc

SEQ ID NO: 310371 - DNA, 25 bp, Mus musculus
ccggttcactctgagcaatgttgct

SEQ ID NO: 310372 - DNA, 25 bp, Mus musculus
cacaaggtggcggcccacagtcact

SEQ ID NO: 310373 - DNA, 25 bp, Mus musculus
gtgcctgatacccatgtgccccctg

SEQ ID NO: 310374 - DNA, 25 bp, Mus musculus
caaccgtggcggcaatcgaggaggt

SEQ ID NO: 310375 - DNA, 25 bp, Mus musculus
tgccgggcaaccgtggcggcaatcg

SEQ ID NO: 310376 - DNA, 25 bp, Mus musculus
gcagacacaaggtggcggcccacag

SEQ ID NO: 310377 - DNA, 25 bp, Mus musculus
ctagaggtcaaggaaggtgcagggt

SEQ ID NO: 310378 - DNA, 25 bp, Mus musculus
ttcactctgagcaatgttgctagag

SEQ ID NO: 310379 - DNA, 25 bp, Mus musculus
gttcactctgagcaatgttgctaga

SEQ ID NO: 310380 - DNA, 25 bp, Mus musculus
cggttcactctgagcaatgttgcta

SEQ ID NO: 310381 - DNA, 25 bp, Mus musculus
cagacacaaggtggcggcccacagt

SEQ ID NO: 310382 - DNA, 25 bp, Mus musculus
cccggttcactctgagcaatgttgc

SEQ ID NO: 310383 - DNA, 25 bp, Mus musculus
ggttcactctgagcaatgttgctag

SEQ ID NO: 310384 - DNA, 25 bp, Mus musculus
aggtcaaggaaggtgcagggtggga

SEQ ID NO: 310385 - DNA, 25 bp, Mus musculus
caggcgggtttaggacaatgctttt

SEQ ID NO: 310386 - DNA, 25 bp, Mus musculus
agactcaatacttggccttgccgga

SEQ ID NO: 310387 - DNA, 25 bp, Mus musculus
ttttaaggatttccaggcctgcgcc

SEQ ID NO: 310388 - DNA, 25 bp, Mus musculus
cctcgagcggccctaagtaagcttc

SEQ ID NO: 310389 - DNA, 25 bp, Mus musculus
gcttctaggcccaaagctggaaacc

SEQ ID NO: 310390 - DNA, 25 bp, Mus musculus
gtggacagaaatcccgtacctctcg

SEQ ID NO: 310391 - DNA, 25 bp, Mus musculus
ccgtacctctcgctactgattaagc

SEQ ID NO: 310392 - DNA, 25 bp, Mus musculus
cgggtgaaataactggccctcctca

SEQ ID NO: 310393 - DNA, 25 bp, Mus musculus
tgtcaccatcatcacagtgcacgta

SEQ ID NO: 310394 - DNA, 25 bp, Mus musculus
agtgcacgtacaccagcagtcctgg

SEQ ID NO: 310395 - DNA, 25 bp, Mus musculus
agcagtcctggccttttggcaatta

SEQ ID NO: 310396 - DNA, 25 bp, Mus musculus
aggttcctccactaatgctcaggtc

SEQ ID NO: 310397 - DNA, 25 bp, Mus musculus
tggtaccaccagacctcgggatccg

SEQ ID NO: 310398 - DNA, 25 bp, Mus musculus
cttcagcggcgtttccaaaagactc

SEQ ID NO: 310399 - DNA, 25 bp, Mus musculus
tgaggcttctttctcctcgcccgct

SEQ ID NO: 310400 - DNA, 25 bp, Mus musculus
ctccgggtgagcctgtctggcgcct

SEQ ID NO: 310401 - DNA, 25 bp, Mus musculus
gtgagcctgtctggcgccttcctcg

SEQ ID NO: 310402 - DNA, 25 bp, Mus musculus
ggtcccgggagatggaagcctccca

SEQ ID NO: 310403 - DNA, 25 bp, Mus musculus
agatggaagcctcccaggcgcgcga

SEQ ID NO: 310404 - DNA, 25 bp, Mus musculus
ctcggacgctgcagttattgacctc

SEQ ID NO: 310405 - DNA, 25 bp, Mus musculus
cccgggcgctctgaggcttctttct

SEQ ID NO: 310406 - DNA, 25 bp, Mus musculus
cctgggctcagctcggacgctgcag

SEQ ID NO: 310407 - DNA, 25 bp, Mus musculus
tgcagttattgacctcccggtcccg

SEQ ID NO: 310408 - DNA, 25 bp, Mus musculus
gctcagctcggacgctgcagttatt

SEQ ID NO: 310409 - DNA, 25 bp, Mus musculus
cgctgcagttattgacctcccggtc

SEQ ID NO: 310410 - DNA, 25 bp, Mus musculus
agctcggacgctgcagttattgacc

SEQ ID NO: 310411 - DNA, 25 bp, Mus musculus
gacgctgcagttattgacctcccgg

SEQ ID NO: 310412 - DNA, 25 bp, Mus musculus
cttcccgggcgctctgaggcttctt

SEQ ID NO: 310413 - DNA, 25 bp, Mus musculus
gggacctcctgtcagggacctgagc

SEQ ID NO: 310414 - DNA, 25 bp, Mus musculus
gtgactcactcagcgcggagcggct

SEQ ID NO: 310415 - DNA, 25 bp, Mus musculus
acatctttccgaggctgcgacaccg

SEQ ID NO: 310416 - DNA, 25 bp, Mus musculus
tacgtttacatctttccgaggctgc

SEQ ID NO: 310417 - DNA, 25 bp, Mus musculus
ccggccgagagctacgtttacatct

SEQ ID NO: 310418 - DNA, 25 bp, Mus musculus
acgtgctcagagctcaagccgctgc

SEQ ID NO: 310419 - DNA, 25 bp, Mus musculus
gctgctctggaatgcaagccgaccc

SEQ ID NO: 310420 - DNA, 25 bp, Mus musculus
cggtcagtcacgtgctcagagctca

SEQ ID NO: 310421 - DNA, 25 bp, Mus musculus
tcaccctcgggaggcatggctggct

SEQ ID NO: 310422 - DNA, 25 bp, Mus musculus
gcctaagatggccaggctcggcacc

SEQ ID NO: 310423 - DNA, 25 bp, Mus musculus
actgagagctctgtgagtcaccctc

SEQ ID NO: 310424 - DNA, 25 bp, Mus musculus
accgcccttcgggactgaactgaga

SEQ ID NO: 310425 - DNA, 25 bp, Mus musculus
agcagcctgagggtcggaaccctac

SEQ ID NO: 310426 - DNA, 25 bp, Mus musculus
tcagggacctgagctctgcagcagc

SEQ ID NO: 310427 - DNA, 25 bp, Mus musculus
ttacccggcacccagtgacgacagg

SEQ ID NO: 310428 - DNA, 25 bp, Mus musculus
ccaactcaggcagaacgcgggcact

SEQ ID NO: 310429 - DNA, 25 bp, Mus musculus
gcagggctctcccaactcaggcaga

SEQ ID NO: 310430 - DNA, 25 bp, Mus musculus
cgcgtgaaatatcaggccagagaca

SEQ ID NO: 310431 - DNA, 25 bp, Mus musculus
cttccaattgctcgcgtgaaatatc

SEQ ID NO: 310432 - DNA, 25 bp, Mus musculus
tgtaatctccttccaattgctcgcg

SEQ ID NO: 310433 - DNA, 25 bp, Mus musculus
gcagtgctcagaacacacataaatc

SEQ ID NO: 310434 - DNA, 25 bp, Mus musculus
ctctacgctgggaaactagcagtgc

SEQ ID NO: 310435 - DNA, 25 bp, Mus musculus
gatctcggctctctacgctgggaaa

SEQ ID NO: 310436 - DNA, 25 bp, Mus musculus
cccaaagcgcgaatgaaaaatggaa

SEQ ID NO: 310437 - DNA, 25 bp, Mus musculus
agacgcggagtcctgtgatcagccc

SEQ ID NO: 310438 - DNA, 25 bp, Mus musculus
tccgcagaccacgagaagggcaaag

SEQ ID NO: 310439 - DNA, 25 bp, Mus musculus
gggtgtttccgcagaccacgagaag

SEQ ID NO: 310440 - DNA, 25 bp, Mus musculus
cacccagtgacgacagggtcgggcc

SEQ ID NO: 310441 - DNA, 25 bp, Mus musculus
tgtctccggtagagagcccgatacc

SEQ ID NO: 310442 - DNA, 25 bp, Mus musculus
ggtaagcactccataggcacagagg

SEQ ID NO: 310443 - DNA, 25 bp, Mus musculus
ttagacatcaggtacagcgtggaga

SEQ ID NO: 310444 - DNA, 25 bp, Mus musculus
ccagcttcgggaactaagggctgaa

SEQ ID NO: 310445 - DNA, 25 bp, Mus musculus
ggctgaaaaggcctcggactgcttg

SEQ ID NO: 310446 - DNA, 25 bp, Mus musculus
tcggactgcttggagctctgagaca

SEQ ID NO: 310447 - DNA, 25 bp, Mus musculus
agctgcttgccctccgtagagttga

SEQ ID NO: 310448 - DNA, 25 bp, Mus musculus
actgggtcgggatagttagacatca

SEQ ID NO: 310449 - DNA, 25 bp, Mus musculus
gccagagctagcttggtgattgtta

SEQ ID NO: 310450 - DNA, 25 bp, Mus musculus
ttaagaccggcaacttgcgcgggtg

SEQ ID NO: 310451 - DNA, 25 bp, Mus musculus
gcttccgagttgtggagtgtgtatt

SEQ ID NO: 310452 - DNA, 25 bp, Mus musculus
tagagtttatgggtccgtagcctaa

SEQ ID NO: 310453 - DNA, 25 bp, Mus musculus
cgtagcctaagggactcgctgagtc

SEQ ID NO: 310454 - DNA, 25 bp, Mus musculus
tgagcacctcgtagttgccgccaga

SEQ ID NO: 310455 - DNA, 25 bp, Mus musculus
gtcacacgctgtggtaggacgcaca

SEQ ID NO: 310456 - DNA, 25 bp, Mus musculus
gctcgcttttgtctcatccgccatt

SEQ ID NO: 310457 - DNA, 25 bp, Mus musculus
ttcgttattactccatcacctcttt

SEQ ID NO: 310458 - DNA, 25 bp, Mus musculus
tccgccattttatcggcgactcata

SEQ ID NO: 310459 - DNA, 25 bp, Mus musculus
gcgccattttcgttattactccatc

SEQ ID NO: 310460 - DNA, 25 bp, Mus musculus
cccgtgatgacgtcacacgctgtgg

SEQ ID NO: 310461 - DNA, 25 bp, Mus musculus
tggtaggacgcacacatactgcccg

SEQ ID NO: 310462 - DNA, 25 bp, Mus musculus
gacgcacacatactgcccgtgacgt

SEQ ID NO: 310463 - DNA, 25 bp, Mus musculus
cgtgacgtcacgctgccacgcgtga

SEQ ID NO: 310464 - DNA, 25 bp, Mus musculus
cgctgccacgcgtgagacattctcg

SEQ ID NO: 310465 - DNA, 25 bp, Mus musculus
gcgtgagacattctcgtcattggta

SEQ ID NO: 310466 - DNA, 25 bp, Mus musculus
cgtcattggtaaatttgcgattatc

SEQ ID NO: 310467 - DNA, 25 bp, Mus musculus
tgcgattatcacaccgcgcgccatt

SEQ ID NO: 310468 - DNA, 25 bp, Mus musculus
ttttatcggcgactcatatcgtccc

SEQ ID NO: 310469 - DNA, 25 bp, Mus musculus
cgagaagcccgcaaccctaagctgg

SEQ ID NO: 310470 - DNA, 25 bp, Mus musculus
accgagaacttgtcctggatctcca

SEQ ID NO: 310471 - DNA, 25 bp, Mus musculus
agacccagagctgagggacgactcc

SEQ ID NO: 310472 - DNA, 25 bp, Mus musculus
tgcaaggatgatcgggaatcgccta

SEQ ID NO: 310473 - DNA, 25 bp, Mus musculus
gtccagtttcagtcccgtcctgctg

SEQ ID NO: 310474 - DNA, 25 bp, Mus musculus
gccaagaggagcacgatttcgacta

SEQ ID NO: 310475 - DNA, 25 bp, Mus musculus
ttctcgtcgaatcccaccacagtgt

SEQ ID NO: 310476 - DNA, 25 bp, Mus musculus
cgggcttaggctgacactgtattct

SEQ ID NO: 310477 - DNA, 25 bp, Mus musculus
cgccagcctgcctactggagaaaga

SEQ ID NO: 310478 - DNA, 25 bp, Mus musculus
tctgactcggaggttttcattggcc

SEQ ID NO: 310479 - DNA, 25 bp, Mus musculus
ggcttgcctaaaaaccctggtgtgc

SEQ ID NO: 310480 - DNA, 25 bp, Mus musculus
aggtcaacctctttcccgcaggaca

SEQ ID NO: 310481 - DNA, 25 bp, Mus musculus
caaaaacacgctgcatcctcggtcg

SEQ ID NO: 310482 - DNA, 25 bp, Mus musculus
aagctgcggatctgcctccttctga

SEQ ID NO: 310483 - DNA, 25 bp, Mus musculus
acgatgcaggatcgcgcgacctgtc

SEQ ID NO: 310484 - DNA, 25 bp, Mus musculus
ggctcgacggctcagacgttcctaa

SEQ ID NO: 310485 - DNA, 25 bp, Mus musculus
agaccagacgcaccgcagcgcttca

SEQ ID NO: 310486 - DNA, 25 bp, Mus musculus
caaggctttgctactcaccggcggg

SEQ ID NO: 310487 - DNA, 25 bp, Mus musculus
gtcggtgtctgtgctcatcgagtca

SEQ ID NO: 310488 - DNA, 25 bp, Mus musculus
ccgctcaccacgatgctcacctgtg

SEQ ID NO: 310489 - DNA, 25 bp, Mus musculus
gaaaacgtcccgtcggtgtctgtgc

SEQ ID NO: 310490 - DNA, 25 bp, Mus musculus
gacgttcctaacgtcctgcagtgga

SEQ ID NO: 310491 - DNA, 25 bp, Mus musculus
ctaacgtcctgcagtggacgccaca

SEQ ID NO: 310492 - DNA, 25 bp, Mus musculus
tcctgcagtggacgccacagggcag

SEQ ID NO: 310493 - DNA, 25 bp, Mus musculus
ccacagggcagacgatgcaggatcg

SEQ ID NO: 310494 - DNA, 25 bp, Mus musculus
atcgcgcgacctgtcagaccagacg

SEQ ID NO: 310495 - DNA, 25 bp, Mus musculus
ttggggatttctcaaggctttgcta

SEQ ID NO: 310496 - DNA, 25 bp, Mus musculus
ggtgtctgtgctcatcgagtcaccc

SEQ ID NO: 310497 - DNA, 25 bp, Mus musculus
gtccgcagaccgagaccacagggtc

SEQ ID NO: 310498 - DNA, 25 bp, Mus musculus
ttcgttgtcgtcatcgctgcgtcat

SEQ ID NO: 310499 - DNA, 25 bp, Mus musculus
gcgggtagcacagaaacgcgaaacc

SEQ ID NO: 310500 - DNA, 25 bp, Mus musculus
acaggaaccgcgaatgtgtaatctc

SEQ ID NO: 310501 - DNA, 25 bp, Mus musculus
ccggatgccgactttgacggacgtc

SEQ ID NO: 310502 - DNA, 25 bp, Mus musculus
aaccgcgggttctagtcctgactct

SEQ ID NO: 310503 - DNA, 25 bp, Mus musculus
cttgtctgattgacgttccgtgcga

SEQ ID NO: 310504 - DNA, 25 bp, Mus musculus
gggccatgtccaccttgcgagcgct

SEQ ID NO: 310505 - DNA, 25 bp, Mus musculus
acaccagcgcagtgttccgaggcgg

SEQ ID NO: 310506 - DNA, 25 bp, Mus musculus
ggcccgcggtgactgacaaacacca

SEQ ID NO: 310507 - DNA, 25 bp, Mus musculus
gctgcgtcatcatcgtgtcctcatc

SEQ ID NO: 310508 - DNA, 25 bp, Mus musculus
tcagtccatgtcttcgttgtcgtca

SEQ ID NO: 310509 - DNA, 25 bp, Mus musculus
ctgagctgtcagtcactcgtccttg

SEQ ID NO: 310510 - DNA, 25 bp, Mus musculus
cgtcgtcgtcagagctcccacgatg

SEQ ID NO: 310511 - DNA, 25 bp, Mus musculus
cggcgccagcgatgctaccgctcac

SEQ ID NO: 310512 - DNA, 25 bp, Mus musculus
agcagccgctcagggacacggacaa

SEQ ID NO: 310513 - DNA, 25 bp, Mus musculus
gcagcgggattaccgcgaccctagc

SEQ ID NO: 310514 - DNA, 25 bp, Mus musculus
ggtccggcatcgctgcaacaccggg

SEQ ID NO: 310515 - DNA, 25 bp, Mus musculus
atcgctgcaacaccggggcgcggac

SEQ ID NO: 310516 - DNA, 25 bp, Mus musculus
cgcagcagccgctcagggacacgga

SEQ ID NO: 310517 - DNA, 25 bp, Mus musculus
cactgcgccgccgagaagctgaggc

SEQ ID NO: 310518 - DNA, 25 bp, Mus musculus
gtcagcggctgtgtgccgccgcatt

SEQ ID NO: 310519 - DNA, 25 bp, Mus musculus
tgtgccgccgcattgtgtctgcctt

SEQ ID NO: 310520 - DNA, 25 bp, Mus musculus
gccgcattgtgtctgccttcgggac

SEQ ID NO: 310521 - DNA, 25 bp, Mus musculus
cacagccggcgggaacaacccgcca

SEQ ID NO: 310522 - DNA, 25 bp, Mus musculus
cgcgtcctcttcgagcgagcccaga

SEQ ID NO: 310523 - DNA, 25 bp, Mus musculus
acacggacaaagaggagcgcggggc

SEQ ID NO: 310524 - DNA, 25 bp, Mus musculus
aggacgcagcgggattaccgcgacc

SEQ ID NO: 310525 - DNA, 25 bp, Mus musculus
tttcatttctggctggggaggttta

SEQ ID NO: 310526 - DNA, 25 bp, Mus musculus
aatgctggttagaggcttatgcctg

SEQ ID NO: 310527 - DNA, 25 bp, Mus musculus
gagtgcttctcttagatgtcggatg

SEQ ID NO: 310528 - DNA, 25 bp, Mus musculus
tttctgagtgcttctcttagatgtc

SEQ ID NO: 310529 - DNA, 25 bp, Mus musculus
cgacgtcacgggtctcctggaagac

SEQ ID NO: 310530 - DNA, 25 bp, Mus musculus
cacgggtctcctggaagacttggtg

SEQ ID NO: 310531 - DNA, 25 bp, Mus musculus
agagtttccgttggtcgcgggctct

SEQ ID NO: 310532 - DNA, 25 bp, Mus musculus
catcacactgtgttttcaggtttca

SEQ ID NO: 310533 - DNA, 25 bp, Mus musculus
ctggggaggtttatgccaatgacga

SEQ ID NO: 310534 - DNA, 25 bp, Mus musculus
tgccaatgacgattttacttttatt

SEQ ID NO: 310535 - DNA, 25 bp, Mus musculus
gaggtttatgccaatgacgatttta

SEQ ID NO: 310536 - DNA, 25 bp, Mus musculus
gcaattaatgctggttagaggctta

SEQ ID NO: 310537 - DNA, 25 bp, Mus musculus
agatgtcggatgtttgatgcaatta

SEQ ID NO: 310538 - DNA, 25 bp, Mus musculus
ggacgtcacggcaacatcacactgt

SEQ ID NO: 310539 - DNA, 25 bp, Mus musculus
gagagcacacacgtagacccagacg

SEQ ID NO: 310540 - DNA, 25 bp, Mus musculus
gctgcccacagcgacgtcgcccacg

SEQ ID NO: 310541 - DNA, 25 bp, Mus musculus
gcccacagcgacgtcgcccacgaga

SEQ ID NO: 310542 - DNA, 25 bp, Mus musculus
agcgacgtcgcccacgagagcacac

SEQ ID NO: 310543 - DNA, 25 bp, Mus musculus
cacgagagcacacacgtagacccag

SEQ ID NO: 310544 - DNA, 25 bp, Mus musculus
cgagagcacacacgtagacccagac

SEQ ID NO: 310545 - DNA, 25 bp, Mus musculus
agagcacacacgtagacccagacgc

SEQ ID NO: 310546 - DNA, 25 bp, Mus musculus
cacacgtagacccagacgccgtggt

SEQ ID NO: 310547 - DNA, 25 bp, Mus musculus
acgtagacccagacgccgtggtcaa

SEQ ID NO: 310548 - DNA, 25 bp, Mus musculus
cgtagacccagacgccgtggtcaag

SEQ ID NO: 310549 - DNA, 25 bp, Mus musculus
caggcacacgcatccacgggacgcc

SEQ ID NO: 310550 - DNA, 25 bp, Mus musculus
cacacgcatccacgggacgccgcgc

SEQ ID NO: 310551 - DNA, 25 bp, Mus musculus
acgcatccacgggacgccgcgcccg

SEQ ID NO: 310552 - DNA, 25 bp, Mus musculus
tatgtgctaacgaccctcgccctgc

SEQ ID NO: 310553 - DNA, 25 bp, Mus musculus
ccgcgcaactgagaccaaacctgaa

SEQ ID NO: 310554 - DNA, 25 bp, Mus musculus
ttccgcgcaactgagaccaaacctg

SEQ ID NO: 310555 - DNA, 25 bp, Mus musculus
ttcacttccgcgcaactgagaccaa

SEQ ID NO: 310556 - DNA, 25 bp, Mus musculus
caccgtcggtaccagacgccgcctg

SEQ ID NO: 310557 - DNA, 25 bp, Mus musculus
gcgtcgtttcacttccgcgcaactg

SEQ ID NO: 310558 - DNA, 25 bp, Mus musculus
gtcgtttcacttccgcgcaactgag

SEQ ID NO: 310559 - DNA, 25 bp, Mus musculus
tgagaccaaacctgaagaccgcttc

SEQ ID NO: 310560 - DNA, 25 bp, Mus musculus
tgaagaccgcttcgcgcccagtcta

SEQ ID NO: 310561 - DNA, 25 bp, Mus musculus
ttcgcgcccagtctagcaaccaatt

SEQ ID NO: 310562 - DNA, 25 bp, Mus musculus
ccagtctagcaaccaattccgggta

SEQ ID NO: 310563 - DNA, 25 bp, Mus musculus
cgccttccggactgcgcaggcgtcc

SEQ ID NO: 310564 - DNA, 25 bp, Mus musculus
cctggctcacctccatctccgcgtc

SEQ ID NO: 310565 - DNA, 25 bp, Mus musculus
caggcgtcctcccttctaggaattc

SEQ ID NO: 310566 - DNA, 25 bp, Mus musculus
ggcgtcctcccttctaggaattcgc

SEQ ID NO: 310567 - DNA, 25 bp, Mus musculus
ggttcgcacagaatcccacttcagc

SEQ ID NO: 310568 - DNA, 25 bp, Mus musculus
cgcggttacaaatcgccttcggatt

SEQ ID NO: 310569 - DNA, 25 bp, Mus musculus
tgcatactcacacctggacgccaag

SEQ ID NO: 310570 - DNA, 25 bp, Mus musculus
tggacgccaagcatttctgtcagcg

SEQ ID NO: 310571 - DNA, 25 bp, Mus musculus
ttctgtcagcgtctaggcgaacgcg

SEQ ID NO: 310572 - DNA, 25 bp, Mus musculus
gtgcgctcaccgaccttagatgaca

SEQ ID NO: 310573 - DNA, 25 bp, Mus musculus
agcatgcccggcagaatcagatccc

SEQ ID NO: 310574 - DNA, 25 bp, Mus musculus
cttagatgacacgaaacctgctatg

SEQ ID NO: 310575 - DNA, 25 bp, Mus musculus
cctgctatgaaaaataatcggacga

SEQ ID NO: 310576 - DNA, 25 bp, Mus musculus
atcggacgacttttcagcgtttaga

SEQ ID NO: 310577 - DNA, 25 bp, Mus musculus
gcgtttagaaacatcgagaggtcca

SEQ ID NO: 310578 - DNA, 25 bp, Mus musculus
aaacaatccaaaaccgcagcgtctg

SEQ ID NO: 310579 - DNA, 25 bp, Mus musculus
agcgtctgcatctcatccctgcata

SEQ ID NO: 310580 - DNA, 25 bp, Mus musculus
tccggatcgtgggttcgcacagaat

SEQ ID NO: 310581 - DNA, 25 bp, Mus musculus
tccttgggcacgtcttccgcactgg

SEQ ID NO: 310582 - DNA, 25 bp, Mus musculus
tttgagtctcgccacacagctcttc

SEQ ID NO: 310583 - DNA, 25 bp, Mus musculus
cgtctagggctgaagaccgttgctc

SEQ ID NO: 310584 - DNA, 25 bp, Mus musculus
gttgctcaaggcagtggtcacgtga

SEQ ID NO: 310585 - DNA, 25 bp, Mus musculus
tcacgtgagtgtctaggtggagctt

SEQ ID NO: 310586 - DNA, 25 bp, Mus musculus
tggagcttgtagtaacgtgactcaa

SEQ ID NO: 310587 - DNA, 25 bp, Mus musculus
cgtgaagcacagtcggctgcgcaaa

SEQ ID NO: 310588 - DNA, 25 bp, Mus musculus
taccatctggatgaagaagagactc

SEQ ID NO: 310589 - DNA, 25 bp, Mus musculus
ctgtgcggtctaggttttgagtctc

SEQ ID NO: 310590 - DNA, 25 bp, Mus musculus
ggcgagacgaaggtgatttaccatc

SEQ ID NO: 310591 - DNA, 25 bp, Mus musculus
gaagagactccttacctggtgaaga

SEQ ID NO: 310592 - DNA, 25 bp, Mus musculus
tacctggtgaagatccctgtcccgg

SEQ ID NO: 310593 - DNA, 25 bp, Mus musculus
tttcaagagcgttttgcagcggccc

SEQ ID NO: 310594 - DNA, 25 bp, Mus musculus
agcgcatcacgctcggcgatttcaa

SEQ ID NO: 310595 - DNA, 25 bp, Mus musculus
tcacccgcgcgagtctcgatcatag

SEQ ID NO: 310596 - DNA, 25 bp, Mus musculus
tcggcctccaggtagaacttgtata

SEQ ID NO: 310597 - DNA, 25 bp, Mus musculus
acgtggcgaggtcgtgaccttcgac

SEQ ID NO: 310598 - DNA, 25 bp, Mus musculus
gaacttgtatagctctgcagcacca

SEQ ID NO: 310599 - DNA, 25 bp, Mus musculus
gagtctcgatcatagtcagggcggc

SEQ ID NO: 310600 - DNA, 25 bp, Mus musculus
tcacagccagacaaccgctggaatg

SEQ ID NO: 310601 - DNA, 25 bp, Mus musculus
ggcgactcagggacgcggtttccac

SEQ ID NO: 310602 - DNA, 25 bp, Mus musculus
acaaccgctggaatgtgtgaaagcc

SEQ ID NO: 310603 - DNA, 25 bp, Mus musculus
cggaacactgcggtctcgaaatatc

SEQ ID NO: 310604 - DNA, 25 bp, Mus musculus
tgtgaaagcctgcaggatcccacgg

SEQ ID NO: 310605 - DNA, 25 bp, Mus musculus
ggttcctcaggctccatccgaaact

SEQ ID NO: 310606 - DNA, 25 bp, Mus musculus
ctgcttcagaacctaggacttggga

SEQ ID NO: 310607 - DNA, 25 bp, Mus musculus
ttgggacctgagacatctccggccc

SEQ ID NO: 310608 - DNA, 25 bp, Mus musculus
ccacccgcggacttctcaaaagtga

SEQ ID NO: 310609 - DNA, 25 bp, Mus musculus
agacgcatttgagggctagcgaagt

SEQ ID NO: 310610 - DNA, 25 bp, Mus musculus
cgggatcccaacctcggagcctttg

SEQ ID NO: 310611 - DNA, 25 bp, Mus musculus
tctcccagtctgagttgttccggga

SEQ ID NO: 310612 - DNA, 25 bp, Mus musculus
gttctcccagtctgagttgttccgg

SEQ ID NO: 310613 - DNA, 25 bp, Mus musculus
gatgttctcccagtctgagttgttc

SEQ ID NO: 310614 - DNA, 25 bp, Mus musculus
ctcggagcctttggccggaagacgc

SEQ ID NO: 310615 - DNA, 25 bp, Mus musculus
atttgagggctagcgaagtgtggct

SEQ ID NO: 310616 - DNA, 25 bp, Mus musculus
ccggaagacgcatttgagggctagc

SEQ ID NO: 310617 - DNA, 25 bp, Mus musculus
cctttggccggaagacgcatttgag

SEQ ID NO: 310618 - DNA, 25 bp, Mus musculus
gacgctcgatgttctcccagtctga

SEQ ID NO: 310619 - DNA, 25 bp, Mus musculus
ggcgacgctcgatgttctcccagtc

SEQ ID NO: 310620 - DNA, 25 bp, Mus musculus
caacctcggagcctttggccggaag

SEQ ID NO: 310621 - DNA, 25 bp, Mus musculus
ttgcggcgacgctcgatgttctccc

SEQ ID NO: 310622 - DNA, 25 bp, Mus musculus
gctcgatgttctcccagtctgagtt

SEQ ID NO: 310623 - DNA, 25 bp, Mus musculus
tctgccaaggcactgtcaggtgaca

SEQ ID NO: 310624 - DNA, 25 bp, Mus musculus
ggtgggcaacagttcaaacttcttc

SEQ ID NO: 310625 - DNA, 25 bp, Mus musculus
ccctggaggcgtcgagttgtgacca

SEQ ID NO: 310626 - DNA, 25 bp, Mus musculus
cgcggggtgggcaacagttcaaact

SEQ ID NO: 310627 - DNA, 25 bp, Mus musculus
acaatcgcggggtgggcaacagttc

SEQ ID NO: 310628 - DNA, 25 bp, Mus musculus
cactgtcaggtgacaatcgcggggt

SEQ ID NO: 310629 - DNA, 25 bp, Mus musculus
aggcgtcgagttgtgaccaccaaag

SEQ ID NO: 310630 - DNA, 25 bp, Mus musculus
gccaaggcactgtcaggtgacaatc

SEQ ID NO: 310631 - DNA, 25 bp, Mus musculus
gtgctctgccaaggcactgtcaggt

SEQ ID NO: 310632 - DNA, 25 bp, Mus musculus
gctgtgctctgccaaggcactgtca

SEQ ID NO: 310633 - DNA, 25 bp, Mus musculus
ttcaccggctccaggctgtgctctg

SEQ ID NO: 310634 - DNA, 25 bp, Mus musculus
cagttcaccggctccaggctgtgct

SEQ ID NO: 310635 - DNA, 25 bp, Mus musculus
agcagcatctccgtggcccagttca

SEQ ID NO: 310636 - DNA, 25 bp, Mus musculus
caaggcactgtcaggtgacaatcgc

SEQ ID NO: 310637 - DNA, 25 bp, Mus musculus
attcatgcgcgcacctccaggcgcc

SEQ ID NO: 310638 - DNA, 25 bp, Mus musculus
gcagcaaggctacggccaacagggt

SEQ ID NO: 310639 - DNA, 25 bp, Mus musculus
actatgggcagcaaggctacggcca

SEQ ID NO: 310640 - DNA, 25 bp, Mus musculus
gcctcagggcgactatgggcagcaa

SEQ ID NO: 310641 - DNA, 25 bp, Mus musculus
tggctacgggcctcagggcgactat

SEQ ID NO: 310642 - DNA, 25 bp, Mus musculus
atcaacccgattacgggcagccagc

SEQ ID NO: 310643 - DNA, 25 bp, Mus musculus
ggttatcaacccgattacgggcagc

SEQ ID NO: 310644 - DNA, 25 bp, Mus musculus
ctcagggtggttatcaacccgatta

SEQ ID NO: 310645 - DNA, 25 bp, Mus musculus
ctacgggcctcagggtggttatcaa

SEQ ID NO: 310646 - DNA, 25 bp, Mus musculus
ccaggactcctacgggcctcagggt

SEQ ID NO: 310647 - DNA, 25 bp, Mus musculus
tcctggcgatgcctacggcgatgcg

SEQ ID NO: 310648 - DNA, 25 bp, Mus musculus
agctcctggcgatgcctacggcgat

SEQ ID NO: 310649 - DNA, 25 bp, Mus musculus
agcaaccagctcctggcgatgccta

SEQ ID NO: 310650 - DNA, 25 bp, Mus musculus
cagaaaagcaaccagctcctggcga

SEQ ID NO: 310651 - DNA, 25 bp, Mus musculus
actttcccgagtaccgcagggccag

SEQ ID NO: 310652 - DNA, 25 bp, Mus musculus
cggaagctgcgaactcgggtttaga

SEQ ID NO: 310653 - DNA, 25 bp, Mus musculus
ccagttctttatccactctgcggga

SEQ ID NO: 310654 - DNA, 25 bp, Mus musculus
ccctcggtcagaaacactcacaatt

SEQ ID NO: 310655 - DNA, 25 bp, Mus musculus
gctcctcagccaagtggaaactccg

SEQ ID NO: 310656 - DNA, 25 bp, Mus musculus
ttctgcggagagacctaaaggaagc

SEQ ID NO: 310657 - DNA, 25 bp, Mus musculus
cccagcgagctgagttaagacgatg

SEQ ID NO: 310658 - DNA, 25 bp, Mus musculus
cggctgcgaagccacggagagaaaa

SEQ ID NO: 310659 - DNA, 25 bp, Mus musculus
agagacatggcaagtggcggaccca

SEQ ID NO: 310660 - DNA, 25 bp, Mus musculus
agaaagcagaggtgccatgcctggc

SEQ ID NO: 310661 - DNA, 25 bp, Mus musculus
cttggcaaaaagaagcggcaatccc

SEQ ID NO: 310662 - DNA, 25 bp, Mus musculus
gcaagctgccgctccctgagaaagc

SEQ ID NO: 310663 - DNA, 25 bp, Mus musculus
caaagtgcgggagtcgtcttagatc

SEQ ID NO: 310664 - DNA, 25 bp, Mus musculus
ggacagttcgccctcctaagacttc

SEQ ID NO: 310665 - DNA, 25 bp, Mus musculus
cgacgctaatcgagggccgctcggc

SEQ ID NO: 310666 - DNA, 25 bp, Mus musculus
cttagttaggactggagtgcttggc

SEQ ID NO: 310667 - DNA, 25 bp, Mus musculus
tcgcccgcggcgcttagttaggact

SEQ ID NO: 310668 - DNA, 25 bp, Mus musculus
tgttttcctgatccgggctcgggcc

SEQ ID NO: 310669 - DNA, 25 bp, Mus musculus
agagttgtgttttcctgatccgggc

SEQ ID NO: 310670 - DNA, 25 bp, Mus musculus
gccgcccagcagagttgtgttttcc

SEQ ID NO: 310671 - DNA, 25 bp, Mus musculus
agtgacttccgtttccttctcctag

SEQ ID NO: 310672 - DNA, 25 bp, Mus musculus
ggagggagacagacatagtgacttc

SEQ ID NO: 310673 - DNA, 25 bp, Mus musculus
ccgatgggactgtcctgcctgggaa

SEQ ID NO: 310674 - DNA, 25 bp, Mus musculus
gttttatccgatgggactgtcctgc

SEQ ID NO: 310675 - DNA, 25 bp, Mus musculus
tccggtcttcgagttttatccgatg

SEQ ID NO: 310676 - DNA, 25 bp, Mus musculus
ggatgcacttggttccggtcttcga

SEQ ID NO: 310677 - DNA, 25 bp, Mus musculus
tcctgacgtggatgcacttggttcc

SEQ ID NO: 310678 - DNA, 25 bp, Mus musculus
tttttaaaagtcctgacgtggatgc

SEQ ID NO: 310679 - DNA, 25 bp, Mus musculus
aaaatcttgtaccagcccaggggtg

SEQ ID NO: 310680 - DNA, 25 bp, Mus musculus
tggcccaaaatggagaacgcgcagc

SEQ ID NO: 310681 - DNA, 25 bp, Mus musculus
ccctcgctggaaggttgtcccttcg

SEQ ID NO: 310682 - DNA, 25 bp, Mus musculus
tttagcgcaagacgctcccttctca

SEQ ID NO: 310683 - DNA, 25 bp, Mus musculus
ccggagccgcttttttagcgcaaga

SEQ ID NO: 310684 - DNA, 25 bp, Mus musculus
acttccaaggaacttgcagtcgccc

SEQ ID NO: 310685 - DNA, 25 bp, Mus musculus
tataaaatggcggaggcgaagcttc

SEQ ID NO: 310686 - DNA, 25 bp, Mus musculus
ggggaggccaacagtctccttgctg

SEQ ID NO: 310687 - DNA, 25 bp, Mus musculus
cgtccctcagtagaactcaagggtg

SEQ ID NO: 310688 - DNA, 25 bp, Mus musculus
cgggagcttccgtccctcagtagaa

SEQ ID NO: 310689 - DNA, 25 bp, Mus musculus
cacggctctagacccgcgggagctt

SEQ ID NO: 310690 - DNA, 25 bp, Mus musculus
tccaagtcgccgaagagcgaacacc

SEQ ID NO: 310691 - DNA, 25 bp, Mus musculus
acagatggcgcctgcgcgttccatt

SEQ ID NO: 310692 - DNA, 25 bp, Mus musculus
tccttgctgcctctgtagacgctga

SEQ ID NO: 310693 - DNA, 25 bp, Mus musculus
gggtggccatcagcgcccagagcac

SEQ ID NO: 310694 - DNA, 25 bp, Mus musculus
gcagatcgccctcgaagcccgctac

SEQ ID NO: 310695 - DNA, 25 bp, Mus musculus
cagagcacggcccttcaagtagtgc

SEQ ID NO: 310696 - DNA, 25 bp, Mus musculus
cacggcccttcaagtagtgcaccaa

SEQ ID NO: 310697 - DNA, 25 bp, Mus musculus
ggcccttcaagtagtgcaccaagga

SEQ ID NO: 310698 - DNA, 25 bp, Mus musculus
ttcaagtagtgcaccaaggagcggc

SEQ ID NO: 310699 - DNA, 25 bp, Mus musculus
caagtagtgcaccaaggagcggcga

SEQ ID NO: 310700 - DNA, 25 bp, Mus musculus
agtgcaccaaggagcggcgagccac

SEQ ID NO: 310701 - DNA, 25 bp, Mus musculus
gccagcagcaatggcccatccgctt

SEQ ID NO: 310702 - DNA, 25 bp, Mus musculus
gcccatccgcttggcccgttcccgc

SEQ ID NO: 310703 - DNA, 25 bp, Mus musculus
cgcagccgccctcccaggcaacgaa

SEQ ID NO: 310704 - DNA, 25 bp, Mus musculus
tcccaggcaacgaagaagtcccagc

SEQ ID NO: 310705 - DNA, 25 bp, Mus musculus
gcaacgaagaagtcccagcgccctg

SEQ ID NO: 310706 - DNA, 25 bp, Mus musculus
agcgccctgctcgacctccgaggct

SEQ ID NO: 310707 - DNA, 25 bp, Mus musculus
taccctgtcgcgcatcagaggaatg

SEQ ID NO: 310708 - DNA, 25 bp, Mus musculus
agcctaccgagtccggagagccttg

SEQ ID NO: 310709 - DNA, 25 bp, Mus musculus
gatcaaccgatcagcggggagccta

SEQ ID NO: 310710 - DNA, 25 bp, Mus musculus
agctagtgagagagcgatcaaccga

SEQ ID NO: 310711 - DNA, 25 bp, Mus musculus
acgcatgatatcaccgggagctgga

SEQ ID NO: 310712 - DNA, 25 bp, Mus musculus
ggagtcggcctgacgcatgatatca

SEQ ID NO: 310713 - DNA, 25 bp, Mus musculus
cctggcgatgaagaagtcccggcgc

SEQ ID NO: 310714 - DNA, 25 bp, Mus musculus
cggcctcttggtcagcagcatggac

SEQ ID NO: 310715 - DNA, 25 bp, Mus musculus
cagcgctcggcccttcaggtagttc

SEQ ID NO: 310716 - DNA, 25 bp, Mus musculus
gtaactgcgcagatctccctcgaag

SEQ ID NO: 310717 - DNA, 25 bp, Mus musculus
aaccacgaagagtgtgttgcactta

SEQ ID NO: 310718 - DNA, 25 bp, Mus musculus
gtgacccggcgaacaacgcgaggtc

SEQ ID NO: 310719 - DNA, 25 bp, Mus musculus
gcgcatgatgtggtcggtcttgaca

SEQ ID NO: 310720 - DNA, 25 bp, Mus musculus
gccacgagacaggtcgggtaccctg

SEQ ID NO: 310721 - DNA, 25 bp, Mus musculus
taggttgacagaccatgtcgagggc

SEQ ID NO: 310722 - DNA, 25 bp, Mus musculus
aggcgtggtttcatggagcaagtgg

SEQ ID NO: 310723 - DNA, 25 bp, Mus musculus
caagtgggcggagtcggcttactct

SEQ ID NO: 310724 - DNA, 25 bp, Mus musculus
ggcggagtcggcttactctatcgga

SEQ ID NO: 310725 - DNA, 25 bp, Mus musculus
agtcggcttactctatcggaggagg

SEQ ID NO: 310726 - DNA, 25 bp, Mus musculus
cttactctatcggaggaggcgggca

SEQ ID NO: 310727 - DNA, 25 bp, Mus musculus
agggcctaggttgacagaccatgtc

SEQ ID NO: 310728 - DNA, 25 bp, Mus musculus
aggcgggcaacaaccctcagaaagg

SEQ ID NO: 310729 - DNA, 25 bp, Mus musculus
tggttcctgtatggataggagaccc

SEQ ID NO: 310730 - DNA, 25 bp, Mus musculus
cctgtatggataggagacccggttc

SEQ ID NO: 310731 - DNA, 25 bp, Mus musculus
tatggataggagacccggttcgtgt

SEQ ID NO: 310732 - DNA, 25 bp, Mus musculus
ttcgtgtggccgtagtcccagtaac

SEQ ID NO: 310733 - DNA, 25 bp, Mus musculus
tggccgtagtcccagtaactgcggg

SEQ ID NO: 310734 - DNA, 25 bp, Mus musculus
cgtagtcccagtaactgcggggtgc

SEQ ID NO: 310735 - DNA, 25 bp, Mus musculus
ttcctatttacctccttcttctcgc

SEQ ID NO: 310736 - DNA, 25 bp, Mus musculus
ccgtgtccggctccatggcgttgga

SEQ ID NO: 310737 - DNA, 25 bp, Mus musculus
ctctgtggccgtgtccggctccatg

SEQ ID NO: 310738 - DNA, 25 bp, Mus musculus
aactgccacggtggctgcctctgtg

SEQ ID NO: 310739 - DNA, 25 bp, Mus musculus
gcatccgaaactgccacggtggctg

SEQ ID NO: 310740 - DNA, 25 bp, Mus musculus
tgtggctctggcatccgaaactgcc

SEQ ID NO: 310741 - DNA, 25 bp, Mus musculus
gactgtggctctggcatccgaaact

SEQ ID NO: 310742 - DNA, 25 bp, Mus musculus
ctctacaaccacgactgtggctctg

SEQ ID NO: 310743 - DNA, 25 bp, Mus musculus
gcccgggctgctcatcctctacaac

SEQ ID NO: 310744 - DNA, 25 bp, Mus musculus
agccgctccctcctctttaaaggtg

SEQ ID NO: 310745 - DNA, 25 bp, Mus musculus
tctcagtggccgtggtgccttcggt

SEQ ID NO: 310746 - DNA, 25 bp, Mus musculus
tctcgcccttctcagtggccgtggt

SEQ ID NO: 310747 - DNA, 25 bp, Mus musculus
ctccatggcgttggagcgggaaaga

SEQ ID NO: 310748 - DNA, 25 bp, Mus musculus
agaagggaggttcctgtgcgacagc

SEQ ID NO: 310749 - DNA, 25 bp, Mus musculus
ttttctctgagcatcttcaaagtcc

SEQ ID NO: 310750 - DNA, 25 bp, Mus musculus
agcatgtcctagggcgagcagagta

SEQ ID NO: 310751 - DNA, 25 bp, Mus musculus
ccctggcagtatccgtctgagagaa

SEQ ID NO: 310752 - DNA, 25 bp, Mus musculus
gccgcggctcccgattggagctcag

SEQ ID NO: 310753 - DNA, 25 bp, Mus musculus
tcgtggaatccgctggcagtccgca

SEQ ID NO: 310754 - DNA, 25 bp, Mus musculus
ggcttccaggctcccagcgctggag

SEQ ID NO: 310755 - DNA, 25 bp, Mus musculus
aagtccttcgggtgcctagctgcag

SEQ ID NO: 310756 - DNA, 25 bp, Mus musculus
ttgaagagggacctgctatggagtc

SEQ ID NO: 310757 - DNA, 25 bp, Mus musculus
gcagatagcaatttgaagagggacc

SEQ ID NO: 310758 - DNA, 25 bp, Mus musculus
cccttctaggatgttgcagatagca

SEQ ID NO: 310759 - DNA, 25 bp, Mus musculus
tcctcagatcccttctaggatgttg

SEQ ID NO: 310760 - DNA, 25 bp, Mus musculus
tgagcatcttcaaagtcctcagatc

SEQ ID NO: 310761 - DNA, 25 bp, Mus musculus
ccagttcaactggtgtagcagtttc

SEQ ID NO: 310762 - DNA, 25 bp, Mus musculus
cagagtagggaaaggggacctgctc

SEQ ID NO: 310763 - DNA, 25 bp, Mus musculus
caccatgtttccctggaggcgggaa

SEQ ID NO: 310764 - DNA, 25 bp, Mus musculus
tcctgcaaggctcgcaccatgtttc

SEQ ID NO: 310765 - DNA, 25 bp, Mus musculus
tgccctgtcaataggcctcccggtg

SEQ ID NO: 310766 - DNA, 25 bp, Mus musculus
aagcaaagcctacatggcatgtcgc

SEQ ID NO: 310767 - DNA, 25 bp, Mus musculus
cccaagcgagcaggagggcacgcac

SEQ ID NO: 310768 - DNA, 25 bp, Mus musculus
ctctctaagtggctgacgctgctct

SEQ ID NO: 310769 - DNA, 25 bp, Mus musculus
cacaaactgcagtcaaggagagcca

SEQ ID NO: 310770 - DNA, 25 bp, Mus musculus
gcctgcacgcagagcctcagattca

SEQ ID NO: 310771 - DNA, 25 bp, Mus musculus
attcatgctgcaactcggtccgcgg

SEQ ID NO: 310772 - DNA, 25 bp, Mus musculus
gtcggcggcaaaaactctctaagtg

SEQ ID NO: 310773 - DNA, 25 bp, Mus musculus
ccggacgcaaagaaaggcgcgagcc

SEQ ID NO: 310774 - DNA, 25 bp, Mus musculus
tgcctctgctcttggtgcagccttc

SEQ ID NO: 310775 - DNA, 25 bp, Mus musculus
gcagggcacccggacgcaaagaaag

SEQ ID NO: 310776 - DNA, 25 bp, Mus musculus
cgcgcgctgtcctaggaagcaaagc

SEQ ID NO: 310777 - DNA, 25 bp, Mus musculus
tggtttccgttcctgacccatgtga

SEQ ID NO: 310778 - DNA, 25 bp, Mus musculus
ggcagccggcttttccatcgaccaa

SEQ ID NO: 310779 - DNA, 25 bp, Mus musculus
ccggcgacagcgatgaactctatca

SEQ ID NO: 310780 - DNA, 25 bp, Mus musculus
gaccgcaagaaaaccgaatgccagg

SEQ ID NO: 310781 - DNA, 25 bp, Mus musculus
cagtgcggaccaactggcaggcagc

SEQ ID NO: 310782 - DNA, 25 bp, Mus musculus
accacactaatctcggaccgcaaga

SEQ ID NO: 310783 - DNA, 25 bp, Mus musculus
ttttccatcgaccaatcctggagcg

SEQ ID NO: 310784 - DNA, 25 bp, Mus musculus
tcctggagcgcctacaatactttgc

SEQ ID NO: 310785 - DNA, 25 bp, Mus musculus
tcgcgcgtgattagcggaagcaaaa

SEQ ID NO: 310786 - DNA, 25 bp, Mus musculus
agcaaaatttgctttgcggcaggca

SEQ ID NO: 310787 - DNA, 25 bp, Mus musculus
aggagcttgctctctctttggtttc

SEQ ID NO: 310788 - DNA, 25 bp, Mus musculus
acccatgtgagttaccggcgacagc

SEQ ID NO: 310789 - DNA, 25 bp, Mus musculus
actctatcaaagctacgaaggggta

SEQ ID NO: 310790 - DNA, 25 bp, Mus musculus
gaatgccagggaaccaataccgcca

SEQ ID NO: 310791 - DNA, 25 bp, Mus musculus
gcctttacatagtccggctctcgga

SEQ ID NO: 310792 - DNA, 25 bp, Mus musculus
agggacctgctgagcgcggctcctc

SEQ ID NO: 310793 - DNA, 25 bp, Mus musculus
gtcctggccgcctttacatagtccg

SEQ ID NO: 310794 - DNA, 25 bp, Mus musculus
tgggccagtcctggccgcctttaca

SEQ ID NO: 310795 - DNA, 25 bp, Mus musculus
accttgtgcccgtcggaagagtata

SEQ ID NO: 310796 - DNA, 25 bp, Mus musculus
ccgtcggaagagtatagggacctgc

SEQ ID NO: 310797 - DNA, 25 bp, Mus musculus
acaaacccaaactgggccagtcctg

SEQ ID NO: 310798 - DNA, 25 bp, Mus musculus
gccctaggagcacaaacccaaactg

SEQ ID NO: 310799 - DNA, 25 bp, Mus musculus
acgatcggacccacagccctaggag

SEQ ID NO: 310800 - DNA, 25 bp, Mus musculus
tctttctttgcaatggtgcgggcac

SEQ ID NO: 310801 - DNA, 25 bp, Mus musculus
aagcctctttctttgcaatggtgcg

SEQ ID NO: 310802 - DNA, 25 bp, Mus musculus
tccgcagatcccagacccacccttt

SEQ ID NO: 310803 - DNA, 25 bp, Mus musculus
tacatagtccggctctcggaacccg

SEQ ID NO: 310804 - DNA, 25 bp, Mus musculus
gccctgctttgctacctcgcccagg

SEQ ID NO: 310805 - DNA, 25 bp, Mus musculus
ctcagaatccgccatggtggtgtac

SEQ ID NO: 310806 - DNA, 25 bp, Mus musculus
ccctgcggccgaagacgatacgggt

SEQ ID NO: 310807 - DNA, 25 bp, Mus musculus
gaatcaccgcgcctagcaaagcagg

SEQ ID NO: 310808 - DNA, 25 bp, Mus musculus
gggaatgaatcaccgcgcctagcaa

SEQ ID NO: 310809 - DNA, 25 bp, Mus musculus
cccgggcaaaggagggaatgaatca

SEQ ID NO: 310810 - DNA, 25 bp, Mus musculus
ggttcgaggtcgctgcacacccagc

SEQ ID NO: 310811 - DNA, 25 bp, Mus musculus
ctcacgggttcgaggtcgctgcaca

SEQ ID NO: 310812 - DNA, 25 bp, Mus musculus
agctctgctttctggctcacgggtt

SEQ ID NO: 310813 - DNA, 25 bp, Mus musculus
ccctgggacgcagaagctctgcttt

SEQ ID NO: 310814 - DNA, 25 bp, Mus musculus
atccgccatggtggtgtactggagt

SEQ ID NO: 310815 - DNA, 25 bp, Mus musculus
gccgagagacgctcagaatccgcca

SEQ ID NO: 310816 - DNA, 25 bp, Mus musculus
ctggtgcaggctaaccagcagccgg

SEQ ID NO: 310817 - DNA, 25 bp, Mus musculus
gcgagaagctggtgcaggctaacca

SEQ ID NO: 310818 - DNA, 25 bp, Mus musculus
tggagtccctgggacgcagaagctc

SEQ ID NO: 310819 - DNA, 25 bp, Mus musculus
gtcgtctgcccttacccagcatgca

SEQ ID NO: 310820 - DNA, 25 bp, Mus musculus
gaggtcggctcgaacttcggcctgt

SEQ ID NO: 310821 - DNA, 25 bp, Mus musculus
tgtggagaaggcaactccgcatctc

SEQ ID NO: 310822 - DNA, 25 bp, Mus musculus
ggcaactccgcatctctttaagatg

SEQ ID NO: 310823 - DNA, 25 bp, Mus musculus
tttaagatgcagaaactcccagccc

SEQ ID NO: 310824 - DNA, 25 bp, Mus musculus
tgcacatcccgcgagcaaagcacga

SEQ ID NO: 310825 - DNA, 25 bp, Mus musculus
cgagcaaagcacgaccgcgggagaa

SEQ ID NO: 310826 - DNA, 25 bp, Mus musculus
cttcggcctgtggagaaggcaactc

SEQ ID NO: 310827 - DNA, 25 bp, Mus musculus
tgactactgccagcagctcgctttc

SEQ ID NO: 310828 - DNA, 25 bp, Mus musculus
aagcggagatcgtgcccacaccagc

SEQ ID NO: 310829 - DNA, 25 bp, Mus musculus
agccgggcgctgactactgccagca

SEQ ID NO: 310830 - DNA, 25 bp, Mus musculus
ccctgagctatcttggagccgcagc

SEQ ID NO: 310831 - DNA, 25 bp, Mus musculus
agcggccagaagaaacaggaagttt

SEQ ID NO: 310832 - DNA, 25 bp, Mus musculus
gtccgaaaaggcaggcccttcgctc

SEQ ID NO: 310833 - DNA, 25 bp, Mus musculus
accgaaccgcggactctggcggcgt

SEQ ID NO: 310834 - DNA, 25 bp, Mus musculus
ggctgcccagcgaggttccggcttc

SEQ ID NO: 310835 - DNA, 25 bp, Mus musculus
gaagagcaaagttgcgacagcagcc

SEQ ID NO: 310836 - DNA, 25 bp, Mus musculus
ataaagaaacttgcttttcgcagcc

SEQ ID NO: 310837 - DNA, 25 bp, Mus musculus
caccctgcgcgggttcggatcttgc

SEQ ID NO: 310838 - DNA, 25 bp, Mus musculus
cgggttcggatcttgcgtgatccga

SEQ ID NO: 310839 - DNA, 25 bp, Mus musculus
tgatccgagccctcgtggagacgct

SEQ ID NO: 310840 - DNA, 25 bp, Mus musculus
cccgagccggactcagatagggacc

SEQ ID NO: 310841 - DNA, 25 bp, Mus musculus
tgggtgaccgtgcaccggaccgaac

SEQ ID NO: 310842 - DNA, 25 bp, Mus musculus
ccaggagcgaaaacgatcgctctcc

SEQ ID NO: 310843 - DNA, 25 bp, Mus musculus
ccaacaacaaaacggggagagcgtg

SEQ ID NO: 310844 - DNA, 25 bp, Mus musculus
cggactcagatagggaccgcgcgtt

SEQ ID NO: 310845 - DNA, 25 bp, Mus musculus
aacggggagagcgtgttacacatca

SEQ ID NO: 310846 - DNA, 25 bp, Mus musculus
cgtgttacacatcaaccaggagcga

SEQ ID NO: 310847 - DNA, 25 bp, Mus musculus
tgtccgttcctcttcccttagcttc

SEQ ID NO: 310848 - DNA, 25 bp, Mus musculus
agctctcgggagctctctctgtcct

SEQ ID NO: 310849 - DNA, 25 bp, Mus musculus
cgcccgcgaacaaggctggactcga

SEQ ID NO: 310850 - DNA, 25 bp, Mus musculus
cgcgaacaaggctggactcgacttc

SEQ ID NO: 310851 - DNA, 25 bp, Mus musculus
cgacttcccgtcgagccctgcgacc

SEQ ID NO: 310852 - DNA, 25 bp, Mus musculus
gaccggcacccactccaccaggctt

SEQ ID NO: 310853 - DNA, 25 bp, Mus musculus
tctgtctctcctccgctttgctgag

SEQ ID NO: 310854 - DNA, 25 bp, Mus musculus
cccggacgtagagctctcgggagct

SEQ ID NO: 310855 - DNA, 25 bp, Mus musculus
cgcttctttctatcctaagcctttc

SEQ ID NO: 310856 - DNA, 25 bp, Mus musculus
tgactccctggctttttcgtattcc

SEQ ID NO: 310857 - DNA, 25 bp, Mus musculus
agccgacccgggaacaggtgcgtct

SEQ ID NO: 310858 - DNA, 25 bp, Mus musculus
tcagttcctagagtccgaccgccgc

SEQ ID NO: 310859 - DNA, 25 bp, Mus musculus
ccgctttgctgagccctcccttctt

SEQ ID NO: 310860 - DNA, 25 bp, Mus musculus
caccaggcttcgctcacacacacag

SEQ ID NO: 310861 - DNA, 25 bp, Mus musculus
gtcccgtggagaggaaggctgggcc

SEQ ID NO: 310862 - DNA, 25 bp, Mus musculus
cccggtgcgtggaggacgaggtgct

SEQ ID NO: 310863 - DNA, 25 bp, Mus musculus
cgaggccaaagagagtcccgtgccg

SEQ ID NO: 310864 - DNA, 25 bp, Mus musculus
gcggtacgagctaggacgacgacga

SEQ ID NO: 310865 - DNA, 25 bp, Mus musculus
gccagagggacgtccgggcaaggct

SEQ ID NO: 310866 - DNA, 25 bp, Mus musculus
aaagagagtcccgtgccggggcaga

SEQ ID NO: 310867 - DNA, 25 bp, Mus musculus
gaaagggatagaggggtgaactgga

SEQ ID NO: 310868 - DNA, 25 bp, Mus musculus
cccagaagccaggaaagggatagag

SEQ ID NO: 310869 - DNA, 25 bp, Mus musculus
gcgcccagaagccaggaaagggata

SEQ ID NO: 310870 - DNA, 25 bp, Mus musculus
ttcggcttcgggacggagccttgtg

SEQ ID NO: 310871 - DNA, 25 bp, Mus musculus
cttggctcccggaggttcggcttcg

SEQ ID NO: 310872 - DNA, 25 bp, Mus musculus
gacgggcctcgtgggcttggctccc

SEQ ID NO: 310873 - DNA, 25 bp, Mus musculus
aggacgaggtgctgggagaaggaag

SEQ ID NO: 310874 - DNA, 25 bp, Mus musculus
accgaggccaaagagagtcccgtgc

SEQ ID NO: 310875 - DNA, 25 bp, Mus musculus
tcaaggtaggagaccctggcggccc

SEQ ID NO: 310876 - DNA, 25 bp, Mus musculus
ccagaaataccgctaccaagatgaa

SEQ ID NO: 310877 - DNA, 25 bp, Mus musculus
ataccgctaccaagatgaagacacg

SEQ ID NO: 310878 - DNA, 25 bp, Mus musculus
accgctaccaagatgaagacacgcc

SEQ ID NO: 310879 - DNA, 25 bp, Mus musculus
caagatgaagacacgccccctctgg

SEQ ID NO: 310880 - DNA, 25 bp, Mus musculus
cctctggaacacagcccggcccacc

SEQ ID NO: 310881 - DNA, 25 bp, Mus musculus
gtaaacgcccccgagctggtgcacg

SEQ ID NO: 310882 - DNA, 25 bp, Mus musculus
cgtggcggagaggaacttgtcccac

SEQ ID NO: 310883 - DNA, 25 bp, Mus musculus
cggagaggaacttgtcccacctcga

SEQ ID NO: 310884 - DNA, 25 bp, Mus musculus
aggaacttgtcccacctcgaggccg

SEQ ID NO: 310885 - DNA, 25 bp, Mus musculus
ctcgaggccgtccacggggtcgtgg

SEQ ID NO: 310886 - DNA, 25 bp, Mus musculus
ggtcgtgggccacgcccacctctcc

SEQ ID NO: 310887 - DNA, 25 bp, Mus musculus
tccctcaaggtaggagaccctggcg

SEQ ID NO: 310888 - DNA, 25 bp, Mus musculus
tcctccctcaaggtaggagaccctg

SEQ ID NO: 310889 - DNA, 25 bp, Mus musculus
gcgccacctgctggatattggcttc

SEQ ID NO: 310890 - DNA, 25 bp, Mus musculus
acgcccgcttagtctgctcttctgg

SEQ ID NO: 310891 - DNA, 25 bp, Mus musculus
caagggacaggaagacgcccgctta

SEQ ID NO: 310892 - DNA, 25 bp, Mus musculus
tcagggaacacttccaagggacagg

SEQ ID NO: 310893 - DNA, 25 bp, Mus musculus
caaagccgcccagaagttgagaatc

SEQ ID NO: 310894 - DNA, 25 bp, Mus musculus
tgcggactgctgaactcttggagag

SEQ ID NO: 310895 - DNA, 25 bp, Mus musculus
gttggccaatgggaaggcgacattc

SEQ ID NO: 310896 - DNA, 25 bp, Mus musculus
tcacctacaggtactagagacgggg

SEQ ID NO: 310897 - DNA, 25 bp, Mus musculus
gtcgccactagctcacctacaggta

SEQ ID NO: 310898 - DNA, 25 bp, Mus musculus
gatattggcttccatgcccggcgca

SEQ ID NO: 310899 - DNA, 25 bp, Mus musculus
ctttagcggctttagggagcccgca

SEQ ID NO: 310900 - DNA, 25 bp, Mus musculus
cagggagattgtcggcggaaaccaa

SEQ ID NO: 310901 - DNA, 25 bp, Mus musculus
agccagagagcccagtcgccactag

SEQ ID NO: 310902 - DNA, 25 bp, Mus musculus
aaggcgacattctgcggactgctga

SEQ ID NO: 310903 - DNA, 25 bp, Mus musculus
acccaggctcttcggatctcggtcg

SEQ ID NO: 310904 - DNA, 25 bp, Mus musculus
cagttcccaggctgagacacacgca

SEQ ID NO: 310905 - DNA, 25 bp, Mus musculus
tggagctcagactcctcacagttcc

SEQ ID NO: 310906 - DNA, 25 bp, Mus musculus
ttgtgacctctggagctcagactcc

SEQ ID NO: 310907 - DNA, 25 bp, Mus musculus
gctcacttctgcttgtgacctctgg

SEQ ID NO: 310908 - DNA, 25 bp, Mus musculus
tctccactgaggctaagctggccgg

SEQ ID NO: 310909 - DNA, 25 bp, Mus musculus
gtcactaacggcctctccactgagg

SEQ ID NO: 310910 - DNA, 25 bp, Mus musculus
gcgtcccaagaagcggcgccatcga

SEQ ID NO: 310911 - DNA, 25 bp, Mus musculus
ggaaatcgcactggagacacacaca

SEQ ID NO: 310912 - DNA, 25 bp, Mus musculus
gcgggtctggtgacccaggctcttc

SEQ ID NO: 310913 - DNA, 25 bp, Mus musculus
gtctcagagcccgagacacgggtcc

SEQ ID NO: 310914 - DNA, 25 bp, Mus musculus
ctagcgagagaaaggggaaatcgca

SEQ ID NO: 310915 - DNA, 25 bp, Mus musculus
acgcgggcaaacttttcgagctctc

SEQ ID NO: 310916 - DNA, 25 bp, Mus musculus
cgccatcgacgtacctgaggtccgg

SEQ ID NO: 310917 - DNA, 25 bp, Mus musculus
caccaagggcaccagtttctgcttg

SEQ ID NO: 310918 - DNA, 25 bp, Mus musculus
gaataccacgggctcgggtccgctc

SEQ ID NO: 310919 - DNA, 25 bp, Mus musculus
tggacattggatagaggaaccggcc

SEQ ID NO: 310920 - DNA, 25 bp, Mus musculus
aggaaccggcccactagagccaggg

SEQ ID NO: 310921 - DNA, 25 bp, Mus musculus
actgaggctggagacccactgcgca

SEQ ID NO: 310922 - DNA, 25 bp, Mus musculus
ctgcgcaggcgtaagactcagcacc

SEQ ID NO: 310923 - DNA, 25 bp, Mus musculus
tgcaattggtcccacagcgaggagg

SEQ ID NO: 310924 - DNA, 25 bp, Mus musculus
cacgcaccgtcgaacgggtcgaata

SEQ ID NO: 310925 - DNA, 25 bp, Mus musculus
ttcggcgatcactcctcggaagctc

SEQ ID NO: 310926 - DNA, 25 bp, Mus musculus
tccacaccggaacatttcggcgatc

SEQ ID NO: 310927 - DNA, 25 bp, Mus musculus
tttctgcttgaaagcacccgccagg

SEQ ID NO: 310928 - DNA, 25 bp, Mus musculus
tggacgtacaccgtccgcaccaagg

SEQ ID NO: 310929 - DNA, 25 bp, Mus musculus
gttcctctgtttcggcctctggacg

SEQ ID NO: 310930 - DNA, 25 bp, Mus musculus
actcagcaccgcactgcaattggtc

SEQ ID NO: 310931 - DNA, 25 bp, Mus musculus
ccttcccggggcctgaaacaagatg

SEQ ID NO: 310932 - DNA, 25 bp, Mus musculus
cctgaaacaagatggtgggccgtgc

SEQ ID NO: 310933 - DNA, 25 bp, Mus musculus
caggctagcgcccaacccgggccca

SEQ ID NO: 310934 - DNA, 25 bp, Mus musculus
cccatgctccgcgttgcccaggcga

SEQ ID NO: 310935 - DNA, 25 bp, Mus musculus
ttcgctcaccttcgaagcggggaga

SEQ ID NO: 310936 - DNA, 25 bp, Mus musculus
cttcgggtccctactatccagggca

SEQ ID NO: 310937 - DNA, 25 bp, Mus musculus
cagccgccggcgatcgccacaagca

SEQ ID NO: 310938 - DNA, 25 bp, Mus musculus
gagacgcggggagacttacccagac

SEQ ID NO: 310939 - DNA, 25 bp, Mus musculus
aaacaagatggtgggccgtgcacca

SEQ ID NO: 310940 - DNA, 25 bp, Mus musculus
gcggggagacttacccagaccgctg

SEQ ID NO: 310941 - DNA, 25 bp, Mus musculus
tactatccagggcacggaagccttg

SEQ ID NO: 310942 - DNA, 25 bp, Mus musculus
tgcaccatcgggcttcgggtcccta

SEQ ID NO: 310943 - DNA, 25 bp, Mus musculus
ttgggctcgcatcgctgccgcttcg

SEQ ID NO: 310944 - DNA, 25 bp, Mus musculus
ggaagccttgggctcgcatcgctgc

SEQ ID NO: 310945 - DNA, 25 bp, Mus musculus
tggcttgaggatggccgcccagaaa

SEQ ID NO: 310946 - DNA, 25 bp, Mus musculus
ccaatctgagctgggtgttcgggtc

SEQ ID NO: 310947 - DNA, 25 bp, Mus musculus
cgtctgaagcgagccgcgcgaagat

SEQ ID NO: 310948 - DNA, 25 bp, Mus musculus
ttatcgcacttaccggcttgcctgc

SEQ ID NO: 310949 - DNA, 25 bp, Mus musculus
agtacttatcgcacttaccggcttg

SEQ ID NO: 310950 - DNA, 25 bp, Mus musculus
ggctgggaggaaaagtacttatcgc

SEQ ID NO: 310951 - DNA, 25 bp, Mus musculus
aagctgttgtcgtctgaagcgagcc

SEQ ID NO: 310952 - DNA, 25 bp, Mus musculus
cgcgaagatgcgaatatgaagtaag

SEQ ID NO: 310953 - DNA, 25 bp, Mus musculus
tgcgaatatgaagtaaggattctgt

SEQ ID NO: 310954 - DNA, 25 bp, Mus musculus
ttctgtttctctgcggataggggcg

SEQ ID NO: 310955 - DNA, 25 bp, Mus musculus
cgccagggcttagcgggccggaact

SEQ ID NO: 310956 - DNA, 25 bp, Mus musculus
tgctccaatctgagctgggtgttcg

SEQ ID NO: 310957 - DNA, 25 bp, Mus musculus
cccgtgctccaatctgagctgggtg

SEQ ID NO: 310958 - DNA, 25 bp, Mus musculus
aggattctgtttctctgcggatagg

SEQ ID NO: 310959 - DNA, 25 bp, Mus musculus
agacctcaggggtttgcgcacagat

SEQ ID NO: 310960 - DNA, 25 bp, Mus musculus
gcaagggtaggaaccaggaccgtca

SEQ ID NO: 310961 - DNA, 25 bp, Mus musculus
cgctagcaatcaccactgcggggtt

SEQ ID NO: 310962 - DNA, 25 bp, Mus musculus
acacagccaggtgtcgccgattctc

SEQ ID NO: 310963 - DNA, 25 bp, Mus musculus
gccgattctctcaccgcagcaaagg

SEQ ID NO: 310964 - DNA, 25 bp, Mus musculus
ctcgaggggcgctccctttaaactg

SEQ ID NO: 310965 - DNA, 25 bp, Mus musculus
agtaacttggcgaccctcacccgtg

SEQ ID NO: 310966 - DNA, 25 bp, Mus musculus
aggcagagagacacgcgccaatccg

SEQ ID NO: 310967 - DNA, 25 bp, Mus musculus
gccaatccgggcaaagagcgggcta

SEQ ID NO: 310968 - DNA, 25 bp, Mus musculus
cctggtgcagcctgaactgagcaaa

SEQ ID NO: 310969 - DNA, 25 bp, Mus musculus
gttccagcgcttcgggagacctcag

SEQ ID NO: 310970 - DNA, 25 bp, Mus musculus
accaggcacaggacagggttccagc

SEQ ID NO: 310971 - DNA, 25 bp, Mus musculus
ccctcgcctgttgcatgatcggagg

SEQ ID NO: 310972 - DNA, 25 bp, Mus musculus
tgagcgcttccgcagtaacttggcg

SEQ ID NO: 310973 - DNA, 25 bp, Mus musculus
aggcgactggcagacctcggagata

SEQ ID NO: 310974 - DNA, 25 bp, Mus musculus
tcacggctcgagctaaacttcccag

SEQ ID NO: 310975 - DNA, 25 bp, Mus musculus
aacttcccagcaagcggagcgctcg

SEQ ID NO: 310976 - DNA, 25 bp, Mus musculus
cgcctgtgactcgagcgaagatggc

SEQ ID NO: 310977 - DNA, 25 bp, Mus musculus
cccgtcaatggctccaatttctttc

SEQ ID NO: 310978 - DNA, 25 bp, Mus musculus
gctccaatttctttcgggttcactc

SEQ ID NO: 310979 - DNA, 25 bp, Mus musculus
cacgtctgtccggaggcgactggca

SEQ ID NO: 310980 - DNA, 25 bp, Mus musculus
ctcggagatagcgaaagacaggccc

SEQ ID NO: 310981 - DNA, 25 bp, Mus musculus
cccagaggagaaagatttcttggcg

SEQ ID NO: 310982 - DNA, 25 bp, Mus musculus
gcagaggtgaaacgccgggtctttc

SEQ ID NO: 310983 - DNA, 25 bp, Mus musculus
gaaagatttcttggcgaccgtggaa

SEQ ID NO: 310984 - DNA, 25 bp, Mus musculus
cgagctaaacttcccagcaagcgga

SEQ ID NO: 310985 - DNA, 25 bp, Mus musculus
aatttctttcgggttcactcgcacg

SEQ ID NO: 310986 - DNA, 25 bp, Mus musculus
caagcggagcgctcgcctgtgactc

SEQ ID NO: 310987 - DNA, 25 bp, Mus musculus
tgtgtgtacttaatcacgagagaac

SEQ ID NO: 310988 - DNA, 25 bp, Mus musculus
gtgtgtgtacttaatcacgagagaa

SEQ ID NO: 310989 - DNA, 25 bp, Mus musculus
ggtgtgtgtacttaatcacgagaga

SEQ ID NO: 310990 - DNA, 25 bp, Mus musculus
cggtgtgtgtacttaatcacgagag

SEQ ID NO: 310991 - DNA, 25 bp, Mus musculus
gcggtgtgtgtacttaatcacgaga

SEQ ID NO: 310992 - DNA, 25 bp, Mus musculus
atgaccggttataccggcacggccg

SEQ ID NO: 310993 - DNA, 25 bp, Mus musculus
gtgtgtacttaatcacgagagaacc

SEQ ID NO: 310994 - DNA, 25 bp, Mus musculus
tggatgaccggttataccggcacgg

SEQ ID NO: 310995 - DNA, 25 bp, Mus musculus
cgcggtgtgtgtacttaatcacgag

SEQ ID NO: 310996 - DNA, 25 bp, Mus musculus
tgtacttaatcacgagagaaccgaa

SEQ ID NO: 310997 - DNA, 25 bp, Mus musculus
ggatgaccggttataccggcacggc

SEQ ID NO: 310998 - DNA, 25 bp, Mus musculus
gtgtacttaatcacgagagaaccga

SEQ ID NO: 310999 - DNA, 25 bp, Mus musculus
gatgaccggttataccggcacggcc

SEQ ID NO: 311000 - DNA, 25 bp, Mus musculus
tgtgtacttaatcacgagagaaccg

SEQ ID NO: 311001 - DNA, 25 bp, Mus musculus
gcggcaaatacttagacaccacaga

SEQ ID NO: 311002 - DNA, 25 bp, Mus musculus
caacccccgagagaagatctggatg

SEQ ID NO: 311003 - DNA, 25 bp, Mus musculus
gttcgcggcaaatacttagacacca

SEQ ID NO: 311004 - DNA, 25 bp, Mus musculus
gccaagtcccgtcggcggaaggaga

SEQ ID NO: 311005 - DNA, 25 bp, Mus musculus
aaaggtagtgtgatcaagacacagc

SEQ ID NO: 311006 - DNA, 25 bp, Mus musculus
tcccaaaggtagtgtgatcaagaca

SEQ ID NO: 311007 - DNA, 25 bp, Mus musculus
agaaccgaaggggccactgccaaga

SEQ ID NO: 311008 - DNA, 25 bp, Mus musculus
gcaaatacttagacaccacagaaga

SEQ ID NO: 311009 - DNA, 25 bp, Mus musculus
gactcctacgtgcgcttcgccaagg

SEQ ID NO: 311010 - DNA, 25 bp, Mus musculus
ccggttcgcggcaaatacttagaca

SEQ ID NO: 311011 - DNA, 25 bp, Mus musculus
cctatgttgattcttcggacttcgg

SEQ ID NO: 311012 - DNA, 25 bp, Mus musculus
atgttgattcttcggacttcggctt

SEQ ID NO: 311013 - DNA, 25 bp, Mus musculus
gacttcggcttcggggaggatccca

SEQ ID NO: 311014 - DNA, 25 bp, Mus musculus
ggaggatcccaaaggtagtgtgatc

SEQ ID NO: 311015 - DNA, 25 bp, Mus musculus
cctcgatcgagaagcctggtagagc

SEQ ID NO: 311016 - DNA, 25 bp, Mus musculus
cctcttcctaaagcggcgaggcgca

SEQ ID NO: 311017 - DNA, 25 bp, Mus musculus
gcgcgaagtagcagtcgccaccatg

SEQ ID NO: 311018 - DNA, 25 bp, Mus musculus
atggcccactcaccggtggctgttc

SEQ ID NO: 311019 - DNA, 25 bp, Mus musculus
tggctgttcaagtgcctgggatgca

SEQ ID NO: 311020 - DNA, 25 bp, Mus musculus
cctccgtaggaggagccagtctctg

SEQ ID NO: 311021 - DNA, 25 bp, Mus musculus
accaccgcagaagcagcgcgaagta

SEQ ID NO: 311022 - DNA, 25 bp, Mus musculus
tgcgtccttccaggcctcgatcgag

SEQ ID NO: 311023 - DNA, 25 bp, Mus musculus
gcaacactgcagttagccaaaagcc

SEQ ID NO: 311024 - DNA, 25 bp, Mus musculus
cattcaggaaagagagcaacactgc

SEQ ID NO: 311025 - DNA, 25 bp, Mus musculus
acaggtcaagccctgcattcaggaa

SEQ ID NO: 311026 - DNA, 25 bp, Mus musculus
cgaggcgcagcaaagcggcatcact

SEQ ID NO: 311027 - DNA, 25 bp, Mus musculus
agagctgcagagatacctccgtagg

SEQ ID NO: 311028 - DNA, 25 bp, Mus musculus
agcggcatcactggagcccaggtcc

SEQ ID NO: 311029 - DNA, 25 bp, Mus musculus
agtcccacctcttcttcggggcgag

SEQ ID NO: 311030 - DNA, 25 bp, Mus musculus
caatggccttgagaaagggcgcttc

SEQ ID NO: 311031 - DNA, 25 bp, Mus musculus
ccagccgcccgggaggctaagtcaa

SEQ ID NO: 311032 - DNA, 25 bp, Mus musculus
gagactggacgcgttcacttccggt

SEQ ID NO: 311033 - DNA, 25 bp, Mus musculus
tccctgacacactggctgaggtgcc

SEQ ID NO: 311034 - DNA, 25 bp, Mus musculus
aagggtttccctgacacactggctg

SEQ ID NO: 311035 - DNA, 25 bp, Mus musculus
gccgcagggactccggttgaaccca

SEQ ID NO: 311036 - DNA, 25 bp, Mus musculus
gaaaagagccaagtgtcgtcgggtg

SEQ ID NO: 311037 - DNA, 25 bp, Mus musculus
gatgctgatgcccttcctataggaa

SEQ ID NO: 311038 - DNA, 25 bp, Mus musculus
atgcccttcctataggaacccaggg

SEQ ID NO: 311039 - DNA, 25 bp, Mus musculus
ccgcggagctcgtgtgacctgtaac

SEQ ID NO: 311040 - DNA, 25 bp, Mus musculus
cgcgttaggtgttgcctgacctcca

SEQ ID NO: 311041 - DNA, 25 bp, Mus musculus
tgctgtcctggccacacgctcccag

SEQ ID NO: 311042 - DNA, 25 bp, Mus musculus
gaggctaagtcaagccaaggccatg

SEQ ID NO: 311043 - DNA, 25 bp, Mus musculus
cactttgaacgaagcgcccaggaca

SEQ ID NO: 311044 - DNA, 25 bp, Mus musculus
agtgcaaccgggctcttcttgcgtg

SEQ ID NO: 311045 - DNA, 25 bp, Mus musculus
gggctcgtgtgtggataattcaatc

SEQ ID NO: 311046 - DNA, 25 bp, Mus musculus
taattcaatcctcgtgggactcggc

SEQ ID NO: 311047 - DNA, 25 bp, Mus musculus
cctgtggtgatctctgtttactgga

SEQ ID NO: 311048 - DNA, 25 bp, Mus musculus
ctgtttactggagagagcggtccaa

SEQ ID NO: 311049 - DNA, 25 bp, Mus musculus
agcggtccaagttgggctccatctc

SEQ ID NO: 311050 - DNA, 25 bp, Mus musculus
ccatctctgtgctggctagctgctc

SEQ ID NO: 311051 - DNA, 25 bp, Mus musculus
agaaccctttctgcggaaagcgcgg

SEQ ID NO: 311052 - DNA, 25 bp, Mus musculus
ggacttctatccctaggcctggttc

SEQ ID NO: 311053 - DNA, 25 bp, Mus musculus
ctggatctcagggacgtcagctccc

SEQ ID NO: 311054 - DNA, 25 bp, Mus musculus
cccaggcgtggagacttcattcaca

SEQ ID NO: 311055 - DNA, 25 bp, Mus musculus
cattcgccgtgaacgggctctccta

SEQ ID NO: 311056 - DNA, 25 bp, Mus musculus
ccgacctcgcggagcactttgaacg

SEQ ID NO: 311057 - DNA, 25 bp, Mus musculus
gggcactttcttcctgtaggacgca

SEQ ID NO: 311058 - DNA, 25 bp, Mus musculus
gagtcgtaccttcgcgcttgctttt

SEQ ID NO: 311059 - DNA, 25 bp, Mus musculus
cgcacttgcgtcgtgaaatctcgtc

SEQ ID NO: 311060 - DNA, 25 bp, Mus musculus
cggctcgctcgcaaagagcgccaaa

SEQ ID NO: 311061 - DNA, 25 bp, Mus musculus
caaactcctggagtcgccggcaatc

SEQ ID NO: 311062 - DNA, 25 bp, Mus musculus
attcggattttaggcgcccgcaagg

SEQ ID NO: 311063 - DNA, 25 bp, Mus musculus
ccattcgggagagacaattcggatt

SEQ ID NO: 311064 - DNA, 25 bp, Mus musculus
ctcactttagcgctcggccattcgg

SEQ ID NO: 311065 - DNA, 25 bp, Mus musculus
cgcttggttcagtccactcggagca

SEQ ID NO: 311066 - DNA, 25 bp, Mus musculus
ttgcctcaggcctaaggagacccta

SEQ ID NO: 311067 - DNA, 25 bp, Mus musculus
agaccacgagcccagaggtgccatc

SEQ ID NO: 311068 - DNA, 25 bp, Mus musculus
ggcaactcacgccaaactcctggag

SEQ ID NO: 311069 - DNA, 25 bp, Mus musculus
atctcgtctttgtgagagtcgtacc

SEQ ID NO: 311070 - DNA, 25 bp, Mus musculus
ctctccgagtgagcgactccagcgg

SEQ ID NO: 311071 - DNA, 25 bp, Mus musculus
ccagcagcagcttgttagatttctc

SEQ ID NO: 311072 - DNA, 25 bp, Mus musculus
gctggcattctgtgccggggcacac

SEQ ID NO: 311073 - DNA, 25 bp, Mus musculus
caccgcaaataggaagagcatcacc

SEQ ID NO: 311074 - DNA, 25 bp, Mus musculus
tttctcatccatgttcccgacgctg

SEQ ID NO: 311075 - DNA, 25 bp, Mus musculus
tcgttacgtcaatcccgcagcttgg

SEQ ID NO: 311076 - DNA, 25 bp, Mus musculus
atttccctccttgtgcgcgagctgc

SEQ ID NO: 311077 - DNA, 25 bp, Mus musculus
gttgctcaccgggtggcctctagaa

SEQ ID NO: 311078 - DNA, 25 bp, Mus musculus
tttcccgcggaacagcggtcagttg

SEQ ID NO: 311079 - DNA, 25 bp, Mus musculus
agttgcgcgctcaacccgtctcgag

SEQ ID NO: 311080 - DNA, 25 bp, Mus musculus
cggcaccctggaactttgagccttg

SEQ ID NO: 311081 - DNA, 25 bp, Mus musculus
gctcaccacgtacctggccaaggga

SEQ ID NO: 311082 - DNA, 25 bp, Mus musculus
cctggccaagggaccgaaaatcttg

SEQ ID NO: 311083 - DNA, 25 bp, Mus musculus
tcttggagaagatcgcactgagcac

SEQ ID NO: 311084 - DNA, 25 bp, Mus musculus
gcacacgtattggaggacgatcacc

SEQ ID NO: 311085 - DNA, 25 bp, Mus musculus
cagagtccctagtggcttcccggga

SEQ ID NO: 311086 - DNA, 25 bp, Mus musculus
gagagcccaagccacgcacgttgag

SEQ ID NO: 311087 - DNA, 25 bp, Mus musculus
cctgggtggcactgaataaaccggc

SEQ ID NO: 311088 - DNA, 25 bp, Mus musculus
gtgcaggattcccacctaccgttga

SEQ ID NO: 311089 - DNA, 25 bp, Mus musculus
acctaccgttgatctcatagagggg

SEQ ID NO: 311090 - DNA, 25 bp, Mus musculus
ttgaagcctttggacacgtagagac

SEQ ID NO: 311091 - DNA, 25 bp, Mus musculus
gacgtcgcacttccgagcaactttt

SEQ ID NO: 311092 - DNA, 25 bp, Mus musculus
cttttcgacttgagctccgcagcca

SEQ ID NO: 311093 - DNA, 25 bp, Mus musculus
ccacctttaggggacagaatgagac

SEQ ID NO: 311094 - DNA, 25 bp, Mus musculus
agacccgatggaaagcagcgctgcg

SEQ ID NO: 311095 - DNA, 25 bp, Mus musculus
cggagtgaacactcacgagcggagc

SEQ ID NO: 311096 - DNA, 25 bp, Mus musculus
tcgggactccgaaggctagagaacc

SEQ ID NO: 311097 - DNA, 25 bp, Mus musculus
agctctgccgctgattgactggccc

SEQ ID NO: 311098 - DNA, 25 bp, Mus musculus
cgcgagcaagcctaagcgtgccatg

SEQ ID NO: 311099 - DNA, 25 bp, Mus musculus
taggtaacctcctgccagtgaacgc

SEQ ID NO: 311100 - DNA, 25 bp, Mus musculus
atgagcgcctagctggatgcacgag

SEQ ID NO: 311101 - DNA, 25 bp, Mus musculus
tcccaagcgcgggatgagcgcctag

SEQ ID NO: 311102 - DNA, 25 bp, Mus musculus
tgttcccaatgtctcccaagcgcgg

SEQ ID NO: 311103 - DNA, 25 bp, Mus musculus
ccagccaagttgtggcgaggcttgt

SEQ ID NO: 311104 - DNA, 25 bp, Mus musculus
ctccctgacttgttgagagccacca

SEQ ID NO: 311105 - DNA, 25 bp, Mus musculus
gcccgcctccctgacttgttgagag

SEQ ID NO: 311106 - DNA, 25 bp, Mus musculus
tcacaacttggtccaacgatccggc

SEQ ID NO: 311107 - DNA, 25 bp, Mus musculus
gcctagctggatgcacgagtcttcg

SEQ ID NO: 311108 - DNA, 25 bp, Mus musculus
tggcagcgcccacaaggcgcgcata

SEQ ID NO: 311109 - DNA, 25 bp, Mus musculus
tggcgaggcttgttcccaatgtctc

SEQ ID NO: 311110 - DNA, 25 bp, Mus musculus
gctggctgcctaggtaacctcctgc

SEQ ID NO: 311111 - DNA, 25 bp, Mus musculus
ggcgcgcatacgcattcacaacttg

SEQ ID NO: 311112 - DNA, 25 bp, Mus musculus
tgttgagagccaccagccaagttgt

SEQ ID NO: 311113 - DNA, 25 bp, Mus musculus
tggctttccactgtgcgcggggaat

SEQ ID NO: 311114 - DNA, 25 bp, Mus musculus
cagcaagtctggcagtagcccgaca

SEQ ID NO: 311115 - DNA, 25 bp, Mus musculus
gctctgggaagagccaccacgcgcg

SEQ ID NO: 311116 - DNA, 25 bp, Mus musculus
ctcacctggtacaggggtttctgga

SEQ ID NO: 311117 - DNA, 25 bp, Mus musculus
tctctggaagaaagaacggacctgg

SEQ ID NO: 311118 - DNA, 25 bp, Mus musculus
gtcccggccatcctgcttcttgggg

SEQ ID NO: 311119 - DNA, 25 bp, Mus musculus
ggaacccatttgagtccgggctgca

SEQ ID NO: 311120 - DNA, 25 bp, Mus musculus
gcggtcccgagactcagcaagtctg

SEQ ID NO: 311121 - DNA, 25 bp, Mus musculus
ggcagtagcccgacagagcaagaga

SEQ ID NO: 311122 - DNA, 25 bp, Mus musculus
agcaagagaggagccgctacccagc

SEQ ID NO: 311123 - DNA, 25 bp, Mus musculus
agccgccgcaaaagtttcctcgcag

SEQ ID NO: 311124 - DNA, 25 bp, Mus musculus
tttcctcgcagctacctgggcgctg

SEQ ID NO: 311125 - DNA, 25 bp, Mus musculus
cttagctgggagattgggtttacca

SEQ ID NO: 311126 - DNA, 25 bp, Mus musculus
caataagagccggagcggtcccgag

SEQ ID NO: 311127 - DNA, 25 bp, Mus musculus
gtgtccgcgcagcaccacttgtgca

SEQ ID NO: 311128 - DNA, 25 bp, Mus musculus
agaacaagcgcgtaggggatctgcc

SEQ ID NO: 311129 - DNA, 25 bp, Mus musculus
ctggtccagtcatccagaacaagcg

SEQ ID NO: 311130 - DNA, 25 bp, Mus musculus
aggtacgcatctcctggtccagtca

SEQ ID NO: 311131 - DNA, 25 bp, Mus musculus
gggatctgccagtgacccgccctgg

SEQ ID NO: 311132 - DNA, 25 bp, Mus musculus
tgctgtcctgcctgccaggatcagg

SEQ ID NO: 311133 - DNA, 25 bp, Mus musculus
caggatcagggaaccgcacgcatct

SEQ ID NO: 311134 - DNA, 25 bp, Mus musculus
gcacgcatcttcctagagctcctgg

SEQ ID NO: 311135 - DNA, 25 bp, Mus musculus
cacttgtgcacacgagcctgtggca

SEQ ID NO: 311136 - DNA, 25 bp, Mus musculus
acacgagcctgtggcagcggtccgt

SEQ ID NO: 311137 - DNA, 25 bp, Mus musculus
agcggtccgtcacctcgagctgcgt

SEQ ID NO: 311138 - DNA, 25 bp, Mus musculus
ccgcccttcgcctttaatagcctag

SEQ ID NO: 311139 - DNA, 25 bp, Mus musculus
aggagccacgtgcaggaaacgcgcc

SEQ ID NO: 311140 - DNA, 25 bp, Mus musculus
tctgctctcctagctggtggaggag

SEQ ID NO: 311141 - DNA, 25 bp, Mus musculus
cgcttcatcagatgcgtgacatagc

SEQ ID NO: 311142 - DNA, 25 bp, Mus musculus
cacggtcttggtgcgaacgcggccc

SEQ ID NO: 311143 - DNA, 25 bp, Mus musculus
tcttcacggtcttggtgcgaacgcg

SEQ ID NO: 311144 - DNA, 25 bp, Mus musculus
gccttcttcacggtcttggtgcgaa

SEQ ID NO: 311145 - DNA, 25 bp, Mus musculus
gggcagccttcttcacggtcttggt

SEQ ID NO: 311146 - DNA, 25 bp, Mus musculus
tgatgacccgggcagccttcttcac

SEQ ID NO: 311147 - DNA, 25 bp, Mus musculus
ttacccagacgcgtgtagtacttct

SEQ ID NO: 311148 - DNA, 25 bp, Mus musculus
tggaagtcattacccagacgcgtgt

SEQ ID NO: 311149 - DNA, 25 bp, Mus musculus
cttgttggtgtggaagtcattaccc

SEQ ID NO: 311150 - DNA, 25 bp, Mus musculus
tggcgatctcctcgcacacgcgctt

SEQ ID NO: 311151 - DNA, 25 bp, Mus musculus
atcttgttccgaagcttcttgctgg

SEQ ID NO: 311152 - DNA, 25 bp, Mus musculus
tgttccgaagcttcttgctggggat

SEQ ID NO: 311153 - DNA, 25 bp, Mus musculus
ccggctatcttgttccgaagcttct

SEQ ID NO: 311154 - DNA, 25 bp, Mus musculus
acacgcgcttgttggtgtggaagtc

SEQ ID NO: 311155 - DNA, 25 bp, Mus musculus
gaagagtggacagggctctccaacc

SEQ ID NO: 311156 - DNA, 25 bp, Mus musculus
tcctgtcggtagtgaccggcttcgg

SEQ ID NO: 311157 - DNA, 25 bp, Mus musculus
gttgctaggcaacagtgcggcccgc

SEQ ID NO: 311158 - DNA, 25 bp, Mus musculus
ccatccgcctggttgctaggcaaca

SEQ ID NO: 311159 - DNA, 25 bp, Mus musculus
ccctttaaatccatccgcctggttg

SEQ ID NO: 311160 - DNA, 25 bp, Mus musculus
tcagtgcccggtccctttaaatcca

SEQ ID NO: 311161 - DNA, 25 bp, Mus musculus
ctaggcaacagtgcggcccgcgctg

SEQ ID NO: 311162 - DNA, 25 bp, Mus musculus
tcgtggtggctagcactgaacaagg

SEQ ID NO: 311163 - DNA, 25 bp, Mus musculus
tgaacaaggggctgcctcctgtcgg

SEQ ID NO: 311164 - DNA, 25 bp, Mus musculus
tgcctcctgtcggtagtgaccggct

SEQ ID NO: 311165 - DNA, 25 bp, Mus musculus
agtggacagggctctccaaccgcac

SEQ ID NO: 311166 - DNA, 25 bp, Mus musculus
cacccgcgcttccaggtatgtctgt

SEQ ID NO: 311167 - DNA, 25 bp, Mus musculus
cgcgcttccaggtatgtctgtgtaa

SEQ ID NO: 311168 - DNA, 25 bp, Mus musculus
tctgtgtaagggacatcccgggttc

SEQ ID NO: 311169 - DNA, 25 bp, Mus musculus
tggcggtggtctccttcattgtcag

SEQ ID NO: 311170 - DNA, 25 bp, Mus musculus
catgttaggcggcagcctagacttc

SEQ ID NO: 311171 - DNA, 25 bp, Mus musculus
acagaggctggcgacctagtgccgt

SEQ ID NO: 311172 - DNA, 25 bp, Mus musculus
ggccaatcagagtgcccggcgcgct

SEQ ID NO: 311173 - DNA, 25 bp, Mus musculus
cgcattgtcggtgctccctacagag

SEQ ID NO: 311174 - DNA, 25 bp, Mus musculus
ggcgcgctcgagacgtctcaacgtc

SEQ ID NO: 311175 - DNA, 25 bp, Mus musculus
tctctctctggcgggagaagacgaa

SEQ ID NO: 311176 - DNA, 25 bp, Mus musculus
ggcagtgccggagaaccgactcccg

SEQ ID NO: 311177 - DNA, 25 bp, Mus musculus
tctcctcgaatgaaaggaaactacc

SEQ ID NO: 311178 - DNA, 25 bp, Mus musculus
agaatagaaggtccgcgcgcgagca

SEQ ID NO: 311179 - DNA, 25 bp, Mus musculus
ggcgagcccgtctctcctcgaatga

SEQ ID NO: 311180 - DNA, 25 bp, Mus musculus
tctcaacgtcctgtgggtcgtgtgc

SEQ ID NO: 311181 - DNA, 25 bp, Mus musculus
cccgctcttcggcagtgccggagaa

SEQ ID NO: 311182 - DNA, 25 bp, Mus musculus
gctccctacagaggctggcgaccta

SEQ ID NO: 311183 - DNA, 25 bp, Mus musculus
tcgcttcggaagcatctgggcacca

SEQ ID NO: 311184 - DNA, 25 bp, Mus musculus
gagaccgtaccgcaaccgcgaagta

SEQ ID NO: 311185 - DNA, 25 bp, Mus musculus
aagccgcaggtgctgcttgctgtca

SEQ ID NO: 311186 - DNA, 25 bp, Mus musculus
acaattacaccagctcccggagggg

SEQ ID NO: 311187 - DNA, 25 bp, Mus musculus
ggagccgcacacctgtaagcatcta

SEQ ID NO: 311188 - DNA, 25 bp, Mus musculus
ctccgcaaggtagatggccacatcc

SEQ ID NO: 311189 - DNA, 25 bp, Mus musculus
tctgggcaccaactctggaagcaca

SEQ ID NO: 311190 - DNA, 25 bp, Mus musculus
aggaagtggtgtctgctctatgcaa

SEQ ID NO: 311191 - DNA, 25 bp, Mus musculus
tgctctatgcaaacgagacgccctc

SEQ ID NO: 311192 - DNA, 25 bp, Mus musculus
cgagacgccctctaggatgcttttg

SEQ ID NO: 311193 - DNA, 25 bp, Mus musculus
ggatgcttttggcttcccatcggaa

SEQ ID NO: 311194 - DNA, 25 bp, Mus musculus
gttctatgcaaataacgcccgagga

SEQ ID NO: 311195 - DNA, 25 bp, Mus musculus
cgcccgaggattcttatttgaacta

SEQ ID NO: 311196 - DNA, 25 bp, Mus musculus
atctaggacgcggaagcctttggac

SEQ ID NO: 311197 - DNA, 25 bp, Mus musculus
agggagagcgttgggcttacctcac

SEQ ID NO: 311198 - DNA, 25 bp, Mus musculus
catgcgcccggtggcacagtgacgc

SEQ ID NO: 311199 - DNA, 25 bp, Mus musculus
agccaaggggactccagcagagccc

SEQ ID NO: 311200 - DNA, 25 bp, Mus musculus
agtcccagcgtcgtggtgagccaag

SEQ ID NO: 311201 - DNA, 25 bp, Mus musculus
acccgcagtcccagcgtcgtggtga

SEQ ID NO: 311202 - DNA, 25 bp, Mus musculus
agaccgctttttgccgcgagccgac

SEQ ID NO: 311203 - DNA, 25 bp, Mus musculus
gctttttgccgcgagccgaccggtc

SEQ ID NO: 311204 - DNA, 25 bp, Mus musculus
tgggcttacctcactgctttccgga

SEQ ID NO: 311205 - DNA, 25 bp, Mus musculus
ttctgagccattgctgaggcggcga

SEQ ID NO: 311206 - DNA, 25 bp, Mus musculus
cagcgtttctgagccattgctgagg

SEQ ID NO: 311207 - DNA, 25 bp, Mus musculus
tggcaatggcgttggacttgacatg

SEQ ID NO: 311208 - DNA, 25 bp, Mus musculus
cactgctttccggagcggtagcacc

SEQ ID NO: 311209 - DNA, 25 bp, Mus musculus
aatggcgttggacttgacatgtgcg

SEQ ID NO: 311210 - DNA, 25 bp, Mus musculus
ggcttcctcctcagaccgctttttg

SEQ ID NO: 311211 - DNA, 25 bp, Mus musculus
cccaagaggcgagcgggagcagcca

SEQ ID NO: 311212 - DNA, 25 bp, Mus musculus
gtggtccgcagcagccctagaaaaa

SEQ ID NO: 311213 - DNA, 25 bp, Mus musculus
aatccggctggaatcgggttggagc

SEQ ID NO: 311214 - DNA, 25 bp, Mus musculus
ttagaagagcgagtcgcggagactt

SEQ ID NO: 311215 - DNA, 25 bp, Mus musculus
agacagacggacagcgagagagaaa

SEQ ID NO: 311216 - DNA, 25 bp, Mus musculus
aaacaagccggggaagctagagaga

SEQ ID NO: 311217 - DNA, 25 bp, Mus musculus
tggagccgagcgcaccccaagaggc

SEQ ID NO: 311218 - DNA, 25 bp, Mus musculus
gcagccagcgcccagtggtccgcag

SEQ ID NO: 311219 - DNA, 25 bp, Mus musculus
tccgcagcagccctagaaaaagccg

SEQ ID NO: 311220 - DNA, 25 bp, Mus musculus
agcagccctagaaaaagccggcccg

SEQ ID NO: 311221 - DNA, 25 bp, Mus musculus
cgcccaaccattcgcccgctcgctc

SEQ ID NO: 311222 - DNA, 25 bp, Mus musculus
agcgtcgacctagaaaacaagccgg

SEQ ID NO: 311223 - DNA, 25 bp, Mus musculus
tgctcctcagcgtcgacctagaaaa

SEQ ID NO: 311224 - DNA, 25 bp, Mus musculus
gaagctgctcctcagcgtcgaccta

SEQ ID NO: 311225 - DNA, 25 bp, Mus musculus
gcgccttacggctgctccaatgatc

SEQ ID NO: 311226 - DNA, 25 bp, Mus musculus
agcgcggctcggctacatttacaga

SEQ ID NO: 311227 - DNA, 25 bp, Mus musculus
gctgcctttgcagcgctagcaatga

SEQ ID NO: 311228 - DNA, 25 bp, Mus musculus
tccaatgatcctggggccaaggcgc

SEQ ID NO: 311229 - DNA, 25 bp, Mus musculus
tgcccgcctgcacgactcagaaaag

SEQ ID NO: 311230 - DNA, 25 bp, Mus musculus
tccgcatcttgtcgcccattgggca

SEQ ID NO: 311231 - DNA, 25 bp, Mus musculus
ttttgcctcccacgcttcagaaatg

SEQ ID NO: 311232 - DNA, 25 bp, Mus musculus
cgggaccctctggagctcaaattga

SEQ ID NO: 311233 - DNA, 25 bp, Mus musculus
ttattggctctaatgacccgcggga

SEQ ID NO: 311234 - DNA, 25 bp, Mus musculus
cccaaaatcttcctgcgtggcattg

SEQ ID NO: 311235 - DNA, 25 bp, Mus musculus
gcggcgctgcttctatctcttattg

SEQ ID NO: 311236 - DNA, 25 bp, Mus musculus
cctcagcgcagggatggcgcttttc

SEQ ID NO: 311237 - DNA, 25 bp, Mus musculus
gcaatgaggacttgacagctggcca

SEQ ID NO: 311238 - DNA, 25 bp, Mus musculus
tccacatgctcagggtctctgtcca

SEQ ID NO: 311239 - DNA, 25 bp, Mus musculus
cttgccagaggcctagaagtcctca

SEQ ID NO: 311240 - DNA, 25 bp, Mus musculus
tcgccatcaaacagctctggaaacg

SEQ ID NO: 311241 - DNA, 25 bp, Mus musculus
cgggagcttgtccatctcgccatca

SEQ ID NO: 311242 - DNA, 25 bp, Mus musculus
cgcgcgcatgcgagatctccaggca

SEQ ID NO: 311243 - DNA, 25 bp, Mus musculus
tctgcacgatgaactccgggagctt

SEQ ID NO: 311244 - DNA, 25 bp, Mus musculus
aggtcctgtcgtccaccaacatgta

SEQ ID NO: 311245 - DNA, 25 bp, Mus musculus
accaacatgtaggagccggtctgca

SEQ ID NO: 311246 - DNA, 25 bp, Mus musculus
aacacccgcttcatctcattcagga

SEQ ID NO: 311247 - DNA, 25 bp, Mus musculus
caggaagccgttgtaatcattgagc

SEQ ID NO: 311248 - DNA, 25 bp, Mus musculus
ctgtcgatcttgatgtaggggatca

SEQ ID NO: 311249 - DNA, 25 bp, Mus musculus
tcaccttgagctcgtcggtgtcgaa

SEQ ID NO: 311250 - DNA, 25 bp, Mus musculus
tgatgaggaacgtcaccttgagctc

SEQ ID NO: 311251 - DNA, 25 bp, Mus musculus
taggggatcacccactgcagggccc

SEQ ID NO: 311252 - DNA, 25 bp, Mus musculus
cagccacaggacaacacagcagcag

SEQ ID NO: 311253 - DNA, 25 bp, Mus musculus
ttgcagaacgcaccgtaggagctgc

SEQ ID NO: 311254 - DNA, 25 bp, Mus musculus
gaacgcaccgtaggagctgcgtgtc

SEQ ID NO: 311255 - DNA, 25 bp, Mus musculus
cccgccgcagtctggaggcactgtg

SEQ ID NO: 311256 - DNA, 25 bp, Mus musculus
ccgcagtctggaggcactgtgcgcc

SEQ ID NO: 311257 - DNA, 25 bp, Mus musculus
agggcgtttgctcactcgatccgca

SEQ ID NO: 311258 - DNA, 25 bp, Mus musculus
gggcgtttgctcactcgatccgcac

SEQ ID NO: 311259 - DNA, 25 bp, Mus musculus
aggccaccatgtagaagtaggggaa

SEQ ID NO: 311260 - DNA, 25 bp, Mus musculus
caccatgtagaagtaggggaagttc

SEQ ID NO: 311261 - DNA, 25 bp, Mus musculus
ccatgtagaagtaggggaagttcac

SEQ ID NO: 311262 - DNA, 25 bp, Mus musculus
aggggaagttcacgcgcaggcgcca

SEQ ID NO: 311263 - DNA, 25 bp, Mus musculus
gcaggcgccaggctaggtcgaagaa

SEQ ID NO: 311264 - DNA, 25 bp, Mus musculus
gacagtcgcactgccaggccagaca

SEQ ID NO: 311265 - DNA, 25 bp, Mus musculus
ccttgcagaacgcaccgtaggagct

SEQ ID NO: 311266 - DNA, 25 bp, Mus musculus
gtcgaagaaggtgagtagcgtgcgc

SEQ ID NO: 311267 - DNA, 25 bp, Mus musculus
taccttttcctctgtgaccaccacc

SEQ ID NO: 311268 - DNA, 25 bp, Mus musculus
ccctcgacaacctcggcaaggctca

SEQ ID NO: 311269 - DNA, 25 bp, Mus musculus
ctcggcaaggctcaccaccgcctcc

SEQ ID NO: 311270 - DNA, 25 bp, Mus musculus
aaccactatcgcctccattttcctc

SEQ ID NO: 311271 - DNA, 25 bp, Mus musculus
tcctcgacaaccactgcagtgctta

SEQ ID NO: 311272 - DNA, 25 bp, Mus musculus
acaaccactgcagtgcttatcactg

SEQ ID NO: 311273 - DNA, 25 bp, Mus musculus
actgcagtgcttatcactgcctcta

SEQ ID NO: 311274 - DNA, 25 bp, Mus musculus
cagtgcttatcactgcctctacctt

SEQ ID NO: 311275 - DNA, 25 bp, Mus musculus
ctcggtcaccaaaaccgctccattt

SEQ ID NO: 311276 - DNA, 25 bp, Mus musculus
cccttgggaacctagacagggatcg

SEQ ID NO: 311277 - DNA, 25 bp, Mus musculus
ggaacctagacagggatcgccaccg

SEQ ID NO: 311278 - DNA, 25 bp, Mus musculus
cagggatcgccaccgcctccatttt

SEQ ID NO: 311279 - DNA, 25 bp, Mus musculus
ttaccttctcctctgtgaccaccac

SEQ ID NO: 311280 - DNA, 25 bp, Mus musculus
ctcggcagggattgccaccgcctcc

SEQ ID NO: 311281 - DNA, 25 bp, Mus musculus
aggcgtagcctcaacgaaactctgc

SEQ ID NO: 311282 - DNA, 25 bp, Mus musculus
tcagagtaaagaagcggccgccatt

SEQ ID NO: 311283 - DNA, 25 bp, Mus musculus
ctagctgagtcgctgcgtcgtgcct

SEQ ID NO: 311284 - DNA, 25 bp, Mus musculus
gcctcaacgaaactctgcctagctg

SEQ ID NO: 311285 - DNA, 25 bp, Mus musculus
tgcgtcgtgcctccgccgcaggaga

SEQ ID NO: 311286 - DNA, 25 bp, Mus musculus
gggcgcaaaccaggcgtagcctcaa

SEQ ID NO: 311287 - DNA, 25 bp, Mus musculus
tagactgaccgacctcctcgcccgg

SEQ ID NO: 311288 - DNA, 25 bp, Mus musculus
gcgaccgccaggctagactgaccga

SEQ ID NO: 311289 - DNA, 25 bp, Mus musculus
actcgcgaccgccaggctagactga

SEQ ID NO: 311290 - DNA, 25 bp, Mus musculus
gacgcccggagttggactcgcgacc

SEQ ID NO: 311291 - DNA, 25 bp, Mus musculus
tttaggcgccttcggtattctccgc

SEQ ID NO: 311292 - DNA, 25 bp, Mus musculus
ttcttcacatcttgggccttgaaca

SEQ ID NO: 311293 - DNA, 25 bp, Mus musculus
ggccgccattcttcacatcttgggc

SEQ ID NO: 311294 - DNA, 25 bp, Mus musculus
aactctgcctagctgagtcgctgcg

SEQ ID NO: 311295 - DNA, 25 bp, Mus musculus
ccatttcccaatgtgcctcacggtg

SEQ ID NO: 311296 - DNA, 25 bp, Mus musculus
cccgagttggtagtttctggtcaca

SEQ ID NO: 311297 - DNA, 25 bp, Mus musculus
ttctggtcacattcatgtttgcagc

SEQ ID NO: 311298 - DNA, 25 bp, Mus musculus
tttgcagctgcgcagtatgcatacg

SEQ ID NO: 311299 - DNA, 25 bp, Mus musculus
tatgcatacgttgctagtcggcggc

SEQ ID NO: 311300 - DNA, 25 bp, Mus musculus
cctcacggtgctgtgagtgataact

SEQ ID NO: 311301 - DNA, 25 bp, Mus musculus
ctgtgagtgataactgggtgttgta

SEQ ID NO: 311302 - DNA, 25 bp, Mus musculus
gggtgttgtagtctcgccgcccttc

SEQ ID NO: 311303 - DNA, 25 bp, Mus musculus
ctggtccagcaacccgcaggatgtc

SEQ ID NO: 311304 - DNA, 25 bp, Mus musculus
tgcgcgccctagacgactttgtcct

SEQ ID NO: 311305 - DNA, 25 bp, Mus musculus
gatccacaacgatggtgtcaccgcg

SEQ ID NO: 311306 - DNA, 25 bp, Mus musculus
tggcgacgcttggtttcccagcagt

SEQ ID NO: 311307 - DNA, 25 bp, Mus musculus
ggctcctgatccaggcgatccacaa

SEQ ID NO: 311308 - DNA, 25 bp, Mus musculus
cagcagtctctgctacccgagttgg

SEQ ID NO: 311309 - DNA, 25 bp, Mus musculus
ggtgcatatccgcacgcaccctgta

SEQ ID NO: 311310 - DNA, 25 bp, Mus musculus
actgcatcctgtgctctggcagcgg

SEQ ID NO: 311311 - DNA, 25 bp, Mus musculus
gagtggcacgcgtccatccgtgcta

SEQ ID NO: 311312 - DNA, 25 bp, Mus musculus
cgtccatccgtgctaggggcacacg

SEQ ID NO: 311313 - DNA, 25 bp, Mus musculus
ccagggcgcatctgctctccaatta

SEQ ID NO: 311314 - DNA, 25 bp, Mus musculus
ctctgtcactgcatcctgtgctctg

SEQ ID NO: 311315 - DNA, 25 bp, Mus musculus
tgcgaacaggcgccaagcatacttc

SEQ ID NO: 311316 - DNA, 25 bp, Mus musculus
atggcggtgagccactactggctcg

SEQ ID NO: 311317 - DNA, 25 bp, Mus musculus
agccactactggctcggggaaggct

SEQ ID NO: 311318 - DNA, 25 bp, Mus musculus
gaaggctgagaagatccggtgcaaa

SEQ ID NO: 311319 - DNA, 25 bp, Mus musculus
aagatccggtgcaaaaggtggctcg

SEQ ID NO: 311320 - DNA, 25 bp, Mus musculus
gcagggcggtgcatatccgcacgca

SEQ ID NO: 311321 - DNA, 25 bp, Mus musculus
cctgtaccatcctactccgagtgtt

SEQ ID NO: 311322 - DNA, 25 bp, Mus musculus
ggggcacacggcaaaatctcctcca

SEQ ID NO: 311323 - DNA, 25 bp, Mus musculus
ggcactcatccttgcgttctgcaga

SEQ ID NO: 311324 - DNA, 25 bp, Mus musculus
cccaggctgcttaagtagctgctta

SEQ ID NO: 311325 - DNA, 25 bp, Mus musculus
tccggcgcgcgtctgaaaacatact

SEQ ID NO: 311326 - DNA, 25 bp, Mus musculus
tgaaaacatactgggatcggaagcc

SEQ ID NO: 311327 - DNA, 25 bp, Mus musculus
ttaagttggggacagaagcccaggc

SEQ ID NO: 311328 - DNA, 25 bp, Mus musculus
gcctgacagacgctgccacgtctta

SEQ ID NO: 311329 - DNA, 25 bp, Mus musculus
ctctccgcggccagagtggctgtta

SEQ ID NO: 311330 - DNA, 25 bp, Mus musculus
gttctgcagatcgtggccctcgagt

SEQ ID NO: 311331 - DNA, 25 bp, Mus musculus
atagctggagccctggcactcatcc

SEQ ID NO: 311332 - DNA, 25 bp, Mus musculus
ttcctcggtgaggatagctggagcc

SEQ ID NO: 311333 - DNA, 25 bp, Mus musculus
ccatagcggaggagtctggttcctc

SEQ ID NO: 311334 - DNA, 25 bp, Mus musculus
aggagacggcttcgtggcctccata

SEQ ID NO: 311335 - DNA, 25 bp, Mus musculus
cgtgacgtacatccggcgcgtagct

SEQ ID NO: 311336 - DNA, 25 bp, Mus musculus
gagcgtacgtcactccttaggcccg

SEQ ID NO: 311337 - DNA, 25 bp, Mus musculus
caccgcgatccctatggaagcgatc

SEQ ID NO: 311338 - DNA, 25 bp, Mus musculus
tgctgcaccgcgatccctatggaag

SEQ ID NO: 311339 - DNA, 25 bp, Mus musculus
cctatggaagcgatccaggagactc

SEQ ID NO: 311340 - DNA, 25 bp, Mus musculus
tccaggagactctggctgcctgctc

SEQ ID NO: 311341 - DNA, 25 bp, Mus musculus
ggagactctggctgcctgctcctca

SEQ ID NO: 311342 - DNA, 25 bp, Mus musculus
aacgccgccacaaattccacgaaga

SEQ ID NO: 311343 - DNA, 25 bp, Mus musculus
gccgccacaaattccacgaagaaga

SEQ ID NO: 311344 - DNA, 25 bp, Mus musculus
aacacgagcgccgactggaagaacg

SEQ ID NO: 311345 - DNA, 25 bp, Mus musculus
cgagcgccgactggaagaacgctga

SEQ ID NO: 311346 - DNA, 25 bp, Mus musculus
tggaagaacgctgagagcaccacca

SEQ ID NO: 311347 - DNA, 25 bp, Mus musculus
gaacgctgagagcaccaccatccat

SEQ ID NO: 311348 - DNA, 25 bp, Mus musculus
cccggacgccgcactcactcccaaa

SEQ ID NO: 311349 - DNA, 25 bp, Mus musculus
cactcactcccaaactgctgcaccg

SEQ ID NO: 311350 - DNA, 25 bp, Mus musculus
cacgaagaagacaccgaaggaacgg

SEQ ID NO: 311351 - DNA, 25 bp, Mus musculus
cggagctgagcagcggcaggtctgg

SEQ ID NO: 311352 - DNA, 25 bp, Mus musculus
cgactgtcgcgttgggcggcgacac

SEQ ID NO: 311353 - DNA, 25 bp, Mus musculus
gtgactgcggccctctctgctgctg

SEQ ID NO: 311354 - DNA, 25 bp, Mus musculus
aggccaatggcggtgactgcggccc

SEQ ID NO: 311355 - DNA, 25 bp, Mus musculus
agccaggccaatggcggtgactgcg

SEQ ID NO: 311356 - DNA, 25 bp, Mus musculus
gtgagccaggccaatggcggtgact

SEQ ID NO: 311357 - DNA, 25 bp, Mus musculus
gcgcagcgcattgagctggctctgc

SEQ ID NO: 311358 - DNA, 25 bp, Mus musculus
tggcgcagcgcattgagctggctct

SEQ ID NO: 311359 - DNA, 25 bp, Mus musculus
aaggctgcacggacccggagccctt

SEQ ID NO: 311360 - DNA, 25 bp, Mus musculus
gaaggctgcacggacccggagccct

SEQ ID NO: 311361 - DNA, 25 bp, Mus musculus
gcggagagctacaaaggcggcggtg

SEQ ID NO: 311362 - DNA, 25 bp, Mus musculus
agagagggcggagagctacaaaggc

SEQ ID NO: 311363 - DNA, 25 bp, Mus musculus
ctgagcagcggcaggtctggagaga

SEQ ID NO: 311364 - DNA, 25 bp, Mus musculus
gcgttgggcggcgacacgcagctcc

SEQ ID NO: 311365 - DNA, 25 bp, Mus musculus
tgcgttctgcaaggggctcacgcgc

SEQ ID NO: 311366 - DNA, 25 bp, Mus musculus
acggtgcgttctgcaaggggctcac

SEQ ID NO: 311367 - DNA, 25 bp, Mus musculus
tgtctggcctggcagtgcgactgtc

SEQ ID NO: 311368 - DNA, 25 bp, Mus musculus
gacacgcagctcctacggtgcgttc

SEQ ID NO: 311369 - DNA, 25 bp, Mus musculus
cacgcagctcctacggtgcgttctg

SEQ ID NO: 311370 - DNA, 25 bp, Mus musculus
cgcgcacgctactcaccttcttcga

SEQ ID NO: 311371 - DNA, 25 bp, Mus musculus
tcctacggtgcgttctgcaaggggc

SEQ ID NO: 311372 - DNA, 25 bp, Mus musculus
ggctcacgcgcacgctactcacctt

SEQ ID NO: 311373 - DNA, 25 bp, Mus musculus
accttcttcgacctagcctggcgcc

SEQ ID NO: 311374 - DNA, 25 bp, Mus musculus
gtgaacttcccctacttctacatgg

SEQ ID NO: 311375 - DNA, 25 bp, Mus musculus
tgcggatcgagtgagcaaacgccct

SEQ ID NO: 311376 - DNA, 25 bp, Mus musculus
cggatcgagtgagcaaacgccctcc

SEQ ID NO: 311377 - DNA, 25 bp, Mus musculus
agctcctacggtgcgttctgcaagg

SEQ ID NO: 311378 - DNA, 25 bp, Mus musculus
gatcgagtgagcaaacgccctccgc

SEQ ID NO: 311379 - DNA, 25 bp, Mus musculus
tgagcctccctactgcatcaaggta

SEQ ID NO: 311380 - DNA, 25 bp, Mus musculus
ggtacatgctggtcacctacgatga

SEQ ID NO: 311381 - DNA, 25 bp, Mus musculus
caatcgcctccgaagatggcggaca

SEQ ID NO: 311382 - DNA, 25 bp, Mus musculus
catcaaggtaaacaggccagcgggg

SEQ ID NO: 311383 - DNA, 25 bp, Mus musculus
aagagcgtgcgcgtccactagcctg

SEQ ID NO: 311384 - DNA, 25 bp, Mus musculus
gtccactagcctggggctgctgatc

SEQ ID NO: 311385 - DNA, 25 bp, Mus musculus
ggggctgctgatcccttttgcctcc

SEQ ID NO: 311386 - DNA, 25 bp, Mus musculus
actggagggccgagttcctagcacg

SEQ ID NO: 311387 - DNA, 25 bp, Mus musculus
ccgagttcctagcacggctgcagca

SEQ ID NO: 311388 - DNA, 25 bp, Mus musculus
cggctgcagcaatcgcctccgaaga

SEQ ID NO: 311389 - DNA, 25 bp, Mus musculus
tttgcttttgtatgaggcagccaga

SEQ ID NO: 311390 - DNA, 25 bp, Mus musculus
agatggcggacattttgcttttgta

SEQ ID NO: 311391 - DNA, 25 bp, Mus musculus
tggtcacctacgatgagcctcccta

SEQ ID NO: 311392 - DNA, 25 bp, Mus musculus
cggagacaggtacatgctggtcacc

SEQ ID NO: 311393 - DNA, 25 bp, Mus musculus
ggagcggcagcccaacaaaaggaga

SEQ ID NO: 311394 - DNA, 25 bp, Mus musculus
agaggtactcctcctttcaccggcg

SEQ ID NO: 311395 - DNA, 25 bp, Mus musculus
tccacgcggcgcaggaacatgacgt

SEQ ID NO: 311396 - DNA, 25 bp, Mus musculus
ggcaaaaagcccgacacctacaagc

SEQ ID NO: 311397 - DNA, 25 bp, Mus musculus
cttacgctgcgcagctgaaaaggca

SEQ ID NO: 311398 - DNA, 25 bp, Mus musculus
gtccctcagttacttacgctgcgca

SEQ ID NO: 311399 - DNA, 25 bp, Mus musculus
gaggcctcctctgcgactgcgcagt

SEQ ID NO: 311400 - DNA, 25 bp, Mus musculus
acagcgacacggaaaaagggcctga

SEQ ID NO: 311401 - DNA, 25 bp, Mus musculus
cgtccgcaaatacgcgccggatttg

SEQ ID NO: 311402 - DNA, 25 bp, Mus musculus
gcgacggcgccatgattcagaagga

SEQ ID NO: 311403 - DNA, 25 bp, Mus musculus
actgcgcagtgcagcttcccggaga

SEQ ID NO: 311404 - DNA, 25 bp, Mus musculus
agacgaggtagagcgtccgcaaata

SEQ ID NO: 311405 - DNA, 25 bp, Mus musculus
aagaacaggccgagcgagaccaatg

SEQ ID NO: 311406 - DNA, 25 bp, Mus musculus
gaacatgacgtcaccagagccctgg

SEQ ID NO: 311407 - DNA, 25 bp, Mus musculus
agagccatcggcaggacagcgccaa

SEQ ID NO: 311408 - DNA, 25 bp, Mus musculus
cgggcccgcttcctgcacgaaaccg

SEQ ID NO: 311409 - DNA, 25 bp, Mus musculus
ttgctcttcgcagtgagcttctttg

SEQ ID NO: 311410 - DNA, 25 bp, Mus musculus
cgcagtgagcttctttggctggacc

SEQ ID NO: 311411 - DNA, 25 bp, Mus musculus
agcttctttggctggaccggggctc

SEQ ID NO: 311412 - DNA, 25 bp, Mus musculus
gaccagagccatggacgaggagatc

SEQ ID NO: 311413 - DNA, 25 bp, Mus musculus
ttggttgctcttcgcagtgagcttc

SEQ ID NO: 311414 - DNA, 25 bp, Mus musculus
acgaggagatcgtgtccgagaagca

SEQ ID NO: 311415 - DNA, 25 bp, Mus musculus
tgacgatctggctcttcaagcaccg

SEQ ID NO: 311416 - DNA, 25 bp, Mus musculus
ctcaccattctgacgatctggctct

SEQ ID NO: 311417 - DNA, 25 bp, Mus musculus
cgccaacctgctcatcttcatcctg

SEQ ID NO: 311418 - DNA, 25 bp, Mus musculus
gctccgggggaacgaccagagccat

SEQ ID NO: 311419 - DNA, 25 bp, Mus musculus
ctttcccgtgagcccacggggagtg

SEQ ID NO: 311420 - DNA, 25 bp, Mus musculus
ctcatgcggcccctttggttgctct

SEQ ID NO: 311421 - DNA, 25 bp, Mus musculus
gctgcctgcagtgactcgtgactcc

SEQ ID NO: 311422 - DNA, 25 bp, Mus musculus
agcagccagcgaaggcctgagcccg

SEQ ID NO: 311423 - DNA, 25 bp, Mus musculus
tccgcgtgcccttcggacgcttgca

SEQ ID NO: 311424 - DNA, 25 bp, Mus musculus
ctgtgcgcgcctagccagcggcttg

SEQ ID NO: 311425 - DNA, 25 bp, Mus musculus
cagcggcttggcctctcccgaggcg

SEQ ID NO: 311426 - DNA, 25 bp, Mus musculus
cccttcccgcgcttgcccgactggg

SEQ ID NO: 311427 - DNA, 25 bp, Mus musculus
cgagcgcgatctgcccgcaccgcag

SEQ ID NO: 311428 - DNA, 25 bp, Mus musculus
cgccctacatccaccgcccggccga

SEQ ID NO: 311429 - DNA, 25 bp, Mus musculus
gctcagtcctgtgctgccgctgtcg

SEQ ID NO: 311430 - DNA, 25 bp, Mus musculus
tcgccgctgcgctttggtctcggag

SEQ ID NO: 311431 - DNA, 25 bp, Mus musculus
cctagacagctgcgcgggtgagcat

SEQ ID NO: 311432 - DNA, 25 bp, Mus musculus
ggtgagcatccccagacagtaagcc

SEQ ID NO: 311433 - DNA, 25 bp, Mus musculus
agtaagcccgctttccctccgcgag

SEQ ID NO: 311434 - DNA, 25 bp, Mus musculus
agctcgtgctccgtggccgctactc

SEQ ID NO: 311435 - DNA, 25 bp, Mus musculus
tcttcacttctctgaccgcggtgtc

SEQ ID NO: 311436 - DNA, 25 bp, Mus musculus
gttgcagtgcacagtccaagctctg

SEQ ID NO: 311437 - DNA, 25 bp, Mus musculus
tgcctcgcagacttcccagggtctg

SEQ ID NO: 311438 - DNA, 25 bp, Mus musculus
agcgacagcgctgaccatttgttgg

SEQ ID NO: 311439 - DNA, 25 bp, Mus musculus
ggggacttcgctctcaactcgttgc

SEQ ID NO: 311440 - DNA, 25 bp, Mus musculus
caataagtacagacacgcggcggca

SEQ ID NO: 311441 - DNA, 25 bp, Mus musculus
aggctgcgtccctaaaggccagttc

SEQ ID NO: 311442 - DNA, 25 bp, Mus musculus
cgaggttaacgaggtgccatgcatt

SEQ ID NO: 311443 - DNA, 25 bp, Mus musculus
ttcggccaaactcgtccggagcgca

SEQ ID NO: 311444 - DNA, 25 bp, Mus musculus
tcctttttcaggctatcgcttcggc

SEQ ID NO: 311445 - DNA, 25 bp, Mus musculus
ccgcgccagctctactggaagagtc

SEQ ID NO: 311446 - DNA, 25 bp, Mus musculus
ttcgcgaagcgggagaaacttgtcc

SEQ ID NO: 311447 - DNA, 25 bp, Mus musculus
ataagacaatcctcggctccagtgc

SEQ ID NO: 311448 - DNA, 25 bp, Mus musculus
gcgtgtacactaaggacaagcattc

SEQ ID NO: 311449 - DNA, 25 bp, Mus musculus
caggggacagccaaacctccgggag

SEQ ID NO: 311450 - DNA, 25 bp, Mus musculus
ctaccgattttcagaacggaacaga

SEQ ID NO: 311451 - DNA, 25 bp, Mus musculus
gccgcaccagtgacagctaccgatt

SEQ ID NO: 311452 - DNA, 25 bp, Mus musculus
tgcgacggtctcaagctcctctgag

SEQ ID NO: 311453 - DNA, 25 bp, Mus musculus
caagtctgtatggaaaacaggccaa

SEQ ID NO: 311454 - DNA, 25 bp, Mus musculus
gacatccagctctaacaagtctgta

SEQ ID NO: 311455 - DNA, 25 bp, Mus musculus
actatctcccgggaaacaaatgaca

SEQ ID NO: 311456 - DNA, 25 bp, Mus musculus
gtgtcttaaaatggcgcccgccgcc

SEQ ID NO: 311457 - DNA, 25 bp, Mus musculus
tccgggagacgcactcagataactg

SEQ ID NO: 311458 - DNA, 25 bp, Mus musculus
cggaacagaaatgacgctaggacga

SEQ ID NO: 311459 - DNA, 25 bp, Mus musculus
gacgctattctggtgttactcccgc

SEQ ID NO: 311460 - DNA, 25 bp, Mus musculus
gggcgaacaaaggagactgcaatct

SEQ ID NO: 311461 - DNA, 25 bp, Mus musculus
cttctgctttaaataggttgacacc

SEQ ID NO: 311462 - DNA, 25 bp, Mus musculus
cgactgcgcaacgagggcgaacaaa

SEQ ID NO: 311463 - DNA, 25 bp, Mus musculus
tttcctctgaccacctttcggggca

SEQ ID NO: 311464 - DNA, 25 bp, Mus musculus
gcccgaacccagaggagctaggctg

SEQ ID NO: 311465 - DNA, 25 bp, Mus musculus
tggtgacgcacgaggcccgaaccca

SEQ ID NO: 311466 - DNA, 25 bp, Mus musculus
agcgcggtgccctcaccttgaggcg

SEQ ID NO: 311467 - DNA, 25 bp, Mus musculus
cggcttcttaaggcagcgcggtgcc

SEQ ID NO: 311468 - DNA, 25 bp, Mus musculus
gcacagcgccacaagctctgagctg

SEQ ID NO: 311469 - DNA, 25 bp, Mus musculus
gtatatgcccgtacgtccagccagc

SEQ ID NO: 311470 - DNA, 25 bp, Mus musculus
gcgggacaccgagtatatgcccgta

SEQ ID NO: 311471 - DNA, 25 bp, Mus musculus
tctgaccacctttcggggcacaggc

SEQ ID NO: 311472 - DNA, 25 bp, Mus musculus
caggaaccggagaccgatccctcgg

SEQ ID NO: 311473 - DNA, 25 bp, Mus musculus
aaggcttcgcgccacaggaaccgga

SEQ ID NO: 311474 - DNA, 25 bp, Mus musculus
tacctgttgctgctgaaggcttcgc

SEQ ID NO: 311475 - DNA, 25 bp, Mus musculus
cccgcagcttacctgttgctgctga

SEQ ID NO: 311476 - DNA, 25 bp, Mus musculus
cacctttcggggcacaggcggctga

SEQ ID NO: 311477 - DNA, 25 bp, Mus musculus
tttccaaaaaggatctcggtgattg

SEQ ID NO: 311478 - DNA, 25 bp, Mus musculus
cgcaaagtgactgccacgtgagaaa

SEQ ID NO: 311479 - DNA, 25 bp, Mus musculus
cacgtgagaaagtctgtgaggcaca

SEQ ID NO: 311480 - DNA, 25 bp, Mus musculus
tctgtgaggcacataatacgcggca

SEQ ID NO: 311481 - DNA, 25 bp, Mus musculus
aatacgcggcacctcgttagggcca

SEQ ID NO: 311482 - DNA, 25 bp, Mus musculus
cctcgttagggccaggctggcattc

SEQ ID NO: 311483 - DNA, 25 bp, Mus musculus
attcggggagctaggcctgcaccat

SEQ ID NO: 311484 - DNA, 25 bp, Mus musculus
tctcggtgattggaccgagctcggc

SEQ ID NO: 311485 - DNA, 25 bp, Mus musculus
cccatcattcatttccctggacgtg

SEQ ID NO: 311486 - DNA, 25 bp, Mus musculus
tccctggacgtgctggtaaaaatgc

SEQ ID NO: 311487 - DNA, 25 bp, Mus musculus
atgcatcaaaacaggctgcggatcg

SEQ ID NO: 311488 - DNA, 25 bp, Mus musculus
ctgcggatcgcggtataaaagcaca

SEQ ID NO: 311489 - DNA, 25 bp, Mus musculus
tcggggttaccacgcaaagtgactg

SEQ ID NO: 311490 - DNA, 25 bp, Mus musculus
agcgggatgagctgctttccaaaaa

SEQ ID NO: 311491 - DNA, 25 bp, Mus musculus
aagtccatccttgtgggcgtttcca

SEQ ID NO: 311492 - DNA, 25 bp, Mus musculus
tcttctggctggaacggttacttac

SEQ ID NO: 311493 - DNA, 25 bp, Mus musculus
agggtccttgcactgccgcgcaggt

SEQ ID NO: 311494 - DNA, 25 bp, Mus musculus
gggccgcgtttgaccgcacacacaa

SEQ ID NO: 311495 - DNA, 25 bp, Mus musculus
gcacacacaagcgttcgccttcaga

SEQ ID NO: 311496 - DNA, 25 bp, Mus musculus
aagcgttcgccttcagaggcagatg

SEQ ID NO: 311497 - DNA, 25 bp, Mus musculus
ctcacctttaactcaggacgtccgt

SEQ ID NO: 311498 - DNA, 25 bp, Mus musculus
gacgtccgtttctggctgcacagcc

SEQ ID NO: 311499 - DNA, 25 bp, Mus musculus
gcagagacaaagtgcgcaggcgcca

SEQ ID NO: 311500 - DNA, 25 bp, Mus musculus
ccagcttgggtcttaggttttcctg

SEQ ID NO: 311501 - DNA, 25 bp, Mus musculus
cacccttcttcttctggctggaacg

SEQ ID NO: 311502 - DNA, 25 bp, Mus musculus
ggagtttgtgcgcacgcgctttttt

SEQ ID NO: 311503 - DNA, 25 bp, Mus musculus
gctttgggagcaccaggaatgaaga

SEQ ID NO: 311504 - DNA, 25 bp, Mus musculus
aggttttcctgctttgggagcacca

SEQ ID NO: 311505 - DNA, 25 bp, Mus musculus
ttacctgaacaaaacgcgagccgca

SEQ ID NO: 311506 - DNA, 25 bp, Mus musculus
cctgcgtatacgagggataattcca

SEQ ID NO: 311507 - DNA, 25 bp, Mus musculus
ggtacccacgtggtatggcttctcc

SEQ ID NO: 311508 - DNA, 25 bp, Mus musculus
tgggacacggatagggcttctctcc

SEQ ID NO: 311509 - DNA, 25 bp, Mus musculus
ctctccggtgtggatgagcacgtgt

SEQ ID NO: 311510 - DNA, 25 bp, Mus musculus
tgtgcgcgtaggtgtgccacctaaa

SEQ ID NO: 311511 - DNA, 25 bp, Mus musculus
cagagccttgagatcaccttgggga

SEQ ID NO: 311512 - DNA, 25 bp, Mus musculus
tattaggctgtatagggtacccacg

SEQ ID NO: 311513 - DNA, 25 bp, Mus musculus
gcaggtctcacacttgtacggtttc

SEQ ID NO: 311514 - DNA, 25 bp, Mus musculus
tacggtttctctccggaatggatgc

SEQ ID NO: 311515 - DNA, 25 bp, Mus musculus
gaatggatgcggctgtgtgttttta

SEQ ID NO: 311516 - DNA, 25 bp, Mus musculus
tcggttaaaacgtgctccgcagatg

SEQ ID NO: 311517 - DNA, 25 bp, Mus musculus
aagacagtcagatcgccctacggga

SEQ ID NO: 311518 - DNA, 25 bp, Mus musculus
gtgccacctaaagggcagagccttg

SEQ ID NO: 311519 - DNA, 25 bp, Mus musculus
atcattgtgtcggtggccaatgggc

SEQ ID NO: 311520 - DNA, 25 bp, Mus musculus
ttgctcctgaaagccgggacccgag

SEQ ID NO: 311521 - DNA, 25 bp, Mus musculus
tgcttcttggtgcagttgctcctga

SEQ ID NO: 311522 - DNA, 25 bp, Mus musculus
cacgttccgcctctgcttcttggtg

SEQ ID NO: 311523 - DNA, 25 bp, Mus musculus
agtgaggttcgagcctgcttactgc

SEQ ID NO: 311524 - DNA, 25 bp, Mus musculus
actcgcgaagcgagcagtgaggttc

SEQ ID NO: 311525 - DNA, 25 bp, Mus musculus
ccaaggacattactctggaggtgaa

SEQ ID NO: 311526 - DNA, 25 bp, Mus musculus
tgactttatcagtccaaggacatta

SEQ ID NO: 311527 - DNA, 25 bp, Mus musculus
ctcccgctcggtttatgtgcgagga

SEQ ID NO: 311528 - DNA, 25 bp, Mus musculus
gcttcgcgctgccaatcattgtgtc

SEQ ID NO: 311529 - DNA, 25 bp, Mus musculus
gcagcggctgccatgttctccgctt

SEQ ID NO: 311530 - DNA, 25 bp, Mus musculus
tacccaatcagctggggtcgcccgg

SEQ ID NO: 311531 - DNA, 25 bp, Mus musculus
ggatccctttcagggacgctgagca

SEQ ID NO: 311532 - DNA, 25 bp, Mus musculus
cgaggagtgagtgattgactttatc

SEQ ID NO: 311533 - DNA, 25 bp, Mus musculus
tcctgggcttcatgagcagggcgct

SEQ ID NO: 311534 - DNA, 25 bp, Mus musculus
cagcacgggcttttcgctggctcgg

SEQ ID NO: 311535 - DNA, 25 bp, Mus musculus
tttctgttccgtcagcgcggttctg

SEQ ID NO: 311536 - DNA, 25 bp, Mus musculus
ggctcggcgagcagtcttcacgctc

SEQ ID NO: 311537 - DNA, 25 bp, Mus musculus
ttcacgctccagctggtattcctga

SEQ ID NO: 311538 - DNA, 25 bp, Mus musculus
agctacttgctctttcctgggcttc

SEQ ID NO: 311539 - DNA, 25 bp, Mus musculus
acgcgcgactttctgttccgtcagc

SEQ ID NO: 311540 - DNA, 25 bp, Mus musculus
tcgcccacagggcacgtggacaaca

SEQ ID NO: 311541 - DNA, 25 bp, Mus musculus
agggcacgtggacaacaaccaggtc

SEQ ID NO: 311542 - DNA, 25 bp, Mus musculus
aacaaccaggtccatctggggctgc

SEQ ID NO: 311543 - DNA, 25 bp, Mus musculus
agctatttggccgtgcagacccata

SEQ ID NO: 311544 - DNA, 25 bp, Mus musculus
gccagtgcgcagttccctaactata

SEQ ID NO: 311545 - DNA, 25 bp, Mus musculus
cgggcgccttcttccgttacatgcg

SEQ ID NO: 311546 - DNA, 25 bp, Mus musculus
attcctgagcctcctagctacttgc

SEQ ID NO: 311547 - DNA, 25 bp, Mus musculus
cctggttattcctcagcgctggcgc

SEQ ID NO: 311548 - DNA, 25 bp, Mus musculus
ggtttctgcccgctgaccctttgac

SEQ ID NO: 311549 - DNA, 25 bp, Mus musculus
cggcggggctgtaaagcagaaatca

SEQ ID NO: 311550 - DNA, 25 bp, Mus musculus
ggggtcaattcgagcccaaacaata

SEQ ID NO: 311551 - DNA, 25 bp, Mus musculus
tagcgctgccagcaaactttgtgtt

SEQ ID NO: 311552 - DNA, 25 bp, Mus musculus
tgttcaattccttttccactggcgg

SEQ ID NO: 311553 - DNA, 25 bp, Mus musculus
gccctcttgctaggctctccaaaga

SEQ ID NO: 311554 - DNA, 25 bp, Mus musculus
gaggctcctgcattccctgagtatg

SEQ ID NO: 311555 - DNA, 25 bp, Mus musculus
ggctgatccaaaaggggcctcctcg

SEQ ID NO: 311556 - DNA, 25 bp, Mus musculus
tcggcactgcgaacacactttgaag

SEQ ID NO: 311557 - DNA, 25 bp, Mus musculus
ctttgaagtgggtttttagcgcgca

SEQ ID NO: 311558 - DNA, 25 bp, Mus musculus
ccttgcagccgtcgagcaggatttt

SEQ ID NO: 311559 - DNA, 25 bp, Mus musculus
ccgtgctgtgttgtccttgagattt

SEQ ID NO: 311560 - DNA, 25 bp, Mus musculus
tggtccgcgaaggaagaacacttgc

SEQ ID NO: 311561 - DNA, 25 bp, Mus musculus
gccgcctgaagaccggcaaaagttg

SEQ ID NO: 311562 - DNA, 25 bp, Mus musculus
agcatgccttctgagctcctccgaa

SEQ ID NO: 311563 - DNA, 25 bp, Mus musculus
gtctccttagcctgcgcttgcttgg

SEQ ID NO: 311564 - DNA, 25 bp, Mus musculus
aggcaccctccagaagagcgcgaca

SEQ ID NO: 311565 - DNA, 25 bp, Mus musculus
caggaattcagtcgctgcaggcacc

SEQ ID NO: 311566 - DNA, 25 bp, Mus musculus
agctcctccgaaggtgctcgggctc

SEQ ID NO: 311567 - DNA, 25 bp, Mus musculus
tcccgcagggatcaaacaggtaatg

SEQ ID NO: 311568 - DNA, 25 bp, Mus musculus
gcgcttccactagtccttgcaactt

SEQ ID NO: 311569 - DNA, 25 bp, Mus musculus
ttctggtagccttggtccgaaccga

SEQ ID NO: 311570 - DNA, 25 bp, Mus musculus
gacacggtgcaagtccaagcggctc

SEQ ID NO: 311571 - DNA, 25 bp, Mus musculus
agtccttgcaacttcgccgcctgaa

SEQ ID NO: 311572 - DNA, 25 bp, Mus musculus
cagagagctgcgcttgtgactgcgt

SEQ ID NO: 311573 - DNA, 25 bp, Mus musculus
gcttctgggcactccggcttcagtc

SEQ ID NO: 311574 - DNA, 25 bp, Mus musculus
acaggtaatggcctggcatcgtcgc

SEQ ID NO: 311575 - DNA, 25 bp, Mus musculus
tgtgagcctgttacaccgcagagcc

SEQ ID NO: 311576 - DNA, 25 bp, Mus musculus
agtcgcgaccgcgagctctcagtgt

SEQ ID NO: 311577 - DNA, 25 bp, Mus musculus
cgcgctccagaagtgcagagacaaa

SEQ ID NO: 311578 - DNA, 25 bp, Mus musculus
tgcctgggtgttctgcccaagctct

SEQ ID NO: 311579 - DNA, 25 bp, Mus musculus
cccaagctctactgggtagcttttc

SEQ ID NO: 311580 - DNA, 25 bp, Mus musculus
ctgctgagccgccaactcaatcaaa

SEQ ID NO: 311581 - DNA, 25 bp, Mus musculus
acatgtgatgagcaacgtgtgagcc

SEQ ID NO: 311582 - DNA, 25 bp, Mus musculus
tataaacgacaaggtgtgggcacgc

SEQ ID NO: 311583 - DNA, 25 bp, Mus musculus
gaggttcgctcctttctatttagtc

SEQ ID NO: 311584 - DNA, 25 bp, Mus musculus
tttagtccgttttcagattcctgtc

SEQ ID NO: 311585 - DNA, 25 bp, Mus musculus
tctccgggcaaagaactctctgatc

SEQ ID NO: 311586 - DNA, 25 bp, Mus musculus
ccgcctgccggctgtagtaaaaaca

SEQ ID NO: 311587 - DNA, 25 bp, Mus musculus
gcactggggtgcgttctatataaac

SEQ ID NO: 311588 - DNA, 25 bp, Mus musculus
cagacgtcagctgccgccttgcaaa

SEQ ID NO: 311589 - DNA, 25 bp, Mus musculus
taactcgtccgttggcgccgcttcg

SEQ ID NO: 311590 - DNA, 25 bp, Mus musculus
tgggaaggcgccgtccacaaaacac

SEQ ID NO: 311591 - DNA, 25 bp, Mus musculus
tggaggcagagttcctcagagcctc

SEQ ID NO: 311592 - DNA, 25 bp, Mus musculus
agtgtactcaccaaacggttgaggg

SEQ ID NO: 311593 - DNA, 25 bp, Mus musculus
tcgaggcttccaggcgtgcccgctt

SEQ ID NO: 311594 - DNA, 25 bp, Mus musculus
ccggcggaacatcgcgtccgaggct

SEQ ID NO: 311595 - DNA, 25 bp, Mus musculus
agccgcggccagtgtactcaccaaa

SEQ ID NO: 311596 - DNA, 25 bp, Mus musculus
tcctcagagcctcggggaacctcag

SEQ ID NO: 311597 - DNA, 25 bp, Mus musculus
cacaaaacacactgcggcgtgggcc

SEQ ID NO: 311598 - DNA, 25 bp, Mus musculus
gcaaagcggacagctagctcgcctg

SEQ ID NO: 311599 - DNA, 25 bp, Mus musculus
actcccaggggtctgtgaggagcca

SEQ ID NO: 311600 - DNA, 25 bp, Mus musculus
ctgtgaggagccacggtctccctca

SEQ ID NO: 311601 - DNA, 25 bp, Mus musculus
acctcagctgaaatgtcccggggca

SEQ ID NO: 311602 - DNA, 25 bp, Mus musculus
cgcccagcacttctggctgaggaga

SEQ ID NO: 311603 - DNA, 25 bp, Mus musculus
tccctaatcagcaccccagatgtga

SEQ ID NO: 311604 - DNA, 25 bp, Mus musculus
gtccacccaaaaaatattgtgtgca

SEQ ID NO: 311605 - DNA, 25 bp, Mus musculus
agctgacaagtccacccaaaaaata

SEQ ID NO: 311606 - DNA, 25 bp, Mus musculus
ttggaagaagctgacaagtccaccc

SEQ ID NO: 311607 - DNA, 25 bp, Mus musculus
ctcatttggaagaagctgacaagtc

SEQ ID NO: 311608 - DNA, 25 bp, Mus musculus
caaaaaatattgtgtgcaaaggggc

SEQ ID NO: 311609 - DNA, 25 bp, Mus musculus
caccagctcatttggaagaagctga

SEQ ID NO: 311610 - DNA, 25 bp, Mus musculus
tttcaccagctcatttggaagaagc

SEQ ID NO: 311611 - DNA, 25 bp, Mus musculus
tgtaaaatttcaccagctcatttgg

SEQ ID NO: 311612 - DNA, 25 bp, Mus musculus
tcagtgacaacacggggctgtaaaa

SEQ ID NO: 311613 - DNA, 25 bp, Mus musculus
cctaatcctcagtgacaacacgggg

SEQ ID NO: 311614 - DNA, 25 bp, Mus musculus
tgtgaaaaacaacagaaagttgctc

SEQ ID NO: 311615 - DNA, 25 bp, Mus musculus
acagaaagttgctcccctaatcctc

SEQ ID NO: 311616 - DNA, 25 bp, Mus musculus
tcctcagtgacaacacggggctgta

SEQ ID NO: 311617 - DNA, 25 bp, Mus musculus
catggccgtgaccagcctctacaaa

SEQ ID NO: 311618 - DNA, 25 bp, Mus musculus
cagaggctctggcacctcttccaga

SEQ ID NO: 311619 - DNA, 25 bp, Mus musculus
aggctctggcacctcttccagatct

SEQ ID NO: 311620 - DNA, 25 bp, Mus musculus
agatctcagccacggcagtggccca

SEQ ID NO: 311621 - DNA, 25 bp, Mus musculus
tggcccagctctacaaagattccgg

SEQ ID NO: 311622 - DNA, 25 bp, Mus musculus
tctacaaagattccgggtgccagca

SEQ ID NO: 311623 - DNA, 25 bp, Mus musculus
agcgccagtgccttgcagaggcgga

SEQ ID NO: 311624 - DNA, 25 bp, Mus musculus
ccagcagccaggactctctatgtgg

SEQ ID NO: 311625 - DNA, 25 bp, Mus musculus
agccaggactctctatgtgggaccc

SEQ ID NO: 311626 - DNA, 25 bp, Mus musculus
ttccagaacgcggccatggccgtga

SEQ ID NO: 311627 - DNA, 25 bp, Mus musculus
gccgtgaccagcctctacaaagaga

SEQ ID NO: 311628 - DNA, 25 bp, Mus musculus
ccagcctctacaaagagagcgggga

SEQ ID NO: 311629 - DNA, 25 bp, Mus musculus
gctcaagatcgagcgccagaggctc

SEQ ID NO: 311630 - DNA, 25 bp, Mus musculus
tatgtgggaccccttccagaacgcg

SEQ ID NO: 311631 - DNA, 25 bp, Mus musculus
ccagtgcacagaggtaaaagtgctc

SEQ ID NO: 311632 - DNA, 25 bp, Mus musculus
aagcagacactcgatcccgggcact

SEQ ID NO: 311633 - DNA, 25 bp, Mus musculus
tcgctgcggaagcagacactcgatc

SEQ ID NO: 311634 - DNA, 25 bp, Mus musculus
cgctctgcatcgctgcggaagcaga

SEQ ID NO: 311635 - DNA, 25 bp, Mus musculus
ctcccgcgttagctaccgcggtgga

SEQ ID NO: 311636 - DNA, 25 bp, Mus musculus
accaccgcaatcaacaagtgcaaga

SEQ ID NO: 311637 - DNA, 25 bp, Mus musculus
agtgctcagcttttggtaagtcttc

SEQ ID NO: 311638 - DNA, 25 bp, Mus musculus
ttcaactcagcgagtatcttcccgc

SEQ ID NO: 311639 - DNA, 25 bp, Mus musculus
tgtaaatatttcaactcagcgagta

SEQ ID NO: 311640 - DNA, 25 bp, Mus musculus
tcattgagatttccgaagggctttc

SEQ ID NO: 311641 - DNA, 25 bp, Mus musculus
ttaaagacgatcattgagatttccg

SEQ ID NO: 311642 - DNA, 25 bp, Mus musculus
ctaccgcggtggaaatactcatttc

SEQ ID NO: 311643 - DNA, 25 bp, Mus musculus
ttgagcgctcactctcccgcgttag

SEQ ID NO: 311644 - DNA, 25 bp, Mus musculus
tttggtaagtcttccgcagccgcag

SEQ ID NO: 311645 - DNA, 25 bp, Mus musculus
atagcgacctaagcctgcgacagcc

SEQ ID NO: 311646 - DNA, 25 bp, Mus musculus
acctgcaagcgataagaactgcctt

SEQ ID NO: 311647 - DNA, 25 bp, Mus musculus
agaggatctaggcattactaaaaca

SEQ ID NO: 311648 - DNA, 25 bp, Mus musculus
cctgcgacagccaccgaaaaagtta

SEQ ID NO: 311649 - DNA, 25 bp, Mus musculus
tgtggaacccatagcgacctaagcc

SEQ ID NO: 311650 - DNA, 25 bp, Mus musculus
cctctggggccgctgtggaacccat

SEQ ID NO: 311651 - DNA, 25 bp, Mus musculus
ggtgaactctcggacgtagcccaga

SEQ ID NO: 311652 - DNA, 25 bp, Mus musculus
tcagattgctaagcacgtcggagga

SEQ ID NO: 311653 - DNA, 25 bp, Mus musculus
cgcaggcgcagctcattcagattgc

SEQ ID NO: 311654 - DNA, 25 bp, Mus musculus
acgtcagtgaggatcccgcgcaggc

SEQ ID NO: 311655 - DNA, 25 bp, Mus musculus
ccaaccagcagcgtgacgtcagtga

SEQ ID NO: 311656 - DNA, 25 bp, Mus musculus
gctcttaggggttgcccgccaacca

SEQ ID NO: 311657 - DNA, 25 bp, Mus musculus
agaactgccttgtgcgctcttaggg

SEQ ID NO: 311658 - DNA, 25 bp, Mus musculus
gccaccgaaaaagttagaggatcta

SEQ ID NO: 311659 - DNA, 25 bp, Mus musculus
gggtgatgactcacggcccatccca

SEQ ID NO: 311660 - DNA, 25 bp, Mus musculus
ttgctcaggaggtatggcccaacca

SEQ ID NO: 311661 - DNA, 25 bp, Mus musculus
ctgccttgctcaggaggtatggccc

SEQ ID NO: 311662 - DNA, 25 bp, Mus musculus
aatctcccggctgcaactggctgcc

SEQ ID NO: 311663 - DNA, 25 bp, Mus musculus
ttagggcgggctctccaatctcccg

SEQ ID NO: 311664 - DNA, 25 bp, Mus musculus
accgctcgaagtcgtggcttagggc

SEQ ID NO: 311665 - DNA, 25 bp, Mus musculus
ccctaccgctcgaagtcgtggctta

SEQ ID NO: 311666 - DNA, 25 bp, Mus musculus
cagtgtggtcacttcctgtggagtt

SEQ ID NO: 311667 - DNA, 25 bp, Mus musculus
cacgcagtgctagctccatggctta

SEQ ID NO: 311668 - DNA, 25 bp, Mus musculus
tccatggcttaacggaggaggcagc

SEQ ID NO: 311669 - DNA, 25 bp, Mus musculus
ggtatggcccaaccagacttccatc

SEQ ID NO: 311670 - DNA, 25 bp, Mus musculus
atgtctcatgcagccgagccagctc

SEQ ID NO: 311671 - DNA, 25 bp, Mus musculus
agccgggcgtcatgtctcatgcagc

SEQ ID NO: 311672 - DNA, 25 bp, Mus musculus
gaagccggtgttccctaccgctcga

SEQ ID NO: 311673 - DNA, 25 bp, Mus musculus
cgggcttctctcacctgatgcgttc

SEQ ID NO: 311674 - DNA, 25 bp, Mus musculus
tcgccgtgatgagtcctggccaatc

SEQ ID NO: 311675 - DNA, 25 bp, Mus musculus
acccgctctgagaccaccaattagg

SEQ ID NO: 311676 - DNA, 25 bp, Mus musculus
gtagtccgggtactccttcatgtgc

SEQ ID NO: 311677 - DNA, 25 bp, Mus musculus
tcatgtgcaccgcacgcagtcgctt

SEQ ID NO: 311678 - DNA, 25 bp, Mus musculus
cgcttctccgcatcggtcagcagtt

SEQ ID NO: 311679 - DNA, 25 bp, Mus musculus
tcagcagtttccagtcggcgcccaa

SEQ ID NO: 311680 - DNA, 25 bp, Mus musculus
gcgttctctcgagctggtcgcattc

SEQ ID NO: 311681 - DNA, 25 bp, Mus musculus
ccacggggttcttgagttcagtctc

SEQ ID NO: 311682 - DNA, 25 bp, Mus musculus
ctccgcgcaaagtcggcgggaactc

SEQ ID NO: 311683 - DNA, 25 bp, Mus musculus
ttcagtctccagcaggctgtacatc

SEQ ID NO: 311684 - DNA, 25 bp, Mus musculus
cgagtgacgtgatgagagctttttc

SEQ ID NO: 311685 - DNA, 25 bp, Mus musculus
agctttttcaggaggcgggagtcca

SEQ ID NO: 311686 - DNA, 25 bp, Mus musculus
ccggtcccttatatacctgctcaga

SEQ ID NO: 311687 - DNA, 25 bp, Mus musculus
tgggtacccggaccgagcagcagcc

SEQ ID NO: 311688 - DNA, 25 bp, Mus musculus
ggccttcagtccctctgcgcacaca

SEQ ID NO: 311689 - DNA, 25 bp, Mus musculus
gtccctctgcgcacacatttctccg

SEQ ID NO: 311690 - DNA, 25 bp, Mus musculus
cagcagcctcctcgcaggcttggtg

SEQ ID NO: 311691 - DNA, 25 bp, Mus musculus
cagcctcctcgcaggcttggtggcg

SEQ ID NO: 311692 - DNA, 25 bp, Mus musculus
atcccagtgcccagagccggcgcgc

SEQ ID NO: 311693 - DNA, 25 bp, Mus musculus
caatgttttgccgcatcccagtgcc

SEQ ID NO: 311694 - DNA, 25 bp, Mus musculus
ggcgtgtaccgcaatgttttgccgc

SEQ ID NO: 311695 - DNA, 25 bp, Mus musculus
ccgctggcgtgtaccgcaatgtttt

SEQ ID NO: 311696 - DNA, 25 bp, Mus musculus
gagcgctacctcgacctggaggcga

SEQ ID NO: 311697 - DNA, 25 bp, Mus musculus
acctcgacctggaggcgacgcggtt

SEQ ID NO: 311698 - DNA, 25 bp, Mus musculus
gcgctacctcgacctggaggcgacg

SEQ ID NO: 311699 - DNA, 25 bp, Mus musculus
gcggggtactgtgcacgatgtcgcg

SEQ ID NO: 311700 - DNA, 25 bp, Mus musculus
cttgggtacccggaccgagcagcag

SEQ ID NO: 311701 - DNA, 25 bp, Mus musculus
gcctttagcaggcaagcaagcgggc

SEQ ID NO: 311702 - DNA, 25 bp, Mus musculus
agcctggaagaagcagcgcgccttt

SEQ ID NO: 311703 - DNA, 25 bp, Mus musculus
cgggctgcacctttacatacacgcg

SEQ ID NO: 311704 - DNA, 25 bp, Mus musculus
cgcacacgggctgcacctttacata

SEQ ID NO: 311705 - DNA, 25 bp, Mus musculus
gaagcagcgcgcctttccttgcagc

SEQ ID NO: 311706 - DNA, 25 bp, Mus musculus
cgcagcccgggcttgaaattcactc

SEQ ID NO: 311707 - DNA, 25 bp, Mus musculus
ggcttgaaattcactcacctctgga

SEQ ID NO: 311708 - DNA, 25 bp, Mus musculus
caagtcctgtggagggcccactgct

SEQ ID NO: 311709 - DNA, 25 bp, Mus musculus
tgctttccgactcgctcctcagttt

SEQ ID NO: 311710 - DNA, 25 bp, Mus musculus
tggtcaagcccacagaacagccttt

SEQ ID NO: 311711 - DNA, 25 bp, Mus musculus
tcttggctcccgctcgctggtcaag

SEQ ID NO: 311712 - DNA, 25 bp, Mus musculus
agtttccgcgatgctctctacttga

SEQ ID NO: 311713 - DNA, 25 bp, Mus musculus
atgctctctacttgatctgggatcc

SEQ ID NO: 311714 - DNA, 25 bp, Mus musculus
atctgggatccagcttcttggctcc

SEQ ID NO: 311715 - DNA, 25 bp, Mus musculus
cctgctggacgaacggccgttacga

SEQ ID NO: 311716 - DNA, 25 bp, Mus musculus
ccgagtttgtcagcgaagcgggaat

SEQ ID NO: 311717 - DNA, 25 bp, Mus musculus
gcgctttctacaaggtaaccggcta

SEQ ID NO: 311718 - DNA, 25 bp, Mus musculus
cggggctccaatggcgctttctaca

SEQ ID NO: 311719 - DNA, 25 bp, Mus musculus
gagcccttggcctcagtcagtcagg

SEQ ID NO: 311720 - DNA, 25 bp, Mus musculus
cgcgggtcacgtgacatcgtttgac

SEQ ID NO: 311721 - DNA, 25 bp, Mus musculus
cgcgccaaagggtgcgccctgatac

SEQ ID NO: 311722 - DNA, 25 bp, Mus musculus
caaataatcctctcccagtgggttc

SEQ ID NO: 311723 - DNA, 25 bp, Mus musculus
gccctgataccctgaggcaggtacc

SEQ ID NO: 311724 - DNA, 25 bp, Mus musculus
cggcttagtccagctttcccaaata

SEQ ID NO: 311725 - DNA, 25 bp, Mus musculus
tcctgtacggaagaggcctctagtc

SEQ ID NO: 311726 - DNA, 25 bp, Mus musculus
cgggcacaggcagccagacttagta

SEQ ID NO: 311727 - DNA, 25 bp, Mus musculus
gccagacttagtactgccctttacg

SEQ ID NO: 311728 - DNA, 25 bp, Mus musculus
tttgactgtttacaggaggcgcagc

SEQ ID NO: 311729 - DNA, 25 bp, Mus musculus
tggatcctgtggtccgcgagtgctt

SEQ ID NO: 311730 - DNA, 25 bp, Mus musculus
cgcttggatcctgtggtccgcgagt

SEQ ID NO: 311731 - DNA, 25 bp, Mus musculus
gtccgcgagtgcttgctgtgagcct

SEQ ID NO: 311732 - DNA, 25 bp, Mus musculus
ccggctctctgaggggcgcggagac

SEQ ID NO: 311733 - DNA, 25 bp, Mus musculus
agtgcttgctgtgagcctgccgcgc

SEQ ID NO: 311734 - DNA, 25 bp, Mus musculus
tcgctcccgcagtgcaaagacgacg

SEQ ID NO: 311735 - DNA, 25 bp, Mus musculus
cgtgaaactggagttcccctcgctc

SEQ ID NO: 311736 - DNA, 25 bp, Mus musculus
tggaggacgtgaaactggagttccc

SEQ ID NO: 311737 - DNA, 25 bp, Mus musculus
ctcccgcagtgcaaagacgacgccg

SEQ ID NO: 311738 - DNA, 25 bp, Mus musculus
catggaggacgtgaaactggagttc

SEQ ID NO: 311739 - DNA, 25 bp, Mus musculus
cctgggaccatggaggacgtgaaac

SEQ ID NO: 311740 - DNA, 25 bp, Mus musculus
cgcgagtgcttgctgtgagcctgcc

SEQ ID NO: 311741 - DNA, 25 bp, Mus musculus
tgctgtgagcctgccgcgcgtcagc

SEQ ID NO: 311742 - DNA, 25 bp, Mus musculus
cagccgcttggatcctgtggtccgc

SEQ ID NO: 311743 - DNA, 25 bp, Mus musculus
ggtcaggctcttgcctgcccggtgc

SEQ ID NO: 311744 - DNA, 25 bp, Mus musculus
atgcggccccagcacttttaaccgg

SEQ ID NO: 311745 - DNA, 25 bp, Mus musculus
ccaggcgaccccagctctaagcggc

SEQ ID NO: 311746 - DNA, 25 bp, Mus musculus
ggaccagagcgggaggtcaggctct

SEQ ID NO: 311747 - DNA, 25 bp, Mus musculus
taggagggccagagagccgcgccgc

SEQ ID NO: 311748 - DNA, 25 bp, Mus musculus
taaccgggtaggagggccagagagc

SEQ ID NO: 311749 - DNA, 25 bp, Mus musculus
ctccggagcgcaggactaggtaccc

SEQ ID NO: 311750 - DNA, 25 bp, Mus musculus
gtgccatcgcttccgctgccgccac

SEQ ID NO: 311751 - DNA, 25 bp, Mus musculus
cctgcccggtgccatcgcttccgct

SEQ ID NO: 311752 - DNA, 25 bp, Mus musculus
cagctcagagccgcgccgacacgca

SEQ ID NO: 311753 - DNA, 25 bp, Mus musculus
gaggtcaggctcttgcctgcccggt

SEQ ID NO: 311754 - DNA, 25 bp, Mus musculus
gccgcggagcgagtggaccagagcg

SEQ ID NO: 311755 - DNA, 25 bp, Mus musculus
ggacgcgctgggcaagcgggcagcc

SEQ ID NO: 311756 - DNA, 25 bp, Mus musculus
cgccgccgaccgcagccagagagcc

SEQ ID NO: 311757 - DNA, 25 bp, Mus musculus
tcgggttgaagtcctgaaagaggcc

SEQ ID NO: 311758 - DNA, 25 bp, Mus musculus
gagaacttcgccgaggcgtcctcct

SEQ ID NO: 311759 - DNA, 25 bp, Mus musculus
tcccagccgctacccgaacccaagc

SEQ ID NO: 311760 - DNA, 25 bp, Mus musculus
gcctcacctcgggttgaagtcctga

SEQ ID NO: 311761 - DNA, 25 bp, Mus musculus
cctcaggttcatggcggagaacttc

SEQ ID NO: 311762 - DNA, 25 bp, Mus musculus
ttccgtagctaggatgcgcatgcgc

SEQ ID NO: 311763 - DNA, 25 bp, Mus musculus
agcgggttcatgctgccaaaggcag

SEQ ID NO: 311764 - DNA, 25 bp, Mus musculus
ctgccaaaggcagcttcgtcgctaa

SEQ ID NO: 311765 - DNA, 25 bp, Mus musculus
aaggcagcttcgtcgctaacgccgc

SEQ ID NO: 311766 - DNA, 25 bp, Mus musculus
ccgccgccaggagaaaccagagcaa

SEQ ID NO: 311767 - DNA, 25 bp, Mus musculus
ggagaaaccagagcaaccaactgtc

SEQ ID NO: 311768 - DNA, 25 bp, Mus musculus
actccttccggcttccgtagctagg

SEQ ID NO: 311769 - DNA, 25 bp, Mus musculus
ggataaccgcctcacctcgggttga

SEQ ID NO: 311770 - DNA, 25 bp, Mus musculus
gcctcacagcgggttcatgctgcca

SEQ ID NO: 311771 - DNA, 25 bp, Mus musculus
gctggagctccgcaacacggtaagg

SEQ ID NO: 311772 - DNA, 25 bp, Mus musculus
ctggctgctgctggagctccgcaac

SEQ ID NO: 311773 - DNA, 25 bp, Mus musculus
ttcaatccggctgggccattaggcg

SEQ ID NO: 311774 - DNA, 25 bp, Mus musculus
ggtgatcttcaatccggctgggcca

SEQ ID NO: 311775 - DNA, 25 bp, Mus musculus
cagcatgaacttggccgcgagctga

SEQ ID NO: 311776 - DNA, 25 bp, Mus musculus
agcgccgccagcatgaacttggccg

SEQ ID NO: 311777 - DNA, 25 bp, Mus musculus
cgagcagattgaggccgccactgca

SEQ ID NO: 311778 - DNA, 25 bp, Mus musculus
cagcagtgagaaatgcctatcagta

SEQ ID NO: 311779 - DNA, 25 bp, Mus musculus
tccgcaacacggtaagggtgaaggc

SEQ ID NO: 311780 - DNA, 25 bp, Mus musculus
gaaatgcctatcagtaacttaaacc

SEQ ID NO: 311781 - DNA, 25 bp, Mus musculus
tgtgcggcgtgcgtgtctcctcctc

SEQ ID NO: 311782 - DNA, 25 bp, Mus musculus
cccgagtgacacagcagtgagaaat

SEQ ID NO: 311783 - DNA, 25 bp, Mus musculus
gtgacacagcagtgagaaatgccta

SEQ ID NO: 311784 - DNA, 25 bp, Mus musculus
gagcgagcagattgaggccgccact

SEQ ID NO: 311785 - DNA, 25 bp, Mus musculus
cttggccaggttccgtcctgatgca

SEQ ID NO: 311786 - DNA, 25 bp, Mus musculus
ccatcggaacctgggcaaacagacg

SEQ ID NO: 311787 - DNA, 25 bp, Mus musculus
cggccctaaagccatcggaacctgg

SEQ ID NO: 311788 - DNA, 25 bp, Mus musculus
ccctgcgcaggaattggcgctctag

SEQ ID NO: 311789 - DNA, 25 bp, Mus musculus
caaatacttttcttgcccacttggc

SEQ ID NO: 311790 - DNA, 25 bp, Mus musculus
cggagcgccgccaaatacttttctt

SEQ ID NO: 311791 - DNA, 25 bp, Mus musculus
ctgagcggacactaataggattacc

SEQ ID NO: 311792 - DNA, 25 bp, Mus musculus
tacccagactgaaaactcggcccta

SEQ ID NO: 311793 - DNA, 25 bp, Mus musculus
agcctggaaagctagcggtgctgtc

SEQ ID NO: 311794 - DNA, 25 bp, Mus musculus
gctgtctgattctgatccgtgatta

SEQ ID NO: 311795 - DNA, 25 bp, Mus musculus
cgtgattaaattcggactgagcgga

SEQ ID NO: 311796 - DNA, 25 bp, Mus musculus
tcccgggcattctctcagcagcaga

SEQ ID NO: 311797 - DNA, 25 bp, Mus musculus
attggcgctctaggctcccgggcat

SEQ ID NO: 311798 - DNA, 25 bp, Mus musculus
tcctgatgcagcgagtccgaagcct

SEQ ID NO: 311799 - DNA, 25 bp, Mus musculus
ctcctttattcagccgggatggcgg

SEQ ID NO: 311800 - DNA, 25 bp, Mus musculus
acccgtgagtctgtatccttccttc

SEQ ID NO: 311801 - DNA, 25 bp, Mus musculus
tgaacccgtgagtctgtatccttcc

SEQ ID NO: 311802 - DNA, 25 bp, Mus musculus
gggtgaacccgtgagtctgtatcct

SEQ ID NO: 311803 - DNA, 25 bp, Mus musculus
tgctcctttattcagccgggatggc

SEQ ID NO: 311804 - DNA, 25 bp, Mus musculus
tctgctcctttattcagccgggatg

SEQ ID NO: 311805 - DNA, 25 bp, Mus musculus
tctctgctcctttattcagccggga

SEQ ID NO: 311806 - DNA, 25 bp, Mus musculus
ggtctctgctcctttattcagccgg

SEQ ID NO: 311807 - DNA, 25 bp, Mus musculus
ttcggtctctgctcctttattcagc

SEQ ID NO: 311808 - DNA, 25 bp, Mus musculus
tctttcggtctctgctcctttattc

SEQ ID NO: 311809 - DNA, 25 bp, Mus musculus
tcctctttcggtctctgctccttta

SEQ ID NO: 311810 - DNA, 25 bp, Mus musculus
aggggctgcggcttctcttctcgag

SEQ ID NO: 311811 - DNA, 25 bp, Mus musculus
caggggctgcggcttctcttctcga

SEQ ID NO: 311812 - DNA, 25 bp, Mus musculus
ggtgaacccgtgagtctgtatcctt

SEQ ID NO: 311813 - DNA, 25 bp, Mus musculus
acagactctcggtgcccagctcaag

SEQ ID NO: 311814 - DNA, 25 bp, Mus musculus
gccgcttgacgcgagcggtcaagca

SEQ ID NO: 311815 - DNA, 25 bp, Mus musculus
acgcgagcggtcaagcagcgaagca

SEQ ID NO: 311816 - DNA, 25 bp, Mus musculus
tgccgctgcactccggactgtggct

SEQ ID NO: 311817 - DNA, 25 bp, Mus musculus
gcactccggactgtggctcaccgga

SEQ ID NO: 311818 - DNA, 25 bp, Mus musculus
cttgacgcgtcatggacaggccagt

SEQ ID NO: 311819 - DNA, 25 bp, Mus musculus
gccgggcgctagctggagaccctct

SEQ ID NO: 311820 - DNA, 25 bp, Mus musculus
tagctggagaccctctcgggttgcg

SEQ ID NO: 311821 - DNA, 25 bp, Mus musculus
cattgagacccttgacaggtaagta

SEQ ID NO: 311822 - DNA, 25 bp, Mus musculus
tagggtcctgggtgccacagactct

SEQ ID NO: 311823 - DNA, 25 bp, Mus musculus
accgtgtggctagggcgccacgcac

SEQ ID NO: 311824 - DNA, 25 bp, Mus musculus
gacccgcaggttcctgggcacagca

SEQ ID NO: 311825 - DNA, 25 bp, Mus musculus
ccgccaggtgacagctaatggcggc

SEQ ID NO: 311826 - DNA, 25 bp, Mus musculus
cccttgacaggtaagtagggtcctg

SEQ ID NO: 311827 - DNA, 25 bp, Mus musculus
gcgttctccgcgtttgctttgctgt

SEQ ID NO: 311828 - DNA, 25 bp, Mus musculus
ccacccggtagttgaggaacctgcg

SEQ ID NO: 311829 - DNA, 25 bp, Mus musculus
gtttcctctgaagccgaatcccgga

SEQ ID NO: 311830 - DNA, 25 bp, Mus musculus
tcccggaaccaggtagcagagagct

SEQ ID NO: 311831 - DNA, 25 bp, Mus musculus
cactggacttcacatccgggatctc

SEQ ID NO: 311832 - DNA, 25 bp, Mus musculus
tatccaggccttgctgttcccgtcg

SEQ ID NO: 311833 - DNA, 25 bp, Mus musculus
aggctgcgaccaatccgtctccgta

SEQ ID NO: 311834 - DNA, 25 bp, Mus musculus
tgctcttcatcgttgggcactggcc

SEQ ID NO: 311835 - DNA, 25 bp, Mus musculus
gcaggcttctccacctccttgtggg

SEQ ID NO: 311836 - DNA, 25 bp, Mus musculus
gtgacgctcttggtgcgacaactgc

SEQ ID NO: 311837 - DNA, 25 bp, Mus musculus
ggcgagccttttgcccacgtacttc

SEQ ID NO: 311838 - DNA, 25 bp, Mus musculus
cgcgcctcttcaattggctggtgtc

SEQ ID NO: 311839 - DNA, 25 bp, Mus musculus
tcgaaccggtgtcctgatctcttta

SEQ ID NO: 311840 - DNA, 25 bp, Mus musculus
gtgcatgcgcacaaccaggaagccc

SEQ ID NO: 311841 - DNA, 25 bp, Mus musculus
gaacaatacaggtacgactcgcacc

SEQ ID NO: 311842 - DNA, 25 bp, Mus musculus
tcagccattttagtgagcggggctc

SEQ ID NO: 311843 - DNA, 25 bp, Mus musculus
cttctctgctgctaggtggccaaga

SEQ ID NO: 311844 - DNA, 25 bp, Mus musculus
gcgctgcccagactagcgaacaata

SEQ ID NO: 311845 - DNA, 25 bp, Mus musculus
aacttttccagtgcctgcgctccag

SEQ ID NO: 311846 - DNA, 25 bp, Mus musculus
gcgcgcggatcagccattttagtga

SEQ ID NO: 311847 - DNA, 25 bp, Mus musculus
gtggccaagaaggaagacgcaattc

SEQ ID NO: 311848 - DNA, 25 bp, Mus musculus
ttatcccgaagagtgcggcccgcgt

SEQ ID NO: 311849 - DNA, 25 bp, Mus musculus
tctgcgtgaacatggccgtcgcgga

SEQ ID NO: 311850 - DNA, 25 bp, Mus musculus
ctgagccggtggctctgcgtgaaca

SEQ ID NO: 311851 - DNA, 25 bp, Mus musculus
tggccagatgttccgcagctgcggt

SEQ ID NO: 311852 - DNA, 25 bp, Mus musculus
aggtctcggccctctacgtggagcc

SEQ ID NO: 311853 - DNA, 25 bp, Mus musculus
ttcaggtgcctcaacttttccagtg

SEQ ID NO: 311854 - DNA, 25 bp, Mus musculus
gcacgggcgcctttgttatcccgaa

SEQ ID NO: 311855 - DNA, 25 bp, Mus musculus
ccgtggacgttcggaggtctgtact

SEQ ID NO: 311856 - DNA, 25 bp, Mus musculus
ccttgggacagtcggccgaactgga

SEQ ID NO: 311857 - DNA, 25 bp, Mus musculus
acagtcggccgaactggacatcgga

SEQ ID NO: 311858 - DNA, 25 bp, Mus musculus
tgtctccaagagagcagcgcggttc

SEQ ID NO: 311859 - DNA, 25 bp, Mus musculus
ccaagtgccgcggatcgccgctcgc

SEQ ID NO: 311860 - DNA, 25 bp, Mus musculus
cccacgcccgagtgtctagcagaga

SEQ ID NO: 311861 - DNA, 25 bp, Mus musculus
ccgagtgtctagcagagaggtctga

SEQ ID NO: 311862 - DNA, 25 bp, Mus musculus
cccgtcccacgcgagcggctggaac

SEQ ID NO: 311863 - DNA, 25 bp, Mus musculus
tgagcctgccggagccgagctccgt

SEQ ID NO: 311864 - DNA, 25 bp, Mus musculus
gccacaggaacggagtttggctgcc

SEQ ID NO: 311865 - DNA, 25 bp, Mus musculus
gccggccgaactgtctccaagagag

SEQ ID NO: 311866 - DNA, 25 bp, Mus musculus
gtctagcagagaggtctgagcctgc

SEQ ID NO: 311867 - DNA, 25 bp, Mus musculus
tccaagagagcagcgcggttcccac

SEQ ID NO: 311868 - DNA, 25 bp, Mus musculus
agtcgccacaggaacggagtttggc

SEQ ID NO: 311869 - DNA, 25 bp, Mus musculus
cccggcctgctcctagagaatgatc

SEQ ID NO: 311870 - DNA, 25 bp, Mus musculus
cgtcttgataaagcagcgctcaatg

SEQ ID NO: 311871 - DNA, 25 bp, Mus musculus
tcaatgcgctgcagcctccagagtt

SEQ ID NO: 311872 - DNA, 25 bp, Mus musculus
gcctccagagttcaggtatccctga

SEQ ID NO: 311873 - DNA, 25 bp, Mus musculus
ggaaactgctcggttgcctagcacc

SEQ ID NO: 311874 - DNA, 25 bp, Mus musculus
tatccctgagttccgctgggcaacg

SEQ ID NO: 311875 - DNA, 25 bp, Mus musculus
aggctcccgtgacaccgcaagcggg

SEQ ID NO: 311876 - DNA, 25 bp, Mus musculus
gaaggacaatgctgcgcggaaagtc

SEQ ID NO: 311877 - DNA, 25 bp, Mus musculus
gaaagtcccggctcaacgtggagtg

SEQ ID NO: 311878 - DNA, 25 bp, Mus musculus
ggccacgccatggagcgtcttgata

SEQ ID NO: 311879 - DNA, 25 bp, Mus musculus
cagccgacagctgggtcgtcctttc

SEQ ID NO: 311880 - DNA, 25 bp, Mus musculus
tagactgtcaccctgttagccgccg

SEQ ID NO: 311881 - DNA, 25 bp, Mus musculus
tcaacgtggagtggctaggctactc

SEQ ID NO: 311882 - DNA, 25 bp, Mus musculus
tcacgtgagtgcttgcagcgtaccc

SEQ ID NO: 311883 - DNA, 25 bp, Mus musculus
agacgcctggaacgctggccttgat

SEQ ID NO: 311884 - DNA, 25 bp, Mus musculus
ctctgcggctccaagacgcctggaa

SEQ ID NO: 311885 - DNA, 25 bp, Mus musculus
aacgctggccttgatgcggcaccta

SEQ ID NO: 311886 - DNA, 25 bp, Mus musculus
tgcggcacctactgaggctggtctt

SEQ ID NO: 311887 - DNA, 25 bp, Mus musculus
tcttcgcagggcttgcgccacgagt

SEQ ID NO: 311888 - DNA, 25 bp, Mus musculus
gcttgcgccacgagtcacctctggg

SEQ ID NO: 311889 - DNA, 25 bp, Mus musculus
ccctcagcagcacgggcgcagtcag

SEQ ID NO: 311890 - DNA, 25 bp, Mus musculus
cacgggccctgcttgaagaggagca

SEQ ID NO: 311891 - DNA, 25 bp, Mus musculus
tgccgaggtaatgggcaaggcctgt

SEQ ID NO: 311892 - DNA, 25 bp, Mus musculus
tttggcgctcgagagtggcacgcca

SEQ ID NO: 311893 - DNA, 25 bp, Mus musculus
acaattgcggcctggctatcggggc

SEQ ID NO: 311894 - DNA, 25 bp, Mus musculus
taagccctaggtcgcttcagccggc

SEQ ID NO: 311895 - DNA, 25 bp, Mus musculus
acctactgaggctggtcttcgcagg

SEQ ID NO: 311896 - DNA, 25 bp, Mus musculus
cccttggcccatcttgctggccttc

SEQ ID NO: 311897 - DNA, 25 bp, Mus musculus
aaaaccgctgtagcggttgtggcct

SEQ ID NO: 311898 - DNA, 25 bp, Mus musculus
cctggcacgaccacctgtgtagagg

SEQ ID NO: 311899 - DNA, 25 bp, Mus musculus
cagcgcaggtctggctgttcggagc

SEQ ID NO: 311900 - DNA, 25 bp, Mus musculus
ttttgttgggctccaactttcactc

SEQ ID NO: 311901 - DNA, 25 bp, Mus musculus
tgttgggctccaactttcactcctc

SEQ ID NO: 311902 - DNA, 25 bp, Mus musculus
cccagtcgcgctccgcaccttggcc

SEQ ID NO: 311903 - DNA, 25 bp, Mus musculus
ccgatggaaatctccgacgacgtga

SEQ ID NO: 311904 - DNA, 25 bp, Mus musculus
cgacgacgtgatcgctgcggcagcg

SEQ ID NO: 311905 - DNA, 25 bp, Mus musculus
tgcctggcacgaccacctgtgtaga

SEQ ID NO: 311906 - DNA, 25 bp, Mus musculus
cactgcggcgctgccagacagccag

SEQ ID NO: 311907 - DNA, 25 bp, Mus musculus
tgggcattgcgggtactttgctgcg

SEQ ID NO: 311908 - DNA, 25 bp, Mus musculus
agcctccactggcagggagaagaca

SEQ ID NO: 311909 - DNA, 25 bp, Mus musculus
ccactggcagggagaagacatgcgc

SEQ ID NO: 311910 - DNA, 25 bp, Mus musculus
atgagggagccctgtcgccaaggcc

SEQ ID NO: 311911 - DNA, 25 bp, Mus musculus
tcaggccctggactccggagagacc

SEQ ID NO: 311912 - DNA, 25 bp, Mus musculus
catccgaggtatgctgcgagccgct

SEQ ID NO: 311913 - DNA, 25 bp, Mus musculus
cactgcagccatgggcatccgaggt

SEQ ID NO: 311914 - DNA, 25 bp, Mus musculus
tgcggaaggactagcgattccgccc

SEQ ID NO: 311915 - DNA, 25 bp, Mus musculus
tctctccttagggtcccgattctgc

SEQ ID NO: 311916 - DNA, 25 bp, Mus musculus
agagctgctgcggagccactgttct

SEQ ID NO: 311917 - DNA, 25 bp, Mus musculus
cttgcagtggcacgccctgtggacc

SEQ ID NO: 311918 - DNA, 25 bp, Mus musculus
cagacgaagcgcaccttgcagtggc

SEQ ID NO: 311919 - DNA, 25 bp, Mus musculus
cagccctgagcggtgccagacgaag

SEQ ID NO: 311920 - DNA, 25 bp, Mus musculus
attggctcagcaggtgctgccgtcg

SEQ ID NO: 311921 - DNA, 25 bp, Mus musculus
tttaccgctccttgcgcctgcggga

SEQ ID NO: 311922 - DNA, 25 bp, Mus musculus
agccactgttctttcaggccctgga

SEQ ID NO: 311923 - DNA, 25 bp, Mus musculus
cccgattctgcggaaggactagcga

SEQ ID NO: 311924 - DNA, 25 bp, Mus musculus
tacttccttcaggtctctccttagg

SEQ ID NO: 311925 - DNA, 25 bp, Mus musculus
gggtccaccgaatccctagcactta

SEQ ID NO: 311926 - DNA, 25 bp, Mus musculus
gcaaaactcgcccaagagcaagagg

SEQ ID NO: 311927 - DNA, 25 bp, Mus musculus
gtggggctaacctggcaaaactcgc

SEQ ID NO: 311928 - DNA, 25 bp, Mus musculus
cacagcccgcttcccattggtttgg

SEQ ID NO: 311929 - DNA, 25 bp, Mus musculus
ggcgtactcgcagcctcagcggcgt

SEQ ID NO: 311930 - DNA, 25 bp, Mus musculus
ttgttaaggcaacggcgtactcgca

SEQ ID NO: 311931 - DNA, 25 bp, Mus musculus
ctgccaccggttgttaaggcaacgg

SEQ ID NO: 311932 - DNA, 25 bp, Mus musculus
cgtcaacgccaagaaccgtgcaaga

SEQ ID NO: 311933 - DNA, 25 bp, Mus musculus
ctagcacttaccatcacccaacgga

SEQ ID NO: 311934 - DNA, 25 bp, Mus musculus
cgcgtggggtccaccgaatccctag

SEQ ID NO: 311935 - DNA, 25 bp, Mus musculus
ctgcaccgaggcctaggaaaggacc

SEQ ID NO: 311936 - DNA, 25 bp, Mus musculus
tagcaaggctgcaccgaggcctagg

SEQ ID NO: 311937 - DNA, 25 bp, Mus musculus
ccgtgcaagaaaggtagcaaggctg

SEQ ID NO: 311938 - DNA, 25 bp, Mus musculus
ccaacggactctgccaccggttgtt

SEQ ID NO: 311939 - DNA, 25 bp, Mus musculus
gtcgccgtcctaaagaagtggctcg

SEQ ID NO: 311940 - DNA, 25 bp, Mus musculus
gaccctctgcccgtcacacaagccg

SEQ ID NO: 311941 - DNA, 25 bp, Mus musculus
taccaggtagggttgttgagtcgcc

SEQ ID NO: 311942 - DNA, 25 bp, Mus musculus
cacctgtaccaggtagggttgttga

SEQ ID NO: 311943 - DNA, 25 bp, Mus musculus
acaagccgggcacctgtaccaggta

SEQ ID NO: 311944 - DNA, 25 bp, Mus musculus
gcagccggagaaaacctgtttgttc

SEQ ID NO: 311945 - DNA, 25 bp, Mus musculus
gcggagcccagtccgtgcctcttcg

SEQ ID NO: 311946 - DNA, 25 bp, Mus musculus
ccgtcctaaagaagtggctcgacca

SEQ ID NO: 311947 - DNA, 25 bp, Mus musculus
tagggttgttgagtcgccgtcctaa

SEQ ID NO: 311948 - DNA, 25 bp, Mus musculus
gcccggctgggttcagtgctgccca

SEQ ID NO: 311949 - DNA, 25 bp, Mus musculus
tgggttcagtgctgcccacccgagg

SEQ ID NO: 311950 - DNA, 25 bp, Mus musculus
gttgagtcgccgtcctaaagaagtg

SEQ ID NO: 311951 - DNA, 25 bp, Mus musculus
cgcaccacgcctgtccgaccctctg

SEQ ID NO: 311952 - DNA, 25 bp, Mus musculus
tcctaaagaagtggctcgaccaccg

SEQ ID NO: 311953 - DNA, 25 bp, Mus musculus
gcaatgtctgcatccttccacgaga

SEQ ID NO: 311954 - DNA, 25 bp, Mus musculus
agcttactagggcttcgagcacccg

SEQ ID NO: 311955 - DNA, 25 bp, Mus musculus
tgcatccttccacgagagggcggtc

SEQ ID NO: 311956 - DNA, 25 bp, Mus musculus
gcaaagctcggcaatgtctgcatcc

SEQ ID NO: 311957 - DNA, 25 bp, Mus musculus
caagtaggcaaagctcggcaatgtc

SEQ ID NO: 311958 - DNA, 25 bp, Mus musculus
tccagcgcggcaagtaggcaaagct

SEQ ID NO: 311959 - DNA, 25 bp, Mus musculus
cgcccgtcggctgcgcttagagtct

SEQ ID NO: 311960 - DNA, 25 bp, Mus musculus
gacgctctccatcagtcctagctta

SEQ ID NO: 311961 - DNA, 25 bp, Mus musculus
agagatacagactcccgcctaaagc

SEQ ID NO: 311962 - DNA, 25 bp, Mus musculus
cccttatagggatccagagatacag

SEQ ID NO: 311963 - DNA, 25 bp, Mus musculus
cgactctcttctcaacccttatagg

SEQ ID NO: 311964 - DNA, 25 bp, Mus musculus
gtccggcctcctactctcgactctc

SEQ ID NO: 311965 - DNA, 25 bp, Mus musculus
gggcggtcgagcaccagcctcgctt

SEQ ID NO: 311966 - DNA, 25 bp, Mus musculus
tctccatcagtcctagcttactagg

SEQ ID NO: 311967 - DNA, 25 bp, Mus musculus
ggcccgacttttcctgcggcaggag

SEQ ID NO: 311968 - DNA, 25 bp, Mus musculus
ctggcacactcggtgcctttgctga

SEQ ID NO: 311969 - DNA, 25 bp, Mus musculus
gggccacccggtacagcaactcgag

SEQ ID NO: 311970 - DNA, 25 bp, Mus musculus
tatttacacgcatgcaacgcctggc

SEQ ID NO: 311971 - DNA, 25 bp, Mus musculus
caagcgcttggtgatgctgcctcct

SEQ ID NO: 311972 - DNA, 25 bp, Mus musculus
tgctgccggtcactttcagcgggct

SEQ ID NO: 311973 - DNA, 25 bp, Mus musculus
cgctgctgcactgtgcctggaacta

SEQ ID NO: 311974 - DNA, 25 bp, Mus musculus
gtgatcccattgtgggctaggcgca

SEQ ID NO: 311975 - DNA, 25 bp, Mus musculus
cgagacctgtcttgggctcgacctt

SEQ ID NO: 311976 - DNA, 25 bp, Mus musculus
taggcgcagcgtagcgttagtcata

SEQ ID NO: 311977 - DNA, 25 bp, Mus musculus
ggacttcttggcacgctatcggcag

SEQ ID NO: 311978 - DNA, 25 bp, Mus musculus
ctatcggcaggtgtccaacaagctc

SEQ ID NO: 311979 - DNA, 25 bp, Mus musculus
gcccaggagtgcctgccttatgctg

SEQ ID NO: 311980 - DNA, 25 bp, Mus musculus
cttcttgaggaagccgaacgtggcc

SEQ ID NO: 311981 - DNA, 25 bp, Mus musculus
tctgcaagggcccagagtcaggcgc

SEQ ID NO: 311982 - DNA, 25 bp, Mus musculus
tccgtggcgcttcctgccacgccgg

SEQ ID NO: 311983 - DNA, 25 bp, Mus musculus
tgagcaaggatgtgtggccgagaga

SEQ ID NO: 311984 - DNA, 25 bp, Mus musculus
tcatgagattgtgtgcgtgagcaag

SEQ ID NO: 311985 - DNA, 25 bp, Mus musculus
cgctcttcttctgcaagggcccaga

SEQ ID NO: 311986 - DNA, 25 bp, Mus musculus
agggatgtgcagctcgagtgatcat

SEQ ID NO: 311987 - DNA, 25 bp, Mus musculus
gcctgcttacaacgcgcccgctctt

SEQ ID NO: 311988 - DNA, 25 bp, Mus musculus
actggcggctccgtggcgcttcctg

SEQ ID NO: 311989 - DNA, 25 bp, Mus musculus
ccacgccgggcctgcttacaacgcg

SEQ ID NO: 311990 - DNA, 25 bp, Mus musculus
gatcatgagattgtgtgcgtgagca

SEQ ID NO: 311991 - DNA, 25 bp, Mus musculus
ttcgatctcagtaccccaggcggcg

SEQ ID NO: 311992 - DNA, 25 bp, Mus musculus
aggcggggcttcgatctcagtaccc

SEQ ID NO: 311993 - DNA, 25 bp, Mus musculus
tcttcttctgcaagggcccagagtc

SEQ ID NO: 311994 - DNA, 25 bp, Mus musculus
tccggaaacgcgctgccgggcttct

SEQ ID NO: 311995 - DNA, 25 bp, Mus musculus
ggaattcccagaagcgtgcatgtct

SEQ ID NO: 311996 - DNA, 25 bp, Mus musculus
gcgggctcaatatacgcagcacctc

SEQ ID NO: 311997 - DNA, 25 bp, Mus musculus
tccatgttgaccaagcctctgcagg

SEQ ID NO: 311998 - DNA, 25 bp, Mus musculus
agcgtagcctcctctgtcacaagca

SEQ ID NO: 311999 - DNA, 25 bp, Mus musculus
gtcatggctgggatcagagtacacc

SEQ ID NO: 312000 - DNA, 25 bp, Mus musculus
tgccgcgtccggattgatcaaagcc

SEQ ID NO: 312001 - DNA, 25 bp, Mus musculus
tgcaaataaggactggctcggattg

SEQ ID NO: 312002 - DNA, 25 bp, Mus musculus
cttgaaacgttgagggtggcatgca

SEQ ID NO: 312003 - DNA, 25 bp, Mus musculus
atacaggcccttcctccgcggaaga

SEQ ID NO: 312004 - DNA, 25 bp, Mus musculus
tccgcttgcgtaggaggcaaggatc

SEQ ID NO: 312005 - DNA, 25 bp, Mus musculus
tttcgaggccgaataccgacttggc

SEQ ID NO: 312006 - DNA, 25 bp, Mus musculus
ctcagcggattcagcgggctcaata

SEQ ID NO: 312007 - DNA, 25 bp, Mus musculus
ggcgcgcgcgacgaatcttaacgct

SEQ ID NO: 312008 - DNA, 25 bp, Mus musculus
tccgcggaagaacctggcatgtatt

SEQ ID NO: 312009 - DNA, 25 bp, Mus musculus
ggcgctcggcactgcagaaacacca

SEQ ID NO: 312010 - DNA, 25 bp, Mus musculus
cctcactgcggcaagctgttccgga

SEQ ID NO: 312011 - DNA, 25 bp, Mus musculus
agctcagagctcaccaagcaccgga

SEQ ID NO: 312012 - DNA, 25 bp, Mus musculus
caagcaccggaggatccacactggt

SEQ ID NO: 312013 - DNA, 25 bp, Mus musculus
ccctatgagtgcaaccagtgcggca

SEQ ID NO: 312014 - DNA, 25 bp, Mus musculus
ctgctggagcacacacgcatccata

SEQ ID NO: 312015 - DNA, 25 bp, Mus musculus
gcggcaagtccttccgtggtgtcaa

SEQ ID NO: 312016 - DNA, 25 bp, Mus musculus
caccgtcggatccacagtggggtca

SEQ ID NO: 312017 - DNA, 25 bp, Mus musculus
tggcaaggcctttaggaggagctca

SEQ ID NO: 312018 - DNA, 25 bp, Mus musculus
aaaccctatgagtgcgacaagtgtg

SEQ ID NO: 312019 - DNA, 25 bp, Mus musculus
aaaccctacgggtgtcctcactgcg

SEQ ID NO: 312020 - DNA, 25 bp, Mus musculus
gggccttctgacctcatcaagcaca

SEQ ID NO: 312021 - DNA, 25 bp, Mus musculus
gagcggccttatgcatgcggcgact

SEQ ID NO: 312022 - DNA, 25 bp, Mus musculus
cacaggcgcatccacagcggactga

SEQ ID NO: 312023 - DNA, 25 bp, Mus musculus
accctatgagtgcagcgaatgcggc

SEQ ID NO: 312024 - DNA, 25 bp, Mus musculus
atctcatagagcatcagcgcatcca

SEQ ID NO: 312025 - DNA, 25 bp, Mus musculus
cgcagcttagcgctgctggagcatc

SEQ ID NO: 312026 - DNA, 25 bp, Mus musculus
cggcgacaagccctatgaatgtggc

SEQ ID NO: 312027 - DNA, 25 bp, Mus musculus
tggcgagtgtggcaaaaccttcacg

SEQ ID NO: 312028 - DNA, 25 bp, Mus musculus
atccacagcagtgagatgccatttg

SEQ ID NO: 312029 - DNA, 25 bp, Mus musculus
tgccgcatgtgtggtaaagtgttca

SEQ ID NO: 312030 - DNA, 25 bp, Mus musculus
tcagccgaagctccaatctcataga

SEQ ID NO: 312031 - DNA, 25 bp, Mus musculus
aagccctacatctgcaaggagtgcg

SEQ ID NO: 312032 - DNA, 25 bp, Mus musculus
tcaagggcgtctcgcagctcatcca

SEQ ID NO: 312033 - DNA, 25 bp, Mus musculus
acaagcccttcacgtgccatgagta

SEQ ID NO: 312034 - DNA, 25 bp, Mus musculus
agggctcagccaacaccagcgggtc

SEQ ID NO: 312035 - DNA, 25 bp, Mus musculus
gtccacagaggtgagaaaccctatg

SEQ ID NO: 312036 - DNA, 25 bp, Mus musculus
cagcttcgcgctgcttgagcacacg

SEQ ID NO: 312037 - DNA, 25 bp, Mus musculus
ggcctttccgtccttggagctgatc

SEQ ID NO: 312038 - DNA, 25 bp, Mus musculus
taagttgtgccctgggcgcacaggc

SEQ ID NO: 312039 - DNA, 25 bp, Mus musculus
gtggggagcactcggccacagccct

SEQ ID NO: 312040 - DNA, 25 bp, Mus musculus
tccttggagctgatcgttgcttgcc

SEQ ID NO: 312041 - DNA, 25 bp, Mus musculus
ctgatcgttgcttgccgggagccct

SEQ ID NO: 312042 - DNA, 25 bp, Mus musculus
gagccctcccgcagcaacagcgaaa

SEQ ID NO: 312043 - DNA, 25 bp, Mus musculus
cccatgccggggtaagttgtgccct

SEQ ID NO: 312044 - DNA, 25 bp, Mus musculus
ggtacgcaggatcccgcccaaggca

SEQ ID NO: 312045 - DNA, 25 bp, Mus musculus
aaggcacctgctccctatgggcctg

SEQ ID NO: 312046 - DNA, 25 bp, Mus musculus
ctccctatgggcctggcctgtgtgt

SEQ ID NO: 312047 - DNA, 25 bp, Mus musculus
ggcctgtgtgtccttgcggcactac

SEQ ID NO: 312048 - DNA, 25 bp, Mus musculus
ggcctcggaactgtcggactgcgcc

SEQ ID NO: 312049 - DNA, 25 bp, Mus musculus
acccgcactggtaccctcatccgca

SEQ ID NO: 312050 - DNA, 25 bp, Mus musculus
cttgcggcactacgggcgcgcgtca

SEQ ID NO: 312051 - DNA, 25 bp, Mus musculus
ccatgtgaccgggtagcgacaactg

SEQ ID NO: 312052 - DNA, 25 bp, Mus musculus
tgactccacccgccaaagtgggacg

SEQ ID NO: 312053 - DNA, 25 bp, Mus musculus
tgatgagtgcttcgcctgactccac

SEQ ID NO: 312054 - DNA, 25 bp, Mus musculus
cgagtgatgagtgcttcgcctgact

SEQ ID NO: 312055 - DNA, 25 bp, Mus musculus
ccgcccaccctgaggcgagtgatga

SEQ ID NO: 312056 - DNA, 25 bp, Mus musculus
cccacagcacgcagtggacctggtg

SEQ ID NO: 312057 - DNA, 25 bp, Mus musculus
ggggacctgagagcgcccacagcac

SEQ ID NO: 312058 - DNA, 25 bp, Mus musculus
tcgcgcattttgctgcgagcagtgc

SEQ ID NO: 312059 - DNA, 25 bp, Mus musculus
ccgggcgggaatcgcgcattttgct

SEQ ID NO: 312060 - DNA, 25 bp, Mus musculus
ctgaaatcctgccactgggccgggc

SEQ ID NO: 312061 - DNA, 25 bp, Mus musculus
tgaccgggtagcgacaactgaaatc

SEQ ID NO: 312062 - DNA, 25 bp, Mus musculus
tctctgggagttgcgctacgggcca

SEQ ID NO: 312063 - DNA, 25 bp, Mus musculus
aacgttgtctctgggagttgcgcta

SEQ ID NO: 312064 - DNA, 25 bp, Mus musculus
gcgacaactgaaatcctgccactgg

SEQ ID NO: 312065 - DNA, 25 bp, Mus musculus
tgccctcaggacaggggttgacttc

SEQ ID NO: 312066 - DNA, 25 bp, Mus musculus
gtccctgcggggacactgaaagcct

SEQ ID NO: 312067 - DNA, 25 bp, Mus musculus
gcgccttccttggtgttctcactgt

SEQ ID NO: 312068 - DNA, 25 bp, Mus musculus
tctggggtatgtctcacgaaaactc

SEQ ID NO: 312069 - DNA, 25 bp, Mus musculus
tagcacttcagagaccggtagacgc

SEQ ID NO: 312070 - DNA, 25 bp, Mus musculus
ggaactggttttagtcctcctagca

SEQ ID NO: 312071 - DNA, 25 bp, Mus musculus
acctcggtgaccctcttgttctctg

SEQ ID NO: 312072 - DNA, 25 bp, Mus musculus
agtcagctcttacgggactcgccga

SEQ ID NO: 312073 - DNA, 25 bp, Mus musculus
ggatctcgctccaggtctctccttt

SEQ ID NO: 312074 - DNA, 25 bp, Mus musculus
tgaacgatacctacgccctgccgtg

SEQ ID NO: 312075 - DNA, 25 bp, Mus musculus
ggggatccgtctccatgaacgatac

SEQ ID NO: 312076 - DNA, 25 bp, Mus musculus
tgcgcgaccatggagagtctgagtc

SEQ ID NO: 312077 - DNA, 25 bp, Mus musculus
ttgacttcccgcctcagtagcctga

SEQ ID NO: 312078 - DNA, 25 bp, Mus musculus
tagcctgatccacgctgcaggagta

SEQ ID NO: 312079 - DNA, 25 bp, Mus musculus
acctaatcgctgcttggcccctggc

SEQ ID NO: 312080 - DNA, 25 bp, Mus musculus
ctgtgtccagagctgcgtgggccgc

SEQ ID NO: 312081 - DNA, 25 bp, Mus musculus
gtaggccaccaacccgctcgaatgc

SEQ ID NO: 312082 - DNA, 25 bp, Mus musculus
tcgaatgcacctgcgaccctgcttg

SEQ ID NO: 312083 - DNA, 25 bp, Mus musculus
aatgcacctgcgaccctgcttgcag

SEQ ID NO: 312084 - DNA, 25 bp, Mus musculus
tgcgaccctgcttgcagccacctgt

SEQ ID NO: 312085 - DNA, 25 bp, Mus musculus
tgcagccacctgtcacgaccacagt

SEQ ID NO: 312086 - DNA, 25 bp, Mus musculus
tgtcacgaccacagtcacccacgca

SEQ ID NO: 312087 - DNA, 25 bp, Mus musculus
agtcacccacgcagccacctaatcg

SEQ ID NO: 312088 - DNA, 25 bp, Mus musculus
cctcggagtggagggactccgcaac

SEQ ID NO: 312089 - DNA, 25 bp, Mus musculus
agtggagggactccgcaacctcggc

SEQ ID NO: 312090 - DNA, 25 bp, Mus musculus
gagggactccgcaacctcggccgcc

SEQ ID NO: 312091 - DNA, 25 bp, Mus musculus
cggagtggagggactccgcaacctc

SEQ ID NO: 312092 - DNA, 25 bp, Mus musculus
cggccgcctgtgtccagagctgcgt

SEQ ID NO: 312093 - DNA, 25 bp, Mus musculus
gcgagtctttgagtccgccgcggcc

SEQ ID NO: 312094 - DNA, 25 bp, Mus musculus
gagtgccaaggcgagtctttgagtc

SEQ ID NO: 312095 - DNA, 25 bp, Mus musculus
aaagagagggacagttggagtgcca

SEQ ID NO: 312096 - DNA, 25 bp, Mus musculus
tcgcgtcgggaaagagagggacagt

SEQ ID NO: 312097 - DNA, 25 bp, Mus musculus
ggaccaccggagccgccagcgccag

SEQ ID NO: 312098 - DNA, 25 bp, Mus musculus
cggagagcggctgtagccgccgccg

SEQ ID NO: 312099 - DNA, 25 bp, Mus musculus
gagtctttgagtccgccgcggcccg

SEQ ID NO: 312100 - DNA, 25 bp, Mus musculus
aaggcgagtctttgagtccgccgcg

SEQ ID NO: 312101 - DNA, 25 bp, Mus musculus
gccaaggcgagtctttgagtccgcc

SEQ ID NO: 312102 - DNA, 25 bp, Mus musculus
caaggcgagtctttgagtccgccgc

SEQ ID NO: 312103 - DNA, 25 bp, Mus musculus
agtgccaaggcgagtctttgagtcc

SEQ ID NO: 312104 - DNA, 25 bp, Mus musculus
cagttggagtgccaaggcgagtctt

SEQ ID NO: 312105 - DNA, 25 bp, Mus musculus
ttggagtgccaaggcgagtctttga

SEQ ID NO: 312106 - DNA, 25 bp, Mus musculus
tgccaaggcgagtctttgagtccgc

SEQ ID NO: 312107 - DNA, 25 bp, Mus musculus
ccgcaagcgaacaggacagccactt

SEQ ID NO: 312108 - DNA, 25 bp, Mus musculus
agcgaacaggacagccacttggggc

SEQ ID NO: 312109 - DNA, 25 bp, Mus musculus
caggacagccacttggggctgggcc

SEQ ID NO: 312110 - DNA, 25 bp, Mus musculus
tccggccgccgcttgcagacagtgg

SEQ ID NO: 312111 - DNA, 25 bp, Mus musculus
agggcgagcagtcctcgctgcagcc

SEQ ID NO: 312112 - DNA, 25 bp, Mus musculus
cgccgcttgcagacagtgggcttcc

SEQ ID NO: 312113 - DNA, 25 bp, Mus musculus
cttgcagacagtgggcttccgatgc

SEQ ID NO: 312114 - DNA, 25 bp, Mus musculus
gcagacagtgggcttccgatgccac

SEQ ID NO: 312115 - DNA, 25 bp, Mus musculus
agtgggcttccgatgccacccgcga

SEQ ID NO: 312116 - DNA, 25 bp, Mus musculus
gatgccacccgcgacgcgctagggt

SEQ ID NO: 312117 - DNA, 25 bp, Mus musculus
acccgcgacgcgctagggtgagcct

SEQ ID NO: 312118 - DNA, 25 bp, Mus musculus
gagccgcaagcgaacaggacagcca

SEQ ID NO: 312119 - DNA, 25 bp, Mus musculus
tccggcagggcgagcagtcctcgct

SEQ ID NO: 312120 - DNA, 25 bp, Mus musculus
gacagtgggcttccgatgccacccg

SEQ ID NO: 312121 - DNA, 25 bp, Mus musculus
tgacgtctcgctagggtcacaagtc

SEQ ID NO: 312122 - DNA, 25 bp, Mus musculus
cgaacttggcagaaggagaagcctc

SEQ ID NO: 312123 - DNA, 25 bp, Mus musculus
ccttgcgcttgttgagacgaacttg

SEQ ID NO: 312124 - DNA, 25 bp, Mus musculus
gctctagcgcaccatgtattccttg

SEQ ID NO: 312125 - DNA, 25 bp, Mus musculus
acggagtctgcggagtctttaaata

SEQ ID NO: 312126 - DNA, 25 bp, Mus musculus
agtcccaaaggacgccagatgagtg

SEQ ID NO: 312127 - DNA, 25 bp, Mus musculus
tccctgaaagcacagacagcaagct

SEQ ID NO: 312128 - DNA, 25 bp, Mus musculus
tccggactcctcgatgaggccggtc

SEQ ID NO: 312129 - DNA, 25 bp, Mus musculus
aagacgttgcttcacttccggctag

SEQ ID NO: 312130 - DNA, 25 bp, Mus musculus
gtccgagactggatgcagctgcatc

SEQ ID NO: 312131 - DNA, 25 bp, Mus musculus
cctccctgcagctgattggccgaga

SEQ ID NO: 312132 - DNA, 25 bp, Mus musculus
caccacgcgagctggaaaccacgga

SEQ ID NO: 312133 - DNA, 25 bp, Mus musculus
aaccttggtggacgctgacgtcatg

SEQ ID NO: 312134 - DNA, 25 bp, Mus musculus
ggctagcttcattccacttccgtcg

SEQ ID NO: 312135 - DNA, 25 bp, Mus musculus
cttcgccgtgggcctcggtaacgtg

SEQ ID NO: 312136 - DNA, 25 bp, Mus musculus
gggcctcggtaacgtgtggcgcttc

SEQ ID NO: 312137 - DNA, 25 bp, Mus musculus
tgggcctcggtaacgtgtggcgctt

SEQ ID NO: 312138 - DNA, 25 bp, Mus musculus
cgtgggcctcggtaacgtgtggcgc

SEQ ID NO: 312139 - DNA, 25 bp, Mus musculus
ccgtgggcctcggtaacgtgtggcg

SEQ ID NO: 312140 - DNA, 25 bp, Mus musculus
cgccgtgggcctcggtaacgtgtgg

SEQ ID NO: 312141 - DNA, 25 bp, Mus musculus
tcgccgtgggcctcggtaacgtgtg

SEQ ID NO: 312142 - DNA, 25 bp, Mus musculus
tgggcttcgccgtgggcctcggtaa

SEQ ID NO: 312143 - DNA, 25 bp, Mus musculus
gtgcgtgggcttcgccgtgggcctc

SEQ ID NO: 312144 - DNA, 25 bp, Mus musculus
tcgtgcgtgggcttcgccgtgggcc

SEQ ID NO: 312145 - DNA, 25 bp, Mus musculus
catgtcgtgcgtgggcttcgccgtg

SEQ ID NO: 312146 - DNA, 25 bp, Mus musculus
tcatgtcgtgcgtgggcttcgccgt

SEQ ID NO: 312147 - DNA, 25 bp, Mus musculus
tcatcatgtcgtgcgtgggcttcgc

SEQ ID NO: 312148 - DNA, 25 bp, Mus musculus
atcatgtcgtgcgtgggcttcgccg

SEQ ID NO: 312149 - DNA, 25 bp, Mus musculus
acggtatctatagcgtgtctggtga

SEQ ID NO: 312150 - DNA, 25 bp, Mus musculus
cgaaaaagagcgctgaaaacggtat

SEQ ID NO: 312151 - DNA, 25 bp, Mus musculus
cacgccagatggacttcatcatgtc

SEQ ID NO: 312152 - DNA, 25 bp, Mus musculus
tctatagcgtgtctggtgacgagaa

SEQ ID NO: 312153 - DNA, 25 bp, Mus musculus
tctggtgacgagaagaagggtcctc

SEQ ID NO: 312154 - DNA, 25 bp, Mus musculus
tgacgagaagaagggtcctctcatc

SEQ ID NO: 312155 - DNA, 25 bp, Mus musculus
aagaagggtcctctcatcgtgtccg

SEQ ID NO: 312156 - DNA, 25 bp, Mus musculus
agggtcctctcatcgtgtccgggcc

SEQ ID NO: 312157 - DNA, 25 bp, Mus musculus
gagcgctgaaaacggtatctatagc

SEQ ID NO: 312158 - DNA, 25 bp, Mus musculus
ttggacacgccagatggacttcatc

SEQ ID NO: 312159 - DNA, 25 bp, Mus musculus
cagatggacttcatcatgtcgtgcg

SEQ ID NO: 312160 - DNA, 25 bp, Mus musculus
agtgccaccgcgagagacttggaca

SEQ ID NO: 312161 - DNA, 25 bp, Mus musculus
gccttgcagtgccaccgcgagagac

SEQ ID NO: 312162 - DNA, 25 bp, Mus musculus
ccgcgagagacttggacacgccaga

SEQ ID NO: 312163 - DNA, 25 bp, Mus musculus
gcggcctgttgccaaggtctagaaa

SEQ ID NO: 312164 - DNA, 25 bp, Mus musculus
cgcttctgtagtgtacgcggacttg

SEQ ID NO: 312165 - DNA, 25 bp, Mus musculus
agcttaccgagcttcagcctactcg

SEQ ID NO: 312166 - DNA, 25 bp, Mus musculus
gattctgggccttggcgtagacgct

SEQ ID NO: 312167 - DNA, 25 bp, Mus musculus
tctgacacttcggacacgcaggggt

SEQ ID NO: 312168 - DNA, 25 bp, Mus musculus
ttggcgtagacgctgtcgttactgc

SEQ ID NO: 312169 - DNA, 25 bp, Mus musculus
gctgtcgttactgccgggctgctca

SEQ ID NO: 312170 - DNA, 25 bp, Mus musculus
gctgctcagcggacaaacacgcctg

SEQ ID NO: 312171 - DNA, 25 bp, Mus musculus
tcagcggacaaacacgcctggtgcc

SEQ ID NO: 312172 - DNA, 25 bp, Mus musculus
cgttggtccgaaagtcagccatgca

SEQ ID NO: 312173 - DNA, 25 bp, Mus musculus
cttgcttcgtttctgttgtcggaga

SEQ ID NO: 312174 - DNA, 25 bp, Mus musculus
tcagccatgcatgcggacccagctt

SEQ ID NO: 312175 - DNA, 25 bp, Mus musculus
agtgtacgcggacttgcttcgtttc

SEQ ID NO: 312176 - DNA, 25 bp, Mus musculus
tgcggacccagcttaccgagcttca

SEQ ID NO: 312177 - DNA, 25 bp, Mus musculus
cggcgatggcatctttcggcgccct

SEQ ID NO: 312178 - DNA, 25 bp, Mus musculus
gaccaaagcaccacacacacgttta

SEQ ID NO: 312179 - DNA, 25 bp, Mus musculus
ttgtgtcgtggcgaccaaagcacca

SEQ ID NO: 312180 - DNA, 25 bp, Mus musculus
gctcgtcgctactgacgggatcttc

SEQ ID NO: 312181 - DNA, 25 bp, Mus musculus
tactcctgctgtctggcctatcttg

SEQ ID NO: 312182 - DNA, 25 bp, Mus musculus
catgtccagggtggcttgctctctt

SEQ ID NO: 312183 - DNA, 25 bp, Mus musculus
ccgccgacgcacgattgggtgctga

SEQ ID NO: 312184 - DNA, 25 bp, Mus musculus
ctagagcactgttccgccatcttgg

SEQ ID NO: 312185 - DNA, 25 bp, Mus musculus
cccttccggtgcctagagcactgtt

SEQ ID NO: 312186 - DNA, 25 bp, Mus musculus
acgcgcacagtcacaccggttctta

SEQ ID NO: 312187 - DNA, 25 bp, Mus musculus
gctagcattacgcacgcgcacagtc

SEQ ID NO: 312188 - DNA, 25 bp, Mus musculus
tgggttgagaaaacgctagcattac

SEQ ID NO: 312189 - DNA, 25 bp, Mus musculus
ttctcgcgacagttggggacagcga

SEQ ID NO: 312190 - DNA, 25 bp, Mus musculus
ctggcctatcttgctgctcaggtag

SEQ ID NO: 312191 - DNA, 25 bp, Mus musculus
cgcgttggaacctgggtccactaca

SEQ ID NO: 312192 - DNA, 25 bp, Mus musculus
tctgggaacccgaagccaccatttg

SEQ ID NO: 312193 - DNA, 25 bp, Mus musculus
gccaccatttgagaatctaagctgg

SEQ ID NO: 312194 - DNA, 25 bp, Mus musculus
ccatcgtatgttgcggataggaatc

SEQ ID NO: 312195 - DNA, 25 bp, Mus musculus
taagacctgtggaaacgctgcggga

SEQ ID NO: 312196 - DNA, 25 bp, Mus musculus
ccgtgtgaacggacctacgtgttag

SEQ ID NO: 312197 - DNA, 25 bp, Mus musculus
gactgaagtgacagctcatcccgtg

SEQ ID NO: 312198 - DNA, 25 bp, Mus musculus
cctaatcggaggtcgggattcttga

SEQ ID NO: 312199 - DNA, 25 bp, Mus musculus
gcctgacgtagaggcgttgcctaat

SEQ ID NO: 312200 - DNA, 25 bp, Mus musculus
ccgggtctcctgtttggatggaatc

SEQ ID NO: 312201 - DNA, 25 bp, Mus musculus
tggatacggaagtagcctgctgttg

SEQ ID NO: 312202 - DNA, 25 bp, Mus musculus
tccggaaacggacgtgatggatacg

SEQ ID NO: 312203 - DNA, 25 bp, Mus musculus
ctaagctgggaacaggctgagagcc

SEQ ID NO: 312204 - DNA, 25 bp, Mus musculus
gtcgagcgtcacgagcatgcaaata

SEQ ID NO: 312205 - DNA, 25 bp, Mus musculus
gggcagcagggtatctcctgccgcc

SEQ ID NO: 312206 - DNA, 25 bp, Mus musculus
caggccaaagcggatgccaacaggc

SEQ ID NO: 312207 - DNA, 25 bp, Mus musculus
tgagaaggtggctcaaggtgcaagc

SEQ ID NO: 312208 - DNA, 25 bp, Mus musculus
acaggcacgcactcacgtagtcacg

SEQ ID NO: 312209 - DNA, 25 bp, Mus musculus
gggctggcaagcctcggcgcacaca

SEQ ID NO: 312210 - DNA, 25 bp, Mus musculus
tcggcgcacacacagacggggcaca

SEQ ID NO: 312211 - DNA, 25 bp, Mus musculus
atgccaacaggcagagcacgtgctg

SEQ ID NO: 312212 - DNA, 25 bp, Mus musculus
gtcctcaaggcccaacaggccaaag

SEQ ID NO: 312213 - DNA, 25 bp, Mus musculus
cgcacgcgtcgctctcaacaccctc

SEQ ID NO: 312214 - DNA, 25 bp, Mus musculus
acacagacggggcacaggcacgcac

SEQ ID NO: 312215 - DNA, 25 bp, Mus musculus
caacaggcagagcacgtgctgggca

SEQ ID NO: 312216 - DNA, 25 bp, Mus musculus
tgcaagcgggcagcagggtatctcc

SEQ ID NO: 312217 - DNA, 25 bp, Mus musculus
tcacgccacgcacaggcaaggaaac

SEQ ID NO: 312218 - DNA, 25 bp, Mus musculus
acgtagtcacgccacgcacaggcaa

SEQ ID NO: 312219 - DNA, 25 bp, Mus musculus
agggtcccgcttctctagctcacgg

SEQ ID NO: 312220 - DNA, 25 bp, Mus musculus
gagtccagcctctgggcttggcgac

SEQ ID NO: 312221 - DNA, 25 bp, Mus musculus
aggccagacacaggcatgctccttc

SEQ ID NO: 312222 - DNA, 25 bp, Mus musculus
ggccgaggccagacacaggcatgct

SEQ ID NO: 312223 - DNA, 25 bp, Mus musculus
cttaactctttgctggccgaggcca

SEQ ID NO: 312224 - DNA, 25 bp, Mus musculus
gcctctcgacttaactctttgctgg

SEQ ID NO: 312225 - DNA, 25 bp, Mus musculus
aggcagctccaagcctctcgactta

SEQ ID NO: 312226 - DNA, 25 bp, Mus musculus
tcgcttgtctccagctcctgcctgg

SEQ ID NO: 312227 - DNA, 25 bp, Mus musculus
gtatctttcactggccagtgcgtgg

SEQ ID NO: 312228 - DNA, 25 bp, Mus musculus
cacgccagctgtagcctcgcagggt

SEQ ID NO: 312229 - DNA, 25 bp, Mus musculus
ggaaggtatctttcactggccagtg

SEQ ID NO: 312230 - DNA, 25 bp, Mus musculus
agcgggaagaggaaggtatctttca

SEQ ID NO: 312231 - DNA, 25 bp, Mus musculus
caagaggaaggcagctccaagcctc

SEQ ID NO: 312232 - DNA, 25 bp, Mus musculus
tccttcgcacccagccaggggaaaa

SEQ ID NO: 312233 - DNA, 25 bp, Mus musculus
cctgcagcggaagtacccagctata

SEQ ID NO: 312234 - DNA, 25 bp, Mus musculus
tcgagccttcatgggtagagacagc

SEQ ID NO: 312235 - DNA, 25 bp, Mus musculus
ggcaatagttgtaccctccctcgga

SEQ ID NO: 312236 - DNA, 25 bp, Mus musculus
tttgaagccacagcgaagacctttc

SEQ ID NO: 312237 - DNA, 25 bp, Mus musculus
gcccaaggtggtgcgtttgaagcca

SEQ ID NO: 312238 - DNA, 25 bp, Mus musculus
ggctcctagaatctgctcgcacatg

SEQ ID NO: 312239 - DNA, 25 bp, Mus musculus
cacaagcatgtggaacagggtcatc

SEQ ID NO: 312240 - DNA, 25 bp, Mus musculus
gcacaaccaatgagcgtggcactta

SEQ ID NO: 312241 - DNA, 25 bp, Mus musculus
cggcggccacttagaagcagggaaa

SEQ ID NO: 312242 - DNA, 25 bp, Mus musculus
tcacctcaccctagcattgcggatg

SEQ ID NO: 312243 - DNA, 25 bp, Mus musculus
accaggtccctcgataacatgctca

SEQ ID NO: 312244 - DNA, 25 bp, Mus musculus
gcgtcggcagacctacaggaccaaa

SEQ ID NO: 312245 - DNA, 25 bp, Mus musculus
tgcagcagccttaaggtccggcgtc

SEQ ID NO: 312246 - DNA, 25 bp, Mus musculus
cgcgagatgtttaaagcaggctgca

SEQ ID NO: 312247 - DNA, 25 bp, Mus musculus
agttcaggtcaggtgcagtagtgcc

SEQ ID NO: 312248 - DNA, 25 bp, Mus musculus
tgcgggcgtcaatagcgagtttcag

SEQ ID NO: 312249 - DNA, 25 bp, Mus musculus
caaatgccgcggttgtctcaacttc

SEQ ID NO: 312250 - DNA, 25 bp, Mus musculus
ttcgccgacagtcagaccacaattg

SEQ ID NO: 312251 - DNA, 25 bp, Mus musculus
cacaattgtggaagccgccatcttg

SEQ ID NO: 312252 - DNA, 25 bp, Mus musculus
cgacccgtatggctcgagaggtttt

SEQ ID NO: 312253 - DNA, 25 bp, Mus musculus
cttgagtccgcctctgctattcagg

SEQ ID NO: 312254 - DNA, 25 bp, Mus musculus
gccgccatcttgtgtgaagaagtaa

SEQ ID NO: 312255 - DNA, 25 bp, Mus musculus
ctctggtctcaagcctcttaaagga

SEQ ID NO: 312256 - DNA, 25 bp, Mus musculus
ttcgcacgtctttgactctggtctc

SEQ ID NO: 312257 - DNA, 25 bp, Mus musculus
aggttttgcacctctcccttgagtc

SEQ ID NO: 312258 - DNA, 25 bp, Mus musculus
accagtgcgttgtctatttgcgggc

SEQ ID NO: 312259 - DNA, 25 bp, Mus musculus
taacaactaaacatggcggctatcg

SEQ ID NO: 312260 - DNA, 25 bp, Mus musculus
cggaacgggctccaactctcagttg

SEQ ID NO: 312261 - DNA, 25 bp, Mus musculus
gatgtgaacgaggtcagctacgcgc

SEQ ID NO: 312262 - DNA, 25 bp, Mus musculus
cctcgtacaagaagtgctgggcgcc

SEQ ID NO: 312263 - DNA, 25 bp, Mus musculus
acccagggtggcacctcgtacaaga

SEQ ID NO: 312264 - DNA, 25 bp, Mus musculus
tagaagcggcacataacccagggtg

SEQ ID NO: 312265 - DNA, 25 bp, Mus musculus
ccagggcgtccatcactttgtagaa

SEQ ID NO: 312266 - DNA, 25 bp, Mus musculus
cgaactggcaccagtcggcgggctc

SEQ ID NO: 312267 - DNA, 25 bp, Mus musculus
cttcagctccagaagcctgagtcca

SEQ ID NO: 312268 - DNA, 25 bp, Mus musculus
atggggaacatcaggcttcagctcc

SEQ ID NO: 312269 - DNA, 25 bp, Mus musculus
ctggtcgcgcacgatcaaggccgct

SEQ ID NO: 312270 - DNA, 25 bp, Mus musculus
tcgcacagccgcagctctgtctggt

SEQ ID NO: 312271 - DNA, 25 bp, Mus musculus
acagaacactggctgtgcgctgctc

SEQ ID NO: 312272 - DNA, 25 bp, Mus musculus
ttgatccagggccacagaacactgg

SEQ ID NO: 312273 - DNA, 25 bp, Mus musculus
gggtccgcggacactgactcacttc

SEQ ID NO: 312274 - DNA, 25 bp, Mus musculus
ctacgcgcgcgttgcggttgatcca

SEQ ID NO: 312275 - DNA, 25 bp, Mus musculus
ccaactggcgaagcccagacgacaa

SEQ ID NO: 312276 - DNA, 25 bp, Mus musculus
accgtcgctcgcgattgcgggagac

SEQ ID NO: 312277 - DNA, 25 bp, Mus musculus
agatcgcgctgagaaccgtcgctcg

SEQ ID NO: 312278 - DNA, 25 bp, Mus musculus
ctccagggagatcgcgctgagaacc

SEQ ID NO: 312279 - DNA, 25 bp, Mus musculus
tcattcgaaggtggctccagggaga

SEQ ID NO: 312280 - DNA, 25 bp, Mus musculus
agggcgtcattcgaaggtggctcca

SEQ ID NO: 312281 - DNA, 25 bp, Mus musculus
acagctggggcctaggatgcgcaca

SEQ ID NO: 312282 - DNA, 25 bp, Mus musculus
ctcccaacgggagatggactgcgca

SEQ ID NO: 312283 - DNA, 25 bp, Mus musculus
cccagacgacaagggcgcttgcaca

SEQ ID NO: 312284 - DNA, 25 bp, Mus musculus
gcgcgcgacagtgccgaggcccaaa

SEQ ID NO: 312285 - DNA, 25 bp, Mus musculus
gagggacgccatccgccagccgtgt

SEQ ID NO: 312286 - DNA, 25 bp, Mus musculus
acagccctctctccgagaggaggga

SEQ ID NO: 312287 - DNA, 25 bp, Mus musculus
cgcttgcacagctggggcctaggat

SEQ ID NO: 312288 - DNA, 25 bp, Mus musculus
tagagaggagggacgccatccgcca

SEQ ID NO: 312289 - DNA, 25 bp, Mus musculus
taggcccacagcacaggagcgacgc

SEQ ID NO: 312290 - DNA, 25 bp, Mus musculus
ggagactgagcggagcacagaagcc

SEQ ID NO: 312291 - DNA, 25 bp, Mus musculus
agagggaaccctggaaatgctagga

SEQ ID NO: 312292 - DNA, 25 bp, Mus musculus
cctggaaatgctaggacaggagctg

SEQ ID NO: 312293 - DNA, 25 bp, Mus musculus
cacagcacaggagcgacgccatgga

SEQ ID NO: 312294 - DNA, 25 bp, Mus musculus
agggaaccctggaaatgctaggaca

SEQ ID NO: 312295 - DNA, 25 bp, Mus musculus
cttaggcccacagcacaggagcgac

SEQ ID NO: 312296 - DNA, 25 bp, Mus musculus
acaggagctggatttggggacttgc

SEQ ID NO: 312297 - DNA, 25 bp, Mus musculus
aatgctaggacaggagctggatttg

SEQ ID NO: 312298 - DNA, 25 bp, Mus musculus
cccaggcgctgaggacgatgccaca

SEQ ID NO: 312299 - DNA, 25 bp, Mus musculus
ctgaggacgatgccacaggcggcca

SEQ ID NO: 312300 - DNA, 25 bp, Mus musculus
aggcggccagcttaggcccacagca

SEQ ID NO: 312301 - DNA, 25 bp, Mus musculus
cagcttaggcccacagcacaggagc

SEQ ID NO: 312302 - DNA, 25 bp, Mus musculus
cgggttagtcccctcaccaacatga

SEQ ID NO: 312303 - DNA, 25 bp, Mus musculus
cgcggcctacagaggatgtgagctc

SEQ ID NO: 312304 - DNA, 25 bp, Mus musculus
gcactgcggaaagagcgagcccttt

SEQ ID NO: 312305 - DNA, 25 bp, Mus musculus
ccacagcgggagtgagagctactca

SEQ ID NO: 312306 - DNA, 25 bp, Mus musculus
gtgaatcgatactgcctcccggaga

SEQ ID NO: 312307 - DNA, 25 bp, Mus musculus
cggtgcatcttctgctaggtctttt

SEQ ID NO: 312308 - DNA, 25 bp, Mus musculus
gctgaattttcttccacggtgcatc

SEQ ID NO: 312309 - DNA, 25 bp, Mus musculus
ggcgatgcgcttgcttacgcactta

SEQ ID NO: 312310 - DNA, 25 bp, Mus musculus
ctcaggtccgtctgcagattggcga

SEQ ID NO: 312311 - DNA, 25 bp, Mus musculus
acattttcgagctgcatctggcgga

SEQ ID NO: 312312 - DNA, 25 bp, Mus musculus
tccaggaattcaagcgccaccgaca

SEQ ID NO: 312313 - DNA, 25 bp, Mus musculus
agcttgatgctctcacggtccagga

SEQ ID NO: 312314 - DNA, 25 bp, Mus musculus
gccctcacctatggacacgagcttg

SEQ ID NO: 312315 - DNA, 25 bp, Mus musculus
caggccagccttttgttctcgagga

SEQ ID NO: 312316 - DNA, 25 bp, Mus musculus
aggaagaatttgttgcgaccacgcc

SEQ ID NO: 312317 - DNA, 25 bp, Mus musculus
aaaggaagtctcaaccgctgccgca

SEQ ID NO: 312318 - DNA, 25 bp, Mus musculus
tggcgcttcttcttctaggctccga

SEQ ID NO: 312319 - DNA, 25 bp, Mus musculus
ctcggcggcctagctctcaaaggaa

SEQ ID NO: 312320 - DNA, 25 bp, Mus musculus
gctgccgcacgagttctgaaagctc

SEQ ID NO: 312321 - DNA, 25 bp, Mus musculus
gccaatctctcacaagcgttacgtt

SEQ ID NO: 312322 - DNA, 25 bp, Mus musculus
cgttacgtttctgtttgccagccca

SEQ ID NO: 312323 - DNA, 25 bp, Mus musculus
gttccctcagctagaccggtctgca

SEQ ID NO: 312324 - DNA, 25 bp, Mus musculus
tgccatggacgactatgcggttttg

SEQ ID NO: 312325 - DNA, 25 bp, Mus musculus
tttgtccgatactgagctggccgca

SEQ ID NO: 312326 - DNA, 25 bp, Mus musculus
gccgcagtgctacgccagtacaaca

SEQ ID NO: 312327 - DNA, 25 bp, Mus musculus
cctcatgggcctattgtgggtatgc

SEQ ID NO: 312328 - DNA, 25 bp, Mus musculus
gtggcgctcagaacctctcttggtc

SEQ ID NO: 312329 - DNA, 25 bp, Mus musculus
aggttccactcgcaagctctacgaa

SEQ ID NO: 312330 - DNA, 25 bp, Mus musculus
tggcgttcaacaccgcttccaggtg

SEQ ID NO: 312331 - DNA, 25 bp, Mus musculus
gagcagcgctgcatctatgatctta

SEQ ID NO: 312332 - DNA, 25 bp, Mus musculus
ctcttttcctctggcgcggtgagtg

SEQ ID NO: 312333 - DNA, 25 bp, Mus musculus
gttcggtcccgcctggtacacatgc

SEQ ID NO: 312334 - DNA, 25 bp, Mus musculus
cctatataaggcgtgagcaggcgtg

SEQ ID NO: 312335 - DNA, 25 bp, Mus musculus
atgcgcagagcagcgctgcatctat

SEQ ID NO: 312336 - DNA, 25 bp, Mus musculus
gctgcatctatgatcttagcgtctg

SEQ ID NO: 312337 - DNA, 25 bp, Mus musculus
cggtgagtgagttcggtcacggttt

SEQ ID NO: 312338 - DNA, 25 bp, Mus musculus
gtctgatagagcgtcgacaccaccc

SEQ ID NO: 312339 - DNA, 25 bp, Mus musculus
cctggctgtaactctatggttgtta

SEQ ID NO: 312340 - DNA, 25 bp, Mus musculus
tgtaactctatggttgttacagtgg

SEQ ID NO: 312341 - DNA, 25 bp, Mus musculus
gttacagtggaagataggccgccta

SEQ ID NO: 312342 - DNA, 25 bp, Mus musculus
taggccgcctatataaggcgtgagc

SEQ ID NO: 312343 - DNA, 25 bp, Mus musculus
cttagcgtctgatagagcgtcgaca

SEQ ID NO: 312344 - DNA, 25 bp, Mus musculus
ccgcctggtacacatgcgcagagca

SEQ ID NO: 312345 - DNA, 25 bp, Mus musculus
cgtgagcaaatggagcagatgaagc

SEQ ID NO: 312346 - DNA, 25 bp, Mus musculus
aaagtcactgttgccgctgtcgtcg

SEQ ID NO: 312347 - DNA, 25 bp, Mus musculus
catcagctgactaaattgccgccgc

SEQ ID NO: 312348 - DNA, 25 bp, Mus musculus
ggtggctgacgtcacgcatcagctg

SEQ ID NO: 312349 - DNA, 25 bp, Mus musculus
cgtccgcacgttccctggtggctga

SEQ ID NO: 312350 - DNA, 25 bp, Mus musculus
ggcccagtacaagggcgctgcaagc

SEQ ID NO: 312351 - DNA, 25 bp, Mus musculus
ggggcacctcagagcttgcgctccg

SEQ ID NO: 312352 - DNA, 25 bp, Mus musculus
tgttgccgctgtcgtcgctgccaac

SEQ ID NO: 312353 - DNA, 25 bp, Mus musculus
ggacgcgccatgcacctaatgaaga

SEQ ID NO: 312354 - DNA, 25 bp, Mus musculus
gggagacctcaacagtgggctatga

SEQ ID NO: 312355 - DNA, 25 bp, Mus musculus
tgctgccaccatggcccagtacaag

SEQ ID NO: 312356 - DNA, 25 bp, Mus musculus
aggtgcgatcacgtgtcagagccgc

SEQ ID NO: 312357 - DNA, 25 bp, Mus musculus
gaaaccgccactgccttcgctgaaa

SEQ ID NO: 312358 - DNA, 25 bp, Mus musculus
cttctccaagcaaaagtcactgttg

SEQ ID NO: 312359 - DNA, 25 bp, Mus musculus
acgtgttcgtgctcaccgtcaccga

SEQ ID NO: 312360 - DNA, 25 bp, Mus musculus
ttcgagcagaaccaggaccgcaagc

SEQ ID NO: 312361 - DNA, 25 bp, Mus musculus
cttgctgggcgtcttcgagcagaac

SEQ ID NO: 312362 - DNA, 25 bp, Mus musculus
gagaaactgaagctgggcggctccc

SEQ ID NO: 312363 - DNA, 25 bp, Mus musculus
tgcacgccgagtacctggagaaact

SEQ ID NO: 312364 - DNA, 25 bp, Mus musculus
gaagatgccatcaaggtcctgcagt

SEQ ID NO: 312365 - DNA, 25 bp, Mus musculus
aagactcggtcagcatcggcaggaa

SEQ ID NO: 312366 - DNA, 25 bp, Mus musculus
caagcaccggacctacgtgttcgtg

SEQ ID NO: 312367 - DNA, 25 bp, Mus musculus
gcaagccgaaccagacgcggaccta

SEQ ID NO: 312368 - DNA, 25 bp, Mus musculus
ggaggatgaagtgcaagccgaacca

SEQ ID NO: 312369 - DNA, 25 bp, Mus musculus
cagctgcaagcgacctcagaggcgg

SEQ ID NO: 312370 - DNA, 25 bp, Mus musculus
ggcccgctcgctaggcagctgcaag

SEQ ID NO: 312371 - DNA, 25 bp, Mus musculus
cggaagcggcgcctccaatcaggcg

SEQ ID NO: 312372 - DNA, 25 bp, Mus musculus
gtggttcaagatcgaagatgccatc

SEQ ID NO: 312373 - DNA, 25 bp, Mus musculus
atgggcacaggcttcgggacagtcc

SEQ ID NO: 312374 - DNA, 25 bp, Mus musculus
ggaaacttcactgcctctgcgcatc

SEQ ID NO: 312375 - DNA, 25 bp, Mus musculus
ttacatggaacggatgtggcccttc

SEQ ID NO: 312376 - DNA, 25 bp, Mus musculus
tgtggcccttctggctagccaataa

SEQ ID NO: 312377 - DNA, 25 bp, Mus musculus
gctagccaataagagcgcgccgttg

SEQ ID NO: 312378 - DNA, 25 bp, Mus musculus
gccgttggccttacgtaagcagaga

SEQ ID NO: 312379 - DNA, 25 bp, Mus musculus
cgtaagcagagaagaaccaattgtt

SEQ ID NO: 312380 - DNA, 25 bp, Mus musculus
attgttcccttggtctacgtacagc

SEQ ID NO: 312381 - DNA, 25 bp, Mus musculus
tacgtacagcgcctcagagcttgtg

SEQ ID NO: 312382 - DNA, 25 bp, Mus musculus
actctggcgccatggaggagtacgc

SEQ ID NO: 312383 - DNA, 25 bp, Mus musculus
gagtacgctcgcgaaccttggtacg

SEQ ID NO: 312384 - DNA, 25 bp, Mus musculus
cgcatccgacgcttacatggaacgg

SEQ ID NO: 312385 - DNA, 25 bp, Mus musculus
tgacccgggaggctcggaaacttca

SEQ ID NO: 312386 - DNA, 25 bp, Mus musculus
tgcagtgtcaagtccctgacccggg

SEQ ID NO: 312387 - DNA, 25 bp, Mus musculus
tgagaggcttgcttcttgcactaga

SEQ ID NO: 312388 - DNA, 25 bp, Mus musculus
gccatgcgctctgcttcttagggcc

SEQ ID NO: 312389 - DNA, 25 bp, Mus musculus
tgcttcttgcactagagtcctgggc

SEQ ID NO: 312390 - DNA, 25 bp, Mus musculus
ctgctggatggcagaggtttcagac

SEQ ID NO: 312391 - DNA, 25 bp, Mus musculus
cagagacccatgagaggcttgcttc

SEQ ID NO: 312392 - DNA, 25 bp, Mus musculus
ttgcagattttgcagcgtgcgaggc

SEQ ID NO: 312393 - DNA, 25 bp, Mus musculus
atggcagaggtttcagacagcctgg

SEQ ID NO: 312394 - DNA, 25 bp, Mus musculus
ctgtgcgccaatagtctgctggatg

SEQ ID NO: 312395 - DNA, 25 bp, Mus musculus
acaggtaggtggtcgccatccttaa

SEQ ID NO: 312396 - DNA, 25 bp, Mus musculus
gtggtcgccatccttaaagcctgtg

SEQ ID NO: 312397 - DNA, 25 bp, Mus musculus
ccttaaagcctgtgcgccaatagtc

SEQ ID NO: 312398 - DNA, 25 bp, Mus musculus
ccgcgcctaggactcagccattgag

SEQ ID NO: 312399 - DNA, 25 bp, Mus musculus
taggactcagccattgagcaaaggg

SEQ ID NO: 312400 - DNA, 25 bp, Mus musculus
ccagatggtttctggggtcaggccc

SEQ ID NO: 312401 - DNA, 25 bp, Mus musculus
tagagtccaccacctgggcttaatg

SEQ ID NO: 312402 - DNA, 25 bp, Mus musculus
ttcacggtcagctgcatggtgtcca

SEQ ID NO: 312403 - DNA, 25 bp, Mus musculus
ccgtgccttgggtagagtccaccac

SEQ ID NO: 312404 - DNA, 25 bp, Mus musculus
cgcattcttcagtcccgcctcccgg

SEQ ID NO: 312405 - DNA, 25 bp, Mus musculus
ctacggccaacgcaaacaccaacgg

SEQ ID NO: 312406 - DNA, 25 bp, Mus musculus
tgcatggtgtccacggcccagtcca

SEQ ID NO: 312407 - DNA, 25 bp, Mus musculus
ggagcgccttcacggtcagctgcat

SEQ ID NO: 312408 - DNA, 25 bp, Mus musculus
ccaccacctgggcttaatggcgcgg

SEQ ID NO: 312409 - DNA, 25 bp, Mus musculus
ctgtaggctacattcccggccctgg

SEQ ID NO: 312410 - DNA, 25 bp, Mus musculus
tcagcccgaattccctgggcggtga

SEQ ID NO: 312411 - DNA, 25 bp, Mus musculus
agaggcaagggctcagcccgaattc

SEQ ID NO: 312412 - DNA, 25 bp, Mus musculus
ctccgccacctgatccggccgaggt

SEQ ID NO: 312413 - DNA, 25 bp, Mus musculus
gcggggtgactttacctgtaggcta

SEQ ID NO: 312414 - DNA, 25 bp, Mus musculus
ttccctgggcggtgaagccctcgca

SEQ ID NO: 312415 - DNA, 25 bp, Mus musculus
gttccatccgcgtgctaggactccg

SEQ ID NO: 312416 - DNA, 25 bp, Mus musculus
ggaagcgacgagctggccctaccac

SEQ ID NO: 312417 - DNA, 25 bp, Mus musculus
gcacccgcaagacctttcgctgggt

SEQ ID NO: 312418 - DNA, 25 bp, Mus musculus
acctttcgctgggtctggccagagc

SEQ ID NO: 312419 - DNA, 25 bp, Mus musculus
gccagagctggtgaccacggactgc

SEQ ID NO: 312420 - DNA, 25 bp, Mus musculus
tgcggacggagccacaagtcacctc

SEQ ID NO: 312421 - DNA, 25 bp, Mus musculus
tcacctacctggtcgaaatctctca

SEQ ID NO: 312422 - DNA, 25 bp, Mus musculus
gaaatctctcacttgcttccgcggc

SEQ ID NO: 312423 - DNA, 25 bp, Mus musculus
gcggccacagagctcctcacaagta

SEQ ID NO: 312424 - DNA, 25 bp, Mus musculus
tcctcacaagtagtggcccgggccg

SEQ ID NO: 312425 - DNA, 25 bp, Mus musculus
caaacgccggcaagtgaggcccgtc

SEQ ID NO: 312426 - DNA, 25 bp, Mus musculus
accaaggttccatccgcgtgctagg

SEQ ID NO: 312427 - DNA, 25 bp, Mus musculus
caacggatgtgacgtttctggaagc

SEQ ID NO: 312428 - DNA, 25 bp, Mus musculus
gcttgtgtcaggttcccaacggatg

SEQ ID NO: 312429 - DNA, 25 bp, Mus musculus
cggatccctccggtgctaggcccgg

SEQ ID NO: 312430 - DNA, 25 bp, Mus musculus
aatggccgcccgcagaaggccacag

SEQ ID NO: 312431 - DNA, 25 bp, Mus musculus
aggcacgacaatggccgcccgcaga

SEQ ID NO: 312432 - DNA, 25 bp, Mus musculus
ttatcaggcacgacaatggccgccc

SEQ ID NO: 312433 - DNA, 25 bp, Mus musculus
gaaaagcttatcaggcacgacaatg

SEQ ID NO: 312434 - DNA, 25 bp, Mus musculus
agtgagtcacgtagaaaagcttatc

SEQ ID NO: 312435 - DNA, 25 bp, Mus musculus
gtgaagcaagtgagtcacgtagaaa

SEQ ID NO: 312436 - DNA, 25 bp, Mus musculus
tcgctctgccggctaggtgaagcaa

SEQ ID NO: 312437 - DNA, 25 bp, Mus musculus
gttacccagttgtctcgctctgccg

SEQ ID NO: 312438 - DNA, 25 bp, Mus musculus
atcagggagttacccagttgtctcg

SEQ ID NO: 312439 - DNA, 25 bp, Mus musculus
agcagaccggatcagggagttaccc

SEQ ID NO: 312440 - DNA, 25 bp, Mus musculus
attgggcgggccaaggatgttgtct

SEQ ID NO: 312441 - DNA, 25 bp, Mus musculus
ggctcaggtcgatccgctcgaggct

SEQ ID NO: 312442 - DNA, 25 bp, Mus musculus
gcagaaggccacagcccacaggcgt

SEQ ID NO: 312443 - DNA, 25 bp, Mus musculus
tcaggaggcgatccaagttaagttc

SEQ ID NO: 312444 - DNA, 25 bp, Mus musculus
ggcctctcaggaggcgatccaagtt

SEQ ID NO: 312445 - DNA, 25 bp, Mus musculus
cgcagttgcagctccagtttcgcct

SEQ ID NO: 312446 - DNA, 25 bp, Mus musculus
gcagctccagtttcgcctcccggtg

SEQ ID NO: 312447 - DNA, 25 bp, Mus musculus
accagccacaaacgcactaggttga

SEQ ID NO: 312448 - DNA, 25 bp, Mus musculus
cacaaacgcactaggttgagggatc

SEQ ID NO: 312449 - DNA, 25 bp, Mus musculus
aacgcactaggttgagggatccgga

SEQ ID NO: 312450 - DNA, 25 bp, Mus musculus
cccagtgaccacacggacgcggtag

SEQ ID NO: 312451 - DNA, 25 bp, Mus musculus
cacacggacgcggtagcggcccatg

SEQ ID NO: 312452 - DNA, 25 bp, Mus musculus
aagttcaattcgaagaccgcccagg

SEQ ID NO: 312453 - DNA, 25 bp, Mus musculus
ctctggcctctcaggaggcgatcca

SEQ ID NO: 312454 - DNA, 25 bp, Mus musculus
aggcgatccaagttaagttcaattc

SEQ ID NO: 312455 - DNA, 25 bp, Mus musculus
ttcaattcgaagaccgcccagggcc

SEQ ID NO: 312456 - DNA, 25 bp, Mus musculus
atggctccctctggcctctcaggag

SEQ ID NO: 312457 - DNA, 25 bp, Mus musculus
gctagtctatcattgcaggaggaga

SEQ ID NO: 312458 - DNA, 25 bp, Mus musculus
tcgctggcccatttaacgcaagagg

SEQ ID NO: 312459 - DNA, 25 bp, Mus musculus
tttaacgcaagagggcgtgtgcttt

SEQ ID NO: 312460 - DNA, 25 bp, Mus musculus
tctgtagcgcacagccagtttccgg

SEQ ID NO: 312461 - DNA, 25 bp, Mus musculus
cacgttcacagatctgtagcgcaca

SEQ ID NO: 312462 - DNA, 25 bp, Mus musculus
ggctaagcttcgctggcccatttaa

SEQ ID NO: 312463 - DNA, 25 bp, Mus musculus
gtgtgctttgactgagctgacccgc

SEQ ID NO: 312464 - DNA, 25 bp, Mus musculus
ggagcttcgggctagtctatcattg

SEQ ID NO: 312465 - DNA, 25 bp, Mus musculus
gttgccgctgccaaacacgttcaca

SEQ ID NO: 312466 - DNA, 25 bp, Mus musculus
ttacctgagtttagttgccgctgcc

SEQ ID NO: 312467 - DNA, 25 bp, Mus musculus
tgaagcatgtccctccaccgacatg

SEQ ID NO: 312468 - DNA, 25 bp, Mus musculus
cgtacaagcgtgaagcatgtccctc

SEQ ID NO: 312469 - DNA, 25 bp, Mus musculus
actcgcggcgtacaagcgtgaagca

SEQ ID NO: 312470 - DNA, 25 bp, Mus musculus
ctgacccgcctcaggagaggcagga

SEQ ID NO: 312471 - DNA, 25 bp, Mus musculus
ggtcacacctccgtggccgaatcag

SEQ ID NO: 312472 - DNA, 25 bp, Mus musculus
ccgaatcagccaatgggattgagta

SEQ ID NO: 312473 - DNA, 25 bp, Mus musculus
attgagtagacagtccgcgggttcg

SEQ ID NO: 312474 - DNA, 25 bp, Mus musculus
cgcgggttcgtagagattcctgccc

SEQ ID NO: 312475 - DNA, 25 bp, Mus musculus
cggacgggtctcacaccataggagt

SEQ ID NO: 312476 - DNA, 25 bp, Mus musculus
cgggtcctaatgacgtgcccggacg

SEQ ID NO: 312477 - DNA, 25 bp, Mus musculus
ccataggagtctacagttcttagtt

SEQ ID NO: 312478 - DNA, 25 bp, Mus musculus
catgagacctgtggggcctcctaca

SEQ ID NO: 312479 - DNA, 25 bp, Mus musculus
ttctggtggcagtgccatgagacct

SEQ ID NO: 312480 - DNA, 25 bp, Mus musculus
acgcacgcggtgcagttcaagatgg

SEQ ID NO: 312481 - DNA, 25 bp, Mus musculus
ttcaagatggcggatgcagaaggta

SEQ ID NO: 312482 - DNA, 25 bp, Mus musculus
cacgacccggagctagttatagtga

SEQ ID NO: 312483 - DNA, 25 bp, Mus musculus
tagtgagattgcatcgtgacccgcg

SEQ ID NO: 312484 - DNA, 25 bp, Mus musculus
ttttatatcagcaagctaggggcgg

SEQ ID NO: 312485 - DNA, 25 bp, Mus musculus
ttgagcgtcatctctcaggagcaga

SEQ ID NO: 312486 - DNA, 25 bp, Mus musculus
ccttggccttccttgtgcttagcga

SEQ ID NO: 312487 - DNA, 25 bp, Mus musculus
gcacgacctgtgaactaccgaagcg

SEQ ID NO: 312488 - DNA, 25 bp, Mus musculus
tgcgcagccagcatccctgaaaaga

SEQ ID NO: 312489 - DNA, 25 bp, Mus musculus
aggcgcagtttagcgttgcttgaaa

SEQ ID NO: 312490 - DNA, 25 bp, Mus musculus
acgcttctgtagtaagtgctccagg

SEQ ID NO: 312491 - DNA, 25 bp, Mus musculus
ggccaagcagagcagtacccacgct

SEQ ID NO: 312492 - DNA, 25 bp, Mus musculus
ccgcagagctttgagcccaggaatc

SEQ ID NO: 312493 - DNA, 25 bp, Mus musculus
aagtgcggtgcgcatgctgttccct

SEQ ID NO: 312494 - DNA, 25 bp, Mus musculus
tgctccaggtagaggtccgaaagtg

SEQ ID NO: 312495 - DNA, 25 bp, Mus musculus
acctcaggtcggttacgcttctgta

SEQ ID NO: 312496 - DNA, 25 bp, Mus musculus
cccaggaatcgcaaatcggggaact

SEQ ID NO: 312497 - DNA, 25 bp, Mus musculus
gcctgttcagagacgagctagacta

SEQ ID NO: 312498 - DNA, 25 bp, Mus musculus
ggagcagagacaaccagacgcagta

SEQ ID NO: 312499 - DNA, 25 bp, Mus musculus
aaaaagagagacacgaggccgcacg

SEQ ID NO: 312500 - DNA, 25 bp, Mus musculus
acgaggccgcacggccaggaatcca

SEQ ID NO: 312501 - DNA, 25 bp, Mus musculus
ccgcacggccaggaatccaggtggt

SEQ ID NO: 312502 - DNA, 25 bp, Mus musculus
ggccgcacggccaggaatccaggtg

SEQ ID NO: 312503 - DNA, 25 bp, Mus musculus
aggccgcacggccaggaatccaggt

SEQ ID NO: 312504 - DNA, 25 bp, Mus musculus
cgaggccgcacggccaggaatccag

SEQ ID NO: 312505 - DNA, 25 bp, Mus musculus
cacgaggccgcacggccaggaatcc

SEQ ID NO: 312506 - DNA, 25 bp, Mus musculus
acacgaggccgcacggccaggaatc

SEQ ID NO: 312507 - DNA, 25 bp, Mus musculus
agagagacacgaggccgcacggcca

SEQ ID NO: 312508 - DNA, 25 bp, Mus musculus
aagagagacacgaggccgcacggcc

SEQ ID NO: 312509 - DNA, 25 bp, Mus musculus
aaaagagagacacgaggccgcacgg

SEQ ID NO: 312510 - DNA, 25 bp, Mus musculus
cgcacggccaggaatccaggtggta

SEQ ID NO: 312511 - DNA, 25 bp, Mus musculus
aaaaaagagagacacgaggccgcac

SEQ ID NO: 312512 - DNA, 25 bp, Mus musculus
aaagagagacacgaggccgcacggc

SEQ ID NO: 312513 - DNA, 25 bp, Mus musculus
actcactgcatcaaagggcacagag

SEQ ID NO: 312514 - DNA, 25 bp, Mus musculus
ctcactgcatcaaagggcacagagc

SEQ ID NO: 312515 - DNA, 25 bp, Mus musculus
agatccactgaaggccatccttgac

SEQ ID NO: 312516 - DNA, 25 bp, Mus musculus
tcactgcatcaaagggcacagagca

SEQ ID NO: 312517 - DNA, 25 bp, Mus musculus
cactgcatcaaagggcacagagcat

SEQ ID NO: 312518 - DNA, 25 bp, Mus musculus
tgcatcaaagggcacagagcatgaa

SEQ ID NO: 312519 - DNA, 25 bp, Mus musculus
catcaaagggcacagagcatgaagg

SEQ ID NO: 312520 - DNA, 25 bp, Mus musculus
atcaaagggcacagagcatgaaggc

SEQ ID NO: 312521 - DNA, 25 bp, Mus musculus
tcaaagggcacagagcatgaaggct

SEQ ID NO: 312522 - DNA, 25 bp, Mus musculus
caaagggcacagagcatgaaggctg

SEQ ID NO: 312523 - DNA, 25 bp, Mus musculus
ggcacagagcatgaaggctgggaga

SEQ ID NO: 312524 - DNA, 25 bp, Mus musculus
agagcatgaaggctgggagagggac

SEQ ID NO: 312525 - DNA, 25 bp, Mus musculus
tgagatccactgaaggccatccttg

SEQ ID NO: 312526 - DNA, 25 bp, Mus musculus
gagatccactgaaggccatccttga

SEQ ID NO: 312527 - DNA, 25 bp, Mus musculus
gcgatgtcgcctcaaagtgctgtcc

SEQ ID NO: 312528 - DNA, 25 bp, Mus musculus
aagctaagggctggtcgctgcgtct

SEQ ID NO: 312529 - DNA, 25 bp, Mus musculus
aaatgggcgccagcactatgaaggc

SEQ ID NO: 312530 - DNA, 25 bp, Mus musculus
ctcaaagtgctgtccgtgacgcatg

SEQ ID NO: 312531 - DNA, 25 bp, Mus musculus
cggagcctcaagctaagggctggtc

SEQ ID NO: 312532 - DNA, 25 bp, Mus musculus
aatgctttgctagccgagaccaacc

SEQ ID NO: 312533 - DNA, 25 bp, Mus musculus
gcggcctggagctactcacagccta

SEQ ID NO: 312534 - DNA, 25 bp, Mus musculus
gctctcatcagcgggcgggcaaaat

SEQ ID NO: 312535 - DNA, 25 bp, Mus musculus
tgacgcgtagacctctttcgccagc

SEQ ID NO: 312536 - DNA, 25 bp, Mus musculus
cagcctgacgcgtagacctctttcg

SEQ ID NO: 312537 - DNA, 25 bp, Mus musculus
tggagctactcacagcctacgtccg

SEQ ID NO: 312538 - DNA, 25 bp, Mus musculus
acccaacgtcccaatgctttgctag

SEQ ID NO: 312539 - DNA, 25 bp, Mus musculus
tccgtgacgcatgtaggccgcgccg

SEQ ID NO: 312540 - DNA, 25 bp, Mus musculus
cactatgaaggcgtctgccctggcg

SEQ ID NO: 312541 - DNA, 25 bp, Mus musculus
tataccagttatatactgctaaaat

SEQ ID NO: 312542 - DNA, 25 bp, Mus musculus
tggaaatataccagttatatactgc

SEQ ID NO: 312543 - DNA, 25 bp, Mus musculus
tcttggaaatataccagttatatac

SEQ ID NO: 312544 - DNA, 25 bp, Mus musculus
cagtattcttggaaatataccagtt

SEQ ID NO: 312545 - DNA, 25 bp, Mus musculus
taactttgaaatcagtattcttgga

SEQ ID NO: 312546 - DNA, 25 bp, Mus musculus
cactgatgattgtaactttgaaatc

SEQ ID NO: 312547 - DNA, 25 bp, Mus musculus
ctttcactgatgattgtaactttga

SEQ ID NO: 312548 - DNA, 25 bp, Mus musculus
tttttctttcactgatgattgtaac

SEQ ID NO: 312549 - DNA, 25 bp, Mus musculus
tcttacttctataagtggaaggtaa

SEQ ID NO: 312550 - DNA, 25 bp, Mus musculus
atttcttacttctataagtggaagg

SEQ ID NO: 312551 - DNA, 25 bp, Mus musculus
ggtcttattatttcttacttctata

SEQ ID NO: 312552 - DNA, 25 bp, Mus musculus
atggaaccggattccaaaatgtact

SEQ ID NO: 312553 - DNA, 25 bp, Mus musculus
ggatggaaccggattccaaaatgta

SEQ ID NO: 312554 - DNA, 25 bp, Mus musculus
gcctcgcggagaggcacttgggctc

SEQ ID NO: 312555 - DNA, 25 bp, Mus musculus
tactaaagtgctgcgctggagcctg

SEQ ID NO: 312556 - DNA, 25 bp, Mus musculus
gatcggtttctgcaggaagtggtcc

SEQ ID NO: 312557 - DNA, 25 bp, Mus musculus
gaaaattgccttgtccgggttctga

SEQ ID NO: 312558 - DNA, 25 bp, Mus musculus
ctcgagtgagggttacaagccatac

SEQ ID NO: 312559 - DNA, 25 bp, Mus musculus
tcctcaccggaagttcggagccaga

SEQ ID NO: 312560 - DNA, 25 bp, Mus musculus
cgggttctgaaccacagcgatggca

SEQ ID NO: 312561 - DNA, 25 bp, Mus musculus
ggacctctgacttcctcggaaagta

SEQ ID NO: 312562 - DNA, 25 bp, Mus musculus
ccgccgatctgtggaccaggatttg

SEQ ID NO: 312563 - DNA, 25 bp, Mus musculus
aggtacttgctagggcggatcctca

SEQ ID NO: 312564 - DNA, 25 bp, Mus musculus
ccgcattccgcaatccttgcaggta

SEQ ID NO: 312565 - DNA, 25 bp, Mus musculus
tggcaaatacatcctgaccgcattc

SEQ ID NO: 312566 - DNA, 25 bp, Mus musculus
gcccttggttgagacgagcactccc

SEQ ID NO: 312567 - DNA, 25 bp, Mus musculus
acgagactcctgacgtggaccctga

SEQ ID NO: 312568 - DNA, 25 bp, Mus musculus
ggggctctgctacgcgtcaaacgcc

SEQ ID NO: 312569 - DNA, 25 bp, Mus musculus
tggcctggcaggactcttcggcccg

SEQ ID NO: 312570 - DNA, 25 bp, Mus musculus
tgaacctctcttgacccgctgtatc

SEQ ID NO: 312571 - DNA, 25 bp, Mus musculus
tgacccgctgtatcccagatctgga

SEQ ID NO: 312572 - DNA, 25 bp, Mus musculus
cccacggtgggatctgaaacctgag

SEQ ID NO: 312573 - DNA, 25 bp, Mus musculus
atctggagcttgatgcgttttcctg

SEQ ID NO: 312574 - DNA, 25 bp, Mus musculus
atgcgttttcctggctcgatctcca

SEQ ID NO: 312575 - DNA, 25 bp, Mus musculus
ctggctcgatctccaccaaacggga

SEQ ID NO: 312576 - DNA, 25 bp, Mus musculus
gatcaggcaggacttgcccaccgtg

SEQ ID NO: 312577 - DNA, 25 bp, Mus musculus
ttgcccaccgtggaatcgccgatga

SEQ ID NO: 312578 - DNA, 25 bp, Mus musculus
tggaatcgccgatgacaatgagccg

SEQ ID NO: 312579 - DNA, 25 bp, Mus musculus
caatgagccggaactggtacagcca

SEQ ID NO: 312580 - DNA, 25 bp, Mus musculus
tggcctccatggcagtggcctggca

SEQ ID NO: 312581 - DNA, 25 bp, Mus musculus
tgaaacctgagcaaagcggccctcg

SEQ ID NO: 312582 - DNA, 25 bp, Mus musculus
ggtacagccagatggcctccatggc

SEQ ID NO: 312583 - DNA, 25 bp, Mus musculus
ggataacataagctgtatgcaaatg

SEQ ID NO: 312584 - DNA, 25 bp, Mus musculus
tgcacagccagcagcctgaagagtt

SEQ ID NO: 312585 - DNA, 25 bp, Mus musculus
tcagaactacaatgcttgtagaagc

SEQ ID NO: 312586 - DNA, 25 bp, Mus musculus
agcatcgtgactgttatggataaca

SEQ ID NO: 312587 - DNA, 25 bp, Mus musculus
gtccctatcatattttcagaactac

SEQ ID NO: 312588 - DNA, 25 bp, Mus musculus
ggcatgttagtgtccctatcatatt

SEQ ID NO: 312589 - DNA, 25 bp, Mus musculus
gctgtatgcaaatgatttatatttt

SEQ ID NO: 312590 - DNA, 25 bp, Mus musculus
tcagtcattagagaatgtgatggca

SEQ ID NO: 312591 - DNA, 25 bp, Mus musculus
atgtgatggcataagatgtcttggc

SEQ ID NO: 312592 - DNA, 25 bp, Mus musculus
aagatgtcttggctgcccttcgccc

SEQ ID NO: 312593 - DNA, 25 bp, Mus musculus
cctcggccgacacccgtgcgaccct

SEQ ID NO: 312594 - DNA, 25 bp, Mus musculus
agccgaccgggtgcacagccagcag

SEQ ID NO: 312595 - DNA, 25 bp, Mus musculus
tctgccctctcttgatctggcagct

SEQ ID NO: 312596 - DNA, 25 bp, Mus musculus
gcttgtagaagcatcgtgactgtta

SEQ ID NO: 312597 - DNA, 25 bp, Mus musculus
tcacagcgatagcacgaggtccagt

SEQ ID NO: 312598 - DNA, 25 bp, Mus musculus
agaacagcgtccacaggccaggccg

SEQ ID NO: 312599 - DNA, 25 bp, Mus musculus
tccctcgtctgagcagtgcagcagc

SEQ ID NO: 312600 - DNA, 25 bp, Mus musculus
cgctggccgagaacagcgtccacag

SEQ ID NO: 312601 - DNA, 25 bp, Mus musculus
gccaggccgcatgacgaagacgatg

SEQ ID NO: 312602 - DNA, 25 bp, Mus musculus
acgaagacgatgacagcgatggcga

SEQ ID NO: 312603 - DNA, 25 bp, Mus musculus
gcgatggcgatgaccacaacgaccc

SEQ ID NO: 312604 - DNA, 25 bp, Mus musculus
agaggcagcggcaccaccaaaggcc

SEQ ID NO: 312605 - DNA, 25 bp, Mus musculus
gcggcaccaccaaaggcctggttct

SEQ ID NO: 312606 - DNA, 25 bp, Mus musculus
ccgagtcgtccctcgtctgagcagt

SEQ ID NO: 312607 - DNA, 25 bp, Mus musculus
cctgttgctcacagcgatagcacga

SEQ ID NO: 312608 - DNA, 25 bp, Mus musculus
agccctgccgagagggacccgacca

SEQ ID NO: 312609 - DNA, 25 bp, Mus musculus
gcgatagcacgaggtccagttccca

SEQ ID NO: 312610 - DNA, 25 bp, Mus musculus
cgcgccagtcctcggctcactgcac

SEQ ID NO: 312611 - DNA, 25 bp, Mus musculus
gtgaccgcgggagccacagacttac

SEQ ID NO: 312612 - DNA, 25 bp, Mus musculus
ggggcggcttgcaaactgctaaccc

SEQ ID NO: 312613 - DNA, 25 bp, Mus musculus
cgcaaacataagtgcgacgcacgcc

SEQ ID NO: 312614 - DNA, 25 bp, Mus musculus
ggcgtggcgtgatgacgcaaacata

SEQ ID NO: 312615 - DNA, 25 bp, Mus musculus
gccatcttcacaggctcgagcaatg

SEQ ID NO: 312616 - DNA, 25 bp, Mus musculus
cgtcctcaatggttaagtggctcta

SEQ ID NO: 312617 - DNA, 25 bp, Mus musculus
gtggctctattctccactctcggct

SEQ ID NO: 312618 - DNA, 25 bp, Mus musculus
tcagcttcaggaaggcgggaccacg

SEQ ID NO: 312619 - DNA, 25 bp, Mus musculus
tgccgtcccatgcagcctcaataag

SEQ ID NO: 312620 - DNA, 25 bp, Mus musculus
tcaataagcacatgagcccgggcaa

SEQ ID NO: 312621 - DNA, 25 bp, Mus musculus
tcgcggctgtaacaacccggaaatg

SEQ ID NO: 312622 - DNA, 25 bp, Mus musculus
tctaacagcagcagacgcagacgcg

SEQ ID NO: 312623 - DNA, 25 bp, Mus musculus
atgaagtctgtggatcgcgtcctca

SEQ ID NO: 312624 - DNA, 25 bp, Mus musculus
gctcacagctccagtgtcagcttca

SEQ ID NO: 312625 - DNA, 25 bp, Mus musculus
acctgttctttgttaagaggtcaga

SEQ ID NO: 312626 - DNA, 25 bp, Mus musculus
tgcgcctgcgctaactgggaaggaa

SEQ ID NO: 312627 - DNA, 25 bp, Mus musculus
gcttccaaaggtcacgtggtccctc

SEQ ID NO: 312628 - DNA, 25 bp, Mus musculus
cgagcgcatgcttccaaaggtcacg

SEQ ID NO: 312629 - DNA, 25 bp, Mus musculus
aggggcggctgccgaacctgttctt

SEQ ID NO: 312630 - DNA, 25 bp, Mus musculus
tctttgttaagaggtcagagcctgc

SEQ ID NO: 312631 - DNA, 25 bp, Mus musculus
ttaagaggtcagagcctgcgcctgc

SEQ ID NO: 312632 - DNA, 25 bp, Mus musculus
tcgctggactcctcaaaggcggccg

SEQ ID NO: 312633 - DNA, 25 bp, Mus musculus
tgtaatcgctggactcctcaaaggc

SEQ ID NO: 312634 - DNA, 25 bp, Mus musculus
gcctaggttgtaatcgctggactcc

SEQ ID NO: 312635 - DNA, 25 bp, Mus musculus
cctgcgctaactgggaaggaactac

SEQ ID NO: 312636 - DNA, 25 bp, Mus musculus
agctgggcctaggttgtaatcgctg

SEQ ID NO: 312637 - DNA, 25 bp, Mus musculus
accgaggagcttcaaagagctgcgc

SEQ ID NO: 312638 - DNA, 25 bp, Mus musculus
aggaactaccgaggagcttcaaaga

SEQ ID NO: 312639 - DNA, 25 bp, Mus musculus
tagctcttctcgtggactaggtggc

SEQ ID NO: 312640 - DNA, 25 bp, Mus musculus
gcatctctttgtctgaggctccaga

SEQ ID NO: 312641 - DNA, 25 bp, Mus musculus
tgcagttcgtcccagcatctctttg

SEQ ID NO: 312642 - DNA, 25 bp, Mus musculus
caagtttagggacgctctgcagttc

SEQ ID NO: 312643 - DNA, 25 bp, Mus musculus
ctgcacgccgaacaatacctctggg

SEQ ID NO: 312644 - DNA, 25 bp, Mus musculus
ctgaagcttcaggaggggcaagttc

SEQ ID NO: 312645 - DNA, 25 bp, Mus musculus
caggggctcaaacttctcgggccga

SEQ ID NO: 312646 - DNA, 25 bp, Mus musculus
aggggagcctcattcatcctcgagg

SEQ ID NO: 312647 - DNA, 25 bp, Mus musculus
accgaaactttccagcgctagctct

SEQ ID NO: 312648 - DNA, 25 bp, Mus musculus
ccagtctcgacgctcgggagcgaca

SEQ ID NO: 312649 - DNA, 25 bp, Mus musculus
ctcccagcctgggtaggcttgctcg

SEQ ID NO: 312650 - DNA, 25 bp, Mus musculus
gcagggctgtagagagcctcttcca

SEQ ID NO: 312651 - DNA, 25 bp, Mus musculus
cagtacgctgagtgcgcggccacaa

SEQ ID NO: 312652 - DNA, 25 bp, Mus musculus
cggccacaagttgcacggctcgcgg

SEQ ID NO: 312653 - DNA, 25 bp, Mus musculus
ggagcctccgagtccctaaggtgaa

SEQ ID NO: 312654 - DNA, 25 bp, Mus musculus
cgagaccttggtcttcacggggtca

SEQ ID NO: 312655 - DNA, 25 bp, Mus musculus
acccacggtggctatggtgtcccaa

SEQ ID NO: 312656 - DNA, 25 bp, Mus musculus
ggtgtcccaatcttgtaacgagtgc

SEQ ID NO: 312657 - DNA, 25 bp, Mus musculus
cccgccttctgtgacgatgtcctgg

SEQ ID NO: 312658 - DNA, 25 bp, Mus musculus
ggtgaagtcaccctcctgaaagctc

SEQ ID NO: 312659 - DNA, 25 bp, Mus musculus
cggggtcatggtctggatcttttac

SEQ ID NO: 312660 - DNA, 25 bp, Mus musculus
atcttttacggtcgccgcggcacca

SEQ ID NO: 312661 - DNA, 25 bp, Mus musculus
cggcgcaatggcagtctgtgcatca

SEQ ID NO: 312662 - DNA, 25 bp, Mus musculus
ggaagcaaactcagcgggtctcaga

SEQ ID NO: 312663 - DNA, 25 bp, Mus musculus
gttggcccaaccctgcctattgtta

SEQ ID NO: 312664 - DNA, 25 bp, Mus musculus
tgcctattgttactcacccgcgggg

SEQ ID NO: 312665 - DNA, 25 bp, Mus musculus
aggctggatgcgatcccgagaaatc

SEQ ID NO: 312666 - DNA, 25 bp, Mus musculus
gctccgccttgttgcgtaaccgacg

SEQ ID NO: 312667 - DNA, 25 bp, Mus musculus
cccgccactgaaaaagctgcacgag

SEQ ID NO: 312668 - DNA, 25 bp, Mus musculus
actgaaaaagctgcacgagtctccc

SEQ ID NO: 312669 - DNA, 25 bp, Mus musculus
taaccgggtcaaagtcttccataca

SEQ ID NO: 312670 - DNA, 25 bp, Mus musculus
gcgctagcagagctgcaagccgcgc

SEQ ID NO: 312671 - DNA, 25 bp, Mus musculus
acggctcactcctctccacacgcag

SEQ ID NO: 312672 - DNA, 25 bp, Mus musculus
cgcagccggaggctggcaacctcga

SEQ ID NO: 312673 - DNA, 25 bp, Mus musculus
aaagtcttccatacacacccgagtc

SEQ ID NO: 312674 - DNA, 25 bp, Mus musculus
acacacccgagtccctttctggctg

SEQ ID NO: 312675 - DNA, 25 bp, Mus musculus
tttctggctgccaaccacgttctct

SEQ ID NO: 312676 - DNA, 25 bp, Mus musculus
gccaaccacgttctctccaaggagt

SEQ ID NO: 312677 - DNA, 25 bp, Mus musculus
cgcaccgctgcctcactcaccgtga

SEQ ID NO: 312678 - DNA, 25 bp, Mus musculus
cgctcagctactacgcgctagcaga

SEQ ID NO: 312679 - DNA, 25 bp, Mus musculus
tactacgcgctagcagagctgcaag

SEQ ID NO: 312680 - DNA, 25 bp, Mus musculus
acacgcagccggaggctggcaacct

SEQ ID NO: 312681 - DNA, 25 bp, Mus musculus
tctctgcgtttgctgtcgctgcagc

SEQ ID NO: 312682 - DNA, 25 bp, Mus musculus
accagtactacctgtccctgtggga

SEQ ID NO: 312683 - DNA, 25 bp, Mus musculus
ggaaacccgccaacctggatatctg

SEQ ID NO: 312684 - DNA, 25 bp, Mus musculus
atcttcttggcgctgtgtctggatc

SEQ ID NO: 312685 - DNA, 25 bp, Mus musculus
ttagcgccgctttcctgttcgggag

SEQ ID NO: 312686 - DNA, 25 bp, Mus musculus
gtgtgcttaactgagacccaaggta

SEQ ID NO: 312687 - DNA, 25 bp, Mus musculus
tccagttgaccactcggtgtgctta

SEQ ID NO: 312688 - DNA, 25 bp, Mus musculus
acctggatatctggcattgcgaatc

SEQ ID NO: 312689 - DNA, 25 bp, Mus musculus
gcgtcccagctaggcaagtccagtt

SEQ ID NO: 312690 - DNA, 25 bp, Mus musculus
gcgaatccactctcggcagcggtga

SEQ ID NO: 312691 - DNA, 25 bp, Mus musculus
cgggctgatcgcttgctgaagattc

SEQ ID NO: 312692 - DNA, 25 bp, Mus musculus
caaggtacgacttcttggcgcggtt

SEQ ID NO: 312693 - DNA, 25 bp, Mus musculus
gggtcaccgcggaccaccagtacta

SEQ ID NO: 312694 - DNA, 25 bp, Mus musculus
tgaccaagggattagtggcgagacc

SEQ ID NO: 312695 - DNA, 25 bp, Mus musculus
ccatctttgtgtctggcgagcgaag

SEQ ID NO: 312696 - DNA, 25 bp, Mus musculus
gaaggcgcccgacggaagccctgaa

SEQ ID NO: 312697 - DNA, 25 bp, Mus musculus
ggaagccctgaagccggcagctctt

SEQ ID NO: 312698 - DNA, 25 bp, Mus musculus
tcccagagaccggatccaggaaata

SEQ ID NO: 312699 - DNA, 25 bp, Mus musculus
tccaggaaatacgaggcgggcttca

SEQ ID NO: 312700 - DNA, 25 bp, Mus musculus
acctgcccgaggctaggacttcgga

SEQ ID NO: 312701 - DNA, 25 bp, Mus musculus
tgccctggggtcgtcctagtgaccc

SEQ ID NO: 312702 - DNA, 25 bp, Mus musculus
tggaggggcttgatcgctatcagcc

SEQ ID NO: 312703 - DNA, 25 bp, Mus musculus
agatcgcttacagcaggcccgggcg

SEQ ID NO: 312704 - DNA, 25 bp, Mus musculus
gggagggagattcatttatcacctt

SEQ ID NO: 312705 - DNA, 25 bp, Mus musculus
catttatcacctttcctgtggggac

SEQ ID NO: 312706 - DNA, 25 bp, Mus musculus
tcccgtggggaaagcctcgcgagat

SEQ ID NO: 312707 - DNA, 25 bp, Mus musculus
ctcgcgagatcgcttacagcaggcc

SEQ ID NO: 312708 - DNA, 25 bp, Mus musculus
ttgatcgctatcagccctcgcggga

SEQ ID NO: 312709 - DNA, 25 bp, Mus musculus
gcgggccaatgagcgactacagaaa

SEQ ID NO: 312710 - DNA, 25 bp, Mus musculus
catcaattcggggtgcgaccagctg

SEQ ID NO: 312711 - DNA, 25 bp, Mus musculus
agctcttctactggcatcaattcgg

SEQ ID NO: 312712 - DNA, 25 bp, Mus musculus
cctgctgagccgctgttaataacaa

SEQ ID NO: 312713 - DNA, 25 bp, Mus musculus
gcctggtggacgatccagtcctttc

SEQ ID NO: 312714 - DNA, 25 bp, Mus musculus
ttccctctctggtaggctgtgcaga

SEQ ID NO: 312715 - DNA, 25 bp, Mus musculus
acccgaagtgcagagctgcctcttc

SEQ ID NO: 312716 - DNA, 25 bp, Mus musculus
agcctgctggagcaacccgaagtgc

SEQ ID NO: 312717 - DNA, 25 bp, Mus musculus
ctttagccaaactcgggcttagtgg

SEQ ID NO: 312718 - DNA, 25 bp, Mus musculus
ggcggagcgtctgcctttagccaaa

SEQ ID NO: 312719 - DNA, 25 bp, Mus musculus
ccagtctgagggttgtgagacgtca

SEQ ID NO: 312720 - DNA, 25 bp, Mus musculus
aaagagacccaggagcaggccagtc

SEQ ID NO: 312721 - DNA, 25 bp, Mus musculus
gcgaccagctgacgaagggatctaa

SEQ ID NO: 312722 - DNA, 25 bp, Mus musculus
attctcctaggccttgggaggcgtg

SEQ ID NO: 312723 - DNA, 25 bp, Mus musculus
aaactgatcatactgcgcctgcgtg

SEQ ID NO: 312724 - DNA, 25 bp, Mus musculus
cggcctcggcagcacctttaaagac

SEQ ID NO: 312725 - DNA, 25 bp, Mus musculus
ggcagcacctttaaagactcactca

SEQ ID NO: 312726 - DNA, 25 bp, Mus musculus
ccctttcgatcagaatccttcagac

SEQ ID NO: 312727 - DNA, 25 bp, Mus musculus
cagacgcctaccgtttaaccaggct

SEQ ID NO: 312728 - DNA, 25 bp, Mus musculus
caaattcccggcgacctgtgtggcc

SEQ ID NO: 312729 - DNA, 25 bp, Mus musculus
tcccttcttttccattgggctgagc

SEQ ID NO: 312730 - DNA, 25 bp, Mus musculus
ttttccattgggctgagctttttca

SEQ ID NO: 312731 - DNA, 25 bp, Mus musculus
gagctttttcatttgcccgcccacg

SEQ ID NO: 312732 - DNA, 25 bp, Mus musculus
acatggattcagtccgcccacaacg

SEQ ID NO: 312733 - DNA, 25 bp, Mus musculus
cgagcttggccatggaaactgatca

SEQ ID NO: 312734 - DNA, 25 bp, Mus musculus
tggggtgctactccctagttcgaga

SEQ ID NO: 312735 - DNA, 25 bp, Mus musculus
ctccctagttcgagacccggatctg

SEQ ID NO: 312736 - DNA, 25 bp, Mus musculus
acacctctcgcgagcttggccatgg

SEQ ID NO: 312737 - DNA, 25 bp, Mus musculus
ccagggtggcatcctctactctatg

SEQ ID NO: 312738 - DNA, 25 bp, Mus musculus
gcagggcagcatcctctacaatcta

SEQ ID NO: 312739 - DNA, 25 bp, Mus musculus
cttgcgtgcgcattcagtataaata

SEQ ID NO: 312740 - DNA, 25 bp, Mus musculus
tacaatctactgatgagcgcgaagc

SEQ ID NO: 312741 - DNA, 25 bp, Mus musculus
cagaagcacgcgtctcaggaagagc

SEQ ID NO: 312742 - DNA, 25 bp, Mus musculus
cttttgtggggagaatcacccgcgc

SEQ ID NO: 312743 - DNA, 25 bp, Mus musculus
ccactgggcagaacgagctacagga

SEQ ID NO: 312744 - DNA, 25 bp, Mus musculus
ccgagggcacgattcggagcacctt

SEQ ID NO: 312745 - DNA, 25 bp, Mus musculus
gaggcagggcagcatcttatacagc

SEQ ID NO: 312746 - DNA, 25 bp, Mus musculus
tacagcttgctcactagcgctcagc

SEQ ID NO: 312747 - DNA, 25 bp, Mus musculus
gcaaacgcacgtgtctcgggaagca

SEQ ID NO: 312748 - DNA, 25 bp, Mus musculus
ggaagcacccgaggcacatcgcaga

SEQ ID NO: 312749 - DNA, 25 bp, Mus musculus
gtataaataagtcccaagcggcggc

SEQ ID NO: 312750 - DNA, 25 bp, Mus musculus
ggtccctcttgtaccgctgctgctt

SEQ ID NO: 312751 - DNA, 25 bp, Mus musculus
ttaccgcttgtcctgagcgcggaga

SEQ ID NO: 312752 - DNA, 25 bp, Mus musculus
agttcgcgctttgcgctttgccggc

SEQ ID NO: 312753 - DNA, 25 bp, Mus musculus
tgccggcaggcctacgcagcccggc

SEQ ID NO: 312754 - DNA, 25 bp, Mus musculus
agcccggcctctgtcgagagccaat

SEQ ID NO: 312755 - DNA, 25 bp, Mus musculus
gcctctgtcgagagccaatcagaga

SEQ ID NO: 312756 - DNA, 25 bp, Mus musculus
agaggacgagctccggctgaggtca

SEQ ID NO: 312757 - DNA, 25 bp, Mus musculus
atcagagagcgcctctcagcacgtg

SEQ ID NO: 312758 - DNA, 25 bp, Mus musculus
cgaaatccagttcgcgctttgcgct

SEQ ID NO: 312759 - DNA, 25 bp, Mus musculus
agcgcctctcagcacgtggagcaga

SEQ ID NO: 312760 - DNA, 25 bp, Mus musculus
tcagcacgtggagcagagagacacc

SEQ ID NO: 312761 - DNA, 25 bp, Mus musculus
cgtggagcagagagacaccagagct

SEQ ID NO: 312762 - DNA, 25 bp, Mus musculus
gcagagagacaccagagctccgcgc

SEQ ID NO: 312763 - DNA, 25 bp, Mus musculus
ggctcactacacttgttaccgcttg

SEQ ID NO: 312764 - DNA, 25 bp, Mus musculus
ctacacttgttaccgcttgtcctga

SEQ ID NO: 312765 - DNA, 25 bp, Mus musculus
gtgccaggttgatccacagacaagg

SEQ ID NO: 312766 - DNA, 25 bp, Mus musculus
aaggaggagaaagagtgaggacgcg

SEQ ID NO: 312767 - DNA, 25 bp, Mus musculus
gaaagagtgaggacgcgcgtgcgca

SEQ ID NO: 312768 - DNA, 25 bp, Mus musculus
cccgagacccagaccgcgaggggag

SEQ ID NO: 312769 - DNA, 25 bp, Mus musculus
cgcgggatccggctgacgcagctgg

SEQ ID NO: 312770 - DNA, 25 bp, Mus musculus
ggagccagctcgaggagggcgggct

SEQ ID NO: 312771 - DNA, 25 bp, Mus musculus
cgcgcgcgcaccatgggagaaaaac

SEQ ID NO: 312772 - DNA, 25 bp, Mus musculus
ggtgtgccaggttgatccacagaca

SEQ ID NO: 312773 - DNA, 25 bp, Mus musculus
ccaggttgatccacagacaaggaca

SEQ ID NO: 312774 - DNA, 25 bp, Mus musculus
gttgatccacagacaaggacaccgg

SEQ ID NO: 312775 - DNA, 25 bp, Mus musculus
tgatccacagacaaggacaccgggg

SEQ ID NO: 312776 - DNA, 25 bp, Mus musculus
ccacagacaaggacaccggggaaga

SEQ ID NO: 312777 - DNA, 25 bp, Mus musculus
cacagacaaggacaccggggaagaa

SEQ ID NO: 312778 - DNA, 25 bp, Mus musculus
cgcgcaccatgggagaaaaacccgg

SEQ ID NO: 312779 - DNA, 25 bp, Mus musculus
aatgcgctgaccacttttccttgcc

SEQ ID NO: 312780 - DNA, 25 bp, Mus musculus
cagccctggacgagctgagtggccc

SEQ ID NO: 312781 - DNA, 25 bp, Mus musculus
aggcggcaaagcagccggctcccaa

SEQ ID NO: 312782 - DNA, 25 bp, Mus musculus
caaacggtcgggctaatgcgctgac

SEQ ID NO: 312783 - DNA, 25 bp, Mus musculus
accaccagctgcacggccaggggag

SEQ ID NO: 312784 - DNA, 25 bp, Mus musculus
tgggacacgctcaagatcagccagg

SEQ ID NO: 312785 - DNA, 25 bp, Mus musculus
tcaagatcagccaggcgccgcaggt

SEQ ID NO: 312786 - DNA, 25 bp, Mus musculus
cgcaggtgagcatcagtcgtagcaa

SEQ ID NO: 312787 - DNA, 25 bp, Mus musculus
tagcaagtcgtaccgcgagaacggg

SEQ ID NO: 312788 - DNA, 25 bp, Mus musculus
ccaaggaagagctgttgctgcaccc

SEQ ID NO: 312789 - DNA, 25 bp, Mus musculus
gctgctgaagcgcaaacagaggcgc

SEQ ID NO: 312790 - DNA, 25 bp, Mus musculus
agcgcaaacagaggcgctaccgcac

SEQ ID NO: 312791 - DNA, 25 bp, Mus musculus
ccgctgcctgggacacgctcaagat

SEQ ID NO: 312792 - DNA, 25 bp, Mus musculus
catcagtcgtagcaagtcgtaccgc

SEQ ID NO: 312793 - DNA, 25 bp, Mus musculus
ttccagggccgctctcggctaccca

SEQ ID NO: 312794 - DNA, 25 bp, Mus musculus
cggggctgccctttccagggccgct

SEQ ID NO: 312795 - DNA, 25 bp, Mus musculus
ggctctgctagcctgccacccagcg

SEQ ID NO: 312796 - DNA, 25 bp, Mus musculus
ggccgctctcggctacccaccctct

SEQ ID NO: 312797 - DNA, 25 bp, Mus musculus
atcaccctgcgcttgattcggcctg

SEQ ID NO: 312798 - DNA, 25 bp, Mus musculus
caccctgcgcttgattcggcctgga

SEQ ID NO: 312799 - DNA, 25 bp, Mus musculus
accctgcgcttgattcggcctggac

SEQ ID NO: 312800 - DNA, 25 bp, Mus musculus
ctgcgcttgattcggcctggaccgc

SEQ ID NO: 312801 - DNA, 25 bp, Mus musculus
gcttgattcggcctggaccgccgcg

SEQ ID NO: 312802 - DNA, 25 bp, Mus musculus
ttgattcggcctggaccgccgcggc

SEQ ID NO: 312803 - DNA, 25 bp, Mus musculus
tggcgcaagcgggagaaggctggcg

SEQ ID NO: 312804 - DNA, 25 bp, Mus musculus
gctgccttcccgagcctacctccgc

SEQ ID NO: 312805 - DNA, 25 bp, Mus musculus
tgctagcctgccacccagcggggcg

SEQ ID NO: 312806 - DNA, 25 bp, Mus musculus
agaaggctggcgcacagacccaccc

SEQ ID NO: 312807 - DNA, 25 bp, Mus musculus
cgccgctctgctcatgaggccgtga

SEQ ID NO: 312808 - DNA, 25 bp, Mus musculus
tcctgccgggcaccagcacggggaa

SEQ ID NO: 312809 - DNA, 25 bp, Mus musculus
gccgcgcagctcacgcagctcaaca

SEQ ID NO: 312810 - DNA, 25 bp, Mus musculus
tcaaggctaaggagcacgccgcgca

SEQ ID NO: 312811 - DNA, 25 bp, Mus musculus
ccgcgctgaggctcaaggctaagga

SEQ ID NO: 312812 - DNA, 25 bp, Mus musculus
agcatagccgcgctgaggctcaagg

SEQ ID NO: 312813 - DNA, 25 bp, Mus musculus
ccaccgccgcggcagacagacgcgc

SEQ ID NO: 312814 - DNA, 25 bp, Mus musculus
ctgaccagcgcgtcgactgcggctg

SEQ ID NO: 312815 - DNA, 25 bp, Mus musculus
tcatgaggccgtgaccgcgctcttt

SEQ ID NO: 312816 - DNA, 25 bp, Mus musculus
acagacgcgcgtcaagcatagccgc

SEQ ID NO: 312817 - DNA, 25 bp, Mus musculus
tgacaggtggcaggactcgctgccc

SEQ ID NO: 312818 - DNA, 25 bp, Mus musculus
aggaggtgtgctaaaggctgccctc

SEQ ID NO: 312819 - DNA, 25 bp, Mus musculus
cccacaggctcttttccactatggc

SEQ ID NO: 312820 - DNA, 25 bp, Mus musculus
tgagacagcccacacccgcggtgga

SEQ ID NO: 312821 - DNA, 25 bp, Mus musculus
cggcgtgactatcacggctcctgga

SEQ ID NO: 312822 - DNA, 25 bp, Mus musculus
ttcgggtgaccgctcggtggaagct

SEQ ID NO: 312823 - DNA, 25 bp, Mus musculus
atttgcagcaattagcgcgccggac

SEQ ID NO: 312824 - DNA, 25 bp, Mus musculus
gggaagagaagcttaattagtttca

SEQ ID NO: 312825 - DNA, 25 bp, Mus musculus
ttgcagcaattagcgcgccggacct

SEQ ID NO: 312826 - DNA, 25 bp, Mus musculus
gctgcgcggcgtgactatcacggct

SEQ ID NO: 312827 - DNA, 25 bp, Mus musculus
agaagcttaattagtttcaatttgc

SEQ ID NO: 312828 - DNA, 25 bp, Mus musculus
ccagggtgatgggaaagggaagaga

SEQ ID NO: 312829 - DNA, 25 bp, Mus musculus
tgactatcacggctcctggagtaga

SEQ ID NO: 312830 - DNA, 25 bp, Mus musculus
tctcgccaatgctcccagggtgatg

SEQ ID NO: 312831 - DNA, 25 bp, Mus musculus
gtctcgccaatgctcccagggtgat

SEQ ID NO: 312832 - DNA, 25 bp, Mus musculus
gctgggtctcgccaatgctcccagg

SEQ ID NO: 312833 - DNA, 25 bp, Mus musculus
attagcgcgccggacctttggggag

SEQ ID NO: 312834 - DNA, 25 bp, Mus musculus
ttcaatttgcagcaattagcgcgcc

SEQ ID NO: 312835 - DNA, 25 bp, Mus musculus
ggcgccagtacgaaagccaatcagc

SEQ ID NO: 312836 - DNA, 25 bp, Mus musculus
gcgcatgcacgctattttaacaatc

SEQ ID NO: 312837 - DNA, 25 bp, Mus musculus
cacgtgccctaagcatgggatcctc

SEQ ID NO: 312838 - DNA, 25 bp, Mus musculus
acctcctaaaggcactgcgcaagcg

SEQ ID NO: 312839 - DNA, 25 bp, Mus musculus
ccctgagcgaaaagcgggaacctcg

SEQ ID NO: 312840 - DNA, 25 bp, Mus musculus
agactgcggacttccgcccggaagg

SEQ ID NO: 312841 - DNA, 25 bp, Mus musculus
ggataaaaagcagagaccttccgct

SEQ ID NO: 312842 - DNA, 25 bp, Mus musculus
tcaccgcttgcctccagtttacagt

SEQ ID NO: 312843 - DNA, 25 bp, Mus musculus
gtttacagtcctcttcgtgcatggg

SEQ ID NO: 312844 - DNA, 25 bp, Mus musculus
gcgccatggtccgatagtctctcta

SEQ ID NO: 312845 - DNA, 25 bp, Mus musculus
gatagtctctctattccgcgccaac

SEQ ID NO: 312846 - DNA, 25 bp, Mus musculus
cggaggccaagataggcgccagtac

SEQ ID NO: 312847 - DNA, 25 bp, Mus musculus
ggagcgcgccaccttcttaaggata

SEQ ID NO: 312848 - DNA, 25 bp, Mus musculus
cagcctgaaactggcgcggaggcca

SEQ ID NO: 312849 - DNA, 25 bp, Mus musculus
ctcgatctgcttggggaccggctgc

SEQ ID NO: 312850 - DNA, 25 bp, Mus musculus
cacaaacctcctgggtctcgggctg

SEQ ID NO: 312851 - DNA, 25 bp, Mus musculus
aaggcgggatctgccgccgcacgta

SEQ ID NO: 312852 - DNA, 25 bp, Mus musculus
cctacacaagtaccgggcagcagtt

SEQ ID NO: 312853 - DNA, 25 bp, Mus musculus
gcgacacctacacaagtaccgggca

SEQ ID NO: 312854 - DNA, 25 bp, Mus musculus
tctacctggggctcggccttggcgc

SEQ ID NO: 312855 - DNA, 25 bp, Mus musculus
gctttacctctacctggggctcggc

SEQ ID NO: 312856 - DNA, 25 bp, Mus musculus
tgcagatccgccgagccgtccggga

SEQ ID NO: 312857 - DNA, 25 bp, Mus musculus
gagcagtgtgcagatccgccgagcc

SEQ ID NO: 312858 - DNA, 25 bp, Mus musculus
cgcatcctcactagagcagtgtgca

SEQ ID NO: 312859 - DNA, 25 bp, Mus musculus
gaagagccgcatcctcactagagca

SEQ ID NO: 312860 - DNA, 25 bp, Mus musculus
cttgagcagccggtagaagagccgc

SEQ ID NO: 312861 - DNA, 25 bp, Mus musculus
ggtaacacgcacacaaacctcctgg

SEQ ID NO: 312862 - DNA, 25 bp, Mus musculus
gggctggtaccagccagctccgttc

SEQ ID NO: 312863 - DNA, 25 bp, Mus musculus
gtcaccattctattggccgaggcca

SEQ ID NO: 312864 - DNA, 25 bp, Mus musculus
ttagacaccacaaagtctcgcacct

SEQ ID NO: 312865 - DNA, 25 bp, Mus musculus
aaagtctcgcacctcgagcccttaa

SEQ ID NO: 312866 - DNA, 25 bp, Mus musculus
cgagcccttaacctcacagagatta

SEQ ID NO: 312867 - DNA, 25 bp, Mus musculus
cggtgggcatcctttagacaccaca

SEQ ID NO: 312868 - DNA, 25 bp, Mus musculus
gccgaggccagagaccattagtttc

SEQ ID NO: 312869 - DNA, 25 bp, Mus musculus
gtccaagcggccatggtcaccattc

SEQ ID NO: 312870 - DNA, 25 bp, Mus musculus
ctaaggcccggtccaagcggccatg

SEQ ID NO: 312871 - DNA, 25 bp, Mus musculus
ccttcgtcatgagcccgtgggccta

SEQ ID NO: 312872 - DNA, 25 bp, Mus musculus
tcacagagattacaaaccacccagg

SEQ ID NO: 312873 - DNA, 25 bp, Mus musculus
cccaggaaactggaaaaggacactg

SEQ ID NO: 312874 - DNA, 25 bp, Mus musculus
aggacactgacttcttaagaatttc

SEQ ID NO: 312875 - DNA, 25 bp, Mus musculus
ccggggaagtgagcacgagccaccc

SEQ ID NO: 312876 - DNA, 25 bp, Mus musculus
gaccattagtttccggtgggcatcc

SEQ ID NO: 312877 - DNA, 25 bp, Mus musculus
aggcggctccaaagccctgcgtgtc

SEQ ID NO: 312878 - DNA, 25 bp, Mus musculus
gccgcctccatcaacgcgttttgtt

SEQ ID NO: 312879 - DNA, 25 bp, Mus musculus
aactgccctgatttcgacttctcgc

SEQ ID NO: 312880 - DNA, 25 bp, Mus musculus
tcggacggtttctagaactgccctg

SEQ ID NO: 312881 - DNA, 25 bp, Mus musculus
ccctgcgcacagttgtcgagttttg

SEQ ID NO: 312882 - DNA, 25 bp, Mus musculus
catgttaaaattcgggtcgtgtgcc

SEQ ID NO: 312883 - DNA, 25 bp, Mus musculus
ggtgggtttcttggagcccatgtta

SEQ ID NO: 312884 - DNA, 25 bp, Mus musculus
caccaagaggctagtgcaggctttt

SEQ ID NO: 312885 - DNA, 25 bp, Mus musculus
tgtgcgccggcctaagcaccaagag

SEQ ID NO: 312886 - DNA, 25 bp, Mus musculus
tctgcctcgtctttgctgtgatgtc

SEQ ID NO: 312887 - DNA, 25 bp, Mus musculus
agggagcttccagctcgcttctgcc

SEQ ID NO: 312888 - DNA, 25 bp, Mus musculus
cttgcagacttgttgagggagcttc

SEQ ID NO: 312889 - DNA, 25 bp, Mus musculus
ttcctgcacggaggggtgcaaaccg

SEQ ID NO: 312890 - DNA, 25 bp, Mus musculus
aggccctgattagtttgttacgatg

SEQ ID NO: 312891 - DNA, 25 bp, Mus musculus
gcctaaccggcctcgcgagaagaga

SEQ ID NO: 312892 - DNA, 25 bp, Mus musculus
agctccggctcacacttgtggaatc

SEQ ID NO: 312893 - DNA, 25 bp, Mus musculus
cccttgtcagtcatattgctagcca

SEQ ID NO: 312894 - DNA, 25 bp, Mus musculus
aagcttgcctttgctccaggacccg

SEQ ID NO: 312895 - DNA, 25 bp, Mus musculus
gcctgcgcagtagcaaagcttgcct

SEQ ID NO: 312896 - DNA, 25 bp, Mus musculus
cccgtcaccaggagtggtctcgaga

SEQ ID NO: 312897 - DNA, 25 bp, Mus musculus
ccacagctaacaacattcgggccta

SEQ ID NO: 312898 - DNA, 25 bp, Mus musculus
gcaccacagcttcaccttttaaatt

SEQ ID NO: 312899 - DNA, 25 bp, Mus musculus
tcaggactctctctcacgcgcgtag

SEQ ID NO: 312900 - DNA, 25 bp, Mus musculus
gtggccgcaaccttctccttcagga

SEQ ID NO: 312901 - DNA, 25 bp, Mus musculus
aacggtcactgagagccgccttttc

SEQ ID NO: 312902 - DNA, 25 bp, Mus musculus
tcttttcctgcacatggaggagccg

SEQ ID NO: 312903 - DNA, 25 bp, Mus musculus
ttctcagcgctctactcgaggccga

SEQ ID NO: 312904 - DNA, 25 bp, Mus musculus
gtgctcgctgcctttattcagagtg

SEQ ID NO: 312905 - DNA, 25 bp, Mus musculus
ggcctaaatcatgtgctcagggtta

SEQ ID NO: 312906 - DNA, 25 bp, Mus musculus
tcccagcggaagctgtcaaagaacc

SEQ ID NO: 312907 - DNA, 25 bp, Mus musculus
tcaaagaacccacggctctcgagct

SEQ ID NO: 312908 - DNA, 25 bp, Mus musculus
agctgcgcagacatggagggcttca

SEQ ID NO: 312909 - DNA, 25 bp, Mus musculus
aggaggcagggaccacggcactccc

SEQ ID NO: 312910 - DNA, 25 bp, Mus musculus
aggaagcaagttggcggcctaaatc

SEQ ID NO: 312911 - DNA, 25 bp, Mus musculus
tcagggttacccagctatgaagtgc

SEQ ID NO: 312912 - DNA, 25 bp, Mus musculus
tatgaagtgccaaggcccagatttg

SEQ ID NO: 312913 - DNA, 25 bp, Mus musculus
atttgggctcaagcctcctggggtc

SEQ ID NO: 312914 - DNA, 25 bp, Mus musculus
aaattatccgccttccatctcaggg

SEQ ID NO: 312915 - DNA, 25 bp, Mus musculus
ccgttcctgtttgtacagatgtgta

SEQ ID NO: 312916 - DNA, 25 bp, Mus musculus
ccatctcaggggtctggtaagctgg

SEQ ID NO: 312917 - DNA, 25 bp, Mus musculus
tgtccatgttggctaggcagtccca

SEQ ID NO: 312918 - DNA, 25 bp, Mus musculus
ctggtaagctggctgagtgtccatg

SEQ ID NO: 312919 - DNA, 25 bp, Mus musculus
ctgagttcgagtttaagaggagtcc

SEQ ID NO: 312920 - DNA, 25 bp, Mus musculus
cgagccattgtttgggtcgtaagtc

SEQ ID NO: 312921 - DNA, 25 bp, Mus musculus
tcgcctggtcacgagccattgtttg

SEQ ID NO: 312922 - DNA, 25 bp, Mus musculus
aaagtgtgacaaagctcgcctggtc

SEQ ID NO: 312923 - DNA, 25 bp, Mus musculus
cttcttggaaaacaaagtgtgacaa

SEQ ID NO: 312924 - DNA, 25 bp, Mus musculus
attacagtcctgtctgtcaggcttc

SEQ ID NO: 312925 - DNA, 25 bp, Mus musculus
agccgctcgctgagttcgagtttaa

SEQ ID NO: 312926 - DNA, 25 bp, Mus musculus
agttaatctttaagccgctcgctga

SEQ ID NO: 312927 - DNA, 25 bp, Mus musculus
ctgaaactgcagaaagttaatcttt

SEQ ID NO: 312928 - DNA, 25 bp, Mus musculus
tccgccactgaaactgcagaaagtt

SEQ ID NO: 312929 - DNA, 25 bp, Mus musculus
attcacccgcgccttccgccactga

SEQ ID NO: 312930 - DNA, 25 bp, Mus musculus
ttttgaaagcgccaccgcgccacgg

SEQ ID NO: 312931 - DNA, 25 bp, Mus musculus
agaggagtccgtatggtgacaaccc

SEQ ID NO: 312932 - DNA, 25 bp, Mus musculus
ccctggaattacagtcctgtctgtc

SEQ ID NO: 312933 - DNA, 25 bp, Mus musculus
cgtggaagtccagccgcttcccgaa

SEQ ID NO: 312934 - DNA, 25 bp, Mus musculus
acggacgacgagatcgaggagttcc

SEQ ID NO: 312935 - DNA, 25 bp, Mus musculus
cgaggagttcctcgaaggcttcctt

SEQ ID NO: 312936 - DNA, 25 bp, Mus musculus
ccaggccgtcgcaagcgctctggag

SEQ ID NO: 312937 - DNA, 25 bp, Mus musculus
tcctttcggagttggagacccagtc

SEQ ID NO: 312938 - DNA, 25 bp, Mus musculus
ctgctattagtctgggctccgtgct

SEQ ID NO: 312939 - DNA, 25 bp, Mus musculus
cctcgaaggcttcctttcggagttg

SEQ ID NO: 312940 - DNA, 25 bp, Mus musculus
caccgctttctggatacccttgacg

SEQ ID NO: 312941 - DNA, 25 bp, Mus musculus
tctggatacccttgacgcccacgtt

SEQ ID NO: 312942 - DNA, 25 bp, Mus musculus
tggcactgctgacgctgtgccctga

SEQ ID NO: 312943 - DNA, 25 bp, Mus musculus
acgctgtgccctgaggggaacccac

SEQ ID NO: 312944 - DNA, 25 bp, Mus musculus
aggggaacccacagacggtgctgac

SEQ ID NO: 312945 - DNA, 25 bp, Mus musculus
gacgacgtggaagtccagccgcttc

SEQ ID NO: 312946 - DNA, 25 bp, Mus musculus
cgctgacgctgctattagtctgggc

SEQ ID NO: 312947 - DNA, 25 bp, Mus musculus
tgcagccttagcctcctcgccaggc

SEQ ID NO: 312948 - DNA, 25 bp, Mus musculus
gagagagacccaggaaaatgcggaa

SEQ ID NO: 312949 - DNA, 25 bp, Mus musculus
cctcacgggctgtagcggaattttc

SEQ ID NO: 312950 - DNA, 25 bp, Mus musculus
gtagcggaattttctcctcagacgc

SEQ ID NO: 312951 - DNA, 25 bp, Mus musculus
ctcagacgccgccttcaaaatggcg

SEQ ID NO: 312952 - DNA, 25 bp, Mus musculus
ccctcgccgatatttacatagcgaa

SEQ ID NO: 312953 - DNA, 25 bp, Mus musculus
ttacatagcgaaaatcggccgggcc

SEQ ID NO: 312954 - DNA, 25 bp, Mus musculus
gcggccttcacctcatgcctgcagc

SEQ ID NO: 312955 - DNA, 25 bp, Mus musculus
cgcccgtttccagaacgcgcctcga

SEQ ID NO: 312956 - DNA, 25 bp, Mus musculus
cctttctctggagcactgggccggg

SEQ ID NO: 312957 - DNA, 25 bp, Mus musculus
agctcggagctgacaaaaagcggcc

SEQ ID NO: 312958 - DNA, 25 bp, Mus musculus
agctgacaaaaagcggcccagctcc

SEQ ID NO: 312959 - DNA, 25 bp, Mus musculus
caggccggcctttctctggagcact

SEQ ID NO: 312960 - DNA, 25 bp, Mus musculus
agcacgtcacgtcaccgccggggag

SEQ ID NO: 312961 - DNA, 25 bp, Mus musculus
taaaacctagagcacgtcagctccg

SEQ ID NO: 312962 - DNA, 25 bp, Mus musculus
caagcagagcggcatgatggaacac

SEQ ID NO: 312963 - DNA, 25 bp, Mus musculus
catgatggaacacgctcagcggggc

SEQ ID NO: 312964 - DNA, 25 bp, Mus musculus
ttgtccaaggctggagtgcagagca

SEQ ID NO: 312965 - DNA, 25 bp, Mus musculus
gcagagcagaaaaagcaggactcct

SEQ ID NO: 312966 - DNA, 25 bp, Mus musculus
gcagaaaaagcaggactcctccgtg

SEQ ID NO: 312967 - DNA, 25 bp, Mus musculus
gcagggggactaaaacaggccactc

SEQ ID NO: 312968 - DNA, 25 bp, Mus musculus
caggccactcctcgttcattttaga

SEQ ID NO: 312969 - DNA, 25 bp, Mus musculus
cgttcattttagacgttccacgtgg

SEQ ID NO: 312970 - DNA, 25 bp, Mus musculus
tttagacgttccacgtggaggaaga

SEQ ID NO: 312971 - DNA, 25 bp, Mus musculus
gcagtggagccagaccgcatcctaa

SEQ ID NO: 312972 - DNA, 25 bp, Mus musculus
ccgcatcctaatggctcagcgggta

SEQ ID NO: 312973 - DNA, 25 bp, Mus musculus
cagcgggtaaaacctagagcacgtc

SEQ ID NO: 312974 - DNA, 25 bp, Mus musculus
ggcgtcccaagcagagcggcatgat

SEQ ID NO: 312975 - DNA, 25 bp, Mus musculus
ctcggtcctgttggatttctgtgca

SEQ ID NO: 312976 - DNA, 25 bp, Mus musculus
tgcagcactgacctgactgctcgga

SEQ ID NO: 312977 - DNA, 25 bp, Mus musculus
actgctcggacttctctctgtttga

SEQ ID NO: 312978 - DNA, 25 bp, Mus musculus
ttgaatttgcgcaggaacgccgggc

SEQ ID NO: 312979 - DNA, 25 bp, Mus musculus
cggcagccgcctgacataccgtagg

SEQ ID NO: 312980 - DNA, 25 bp, Mus musculus
tttcagaacgtatccgtctcggtcc

SEQ ID NO: 312981 - DNA, 25 bp, Mus musculus
cggactgcggcatagacctgatgaa

SEQ ID NO: 312982 - DNA, 25 bp, Mus musculus
ttctgtgcaggcaagactcagggca

SEQ ID NO: 312983 - DNA, 25 bp, Mus musculus
ttatcgatgtgacactgcgcagctc

SEQ ID NO: 312984 - DNA, 25 bp, Mus musculus
ctgcgcagctcagaacggagaaatc

SEQ ID NO: 312985 - DNA, 25 bp, Mus musculus
tgggagctggccgaaaagacttgcc

SEQ ID NO: 312986 - DNA, 25 bp, Mus musculus
acttgccggcgtctttacatttggg

SEQ ID NO: 312987 - DNA, 25 bp, Mus musculus
gctatatcagctcggcgttctcttc

SEQ ID NO: 312988 - DNA, 25 bp, Mus musculus
gccgggcgacctgactcgaaaacag

SEQ ID NO: 312989 - DNA, 25 bp, Mus musculus
ctctgagggtcaacctcagcggatc

SEQ ID NO: 312990 - DNA, 25 bp, Mus musculus
actacagtagcaggcccgcctctgg

SEQ ID NO: 312991 - DNA, 25 bp, Mus musculus
aagtgacgcgcctgggctgaaagat

SEQ ID NO: 312992 - DNA, 25 bp, Mus musculus
agatggcggcattggcgttcaacca

SEQ ID NO: 312993 - DNA, 25 bp, Mus musculus
aggctcggctctgcgtcctcgagac

SEQ ID NO: 312994 - DNA, 25 bp, Mus musculus
agacgccgtcgtgtatgtggttccc

SEQ ID NO: 312995 - DNA, 25 bp, Mus musculus
ttcccgctggcgtttctgttgccct

SEQ ID NO: 312996 - DNA, 25 bp, Mus musculus
cccagttggtggtcctgagtcgcct

SEQ ID NO: 312997 - DNA, 25 bp, Mus musculus
gcgtcacgcctagcccaactgtttg

SEQ ID NO: 312998 - DNA, 25 bp, Mus musculus
tttggactcgccactcaaccgctgt

SEQ ID NO: 312999 - DNA, 25 bp, Mus musculus
accgctgtcttctttcccaggactg

SEQ ID NO: 313000 - DNA, 25 bp, Mus musculus
ccttgtagaggttcgaggagctatc

SEQ ID NO: 313001 - DNA, 25 bp, Mus musculus
tcgaggagctatcgcggtccatccc

SEQ ID NO: 313002 - DNA, 25 bp, Mus musculus
tgcagactgccgtccactagaggct

SEQ ID NO: 313003 - DNA, 25 bp, Mus musculus
caccgtagttgccttttttatagtg

SEQ ID NO: 313004 - DNA, 25 bp, Mus musculus
atcaggatctaacccggccaccgta

SEQ ID NO: 313005 - DNA, 25 bp, Mus musculus
tcgtggtcaagggaatcaggatcta

SEQ ID NO: 313006 - DNA, 25 bp, Mus musculus
tcatctcgtgctcgctcgtggtcaa

SEQ ID NO: 313007 - DNA, 25 bp, Mus musculus
gctggcgtcacagcatcatctcgtg

SEQ ID NO: 313008 - DNA, 25 bp, Mus musculus
ggttgctaagcaacgcgacacgcca

SEQ ID NO: 313009 - DNA, 25 bp, Mus musculus
tgaatttgttaggttcccgcgcgcg

SEQ ID NO: 313010 - DNA, 25 bp, Mus musculus
cctagcaacagcctgcaaggaggca

SEQ ID NO: 313011 - DNA, 25 bp, Mus musculus
agggagccagagaaccgccttcttc

SEQ ID NO: 313012 - DNA, 25 bp, Mus musculus
ggattctcaaccctcgcagccggag

SEQ ID NO: 313013 - DNA, 25 bp, Mus musculus
gctgcctcagcgtgcaggattctca

SEQ ID NO: 313014 - DNA, 25 bp, Mus musculus
tgcagtttaccctcgtccgtcgggc

SEQ ID NO: 313015 - DNA, 25 bp, Mus musculus
ctccctaagagactggtgcagttta

SEQ ID NO: 313016 - DNA, 25 bp, Mus musculus
gtcgatccgctgcttctccctaaga

SEQ ID NO: 313017 - DNA, 25 bp, Mus musculus
tagaaatctgagagcccgcggtgtc

SEQ ID NO: 313018 - DNA, 25 bp, Mus musculus
tccgcgtccaggagaaaatgccagc

SEQ ID NO: 313019 - DNA, 25 bp, Mus musculus
gctgtttccttcttcgcgactcaag

SEQ ID NO: 313020 - DNA, 25 bp, Mus musculus
ggggcgaacctcaccttgcctcagg

SEQ ID NO: 313021 - DNA, 25 bp, Mus musculus
ttcagaggaaccatctaacgggatc

SEQ ID NO: 313022 - DNA, 25 bp, Mus musculus
tcagcgctgccgttttggagtcaga

SEQ ID NO: 313023 - DNA, 25 bp, Mus musculus
cggccagggaaaagcttcagcgctg

SEQ ID NO: 313024 - DNA, 25 bp, Mus musculus
ctccaatctcagacgcggccaggga

SEQ ID NO: 313025 - DNA, 25 bp, Mus musculus
gaggagctgggcattacactacaga

SEQ ID NO: 313026 - DNA, 25 bp, Mus musculus
gtctccctggcaagagcagagccta

SEQ ID NO: 313027 - DNA, 25 bp, Mus musculus
tgagccatagctctcgtctccctgg

SEQ ID NO: 313028 - DNA, 25 bp, Mus musculus
gccgtccggtttctgagccatagct

SEQ ID NO: 313029 - DNA, 25 bp, Mus musculus
gatcctgccattcgcgcgacctaag

SEQ ID NO: 313030 - DNA, 25 bp, Mus musculus
tctaggccggaagaagggcaaaatc

SEQ ID NO: 313031 - DNA, 25 bp, Mus musculus
ctcagcttggccttcagcagtcagc

SEQ ID NO: 313032 - DNA, 25 bp, Mus musculus
agtgcagcatctgcgcttagctgcc

SEQ ID NO: 313033 - DNA, 25 bp, Mus musculus
gctaaggttcgcgtcgctcgcccgt

SEQ ID NO: 313034 - DNA, 25 bp, Mus musculus
gcccgtggctgttcctgccttacta

SEQ ID NO: 313035 - DNA, 25 bp, Mus musculus
tgttcctgccttactaccaccggta

SEQ ID NO: 313036 - DNA, 25 bp, Mus musculus
cacaccatggatctcggcagcagca

SEQ ID NO: 313037 - DNA, 25 bp, Mus musculus
gaggcccagcgcaagcatctcagct

SEQ ID NO: 313038 - DNA, 25 bp, Mus musculus
cgacgaaacctgcatcggtggcgcc

SEQ ID NO: 313039 - DNA, 25 bp, Mus musculus
ggccttcagcagtcagctcaacatc

SEQ ID NO: 313040 - DNA, 25 bp, Mus musculus
gccaaacctttcgtgcctagcgtaa

SEQ ID NO: 313041 - DNA, 25 bp, Mus musculus
ctagcgtaagcgcagcggagttcgt

SEQ ID NO: 313042 - DNA, 25 bp, Mus musculus
cgccgcagctgtgagtgcagcatct

SEQ ID NO: 313043 - DNA, 25 bp, Mus musculus
tccagctgcgacgaaacctgcatcg

SEQ ID NO: 313044 - DNA, 25 bp, Mus musculus
ccgactgctgggatcaggtggacat

SEQ ID NO: 313045 - DNA, 25 bp, Mus musculus
cccactggtcccagggaccctccag

SEQ ID NO: 313046 - DNA, 25 bp, Mus musculus
gcgccacgaggccacagcacagcac

SEQ ID NO: 313047 - DNA, 25 bp, Mus musculus
cctcaggcgccacgaggccacagca

SEQ ID NO: 313048 - DNA, 25 bp, Mus musculus
gtaccaagcccgcaacacagcgccg

SEQ ID NO: 313049 - DNA, 25 bp, Mus musculus
tgctgcgcagctacagtaccaagcc

SEQ ID NO: 313050 - DNA, 25 bp, Mus musculus
catgctgcgcagctacagtaccaag

SEQ ID NO: 313051 - DNA, 25 bp, Mus musculus
tccaggccatgctgcgcagctacag

SEQ ID NO: 313052 - DNA, 25 bp, Mus musculus
tccggcccatagcatggttccgccc

SEQ ID NO: 313053 - DNA, 25 bp, Mus musculus
tctcctccggcccatagcatggttc

SEQ ID NO: 313054 - DNA, 25 bp, Mus musculus
ctcggctctcctccggcccatagca

SEQ ID NO: 313055 - DNA, 25 bp, Mus musculus
agcgcctacccacggtgcctctgcc

SEQ ID NO: 313056 - DNA, 25 bp, Mus musculus
ccatagcagcgcctacccacggtgc

SEQ ID NO: 313057 - DNA, 25 bp, Mus musculus
ggccatgctgcgcagctacagtacc

SEQ ID NO: 313058 - DNA, 25 bp, Mus musculus
cacggtgcctctgcctcggctctcc

SEQ ID NO: 313059 - DNA, 25 bp, Mus musculus
cggccatcttgggacgttccacttg

SEQ ID NO: 313060 - DNA, 25 bp, Mus musculus
ccaaaccactgcgtgtggcctgggg

SEQ ID NO: 313061 - DNA, 25 bp, Mus musculus
ttgggacgttccacttgctgaaggg

SEQ ID NO: 313062 - DNA, 25 bp, Mus musculus
ggcgcctggccacgaacggccacca

SEQ ID NO: 313063 - DNA, 25 bp, Mus musculus
caccagtccgctcgccctagaaccc

SEQ ID NO: 313064 - DNA, 25 bp, Mus musculus
tggtatgtcttctgcgtggtgactc

SEQ ID NO: 313065 - DNA, 25 bp, Mus musculus
tgactctggcggatggtaagatcga

SEQ ID NO: 313066 - DNA, 25 bp, Mus musculus
tctggcggatggtaagatcgagtca

SEQ ID NO: 313067 - DNA, 25 bp, Mus musculus
gtaagatcgagtcagcggaaggcct

SEQ ID NO: 313068 - DNA, 25 bp, Mus musculus
cggaaggcctctatgccacccacca

SEQ ID NO: 313069 - DNA, 25 bp, Mus musculus
tgccacccaccacgttcacccgctt

SEQ ID NO: 313070 - DNA, 25 bp, Mus musculus
aaggcactcgcgcaggccattggtt

SEQ ID NO: 313071 - DNA, 25 bp, Mus musculus
atgtcttctgcgtggtgactctggc

SEQ ID NO: 313072 - DNA, 25 bp, Mus musculus
cgtggcccaaaccactgcgtgtggc

SEQ ID NO: 313073 - DNA, 25 bp, Mus musculus
caaggaaaagactaacgagcggctc

SEQ ID NO: 313074 - DNA, 25 bp, Mus musculus
gctacctacagtctggcgaacgagc

SEQ ID NO: 313075 - DNA, 25 bp, Mus musculus
gaacggcgatcctggaactgtccaa

SEQ ID NO: 313076 - DNA, 25 bp, Mus musculus
aagacggcctgtggggctttccact

SEQ ID NO: 313077 - DNA, 25 bp, Mus musculus
tagtgttcgctgcagtggcctctgc

SEQ ID NO: 313078 - DNA, 25 bp, Mus musculus
cgccctggaggatatcgagcgtgaa

SEQ ID NO: 313079 - DNA, 25 bp, Mus musculus
tccactggaacgatggctacctaca

SEQ ID NO: 313080 - DNA, 25 bp, Mus musculus
cgcaggcgcacattaacaggcattt

SEQ ID NO: 313081 - DNA, 25 bp, Mus musculus
gcgggacctgaatgctagccttagg

SEQ ID NO: 313082 - DNA, 25 bp, Mus musculus
aagcctgggtctgacatcgccctct

SEQ ID NO: 313083 - DNA, 25 bp, Mus musculus
cctgggaattgtagtgttcgctgca

SEQ ID NO: 313084 - DNA, 25 bp, Mus musculus
ggcgccatcctccagaacgcaggtt

SEQ ID NO: 313085 - DNA, 25 bp, Mus musculus
tggcgccacacctcgcaaaagacgg

SEQ ID NO: 313086 - DNA, 25 bp, Mus musculus
tcgagcgtgaaatcggcgccatcct

SEQ ID NO: 313087 - DNA, 25 bp, Mus musculus
tcagcttggccaatctgcgaaaccg

SEQ ID NO: 313088 - DNA, 25 bp, Mus musculus
ctcccagcagtttgcgctttgcgcg

SEQ ID NO: 313089 - DNA, 25 bp, Mus musculus
cgccacttagctgttgtcaacgctg

SEQ ID NO: 313090 - DNA, 25 bp, Mus musculus
aggcagtagcacgtctcccagcagt

SEQ ID NO: 313091 - DNA, 25 bp, Mus musculus
cgcggccacgaaagtgcaggcagta

SEQ ID NO: 313092 - DNA, 25 bp, Mus musculus
aacagggatgtttcgcggccacgaa

SEQ ID NO: 313093 - DNA, 25 bp, Mus musculus
gcagcgcttgtcagcttggccaatc

SEQ ID NO: 313094 - DNA, 25 bp, Mus musculus
gtggactgttaacctggaccggaga

SEQ ID NO: 313095 - DNA, 25 bp, Mus musculus
cggcaacagagaagaagtggactgt

SEQ ID NO: 313096 - DNA, 25 bp, Mus musculus
gcggtcgcagaacggcaacagagaa

SEQ ID NO: 313097 - DNA, 25 bp, Mus musculus
tgtcaacgctgctgcggtcgcagaa

SEQ ID NO: 313098 - DNA, 25 bp, Mus musculus
gccagaatccgccacttagctgttg

SEQ ID NO: 313099 - DNA, 25 bp, Mus musculus
ggaccggagataacagggatgtttc

SEQ ID NO: 313100 - DNA, 25 bp, Mus musculus
gcctggtcttggcagcgcttgtcag

SEQ ID NO: 313101 - DNA, 25 bp, Mus musculus
cgtgcactcaccattcccgttccgc

SEQ ID NO: 313102 - DNA, 25 bp, Mus musculus
ctcagcctgacctagccttcagttt

SEQ ID NO: 313103 - DNA, 25 bp, Mus musculus
ggaagcgagagtcccagcgcccact

SEQ ID NO: 313104 - DNA, 25 bp, Mus musculus
cacgaagtccagcttctgtgaggcc

SEQ ID NO: 313105 - DNA, 25 bp, Mus musculus
tgtccacgaagtccagcttctgtga

SEQ ID NO: 313106 - DNA, 25 bp, Mus musculus
tggtgtccacgaagtccagcttctg

SEQ ID NO: 313107 - DNA, 25 bp, Mus musculus
catggtgtccacgaagtccagcttc

SEQ ID NO: 313108 - DNA, 25 bp, Mus musculus
tgcatggtgtccacgaagtccagct

SEQ ID NO: 313109 - DNA, 25 bp, Mus musculus
cctctaatccactgcatggtgtcca

SEQ ID NO: 313110 - DNA, 25 bp, Mus musculus
gttccgcctctaatccactgcatgg

SEQ ID NO: 313111 - DNA, 25 bp, Mus musculus
tcctccacagcgctacagccgaatc

SEQ ID NO: 313112 - DNA, 25 bp, Mus musculus
tagccttcagtttggttgtttcttg

SEQ ID NO: 313113 - DNA, 25 bp, Mus musculus
tccgcctctaatccactgcatggtg

SEQ ID NO: 313114 - DNA, 25 bp, Mus musculus
aagtccagcttctgtgaggccgggt

SEQ ID NO: 313115 - DNA, 25 bp, Mus musculus
aacagcacgtgtgggcccatcccag

SEQ ID NO: 313116 - DNA, 25 bp, Mus musculus
ctgcaaatgcgttctccgggtgctg

SEQ ID NO: 313117 - DNA, 25 bp, Mus musculus
gctagcggcgcccttcccggaacca

SEQ ID NO: 313118 - DNA, 25 bp, Mus musculus
acgcaacagcacgtgtgggcccatc

SEQ ID NO: 313119 - DNA, 25 bp, Mus musculus
gggcccatcccagcctcccattaca

SEQ ID NO: 313120 - DNA, 25 bp, Mus musculus
ccggaaccacgcaacagcacgtgtg

SEQ ID NO: 313121 - DNA, 25 bp, Mus musculus
cctagaggcgtagcccaggatagtc

SEQ ID NO: 313122 - DNA, 25 bp, Mus musculus
ggcgtagcccaggatagtccgcccg

SEQ ID NO: 313123 - DNA, 25 bp, Mus musculus
agactaacggccgctgggcccttcg

SEQ ID NO: 313124 - DNA, 25 bp, Mus musculus
gggcccttcgctggacagtacgcaa

SEQ ID NO: 313125 - DNA, 25 bp, Mus musculus
ccttcgctggacagtacgcaaagcg

SEQ ID NO: 313126 - DNA, 25 bp, Mus musculus
tcccattacaacctagaggcgtagc

SEQ ID NO: 313127 - DNA, 25 bp, Mus musculus
cggcctgcaaatgcgttctccgggt

SEQ ID NO: 313128 - DNA, 25 bp, Mus musculus
caaatgcgttctccgggtgctggct

SEQ ID NO: 313129 - DNA, 25 bp, Mus musculus
caagagggagcagccactgttctgt

SEQ ID NO: 313130 - DNA, 25 bp, Mus musculus
gttgctaagaaacggcgatccaggc

SEQ ID NO: 313131 - DNA, 25 bp, Mus musculus
cgcatgcgcgcggttgctaagaaac

SEQ ID NO: 313132 - DNA, 25 bp, Mus musculus
tccgagatcagaccgcggctccagt

SEQ ID NO: 313133 - DNA, 25 bp, Mus musculus
cgcaaaccaaactcgtccgagatca

SEQ ID NO: 313134 - DNA, 25 bp, Mus musculus
tgccagaagcgcaggcctagtattc

SEQ ID NO: 313135 - DNA, 25 bp, Mus musculus
tattccgggagagttcggtctgctg

SEQ ID NO: 313136 - DNA, 25 bp, Mus musculus
gggcgaaggcctgccgcctttgctt

SEQ ID NO: 313137 - DNA, 25 bp, Mus musculus
tggccctccaagtcgatggtggtga

SEQ ID NO: 313138 - DNA, 25 bp, Mus musculus
caagcgccaggctggttctcttgca

SEQ ID NO: 313139 - DNA, 25 bp, Mus musculus
tggttctcttgcacccggcgcttat

SEQ ID NO: 313140 - DNA, 25 bp, Mus musculus
cggcgcttatctggccctgcttgaa

SEQ ID NO: 313141 - DNA, 25 bp, Mus musculus
tgcttgaacagctgcgacgccgcct

SEQ ID NO: 313142 - DNA, 25 bp, Mus musculus
cgcggggccaaagcaattggaatta

SEQ ID NO: 313143 - DNA, 25 bp, Mus musculus
cggattcccaacctcaactgaagtg

SEQ ID NO: 313144 - DNA, 25 bp, Mus musculus
ctcaactgaagtgcgcagcatgctg

SEQ ID NO: 313145 - DNA, 25 bp, Mus musculus
ctggcactcggcgactcaggctggt

SEQ ID NO: 313146 - DNA, 25 bp, Mus musculus
gcgatccatgccctgggagccaaga

SEQ ID NO: 313147 - DNA, 25 bp, Mus musculus
cacaggtctgacgtgcggaattctg

SEQ ID NO: 313148 - DNA, 25 bp, Mus musculus
cgactcaggctggttctctttgaag

SEQ ID NO: 313149 - DNA, 25 bp, Mus musculus
aacggcacaccattagccaattgga

SEQ ID NO: 313150 - DNA, 25 bp, Mus musculus
gccggaagcgttcattcacaaagcc

SEQ ID NO: 313151 - DNA, 25 bp, Mus musculus
gcggaattctggcaccgctcgctgc

SEQ ID NO: 313152 - DNA, 25 bp, Mus musculus
tgtagccaataggaacgtgggacac

SEQ ID NO: 313153 - DNA, 25 bp, Mus musculus
ctcaacgtgactgtagccaatagga

SEQ ID NO: 313154 - DNA, 25 bp, Mus musculus
agcccgcctctcaacgtgactgtag

SEQ ID NO: 313155 - DNA, 25 bp, Mus musculus
attagccaattggagaatatgaccc

SEQ ID NO: 313156 - DNA, 25 bp, Mus musculus
gctcgctgccggaagcgttcattca

SEQ ID NO: 313157 - DNA, 25 bp, Mus musculus
gtctctatgcagcccagcctctgcg

SEQ ID NO: 313158 - DNA, 25 bp, Mus musculus
ccctctgcctatagggcataggccg

SEQ ID NO: 313159 - DNA, 25 bp, Mus musculus
tgcctatagggcataggccgctgga

SEQ ID NO: 313160 - DNA, 25 bp, Mus musculus
aacacacacatcgtggcctttctct

SEQ ID NO: 313161 - DNA, 25 bp, Mus musculus
gccccggcctctctgtctctatgca

SEQ ID NO: 313162 - DNA, 25 bp, Mus musculus
ctgtggcctgtgtctatgtagctag

SEQ ID NO: 313163 - DNA, 25 bp, Mus musculus
tggcctgtgtctatgtagctagctc

SEQ ID NO: 313164 - DNA, 25 bp, Mus musculus
tatgtagctagctccggctccatgg

SEQ ID NO: 313165 - DNA, 25 bp, Mus musculus
cccgtggacgctcagacgctataca

SEQ ID NO: 313166 - DNA, 25 bp, Mus musculus
ctatagggcataggccgctggagct

SEQ ID NO: 313167 - DNA, 25 bp, Mus musculus
cgtggacgctcagacgctatacagc

SEQ ID NO: 313168 - DNA, 25 bp, Mus musculus
gtggacgctcagacgctatacagcg

SEQ ID NO: 313169 - DNA, 25 bp, Mus musculus
atgtagctagctccggctccatggt

SEQ ID NO: 313170 - DNA, 25 bp, Mus musculus
tcgtggcctttctctccagcccagc

SEQ ID NO: 313171 - DNA, 25 bp, Mus musculus
tccttgccgaagtgtactgcgcgct

SEQ ID NO: 313172 - DNA, 25 bp, Mus musculus
tgagtgccgacaactagcgcggtcg

SEQ ID NO: 313173 - DNA, 25 bp, Mus musculus
cgaagacggtgagtgccgacaacta

SEQ ID NO: 313174 - DNA, 25 bp, Mus musculus
ttgccgccaccatgccgaagacggt

SEQ ID NO: 313175 - DNA, 25 bp, Mus musculus
gtactgcgcgctcagagcagcccga

SEQ ID NO: 313176 - DNA, 25 bp, Mus musculus
gttctccggagtccttgccgaagtg

SEQ ID NO: 313177 - DNA, 25 bp, Mus musculus
tttgtaaagtcgtggcccgttagca

SEQ ID NO: 313178 - DNA, 25 bp, Mus musculus
tgggacccaatctgagcacccggtt

SEQ ID NO: 313179 - DNA, 25 bp, Mus musculus
tcgcccaacgctagagtgggaccca

SEQ ID NO: 313180 - DNA, 25 bp, Mus musculus
gaagcggagcagtcgcccaacgcta

SEQ ID NO: 313181 - DNA, 25 bp, Mus musculus
aagtcgtggcccgttagcaggaagc

SEQ ID NO: 313182 - DNA, 25 bp, Mus musculus
agcagcccgacagtttccagccaaa

SEQ ID NO: 313183 - DNA, 25 bp, Mus musculus
gccacataaaggagcgagcagcgca

SEQ ID NO: 313184 - DNA, 25 bp, Mus musculus
cggaagcccggccacataaaggagc

SEQ ID NO: 313185 - DNA, 25 bp, Mus musculus
aagtgggcacagacctggacggaca

SEQ ID NO: 313186 - DNA, 25 bp, Mus musculus
ctctgaagtgggcacagacctggac

SEQ ID NO: 313187 - DNA, 25 bp, Mus musculus
gctaggcggctagtccgctagtccg

SEQ ID NO: 313188 - DNA, 25 bp, Mus musculus
gcaaagctctgccagtcctcgcggg

SEQ ID NO: 313189 - DNA, 25 bp, Mus musculus
ccctattgcttagggtcactaccca

SEQ ID NO: 313190 - DNA, 25 bp, Mus musculus
ttagggtcactacccagtcccactg

SEQ ID NO: 313191 - DNA, 25 bp, Mus musculus
tacccagtcccactgacgcggggga

SEQ ID NO: 313192 - DNA, 25 bp, Mus musculus
agtgcgcacgactctgcctgcggca

SEQ ID NO: 313193 - DNA, 25 bp, Mus musculus
acgactctgcctgcggcagttggct

SEQ ID NO: 313194 - DNA, 25 bp, Mus musculus
ctgtggtgcgcagagccagagacac

SEQ ID NO: 313195 - DNA, 25 bp, Mus musculus
tgcgcagagccagagacacctcagg

SEQ ID NO: 313196 - DNA, 25 bp, Mus musculus
gagccagagacacctcaggctctga

SEQ ID NO: 313197 - DNA, 25 bp, Mus musculus
gacacctcaggctctgaagtgggca

SEQ ID NO: 313198 - DNA, 25 bp, Mus musculus
gcacagacctggacggacaggccag

SEQ ID NO: 313199 - DNA, 25 bp, Mus musculus
ccgaacgagagcacaggatcccttt

SEQ ID NO: 313200 - DNA, 25 bp, Mus musculus
acttagagagttaagcccggcggca

SEQ ID NO: 313201 - DNA, 25 bp, Mus musculus
ggagtgcttaccaacgtcttctgac

SEQ ID NO: 313202 - DNA, 25 bp, Mus musculus
ccatcgtgatgtggggtttggcact

SEQ ID NO: 313203 - DNA, 25 bp, Mus musculus
actcggaagctgcagagaccgccta

SEQ ID NO: 313204 - DNA, 25 bp, Mus musculus
gggctcgtcgcccacaactcggaag

SEQ ID NO: 313205 - DNA, 25 bp, Mus musculus
tttgcgctcccaagccagcctaagg

SEQ ID NO: 313206 - DNA, 25 bp, Mus musculus
cacaatagctgtggtagcccggcgc

SEQ ID NO: 313207 - DNA, 25 bp, Mus musculus
gcggcctgggatatgtagtctttcc

SEQ ID NO: 313208 - DNA, 25 bp, Mus musculus
ctccatctggaaagcgtggcggcct

SEQ ID NO: 313209 - DNA, 25 bp, Mus musculus
gtcagcgccctaggactccatctgg

SEQ ID NO: 313210 - DNA, 25 bp, Mus musculus
gggcgacaacgctacgcacaatagc

SEQ ID NO: 313211 - DNA, 25 bp, Mus musculus
agccaatgccaccttttcacgctgg

SEQ ID NO: 313212 - DNA, 25 bp, Mus musculus
tggatgtcttcctcgggtcttcagg

SEQ ID NO: 313213 - DNA, 25 bp, Mus musculus
tgagcaaataggctcgcgctcgagc

SEQ ID NO: 313214 - DNA, 25 bp, Mus musculus
ggcgagccggcgcttctagcctgca

SEQ ID NO: 313215 - DNA, 25 bp, Mus musculus
gcgcttctagcctgcactctcagtg

SEQ ID NO: 313216 - DNA, 25 bp, Mus musculus
ttctagcctgcactctcagtgggcg

SEQ ID NO: 313217 - DNA, 25 bp, Mus musculus
cctgcactctcagtgggcgtggaag

SEQ ID NO: 313218 - DNA, 25 bp, Mus musculus
cccaaacagtgagcaaataggctcg

SEQ ID NO: 313219 - DNA, 25 bp, Mus musculus
aataggctcgcgctcgagcctcgga

SEQ ID NO: 313220 - DNA, 25 bp, Mus musculus
gagcctcggaggctaccggagcacc

SEQ ID NO: 313221 - DNA, 25 bp, Mus musculus
gctaccggagcaccggaactcggct

SEQ ID NO: 313222 - DNA, 25 bp, Mus musculus
gcagcagccagcctcaggcgccggc

SEQ ID NO: 313223 - DNA, 25 bp, Mus musculus
cgccggcggtgacgccgtcttaacg

SEQ ID NO: 313224 - DNA, 25 bp, Mus musculus
gtgacgccgtcttaacgcgaccgcg

SEQ ID NO: 313225 - DNA, 25 bp, Mus musculus
ccggtctccacgtctcaggtttcgc

SEQ ID NO: 313226 - DNA, 25 bp, Mus musculus
agcgaaactgcgtccccaaacagtg

SEQ ID NO: 313227 - DNA, 25 bp, Mus musculus
taccggggagcccgctttgcgccca

SEQ ID NO: 313228 - DNA, 25 bp, Mus musculus
aggcgctgatccgtgccaagctcag

SEQ ID NO: 313229 - DNA, 25 bp, Mus musculus
cgaaggcgctgatccgtgccaagct

SEQ ID NO: 313230 - DNA, 25 bp, Mus musculus
gcgctgatccgtgccaagctcagga

SEQ ID NO: 313231 - DNA, 25 bp, Mus musculus
ctgtccggaaccgaccgtctggtcg

SEQ ID NO: 313232 - DNA, 25 bp, Mus musculus
cagccaagactatccgacaaaaccg

SEQ ID NO: 313233 - DNA, 25 bp, Mus musculus
ggtcagccaagactatccgacaaaa

SEQ ID NO: 313234 - DNA, 25 bp, Mus musculus
agggtcagccaagactatccgacaa

SEQ ID NO: 313235 - DNA, 25 bp, Mus musculus
cgaaggcggagctccagtctccggc

SEQ ID NO: 313236 - DNA, 25 bp, Mus musculus
cgctgtccggaaccgaccgtctggt

SEQ ID NO: 313237 - DNA, 25 bp, Mus musculus
gcgcgaggtggtggcgccttctgtc

SEQ ID NO: 313238 - DNA, 25 bp, Mus musculus
atccgtgccaagctcaggaggggag

SEQ ID NO: 313239 - DNA, 25 bp, Mus musculus
ctgatccgtgccaagctcaggaggg

SEQ ID NO: 313240 - DNA, 25 bp, Mus musculus
gtagggtcagccaagactatccgac

SEQ ID NO: 313241 - DNA, 25 bp, Mus musculus
agcggccgtcctcggaggcccagat

SEQ ID NO: 313242 - DNA, 25 bp, Mus musculus
aggtggacacaaggatgtcattgga

SEQ ID NO: 313243 - DNA, 25 bp, Mus musculus
ccatcagggtcagggatctcacgga

SEQ ID NO: 313244 - DNA, 25 bp, Mus musculus
atctcacggatgcagcggccgtcct

SEQ ID NO: 313245 - DNA, 25 bp, Mus musculus
cccgtagcacatggagcacagtggg

SEQ ID NO: 313246 - DNA, 25 bp, Mus musculus
cggtgccggtcgtcattggcgaagc

SEQ ID NO: 313247 - DNA, 25 bp, Mus musculus
tcagggatctcacggatgcagcggc

SEQ ID NO: 313248 - DNA, 25 bp, Mus musculus
tggcacagggagatgctgccgtcca

SEQ ID NO: 313249 - DNA, 25 bp, Mus musculus
caaggatgtcattggagagggacca

SEQ ID NO: 313250 - DNA, 25 bp, Mus musculus
acgccacgtgtatggccccgtagca

SEQ ID NO: 313251 - DNA, 25 bp, Mus musculus
ggaccaggcgaagtccgagacgcca

SEQ ID NO: 313252 - DNA, 25 bp, Mus musculus
gtccgagacgccacgtgtatggccc

SEQ ID NO: 313253 - DNA, 25 bp, Mus musculus
cgaagtccgagacgccacgtgtatg

SEQ ID NO: 313254 - DNA, 25 bp, Mus musculus
agatgctgccgtccagggagcagca

SEQ ID NO: 313255 - DNA, 25 bp, Mus musculus
ccaagtaagagttggggcgacgtca

SEQ ID NO: 313256 - DNA, 25 bp, Mus musculus
acacccaggcagactggggccctga

SEQ ID NO: 313257 - DNA, 25 bp, Mus musculus
tgtgccggctgcacactcccatagg

SEQ ID NO: 313258 - DNA, 25 bp, Mus musculus
tgcctctgcttatgggcggggttca

SEQ ID NO: 313259 - DNA, 25 bp, Mus musculus
ctgctctcctggcagttccgctggg

SEQ ID NO: 313260 - DNA, 25 bp, Mus musculus
cagtatcccgcttagccgctgtggc

SEQ ID NO: 313261 - DNA, 25 bp, Mus musculus
ccgcaaacggctggtctggtggcct

SEQ ID NO: 313262 - DNA, 25 bp, Mus musculus
tccacgcgtgtcttcttcgagcagc

SEQ ID NO: 313263 - DNA, 25 bp, Mus musculus
tgcaattctggctcgcacctttacc

SEQ ID NO: 313264 - DNA, 25 bp, Mus musculus
gctactatagctgcaattctggctc

SEQ ID NO: 313265 - DNA, 25 bp, Mus musculus
gttgacaacggctaagcagctacta

SEQ ID NO: 313266 - DNA, 25 bp, Mus musculus
cgcggcgagcatagtctagttgaca

SEQ ID NO: 313267 - DNA, 25 bp, Mus musculus
cactacggcttactcgcgaatgctc

SEQ ID NO: 313268 - DNA, 25 bp, Mus musculus
tcctatccctttgccgctgtgtgga

SEQ ID NO: 313269 - DNA, 25 bp, Mus musculus
ggtgcggcgccctattttatatctg

SEQ ID NO: 313270 - DNA, 25 bp, Mus musculus
tcaatcgccggggattaaggacttg

SEQ ID NO: 313271 - DNA, 25 bp, Mus musculus
ccgaggcttcagaggtgcaaatcga

SEQ ID NO: 313272 - DNA, 25 bp, Mus musculus
atcgacgggactgatttgctcggca

SEQ ID NO: 313273 - DNA, 25 bp, Mus musculus
tcggcagggccgtactagcctttta

SEQ ID NO: 313274 - DNA, 25 bp, Mus musculus
ggccggtgctaaagtagaagctgtc

SEQ ID NO: 313275 - DNA, 25 bp, Mus musculus
accgagctcgcattgttgggagaca

SEQ ID NO: 313276 - DNA, 25 bp, Mus musculus
cttcccagaggcgtcaatcccagga

SEQ ID NO: 313277 - DNA, 25 bp, Mus musculus
gagcgctcttcagggagacccgatc

SEQ ID NO: 313278 - DNA, 25 bp, Mus musculus
ggacttgcagtctcaaacaatctgg

SEQ ID NO: 313279 - DNA, 25 bp, Mus musculus
aggggatcctgaagtgcattctgcc

SEQ ID NO: 313280 - DNA, 25 bp, Mus musculus
tggccaagaacctggagcccgtgtc

SEQ ID NO: 313281 - DNA, 25 bp, Mus musculus
ctggagctctcttaaccctaagtga

SEQ ID NO: 313282 - DNA, 25 bp, Mus musculus
ttctagtgttttcttgcgggcagtc

SEQ ID NO: 313283 - DNA, 25 bp, Mus musculus
gaattctgctgacggcgctctcctc

SEQ ID NO: 313284 - DNA, 25 bp, Mus musculus
ttgtgtgtccatcggtgtcgccgcg

SEQ ID NO: 313285 - DNA, 25 bp, Mus musculus
taaacacggcccacagcggggcgcg

SEQ ID NO: 313286 - DNA, 25 bp, Mus musculus
ccaatgtttctttctatcgagggcc

SEQ ID NO: 313287 - DNA, 25 bp, Mus musculus
gcgcggaattctgctgacggcgctc

SEQ ID NO: 313288 - DNA, 25 bp, Mus musculus
tttgtctggcacctccggtcatggc

SEQ ID NO: 313289 - DNA, 25 bp, Mus musculus
gtagtgtcccgtccgtgcccgagac

SEQ ID NO: 313290 - DNA, 25 bp, Mus musculus
tggcggctgagctctctgcagcgac

SEQ ID NO: 313291 - DNA, 25 bp, Mus musculus
gctctgcgggctttgtctggcacct

SEQ ID NO: 313292 - DNA, 25 bp, Mus musculus
gcagcgcgcccaatgtttctttcta

SEQ ID NO: 313293 - DNA, 25 bp, Mus musculus
ttctcaacaagaaagggcctcaagg

SEQ ID NO: 313294 - DNA, 25 bp, Mus musculus
gcgggcacccgcattctcaacaaga

SEQ ID NO: 313295 - DNA, 25 bp, Mus musculus
ccggtcatggcccttgcggagctgc

SEQ ID NO: 313296 - DNA, 25 bp, Mus musculus
cggcagggtaaacacggcccacagc

SEQ ID NO: 313297 - DNA, 25 bp, Mus musculus
gctgctgccctctgtgaattggggt

SEQ ID NO: 313298 - DNA, 25 bp, Mus musculus
cccaggccgcctcttactcaccttt

SEQ ID NO: 313299 - DNA, 25 bp, Mus musculus
ggggtgggctcaaaagcgtcatttc

SEQ ID NO: 313300 - DNA, 25 bp, Mus musculus
caaaagcgtcatttcgttcgaaacg

SEQ ID NO: 313301 - DNA, 25 bp, Mus musculus
ccgaagaggccataggcctcggcgt

SEQ ID NO: 313302 - DNA, 25 bp, Mus musculus
caccctgcagcactcgcccaccagc

SEQ ID NO: 313303 - DNA, 25 bp, Mus musculus
cagctagggatgcagtccccgaaga

SEQ ID NO: 313304 - DNA, 25 bp, Mus musculus
actcacctttctggctagtcgcgcg

SEQ ID NO: 313305 - DNA, 25 bp, Mus musculus
ctttctggctagtcgcgcgctcgga

SEQ ID NO: 313306 - DNA, 25 bp, Mus musculus
ctgcagagctgtcggacctccggac

SEQ ID NO: 313307 - DNA, 25 bp, Mus musculus
cccgctaaagagcactagggcaggc

SEQ ID NO: 313308 - DNA, 25 bp, Mus musculus
ccctctgtgaattggggtgggctca

SEQ ID NO: 313309 - DNA, 25 bp, Mus musculus
gggctcaaaagcgtcatttcgttcg

SEQ ID NO: 313310 - DNA, 25 bp, Mus musculus
cgctcccgagacgaacccgcaaagg

SEQ ID NO: 313311 - DNA, 25 bp, Mus musculus
acgccgccgcgctgactatctgctg

SEQ ID NO: 313312 - DNA, 25 bp, Mus musculus
tgggctcccaggcagagcgacaaac

SEQ ID NO: 313313 - DNA, 25 bp, Mus musculus
agcgagaggcgcactaagtaaagcc

SEQ ID NO: 313314 - DNA, 25 bp, Mus musculus
cgcactaagtaaagccgggcgtccg

SEQ ID NO: 313315 - DNA, 25 bp, Mus musculus
cccgaggtaaagcctggacggcgct

SEQ ID NO: 313316 - DNA, 25 bp, Mus musculus
cgcctgcctactccctccagcccgg

SEQ ID NO: 313317 - DNA, 25 bp, Mus musculus
aaatatgttcaggggcgcttggatg

SEQ ID NO: 313318 - DNA, 25 bp, Mus musculus
gacggccagagcagagtgcgagcca

SEQ ID NO: 313319 - DNA, 25 bp, Mus musculus
ctcccaggcagagcgacaaaccttg

SEQ ID NO: 313320 - DNA, 25 bp, Mus musculus
gcgacaaaccttgcgccgattcgga

SEQ ID NO: 313321 - DNA, 25 bp, Mus musculus
aaccttgcgccgattcggagcgggc

SEQ ID NO: 313322 - DNA, 25 bp, Mus musculus
gatggcgactgtccctggcgtccct

SEQ ID NO: 313323 - DNA, 25 bp, Mus musculus
gtccctgctcttcttcaccgtgctg

SEQ ID NO: 313324 - DNA, 25 bp, Mus musculus
ccgacaccatgaggagtgcggcgcc

SEQ ID NO: 313325 - DNA, 25 bp, Mus musculus
tgcctttcccggataccggccgctg

SEQ ID NO: 313326 - DNA, 25 bp, Mus musculus
tcaagccaaacgcaggctgaggctg

SEQ ID NO: 313327 - DNA, 25 bp, Mus musculus
aggcgcagccgctgaacaaggccca

SEQ ID NO: 313328 - DNA, 25 bp, Mus musculus
tgccatgaaatgcagctcagcgctc

SEQ ID NO: 313329 - DNA, 25 bp, Mus musculus
tcatccgcacccaggccctcagttg

SEQ ID NO: 313330 - DNA, 25 bp, Mus musculus
ccctccgcctctggcggccttggct

SEQ ID NO: 313331 - DNA, 25 bp, Mus musculus
tcccggaaccctgccatgaaatgca

SEQ ID NO: 313332 - DNA, 25 bp, Mus musculus
agccgctgaacaaggcccaggcgcg

SEQ ID NO: 313333 - DNA, 25 bp, Mus musculus
tgccggccttccctccttggcctct

SEQ ID NO: 313334 - DNA, 25 bp, Mus musculus
tgcagctcagcgctccagagtctca

SEQ ID NO: 313335 - DNA, 25 bp, Mus musculus
tccagagtctcagccacagcttggg

SEQ ID NO: 313336 - DNA, 25 bp, Mus musculus
tgctttcctcgcgtctgggccattt

SEQ ID NO: 313337 - DNA, 25 bp, Mus musculus
actaccctgtcaagccaaacgcagg

SEQ ID NO: 313338 - DNA, 25 bp, Mus musculus
gtctgggccatttcccgccttcatc

SEQ ID NO: 313339 - DNA, 25 bp, Mus musculus
cagcagtgtggattcggttacagcc

SEQ ID NO: 313340 - DNA, 25 bp, Mus musculus
agccgacctcgaaaagatgaatctc

SEQ ID NO: 313341 - DNA, 25 bp, Mus musculus
tgaatctcgagaatatgcctccacg

SEQ ID NO: 313342 - DNA, 25 bp, Mus musculus
tttggagaaaatcctgacagcagtg

SEQ ID NO: 313343 - DNA, 25 bp, Mus musculus
aggccgaacaactggctgccaaccg

SEQ ID NO: 313344 - DNA, 25 bp, Mus musculus
ccactatcgcgaaaaaagggagcta

SEQ ID NO: 313345 - DNA, 25 bp, Mus musculus
cgcgaccgaagagctcaccaggaga

SEQ ID NO: 313346 - DNA, 25 bp, Mus musculus
ccgagatggagcagaggcacaagca

SEQ ID NO: 313347 - DNA, 25 bp, Mus musculus
caagggcagacggaagcagatgctc

SEQ ID NO: 313348 - DNA, 25 bp, Mus musculus
tccgtcccaaagaacgacaagggca

SEQ ID NO: 313349 - DNA, 25 bp, Mus musculus
gctacaagcacacatccagactttg

SEQ ID NO: 313350 - DNA, 25 bp, Mus musculus
aacgggtgatccgtcgccactatcg

SEQ ID NO: 313351 - DNA, 25 bp, Mus musculus
cgagcaggaactccaacgggtgatc

SEQ ID NO: 313352 - DNA, 25 bp, Mus musculus
cagactttgaaagcttccgtcccaa

SEQ ID NO: 313353 - DNA, 25 bp, Mus musculus
ttaactcagggccacctcaccggta

SEQ ID NO: 313354 - DNA, 25 bp, Mus musculus
gcgcctctgggatcaatttgaaact

SEQ ID NO: 313355 - DNA, 25 bp, Mus musculus
gcgctcgcgaccacttaactcaggg

SEQ ID NO: 313356 - DNA, 25 bp, Mus musculus
acacgggctaccttctagatccagg

SEQ ID NO: 313357 - DNA, 25 bp, Mus musculus
tgctgtctctgctggagtttcctta

SEQ ID NO: 313358 - DNA, 25 bp, Mus musculus
ggcaccgcgttagctccgattctgc

SEQ ID NO: 313359 - DNA, 25 bp, Mus musculus
tctcacaggctgtacgcgctccgat

SEQ ID NO: 313360 - DNA, 25 bp, Mus musculus
gtgcgtgctcaagttcgtctgcttc

SEQ ID NO: 313361 - DNA, 25 bp, Mus musculus
tctctttgggcgagccagagctcca

SEQ ID NO: 313362 - DNA, 25 bp, Mus musculus
tcggaaccggaagcggatgctccta

SEQ ID NO: 313363 - DNA, 25 bp, Mus musculus
cctcggtcagcgacagccaattcgg

SEQ ID NO: 313364 - DNA, 25 bp, Mus musculus
ctcaccggtaagaaggcctcggtca

SEQ ID NO: 313365 - DNA, 25 bp, Mus musculus
gtttccttattgctgacgccgcttc

SEQ ID NO: 313366 - DNA, 25 bp, Mus musculus
tctgcgctttggagcactttagggc

SEQ ID NO: 313367 - DNA, 25 bp, Mus musculus
agccggttatgcaaacaaaggtgtt

SEQ ID NO: 313368 - DNA, 25 bp, Mus musculus
agccggcgctttctcgacaactaga

SEQ ID NO: 313369 - DNA, 25 bp, Mus musculus
cgctttctcgacaactagacctgga

SEQ ID NO: 313370 - DNA, 25 bp, Mus musculus
tagacctggactccgactgagcgcc

SEQ ID NO: 313371 - DNA, 25 bp, Mus musculus
tggactccgactgagcgccaggtga

SEQ ID NO: 313372 - DNA, 25 bp, Mus musculus
tgtccgtggtctcccgcgcgggaca

SEQ ID NO: 313373 - DNA, 25 bp, Mus musculus
gcctctggcgtctcctcctctatcc

SEQ ID NO: 313374 - DNA, 25 bp, Mus musculus
ggcggagccggttatgcaaacaaag

SEQ ID NO: 313375 - DNA, 25 bp, Mus musculus
attggtgcgccgagcgcggcctcca

SEQ ID NO: 313376 - DNA, 25 bp, Mus musculus
ggacaaccattggtgcgccgagcgc

SEQ ID NO: 313377 - DNA, 25 bp, Mus musculus
cagccagctggacaaccattggtgc

SEQ ID NO: 313378 - DNA, 25 bp, Mus musculus
aggtgaactgtacgaaggcgcgccc

SEQ ID NO: 313379 - DNA, 25 bp, Mus musculus
caaaggtgtttgattggctcgggcc

SEQ ID NO: 313380 - DNA, 25 bp, Mus musculus
gacaactagacctggactccgactg

SEQ ID NO: 313381 - DNA, 25 bp, Mus musculus
tttggtctacaagcctccccaaggc

SEQ ID NO: 313382 - DNA, 25 bp, Mus musculus
tcttccatttggtctacaagcctcc

SEQ ID NO: 313383 - DNA, 25 bp, Mus musculus
gccttcatcttccatttggtctaca

SEQ ID NO: 313384 - DNA, 25 bp, Mus musculus
acgccttcatcttccatttggtcta

SEQ ID NO: 313385 - DNA, 25 bp, Mus musculus
gtactgcaacgccttcatcttccat

SEQ ID NO: 313386 - DNA, 25 bp, Mus musculus
caggtactgcaacgccttcatcttc

SEQ ID NO: 313387 - DNA, 25 bp, Mus musculus
agaaaagaaagctgcacgcgggccc

SEQ ID NO: 313388 - DNA, 25 bp, Mus musculus
tgcaacgccttcatcttccatttgg

SEQ ID NO: 313389 - DNA, 25 bp, Mus musculus
cccgccggcgcagatgagagcggac

SEQ ID NO: 313390 - DNA, 25 bp, Mus musculus
gcgcagatgagagcggacttggcag

SEQ ID NO: 313391 - DNA, 25 bp, Mus musculus
cgccctcgccctcaccgctgcaggt

SEQ ID NO: 313392 - DNA, 25 bp, Mus musculus
ctgcaggtactgcaacgccttcatc

SEQ ID NO: 313393 - DNA, 25 bp, Mus musculus
ggctcccggccctgcacctagaccc

SEQ ID NO: 313394 - DNA, 25 bp, Mus musculus
caaggcggcacagtccgctcggctc

SEQ ID NO: 313395 - DNA, 25 bp, Mus musculus
gtctctccgtctctggtggcccgaa

SEQ ID NO: 313396 - DNA, 25 bp, Mus musculus
gaaacgcttgctggcgtctcgcgtc

SEQ ID NO: 313397 - DNA, 25 bp, Mus musculus
ttcacgctttaccagagagtcacgc

SEQ ID NO: 313398 - DNA, 25 bp, Mus musculus
agtcactgaattggcgctgagcttc

SEQ ID NO: 313399 - DNA, 25 bp, Mus musculus
gccggaaggagagattcacgcttta

SEQ ID NO: 313400 - DNA, 25 bp, Mus musculus
agagtcacgctctgtgattggtctg

SEQ ID NO: 313401 - DNA, 25 bp, Mus musculus
attggtctgtctgtcactcagtgcc

SEQ ID NO: 313402 - DNA, 25 bp, Mus musculus
cgccctcgtcgtgcagacagaatga

SEQ ID NO: 313403 - DNA, 25 bp, Mus musculus
acgcctttccgctaacagtcactga

SEQ ID NO: 313404 - DNA, 25 bp, Mus musculus
ctgtgattggtctgattcaatgttc

SEQ ID NO: 313405 - DNA, 25 bp, Mus musculus
ttcaatgttcaaaaactctcgtgcg

SEQ ID NO: 313406 - DNA, 25 bp, Mus musculus
aaaaactctcgtgcgcatcccatcg

SEQ ID NO: 313407 - DNA, 25 bp, Mus musculus
tttggcgccttctttcccgctcttg

SEQ ID NO: 313408 - DNA, 25 bp, Mus musculus
cagaatgagtcacgctctgtgattg

SEQ ID NO: 313409 - DNA, 25 bp, Mus musculus
atatcagcggccacaactcttcctg

SEQ ID NO: 313410 - DNA, 25 bp, Mus musculus
tgcgtagccgagacgtcacacaacg

SEQ ID NO: 313411 - DNA, 25 bp, Mus musculus
cctgataaagcgtgcgtagccgaga

SEQ ID NO: 313412 - DNA, 25 bp, Mus musculus
cagagacgacgagctcgaaggaacc

SEQ ID NO: 313413 - DNA, 25 bp, Mus musculus
tcgtccctcgcccatagagggcaag

SEQ ID NO: 313414 - DNA, 25 bp, Mus musculus
tgggactaaccctcctcaaagctca

SEQ ID NO: 313415 - DNA, 25 bp, Mus musculus
cgtgcgtgctcattggttgaggcca

SEQ ID NO: 313416 - DNA, 25 bp, Mus musculus
acatttttgccttcgagcctgggac

SEQ ID NO: 313417 - DNA, 25 bp, Mus musculus
gcccgcctcacaatgaatacatttt

SEQ ID NO: 313418 - DNA, 25 bp, Mus musculus
aggcagcaatttgcctcgccgcttc

SEQ ID NO: 313419 - DNA, 25 bp, Mus musculus
ttccggcatttctcccgttccgatg

SEQ ID NO: 313420 - DNA, 25 bp, Mus musculus
cgcaggcctacagcagcattgcatt

SEQ ID NO: 313421 - DNA, 25 bp, Mus musculus
tcattttgtacggtcgcgcaggcct

SEQ ID NO: 313422 - DNA, 25 bp, Mus musculus
gcgaaggcgcttacctggaaattaa

SEQ ID NO: 313423 - DNA, 25 bp, Mus musculus
taaggcgcctagtgtcagccactgc

SEQ ID NO: 313424 - DNA, 25 bp, Mus musculus
cttggggcttcgagttaaggcgcct

SEQ ID NO: 313425 - DNA, 25 bp, Mus musculus
tcccgcttgcaaaataaccagccaa

SEQ ID NO: 313426 - DNA, 25 bp, Mus musculus
catctttccgaagaagagcccggta

SEQ ID NO: 313427 - DNA, 25 bp, Mus musculus
gcggtgtccgacatctttccgaaga

SEQ ID NO: 313428 - DNA, 25 bp, Mus musculus
cctagtgtcagccactgcggtgtcc

SEQ ID NO: 313429 - DNA, 25 bp, Mus musculus
cggcccgtaagcgtcggtcaggtct

SEQ ID NO: 313430 - DNA, 25 bp, Mus musculus
tatctccaggaagttactgggcggc

SEQ ID NO: 313431 - DNA, 25 bp, Mus musculus
gatgtctatctccaggaagttactg

SEQ ID NO: 313432 - DNA, 25 bp, Mus musculus
cgtctgtggattaaagatgtctatc

SEQ ID NO: 313433 - DNA, 25 bp, Mus musculus
ccaccgtctgtggattaaagatgtc

SEQ ID NO: 313434 - DNA, 25 bp, Mus musculus
aacctcataggtggtgaagcgcgcg

SEQ ID NO: 313435 - DNA, 25 bp, Mus musculus
tcacccgcatgcgaacctcataggt

SEQ ID NO: 313436 - DNA, 25 bp, Mus musculus
gccactgcggtgtccgacatctttc

SEQ ID NO: 313437 - DNA, 25 bp, Mus musculus
atcgctgagctgcagaggttcgacc

SEQ ID NO: 313438 - DNA, 25 bp, Mus musculus
ccagcgagtggtaaacagagacgtc

SEQ ID NO: 313439 - DNA, 25 bp, Mus musculus
ccgataggggattcagttctggagt

SEQ ID NO: 313440 - DNA, 25 bp, Mus musculus
tggggccgcaagaaccttgaccctc

SEQ ID NO: 313441 - DNA, 25 bp, Mus musculus
ttgaccctctcaagagtgacctgga

SEQ ID NO: 313442 - DNA, 25 bp, Mus musculus
aacttcgctgaggagacgttcggtg

SEQ ID NO: 313443 - DNA, 25 bp, Mus musculus
tacggtgcctcaggtttaaaagagc

SEQ ID NO: 313444 - DNA, 25 bp, Mus musculus
tgtggcaggctccactgatcgctga

SEQ ID NO: 313445 - DNA, 25 bp, Mus musculus
ggctgccgcgatcctagacctcgat

SEQ ID NO: 313446 - DNA, 25 bp, Mus musculus
cacacgaaccgtccgaggtggagcc

SEQ ID NO: 313447 - DNA, 25 bp, Mus musculus
cccagtctgggacagaaggtaccca

SEQ ID NO: 313448 - DNA, 25 bp, Mus musculus
gggacactccgaaccgatcctgttg

SEQ ID NO: 313449 - DNA, 25 bp, Mus musculus
cagtttcccaagtggctcctgaggc

SEQ ID NO: 313450 - DNA, 25 bp, Mus musculus
gagggtgcagaaagtgccttcgcta

SEQ ID NO: 313451 - DNA, 25 bp, Mus musculus
ttccggcagtaatcgagagtttcta

SEQ ID NO: 313452 - DNA, 25 bp, Mus musculus
gtccctcggcagtttccggcagtaa

SEQ ID NO: 313453 - DNA, 25 bp, Mus musculus
tattgtccgacggtacccagcgtcc

SEQ ID NO: 313454 - DNA, 25 bp, Mus musculus
cagtcagtattgtccgacggtaccc

SEQ ID NO: 313455 - DNA, 25 bp, Mus musculus
ccacccactctgcagtcagtattgt

SEQ ID NO: 313456 - DNA, 25 bp, Mus musculus
ttctagtgtgtgaaattgactttcc

SEQ ID NO: 313457 - DNA, 25 bp, Mus musculus
cggcagtaatcgagagtttctaacg

SEQ ID NO: 313458 - DNA, 25 bp, Mus musculus
cgccggtggatttctagtgtgtgaa

SEQ ID NO: 313459 - DNA, 25 bp, Mus musculus
ccacgggaagccagttccagcgaga

SEQ ID NO: 313460 - DNA, 25 bp, Mus musculus
ccggccacgccggtggatttctagt

SEQ ID NO: 313461 - DNA, 25 bp, Mus musculus
ctattccaggtctgcgcctccagcc

SEQ ID NO: 313462 - DNA, 25 bp, Mus musculus
ggctgccttccctattccaggtctg

SEQ ID NO: 313463 - DNA, 25 bp, Mus musculus
ggaagccagttccagcgagagagct

SEQ ID NO: 313464 - DNA, 25 bp, Mus musculus
tgaaattgactttccctcctagggc

SEQ ID NO: 313465 - DNA, 25 bp, Mus musculus
cattatcctcaacgtggcggaggtg

SEQ ID NO: 313466 - DNA, 25 bp, Mus musculus
ccgccgtgctcagcgccgctccaat

SEQ ID NO: 313467 - DNA, 25 bp, Mus musculus
gcaggatggctctctgaaagacata

SEQ ID NO: 313468 - DNA, 25 bp, Mus musculus
tccggcatctgcattatcctcaacg

SEQ ID NO: 313469 - DNA, 25 bp, Mus musculus
ctgagcgagcaggatggctctctga

SEQ ID NO: 313470 - DNA, 25 bp, Mus musculus
tcactgtctttatgctcgcagcctc

SEQ ID NO: 313471 - DNA, 25 bp, Mus musculus
cgtcttcactgtctttatgctcgca

SEQ ID NO: 313472 - DNA, 25 bp, Mus musculus
ccaccgagaaaaccgtcttcactgt

SEQ ID NO: 313473 - DNA, 25 bp, Mus musculus
cgcctctcacctgaatacaagcaga

SEQ ID NO: 313474 - DNA, 25 bp, Mus musculus
tacaagcagaatgagatcaacaagc

SEQ ID NO: 313475 - DNA, 25 bp, Mus musculus
ggcggaggtggtgtacctcatcatc

SEQ ID NO: 313476 - DNA, 25 bp, Mus musculus
tgtacctcatcatccgggcctgtgc

SEQ ID NO: 313477 - DNA, 25 bp, Mus musculus
agatcaacaagctgctgagcgagca

SEQ ID NO: 313478 - DNA, 25 bp, Mus musculus
tctgaaagacatactgcgccgcagc

SEQ ID NO: 313479 - DNA, 25 bp, Mus musculus
ccctacctgaggcagggttagagta

SEQ ID NO: 313480 - DNA, 25 bp, Mus musculus
aaaagatagcctctggagctttgga

SEQ ID NO: 313481 - DNA, 25 bp, Mus musculus
cgttagttgaggaaaagatagcctc

SEQ ID NO: 313482 - DNA, 25 bp, Mus musculus
aaattgcggagtggagtgccgtcac

SEQ ID NO: 313483 - DNA, 25 bp, Mus musculus
agactcccagcccagtggccgcctg

SEQ ID NO: 313484 - DNA, 25 bp, Mus musculus
tgccagcgaccaatcccattggctg

SEQ ID NO: 313485 - DNA, 25 bp, Mus musculus
cctttaaatggcagcgccgcttgca

SEQ ID NO: 313486 - DNA, 25 bp, Mus musculus
tacaagcctagaactgcagacagca

SEQ ID NO: 313487 - DNA, 25 bp, Mus musculus
aggcagggttagagtaaccgctaca

SEQ ID NO: 313488 - DNA, 25 bp, Mus musculus
cgagatcccgcctgcaggttcggtt

SEQ ID NO: 313489 - DNA, 25 bp, Mus musculus
tcggttcggcttgaacagacccgac

SEQ ID NO: 313490 - DNA, 25 bp, Mus musculus
ggctactgcgagatcccgcctgcag

SEQ ID NO: 313491 - DNA, 25 bp, Mus musculus
ctgcaggttcggttcggcttgaaca

SEQ ID NO: 313492 - DNA, 25 bp, Mus musculus
gtaaccgctacaagcctagaactgc

SEQ ID NO: 313493 - DNA, 25 bp, Mus musculus
tggctctttggttgcttagggatgc

SEQ ID NO: 313494 - DNA, 25 bp, Mus musculus
ggggcttcctgcgacactctggaaa

SEQ ID NO: 313495 - DNA, 25 bp, Mus musculus
ctccgagcaaagaactgtggccaga

SEQ ID NO: 313496 - DNA, 25 bp, Mus musculus
gcgtcgcccatactccgagcaaaga

SEQ ID NO: 313497 - DNA, 25 bp, Mus musculus
gtaccgagctccgtcggctcgtttc

SEQ ID NO: 313498 - DNA, 25 bp, Mus musculus
ggcagttcacatagccaatcgggaa

SEQ ID NO: 313499 - DNA, 25 bp, Mus musculus
ctcgggagataaactttgactggca

SEQ ID NO: 313500 - DNA, 25 bp, Mus musculus
tttgcacacgggctatgggttccga

SEQ ID NO: 313501 - DNA, 25 bp, Mus musculus
aaatggcggactaatgagactttct

SEQ ID NO: 313502 - DNA, 25 bp, Mus musculus
catgcgcataagctacgaagcctcg

SEQ ID NO: 313503 - DNA, 25 bp, Mus musculus
tcggcgcctctagtgcatgcgcata

SEQ ID NO: 313504 - DNA, 25 bp, Mus musculus
tgtcgttcacacgaacccaaggctt

SEQ ID NO: 313505 - DNA, 25 bp, Mus musculus
acccaaggctttgacagtcggtagc

SEQ ID NO: 313506 - DNA, 25 bp, Mus musculus
cagtcggtagccaataaacgttaag

SEQ ID NO: 313507 - DNA, 25 bp, Mus musculus
gtagcccttccgtcgtcatgtccga

SEQ ID NO: 313508 - DNA, 25 bp, Mus musculus
cttattggagaaaaatctgccgctc

SEQ ID NO: 313509 - DNA, 25 bp, Mus musculus
ggtcacgccgcctcagatctacttt

SEQ ID NO: 313510 - DNA, 25 bp, Mus musculus
tccgacacagacagcgacgaagagt

SEQ ID NO: 313511 - DNA, 25 bp, Mus musculus
cacccgtgtgcgactgacgtatttt

SEQ ID NO: 313512 - DNA, 25 bp, Mus musculus
gcggaccaatcaaacacatcaaagg

SEQ ID NO: 313513 - DNA, 25 bp, Mus musculus
tgccgctcttaccatagcaaccaga

SEQ ID NO: 313514 - DNA, 25 bp, Mus musculus
cgggactggtttgtttgaccaatca

SEQ ID NO: 313515 - DNA, 25 bp, Mus musculus
cagcctgatcttgggcggaccaatc

SEQ ID NO: 313516 - DNA, 25 bp, Mus musculus
ttcaacttccggtagcctctggttg

SEQ ID NO: 313517 - DNA, 25 bp, Mus musculus
ttcggcaacatcaatggagcagggc

SEQ ID NO: 313518 - DNA, 25 bp, Mus musculus
ggaagtagccatcccgacatcaaag

SEQ ID NO: 313519 - DNA, 25 bp, Mus musculus
ggtggaggcccattttctctaactg

SEQ ID NO: 313520 - DNA, 25 bp, Mus musculus
aaaggatcacgtaggacggcccatc

SEQ ID NO: 313521 - DNA, 25 bp, Mus musculus
ctgatggcggactggtagacgccgg

SEQ ID NO: 313522 - DNA, 25 bp, Mus musculus
gctgatggcggactggtagacgccg

SEQ ID NO: 313523 - DNA, 25 bp, Mus musculus
tttgagacttgagacgacggtcgtg

SEQ ID NO: 313524 - DNA, 25 bp, Mus musculus
ggtggtttttgagacttgagacgac

SEQ ID NO: 313525 - DNA, 25 bp, Mus musculus
atggcggactggtagacgcccgagt

SEQ ID NO: 313526 - DNA, 25 bp, Mus musculus
ttgagacttgagacgacggtcgtga

SEQ ID NO: 313527 - DNA, 25 bp, Mus musculus
acgccggagtgaggtggttttgaga

SEQ ID NO: 313528 - DNA, 25 bp, Mus musculus
gtggtttttgagacttgagacgacg

SEQ ID NO: 313529 - DNA, 25 bp, Mus musculus
tggcggactggtagacgcccgagtt

SEQ ID NO: 313530 - DNA, 25 bp, Mus musculus
ttttgagacttgagacgacggtcgt

SEQ ID NO: 313531 - DNA, 25 bp, Mus musculus
ggttttgagacttgagacgacggtc

SEQ ID NO: 313532 - DNA, 25 bp, Mus musculus
tgatggcggactggtagacgccgga

SEQ ID NO: 313533 - DNA, 25 bp, Mus musculus
aggtggttttgagacttgagacgac

SEQ ID NO: 313534 - DNA, 25 bp, Mus musculus
tagacgccggagtgaggtggttttg

SEQ ID NO: 313535 - DNA, 25 bp, Mus musculus
gacagggccgatggcggcactcgag

SEQ ID NO: 313536 - DNA, 25 bp, Mus musculus
gacatggccgatggccgtcggttac

SEQ ID NO: 313537 - DNA, 25 bp, Mus musculus
actcttgagtcttgagatggtcgtg

SEQ ID NO: 313538 - DNA, 25 bp, Mus musculus
cagacatggccgatggccgtcggtt

SEQ ID NO: 313539 - DNA, 25 bp, Mus musculus
ggcagggcccatagactcttgagtc

SEQ ID NO: 313540 - DNA, 25 bp, Mus musculus
acagagaaggccgaggcagggtggt

SEQ ID NO: 313541 - DNA, 25 bp, Mus musculus
cacagactacaggtgacagagaagg

SEQ ID NO: 313542 - DNA, 25 bp, Mus musculus
gggcacagactacaggtgacagaga

SEQ ID NO: 313543 - DNA, 25 bp, Mus musculus
tggcgggcacagactacaggtgaca

SEQ ID NO: 313544 - DNA, 25 bp, Mus musculus
gggccgcggacgatgaagaaggaga

SEQ ID NO: 313545 - DNA, 25 bp, Mus musculus
tggtcttgagaagggcgcgaggaag

SEQ ID NO: 313546 - DNA, 25 bp, Mus musculus
ggaggaggataggtggtcttgagaa

SEQ ID NO: 313547 - DNA, 25 bp, Mus musculus
tggccgtcggttactcggcggagga

SEQ ID NO: 313548 - DNA, 25 bp, Mus musculus
cactcgagtggggtggttttgagaa

SEQ ID NO: 313549 - DNA, 25 bp, Mus musculus
tcctggaggatgtgtacaatcgtac

SEQ ID NO: 313550 - DNA, 25 bp, Mus musculus
cgctgatgactatgatcacatggga

SEQ ID NO: 313551 - DNA, 25 bp, Mus musculus
gcaggattgctacagcgcccgggaa

SEQ ID NO: 313552 - DNA, 25 bp, Mus musculus
gaacctgggcattcagccgggtcct

SEQ ID NO: 313553 - DNA, 25 bp, Mus musculus
ctcgggctctcgaacgctacttttg

SEQ ID NO: 313554 - DNA, 25 bp, Mus musculus
gctacttttgttgcatcgcgcgctg

SEQ ID NO: 313555 - DNA, 25 bp, Mus musculus
cagctctgcctccacagggtggcga

SEQ ID NO: 313556 - DNA, 25 bp, Mus musculus
ggggaagcctacagcaccgccctgg

SEQ ID NO: 313557 - DNA, 25 bp, Mus musculus
ctccagctggcgtgtcccggaacag

SEQ ID NO: 313558 - DNA, 25 bp, Mus musculus
gtgtacaatcgtacccagggcctgc

SEQ ID NO: 313559 - DNA, 25 bp, Mus musculus
cacggcctgctccagctggcttgat

SEQ ID NO: 313560 - DNA, 25 bp, Mus musculus
tgatggccgcggcatcaagagaccg

SEQ ID NO: 313561 - DNA, 25 bp, Mus musculus
tgcttcacactacacatcgctgatg

SEQ ID NO: 313562 - DNA, 25 bp, Mus musculus
accatccatggcttatccgtcaggc

SEQ ID NO: 313563 - DNA, 25 bp, Mus musculus
ggacgcaggatctcacaggaatgtt

SEQ ID NO: 313564 - DNA, 25 bp, Mus musculus
gcagttacgtttctcgaaaattcca

SEQ ID NO: 313565 - DNA, 25 bp, Mus musculus
aaattccagaaaatggcggcagctc

SEQ ID NO: 313566 - DNA, 25 bp, Mus musculus
ctcttgggatgggacgcaggatctc

SEQ ID NO: 313567 - DNA, 25 bp, Mus musculus
caggatctcacaggaatgttggaga

SEQ ID NO: 313568 - DNA, 25 bp, Mus musculus
aatgttggagaagcccgaggtctgc

SEQ ID NO: 313569 - DNA, 25 bp, Mus musculus
ccgaggtctgcgcagccaatgggaa

SEQ ID NO: 313570 - DNA, 25 bp, Mus musculus
caatgggaagccgtggagacagagc

SEQ ID NO: 313571 - DNA, 25 bp, Mus musculus
gacagagcgggccattgcgcagtaa

SEQ ID NO: 313572 - DNA, 25 bp, Mus musculus
ccattgcgcagtaagaggggctgtc

SEQ ID NO: 313573 - DNA, 25 bp, Mus musculus
ctgtcgcgaggcctcctgtggctcc

SEQ ID NO: 313574 - DNA, 25 bp, Mus musculus
ctgtggctccctcttgcggcgggtc

SEQ ID NO: 313575 - DNA, 25 bp, Mus musculus
gaagcccgaggtctgcgcagccaat

SEQ ID NO: 313576 - DNA, 25 bp, Mus musculus
attccagaaaatggcggcagctctt

SEQ ID NO: 313577 - DNA, 25 bp, Mus musculus
ctcatcggtggaaatgcttccgctg

SEQ ID NO: 313578 - DNA, 25 bp, Mus musculus
ctcgctcatcggtggaaatgcttcc

SEQ ID NO: 313579 - DNA, 25 bp, Mus musculus
aatgcttccgctgaaggtccggagg

SEQ ID NO: 313580 - DNA, 25 bp, Mus musculus
cgacatctacaagatccgggagatc

SEQ ID NO: 313581 - DNA, 25 bp, Mus musculus
ggtggaaatgcttccgctgaaggtc

SEQ ID NO: 313582 - DNA, 25 bp, Mus musculus
atgactcgctcatcggtggaaatgc

SEQ ID NO: 313583 - DNA, 25 bp, Mus musculus
atgacgagctgttctccgacatcta

SEQ ID NO: 313584 - DNA, 25 bp, Mus musculus
gttctccgacatctacaagatccgg

SEQ ID NO: 313585 - DNA, 25 bp, Mus musculus
tacaagatccgggagatcgcggacg

SEQ ID NO: 313586 - DNA, 25 bp, Mus musculus
ggtcagtagaacagagggtgccatc

SEQ ID NO: 313587 - DNA, 25 bp, Mus musculus
tagaacagagggtgccatcgatgac

SEQ ID NO: 313588 - DNA, 25 bp, Mus musculus
acagagggtgccatcgatgactcgc

SEQ ID NO: 313589 - DNA, 25 bp, Mus musculus
gggtgccatcgatgactcgctcatc

SEQ ID NO: 313590 - DNA, 25 bp, Mus musculus
gagctgttctccgacatctacaaga

SEQ ID NO: 313591 - DNA, 25 bp, Mus musculus
cgcagaggtgctgtaggaccctgcc

SEQ ID NO: 313592 - DNA, 25 bp, Mus musculus
gcctagagtgctcttgcctggaacc

SEQ ID NO: 313593 - DNA, 25 bp, Mus musculus
caggctagcctcaccttgactcgga

SEQ ID NO: 313594 - DNA, 25 bp, Mus musculus
tgtaagtgcctgtccaggtcctgcc

SEQ ID NO: 313595 - DNA, 25 bp, Mus musculus
tggcagtttacttccggattcatga

SEQ ID NO: 313596 - DNA, 25 bp, Mus musculus
tgcctgtgtgtaagtgcctgtccag

SEQ ID NO: 313597 - DNA, 25 bp, Mus musculus
agaattttactttttactgcctgtg

SEQ ID NO: 313598 - DNA, 25 bp, Mus musculus
agcatgcgcctagagtgctcttgcc

SEQ ID NO: 313599 - DNA, 25 bp, Mus musculus
aggtggttgccatcccgccgctgtc

SEQ ID NO: 313600 - DNA, 25 bp, Mus musculus
ccggattcatgaaccgccgcgttaa

SEQ ID NO: 313601 - DNA, 25 bp, Mus musculus
cgctgtcgtctctgtccaggtgata

SEQ ID NO: 313602 - DNA, 25 bp, Mus musculus
ctaacgtacacccaacagtgcgggc

SEQ ID NO: 313603 - DNA, 25 bp, Mus musculus
gtggcgccgttgttttggcagttta

SEQ ID NO: 313604 - DNA, 25 bp, Mus musculus
tccaggtgataaccgatagttaccc

SEQ ID NO: 313605 - DNA, 25 bp, Mus musculus
ttctcggagaagcttgccctagctg

SEQ ID NO: 313606 - DNA, 25 bp, Mus musculus
gaatccatgggcaaaccggcgtctc

SEQ ID NO: 313607 - DNA, 25 bp, Mus musculus
gccctagctgtgacgaaaggccgtg

SEQ ID NO: 313608 - DNA, 25 bp, Mus musculus
cgaaggctcgccaagttctcggaga

SEQ ID NO: 313609 - DNA, 25 bp, Mus musculus
cctttcctgagtgaggcggtttcga

SEQ ID NO: 313610 - DNA, 25 bp, Mus musculus
tattgttgggccgttcctcgaagcc

SEQ ID NO: 313611 - DNA, 25 bp, Mus musculus
tagccaccaaccagggcgcctattg

SEQ ID NO: 313612 - DNA, 25 bp, Mus musculus
ttctcattggtctgccactccacta

SEQ ID NO: 313613 - DNA, 25 bp, Mus musculus
agggcctagtctcgccgttctcatt

SEQ ID NO: 313614 - DNA, 25 bp, Mus musculus
cgagacttcgcgcagcagtgtgccc

SEQ ID NO: 313615 - DNA, 25 bp, Mus musculus
ggtgccatccgcttccggtcaagtc

SEQ ID NO: 313616 - DNA, 25 bp, Mus musculus
acgcctgggcgaaggcaaccgtcac

SEQ ID NO: 313617 - DNA, 25 bp, Mus musculus
gacacctcatcaggagaactcatgg

SEQ ID NO: 313618 - DNA, 25 bp, Mus musculus
ggagactcttcctccgtatcgcatg

SEQ ID NO: 313619 - DNA, 25 bp, Mus musculus
acactccgcgttgcctcgctgggag

SEQ ID NO: 313620 - DNA, 25 bp, Mus musculus
agccgctaaggtccggctgcccaga

SEQ ID NO: 313621 - DNA, 25 bp, Mus musculus
attcccgagtgccacaaggctagcg

SEQ ID NO: 313622 - DNA, 25 bp, Mus musculus
gatgccgttctaccggcgcactgtg

SEQ ID NO: 313623 - DNA, 25 bp, Mus musculus
tgagctccgcgacgtgagccacctg

SEQ ID NO: 313624 - DNA, 25 bp, Mus musculus
aattgctaggtaaaaggcgcgaggc

SEQ ID NO: 313625 - DNA, 25 bp, Mus musculus
ctcaaagatcgagggacacggcctc

SEQ ID NO: 313626 - DNA, 25 bp, Mus musculus
gccgccacctctggagtgcttggtg

SEQ ID NO: 313627 - DNA, 25 bp, Mus musculus
cggcgcagaccaaagagtcccggtg

SEQ ID NO: 313628 - DNA, 25 bp, Mus musculus
aaccgaatggccgtgcctgcgtctc

SEQ ID NO: 313629 - DNA, 25 bp, Mus musculus
gccactttggaaatcgcgcccgagc

SEQ ID NO: 313630 - DNA, 25 bp, Mus musculus
gcccagggcttagcggattccatac

SEQ ID NO: 313631 - DNA, 25 bp, Mus musculus
ccagatttgcgggagagaaccattt

SEQ ID NO: 313632 - DNA, 25 bp, Mus musculus
tgcgtctctcctgatgggccacttt

SEQ ID NO: 313633 - DNA, 25 bp, Mus musculus
cggcaggatctgtcgaggaaaaatc

SEQ ID NO: 313634 - DNA, 25 bp, Mus musculus
cagctaactcgggtcgggaaaatgc

SEQ ID NO: 313635 - DNA, 25 bp, Mus musculus
tccgggacgcgttacctcgtggcag

SEQ ID NO: 313636 - DNA, 25 bp, Mus musculus
aacgtgttcctctcctcgggcaggc

SEQ ID NO: 313637 - DNA, 25 bp, Mus musculus
tggcgacagccagtgaacgtgttcc

SEQ ID NO: 313638 - DNA, 25 bp, Mus musculus
gcgacagcgactgcccactcgaggt

SEQ ID NO: 313639 - DNA, 25 bp, Mus musculus
cccgagtgtagaggaactgcttcgc

SEQ ID NO: 313640 - DNA, 25 bp, Mus musculus
cttccctagctgcagctaactcggg

SEQ ID NO: 313641 - DNA, 25 bp, Mus musculus
cttcgggaaccgagggagcccactg

SEQ ID NO: 313642 - DNA, 25 bp, Mus musculus
gccttttaagctcagctacgcgcgc

SEQ ID NO: 313643 - DNA, 25 bp, Mus musculus
gatccctctcgccttttaagctcag

SEQ ID NO: 313644 - DNA, 25 bp, Mus musculus
atcttgcagacagcgatccctctcg

SEQ ID NO: 313645 - DNA, 25 bp, Mus musculus
gacgctggcagaggtgacgccaaca

SEQ ID NO: 313646 - DNA, 25 bp, Mus musculus
cactcgaggtcgtcatggcgacagc

SEQ ID NO: 313647 - DNA, 25 bp, Mus musculus
agctacgttagctagagtggcctta

SEQ ID NO: 313648 - DNA, 25 bp, Mus musculus
cacgcactagactggtagagccaac

SEQ ID NO: 313649 - DNA, 25 bp, Mus musculus
gccaatccgggatctggcgctcgag

SEQ ID NO: 313650 - DNA, 25 bp, Mus musculus
atctggcgctcgagcgcggtttcct

SEQ ID NO: 313651 - DNA, 25 bp, Mus musculus
gccctcgagcactggcgctagctag

SEQ ID NO: 313652 - DNA, 25 bp, Mus musculus
gcactggcgctagctagctacgtta

SEQ ID NO: 313653 - DNA, 25 bp, Mus musculus
gttaagagcgtgagtaaaatgcgcg

SEQ ID NO: 313654 - DNA, 25 bp, Mus musculus
agctagagtggccttacgttttggg

SEQ ID NO: 313655 - DNA, 25 bp, Mus musculus
ctgctgattcacgtgaccggtggtg

SEQ ID NO: 313656 - DNA, 25 bp, Mus musculus
ttcacgtgaccggtggtggtttcag

SEQ ID NO: 313657 - DNA, 25 bp, Mus musculus
acccaggctgggctcacgcactaga

SEQ ID NO: 313658 - DNA, 25 bp, Mus musculus
ttccgtcctaactgcgtggcggtga

SEQ ID NO: 313659 - DNA, 25 bp, Mus musculus
tgtgaatgttgagtaatgagagcga

SEQ ID NO: 313660 - DNA, 25 bp, Mus musculus
gtggtttcagttccgtcctaactgc

SEQ ID NO: 313661 - DNA, 25 bp, Mus musculus
cgtacttgacctttccttgcagtct

SEQ ID NO: 313662 - DNA, 25 bp, Mus musculus
ggctctgttccgtgcagctccgtag

SEQ ID NO: 313663 - DNA, 25 bp, Mus musculus
ttgacctttccttgcagtctcaccg

SEQ ID NO: 313664 - DNA, 25 bp, Mus musculus
gctctgttccgtgcagctccgtagc

SEQ ID NO: 313665 - DNA, 25 bp, Mus musculus
ctctgttccgtgcagctccgtagcg

SEQ ID NO: 313666 - DNA, 25 bp, Mus musculus
gtacttgacctttccttgcagtctc

SEQ ID NO: 313667 - DNA, 25 bp, Mus musculus
tacttgacctttccttgcagtctca

SEQ ID NO: 313668 - DNA, 25 bp, Mus musculus
acttgacctttccttgcagtctcac

SEQ ID NO: 313669 - DNA, 25 bp, Mus musculus
gcggtcgtacttgacctttccttgc

SEQ ID NO: 313670 - DNA, 25 bp, Mus musculus
cggtcgtacttgacctttccttgca

SEQ ID NO: 313671 - DNA, 25 bp, Mus musculus
ggtcgtacttgacctttccttgcag

SEQ ID NO: 313672 - DNA, 25 bp, Mus musculus
gtcgtacttgacctttccttgcagt

SEQ ID NO: 313673 - DNA, 25 bp, Mus musculus
tcgtacttgacctttccttgcagtc

SEQ ID NO: 313674 - DNA, 25 bp, Mus musculus
gggctctgttccgtgcagctccgta

SEQ ID NO: 313675 - DNA, 25 bp, Mus musculus
ctgcgctaggaacggaaagagactc

SEQ ID NO: 313676 - DNA, 25 bp, Mus musculus
cagcctcagactttcccagcgggcg

SEQ ID NO: 313677 - DNA, 25 bp, Mus musculus
tccaccctgtagtcgaccgcgggag

SEQ ID NO: 313678 - DNA, 25 bp, Mus musculus
cgcgggagccctgataacccgggca

SEQ ID NO: 313679 - DNA, 25 bp, Mus musculus
ataacccgggcagcatcggtcaggg

SEQ ID NO: 313680 - DNA, 25 bp, Mus musculus
ggatggaagccgatgcaacccaaga

SEQ ID NO: 313681 - DNA, 25 bp, Mus musculus
atgcaacccaagagctcgctgtacc

SEQ ID NO: 313682 - DNA, 25 bp, Mus musculus
ctgccttaccatggctgcgctagga

SEQ ID NO: 313683 - DNA, 25 bp, Mus musculus
accatggctgcgctaggaacggaaa

SEQ ID NO: 313684 - DNA, 25 bp, Mus musculus
cgctaggaacggaaagagactcgcc

SEQ ID NO: 313685 - DNA, 25 bp, Mus musculus
actcgccttcttccggcgaacgaag

SEQ ID NO: 313686 - DNA, 25 bp, Mus musculus
acgaagaaattagggtcggaggctg

SEQ ID NO: 313687 - DNA, 25 bp, Mus musculus
aaagagactcgccttcttccggcga

SEQ ID NO: 313688 - DNA, 25 bp, Mus musculus
gttgctccgcccagcctcagacttt

SEQ ID NO: 313689 - DNA, 25 bp, Mus musculus
agaatgttccaacttgcagcacgca

SEQ ID NO: 313690 - DNA, 25 bp, Mus musculus
agggctccaagcgtcctttacctca

SEQ ID NO: 313691 - DNA, 25 bp, Mus musculus
cttgcccgggagaggaaagctcaca

SEQ ID NO: 313692 - DNA, 25 bp, Mus musculus
ggcagctccggcagcaaacaagtcc

SEQ ID NO: 313693 - DNA, 25 bp, Mus musculus
atgtgctgcgggtttctccggacaa

SEQ ID NO: 313694 - DNA, 25 bp, Mus musculus
gcagtcctgggtattggcaaagtcg

SEQ ID NO: 313695 - DNA, 25 bp, Mus musculus
gcagcacgcagcttggctgagttca

SEQ ID NO: 313696 - DNA, 25 bp, Mus musculus
catggttcagactagctgtcccgcc

SEQ ID NO: 313697 - DNA, 25 bp, Mus musculus
cacaacgttaaaagtggcatggttc

SEQ ID NO: 313698 - DNA, 25 bp, Mus musculus
ggtgcgataacttaacccaaggtca

SEQ ID NO: 313699 - DNA, 25 bp, Mus musculus
gctcgcagctggctagcaaagattc

SEQ ID NO: 313700 - DNA, 25 bp, Mus musculus
tcagaagcagacaggcgacgaagca

SEQ ID NO: 313701 - DNA, 25 bp, Mus musculus
tttacctcaggtgctcagaagcaga

SEQ ID NO: 313702 - DNA, 25 bp, Mus musculus
tgagttcagccagaagcccttctcg

SEQ ID NO: 313703 - DNA, 25 bp, Mus musculus
ctgactcagccgctcgtccagattt

SEQ ID NO: 313704 - DNA, 25 bp, Mus musculus
ggggagcgcgcaacttcctcattcc

SEQ ID NO: 313705 - DNA, 25 bp, Mus musculus
tggctgagttctgcctgcttgcgaa

SEQ ID NO: 313706 - DNA, 25 bp, Mus musculus
taggctcctggctgagttctgcctg

SEQ ID NO: 313707 - DNA, 25 bp, Mus musculus
ccctctggggtgtaggctcctggct

SEQ ID NO: 313708 - DNA, 25 bp, Mus musculus
cccagtcgacgcgacagtcgtggag

SEQ ID NO: 313709 - DNA, 25 bp, Mus musculus
gcgggacccagtcgacgcgacagtc

SEQ ID NO: 313710 - DNA, 25 bp, Mus musculus
cgtctctaacgcagggcgggcagag

SEQ ID NO: 313711 - DNA, 25 bp, Mus musculus
agctgcaacggccttctgactcagc

SEQ ID NO: 313712 - DNA, 25 bp, Mus musculus
agccgctcgtccagatttcgggatc

SEQ ID NO: 313713 - DNA, 25 bp, Mus musculus
tcgtccagatttcgggatctctctc

SEQ ID NO: 313714 - DNA, 25 bp, Mus musculus
gatttcgggatctctctcctgggcg

SEQ ID NO: 313715 - DNA, 25 bp, Mus musculus
agttctgcctgcttgcgaacccgca

SEQ ID NO: 313716 - DNA, 25 bp, Mus musculus
ctggagctgcaacggccttctgact

SEQ ID NO: 313717 - DNA, 25 bp, Mus musculus
aacgctcccttgctcgtgtggccaa

SEQ ID NO: 313718 - DNA, 25 bp, Mus musculus
ttactgcggctcctcatggtgccac

SEQ ID NO: 313719 - DNA, 25 bp, Mus musculus
agctcggacgccaggcctacggaaa

SEQ ID NO: 313720 - DNA, 25 bp, Mus musculus
gtggccaatggttcccgcgcgtcac

SEQ ID NO: 313721 - DNA, 25 bp, Mus musculus
gttccggcggcctcagagtccactt

SEQ ID NO: 313722 - DNA, 25 bp, Mus musculus
agagtccacttcaggccgcggctca

SEQ ID NO: 313723 - DNA, 25 bp, Mus musculus
cggcatcctccgcttgactgaagga

SEQ ID NO: 313724 - DNA, 25 bp, Mus musculus
cgagcatagccgtccaggcggactc

SEQ ID NO: 313725 - DNA, 25 bp, Mus musculus
gccctgagactgaaggccggcgaca

SEQ ID NO: 313726 - DNA, 25 bp, Mus musculus
cgtgggtcctgcagctgcgcgctac

SEQ ID NO: 313727 - DNA, 25 bp, Mus musculus
tccgcccagaatgtgtcgcccgagg

SEQ ID NO: 313728 - DNA, 25 bp, Mus musculus
gcggactcccgagttactgcggctc

SEQ ID NO: 313729 - DNA, 25 bp, Mus musculus
cggtctaggcttcggccggcaaaga

SEQ ID NO: 313730 - DNA, 25 bp, Mus musculus
ccactgcacacacgggaagctcgga

SEQ ID NO: 313731 - DNA, 25 bp, Mus musculus
gggctacgtgcctcagaagaagtgc

SEQ ID NO: 313732 - DNA, 25 bp, Mus musculus
agctactttctagctcccggggcct

SEQ ID NO: 313733 - DNA, 25 bp, Mus musculus
aggtactgcgccagcagctcagcta

SEQ ID NO: 313734 - DNA, 25 bp, Mus musculus
gggtccacaaaggagctcgcagaag

SEQ ID NO: 313735 - DNA, 25 bp, Mus musculus
ctcagaagaagtgctctcggggctc

SEQ ID NO: 313736 - DNA, 25 bp, Mus musculus
cggtcctgcagcacggggccagaaa

SEQ ID NO: 313737 - DNA, 25 bp, Mus musculus
cgcggacgttctcacctgcggcttt

SEQ ID NO: 313738 - DNA, 25 bp, Mus musculus
ggatgccacctctaccgcggacgtt

SEQ ID NO: 313739 - DNA, 25 bp, Mus musculus
cgctcccgcggggtttcctgagcaa

SEQ ID NO: 313740 - DNA, 25 bp, Mus musculus
gggagcactgagcatccccgctgca

SEQ ID NO: 313741 - DNA, 25 bp, Mus musculus
ttgtggggtccacaaaggagctcgc

SEQ ID NO: 313742 - DNA, 25 bp, Mus musculus
gcgttcttaaccagcaggtactgcg

SEQ ID NO: 313743 - DNA, 25 bp, Mus musculus
cgtcttcgcgttcttaaccagcagg

SEQ ID NO: 313744 - DNA, 25 bp, Mus musculus
gcgccagcagctcagctactttcta

SEQ ID NO: 313745 - DNA, 25 bp, Mus musculus
ccagcgctgacttcaaggatttcga

SEQ ID NO: 313746 - DNA, 25 bp, Mus musculus
tatgggttcgtgcacttccagaagc

SEQ ID NO: 313747 - DNA, 25 bp, Mus musculus
tggcaacatcctgtcctgcaaggtg

SEQ ID NO: 313748 - DNA, 25 bp, Mus musculus
ccctggagaccatgaactttgacgt

SEQ ID NO: 313749 - DNA, 25 bp, Mus musculus
tgacgttatcaatggccggccagtg

SEQ ID NO: 313750 - DNA, 25 bp, Mus musculus
ccagtgcgcatcatgtggtcccaga

SEQ ID NO: 313751 - DNA, 25 bp, Mus musculus
ctctgggctacgcatatgtcaacta

SEQ ID NO: 313752 - DNA, 25 bp, Mus musculus
ccgcaagattttcgtggggagattc

SEQ ID NO: 313753 - DNA, 25 bp, Mus musculus
taccagcaaccggtggacgccaagc

SEQ ID NO: 313754 - DNA, 25 bp, Mus musculus
catccgcatctgcagggacaaggtc

SEQ ID NO: 313755 - DNA, 25 bp, Mus musculus
cgctgaatggcatgttcctgaacta

SEQ ID NO: 313756 - DNA, 25 bp, Mus musculus
ctcggacgatgggaacccagacttt

SEQ ID NO: 313757 - DNA, 25 bp, Mus musculus
tcgccttcctatgggagggtggata

SEQ ID NO: 313758 - DNA, 25 bp, Mus musculus
aaggcgctgtacaacatcttctcgg

SEQ ID NO: 313759 - DNA, 25 bp, Mus musculus
ttccgtcgtctggacaaccgattta

SEQ ID NO: 313760 - DNA, 25 bp, Mus musculus
aggaagacctgcaggctccctaata

SEQ ID NO: 313761 - DNA, 25 bp, Mus musculus
gcttgcgactttccaggaagacctg

SEQ ID NO: 313762 - DNA, 25 bp, Mus musculus
aggcttgcgactttccaggaagacc

SEQ ID NO: 313763 - DNA, 25 bp, Mus musculus
cttcctaacacaggcttgcgacttt

SEQ ID NO: 313764 - DNA, 25 bp, Mus musculus
agggcgacttcctaacacaggcttg

SEQ ID NO: 313765 - DNA, 25 bp, Mus musculus
ggcgcgatcgcagggcgacttccta

SEQ ID NO: 313766 - DNA, 25 bp, Mus musculus
ctcggacaagctggctggcactcac

SEQ ID NO: 313767 - DNA, 25 bp, Mus musculus
ctcgcaggcaaaccgctgtcgtgga

SEQ ID NO: 313768 - DNA, 25 bp, Mus musculus
aggactcgcaggcaaaccgctgtcg

SEQ ID NO: 313769 - DNA, 25 bp, Mus musculus
tcgtctggacaaccgatttagggcc

SEQ ID NO: 313770 - DNA, 25 bp, Mus musculus
ggcgagtcttccgtcgtctggacaa

SEQ ID NO: 313771 - DNA, 25 bp, Mus musculus
aagacctgcaggctccctaatagcc

SEQ ID NO: 313772 - DNA, 25 bp, Mus musculus
gtagggcaggactcgcaggcaaacc

SEQ ID NO: 313773 - DNA, 25 bp, Mus musculus
agtcgtcgtcgaaatccttgaagtc

SEQ ID NO: 313774 - DNA, 25 bp, Mus musculus
cccacgaaaatcttgcggtagttca

SEQ ID NO: 313775 - DNA, 25 bp, Mus musculus
gtgaccttgtccctgcagatgcgga

SEQ ID NO: 313776 - DNA, 25 bp, Mus musculus
ttgacatatgcgtagcccagagagc

SEQ ID NO: 313777 - DNA, 25 bp, Mus musculus
ccaccggttgctggtagttgacata

SEQ ID NO: 313778 - DNA, 25 bp, Mus musculus
acgtcaaagttcatggtctccaggg

SEQ ID NO: 313779 - DNA, 25 bp, Mus musculus
cactggccggccattgataacgtca

SEQ ID NO: 313780 - DNA, 25 bp, Mus musculus
ctctgggaccacatgatgcgcactg

SEQ ID NO: 313781 - DNA, 25 bp, Mus musculus
atggtcttgcccaggttcttgatga

SEQ ID NO: 313782 - DNA, 25 bp, Mus musculus
cagcgccttgttgtcgatggtcttg

SEQ ID NO: 313783 - DNA, 25 bp, Mus musculus
ccgagaagatgttgtacagcgcctt

SEQ ID NO: 313784 - DNA, 25 bp, Mus musculus
gaagtgcacgaacccatagcccttg

SEQ ID NO: 313785 - DNA, 25 bp, Mus musculus
tcggccgactcctgcttctggaagt

SEQ ID NO: 313786 - DNA, 25 bp, Mus musculus
tcacaggccaccttgcaggacagga

SEQ ID NO: 313787 - DNA, 25 bp, Mus musculus
gggaaactcacctgtattgttaaga

SEQ ID NO: 313788 - DNA, 25 bp, Mus musculus
agaaatagaaaattatgggctgatg

SEQ ID NO: 313789 - DNA, 25 bp, Mus musculus
cgctataaaaatatcatggatgatt

SEQ ID NO: 313790 - DNA, 25 bp, Mus musculus
ttcaatcgctataaaaatatcatgg

SEQ ID NO: 313791 - DNA, 25 bp, Mus musculus
atctagtaaataaattcaatcgcta

SEQ ID NO: 313792 - DNA, 25 bp, Mus musculus
acagtgctaccaaattcaatctagt

SEQ ID NO: 313793 - DNA, 25 bp, Mus musculus
gatgacagtgctaccaaattcaatc

SEQ ID NO: 313794 - DNA, 25 bp, Mus musculus
gtattgttaagatgacagtgctacc

SEQ ID NO: 313795 - DNA, 25 bp, Mus musculus
acctgtattgttaagatgacagtgc

SEQ ID NO: 313796 - DNA, 25 bp, Mus musculus
gaaactcacctgtattgttaagatg

SEQ ID NO: 313797 - DNA, 25 bp, Mus musculus
aattatgggctgatgaggtggctca

SEQ ID NO: 313798 - DNA, 25 bp, Mus musculus
tgacagtgctaccaaattcaatcta

SEQ ID NO: 313799 - DNA, 25 bp, Mus musculus
actcacctgtattgttaagatgaca

SEQ ID NO: 313800 - DNA, 25 bp, Mus musculus
ttaagatgacagtgctaccaaattc

SEQ ID NO: 313801 - DNA, 25 bp, Mus musculus
acccgcagaccggacctcgagaatt

SEQ ID NO: 313802 - DNA, 25 bp, Mus musculus
acgtccgaaacgcagtatgaagatc

SEQ ID NO: 313803 - DNA, 25 bp, Mus musculus
cggacctcgagaattccctggagtt

SEQ ID NO: 313804 - DNA, 25 bp, Mus musculus
ccctgtgtacaagagactgacgtcc

SEQ ID NO: 313805 - DNA, 25 bp, Mus musculus
agcgtacaccgaatttactccctgg

SEQ ID NO: 313806 - DNA, 25 bp, Mus musculus
agctccgcaggttcaaactcttctc

SEQ ID NO: 313807 - DNA, 25 bp, Mus musculus
ctcttctccgggagagtggcggcta

SEQ ID NO: 313808 - DNA, 25 bp, Mus musculus
attccctggagttcacctctaccgg

SEQ ID NO: 313809 - DNA, 25 bp, Mus musculus
gtgatgagcatcctgctgcccaaca

SEQ ID NO: 313810 - DNA, 25 bp, Mus musculus
ggcgcgcaagcgtacaccgaattta

SEQ ID NO: 313811 - DNA, 25 bp, Mus musculus
cccaacatggcggagttcgacacca

SEQ ID NO: 313812 - DNA, 25 bp, Mus musculus
tatgaagatcagcacccgcagaccg

SEQ ID NO: 313813 - DNA, 25 bp, Mus musculus
catggcggagttcgacaccatctcg

SEQ ID NO: 313814 - DNA, 25 bp, Mus musculus
ggtcacgtgatgagcatcctgctgc

SEQ ID NO: 313815 - DNA, 25 bp, Mus musculus
tgaggcgctacgtcgtgctccactc

SEQ ID NO: 313816 - DNA, 25 bp, Mus musculus
gcaagatccggtgaggcgctacgtc

SEQ ID NO: 313817 - DNA, 25 bp, Mus musculus
ggcgcaatctcgcaagatccggtga

SEQ ID NO: 313818 - DNA, 25 bp, Mus musculus
ttgtgtcaggcgcaatctcgcaaga

SEQ ID NO: 313819 - DNA, 25 bp, Mus musculus
gtcccaaaagtacctgcaagcgcta

SEQ ID NO: 313820 - DNA, 25 bp, Mus musculus
agccagctagacaggtggccagagc

SEQ ID NO: 313821 - DNA, 25 bp, Mus musculus
aagcgctacacacttgcgctcggcg

SEQ ID NO: 313822 - DNA, 25 bp, Mus musculus
ggcgcccttgctctgttctcacttt

SEQ ID NO: 313823 - DNA, 25 bp, Mus musculus
tgctctgttctcactttccgagata

SEQ ID NO: 313824 - DNA, 25 bp, Mus musculus
ctttccgagatatccacgcatcttg

SEQ ID NO: 313825 - DNA, 25 bp, Mus musculus
acgcatcttgagtcctgcatccact

SEQ ID NO: 313826 - DNA, 25 bp, Mus musculus
tgatggaagaagagcgtgatagcca

SEQ ID NO: 313827 - DNA, 25 bp, Mus musculus
gaagagcgtgatagccagctagaca

SEQ ID NO: 313828 - DNA, 25 bp, Mus musculus
gtcgtgctccactcggtcccaaaag

SEQ ID NO: 313829 - DNA, 25 bp, Mus musculus
gccgtatcacgcagaagccataatg

SEQ ID NO: 313830 - DNA, 25 bp, Mus musculus
actggctcgagaatagccgtatcac

SEQ ID NO: 313831 - DNA, 25 bp, Mus musculus
gcgcaacaccgcacactaatacgag

SEQ ID NO: 313832 - DNA, 25 bp, Mus musculus
gtgctcctcggtgtcctaattcttg

SEQ ID NO: 313833 - DNA, 25 bp, Mus musculus
ttatccagtccgctgtgctcctcgg

SEQ ID NO: 313834 - DNA, 25 bp, Mus musculus
cgcagcgcaattggttgcttttatc

SEQ ID NO: 313835 - DNA, 25 bp, Mus musculus
ctttagctagcgcagcgcaattggt

SEQ ID NO: 313836 - DNA, 25 bp, Mus musculus
cccgcacatataaagaaagccttta

SEQ ID NO: 313837 - DNA, 25 bp, Mus musculus
taccacaaatcaaggcgaatcccgc

SEQ ID NO: 313838 - DNA, 25 bp, Mus musculus
cccgcaaatgctaccacaaatcaag

SEQ ID NO: 313839 - DNA, 25 bp, Mus musculus
ctaatacgagcactccttggctttc

SEQ ID NO: 313840 - DNA, 25 bp, Mus musculus
gccataatggcggacgcgggctctc

SEQ ID NO: 313841 - DNA, 25 bp, Mus musculus
cttggctttctacttccggctagca

SEQ ID NO: 313842 - DNA, 25 bp, Mus musculus
ctaattcttggcgtaactggctcga

SEQ ID NO: 313843 - DNA, 25 bp, Mus musculus
agcctggacgacatcgacctgtctg

SEQ ID NO: 313844 - DNA, 25 bp, Mus musculus
gcctgtcagccgctgggtcggtcct

SEQ ID NO: 313845 - DNA, 25 bp, Mus musculus
acatcgacctgtctgccctgcgggt

SEQ ID NO: 313846 - DNA, 25 bp, Mus musculus
ggacgacatcgacctgtctgccctg

SEQ ID NO: 313847 - DNA, 25 bp, Mus musculus
tgggtcggtcctcccgctggccctc

SEQ ID NO: 313848 - DNA, 25 bp, Mus musculus
tcgcgtcacggtcggctctgcgcgt

SEQ ID NO: 313849 - DNA, 25 bp, Mus musculus
gcgcgttcgcgtcacggtcggctct

SEQ ID NO: 313850 - DNA, 25 bp, Mus musculus
tagcgagactgggtccgcgctcgcc

SEQ ID NO: 313851 - DNA, 25 bp, Mus musculus
gctctagcgagactgggtccgcgct

SEQ ID NO: 313852 - DNA, 25 bp, Mus musculus
ctccaggctctagcgagactgggtc

SEQ ID NO: 313853 - DNA, 25 bp, Mus musculus
tccactccaggctctagcgagactg

SEQ ID NO: 313854 - DNA, 25 bp, Mus musculus
ggtggtcgcgctccttccactccag

SEQ ID NO: 313855 - DNA, 25 bp, Mus musculus
gcaccagcgggtggtcgcgctcctt

SEQ ID NO: 313856 - DNA, 25 bp, Mus musculus
cgcagcctggacgacatcgacctgt

SEQ ID NO: 313857 - DNA, 25 bp, Mus musculus
actgttcggctgtgacgcatgctct

SEQ ID NO: 313858 - DNA, 25 bp, Mus musculus
cagccatttagggacagcctgacag

SEQ ID NO: 313859 - DNA, 25 bp, Mus musculus
gtcacgttgctggagcagccattta

SEQ ID NO: 313860 - DNA, 25 bp, Mus musculus
gctcagtcatctgcggaagcgaccg

SEQ ID NO: 313861 - DNA, 25 bp, Mus musculus
gaggaaccgcaagcgctcagtcatc

SEQ ID NO: 313862 - DNA, 25 bp, Mus musculus
acgcgggagcacgtgaaagatgcta

SEQ ID NO: 313863 - DNA, 25 bp, Mus musculus
ggcaccaccaggcttctgtaactta

SEQ ID NO: 313864 - DNA, 25 bp, Mus musculus
ctgtaacttataaaatggcggcgtc

SEQ ID NO: 313865 - DNA, 25 bp, Mus musculus
atggcggcgtccacatgtatacgtc

SEQ ID NO: 313866 - DNA, 25 bp, Mus musculus
catgtatacgtccttcccgggatta

SEQ ID NO: 313867 - DNA, 25 bp, Mus musculus
cttcccgggattagccaggcagcta

SEQ ID NO: 313868 - DNA, 25 bp, Mus musculus
caggcagctagaggatgacttaata

SEQ ID NO: 313869 - DNA, 25 bp, Mus musculus
tggccaattaatgaacatgccctgg

SEQ ID NO: 313870 - DNA, 25 bp, Mus musculus
tctcgcgctgtcagagagatggccg

SEQ ID NO: 313871 - DNA, 25 bp, Mus musculus
agatcttggagccagcgtgcgaaag

SEQ ID NO: 313872 - DNA, 25 bp, Mus musculus
ccttgtacctggcagcggagatctt

SEQ ID NO: 313873 - DNA, 25 bp, Mus musculus
ccactatgaagagcgcaagggcacg

SEQ ID NO: 313874 - DNA, 25 bp, Mus musculus
tgggcccactatgaagagcgcaagg

SEQ ID NO: 313875 - DNA, 25 bp, Mus musculus
tgcatgggcccactatgaagagcgc

SEQ ID NO: 313876 - DNA, 25 bp, Mus musculus
ctgattgatatgcatgggcccacta

SEQ ID NO: 313877 - DNA, 25 bp, Mus musculus
tgactgcgttcactgattgatatgc

SEQ ID NO: 313878 - DNA, 25 bp, Mus musculus
cccattgactgcgttcactgattga

SEQ ID NO: 313879 - DNA, 25 bp, Mus musculus
cagttccctcgcaagaaggaagttt

SEQ ID NO: 313880 - DNA, 25 bp, Mus musculus
aggcctagttgtgctcatggtgcgc

SEQ ID NO: 313881 - DNA, 25 bp, Mus musculus
acgccaaggcctagttgtgctcatg

SEQ ID NO: 313882 - DNA, 25 bp, Mus musculus
caggtgcacgccaaggcctagttgt

SEQ ID NO: 313883 - DNA, 25 bp, Mus musculus
agcttcaggcgcagtggagcatgtc

SEQ ID NO: 313884 - DNA, 25 bp, Mus musculus
cttggagccagcgtgcgaaagatgc

SEQ ID NO: 313885 - DNA, 25 bp, Mus musculus
ccttacacgcgcgtgtgaggcgagc

SEQ ID NO: 313886 - DNA, 25 bp, Mus musculus
acatttcccgagaggccgtagacgc

SEQ ID NO: 313887 - DNA, 25 bp, Mus musculus
tgccacccgcgctagcgcgcgaggc

SEQ ID NO: 313888 - DNA, 25 bp, Mus musculus
ccggaaatggatcctagcccttaca

SEQ ID NO: 313889 - DNA, 25 bp, Mus musculus
agaggccgtagacgcgatgtcaccc

SEQ ID NO: 313890 - DNA, 25 bp, Mus musculus
ggatcctagcccttacacgcgcgtg

SEQ ID NO: 313891 - DNA, 25 bp, Mus musculus
tgacactacatttcccgagaggccg

SEQ ID NO: 313892 - DNA, 25 bp, Mus musculus
ccgcgtactacctgacactacattt

SEQ ID NO: 313893 - DNA, 25 bp, Mus musculus
acgtgctggctcagcccgcgtacta

SEQ ID NO: 313894 - DNA, 25 bp, Mus musculus
aagcttccttcaggcggcggacgcg

SEQ ID NO: 313895 - DNA, 25 bp, Mus musculus
aaagaagcttccttcaggcggcgga

SEQ ID NO: 313896 - DNA, 25 bp, Mus musculus
ggcgcgggaaaagaagcttccttca

SEQ ID NO: 313897 - DNA, 25 bp, Mus musculus
cgaggcgcgggaaaagaagcttcct

SEQ ID NO: 313898 - DNA, 25 bp, Mus musculus
agacgcgatgtcacccggaaatgga

SEQ ID NO: 313899 - DNA, 25 bp, Mus musculus
gtggcagcagcgatgacttaacggc

SEQ ID NO: 313900 - DNA, 25 bp, Mus musculus
gctgtgctgcaacgcatgcgccgcg

SEQ ID NO: 313901 - DNA, 25 bp, Mus musculus
agcgctgcgctgtgctgcaacgcat

SEQ ID NO: 313902 - DNA, 25 bp, Mus musculus
agcctctccaggagcgctgcgctgt

SEQ ID NO: 313903 - DNA, 25 bp, Mus musculus
cggatgccacgaacccacagcctct

SEQ ID NO: 313904 - DNA, 25 bp, Mus musculus
aacctgctatacttgcggccgcggc

SEQ ID NO: 313905 - DNA, 25 bp, Mus musculus
aggtacgaaacctgctatacttgcg

SEQ ID NO: 313906 - DNA, 25 bp, Mus musculus
cggcgatgaacaccaggtacgaaac

SEQ ID NO: 313907 - DNA, 25 bp, Mus musculus
cagcgatgacttaacggcgatgaac

SEQ ID NO: 313908 - DNA, 25 bp, Mus musculus
ttaaaattcttacggcaggcagtgc

SEQ ID NO: 313909 - DNA, 25 bp, Mus musculus
gcgagtgtcgcagttaaaattctta

SEQ ID NO: 313910 - DNA, 25 bp, Mus musculus
acctcctgctgaagcgagtgtcgca

SEQ ID NO: 313911 - DNA, 25 bp, Mus musculus
cctttacctcctgctgaagcgagtg

SEQ ID NO: 313912 - DNA, 25 bp, Mus musculus
acttaacggcgatgaacaccaggta

SEQ ID NO: 313913 - DNA, 25 bp, Mus musculus
ggccacttgccattccagctcagga

SEQ ID NO: 313914 - DNA, 25 bp, Mus musculus
cgcacagaaggttcaccggtacctt

SEQ ID NO: 313915 - DNA, 25 bp, Mus musculus
ggtacctttttcaggccacttgcca

SEQ ID NO: 313916 - DNA, 25 bp, Mus musculus
tcggcgcacagaaggttcaccggta

SEQ ID NO: 313917 - DNA, 25 bp, Mus musculus
cgctggagcacgtcggcgcacagaa

SEQ ID NO: 313918 - DNA, 25 bp, Mus musculus
accaggaggagtgagcccgagcatc

SEQ ID NO: 313919 - DNA, 25 bp, Mus musculus
tcctccaatccgaaagcgggagcgg

SEQ ID NO: 313920 - DNA, 25 bp, Mus musculus
tgagttcctccaatccgaaagcggg

SEQ ID NO: 313921 - DNA, 25 bp, Mus musculus
cctggcagaaaggaagccgtggtcc

SEQ ID NO: 313922 - DNA, 25 bp, Mus musculus
ctggagacctacctggcagaaagga

SEQ ID NO: 313923 - DNA, 25 bp, Mus musculus
gcgcacactactggagacctacctg

SEQ ID NO: 313924 - DNA, 25 bp, Mus musculus
gaaccgcgcgcacactactggagac

SEQ ID NO: 313925 - DNA, 25 bp, Mus musculus
cccgcaggccagcttaaggatggga

SEQ ID NO: 313926 - DNA, 25 bp, Mus musculus
cgggctagcagctgagttcctccaa

SEQ ID NO: 313927 - DNA, 25 bp, Mus musculus
cagcaggaaaccgacgctgaggcgc

SEQ ID NO: 313928 - DNA, 25 bp, Mus musculus
cagaggagagcaatgggctaatttt

SEQ ID NO: 313929 - DNA, 25 bp, Mus musculus
ctccaacacttgtcagaggagagca

SEQ ID NO: 313930 - DNA, 25 bp, Mus musculus
tccgactgggactcagcaggaaacc

SEQ ID NO: 313931 - DNA, 25 bp, Mus musculus
ccctcgagcgcacgcgacaggtggt

SEQ ID NO: 313932 - DNA, 25 bp, Mus musculus
gctactggccactgagggaacgcac

SEQ ID NO: 313933 - DNA, 25 bp, Mus musculus
aacgtgcagccctggctctgtgcta

SEQ ID NO: 313934 - DNA, 25 bp, Mus musculus
tgtcacagagcaacgtgcagccctg

SEQ ID NO: 313935 - DNA, 25 bp, Mus musculus
ctcaggggcgatgtcacagagcaac

SEQ ID NO: 313936 - DNA, 25 bp, Mus musculus
cacaactagatggtcccagggtgca

SEQ ID NO: 313937 - DNA, 25 bp, Mus musculus
ctgcgctgcctgcacaactagatgg

SEQ ID NO: 313938 - DNA, 25 bp, Mus musculus
cgcctcccgttttgcccgagactag

SEQ ID NO: 313939 - DNA, 25 bp, Mus musculus
cgagcagccggagtcaatgtcccgc

SEQ ID NO: 313940 - DNA, 25 bp, Mus musculus
ggctaattttatccgactgggactc

SEQ ID NO: 313941 - DNA, 25 bp, Mus musculus
gggaacctcttagtaagaagcactg

SEQ ID NO: 313942 - DNA, 25 bp, Mus musculus
ccgggcaagagacccgcctctagaa

SEQ ID NO: 313943 - DNA, 25 bp, Mus musculus
gggacctccgctgcgctactgtgct

SEQ ID NO: 313944 - DNA, 25 bp, Mus musculus
agggaactcaactgggctccgccgc

SEQ ID NO: 313945 - DNA, 25 bp, Mus musculus
acttacacggtgtttcggccaggag

SEQ ID NO: 313946 - DNA, 25 bp, Mus musculus
tgcccgtaccttcacttacacggtg

SEQ ID NO: 313947 - DNA, 25 bp, Mus musculus
catcccatttctcggggtgcccgta

SEQ ID NO: 313948 - DNA, 25 bp, Mus musculus
caactcgggccattttgagggccgc

SEQ ID NO: 313949 - DNA, 25 bp, Mus musculus
gcggctggccaactcgggccatttt

SEQ ID NO: 313950 - DNA, 25 bp, Mus musculus
atggcagcggcgactacgccacgga

SEQ ID NO: 313951 - DNA, 25 bp, Mus musculus
cgccacccaactaaaatggcagcgg

SEQ ID NO: 313952 - DNA, 25 bp, Mus musculus
ccggcgttcgttcttagctcgggag

SEQ ID NO: 313953 - DNA, 25 bp, Mus musculus
gtaagaagcactggagccatcctca

SEQ ID NO: 313954 - DNA, 25 bp, Mus musculus
aagagacccgcctctagaacagcgc

SEQ ID NO: 313955 - DNA, 25 bp, Mus musculus
cgccttcgcacctctgcagcttcgg

SEQ ID NO: 313956 - DNA, 25 bp, Mus musculus
gcacacaggcctttcctagattgca

SEQ ID NO: 313957 - DNA, 25 bp, Mus musculus
caggcctttcctagattgcagcgca

SEQ ID NO: 313958 - DNA, 25 bp, Mus musculus
ctaacttctcgtcggtcgccagcgg

SEQ ID NO: 313959 - DNA, 25 bp, Mus musculus
agacagcacccgcacgccattcgca

SEQ ID NO: 313960 - DNA, 25 bp, Mus musculus
cgcacgtcgctggtgggtccttgct

SEQ ID NO: 313961 - DNA, 25 bp, Mus musculus
tgggtccttgctgccggcgtcccga

SEQ ID NO: 313962 - DNA, 25 bp, Mus musculus
cccgagctgggacggtcgcagtcaa

SEQ ID NO: 313963 - DNA, 25 bp, Mus musculus
tcgcagtcaaggctgggctgccgcc

SEQ ID NO: 313964 - DNA, 25 bp, Mus musculus
cgccgtcgccggagctgctagagct

SEQ ID NO: 313965 - DNA, 25 bp, Mus musculus
gtctcctctgcctctgctccatgcg

SEQ ID NO: 313966 - DNA, 25 bp, Mus musculus
tgcatggcagcgctcagactcacct

SEQ ID NO: 313967 - DNA, 25 bp, Mus musculus
gccgcgtgcctacgttttcccgctc

SEQ ID NO: 313968 - DNA, 25 bp, Mus musculus
ttcctagattgcagcgcacgctcgg

SEQ ID NO: 313969 - DNA, 25 bp, Mus musculus
gcctgagggtaacggctatgagaaa

SEQ ID NO: 313970 - DNA, 25 bp, Mus musculus
gaggagcaacagcagtgacaaaccc

SEQ ID NO: 313971 - DNA, 25 bp, Mus musculus
gcaacagcagtgacaaaccctctgg

SEQ ID NO: 313972 - DNA, 25 bp, Mus musculus
agacgctagctcctaatccgcgagg

SEQ ID NO: 313973 - DNA, 25 bp, Mus musculus
agcagtgacaaaccctctggcagcc

SEQ ID NO: 313974 - DNA, 25 bp, Mus musculus
acgctagctcctaatccgcgagggg

SEQ ID NO: 313975 - DNA, 25 bp, Mus musculus
ggggggcagcgactaatcaaacgac

SEQ ID NO: 313976 - DNA, 25 bp, Mus musculus
atcaaacgacggctgcaaacgcttc

SEQ ID NO: 313977 - DNA, 25 bp, Mus musculus
acgacggctgcaaacgcttcacgga

SEQ ID NO: 313978 - DNA, 25 bp, Mus musculus
gacggctgcaaacgcttcacggaga

SEQ ID NO: 313979 - DNA, 25 bp, Mus musculus
gctgcaaacgcttcacggagactga

SEQ ID NO: 313980 - DNA, 25 bp, Mus musculus
gcaaacgcttcacggagactgaacc

SEQ ID NO: 313981 - DNA, 25 bp, Mus musculus
ctctcgcttcctcccaggggcaccg

SEQ ID NO: 313982 - DNA, 25 bp, Mus musculus
ggcgggagacgctagctcctaatcc

SEQ ID NO: 313983 - DNA, 25 bp, Mus musculus
ccgaatgcttgtgcttttcgaaagc

SEQ ID NO: 313984 - DNA, 25 bp, Mus musculus
acacacctgggacagccgagcgctt

SEQ ID NO: 313985 - DNA, 25 bp, Mus musculus
cccgggtcagaactgccgaatgctt

SEQ ID NO: 313986 - DNA, 25 bp, Mus musculus
tgccgcggctttcattgctttctcc

SEQ ID NO: 313987 - DNA, 25 bp, Mus musculus
cgcgctgggacgaactccatcgcgg

SEQ ID NO: 313988 - DNA, 25 bp, Mus musculus
cttttcgaaagcgaccgccgcggct

SEQ ID NO: 313989 - DNA, 25 bp, Mus musculus
gcctgagccgcacatggagactaga

SEQ ID NO: 313990 - DNA, 25 bp, Mus musculus
tgtatcgcgagcagcgccatcttga

SEQ ID NO: 313991 - DNA, 25 bp, Mus musculus
ccaggaatgtatcgcgagcagcgcc

SEQ ID NO: 313992 - DNA, 25 bp, Mus musculus
ctgcccagcgccaggaatgtatcgc

SEQ ID NO: 313993 - DNA, 25 bp, Mus musculus
tgagtgccgcggctttcattgcttt

SEQ ID NO: 313994 - DNA, 25 bp, Mus musculus
cagcgccatcttgagcgaggaaaaa

SEQ ID NO: 313995 - DNA, 25 bp, Mus musculus
cacatggagactagagcccgggtca

SEQ ID NO: 313996 - DNA, 25 bp, Mus musculus
gacgaactccatcgcgggcctgagc

SEQ ID NO: 313997 - DNA, 25 bp, Mus musculus
acgcggcagcagctctaataaaatc

SEQ ID NO: 313998 - DNA, 25 bp, Mus musculus
tctaataaaatctgcagccggggca

SEQ ID NO: 313999 - DNA, 25 bp, Mus musculus
agagaggttccaagcccgcttccca

SEQ ID NO: 314000 - DNA, 25 bp, Mus musculus
gggcagtactttctccaaccagcgc

SEQ ID NO: 314001 - DNA, 25 bp, Mus musculus
gttggcgtcctcaaagatacgttga

SEQ ID NO: 314002 - DNA, 25 bp, Mus musculus
tcgctccgcggctttttcaagatga

SEQ ID NO: 314003 - DNA, 25 bp, Mus musculus
tgtagcatgagtcgttggcgtcctc

SEQ ID NO: 314004 - DNA, 25 bp, Mus musculus
ttcaagatgagctcctccgctctga

SEQ ID NO: 314005 - DNA, 25 bp, Mus musculus
tctgaccctcaaacacgagttcgct

SEQ ID NO: 314006 - DNA, 25 bp, Mus musculus
gtccaagttccgtgccgatgcctct

SEQ ID NO: 314007 - DNA, 25 bp, Mus musculus
gagcagtgcttaccggtccaagttc

SEQ ID NO: 314008 - DNA, 25 bp, Mus musculus
gcctttgacccaagagcagtgctta

SEQ ID NO: 314009 - DNA, 25 bp, Mus musculus
acggcgagtgtatgcctttgaccca

SEQ ID NO: 314010 - DNA, 25 bp, Mus musculus
ccgctctgagcagaatgcccacaga

SEQ ID NO: 314011 - DNA, 25 bp, Mus musculus
cgctgctatggctaagctgactctc

SEQ ID NO: 314012 - DNA, 25 bp, Mus musculus
tgtcacaatcggcaagtaaactcta

SEQ ID NO: 314013 - DNA, 25 bp, Mus musculus
acgcccattctagcgtgctttcgga

SEQ ID NO: 314014 - DNA, 25 bp, Mus musculus
cgtgctttcggagcgggactctccg

SEQ ID NO: 314015 - DNA, 25 bp, Mus musculus
ccgtgtatggcctcggagttacagc

SEQ ID NO: 314016 - DNA, 25 bp, Mus musculus
ggactccatgccctgtcacaatcgg

SEQ ID NO: 314017 - DNA, 25 bp, Mus musculus
gtaaactctacttctagcccaagtc

SEQ ID NO: 314018 - DNA, 25 bp, Mus musculus
agcccaagtcccgagcatctgctag

SEQ ID NO: 314019 - DNA, 25 bp, Mus musculus
ccgagcatctgctagccgaggaccg

SEQ ID NO: 314020 - DNA, 25 bp, Mus musculus
atctgctagccgaggaccgggtcct

SEQ ID NO: 314021 - DNA, 25 bp, Mus musculus
gtcctggatcatgcagaggaaaata

SEQ ID NO: 314022 - DNA, 25 bp, Mus musculus
tgcagaggaaaataacgctgctatg

SEQ ID NO: 314023 - DNA, 25 bp, Mus musculus
gctatggctaagctgactctcctcc

SEQ ID NO: 314024 - DNA, 25 bp, Mus musculus
gagttacagcgtccggactccatgc

SEQ ID NO: 314025 - DNA, 25 bp, Mus musculus
cgacgaggacaataacgagcactgg

SEQ ID NO: 314026 - DNA, 25 bp, Mus musculus
cgctgtgcggcgctccactgcttag

SEQ ID NO: 314027 - DNA, 25 bp, Mus musculus
cgctgccacctgtggggctgcactg

SEQ ID NO: 314028 - DNA, 25 bp, Mus musculus
tggcgggaaccgtcctcgagccgct

SEQ ID NO: 314029 - DNA, 25 bp, Mus musculus
ttagcctggcgggaaccgtcctcga

SEQ ID NO: 314030 - DNA, 25 bp, Mus musculus
cactgcttagcctggcgggaaccgt

SEQ ID NO: 314031 - DNA, 25 bp, Mus musculus
gctccactgcttagcctggcgggaa

SEQ ID NO: 314032 - DNA, 25 bp, Mus musculus
atcgaccgagcaggcctgctggcgc

SEQ ID NO: 314033 - DNA, 25 bp, Mus musculus
cgaagatcgaccgagcaggcctgct

SEQ ID NO: 314034 - DNA, 25 bp, Mus musculus
ccgcatcttcggctcgaagatcgac

SEQ ID NO: 314035 - DNA, 25 bp, Mus musculus
agtacccggcggcagcaccgcaacc

SEQ ID NO: 314036 - DNA, 25 bp, Mus musculus
tggcacccaggacagtacccggcgg

SEQ ID NO: 314037 - DNA, 25 bp, Mus musculus
ggacaataacgagcactggcaccca

SEQ ID NO: 314038 - DNA, 25 bp, Mus musculus
acgagcactggcacccaggacagta

SEQ ID NO: 314039 - DNA, 25 bp, Mus musculus
tcaccctggctgttgctgtaatcgg

SEQ ID NO: 314040 - DNA, 25 bp, Mus musculus
ctgtaatcggcggtagtctctgcgc

SEQ ID NO: 314041 - DNA, 25 bp, Mus musculus
ctggctccctgtggatcgtttggaa

SEQ ID NO: 314042 - DNA, 25 bp, Mus musculus
tctctgcgctgctttggcgcgcatt

SEQ ID NO: 314043 - DNA, 25 bp, Mus musculus
ttggcgcgcattctggcttaccaga

SEQ ID NO: 314044 - DNA, 25 bp, Mus musculus
accagagacatggttccaggagaca

SEQ ID NO: 314045 - DNA, 25 bp, Mus musculus
tccaggagacaggaacgcgaacgcg

SEQ ID NO: 314046 - DNA, 25 bp, Mus musculus
ttagtagcctgcatttcaccctggc

SEQ ID NO: 314047 - DNA, 25 bp, Mus musculus
cccggaggcattagtagcctgcatt

SEQ ID NO: 314048 - DNA, 25 bp, Mus musculus
atcgtttggaatctcagggccctgg

SEQ ID NO: 314049 - DNA, 25 bp, Mus musculus
cccaaacgtcgggactgctcgtcga

SEQ ID NO: 314050 - DNA, 25 bp, Mus musculus
gaacctcgatgtcactcgggtcccg

SEQ ID NO: 314051 - DNA, 25 bp, Mus musculus
ctgctcgtcgatgagaacctcgatg

SEQ ID NO: 314052 - DNA, 25 bp, Mus musculus
acagcctgggaagcgctggctccct

SEQ ID NO: 314053 - DNA, 25 bp, Mus musculus
ttccgggacgagaaagccgcactta

SEQ ID NO: 314054 - DNA, 25 bp, Mus musculus
gccgcacttacctagcggcgacatg

SEQ ID NO: 314055 - DNA, 25 bp, Mus musculus
actggtctctgtttccgccctattg

SEQ ID NO: 314056 - DNA, 25 bp, Mus musculus
tacctagcggcgacatggatgctgc

SEQ ID NO: 314057 - DNA, 25 bp, Mus musculus
gttaactgtgaaagcagcgcgcgca

SEQ ID NO: 314058 - DNA, 25 bp, Mus musculus
cagacggagaaactggtctctgttt

SEQ ID NO: 314059 - DNA, 25 bp, Mus musculus
taaggcggagccaccgcttcctctg

SEQ ID NO: 314060 - DNA, 25 bp, Mus musculus
ccggataaggcggagccaccgcttc

SEQ ID NO: 314061 - DNA, 25 bp, Mus musculus
cgcgcaacaggtcacttccgggacg

SEQ ID NO: 314062 - DNA, 25 bp, Mus musculus
atgctgccggcgaaagcgaagagcc

SEQ ID NO: 314063 - DNA, 25 bp, Mus musculus
aagcagcgcgcgcaacaggtcactt

SEQ ID NO: 314064 - DNA, 25 bp, Mus musculus
gccctattgctttcagttaactgtg

SEQ ID NO: 314065 - DNA, 25 bp, Mus musculus
gtttccgccctattgctttcagtta

SEQ ID NO: 314066 - DNA, 25 bp, Mus musculus
cgacatggatgctgccggcgaaagc

SEQ ID NO: 314067 - DNA, 25 bp, Mus musculus
gaccgggtatcaacgagccctactc

SEQ ID NO: 314068 - DNA, 25 bp, Mus musculus
aggcagttcatcatttcccaggggc

SEQ ID NO: 314069 - DNA, 25 bp, Mus musculus
ggtgccgcccactgactctaatgga

SEQ ID NO: 314070 - DNA, 25 bp, Mus musculus
ctccgctttggaggaacccgacatc

SEQ ID NO: 314071 - DNA, 25 bp, Mus musculus
agctcctgggtgtcgcccatcataa

SEQ ID NO: 314072 - DNA, 25 bp, Mus musculus
ctggtaagccagaattcgcgccgcc

SEQ ID NO: 314073 - DNA, 25 bp, Mus musculus
gcagggctgaacaccgctatgtcaa

SEQ ID NO: 314074 - DNA, 25 bp, Mus musculus
atgagcatctccctgtctcagaagg

SEQ ID NO: 314075 - DNA, 25 bp, Mus musculus
tggccatctctgagcagcgtcactc

SEQ ID NO: 314076 - DNA, 25 bp, Mus musculus
ccttctctgaggaatcgggcatttc

SEQ ID NO: 314077 - DNA, 25 bp, Mus musculus
ttatgtcgcccaacatctcggaggg

SEQ ID NO: 314078 - DNA, 25 bp, Mus musculus
ctactccgttagtgaggacccaagc

SEQ ID NO: 314079 - DNA, 25 bp, Mus musculus
ctctaatggactgggcatcaacctg

SEQ ID NO: 314080 - DNA, 25 bp, Mus musculus
gggcctgtcagtgtcagcttccaca

SEQ ID NO: 314081 - DNA, 25 bp, Mus musculus
agtggcccgaggacgtaaattcctg

SEQ ID NO: 314082 - DNA, 25 bp, Mus musculus
gcccggctgcaccttgggccattag

SEQ ID NO: 314083 - DNA, 25 bp, Mus musculus
tgttgactcccaggctcagaaaatg

SEQ ID NO: 314084 - DNA, 25 bp, Mus musculus
tcatgggccttgcatgtccaagttc

SEQ ID NO: 314085 - DNA, 25 bp, Mus musculus
aggccgagctctctctggcttctca

SEQ ID NO: 314086 - DNA, 25 bp, Mus musculus
cctctttctactgctcttggtgtga

SEQ ID NO: 314087 - DNA, 25 bp, Mus musculus
agaagactctggctggggcatagca

SEQ ID NO: 314088 - DNA, 25 bp, Mus musculus
tcaaaatggtggctttggtcaggcc

SEQ ID NO: 314089 - DNA, 25 bp, Mus musculus
ctgttgacgcagttctcggccagca

SEQ ID NO: 314090 - DNA, 25 bp, Mus musculus
tgcctctgggatcaggaccaccatc

SEQ ID NO: 314091 - DNA, 25 bp, Mus musculus
gatgcactgctcctacgaccgaaag

SEQ ID NO: 314092 - DNA, 25 bp, Mus musculus
gaccgctgatgcactgctccgagga

SEQ ID NO: 314093 - DNA, 25 bp, Mus musculus
acctcgtggtactgctgggagcaac

SEQ ID NO: 314094 - DNA, 25 bp, Mus musculus
gacgtaaattccagcctgtgcactg

SEQ ID NO: 314095 - DNA, 25 bp, Mus musculus
ctcctagggccgtctttatgggcca

SEQ ID NO: 314096 - DNA, 25 bp, Mus musculus
tcggaaccgtgcgagccagaagaag

SEQ ID NO: 314097 - DNA, 25 bp, Mus musculus
gctcctgttgtgtcgcaggcacacg

SEQ ID NO: 314098 - DNA, 25 bp, Mus musculus
ggcggcccgcaatcgggactgcttc

SEQ ID NO: 314099 - DNA, 25 bp, Mus musculus
tttatgggccaccttctctcgaagg

SEQ ID NO: 314100 - DNA, 25 bp, Mus musculus
gttctcttgggctcgccctcctagg

SEQ ID NO: 314101 - DNA, 25 bp, Mus musculus
gcgggcctctatcccgttctcttgg

SEQ ID NO: 314102 - DNA, 25 bp, Mus musculus
ggcccgaagtatgtagcccgcctgc

SEQ ID NO: 314103 - DNA, 25 bp, Mus musculus
gggctcagctttctccaggcttctg

SEQ ID NO: 314104 - DNA, 25 bp, Mus musculus
agaggcctagcgacccgactcgctg

SEQ ID NO: 314105 - DNA, 25 bp, Mus musculus
ctgccagagcggaccaagaggccta

SEQ ID NO: 314106 - DNA, 25 bp, Mus musculus
cggagctgcagataaagtggtctga

SEQ ID NO: 314107 - DNA, 25 bp, Mus musculus
cacacgcgccgttggcggagctgca

SEQ ID NO: 314108 - DNA, 25 bp, Mus musculus
tctctcgaaggagcctcggaaccgt

SEQ ID NO: 314109 - DNA, 25 bp, Mus musculus
atgcccgggccaccctttgcgagcc

SEQ ID NO: 314110 - DNA, 25 bp, Mus musculus
ctttgcgagccaccgcagctgtcct

SEQ ID NO: 314111 - DNA, 25 bp, Mus musculus
ctgccagcgccttcagtggctgcga

SEQ ID NO: 314112 - DNA, 25 bp, Mus musculus
cagcgccttcagtggctgcgagcgc

SEQ ID NO: 314113 - DNA, 25 bp, Mus musculus
ggtcccggggccaccagagtacaga

SEQ ID NO: 314114 - DNA, 25 bp, Mus musculus
acggtgccctgcatccacaaagcaa

SEQ ID NO: 314115 - DNA, 25 bp, Mus musculus
aaccagccagctctagcggcgggca

SEQ ID NO: 314116 - DNA, 25 bp, Mus musculus
ccagagtacagagacgcagccgcca

SEQ ID NO: 314117 - DNA, 25 bp, Mus musculus
gcagctgtgcctggccacttttcca

SEQ ID NO: 314118 - DNA, 25 bp, Mus musculus
actcgctcgggtcgcgcagctgtgc

SEQ ID NO: 314119 - DNA, 25 bp, Mus musculus
aaagaagatcccactcgctcgggtc

SEQ ID NO: 314120 - DNA, 25 bp, Mus musculus
cgctccaggccatgcacaaagaaga

SEQ ID NO: 314121 - DNA, 25 bp, Mus musculus
cgcgctccaggccatgcacaaagaa

SEQ ID NO: 314122 - DNA, 25 bp, Mus musculus
ggccacttttccaccgccagcacgg

SEQ ID NO: 314123 - DNA, 25 bp, Mus musculus
tttcctgaacgagcgcctgggccag

SEQ ID NO: 314124 - DNA, 25 bp, Mus musculus
gactgggacctgcacggcttctcct

SEQ ID NO: 314125 - DNA, 25 bp, Mus musculus
ttcgcccacctgaaggggatcctgc

SEQ ID NO: 314126 - DNA, 25 bp, Mus musculus
ccgccgctgagaagttctttggacg

SEQ ID NO: 314127 - DNA, 25 bp, Mus musculus
gaccacagccgcttcggtgaggacc

SEQ ID NO: 314128 - DNA, 25 bp, Mus musculus
tcctctctggggaacgtgcccttag

SEQ ID NO: 314129 - DNA, 25 bp, Mus musculus
tctttggacgcgaacagacgtgtgc

SEQ ID NO: 314130 - DNA, 25 bp, Mus musculus
cacttttatctgacggggatccggc

SEQ ID NO: 314131 - DNA, 25 bp, Mus musculus
agccgaagtcctcgactaggaggca

SEQ ID NO: 314132 - DNA, 25 bp, Mus musculus
agtcttaagggtggcagacccgtcg

SEQ ID NO: 314133 - DNA, 25 bp, Mus musculus
gcgtctttgcctccttggactggga

SEQ ID NO: 314134 - DNA, 25 bp, Mus musculus
gtcgcgactgatcgcccagagcagg

SEQ ID NO: 314135 - DNA, 25 bp, Mus musculus
agagcaggagcctccacgggccagc

SEQ ID NO: 314136 - DNA, 25 bp, Mus musculus
tgagagcccatcgtcgggtctccga

SEQ ID NO: 314137 - DNA, 25 bp, Mus musculus
tgggctctcttctacctttgcaata

SEQ ID NO: 314138 - DNA, 25 bp, Mus musculus
agcacgatctaactacttcacggaa

SEQ ID NO: 314139 - DNA, 25 bp, Mus musculus
ttcacggaacgtgtcccaaaccgca

SEQ ID NO: 314140 - DNA, 25 bp, Mus musculus
ttctcctgcaaagtcgtcggccgct

SEQ ID NO: 314141 - DNA, 25 bp, Mus musculus
cgtcggccgctgttctcagaaagca

SEQ ID NO: 314142 - DNA, 25 bp, Mus musculus
tcagaaagcaaaagcccgcattggg

SEQ ID NO: 314143 - DNA, 25 bp, Mus musculus
cgaccattggggttcgctagttcca

SEQ ID NO: 314144 - DNA, 25 bp, Mus musculus
ggacttccagtggaggcgaccattg

SEQ ID NO: 314145 - DNA, 25 bp, Mus musculus
tcacctagagggaaaacgatgccgc

SEQ ID NO: 314146 - DNA, 25 bp, Mus musculus
gggcacctagcgcacgtctttgcaa

SEQ ID NO: 314147 - DNA, 25 bp, Mus musculus
gcttgcgttttacctcatgggctca

SEQ ID NO: 314148 - DNA, 25 bp, Mus musculus
cagcggtcatgtttttggctcggac

SEQ ID NO: 314149 - DNA, 25 bp, Mus musculus
aggcaccttctagaggtaccttccg

SEQ ID NO: 314150 - DNA, 25 bp, Mus musculus
cccgagattcgaaagactgaccgca

SEQ ID NO: 314151 - DNA, 25 bp, Mus musculus
caaatctggctccagctggaagctg

SEQ ID NO: 314152 - DNA, 25 bp, Mus musculus
tggcaagcactctcgcgatactttg

SEQ ID NO: 314153 - DNA, 25 bp, Mus musculus
tactttgaacgtaccgtggcggcca

SEQ ID NO: 314154 - DNA, 25 bp, Mus musculus
gctatgaggcctctcgcgatatatt

SEQ ID NO: 314155 - DNA, 25 bp, Mus musculus
tttgggtcccgtgcacgtacagccc

SEQ ID NO: 314156 - DNA, 25 bp, Mus musculus
atcagccgagttcgggctatgaggc

SEQ ID NO: 314157 - DNA, 25 bp, Mus musculus
cccttgatggccctcggctttgggt

SEQ ID NO: 314158 - DNA, 25 bp, Mus musculus
cctcgcgagagcaagtgaatcagcc

SEQ ID NO: 314159 - DNA, 25 bp, Mus musculus
aagcttgtttgaaaacctcgcgaga

SEQ ID NO: 314160 - DNA, 25 bp, Mus musculus
cgcgatatatttcagcggcgaaagg

SEQ ID NO: 314161 - DNA, 25 bp, Mus musculus
aataaggcggggctaagatgcacga

SEQ ID NO: 314162 - DNA, 25 bp, Mus musculus
caaggtgacaccagcgcgcaacagg

SEQ ID NO: 314163 - DNA, 25 bp, Mus musculus
ctccgacaggcaaatctggctccag

SEQ ID NO: 314164 - DNA, 25 bp, Mus musculus
gtggccgatttaggaagctacccta

SEQ ID NO: 314165 - DNA, 25 bp, Mus musculus
aggctgcacccttttcctacgtgta

SEQ ID NO: 314166 - DNA, 25 bp, Mus musculus
ccgaaggaaccttggaaacgagcag

SEQ ID NO: 314167 - DNA, 25 bp, Mus musculus
ccttctttctttgggcagaggccga

SEQ ID NO: 314168 - DNA, 25 bp, Mus musculus
tcctacgtgtaaagacatcgcgctc

SEQ ID NO: 314169 - DNA, 25 bp, Mus musculus
ttattggtccgctgaaaaggctgca

SEQ ID NO: 314170 - DNA, 25 bp, Mus musculus
taatctggaggtttcttattggtcc

SEQ ID NO: 314171 - DNA, 25 bp, Mus musculus
gggagccaatcggaaaaggataatc

SEQ ID NO: 314172 - DNA, 25 bp, Mus musculus
acgctcagcagacgcccgcttttaa

SEQ ID NO: 314173 - DNA, 25 bp, Mus musculus
ggcgaaactttcttccagcacggtc

SEQ ID NO: 314174 - DNA, 25 bp, Mus musculus
gaccagaaccaccttggcgaggcca

SEQ ID NO: 314175 - DNA, 25 bp, Mus musculus
tacacatgcgcaggtttgaaatggc

SEQ ID NO: 314176 - DNA, 25 bp, Mus musculus
aggccatgttcacgcttctctcttg

SEQ ID NO: 314177 - DNA, 25 bp, Mus musculus
tcgagaaagtccctgccgctggcag

SEQ ID NO: 314178 - DNA, 25 bp, Mus musculus
tcgcgctcagcgaacttttagtaca

SEQ ID NO: 314179 - DNA, 25 bp, Mus musculus
cagccctggaaacccaggtgagtcc

SEQ ID NO: 314180 - DNA, 25 bp, Mus musculus
tcggcccagcttccgggccctggca

SEQ ID NO: 314181 - DNA, 25 bp, Mus musculus
gcgcgtgctccctttcacgtgacgt

SEQ ID NO: 314182 - DNA, 25 bp, Mus musculus
gctgcctgcgcctagactcttctgt

SEQ ID NO: 314183 - DNA, 25 bp, Mus musculus
ctgcgcctagactcttctgtgtgtg

SEQ ID NO: 314184 - DNA, 25 bp, Mus musculus
cctagactcttctgtgtgtgcgagc

SEQ ID NO: 314185 - DNA, 25 bp, Mus musculus
actcttctgtgtgtgcgagcgcgga

SEQ ID NO: 314186 - DNA, 25 bp, Mus musculus
tcacgtgacgtggaccatttcccta

SEQ ID NO: 314187 - DNA, 25 bp, Mus musculus
gtgctggtcaatcgctgccgccctg

SEQ ID NO: 314188 - DNA, 25 bp, Mus musculus
cctggaaacccaggtgagtcccaga

SEQ ID NO: 314189 - DNA, 25 bp, Mus musculus
gtgagtcccagagcggcttcccatc

SEQ ID NO: 314190 - DNA, 25 bp, Mus musculus
tggaccatttccctagtcggcccag

SEQ ID NO: 314191 - DNA, 25 bp, Mus musculus
ctgcgtgctggtcaatcgctgccgc

SEQ ID NO: 314192 - DNA, 25 bp, Mus musculus
tgacgtggaccatttccctagtcgg

SEQ ID NO: 314193 - DNA, 25 bp, Mus musculus
tcgctttccaacaagctgactttgg

SEQ ID NO: 314194 - DNA, 25 bp, Mus musculus
ctgactttggacaagctggacgtga

SEQ ID NO: 314195 - DNA, 25 bp, Mus musculus
ctcgcgtcgtgcaggacgtgacaaa

SEQ ID NO: 314196 - DNA, 25 bp, Mus musculus
caggacgtgacaaatggaagtagca

SEQ ID NO: 314197 - DNA, 25 bp, Mus musculus
ggaagtagcacgtctcactagtctc

SEQ ID NO: 314198 - DNA, 25 bp, Mus musculus
cactagtctcgtgcagatggacagc

SEQ ID NO: 314199 - DNA, 25 bp, Mus musculus
caccgctgagcaatggaagcgggta

SEQ ID NO: 314200 - DNA, 25 bp, Mus musculus
tgctccttcgctttctgggctcaga

SEQ ID NO: 314201 - DNA, 25 bp, Mus musculus
aggcccggcattctgcacgcttcaa

SEQ ID NO: 314202 - DNA, 25 bp, Mus musculus
tgcacgcttcaaaagcgcacgtctg

SEQ ID NO: 314203 - DNA, 25 bp, Mus musculus
gcctttcgacctcacggtgttgcca

SEQ ID NO: 314204 - DNA, 25 bp, Mus musculus
gtgttgccaaaatgtcgctttccaa

SEQ ID NO: 314205 - DNA, 25 bp, Mus musculus
gcagcggccaatagcagctttgctc

SEQ ID NO: 314206 - DNA, 25 bp, Mus musculus
aagcgggtcgtgatgaggtaattcc

SEQ ID NO: 314207 - DNA, 25 bp, Mus musculus
agcgttcttgataggcgccatcttg

SEQ ID NO: 314208 - DNA, 25 bp, Mus musculus
aggcggtttccacctcggtctggct

SEQ ID NO: 314209 - DNA, 25 bp, Mus musculus
cgatgctcagcgactctgcgccatg

SEQ ID NO: 314210 - DNA, 25 bp, Mus musculus
gaggaagtcgccctagcgatgctca

SEQ ID NO: 314211 - DNA, 25 bp, Mus musculus
ccacctgtgtggacttggctacccg

SEQ ID NO: 314212 - DNA, 25 bp, Mus musculus
gaaggcggtcctagcacgcagctcc

SEQ ID NO: 314213 - DNA, 25 bp, Mus musculus
agatagagctgcaggcggtttccac

SEQ ID NO: 314214 - DNA, 25 bp, Mus musculus
ggctccattttctcttgcggctcct

SEQ ID NO: 314215 - DNA, 25 bp, Mus musculus
ggcatctctcggagcgttcttgata

SEQ ID NO: 314216 - DNA, 25 bp, Mus musculus
gcgcgcttaccaaggcatctctcgg

SEQ ID NO: 314217 - DNA, 25 bp, Mus musculus
caggtcccaatgctacggagtgcgc

SEQ ID NO: 314218 - DNA, 25 bp, Mus musculus
ctaccggctgcaaacggcgcgcgat

SEQ ID NO: 314219 - DNA, 25 bp, Mus musculus
ggctggcctgtctcacaggtcccaa

SEQ ID NO: 314220 - DNA, 25 bp, Mus musculus
gcggctcctcaacctcggagataga

SEQ ID NO: 314221 - DNA, 25 bp, Mus musculus
gctaagagaggtttcgagcggttaa

SEQ ID NO: 314222 - DNA, 25 bp, Mus musculus
ctacgtttctcaacagccctgttct

SEQ ID NO: 314223 - DNA, 25 bp, Mus musculus
acagccctgttctcttccgccttcg

SEQ ID NO: 314224 - DNA, 25 bp, Mus musculus
cgagtccgagaatcccgttcctacg

SEQ ID NO: 314225 - DNA, 25 bp, Mus musculus
tctctggtttaaaacgagtccgaga

SEQ ID NO: 314226 - DNA, 25 bp, Mus musculus
gaattacgaagttaacagtctctgg

SEQ ID NO: 314227 - DNA, 25 bp, Mus musculus
aggttcacgccatggcttctacttc

SEQ ID NO: 314228 - DNA, 25 bp, Mus musculus
ccgaggttcacgaggttcacgccat

SEQ ID NO: 314229 - DNA, 25 bp, Mus musculus
tgacctctgaattccacaaatgccc

SEQ ID NO: 314230 - DNA, 25 bp, Mus musculus
agtctgatgacctctgaattccaca

SEQ ID NO: 314231 - DNA, 25 bp, Mus musculus
ccggcatgacaagtctgatgacctc

SEQ ID NO: 314232 - DNA, 25 bp, Mus musculus
cgctcttccggcatgacaagtctga

SEQ ID NO: 314233 - DNA, 25 bp, Mus musculus
gcggttaaacgctcttccggcatga

SEQ ID NO: 314234 - DNA, 25 bp, Mus musculus
gttcctacgtttctcaacagccctg

SEQ ID NO: 314235 - DNA, 25 bp, Mus musculus
tgagtcgcttcggttaggatggctc

SEQ ID NO: 314236 - DNA, 25 bp, Mus musculus
cttttgtcaacctggacgccgctta

SEQ ID NO: 314237 - DNA, 25 bp, Mus musculus
ggcatcccaccggacttctagttct

SEQ ID NO: 314238 - DNA, 25 bp, Mus musculus
ataactgcgctaaacctggtccggc

SEQ ID NO: 314239 - DNA, 25 bp, Mus musculus
agatgcttcacgtgcgctcaggata

SEQ ID NO: 314240 - DNA, 25 bp, Mus musculus
tcccacgagctagagaggcgggact

SEQ ID NO: 314241 - DNA, 25 bp, Mus musculus
ccgagagctgaagcttaggtccctc

SEQ ID NO: 314242 - DNA, 25 bp, Mus musculus
ggccctggtagcatcttgaccaaca

SEQ ID NO: 314243 - DNA, 25 bp, Mus musculus
caacatggctgcagtgagtcgcttc

SEQ ID NO: 314244 - DNA, 25 bp, Mus musculus
gtttcgagggatcctagcccacttc

SEQ ID NO: 314245 - DNA, 25 bp, Mus musculus
gacatgatctctcgagttcaccggg

SEQ ID NO: 314246 - DNA, 25 bp, Mus musculus
aggatactctccatgttcgacatga

SEQ ID NO: 314247 - DNA, 25 bp, Mus musculus
cttgaccaacagaaaggatactctc

SEQ ID NO: 314248 - DNA, 25 bp, Mus musculus
aggtccctcccacttagatgcttca

SEQ ID NO: 314249 - DNA, 25 bp, Mus musculus
ggtctctctcggattcatcgcatca

SEQ ID NO: 314250 - DNA, 25 bp, Mus musculus
atctgggtaggtgccgccgccatcc

SEQ ID NO: 314251 - DNA, 25 bp, Mus musculus
gctacccaccggcttcgatctgggt

SEQ ID NO: 314252 - DNA, 25 bp, Mus musculus
caccggcttcgatctgggtaggtgc

SEQ ID NO: 314253 - DNA, 25 bp, Mus musculus
gtttcggtctctctcggattcatcg

SEQ ID NO: 314254 - DNA, 25 bp, Mus musculus
tgccgccgccatccttttcccgagg

SEQ ID NO: 314255 - DNA, 25 bp, Mus musculus
ccagtttcggtctctctcggattca

SEQ ID NO: 314256 - DNA, 25 bp, Mus musculus
tctcggattcatcgcatcacgtttc

SEQ ID NO: 314257 - DNA, 25 bp, Mus musculus
ttcgtcccagtttcggtctctctcg

SEQ ID NO: 314258 - DNA, 25 bp, Mus musculus
actcttcgtcccagtttcggtctct

SEQ ID NO: 314259 - DNA, 25 bp, Mus musculus
cgcttccgccgcactcttcgtccca

SEQ ID NO: 314260 - DNA, 25 bp, Mus musculus
tgaagcccccatgcttgggagtccc

SEQ ID NO: 314261 - DNA, 25 bp, Mus musculus
cgctgcctctattgtggtgaagccc

SEQ ID NO: 314262 - DNA, 25 bp, Mus musculus
ggcgctgcctctattgtggtgaagc

SEQ ID NO: 314263 - DNA, 25 bp, Mus musculus
caggaggtactgctccgggcttcag

SEQ ID NO: 314264 - DNA, 25 bp, Mus musculus
tcatccacagccatctgagcgagcg

SEQ ID NO: 314265 - DNA, 25 bp, Mus musculus
tccaaaggtgcccagctcgacattc

SEQ ID NO: 314266 - DNA, 25 bp, Mus musculus
gctgcttcgccaaccgcttcgatga

SEQ ID NO: 314267 - DNA, 25 bp, Mus musculus
cttcgatgactaccagggcagcctg

SEQ ID NO: 314268 - DNA, 25 bp, Mus musculus
tcgaacgcattcttcaggagctgcc

SEQ ID NO: 314269 - DNA, 25 bp, Mus musculus
ggtggcctacatgctctaccacgtc

SEQ ID NO: 314270 - DNA, 25 bp, Mus musculus
gggagcgctacctgcgcttcgccaa

SEQ ID NO: 314271 - DNA, 25 bp, Mus musculus
tctccttcctggactgtggctccga

SEQ ID NO: 314272 - DNA, 25 bp, Mus musculus
tgctcaagcagaagctcgcccagga

SEQ ID NO: 314273 - DNA, 25 bp, Mus musculus
cgcgcctctgagagcaggaggtact

SEQ ID NO: 314274 - DNA, 25 bp, Mus musculus
cgtgtgacacgcattcctagctctg

SEQ ID NO: 314275 - DNA, 25 bp, Mus musculus
cagcatggacaccaagcgctgcttc

SEQ ID NO: 314276 - DNA, 25 bp, Mus musculus
agctcgttgtcccacttggccactg

SEQ ID NO: 314277 - DNA, 25 bp, Mus musculus
actgcctctagggtgccggagtcca

SEQ ID NO: 314278 - DNA, 25 bp, Mus musculus
cgaacttgcccgaagccctcgtatg

SEQ ID NO: 314279 - DNA, 25 bp, Mus musculus
agccctcgtatgctgccggctttga

SEQ ID NO: 314280 - DNA, 25 bp, Mus musculus
ttagcagacgcctagtgctccaacg

SEQ ID NO: 314281 - DNA, 25 bp, Mus musculus
tgccggagtccacgcacttagcaga

SEQ ID NO: 314282 - DNA, 25 bp, Mus musculus
ggcgtggcccgcgaacttgcccgaa

SEQ ID NO: 314283 - DNA, 25 bp, Mus musculus
actacgtgaatggttacccgaagtg

SEQ ID NO: 314284 - DNA, 25 bp, Mus musculus
tccgcgagcgactgagttttcaatg

SEQ ID NO: 314285 - DNA, 25 bp, Mus musculus
cgccaagacgcaaccaaactacgtg

SEQ ID NO: 314286 - DNA, 25 bp, Mus musculus
tggcaacattaaacacgccaagacg

SEQ ID NO: 314287 - DNA, 25 bp, Mus musculus
aaatctctcgttattggcaacatta

SEQ ID NO: 314288 - DNA, 25 bp, Mus musculus
ttgcagcacgatatgtactcgcgtc

SEQ ID NO: 314289 - DNA, 25 bp, Mus musculus
ttttcaatgaactaattgcagcacg

SEQ ID NO: 314290 - DNA, 25 bp, Mus musculus
atgctgccggctttgactgcctcta

SEQ ID NO: 314291 - DNA, 25 bp, Mus musculus
aggcttcaccgtgagcggtatgctg

SEQ ID NO: 314292 - DNA, 25 bp, Mus musculus
aagccgggacgcgaagatctgcaac

SEQ ID NO: 314293 - DNA, 25 bp, Mus musculus
cgaagatctgcaactgggcgcaatc

SEQ ID NO: 314294 - DNA, 25 bp, Mus musculus
tgcaactgggcgcaatcatccatca

SEQ ID NO: 314295 - DNA, 25 bp, Mus musculus
aactgggcgcaatcatccatcaccg

SEQ ID NO: 314296 - DNA, 25 bp, Mus musculus
caccgtgagcggtatgctggagcac

SEQ ID NO: 314297 - DNA, 25 bp, Mus musculus
agcggccaacccctcaatgtgtact

SEQ ID NO: 314298 - DNA, 25 bp, Mus musculus
agccctgctccaaactcgtccatca

SEQ ID NO: 314299 - DNA, 25 bp, Mus musculus
ggggagcgagccctgctccaaactc

SEQ ID NO: 314300 - DNA, 25 bp, Mus musculus
taaccatccgaacgcctggggagcg

SEQ ID NO: 314301 - DNA, 25 bp, Mus musculus
cactaaccatccgaacgcctgggga

SEQ ID NO: 314302 - DNA, 25 bp, Mus musculus
gtagcccaccactcgccgcacacta

SEQ ID NO: 314303 - DNA, 25 bp, Mus musculus
tccatcaccgctcgccgcacgtagc

SEQ ID NO: 314304 - DNA, 25 bp, Mus musculus
tcgtccatcacgtccagcggccaac

SEQ ID NO: 314305 - DNA, 25 bp, Mus musculus
gcgcgtccctagattcccgaggaat

SEQ ID NO: 314306 - DNA, 25 bp, Mus musculus
accatccgaggagggaagacgcgtc

SEQ ID NO: 314307 - DNA, 25 bp, Mus musculus
ttgccgagttcgatggaaagccacg

SEQ ID NO: 314308 - DNA, 25 bp, Mus musculus
ccgccgggccagatagcgaactttt

SEQ ID NO: 314309 - DNA, 25 bp, Mus musculus
ctgctgccttctccacatttatcta

SEQ ID NO: 314310 - DNA, 25 bp, Mus musculus
aaggtctctccaaccagggcacctg

SEQ ID NO: 314311 - DNA, 25 bp, Mus musculus
aaccgtctgccatgtacagcgcaca

SEQ ID NO: 314312 - DNA, 25 bp, Mus musculus
ggctcgctccgattcatcctgaata

SEQ ID NO: 314313 - DNA, 25 bp, Mus musculus
gggttcattcgagcgcgtccctaga

SEQ ID NO: 314314 - DNA, 25 bp, Mus musculus
aggaatcattcccttcgctggatcc

SEQ ID NO: 314315 - DNA, 25 bp, Mus musculus
cctggcgggacacatttggaccatc

SEQ ID NO: 314316 - DNA, 25 bp, Mus musculus
aacgcggctctgttagctgtgcagc

SEQ ID NO: 314317 - DNA, 25 bp, Mus musculus
tacagcgcacacgttgggttcattc

SEQ ID NO: 314318 - DNA, 25 bp, Mus musculus
tcattttcagtactaaaggtctctc

SEQ ID NO: 314319 - DNA, 25 bp, Mus musculus
cctcgatctgccagagctaggtctg

SEQ ID NO: 314320 - DNA, 25 bp, Mus musculus
gcatgcgcgatgctcccgacacatg

SEQ ID NO: 314321 - DNA, 25 bp, Mus musculus
ccgcttcaggggctctcgagaagaa

SEQ ID NO: 314322 - DNA, 25 bp, Mus musculus
tgtagtaaagcccacagctcgcgcc

SEQ ID NO: 314323 - DNA, 25 bp, Mus musculus
gtcacccgcacgtcaatggaggttc

SEQ ID NO: 314324 - DNA, 25 bp, Mus musculus
tcagaacaaactccggcgtggccgc

SEQ ID NO: 314325 - DNA, 25 bp, Mus musculus
ggtcgtcttcgaaggaccaggtctc

SEQ ID NO: 314326 - DNA, 25 bp, Mus musculus
cgggctgcagacttacaaccggtcc

SEQ ID NO: 314327 - DNA, 25 bp, Mus musculus
tcccgcttcgggttggaagtgaaga

SEQ ID NO: 314328 - DNA, 25 bp, Mus musculus
gtgctgccgaacacctccatgtctt

SEQ ID NO: 314329 - DNA, 25 bp, Mus musculus
ccatgtcttcttggtcccagggatc

SEQ ID NO: 314330 - DNA, 25 bp, Mus musculus
cgaacggtagcatcgccgcttcagg

SEQ ID NO: 314331 - DNA, 25 bp, Mus musculus
caagactaccgaactgcctgcctgg

SEQ ID NO: 314332 - DNA, 25 bp, Mus musculus
actaacctcgctactgctcgtgctg

SEQ ID NO: 314333 - DNA, 25 bp, Mus musculus
cttacctcgggcgtggtgcggtcac

SEQ ID NO: 314334 - DNA, 25 bp, Mus musculus
caatgagagcccgagatcagctccg

SEQ ID NO: 314335 - DNA, 25 bp, Mus musculus
tcaccaaagacagcggccaatgaga

SEQ ID NO: 314336 - DNA, 25 bp, Mus musculus
tgatcgtgacgtcaccaaagacagc

SEQ ID NO: 314337 - DNA, 25 bp, Mus musculus
caattctcatcatgatcgtgacgtc

SEQ ID NO: 314338 - DNA, 25 bp, Mus musculus
gcgtgtccgatcatcaattctcatc

SEQ ID NO: 314339 - DNA, 25 bp, Mus musculus
acaatgaaatcagcgtgtccgatca

SEQ ID NO: 314340 - DNA, 25 bp, Mus musculus
cactgccgcctcagacaatgaaatc

SEQ ID NO: 314341 - DNA, 25 bp, Mus musculus
agattttttcctgggtctccactgc

SEQ ID NO: 314342 - DNA, 25 bp, Mus musculus
caggcggagtccgcaagattttttc

SEQ ID NO: 314343 - DNA, 25 bp, Mus musculus
aggttccaagatgagaccagggcca

SEQ ID NO: 314344 - DNA, 25 bp, Mus musculus
agatcagaggttccaagatgagacc

SEQ ID NO: 314345 - DNA, 25 bp, Mus musculus
tggtgcggtcacgaaagagatcaga

SEQ ID NO: 314346 - DNA, 25 bp, Mus musculus
cggtcacgaaagagatcagaggttc

SEQ ID NO: 314347 - DNA, 25 bp, Mus musculus
gggccacctgttgctttccacttaa

SEQ ID NO: 314348 - DNA, 25 bp, Mus musculus
cttaggacaaggagaagtagctttc

SEQ ID NO: 314349 - DNA, 25 bp, Mus musculus
ccctcgattttatggtctggaaagc

SEQ ID NO: 314350 - DNA, 25 bp, Mus musculus
agtagctttcccagagcctttagga

SEQ ID NO: 314351 - DNA, 25 bp, Mus musculus
cttttattcgcgagtctggggccac

SEQ ID NO: 314352 - DNA, 25 bp, Mus musculus
tttccgacagttccggagggagcgc

SEQ ID NO: 314353 - DNA, 25 bp, Mus musculus
cgcaaagtttgcaggccggttcctc

SEQ ID NO: 314354 - DNA, 25 bp, Mus musculus
ctacgtcacgtcgacggcaagcgga

SEQ ID NO: 314355 - DNA, 25 bp, Mus musculus
ttcgcgctctgaggagaagccaccc

SEQ ID NO: 314356 - DNA, 25 bp, Mus musculus
gtggcctcctgacaggggacactgc

SEQ ID NO: 314357 - DNA, 25 bp, Mus musculus
ggacactgccttgacgtcgtcgctt

SEQ ID NO: 314358 - DNA, 25 bp, Mus musculus
tcgtcgcttctcttcgcgcttcaag

SEQ ID NO: 314359 - DNA, 25 bp, Mus musculus
ctggagccgccaaagagtcttgagg

SEQ ID NO: 314360 - DNA, 25 bp, Mus musculus
caaggaacggtctcttttattcgcg

SEQ ID NO: 314361 - DNA, 25 bp, Mus musculus
ggtgacaggaaaatggcggaaaaca

SEQ ID NO: 314362 - DNA, 25 bp, Mus musculus
tagcgtgacgtaatgcaacctcagc

SEQ ID NO: 314363 - DNA, 25 bp, Mus musculus
agcaactcggaagccgcggctctgc

SEQ ID NO: 314364 - DNA, 25 bp, Mus musculus
gctagcaggctctgccgctcaagtg

SEQ ID NO: 314365 - DNA, 25 bp, Mus musculus
aagccagagccgtcgttgtggccgt

SEQ ID NO: 314366 - DNA, 25 bp, Mus musculus
aacaatggaagtggcgtctagtccc

SEQ ID NO: 314367 - DNA, 25 bp, Mus musculus
tctgccaggctcagcgtgtttctgg

SEQ ID NO: 314368 - DNA, 25 bp, Mus musculus
cgaacgaacgccaggaccttccagg

SEQ ID NO: 314369 - DNA, 25 bp, Mus musculus
taccctgcagcaagggtagcgtgac

SEQ ID NO: 314370 - DNA, 25 bp, Mus musculus
cctcagcatgtaggagcgctataaa

SEQ ID NO: 314371 - DNA, 25 bp, Mus musculus
cgcagacgcagagtagctcgtgatt

SEQ ID NO: 314372 - DNA, 25 bp, Mus musculus
ggctgcggaacctcggaatcccgaa

SEQ ID NO: 314373 - DNA, 25 bp, Mus musculus
taaggggactcctgagcagcaactc

SEQ ID NO: 314374 - DNA, 25 bp, Mus musculus
caccattttgcctggtggccggctc

SEQ ID NO: 314375 - DNA, 25 bp, Mus musculus
tcactcggtccgtacccagtggtca

SEQ ID NO: 314376 - DNA, 25 bp, Mus musculus
aggctgcagaaatcaccgcgcctca

SEQ ID NO: 314377 - DNA, 25 bp, Mus musculus
agagcctcaggctgcagaaatcacc

SEQ ID NO: 314378 - DNA, 25 bp, Mus musculus
tccggacctgcggagagagcctcag

SEQ ID NO: 314379 - DNA, 25 bp, Mus musculus
cagtccctccggacctgcggagaga

SEQ ID NO: 314380 - DNA, 25 bp, Mus musculus
ggcgcggctgccagtcagtccctcc

SEQ ID NO: 314381 - DNA, 25 bp, Mus musculus
accagcctcgcgtcagagctgagca

SEQ ID NO: 314382 - DNA, 25 bp, Mus musculus
tctgctctcctctgctgactccgcc

SEQ ID NO: 314383 - DNA, 25 bp, Mus musculus
gatatgggcggtctcccgttcccta

SEQ ID NO: 314384 - DNA, 25 bp, Mus musculus
cggcccttggcacgtctgctctcct

SEQ ID NO: 314385 - DNA, 25 bp, Mus musculus
cggtccgtacccagtggtcatcttg

SEQ ID NO: 314386 - DNA, 25 bp, Mus musculus
acccagtggtcatcttggggatatg

SEQ ID NO: 314387 - DNA, 25 bp, Mus musculus
tcatcttggggatatgggcggtctc

SEQ ID NO: 314388 - DNA, 25 bp, Mus musculus
cccgcatctgtccaaaccagcctcg

SEQ ID NO: 314389 - DNA, 25 bp, Mus musculus
ctgcgcttaggacgcggtgactgct

SEQ ID NO: 314390 - DNA, 25 bp, Mus musculus
ggactcatggcatgtcctgcgctta

SEQ ID NO: 314391 - DNA, 25 bp, Mus musculus
gctgtgagccagagcagccagcagc

SEQ ID NO: 314392 - DNA, 25 bp, Mus musculus
gcctccaagacaaacagctgctctg

SEQ ID NO: 314393 - DNA, 25 bp, Mus musculus
agctgtggcggtagatcccgctaca

SEQ ID NO: 314394 - DNA, 25 bp, Mus musculus
agatcccgctacagcaatcgcagtc

SEQ ID NO: 314395 - DNA, 25 bp, Mus musculus
caatcgcagtctctgtggagcgggc

SEQ ID NO: 314396 - DNA, 25 bp, Mus musculus
tcttcatactactcaaagaggagtc

SEQ ID NO: 314397 - DNA, 25 bp, Mus musculus
tcaggcgacacaggcagcccagcta

SEQ ID NO: 314398 - DNA, 25 bp, Mus musculus
gcccgcgcagcaaagcggaaagcta

SEQ ID NO: 314399 - DNA, 25 bp, Mus musculus
cggaaagctaggctaccagagtgca

SEQ ID NO: 314400 - DNA, 25 bp, Mus musculus
ttcgggagctaaagccgctgaggct

SEQ ID NO: 314401 - DNA, 25 bp, Mus musculus
tctcagtggcagaagctactcaggc

SEQ ID NO: 314402 - DNA, 25 bp, Mus musculus
taccagagtgcaaggagtctcagtg

SEQ ID NO: 314403 - DNA, 25 bp, Mus musculus
tgagttcgccaagcggctcgctaga

SEQ ID NO: 314404 - DNA, 25 bp, Mus musculus
cttctctggcaatgatgtcagctgc

SEQ ID NO: 314405 - DNA, 25 bp, Mus musculus
ccctccttctctggcaatgatgtca

SEQ ID NO: 314406 - DNA, 25 bp, Mus musculus
ctggcaatgatgtcagctgcagtga

SEQ ID NO: 314407 - DNA, 25 bp, Mus musculus
atgatgtcagctgcagtgagggtcc

SEQ ID NO: 314408 - DNA, 25 bp, Mus musculus
atgtcagctgcagtgagggtccgcc

SEQ ID NO: 314409 - DNA, 25 bp, Mus musculus
gtagggagcggaagcaggccaacct

SEQ ID NO: 314410 - DNA, 25 bp, Mus musculus
aggccaacctgaggggcgcgctccc

SEQ ID NO: 314411 - DNA, 25 bp, Mus musculus
gtcgccctacgtccctaggctcctg

SEQ ID NO: 314412 - DNA, 25 bp, Mus musculus
tgctggggtctttttcacgtgggcc

SEQ ID NO: 314413 - DNA, 25 bp, Mus musculus
ttcgtgctggggtctttttcacgtg

SEQ ID NO: 314414 - DNA, 25 bp, Mus musculus
gaacgcagttcgtgctggggtcttt

SEQ ID NO: 314415 - DNA, 25 bp, Mus musculus
gctagagcctcagagagcgagcaga

SEQ ID NO: 314416 - DNA, 25 bp, Mus musculus
aagcggctcgctagagcctcagaga

SEQ ID NO: 314417 - DNA, 25 bp, Mus musculus
gctgtgcgccgccagcacagttgga

SEQ ID NO: 314418 - DNA, 25 bp, Mus musculus
cctggcgggaccgctaagctgcaga

SEQ ID NO: 314419 - DNA, 25 bp, Mus musculus
caagcccagccattatcttcgggtc

SEQ ID NO: 314420 - DNA, 25 bp, Mus musculus
agccattatcttcgggtccctgctg

SEQ ID NO: 314421 - DNA, 25 bp, Mus musculus
atcttcgggtccctgctgtttgcct

SEQ ID NO: 314422 - DNA, 25 bp, Mus musculus
tggcggttccgtagctgtagtgcct

SEQ ID NO: 314423 - DNA, 25 bp, Mus musculus
ccgtagctgtagtgcctggcggccc

SEQ ID NO: 314424 - DNA, 25 bp, Mus musculus
cgcccacgcgcttctgtcgcaccgc

SEQ ID NO: 314425 - DNA, 25 bp, Mus musculus
tgcgctgttgtcagagcgcgggaca

SEQ ID NO: 314426 - DNA, 25 bp, Mus musculus
gacccatgcccgtgcaggcaggaca

SEQ ID NO: 314427 - DNA, 25 bp, Mus musculus
ccagcgggcctttccagcggtcccg

SEQ ID NO: 314428 - DNA, 25 bp, Mus musculus
gtcttggtgtactgccatggtgggt

SEQ ID NO: 314429 - DNA, 25 bp, Mus musculus
accagagcacgggacgcaggaaaag

SEQ ID NO: 314430 - DNA, 25 bp, Mus musculus
cgccgccagcacagttggacgtgcg

SEQ ID NO: 314431 - DNA, 25 bp, Mus musculus
taccgctccgcaggggaccgcatgt

SEQ ID NO: 314432 - DNA, 25 bp, Mus musculus
gcccgcccggaacagtctgtgacga

SEQ ID NO: 314433 - DNA, 25 bp, Mus musculus
acagtctgtgacgagcggccagcga

SEQ ID NO: 314434 - DNA, 25 bp, Mus musculus
catgctgggagtcgttcgggaaacc

SEQ ID NO: 314435 - DNA, 25 bp, Mus musculus
ccctgaggcacggagatgaaattcc

SEQ ID NO: 314436 - DNA, 25 bp, Mus musculus
gcacggagatgaaattcccggcctc

SEQ ID NO: 314437 - DNA, 25 bp, Mus musculus
aattcccggcctcggtgatagcgtc

SEQ ID NO: 314438 - DNA, 25 bp, Mus musculus
cggcgctctacttgagcagcaccta

SEQ ID NO: 314439 - DNA, 25 bp, Mus musculus
accgcatgtggcaggtgctgacgct

SEQ ID NO: 314440 - DNA, 25 bp, Mus musculus
atgccctgcgccctggtgcagttca

SEQ ID NO: 314441 - DNA, 25 bp, Mus musculus
cctgtacaggtacgtgtcgaaccca

SEQ ID NO: 314442 - DNA, 25 bp, Mus musculus
caggtacgtgtcgaacccacaaccg

SEQ ID NO: 314443 - DNA, 25 bp, Mus musculus
tggtgcagttcacgctcctcttcgt

SEQ ID NO: 314444 - DNA, 25 bp, Mus musculus
tgatagcgtccgtgttcctgttcgt

SEQ ID NO: 314445 - DNA, 25 bp, Mus musculus
ccgacagcgggcactttgatgaatc

SEQ ID NO: 314446 - DNA, 25 bp, Mus musculus
gtgatctcgccgcacaactcaggga

SEQ ID NO: 314447 - DNA, 25 bp, Mus musculus
gtcctgcccaggaacacgcctggga

SEQ ID NO: 314448 - DNA, 25 bp, Mus musculus
ccgctggtctcggagacccgagatc

SEQ ID NO: 314449 - DNA, 25 bp, Mus musculus
caaactggtaagtcttcccgcaagc

SEQ ID NO: 314450 - DNA, 25 bp, Mus musculus
cgccaacgaagaggagacgagaaac

SEQ ID NO: 314451 - DNA, 25 bp, Mus musculus
cgctccgaggggtgtttgcccttga

SEQ ID NO: 314452 - DNA, 25 bp, Mus musculus
acgcgggacattcttagcgctccga

SEQ ID NO: 314453 - DNA, 25 bp, Mus musculus
tctctgtccgtggacgcgggacatt

SEQ ID NO: 314454 - DNA, 25 bp, Mus musculus
gcgggcaaccctctctgtccgtgga

SEQ ID NO: 314455 - DNA, 25 bp, Mus musculus
cgaccgcggtgattgcagctgctta

SEQ ID NO: 314456 - DNA, 25 bp, Mus musculus
tcacgtgtgtcgaggccgtcttaaa

SEQ ID NO: 314457 - DNA, 25 bp, Mus musculus
gctccacgagtaggaagcggctttc

SEQ ID NO: 314458 - DNA, 25 bp, Mus musculus
ccgtcttaaagagataggcacctac

SEQ ID NO: 314459 - DNA, 25 bp, Mus musculus
cagttgcagcgatgacctacgtctc

SEQ ID NO: 314460 - DNA, 25 bp, Mus musculus
tgcggtcgatcaatggcacttcgta

SEQ ID NO: 314461 - DNA, 25 bp, Mus musculus
tcggtgccttctgcccggacatctt

SEQ ID NO: 314462 - DNA, 25 bp, Mus musculus
tgtggctctccgttcggtgccttct

SEQ ID NO: 314463 - DNA, 25 bp, Mus musculus
acttcgtaagctcggcgcccgacga

SEQ ID NO: 314464 - DNA, 25 bp, Mus musculus
ggacatcttcctcaacacgctgagc

SEQ ID NO: 314465 - DNA, 25 bp, Mus musculus
atttcgctcggctcttcggggccga

SEQ ID NO: 314466 - DNA, 25 bp, Mus musculus
cgcgaccagcgcagctgctgttgct

SEQ ID NO: 314467 - DNA, 25 bp, Mus musculus
cctacgtctccacgtgcagtgggga

SEQ ID NO: 314468 - DNA, 25 bp, Mus musculus
tgctgtgccacggaggcatctttac

SEQ ID NO: 314469 - DNA, 25 bp, Mus musculus
gagccgtaacccaggcctagtgctg

SEQ ID NO: 314470 - DNA, 25 bp, Mus musculus
cagcggggtgattctgagccgtaac

SEQ ID NO: 314471 - DNA, 25 bp, Mus musculus
gaccctctatgagagtggcggagca

SEQ ID NO: 314472 - DNA, 25 bp, Mus musculus
gtgcacgcctcagtgcgcaagcctg

SEQ ID NO: 314473 - DNA, 25 bp, Mus musculus
actctcctggtcaccgaggctgggt

SEQ ID NO: 314474 - DNA, 25 bp, Mus musculus
ccaagcccatgcacaagtagaaagt

SEQ ID NO: 314475 - DNA, 25 bp, Mus musculus
gcaattcgtataaaccaagcccatg

SEQ ID NO: 314476 - DNA, 25 bp, Mus musculus
cagagacgtttaatggcaattcgta

SEQ ID NO: 314477 - DNA, 25 bp, Mus musculus
aggctagctggtgcagagacgttta

SEQ ID NO: 314478 - DNA, 25 bp, Mus musculus
cccgcttaaggcagcgagatgaggc

SEQ ID NO: 314479 - DNA, 25 bp, Mus musculus
acgtcggaagcgaaaaaccgcgctg

SEQ ID NO: 314480 - DNA, 25 bp, Mus musculus
ccgccatcttgggaatgagtgagag

SEQ ID NO: 314481 - DNA, 25 bp, Mus musculus
gccgcgcagcgccttaaatagattc

SEQ ID NO: 314482 - DNA, 25 bp, Mus musculus
ccctacgtgggcgaccagagagtca

SEQ ID NO: 314483 - DNA, 25 bp, Mus musculus
ctgggtggtttctccatggagctca

SEQ ID NO: 314484 - DNA, 25 bp, Mus musculus
cagacgcaaacatgcggagtcaagg

SEQ ID NO: 314485 - DNA, 25 bp, Mus musculus
gtagaaagtgctcgtggagccagcc

SEQ ID NO: 314486 - DNA, 25 bp, Mus musculus
acgcggttgtgaatctgggatcctc

SEQ ID NO: 314487 - DNA, 25 bp, Mus musculus
tccgggtcatatgcactgtccagtg

SEQ ID NO: 314488 - DNA, 25 bp, Mus musculus
accacgcggaaagcagaagcctgtc

SEQ ID NO: 314489 - DNA, 25 bp, Mus musculus
cgcgcaggctccaatgctgagattg

SEQ ID NO: 314490 - DNA, 25 bp, Mus musculus
gcgtccttggccacgttagcgatca

SEQ ID NO: 314491 - DNA, 25 bp, Mus musculus
gtccacagtacagccagcagcaata

SEQ ID NO: 314492 - DNA, 25 bp, Mus musculus
tttaaggttaatcagggcagccgcc

SEQ ID NO: 314493 - DNA, 25 bp, Mus musculus
ctgctcctcttcgaccgagtattta

SEQ ID NO: 314494 - DNA, 25 bp, Mus musculus
taggtctgcacaccaaagctgccgg

SEQ ID NO: 314495 - DNA, 25 bp, Mus musculus
gctgcctcagagatctccagctcta

SEQ ID NO: 314496 - DNA, 25 bp, Mus musculus
cagctctatctgtgcggccggaaaa

SEQ ID NO: 314497 - DNA, 25 bp, Mus musculus
agcattgtcgttcaggtctttgatc

SEQ ID NO: 314498 - DNA, 25 bp, Mus musculus
tctccattgagctggacatgacctc

SEQ ID NO: 314499 - DNA, 25 bp, Mus musculus
acctcgagcgagatgatacacttgg

SEQ ID NO: 314500 - DNA, 25 bp, Mus musculus
ggcacagcaggtctcggtcaatctt

SEQ ID NO: 314501 - DNA, 25 bp, Mus musculus
gaggtctgttcgtggatgttcgaaa

SEQ ID NO: 314502 - DNA, 25 bp, Mus musculus
tctgttcgtggatgttcgaaagaga

SEQ ID NO: 314503 - DNA, 25 bp, Mus musculus
tacgccaggcactagccaatcagcg

SEQ ID NO: 314504 - DNA, 25 bp, Mus musculus
gccacagagtctggagagagccgga

SEQ ID NO: 314505 - DNA, 25 bp, Mus musculus
tgccgcaaactactggccacagagt

SEQ ID NO: 314506 - DNA, 25 bp, Mus musculus
ctcctcctcccgatgccgcaaacta

SEQ ID NO: 314507 - DNA, 25 bp, Mus musculus
tgccagtgccctctgggcaagccgg

SEQ ID NO: 314508 - DNA, 25 bp, Mus musculus
agtgaatgccagtgccctctgggca

SEQ ID NO: 314509 - DNA, 25 bp, Mus musculus
gctagggaagtgaatgccagtgccc

SEQ ID NO: 314510 - DNA, 25 bp, Mus musculus
atcggctcagctggaaagccaggga

SEQ ID NO: 314511 - DNA, 25 bp, Mus musculus
ttcgggtctcagatgaatcggctca

SEQ ID NO: 314512 - DNA, 25 bp, Mus musculus
cgagaggttcgggtctcagatgaat

SEQ ID NO: 314513 - DNA, 25 bp, Mus musculus
tctcagatgaatcggctcagctgga

SEQ ID NO: 314514 - DNA, 25 bp, Mus musculus
ttcgaaagagaggaagagtgaatgt

SEQ ID NO: 314515 - DNA, 25 bp, Mus musculus
tcacgagtatctgcaactgagaaga

SEQ ID NO: 314516 - DNA, 25 bp, Mus musculus
ctgcgcctatgcaccgggcgatcgg

SEQ ID NO: 314517 - DNA, 25 bp, Mus musculus
ccgggcgatcggctcgagcttgcca

SEQ ID NO: 314518 - DNA, 25 bp, Mus musculus
ctcgagcttgccaggcgcgagagtt

SEQ ID NO: 314519 - DNA, 25 bp, Mus musculus
gcgcgagagtttccgagtttccacg

SEQ ID NO: 314520 - DNA, 25 bp, Mus musculus
ttccacggaaactgccgaaaactca

SEQ ID NO: 314521 - DNA, 25 bp, Mus musculus
actgccgaaaactcacgagtatctg

SEQ ID NO: 314522 - DNA, 25 bp, Mus musculus
ggaaagttgcaacaatcggacgccc

SEQ ID NO: 314523 - DNA, 25 bp, Mus musculus
ctgcaactgagaagaaccggaaaca

SEQ ID NO: 314524 - DNA, 25 bp, Mus musculus
ccggaaacaggagacgattttctag

SEQ ID NO: 314525 - DNA, 25 bp, Mus musculus
acgattttctagagggtcattctta

SEQ ID NO: 314526 - DNA, 25 bp, Mus musculus
gtcattcttaggaggctgcccggaa

SEQ ID NO: 314527 - DNA, 25 bp, Mus musculus
ggctgcccggaaagttgcaacaatc

SEQ ID NO: 314528 - DNA, 25 bp, Mus musculus
gggacgccatgactacccggagacc

SEQ ID NO: 314529 - DNA, 25 bp, Mus musculus
ccggcggactcgtggacacacacga

SEQ ID NO: 314530 - DNA, 25 bp, Mus musculus
cctcgagccggtgtcttctcttgcg

SEQ ID NO: 314531 - DNA, 25 bp, Mus musculus
ctccgtcttcggtgagaggattttc

SEQ ID NO: 314532 - DNA, 25 bp, Mus musculus
ctcagggagccagcctcgagccggt

SEQ ID NO: 314533 - DNA, 25 bp, Mus musculus
cacggtaccggaggttttgccgcag

SEQ ID NO: 314534 - DNA, 25 bp, Mus musculus
ctttggcactgcagcccggcggact

SEQ ID NO: 314535 - DNA, 25 bp, Mus musculus
agaggattttccgaggcgcctcggc

SEQ ID NO: 314536 - DNA, 25 bp, Mus musculus
cggtggatcgttccctgcgctccgt

SEQ ID NO: 314537 - DNA, 25 bp, Mus musculus
agagaccctgcggtggatcgttccc

SEQ ID NO: 314538 - DNA, 25 bp, Mus musculus
gtttgccagtgagagaccctgcggt

SEQ ID NO: 314539 - DNA, 25 bp, Mus musculus
tttagcgcaccggaagccacctcgg

SEQ ID NO: 314540 - DNA, 25 bp, Mus musculus
ccgcggaagtgtgctttagcgcacc

SEQ ID NO: 314541 - DNA, 25 bp, Mus musculus
cttcggggccaggtgcttccggctc

SEQ ID NO: 314542 - DNA, 25 bp, Mus musculus
ctcgctgctgtcctttggcactgca

SEQ ID NO: 314543 - DNA, 25 bp, Mus musculus
gagccagcctctgcgtcgtcataga

SEQ ID NO: 314544 - DNA, 25 bp, Mus musculus
ctctgcgtcgtcatagagccgcgtc

SEQ ID NO: 314545 - DNA, 25 bp, Mus musculus
cgtcgtcatagagccgcgtcacttt

SEQ ID NO: 314546 - DNA, 25 bp, Mus musculus
atagagccgcgtcactttccgctcg

SEQ ID NO: 314547 - DNA, 25 bp, Mus musculus
ctctagagcggcattcgagccaatt

SEQ ID NO: 314548 - DNA, 25 bp, Mus musculus
cgagccaattagtttttggctgaac

SEQ ID NO: 314549 - DNA, 25 bp, Mus musculus
ccgcaggcctacgtgggcggagcca

SEQ ID NO: 314550 - DNA, 25 bp, Mus musculus
gtttttggctgaactaactcctctg

SEQ ID NO: 314551 - DNA, 25 bp, Mus musculus
ttggctgaactaactcctctgccgc

SEQ ID NO: 314552 - DNA, 25 bp, Mus musculus
tgaactaactcctctgccgccgcgg

SEQ ID NO: 314553 - DNA, 25 bp, Mus musculus
ttttgggctccagaggctgtgtgct

SEQ ID NO: 314554 - DNA, 25 bp, Mus musculus
gagcccgcgcctttgaatctccagg

SEQ ID NO: 314555 - DNA, 25 bp, Mus musculus
cctttgaatctccaggcggcttttg

SEQ ID NO: 314556 - DNA, 25 bp, Mus musculus
cggcattcgagccaattagtttttg

SEQ ID NO: 314557 - DNA, 25 bp, Mus musculus
aggctcccaggtctctccgagagtc

SEQ ID NO: 314558 - DNA, 25 bp, Mus musculus
acccttgcggccatgatggacgctg

SEQ ID NO: 314559 - DNA, 25 bp, Mus musculus
cgaggccacctctgatgttaaacac

SEQ ID NO: 314560 - DNA, 25 bp, Mus musculus
gacgttcgactgctcgaggctcaca

SEQ ID NO: 314561 - DNA, 25 bp, Mus musculus
ggacaaacgtgccaccctgccaagg

SEQ ID NO: 314562 - DNA, 25 bp, Mus musculus
taaggtcgggcccaggcctttctca

SEQ ID NO: 314563 - DNA, 25 bp, Mus musculus
cctttctcagcacggtcggccatta

SEQ ID NO: 314564 - DNA, 25 bp, Mus musculus
tcggccattacttctgggctgccgc

SEQ ID NO: 314565 - DNA, 25 bp, Mus musculus
cgaggaccttttgacgctcccaagt

SEQ ID NO: 314566 - DNA, 25 bp, Mus musculus
agttcaaaaccactcacatcgcatg

SEQ ID NO: 314567 - DNA, 25 bp, Mus musculus
acatcgcatggcactctcgagggtc

SEQ ID NO: 314568 - DNA, 25 bp, Mus musculus
gggtcttctgagacttggccctgcc

SEQ ID NO: 314569 - DNA, 25 bp, Mus musculus
cagcaaacagatggcgcagcacttg

SEQ ID NO: 314570 - DNA, 25 bp, Mus musculus
tcccagaactgtcgcctgacgaggc

SEQ ID NO: 314571 - DNA, 25 bp, Mus musculus
gggtctggctgtcgcgctaggccgc

SEQ ID NO: 314572 - DNA, 25 bp, Mus musculus
tcgggtctggctgtcgcgctaggcc

SEQ ID NO: 314573 - DNA, 25 bp, Mus musculus
atatgatgatggctctgtcgggtct

SEQ ID NO: 314574 - DNA, 25 bp, Mus musculus
gccacggatctctatatgatgatgg

SEQ ID NO: 314575 - DNA, 25 bp, Mus musculus
cgccacggatctctatatgatgatg

SEQ ID NO: 314576 - DNA, 25 bp, Mus musculus
gcgccacggatctctatatgatgat

SEQ ID NO: 314577 - DNA, 25 bp, Mus musculus
ggcgccacggatctctatatgatga

SEQ ID NO: 314578 - DNA, 25 bp, Mus musculus
gggcgccacggatctctatatgatg

SEQ ID NO: 314579 - DNA, 25 bp, Mus musculus
agccttgccgtggtctcccttgctc

SEQ ID NO: 314580 - DNA, 25 bp, Mus musculus
gccagccttgccgtggtctcccttg

SEQ ID NO: 314581 - DNA, 25 bp, Mus musculus
tcctgccagccttgccgtggtctcc

SEQ ID NO: 314582 - DNA, 25 bp, Mus musculus
cctcctgccagccttgccgtggtct

SEQ ID NO: 314583 - DNA, 25 bp, Mus musculus
gccctcctgccagccttgccgtggt

SEQ ID NO: 314584 - DNA, 25 bp, Mus musculus
ccgccctcctgccagccttgccgtg

SEQ ID NO: 314585 - DNA, 25 bp, Mus musculus
ccgaagaggacgtggaggactccat

SEQ ID NO: 314586 - DNA, 25 bp, Mus musculus
ggaagcgctgcttctgcgtctccac

SEQ ID NO: 314587 - DNA, 25 bp, Mus musculus
gtggaggactccatcccggcacgac

SEQ ID NO: 314588 - DNA, 25 bp, Mus musculus
cgaggcgagcactgaagcgacttgc

SEQ ID NO: 314589 - DNA, 25 bp, Mus musculus
aatgctgcaactgagggtccacggc

SEQ ID NO: 314590 - DNA, 25 bp, Mus musculus
ccacctcgatgaaatgctgcaactg

SEQ ID NO: 314591 - DNA, 25 bp, Mus musculus
tctgcgtctccacctcgatgaaatg

SEQ ID NO: 314592 - DNA, 25 bp, Mus musculus
aagttccgtcatctggtgcaccagc

SEQ ID NO: 314593 - DNA, 25 bp, Mus musculus
gagctcacccagcaaagttccgtca

SEQ ID NO: 314594 - DNA, 25 bp, Mus musculus
cgtccggatctgagtcccgagctca

SEQ ID NO: 314595 - DNA, 25 bp, Mus musculus
tctgggtgacggaaccggaactaca

SEQ ID NO: 314596 - DNA, 25 bp, Mus musculus
cttcacgtgtctgggtgacggaacc

SEQ ID NO: 314597 - DNA, 25 bp, Mus musculus
cagctgctggaagcgctgcttctgc

SEQ ID NO: 314598 - DNA, 25 bp, Mus musculus
agcgacttgccgaccttcacgtgtc

SEQ ID NO: 314599 - DNA, 25 bp, Mus musculus
cagacagctctatggtcgccgtttc

SEQ ID NO: 314600 - DNA, 25 bp, Mus musculus
gcgtgggactgcaacgccttttaga

SEQ ID NO: 314601 - DNA, 25 bp, Mus musculus
cagtttaatccttgtacccagcgtg

SEQ ID NO: 314602 - DNA, 25 bp, Mus musculus
tcgtctgtggggctttgatagcatc

SEQ ID NO: 314603 - DNA, 25 bp, Mus musculus
tgctagcgctcctgcgaacatggta

SEQ ID NO: 314604 - DNA, 25 bp, Mus musculus
agcctctctctttccgagctgctag

SEQ ID NO: 314605 - DNA, 25 bp, Mus musculus
cgccattgtggtccggtaaccgagt

SEQ ID NO: 314606 - DNA, 25 bp, Mus musculus
ccacggctctgaggaagtgcaccca

SEQ ID NO: 314607 - DNA, 25 bp, Mus musculus
tatttgcatccagcgaggactctgc

SEQ ID NO: 314608 - DNA, 25 bp, Mus musculus
ctcgcgtctgcaacgaagataaatc

SEQ ID NO: 314609 - DNA, 25 bp, Mus musculus
gagcctcggctcaaactcgcgtctg

SEQ ID NO: 314610 - DNA, 25 bp, Mus musculus
tccgccaacagggataaagcagtta

SEQ ID NO: 314611 - DNA, 25 bp, Mus musculus
aggcaccgcctataaacttccgttg

SEQ ID NO: 314612 - DNA, 25 bp, Mus musculus
gggctctggcatgacctcgatgtac

SEQ ID NO: 314613 - DNA, 25 bp, Mus musculus
caagacacggggtcagatggccggc

SEQ ID NO: 314614 - DNA, 25 bp, Mus musculus
gaacttggtctggaactggcagcgc

SEQ ID NO: 314615 - DNA, 25 bp, Mus musculus
gatggccggcctagagccggctctc

SEQ ID NO: 314616 - DNA, 25 bp, Mus musculus
gctctgcgagttcgggcaagacacg

SEQ ID NO: 314617 - DNA, 25 bp, Mus musculus
cgctctgcgagttcgggcaagacac

SEQ ID NO: 314618 - DNA, 25 bp, Mus musculus
aggacccgccgctctgcgagttcgg

SEQ ID NO: 314619 - DNA, 25 bp, Mus musculus
tggcgaggacaggacccgccgctct

SEQ ID NO: 314620 - DNA, 25 bp, Mus musculus
gcctcatggcgaggacaggacccgc

SEQ ID NO: 314621 - DNA, 25 bp, Mus musculus
tctggaactggcagcgcgtgccgct

SEQ ID NO: 314622 - DNA, 25 bp, Mus musculus
cggcctcatggcgaggacaggaccc

SEQ ID NO: 314623 - DNA, 25 bp, Mus musculus
ctgctgcggcctcatggcgaggaca

SEQ ID NO: 314624 - DNA, 25 bp, Mus musculus
accggtgcctgctgcggcctcatgg

SEQ ID NO: 314625 - DNA, 25 bp, Mus musculus
actggcagcgcgtgccgctgctgta

SEQ ID NO: 314626 - DNA, 25 bp, Mus musculus
acttggtctggaactggcagcgcgt

SEQ ID NO: 314627 - DNA, 25 bp, Mus musculus
gctgtccaggtaccgccaagtctga

SEQ ID NO: 314628 - DNA, 25 bp, Mus musculus
ccagctcgggcccatgttacagttc

SEQ ID NO: 314629 - DNA, 25 bp, Mus musculus
aggtaccgccaagtctgacccagga

SEQ ID NO: 314630 - DNA, 25 bp, Mus musculus
caagtctgacccaggacccacgtta

SEQ ID NO: 314631 - DNA, 25 bp, Mus musculus
cgcccatcggcgcatccagccaatc

SEQ ID NO: 314632 - DNA, 25 bp, Mus musculus
gcccatcgctgcacgcttcatccag

SEQ ID NO: 314633 - DNA, 25 bp, Mus musculus
cgaggaaacgcggagtcacgcctcc

SEQ ID NO: 314634 - DNA, 25 bp, Mus musculus
cgggacaacccatcacttagcactg

SEQ ID NO: 314635 - DNA, 25 bp, Mus musculus
ccatcacttagcactgggtttcctg

SEQ ID NO: 314636 - DNA, 25 bp, Mus musculus
cttagcactgggtttcctgtgcgca

SEQ ID NO: 314637 - DNA, 25 bp, Mus musculus
tttcctgtgcgcatgcggtgtttgc

SEQ ID NO: 314638 - DNA, 25 bp, Mus musculus
gctgggcctcatcgggtgaactcct

SEQ ID NO: 314639 - DNA, 25 bp, Mus musculus
atcgggtgaactccttgggtagcgt

SEQ ID NO: 314640 - DNA, 25 bp, Mus musculus
tcgggcccatgttacagttcgaagc

SEQ ID NO: 314641 - DNA, 25 bp, Mus musculus
cggcatctcagtgatcccgagttta

SEQ ID NO: 314642 - DNA, 25 bp, Mus musculus
cgtgaccgagatctcacatgacgta

SEQ ID NO: 314643 - DNA, 25 bp, Mus musculus
agatgctcacgtgatcaatcgctta

SEQ ID NO: 314644 - DNA, 25 bp, Mus musculus
tcgcttacgtgagcagaagtagttc

SEQ ID NO: 314645 - DNA, 25 bp, Mus musculus
ggtcgtcgtctatcgtctcgctata

SEQ ID NO: 314646 - DNA, 25 bp, Mus musculus
ctcgctatagccgtttgagggaaga

SEQ ID NO: 314647 - DNA, 25 bp, Mus musculus
gactgcgtgcgtgtttttgtaaatc

SEQ ID NO: 314648 - DNA, 25 bp, Mus musculus
catccttgaaagtatgagttgggca

SEQ ID NO: 314649 - DNA, 25 bp, Mus musculus
tgcgctcaactattcaaactgccgg

SEQ ID NO: 314650 - DNA, 25 bp, Mus musculus
ctgcttatcacgatctacgagttga

SEQ ID NO: 314651 - DNA, 25 bp, Mus musculus
ggtcccgagggaattccatccttga

SEQ ID NO: 314652 - DNA, 25 bp, Mus musculus
agccgagagttgctcacgtgaccga

SEQ ID NO: 314653 - DNA, 25 bp, Mus musculus
tcgagaggcgcccaataaatgcttt

SEQ ID NO: 314654 - DNA, 25 bp, Mus musculus
cccgcaagagggacccgtaagatga

SEQ ID NO: 314655 - DNA, 25 bp, Mus musculus
catttctttgctgccctgcgggtcg

SEQ ID NO: 314656 - DNA, 25 bp, Mus musculus
catggttcgggtctgcgggcaggac

SEQ ID NO: 314657 - DNA, 25 bp, Mus musculus
gaccatggctgtcctccgaggagcc

SEQ ID NO: 314658 - DNA, 25 bp, Mus musculus
agaccatggctgtcctccgaggagc

SEQ ID NO: 314659 - DNA, 25 bp, Mus musculus
cagaccatggctgtcctccgaggag

SEQ ID NO: 314660 - DNA, 25 bp, Mus musculus
gcagaccatggctgtcctccgagga

SEQ ID NO: 314661 - DNA, 25 bp, Mus musculus
ttggagcgctgcagaccatggctgt

SEQ ID NO: 314662 - DNA, 25 bp, Mus musculus
ccttggagcgctgcagaccatggct

SEQ ID NO: 314663 - DNA, 25 bp, Mus musculus
caccttggagcgctgcagaccatgg

SEQ ID NO: 314664 - DNA, 25 bp, Mus musculus
agcatttctttgctgccctgcgggt

SEQ ID NO: 314665 - DNA, 25 bp, Mus musculus
cggcaccttggagcgctgcagacca

SEQ ID NO: 314666 - DNA, 25 bp, Mus musculus
gcatttctttgctgccctgcgggtc

SEQ ID NO: 314667 - DNA, 25 bp, Mus musculus
tgcagaccatggctgtcctccgagg

SEQ ID NO: 314668 - DNA, 25 bp, Mus musculus
tttctttgctgccctgcgggtcgga

SEQ ID NO: 314669 - DNA, 25 bp, Mus musculus
gcgctctggggcttggcgcacggac

SEQ ID NO: 314670 - DNA, 25 bp, Mus musculus
gtcgtcactctcgtctggccaccaa

SEQ ID NO: 314671 - DNA, 25 bp, Mus musculus
gggtgcagtcgtcactctcgtctgg

SEQ ID NO: 314672 - DNA, 25 bp, Mus musculus
gagggcgagcgatgacgcggagccc

SEQ ID NO: 314673 - DNA, 25 bp, Mus musculus
gttgactgctttctgaccagtgggg

SEQ ID NO: 314674 - DNA, 25 bp, Mus musculus
cctgttgactgctttctgaccagtg

SEQ ID NO: 314675 - DNA, 25 bp, Mus musculus
gtcctgttgactgctttctgaccag

SEQ ID NO: 314676 - DNA, 25 bp, Mus musculus
ggtcctgttgactgctttctgacca

SEQ ID NO: 314677 - DNA, 25 bp, Mus musculus
ggggtcctgttgactgctttctgac

SEQ ID NO: 314678 - DNA, 25 bp, Mus musculus
gcttggcgcacggacgcgaggaggg

SEQ ID NO: 314679 - DNA, 25 bp, Mus musculus
gtcactctcgtctggccaccaactc

SEQ ID NO: 314680 - DNA, 25 bp, Mus musculus
actgctttctgaccagtggggggtt

SEQ ID NO: 314681 - DNA, 25 bp, Mus musculus
ggggttgcctgtgcgtacagaaggg

SEQ ID NO: 314682 - DNA, 25 bp, Mus musculus
tgttgactgctttctgaccagtggg

SEQ ID NO: 314683 - DNA, 25 bp, Mus musculus
ggttccgggccagctgctgactggc

SEQ ID NO: 314684 - DNA, 25 bp, Mus musculus
ttctccacagcaccggcaagtgagc

SEQ ID NO: 314685 - DNA, 25 bp, Mus musculus
cgccatagtggagccgccaaagccg

SEQ ID NO: 314686 - DNA, 25 bp, Mus musculus
acagcaccggcaagtgagcaggcag

SEQ ID NO: 314687 - DNA, 25 bp, Mus musculus
cgccgccatagtggagccgccaaag

SEQ ID NO: 314688 - DNA, 25 bp, Mus musculus
gcaagggcaggtgtctactttaaaa

SEQ ID NO: 314689 - DNA, 25 bp, Mus musculus
aggcaagggcaggtgtctactttaa

SEQ ID NO: 314690 - DNA, 25 bp, Mus musculus
ctgaggcaagggcaggtgtctactt

SEQ ID NO: 314691 - DNA, 25 bp, Mus musculus
cgaaggcgaacaggccgccttcgcg

SEQ ID NO: 314692 - DNA, 25 bp, Mus musculus
ccagctgctgactggcggcgaaggc

SEQ ID NO: 314693 - DNA, 25 bp, Mus musculus
gaggcaccagcaaggccgccgccgc

SEQ ID NO: 314694 - DNA, 25 bp, Mus musculus
ccacagcaccggcaagtgagcaggc

SEQ ID NO: 314695 - DNA, 25 bp, Mus musculus
cggcgaaggcgaacaggccgccttc

SEQ ID NO: 314696 - DNA, 25 bp, Mus musculus
cttctccacagcaccggcaagtgag

SEQ ID NO: 314697 - DNA, 25 bp, Mus musculus
agaaaggcaatgatccaggatgagc

SEQ ID NO: 314698 - DNA, 25 bp, Mus musculus
cagcacctccgagtggtccagcttg

SEQ ID NO: 314699 - DNA, 25 bp, Mus musculus
gcacctccgagtggtccagcttggc

SEQ ID NO: 314700 - DNA, 25 bp, Mus musculus
tgcagatggagaaaggcaatgatcc

SEQ ID NO: 314701 - DNA, 25 bp, Mus musculus
gcaatgatccaggatgagcgatccc

SEQ ID NO: 314702 - DNA, 25 bp, Mus musculus
tccaggatgagcgatcccggaacca

SEQ ID NO: 314703 - DNA, 25 bp, Mus musculus
gccgcatctctgtggccgcgagcaa

SEQ ID NO: 314704 - DNA, 25 bp, Mus musculus
gcgatcccggaaccacctcctagtg

SEQ ID NO: 314705 - DNA, 25 bp, Mus musculus
acgtggcgtccacccagtcgcttgc

SEQ ID NO: 314706 - DNA, 25 bp, Mus musculus
agtcgcttgccgcatctctgtggcc

SEQ ID NO: 314707 - DNA, 25 bp, Mus musculus
gcttgccgcatctctgtggccgcga

SEQ ID NO: 314708 - DNA, 25 bp, Mus musculus
aggatgagcgatcccggaaccacct

SEQ ID NO: 314709 - DNA, 25 bp, Mus musculus
ccagcttggcctgcgtgcgtgcaga

SEQ ID NO: 314710 - DNA, 25 bp, Mus musculus
cccgcaggctcttgatccctgcgcg

SEQ ID NO: 314711 - DNA, 25 bp, Mus musculus
gacgccacagcgtgaaaaccgcatg

SEQ ID NO: 314712 - DNA, 25 bp, Mus musculus
ccgcatgcatttcgaaatggaaaga

SEQ ID NO: 314713 - DNA, 25 bp, Mus musculus
ttcgggatcagaacctaagtgtcgc

SEQ ID NO: 314714 - DNA, 25 bp, Mus musculus
agtagtatcactccgcttccctaag

SEQ ID NO: 314715 - DNA, 25 bp, Mus musculus
cccggcggatgtaggtagctatgta

SEQ ID NO: 314716 - DNA, 25 bp, Mus musculus
aaggcggccgctttttcttctgacg

SEQ ID NO: 314717 - DNA, 25 bp, Mus musculus
ccgacatttggtaatcgcctgcttg

SEQ ID NO: 314718 - DNA, 25 bp, Mus musculus
ctccgtaatgacgtagccgcgccta

SEQ ID NO: 314719 - DNA, 25 bp, Mus musculus
ctatgtagtcgcttcgtgagggacc

SEQ ID NO: 314720 - DNA, 25 bp, Mus musculus
cgcagtgtgcgccacagtagtatca

SEQ ID NO: 314721 - DNA, 25 bp, Mus musculus
agtaatttgctagtcatggcccttc

SEQ ID NO: 314722 - DNA, 25 bp, Mus musculus
atggcccttcatcttgtcctacatc

SEQ ID NO: 314723 - DNA, 25 bp, Mus musculus
ccctaaattacagtcgccgccattg

SEQ ID NO: 314724 - DNA, 25 bp, Mus musculus
tgcctgcctcctttctgtgtgggaa

SEQ ID NO: 314725 - DNA, 25 bp, Mus musculus
caccctccaggcgagctggcttgcc

SEQ ID NO: 314726 - DNA, 25 bp, Mus musculus
accctccaggcgagctggcttgccg

SEQ ID NO: 314727 - DNA, 25 bp, Mus musculus
ccctccaggcgagctggcttgccgc

SEQ ID NO: 314728 - DNA, 25 bp, Mus musculus
ctccaggcgagctggcttgccgcag

SEQ ID NO: 314729 - DNA, 25 bp, Mus musculus
aggcgagctggcttgccgcagtcta

SEQ ID NO: 314730 - DNA, 25 bp, Mus musculus
cctccaggcgagctggcttgccgca

SEQ ID NO: 314731 - DNA, 25 bp, Mus musculus
ggcgagctggcttgccgcagtctac

SEQ ID NO: 314732 - DNA, 25 bp, Mus musculus
gcgagctggcttgccgcagtctacg

SEQ ID NO: 314733 - DNA, 25 bp, Mus musculus
cgagctggcttgccgcagtctacgc

SEQ ID NO: 314734 - DNA, 25 bp, Mus musculus
gagctggcttgccgcagtctacgca

SEQ ID NO: 314735 - DNA, 25 bp, Mus musculus
agctggcttgccgcagtctacgcag

SEQ ID NO: 314736 - DNA, 25 bp, Mus musculus
ttaaagaccagtgagaggatccgcc

SEQ ID NO: 314737 - DNA, 25 bp, Mus musculus
caggcgagctggcttgccgcagtct

SEQ ID NO: 314738 - DNA, 25 bp, Mus musculus
tccaggcgagctggcttgccgcagt

SEQ ID NO: 314739 - DNA, 25 bp, Mus musculus
ggaactaaggcagggccgcaggagc

SEQ ID NO: 314740 - DNA, 25 bp, Mus musculus
ggggaactaaggcagggccgcagga

SEQ ID NO: 314741 - DNA, 25 bp, Mus musculus
gcggggaactaaggcagggccgcag

SEQ ID NO: 314742 - DNA, 25 bp, Mus musculus
agcggggaactaaggcagggccgca

SEQ ID NO: 314743 - DNA, 25 bp, Mus musculus
aaaggccagtgagaggatctgcaga

SEQ ID NO: 314744 - DNA, 25 bp, Mus musculus
taaaggccagtgagaggatctgcag

SEQ ID NO: 314745 - DNA, 25 bp, Mus musculus
aactaaggcagggccgcaggagcag

SEQ ID NO: 314746 - DNA, 25 bp, Mus musculus
gctggcttgtcgcatcctgcgcagc

SEQ ID NO: 314747 - DNA, 25 bp, Mus musculus
gagctggcttgtcgcatcctgcgca

SEQ ID NO: 314748 - DNA, 25 bp, Mus musculus
agagctggcttgtcgcatcctgcgc

SEQ ID NO: 314749 - DNA, 25 bp, Mus musculus
gagagctggcttgtcgcatcctgcg

SEQ ID NO: 314750 - DNA, 25 bp, Mus musculus
acaccctcgaggagagctggcttgt

SEQ ID NO: 314751 - DNA, 25 bp, Mus musculus
ttaaaggccagtgagaggatctgca

SEQ ID NO: 314752 - DNA, 25 bp, Mus musculus
gggaactaaggcagggccgcaggag

SEQ ID NO: 314753 - DNA, 25 bp, Mus musculus
gcggtcgcgcactgcaaacaactgc

SEQ ID NO: 314754 - DNA, 25 bp, Mus musculus
tgggcggtcgcgcactgcaaacaac

SEQ ID NO: 314755 - DNA, 25 bp, Mus musculus
gctctgggcggtcgcgcactgcaaa

SEQ ID NO: 314756 - DNA, 25 bp, Mus musculus
cacccaggaataggagtcggacgtg

SEQ ID NO: 314757 - DNA, 25 bp, Mus musculus
gaacacccaggaataggagtcggac

SEQ ID NO: 314758 - DNA, 25 bp, Mus musculus
tggggacaggacacatctctgccat

SEQ ID NO: 314759 - DNA, 25 bp, Mus musculus
aggcgtggggacaggacacatctct

SEQ ID NO: 314760 - DNA, 25 bp, Mus musculus
tcttagccatcccacacactgttgt

SEQ ID NO: 314761 - DNA, 25 bp, Mus musculus
tcgcgcactgcaaacaactgcctgg

SEQ ID NO: 314762 - DNA, 25 bp, Mus musculus
gcagacgcctaaccggtgcaaccca

SEQ ID NO: 314763 - DNA, 25 bp, Mus musculus
gtctgcagacgcctaaccggtgcaa

SEQ ID NO: 314764 - DNA, 25 bp, Mus musculus
caaacaactgcctggccctgacagt

SEQ ID NO: 314765 - DNA, 25 bp, Mus musculus
acacactgttgtggcgccaaaaaaa

SEQ ID NO: 314766 - DNA, 25 bp, Mus musculus
actgcaaacaactgcctggccctga

SEQ ID NO: 314767 - DNA, 25 bp, Mus musculus
ggagcccggacacctgggccgtgcg

SEQ ID NO: 314768 - DNA, 25 bp, Mus musculus
acactgaggaccactgcccggccct

SEQ ID NO: 314769 - DNA, 25 bp, Mus musculus
cgccgaggacagagaccagccggga

SEQ ID NO: 314770 - DNA, 25 bp, Mus musculus
gctccgagtggtcgcacactgagga

SEQ ID NO: 314771 - DNA, 25 bp, Mus musculus
tgaaggccagcaggtcgcggcctcc

SEQ ID NO: 314772 - DNA, 25 bp, Mus musculus
ggcgggacacgtctctgccattcca

SEQ ID NO: 314773 - DNA, 25 bp, Mus musculus
tcgagggctccgagtggtcgcacac

SEQ ID NO: 314774 - DNA, 25 bp, Mus musculus
ctgtttggtgcagagacgtaggggc

SEQ ID NO: 314775 - DNA, 25 bp, Mus musculus
tgagctgtgcttgccgcatcctgcg

SEQ ID NO: 314776 - DNA, 25 bp, Mus musculus
aggtgagctgtgcttgccgcatcct

SEQ ID NO: 314777 - DNA, 25 bp, Mus musculus
acaccctcgaggtgagctgtgcttg

SEQ ID NO: 314778 - DNA, 25 bp, Mus musculus
ccgacaccctcgaggtgagctgtgc

SEQ ID NO: 314779 - DNA, 25 bp, Mus musculus
cctgacagtccagtgaaggccagca

SEQ ID NO: 314780 - DNA, 25 bp, Mus musculus
acagtccagtgaaggccagcaggtc

SEQ ID NO: 314781 - DNA, 25 bp, Mus musculus
tgaacaccctgcaagatgaactccc

SEQ ID NO: 314782 - DNA, 25 bp, Mus musculus
gccgattgaacaccctgcaagatga

SEQ ID NO: 314783 - DNA, 25 bp, Mus musculus
gccgccgattgaacaccctgcaaga

SEQ ID NO: 314784 - DNA, 25 bp, Mus musculus
ggagccgccgattgaacaccctgca

SEQ ID NO: 314785 - DNA, 25 bp, Mus musculus
gagggagccgccgattgaacaccct

SEQ ID NO: 314786 - DNA, 25 bp, Mus musculus
cagcgagcgccggtggagcccgcgt

SEQ ID NO: 314787 - DNA, 25 bp, Mus musculus
ggaccgcggagcgaactgcacgccc

SEQ ID NO: 314788 - DNA, 25 bp, Mus musculus
acgcgtgcgcgagcccggcattccg

SEQ ID NO: 314789 - DNA, 25 bp, Mus musculus
aagatgaactccctgctgtcccggg

SEQ ID NO: 314790 - DNA, 25 bp, Mus musculus
cctgcaagatgaactccctgctgtc

SEQ ID NO: 314791 - DNA, 25 bp, Mus musculus
cggcgctcaccttgggctgcatcct

SEQ ID NO: 314792 - DNA, 25 bp, Mus musculus
caactcgctgttcgccttcacgctg

SEQ ID NO: 314793 - DNA, 25 bp, Mus musculus
tgctgtcccgggccaactcgctgtt

SEQ ID NO: 314794 - DNA, 25 bp, Mus musculus
cattccgcgcgagccagaggaaggc

SEQ ID NO: 314795 - DNA, 25 bp, Mus musculus
caatagcgctgaggagaaccgggat

SEQ ID NO: 314796 - DNA, 25 bp, Mus musculus
cccgcactctctgatccgtgaaggg

SEQ ID NO: 314797 - DNA, 25 bp, Mus musculus
ccgattgacgtgacttgtgggcgca

SEQ ID NO: 314798 - DNA, 25 bp, Mus musculus
aagctcggccgattgacgtgacttg

SEQ ID NO: 314799 - DNA, 25 bp, Mus musculus
cgtccctaaagaggcaatagcgctg

SEQ ID NO: 314800 - DNA, 25 bp, Mus musculus
cgcgctgctggaccgtccctaaaga

SEQ ID NO: 314801 - DNA, 25 bp, Mus musculus
cagtctacgagacgcgctgctggac

SEQ ID NO: 314802 - DNA, 25 bp, Mus musculus
agcacacttgggactctgggccagt

SEQ ID NO: 314803 - DNA, 25 bp, Mus musculus
aacctggggtcagcacacttgggac

SEQ ID NO: 314804 - DNA, 25 bp, Mus musculus
agcggcgttcgacgtcagtgcgcac

SEQ ID NO: 314805 - DNA, 25 bp, Mus musculus
actctctgatccgtgaaggggccct

SEQ ID NO: 314806 - DNA, 25 bp, Mus musculus
cctagcgccggctgacagcggcgtt

SEQ ID NO: 314807 - DNA, 25 bp, Mus musculus
ggctagaggccctggctcttacctc

SEQ ID NO: 314808 - DNA, 25 bp, Mus musculus
ctctgggccagtctacgagacgcgc

SEQ ID NO: 314809 - DNA, 25 bp, Mus musculus
caccctctagcggtcgcgattggaa

SEQ ID NO: 314810 - DNA, 25 bp, Mus musculus
aggcgcaagcgcagatgccatggtc

SEQ ID NO: 314811 - DNA, 25 bp, Mus musculus
acaaacagacgctaggggcaacgga

SEQ ID NO: 314812 - DNA, 25 bp, Mus musculus
ttggcatagaccactactgtgctcc

SEQ ID NO: 314813 - DNA, 25 bp, Mus musculus
atcgcgaccctcttggcatagacca

SEQ ID NO: 314814 - DNA, 25 bp, Mus musculus
attgagcctaaggtgctgccctacc

SEQ ID NO: 314815 - DNA, 25 bp, Mus musculus
caggggcgactcgattgagcctaag

SEQ ID NO: 314816 - DNA, 25 bp, Mus musculus
ttcggaaagatagcaggggcgactc

SEQ ID NO: 314817 - DNA, 25 bp, Mus musculus
ggaatctgtgcctgcttcggaaaga

SEQ ID NO: 314818 - DNA, 25 bp, Mus musculus
ccgaagcctgcgaacggaatctgtg

SEQ ID NO: 314819 - DNA, 25 bp, Mus musculus
tcagattccgccatgccgaagcctg

SEQ ID NO: 314820 - DNA, 25 bp, Mus musculus
caccgggcaccagtgactcagattc

SEQ ID NO: 314821 - DNA, 25 bp, Mus musculus
atctaaggcggttgactgaggctca

SEQ ID NO: 314822 - DNA, 25 bp, Mus musculus
tcaggttgcggcctgtaccactacg

SEQ ID NO: 314823 - DNA, 25 bp, Mus musculus
cgagctgctggccagacgctcgtga

SEQ ID NO: 314824 - DNA, 25 bp, Mus musculus
ctgcgtcactgccaagcccgctccc

SEQ ID NO: 314825 - DNA, 25 bp, Mus musculus
tgagggccctgcgtcactgccaagc

SEQ ID NO: 314826 - DNA, 25 bp, Mus musculus
ccagacgctcgtgacgactgcaccc

SEQ ID NO: 314827 - DNA, 25 bp, Mus musculus
ctggccagacgctcgtgacgactgc

SEQ ID NO: 314828 - DNA, 25 bp, Mus musculus
ctgctggccagacgctcgtgacgac

SEQ ID NO: 314829 - DNA, 25 bp, Mus musculus
cgcgcagaggagctccgagctgctg

SEQ ID NO: 314830 - DNA, 25 bp, Mus musculus
cccttacctgtcccgctcgcctcgg

SEQ ID NO: 314831 - DNA, 25 bp, Mus musculus
cccgcccgtcgcgaggctgtcgccc

SEQ ID NO: 314832 - DNA, 25 bp, Mus musculus
cacaaagccgcggtgcgcgcccgcc

SEQ ID NO: 314833 - DNA, 25 bp, Mus musculus
ccgcgcggtgcacaaagccgcggtg

SEQ ID NO: 314834 - DNA, 25 bp, Mus musculus
ggggctcgctctagcgctctccgct

SEQ ID NO: 314835 - DNA, 25 bp, Mus musculus
cgccgccagtgctcacctcgggccc

SEQ ID NO: 314836 - DNA, 25 bp, Mus musculus
tcgctctagcgctctccgctgcggg

SEQ ID NO: 314837 - DNA, 25 bp, Mus musculus
agaccctcggggagtaggagcatgc

SEQ ID NO: 314838 - DNA, 25 bp, Mus musculus
ggagctttggcttctgacgcaagtg

SEQ ID NO: 314839 - DNA, 25 bp, Mus musculus
ctttggcttctgacgcaagtggcac

SEQ ID NO: 314840 - DNA, 25 bp, Mus musculus
ttctgacgcaagtggcacgtgacta

SEQ ID NO: 314841 - DNA, 25 bp, Mus musculus
acgcaagtggcacgtgactagccca

SEQ ID NO: 314842 - DNA, 25 bp, Mus musculus
tggcacgtgactagcccacgcaggc

SEQ ID NO: 314843 - DNA, 25 bp, Mus musculus
cctcgctgggtctcggacctgccct

SEQ ID NO: 314844 - DNA, 25 bp, Mus musculus
tctccagcccgccatccctaacgga

SEQ ID NO: 314845 - DNA, 25 bp, Mus musculus
ccctaacggaggcacctgttcctgg

SEQ ID NO: 314846 - DNA, 25 bp, Mus musculus
aacggaggcacctgttcctggtggc

SEQ ID NO: 314847 - DNA, 25 bp, Mus musculus
ggcttctgacgcaagtggcacgtga

SEQ ID NO: 314848 - DNA, 25 bp, Mus musculus
aggccgaggctgcaggtggccgtcc

SEQ ID NO: 314849 - DNA, 25 bp, Mus musculus
gagtaggagcatgcgccccgcgaca

SEQ ID NO: 314850 - DNA, 25 bp, Mus musculus
gcacctgttcctggtggcgcagctc

SEQ ID NO: 314851 - DNA, 25 bp, Mus musculus
atgccggggtctatgggaagctgtc

SEQ ID NO: 314852 - DNA, 25 bp, Mus musculus
cacttgcgtcagaagccaaagctcc

SEQ ID NO: 314853 - DNA, 25 bp, Mus musculus
cgtgccacttgcgtcagaagccaaa

SEQ ID NO: 314854 - DNA, 25 bp, Mus musculus
ggctagtcacgtgccacttgcgtca

SEQ ID NO: 314855 - DNA, 25 bp, Mus musculus
cctgcgtgggctagtcacgtgccac

SEQ ID NO: 314856 - DNA, 25 bp, Mus musculus
gagacccagcgaggggtgtgagcct

SEQ ID NO: 314857 - DNA, 25 bp, Mus musculus
gctgcgcacaccaggacggccacct

SEQ ID NO: 314858 - DNA, 25 bp, Mus musculus
gacggccacctgcagcctcggcctg

SEQ ID NO: 314859 - DNA, 25 bp, Mus musculus
cctcctgctgctttccgcgccgccc

SEQ ID NO: 314860 - DNA, 25 bp, Mus musculus
gagctgcgccaccaggaacaggtgc

SEQ ID NO: 314861 - DNA, 25 bp, Mus musculus
ccaccaggaacaggtgcctccgtta

SEQ ID NO: 314862 - DNA, 25 bp, Mus musculus
aggaacaggtgcctccgttagggat

SEQ ID NO: 314863 - DNA, 25 bp, Mus musculus
agcgagggcaggtccgagacccagc

SEQ ID NO: 314864 - DNA, 25 bp, Mus musculus
tgtcgcggggcgcatgctcctactc

SEQ ID NO: 314865 - DNA, 25 bp, Mus musculus
gcttggcagtgacgcagggccctca

SEQ ID NO: 314866 - DNA, 25 bp, Mus musculus
cccgcagcggagagcgctagagcga

SEQ ID NO: 314867 - DNA, 25 bp, Mus musculus
gctttgtgcaccgcgcggggaaccc

SEQ ID NO: 314868 - DNA, 25 bp, Mus musculus
cgcgcaccgcggctttgtgcaccgc

SEQ ID NO: 314869 - DNA, 25 bp, Mus musculus
gccctgcgggcgacagcctcgcgac

SEQ ID NO: 314870 - DNA, 25 bp, Mus musculus
agcgggacaggtaaggggcctgcac

SEQ ID NO: 314871 - DNA, 25 bp, Mus musculus
cagcagctcggagctcctctgcgcg

SEQ ID NO: 314872 - DNA, 25 bp, Mus musculus
tcacgagcgtctggccagcagctcg

SEQ ID NO: 314873 - DNA, 25 bp, Mus musculus
cgtcacgagcgtctggccagcagct

SEQ ID NO: 314874 - DNA, 25 bp, Mus musculus
gtcgtcacgagcgtctggccagcag

SEQ ID NO: 314875 - DNA, 25 bp, Mus musculus
cagcggagagcgctagagcgagccc

SEQ ID NO: 314876 - DNA, 25 bp, Mus musculus
gcagtcgtcacgagcgtctggccag

SEQ ID NO: 314877 - DNA, 25 bp, Mus musculus
ggcccgaggtgagcactggcggcgg

SEQ ID NO: 314878 - DNA, 25 bp, Mus musculus
cagtcgtcacgagcgtctggccagc

SEQ ID NO: 314879 - DNA, 25 bp, Mus musculus
cattatgggtttgtgggtccgctcc

SEQ ID NO: 314880 - DNA, 25 bp, Mus musculus
gatgcctggatgctttggagaaacg

SEQ ID NO: 314881 - DNA, 25 bp, Mus musculus
ccactgggcggatgcctggatgctt

SEQ ID NO: 314882 - DNA, 25 bp, Mus musculus
caaaggcaaaggaatggtgaaggtt

SEQ ID NO: 314883 - DNA, 25 bp, Mus musculus
agcctgttgcgcaactcgcggacct

SEQ ID NO: 314884 - DNA, 25 bp, Mus musculus
acaggctaggcggaaatgagctaag

SEQ ID NO: 314885 - DNA, 25 bp, Mus musculus
agcgcgttcacgtggcccgtcttca

SEQ ID NO: 314886 - DNA, 25 bp, Mus musculus
tcagaagtctatagggcagcgcgtt

SEQ ID NO: 314887 - DNA, 25 bp, Mus musculus
tccagccgttgggtcagaagtctat

SEQ ID NO: 314888 - DNA, 25 bp, Mus musculus
ctccaagtgcgctccagccgttggg

SEQ ID NO: 314889 - DNA, 25 bp, Mus musculus
tcttttaggatcttagcccgccctc

SEQ ID NO: 314890 - DNA, 25 bp, Mus musculus
cgccaatggcgatggttcttttagg

SEQ ID NO: 314891 - DNA, 25 bp, Mus musculus
ctctcctgcagggaggcattatggg

SEQ ID NO: 314892 - DNA, 25 bp, Mus musculus
aaatgagctaaggttcccgcgagtg

SEQ ID NO: 314893 - DNA, 25 bp, Mus musculus
gatgagcgtagagcccgtctgatca

SEQ ID NO: 314894 - DNA, 25 bp, Mus musculus
cagtggctgaaggaaccatggcgat

SEQ ID NO: 314895 - DNA, 25 bp, Mus musculus
agagagatccagaccgctattcgac

SEQ ID NO: 314896 - DNA, 25 bp, Mus musculus
aagccagcttcttggcgcgtcaagc

SEQ ID NO: 314897 - DNA, 25 bp, Mus musculus
tgaaagaattgcatccgaagccagc

SEQ ID NO: 314898 - DNA, 25 bp, Mus musculus
cctggattcattcgtgaaggatatg

SEQ ID NO: 314899 - DNA, 25 bp, Mus musculus
agcggtctgtgaacatcctggattc

SEQ ID NO: 314900 - DNA, 25 bp, Mus musculus
tctccctctcgcagcggtctgtgaa

SEQ ID NO: 314901 - DNA, 25 bp, Mus musculus
gctgaaaaatatccacgtgggtctc

SEQ ID NO: 314902 - DNA, 25 bp, Mus musculus
tcagacgccgtaagaacagcttcgc

SEQ ID NO: 314903 - DNA, 25 bp, Mus musculus
ggcgtcgctcacttcaccaaagcat

SEQ ID NO: 314904 - DNA, 25 bp, Mus musculus
gcgcgtcaagccagaaactctacta

SEQ ID NO: 314905 - DNA, 25 bp, Mus musculus
gctatctactttccgaaggtgctga

SEQ ID NO: 314906 - DNA, 25 bp, Mus musculus
attcgacttctgcttcctggcgagc

SEQ ID NO: 314907 - DNA, 25 bp, Mus musculus
ccaactcgttcacggaggcggtggt

SEQ ID NO: 314908 - DNA, 25 bp, Mus musculus
ctcgagctcggggtcggaggaggca

SEQ ID NO: 314909 - DNA, 25 bp, Mus musculus
gcacggaccaactcgttcacggagg

SEQ ID NO: 314910 - DNA, 25 bp, Mus musculus
ggcacggaccaactcgttcacggag

SEQ ID NO: 314911 - DNA, 25 bp, Mus musculus
tggcacggaccaactcgttcacgga

SEQ ID NO: 314912 - DNA, 25 bp, Mus musculus
ctggcacggaccaactcgttcacgg

SEQ ID NO: 314913 - DNA, 25 bp, Mus musculus
ggcctggcacggaccaactcgttca

SEQ ID NO: 314914 - DNA, 25 bp, Mus musculus
cacggaccaactcgttcacggaggc

SEQ ID NO: 314915 - DNA, 25 bp, Mus musculus
cttggcgccatgagcagcggccagc

SEQ ID NO: 314916 - DNA, 25 bp, Mus musculus
gaccaactcgttcacggaggcggtg

SEQ ID NO: 314917 - DNA, 25 bp, Mus musculus
accaactcgttcacggaggcggtgg

SEQ ID NO: 314918 - DNA, 25 bp, Mus musculus
cgcttggcgccatgagcagcggcca

SEQ ID NO: 314919 - DNA, 25 bp, Mus musculus
cggaccaactcgttcacggaggcgg

SEQ ID NO: 314920 - DNA, 25 bp, Mus musculus
tcgggcctggcacggaccaactcgt

SEQ ID NO: 314921 - DNA, 25 bp, Mus musculus
cccagaatctcgtggcagctttccg

SEQ ID NO: 314922 - DNA, 25 bp, Mus musculus
ggtttctaaccttgagccggagaca

SEQ ID NO: 314923 - DNA, 25 bp, Mus musculus
agaagcctctgcgaaggtcgccgcc

SEQ ID NO: 314924 - DNA, 25 bp, Mus musculus
tcgccgggtgttcggtccgttctca

SEQ ID NO: 314925 - DNA, 25 bp, Mus musculus
agcacaccggaaacagcgacacgcg

SEQ ID NO: 314926 - DNA, 25 bp, Mus musculus
tatccagccgtatggcctccgggag

SEQ ID NO: 314927 - DNA, 25 bp, Mus musculus
gcgtcatcaacagtcgccgggtgtt

SEQ ID NO: 314928 - DNA, 25 bp, Mus musculus
agttcccatctctttgagccttttg

SEQ ID NO: 314929 - DNA, 25 bp, Mus musculus
gcagtagcaacacggggcccgatcc

SEQ ID NO: 314930 - DNA, 25 bp, Mus musculus
cttttggcagctggaggtttctaac

SEQ ID NO: 314931 - DNA, 25 bp, Mus musculus
tgggactgacctatccagccgtatg

SEQ ID NO: 314932 - DNA, 25 bp, Mus musculus
cctccgggagcatcggcaacagtag

SEQ ID NO: 314933 - DNA, 25 bp, Mus musculus
tcggcaacagtagcggcagtagcaa

SEQ ID NO: 314934 - DNA, 25 bp, Mus musculus
cgctgctgtggcgtcatcaacagtc

SEQ ID NO: 314935 - DNA, 25 bp, Mus musculus
cggagttccgaggtcccgattgcac

SEQ ID NO: 314936 - DNA, 25 bp, Mus musculus
cccacgttctggtgatttgctttcc

SEQ ID NO: 314937 - DNA, 25 bp, Mus musculus
gagcagctccgtagtgagcccggtc

SEQ ID NO: 314938 - DNA, 25 bp, Mus musculus
ctgggcgtggtctgccattaagccc

SEQ ID NO: 314939 - DNA, 25 bp, Mus musculus
caggagcgctagttttcccacgttc

SEQ ID NO: 314940 - DNA, 25 bp, Mus musculus
actgcgaagcgagttctggaacctc

SEQ ID NO: 314941 - DNA, 25 bp, Mus musculus
gctttcccttagtgtccgcaactca

SEQ ID NO: 314942 - DNA, 25 bp, Mus musculus
cggcgagccctactgtcagagtgca

SEQ ID NO: 314943 - DNA, 25 bp, Mus musculus
ttaactagagtgacccgggtggctc

SEQ ID NO: 314944 - DNA, 25 bp, Mus musculus
aagtttgtccctttgctctccgccg

SEQ ID NO: 314945 - DNA, 25 bp, Mus musculus
ccgggagtcaaaccagaaggctatc

SEQ ID NO: 314946 - DNA, 25 bp, Mus musculus
cgcgagagctcggatcatgtgctat

SEQ ID NO: 314947 - DNA, 25 bp, Mus musculus
catgtgctatttatcccgcggaggc

SEQ ID NO: 314948 - DNA, 25 bp, Mus musculus
ccggtcttaggcatcccagaaagtt

SEQ ID NO: 314949 - DNA, 25 bp, Mus musculus
ctccgggtagcccaggagctggcag

SEQ ID NO: 314950 - DNA, 25 bp, Mus musculus
gccgcagtgactcgtcgggcttggc

SEQ ID NO: 314951 - DNA, 25 bp, Mus musculus
ttgggtcgccctgggcttaagacac

SEQ ID NO: 314952 - DNA, 25 bp, Mus musculus
aagccggcccatctcccaccatgtc

SEQ ID NO: 314953 - DNA, 25 bp, Mus musculus
gcggcctcgcagcaacctttgtgca

SEQ ID NO: 314954 - DNA, 25 bp, Mus musculus
ttctgaggtttcagaggagcggact

SEQ ID NO: 314955 - DNA, 25 bp, Mus musculus
tcagttcctcctccactccggcagg

SEQ ID NO: 314956 - DNA, 25 bp, Mus musculus
gcagcaacctttgtgcagagccctc

SEQ ID NO: 314957 - DNA, 25 bp, Mus musculus
gggcgagtgccagagtagcccatct

SEQ ID NO: 314958 - DNA, 25 bp, Mus musculus
agtagcccatctgcagccagtgaga

SEQ ID NO: 314959 - DNA, 25 bp, Mus musculus
agccagtgagaccaagccggcccat

SEQ ID NO: 314960 - DNA, 25 bp, Mus musculus
tcgccctgggcttaagacactgaca

SEQ ID NO: 314961 - DNA, 25 bp, Mus musculus
gccctgggcttaagacactgacatt

SEQ ID NO: 314962 - DNA, 25 bp, Mus musculus
agacactgacattcagttcctcctc

SEQ ID NO: 314963 - DNA, 25 bp, Mus musculus
gaagcactcgctctttaacgccatg

SEQ ID NO: 314964 - DNA, 25 bp, Mus musculus
ctgtctcccaagcagaaaaaggcta

SEQ ID NO: 314965 - DNA, 25 bp, Mus musculus
aatcgcttcattggcgcggtgaaca

SEQ ID NO: 314966 - DNA, 25 bp, Mus musculus
aaccaggggatttcgcagtgcaaga

SEQ ID NO: 314967 - DNA, 25 bp, Mus musculus
atcgccagcggtctatctccgtgta

SEQ ID NO: 314968 - DNA, 25 bp, Mus musculus
gctcggccaccatgatgcaaatctg

SEQ ID NO: 314969 - DNA, 25 bp, Mus musculus
ggctgggaccttttatctgtgctgc

SEQ ID NO: 314970 - DNA, 25 bp, Mus musculus
ccgtccgcaacgcaagcactgagaa

SEQ ID NO: 314971 - DNA, 25 bp, Mus musculus
cccgggctaatatggttgctttcgc

SEQ ID NO: 314972 - DNA, 25 bp, Mus musculus
tgataccggctggtcccaaggaacc

SEQ ID NO: 314973 - DNA, 25 bp, Mus musculus
ggaaccacccttgtgccttctctgg

SEQ ID NO: 314974 - DNA, 25 bp, Mus musculus
tctgggaatcccgtcacaccggctt

SEQ ID NO: 314975 - DNA, 25 bp, Mus musculus
atctccgtgtaccagcgtccctgtg

SEQ ID NO: 314976 - DNA, 25 bp, Mus musculus
tcccggactataaattgagcacctg

SEQ ID NO: 314977 - DNA, 25 bp, Mus musculus
cgaggttgctctgccgtcggttccc

SEQ ID NO: 314978 - DNA, 25 bp, Mus musculus
gacgcgctggaaaaaggcctccagc

SEQ ID NO: 314979 - DNA, 25 bp, Mus musculus
acaggccacgggtgccagcttttgc

SEQ ID NO: 314980 - DNA, 25 bp, Mus musculus
tgctcaacaggccacgggtgccagc

SEQ ID NO: 314981 - DNA, 25 bp, Mus musculus
cccagagcctgcagatctaagttgg

SEQ ID NO: 314982 - DNA, 25 bp, Mus musculus
gagcctgcagatctaagttggaccc

SEQ ID NO: 314983 - DNA, 25 bp, Mus musculus
tctggcgtgctaccacccagcaaag

SEQ ID NO: 314984 - DNA, 25 bp, Mus musculus
tttgcgcgctccgttggcccagagc

SEQ ID NO: 314985 - DNA, 25 bp, Mus musculus
gagtctgcctgccacatggtcgcca

SEQ ID NO: 314986 - DNA, 25 bp, Mus musculus
ctcacctagcaaacaggtccgggta

SEQ ID NO: 314987 - DNA, 25 bp, Mus musculus
aacaggtccgggtactggacgcgct

SEQ ID NO: 314988 - DNA, 25 bp, Mus musculus
ctccgctgcgaggttgctctgccgt

SEQ ID NO: 314989 - DNA, 25 bp, Mus musculus
tactggacgcgctggaaaaaggcct

SEQ ID NO: 314990 - DNA, 25 bp, Mus musculus
agcttttgcgcgctccgttggccca

SEQ ID NO: 314991 - DNA, 25 bp, Mus musculus
atcagaggacgcatcagggactgcc

SEQ ID NO: 314992 - DNA, 25 bp, Mus musculus
ttctcctcttgagggttcgaatccc

SEQ ID NO: 314993 - DNA, 25 bp, Mus musculus
ttgcggcgaagactgagcaacaggc

SEQ ID NO: 314994 - DNA, 25 bp, Mus musculus
acaggctgcatcagaggacgcatca

SEQ ID NO: 314995 - DNA, 25 bp, Mus musculus
gaggacgcatcagggactgccgcac

SEQ ID NO: 314996 - DNA, 25 bp, Mus musculus
ccagctgagcgttggactccaggaa

SEQ ID NO: 314997 - DNA, 25 bp, Mus musculus
agcgttggactccaggaagccgcct

SEQ ID NO: 314998 - DNA, 25 bp, Mus musculus
caggaagccgcctccaaggttttca

SEQ ID NO: 314999 - DNA, 25 bp, Mus musculus
caaggttttcattcccattccaggc

SEQ ID NO: 315000 - DNA, 25 bp, Mus musculus
tcattcccattccaggcttgcggtg

SEQ ID NO: 315001 - DNA, 25 bp, Mus musculus
tccaggcttgcggtgcttctgcaac

SEQ ID NO: 315002 - DNA, 25 bp, Mus musculus
gtgcttctgcaaccggcgctgctgc

SEQ ID NO: 315003 - DNA, 25 bp, Mus musculus
gctgcttctcctcttgagggttcga

SEQ ID NO: 315004 - DNA, 25 bp, Mus musculus
tgagcaacaggctgcatcagaggac

SEQ ID NO: 315005 - DNA, 25 bp, Mus musculus
cccgctcgctacagcgctgccaccc

SEQ ID NO: 315006 - DNA, 25 bp, Mus musculus
gacgcctctctacctgccgcccgct

SEQ ID NO: 315007 - DNA, 25 bp, Mus musculus
tcgacgcctctctacctgccgcccg

SEQ ID NO: 315008 - DNA, 25 bp, Mus musculus
tcctcgacgcctctctacctgccgc

SEQ ID NO: 315009 - DNA, 25 bp, Mus musculus
gctcctcgacgcctctctacctgcc

SEQ ID NO: 315010 - DNA, 25 bp, Mus musculus
ccggctcctcgacgcctctctacct

SEQ ID NO: 315011 - DNA, 25 bp, Mus musculus
tcccggctcctcgacgcctctctac

SEQ ID NO: 315012 - DNA, 25 bp, Mus musculus
gcccgctcgctacagcgctgccacc

SEQ ID NO: 315013 - DNA, 25 bp, Mus musculus
cccatgccgcccctccacacagttc

SEQ ID NO: 315014 - DNA, 25 bp, Mus musculus
ctccacacagttcccctcccggccg

SEQ ID NO: 315015 - DNA, 25 bp, Mus musculus
agcccccactccacgccggacgcta

SEQ ID NO: 315016 - DNA, 25 bp, Mus musculus
cactccacgccggacgctaccccct

SEQ ID NO: 315017 - DNA, 25 bp, Mus musculus
tgccgtcccggctcctcgacgcctc

SEQ ID NO: 315018 - DNA, 25 bp, Mus musculus
cgtcccggctcctcgacgcctctct

SEQ ID NO: 315019 - DNA, 25 bp, Mus musculus
tctggagctcgcgagtcccgtgagc

SEQ ID NO: 315020 - DNA, 25 bp, Mus musculus
cactgttcggcctgaaccaggtgcg

SEQ ID NO: 315021 - DNA, 25 bp, Mus musculus
gcgtcccagcgtggcgcgcactgtt

SEQ ID NO: 315022 - DNA, 25 bp, Mus musculus
tggtagcaccgccaactggggtgcc

SEQ ID NO: 315023 - DNA, 25 bp, Mus musculus
tgagcggtggtagcaccgccaactg

SEQ ID NO: 315024 - DNA, 25 bp, Mus musculus
gcactcctctctttgagggctgggg

SEQ ID NO: 315025 - DNA, 25 bp, Mus musculus
tcccgtgagcggtggtagcaccgcc

SEQ ID NO: 315026 - DNA, 25 bp, Mus musculus
gcgcgcactgttcggcctgaaccag

SEQ ID NO: 315027 - DNA, 25 bp, Mus musculus
tgagccggtggctccgctgctttct

SEQ ID NO: 315028 - DNA, 25 bp, Mus musculus
tgcaagctaggctgcctgcaccaca

SEQ ID NO: 315029 - DNA, 25 bp, Mus musculus
tgcgagtggcttctgcgcactggct

SEQ ID NO: 315030 - DNA, 25 bp, Mus musculus
ctcgcactcctctctttgagggctg

SEQ ID NO: 315031 - DNA, 25 bp, Mus musculus
tgctttctggagctcgcgagtcccg

SEQ ID NO: 315032 - DNA, 25 bp, Mus musculus
ctccgggaagcgctggagccacgca

SEQ ID NO: 315033 - DNA, 25 bp, Mus musculus
gcggagcacccttctggcttcttcg

SEQ ID NO: 315034 - DNA, 25 bp, Mus musculus
ttcttcgtctctcggacggacggac

SEQ ID NO: 315035 - DNA, 25 bp, Mus musculus
aagaccgttagagactccctctgcc

SEQ ID NO: 315036 - DNA, 25 bp, Mus musculus
gaagaccgttagagactccctctgc

SEQ ID NO: 315037 - DNA, 25 bp, Mus musculus
agaggctggcctgaagaccgttaga

SEQ ID NO: 315038 - DNA, 25 bp, Mus musculus
ctagaggctggcctgaagaccgtta

SEQ ID NO: 315039 - DNA, 25 bp, Mus musculus
ctggcttcttcgtctctcggacgga

SEQ ID NO: 315040 - DNA, 25 bp, Mus musculus
gcccacctggcgacgtgacgctcca

SEQ ID NO: 315041 - DNA, 25 bp, Mus musculus
ggcgacgtgacgctccaccaatccc

SEQ ID NO: 315042 - DNA, 25 bp, Mus musculus
ggccgctctgcgctctcgccgcgga

SEQ ID NO: 315043 - DNA, 25 bp, Mus musculus
ggagcacccttctggcttcttcgtc

SEQ ID NO: 315044 - DNA, 25 bp, Mus musculus
ccttctggcttcttcgtctctcgga

SEQ ID NO: 315045 - DNA, 25 bp, Mus musculus
cctgctgcgcggctgcccacctggc

SEQ ID NO: 315046 - DNA, 25 bp, Mus musculus
tcctcaccctgaaaggcgcaccctg

SEQ ID NO: 315047 - DNA, 25 bp, Mus musculus
ccaggaagtggagcactgtgttcga

SEQ ID NO: 315048 - DNA, 25 bp, Mus musculus
aagtggagcactgtgttcgaactga

SEQ ID NO: 315049 - DNA, 25 bp, Mus musculus
tgccaggaagtggagcactgtgttc

SEQ ID NO: 315050 - DNA, 25 bp, Mus musculus
taaggatgccaggaagtggagcact

SEQ ID NO: 315051 - DNA, 25 bp, Mus musculus
ctttaaggatgccaggaagtggagc

SEQ ID NO: 315052 - DNA, 25 bp, Mus musculus
ccatctttaaggatgccaggaagtg

SEQ ID NO: 315053 - DNA, 25 bp, Mus musculus
ccaccatctttaaggatgccaggaa

SEQ ID NO: 315054 - DNA, 25 bp, Mus musculus
gtttctcatgatccccggtgccaca

SEQ ID NO: 315055 - DNA, 25 bp, Mus musculus
gacttgtttctcatgatccccggtg

SEQ ID NO: 315056 - DNA, 25 bp, Mus musculus
cccacagtccttaggacttgtttct

SEQ ID NO: 315057 - DNA, 25 bp, Mus musculus
gcggacccacagtccttaggacttg

SEQ ID NO: 315058 - DNA, 25 bp, Mus musculus
cgcggacccacagtccttaggactt

SEQ ID NO: 315059 - DNA, 25 bp, Mus musculus
tgacgcggacccacagtccttagga

SEQ ID NO: 315060 - DNA, 25 bp, Mus musculus
agaccaccatctttaaggatgccag

SEQ ID NO: 315061 - DNA, 25 bp, Mus musculus
ttggccctcatccaacgcggtggag

SEQ ID NO: 315062 - DNA, 25 bp, Mus musculus
ctgcagtagcctggccgctgacgct

SEQ ID NO: 315063 - DNA, 25 bp, Mus musculus
cttgcttgtaggagctgcgtctgca

SEQ ID NO: 315064 - DNA, 25 bp, Mus musculus
cgagcatccctagcgcttgcttgta

SEQ ID NO: 315065 - DNA, 25 bp, Mus musculus
cggcagtcgcgagcgagcatcccta

SEQ ID NO: 315066 - DNA, 25 bp, Mus musculus
gagcttcgcgcgagcgtcccagagc

SEQ ID NO: 315067 - DNA, 25 bp, Mus musculus
ggctactggcttggtgcttccttct

SEQ ID NO: 315068 - DNA, 25 bp, Mus musculus
cgcacaccggagtgaaccgcacggt

SEQ ID NO: 315069 - DNA, 25 bp, Mus musculus
tgtaacccgcacaccaatttcacgg

SEQ ID NO: 315070 - DNA, 25 bp, Mus musculus
gcaagtatcttggttggccctcatc

SEQ ID NO: 315071 - DNA, 25 bp, Mus musculus
aagccgtgtggaccgcgtacctcaa

SEQ ID NO: 315072 - DNA, 25 bp, Mus musculus
cgtacctcaacgtgtcctggcgggt

SEQ ID NO: 315073 - DNA, 25 bp, Mus musculus
gcttccttctggctctgagtccgca

SEQ ID NO: 315074 - DNA, 25 bp, Mus musculus
ccaatttcacggtgcccacggtttg

SEQ ID NO: 315075 - DNA, 25 bp, Mus musculus
tttgccataggccaggcggccgagc

SEQ ID NO: 315076 - DNA, 25 bp, Mus musculus
tagcagctccgcgatggcactgaag

SEQ ID NO: 315077 - DNA, 25 bp, Mus musculus
ctccgcgatggcactgaagggtcgc

SEQ ID NO: 315078 - DNA, 25 bp, Mus musculus
cgagagaaggttccgtcccgcgtga

SEQ ID NO: 315079 - DNA, 25 bp, Mus musculus
acctaccgtgctcaggcggatcctg

SEQ ID NO: 315080 - DNA, 25 bp, Mus musculus
atcctgaaggcctgcgggacgctgc

SEQ ID NO: 315081 - DNA, 25 bp, Mus musculus
ccctcggtacaggagcatttttttg

SEQ ID NO: 315082 - DNA, 25 bp, Mus musculus
cctaattaattcttggcgtttgcca

SEQ ID NO: 315083 - DNA, 25 bp, Mus musculus
tttggccgccaggataccggtttgc

SEQ ID NO: 315084 - DNA, 25 bp, Mus musculus
ataccggtttgctgctgccggaccc

SEQ ID NO: 315085 - DNA, 25 bp, Mus musculus
ccctgggccgtacagaaatatggcg

SEQ ID NO: 315086 - DNA, 25 bp, Mus musculus
cgtacagaaatatggcgatctcctg

SEQ ID NO: 315087 - DNA, 25 bp, Mus musculus
tggcacctctgcctcgggcttgcga

SEQ ID NO: 315088 - DNA, 25 bp, Mus musculus
tggcgatctcctgacagacgctcct

SEQ ID NO: 315089 - DNA, 25 bp, Mus musculus
tccagcccacggaaacgtcaggggc

SEQ ID NO: 315090 - DNA, 25 bp, Mus musculus
gcggagtttcgagttttccagccca

SEQ ID NO: 315091 - DNA, 25 bp, Mus musculus
cccacggaaacgtcaggggcgcgca

SEQ ID NO: 315092 - DNA, 25 bp, Mus musculus
aggaccctgcgcgtcagtggtcaag

SEQ ID NO: 315093 - DNA, 25 bp, Mus musculus
cgcgtcagtggtcaagggacacagt

SEQ ID NO: 315094 - DNA, 25 bp, Mus musculus
tcaagggacacagtgggtttcgcga

SEQ ID NO: 315095 - DNA, 25 bp, Mus musculus
acacagtgggtttcgcgaggtgcat

SEQ ID NO: 315096 - DNA, 25 bp, Mus musculus
cgaggtgcatgggacattccagcta

SEQ ID NO: 315097 - DNA, 25 bp, Mus musculus
attggccgcagtgcgcccggtaccg

SEQ ID NO: 315098 - DNA, 25 bp, Mus musculus
gggtcgcccgtgacaccagacaaca

SEQ ID NO: 315099 - DNA, 25 bp, Mus musculus
acaacagctgcggttctgtgcgcgc

SEQ ID NO: 315100 - DNA, 25 bp, Mus musculus
atccgccagcggtgaggcctctctg

SEQ ID NO: 315101 - DNA, 25 bp, Mus musculus
gaggcctctctggttccgtcgtgcc

SEQ ID NO: 315102 - DNA, 25 bp, Mus musculus
cggccctgtccgaccgggcgaagat

SEQ ID NO: 315103 - DNA, 25 bp, Mus musculus
acagagtcggcacaacacgtgtttc

SEQ ID NO: 315104 - DNA, 25 bp, Mus musculus
gacctccaaggtacaggctccggtg

SEQ ID NO: 315105 - DNA, 25 bp, Mus musculus
agcatcgccgagaccaaagctttcc

SEQ ID NO: 315106 - DNA, 25 bp, Mus musculus
gggctcctggatagacccactctct

SEQ ID NO: 315107 - DNA, 25 bp, Mus musculus
ctcctatgggctccgggacggacta

SEQ ID NO: 315108 - DNA, 25 bp, Mus musculus
tgggctccgagacggccacgctttc

SEQ ID NO: 315109 - DNA, 25 bp, Mus musculus
ccagcctcccggagggacaggcttt

SEQ ID NO: 315110 - DNA, 25 bp, Mus musculus
cccatacggaataaaaagcgcaatc

SEQ ID NO: 315111 - DNA, 25 bp, Mus musculus
tgaagagtcggagcatcgccgagac

SEQ ID NO: 315112 - DNA, 25 bp, Mus musculus
aaaaagcgcaatcccaccgcaagcg

SEQ ID NO: 315113 - DNA, 25 bp, Mus musculus
caaggtacaggctccggtggaacca

SEQ ID NO: 315114 - DNA, 25 bp, Mus musculus
aaccagtgcctagcagggacagagt

SEQ ID NO: 315115 - DNA, 25 bp, Mus musculus
aacacgtgtttctgtcacgggaggg

SEQ ID NO: 315116 - DNA, 25 bp, Mus musculus
ctccggtggaaccagtgcctagcag

SEQ ID NO: 315117 - DNA, 25 bp, Mus musculus
tcggtactcggtgagtctcgggctt

SEQ ID NO: 315118 - DNA, 25 bp, Mus musculus
caggggaatgcagcgcgttcattat

SEQ ID NO: 315119 - DNA, 25 bp, Mus musculus
tgccaaaacagctgtctgaagcatg

SEQ ID NO: 315120 - DNA, 25 bp, Mus musculus
gctgctggaaggtggtcacttagcc

SEQ ID NO: 315121 - DNA, 25 bp, Mus musculus
cgttcattatggagcctttgtgtgc

SEQ ID NO: 315122 - DNA, 25 bp, Mus musculus
ttcctggggccatgttcacaagcgg

SEQ ID NO: 315123 - DNA, 25 bp, Mus musculus
ggccatgttcacaagcggacacaga

SEQ ID NO: 315124 - DNA, 25 bp, Mus musculus
cactcctggagcgagagagtgacga

SEQ ID NO: 315125 - DNA, 25 bp, Mus musculus
aagcggacacagacgcacactctca

SEQ ID NO: 315126 - DNA, 25 bp, Mus musculus
tgggcactcggtactcggtgagtct

SEQ ID NO: 315127 - DNA, 25 bp, Mus musculus
aggaaggtaagaagcgcgctgcttc

SEQ ID NO: 315128 - DNA, 25 bp, Mus musculus
tcggcgcaatccgtcacctcgcagc

SEQ ID NO: 315129 - DNA, 25 bp, Mus musculus
tctgaagcatgtgcgtggttcctgg

SEQ ID NO: 315130 - DNA, 25 bp, Mus musculus
tgaagagcccaacgcaggggaatgc

SEQ ID NO: 315131 - DNA, 25 bp, Mus musculus
tcctgccacatgaaaagaagcatta

SEQ ID NO: 315132 - DNA, 25 bp, Mus musculus
tggtcatatccgatcctgccacatg

SEQ ID NO: 315133 - DNA, 25 bp, Mus musculus
acgtttgccacgaagccgctattca

SEQ ID NO: 315134 - DNA, 25 bp, Mus musculus
gctggaaaatcaacaggggctgctt

SEQ ID NO: 315135 - DNA, 25 bp, Mus musculus
ggggctgctttcctaacatcctggg

SEQ ID NO: 315136 - DNA, 25 bp, Mus musculus
catcctgggagatgctattatcctc

SEQ ID NO: 315137 - DNA, 25 bp, Mus musculus
tgctattatcctcccggcagcgcag

SEQ ID NO: 315138 - DNA, 25 bp, Mus musculus
agaagcattacaccggcctctcggg

SEQ ID NO: 315139 - DNA, 25 bp, Mus musculus
cgcagctcacagaacgcagcgaggc

SEQ ID NO: 315140 - DNA, 25 bp, Mus musculus
cagcgaggccggcttaacccgaatt

SEQ ID NO: 315141 - DNA, 25 bp, Mus musculus
accactcgtaatatctgacagaacc

SEQ ID NO: 315142 - DNA, 25 bp, Mus musculus
agctgggctgcctcggtaataacca

SEQ ID NO: 315143 - DNA, 25 bp, Mus musculus
gctgcggcacaaatcagaaacgttt

SEQ ID NO: 315144 - DNA, 25 bp, Mus musculus
tgacagaacccacgctggtcatatc

SEQ ID NO: 315145 - DNA, 25 bp, Mus musculus
tcagactgcctgctgacttccgttc

SEQ ID NO: 315146 - DNA, 25 bp, Mus musculus
caggagacctggtaaggacgcaatt

SEQ ID NO: 315147 - DNA, 25 bp, Mus musculus
cttgcctcgcgggttgttccgttat

SEQ ID NO: 315148 - DNA, 25 bp, Mus musculus
ttacctcccgagagggtcgcgttca

SEQ ID NO: 315149 - DNA, 25 bp, Mus musculus
gtaatggcctcctggaatgtctgga

SEQ ID NO: 315150 - DNA, 25 bp, Mus musculus
gccagtagattggattcggttcact

SEQ ID NO: 315151 - DNA, 25 bp, Mus musculus
accttgagtgtacctgacctgccca

SEQ ID NO: 315152 - DNA, 25 bp, Mus musculus
cgcggtactgttggtgttcagactg

SEQ ID NO: 315153 - DNA, 25 bp, Mus musculus
gaaaatcgctgaccgcctgggcctt

SEQ ID NO: 315154 - DNA, 25 bp, Mus musculus
acttccgttcccgtgttggcagcgg

SEQ ID NO: 315155 - DNA, 25 bp, Mus musculus
ccactgagcacgttgaggtagttac

SEQ ID NO: 315156 - DNA, 25 bp, Mus musculus
aggtagttacccaagatgccgaata

SEQ ID NO: 315157 - DNA, 25 bp, Mus musculus
tatcaaaatcttcagcgggagctcc

SEQ ID NO: 315158 - DNA, 25 bp, Mus musculus
gcgggagctcccaccaggacttatc

SEQ ID NO: 315159 - DNA, 25 bp, Mus musculus
ctgaatggccgggacgtccagcagc

SEQ ID NO: 315160 - DNA, 25 bp, Mus musculus
acccaagtgtcgaggcctcggcggt

SEQ ID NO: 315161 - DNA, 25 bp, Mus musculus
ggaagcgccaagagacccaagtgtc

SEQ ID NO: 315162 - DNA, 25 bp, Mus musculus
gcggccctgtcgagagccaccgagt

SEQ ID NO: 315163 - DNA, 25 bp, Mus musculus
tcccgagtgggccaaaggtcgccgc

SEQ ID NO: 315164 - DNA, 25 bp, Mus musculus
ccaccgcgcctgagactcacgcagc

SEQ ID NO: 315165 - DNA, 25 bp, Mus musculus
gccggccggcggcagttatctgtcc

SEQ ID NO: 315166 - DNA, 25 bp, Mus musculus
gcgctcaccgcctgaatggccggga

SEQ ID NO: 315167 - DNA, 25 bp, Mus musculus
gtgctcctgaggagcccgcctcaag

SEQ ID NO: 315168 - DNA, 25 bp, Mus musculus
gccgctcactcgcacgcccgtgctc

SEQ ID NO: 315169 - DNA, 25 bp, Mus musculus
gccgtgacagcatgtaaatgagccc

SEQ ID NO: 315170 - DNA, 25 bp, Mus musculus
agcgtgtgagctagccgcgagctca

SEQ ID NO: 315171 - DNA, 25 bp, Mus musculus
tagccgcgagctcaggagtccgcgc

SEQ ID NO: 315172 - DNA, 25 bp, Mus musculus
gcggcagttatctgtccgcccgtct

SEQ ID NO: 315173 - DNA, 25 bp, Mus musculus
agcctaggaaggtggcccagcgccc

SEQ ID NO: 315174 - DNA, 25 bp, Mus musculus
ctctcgtggcgcctaggcgcaagtc

SEQ ID NO: 315175 - DNA, 25 bp, Mus musculus
agaaagcagtggagcggctcagctc

SEQ ID NO: 315176 - DNA, 25 bp, Mus musculus
ttgcactcctagatcccaggctggg

SEQ ID NO: 315177 - DNA, 25 bp, Mus musculus
ccctcctgggaaggagtttgcactc

SEQ ID NO: 315178 - DNA, 25 bp, Mus musculus
acactgttgtgacccgagctcctgc

SEQ ID NO: 315179 - DNA, 25 bp, Mus musculus
cccggttgtctgtcacactgttgtg

SEQ ID NO: 315180 - DNA, 25 bp, Mus musculus
gaactggccgaggacacttgggctt

SEQ ID NO: 315181 - DNA, 25 bp, Mus musculus
cctagacgcgggaacgtcgcggtct

SEQ ID NO: 315182 - DNA, 25 bp, Mus musculus
tctggaccgagaggcgaaaactctt

SEQ ID NO: 315183 - DNA, 25 bp, Mus musculus
tgtcatggtgctgcctctggaccga

SEQ ID NO: 315184 - DNA, 25 bp, Mus musculus
tttccctctgctgcggcggaaatga

SEQ ID NO: 315185 - DNA, 25 bp, Mus musculus
ctccaccctcctttcgaagggattg

SEQ ID NO: 315186 - DNA, 25 bp, Mus musculus
ccgtgctcccgtagggtgtcagcct

SEQ ID NO: 315187 - DNA, 25 bp, Mus musculus
tcgaccaggagagagagaaacgtcc

SEQ ID NO: 315188 - DNA, 25 bp, Mus musculus
ctgggcacccgcaacaggttggaac

SEQ ID NO: 315189 - DNA, 25 bp, Mus musculus
cggaagcctgcaaagacgtcgccta

SEQ ID NO: 315190 - DNA, 25 bp, Mus musculus
gcctgcggcaaggtcctggaattct

SEQ ID NO: 315191 - DNA, 25 bp, Mus musculus
taaagcccggctcactgccaagaga

SEQ ID NO: 315192 - DNA, 25 bp, Mus musculus
tggagcagcaatcaccgcagaagcg

SEQ ID NO: 315193 - DNA, 25 bp, Mus musculus
cgggaaagtctctgtccaagctgtc

SEQ ID NO: 315194 - DNA, 25 bp, Mus musculus
ccaagctgtcagtcgggaaagccga

SEQ ID NO: 315195 - DNA, 25 bp, Mus musculus
tcatcgtcgtcgtcctcagaatccg

SEQ ID NO: 315196 - DNA, 25 bp, Mus musculus
cgcggctcgagtgctggcaaataaa

SEQ ID NO: 315197 - DNA, 25 bp, Mus musculus
aatccgctctctcttggggtctcag

SEQ ID NO: 315198 - DNA, 25 bp, Mus musculus
tgtggttaagggctccaggattcca

SEQ ID NO: 315199 - DNA, 25 bp, Mus musculus
cagcctagctacaggtggcggttca

SEQ ID NO: 315200 - DNA, 25 bp, Mus musculus
ctggaattctcttacagcctgggca

SEQ ID NO: 315201 - DNA, 25 bp, Mus musculus
ggtagccgcgtttgcagacttcatc

SEQ ID NO: 315202 - DNA, 25 bp, Mus musculus
tgggcaaaacaacacgtgaccgtcg

SEQ ID NO: 315203 - DNA, 25 bp, Mus musculus
gtaccagctttcttgttccgactcg

SEQ ID NO: 315204 - DNA, 25 bp, Mus musculus
catcgcgaagtattcgtcctgggta

SEQ ID NO: 315205 - DNA, 25 bp, Mus musculus
cattggtacaggatgatcacgcgcc

SEQ ID NO: 315206 - DNA, 25 bp, Mus musculus
gccggaacttcctggcatttcggta

SEQ ID NO: 315207 - DNA, 25 bp, Mus musculus
cgtctgcggtctcgagtttgagcac

SEQ ID NO: 315208 - DNA, 25 bp, Mus musculus
tttgagcacgaagtaacgcctatgc

SEQ ID NO: 315209 - DNA, 25 bp, Mus musculus
tatgcccatgcttctgcttcctcag

SEQ ID NO: 315210 - DNA, 25 bp, Mus musculus
ggaggtcctcctcttcggattccga

SEQ ID NO: 315211 - DNA, 25 bp, Mus musculus
ctcctaagcgcttggtggccagaga

SEQ ID NO: 315212 - DNA, 25 bp, Mus musculus
agcaactcgccatggtgatgcaccg

SEQ ID NO: 315213 - DNA, 25 bp, Mus musculus
aggacgacccggtcccaatgagtgc

SEQ ID NO: 315214 - DNA, 25 bp, Mus musculus
ctgggctcaaggcagtgggcaaaac

SEQ ID NO: 315215 - DNA, 25 bp, Mus musculus
agcgtcgttacccttggcgctggtc

SEQ ID NO: 315216 - DNA, 25 bp, Mus musculus
acagcggatctagaccctctcagcg

SEQ ID NO: 315217 - DNA, 25 bp, Mus musculus
cattctccgggtcggcagatgcgat

SEQ ID NO: 315218 - DNA, 25 bp, Mus musculus
ggggacccattcctgctcagcaaca

SEQ ID NO: 315219 - DNA, 25 bp, Mus musculus
caacacaggccaggggtggctcatc

SEQ ID NO: 315220 - DNA, 25 bp, Mus musculus
catccttggcctcgacgagcttgcg

SEQ ID NO: 315221 - DNA, 25 bp, Mus musculus
ccaggatgaggcctccggctaggca

SEQ ID NO: 315222 - DNA, 25 bp, Mus musculus
taggatgtagagataagcgtcgtta

SEQ ID NO: 315223 - DNA, 25 bp, Mus musculus
ccaggcccagggataagcaaaatga

SEQ ID NO: 315224 - DNA, 25 bp, Mus musculus
gctctggaacggcagtaaaagcgcg

SEQ ID NO: 315225 - DNA, 25 bp, Mus musculus
gcctcgcggcccacgaaagggtcag

SEQ ID NO: 315226 - DNA, 25 bp, Mus musculus
tccggctaggcaggcatagaagatc

SEQ ID NO: 315227 - DNA, 25 bp, Mus musculus
atgctcgggccggttccgatgccca

SEQ ID NO: 315228 - DNA, 25 bp, Mus musculus
agcaaaatgaggaggacagcggatc

SEQ ID NO: 315229 - DNA, 25 bp, Mus musculus
gcccacgagggcttagcgcccagta

SEQ ID NO: 315230 - DNA, 25 bp, Mus musculus
cctccagccggctcaggtgaggatc

SEQ ID NO: 315231 - DNA, 25 bp, Mus musculus
gcaggtcgcctaaagcctcccttga

SEQ ID NO: 315232 - DNA, 25 bp, Mus musculus
tcgctcgctacgagtctgccactgg

SEQ ID NO: 315233 - DNA, 25 bp, Mus musculus
ctgccactgggtcccggccttaaga

SEQ ID NO: 315234 - DNA, 25 bp, Mus musculus
cggccttaagaggaaggaagctcct

SEQ ID NO: 315235 - DNA, 25 bp, Mus musculus
cgcccagtagtctagagccgcagaa

SEQ ID NO: 315236 - DNA, 25 bp, Mus musculus
gcgcgagcccggaaaagacgagccc

SEQ ID NO: 315237 - DNA, 25 bp, Mus musculus
cgcagtgctgggcaaaatagcccac

SEQ ID NO: 315238 - DNA, 25 bp, Mus musculus
gctcactaaggacgtcaccgccaaa

SEQ ID NO: 315239 - DNA, 25 bp, Mus musculus
cgatcgggcttgcagctgctgcaaa

SEQ ID NO: 315240 - DNA, 25 bp, Mus musculus
ccagcctaggatcactcaccgaagg

SEQ ID NO: 315241 - DNA, 25 bp, Mus musculus
gagccgcggagaccagtggaaaaaa

SEQ ID NO: 315242 - DNA, 25 bp, Mus musculus
gcacgtcaggaataggggactctcc

SEQ ID NO: 315243 - DNA, 25 bp, Mus musculus
gcggcatcccgggacgccgcttccc

SEQ ID NO: 315244 - DNA, 25 bp, Mus musculus
ctcctccgccagctgagcccgcggc

SEQ ID NO: 315245 - DNA, 25 bp, Mus musculus
gcggctcggtcgacgcctcctccgc

SEQ ID NO: 315246 - DNA, 25 bp, Mus musculus
cttagcggttcctccctgggcggcg

SEQ ID NO: 315247 - DNA, 25 bp, Mus musculus
ggcggctccagccttagcggttcct

SEQ ID NO: 315248 - DNA, 25 bp, Mus musculus
tccgtctctgcccgaggctgtggcg

SEQ ID NO: 315249 - DNA, 25 bp, Mus musculus
cggtccgtctctgcccgaggctgtg

SEQ ID NO: 315250 - DNA, 25 bp, Mus musculus
tgcgcactgcttatttcccgctgtc

SEQ ID NO: 315251 - DNA, 25 bp, Mus musculus
gcactgcttatttcccgctgtcagg

SEQ ID NO: 315252 - DNA, 25 bp, Mus musculus
agcctgacggtgaggcgcccaccat

SEQ ID NO: 315253 - DNA, 25 bp, Mus musculus
gcgcactgcttatttcccgctgtca

SEQ ID NO: 315254 - DNA, 25 bp, Mus musculus
ctgcgcactgcttatttcccgctgt

SEQ ID NO: 315255 - DNA, 25 bp, Mus musculus
cgtcacgtgccgtcccatccccccg

SEQ ID NO: 315256 - DNA, 25 bp, Mus musculus
atgaggaggcggaggtcggcgctcc

SEQ ID NO: 315257 - DNA, 25 bp, Mus musculus
actgctctaaattggctggagaggg

SEQ ID NO: 315258 - DNA, 25 bp, Mus musculus
ccacgcggttgcaggagtaagaccc

SEQ ID NO: 315259 - DNA, 25 bp, Mus musculus
ccgggactgctctaaattggctgga

SEQ ID NO: 315260 - DNA, 25 bp, Mus musculus
ggagcccagccgagtgccgcctggg

SEQ ID NO: 315261 - DNA, 25 bp, Mus musculus
gaggagtccggcgtccctgccctcc

SEQ ID NO: 315262 - DNA, 25 bp, Mus musculus
ccctctcgtggagtggctgagacga

SEQ ID NO: 315263 - DNA, 25 bp, Mus musculus
cccgtcggcggcgaagttgctagct

SEQ ID NO: 315264 - DNA, 25 bp, Mus musculus
gggactgctctaaattggctggaga

SEQ ID NO: 315265 - DNA, 25 bp, Mus musculus
gaccgggactgctctaaattggctg

SEQ ID NO: 315266 - DNA, 25 bp, Mus musculus
tggaccgggactgctctaaattggc

SEQ ID NO: 315267 - DNA, 25 bp, Mus musculus
ctggaccgggactgctctaaattgg

SEQ ID NO: 315268 - DNA, 25 bp, Mus musculus
aggctggaccgggactgctctaaat

SEQ ID NO: 315269 - DNA, 25 bp, Mus musculus
gagacggagagttcggtggagcccg

SEQ ID NO: 315270 - DNA, 25 bp, Mus musculus
ctgagacgaggagtccggcgtccct

SEQ ID NO: 315271 - DNA, 25 bp, Mus musculus
ctcctggaagttagcgcaaagagga

SEQ ID NO: 315272 - DNA, 25 bp, Mus musculus
tagaaagtagggttcccactccgca

SEQ ID NO: 315273 - DNA, 25 bp, Mus musculus
cgcagcgcttccgacccataagtga

SEQ ID NO: 315274 - DNA, 25 bp, Mus musculus
gggcgaactggacagtttctgcttc

SEQ ID NO: 315275 - DNA, 25 bp, Mus musculus
tccgacccataagtgaggcgagctg

SEQ ID NO: 315276 - DNA, 25 bp, Mus musculus
ccactccgcagctcagaggtggaga

SEQ ID NO: 315277 - DNA, 25 bp, Mus musculus
cagaagcagcacatctccgctgaca

SEQ ID NO: 315278 - DNA, 25 bp, Mus musculus
tagagcacatcgaagcagaagcagc

SEQ ID NO: 315279 - DNA, 25 bp, Mus musculus
cgtacaggtgacagtagagcacatc

SEQ ID NO: 315280 - DNA, 25 bp, Mus musculus
ggctgctggtatccgtacaggtgac

SEQ ID NO: 315281 - DNA, 25 bp, Mus musculus
actcactagggctcgttggtgaagc

SEQ ID NO: 315282 - DNA, 25 bp, Mus musculus
ttacactttgcctcaactctgagcc

SEQ ID NO: 315283 - DNA, 25 bp, Mus musculus
agcgcggtactcactagggctcgtt

SEQ ID NO: 315284 - DNA, 25 bp, Mus musculus
ggaggcggaggacttacactttgcc

SEQ ID NO: 315285 - DNA, 25 bp, Mus musculus
cacgactgtcatgtgtcccttggca

SEQ ID NO: 315286 - DNA, 25 bp, Mus musculus
cggttctgccctgcagggtctgtgt

SEQ ID NO: 315287 - DNA, 25 bp, Mus musculus
gggcctcgactacttccacgtctgg

SEQ ID NO: 315288 - DNA, 25 bp, Mus musculus
ttaagctctgctcgccttcccgagg

SEQ ID NO: 315289 - DNA, 25 bp, Mus musculus
ccctctcaggccagtcaggggtttt

SEQ ID NO: 315290 - DNA, 25 bp, Mus musculus
cccatttcctctaggatggcaaacg

SEQ ID NO: 315291 - DNA, 25 bp, Mus musculus
tggcaaacggttttccctcactgtg

SEQ ID NO: 315292 - DNA, 25 bp, Mus musculus
ctcgtggtggtattggttttccctg

SEQ ID NO: 315293 - DNA, 25 bp, Mus musculus
tccatcctcgggctggtaatggttg

SEQ ID NO: 315294 - DNA, 25 bp, Mus musculus
tggttggttgccctttagtgcttca

SEQ ID NO: 315295 - DNA, 25 bp, Mus musculus
tttagtgcttcaggcccacgtctcc

SEQ ID NO: 315296 - DNA, 25 bp, Mus musculus
tgcctagcgccaccttggctcgaga

SEQ ID NO: 315297 - DNA, 25 bp, Mus musculus
ggtgctggccgctttaagctctgct

SEQ ID NO: 315298 - DNA, 25 bp, Mus musculus
tattggttttccctgcagcacctcg

SEQ ID NO: 315299 - DNA, 25 bp, Mus musculus
tcatttccatttggagcgcgacgcc

SEQ ID NO: 315300 - DNA, 25 bp, Mus musculus
gcccgctcgctggattcatttccat

SEQ ID NO: 315301 - DNA, 25 bp, Mus musculus
ccaaggactcaacgctccaggcgga

SEQ ID NO: 315302 - DNA, 25 bp, Mus musculus
ggcagcgaacccagcttctccttaa

SEQ ID NO: 315303 - DNA, 25 bp, Mus musculus
ggccggccaggcctcctctaatgag

SEQ ID NO: 315304 - DNA, 25 bp, Mus musculus
tggcctccgaggttctccaattacc

SEQ ID NO: 315305 - DNA, 25 bp, Mus musculus
tcagaatcagctacgcttggcgggc

SEQ ID NO: 315306 - DNA, 25 bp, Mus musculus
ttaatgacactggatcagaatcagc

SEQ ID NO: 315307 - DNA, 25 bp, Mus musculus
ttaatgctgatgaaacccacgcggg

SEQ ID NO: 315308 - DNA, 25 bp, Mus musculus
tcttccctgaggacacggtcactgg

SEQ ID NO: 315309 - DNA, 25 bp, Mus musculus
cttcatcgcgctgcttggggaactc

SEQ ID NO: 315310 - DNA, 25 bp, Mus musculus
ccggagaagtgccaaggactcaacg

SEQ ID NO: 315311 - DNA, 25 bp, Mus musculus
cctcctctaatgagcgggcggagcc

SEQ ID NO: 315312 - DNA, 25 bp, Mus musculus
cacgcgggtttcgaaattaatgaca

SEQ ID NO: 315313 - DNA, 25 bp, Mus musculus
tgcccgctctgtagctcagtggcca

SEQ ID NO: 315314 - DNA, 25 bp, Mus musculus
gaaagaagccgcaagccgcagccgc

SEQ ID NO: 315315 - DNA, 25 bp, Mus musculus
cccctcccctgggtggtggcagaga

SEQ ID NO: 315316 - DNA, 25 bp, Mus musculus
catctctcccccctcggtacggaat

SEQ ID NO: 315317 - DNA, 25 bp, Mus musculus
tagcgagtacaggagcgcctctggc

SEQ ID NO: 315318 - DNA, 25 bp, Mus musculus
ccgctgccccgtcccaccgtctcat

SEQ ID NO: 315319 - DNA, 25 bp, Mus musculus
ggaaagaagccgcaagccgcagccg

SEQ ID NO: 315320 - DNA, 25 bp, Mus musculus
gctcagtggccaggggtggaaagaa

SEQ ID NO: 315321 - DNA, 25 bp, Mus musculus
ccgctctgtagctcagtggccaggg

SEQ ID NO: 315322 - DNA, 25 bp, Mus musculus
agtacaggagcgcctctggcgcccg

SEQ ID NO: 315323 - DNA, 25 bp, Mus musculus
gcccgctctgtagctcagtggccag

SEQ ID NO: 315324 - DNA, 25 bp, Mus musculus
tcctgcccgctctgtagctcagtgg

SEQ ID NO: 315325 - DNA, 25 bp, Mus musculus
caatcaggaggacggggcagcctgc

SEQ ID NO: 315326 - DNA, 25 bp, Mus musculus
cccgctctgtagctcagtggccagg

SEQ ID NO: 315327 - DNA, 25 bp, Mus musculus
gggagcgactcagagcgctcaaatc

SEQ ID NO: 315328 - DNA, 25 bp, Mus musculus
caggttgcccacaggaggtcgactt

SEQ ID NO: 315329 - DNA, 25 bp, Mus musculus
tagtgtagttagttaggggccttca

SEQ ID NO: 315330 - DNA, 25 bp, Mus musculus
tccgtcttctgagaagcgaggttgc

SEQ ID NO: 315331 - DNA, 25 bp, Mus musculus
acaggtcccggatggttgcagcctg

SEQ ID NO: 315332 - DNA, 25 bp, Mus musculus
tggtggtcttcgtccgcttagaata

SEQ ID NO: 315333 - DNA, 25 bp, Mus musculus
gctggaggtgtcagttactatgcta

SEQ ID NO: 315334 - DNA, 25 bp, Mus musculus
tagggtagtaaaacaattccagcca

SEQ ID NO: 315335 - DNA, 25 bp, Mus musculus
tccatccttctttccgtcttctgag

SEQ ID NO: 315336 - DNA, 25 bp, Mus musculus
tcagagcagcgcactgactgccgcg

SEQ ID NO: 315337 - DNA, 25 bp, Mus musculus
ccgagtccgtttctcgtctagctgc

SEQ ID NO: 315338 - DNA, 25 bp, Mus musculus
tcttcctcccggacgctagtggtaa

SEQ ID NO: 315339 - DNA, 25 bp, Mus musculus
tgctagctgagaccttaatgatttg

SEQ ID NO: 315340 - DNA, 25 bp, Mus musculus
tgcacatcgattgtcgtcggcgtcg

SEQ ID NO: 315341 - DNA, 25 bp, Mus musculus
gggccagcagactccaaggcagcca

SEQ ID NO: 315342 - DNA, 25 bp, Mus musculus
agaggacgctggaacgtgctcaacg

SEQ ID NO: 315343 - DNA, 25 bp, Mus musculus
gcccattggggaacggctgaccgaa

SEQ ID NO: 315344 - DNA, 25 bp, Mus musculus
tgtccgtcaggtcgtaaccgctgcc

SEQ ID NO: 315345 - DNA, 25 bp, Mus musculus
tttcctgccactgaggctcaggatg

SEQ ID NO: 315346 - DNA, 25 bp, Mus musculus
tgaggctcaggatgccagagttccc

SEQ ID NO: 315347 - DNA, 25 bp, Mus musculus
ggtccaggctcctcaccgtgtgctg

SEQ ID NO: 315348 - DNA, 25 bp, Mus musculus
tcaccgtgtgctgcggctgcaagct

SEQ ID NO: 315349 - DNA, 25 bp, Mus musculus
tcggtaccgggatgggcaccgccac

SEQ ID NO: 315350 - DNA, 25 bp, Mus musculus
ctgactcgccgccatgttcctggga

SEQ ID NO: 315351 - DNA, 25 bp, Mus musculus
cgccatgttcctgggagagagaata

SEQ ID NO: 315352 - DNA, 25 bp, Mus musculus
ttcttaggacgcatgcgcaggctga

SEQ ID NO: 315353 - DNA, 25 bp, Mus musculus
tgtcgcgcacacagaggacgctgga

SEQ ID NO: 315354 - DNA, 25 bp, Mus musculus
ccagtggctatgaggtgtcgcgcac

SEQ ID NO: 315355 - DNA, 25 bp, Mus musculus
gtcgtgcgccctggcctgtggccat

SEQ ID NO: 315356 - DNA, 25 bp, Mus musculus
gtgcgccctggcctgtggccattct

SEQ ID NO: 315357 - DNA, 25 bp, Mus musculus
ctggcctgtggccattctcggccag

SEQ ID NO: 315358 - DNA, 25 bp, Mus musculus
cctgtggccattctcggccagcagg

SEQ ID NO: 315359 - DNA, 25 bp, Mus musculus
ccagcagggatggacgggtccctcc

SEQ ID NO: 315360 - DNA, 25 bp, Mus musculus
agcagggatggacgggtccctccca

SEQ ID NO: 315361 - DNA, 25 bp, Mus musculus
agggatggacgggtccctcccagca

SEQ ID NO: 315362 - DNA, 25 bp, Mus musculus
ggatggacgggtccctcccagcacg

SEQ ID NO: 315363 - DNA, 25 bp, Mus musculus
cgggtccctcccagcacggctggac

SEQ ID NO: 315364 - DNA, 25 bp, Mus musculus
ctcccagcacggctggacccgggga

SEQ ID NO: 315365 - DNA, 25 bp, Mus musculus
tgcaaagggcttggtggaaagagac

SEQ ID NO: 315366 - DNA, 25 bp, Mus musculus
ctaatgagggtgctctccggggctt

SEQ ID NO: 315367 - DNA, 25 bp, Mus musculus
aatgagggtgctctccggggcttct

SEQ ID NO: 315368 - DNA, 25 bp, Mus musculus
ggctgagaccgagtaggcgctgctc

SEQ ID NO: 315369 - DNA, 25 bp, Mus musculus
ttatccgcgtgtgcctctacggcac

SEQ ID NO: 315370 - DNA, 25 bp, Mus musculus
ggttgattcctccagccggactatg

SEQ ID NO: 315371 - DNA, 25 bp, Mus musculus
ctgccagcacggccggacgggcacc

SEQ ID NO: 315372 - DNA, 25 bp, Mus musculus
agcggtaagatccgccgtgcgccgc

SEQ ID NO: 315373 - DNA, 25 bp, Mus musculus
gaggaatggggagcggtaagatccg

SEQ ID NO: 315374 - DNA, 25 bp, Mus musculus
gcccgcgcggcctgctgtcgcaccc

SEQ ID NO: 315375 - DNA, 25 bp, Mus musculus
tgcctctacggcaccgctacccgcg

SEQ ID NO: 315376 - DNA, 25 bp, Mus musculus
cttatccgcgtgtgcctctacggca

SEQ ID NO: 315377 - DNA, 25 bp, Mus musculus
gccttatccgcgtgtgcctctacgg

SEQ ID NO: 315378 - DNA, 25 bp, Mus musculus
atccgagcgccttatccgcgtgtgc

SEQ ID NO: 315379 - DNA, 25 bp, Mus musculus
tcatccgagcgccttatccgcgtgt

SEQ ID NO: 315380 - DNA, 25 bp, Mus musculus
gtgggagcagttccccgctggctcc

SEQ ID NO: 315381 - DNA, 25 bp, Mus musculus
gtcgcccgccgtgggagcagttccc

SEQ ID NO: 315382 - DNA, 25 bp, Mus musculus
ttgattcctccagccggactatgcg

SEQ ID NO: 315383 - DNA, 25 bp, Mus musculus
cgccaacgaaccaaaaggctgattg

SEQ ID NO: 315384 - DNA, 25 bp, Mus musculus
tgattgctttcacgatggaccggcg

SEQ ID NO: 315385 - DNA, 25 bp, Mus musculus
gagccgcaagaacacgacgtggtta

SEQ ID NO: 315386 - DNA, 25 bp, Mus musculus
acgtggttaggaagccagctctgcc

SEQ ID NO: 315387 - DNA, 25 bp, Mus musculus
cgccatcttgaactaacagctcagg

SEQ ID NO: 315388 - DNA, 25 bp, Mus musculus
aagcccgctgctgtgcgtagccaat

SEQ ID NO: 315389 - DNA, 25 bp, Mus musculus
ctggactctggtttcttacgccctc

SEQ ID NO: 315390 - DNA, 25 bp, Mus musculus
accggcgcacctgatactgggagag

SEQ ID NO: 315391 - DNA, 25 bp, Mus musculus
tggggcgttcccaaaagacgccagc

SEQ ID NO: 315392 - DNA, 25 bp, Mus musculus
tggggcctcgaaggcgaaccaccaa

SEQ ID NO: 315393 - DNA, 25 bp, Mus musculus
cgaaccaccaagaaggcgctgcctt

SEQ ID NO: 315394 - DNA, 25 bp, Mus musculus
ttctgcgtcccacagaaacagttcc

SEQ ID NO: 315395 - DNA, 25 bp, Mus musculus
ctccgaggccgaagaccaggtttct

SEQ ID NO: 315396 - DNA, 25 bp, Mus musculus
ccaggtttctcgtcggcaaatgcgg

SEQ ID NO: 315397 - DNA, 25 bp, Mus musculus
gtaagcggaatggagaaaaccgcca

SEQ ID NO: 315398 - DNA, 25 bp, Mus musculus
gattttcgcgttggcgcagtggtac

SEQ ID NO: 315399 - DNA, 25 bp, Mus musculus
cgaaaatcagccgaagtcccgcctt

SEQ ID NO: 315400 - DNA, 25 bp, Mus musculus
gagaaaaccgccaaaatcactcgta

SEQ ID NO: 315401 - DNA, 25 bp, Mus musculus
ctgcggtctaggattggctgatttt

SEQ ID NO: 315402 - DNA, 25 bp, Mus musculus
cgccaaaatcactcgtacttgccta

SEQ ID NO: 315403 - DNA, 25 bp, Mus musculus
attggctgattttcgcgttggcgca

SEQ ID NO: 315404 - DNA, 25 bp, Mus musculus
ttctcaccggaaggaagctgtaatc

SEQ ID NO: 315405 - DNA, 25 bp, Mus musculus
ccctagcgaaaatcagccgaagtcc

SEQ ID NO: 315406 - DNA, 25 bp, Mus musculus
gcccgaacgcccatcctcaccctag

SEQ ID NO: 315407 - DNA, 25 bp, Mus musculus
cgaatccgcgatgaaagcccgaacg

SEQ ID NO: 315408 - DNA, 25 bp, Mus musculus
acggcgatccgaatccgcgatgaaa

SEQ ID NO: 315409 - DNA, 25 bp, Mus musculus
cttgcctaagagagtacggcgatcc

SEQ ID NO: 315410 - DNA, 25 bp, Mus musculus
ggaagctgtaatctgcggtctagga

SEQ ID NO: 315411 - DNA, 25 bp, Mus musculus
attgctgcccggaagtgagctggct

SEQ ID NO: 315412 - DNA, 25 bp, Mus musculus
gtccaaaacgcgtcgcaaggccgtg

SEQ ID NO: 315413 - DNA, 25 bp, Mus musculus
ccttgcaggggactccggatcccat

SEQ ID NO: 315414 - DNA, 25 bp, Mus musculus
cggatcccattgatgttccagctta

SEQ ID NO: 315415 - DNA, 25 bp, Mus musculus
attgatgttccagcttaccacgcgc

SEQ ID NO: 315416 - DNA, 25 bp, Mus musculus
gcttaccacgcgcagcattttggta

SEQ ID NO: 315417 - DNA, 25 bp, Mus musculus
cagcattttggtaaacggtacagtt

SEQ ID NO: 315418 - DNA, 25 bp, Mus musculus
cagtttcccaaaggaagcttaggcg

SEQ ID NO: 315419 - DNA, 25 bp, Mus musculus
ggttcctggcatgcaaggccttgca

SEQ ID NO: 315420 - DNA, 25 bp, Mus musculus
caaatgcattgctgcccggaagtga

SEQ ID NO: 315421 - DNA, 25 bp, Mus musculus
cctccgacggcaggacgcaagcagg

SEQ ID NO: 315422 - DNA, 25 bp, Mus musculus
cgggacttcgagttcagttctctta

SEQ ID NO: 315423 - DNA, 25 bp, Mus musculus
gttcagttctcttaggcgggagacg

SEQ ID NO: 315424 - DNA, 25 bp, Mus musculus
cttaggcgggcaaatgcattgctgc

SEQ ID NO: 315425 - DNA, 25 bp, Mus musculus
ctttacgcagtgagaattgggtcca

SEQ ID NO: 315426 - DNA, 25 bp, Mus musculus
agtgagaattgggtccaggcacctc

SEQ ID NO: 315427 - DNA, 25 bp, Mus musculus
ttgggtccaggcacctctaaaccca

SEQ ID NO: 315428 - DNA, 25 bp, Mus musculus
ggcacctctaaacccaccacatcga

SEQ ID NO: 315429 - DNA, 25 bp, Mus musculus
acctcgccctcgtgagccgagagga

SEQ ID NO: 315430 - DNA, 25 bp, Mus musculus
catcgaaaccgctagatcccgaatc

SEQ ID NO: 315431 - DNA, 25 bp, Mus musculus
ctagatcccgaatccagccaggttc

SEQ ID NO: 315432 - DNA, 25 bp, Mus musculus
cgaatccagccaggttcctgtcaaa

SEQ ID NO: 315433 - DNA, 25 bp, Mus musculus
tcctgtcaaaccttaatgctgtgtg

SEQ ID NO: 315434 - DNA, 25 bp, Mus musculus
ccttaatgctgtgtgaagccagtca

SEQ ID NO: 315435 - DNA, 25 bp, Mus musculus
taatgctgtgtgaagccagtcaccc

SEQ ID NO: 315436 - DNA, 25 bp, Mus musculus
cccgcctttacgcagtgagaattgg

SEQ ID NO: 315437 - DNA, 25 bp, Mus musculus
tttcctaaagctggccacctcagct

SEQ ID NO: 315438 - DNA, 25 bp, Mus musculus
ggtctttcctaaagctggccacctc

SEQ ID NO: 315439 - DNA, 25 bp, Mus musculus
tagctatacataaagcgcatgcgca

SEQ ID NO: 315440 - DNA, 25 bp, Mus musculus
cataaagcgcatgcgcaatgtccac

SEQ ID NO: 315441 - DNA, 25 bp, Mus musculus
ccctttctagctatacataaagcgc

SEQ ID NO: 315442 - DNA, 25 bp, Mus musculus
cagtctctgcgagcccttctcaaca

SEQ ID NO: 315443 - DNA, 25 bp, Mus musculus
gaagtccaccgtgcacatgcgcatt

SEQ ID NO: 315444 - DNA, 25 bp, Mus musculus
tctttgaagtccaccgtgcacatgc

SEQ ID NO: 315445 - DNA, 25 bp, Mus musculus
cgttctttgaagtccaccgtgcaca

SEQ ID NO: 315446 - DNA, 25 bp, Mus musculus
cccgttctttgaagtccaccgtgca

SEQ ID NO: 315447 - DNA, 25 bp, Mus musculus
cgcctgctttcccagtacaaacccg

SEQ ID NO: 315448 - DNA, 25 bp, Mus musculus
atgcgcgtcttctgcagcgcccttt

SEQ ID NO: 315449 - DNA, 25 bp, Mus musculus
tagagtgcgcatgcgcgtcttctgc

SEQ ID NO: 315450 - DNA, 25 bp, Mus musculus
gcttagagtgcgcatgcgcgtcttc

SEQ ID NO: 315451 - DNA, 25 bp, Mus musculus
ccgcaggcttagagtgcgcatgcgc

SEQ ID NO: 315452 - DNA, 25 bp, Mus musculus
cccagccgcaggcttagagtgcgca

SEQ ID NO: 315453 - DNA, 25 bp, Mus musculus
aatagttgtcattagggccgcggaa

SEQ ID NO: 315454 - DNA, 25 bp, Mus musculus
cctcgatcgatacggcttgctaaca

SEQ ID NO: 315455 - DNA, 25 bp, Mus musculus
agcgcctcgcgcctgtaaatagaaa

SEQ ID NO: 315456 - DNA, 25 bp, Mus musculus
cgctgctggctgctgagtaatgatt

SEQ ID NO: 315457 - DNA, 25 bp, Mus musculus
ggccctaatggatggagccgctctc

SEQ ID NO: 315458 - DNA, 25 bp, Mus musculus
cggggaggcagttctaatagttgtc

SEQ ID NO: 315459 - DNA, 25 bp, Mus musculus
atgaatctggcgcttttgtgctcgc

SEQ ID NO: 315460 - DNA, 25 bp, Mus musculus
ggctctgatagttgtggcaccgaga

SEQ ID NO: 315461 - DNA, 25 bp, Mus musculus
acagctctgcgttgtctgccgatcg

SEQ ID NO: 315462 - DNA, 25 bp, Mus musculus
acagcaaatcttgtcccggacgccg

SEQ ID NO: 315463 - DNA, 25 bp, Mus musculus
aggggttctccgacttctggacaca

SEQ ID NO: 315464 - DNA, 25 bp, Mus musculus
atttattatgcgtccggacctcgga

SEQ ID NO: 315465 - DNA, 25 bp, Mus musculus
cgcagcgctagggtgtaaattaact

SEQ ID NO: 315466 - DNA, 25 bp, Mus musculus
tttctaattggaggcgaacagcggc

SEQ ID NO: 315467 - DNA, 25 bp, Mus musculus
cgatataattgctgcgccgcacagt

SEQ ID NO: 315468 - DNA, 25 bp, Mus musculus
ggcggagtttcgatataattgctgc

SEQ ID NO: 315469 - DNA, 25 bp, Mus musculus
cgcaagggcggagtttcgatataat

SEQ ID NO: 315470 - DNA, 25 bp, Mus musculus
ctaatttgcgtaagacgcaagggcg

SEQ ID NO: 315471 - DNA, 25 bp, Mus musculus
ctccgcctaatttgcgtaagacgca

SEQ ID NO: 315472 - DNA, 25 bp, Mus musculus
tctttgctccgcctaatttgcgtaa

SEQ ID NO: 315473 - DNA, 25 bp, Mus musculus
ccagacttccggatcccagcccagc

SEQ ID NO: 315474 - DNA, 25 bp, Mus musculus
agtgcgcagctaggctccgcccaga

SEQ ID NO: 315475 - DNA, 25 bp, Mus musculus
aacgtcgccagtccaggagtgcgca
